United States Patent 10,706,955 (BIOINFORMATIC PROCESSES FOR DETERMINATION OF PEPTIDE BINDING) - sequence listing, part 60

SEQ ID NO: 2288963 - protein, 22 aa, Cryptosporidium parvum
ALKLADFGLARAFGIPVRSYTH

SEQ ID NO: 2288964 - protein, 24 aa, Cryptosporidium parvum
ALKQSLICRLGYIPLLKLNPPVSL

SEQ ID NO: 2288965 - protein, 17 aa, Cryptosporidium parvum
ALKRVTVDYSRFEEALR

SEQ ID NO: 2288966 - protein, 20 aa, Cryptosporidium parvum
ALLATRFNKEVPNFQSNNNN

SEQ ID NO: 2288967 - protein, 17 aa, Cryptosporidium parvum
ALLCDLKALLIEAKQEI

SEQ ID NO: 2288968 - protein, 25 aa, Cryptosporidium parvum
ALLELLFKSTIPISGLYNSKPKNIY

SEQ ID NO: 2288969 - protein, 18 aa, Cryptosporidium parvum
ALLKRRRNTFETKFNLNQ

SEQ ID NO: 2288970 - protein, 19 aa, Cryptosporidium parvum
ALLQLYFTNLFQGNHGFMP

SEQ ID NO: 2288971 - protein, 28 aa, Cryptosporidium parvum
ALLYDIFQKLKIYIRVCQSDIKCSNKSL

SEQ ID NO: 2288972 - protein, 21 aa, Cryptosporidium parvum
ALLYNCPRAASVVAKTDCLLW

SEQ ID NO: 2288973 - protein, 24 aa, Cryptosporidium parvum
ALNISKALVERAVQQRIYLLEPKL

SEQ ID NO: 2288974 - protein, 18 aa, Cryptosporidium parvum
ALNNRWFGGNQVFCSLYN

SEQ ID NO: 2288975 - protein, 18 aa, Cryptosporidium parvum
ALNPKTGILNNIIVNGPG

SEQ ID NO: 2288976 - protein, 21 aa, Cryptosporidium parvum
ALNSESDFQVSILHTDDNGNI

SEQ ID NO: 2288977 - protein, 20 aa, Cryptosporidium parvum
ALNYMFKVNSIVIYPYVLSL

SEQ ID NO: 2288978 - protein, 22 aa, Cryptosporidium parvum
ALPKICCILFLVNPGVCSDMIS

SEQ ID NO: 2288979 - protein, 25 aa, Cryptosporidium parvum
ALPNVGYCQGMNYLVGIFLYALDFN

SEQ ID NO: 2288980 - protein, 19 aa, Cryptosporidium parvum
ALQLACRMCLVIPEHDLQS

SEQ ID NO: 2288981 - protein, 20 aa, Cryptosporidium parvum
ALQRFCSFILPMLDEKGTHT

SEQ ID NO: 2288982 - protein, 18 aa, Cryptosporidium parvum
ALRFYKRALLMDSRSSQT

SEQ ID NO: 2288983 - protein, 23 aa, Cryptosporidium parvum
ALRKLCCTFSRVIIQDYFTSWKV

SEQ ID NO: 2288984 - protein, 18 aa, Cryptosporidium parvum
ALSRFAVNYWMKNKLNIN

SEQ ID NO: 2288985 - protein, 19 aa, Cryptosporidium parvum
ALSTLNELLPIWKISINSQ

SEQ ID NO: 2288986 - protein, 22 aa, Cryptosporidium parvum
ALSVCKILGEFGIKEPKIKWVN

SEQ ID NO: 2288987 - protein, 18 aa, Cryptosporidium parvum
ALTALILNKLQLNLKVCA

SEQ ID NO: 2288988 - protein, 18 aa, Cryptosporidium parvum
ALTAWKKICEVSRVEFQK

SEQ ID NO: 2288989 - protein, 18 aa, Cryptosporidium parvum
ALTDFKAKIPRGARTGTV

SEQ ID NO: 2288990 - protein, 18 aa, Cryptosporidium parvum
ALTGFKFIITHLDGRKLL

SEQ ID NO: 2288991 - protein, 17 aa, Cryptosporidium parvum
ALTLISNKIPFLFEYVS

SEQ ID NO: 2288992 - protein, 17 aa, Cryptosporidium parvum
ALTQSMKNHKRWIMSLP

SEQ ID NO: 2288993 - protein, 18 aa, Cryptosporidium parvum
ALVEKAAKCDLGAIEGEI

SEQ ID NO: 2288994 - protein, 26 aa, Cryptosporidium parvum
ALVLSDRGICCIDEFDKMDDSSRSIL

SEQ ID NO: 2288995 - protein, 20 aa, Cryptosporidium parvum
ALYLEVLQFIISQYDPRIKI

SEQ ID NO: 2288996 - protein, 19 aa, Cryptosporidium parvum
ALYLRASSYLKLDDPDEAR

SEQ ID NO: 2288997 - protein, 19 aa, Cryptosporidium parvum
ALYLRRSGKKLILPLNIVS

SEQ ID NO: 2288998 - protein, 24 aa, Cryptosporidium parvum
AMEIDEFKIEPSLERVIVEASTNS

SEQ ID NO: 2288999 - protein, 30 aa, Cryptosporidium parvum; identical to SEQ ID NO: 2168333

SEQ ID NO: 2289000 - protein, 28 aa, Cryptosporidium parvum
AMENALRFVCRGCRIGKVLLNNSSENEF

SEQ ID NO: 2289001 - protein, 27 aa, Cryptosporidium parvum
AMIHRRGSLIKKLVCIPTTCGSGSEVT

SEQ ID NO: 2289002 - protein, 18 aa, Cryptosporidium parvum
AMILKCLIYLQKVGKYSS

SEQ ID NO: 2289003 - protein, 20 aa, Cryptosporidium parvum
AMKWFPLVKYNGFTGVGSVD

SEQ ID NO: 2289004 - protein, 28 aa, Cryptosporidium parvum
AMLNDLKLLIGFLIKYPLNCLRTAESDS

SEQ ID NO: 2289005 - protein, 25 aa, Cryptosporidium parvum
AMLPGCPVKPLGGGEFSSFNIYSKE

SEQ ID NO: 2289006 - protein, 23 aa, Cryptosporidium parvum
AMLRKKDIFDIFSKIPGNPLFKK

SEQ ID NO: 2289007 - protein, 25 aa, Cryptosporidium parvum
AMNCLKIPQMEAASVPPIKKEVDTS

SEQ ID NO: 2289008 - protein, 18 aa, Cryptosporidium parvum
AMNNRGSASLGLNSGFSE

SEQ ID NO: 2289009 - protein, 25 aa, Cryptosporidium parvum
AMTFLGGSIFKIGLSKCLQKKLIKL

SEQ ID NO: 2289010 - protein, 17 aa, Cryptosporidium parvum
AMVKPRRLIYMAIDGVA

SEQ ID NO: 2289011 - protein, 17 aa, Cryptosporidium parvum
ANALIQILSNCKFLEII

SEQ ID NO: 2289012 - protein, 19 aa, Cryptosporidium parvum
ANALTNWTSPFVLNRFQKM

SEQ ID NO: 2289013 - protein, 33 aa, Cryptosporidium parvum
ANCSKKELFKFMLKNIGPRPIWTNSGAIGDVNN

SEQ ID NO: 2289014 - protein, 24 aa, Cryptosporidium parvum
ANDLRKDRCTGLIANLHRMGINNS

SEQ ID NO: 2289015 - protein, 18 aa, Cryptosporidium parvum
ANDTFLWSLTEIENDCSL

SEQ ID NO: 2289016 - protein, 24 aa, Cryptosporidium parvum
ANEEMGYPYGMDFVFSSRSINNSY

SEQ ID NO: 2289017 - protein, 18 aa, Cryptosporidium parvum
ANELLDYILMSIVKDNGH

SEQ ID NO: 2289018 - protein, 22 aa, Cryptosporidium parvum
ANELNLKCRIGEGGYGKVYKAI

SEQ ID NO: 2289019 - protein, 25 aa, Cryptosporidium parvum
ANENMGIDIWGEFLVPDIKIDPKEV

SEQ ID NO: 2289020 - protein, 21 aa, Cryptosporidium parvum
ANESTLIRLGELVTLRESNDR

SEQ ID NO: 2289021 - protein, 28 aa, Cryptosporidium parvum
ANEVFKPMVYETIVFPPGYFEYKKQLEE

SEQ ID NO: 2289022 - protein, 17 aa, Cryptosporidium parvum
ANEWGERLLSYFQFERN

SEQ ID NO: 2289023 - protein, 27 aa, Cryptosporidium parvum
ANGFMFSMVVSYTWNNVYLLGRYIKFS

SEQ ID NO: 2289024 - protein, 19 aa, Cryptosporidium parvum
ANHRCYLLSIKICEYCNIS

SEQ ID NO: 2289025 - protein, 22 aa, Cryptosporidium parvum
ANIHSLRSSFYRKLSDRLSLAS

SEQ ID NO: 2289026 - protein, 19 aa, Cryptosporidium parvum
ANISQFIRLNNRLRANGFL

SEQ ID NO: 2289027 - protein, 27 aa, Cryptosporidium parvum
ANKVCGMSGVLDSARFRCNLSRALGVK

SEQ ID NO: 2289028 - protein, 18 aa, Cryptosporidium parvum
ANLERFLPIYNEIIDSIA

SEQ ID NO: 2289029 - protein, 19 aa, Cryptosporidium parvum
ANLILPLLIIQSHSIQNII

SEQ ID NO: 2289030 - protein, 27 aa, Cryptosporidium parvum
ANLINFICPFCRFFVIDPYNKIIKPLF

SEQ ID NO: 2289031 - protein, 17 aa, Cryptosporidium parvum
ANLLKRYSRFILDKFDI

SEQ ID NO: 2289032 - protein, 18 aa, Cryptosporidium parvum
ANLVQEFLDGCWDMDQHY

SEQ ID NO: 2289033 - protein, 19 aa, Cryptosporidium parvum
ANLVRYSRHYELPTISTII

SEQ ID NO: 2289034 - protein, 17 aa, Cryptosporidium parvum
ANMNNMIMQDRYNKNME

SEQ ID NO: 2289035 - protein, 17 aa, Cryptosporidium parvum
ANMPWFVLFKSNPQLLE

SEQ ID NO: 2289036 - protein, 24 aa, Cryptosporidium parvum
ANNAIKYIVCEQIKKNKLKKLSLE

SEQ ID NO: 2289037 - protein, 23 aa, Cryptosporidium parvum
ANNEAFFPLPNNFSLKPCDTKTL

SEQ ID NO: 2289038 - protein, 18 aa, Cryptosporidium parvum
ANNQFQFKNNTGYATSAR

SEQ ID NO: 2289039 - protein, 18 aa, Cryptosporidium parvum
ANQIRFISNDGSFKSQQL

SEQ ID NO: 2289040 - protein, 19 aa, Cryptosporidium parvum
ANQRLEAVDSMLKSHHSAS

SEQ ID NO: 2289041 - protein, 17 aa, Cryptosporidium parvum
ANRCLSSTLPLSSKSHI

SEQ ID NO: 2289042 - protein, 38 aa, Cryptosporidium parvum
ANRLKPLPKRIIWVPSRRVFIVSYKRLGAINQMNTKSF

SEQ ID NO: 2289043 - protein, 26 aa, Cryptosporidium parvum
ANRPDILCLEGLVIALGCFIGNSNIP

SEQ ID NO: 2289044 - protein, 25 aa, Cryptosporidium parvum
ANSELLKHIFIEGSPDHIPNSVDID

SEQ ID NO: 2289045 - protein, 24 aa, Cryptosporidium parvum
ANSIIKLQLHPCIILEVYSDLIKS

SEQ ID NO: 2289046 - protein, 22 aa, Cryptosporidium parvum
ANSPLCRNIAFAVERRLLDSNL

SEQ ID NO: 2289047 - protein, 20 aa, Cryptosporidium parvum
ANSQKCIRAGGKHNDLDDVG

SEQ ID NO: 2289048 - protein, 20 aa, Cryptosporidium parvum
ANSSPGCNIVNERDDAYSNL

SEQ ID NO: 2289049 - protein, 25 aa, Cryptosporidium parvum
ANSYNWVKSVCPWDLSLSSNTWKHI

SEQ ID NO: 2289050 - protein, 23 aa, Cryptosporidium parvum
ANSYRLAGYETSEPVKVEIPLIK

SEQ ID NO: 2289051 - protein, 20 aa, Cryptosporidium parvum
ANTIPFNFQSRQQLNRNSIG

SEQ ID NO: 2289052 - protein, 26 aa, Cryptosporidium parvum
ANTLLRLNNLLSFKGNLLRIGKPKVS

SEQ ID NO: 2289053 - protein, 18 aa, Cryptosporidium parvum
ANTPRFLHTSLTYPQHST

SEQ ID NO: 2289054 - protein, 26 aa, Cryptosporidium parvum
ANVILRLVPRLDVPALIRKSQNSQDV

SEQ ID NO: 2289055 - protein, 21 aa, Cryptosporidium parvum
ANYLISFLIQMGRVLSFLSDE

SEQ ID NO: 2289056 - protein, 17 aa, Cryptosporidium parvum
APAYIANIIGHKGEGGI

SEQ ID NO: 2289057 - protein, 24 aa, Cryptosporidium parvum
APEKSGSFFSAFSMKDQAKSKSWA

SEQ ID NO: 2289058 - protein, 19 aa, Cryptosporidium parvum
APELWKKLWTEKRISDVIK

SEQ ID NO: 2289059 - protein, 27 aa, Cryptosporidium parvum
APENFKFDVDRGIKLKLGQIIGKVLDS

SEQ ID NO: 2289060 - protein, 19 aa, Cryptosporidium parvum
APFLTWSIFLIEFLSNRST

SEQ ID NO: 2289061 - protein, 20 aa, Cryptosporidium parvum
APGILRKLLQIISRMNTCMV

SEQ ID NO: 2289062 - protein, 29 aa, Cryptosporidium parvum
APHNLRILRWTIFKSNRLPIGKYVCAIFD

SEQ ID NO: 2289063 - protein, 19 aa, Cryptosporidium parvum
APHYACFPANIPPHNCKQI

SEQ ID NO: 2289064 - protein, 25 aa, Cryptosporidium parvum
APIKNGLPWCVSLTWSNDGKTLFAG

SEQ ID NO: 2289065 - protein, 23 aa, Cryptosporidium parvum
APIPLELSSSFWIYKDSGKEYTH

SEQ ID NO: 2289066 - protein, 17 aa, Cryptosporidium parvum
APIVASLPLRKKDETPE

SEQ ID NO: 2289067 - protein, 30 aa, Cryptosporidium parvum; identical to SEQ ID NO: 2168391

SEQ ID NO: 2289068 - protein, 21 aa, Cryptosporidium parvum
APLLPYLRRLFNTLNREICLF

SEQ ID NO: 2289069 - protein, 28 aa, Cryptosporidium parvum
APLNSLRVYQFLSYDERISGLGIGVHWE

SEQ ID NO: 2289070 - protein, 17 aa, Cryptosporidium parvum
APLPSVSWIPKKEFNVT

SEQ ID NO: 2289071 - protein, 29 aa, Cryptosporidium parvum
APNTLIPPFTEWGGTPGVMLRRLPESQNT

SEQ ID NO: 2289072 - protein, 25 aa, Cryptosporidium parvum
APNVTYKYDQRWYITEQNKMGPFGW

SEQ ID NO: 2289073 - protein, 21 aa, Cryptosporidium parvum
APNYCYRCENQAAILRIDDLG

SEQ ID NO: 2289074 - protein, 21 aa, Cryptosporidium parvum
APNYCYRCGNIATVMELDEQL

SEQ ID NO: 2289075 - protein, 28 aa, Cryptosporidium parvum
APPAEESSWFSGWFGAAAPAEPEPEPNK

SEQ ID NO: 2289076 - protein, 26 aa, Cryptosporidium parvum
APPAEESSWFSGWFGASAPEEPPKEE

SEQ ID NO: 2289077 - protein, 25 aa, Cryptosporidium parvum
APPAFSKKIIKFFKMNQRNSLNYPS

SEQ ID NO: 2289078 - protein, 17 aa, Cryptosporidium parvum
APPHGGCGIGLERVIML

SEQ ID NO: 2289079 - protein, 25 aa, Cryptosporidium parvum
APRLKDVPISLGRKSWVRLYIEIIG

SEQ ID NO: 2289080 - protein, 23 aa, Cryptosporidium parvum
APSEVIKIIGLLRPTILQRLIWF

SEQ ID NO: 2289081 - protein, 19 aa, Cryptosporidium parvum
APSLKRKSLIQDIFDLSIY

SEQ ID NO: 2289082 - protein, 27 aa, Cryptosporidium parvum
APSRVGGRLGVCADRFFLVLTNVRNDQ

SEQ ID NO: 2289083 - protein, 17 aa, Cryptosporidium parvum
APSYNWYLNTMVSLFEL

SEQ ID NO: 2289084 - protein, 25 aa, Cryptosporidium parvum
APVDGEYQLVSGFPPKEIKFDPSTT

SEQ ID NO: 2289085 - protein, 25 aa, Cryptosporidium parvum
APVEESSWFSSWFGGTTEPAKVNDL

SEQ ID NO: 2289086 - protein, 30 aa, Cryptosporidium parvum
APVPLKNGFCSFILEITRLIIVLNPSISEE

SEQ ID NO: 2289087 - protein, 17 aa, Cryptosporidium parvum
APVSGKLVRWLIQNGGQ

SEQ ID NO: 2289088 - protein, 17 aa, Cryptosporidium parvum
APYIIGLFLTKTISCDN

SEQ ID NO: 2289089 - protein, 17 aa, Cryptosporidium parvum
AQDFLKEDEPFFVCNSD

SEQ ID NO: 2289090 - protein, 21 aa, Cryptosporidium parvum
AQDGLLYPLNRSFIFITKPVI

SEQ ID NO: 2289091 - protein, 22 aa, Cryptosporidium parvum
AQDWTFASSIIKNSSINASNSA

SEQ ID NO: 2289092 - protein, 18 aa, Cryptosporidium parvum
AQEKCLFPSTVHETLANE

SEQ ID NO: 2289093 - protein, 21 aa, Cryptosporidium parvum
AQGLVGPIFGSFIMTNFRIIL

SEQ ID NO: 2289094 - protein, 17 aa, Cryptosporidium parvum
AQIGSAVAKRLNAAASA

SEQ ID NO: 2289095 - protein, 25 aa, Cryptosporidium parvum
AQIQSICLMDTFSLVRSISNLRLIG

SEQ ID NO: 2289096 - protein, 24 aa, Cryptosporidium parvum
AQIRKRLFEIIKMENIPYVDSGID

SEQ ID NO: 2289097 - protein, 19 aa, Cryptosporidium parvum
AQIRRKLGLQSQMNSKSYF

SEQ ID NO: 2289098 - protein, 17 aa, Cryptosporidium parvum
AQKKGNYGFVEFRTVEE

SEQ ID NO: 2289099 - protein, 21 aa, Cryptosporidium parvum
AQKKIPLWARSMNWIPKMKEQ

SEQ ID NO: 2289100 - protein, 25 aa, Cryptosporidium parvum
AQKYIFSAEFLKLLLELYKLTSELK

SEQ ID NO: 2289101 - protein, 17 aa, Cryptosporidium parvum
AQLFASAQIRIEDINNQ

SEQ ID NO: 2289102 - protein, 19 aa, Cryptosporidium parvum
AQLIFQWIKNPNIGDQEIY

SEQ ID NO: 2289103 - protein, 18 aa, Cryptosporidium parvum
AQLIMIRYLLEIEDKHSD

SEQ ID NO: 2289104 - protein, 25 aa, Cryptosporidium parvum
AQLLRKLYHFCIENNLPPTEETFKK

SEQ ID NO: 2289105 - protein, 18 aa, Cryptosporidium parvum
AQLQALELTWKYPIENSS

SEQ ID NO: 2289106 - protein, 17 aa, Cryptosporidium parvum
AQLQIAMGIPLKKIRDI

SEQ ID NO: 2289107 - protein, 17 aa, Cryptosporidium parvum
AQLYKTYFDGIDYQVPR

SEQ ID NO: 2289108 - protein, 17 aa, Cryptosporidium parvum
AQMGLKEENAWGIVRAL

SEQ ID NO: 2289109 - protein, 17 aa, Cryptosporidium parvum
AQMIKGKVPLNVGEPKK

SEQ ID NO: 2289110 - protein, 27 aa, Cryptosporidium parvum
AQNDFPSITLIKIWLTLLTDINIQSRS

SEQ ID NO: 2289111 - protein, 23 aa, Cryptosporidium parvum
AQPGPSPAFCRIAIPNYIQSIYK

SEQ ID NO: 2289112 - protein, 25 aa, Cryptosporidium parvum
AQQHVCEGWAFPMVPDYCSISGQNV

SEQ ID NO: 2289113 - protein, 20 aa, Cryptosporidium parvum
AQRIIPGIFLGGSTVANDLK

SEQ ID NO: 2289114 - protein, 24 aa, Cryptosporidium parvum
AQRVFLMAVQRSFTIGRNNMHVAS

SEQ ID NO: 2289115 - protein, 27 aa, Cryptosporidium parvum
AQRYDLIFKDILLRDMNRMDAMYNRDI

SEQ ID NO: 2289116 - protein, 22 aa, Cryptosporidium parvum
AQSLGLECLGLVFTHNERDEVL

SEQ ID NO: 2289117 - protein, 29 aa, Cryptosporidium parvum
AQSNTLFQFCHAFYLSIIREIFCVLTDTL

SEQ ID NO: 2289118 - protein, 17 aa, Cryptosporidium parvum
AQTLLLLLETIKPFYAK

SEQ ID NO: 2289119 - protein, 23 aa, Cryptosporidium parvum
AQVCGYEPGELAIFIGDAHIYEN

SEQ ID NO: 2289120 - protein, 25 aa, Cryptosporidium parvum
AQVTCLKFLPNLGIIISGDISGGLE

SEQ ID NO: 2289121 - protein, 25 aa, Cryptosporidium parvum
ARAFCIKLKGDLMRYKAEILKDEEK

SEQ ID NO: 2289122 - protein, 18 aa, Cryptosporidium parvum
ARARGAVTMLTRQPREGR

SEQ ID NO: 2289123 - protein, 30 aa, Cryptosporidium parvum
ARASYLKHRSIVLGEQMKAYTLGHPLPTHY

SEQ ID NO: 2289124 - protein, 22 aa, Cryptosporidium parvum
ARAYCRLLYSLSCISFGIPMVF

SEQ ID NO: 2289125 - protein, 18 aa, Cryptosporidium parvum
AREGGLRFGEMERDCMIS

SEQ ID NO: 2289126 - protein, 21 aa, Cryptosporidium parvum
ARELGPLGIRVVTIGPGVFDT

SEQ ID NO: 2289127 - protein, 21 aa, Cryptosporidium parvum
ARFAFFPKDLLEIIIQKISLL

SEQ ID NO: 2289128 - protein, 23 aa, Cryptosporidium parvum
ARFCPSIKAVKFLGNGQERSDLI

SEQ ID NO: 2289129 - protein, 34 aa, Cryptosporidium parvum
ARFISLDTITWEWKFEVTHFSKYGFLSEDNSLSH

SEQ ID NO: 2289130 - protein, 29 aa, Cryptosporidium parvum
ARGCIKGLSPFLPRVLSYLVKLTSNSKPL

SEQ ID NO: 2289131 - protein, 21 aa, Cryptosporidium parvum
ARGPKHLQIKLSRAKYEELVD

SEQ ID NO: 2289132 - protein, 18 aa, Cryptosporidium parvum
ARIAYILMVVYDSDVNIQ

SEQ ID NO: 2289133 - protein, 18 aa, Cryptosporidium parvum
ARIKERFLHEIGLLDSGI

SEQ ID NO: 2289134 - protein, 23 aa, Cryptosporidium parvum
ARIQCFRRALSAISIYIWEPSTK

SEQ ID NO: 2289135 - protein, 17 aa, Cryptosporidium parvum
ARISSYSNFGLKELTLD

SEQ ID NO: 2289136 - protein, 18 aa, Cryptosporidium parvum
ARKFSIDLVNYIIMIFNR

SEQ ID NO: 2289137 - protein, 19 aa, Cryptosporidium parvum
ARKRRRPGTVGNDRNFYIV

SEQ ID NO: 2289138 - protein, 19 aa, Cryptosporidium parvum
ARLSTEITSFEKKKEELET

SEQ ID NO: 2289139 - protein, 18 aa, Cryptosporidium parvum
ARMAERKAAAAAAAAAAA

SEQ ID NO: 2289140 - protein, 19 aa, Cryptosporidium parvum
ARMNKMRLMGLLNNNNTPM

SEQ ID NO: 2289141 - protein, 18 aa, Cryptosporidium parvum
ARNASFIRSSRRGCEPEV

SEQ ID NO: 2289142 - protein, 23 aa, Cryptosporidium parvum
ARNNPVLFVFGFQGFQHVNMGKY

SEQ ID NO: 2289143 - protein, 21 aa, Cryptosporidium parvum
ARNNSPVCVPPIYDSFWNPSE

SEQ ID NO: 2289144 - protein, 23 aa, Cryptosporidium parvum
ARNSVFKLKWKFATMPDKNKIKI

SEQ ID NO: 2289145 - protein, 18 aa, Cryptosporidium parvum
ARQILVFELKSLQKLFIE

SEQ ID NO: 2289146 - protein, 24 aa, Cryptosporidium parvum
ARQKWAKMALRFGGNELQKNISDQ

SEQ ID NO: 2289147 - protein, 30 aa, Cryptosporidium parvum
ARRDPRVLHPKRRFKLFRSILKFGDPYRRL

SEQ ID NO: 2289148 - protein, 18 aa, Cryptosporidium parvum
ARRIAMLQKRRELKAAGM

SEQ ID NO: 2289149 - protein, 23 aa, Cryptosporidium parvum
ARRKYSYFCCNFAQLDYTNSARN

SEQ ID NO: 2289150 - protein, 19 aa, Cryptosporidium parvum
ARRQLLMNGFHSFKQYLIH

SEQ ID NO: 2289151 - protein, 20 aa, Cryptosporidium parvum
ARSILLDNPQFCYALLHSQF

SEQ ID NO: 2289152 - protein, 26 aa, Cryptosporidium parvum
ARSLKRPPAYPTKFFGCELGALSKWE

SEQ ID NO: 2289153 - protein, 18 aa, Cryptosporidium parvum
ARTAIIDYLTLVTGNENR

SEQ ID NO: 2289154 - protein, 22 aa, Cryptosporidium parvum
ARTGKMWKPRILLQQKSKRSIR

SEQ ID NO: 2289155 - protein, 24 aa, Cryptosporidium parvum
ARVRPFILCAILRDLSFNEDVYKS

SEQ ID NO: 2289156 - protein, 19 aa, Cryptosporidium parvum
ASARIYGYRVDSTFDNAYR

SEQ ID NO: 2289157 - protein, 17 aa, Cryptosporidium parvum
ASCIARTILFFNSKPLN

SEQ ID NO: 2289158 - protein, 17 aa, Cryptosporidium parvum
ASCLNKWYEKYSSVNDE

SEQ ID NO: 2289159 - protein, 25 aa, Cryptosporidium parvum
ASDIPAELSLKVVYDMLKRREAEGL

SEQ ID NO: 2289160 - protein, 26 aa, Cryptosporidium parvum
ASDSRCLRDTWGLRQHRDGRWDWIEA

SEQ ID NO: 2289161 - protein, 25 aa, Cryptosporidium parvum
ASEDELRHSLGLFEHLTYGRGEKRG

SEQ ID NO: 2289162 - protein, 23 aa, Cryptosporidium parvum
ASESIQLAAIVSCFHEVRMEMEK

SEQ ID NO: 2289163 - protein, 17 aa, Cryptosporidium parvum
ASFLELEKEFLLKKVTK

SEQ ID NO: 2289164 - protein, 18 aa, Cryptosporidium parvum
ASGHLLATRKARLMNNVI

SEQ ID NO: 2289165 - protein, 22 aa, Cryptosporidium parvum
ASGKTSVCTRIFSELGDKRVTV

SEQ ID NO: 2289166 - protein, 18 aa, Cryptosporidium parvum
ASGLKRGRFNKESNELKM

SEQ ID NO: 2289167 - protein, 24 aa, Cryptosporidium parvum
ASHAAGPLSSWVSSILQYSLISEK

SEQ ID NO: 2289168 - protein, 26 aa, Cryptosporidium parvum
ASHDFFLKRLKGIGRHQVKINIYNSL

SEQ ID NO: 2289169 - protein, 20 aa, Cryptosporidium parvum
ASHKGNVSSLNWINDSNNNL

SEQ ID NO: 2289170 - protein, 17 aa, Cryptosporidium parvum
ASIEYPLVISWGETYKI

SEQ ID NO: 2289171 - protein, 27 aa, Cryptosporidium parvum
ASIGSLLIFLSSLWRSSISKDPRAVFE

SEQ ID NO: 2289172 - protein, 18 aa, Cryptosporidium parvum
ASILNFKFFNSIFELYEQ

SEQ ID NO: 2289173 - protein, 27 aa, Cryptosporidium parvum
ASINPECCGWLYVLNLKGNQYGRDISL

SEQ ID NO: 2289174 - protein, 18 aa, Cryptosporidium parvum
ASKFGEDQVKIWRRSFDV

SEQ ID NO: 2289175 - protein, 19 aa, Cryptosporidium parvum
ASKFKQALESTGLACQEIQ

SEQ ID NO: 2289176 - protein, 23 aa, Cryptosporidium parvum
ASKKKVGAALECFSGNSSTKNAY

SEQ ID NO: 2289177 - protein, 23 aa, Cryptosporidium parvum
ASLAEVLSAFGIEKFNQILPFII

SEQ ID NO: 2289178 - protein, 18 aa, Cryptosporidium parvum
ASLFPFNPDFAGRRVIAF

SEQ ID NO: 2289179 - protein, 24 aa, Cryptosporidium parvum
ASLFPVQSYCHIFSRLASNSINQH

SEQ ID NO: 2289180 - protein, 17 aa, Cryptosporidium parvum
ASLRKNLKIKYDKEREQ

SEQ ID NO: 2289181 - protein, 18 aa, Cryptosporidium parvum
ASLRKRGKVNNMVSGLGG

SEQ ID NO: 2289182 - protein, 18 aa, Cryptosporidium parvum
ASLSAQCEMAYIDIISQT

SEQ ID NO: 2289183 - protein, 18 aa, Cryptosporidium parvum
ASLTILLCDSQFPGQPLT

SEQ ID NO: 2289184 - protein, 18 aa, Cryptosporidium parvum
ASLVRLGHEVHLFTRATT

SEQ ID NO: 2289185 - protein, 17 aa, Cryptosporidium parvum
ASNAIDLNLTWQSSIYA

SEQ ID NO: 2289186 - protein, 23 aa, Cryptosporidium parvum
ASNRTCNCLALLQCVASHSETRA

SEQ ID NO: 2289187 - protein, 24 aa, Cryptosporidium parvum
ASQLKEIYQMITLGGDAELELIDS

SEQ ID NO: 2289188 - protein, 20 aa, Cryptosporidium parvum
ASQLMLMFSLPKKEYGLSRI

SEQ ID NO: 2289189 - protein, 18 aa, Cryptosporidium parvum
ASRGSKCRVFSRMLESFK

SEQ ID NO: 2289190 - protein, 19 aa, Cryptosporidium parvum
ASRPLTSYVSTRWYRAPEL

SEQ ID NO: 2289191 - protein, 20 aa, Cryptosporidium parvum
ASRTCRRCGQVGHIASNPMC

SEQ ID NO: 2289192 - protein, 19 aa, Cryptosporidium parvum
ASSDETWRIWDIETLNQVQ

SEQ ID NO: 2289193 - protein, 23 aa, Cryptosporidium parvum
ASSGAIIEYVGNFAFIHGDLSER

SEQ ID NO: 2289194 - protein, 20 aa, Cryptosporidium parvum
ASSNGSIFWVTPTQFNPQTG

SEQ ID NO: 2289195 - protein, 24 aa, Cryptosporidium parvum
ASSNNFPSIVGFSGVSGQSSSEIT

SEQ ID NO: 2289196 - protein, 23 aa, Cryptosporidium parvum
ASSSRIFIKILFQELSYNMGIKN

SEQ ID NO: 2289197 - protein, 18 aa, Cryptosporidium parvum
ASTMVILQRHGCCTMLLY

SEQ ID NO: 2289198 - protein, 24 aa, Cryptosporidium parvum
ASTNLPRSSWIDISSFPQSGTEIG

SEQ ID NO: 2289199 - protein, 17 aa, Cryptosporidium parvum
ASVAEAFVFWFESEKDM

SEQ ID NO: 2289200 - protein, 20 aa, Cryptosporidium parvum
ASVAMIRGTRRFLFDFSVTL

SEQ ID NO: 2289201 - protein, 19 aa, Cryptosporidium parvum
ASVDRGFARCFVMKRQTIE

SEQ ID NO: 2289202 - protein, 30 aa, Cryptosporidium parvum
ASVSHGCLMCLTCSGVHRGLGVHISFIRSI

SEQ ID NO: 2289203 - protein, 18 aa, Cryptosporidium parvum
ASYIPFSLSTQIKENNLY

SEQ ID NO: 2289204 - protein, 23 aa, Cryptosporidium parvum
ASYPDLLEEFVLFIPELSGKTES

SEQ ID NO: 2289205 - protein, 25 aa, Cryptosporidium parvum
ATALTGWRGRLLVGINKTLRVYSLG

SEQ ID NO: 2289206 - protein, 20 aa, Cryptosporidium parvum
ATEMFKLALRNIKMNNNNNN

SEQ ID NO: 2289207 - protein, 23 aa, Cryptosporidium parvum
ATESNSLYIWIFSHESIKSNELN

SEQ ID NO: 2289208 - protein, 25 aa, Cryptosporidium parvum
ATFIKEAFCAPSFAPPKSDIFSINN

SEQ ID NO: 2289209 - protein, 22 aa, Cryptosporidium parvum
ATGCPSLVMARGHRINNVPELP

SEQ ID NO: 2289210 - protein, 19 aa, Cryptosporidium parvum
ATGHPPLVMSMSFTNQVLA

SEQ ID NO: 2289211 - protein, 23 aa, Cryptosporidium parvum
ATIPNYIEFANWIGRIKQNTVYC

SEQ ID NO: 2289212 - protein, 21 aa, Cryptosporidium parvum
ATIWLFRCLLSIDSPSFHQLM

SEQ ID NO: 2289213 - protein, 25 aa, Cryptosporidium parvum
ATKCTAAVFFYHLLVLATYNEIKLT

SEQ ID NO: 2289214 - protein, 20 aa, Cryptosporidium parvum
ATKIILCYLANIQKSTSSFD

SEQ ID NO: 2289215 - protein, 17 aa, Cryptosporidium parvum
ATKNIKALLSSSSSKVI

SEQ ID NO: 2289216 - protein, 17 aa, Cryptosporidium parvum
ATKRIATVYPRDIVNIR

SEQ ID NO: 2289217 - protein, 25 aa, Cryptosporidium parvum
ATLCCLSALGLRGKVVSSFSFFPPK

SEQ ID NO: 2289218 - protein, 23 aa, Cryptosporidium parvum
ATLQKRILELFVERRALMDENKS

SEQ ID NO: 2289219 - protein, 19 aa, Cryptosporidium parvum
ATLSKPVEDLARYSLKNDP

SEQ ID NO: 2289220 - protein, 23 aa, Cryptosporidium parvum
ATLSRSVTDLALLALNNPCKVST

SEQ ID NO: 2289221 - protein, 28 aa, Cryptosporidium parvum
ATLVDNCLGILAAQLYKFPVTKTLNLAY

SEQ ID NO: 2289222 - protein, 26 aa, Cryptosporidium parvum
ATNEKGFSSLHWASLKGHSQVVEELL

SEQ ID NO: 2289223 - protein, 17 aa, Cryptosporidium parvum
ATNIFKRAFVSILKKHD

SEQ ID NO: 2289224 - protein, 18 aa, Cryptosporidium parvum
ATNVNELNQAIKMAYSVG

SEQ ID NO: 2289225 - protein, 24 aa, Cryptosporidium parvum
ATPNRRGGGDSHYYGYGRQHGARE

SEQ ID NO: 2289226 - protein, 19 aa, Cryptosporidium parvum
ATPPFIYNVDHLMECVEIP

SEQ ID NO: 2289227 - protein, 29 aa, Cryptosporidium parvum
ATQCPLCKREFDHINAFNVIPGELSIPVM

SEQ ID NO: 2289228 - protein, 31 aa, Cryptosporidium parvum; identical to SEQ ID NO: 2168530

SEQ ID NO: 2289229 - protein, 22 aa, Cryptosporidium parvum
ATRRIKTEFLVQMDGVNSNSNN

SEQ ID NO: 2289230 - protein, 19 aa, Cryptosporidium parvum
ATSILPLKRFEAVDLDEIL

SEQ ID NO: 2289231 - protein, 19 aa, Cryptosporidium parvum
ATSTPLIFQNRCQEHHLPS

SEQ ID NO: 2289232 - protein, 20 aa, Cryptosporidium parvum
ATSVKLTFNYFLVKQNELFE

SEQ ID NO: 2289233 - protein, 23 aa, Cryptosporidium parvum
ATTGKPKGFGFVLFNDRKFVISS

SEQ ID NO: 2289234 - protein, 27 aa, Cryptosporidium parvum
ATTLRCFCGVGCYKQGFAQLRRFYEVR

SEQ ID NO: 2289235 - protein, 17 aa, Cryptosporidium parvum
ATTMIHGITPFYYGISG

SEQ ID NO: 2289236 - protein, 29 aa, Cryptosporidium parvum
ATTSFFRRLDWSPKGEMLVVPTGQYLLNQ

SEQ ID NO: 2289237 - protein, 31 aa, Cryptosporidium parvum; identical to SEQ ID NO: 2168537

SEQ ID NO: 2289238 - protein, 25 aa, Cryptosporidium parvum
AVALKKPFVCGSVDTLERIKILQQF

SEQ ID NO: 2289239 - protein, 24 aa, Cryptosporidium parvum
AVAQRLSKIFSRYKALSSGFVDVL

SEQ ID NO: 2289240 - protein, 18 aa, Cryptosporidium parvum
AVCDFSYTSYSRGRDAKS

SEQ ID NO: 2289241 - protein, 17 aa, Cryptosporidium parvum
AVFELFKAIINFPNSGF

SEQ ID NO: 2289242 - protein, 17 aa, Cryptosporidium parvum
AVFNRLASRIEEGIQDL

SEQ ID NO: 2289243 - protein, 19 aa, Cryptosporidium parvum
AVGKSCLLLQFTDRRFRVD

SEQ ID NO: 2289244 - protein, 23 aa, Cryptosporidium parvum
AVGTPGRLSALIFGEYENETLFG

SEQ ID NO: 2289245 - protein, 18 aa, Cryptosporidium parvum
AVHLFDPLFYEGFLEEVP

SEQ ID NO: 2289246 - protein, 18 aa, Cryptosporidium parvum
AVITKVRICKLNVEIVEK

SEQ ID NO: 2289247 - protein, 33 aa, Cryptosporidium parvum
AVKTIHKLASFYVRDILKFILNEESISNDKLNG

SEQ ID NO: 2289248 - protein, 19 aa, Cryptosporidium parvum
AVLGDRPIYVGKFQKKAER

SEQ ID NO: 2289249 - protein, 22 aa, Cryptosporidium parvum
AVLPDCYSAIPSGYNLNGTVVP

SEQ ID NO: 2289250 - protein, 18 aa, Cryptosporidium parvum
AVNCAVAPGLCSTNSFLA

SEQ ID NO: 2289251 - protein, 19 aa, Cryptosporidium parvum
AVNNLKLFNSMKELITNNY

SEQ ID NO: 2289252 - protein, 17 aa, Cryptosporidium parvum
AVRFGRYSQEIEMPVPY

SEQ ID NO: 2289253 - protein, 23 aa, Cryptosporidium parvum
AVRNSWMHIFSFDSAIPRSNQRE

SEQ ID NO: 2289254 - protein, 18 aa, Cryptosporidium parvum
AVRPEKLSDPCIYIKQLL

SEQ ID NO: 2289255 - protein, 18 aa, Cryptosporidium parvum
AVSRGRMATNTANINNAN

SEQ ID NO: 2289256 - protein, 20 aa, Cryptosporidium parvum
AVTALACSFSIIFDYDNLPQ

SEQ ID NO: 2289257 - protein, 20 aa, Cryptosporidium parvum
AVTLFHWQNSLALERIVGTS

SEQ ID NO: 2289258 - protein, 21 aa, Cryptosporidium parvum
AVVHPCAKMLVELSKAQDVEV

SEQ ID NO: 2289259 - protein, 18 aa, Cryptosporidium parvum
AVVPNAKCRLRLLKYERI

SEQ ID NO: 2289260 - protein, 20 aa, Cryptosporidium parvum
AVVREIEWEEVFSINDLRFL

SEQ ID NO: 2289261 - protein, 23 aa, Cryptosporidium parvum
AVYPRKGIAFVEYFDIRKAEGAR

SEQ ID NO: 2289262 - protein, 33 aa, Cryptosporidium parvum; identical to SEQ ID NO: 2168558

SEQ ID NO: 2289263 - protein, 17 aa, Cryptosporidium parvum
AWIILPHKCDAFDAQRI

SEQ ID NO: 2289264 - protein, 19 aa, Cryptosporidium parvum
AWLLEGITLILYKNGVLKA

SEQ ID NO: 2289265 - protein, 18 aa, Cryptosporidium parvum
AWSPALTLRTVMLSIQAL

SEQ ID NO: 2289266 - protein, 18 aa, Cryptosporidium parvum
AYCAIAISADWLILATDV

SEQ ID NO: 2289267 - protein, 17 aa, Cryptosporidium parvum
AYDHVAAISKKWLSLID

SEQ ID NO: 2289268 - protein, 17 aa, Cryptosporidium parvum
AYDYSINDITGFDNINE

SEQ ID NO: 2289269 - protein, 19 aa, Cryptosporidium parvum
AYDYSYKFGKIKNRASVIL

SEQ ID NO: 2289270 - protein, 19 aa, Cryptosporidium parvum
AYFKESIWIPNALIPLVRQ

SEQ ID NO: 2289271 - protein, 18 aa, Cryptosporidium parvum
AYFKKSQFELALDAYTKA

SEQ ID NO: 2289272 - protein, 20 aa, Cryptosporidium parvum
AYFMNCNIFTIPGRTFPVEI

SEQ ID NO: 2289273 - protein, 17 aa, Cryptosporidium parvum
AYFPKWDASIVMTNGKM

SEQ ID NO: 2289274 - protein, 28 aa, Cryptosporidium parvum
AYGIVWKSIDRRTGEVVAVKKIFDAFQN

SEQ ID NO: 2289275 - protein, 21 aa, Cryptosporidium parvum
AYICSRFYRAPELMLGATEYT

SEQ ID NO: 2289276 - protein, 25 aa, Cryptosporidium parvum
AYKQRARLAAMVSRRRVTLQHVRAQ

SEQ ID NO: 2289277 - protein, 22 aa, Cryptosporidium parvum
AYKTYFKAVIFCSSKETTSNLT

SEQ ID NO: 2289278 - protein, 27 aa, Cryptosporidium parvum
AYLARMKKLYVCLGRHSIYLLKRNLRK

SEQ ID NO: 2289279 - protein, 17 aa, Cryptosporidium parvum
AYLGRQIKNAVVTVPAY

SEQ ID NO: 2289280 - protein, 23 aa, Cryptosporidium parvum
AYLYFDILKVLGIDFDSSNNSFS

SEQ ID NO: 2289281 - protein, 17 aa, Cryptosporidium parvum
AYNSVIIFFFLYHCAFK

SEQ ID NO: 2289282 - protein, 23 aa, Cryptosporidium parvum
AYQPRFTSIFSKIIIQLSETETI

SEQ ID NO: 2289283 - protein, 20 aa, Cryptosporidium parvum
AYRLIFRSFVELSLNNISQE

SEQ ID NO: 2289284 - protein, 24 aa, Cryptosporidium parvum
AYRLTVIKIVPWITQLDAIPINRS

SEQ ID NO: 2289285 - protein, 18 aa, Cryptosporidium parvum
AYRVHVCEMCGLICIADL

SEQ ID NO: 2289286 - protein, 19 aa, Cryptosporidium parvum
AYYRGMLKDLCEGNTPGPK

SEQ ID NO: 2289287 - protein, 33 aa, Cryptosporidium parvum; identical to SEQ ID NO: 2168585

SEQ ID NO: 2289288 - protein, 30 aa, Cryptosporidium parvum
CADIKKNKLCFVPIKRVYPIMRLNLNRNTK

SEQ ID NO: 2289289 - protein, 22 aa, Cryptosporidium parvum
CADINAQVPILFGVSNSIIENV

SEQ ID NO: 2289290 - protein, 18 aa, Cryptosporidium parvum
CALISLCKLTSLTTKLLN

SEQ ID NO: 2289291 - protein, 17 aa, Cryptosporidium parvum
CALKILINLSQKSEIGE

SEQ ID NO: 2289292 - protein, 17 aa, Cryptosporidium parvum
CALLPTPDYRILNLGGI

SEQ ID NO: 2289293 - protein, 25 aa, Cryptosporidium parvum
CANDAKLMALTLMSHFDFNASDIIF

SEQ ID NO: 2289294 - protein, 20 aa, Cryptosporidium parvum
CANLIKLGYIKGYISWEHQV

SEQ ID NO: 2289295 - protein, 25 aa, Cryptosporidium parvum
CAPPSLKIIQVFVFCIMNRYDLAQS

SEQ ID NO: 2289296 - protein, 17 aa, Cryptosporidium parvum
CAPYESFEGKISSKKED

SEQ ID NO: 2289297 - protein, 22 aa, Cryptosporidium parvum
CAQALFKGPHLALGPDVLLKVL

SEQ ID NO: 2289298 - protein, 21 aa, Cryptosporidium parvum
CAQGLSGVGARVIVTEIDPIC

SEQ ID NO: 2289299 - protein, 19 aa, Cryptosporidium parvum
CAQKVIQHLHLRRHFKNAP

SEQ ID NO: 2289300 - protein, 21 aa, Cryptosporidium parvum
CAQYFLGFCKYGPKCKRRHEP

SEQ ID NO: 2289301 - protein, 20 aa, Cryptosporidium parvum
CARIGAVHMVVFAGFAAQNL

SEQ ID NO: 2289302 - protein, 20 aa, Cryptosporidium parvum
CASCKKKILNKEIDENSVEY

SEQ ID NO: 2289303 - protein, 21 aa, Cryptosporidium parvum
CATEMKGTFLSISSADLTSKW

SEQ ID NO: 2289304 - protein, 19 aa, Cryptosporidium parvum
CATPERFFTVCQVLGNVIT

SEQ ID NO: 2289305 - protein, 27 aa, Cryptosporidium parvum
CCAPEKSGIMTPEFPGSHDSNFSFSNN

SEQ ID NO: 2289306 - protein, 23 aa, Cryptosporidium parvum
CCATLDHFVSFIFTTLEKEKIVL

SEQ ID NO: 2289307 - protein, 26 aa, Cryptosporidium parvum
CCDYYRYIRRKSWLILNVLLLMVDSS

SEQ ID NO: 2289308 - protein, 19 aa, Cryptosporidium parvum
CCHHRCLISQHLGAEMLNQ

SEQ ID NO: 2289309 - protein, 26 aa, Cryptosporidium parvum
CCKDNELLRLLVLLNRIQLLNDVRPY

SEQ ID NO: 2289310 - protein, 18 aa, Cryptosporidium parvum
CCNRGGYCNFMHIKHVPR

SEQ ID NO: 2289311 - protein, 19 aa, Cryptosporidium parvum
CDAVWPGWGHASENPELPK

SEQ ID NO: 2289312 - protein, 17 aa, Cryptosporidium parvum
CDCKSETCCSKNKKKKR

SEQ ID NO: 2289313 - protein, 25 aa, Cryptosporidium parvum
CDDAPKICNILKCVPFKEAPSEVIK

SEQ ID NO: 2289314 - protein, 24 aa, Cryptosporidium parvum
CDEEASVFIEIDFGTSREEFRVQL

SEQ ID NO: 2289315 - protein, 19 aa, Cryptosporidium parvum
CDFNIPSRANIDMRSTNAV

SEQ ID NO: 2289316 - protein, 20 aa, Cryptosporidium parvum
CDFPGKMVPNKNLLRLSRNH

SEQ ID NO: 2289317 - protein, 21 aa, Cryptosporidium parvum
CDGQLKRWIIRPADKDVMTTE

SEQ ID NO: 2289318 - protein, 19 aa, Cryptosporidium parvum
CDGRGGTYVDVIGNGGRIG

SEQ ID NO: 2289319 - protein, 25 aa, Cryptosporidium parvum
CDGYIRYSLKNCYFFNVPLTRMTMD

SEQ ID NO: 2289320 - protein, 28 aa, Cryptosporidium parvum
CDIATATQCSICLENMKLTSLSSSSSSS

SEQ ID NO: 2289321 - protein, 25 aa, Cryptosporidium parvum
CDICSKSIHKSCLKKCNQFIASSSF

SEQ ID NO: 2289322 - protein, 21 aa, Cryptosporidium parvum
CDLDIRKDLYANIVLSGGTTM

SEQ ID NO: 2289323 - protein, 27 aa, Cryptosporidium parvum
CDPRHGKYMACCLMYRGDVVPKDTNAA

SEQ ID NO: 2289324 - protein, 25 aa, Cryptosporidium parvum
CDQIQLPPIFYILSKRILIQEAKYH

SEQ ID NO: 2289325 - protein, 20 aa, Cryptosporidium parvum
CDQRGGDYCKYIGVDDEYMS

SEQ ID NO: 2289326 - protein, 19 aa, Cryptosporidium parvum
CDRNMILGKGFFVTPSDSV

SEQ ID NO: 2289327 - protein, 27 aa, Cryptosporidium parvum
CDRSFLKRTLKIHLRYFCGPNSMRTAK

SEQ ID NO: 2289328 - protein, 17 aa, Cryptosporidium parvum
CDSHRNLWDSLGGYQDV

SEQ ID NO: 2289329 - protein, 25 aa, Cryptosporidium parvum
CDSKLGYYCWFGGKCSCGYWQTPSF

SEQ ID NO: 2289330 - protein, 20 aa, Cryptosporidium parvum
CDSLSLNNCCLKRNCDFRIR

SEQ ID NO: 2289331 - protein, 17 aa, Cryptosporidium parvum
CDTKARLLPSEARTAII

SEQ ID NO: 2289332 - protein, 28 aa, Cryptosporidium parvum
CDVARCSGRKLLRFNYAKKLQFSSNYAR

SEQ ID NO: 2289333 - protein, 28 aa, Cryptosporidium parvum
CECRKVINCRDCNLFIYDSINNVFYHGF

SEQ ID NO: 2289334 - protein, 17 aa, Cryptosporidium parvum
CEDNLLLALSNVKGNIL

SEQ ID NO: 2289335 - protein, 24 aa, Cryptosporidium parvum
CEECSRWYHQDCVGYSSKSNNFPE

SEQ ID NO: 2289336 - protein, 24 aa, Cryptosporidium parvum
CEEKALLIKAGFSACIRAFTFEGF

SEQ ID NO: 2289337 - protein, 18 aa, Cryptosporidium parvum
CEELRKLFISVYLSQTLQ

SEQ ID NO: 2289338 - protein, 23 aa, Cryptosporidium parvum
CEENKSDCVFIKSQTFNILNSPC

SEQ ID NO: 2289339 - protein, 25 aa, Cryptosporidium parvum
CEEPFSIFKRHECWCRPLEQIGSNT

SEQ ID NO: 2289340 - protein, 27 aa, Cryptosporidium parvum
CEEYLKTKHLFKLIIKSVIKNDPEPLI

SEQ ID NO: 2289341 - protein, 33 aa, Cryptosporidium parvum
CEFIKAPRGWICRPMVPNKWLVVFCDECNLPEP

SEQ ID NO: 2289342 - protein, 25 aa, Cryptosporidium parvum
CEFRLKKTLLHECCHVAQFLLDSCI

SEQ ID NO: 2289343 - protein, 25 aa, Cryptosporidium parvum
CEFSPRSPLNFKDIFPNASEMAIDL

SEQ ID NO: 2289344 - protein, 24 aa, Cryptosporidium parvum
CEGRVKLGDFGWCGDLCRRCNSMA

SEQ ID NO: 2289345 - protein, 17 aa, Cryptosporidium parvum
CEIHPSLILGVCASIIP

SEQ ID NO: 2289346 - protein, 23 aa, Cryptosporidium parvum
CEIIPFELPIDFITSIYNSGTIS

SEQ ID NO: 2289347 - protein, 22 aa, Cryptosporidium parvum
CELDERCPFSHCLSWHRRNPYE

SEQ ID NO: 2289348 - protein, 31 aa, Cryptosporidium parvum
CELFVRDLTSFSWNFTRRAKRRTVQVQDIKS

SEQ ID NO: 2289349 - protein, 22 aa, Cryptosporidium parvum
CELYETALWGRYEFPNDDSNKG

SEQ ID NO: 2289350 - protein, 18 aa, Cryptosporidium parvum
CENFSVHCFNGYYNNCIF

SEQ ID NO: 2289351 - protein, 17 aa, Cryptosporidium parvum
CENIRYAQKMYVQHLML

SEQ ID NO: 2289352 - protein, 18 aa, Cryptosporidium parvum
CENMAKKCKGIEEIIGNL

SEQ ID NO: 2289353 - protein, 20 aa, Cryptosporidium parvum
CEQTACVKIGDLICAPQNNV

SEQ ID NO: 2289354 - protein, 19 aa, Cryptosporidium parvum
CEREAIFNRLILNNPSIIS

SEQ ID NO: 2289355 - protein, 23 aa, Cryptosporidium parvum
CESEDKWAIVVASDGIWDSISEE

SEQ ID NO: 2289356 - protein, 18 aa, Cryptosporidium parvum
CESMEGFVLCHSIAGGTG

SEQ ID NO: 2289357 - protein, 20 aa, Cryptosporidium parvum
CESTRLWIRLQNHGTPKDKL

SEQ ID NO: 2289358 - protein, 17 aa, Cryptosporidium parvum
CEVGRSCVVVSFKGRSV

SEQ ID NO: 2289359 - protein, 27 aa, Cryptosporidium parvum
CEVQAFKIFLTKNCRYTEDIDNRLSKN

SEQ ID NO: 2289360 - protein, 26 aa, Cryptosporidium parvum
CFAIDANGILFVWGMNLTGQIGIKKL

SEQ ID NO: 2289361 - protein, 18 aa, Cryptosporidium parvum
CFEHSYSSIVGNFIEETP

SEQ ID NO: 2289362 - protein, 30 aa, Cryptosporidium parvum
CFEKNEAHCLKPFNRAENKMTFGSEKDLAT

SEQ ID NO: 2289363 - protein, 21 aa, Cryptosporidium parvum
CFELKSLFIAPTREICIQINK

SEQ ID NO: 2289364 - protein, 17 aa, Cryptosporidium parvum
CFFKEFVKESSITSLSL

SEQ ID NO: 2289365 - protein, 18 aa, Cryptosporidium parvum
CFGEFKRIHVMPFSDTLP

SEQ ID NO: 2289366 - protein, 19 aa, Cryptosporidium parvum
CFGFGGFLVLCYANNSSQI

SEQ ID NO: 2289367 - protein, 32 aa, Cryptosporidium parvum
CFKAMLNPLRLLRFLIGFNFNITNAFNSFDKH

SEQ ID NO: 2289368 - protein, 25 aa, Cryptosporidium parvum
CFKQIRLKIIFPNGEEVIRSDLIAW

SEQ ID NO: 2289369 - protein, 21 aa, Cryptosporidium parvum
CFLLSTKAGGLGINLTTADTV

SEQ ID NO: 2289370 - protein, 17 aa, Cryptosporidium parvum
CFMMLRMPYESEGAKKL

SEQ ID NO: 2289371 - protein, 20 aa, Cryptosporidium parvum
CFNFKSRKIEIIKIKCTSTL

SEQ ID NO: 2289372 - protein, 29 aa, Cryptosporidium parvum
CFNGYYNNCIFHRVIKGFMIQTGDPTGQG

SEQ ID NO: 2289373 - protein, 23 aa, Cryptosporidium parvum
CFNLEKFCLPKICGINEISFNEY

SEQ ID NO: 2289374 - protein, 20 aa, Cryptosporidium parvum
CFNLKGCYPIYNQDERGELM

SEQ ID NO: 2289375 - protein, 27 aa, Cryptosporidium parvum
CFRFSFLGLRSNEQWLGELFSLSSDDQ

SEQ ID NO: 2289376 - protein, 27 aa, Cryptosporidium parvum
CFSLKVPPVFCNNGNLLLIPKGRDNEI

SEQ ID NO: 2289377 - protein, 28 aa, Cryptosporidium parvum
CFSQDVFKKKCKRRPKVANPNYGTPLAG

SEQ ID NO: 2289378 - protein, 18 aa, Cryptosporidium parvum
CFTEFAVSEYRLAREESN

SEQ ID NO: 2289379 - protein, 30 aa, Cryptosporidium parvum
CFVAWNKCSVCLWNRSSYEYHILQECSNSN

SEQ ID NO: 2289380 - protein, 18 aa, Cryptosporidium parvum
CFYDTFRVKKIEKEGMIS

SEQ ID NO: 2289381 - protein, 34 aa, Cryptosporidium parvum
CFYVELNPLLKIEFLIRFLLNMKRELESGKQIKC

SEQ ID NO: 2289382 - protein, 20 aa, Cryptosporidium parvum
CGAKSVVLASHLGRPDGQRK

SEQ ID NO: 2289383 - protein, 22 aa, Cryptosporidium parvum
CGASCCWHYGVDNTFVLRAKTR

SEQ ID NO: 2289384 - protein, 24 aa, Cryptosporidium parvum
CGDAFKGGLIYGISNSYPLDASIY

SEQ ID NO: 2289385 - protein, 21 aa, Cryptosporidium parvum
CGDIDEIYCTSTINTEVTPFY

SEQ ID NO: 2289386 - protein, 29 aa, Cryptosporidium parvum
CGDLCRRCNSMAGTFCYMAPEILKGERQT

SEQ ID NO: 2289387 - protein, 25 aa, Cryptosporidium parvum
CGDTIELFLDFPIDLQKSVLKELHS

SEQ ID NO: 2289388 - protein, 25 aa, Cryptosporidium parvum
CGEDKVVCIWRCSNWDPIKSFDDIH

SEQ ID NO: 2289389 - protein, 20 aa, Cryptosporidium parvum
CGETYCQECIINFIRNHMDA

SEQ ID NO: 2289390 - protein, 19 aa, Cryptosporidium parvum
CGGVSKILMSIHPDLNIDT

SEQ ID NO: 2289391 - protein, 17 aa, Cryptosporidium parvum
CGHLLIGAYRAHPNIPI

SEQ ID NO: 2289392 - protein, 22 aa, Cryptosporidium parvum
CGHVFHKQCIDAWLSKCDSNKN

SEQ ID NO: 2289393 - protein, 22 aa, Cryptosporidium parvum
CGILDWYCILNRIYIAGQTLGY

SEQ ID NO: 2289394 - protein, 17 aa, Cryptosporidium parvum
CGKKVKWFSMDNLEEQK

SEQ ID NO: 2289395 - protein, 18 aa, Cryptosporidium parvum
CGKSGGSEEVKRYMYVEG

SEQ ID NO: 2289396 - protein, 26 aa, Cryptosporidium parvum
CGLHPAEGPVIWSEYRRFLSHQNEEN

SEQ ID NO: 2289397 - protein, 19 aa, Cryptosporidium parvum
CGLSAGLGMGGIMDVGYNQ

SEQ ID NO: 2289398 - protein, 18 aa, Cryptosporidium parvum
CGNFSPLPAESLKLKNGD

SEQ ID NO: 2289399 - protein, 21 aa, Cryptosporidium parvum
CGNGVEYLNELSLKFRETIGK

SEQ ID NO: 2289400 - protein, 17 aa, Cryptosporidium parvum
CGNQIGMEFWKQLCTEH

SEQ ID NO: 2289401 - protein, 24 aa, Cryptosporidium parvum
CGPHAEYHIKWCSKVSSIKFLSQN

SEQ ID NO: 2289402 - protein, 29 aa, Cryptosporidium parvum
CGPVYKLPRFKKIDAFTCNYKFFPERSIE

SEQ ID NO: 2289403 - protein, 19 aa, Cryptosporidium parvum
CGQLGFGNLEDCLVPRVNL

SEQ ID NO: 2289404 - protein, 17 aa, Cryptosporidium parvum
CGQRFRGSVPNKSLANM

SEQ ID NO: 2289405 - protein, 25 aa, Cryptosporidium parvum
CGRAGRTGYAITFFTLRDIPKIKSI

SEQ ID NO: 2289406 - protein, 18 aa, Cryptosporidium parvum
CGRQAPMFSKGSKIKDMI

SEQ ID NO: 2289407 - protein, 23 aa, Cryptosporidium parvum
CGSDCKLQYIGLIDPQNYPKKEV

SEQ ID NO: 2289408 - protein, 20 aa, Cryptosporidium parvum
CGSFLESRRLIFISQTVMCI

SEQ ID NO: 2289409 - protein, 18 aa, Cryptosporidium parvum
CGSINRITIMNDKRTGMP

SEQ ID NO: 2289410 - protein, 18 aa, Cryptosporidium parvum
CGTIHDILGQTNCPMDIS

SEQ ID NO: 2289411 - protein, 17 aa, Cryptosporidium parvum
CGVFTCMFAECISEGRS

SEQ ID NO: 2289412 - protein, 18 aa, Cryptosporidium parvum
CGVLPYLVKCMSSEIDGL

SEQ ID NO: 2289413 - protein, 22 aa, Cryptosporidium parvum
CHDRKHCPGLPPLHRFVQSSGI

SEQ ID NO: 2289414 - protein, 18 aa, Cryptosporidium parvum
CHGGHLLDKLNVFIDDST

SEQ ID NO: 2289415 - protein, 28 aa, Cryptosporidium parvum
CHHIFHANCLLPWLNQHNSCPVCRFELP

SEQ ID NO: 2289416 - protein, 30 aa, Cryptosporidium parvum
CHKAIEMYCCYNLFQCAWLISNLYLGNNHE

SEQ ID NO: 2289417 - protein, 17 aa, Cryptosporidium parvum
CHKSLINYMILRKNAEI

SEQ ID NO: 2289418 - protein, 19 aa, Cryptosporidium parvum
CHLFYKFKVYMNDLVNSFT

SEQ ID NO: 2289419 - protein, 17 aa, Cryptosporidium parvum
CHNLALQVGRTVVNLRL

SEQ ID NO: 2289420 - protein, 17 aa, Cryptosporidium parvum
CHSEAYKLEIIKDLIDE

SEQ ID NO: 2289421 - protein, 24 aa, Cryptosporidium parvum
CHSKVSFLIDERYTILSAIDDTGS

SEQ ID NO: 2289422 - protein, 17 aa, Cryptosporidium parvum
CHVMRRVPSKFLLGEAS

SEQ ID NO: 2289423 - protein, 23 aa, Cryptosporidium parvum
CHVQYRLGNIDAFQLADGLQYIF

SEQ ID NO: 2289424 - protein, 17 aa, Cryptosporidium parvum
CHYLKWIPLNYILECDL

SEQ ID NO: 2289425 - protein, 20 aa, Cryptosporidium parvum
CIALELLTGKALFNGRNEID

SEQ ID NO: 2289426 - protein, 25 aa, Cryptosporidium parvum
CIAQKWLVGNECRVGIFSKREILPN

SEQ ID NO: 2289427 - protein, 18 aa, Cryptosporidium parvum
CICADARKLLSLSTPSLI

SEQ ID NO: 2289428 - protein, 26 aa, Cryptosporidium parvum
CICKSFNLIDFFSCILRICPPVLYLD

SEQ ID NO: 2289429 - protein, 17 aa, Cryptosporidium parvum
CIDAWLSKCDSNKNSNI

SEQ ID NO: 2289430 - protein, 26 aa, Cryptosporidium parvum
CIDDEPKKGFGWEICVYNEDMGKNQT

SEQ ID NO: 2289431 - protein, 38 aa, Cryptosporidium parvum
CIDFYYKYKYTLGFKRILRLVYYFKGNHNKNQINMNHH

SEQ ID NO: 2289432 - protein, 26 aa, Cryptosporidium parvum
CIDNPLCKICDPFFIGYSDLLNLQVS

SEQ ID NO: 2289433 - protein, 17 aa, Cryptosporidium parvum
CIDSGYNQIALKSLFKE

SEQ ID NO: 2289434 - protein, 22 aa, Cryptosporidium parvum
CIELKKLVYLYIINYAKVQPEL

SEQ ID NO: 2289435 - protein, 19 aa, Cryptosporidium parvum
CIKSFSGHNDRIWTLNLLK

SEQ ID NO: 2289436 - protein, 20 aa, Cryptosporidium parvum
CILLSSRLGRCIPANPIALV

SEQ ID NO: 2289437 - protein, 28 aa, Cryptosporidium parvum
CILYSKRFFPYYSFCLLSGLDEQGKGVV

SEQ ID NO: 2289438 - protein, 20 aa, Cryptosporidium parvum
CIMAIKSLNGYELRGRSIRV

SEQ ID NO: 2289439 - protein, 21 aa, Cryptosporidium parvum
CINCHDCPKCMATISTNKLDL

SEQ ID NO: 2289440 - protein, 17 aa, Cryptosporidium parvum
CINCRRGDLLAKELGFN

SEQ ID NO: 2289441 - protein, 22 aa, Cryptosporidium parvum
CINFENCFLKPPISQGILSGNQ

SEQ ID NO: 2289442 - protein, 23 aa, Cryptosporidium parvum
CINGLRPALFEADFDNWNEVNAA

SEQ ID NO: 2289443 - protein, 25 aa, Cryptosporidium parvum
CINILWLETIIYTWISPLKININNP

SEQ ID NO: 2289444 - protein, 19 aa, Cryptosporidium parvum
CINLKYRNKDFIIIENLIE

SEQ ID NO: 2289445 - protein, 18 aa, Cryptosporidium parvum
CINVCSRLPSNGSGNPEI

SEQ ID NO: 2289446 - protein, 18 aa, Cryptosporidium parvum
CIPFSGAIRDILRQFHPP

SEQ ID NO: 2289447 - protein, 31 aa, Cryptosporidium parvum; identical to SEQ ID NO: 2168714

SEQ ID NO: 2289448 - protein, 24 aa, Cryptosporidium parvum
CIPSDFDSTLGLMYGMLASKIINS

SEQ ID NO: 2289449 - protein, 20 aa, Cryptosporidium parvum
CIPYCPIKLISFVLALSSDI

SEQ ID NO: 2289450 - protein, 20 aa, Cryptosporidium parvum
CIRERRGYCDFELDELREDD

SEQ ID NO: 2289451 - protein, 17 aa, Cryptosporidium parvum
CIRHLRKNQNFLIPQEA

SEQ ID NO: 2289452 - protein, 19 aa, Cryptosporidium parvum
CIRMAIHLFHDYFYCQIKQ

SEQ ID NO: 2289453 - protein, 17 aa, Cryptosporidium parvum
CIRQCTIKDLSSGIYQK

SEQ ID NO: 2289454 - protein, 20 aa, Cryptosporidium parvum
CISCISFCQNMNWSNMQIVF

SEQ ID NO: 2289455 - protein, 25 aa, Cryptosporidium parvum
CISILTGDWYIQWYLNNYKDDIKDN

SEQ ID NO: 2289456 - protein, 18 aa, Cryptosporidium parvum
CISTGGTCEGIFFGPSSV

SEQ ID NO: 2289457 - protein, 20 aa, Cryptosporidium parvum
CITCKMKKNCTGKLRDHIKI

SEQ ID NO: 2289458 - protein, 23 aa, Cryptosporidium parvum
CITEIPLDRWPFDLYYDPDPDNR

SEQ ID NO: 2289459 - protein, 24 aa, Cryptosporidium parvum
CITIKSTGISLFFEHDLEDGKGRQ

SEQ ID NO: 2289460 - protein, 19 aa, Cryptosporidium parvum
CIYDALCVVRNLIRDSRVV

SEQ ID NO: 2289461 - protein, 20 aa, Cryptosporidium parvum
CKCSSEWSTIIIYTCSKDCN

SEQ ID NO: 2289462 - protein, 17 aa, Cryptosporidium parvum
CKDEHPESIIFNQNAIK

SEQ ID NO: 2289463 - protein, 21 aa, Cryptosporidium parvum
CKDIIATGCNVVFTEKGVSDL

SEQ ID NO: 2289464 - protein, 25 aa, Cryptosporidium parvum
CKDNIFVDNIFLFWLSRSSSIIKIG

SEQ ID NO: 2289465 - protein, 19 aa, Cryptosporidium parvum
CKDPYEIIDPAIIGTKNVI

SEQ ID NO: 2289466 - protein, 21 aa, Cryptosporidium parvum
CKEGRIYVLVNIAAKSSSRTS

SEQ ID NO: 2289467 - protein, 19 aa, Cryptosporidium parvum
CKEIESWKNRFHNLESTAG

SEQ ID NO: 2289468 - protein, 17 aa, Cryptosporidium parvum
CKEIEYYGFLGEFYSPS

SEQ ID NO: 2289469 - protein, 24 aa, Cryptosporidium parvum
CKELCIACESLGWKTPTEIQKKTI

SEQ ID NO: 2289470 - protein, 24 aa, Cryptosporidium parvum
CKELWRRCEAKGDIYLGKYNGWYN

SEQ ID NO: 2289471 - protein, 19 aa, Cryptosporidium parvum
CKFCPHQTCNFSLKSTFFM

SEQ ID NO: 2289472 - protein, 18 aa, Cryptosporidium parvum
CKFFHTIFKTVKRYLNQT

SEQ ID NO: 2289473 - protein, 26 aa, Cryptosporidium parvum
CKFTTSICSYGNYFILIDFKEKQQDF

SEQ ID NO: 2289474 - protein, 17 aa, Cryptosporidium parvum
CKGARMVQIATINQDGT

SEQ ID NO: 2289475 - protein, 26 aa, Cryptosporidium parvum
CKGFWRRESSQWSFVTLERVQFIGAC

SEQ ID NO: 2289476 - protein, 19 aa, Cryptosporidium parvum
CKGLDLVRRDWSILTRNVS

SEQ ID NO: 2289477 - protein, 20 aa, Cryptosporidium parvum
CKGRTNWRSLFLEFQSTQDR

SEQ ID NO: 2289478 - protein, 21 aa, Cryptosporidium parvum
CKHGFHIKCIKEYIEQAPQED

SEQ ID NO: 2289479 - protein, 26 aa, Cryptosporidium parvum
CKICNRPCTMFRWKLHNSKKYNQTTI

SEQ ID NO: 2289480 - protein, 21 aa, Cryptosporidium parvum
CKIGDGVRLKDCVIFDNTNIN

SEQ ID NO: 2289481 - protein, 24 aa, Cryptosporidium parvum
CKIMKRSIFLSVDMAHSIHPNYPE

SEQ ID NO: 2289482 - protein, 19 aa, Cryptosporidium parvum
CKIYVWSFQTGKLVDKLSG

SEQ ID NO: 2289483 - protein, 22 aa, Cryptosporidium parvum
CKKALKNTLKIAADANEISMYS

SEQ ID NO: 2289484 - protein, 20 aa, Cryptosporidium parvum
CKKCGSTLFTTDHIIKHGKL

SEQ ID NO: 2289485 - protein, 21 aa, Cryptosporidium parvum
CKKCIICREYIHDKCGYYYKN

SEQ ID NO: 2289486 - protein, 21 aa, Cryptosporidium parvum
CKKKRIECAESNLITEKKVDL

SEQ ID NO: 2289487 - protein, 19 aa, Cryptosporidium parvum
CKKYAFKRFLLTLEKVEAK

SEQ ID NO: 2289488 - protein, 18 aa, Cryptosporidium parvum
CKLIEGFGMSECIGTLGT

SEQ ID NO: 2289489 - protein, 17 aa, Cryptosporidium parvum
CKLKWVESLYNFLNITE

SEQ ID NO: 2289490 - protein, 20 aa, Cryptosporidium parvum
CKLLINGIWRNIFVDSLIPI

SEQ ID NO: 2289491 - protein, 19 aa, Cryptosporidium parvum
CKLREEFPNVPIIALTATA

SEQ ID NO: 2289492 - protein, 25 aa, Cryptosporidium parvum
CKLSECSNCELVICNLCGNYNYGNN

SEQ ID NO: 2289493 - protein, 19 aa, Cryptosporidium parvum
CKMEILPYMIGALYSGQPN

SEQ ID NO: 2289494 - protein, 18 aa, Cryptosporidium parvum
CKMHKILIFTQFQLILDE

SEQ ID NO: 2289495 - protein, 17 aa, Cryptosporidium parvum
CKMIAGRIIPAMATTTA

SEQ ID NO: 2289496 - protein, 17 aa, Cryptosporidium parvum
CKNEKYPERLIYSYLRE

SEQ ID NO: 2289497 - protein, 17 aa, Cryptosporidium parvum
CKNHHLVSDKLGWFEDN

SEQ ID NO: 2289498 - protein, 22 aa, Cryptosporidium parvum
CKPCRTYINPFVRWEAGGRRWI

SEQ ID NO: 2289499 - protein, 17 aa, Cryptosporidium parvum
CKQEIRQQTQWKILQES

SEQ ID NO: 2289500 - protein, 20 aa, Cryptosporidium parvum
CKQKFGINGEAIWERINDAF

SEQ ID NO: 2289501 - protein, 37 aa, Cryptosporidium parvum; identical to SEQ ID NO: 2168758

SEQ ID NO: 2289502 - protein, 22 aa, Cryptosporidium parvum
CKSELSKRFLLERRITNNSDIG

SEQ ID NO: 2289503 - protein, 18 aa, Cryptosporidium parvum
CKSETCCSKNKKKKRSAP

SEQ ID NO: 2289504 - protein, 19 aa, Cryptosporidium parvum
CKSIGWLELAEIILNINNH

SEQ ID NO: 2289505 - protein, 19 aa, Cryptosporidium parvum
CKSNHRISNKTSLRLPCSS

SEQ ID NO: 2289506 - protein, 19 aa, Cryptosporidium parvum
CKSSKCEIFNVIIGKHTSL

SEQ ID NO: 2289507 - protein, 19 aa, Cryptosporidium parvum
CKSTENCSKNASSSSSVLN

SEQ ID NO: 2289508 - protein, 24 aa, Cryptosporidium parvum
CKTGLKISDDFSFYSCKIMLDILH

SEQ ID NO: 2289509 - protein, 17 aa, Cryptosporidium parvum
CKVYFPTQLRLIDNYAS

SEQ ID NO: 2289510 - protein, 18 aa, Cryptosporidium parvum
CKYIIRQILESVNHLHCL

SEQ ID NO: 2289511 - protein, 18 aa, Cryptosporidium parvum
CLAEKLLPFQEGDYVMFR

SEQ ID NO: 2289512 - protein, 22 aa, Cryptosporidium parvum
CLALSYYFIEWLHEYMRNKFSK

SEQ ID NO: 2289513 - protein, 30 aa, Cryptosporidium parvum
CLCGVDIGKSSLWKSLAIYLIGALEIETTD

SEQ ID NO: 2289514 - protein, 20 aa, Cryptosporidium parvum
CLDKRYRPFIIQFVIFNSKI

SEQ ID NO: 2289515 - protein, 18 aa, Cryptosporidium parvum
CLDSFSGDTSHVIHNFLQ

SEQ ID NO: 2289516 - protein, 17 aa, Cryptosporidium parvum
CLEFWDFLSNTLQKSSD

SEQ ID NO: 2289517 - protein, 17 aa, Cryptosporidium parvum
CLELKVSNFDAYNFNPR

SEQ ID NO: 2289518 - protein, 19 aa, Cryptosporidium parvum
CLFDYIPKLVLLLRSHETL

SEQ ID NO: 2289519 - protein, 19 aa, Cryptosporidium parvum
CLGPHPKSSGLIFSPIKRS

SEQ ID NO: 2289520 - protein, 18 aa, Cryptosporidium parvum
CLHRFCGECIEKCVRIGL

SEQ ID NO: 2289521 - protein, 17 aa, Cryptosporidium parvum
CLIILTCKCTNTKGNEY

SEQ ID NO: 2289522 - protein, 17 aa, Cryptosporidium parvum
CLIKDRYIQSGVPSEDG

SEQ ID NO: 2289523 - protein, 23 aa, Cryptosporidium parvum
CLIKEIRKSKDFFLNLLQDKNLI

SEQ ID NO: 2289524 - protein, 17 aa, Cryptosporidium parvum
CLINLEITFTVSKTTSD

SEQ ID NO: 2289525 - protein, 23 aa, Cryptosporidium parvum
CLISQCVFIKNSLKYYLNTEYLE

SEQ ID NO: 2289526 - protein, 20 aa, Cryptosporidium parvum
CLKSDLTYNIGMLYQPSNNS

SEQ ID NO: 2289527 - protein, 26 aa, Cryptosporidium parvum
CLLDMKSKFGSLVEFTRPIKLGKENL

SEQ ID NO: 2289528 - protein, 20 aa, Cryptosporidium parvum
CLLEELSFSSLQHFLLSNTR

SEQ ID NO: 2289529 - protein, 20 aa, Cryptosporidium parvum
CLLFEDISCVTELFSSLSEI

SEQ ID NO: 2289530 - protein, 17 aa, Cryptosporidium parvum
CLLFGGYDGNCWKSDTY

SEQ ID NO: 2289531 - protein, 17 aa, Cryptosporidium parvum
CLMNSKIPNSSCLKYNV

SEQ ID NO: 2289532 - protein, 25 aa, Cryptosporidium parvum
CLNHEKIVRYYHAWVQESVDGNSRC

SEQ ID NO: 2289533 - protein, 18 aa, Cryptosporidium parvum
CLSIFCSRFKAPICSTCG

SEQ ID NO: 2289534 - protein, 23 aa, Cryptosporidium parvum
CLSLKRLRNLLDMNNNWTCEEIE

SEQ ID NO: 2289535 - protein, 21 aa, Cryptosporidium parvum
CLTQFKWINTQGMLQIIKNYT

SEQ ID NO: 2289536 - protein, 25 aa, Cryptosporidium parvum
CLVIKETWRSLYVYPRESMPNHPDP

SEQ ID NO: 2289537 - protein, 17 aa, Cryptosporidium parvum
CLVMEYMEFGTLSDILY

SEQ ID NO: 2289538 - protein, 19 aa, Cryptosporidium parvum
CLYDTLTFTLVSTVQLTNS

SEQ ID NO: 2289539 - protein, 17 aa, Cryptosporidium parvum
CMENCLSEGISPPRELL

SEQ ID NO: 2289540 - protein, 19 aa, Cryptosporidium parvum
CMLFITLKFQDIFTKKNSE

SEQ ID NO: 2289541 - protein, 17 aa, Cryptosporidium parvum
CNAKIEIIGLFSATNII

SEQ ID NO: 2289542 - protein, 25 aa, Cryptosporidium parvum
CNAYKPLLKLISSWERFCNYTLLKR

SEQ ID NO: 2289543 - protein, 20 aa, Cryptosporidium parvum
CNCERCLRNQQIRKIKNYLK

SEQ ID NO: 2289544 - protein, 19 aa, Cryptosporidium parvum
CNCNCFELNSPLKLIDFGL

SEQ ID NO: 2289545 - protein, 24 aa, Cryptosporidium parvum
CNDKKYRICTYVDKTLWYEYNSFN

SEQ ID NO: 2289546 - protein, 25 aa, Cryptosporidium parvum
CNELKKRYNQLVLRFEEAIEQKESF

SEQ ID NO: 2289547 - protein, 17 aa, Cryptosporidium parvum
CNEQRKAKRRSFSRSLS

SEQ ID NO: 2289548 - protein, 17 aa, Cryptosporidium parvum
CNEQYYPSILMITNSKL

SEQ ID NO: 2289549 - protein, 26 aa, Cryptosporidium parvum
CNFDDLIKFLHRLGLSPTEDQCNELK

SEQ ID NO: 2289550 - protein, 32 aa, Cryptosporidium parvum
CNFGMGKSIGGKGLGMKLTLSGNVSSVKPIMI

SEQ ID NO: 2289551 - protein, 19 aa, Cryptosporidium parvum
CNFKEALADLRLMFNDGRA

SEQ ID NO: 2289552 - protein, 24 aa, Cryptosporidium parvum
CNFKEKLCRTCQYSSLKNIDLYIE

SEQ ID NO: 2289553 - protein, 20 aa, Cryptosporidium parvum
CNFLKCYHPICMRFFHTQCL

SEQ ID NO: 2289554 - protein, 33 aa, Cryptosporidium parvum; identical to SEQ ID NO: 2168801

SEQ ID NO: 2289555 - protein, 26 aa, Cryptosporidium parvum
CNIHKEMLQGLSVIFGMIPDFNIFKV

SEQ ID NO: 2289556 - protein, 19 aa, Cryptosporidium parvum
CNILNYLIDGVWRQQQYRL

SEQ ID NO: 2289557 - protein, 24 aa, Cryptosporidium parvum
CNIPDFGSLLLRRLINQFRISYSK

SEQ ID NO: 2289558 - protein, 21 aa, Cryptosporidium parvum
CNITRRRNLPVPKTSAKFSLL

SEQ ID NO: 2289559 - protein, 24 aa, Cryptosporidium parvum
CNLGNCKGFLSRNNEIIKFHNENF

SEQ ID NO: 2289560 - protein, 25 aa, Cryptosporidium parvum
CNLKFKCIGIAPLEVLSDSTIKQDK

SEQ ID NO: 2289561 - protein, 23 aa, Cryptosporidium parvum
CNMPLRIKNVRTWFHGSLYIQSG

SEQ ID NO: 2289562 - protein, 18 aa, Cryptosporidium parvum
CNNIILLEARRHEELYMW

SEQ ID NO: 2289563 - protein, 21 aa, Cryptosporidium parvum
CNNNIKILEWDPPTIINEGLG

SEQ ID NO: 2289564 - protein, 19 aa, Cryptosporidium parvum
CNRGGYCPYSHSMEEVIYH

SEQ ID NO: 2289565 - protein, 18 aa, Cryptosporidium parvum
CNRMYKNELDSFSGIGIV

SEQ ID NO: 2289566 - protein, 18 aa, Cryptosporidium parvum
CNRYEFLAWLQQIQKIDS

SEQ ID NO: 2289567 - protein, 25 aa, Cryptosporidium parvum
CNSHKKWKLYVFKYNYPHDVGKNDN

SEQ ID NO: 2289568 - protein, 25 aa, Cryptosporidium parvum
CNSLSILICRLIIYRHTEFENNIIE

SEQ ID NO: 2289569 - protein, 20 aa, Cryptosporidium parvum
CNSLYKLIFDPTSPKNYSKN

SEQ ID NO: 2289570 - protein, 38 aa, Cryptosporidium parvum
CNSPEIFKITYKIPFYWASLIANIYVFEKLRNYDIMLI

SEQ ID NO: 2289571 - protein, 22 aa, Cryptosporidium parvum
CNSPSCKGRIGIENFKETNQEL

SEQ ID NO: 2289572 - protein, 24 aa, Cryptosporidium parvum
CNTEFKLLLNETIPATYQESERKL

SEQ ID NO: 2289573 - protein, 17 aa, Cryptosporidium parvum
CNTYYCHLIHGLAERRE

SEQ ID NO: 2289574 - protein, 20 aa, Cryptosporidium parvum
CNVIPSLCCLVYPNESHLNL

SEQ ID NO: 2289575 - protein, 18 aa, Cryptosporidium parvum
CNVMKESIGILVHDPIDN

SEQ ID NO: 2289576 - protein, 19 aa, Cryptosporidium parvum
CNVVSSCRELLRICKILQE

SEQ ID NO: 2289577 - protein, 18 aa, Cryptosporidium parvum
CNWMELDKNLGLHSSKFA

SEQ ID NO: 2289578 - protein, 19 aa, Cryptosporidium parvum
CNYFSLTFEGVNLNEKNTS

SEQ ID NO: 2289579 - protein, 21 aa, Cryptosporidium parvum
CNYWLCAATDKCIRIWELEHK

SEQ ID NO: 2289580 - protein, 21 aa, Cryptosporidium parvum
CPCDCKGSMQFVHLQCLRTWL

SEQ ID NO: 2289581 - protein, 18 aa, Cryptosporidium parvum
CPDEKAIVAFGGESTILW

SEQ ID NO: 2289582 - protein, 18 aa, Cryptosporidium parvum
CPEEPIGSIDVIKSYNRQ

SEQ ID NO: 2289583 - protein, 26 aa, Cryptosporidium parvum
CPEPYYPKIFGFRVSDKLSIIERKGI

SEQ ID NO: 2289584 - protein, 29 aa, Cryptosporidium parvum
CPGQIQSILWYFRYVVRDFIQFLSQKLLE

SEQ ID NO: 2289585 - protein, 45 aa, Cryptosporidium parvum
CPGSDKMILSPRFLKCARGFLTSDYYFCATLCPQQKYADHESNFW

SEQ ID NO: 2289586 - protein, 18 aa, Cryptosporidium parvum
CPIINHWRLNERHYGALQ

SEQ ID NO: 2289587 - protein, 25 aa, Cryptosporidium parvum
CPIKEIDPIWLIELHPKIAKFSENS

SEQ ID NO: 2289588 - protein, 19 aa, Cryptosporidium parvum
CPKCKRKVTEIEDPNSINA

SEQ ID NO: 2289589 - protein, 18 aa, Cryptosporidium parvum
CPKFILRSFYTVTKFLLC

SEQ ID NO: 2289590 - protein, 20 aa, Cryptosporidium parvum
CPKLVPIACNNLFRATSFLE

SEQ ID NO: 2289591 - protein, 25 aa, Cryptosporidium parvum
CPKTSPPYPCRRSTTIFSDHEIEIT

SEQ ID NO: 2289592 - protein, 25 aa, Cryptosporidium parvum
CPLLHRSAFRLALLVVGISHSVLGK

SEQ ID NO: 2289593 - protein, 25 aa, Cryptosporidium parvum
CPMEMIHRRRHSLSYKPDIKKGVRK

SEQ ID NO: 2289594 - protein, 20 aa, Cryptosporidium parvum
CPNAFVICITNPLDAMVYYF

SEQ ID NO: 2289595 - protein, 26 aa, Cryptosporidium parvum
CPVDYLRLLLKNIIFIGGSSINSLLS

SEQ ID NO: 2289596 - protein, 19 aa, Cryptosporidium parvum
CPVVKKFKAQLLLVELLEQ

SEQ ID NO: 2289597 - protein, 24 aa, Cryptosporidium parvum
CPYGEVGTSYFSCLYPFRDISDIK

SEQ ID NO: 2289598 - protein, 30 aa, Cryptosporidium parvum
CQFHYDCYKALYFLLIAKRLIGESIERILF

SEQ ID NO: 2289599 - protein, 19 aa, Cryptosporidium parvum
CQFMKRFLGNLNIEKILNN

SEQ ID NO: 2289600 - protein, 24 aa, Cryptosporidium parvum
CQGIIPEYLANLFSSNELNDGKFE

SEQ ID NO: 2289601 - protein, 24 aa, Cryptosporidium parvum
CQHVRCITKLPQLLVLSCNIQSLK

SEQ ID NO: 2289602 - protein, 23 aa, Cryptosporidium parvum
CQIDPKGRFVICVDSSKEIHPKT

SEQ ID NO: 2289603 - protein, 33 aa, Cryptosporidium parvum
CQIFLEMWLRIKYKAFEYDKFCEIFNDWLSQLI

SEQ ID NO: 2289604 - protein, 25 aa, Cryptosporidium parvum
CQKGIISCLSLKTSGIGSFSVFASG

SEQ ID NO: 2289605 - protein, 25 aa, Cryptosporidium parvum
CQLAFSCTPEIPKYQVLIIALKIQC

SEQ ID NO: 2289606 - protein, 28 aa, Cryptosporidium parvum
CQLESRELLALCLKKIKGLNTVRLVDAS

SEQ ID NO: 2289607 - protein, 17 aa, Cryptosporidium parvum
CQLHHFYGPGCKARSSA

SEQ ID NO: 2289608 - protein, 17 aa, Cryptosporidium parvum
CQLLFIECELWRLHPAE

SEQ ID NO: 2289609 - protein, 23 aa, Cryptosporidium parvum
CQMEMFPSLYFINVKRPKFVEFF

SEQ ID NO: 2289610 - protein, 18 aa, Cryptosporidium parvum
CQPFKQIFKMIALSSTYS

SEQ ID NO: 2289611 - protein, 17 aa, Cryptosporidium parvum
CQPISSFGLGIPIQVKT

SEQ ID NO: 2289612 - protein, 27 aa, Cryptosporidium parvum
CQSCVSDLNFGLSLYARDDYIKSKKEQ

SEQ ID NO: 2289613 - protein, 17 aa, Cryptosporidium parvum
CQSDWDLRNLIQKEGQF

SEQ ID NO: 2289614 - protein, 17 aa, Cryptosporidium parvum
CQSYKGTFDPVYGDTLS

SEQ ID NO: 2289615 - protein, 25 aa, Cryptosporidium parvum
CRAVFREVSELLLVGNPFIKKRALL

SEQ ID NO: 2289616 - protein, 22 aa, Cryptosporidium parvum
CRDALTRRSLGYAYVNYNSVAD

SEQ ID NO: 2289617 - protein, 20 aa, Cryptosporidium parvum
CREDLEIPSSIELLIQRSLQ

SEQ ID NO: 2289618 - protein, 23 aa, Cryptosporidium parvum
CREIKRDFCDGIQYKDSIISSRI

SEQ ID NO: 2289619 - protein, 22 aa, Cryptosporidium parvum
CRHIFPLQHVFIRKVKVLSKPS

SEQ ID NO: 2289620 - protein, 17 aa, Cryptosporidium parvum
CRHSLKIEDMMTKSFKE

SEQ ID NO: 2289621 - protein, 26 aa, Cryptosporidium parvum
CRIIGALKFEISILKLYISLNSQNYW

SEQ ID NO: 2289622 - protein, 19 aa, Cryptosporidium parvum
CRKFMQNPVEIFVDDETKL

SEQ ID NO: 2289623 - protein, 19 aa, Cryptosporidium parvum
CRKSLNLIVVNPGMVIGPS

SEQ ID NO: 2289624 - protein, 17 aa, Cryptosporidium parvum
CRLKREMERLIRSNTRY

SEQ ID NO: 2289625 - protein, 17 aa, Cryptosporidium parvum
CRLLCIHGAGGSDQIFV

SEQ ID NO: 2289626 - protein, 17 aa, Cryptosporidium parvum
CRLNSSGLYSYNSNDQS

SEQ ID NO: 2289627 - protein, 18 aa, Cryptosporidium parvum
CRLYLSIKGTRKYHPENI

SEQ ID NO: 2289628 - protein, 19 aa, Cryptosporidium parvum
CRMMLETIKKLAFKNTSSN

SEQ ID NO: 2289629 - protein, 17 aa, Cryptosporidium parvum
CRNGFPLEISLNGSVEE

SEQ ID NO: 2289630 - protein, 17 aa, Cryptosporidium parvum
CRNTISIQIIYPKNQLS

SEQ ID NO: 2289631 - protein, 18 aa, Cryptosporidium parvum
CRPSVMWETKRNKPNTRQ

SEQ ID NO: 2289632 - protein, 22 aa, Cryptosporidium parvum
CRTARFGTAMVHNGLLKLKLSK

SEQ ID NO: 2289633 - protein, 24 aa, Cryptosporidium parvum
CSAAWKLYEIDGGIGIFESPTGTG

SEQ ID NO: 2289634 - protein, 22 aa, Cryptosporidium parvum
CSCIGKIPSIIFVFHKNGVLVI

SEQ ID NO: 2289635 - protein, 26 aa, Cryptosporidium parvum
CSCKPERIFILAGGFASLSPRYEGCI

SEQ ID NO: 2289636 - protein, 18 aa, Cryptosporidium parvum
CSCLCSCTEKSSSNGSCS

SEQ ID NO: 2289637 - protein, 20 aa, Cryptosporidium parvum
CSCLLGIGFDAYVCKGTIEN

SEQ ID NO: 2289638 - protein, 19 aa, Cryptosporidium parvum
CSEAAPIDIADVYRDMEEL

SEQ ID NO: 2289639 - protein, 24 aa, Cryptosporidium parvum
CSEANFSFVLKLFISIVGSCVDML

SEQ ID NO: 2289640 - protein, 19 aa, Cryptosporidium parvum
CSEIPKGRYILQVESCDTV

SEQ ID NO: 2289641 - protein, 22 aa, Cryptosporidium parvum
CSEKSLLGIIAFSISKSFKSLN

SEQ ID NO: 2289642 - protein, 19 aa, Cryptosporidium parvum
CSENEIFNDKLVREFSESS

SEQ ID NO: 2289643 - protein, 23 aa, Cryptosporidium parvum
CSESHAAYTYCCVVSLALLNSLD

SEQ ID NO: 2289644 - protein, 25 aa, Cryptosporidium parvum
CSETTYKLLLSIFFIFINIELKFRN

SEQ ID NO: 2289645 - protein, 20 aa, Cryptosporidium parvum
CSFCGHARSCHYSYFNKLII

SEQ ID NO: 2289646 - protein, 17 aa, Cryptosporidium parvum
CSFKKPSTILGTAFCPL

SEQ ID NO: 2289647 - protein, 28 aa, Cryptosporidium parvum
CSHIKRRNRYGITRGRKHLAYSGDYSTC

SEQ ID NO: 2289648 - protein, 17 aa, Cryptosporidium parvum
CSHKFRITSKLSHNNSE

SEQ ID NO: 2289649 - protein, 22 aa, Cryptosporidium parvum
CSIDRLPCFSVENSLINNYLMN

SEQ ID NO: 2289650 - protein, 21 aa, Cryptosporidium parvum
CSIGGHTPVWVYNLHDLGQGK

SEQ ID NO: 2289651 - protein, 17 aa, Cryptosporidium parvum
CSILTLPSGMDIDEITS

SEQ ID NO: 2289652 - protein, 22 aa, Cryptosporidium parvum
CSINTIKVGTLWDGNKIEDLIF

SEQ ID NO: 2289653 - protein, 23 aa, Cryptosporidium parvum
CSISKGSILWVRNFRVITKEFGD

SEQ ID NO: 2289654 - protein, 18 aa, Cryptosporidium parvum
CSKKRNLLSLKFVSSHNI

SEQ ID NO: 2289655 - protein, 20 aa, Cryptosporidium parvum
CSKPRLAKLYVNSPLVDFGE

SEQ ID NO: 2289656 - protein, 25 aa, Cryptosporidium parvum
CSKTRRELLSNWLFYCQCERCNNPT

SEQ ID NO: 2289657 - protein, 21 aa, Cryptosporidium parvum
CSLCQSIELNERLIVKATLII

SEQ ID NO: 2289658 - protein, 17 aa, Cryptosporidium parvum
CSLFGEAFVDKSLREEE

SEQ ID NO: 2289659 - protein, 18 aa, Cryptosporidium parvum
CSLIEALHNPSFYKISLY

SEQ ID NO: 2289660 - protein, 17 aa, Cryptosporidium parvum
CSLNARVAILASANPIS

SEQ ID NO: 2289661 - protein, 20 aa, Cryptosporidium parvum
CSLNNCQFLRIIPNECKIYN

SEQ ID NO: 2289662 - protein, 19 aa, Cryptosporidium parvum
CSLYPYTGIIWKELSRISA

SEQ ID NO: 2289663 - protein, 19 aa, Cryptosporidium parvum
CSNDREFEEAIKLNLGSYY

SEQ ID NO: 2289664 - protein, 19 aa, Cryptosporidium parvum
CSNECFVLAIIYVGRIIKF

SEQ ID NO: 2289665 - protein, 18 aa, Cryptosporidium parvum
CSNFPISHTNTGAVSSVI

SEQ ID NO: 2289666 - protein, 20 aa, Cryptosporidium parvum
CSNISLPLTKIVLQVHPEIQ

SEQ ID NO: 2289667 - protein, 18 aa, Cryptosporidium parvum
CSNLKWEKWYLTHHCTIY

SEQ ID NO: 2289668 - protein, 17 aa, Cryptosporidium parvum
CSNMSGYINNMVDSALK

SEQ ID NO: 2289669 - protein, 21 aa, Cryptosporidium parvum
CSPQLLKTFCETFDFTDLFND

SEQ ID NO: 2289670 - protein, 20 aa, Cryptosporidium parvum
CSRSLKFGQILSRSIFQQLN

SEQ ID NO: 2289671 - protein, 21 aa, Cryptosporidium parvum
CSSIEVCLVFGADIIFMQNWD

SEQ ID NO: 2289672 - protein, 25 aa, Cryptosporidium parvum
CSSRREALPYIPLLLPIGITVMAVD

SEQ ID NO: 2289673 - protein, 18 aa, Cryptosporidium parvum
CSTFESIYISATESNETF

SEQ ID NO: 2289674 - protein, 18 aa, Cryptosporidium parvum
CSTFKTFLNSEGLQEIGQ

SEQ ID NO: 2289675 - protein, 17 aa, Cryptosporidium parvum
CSTICKDELFKVNKKTL

SEQ ID NO: 2289676 - protein, 26 aa, Cryptosporidium parvum
CSTSIKSEQGFKIFSPNSEPSNINSI

SEQ ID NO: 2289677 - protein, 19 aa, Cryptosporidium parvum
CSVFGRFNAIIPEGMLSQN

SEQ ID NO: 2289678 - protein, 18 aa, Cryptosporidium parvum
CSVGRKNSIPRFRDSFKV

SEQ ID NO: 2289679 - protein, 26 aa, Cryptosporidium parvum
CSVHPNTCPFVFCRWECMVKYSRRHE

SEQ ID NO: 2289680 - protein, 20 aa, Cryptosporidium parvum
CSVKNSFLNMVTLWNSFTEA

SEQ ID NO: 2289681 - protein, 18 aa, Cryptosporidium parvum
CSVPFVNFFDGFRTSHEL

SEQ ID NO: 2289682 - protein, 23 aa, Cryptosporidium parvum
CSVSCCKKLIPLLESMKSVKFLI

SEQ ID NO: 2289683 - protein, 24 aa, Cryptosporidium parvum
CSYIGVCLEPGFYAIITEYLTNGN

SEQ ID NO: 2289684 - protein, 25 aa, Cryptosporidium parvum
CSYPLPLVICPQVFDYRESLSPGLE

SEQ ID NO: 2289685 - protein, 24 aa, Cryptosporidium parvum
CSYSEYRIYPGRGRKFVARDGRVS

SEQ ID NO: 2289686 - protein, 22 aa, Cryptosporidium parvum
CTAGIRPNCEVLVFIDVVNCVT

SEQ ID NO: 2289687 - protein, 27 aa, Cryptosporidium parvum
CTDACLLRYLRGYNLKVIKSFEALAKT

SEQ ID NO: 2289688 - protein, 17 aa, Cryptosporidium parvum
CTEAGMFALRERRKHVT

SEQ ID NO: 2289689 - protein, 23 aa, Cryptosporidium parvum
CTFHLSCRIFDTFLIETHVQYNN

SEQ ID NO: 2289690 - protein, 19 aa, Cryptosporidium parvum
CTFNPLKADEVVIFVQTEF

SEQ ID NO: 2289691 - protein, 18 aa, Cryptosporidium parvum
CTGGELFDRIIKRGHFSE

SEQ ID NO: 2289692 - protein, 21 aa, Cryptosporidium parvum
CTIAPCKSIQGGDPIPNAFAV

SEQ ID NO: 2289693 - protein, 25 aa, Cryptosporidium parvum
CTIECDRRKMSILLIKVKNRQVESF

SEQ ID NO: 2289694 - protein, 29 aa, Cryptosporidium parvum
CTLKTTPRPYLVWLLHDFNFLLYDTANNM

SEQ ID NO: 2289695 - protein, 28 aa, Cryptosporidium parvum
CTLPVNTLMPLVKWRPSSHFQNNQIELP

SEQ ID NO: 2289696 - protein, 23 aa, Cryptosporidium parvum
CTNNKYLTGTRFGPSIRQKTMMQ

SEQ ID NO: 2289697 - protein, 20 aa, Cryptosporidium parvum
CTPDLLELTQFIIFNSKSSF

SEQ ID NO: 2289698 - protein, 30 aa, Cryptosporidium parvum; identical to SEQ ID NO: 2168914

SEQ ID NO: 2289699 - protein, 18 aa, Cryptosporidium parvum
CTQPHPFMLPGKFQNSIH

SEQ ID NO: 2289700 - protein, 19 aa, Cryptosporidium parvum
CTRGNLCAFAHSVQELRPL

SEQ ID NO: 2289701 - protein, 21 aa, Cryptosporidium parvum
CTSCFDHWAIVPGNPLDRNIS

SEQ ID NO: 2289702 - protein, 24 aa, Cryptosporidium parvum
CTSISGCGPGYFSNIAHHFIQSGI

SEQ ID NO: 2289703 - protein, 20 aa, Cryptosporidium parvum
CTTQCRVIHPNLVHSVNQRW

SEQ ID NO: 2289704 - protein, 25 aa, Cryptosporidium parvum
CTTTTRSGRFVSLKYGYDDILMSDD

SEQ ID NO: 2289705 - protein, 25 aa, Cryptosporidium parvum
CTVYKVRHNECVAAVKCPQKRIHDS

SEQ ID NO: 2289706 - protein, 20 aa, Cryptosporidium parvum
CTYFPLRKLLIKSLLEKGEI

SEQ ID NO: 2289707 - protein, 20 aa, Cryptosporidium parvum
CVAHIEMGRLVTKVENPIVL

SEQ ID NO: 2289708 - protein, 23 aa, Cryptosporidium parvum
CVASETYDEFIFYEPTEKFYEKL

SEQ ID NO: 2289709 - protein, 21 aa, Cryptosporidium parvum
CVAVVKNLKMDIMKRDERKFG

SEQ ID NO: 2289710 - protein, 28 aa, Cryptosporidium parvum
CVCDFWEEIQIYWSINIHEIIKKPSFVQ

SEQ ID NO: 2289711 - protein, 25 aa, Cryptosporidium parvum
CVDSRGRWLSGLCDKDSFKEVMSDW

SEQ ID NO: 2289712 - protein, 26 aa, Cryptosporidium parvum
CVGKKFRPPEIFAGKPYIASKVDSWC

SEQ ID NO: 2289713 - protein, 19 aa, Cryptosporidium parvum
CVIMGKPIKIGTGSFDILY

SEQ ID NO: 2289714 - protein, 17 aa, Cryptosporidium parvum
CVINLPDKKTLCLMFND

SEQ ID NO: 2289715 - protein, 17 aa, Cryptosporidium parvum
CVINRLFDGKIFQVLEY

SEQ ID NO: 2289716 - protein, 17 aa, Cryptosporidium parvum
CVIYRKEEKEVIFESEI

SEQ ID NO: 2289717 - protein, 20 aa, Cryptosporidium parvum
CVKIGDLICAPQNNVKKIRV

SEQ ID NO: 2289718 - protein, 20 aa, Cryptosporidium parvum
CVLEGVSTIPVLKISGDDNI

SEQ ID NO: 2289719 - protein, 20 aa, Cryptosporidium parvum
CVPPETQLNVILDCNGGQTI

SEQ ID NO: 2289720 - protein, 26 aa, Cryptosporidium parvum
CVRPEEITRLYGLKPIRTLTLGTTKK

SEQ ID NO: 2289721 - protein, 19 aa, Cryptosporidium parvum
CVTAATLFSKWQIDNISYN

SEQ ID NO: 2289722 - protein, 18 aa, Cryptosporidium parvum
CVTHLLFASSKEKFREIE

SEQ ID NO: 2289723 - protein, 25 aa, Cryptosporidium parvum
CVTLSKPVYICLCADLVNEYIKRPE

SEQ ID NO: 2289724 - protein, 19 aa, Cryptosporidium parvum
CVTQFLRKSVAPFKLANMH

SEQ ID NO: 2289725 - protein, 17 aa, Cryptosporidium parvum
CVVGRNFGSYVTHETRH

SEQ ID NO: 2289726 - protein, 28 aa, Cryptosporidium parvum
CWDSPWGKGRPGWHIECSVMASNTLGFP

SEQ ID NO: 2289727 - protein, 23 aa, Cryptosporidium parvum
CYDKAENHFNLFLKSINRLFHFN

SEQ ID NO: 2289728 - protein, 23 aa, Cryptosporidium parvum
CYGYFPDQVILFILKNINREEIQ

SEQ ID NO: 2289729 - protein, 23 aa, Cryptosporidium parvum
CYHPPGTCQRAQIAHFYKKVIED

SEQ ID NO: 2289730 - protein, 26 aa, Cryptosporidium parvum
CYIEEAKLLLSLKLKYVKMLLSSSIN

SEQ ID NO: 2289731 - protein, 24 aa, Cryptosporidium parvum
CYKEKKFDEALGFYLKALGILELE

SEQ ID NO: 2289732 - protein, 17 aa, Cryptosporidium parvum
CYLDFAQRWVYQQDCNK

SEQ ID NO: 2289733 - protein, 19 aa, Cryptosporidium parvum
CYLLSIKICEYCNISYFHI

SEQ ID NO: 2289734 - protein, 25 aa, Cryptosporidium parvum
CYNEIYQGCMIFRGDNLMLCGLIDQ

SEQ ID NO: 2289735 - protein, 20 aa, Cryptosporidium parvum
CYPMAAGSIKKNGYCMLKGK

SEQ ID NO: 2289736 - protein, 18 aa, Cryptosporidium parvum
CYSAFHGICRECNIQTRR

SEQ ID NO: 2289737 - protein, 17 aa, Cryptosporidium parvum
CYSNLGLVYRLLGDCRQ

SEQ ID NO: 2289738 - protein, 29 aa, Cryptosporidium parvum
CYVCQKGGKLLGCDFCTYSYHPKCIETEV

SEQ ID NO: 2289739 - protein, 24 aa, Cryptosporidium parvum
DAASMPKYWHFIRLMGRQPSNEVL

SEQ ID NO: 2289740 - protein, 26 aa, Cryptosporidium parvum
DADITSRLGTWLLRIQLNNKLVTDKK

SEQ ID NO: 2289741 - protein, 30 aa, Cryptosporidium parvum
DAEKKFKTHILKRSKSIGVSKVKRATNTEL

SEQ ID NO: 2289742 - protein, 17 aa, Cryptosporidium parvum
DAELLLADMEFRDSDTP

SEQ ID NO: 2289743 - protein, 23 aa, Cryptosporidium parvum
DAEWKIIFEKLDLIANSGVNVVL

SEQ ID NO: 2289744 - protein, 17 aa, Cryptosporidium parvum
DAFNSIIIILAKLTDLI

SEQ ID NO: 2289745 - protein, 19 aa, Cryptosporidium parvum
DAGAIAGLNVMRIINEPTA

SEQ ID NO: 2289746 - protein, 22 aa, Cryptosporidium parvum
DAGKFKRLIAYEHKADMYHIVK

SEQ ID NO: 2289747 - protein, 22 aa, Cryptosporidium parvum
DAGVIPRLVHFLSDYDHPNLQF

SEQ ID NO: 2289748 - protein, 23 aa, Cryptosporidium parvum
DAIKKYFCNLGCSYLATRYKDTF

SEQ ID NO: 2289749 - protein, 18 aa, Cryptosporidium parvum
DAKLGYALGHFASIVVES

SEQ ID NO: 2289750 - protein, 27 aa, Cryptosporidium parvum
DAKYGLCIPTLYSVLLLTICHVHKLKD

SEQ ID NO: 2289751 - protein, 19 aa, Cryptosporidium parvum
DALISEFVIPSLASIIDSK

SEQ ID NO: 2289752 - protein, 20 aa, Cryptosporidium parvum
DALKAVVHIIDLYRSRRGIT

SEQ ID NO: 2289753 - protein, 20 aa, Cryptosporidium parvum
DALLRPGRIDRKIEFPNPNE

SEQ ID NO: 2289754 - protein, 24 aa, Cryptosporidium parvum
DALNEIKAELSLRNVNFNQNKYDF

SEQ ID NO: 2289755 - protein, 19 aa, Cryptosporidium parvum
DALTLAIEFENKCKEIKEV

SEQ ID NO: 2289756 - protein, 23 aa, Cryptosporidium parvum
DALVTCCTFFKLFKLHLNSQVDD

SEQ ID NO: 2289757 - protein, 20 aa, Cryptosporidium parvum
DAMSEWLNKSELGINKMEPK

SEQ ID NO: 2289758 - protein, 22 aa, Cryptosporidium parvum
DAPEILQPPVIFIAETNGDIIT

SEQ ID NO: 2289759 - protein, 19 aa, Cryptosporidium parvum
DAPRCVFPSIVGRPKMPGV

SEQ ID NO: 2289760 - protein, 23 aa, Cryptosporidium parvum
DARTLKYRCDVDCRNRRGKSSKG

SEQ ID NO: 2289761 - protein, 20 aa, Cryptosporidium parvum
DASHFKLQFMMDPSKYGGAF

SEQ ID NO: 2289762 - protein, 18 aa, Cryptosporidium parvum
DASPLSWMVDRNIYPISS

SEQ ID NO: 2289763 - protein, 18 aa, Cryptosporidium parvum
DATMPFFIQSLRDMTNRI

SEQ ID NO: 2289764 - protein, 24 aa, Cryptosporidium parvum
DAVIYKLVGSVMVKQSLDDAKSTV

SEQ ID NO: 2289765 - protein, 19 aa, Cryptosporidium parvum
DAVSPFIPSVHDPETQINS

SEQ ID NO: 2289766 - protein, 21 aa, Cryptosporidium parvum
DAVVYQSNFRPVPLREHIVIK

SEQ ID NO: 2289767 - protein, 19 aa, Cryptosporidium parvum
DAYFKLKHLISAVNNSILE

SEQ ID NO: 2289768 - protein, 27 aa, Cryptosporidium parvum
DCASICLQCLILYSSVRRSFFPTQADR

SEQ ID NO: 2289769 - protein, 26 aa, Cryptosporidium parvum
DCDARSQIFFGFREEFIYSLVKRKID

SEQ ID NO: 2289770 - protein, 17 aa, Cryptosporidium parvum
DCEFVYEFITDKYRYRV

SEQ ID NO: 2289771 - protein, 18 aa, Cryptosporidium parvum
DCESRNPTWLSLSFAVFI

SEQ ID NO: 2289772 - protein, 19 aa, Cryptosporidium parvum
DCFEYRKVISSNFFHENSN

SEQ ID NO: 2289773 - protein, 19 aa, Cryptosporidium parvum
DCFNYMYEKCVSKENKEKM

SEQ ID NO: 2289774 - protein, 27 aa, Cryptosporidium parvum
DCFTVTFEFLRRFYIATNVQIQIMDND

SEQ ID NO: 2289775 - protein, 23 aa, Cryptosporidium parvum
DCGMKGMEIDSKMMGEENTSSKI

SEQ ID NO: 2289776 - protein, 17 aa, Cryptosporidium parvum
DCIQCIKAGNSESSSVF

SEQ ID NO: 2289777 - protein, 22 aa, Cryptosporidium parvum
DCNRSGLPLGGIIIQSGIASGL

SEQ ID NO: 2289778 - protein, 19 aa, Cryptosporidium parvum
DCNTPLPAPPSPRYTTIKV

SEQ ID NO: 2289779 - protein, 20 aa, Cryptosporidium parvum
DCPIAFQAIIRYMYGHTSEV

SEQ ID NO: 2289780 - protein, 59 aa, Cryptosporidium parvum; identical to SEQ ID NO: 2168982

SEQ ID NO: 2289781 - protein, 24 aa, Cryptosporidium parvum
DDDDKFCICVQSIIGEIFELRTQL

SEQ ID NO: 2289782 - protein, 17 aa, Cryptosporidium parvum
DDDIFRVSCKFEVLDRM

SEQ ID NO: 2289783 - protein, 27 aa, Cryptosporidium parvum
DDDIQYIWRRNCPYLYDTMLSYTLEWP

SEQ ID NO: 2289784 - protein, 28 aa, Cryptosporidium parvum
DDDSWRFKLLKRRQISWSDISHPIIAPL

SEQ ID NO: 2289785 - protein, 22 aa, Cryptosporidium parvum
DDEFKLGIQLTKSGMNLYSSFD

SEQ ID NO: 2289786 - protein, 23 aa, Cryptosporidium parvum
DDEFWSKIYINGICHKLFGIPLL

SEQ ID NO: 2289787 - protein, 24 aa, Cryptosporidium parvum
DDEIPRFFKDIGYPITINKTTIIA

SEQ ID NO: 2289788 - protein, 25 aa, Cryptosporidium parvum
DDELDWKVVCIRVCDPHASQLNDIT

SEQ ID NO: 2289789 - protein, 17 aa, Cryptosporidium parvum
DDEMVIISCIYKCHCDI

SEQ ID NO: 2289790 - protein, 22 aa, Cryptosporidium parvum
DDESRLLLNDEVVLKYYLDYVR

SEQ ID NO: 2289791 - protein, 17 aa, Cryptosporidium parvum
DDESVLSLIYFRTKTEL

SEQ ID NO: 2289792 - protein, 20 aa, Cryptosporidium parvum
DDFDGLPSEEEELDDIDDEE

SEQ ID NO: 2289793 - protein, 18 aa, Cryptosporidium parvum
DDFLSNWWTQASVESCDF

SEQ ID NO: 2289794 - protein, 37 aa, Cryptosporidium parvum; identical to SEQ ID NO: 2168992

SEQ ID NO: 2289795 - protein, 27 aa, Cryptosporidium parvum
DDFSIKLICNFGYRPNCITWNEVNKYV

SEQ ID NO: 2289796 - protein, 22 aa, Cryptosporidium parvum
DDGAIFGMEGIFIVKSDPSTIM

SEQ ID NO: 2289797 - protein, 28 aa, Cryptosporidium parvum
DDGCVIPGAGAFEFRAYNALKEARKSAN

SEQ ID NO: 2289798 - protein, 19 aa, Cryptosporidium parvum
DDHKGIRGLYSFFQKENNW

SEQ ID NO: 2289799 - protein, 18 aa, Cryptosporidium parvum
DDICILHFNDVYNIEEDV

SEQ ID NO: 2289800 - protein, 33 aa, Cryptosporidium parvum; identical to SEQ ID NO: 2168999

SEQ ID NO: 2289801 - protein, 17 aa, Cryptosporidium parvum
DDIKPNTLFPWKYIQNT

SEQ ID NO: 2289802 - protein, 23 aa, Cryptosporidium parvum
DDILKYGFLDHWNEMKGIFETKL

SEQ ID NO: 2289803 - protein, 17 aa, Cryptosporidium parvum
DDIRLKVSHNIRFSDFP

SEQ ID NO: 2289804 - protein, 19 aa, Cryptosporidium parvum
DDISVLVAWVVHKDDFETL

SEQ ID NO: 2289805 - protein, 22 aa, Cryptosporidium parvum
DDITRVVLIDAYYSKNSKSAIT

SEQ ID NO: 2289806 - protein, 25 aa, Cryptosporidium parvum
DDIVRLLTCRKIQLREGEIMKHLSV

SEQ ID NO: 2289807 - protein, 23 aa, Cryptosporidium parvum
DDLCSKCFYIVRKSPDGIEEFED

SEQ ID NO: 2289808 - protein, 25 aa, Cryptosporidium parvum
DDLFYSFRISMGIFDSLISKDEEEK

SEQ ID NO: 2289809 - protein, 24 aa, Cryptosporidium parvum
DDLILDFFMEFAKELCVGIKENCS

SEQ ID NO: 2289810 - protein, 20 aa, Cryptosporidium parvum
DDLIYKFLFRKHDDSHLNTN

SEQ ID NO: 2289811 - protein, 17 aa, Cryptosporidium parvum
DDLLVSFYNSAKASTSV

SEQ ID NO: 2289812 - protein, 22 aa, Cryptosporidium parvum
DDLPKAYSLLLEKHLKLKSEFD

SEQ ID NO: 2289813 - protein, 19 aa, Cryptosporidium parvum
DDLQFEIDESISLNPTLPS

SEQ ID NO: 2289814 - protein, 19 aa, Cryptosporidium parvum
DDLRAQFELAVNKVRAYIE

SEQ ID NO: 2289815 - protein, 23 aa, Cryptosporidium parvum
DDLRDLFKLYGRVVNVSVIREKS

SEQ ID NO: 2289816 - protein, 21 aa, Cryptosporidium parvum
DDLRHAHVLLHIIDISGNTNE

SEQ ID NO: 2289817 - protein, 25 aa, Cryptosporidium parvum
DDLSSLKVLFRWFSISDQTNLAKNL

SEQ ID NO: 2289818 - protein, 17 aa, Cryptosporidium parvum
DDLTLKLQQIIKLNENL

SEQ ID NO: 2289819 - protein, 17 aa, Cryptosporidium parvum
DDNFILLIIDLIRELVQ

SEQ ID NO: 2289820 - protein, 23 aa, Cryptosporidium parvum
DDPDSCWNWFNRVFEYLPVGAII

SEQ ID NO: 2289821 - protein, 24 aa, Cryptosporidium parvum
DDPDVIEIWNLVFMQYYREVDSTL

SEQ ID NO: 2289822 - protein, 17 aa, Cryptosporidium parvum
DDPRMPTLSAVRRKGYP

SEQ ID NO: 2289823 - protein, 27 aa, Cryptosporidium parvum
DDRKVFPSYWFNLSWVYIEDRKANKLV

SEQ ID NO: 2289824 - protein, 35 aa, Cryptosporidium parvum
DDRNFHCWRHRSFVLCCLRYISVIISWNTFLEEMQ

SEQ ID NO: 2289825 - protein, 18 aa, Cryptosporidium parvum
DDRSIVMNLMEKKNIQKI

SEQ ID NO: 2289826 - protein, 22 aa, Cryptosporidium parvum
DDRVLYCINIHYLIQRKLGISM

SEQ ID NO: 2289827 - protein, 17 aa, Cryptosporidium parvum
DDSDCLIFGAKKIFRNF

SEQ ID NO: 2289828 - protein, 32 aa, Cryptosporidium parvum; identical to SEQ ID NO: 2169021

SEQ ID NO: 2289829 - protein, 18 aa, Cryptosporidium parvum
DDTLRGVLIKNLYSMDIK

SEQ ID NO: 2289830 - protein, 18 aa, Cryptosporidium parvum
DDVDIIISISARFDLANS

SEQ ID NO: 2289831 - protein, 23 aa, Cryptosporidium parvum
DDVIPPFIFVRAIADKWLHSETS

SEQ ID NO: 2289832 - protein, 18 aa, Cryptosporidium parvum
DDVLRALTLISNKIPFLF

SEQ ID NO: 2289833 - protein, 23 aa, Cryptosporidium parvum
DDYCEENDYLAFKRETYRGTFES

SEQ ID NO: 2289834 - protein, 17 aa, Cryptosporidium parvum
DDYCSRLSMKTLMRNSS

SEQ ID NO: 2289835 - protein, 19 aa, Cryptosporidium parvum
DDYIDAAVRQCLKIHCTNP

SEQ ID NO: 2289836 - protein, 22 aa, Cryptosporidium parvum
DDYKELFCAYGEVKKVSSNRKR

SEQ ID NO: 2289837 - protein, 17 aa, Cryptosporidium parvum
DDYKPDPTPAYNFSDEK

SEQ ID NO: 2289838 - protein, 21 aa, Cryptosporidium parvum
DDYPLNWTMSNCEVHPSEDLI

SEQ ID NO: 2289839 - protein, 18 aa, Cryptosporidium parvum
DDYRVCVSNGIIDNHGTN

SEQ ID NO: 2289840 - protein, 24 aa, Cryptosporidium parvum
DEADRLLDMGFRQECLEILKYSSR

SEQ ID NO: 2289841 - protein, 18 aa, Cryptosporidium parvum
DEALTYRIESAITAEREI

SEQ ID NO: 2289842 - protein, 33 aa, Cryptosporidium parvum
DEAQPFKNCKGILFAIQVCKAIMEGNYCRYFKL

SEQ ID NO: 2289843 - protein, 18 aa, Cryptosporidium parvum
DECDPIDLIVKFLDNPSK

SEQ ID NO: 2289844 - protein, 26 aa, Cryptosporidium parvum
DECSPPCSLPAPPGSDPFTISGFGPE

SEQ ID NO: 2289845 - protein, 18 aa, Cryptosporidium parvum
DEDDFWSESEINSDNLSS

SEQ ID NO: 2289846 - protein, 19 aa, Cryptosporidium parvum
DEDFIASGMAEYLAITLLR

SEQ ID NO: 2289847 - protein, 22 aa, Cryptosporidium parvum
DEDGKEVFAYFCRCGGLIFLEK

SEQ ID NO: 2289848 - protein, 26 aa, Cryptosporidium parvum
DEEGNNGFCFLQFSSPLTSYRALKWE

SEQ ID NO: 2289849 - protein, 24 aa, Cryptosporidium parvum
DEEPECSDVIIGHFEKVIRPYTRK

SEQ ID NO: 2289850 - protein, 17 aa, Cryptosporidium parvum
DEFCKDLNFNDYALYIE

SEQ ID NO: 2289851 - protein, 20 aa, Cryptosporidium parvum
DEFCQANLKLTTSEKNIKFR

SEQ ID NO: 2289852 - protein, 19 aa, Cryptosporidium parvum
DEFECFDDSMVMDPLNIKN

SEQ ID NO: 2289853 - protein, 24 aa, Cryptosporidium parvum
DEFKNPSSFLKIYGDPLCGKQPSN

SEQ ID NO: 2289854 - protein, 26 aa, Cryptosporidium parvum
DEFLHDWTLICTRIENGLKLGDQLRQ

SEQ ID NO: 2289855 - protein, 20 aa, Cryptosporidium parvum
DEFLNPIHMELEIENSKTTI

SEQ ID NO: 2289856 - protein, 27 aa, Cryptosporidium parvum
DEFSTWLDKYVCCDSIEILHVNLYVTS

SEQ ID NO: 2289857 - protein, 20 aa, Cryptosporidium parvum
DEGIGLLMEEMKHLKEDAEY

SEQ ID NO: 2289858 - protein, 20 aa, Cryptosporidium parvum
DEHGKTVLMGGIASLSSSSS

SEQ ID NO: 2289859 - protein, 24 aa, Cryptosporidium parvum
DEHKWKIKSFKAVAQCAIRYLQTK

SEQ ID NO: 2289860 - protein, 17 aa, Cryptosporidium parvum
DEHPESIIFNQNAIKES

SEQ ID NO: 2289861 - protein, 23 aa, Cryptosporidium parvum
DEIEHFQWYVGQYLTSRYRILDI

SEQ ID NO: 2289862 - protein, 21 aa, Cryptosporidium parvum
DEIKISIVYLLSKMVNNNPEL

SEQ ID NO: 2289863 - protein, 20 aa, Cryptosporidium parvum
DEILKLVLAEVYELRKKLDK

SEQ ID NO: 2289864 - protein, 21 aa, Cryptosporidium parvum
DEINKIILCKNAPNSNVGSLE

SEQ ID NO: 2289865 - protein, 22 aa, Cryptosporidium parvum
DEIPRSILYYETPQYCYSLLRC

SEQ ID NO: 2289866 - protein, 18 aa, Cryptosporidium parvum
DEISEKFINCINKASDAL

SEQ ID NO: 2289867 - protein, 18 aa, Cryptosporidium parvum
DEIVCLGKGGVYRLRGMT

SEQ ID NO: 2289868 - protein, 19 aa, Cryptosporidium parvum
DEIVECFEALNLEGDLLRG

SEQ ID NO: 2289869 - protein, 24 aa, Cryptosporidium parvum
DEIYKAECLYNLARAFHQINLKTN

SEQ ID NO: 2289870 - protein, 23 aa, Cryptosporidium parvum
DEIYLRWQHFKTIDQLKQEIVAR

SEQ ID NO: 2289871 - protein, 25 aa, Cryptosporidium parvum
DEKDLICGVCNCALYKSGNRVCSLC

SEQ ID NO: 2289872 - protein, 22 aa, Cryptosporidium parvum
DEKELFRVFATFDINHLMSVLQ

SEQ ID NO: 2289873 - protein, 30 aa, Cryptosporidium parvum
DEKPEVVGLLEWLVSIVIYRQNRYMEALEF

SEQ ID NO: 2289874 - protein, 22 aa, Cryptosporidium parvum
DEKRKKLTFIVAGGGPTGVEVS

SEQ ID NO: 2289875 - protein, 25 aa, Cryptosporidium parvum
DELAADFGENWFSRIRRISENNIKN

SEQ ID NO: 2289876 - protein, 26 aa, Cryptosporidium parvum
DELENYCLWRGWQYMRLDGSTNKLIR

SEQ ID NO: 2289877 - protein, 19 aa, Cryptosporidium parvum
DELKARSWDDWKDLNPKGH

SEQ ID NO: 2289878 - protein, 19 aa, Cryptosporidium parvum
DELKRIVLVGNEAIKSLES

SEQ ID NO: 2289879 - protein, 23 aa, Cryptosporidium parvum
DELKRKYIPAILDWGMVKIFDKS

SEQ ID NO: 2289880 - protein, 25 aa, Cryptosporidium parvum
DELLHCLKCGVNIHSKCSEVVNGSF

SEQ ID NO: 2289881 - protein, 25 aa, Cryptosporidium parvum
DELNSGICMGAKQPAFLSSKQLFDE

SEQ ID NO: 2289882 - protein, 26 aa, Cryptosporidium parvum
DELPAISGRKLWKLKHKKRVKKYKDF

SEQ ID NO: 2289883 - protein, 21 aa, Cryptosporidium parvum
DELPMDYNFWAGRDDWKDTMR

SEQ ID NO: 2289884 - protein, 25 aa, Cryptosporidium parvum
DELQLEISKVWKGIESPFSPKKISY

SEQ ID NO: 2289885 - protein, 23 aa, Cryptosporidium parvum
DELREVMNSAGPVLSMRIVHDKD

SEQ ID NO: 2289886 - protein, 20 aa, Cryptosporidium parvum
DELRRFVTMSLNEDCVHSVR

SEQ ID NO: 2289887 - protein, 26 aa, Cryptosporidium parvum
DENRYPYRRMIISNIYTLLGELASQA

SEQ ID NO: 2289888 - protein, 20 aa, Cryptosporidium parvum
DEPQMARGRFREFYQCDLDI

SEQ ID NO: 2289889 - protein, 20 aa, Cryptosporidium parvum
DEQLHGGLLDGKKYIPGSVG

SEQ ID NO: 2289890 - protein, 20 aa, Cryptosporidium parvum
DEQLKRFLRETDVHCLIVGK

SEQ ID NO: 2289891 - protein, 20 aa, Cryptosporidium parvum
DEQRESLAFEFSNKKKTESL

SEQ ID NO: 2289892 - protein, 20 aa, Cryptosporidium parvum
DERDLHSFLKPISRFQTEEE

SEQ ID NO: 2289893 - protein, 25 aa, Cryptosporidium parvum
DERQWKFAGYEVVLLSIDFIRRNIG

SEQ ID NO: 2289894 - protein, 18 aa, Cryptosporidium parvum
DERYGWGVSHRGAGYTFG

SEQ ID NO: 2289895 - protein, 20 aa, Cryptosporidium parvum
DESELLKSHIEEVELNTKEI

SEQ ID NO: 2289896 - protein, 26 aa, Cryptosporidium parvum
DESELRKSNDLVIINSLNFSELSSEE

SEQ ID NO: 2289897 - protein, 26 aa, Cryptosporidium parvum
DESIVRVCGKFVMLDSILPKLRAAGH

SEQ ID NO: 2289898 - protein, 20 aa, Cryptosporidium parvum
DESMLSLLERFYSIKISKLP

SEQ ID NO: 2289899 - protein, 46 aa, Cryptosporidium parvum
DESVKSFFNGCGVVKRVSIPRYSDTGKMRGFAMVEFENDEQIQNAL

SEQ ID NO: 2289900 - protein, 20 aa, Cryptosporidium parvum
DETKYNFSFIKSIKVSNVGI

SEQ ID NO: 2289901 - protein, 25 aa, Cryptosporidium parvum
DETSKFCFCKQPVLDNMIRCESGNQ

SEQ ID NO: 2289902 - protein, 35 aa, Cryptosporidium parvum
DEVGLIWKYRFYLFRFKAGIPMLFHFINLSDKEIM

SEQ ID NO: 2289903 - protein, 18 aa, Cryptosporidium parvum
DEVPSLYSNATFQVTKSE

SEQ ID NO: 2289904 - protein, 24 aa, Cryptosporidium parvum
DEVVLKYYLDYVRSVVPPNTPLDL

SEQ ID NO: 2289905 - protein, 17 aa, Cryptosporidium parvum
DEYGRWCRSILNSGQVQ

SEQ ID NO: 2289906 - protein, 17 aa, Cryptosporidium parvum
DEYSFSEGLSFDSFILV

SEQ ID NO: 2289907 - protein, 25 aa, Cryptosporidium parvum
DEYWTEFWNLIALDLGNRCERTGRD

SEQ ID NO: 2289908 - protein, 17 aa, Cryptosporidium parvum
DEYYLKFFKACEYDETL

SEQ ID NO: 2289909 - protein, 18 aa, Cryptosporidium parvum
DFAKGHYEGKIKIKEEAI

SEQ ID NO: 2289910 - protein, 22 aa, Cryptosporidium parvum
DFDAICKLCDGFNGADMRNVCS

SEQ ID NO: 2289911 - protein, 25 aa, Cryptosporidium parvum
DFDSRSSGTLGFVIKGSGLGGSSSI

SEQ ID NO: 2289912 - protein, 18 aa, Cryptosporidium parvum
DFECSFVLIPNQNKILEK

SEQ ID NO: 2289913 - protein, 24 aa, Cryptosporidium parvum
DFEECAAVHLAVVDKAVRYSKIIR

SEQ ID NO: 2289914 - protein, 17 aa, Cryptosporidium parvum
DFERCRIVFSYTELIYY

SEQ ID NO: 2289915 - protein, 25 aa, Cryptosporidium parvum
DFEYIIPIFVIYRIFEVHSENCKSI

SEQ ID NO: 2289916 - protein, 18 aa, Cryptosporidium parvum
DFFHAENPPLLLLKSNTI

SEQ ID NO: 2289917 - protein, 21 aa, Cryptosporidium parvum
DFFKVVFAIVVIDSYVSILCN

SEQ ID NO: 2289918 - protein, 23 aa, Cryptosporidium parvum
DFFLWRRIGQMSAEIQDWNRAIY

SEQ ID NO: 2289919 - protein, 20 aa, Cryptosporidium parvum
DFFSKIDLNLIVSARNNSPV

SEQ ID NO: 2289920 - protein, 25 aa, Cryptosporidium parvum
DFGARPNWICLGNYHISIHTNNASL

SEQ ID NO: 2289921 - protein, 19 aa, Cryptosporidium parvum
DFGLSSFIYDGDFLNTSCG

SEQ ID NO: 2289922 - protein, 26 aa, Cryptosporidium parvum
DFIGKFKCILCPKKIIINESDLDKHI

SEQ ID NO: 2289923 - protein, 17 aa, Cryptosporidium parvum
DFIIIRFYGEAYGSMSY

SEQ ID NO: 2289924 - protein, 19 aa, Cryptosporidium parvum
DFIPYAISVLQLFQQASIT

SEQ ID NO: 2289925 - protein, 24 aa, Cryptosporidium parvum
DFIQEYLPLFAFFMKLSIRVHFDM

SEQ ID NO: 2289926 - protein, 25 aa, Cryptosporidium parvum
DFKDQSLCYVRRQLIIGNEANVEES

SEQ ID NO: 2289927 - protein, 23 aa, Cryptosporidium parvum
DFKLFEKSFHEFLYSKQEYKDLL

SEQ ID NO: 2289928 - protein, 17 aa, Cryptosporidium parvum
DFLKDFGGDSLFPNIND

SEQ ID NO: 2289929 - protein, 25 aa, Cryptosporidium parvum
DFLKPGHALFGYFADLVEAYSLCLI

SEQ ID NO: 2289930 - protein, 19 aa, Cryptosporidium parvum
DFLPNLPVFSIYKGSLDQI

SEQ ID NO: 2289931 - protein, 18 aa, Cryptosporidium parvum
DFLSHGGNDFGSRISNSI

SEQ ID NO: 2289932 - protein, 25 aa, Cryptosporidium parvum
DFNYKLDEEHGWYVGDNSVWLYNKD

SEQ ID NO: 2289933 - protein, 23 aa, Cryptosporidium parvum
DFPSCIKSALAKQIHSTLHRVHW

SEQ ID NO: 2289934 - protein, 23 aa, Cryptosporidium parvum
DFRSESISSIAGYMGPGNRRKYY

SEQ ID NO: 2289935 - protein, 23 aa, Cryptosporidium parvum
DFRSTKKKIHWLANLPSVLTKCI

SEQ ID NO: 2289936 - protein, 24 aa, Cryptosporidium parvum
DFSCFKALQLESIYSTPIPESNNV

SEQ ID NO: 2289937 - protein, 24 aa, Cryptosporidium parvum
DFSEADLQCCINIVNQWTITNISG

SEQ ID NO: 2289938 - protein, 18 aa, Cryptosporidium parvum
DFSGYWCYDNFLQVKSLK

SEQ ID NO: 2289939 - protein, 20 aa, Cryptosporidium parvum
DFSYLNIRWRRKMGEKLIDI

SEQ ID NO: 2289940 - protein, 20 aa, Cryptosporidium parvum
DFTAEYILPALISLFNDVQK

SEQ ID NO: 2289941 - protein, 20 aa, Cryptosporidium parvum
DFTAPELLKGETFSYSLDVW

SEQ ID NO: 2289942 - protein, 20 aa, Cryptosporidium parvum
DFTRKLRVVRKGESISTNDH

SEQ ID NO: 2289943 - protein, 26 aa, Cryptosporidium parvum
DFVFNSYCLIHLKDCINLLTNEINSQ

SEQ ID NO: 2289944 - protein, 18 aa, Cryptosporidium parvum
DFVFWSDRLIRLVVENAL

SEQ ID NO: 2289945 - protein, 18 aa, Cryptosporidium parvum
DFWSCGKLLYLMLTGKYL

SEQ ID NO: 2289946 - protein, 23 aa, Cryptosporidium parvum
DFYSNPFYPIFVNEYNKRLFMDH

SEQ ID NO: 2289947 - protein, 19 aa, Cryptosporidium parvum
DGAVIYHRFVRKSKDELKE

SEQ ID NO: 2289948 - protein, 24 aa, Cryptosporidium parvum
DGDKWKCPVCRGEDPLKNMRHKRM

SEQ ID NO: 2289949 - protein, 19 aa, Cryptosporidium parvum
DGDSLLICESDTLRVYTIS

SEQ ID NO: 2289950 - protein, 27 aa, Cryptosporidium parvum
DGEELPQRFVLTPIVEKFLKRRPQMKH

SEQ ID NO: 2289951 - protein, 17 aa, Cryptosporidium parvum
DGELINFDDFDKLLNTF

SEQ ID NO: 2289952 - protein, 22 aa, Cryptosporidium parvum
DGETRQHLPININRIIQMAQQK

SEQ ID NO: 2289953 - protein, 20 aa, Cryptosporidium parvum
DGGRLVKLLQGHGLNIENYE

SEQ ID NO: 2289954 - protein, 21 aa, Cryptosporidium parvum
DGGSLGMLSAHDFIGMRTSLV

SEQ ID NO: 2289955 - protein, 30 aa, Cryptosporidium parvum
DGHGLRMGAVIKRFYIDSIYTQDNLINLDT

SEQ ID NO: 2289956 - protein, 31 aa, Cryptosporidium parvum
DGIARLWDLRMGRELVKYSSGLRSSCHSKVS

SEQ ID NO: 2289957 - protein, 34 aa, Cryptosporidium parvum
DGIDISRLKAIEWRVKLINEKKLRDNVVEYVNNK

SEQ ID NO: 2289958 - protein, 18 aa, Cryptosporidium parvum
DGIIPLSINEIFNPEYTN

SEQ ID NO: 2289959 - protein, 18 aa, Cryptosporidium parvum
DGIISSFRNCVALGLDVD

SEQ ID NO: 2289960 - protein, 24 aa, Cryptosporidium parvum
DGIKRSYHSLARYFSRNAQDTGNN

SEQ ID NO: 2289961 - protein, 23 aa, Cryptosporidium parvum
DGILELFQKFLLDTKLIEKIEKV

SEQ ID NO: 2289962 - protein, 29 aa, Cryptosporidium parvum
DGINSLLYEFWIKKFYSITNVEISRSLEP

SEQ ID NO: 2289963 - protein, 17 aa, Cryptosporidium parvum
DGIRLLLYAASRRVFLI

SEQ ID NO: 2289964 - protein, 25 aa, Cryptosporidium parvum
DGIYKTEIDPECTFQPNLRKTLFEK

SEQ ID NO: 2289965 - protein, 23 aa, Cryptosporidium parvum
DGKLSAAEFIIFNTLVKVSIERN

SEQ ID NO: 2289966 - protein, 18 aa, Cryptosporidium parvum
DGKVYSEIDWNEDCNPLI

SEQ ID NO: 2289967 - protein, 17 aa, Cryptosporidium parvum
DGLELESAIATNGSGVA

SEQ ID NO: 2289968 - protein, 25 aa, Cryptosporidium parvum
DGLIDWKEFCTFIVDYFNTSRESLR

SEQ ID NO: 2289969 - protein, 25 aa, Cryptosporidium parvum
DGLKVCGNELCEFLVNAVEPLKSNF

SEQ ID NO: 2289970 - protein, 21 aa, Cryptosporidium parvum
DGLRVYLSVVGNEYFNTVINL

SEQ ID NO: 2289971 - protein, 20 aa, Cryptosporidium parvum
DGNELFARFTKLVQENLHIV

SEQ ID NO: 2289972 - protein, 17 aa, Cryptosporidium parvum
DGNILWNKPFTTVQGGW

SEQ ID NO: 2289973 - protein, 24 aa, Cryptosporidium parvum
DGNRREREWELKKKKKNIIKEKEL

SEQ ID NO: 2289974 - protein, 25 aa, Cryptosporidium parvum
DGNSTLKWNICSSQMETKMDMNGIS

SEQ ID NO: 2289975 - protein, 18 aa, Cryptosporidium parvum
DGNYKFASLKTFKKDTSD

SEQ ID NO: 2289976 - protein, 25 aa, Cryptosporidium parvum
DGPILPVCINAAVLALIDLGIPMEF

SEQ ID NO: 2289977 - protein, 25 aa, Cryptosporidium parvum
DGQKKNCYIYRLFSTGTIEEKIYQR

SEQ ID NO: 2289978 - protein, 19 aa, Cryptosporidium parvum
DGQPLKFSQVFNLMPSGNG

SEQ ID NO: 2289979 - protein, 23 aa, Cryptosporidium parvum
DGRGPPRKHFRVCVFNLDDNASW

SEQ ID NO: 2289980 - protein, 25 aa, Cryptosporidium parvum
DGRKPEVCRNFKLELNELSSSNYGA

SEQ ID NO: 2289981 - protein, 19 aa, Cryptosporidium parvum
DGSGCGFVQPTYSKEGYNL

SEQ ID NO: 2289982 - protein, 20 aa, Cryptosporidium parvum
DGSLSFWKVIYDLNSKSKIK

SEQ ID NO: 2289983 - protein, 17 aa, Cryptosporidium parvum
DGSYCFCSNSCRNAEVN

SEQ ID NO: 2289984 - protein, 23 aa, Cryptosporidium parvum
DGTHCSLCGKSMRVETQANSNNQ

SEQ ID NO: 2289985 - protein, 22 aa, Cryptosporidium parvum
DGVEIRVLFMPGKDEDINEESE

SEQ ID NO: 2289986 - protein, 29 aa, Cryptosporidium parvum
DGVTNYVLWDAIWKSHRFNNLELLANVIS

SEQ ID NO: 2289987 - protein, 17 aa, Cryptosporidium parvum
DGYECSKNSILHSTSVN

SEQ ID NO: 2289988 - protein, 25 aa, Cryptosporidium parvum
DGYYIKGQCAIIMFDVTSRITYKNV

SEQ ID NO: 2289989 - protein, 19 aa, Cryptosporidium parvum
DHAKIKCTNRMNSRQTDLI

SEQ ID NO: 2289990 - protein, 23 aa, Cryptosporidium parvum
DHCPQYLTSLLFTLGVQDISSCS

SEQ ID NO: 2289991 - protein, 18 aa, Cryptosporidium parvum
DHEWLRIEIEMWIFNNIN

SEQ ID NO: 2289992 - protein, 25 aa, Cryptosporidium parvum
DHFYELRLQLLINRMEEKGDSEDAN

SEQ ID NO: 2289993 - protein, 28 aa, Cryptosporidium parvum
DHGLSYTRIRFASVQQLFKISYVCDVFD

SEQ ID NO: 2289994 - protein, 22 aa, Cryptosporidium parvum
DHGRIPLARRLLMQLLKKANKQ

SEQ ID NO: 2289995 - protein, 29 aa, Cryptosporidium parvum
DHHLKHWSRLQLWLFLKGCGMKLEEQLSL

SEQ ID NO: 2289996 - protein, 25 aa, Cryptosporidium parvum
DHIEMARSIFSSCIEKNFKPRSMKM

SEQ ID NO: 2289997 - protein, 18 aa, Cryptosporidium parvum
DHIKEIYDKPVVGYQSNE

SEQ ID NO: 2289998 - protein, 18 aa, Cryptosporidium parvum
DHIPFLISTFNYLMDEIK

SEQ ID NO: 2289999 - protein, 17 aa, Cryptosporidium parvum
DHISTFFSQCLIKSITV

SEQ ID NO: 2290000 - protein, 18 aa, Cryptosporidium parvum
DHLFWYSANNHIRYGELT

SEQ ID NO: 2290001 - protein, 19 aa, Cryptosporidium parvum
DHLTLLNIFIQWKRHGSNV

SEQ ID NO: 2290002 - protein, 21 aa, Cryptosporidium parvum
DHLTLLYAFESFREVLYKDEN

SEQ ID NO: 2290003 - protein, 22 aa, Cryptosporidium parvum
DHNKFALKVIKDILRPINGDFY

SEQ ID NO: 2290004 - protein, 23 aa, Cryptosporidium parvum
DHPFIIKLVRTFKDSENIYLLTE

SEQ ID NO: 2290005 - protein, 21 aa, Cryptosporidium parvum
DHRVSIGSGKSIRNNNGSDLD

SEQ ID NO: 2290006 - protein, 25 aa, Cryptosporidium parvum
DHTLLQVCLLLGLNRIAFLACGTLL

SEQ ID NO: 2290007 - protein, 17 aa, Cryptosporidium parvum
DHTTFLSNICVECGFIL

SEQ ID NO: 2290008 - protein, 18 aa, Cryptosporidium parvum
DHVEGFSPEVAWVTKSGK

SEQ ID NO: 2290009 - protein, 36 aa, Cryptosporidium parvum; identical to SEQ ID NO: 2169168

SEQ ID NO: 2290010 - protein, 18 aa, Cryptosporidium parvum
DHYYKIQPLQGIEQNIGE

SEQ ID NO: 2290011 - protein, 18 aa, Cryptosporidium parvum
DIADLLRLCENSMPYDLI

SEQ ID NO: 2290012 - protein, 17 aa, Cryptosporidium parvum
DIDDAIYNTNWRDDAGR

SEQ ID NO: 2290013 - protein, 25 aa, Cryptosporidium parvum
DIDILKGIYIYGFSNWTMMSMDENL

SEQ ID NO: 2290014 - protein, 24 aa, Cryptosporidium parvum
DIDKIIRFSICSSSLQMDLINKTL

SEQ ID NO: 2290015 - protein, 17 aa, Cryptosporidium parvum
DIDKSRVGISSWNSKGT

SEQ ID NO: 2290016 - protein, 33 aa, Cryptosporidium parvum
DIDYKPPFFPKIRSSLQLSTFLIVFLKSLEHKL

SEQ ID NO: 2290017 - protein, 18 aa, Cryptosporidium parvum
DIDYRVLNEFSIVSWCTP

SEQ ID NO: 2290018 - protein, 26 aa, Cryptosporidium parvum
DIECYNCSGFGHIICNNEIPFKNAIK

SEQ ID NO: 2290019 - protein, 29 aa, Cryptosporidium parvum
DIEISHPLNLRIVGYSIIDIISRNRDLQD

SEQ ID NO: 2290020 - protein, 30 aa, Cryptosporidium parvum
DIESFNMIFKAFKFDSSWIDTELNKVTSET

SEQ ID NO: 2290021 - protein, 24 aa, Cryptosporidium parvum
DIESGKRFALKKVLQDPRYKNREL

SEQ ID NO: 2290022 - protein, 19 aa, Cryptosporidium parvum
DIETPFPCFVKEGCIIPYQ

SEQ ID NO: 2290023 - protein, 19 aa, Cryptosporidium parvum
DIFERISLVLNHLGEISRF

SEQ ID NO: 2290024 - protein, 26 aa, Cryptosporidium parvum
DIFIAPYRLAELFVIGLPRCSFYMQK

SEQ ID NO: 2290025 - protein, 21 aa, Cryptosporidium parvum
DIFRVSCKFEVLDRMLPKLIR

SEQ ID NO: 2290026 - protein, 19 aa, Cryptosporidium parvum
DIFTKWKNLLLKINPKADC

SEQ ID NO: 2290027 - protein, 22 aa, Cryptosporidium parvum
DIGCGNGLFLIDLIRNINFSSA

SEQ ID NO: 2290028 - protein, 24 aa, Cryptosporidium parvum
DIGEWQKLCSYNFHDQEEYKLEWW

SEQ ID NO: 2290029 - protein, 19 aa, Cryptosporidium parvum
DIICNLLFEEEMRKEFCDL

SEQ ID NO: 2290030 - protein, 17 aa, Cryptosporidium parvum
DIICPKLDGSLVGEDRI

SEQ ID NO: 2290031 - protein, 27 aa, Cryptosporidium parvum
DIIDDYLRWCGYPYCRIDGSTPGIERQ

SEQ ID NO: 2290032 - protein, 26 aa, Cryptosporidium parvum
DIIHWLFLSICTFEERKCFSLTDLSK

SEQ ID NO: 2290033 - protein, 23 aa, Cryptosporidium parvum
DIIKKNCSAIQNFDNFSSTNNFN

SEQ ID NO: 2290034 - protein, 26 aa, Cryptosporidium parvum
DIIKLRCMSRVFSISVMNCEKYREVR

SEQ ID NO: 2290035 - protein, 25 aa, Cryptosporidium parvum
DIIWLQRDFSVYIVNMFDTGQAARI

SEQ ID NO: 2290036 - protein, 24 aa, Cryptosporidium parvum
DIKEGYGKCRFQVINTIEVDDIVE

SEQ ID NO: 2290037 - protein, 20 aa, Cryptosporidium parvum
DIKFHQCVRLARFESDRTIS

SEQ ID NO: 2290038 - protein, 21 aa, Cryptosporidium parvum
DILAIRIFIQNALKLCNQLPP

SEQ ID NO: 2290039 - protein, 17 aa, Cryptosporidium parvum
DILDLNVSIMIMDSLQD

SEQ ID NO: 2290040 - protein, 22 aa, Cryptosporidium parvum
DILEEMKHRFVINEPSIDKNRL

SEQ ID NO: 2290041 - protein, 20 aa, Cryptosporidium parvum
DILEIRKLRFKDFKNTDLVD

SEQ ID NO: 2290042 - protein, 20 aa, Cryptosporidium parvum
DILESARFINYIGKNNNVDN

SEQ ID NO: 2290043 - protein, 17 aa, Cryptosporidium parvum
DILEYVMKICKLYLKIL

SEQ ID NO: 2290044 - protein, 17 aa, Cryptosporidium parvum
DILKDAWSPALTLRTVM

SEQ ID NO: 2290045 - protein, 17 aa, Cryptosporidium parvum
DILLNFLNILSVGISES

SEQ ID NO: 2290046 - protein, 17 aa, Cryptosporidium parvum
DILNLTYYGKLYDTNNN

SEQ ID NO: 2290047 - protein, 18 aa, Cryptosporidium parvum
DILQESYHNFKFISSSNK

SEQ ID NO: 2290048 - protein, 23 aa, Cryptosporidium parvum
DILRCMKRQKSLHCDTMDFHVLV

SEQ ID NO: 2290049 - protein, 18 aa, Cryptosporidium parvum
DILRDYDQIVPKRSNLSL

SEQ ID NO: 2290050 - protein, 17 aa, Cryptosporidium parvum
DILSFFLLLGVPLNPER

SEQ ID NO: 2290051 - protein, 25 aa, Cryptosporidium parvum
DILTLRITSKWELRRICRSIGAVAM

SEQ ID NO: 2290052 - protein, 17 aa, Cryptosporidium parvum
DIMFKGRTNNDMIKLIM

SEQ ID NO: 2290053 - protein, 19 aa, Cryptosporidium parvum
DIMNLCSQFGNIIDISINN

SEQ ID NO: 2290054 - protein, 23 aa, Cryptosporidium parvum
DINISFPPIEFIKNEKFAFLQAY

SEQ ID NO: 2290055 - protein, 24 aa, Cryptosporidium parvum
DINLLKHNLLCLVFENEPLLNIIP

SEQ ID NO: 2290056 - protein, 19 aa, Cryptosporidium parvum
DIPHRFFLNQVKLLQIKYS

SEQ ID NO: 2290057 - protein, 24 aa, Cryptosporidium parvum
DIPITAEAVSRCIAQMAADIYFYW

SEQ ID NO: 2290058 - protein, 25 aa, Cryptosporidium parvum
DIPKKECKKKLKATKLKNSTELNGA

SEQ ID NO: 2290059 - protein, 18 aa, Cryptosporidium parvum
DIQCCGILANISITTELP

SEQ ID NO: 2290060 - protein, 18 aa, Cryptosporidium parvum
DIQIGKRVLIIGKFETGK

SEQ ID NO: 2290061 - protein, 18 aa, Cryptosporidium parvum
DIQNNLLLEFGLKETDDQ

SEQ ID NO: 2290062 - protein, 24 aa, Cryptosporidium parvum
DISDVPRAYGVFGEELEQPGPDNI

SEQ ID NO: 2290063 - protein, 18 aa, Cryptosporidium parvum
DISICKNHIFLTYFPESE

SEQ ID NO: 2290064 - protein, 24 aa, Cryptosporidium parvum
DISKSDQAVKCLIQDANLNMPKVF

SEQ ID NO: 2290065 - protein, 22 aa, Cryptosporidium parvum
DISMLTCFLIILVNVINYNQFH

SEQ ID NO: 2290066 - protein, 18 aa, Cryptosporidium parvum
DISPCSKIKDQSEKSFMK

SEQ ID NO: 2290067 - protein, 23 aa, Cryptosporidium parvum
DIVELFLIPQWWMNCKPFAEKAC

SEQ ID NO: 2290068 - protein, 20 aa, Cryptosporidium parvum
DIVQRLKRVSSMFSSTLPIN

SEQ ID NO: 2290069 - protein, 19 aa, Cryptosporidium parvum
DIVRAFGRILRLIPYNEND

SEQ ID NO: 2290070 - protein, 25 aa, Cryptosporidium parvum
DIVSSIRTSPLLFPKLGTLLDGSYC

SEQ ID NO: 2290071 - protein, 17 aa, Cryptosporidium parvum
DIVVIAWGLSLERPTMI

SEQ ID NO: 2290072 - protein, 17 aa, Cryptosporidium parvum
DIVVVGMSCSFPGGSST

SEQ ID NO: 2290073 - protein, 19 aa, Cryptosporidium parvum
DIWCIKYLSNFKWHNLTEH

SEQ ID NO: 2290074 - protein, 31 aa, Cryptosporidium parvum; identical to SEQ ID NO: 2169220

SEQ ID NO: 2290075 - protein, 18 aa, Cryptosporidium parvum
DIWSLLLSCHQNFGQMNV

SEQ ID NO: 2290076 - protein, 22 aa, Cryptosporidium parvum
DIYDRFPDYKIYGPTCIGTDIR

SEQ ID NO: 2290077 - protein, 23 aa, Cryptosporidium parvum
DIYELKESILLVYSEFKQKGWCQ

SEQ ID NO: 2290078 - protein, 18 aa, Cryptosporidium parvum
DIYHAPLLYYREDDSISD

SEQ ID NO: 2290079 - protein, 24 aa, Cryptosporidium parvum
DIYLETISVFGIIHKPKIILLNIN

SEQ ID NO: 2290080 - protein, 24 aa, Cryptosporidium parvum
DIYLNLKLPIWVSNMAKQFYNAYN

SEQ ID NO: 2290081 - protein, 24 aa, Cryptosporidium parvum
DIYNFLRDRLRAVWQDLTVQHATR

SEQ ID NO: 2290082 - protein, 18 aa, Cryptosporidium parvum
DKACCKSIRCENVMETVS

SEQ ID NO: 2290083 - protein, 19 aa, Cryptosporidium parvum
DKAHLCASCDEFHHSSTRL

SEQ ID NO: 2290084 - protein, 28 aa, Cryptosporidium parvum
DKARHFLWKAMVTGVPYSQAKLMKESQV

SEQ ID NO: 2290085 - protein, 25 aa, Cryptosporidium parvum
DKCFKYYHIDCIFKGFQKNNFEYYS

SEQ ID NO: 2290086 - protein, 27 aa, Cryptosporidium parvum
DKCLPNLKKGLFSRLVNNYNNLQNTKL

SEQ ID NO: 2290087 - protein, 20 aa, Cryptosporidium parvum
DKCVGREYRLNFSVGTKLKK

SEQ ID NO: 2290088 - protein, 21 aa, Cryptosporidium parvum
DKDINLFKLVGFVRNVEHDDY

SEQ ID NO: 2290089 - protein, 25 aa, Cryptosporidium parvum
DKDIWLESICMVVNAVTRVETLKDA

SEQ ID NO: 2290090 - protein, 27 aa, Cryptosporidium parvum
DKDLLSSCFAFHFSLMKTRKIFYDLLQ

SEQ ID NO: 2290091 - protein, 18 aa, Cryptosporidium parvum
DKDRIGINVSAQKEMVIL

SEQ ID NO: 2290092 - protein, 22 aa, Cryptosporidium parvum
DKEIWTNELVELLGNHFNYKVN

SEQ ID NO: 2290093 - protein, 20 aa, Cryptosporidium parvum
DKEKRKVIVEWLNNNEWSCK

SEQ ID NO: 2290094 - protein, 24 aa, Cryptosporidium parvum
DKEPILFKRIYLWREEAKIQVSKN

SEQ ID NO: 2290095 - protein, 23 aa, Cryptosporidium parvum
DKEPLKPLYLLYRHLKDSTYRTK

SEQ ID NO: 2290096 - protein, 20 aa, Cryptosporidium parvum
DKEWGGSCEDVFDPNEYWQK

SEQ ID NO: 2290097 - protein, 17 aa, Cryptosporidium parvum
DKFGGLHNFMRWNRNIL

SEQ ID NO: 2290098 - protein, 20 aa, Cryptosporidium parvum
DKFIRFRAIYSQIQPVLQFV

SEQ ID NO: 2290099 - protein, 25 aa, Cryptosporidium parvum
DKFKFKRTKIKVIKKNLRKETNFEL

SEQ ID NO: 2290100 - protein, 17 aa, Cryptosporidium parvum
DKFNVFFIKSIINTACI

SEQ ID NO: 2290101 - protein, 18 aa, Cryptosporidium parvum
DKICEPVIIQGNYDIHPI

SEQ ID NO: 2290102 - protein, 23 aa, Cryptosporidium parvum
DKIEGKQRCELMLSINTRKEPSI

SEQ ID NO: 2290103 - protein, 25 aa, Cryptosporidium parvum
DKIIRDIWLPLSPSGWQWYKRLLDV

SEQ ID NO: 2290104 - protein, 17 aa, Cryptosporidium parvum
DKIKTGAIFFGEPGTNA

SEQ ID NO: 2290105 - protein, 33 aa, Cryptosporidium parvum
DKISKFYCNLVPYMIKNLWRRLENASYQRVDWS

SEQ ID NO: 2290106 - protein, 25 aa, Cryptosporidium parvum
DKKDLLDLILIYGFLIGNKLENKVL

SEQ ID NO: 2290107 - protein, 34 aa, Cryptosporidium parvum; identical to SEQ ID NO: 2169252

SEQ ID NO: 2290108 - protein, 22 aa, Cryptosporidium parvum
DKKGKKQWILGLDKFQDNNTNK

SEQ ID NO: 2290109 - protein, 17 aa, Cryptosporidium parvum
DKKICKKFVPPGFTKIK

SEQ ID NO: 2290110 - protein, 19 aa, Cryptosporidium parvum
DKKMCLICLDEFKDQQEIL

SEQ ID NO: 2290111 - protein, 25 aa, Cryptosporidium parvum
DKLAISRRVDKHWRLIGFGDIISGD

SEQ ID NO: 2290112 - protein, 20 aa, Cryptosporidium parvum
DKLLRPIIVFRAKAFLDGEE

SEQ ID NO: 2290113 - protein, 23 aa, Cryptosporidium parvum
DKLSEFLPALLLRLKEQGKHIKF

SEQ ID NO: 2290114 - protein, 18 aa, Cryptosporidium parvum
DKLSILIIDVQPLLHASP

SEQ ID NO: 2290115 - protein, 23 aa, Cryptosporidium parvum
DKNEFQYYLSRICNSKTYESHLT

SEQ ID NO: 2290116 - protein, 25 aa, Cryptosporidium parvum
DKNGCWMLSFFLGEYNLRKQVLCDL

SEQ ID NO: 2290117 - protein, 24 aa, Cryptosporidium parvum
DKNSALLVLRRKKLVTQEREKLLS

SEQ ID NO: 2290118 - protein, 17 aa, Cryptosporidium parvum
DKPDFILRSSDLQSSGS

SEQ ID NO: 2290119 - protein, 18 aa, Cryptosporidium parvum
DKPLKPGRTYKIPSRNYT

SEQ ID NO: 2290120 - protein, 21 aa, Cryptosporidium parvum
DKPNQNMRISAARANALSSEL

SEQ ID NO: 2290121 - protein, 18 aa, Cryptosporidium parvum
DKQIQFSQFRGVLNRLCE

SEQ ID NO: 2290122 - protein, 25 aa, Cryptosporidium parvum
DKQLYRSNASFSYFSFQLNNSGYRI

SEQ ID NO: 2290123 - protein, 22 aa, Cryptosporidium parvum
DKRILIKKCVPICQRLFYSDTV

SEQ ID NO: 2290124 - protein, 18 aa, Cryptosporidium parvum
DKRLEIRKEELMDELKVQ

SEQ ID NO: 2290125 - protein, 19 aa, Cryptosporidium parvum
DKRLVGLRFENKEIKDKVN

SEQ ID NO: 2290126 - protein, 18 aa, Cryptosporidium parvum
DKRRPSFERDLSLSEDTA

SEQ ID NO: 2290127 - protein, 19 aa, Cryptosporidium parvum
DKSDWLLKYCEHLSEKINS

SEQ ID NO: 2290128 - protein, 19 aa, Cryptosporidium parvum
DKSITEFIEDIIISLPEGF

SEQ ID NO: 2290129 - protein, 20 aa, Cryptosporidium parvum
DKSNKRVIKIFTRNLESATD

SEQ ID NO: 2290130 - protein, 18 aa, Cryptosporidium parvum
DKSVKIYIDLVGVQDKPD

SEQ ID NO: 2290131 - protein, 25 aa, Cryptosporidium parvum
DKTCSDIVFFIAKFIQHYPRLDEGL

SEQ ID NO: 2290132 - protein, 18 aa, Cryptosporidium parvum
DKTLWISAEEEVDDSTSN

SEQ ID NO: 2290133 - protein, 26 aa, Cryptosporidium parvum
DKTNSCKHLFSWIEYEMALLGNSIHG

SEQ ID NO: 2290134 - protein, 18 aa, Cryptosporidium parvum
DKVYKKIWKRGVHLKSPN

SEQ ID NO: 2290135 - protein, 21 aa, Cryptosporidium parvum
DKWDVMVDVFFWRDPEEYENS

SEQ ID NO: 2290136 - protein, 18 aa, Cryptosporidium parvum
DKWINLKDIKLEIDKISI

SEQ ID NO: 2290137 - protein, 26 aa, Cryptosporidium parvum
DKWNISIPIYSCFPDGTFLDTKDSQL

SEQ ID NO: 2290138 - protein, 26 aa, Cryptosporidium parvum
DKWPLNKWAPSPFRVQHASPYKQMHA

SEQ ID NO: 2290139 - protein, 30 aa, Cryptosporidium parvum
DKYEISTSIPLYCPLAIGYFWIDKFMWQMY

SEQ ID NO: 2290140 - protein, 28 aa, Cryptosporidium parvum
DKYNPVLDNTFEWCIDVCDEWKKNTQIE

SEQ ID NO: 2290141 - protein, 18 aa, Cryptosporidium parvum
DKYRMASDLIKVLKEAKQ

SEQ ID NO: 2290142 - protein, 23 aa, Cryptosporidium parvum
DLDGKYLVCNLEFDEKKNIEFDS

SEQ ID NO: 2290143 - protein, 25 aa, Cryptosporidium parvum
DLDHCRSDFWSLVFPKTYMQILKKS

SEQ ID NO: 2290144 - protein, 21 aa, Cryptosporidium parvum
DLEAIGYVLMYFCRNGTLPWQ

SEQ ID NO: 2290145 - protein, 24 aa, Cryptosporidium parvum
DLEAKKWGFRCCKQTCRFSKCTNI

SEQ ID NO: 2290146 - protein, 24 aa, Cryptosporidium parvum
DLEKGEFLFKVLITEDLYNNILNC

SEQ ID NO: 2290147 - protein, 28 aa, Cryptosporidium parvum
DLELPLPKKEYRGIPELELSDKSEDKHE

SEQ ID NO: 2290148 - protein, 22 aa, Cryptosporidium parvum
DLFPDCFAGIPSCTSDDWRKGV

SEQ ID NO: 2290149 - protein, 19 aa, Cryptosporidium parvum
DLFSLYGKNPFFYTLKENA

SEQ ID NO: 2290150 - protein, 19 aa, Cryptosporidium parvum
DLFSSNFLLFKFYPSGNEI

SEQ ID NO: 2290151 - protein, 25 aa, Cryptosporidium parvum
DLGALRSPLPWDLGRHSKSTIQVSH

SEQ ID NO: 2290152 - protein, 18 aa, Cryptosporidium parvum
DLGNACWMNKHFSQDIQT

SEQ ID NO: 2290153 - protein, 19 aa, Cryptosporidium parvum
DLGPMRFAIGKSIFKRSDF

SEQ ID NO: 2290154 - protein, 17 aa, Cryptosporidium parvum
DLGRTSPSLGDLIQESL

SEQ ID NO: 2290155 - protein, 27 aa, Cryptosporidium parvum
DLGTFGLKMMFDWNFEFNWYEDFTDVI

SEQ ID NO: 2290156 - protein, 24 aa, Cryptosporidium parvum
DLHREAGELYGLIHARYITTPRGL

SEQ ID NO: 2290157 - protein, 26 aa, Cryptosporidium parvum
DLIDILRFVMDLLFAMVDISSSNGWI

SEQ ID NO: 2290158 - protein, 28 aa, Cryptosporidium parvum
DLIIKWPKYDKLFIGNWIDTDAFAEYVS

SEQ ID NO: 2290159 - protein, 29 aa, Cryptosporidium parvum
DLILRLHYHFPLDIGIISPILLNYYKLNT

SEQ ID NO: 2290160 - protein, 24 aa, Cryptosporidium parvum
DLIRRRYLGELKKTLVNDSQILNR

SEQ ID NO: 2290161 - protein, 21 aa, Cryptosporidium parvum
DLISEAFCFLPLAHVINDKVF

SEQ ID NO: 2290162 - protein, 18 aa, Cryptosporidium parvum
DLISLCLGVSLVGVATSK

SEQ ID NO: 2290163 - protein, 17 aa, Cryptosporidium parvum
DLIVSVGIFKLLFHLQV

SEQ ID NO: 2290164 - protein, 27 aa, Cryptosporidium parvum
DLKCRQCFLNEYIPDWSMDESISVFLK

SEQ ID NO: 2290165 - protein, 24 aa, Cryptosporidium parvum
DLKEVSELHILRLKQIETAQRLKE

SEQ ID NO: 2290166 - protein, 20 aa, Cryptosporidium parvum
DLKFLVSIHNLFFFKNIILE

SEQ ID NO: 2290167 - protein, 19 aa, Cryptosporidium parvum
DLKPRWVSGETLSYSNSFD

SEQ ID NO: 2290168 - protein, 24 aa, Cryptosporidium parvum
DLKSVLELPPFYKYENKMQLQLTT

SEQ ID NO: 2290169 - protein, 18 aa, Cryptosporidium parvum
DLKYPALRNPDEFTNALY

SEQ ID NO: 2290170 - protein, 23 aa, Cryptosporidium parvum
DLKYTMKKGRSVNISIDKEEDVR

SEQ ID NO: 2290171 - protein, 21 aa, Cryptosporidium parvum
DLLCSCIPADLILVTLTKQLL

SEQ ID NO: 2290172 - protein, 18 aa, Cryptosporidium parvum
DLLDRLLIIRTIPYNIEE

SEQ ID NO: 2290173 - protein, 19 aa, Cryptosporidium parvum
DLLFTPKATEDFSGDDDHL

SEQ ID NO: 2290174 - protein, 25 aa, Cryptosporidium parvum
DLLHKGGNCNSFIEKFGRNHLNDSS

SEQ ID NO: 2290175 - protein, 17 aa, Cryptosporidium parvum
DLLKKGLILPGMKEAEG

SEQ ID NO: 2290176 - protein, 26 aa, Cryptosporidium parvum
DLLKKGTKIYCDRRHSTILGKAGKIQ

SEQ ID NO: 2290177 - protein, 24 aa, Cryptosporidium parvum
DLLKWRSAMELVQMISSISDALTE

SEQ ID NO: 2290178 - protein, 24 aa, Cryptosporidium parvum
DLLLIKRRIILFKIEQGSNHLKRL

SEQ ID NO: 2290179 - protein, 26 aa, Cryptosporidium parvum
DLLNSECWKELVKGCRIVIHCASPYK

SEQ ID NO: 2290180 - protein, 18 aa, Cryptosporidium parvum
DLLPTCSNYDYLFRLIWV

SEQ ID NO: 2290181 - protein, 28 aa, Cryptosporidium parvum
DLLRIMLKFRRHLICPNHIIVEEIKATW

SEQ ID NO: 2290182 - protein, 23 aa, Cryptosporidium parvum
DLLRLIEVWSKYRLELQKSVQKY

SEQ ID NO: 2290183 - protein, 17 aa, Cryptosporidium parvum
DLLSLPIVRGPPCFEKN

SEQ ID NO: 2290184 - protein, 20 aa, Cryptosporidium parvum
DLMRSVGLWEFDRYTGKFHE

SEQ ID NO: 2290185 - protein, 29 aa, Cryptosporidium parvum
DLMSLGLHRCWKDIFVENIISPESFLRIK

SEQ ID NO: 2290186 - protein, 24 aa, Cryptosporidium parvum
DLMYSKRAFVHWYVGEGMEEGEFS

SEQ ID NO: 2290187 - protein, 23 aa, Cryptosporidium parvum
DLNHEFPRVLFIKANGKVIQNIE

SEQ ID NO: 2290188 - protein, 24 aa, Cryptosporidium parvum
DLNLEKRKTYVIGVVPDPGIDSEW

SEQ ID NO: 2290189 - protein, 25 aa, Cryptosporidium parvum
DLNLKCFKFETARNYLESKLRNYLE

SEQ ID NO: 2290190 - protein, 29 aa, Cryptosporidium parvum
DLNNISFLPKKEFFKPYYTTSTTTTTTTT

SEQ ID NO: 2290191 - protein, 25 aa, Cryptosporidium parvum
DLNQGMGFADLFYNFLNSEVEESMQ

SEQ ID NO: 2290192 - protein, 41 aa, Cryptosporidium parvum
DLNSVKYYEGFKLPLGDLGRKMLLKKLREIHTQNPTKMEKA

SEQ ID NO: 2290193 - protein, 18 aa, Cryptosporidium parvum
DLPARVSVLQAILRKSPL

SEQ ID NO: 2290194 - protein, 21 aa, Cryptosporidium parvum
DLPRSVVPTCIGIPNKEVDLI

SEQ ID NO: 2290195 - protein, 33 aa, Cryptosporidium parvum
DLPSNCLSFEFYLRSYLFIPYNIAKIGSCLYSK

SEQ ID NO: 2290196 - protein, 25 aa, Cryptosporidium parvum
DLQFKQDLSYFIHGKWASIKKLVDD

SEQ ID NO: 2290197 - protein, 19 aa, Cryptosporidium parvum
DLQGIMTCFNLLKTYINNV

SEQ ID NO: 2290198 - protein, 26 aa, Cryptosporidium parvum
DLQLYLYLCRLLSGAISLRSQNIQDT

SEQ ID NO: 2290199 - protein, 20 aa, Cryptosporidium parvum
DLREPEAIYAFSNRYADMIL

SEQ ID NO: 2290200 - protein, 17 aa, Cryptosporidium parvum
DLRRMIDDILNLMESHY

SEQ ID NO: 2290201 - protein, 20 aa, Cryptosporidium parvum
DLRVINGWFCSYVNPHMIKD

SEQ ID NO: 2290202 - protein, 17 aa, Cryptosporidium parvum
DLSGVIFQNGFILEQNI

SEQ ID NO: 2290203 - protein, 27 aa, Cryptosporidium parvum
DLSIGLSPKRSKCMLNDGLELESAIAT

SEQ ID NO: 2290204 - protein, 24 aa, Cryptosporidium parvum
DLSKKRIYFFLGLGPTISNNILKS

SEQ ID NO: 2290205 - protein, 18 aa, Cryptosporidium parvum
DLSLLFSAPIKYRNTDML

SEQ ID NO: 2290206 - protein, 20 aa, Cryptosporidium parvum
DLSLRFVRGTLVVCDIHNKL

SEQ ID NO: 2290207 - protein, 18 aa, Cryptosporidium parvum
DLSSIQWFSIEDVAKIIY

SEQ ID NO: 2290208 - protein, 23 aa, Cryptosporidium parvum
DLSTISFSWRFGAFSNFKEMLSI

SEQ ID NO: 2290209 - protein, 22 aa, Cryptosporidium parvum
DLSWFKRTITFISKLYIVGSKF

SEQ ID NO: 2290210 - protein, 19 aa, Cryptosporidium parvum
DLTALCKLSECLDGRSNRN

SEQ ID NO: 2290211 - protein, 25 aa, Cryptosporidium parvum
DLTCPQCGNNGFVELISFGSQQSQG

SEQ ID NO: 2290212 - protein, 26 aa, Cryptosporidium parvum
DLTQKEMKHWGATIERINRQEIISYG

SEQ ID NO: 2290213 - protein, 17 aa, Cryptosporidium parvum
DLTRCIIDHLSKLSSII

SEQ ID NO: 2290214 - protein, 17 aa, Cryptosporidium parvum
DLTRKCYISKSVLLYYF

SEQ ID NO: 2290215 - protein, 24 aa, Cryptosporidium parvum
DLVIPRGSGELVHMIKKNTCIPVL

SEQ ID NO: 2290216 - protein, 18 aa, Cryptosporidium parvum
DLYESFMLTNLNTFNPSF

SEQ ID NO: 2290217 - protein, 29 aa, Cryptosporidium parvum
DLYKCKKEDLEFVSPFYLKAARKDFVHAF

SEQ ID NO: 2290218 - protein, 21 aa, Cryptosporidium parvum
DLYRIPIYIFEKVRNSKLNAS

SEQ ID NO: 2290219 - protein, 20 aa, Cryptosporidium parvum
DMEVCPNCNQVFKTIVPPEL

SEQ ID NO: 2290220 - protein, 24 aa, Cryptosporidium parvum
DMFHACRLACECCMDIHRTLHNFP

SEQ ID NO: 2290221 - protein, 24 aa, Cryptosporidium parvum
DMHPEKRQKAAWLAYVDNNLPILK

SEQ ID NO: 2290222 - protein, 26 aa, Cryptosporidium parvum
DMIKQKLKFILNHAISKSTSSKSNSR

SEQ ID NO: 2290223 - protein, 24 aa, Cryptosporidium parvum
DMKGSNKINCILFRSSPNSDIQND

SEQ ID NO: 2290224 - protein, 18 aa, Cryptosporidium parvum
DMLFPSISKKINKRKYEY

SEQ ID NO: 2290225 - protein, 26 aa, Cryptosporidium parvum
DMPKELKNCFILTLNVSLEYENSEVT

SEQ ID NO: 2290226 - protein, 30 aa, Cryptosporidium parvum; identical to SEQ ID NO: 2169378

SEQ ID NO: 2290227 - protein, 19 aa, Cryptosporidium parvum
DNACRGVIIAGLPFPSIAD

SEQ ID NO: 2290228 - protein, 18 aa, Cryptosporidium parvum
DNADFPIIILYFDDGKVF

SEQ ID NO: 2290229 - protein, 22 aa, Cryptosporidium parvum
DNATLWSIVIKTAYRKRRSKRK

SEQ ID NO: 2290230 - protein, 19 aa, Cryptosporidium parvum
DNCTLSLRKEGPIWILLIR

SEQ ID NO: 2290231 - protein, 24 aa, Cryptosporidium parvum
DNDIRWQWYSMGYRDYLYTYLGIK

SEQ ID NO: 2290232 - protein, 25 aa, Cryptosporidium parvum
DNDLTLLFVRTLRFFLSSCHEKKFG

SEQ ID NO: 2290233 - protein, 37 aa, Cryptosporidium parvum; identical to SEQ ID NO: 2169382

SEQ ID NO: 2290234 - protein, 18 aa, Cryptosporidium parvum
DNECRLVQFLIDFYCMND

SEQ ID NO: 2290235 - protein, 25 aa, Cryptosporidium parvum
DNELNIMLLQGMNPYSGPEIKIEYD

SEQ ID NO: 2290236 - protein, 27 aa, Cryptosporidium parvum
DNFNPRSGIRWLCFILGEYGKLISSKV

SEQ ID NO: 2290237 - protein, 19 aa, Cryptosporidium parvum
DNFSLCFSISNHIIQQYHP

SEQ ID NO: 2290238 - protein, 23 aa, Cryptosporidium parvum
DNGGRFLSLHAYNLSKLNSNIPS

SEQ ID NO: 2290239 - protein, 26 aa, Cryptosporidium parvum
DNGPVNLRYGSLMLMTDQDHDGSHIK

SEQ ID NO: 2290240 - protein, 25 aa, Cryptosporidium parvum
DNIEIYSYLNACPKSLLEVYWENEV

SEQ ID NO: 2290241 - protein, 26 aa, Cryptosporidium parvum
DNIIKRKFIEWKKYILSDFLKFENFD

SEQ ID NO: 2290242 - protein, 24 aa, Cryptosporidium parvum
DNIKDLNRVTAFRHFCELHLIPLY

SEQ ID NO: 2290243 - protein, 20 aa, Cryptosporidium parvum
DNIKKGFTIENDWETRMKIR

SEQ ID NO: 2290244 - protein, 24 aa, Cryptosporidium parvum
DNILNWERTVLKYFIFGGAIRVKI

SEQ ID NO: 2290245 - protein, 25 aa, Cryptosporidium parvum
DNIRSQKLPSFGFENRFQDNIKGKG

SEQ ID NO: 2290246 - protein, 24 aa, Cryptosporidium parvum
DNISKAALLLPFAIQKELKLFNSC

SEQ ID NO: 2290247 - protein, 19 aa, Cryptosporidium parvum
DNISRCLVLIQFNDSNDKP

SEQ ID NO: 2290248 - protein, 17 aa, Cryptosporidium parvum
DNITKCKIEFPRQPTLS

SEQ ID NO: 2290249 - protein, 26 aa, Cryptosporidium parvum
DNIVRIKMCGPCVVCQDEYSIGDEVM

SEQ ID NO: 2290250 - protein, 22 aa, Cryptosporidium parvum
DNKEEKNEFVLYSEINKEENVD

SEQ ID NO: 2290251 - protein, 25 aa, Cryptosporidium parvum
DNKGRLRVGAAIGVNEIERAKLLVE

SEQ ID NO: 2290252 - protein, 31 aa, Cryptosporidium parvum; identical to SEQ ID NO: 2169394

SEQ ID NO: 2290253 - protein, 23 aa, Cryptosporidium parvum
DNKSELLAAAAAFAASNTMNISN

SEQ ID NO: 2290254 - protein, 19 aa, Cryptosporidium parvum
DNLADVVLFDIAEGIPQGK

SEQ ID NO: 2290255 - protein, 25 aa, Cryptosporidium parvum
DNLEDAWPCAELIGYYLDKKNPGNS

SEQ ID NO: 2290256 - protein, 21 aa, Cryptosporidium parvum
DNLENGMICYYGEDEVIGGYP

SEQ ID NO: 2290257 - protein, 18 aa, Cryptosporidium parvum
DNLEVDIGLDMEMNMNKS

SEQ ID NO: 2290258 - protein, 18 aa, Cryptosporidium parvum
DNLIMEYLGPIDSIRAAN

SEQ ID NO: 2290259 - protein, 18 aa, Cryptosporidium parvum
DNLKFILVQTQLKSLCIS

SEQ ID NO: 2290260 - protein, 17 aa, Cryptosporidium parvum
DNLMFHIAQIYGAISKE

SEQ ID NO: 2290261 - protein, 26 aa, Cryptosporidium parvum
DNNMRVDRLLSMVAQQDSERVLNVIA

SEQ ID NO: 2290262 - protein, 19 aa, Cryptosporidium parvum
DNQGRCVRMQNWLEVSKSN

SEQ ID NO: 2290263 - protein, 21 aa, Cryptosporidium parvum
DNRDYICLWKIISSTASPNKS

SEQ ID NO: 2290264 - protein, 18 aa, Cryptosporidium parvum
DNRFLIKLPIVVQTYSPS

SEQ ID NO: 2290265 - protein, 18 aa, Cryptosporidium parvum
DNSEGLVVVGGVIEQNKN

SEQ ID NO: 2290266 - protein, 23 aa, Cryptosporidium parvum
DNSEVAFQWKCSCWSTNDEFLLE

SEQ ID NO: 2290267 - protein, 28 aa, Cryptosporidium parvum
DNSFGMGGAEAFGGLRTMNYGGGKLSDF

SEQ ID NO: 2290268 - protein, 18 aa, Cryptosporidium parvum
DNSIAWVVEGIFLSKDMY

SEQ ID NO: 2290269 - protein, 19 aa, Cryptosporidium parvum
DNSKEIILEKCRVKVSSDG

SEQ ID NO: 2290270 - protein, 23 aa, Cryptosporidium parvum
DNSWILRYLVLRLEKEHLKMKNI

SEQ ID NO: 2290271 - protein, 17 aa, Cryptosporidium parvum
DNSWNLFHPSLLGSSTR

SEQ ID NO: 2290272 - protein, 20 aa, Cryptosporidium parvum
DNTFILKLIDLFQSFDPRER

SEQ ID NO: 2290273 - protein, 21 aa, Cryptosporidium parvum
DNTHSKIILFAGNYKNGTNNG

SEQ ID NO: 2290274 - protein, 20 aa, Cryptosporidium parvum
DNTRCILGMMSMENTAILSV

SEQ ID NO: 2290275 - protein, 18 aa, Cryptosporidium parvum
DNTRLMLENLRLRDSGGI

SEQ ID NO: 2290276 - protein, 17 aa, Cryptosporidium parvum
DNYCSIDGLLSLILTPT

SEQ ID NO: 2290277 - protein, 33 aa, Cryptosporidium parvum
DPAGNLNGMWYIKGIVTKGIWPFLSATNKVKRA

SEQ ID NO: 2290278 - protein, 23 aa, Cryptosporidium parvum
DPAPYWWYNELRKYGSVPHSGFG

SEQ ID NO: 2290279 - protein, 25 aa, Cryptosporidium parvum
DPCYSRGETLVGYIQGWRNVQDEAL

SEQ ID NO: 2290280 - protein, 20 aa, Cryptosporidium parvum
DPELERYSAIIMDEAHERSL

SEQ ID NO: 2290281 - protein, 20 aa, Cryptosporidium parvum
DPGALILKLLHSGRNIETAS

SEQ ID NO: 2290282 - protein, 19 aa, Cryptosporidium parvum
DPGDSLGIPSFLTITRQQK

SEQ ID NO: 2290283 - protein, 17 aa, Cryptosporidium parvum
DPIEIIEGISLDDLNKK

SEQ ID NO: 2290284 - protein, 33 aa, Cryptosporidium parvum; identical to SEQ ID NO: 2169417

SEQ ID NO: 2290285 - protein, 17 aa, Cryptosporidium parvum
DPIESWLHNLLCLDSTN

SEQ ID NO: 2290286 - protein, 26 aa, Cryptosporidium parvum
DPINWKRSWSSLIRMLYTDYLMSNPK

SEQ ID NO: 2290287 - protein, 22 aa, Cryptosporidium parvum
DPKEEIIKAFKLFDDDETGKIT

SEQ ID NO: 2290288 - protein, 24 aa, Cryptosporidium parvum
DPKLLKLCNNFGFVEFLKLSNEQG

SEQ ID NO: 2290289 - protein, 25 aa, Cryptosporidium parvum
DPKVRIKYLRYIQRLEQRGVEGIDA

SEQ ID NO: 2290290 - protein, 23 aa, Cryptosporidium parvum
DPKVTGCLLVCLNRATRLVKSQQ

SEQ ID NO: 2290291 - protein, 17 aa, Cryptosporidium parvum
DPLLRKKLHKVPGVPLI

SEQ ID NO: 2290292 - protein, 24 aa, Cryptosporidium parvum
DPLRAVFAGLRILDSIRFMGLSSS

SEQ ID NO: 2290293 - protein, 26 aa, Cryptosporidium parvum
DPLTDSWRVGPSMLIGRRNLASITLE

SEQ ID NO: 2290294 - protein, 26 aa, Cryptosporidium parvum
DPLYYSKRVKALMCKSLLNYTDAVRD

SEQ ID NO: 2290295 - protein, 22 aa, Cryptosporidium parvum
DPMRGQSEIQRFCDIKQASETN

SEQ ID NO: 2290296 - protein, 23 aa, Cryptosporidium parvum
DPNICGFIFIIAKPIHIEEPGKT

SEQ ID NO: 2290297 - protein, 24 aa, Cryptosporidium parvum
DPNSCIKYHECIHVPKERLIDVNG

SEQ ID NO: 2290298 - protein, 30 aa, Cryptosporidium parvum
DPPIWKYWSLPNIEFHGLWDVLHYENNLKQ

SEQ ID NO: 2290299 - protein, 23 aa, Cryptosporidium parvum
DPQKKLQVVFSISQLEKALEESN

SEQ ID NO: 2290300 - protein, 21 aa, Cryptosporidium parvum
DPQRCIMWYGQVSAIDGCPVI

SEQ ID NO: 2290301 - protein, 25 aa, Cryptosporidium parvum
DPRDVPWEFLDEISKLDTMPSQELN

SEQ ID NO: 2290302 - protein, 21 aa, Cryptosporidium parvum
DPRTANAIGTIFGHRHTVVRI

SEQ ID NO: 2290303 - protein, 23 aa, Cryptosporidium parvum
DPRVIKKLYSMTGNINLKSLQDE

SEQ ID NO: 2290304 - protein, 23 aa, Cryptosporidium parvum
DPRVIWQKEFLNIPYEVTADLIR

SEQ ID NO: 2290305 - protein, 21 aa, Cryptosporidium parvum
DPSGIALEWKAQAVGQNSKTV

SEQ ID NO: 2290306 - protein, 32 aa, Cryptosporidium parvum; identical to SEQ ID NO: 2169432

SEQ ID NO: 2290307 - protein, 17 aa, Cryptosporidium parvum
DPTHWLWDRIIFSNTRQ

SEQ ID NO: 2290308 - protein, 19 aa, Cryptosporidium parvum
DPYSWAVTIHYEYIMSEND

SEQ ID NO: 2290309 - protein, 23 aa, Cryptosporidium parvum
DPYTLLPEQPWDVMKEDGDKPLA

SEQ ID NO: 2290310 - protein, 18 aa, Cryptosporidium parvum
DPYVLVAIAISFWKENDF

SEQ ID NO: 2290311 - protein, 17 aa, Cryptosporidium parvum
DQEDRWAVWLPTVKREQ

SEQ ID NO: 2290312 - protein, 19 aa, Cryptosporidium parvum
DQFGELWEHIDIIVEDVML

SEQ ID NO: 2290313 - protein, 38 aa, Cryptosporidium parvum
DQFIRHPLCPSFIRSSIVNRLTWNFLFSLLTNGVHIPT

SEQ ID NO: 2290314 - protein, 33 aa, Cryptosporidium parvum; identical to SEQ ID NO: 2169441

SEQ ID NO: 2290315 - protein, 22 aa, Cryptosporidium parvum
DQFPRVRYACCQTIGQISLDHS

SEQ ID NO: 2290316 - protein, 32 aa, Cryptosporidium parvum; identical to SEQ ID NO: 2169443

SEQ ID NO: 2290317 - protein, 20 aa, Cryptosporidium parvum
DQGKPIWGLLPPIEDDDSNN

SEQ ID NO: 2290318 - protein, 17 aa, Cryptosporidium parvum
DQGMLVIVASGNYESDR

SEQ ID NO: 2290319 - protein, 19 aa, Cryptosporidium parvum
DQGRALLKSELSAYLRSHP

SEQ ID NO: 2290320 - protein, 19 aa, Cryptosporidium parvum
DQIELRNIFDLILNKMEIK

SEQ ID NO: 2290321 - protein, 22 aa, Cryptosporidium parvum
DQIFRKRLDDLEIERNNLIEKI

SEQ ID NO: 2290322 - protein, 22 aa, Cryptosporidium parvum
DQIKIPFLLKNNMREYQVAGLE

SEQ ID NO: 2290323 - protein, 32 aa, Cryptosporidium parvum
DQIKKIRCVSFWVKEWGILFVGSTAFSQMVVF

SEQ ID NO: 2290324 - protein, 22 aa, Cryptosporidium parvum
DQIPELRLDEMETNIIEPTLEE

SEQ ID NO: 2290325 - protein, 18 aa, Cryptosporidium parvum
DQIRKIQTEFGWNTYKSS

SEQ ID NO: 2290326 - protein, 23 aa, Cryptosporidium parvum
DQLGCFAKFCLRVDGSAKLTFIQ

SEQ ID NO: 2290327 - protein, 23 aa, Cryptosporidium parvum
DQLYEESIIDFLKKNGRTNMAMI

SEQ ID NO: 2290328 - protein, 22 aa, Cryptosporidium parvum
DQLYEWAKKLILAGKAYVDHQT

SEQ ID NO: 2290329 - protein, 25 aa, Cryptosporidium parvum
DQMSSVLLKRSCELLIASFDVNSSL

SEQ ID NO: 2290330 - protein, 24 aa, Cryptosporidium parvum
DQNIPICSAFGSPFDSSLIISSSL

SEQ ID NO: 2290331 - protein, 26 aa, Cryptosporidium parvum
DQRIRPNTQLQWLFIDKWPHLVVLTI

SEQ ID NO: 2290332 - protein, 24 aa, Cryptosporidium parvum
DQSGSWEYSEFIAASMEPEMYLNN

SEQ ID NO: 2290333 - protein, 33 aa, Cryptosporidium parvum
DQSRIGMYYAPMLGIAPSWCSFLDSITEELEEE

SEQ ID NO: 2290334 - protein, 25 aa, Cryptosporidium parvum
DQVCIHYLRGLSWVLGYYYHGVPSW

SEQ ID NO: 2290335 - protein, 24 aa, Cryptosporidium parvum
DQWRGSCYGTLYKGVEYLKSNNYD

SEQ ID NO: 2290336 - protein, 18 aa, Cryptosporidium parvum
DQYEICNESLKIVNEEFE

SEQ ID NO: 2290337 - protein, 22 aa, Cryptosporidium parvum
DQYKKEILSLLLESRPAIVESA

SEQ ID NO: 2290338 - protein, 35 aa, Cryptosporidium parvum; identical to SEQ ID NO: 2169461

SEQ ID NO: 2290339 - protein, 22 aa, Cryptosporidium parvum
DQYSGLPPHIFKMAQNAYDSLF

SEQ ID NO: 2290340 - protein, 48 aa, Cryptosporidium parvum; identical to SEQ ID NO: 2169462

SEQ ID NO: 2290341 - protein, 26 aa, Cryptosporidium parvum
DRDDWVRKLSRLMIPYVQKGVLDLGE

SEQ ID NO: 2290342 - protein, 21 aa, Cryptosporidium parvum
DREDLEYNDFISLLANDIENH

SEQ ID NO: 2290343 - protein, 18 aa, Cryptosporidium parvum
DRFIDALNATKCAIEQGI

SEQ ID NO: 2290344 - protein, 19 aa, Cryptosporidium parvum
DRFPTLNLSPPVTGGVTIK

SEQ ID NO: 2290345 - protein, 20 aa, Cryptosporidium parvum
DRFSSFFTEPLFCKDMTEKE

SEQ ID NO: 2290346 - protein, 18 aa, Cryptosporidium parvum
DRFTEAFKSVGIKHNVIK

SEQ ID NO: 2290347 - protein, 21 aa, Cryptosporidium parvum
DRGVLFKGILRMISRNRGEIE

SEQ ID NO: 2290348 - protein, 21 aa, Cryptosporidium parvum
DRHEKSLGICINFILNKSNLT

SEQ ID NO: 2290349 - protein, 17 aa, Cryptosporidium parvum
DRICRIVLEHALNLLPY

SEQ ID NO: 2290350 - protein, 18 aa, Cryptosporidium parvum
DRIIKRGHFSERYAAVIM

SEQ ID NO: 2290351 - protein, 25 aa, Cryptosporidium parvum
DRIQELFCRYKLKVDNIKRINKVNH

SEQ ID NO: 2290352 - protein, 22 aa, Cryptosporidium parvum
DRIRTLKTLFGYQVGMPGRPLL

SEQ ID NO: 2290353 - protein, 25 aa, Cryptosporidium parvum
DRISDDWRWLALKSEKRLNNMKKMN

SEQ ID NO: 2290354 - protein, 20 aa, Cryptosporidium parvum
DRISSLINYNVWHKLERYCK

SEQ ID NO: 2290355 - protein, 26 aa, Cryptosporidium parvum
DRKATPFLCLLVKLLQIRPSTEIVLE

SEQ ID NO: 2290356 - protein, 20 aa, Cryptosporidium parvum
DRKISDIYTNHMDNNSDHQL

SEQ ID NO: 2290357 - protein, 23 aa, Cryptosporidium parvum
DRKKEIMDNLPLITDQFSTSKNS

SEQ ID NO: 2290358 - protein, 21 aa, Cryptosporidium parvum
DRKRSSSIMSFELIEENSSIS

SEQ ID NO: 2290359 - protein, 22 aa, Cryptosporidium parvum
DRMRFKVINLFKKWTSRLSNSN

SEQ ID NO: 2290360 - protein, 18 aa, Cryptosporidium parvum
DRNTRFVHRSRLLAHKEV

SEQ ID NO: 2290361 - protein, 18 aa, Cryptosporidium parvum
DRPFPFVLVAGVEKAPLK

SEQ ID NO: 2290362 - protein, 23 aa, Cryptosporidium parvum
DRQRWSRRRNLSKIISGKNVNNT

SEQ ID NO: 2290363 - protein, 23 aa, Cryptosporidium parvum
DRQTLLWSATWPKEVQKLARDLC

SEQ ID NO: 2290364 - protein, 22 aa, Cryptosporidium parvum
DRRKAMELACHRVALREHIAIQ

SEQ ID NO: 2290365 - protein, 19 aa, Cryptosporidium parvum
DRRLAICKYHDTQISISEN

SEQ ID NO: 2290366 - protein, 18 aa, Cryptosporidium parvum
DRRNVIVVLFLIREYPLA

SEQ ID NO: 2290367 - protein, 18 aa, Cryptosporidium parvum
DRSKSNSYIKTWGKEKWT

SEQ ID NO: 2290368 - protein, 23 aa, Cryptosporidium parvum
DRSPLFPGSSCFPLSPDNKQQTE

SEQ ID NO: 2290369 - protein, 18 aa, Cryptosporidium parvum
DRVGCSINSNIARNTYGK

SEQ ID NO: 2290370 - protein, 17 aa, Cryptosporidium parvum
DRVGVVIAILLSILGVG

SEQ ID NO: 2290371 - protein, 19 aa, Cryptosporidium parvum
DRVKRSWTNKRIGKENNSS

SEQ ID NO: 2290372 - protein, 22 aa, Cryptosporidium parvum
DRVYKIAPYRIKSMINQDFKIE

SEQ ID NO: 2290373 - protein, 20 aa, Cryptosporidium parvum
DRYGNIIAIMNLFKDYKFDN

SEQ ID NO: 2290374 - protein, 24 aa, Cryptosporidium parvum
DRYYRLLYSQLLYRPIYISKNKKL

SEQ ID NO: 2290375 - protein, 17 aa, Cryptosporidium parvum
DSACVFHNCSSRFSDGY

SEQ ID NO: 2290376 - protein, 25 aa, Cryptosporidium parvum
DSAFSKLIELCFELKHSLATKYIGR

SEQ ID NO: 2290377 - protein, 18 aa, Cryptosporidium parvum
DSAIKKAHYFDRIETERN

SEQ ID NO: 2290378 - protein, 22 aa, Cryptosporidium parvum
DSARFMILIRNAMEDLQHQVET

SEQ ID NO: 2290379 - protein, 22 aa, Cryptosporidium parvum
DSCQAFENIDFIQGRVKGGEEV

SEQ ID NO: 2290380 - protein, 20 aa, Cryptosporidium parvum
DSDLRMCERVNNKLKRAFIN

SEQ ID NO: 2290381 - protein, 31 aa, Cryptosporidium parvum
DSDPLMSRYRCYTEWKLLYRCNRHPNILNLI

SEQ ID NO: 2290382 - protein, 23 aa, Cryptosporidium parvum
DSEISITDLITWHISEYDHPESE

SEQ ID NO: 2290383 - protein, 20 aa, Cryptosporidium parvum
DSFCCPDCKNNEDFCYICRD

SEQ ID NO: 2290384 - protein, 20 aa, Cryptosporidium parvum
DSFEWQLKYKNKMKGNMIFM

SEQ ID NO: 2290385 - protein, 19 aa, Cryptosporidium parvum
DSFEYFQYFMTIKLNQFVD

SEQ ID NO: 2290386 - protein, 26 aa, Cryptosporidium parvum
DSFFILRLLIPPLFGKKSFDQFSESG

SEQ ID NO: 2290387 - protein, 17 aa, Cryptosporidium parvum
DSFGLCHKETLIHEGNP

SEQ ID NO: 2290388 - protein, 24 aa, Cryptosporidium parvum
DSFGVVELCWTLNFNQIGDFYPSN

SEQ ID NO: 2290389 - protein, 17 aa, Cryptosporidium parvum
DSFKIPLLIDLNGEVVK

SEQ ID NO: 2290390 - protein, 17 aa, Cryptosporidium parvum
DSFKLQKGVYMDHFRIS

SEQ ID NO: 2290391 - protein, 19 aa, Cryptosporidium parvum
DSFKLYVCGDYSNDDNEVF

SEQ ID NO: 2290392 - protein, 18 aa, Cryptosporidium parvum
DSFLEYRFKIASLLWDNH

SEQ ID NO: 2290393 - protein, 24 aa, Cryptosporidium parvum
DSGALQYYGKWIILGNMKRSLEKN

SEQ ID NO: 2290394 - protein, 24 aa, Cryptosporidium parvum
DSGKFRRGAPCWYIVHGQSNAIND

SEQ ID NO: 2290395 - protein, 18 aa, Cryptosporidium parvum
DSGKRIDFSLLMNNNKCS

SEQ ID NO: 2290396 - protein, 18 aa, Cryptosporidium parvum
DSGLLGGNFEEYITPIQL

SEQ ID NO: 2290397 - protein, 17 aa, Cryptosporidium parvum
DSIARATSFLYFEQCNV

SEQ ID NO: 2290398 - protein, 19 aa, Cryptosporidium parvum
DSIFSESSCVSGYTMMKSS

SEQ ID NO: 2290399 - protein, 17 aa, Cryptosporidium parvum
DSIFVKCHDIQVENIKY

SEQ ID NO: 2290400 - protein, 17 aa, Cryptosporidium parvum
DSIGNYFLFSRDILQSD

SEQ ID NO: 2290401 - protein, 25 aa, Cryptosporidium parvum
DSIKKYLCCFLFHYIAEFQGVWICF

SEQ ID NO: 2290402 - protein, 19 aa, Cryptosporidium parvum
DSILIKNLICFDHPTTEIN

SEQ ID NO: 2290403 - protein, 18 aa, Cryptosporidium parvum
DSIPIEYLDLIKRWLNEM

SEQ ID NO: 2290404 - protein, 24 aa, Cryptosporidium parvum
DSIRLFKEGNLICDLRLKDLELNS

SEQ ID NO: 2290405 - protein, 22 aa, Cryptosporidium parvum
DSIRREKLWIWIGSQVNEGVRE

SEQ ID NO: 2290406 - protein, 22 aa, Cryptosporidium parvum
DSIVSLGERSDLEFARNRKSMF

SEQ ID NO: 2290407 - protein, 19 aa, Cryptosporidium parvum
DSKLEVISQSYSIFSSSSS

SEQ ID NO: 2290408 - protein, 20 aa, Cryptosporidium parvum
DSKLILSYCLSFHNVKYYLN

SEQ ID NO: 2290409 - protein, 25 aa, Cryptosporidium parvum
DSKLIRLIWEGLNICVPINNKKKQF

SEQ ID NO: 2290410 - protein, 28 aa, Cryptosporidium parvum
DSKLRISIQRLLAGMTFELDSEQEQTST

SEQ ID NO: 2290411 - protein, 20 aa, Cryptosporidium parvum
DSKMSYKYCKPIIVSSNKVF

SEQ ID NO: 2290412 - protein, 25 aa, Cryptosporidium parvum
DSKRFKELHEFGTMYRLLLSGTPLH

SEQ ID NO: 2290413 - protein, 26 aa, Cryptosporidium parvum
DSKVFPYPICFVSKSLPTPPKDYNLR

SEQ ID NO: 2290414 - protein, 23 aa, Cryptosporidium parvum
DSKWNWSNKQLLTLFDLIHDSYN

SEQ ID NO: 2290415 - protein, 22 aa, Cryptosporidium parvum
DSLATKNYAGWGYGIRYTYGIF

SEQ ID NO: 2290416 - protein, 19 aa, Cryptosporidium parvum
DSLCRRYPLASWGASKVLS

SEQ ID NO: 2290417 - protein, 24 aa, Cryptosporidium parvum
DSLEGKIPLGFSFSVSAMLIPYHL

SEQ ID NO: 2290418 - protein, 19 aa, Cryptosporidium parvum
DSLELSLLLNFRSLSTKLQ

SEQ ID NO: 2290419 - protein, 31 aa, Cryptosporidium parvum
DSLLLEILCYLDAIWNKGKILYPIFVTSPLI

SEQ ID NO: 2290420 - protein, 19 aa, Cryptosporidium parvum
DSLLSRFDLQFLLLDIPDK

SEQ ID NO: 2290421 - protein, 18 aa, Cryptosporidium parvum
DSLMDFIFFIWAADDEFW

SEQ ID NO: 2290422 - protein, 23 aa, Cryptosporidium parvum
DSLNLAWRLAFVLKNKYEEDIKK

SEQ ID NO: 2290423 - protein, 24 aa, Cryptosporidium parvum
DSLSGDRLGCFNLSLKGHGHAVSF

SEQ ID NO: 2290424 - protein, 20 aa, Cryptosporidium parvum
DSLVCKAGIIASKAAGDARF

SEQ ID NO: 2290425 - protein, 30 aa, Cryptosporidium parvum; identical to SEQ ID NO: 2169538

SEQ ID NO: 2290426 - protein, 25 aa, Cryptosporidium parvum
DSMLRRGKLFFSVCASSYQLGKKTE

SEQ ID NO: 2290427 - protein, 31 aa, Cryptosporidium parvum
DSNERGKSLWLWKPLPQFISRSNRYQLDNLS

SEQ ID NO: 2290428 - protein, 25 aa, Cryptosporidium parvum
DSNFLRWRVCFEGPPDTLYEGGIFN

SEQ ID NO: 2290429 - protein, 25 aa, Cryptosporidium parvum
DSNGLNKYPFCLTILSSGKLINTLS

SEQ ID NO: 2290430 - protein, 18 aa, Cryptosporidium parvum
DSNTAIAFLLRHEENLEQ

SEQ ID NO: 2290431 - protein, 17 aa, Cryptosporidium parvum
DSPDIISDWYFKKSKNI

SEQ ID NO: 2290432 - protein, 22 aa, Cryptosporidium parvum
DSQDINLIWSRSRVFELQVANC

SEQ ID NO: 2290433 - protein, 19 aa, Cryptosporidium parvum
DSQIAKMYLEMYPGDMNSA

SEQ ID NO: 2290434 - protein, 25 aa, Cryptosporidium parvum
DSQLFISLLESWVGIKYEKAKYIQI

SEQ ID NO: 2290435 - protein, 18 aa, Cryptosporidium parvum
DSQMLMIVPSEFSFGSNY

SEQ ID NO: 2290436 - protein, 23 aa, Cryptosporidium parvum
DSSCPVFTFGAPVNNMNTNHQNS

SEQ ID NO: 2290437 - protein, 19 aa, Cryptosporidium parvum
DSSFKDFLNSLGLNESLYA

SEQ ID NO: 2290438 - protein, 33 aa, Cryptosporidium parvum
DSSFRLPVELEMVKCPEFPVLDFHHWYENFQNS

SEQ ID NO: 2290439 - protein, 17 aa, Cryptosporidium parvum
DSSGIFVLFNFKLKFNK

SEQ ID NO: 2290440 - protein, 22 aa, Cryptosporidium parvum
DSSKLCISKNCLDITSDSKGDE

SEQ ID NO: 2290441 - protein, 22 aa, Cryptosporidium parvum
DSSLKPQLSIFGRPSPVDEEKK

SEQ ID NO: 2290442 - protein, 18 aa, Cryptosporidium parvum
DSSMFGMLLSSIFTAGIK

SEQ ID NO: 2290443 - protein, 21 aa, Cryptosporidium parvum
DSSNLPLYSLGSFQDANYYPN

SEQ ID NO: 2290444 - protein, 19 aa, Cryptosporidium parvum
DSSRKAFLRDLRKLIEESD

SEQ ID NO: 2290445 - protein, 32 aa, Cryptosporidium parvum
DSSTNVNACMDISGYVSDLSLKNVTTGTKTGE

SEQ ID NO: 2290446 - protein, 21 aa, Cryptosporidium parvum
DSSVLCSLVLTVSDLCSMYRD

SEQ ID NO: 2290447 - protein, 22 aa, Cryptosporidium parvum
DSTDFPSKRKVPLDTNNGIVRI

SEQ ID NO: 2290448 - protein, 23 aa, Cryptosporidium parvum
DSTECYRAHQSYIQRRFANGDFG

SEQ ID NO: 2290449 - protein, 17 aa, Cryptosporidium parvum
DSTRGAGGVGVGMGANG

SEQ ID NO: 2290450 - protein, 23 aa, Cryptosporidium parvum
DSVHNMPNWLLKNITFRLKEEFP

SEQ ID NO: 2290451 - protein, 17 aa, Cryptosporidium parvum
DSVLGHSLGEFIAATIS

SEQ ID NO: 2290452 - protein, 18 aa, Cryptosporidium parvum
DSVPFKCDIIISEWMGYC

SEQ ID NO: 2290453 - protein, 18 aa, Cryptosporidium parvum
DSVPKIIGHFLVRQIMDK

SEQ ID NO: 2290454 - protein, 25 aa, Cryptosporidium parvum
DSVRVSLKFYFKCEFERRLFNQLTI

SEQ ID NO: 2290455 - protein, 17 aa, Cryptosporidium parvum
DSYYKWSVQLESWDYSA

SEQ ID NO: 2290456 - protein, 26 aa, Cryptosporidium parvum
DTDLRCSQCGKVFHFDCLRNCNLIGS

SEQ ID NO: 2290457 - protein, 24 aa, Cryptosporidium parvum
DTDQRIQGLIGRYNSMCMDDQILK

SEQ ID NO: 2290458 - protein, 20 aa, Cryptosporidium parvum
DTEHFWSLCNDKFMLIAYKW

SEQ ID NO: 2290459 - protein, 21 aa, Cryptosporidium parvum
DTENKGILGFSDFGNACRLVS

SEQ ID NO: 2290460 - protein, 31 aa, Cryptosporidium parvum
DTFFFRQLQCELCKSPLPSSASIKGSRVNIV

SEQ ID NO: 2290461 - protein, 19 aa, Cryptosporidium parvum
DTFMRRYNTIPTFLSEVDY

SEQ ID NO: 2290462 - protein, 21 aa, Cryptosporidium parvum
DTFSGKGLFRYSGHLNEITDI

SEQ ID NO: 2290463 - protein, 20 aa, Cryptosporidium parvum
DTICADCEGVGGPKDAIQYC

SEQ ID NO: 2290464 - protein, 18 aa, Cryptosporidium parvum
DTIIPFHNLYYLKSKISK

SEQ ID NO: 2290465 - protein, 21 aa, Cryptosporidium parvum
DTIIYIWSFKHKKLINKLVGH

SEQ ID NO: 2290466 - protein, 21 aa, Cryptosporidium parvum
DTIRNLSFILGKVVSNEPETL

SEQ ID NO: 2290467 - protein, 24 aa, Cryptosporidium parvum
DTISEVVDVFSFFDTVKRIYYSWQ

SEQ ID NO: 2290468 - protein, 19 aa, Cryptosporidium parvum
DTKELKLSESLEDLNGLNN

SEQ ID NO: 2290469 - protein, 25 aa, Cryptosporidium parvum
DTKKKSKVCGINWTCDGNKLVYSAR

SEQ ID NO: 2290470 - protein, 18 aa, Cryptosporidium parvum
DTKLEEFCETISQRKEGR

SEQ ID NO: 2290471 - protein, 23 aa, Cryptosporidium parvum
DTKLSVPIIEGVLKYWPITNSSK

SEQ ID NO: 2290472 - protein, 23 aa, Cryptosporidium parvum
DTLLCIIQRVSLLWENKDFEFFE

SEQ ID NO: 2290473 - protein, 31 aa, Cryptosporidium parvum; identical to SEQ ID NO: 2169574

SEQ ID NO: 2290474 - protein, 24 aa, Cryptosporidium parvum
DTPSGSIGKLIFRQDGNIDLYLNS

SEQ ID NO: 2290475 - protein, 23 aa, Cryptosporidium parvum
DTQKWNVILGRRLILNRRVGLGC

SEQ ID NO: 2290476 - protein, 22 aa, Cryptosporidium parvum
DTQRFSQFWIVNNIINSLFSTN

SEQ ID NO: 2290477 - protein, 26 aa, Cryptosporidium parvum
DTRIFPLKPGVPFTDDFQLIVKNILR

SEQ ID NO: 2290478 - protein, 23 aa, Cryptosporidium parvum
DTRKFRPRKNISFSPGPINIAWS

SEQ ID NO: 2290479 - protein, 22 aa, Cryptosporidium parvum
DTRQIKIMRFKKIKELKSSLSL

SEQ ID NO: 2290480 - protein, 20 aa, Cryptosporidium parvum
DTSELFKLVGNRNKIFKNTL

SEQ ID NO: 2290481 - protein, 23 aa, Cryptosporidium parvum
DTSLPVIFQIAIKTLRQFHLGSV

SEQ ID NO: 2290482 - protein, 18 aa, Cryptosporidium parvum
DTSLTIERLKAFNMLSSS

SEQ ID NO: 2290483 - protein, 20 aa, Cryptosporidium parvum
DTSNLCSPTPVISFEDNGVA

SEQ ID NO: 2290484 - protein, 28 aa, Cryptosporidium parvum
DTVINRCGHLFCRDCIDRNLSSRNRKCP

SEQ ID NO: 2290485 - protein, 27 aa, Cryptosporidium parvum
DVAHSEWVRDVAWRPSVDLLAETIASC

SEQ ID NO: 2290486 - protein, 23 aa, Cryptosporidium parvum
DVDEIHEYLLLKGVNAVAIHGGL

SEQ ID NO: 2290487 - protein, 18 aa, Cryptosporidium parvum
DVDFDFPEMQAIKNALAN

SEQ ID NO: 2290488 - protein, 29 aa, Cryptosporidium parvum
DVEELKNGLRWGLKYLKLEDYRKGQKDAI

SEQ ID NO: 2290489 - protein, 20 aa, Cryptosporidium parvum
DVEIRFEAIGLISSIVESND

SEQ ID NO: 2290490 - protein, 24 aa, Cryptosporidium parvum
DVEKCIFLSDGRFHLESAMIQNPS

SEQ ID NO: 2290491 - protein, 18 aa, Cryptosporidium parvum
DVFNFSFDFKHFLKDEEL

SEQ ID NO: 2290492 - protein, 17 aa, Cryptosporidium parvum
DVFWSMLARKLSCFDWF

SEQ ID NO: 2290493 - protein, 26 aa, Cryptosporidium parvum
DVGGCFLNFRRLILANVNFTYFCSIK

SEQ ID NO: 2290494 - protein, 22 aa, Cryptosporidium parvum
DVGLEPKPIFELDDLSYKQRRK

SEQ ID NO: 2290495 - protein, 62 aa, Cryptosporidium parvum; identical to SEQ ID NO: 2169592

SEQ ID NO: 2290496 - protein, 19 aa, Cryptosporidium parvum
DVKSNLCLINSRPNYKNRA

SEQ ID NO: 2290497 - protein, 21 aa, Cryptosporidium parvum
DVLDPALLRPGRLDRKVEIPL

SEQ ID NO: 2290498 - protein, 24 aa, Cryptosporidium parvum
DVLFKTELINGISTVSRIENFFNG

SEQ ID NO: 2290499 - protein, 19 aa, Cryptosporidium parvum
DVLSSLALVSLDTSDGPFC

SEQ ID NO: 2290500 - protein, 17 aa, Cryptosporidium parvum
DVLTLFIDYRLLSEICN

SEQ ID NO: 2290501 - protein, 21 aa, Cryptosporidium parvum
DVNDPDFWKKVLGDSSVSSFL

SEQ ID NO: 2290502 - protein, 20 aa, Cryptosporidium parvum
DVNGLHILLKFPSEAETTVM

SEQ ID NO: 2290503 - protein, 26 aa, Cryptosporidium parvum
DVNQCVGHAFAFAFLQQVVVEPSVKY

SEQ ID NO: 2290504 - protein, 33 aa, Cryptosporidium parvum; identical to SEQ ID NO: 2169601

SEQ ID NO: 2290505 - protein, 20 aa, Cryptosporidium parvum
DVNWSDGELINFDDFDKLLN

SEQ ID NO: 2290506 - protein, 23 aa, Cryptosporidium parvum
DVPCLACPVFETCSWSFESQILP

SEQ ID NO: 2290507 - protein, 25 aa, Cryptosporidium parvum
DVQYGIKFWAHIGGVPQWEMLMLEY

SEQ ID NO: 2290508 - protein, 26 aa, Cryptosporidium parvum
DVRINWRKVIIRSRMNHVNILDDLNK

SEQ ID NO: 2290509 - protein, 26 aa, Cryptosporidium parvum
DVSEGCSLLVRNLRFETSPGRVRHHF

SEQ ID NO: 2290510 - protein, 24 aa, Cryptosporidium parvum
DVSKYSFLLQYIIDINIKIIQDDE

SEQ ID NO: 2290511 - protein, 25 aa, Cryptosporidium parvum
DVSNCNCGYMFKVIVVSDCFVGKRI

SEQ ID NO: 2290512 - protein, 17 aa, Cryptosporidium parvum
DVTCARMLLSKAKNIHI

SEQ ID NO: 2290513 - protein, 25 aa, Cryptosporidium parvum
DVVASLKVLLPVVGDEINEILKLAT

SEQ ID NO: 2290514 - protein, 19 aa, Cryptosporidium parvum
DVYCNCLDLLQAKQLVKNK

SEQ ID NO: 2290515 - protein, 25 aa, Cryptosporidium parvum
DVYELALLSVEWGNYLGGTFIRYWK

SEQ ID NO: 2290516 - protein, 24 aa, Cryptosporidium parvum
DWCISRQLWWGHRIPAYKIISSKL

SEQ ID NO: 2290517 - protein, 20 aa, Cryptosporidium parvum
DWGPVYIIKKVESLLDKLLL

SEQ ID NO: 2290518 - protein, 18 aa, Cryptosporidium parvum
DWLLCELIWEQVLLELGV

SEQ ID NO: 2290519 - protein, 19 aa, Cryptosporidium parvum
DWNQVVWKKGGSRPKGISK

SEQ ID NO: 2290520 - protein, 32 aa, Cryptosporidium parvum
DWNSIRDSLILDRELLIKLAPPHYESYLKNTI

SEQ ID NO: 2290521 - protein, 20 aa, Cryptosporidium parvum
DWQDIEWESANTILTKPQEN

SEQ ID NO: 2290522 - protein, 32 aa, Cryptosporidium parvum
DWVCYYLSAGIALRFISNIKKLYADNNNKENS

SEQ ID NO: 2290523 - protein, 26 aa, Cryptosporidium parvum
DYCNFKGGFQKLDLSKIIQLQESANS

SEQ ID NO: 2290524 - protein, 18 aa, Cryptosporidium parvum
DYDFSLACKNLFATLHQA

SEQ ID NO: 2290525 - protein, 26 aa, Cryptosporidium parvum
DYFKEEAIEWAFKLLTQVYGIPKDRL

SEQ ID NO: 2290526 - protein, 22 aa, Cryptosporidium parvum
DYFRVLWNFISSVDLVRKTKLD

SEQ ID NO: 2290527 - protein, 17 aa, Cryptosporidium parvum
DYIDRLYAMVKPRRLIY

SEQ ID NO: 2290528 - protein, 21 aa, Cryptosporidium parvum
DYIFFKCIEFITETKYSSCMI

SEQ ID NO: 2290529 - protein, 18 aa, Cryptosporidium parvum
DYIIEILNSFNISSLTLE

SEQ ID NO: 2290530 - protein, 17 aa, Cryptosporidium parvum
DYILYPSSCCGYIINSS

SEQ ID NO: 2290531 - protein, 18 aa, Cryptosporidium parvum
DYISTIILSGRIRNIENK

SEQ ID NO: 2290532 - protein, 28 aa, Cryptosporidium parvum
DYITQVEFLTGMLIFRPYNIKEKNSPNF

SEQ ID NO: 2290533 - protein, 20 aa, Cryptosporidium parvum
DYLLMTILFVLKVERDEFVK

SEQ ID NO: 2290534 - protein, 17 aa, Cryptosporidium parvum
DYLRMMIIIYKMNKIYY

SEQ ID NO: 2290535 - protein, 18 aa, Cryptosporidium parvum
DYLSTWPELCFVCEAPDH

SEQ ID NO: 2290536 - protein, 24 aa, Cryptosporidium parvum
DYNEKKEDLSLCEILENNDEGLNE

SEQ ID NO: 2290537 - protein, 17 aa, Cryptosporidium parvum
DYNEWKSEALIFEIDGY

SEQ ID NO: 2290538 - protein, 24 aa, Cryptosporidium parvum
DYNIFRRNCLTFADELCMVLNVGQ

SEQ ID NO: 2290539 - protein, 20 aa, Cryptosporidium parvum
DYNLRHFNEYGGLEGLTKLK

SEQ ID NO: 2290540 - protein, 19 aa, Cryptosporidium parvum
DYNTGKWSNYSMHNQYYIP

SEQ ID NO: 2290541 - protein, 21 aa, Cryptosporidium parvum
DYPSMRVPSLIVFGQGQSQNH

SEQ ID NO: 2290542 - protein, 24 aa, Cryptosporidium parvum
DYRIFRVSGEFSRALQQARVAKKL

SEQ ID NO: 2290543 - protein, 23 aa, Cryptosporidium parvum
DYSGFRIVVRPLPPIPFTICDWP

SEQ ID NO: 2290544 - protein, 22 aa, Cryptosporidium parvum
DYSHPIKGVGTYGSISSIETTI

SEQ ID NO: 2290545 - protein, 21 aa, Cryptosporidium parvum
DYSLLSASLRKRGKVNNMVSG

SEQ ID NO: 2290546 - protein, 18 aa, Cryptosporidium parvum
DYTYLRKLFRDLMQREGY

SEQ ID NO: 2290547 - protein, 20 aa, Cryptosporidium parvum
DYVATRWYRAPEILLGSTKY

SEQ ID NO: 2290548 - protein, 25 aa, Cryptosporidium parvum
DYVPGKGRGAIGFASGVSRDDQTIT

SEQ ID NO: 2290549 - protein, 21 aa, Cryptosporidium parvum
DYWKRVAVITKVRICKLNVEI

SEQ ID NO: 2290550 - protein, 18 aa, Cryptosporidium parvum
DYYGRRLATASSDHTIRI

SEQ ID NO: 2290551 - protein, 24 aa, Cryptosporidium parvum
EAAAKKLQSAWIHYKKKRLVILLR

SEQ ID NO: 2290552 - protein, 23 aa, Cryptosporidium parvum
EAALCCIREKMDVIDMEDETIDA

SEQ ID NO: 2290553 - protein, 18 aa, Cryptosporidium parvum
EACSMNNERLEVITKTAI

SEQ ID NO: 2290554 - protein, 20 aa, Cryptosporidium parvum
EADLTCRIYGGTASNHNSNA

SEQ ID NO: 2290555 - protein, 27 aa, Cryptosporidium parvum
EADLWSLGVLFYVMLGGAFPFDERKGN

SEQ ID NO: 2290556 - protein, 29 aa, Cryptosporidium parvum
EAEEKLYIRRVCLIQSTFRMYLQRRYFIR

SEQ ID NO: 2290557 - protein, 22 aa, Cryptosporidium parvum
EAESSLGMEPRIEDSFSQIEYV

SEQ ID NO: 2290558 - protein, 32 aa, Cryptosporidium parvum; identical to SEQ ID NO: 2169657

SEQ ID NO: 2290559 - protein, 24 aa, Cryptosporidium parvum
EAEVIRKLSLAGGRMQIKPFLDAM

SEQ ID NO: 2290560 - protein, 24 aa, Cryptosporidium parvum
EAFCSKWFVGLNVHVLPFPSLCKF

SEQ ID NO: 2290561 - protein, 21 aa, Cryptosporidium parvum
EAFLPTIDLLMALKATYGNEL

SEQ ID NO: 2290562 - protein, 24 aa, Cryptosporidium parvum
EAGNKFKILKAWMDGCECFSRAAE

SEQ ID NO: 2290563 - protein, 17 aa, Cryptosporidium parvum
EAGRMLLEKGFKFDVVY

SEQ ID NO: 2290564 - protein, 19 aa, Cryptosporidium parvum
EAIFKLKEYIIQNLSNSLN

SEQ ID NO: 2290565 - protein, 19 aa, Cryptosporidium parvum
EAIRTVIEYVSTKYGPEEE

SEQ ID NO: 2290566 - protein, 19 aa, Cryptosporidium parvum
EAISTLALDYCAKAKILVV

SEQ ID NO: 2290567 - protein, 18 aa, Cryptosporidium parvum
EAITSPWVDPHKMEQLSY

SEQ ID NO: 2290568 - protein, 21 aa, Cryptosporidium parvum
EAITYLKECVLIFRRKESTKN

SEQ ID NO: 2290569 - protein, 20 aa, Cryptosporidium parvum
EAIWKEKIAVFDFCSPGQPG

SEQ ID NO: 2290570 - protein, 23 aa, Cryptosporidium parvum
EAKAFGIKSPWRIVRSRFYVTSA

SEQ ID NO: 2290571 - protein, 19 aa, Cryptosporidium parvum
EAKMDAVLEKLPYKNGEDK

SEQ ID NO: 2290572 - protein, 22 aa, Cryptosporidium parvum
EAKNKRKIFVHSLPTNISDDQI

SEQ ID NO: 2290573 - protein, 18 aa, Cryptosporidium parvum
EAKRCIYDALCVVRNLIR

SEQ ID NO: 2290574 - protein, 19 aa, Cryptosporidium parvum
EALDIAASMIKPGVTTDAI

SEQ ID NO: 2290575 - protein, 26 aa, Cryptosporidium parvum
EALDLLKNLLCHPSKRFDGEQIKKHP

SEQ ID NO: 2290576 - protein, 24 aa, Cryptosporidium parvum
EALFNLLNALACFGSSLKKRPAVM

SEQ ID NO: 2290577 - protein, 18 aa, Cryptosporidium parvum
EALFVGEMLCLVRFAGDF

SEQ ID NO: 2290578 - protein, 19 aa, Cryptosporidium parvum
EALGAYVFIADNCKELLDV

SEQ ID NO: 2290579 - protein, 17 aa, Cryptosporidium parvum
EALLRPGRFEVQIEIGL

SEQ ID NO: 2290580 - protein, 25 aa, Cryptosporidium parvum
EALRTYLFTYGHLYSSYSVNNLIEM

SEQ ID NO: 2290581 - protein, 17 aa, Cryptosporidium parvum
EALSHPYFNGININSGY

SEQ ID NO: 2290582 - protein, 24 aa, Cryptosporidium parvum
EAMSFPLCFLAHLSSISSGGLAET

SEQ ID NO: 2290583 - protein, 28 aa, Cryptosporidium parvum
EANTIECAICLMTLQDLLNCKNKGEEQE

SEQ ID NO: 2290584 - protein, 20 aa, Cryptosporidium parvum
EAQAKMRLSPVVSNKDVDGA

SEQ ID NO: 2290585 - protein, 25 aa, Cryptosporidium parvum
EARAVPKVRRKRTLIPQESVDERNE

SEQ ID NO: 2290586 - protein, 21 aa, Cryptosporidium parvum
EARKSPCLDGKVQRTEKGKEV

SEQ ID NO: 2290587 - protein, 18 aa, Cryptosporidium parvum
EASGKMVLLHKLLPKLFS

SEQ ID NO: 2290588 - protein, 23 aa, Cryptosporidium parvum
EASKAKMVFHGRFFAGRKLNVSF

SEQ ID NO: 2290589 - protein, 35 aa, Cryptosporidium parvum; identical to SEQ ID NO: 2169701

SEQ ID NO: 2290590 - protein, 18 aa, Cryptosporidium parvum
EASLSFDDFFLFKSSSDS

SEQ ID NO: 2290591 - protein, 18 aa, Cryptosporidium parvum
EASMGRRLRFLANVDPID

SEQ ID NO: 2290592 - protein, 18 aa, Cryptosporidium parvum
EASRCAQENDILFLETSA

SEQ ID NO: 2290593 - protein, 17 aa, Cryptosporidium parvum
EASRLSSLVRCAILGGA

SEQ ID NO: 2290594 - protein, 21 aa, Cryptosporidium parvum
EASYWKNYWAEREKYVVQYIR

SEQ ID NO: 2290595 - protein, 18 aa, Cryptosporidium parvum
EATELFLKQIDVLKTKTV

SEQ ID NO: 2290596 - protein, 19 aa, Cryptosporidium parvum
EATHRFQLIAAAYEVLSDP

SEQ ID NO: 2290597 - protein, 24 aa, Cryptosporidium parvum
EATRAKVCRKIEFSQNLDLYEFCS

SEQ ID NO: 2290598 - protein, 23 aa, Cryptosporidium parvum
EAVAKLRFSYLVTPEHVEEACQI

SEQ ID NO: 2290599 - protein, 19 aa, Cryptosporidium parvum
EAVELPLVCPELYQQIGID

SEQ ID NO: 2290600 - protein, 17 aa, Cryptosporidium parvum
EAVKRLNSDFGDSPLCF

SEQ ID NO: 2290601 - protein, 19 aa, Cryptosporidium parvum
EAVYLRYKLRREFRKNQLK

SEQ ID NO: 2290602 - protein, 17 aa, Cryptosporidium parvum
EAWFPGYNSYRELVSCS

SEQ ID NO: 2290603 - protein, 27 aa, Cryptosporidium parvum
EAYFILIKTRIENMWNEKINVFSQKRK

SEQ ID NO: 2290604 - protein, 17 aa, Cryptosporidium parvum
ECASVAEAFVFWFESEK

SEQ ID NO: 2290605 - protein, 18 aa, Cryptosporidium parvum
ECCEILNLKISNLNNDGE

SEQ ID NO: 2290606 - protein, 21 aa, Cryptosporidium parvum
ECDRHKCKMIAGRIIPAMATT

SEQ ID NO: 2290607 - protein, 21 aa, Cryptosporidium parvum
ECEELKMGAFLAVAQGSKSPA

SEQ ID NO: 2290608 - protein, 19 aa, Cryptosporidium parvum
ECGILKLDILQMISNKVGV

SEQ ID NO: 2290609 - protein, 21 aa, Cryptosporidium parvum
ECGNLPDWVLDNIMNILKYQK

SEQ ID NO: 2290610 - protein, 18 aa, Cryptosporidium parvum
ECHYSILQVDYKATFDEI

SEQ ID NO: 2290611 - protein, 25 aa, Cryptosporidium parvum
ECIDVCKRIGFPVMIKASSGGGGKG

SEQ ID NO: 2290612 - protein, 18 aa, Cryptosporidium parvum
ECIFCKSKLVKDESGDFI

SEQ ID NO: 2290613 - protein, 21 aa, Cryptosporidium parvum
ECIIMARVLPYGICFVTSSYN

SEQ ID NO: 2290614 - protein, 19 aa, Cryptosporidium parvum
ECKRRYNVKLWKTFTDCFN

SEQ ID NO: 2290615 - protein, 19 aa, Cryptosporidium parvum
ECKVLPINSSIFGFVDYID

SEQ ID NO: 2290616 - protein, 19 aa, Cryptosporidium parvum
ECLDLWGKPNRKFFQEFYR

SEQ ID NO: 2290617 - protein, 31 aa, Cryptosporidium parvum
ECNFNLNISKEWKLVNTISLVISNNALIQEG

SEQ ID NO: 2290618 - protein, 22 aa, Cryptosporidium parvum
ECNRRGRSPSLSYTVTTLQAQR

SEQ ID NO: 2290619 - protein, 20 aa, Cryptosporidium parvum
ECNYLSTLFSSFSNTVKGFI

SEQ ID NO: 2290620 - protein, 21 aa, Cryptosporidium parvum
ECQNRLNGCFLECLFNNENNN

SEQ ID NO: 2290621 - protein, 24 aa, Cryptosporidium parvum
ECREKRVRCMFMIVGDNSRYQICN

SEQ ID NO: 2290622 - protein, 24 aa, Cryptosporidium parvum
ECRNLKFQGLMTMGDSDVNLTSEC

SEQ ID NO: 2290623 - protein, 18 aa, Cryptosporidium parvum
ECSIRIKSLDSIYNQRNG

SEQ ID NO: 2290624 - protein, 19 aa, Cryptosporidium parvum
ECVEIKKNLIQKIGKLKLE

SEQ ID NO: 2290625 - protein, 22 aa, Cryptosporidium parvum
ECVRKLYYELLVEYNGDDSGKV

SEQ ID NO: 2290626 - protein, 23 aa, Cryptosporidium parvum
EDCPRQVWPSVVGVKENGDKRFP

SEQ ID NO: 2290627 - protein, 23 aa, Cryptosporidium parvum
EDDLKGKLIHHFSPSTITCPGIS

SEQ ID NO: 2290628 - protein, 36 aa, Cryptosporidium parvum
EDDTYLLFDLCKEFDLRFIVIHDRYIPPSGKQRTLE

SEQ ID NO: 2290629 - protein, 26 aa, Cryptosporidium parvum
EDEAISRFFSWFSELICSRNHIIDPI

SEQ ID NO: 2290630 - protein, 23 aa, Cryptosporidium parvum
EDEEIQNLYAFYLSLATGEAPLS

SEQ ID NO: 2290631 - protein, 18 aa, Cryptosporidium parvum
EDEFIRFSGCAKNQACTI

SEQ ID NO: 2290632 - protein, 24 aa, Cryptosporidium parvum
EDEFIVLACDGIWDVVDNQLCVDI

SEQ ID NO: 2290633 - protein, 18 aa, Cryptosporidium parvum
EDEFLLIACDGIFESFMD

SEQ ID NO: 2290634 - protein, 18 aa, Cryptosporidium parvum
EDEFPFEILVSKISNLIE

SEQ ID NO: 2290635 - protein, 24 aa, Cryptosporidium parvum
EDERICLGNCNICSKPSSTSSSSV

SEQ ID NO: 2290636 - protein, 29 aa, Cryptosporidium parvum
EDESSISHCNRGGGCPFAHSYEEINYHPL

SEQ ID NO: 2290637 - protein, 29 aa, Cryptosporidium parvum
EDFFCSHSPFPVIWFSNYDDIQSFDIMAN

SEQ ID NO: 2290638 - protein, 23 aa, Cryptosporidium parvum
EDFLRISCPFYFSNNYFGDLFWK

SEQ ID NO: 2290639 - protein, 17 aa, Cryptosporidium parvum
EDFQVWFSKPFSDLPSN

SEQ ID NO: 2290640 - protein, 22 aa, Cryptosporidium parvum
EDFRCLAEGLIDKRSRRADGKP

SEQ ID NO: 2290641 - protein, 23 aa, Cryptosporidium parvum
EDFSKRNSISFNLILNTNNSNSN

SEQ ID NO: 2290642 - protein, 17 aa, Cryptosporidium parvum
EDGAPVIRILKPGETDE

SEQ ID NO: 2290643 - protein, 26 aa, Cryptosporidium parvum
EDGLKLCMLRASLLSEFSAGEGKMAL

SEQ ID NO: 2290644 - protein, 18 aa, Cryptosporidium parvum
EDGLYVFSCVCNVCNSKI

SEQ ID NO: 2290645 - protein, 24 aa, Cryptosporidium parvum
EDGNYPPICSVYGVPAKYLDPLTN

SEQ ID NO: 2290646 - protein, 22 aa, Cryptosporidium parvum
EDHCKFPLTFLLNMNSKSPKQG

SEQ ID NO: 2290647 - protein, 20 aa, Cryptosporidium parvum
EDHIDYMVSYFRKYDLRGNG

SEQ ID NO: 2290648 - protein, 24 aa, Cryptosporidium parvum
EDIKWLRKISAIYRQNGHKKLLNG

SEQ ID NO: 2290649 - protein, 22 aa, Cryptosporidium parvum
EDINSLLFRHSPPQMNGDELAN

SEQ ID NO: 2290650 - protein, 17 aa, Cryptosporidium parvum
EDIQVLDLWKLSILIGG

SEQ ID NO: 2290651 - protein, 17 aa, Cryptosporidium parvum
EDIRFVIDTGRVRISIY

SEQ ID NO: 2290652 - protein, 20 aa, Cryptosporidium parvum
EDKSRINAFLSSEKAKMSSL

SEQ ID NO: 2290653 - protein, 26 aa, Cryptosporidium parvum
EDLARYSLKNDPEWLVLDQYREIGHK

SEQ ID NO: 2290654 - protein, 25 aa, Cryptosporidium parvum
EDLELPQFCLFLILKYILNDYKQFI

SEQ ID NO: 2290655 - protein, 21 aa, Cryptosporidium parvum
EDLESGIIYWHGRDYCLRPIL

SEQ ID NO: 2290656 - protein, 19 aa, Cryptosporidium parvum
EDLEWKIVYISCAESKDMD

SEQ ID NO: 2290657 - protein, 27 aa, Cryptosporidium parvum
EDLKRKRKVAIKVIRDVQRYTSAAKIE

SEQ ID NO: 2290658 - protein, 21 aa, Cryptosporidium parvum
EDLNQLLTFWKHESNMGDHPL

SEQ ID NO: 2290659 - protein, 24 aa, Cryptosporidium parvum
EDLPFNKMQFIWSSELDEHKRVKL

SEQ ID NO: 2290660 - protein, 26 aa, Cryptosporidium parvum
EDLVDCKRILREIAILSRLNHDHIVK

SEQ ID NO: 2290661 - protein, 27 aa, Cryptosporidium parvum
EDLYSGSIISRFIPRFILSLSSCNNCV

SEQ ID NO: 2290662 - protein, 23 aa, Cryptosporidium parvum
EDNEWYKAQFLEMKNELEKAISQ

SEQ ID NO: 2290663 - protein, 30 aa, Cryptosporidium parvum; identical to SEQ ID NO: 2169764

SEQ ID NO: 2290664 - protein, 25 aa, Cryptosporidium parvum
EDPRNCPHLHPYLELGLLCNPEVLP

SEQ ID NO: 2290665 - protein, 20 aa, Cryptosporidium parvum
EDPSWFGGMLTRIKNLAEEG

SEQ ID NO: 2290666 - protein, 20 aa, Cryptosporidium parvum
EDQLRYEIQLSQPLSREERE

SEQ ID NO: 2290667 - protein, 22 aa, Cryptosporidium parvum
EDQMVKRGIWAPREQEKKNEEL

SEQ ID NO: 2290668 - protein, 18 aa, Cryptosporidium parvum
EDQVKIWRRSFDVPPPVL

SEQ ID NO: 2290669 - protein, 22 aa, Cryptosporidium parvum
EDRLRRISTHSNKAWPSNVTSY

SEQ ID NO: 2290670 - protein, 24 aa, Cryptosporidium parvum
EDRTQLYYFVKWLSCPYDQCTWES

SEQ ID NO: 2290671 - protein, 18 aa, Cryptosporidium parvum
EDRWPGVENTFYFDKEIN

SEQ ID NO: 2290672 - protein, 18 aa, Cryptosporidium parvum
EDSLLCKIDNTKIDSYRS

SEQ ID NO: 2290673 - protein, 22 aa, Cryptosporidium parvum
EDSPIQRYFLFPIYEQPNINTN

SEQ ID NO: 2290674 - protein, 27 aa, Cryptosporidium parvum
EDSQKRLPDWAKRFHRILKVISQQEAF

SEQ ID NO: 2290675 - protein, 17 aa, Cryptosporidium parvum
EDSRCLASWMLNGLAEY

SEQ ID NO: 2290676 - protein, 23 aa, Cryptosporidium parvum
EDTPTCGIGENFDKSNEVEVGNS

SEQ ID NO: 2290677 - protein, 19 aa, Cryptosporidium parvum
EDTVRYSFEQCINNIIDNY

SEQ ID NO: 2290678 - protein, 21 aa, Cryptosporidium parvum
EDVFQRPWYISTIARDNRIKS

SEQ ID NO: 2290679 - protein, 23 aa, Cryptosporidium parvum
EDVIRACKDYAFQISPYPIILSL

SEQ ID NO: 2290680 - protein, 19 aa, Cryptosporidium parvum
EDVLIAFELLSYAMFGEVI

SEQ ID NO: 2290681 - protein, 19 aa, Cryptosporidium parvum
EDVMTARFAFFPKDLLEII

SEQ ID NO: 2290682 - protein, 22 aa, Cryptosporidium parvum
EDWKHVSFLAIDLIRKLLTYNP

SEQ ID NO: 2290683 - protein, 24 aa, Cryptosporidium parvum
EDWQIWYLLSWCSLVSEDVSGAIE

SEQ ID NO: 2290684 - protein, 18 aa, Cryptosporidium parvum
EDYFGYDVYLVMNITDID

SEQ ID NO: 2290685 - protein, 29 aa, Cryptosporidium parvum
EDYLKSVCAINCWGLFASNLISFQNLMNV

SEQ ID NO: 2290686 - protein, 26 aa, Cryptosporidium parvum
EEAIAWKQFLDQQMQVIAKKLERRIS

SEQ ID NO: 2290687 - protein, 21 aa, Cryptosporidium parvum
EEAIQCLKSIFSSNNRSDESI

SEQ ID NO: 2290688 - protein, 23 aa, Cryptosporidium parvum
EEASRRFFIGKFINQMVVVNINK

SEQ ID NO: 2290689 - protein, 20 aa, Cryptosporidium parvum
EEATRECLIILADLHDILTS

SEQ ID NO: 2290690 - protein, 26 aa, Cryptosporidium parvum
EECHWVRIKLSYLFKEGEELPASHIL

SEQ ID NO: 2290691 - protein, 26 aa, Cryptosporidium parvum
EEDFKTSFSYFYEAFEAFNIANDERA

SEQ ID NO: 2290692 - protein, 36 aa, Cryptosporidium parvum; identical to SEQ ID NO: 2169786

SEQ ID NO: 2290693 - protein, 33 aa, Cryptosporidium parvum
EEDHVCLVLEFLGGGELFEWIAQKGAYSEDQAK

SEQ ID NO: 2290694 - protein, 30 aa, Cryptosporidium parvum; identical to SEQ ID NO: 2169787

SEQ ID NO: 2290695 - protein, 17 aa, Cryptosporidium parvum
EEDLSTISFSWRFGAFS

SEQ ID NO: 2290696 - protein, 23 aa, Cryptosporidium parvum
EEDSLCAIREAYEELGIDVTKHL

SEQ ID NO: 2290697 - protein, 31 aa, Cryptosporidium parvum; identical to SEQ ID NO: 2169795

SEQ ID NO: 2290698 - protein, 23 aa, Cryptosporidium parvum
EEEGRLKPWLPNSEYNVIYRDGE

SEQ ID NO: 2290699 - protein, 23 aa, Cryptosporidium parvum
EEEGRRAGLGVGVGEEEEGEVRM

SEQ ID NO: 2290700 - protein, 22 aa, Cryptosporidium parvum
EEELICFVCCRAFGSIWEKVNH

SEQ ID NO: 2290701 - protein, 24 aa, Cryptosporidium parvum
EEERRKWDYSWQIGKTQVFVKDSL

SEQ ID NO: 2290702 - protein, 18 aa, Cryptosporidium parvum
EEFCLPMFLHIRGDQDCY

SEQ ID NO: 2290703 - protein, 22 aa, Cryptosporidium parvum
EEFDWGLDTERTLKEKLDSKTN

SEQ ID NO: 2290704 - protein, 17 aa, Cryptosporidium parvum
EEFKVFLYVTNNLSIDQ

SEQ ID NO: 2290705 - protein, 17 aa, Cryptosporidium parvum
EEFLKSQWDMFSISCGT

SEQ ID NO: 2290706 - protein, 17 aa, Cryptosporidium parvum
EEFPCISKYYANEGSHY

SEQ ID NO: 2290707 - protein, 22 aa, Cryptosporidium parvum
EEFPDRILQTFSVFPSPKVSDT

SEQ ID NO: 2290708 - protein, 27 aa, Cryptosporidium parvum
EEFVHFLFREGFLVKGSRMESYDFHSI

SEQ ID NO: 2290709 - protein, 18 aa, Cryptosporidium parvum
EEHKFLSFIDSFYAQMEL

SEQ ID NO: 2290710 - protein, 20 aa, Cryptosporidium parvum
EEIDEIYSLEFIYSEESSII

SEQ ID NO: 2290711 - protein, 17 aa, Cryptosporidium parvum
EEIDRILTILYSKISAF

SEQ ID NO: 2290712 - protein, 25 aa, Cryptosporidium parvum
EEIEKWLICRKMKFPRPVCSKNHSI

SEQ ID NO: 2290713 - protein, 17 aa, Cryptosporidium parvum
EEIISFISLLEKCKSPA

SEQ ID NO: 2290714 - protein, 17 aa, Cryptosporidium parvum
EEIKFSSSRNYESRTVC

SEQ ID NO: 2290715 - protein, 22 aa, Cryptosporidium parvum
EEIKRIISKYFKIVKEEWRNAT

SEQ ID NO: 2290716 - protein, 23 aa, Cryptosporidium parvum
EEILEYWRKINILKLTLEKTKGR

SEQ ID NO: 2290717 - protein, 34 aa, Cryptosporidium parvum
EEILGAFNLLNWLKGRVSICLGRNLENNIEEISA

SEQ ID NO: 2290718 - protein, 21 aa, Cryptosporidium parvum
EEILRLTSRVFANAYEVIGIP

SEQ ID NO: 2290719 - protein, 20 aa, Cryptosporidium parvum
EEINRIVAIVANPLQFNIPS

SEQ ID NO: 2290720 - protein, 21 aa, Cryptosporidium parvum
EEIPSLCELQDKYYRDKNLSS

SEQ ID NO: 2290721 - protein, 22 aa, Cryptosporidium parvum
EEIPSNMVNIFIKNNINVSILD

SEQ ID NO: 2290722 - protein, 17 aa, Cryptosporidium parvum
EEIRQNLTLAINFLVSL

SEQ ID NO: 2290723 - protein, 18 aa, Cryptosporidium parvum
EEISRYCLEFDIEKTVEI

SEQ ID NO: 2290724 - protein, 29 aa, Cryptosporidium parvum
EEKDDIKLYGWKEYYSLKQASEVSLVAKN

SEQ ID NO: 2290725 - protein, 27 aa, Cryptosporidium parvum
EEKEECFQILLGVVIRLFNKRLELDLP

SEQ ID NO: 2290726 - protein, 25 aa, Cryptosporidium parvum
EEKEFKMNLCLISLNRMDFELNMEF

SEQ ID NO: 2290727 - protein, 30 aa, Cryptosporidium parvum
EEKKRGICRLVRRSDYYISYFTDFSDLEKK

SEQ ID NO: 2290728 - protein, 25 aa, Cryptosporidium parvum
EEKLSWLPNIEILDMPEKVDLTLPC

SEQ ID NO: 2290729 - protein, 19 aa, Cryptosporidium parvum
EELAMPMHIHITAESQYKL

SEQ ID NO: 2290730 - protein, 27 aa, Cryptosporidium parvum
EELCACVSIIPSVRSIYKFKGQVHDEN

SEQ ID NO: 2290731 - protein, 25 aa, Cryptosporidium parvum
EELDSCVKRFVEVDIVRLGNAIKSE

SEQ ID NO: 2290732 - protein, 24 aa, Cryptosporidium parvum
EELDWKLQNIIKFLNSVENKLDAY

SEQ ID NO: 2290733 - protein, 26 aa, Cryptosporidium parvum
EELEILDRISFIWGYNNDNIYKINII

SEQ ID NO: 2290734 - protein, 17 aa, Cryptosporidium parvum
EELESFYNYSLSYKELI

SEQ ID NO: 2290735 - protein, 19 aa, Cryptosporidium parvum
EELFLKFIYCVLRVKIEWI

SEQ ID NO: 2290736 - protein, 19 aa, Cryptosporidium parvum
EELFRVALLEKIECLEQMD

SEQ ID NO: 2290737 - protein, 21 aa, Cryptosporidium parvum
EELIKASGYDKAALLSMLGEY

SEQ ID NO: 2290738 - protein, 19 aa, Cryptosporidium parvum
EELINVLTLLPSVSLKQSF

SEQ ID NO: 2290739 - protein, 21 aa, Cryptosporidium parvum
EELKTNWSYTTGVKNLSSVSC

SEQ ID NO: 2290740 - protein, 21 aa, Cryptosporidium parvum
EELKVFRSALGLDKPTRGRYK

SEQ ID NO: 2290741 - protein, 21 aa, Cryptosporidium parvum
EELNLCFGYKFGLKNDSQDQI

SEQ ID NO: 2290742 - protein, 24 aa, Cryptosporidium parvum
EELRRQNDRCCCNSRGEKLYQRNC

SEQ ID NO: 2290743 - protein, 26 aa, Cryptosporidium parvum
EELSWKKCFTMLCLFLDHQIIRGFYQ

SEQ ID NO: 2290744 - protein, 33 aa, Cryptosporidium parvum
EELTKLNGIGVWSAEMAMIFCMNRKNVFSFSDI

SEQ ID NO: 2290745 - protein, 25 aa, Cryptosporidium parvum
EELVLSGIKWLTSVVNEIDELEQRC

SEQ ID NO: 2290746 - protein, 23 aa, Cryptosporidium parvum
EELYFLRNKVRTIESKVRDYEKE

SEQ ID NO: 2290747 - protein, 17 aa, Cryptosporidium parvum
EEMELRNSESLRIESDF

SEQ ID NO: 2290748 - protein, 24 aa, Cryptosporidium parvum
EEMKRIESSIAIRCGKGKMRNRRR

SEQ ID NO: 2290749 - protein, 20 aa, Cryptosporidium parvum
EEMLRAPIILLKEGSDTSQG

SEQ ID NO: 2290750 - protein, 23 aa, Cryptosporidium parvum
EENARLLIFEIYCRIHKSIDLNV

SEQ ID NO: 2290751 - protein, 19 aa, Cryptosporidium parvum
EENIRTSLFLEIIGLESSD

SEQ ID NO: 2290752 - protein, 26 aa, Cryptosporidium parvum
EENNFELLLCHPFNLSLNKYNAINKL

SEQ ID NO: 2290753 - protein, 21 aa, Cryptosporidium parvum
EENNNYIKICEELKNEKSSLI

SEQ ID NO: 2290754 - protein, 22 aa, Cryptosporidium parvum
EENRKLNIFAYIGRLEDEIANL

SEQ ID NO: 2290755 - protein, 22 aa, Cryptosporidium parvum
EENSRLKLILGDYSMDKYDSTR

SEQ ID NO: 2290756 - protein, 23 aa, Cryptosporidium parvum
EEPTRISNYNSFPINEPSIKNLV

SEQ ID NO: 2290757 - protein, 23 aa, Cryptosporidium parvum
EEQFNLWKMAFKSEMIEKKIWKD

SEQ ID NO: 2290758 - protein, 19 aa, Cryptosporidium parvum
EEQIFKWIYDRNIDYSRYQ

SEQ ID NO: 2290759 - protein, 20 aa, Cryptosporidium parvum
EEQRMLISRLLKGLDQLGFT

SEQ ID NO: 2290760 - protein, 17 aa, Cryptosporidium parvum
EEREGALFYILNKIFTK

SEQ ID NO: 2290761 - protein, 20 aa, Cryptosporidium parvum
EERIKRFLDMGFNRESIITA

SEQ ID NO: 2290762 - protein, 26 aa, Cryptosporidium parvum
EERKKFVPRCCFFGGKAAPGYATAKT

SEQ ID NO: 2290763 - protein, 23 aa, Cryptosporidium parvum
EERNFKSFLTRNIEEGGDPIESL

SEQ ID NO: 2290764 - protein, 20 aa, Cryptosporidium parvum
EERVALTIDCIISLFHAEVG

SEQ ID NO: 2290765 - protein, 28 aa, Cryptosporidium parvum
EESAALFYSRWFDFELLRSANLKEVIIS

SEQ ID NO: 2290766 - protein, 25 aa, Cryptosporidium parvum
EESGFYLGIRLVERLSVFRHRIYDQ

SEQ ID NO: 2290767 - protein, 19 aa, Cryptosporidium parvum
EESIVVVLFKIRNLMRNLW

SEQ ID NO: 2290768 - protein, 26 aa, Cryptosporidium parvum
EESKELKRSLGLIMLRGENIVTFVAE

SEQ ID NO: 2290769 - protein, 20 aa, Cryptosporidium parvum
EESRKFCFGTGIRTNVLYGG

SEQ ID NO: 2290770 - protein, 22 aa, Cryptosporidium parvum
EESRLSDQLELFHEDLINLQET

SEQ ID NO: 2290771 - protein, 29 aa, Cryptosporidium parvum
EESYMLLSCLHRYHYSCVLNNISAVTPSG

SEQ ID NO: 2290772 - protein, 17 aa, Cryptosporidium parvum
EETEKALQLDGFACMGS

SEQ ID NO: 2290773 - protein, 38 aa, Cryptosporidium parvum; identical to SEQ ID NO: 2169851

SEQ ID NO: 2290774 - protein, 34 aa, Cryptosporidium parvum
EETKSQRFLLIFIRTSLLDFKRIILEIMEEIQKK

SEQ ID NO: 2290775 - protein, 20 aa, Cryptosporidium parvum
EETSSLLFEFMVTLQERFYS

SEQ ID NO: 2290776 - protein, 18 aa, Cryptosporidium parvum
EEVFDCWFESGSMPYASI

SEQ ID NO: 2290777 - protein, 24 aa, Cryptosporidium parvum
EEVFKALDFLFFIYGQLGFTFDLF

SEQ ID NO: 2290778 - protein, 24 aa, Cryptosporidium parvum
EEVFKPKAIGAWNLHNICEELGLN

SEQ ID NO: 2290779 - protein, 26 aa, Cryptosporidium parvum
EEVIIKRRRLDLFTQKSIFKKIYDND

SEQ ID NO: 2290780 - protein, 20 aa, Cryptosporidium parvum
EEVIPLFVVFDESMITENNL

SEQ ID NO: 2290781 - protein, 27 aa, Cryptosporidium parvum
EEVQYRIPLLNCHVGDWQPVDSDRVVF

SEQ ID NO: 2290782 - protein, 20 aa, Cryptosporidium parvum
EEVSRYYNVFLKRYKELPGG

SEQ ID NO: 2290783 - protein, 29 aa, Cryptosporidium parvum
EEVTNGFSKWQVCRSFLATLMLSNNREID

SEQ ID NO: 2290784 - protein, 26 aa, Cryptosporidium parvum
EEYAICYPMIRFLLSNRTLSDTEKEK

SEQ ID NO: 2290785 - protein, 21 aa, Cryptosporidium parvum
EEYLELPIAYISRLTDCHHLL

SEQ ID NO: 2290786 - protein, 25 aa, Cryptosporidium parvum
EEYMKILLSRRGLKFSGKKDTKFIE

SEQ ID NO: 2290787 - protein, 22 aa, Cryptosporidium parvum
EEYRALWSHIFQREALKKSIEA

SEQ ID NO: 2290788 - protein, 23 aa, Cryptosporidium parvum
EFAKCPQLGRFTLRDEGKTIAVG

SEQ ID NO: 2290789 - protein, 25 aa, Cryptosporidium parvum
EFALKKDFPLPFGSLLVTFERLDLI

SEQ ID NO: 2290790 - protein, 23 aa, Cryptosporidium parvum
EFAQYYLHMAFVFDDSSLFTHIA

SEQ ID NO: 2290791 - protein, 17 aa, Cryptosporidium parvum
EFCFTELNNIIPISLEE

SEQ ID NO: 2290792 - protein, 19 aa, Cryptosporidium parvum
EFCNGAWRVLVKKQQRYSF

SEQ ID NO: 2290793 - protein, 25 aa, Cryptosporidium parvum
EFCTLCHVPMCRLCRPSHTHADEKT

SEQ ID NO: 2290794 - protein, 33 aa, Cryptosporidium parvum; identical to SEQ ID NO: 2169866

SEQ ID NO: 2290795 - protein, 24 aa, Cryptosporidium parvum
EFCYEIPKKMGIFCNTTILKKEEI

SEQ ID NO: 2290796 - protein, 21 aa, Cryptosporidium parvum
EFDLPFLLNICNTKQYKRLKA

SEQ ID NO: 2290797 - protein, 26 aa, Cryptosporidium parvum
EFDQRLPGELGRRLRIDDSDFNDIDQ

SEQ ID NO: 2290798 - protein, 20 aa, Cryptosporidium parvum
EFEEAIKLNLGSYYYIYQRT

SEQ ID NO: 2290799 - protein, 17 aa, Cryptosporidium parvum
EFEEKFPNIAVWSKESP

SEQ ID NO: 2290800 - protein, 26 aa, Cryptosporidium parvum
EFEKLNKLKSALSELGDFNKKLLEEN

SEQ ID NO: 2290801 - protein, 24 aa, Cryptosporidium parvum
EFEKQLRCDFTMFDSFEMNLVDKI

SEQ ID NO: 2290802 - protein, 21 aa, Cryptosporidium parvum
EFEQLKLLFRHFSTIHHGMHA

SEQ ID NO: 2290803 - protein, 19 aa, Cryptosporidium parvum
EFERARLAGNTGITTLTTN

SEQ ID NO: 2290804 - protein, 33 aa, Cryptosporidium parvum
EFETRGRFSGTLKCKVSVWPDNSCFLSRKEYSY

SEQ ID NO: 2290805 - protein, 23 aa, Cryptosporidium parvum
EFEYCKRENFFLLEERCKESIYY

SEQ ID NO: 2290806 - protein, 19 aa, Cryptosporidium parvum
EFFGEATVNLIQCGINILE

SEQ ID NO: 2290807 - protein, 17 aa, Cryptosporidium parvum
EFFQLLVQEIFNIDFGM

SEQ ID NO: 2290808 - protein, 25 aa, Cryptosporidium parvum
EFGKETSCASWACYYNSRYSGSDIK

SEQ ID NO: 2290809 - protein, 19 aa, Cryptosporidium parvum
EFIDELRLIKKEYTEYLQK

SEQ ID NO: 2290810 - protein, 18 aa, Cryptosporidium parvum
EFIGEIGIDLDIEKSKFV

SEQ ID NO: 2290811 - protein, 31 aa, Cryptosporidium parvum
EFIKFSDLFRRICIFEGIFVGDTPANILKAV

SEQ ID NO: 2290812 - protein, 19 aa, Cryptosporidium parvum
EFIQRIIIHGTYLDKWKNI

SEQ ID NO: 2290813 - protein, 19 aa, Cryptosporidium parvum
EFIVPNLIFTLSRIRLYKE

SEQ ID NO: 2290814 - protein, 18 aa, Cryptosporidium parvum
EFKLKRSNEIHKKKLSKI

SEQ ID NO: 2290815 - protein, 24 aa, Cryptosporidium parvum
EFKSIRYNPEYAITIRQLYEFIKA

SEQ ID NO: 2290816 - protein, 19 aa, Cryptosporidium parvum
EFLDHILKLLPQIKNHSKK

SEQ ID NO: 2290817 - protein, 32 aa, Cryptosporidium parvum
EFLVYLKSCLGSVRIPHHWNSKRRYLQGKKGL

SEQ ID NO: 2290818 - protein, 24 aa, Cryptosporidium parvum
EFMERLKIPLLWVPGTSAGIFKAG

SEQ ID NO: 2290819 - protein, 26 aa, Cryptosporidium parvum
EFNGPSYFCSYSFASVFSRMGPNSWP

SEQ ID NO: 2290820 - protein, 26 aa, Cryptosporidium parvum
EFPNPCPSREVLFFTSGFKNVQTQMI

SEQ ID NO: 2290821 - protein, 20 aa, Cryptosporidium parvum
EFPTGSTLYCKGSGVVDCIA

SEQ ID NO: 2290822 - protein, 23 aa, Cryptosporidium parvum
EFQIISSIIYEWENLFGEKDIFC

SEQ ID NO: 2290823 - protein, 25 aa, Cryptosporidium parvum
EFQPSIPALIFFKNNEYSFSFNFTE

SEQ ID NO: 2290824 - protein, 27 aa, Cryptosporidium parvum
EFQSLLLAYRIDYLFYWDQVIQSFLLP

SEQ ID NO: 2290825 - protein, 22 aa, Cryptosporidium parvum
EFSCKPSHLIMYINTREETNNY

SEQ ID NO: 2290826 - protein, 22 aa, Cryptosporidium parvum
EFSPFYSCLLVSASQDKTIKLW

SEQ ID NO: 2290827 - protein, 18 aa, Cryptosporidium parvum
EFSQEFKNKSIVNRLINV

SEQ ID NO: 2290828 - protein, 19 aa, Cryptosporidium parvum
EFSRYIRRFYSVIIPNSDN

SEQ ID NO: 2290829 - protein, 18 aa, Cryptosporidium parvum
EFSSLLLQKERNLLMKKF

SEQ ID NO: 2290830 - protein, 20 aa, Cryptosporidium parvum
EFSVLKFISTVHEINKKGLK

SEQ ID NO: 2290831 - protein, 17 aa, Cryptosporidium parvum
EFTENWDLILFPEKFDI

SEQ ID NO: 2290832 - protein, 22 aa, Cryptosporidium parvum
EFWDIDAPLGRFAAFSINGAFG

SEQ ID NO: 2290833 - protein, 24 aa, Cryptosporidium parvum
EFYDLRAPSTFKVRNFGTTIASKN

SEQ ID NO: 2290834 - protein, 19 aa, Cryptosporidium parvum
EFYTKLIFLNDERWANISH

SEQ ID NO: 2290835 - protein, 17 aa, Cryptosporidium parvum
EGANCLKEKVLFLENEL

SEQ ID NO: 2290836 - protein, 23 aa, Cryptosporidium parvum
EGAYKYSTETGFIVWSFQGRQLY

SEQ ID NO: 2290837 - protein, 25 aa, Cryptosporidium parvum
EGCAPYRFIHRDIKTINMLINRKDL

SEQ ID NO: 2290838 - protein, 23 aa, Cryptosporidium parvum
EGCSMIEKILRGMSIKVDLTDKN

SEQ ID NO: 2290839 - protein, 25 aa, Cryptosporidium parvum
EGCVEILKWLSYVPECVGGRLPIMV

SEQ ID NO: 2290840 - protein, 19 aa, Cryptosporidium parvum
EGDCVLKATKVINTSDESI

SEQ ID NO: 2290841 - protein, 21 aa, Cryptosporidium parvum
EGDMIFGYKNTRYFDTEIQSM

SEQ ID NO: 2290842 - protein, 27 aa, Cryptosporidium parvum
EGDSFGTCFVMKHIINPFNFLNDNINE

SEQ ID NO: 2290843 - protein, 19 aa, Cryptosporidium parvum
EGEFRFRRGYLKSKNPRKM

SEQ ID NO: 2290844 - protein, 24 aa, Cryptosporidium parvum
EGEIKVPEPIDWNRHAIVMELIDA

SEQ ID NO: 2290845 - protein, 26 aa, Cryptosporidium parvum
EGEWLQCDICKFWVHYDCDKDLNEPI

SEQ ID NO: 2290846 - protein, 27 aa, Cryptosporidium parvum
EGFCIFCNLHWNFLYMLSVHMRPVLHP

SEQ ID NO: 2290847 - protein, 24 aa, Cryptosporidium parvum
EGFESCLRISQPFFVGQGNGLELW

SEQ ID NO: 2290848 - protein, 21 aa, Cryptosporidium parvum
EGFLTRLGRKMAELPMEPKLS

SEQ ID NO: 2290849 - protein, 22 aa, Cryptosporidium parvum
EGFVSIFIDYWHRILRFLHKSL

SEQ ID NO: 2290850 - protein, 19 aa, Cryptosporidium parvum
EGGIPLVKLVETVVPDVEV

SEQ ID NO: 2290851 - protein, 19 aa, Cryptosporidium parvum
EGGKDASAARYIFTKLSKW

SEQ ID NO: 2290852 - protein, 18 aa, Cryptosporidium parvum
EGGWGVGSGYDYMQVDEK

SEQ ID NO: 2290853 - protein, 23 aa, Cryptosporidium parvum
EGHSRPIFGLDVHPDGALVVSGD

SEQ ID NO: 2290854 - protein, 31 aa, Cryptosporidium parvum
EGIIKFWDPKFKLFFIHFLLSPSINSFRNIN

SEQ ID NO: 2290855 - protein, 26 aa, Cryptosporidium parvum
EGIIKRKKEIIELIESRFKQLNREDL

SEQ ID NO: 2290856 - protein, 18 aa, Cryptosporidium parvum
EGIPDGWMGLDIGPESSN

SEQ ID NO: 2290857 - protein, 23 aa, Cryptosporidium parvum
EGIVARFKKSFTRLVGLSATLPN

SEQ ID NO: 2290858 - protein, 18 aa, Cryptosporidium parvum
EGIYWKFRNKLQESVCQS

SEQ ID NO: 2290859 - protein, 29 aa, Cryptosporidium parvum
EGKKLLLLKRRCINYFSFGEESRVGITFD

SEQ ID NO: 2290860 - protein, 17 aa, Cryptosporidium parvum
EGKKLLVSAKFPNDKLN

SEQ ID NO: 2290861 - protein, 21 aa, Cryptosporidium parvum
EGKQMLARVVGWKLYGTQVTH

SEQ ID NO: 2290862 - protein, 22 aa, Cryptosporidium parvum
EGKRIPFGFRDRSLPHFLKYDY

SEQ ID NO: 2290863 - protein, 18 aa, Cryptosporidium parvum
EGLDRMATDSSYSMIGGG

SEQ ID NO: 2290864 - protein, 17 aa, Cryptosporidium parvum
EGLHILVRYNEPRELEI

SEQ ID NO: 2290865 - protein, 17 aa, Cryptosporidium parvum
EGLKRGIGIHHDGLSLR

SEQ ID NO: 2290866 - protein, 23 aa, Cryptosporidium parvum
EGLKRQFYYYLKFISTEYNLKDI

SEQ ID NO: 2290867 - protein, 28 aa, Cryptosporidium parvum
EGLLLSLKLILPWLDYLDDVPIVRMTIP

SEQ ID NO: 2290868 - protein, 19 aa, Cryptosporidium parvum
EGLNWPRINISEISSENIR

SEQ ID NO: 2290869 - protein, 17 aa, Cryptosporidium parvum
EGLQWVSYYYFRGVPSW

SEQ ID NO: 2290870 - protein, 26 aa, Cryptosporidium parvum
EGLYGPECDEWSAGVMMYVLLCGYPP

SEQ ID NO: 2290871 - protein, 18 aa, Cryptosporidium parvum
EGMWYKDQAIGLYILQAN

SEQ ID NO: 2290872 - protein, 19 aa, Cryptosporidium parvum
EGNCDVFVEIIAKEDLENA

SEQ ID NO: 2290873 - protein, 21 aa, Cryptosporidium parvum
EGNDFYLHYNFVCSLLNDLFG

SEQ ID NO: 2290874 - protein, 20 aa, Cryptosporidium parvum
EGNQLIFPPGYKIPASSKSK

SEQ ID NO: 2290875 - protein, 42 aa, Cryptosporidium parvum; identical to SEQ ID NO: 2169934

SEQ ID NO: 2290876 - protein, 17 aa, Cryptosporidium parvum
EGPLEKKNSWSWGHKLR

SEQ ID NO: 2290877 - protein, 17 aa, Cryptosporidium parvum
EGPMCLSGLKSQVARDF

SEQ ID NO: 2290878 - protein, 22 aa, Cryptosporidium parvum
EGPRNVGGYGYIGSNELNSIIK

SEQ ID NO: 2290879 - protein, 33 aa, Cryptosporidium parvum
EGRNIFLKKAIIDWKEKVIFPLKNSIINKFEEM

SEQ ID NO: 2290880 - protein, 21 aa, Cryptosporidium parvum
EGRNNLFLKRDEIIIRKISHM

SEQ ID NO: 2290881 - protein, 22 aa, Cryptosporidium parvum
EGRRISMEPLDIGELNTSSTSN

SEQ ID NO: 2290882 - protein, 19 aa, Cryptosporidium parvum
EGSEKLIFLLSTRAGGIGI

SEQ ID NO: 2290883 - protein, 20 aa, Cryptosporidium parvum
EGSGSGHLRFYLARKITEDD

SEQ ID NO: 2290884 - protein, 17 aa, Cryptosporidium parvum
EGSIHKFIENIEKPIGE

SEQ ID NO: 2290885 - protein, 27 aa, Cryptosporidium parvum
EGSIRGILRWIKSWDNFVFKSESSNKG

SEQ ID NO: 2290886 - protein, 40 aa, Cryptosporidium parvum
EGSKFLDPFLFWEGRVKLFPPELLSALVECISKENSLLRE

SEQ ID NO: 2290887 - protein, 28 aa, Cryptosporidium parvum
EGSKTWDRYEMRIYKRVIDLYSSSDVVK

SEQ ID NO: 2290888 - protein, 24 aa, Cryptosporidium parvum
EGSLRSNAIISIFESYCVEKNPST

SEQ ID NO: 2290889 - protein, 18 aa, Cryptosporidium parvum
EGSRPLYKLFPAPLDEAW

SEQ ID NO: 2290890 - protein, 22 aa, Cryptosporidium parvum
EGSYKIKLIFDEAVSEFMEPNI

SEQ ID NO: 2290891 - protein, 19 aa, Cryptosporidium parvum
EGTCSITLRQRCSPTPEQP

SEQ ID NO: 2290892 - protein, 23 aa, Cryptosporidium parvum
EGTCYMPYWMMQNLELQEGDITS

SEQ ID NO: 2290893 - protein, 25 aa, Cryptosporidium parvum
EGTDRRLDCWLTWESLRVIPNEYLP

SEQ ID NO: 2290894 - protein, 28 aa, Cryptosporidium parvum
EGTFRPERIVKIAERFGVQGDVALDNIM

SEQ ID NO: 2290895 - protein, 20 aa, Cryptosporidium parvum
EGTLGYPSNYSIEWDFVNYQ

SEQ ID NO: 2290896 - protein, 19 aa, Cryptosporidium parvum
EGVEESWAPAVEYYTGYTR

SEQ ID NO: 2290897 - protein, 22 aa, Cryptosporidium parvum
EHAESVLRKYSGIKSVNGGRGI

SEQ ID NO: 2290898 - protein, 19 aa, Cryptosporidium parvum
EHCGFDSFYIWLLMEQLLG

SEQ ID NO: 2290899 - protein, 19 aa, Cryptosporidium parvum
EHDKFLLNWKRYCKTIPLR

SEQ ID NO: 2290900 - protein, 22 aa, Cryptosporidium parvum
EHFKEVFPISFRSNIPLICESF

SEQ ID NO: 2290901 - protein, 22 aa, Cryptosporidium parvum
EHGLKCCVRAKIDMQCKNKCMR

SEQ ID NO: 2290902 - protein, 24 aa, Cryptosporidium parvum
EHIYCCLVCGINYQGKGKGSMAYK

SEQ ID NO: 2290903 - protein, 22 aa, Cryptosporidium parvum
EHKLCIRSAYNIPENANLTISY

SEQ ID NO: 2290904 - protein, 22 aa, Cryptosporidium parvum
EHKLPTGFQRPSWSSQQHSIVE

SEQ ID NO: 2290905 - protein, 23 aa, Cryptosporidium parvum
EHKQRATILTAIFGELYAIKNDF

SEQ ID NO: 2290906 - protein, 20 aa, Cryptosporidium parvum
EHKQWGTAVFNFRRNEVRSF

SEQ ID NO: 2290907 - protein, 26 aa, Cryptosporidium parvum
EHKYPGAYHKWKFNAFLEIQKKLDSE

SEQ ID NO: 2290908 - protein, 18 aa, Cryptosporidium parvum
EHMDMVWINDYHLLLLCQ

SEQ ID NO: 2290909 - protein, 23 aa, Cryptosporidium parvum
EHNLRMKALELFKRKNQAKNFRS

SEQ ID NO: 2290910 - protein, 18 aa, Cryptosporidium parvum
EHQGVMFAPPYKVHNVPL

SEQ ID NO: 2290911 - protein, 18 aa, Cryptosporidium parvum
EHSVSGRNKMDFPFDMPS

SEQ ID NO: 2290912 - protein, 25 aa, Cryptosporidium parvum
EHTGGKLPFWLSPRQAIVLSISEKT

SEQ ID NO: 2290913 - protein, 18 aa, Cryptosporidium parvum
EHVDKWINLKDIKLEIDK

SEQ ID NO: 2290914 - protein, 18 aa, Cryptosporidium parvum
EHVRFCIICNYVNKITPA

SEQ ID NO: 2290915 - protein, 27 aa, Cryptosporidium parvum
EHYQRSPTCWRLVMRHIGILDFDSNQN

SEQ ID NO: 2290916 - protein, 27 aa, Cryptosporidium parvum
EIACDMLFACIPKSLTNVGERLKRRFG

SEQ ID NO: 2290917 - protein, 24 aa, Cryptosporidium parvum
EIACHVCSSMIKKAREEKLKITNS

SEQ ID NO: 2290918 - protein, 24 aa, Cryptosporidium parvum
EIAEVCIQLGIPCKVESKRYSKDC

SEQ ID NO: 2290919 - protein, 25 aa, Cryptosporidium parvum
EIAFEKLEVASLFTSRRPVLSCFAC

SEQ ID NO: 2290920 - protein, 18 aa, Cryptosporidium parvum
EIAGKFAFEKGVEIPVSY

SEQ ID NO: 2290921 - protein, 24 aa, Cryptosporidium parvum
EIAISLRRLMKISQVLRKNRISRG

SEQ ID NO: 2290922 - protein, 20 aa, Cryptosporidium parvum
EIAISYFIECFLRKNRENSP

SEQ ID NO: 2290923 - protein, 26 aa, Cryptosporidium parvum
EIALRVMLLENEYFLGLEPILDRQSA

SEQ ID NO: 2290924 - protein, 18 aa, Cryptosporidium parvum
EIALSCGAIDIIMELGVK

SEQ ID NO: 2290925 - protein, 19 aa, Cryptosporidium parvum
EIANKLGLIEILEKENEEI

SEQ ID NO: 2290926 - protein, 17 aa, Cryptosporidium parvum
EICGYEIINEQNIEDKN

SEQ ID NO: 2290927 - protein, 21 aa, Cryptosporidium parvum
EIDEKFLFYLFSNFGKILSLK

SEQ ID NO: 2290928 - protein, 17 aa, Cryptosporidium parvum
EIDLPDVMSIRLDRKLS

SEQ ID NO: 2290929 - protein, 25 aa, Cryptosporidium parvum
EIDMLFNRKEYINALNLSLGQKLQY

SEQ ID NO: 2290930 - protein, 20 aa, Cryptosporidium parvum
EIDMVWRIFRYFGTPTEESW

SEQ ID NO: 2290931 - protein, 22 aa, Cryptosporidium parvum
EIDNGVIKVCLAFLQRTKVLLE

SEQ ID NO: 2290932 - protein, 20 aa, Cryptosporidium parvum
EIECNRKAEVERMQKLRNTL

SEQ ID NO: 2290933 - protein, 24 aa, Cryptosporidium parvum
EIEDFWYKNIEGINNIQGFDYSSM

SEQ ID NO: 2290934 - protein, 20 aa, Cryptosporidium parvum
EIEDLLKHGAYYLLEGSEAS

SEQ ID NO: 2290935 - protein, 22 aa, Cryptosporidium parvum
EIEEIRKTFNLFDTDGSGTIDP

SEQ ID NO: 2290936 - protein, 24 aa, Cryptosporidium parvum
EIEKKKFLVPMNMLVGEFKYIIHK

SEQ ID NO: 2290937 - protein, 24 aa, Cryptosporidium parvum
EIEKRIPDPLLFSIIESIQKIYNP

SEQ ID NO: 2290938 - protein, 22 aa, Cryptosporidium parvum
EIEKVWKPKVDEINSKCEDYLF

SEQ ID NO: 2290939 - protein, 28 aa, Cryptosporidium parvum
EIELGGGINGGMKLRELFKENKRLNKNS

SEQ ID NO: 2290940 - protein, 22 aa, Cryptosporidium parvum
EIELQIGDIFGFLKERGLYKPN

SEQ ID NO: 2290941 - protein, 21 aa, Cryptosporidium parvum
EIERLKVRMAKECEEEQMESV

SEQ ID NO: 2290942 - protein, 26 aa, Cryptosporidium parvum
EIEVLRKVHHPHIVHFIASFEEEDHV

SEQ ID NO: 2290943 - protein, 21 aa, Cryptosporidium parvum
EIFDSIYIPYSLVKSNSLEEI

SEQ ID NO: 2290944 - protein, 25 aa, Cryptosporidium parvum
EIFGMLDVKKGLLLQLIGGVTNQMN

SEQ ID NO: 2290945 - protein, 32 aa, Cryptosporidium parvum; identical to SEQ ID NO: 2169989

SEQ ID NO: 2290946 - protein, 21 aa, Cryptosporidium parvum
EIFNIVAVESFNFGAMENKSL

SEQ ID NO: 2290947 - protein, 20 aa, Cryptosporidium parvum
EIFPLCSYISPIAVPNLISN

SEQ ID NO: 2290948 - protein, 19 aa, Cryptosporidium parvum
EIFRFRQEMQLLSILDHPN

SEQ ID NO: 2290949 - protein, 17 aa, Cryptosporidium parvum
EIGEGVTIFCITELYIV

SEQ ID NO: 2290950 - protein, 22 aa, Cryptosporidium parvum
EIGGYCCECYYNNNNNNNNNNN

SEQ ID NO: 2290951 - protein, 24 aa, Cryptosporidium parvum
EIGNLDMLLKYSWENETSLLSYYY

SEQ ID NO: 2290952 - protein, 22 aa, Cryptosporidium parvum
EIGPRFILKLYKIELGTLEMKN

SEQ ID NO: 2290953 - protein, 25 aa, Cryptosporidium parvum
EIGRATFEGGGGFISHILPNRKPVS

SEQ ID NO: 2290954 - protein, 23 aa, Cryptosporidium parvum
EIHCIRVMPNLTLSICQGTWLYY

SEQ ID NO: 2290955 - protein, 18 aa, Cryptosporidium parvum
EIHKELNNRCIIEIEKKE

SEQ ID NO: 2290956 - protein, 36 aa, Cryptosporidium parvum
EIHYKLILKRRIFLFWRELLRIILLKDKNFKQENRK

SEQ ID NO: 2290957 - protein, 22 aa, Cryptosporidium parvum
EIICGWLGELARVIRHLVKHFP

SEQ ID NO: 2290958 - protein, 23 aa, Cryptosporidium parvum
EIIDELRMKLDLIQGNISMVDEF

SEQ ID NO: 2290959 - protein, 21 aa, Cryptosporidium parvum
EIIDLFRFSDKYGIKSLYNAC

SEQ ID NO: 2290960 - protein, 19 aa, Cryptosporidium parvum
EIIFWNWSKDDPIYSVQTE

SEQ ID NO: 2290961 - protein, 24 aa, Cryptosporidium parvum
EIIGGCSRIPWVQRAIGAAFNDKE

SEQ ID NO: 2290962 - protein, 24 aa, Cryptosporidium parvum
EIIKKPSFVQLQFSSYPIFVSKYL

SEQ ID NO: 2290963 - protein, 17 aa, Cryptosporidium parvum
EIIKLAGFNSLLDVPEA

SEQ ID NO: 2290964 - protein, 24 aa, Cryptosporidium parvum
EIILHLRSTFYNNIKDLSTLENIN

SEQ ID NO: 2290965 - protein, 26 aa, Cryptosporidium parvum
EIILKSKKCRFMIHILAINYKGKHKE

SEQ ID NO: 2290966 - protein, 19 aa, Cryptosporidium parvum
EIINRVAACIRMTAVDSDQ

SEQ ID NO: 2290967 - protein, 17 aa, Cryptosporidium parvum
EIIPEIRKTTNLDEKRD

SEQ ID NO: 2290968 - protein, 18 aa, Cryptosporidium parvum
EIIQWAKECNAFIEVPKL

SEQ ID NO: 2290969 - protein, 22 aa, Cryptosporidium parvum
EIIRGGLSLDLFSRIRDALSSL

SEQ ID NO: 2290970 - protein, 19 aa, Cryptosporidium parvum
EIISEILEVAKRFRSQVTA

SEQ ID NO: 2290971 - protein, 19 aa, Cryptosporidium parvum
EIITFKRNKYVVIEKKVEV

SEQ ID NO: 2290972 - protein, 19 aa, Cryptosporidium parvum
EIITGLGVIKSDQNEEFIV

SEQ ID NO: 2290973 - protein, 20 aa, Cryptosporidium parvum
EIKALKFILMEIGFESIIAD

SEQ ID NO: 2290974 - protein, 20 aa, Cryptosporidium parvum
EIKEFAWIQICDKYNNGKSC

SEQ ID NO: 2290975 - protein, 25 aa, Cryptosporidium parvum
EIKGNLFPEVKFILNTMLQDGIFLV

SEQ ID NO: 2290976 - protein, 20 aa, Cryptosporidium parvum
EIKHFLRLYPPGTTDVRSVK

SEQ ID NO: 2290977 - protein, 19 aa, Cryptosporidium parvum
EIKIESGIDFSNVPLPMQT

SEQ ID NO: 2290978 - protein, 24 aa, Cryptosporidium parvum
EIKIPRIYFHGVLGSNIPTKNVKL

SEQ ID NO: 2290979 - protein, 22 aa, Cryptosporidium parvum
EIKKAYRRLAIKHHPDKGGDQE

SEQ ID NO: 2290980 - protein, 23 aa, Cryptosporidium parvum
EIKKEYRLRALALHPDKNQNDEK

SEQ ID NO: 2290981 - protein, 20 aa, Cryptosporidium parvum
EIKKRRGLSSASGMLKYKDI

SEQ ID NO: 2290982 - protein, 21 aa, Cryptosporidium parvum
EIKKWNAVALWSWDIVVDNCA

SEQ ID NO: 2290983 - protein, 27 aa, Cryptosporidium parvum
EIKRIEYELGNPLCFSQHPAFSTSFVM

SEQ ID NO: 2290984 - protein, 23 aa, Cryptosporidium parvum
EIKVKLCGGREVIGILRGFDAVT

SEQ ID NO: 2290985 - protein, 22 aa, Cryptosporidium parvum
EIKYRTLLCKRLMEFDVNKRNI

SEQ ID NO: 2290986 - protein, 24 aa, Cryptosporidium parvum
EILARLSQCRVINSKTIKLATNNN

SEQ ID NO: 2290987 - protein, 18 aa, Cryptosporidium parvum
EILELLNHYKYHFDSSLQ

SEQ ID NO: 2290988 - protein, 20 aa, Cryptosporidium parvum
EILFKISYALPNVGYCQGMN

SEQ ID NO: 2290989 - protein, 17 aa, Cryptosporidium parvum
EILFLTVHFMDNVIIKD

SEQ ID NO: 2290990 - protein, 21 aa, Cryptosporidium parvum
EILHLSQACLSEPKDNGRVYV

SEQ ID NO: 2290991 - protein, 22 aa, Cryptosporidium parvum
EILIICLELIYGIKKSFIVSNE

SEQ ID NO: 2290992 - protein, 18 aa, Cryptosporidium parvum
EILLGSIINGCRKVKNVK

SEQ ID NO: 2290993 - protein, 21 aa, Cryptosporidium parvum
EILQAQIYYMFNCREDQSVEP

SEQ ID NO: 2290994 - protein, 20 aa, Cryptosporidium parvum
EILRSRGIERLFPIQAQSFE

SEQ ID NO: 2290995 - protein, 21 aa, Cryptosporidium parvum
EILTPERKRELALKRKRDRET

SEQ ID NO: 2290996 - protein, 19 aa, Cryptosporidium parvum
EIMEISLTLIKNVTNILAP

SEQ ID NO: 2290997 - protein, 24 aa, Cryptosporidium parvum
EINGSVRFQIDWIPTTHFEMKKVN

SEQ ID NO: 2290998 - protein, 26 aa, Cryptosporidium parvum
EINIKLIDWGSCLSIYQASNTRNSYI

SEQ ID NO: 2290999 - protein, 20 aa, Cryptosporidium parvum
EINKRPNIFDDLLGGDDETE

SEQ ID NO: 2291000 - protein, 25 aa, Cryptosporidium parvum
EINNWKIKIELGIEEEKKTKIKILE

SEQ ID NO: 2291001 - protein, 32 aa, Cryptosporidium parvum
EINVLKLRFKILIQCYRMLSRGLIPGEKLLGE

SEQ ID NO: 2291002 - protein, 24 aa, Cryptosporidium parvum
EIPELFRNIHFIIVDEVDRLLSQP

SEQ ID NO: 2291003 - protein, 18 aa, Cryptosporidium parvum
EIPFILVPLSSLYMENFS

SEQ ID NO: 2291004 - protein, 25 aa, Cryptosporidium parvum
EIPIEFKYIPKTAIIIIRKLKNIED

SEQ ID NO: 2291005 - protein, 20 aa, Cryptosporidium parvum
EIPIQRWNHNLVYNADPDKT

SEQ ID NO: 2291006 - protein, 24 aa, Cryptosporidium parvum
EIPNCKGENIVNCHHSFGDGIDKS

SEQ ID NO: 2291007 - protein, 17 aa, Cryptosporidium parvum
EIPRLSMSYNIRKKTIG

SEQ ID NO: 2291008 - protein, 25 aa, Cryptosporidium parvum
EIPSVYCCICKSSYGVNLACNHPGC

SEQ ID NO: 2291009 - protein, 28 aa, Cryptosporidium parvum
EIQAIVCLFLDYKRLLFNTLQLNMNLEL

SEQ ID NO: 2291010 - protein, 24 aa, Cryptosporidium parvum
EIQWFKRIIENFVDQYYLYADNWI

SEQ ID NO: 2291011 - protein, 20 aa, Cryptosporidium parvum
EIRDTCTYFPLRKLLIKSLL

SEQ ID NO: 2291012 - protein, 26 aa, Cryptosporidium parvum
EIREKPSRFSPLLVDSSLVFPNDKSL

SEQ ID NO: 2291013 - protein, 41 aa, Cryptosporidium parvum
EIRGLFEECGSIERVSVLSDKGCAFITFEQEEGAKSAIQWN

SEQ ID NO: 2291014 - protein, 18 aa, Cryptosporidium parvum
EIRKLRRGCNLSKLLVEV

SEQ ID NO: 2291015 - protein, 20 aa, Cryptosporidium parvum
EIRKRYRIHFKRIQNEGEDN

SEQ ID NO: 2291016 - protein, 20 aa, Cryptosporidium parvum
EIRQVCAILSGLAVSFDYEL

SEQ ID NO: 2291017 - protein, 17 aa, Cryptosporidium parvum
EIRWCSCNIYSTQDHAA

SEQ ID NO: 2291018 - protein, 19 aa, Cryptosporidium parvum
EISDLEFIGLIKTKVQEEF

SEQ ID NO: 2291019 - protein, 25 aa, Cryptosporidium parvum
EISFFTLYEYEQWRKNNSSNLNGWR

SEQ ID NO: 2291020 - protein, 18 aa, Cryptosporidium parvum
EISGKFRSNIMLKCCETE

SEQ ID NO: 2291021 - protein, 27 aa, Cryptosporidium parvum
EISIPFSWSQPILKLKILEENDFKADI

SEQ ID NO: 2291022 - protein, 23 aa, Cryptosporidium parvum
EISKMDPCVYCLTINNNEENLEK

SEQ ID NO: 2291023 - protein, 27 aa, Cryptosporidium parvum
EISMLQKRHEMCVVQKNAIKDLINLHK

SEQ ID NO: 2291024 - protein, 22 aa, Cryptosporidium parvum
EISPELKSLMSVDYSRRNLIKK

SEQ ID NO: 2291025 - protein, 19 aa, Cryptosporidium parvum
EISQLIWYQHIQPLSTEIV

SEQ ID NO: 2291026 - protein, 24 aa, Cryptosporidium parvum
EISREIYKGYGIKNETDGSVTETE

SEQ ID NO: 2291027 - protein, 20 aa, Cryptosporidium parvum
EISRIQGILKNFARESDKMD

SEQ ID NO: 2291028 - protein, 20 aa, Cryptosporidium parvum
EISTRKIVRIRKRYDDLGDS

SEQ ID NO: 2291029 - protein, 20 aa, Cryptosporidium parvum
EISYAMLLGSNFALNYMFKV

SEQ ID NO: 2291030 - protein, 18 aa, Cryptosporidium parvum
EITIKRKFIIPFHENERN

SEQ ID NO: 2291031 - protein, 23 aa, Cryptosporidium parvum
EIVKDIKETACFVSSNIQKDEND

SEQ ID NO: 2291032 - protein, 19 aa, Cryptosporidium parvum
EIVLTRFLSIFKINHVAII

SEQ ID NO: 2291033 - protein, 25 aa, Cryptosporidium parvum
EIWREALIASCRARHAAKENRLRTL

SEQ ID NO: 2291034 - protein, 25 aa, Cryptosporidium parvum
EIYCVPEYARYGAIHSGYSPSPQVV

SEQ ID NO: 2291035 - protein, 20 aa, Cryptosporidium parvum
EIYNQLLFLYKFRLSNSYRT

SEQ ID NO: 2291036 - protein, 31 aa, Cryptosporidium parvum
EIYVRNEILCGLNFCTLCYGKYSGISNQKAR

SEQ ID NO: 2291037 - protein, 37 aa, Cryptosporidium parvum; identical to SEQ ID NO: 2170075

SEQ ID NO: 2291038 - protein, 24 aa, Cryptosporidium parvum
EKAEDLRLLALVSENEGFNWFKIA

SEQ ID NO: 2291039 - protein, 18 aa, Cryptosporidium parvum
EKAIKEAEFIAASESIKL

SEQ ID NO: 2291040 - protein, 18 aa, Cryptosporidium parvum
EKALKLGLILPKPNQFVS

SEQ ID NO: 2291041 - protein, 19 aa, Cryptosporidium parvum
EKANLLFDLFGYDDANRLS

SEQ ID NO: 2291042 - protein, 19 aa, Cryptosporidium parvum
EKARIIGTRALQISMNAPV

SEQ ID NO: 2291043 - protein, 24 aa, Cryptosporidium parvum
EKARNFFGRFGITGSLALEPLYVL

SEQ ID NO: 2291044 - protein, 17 aa, Cryptosporidium parvum
EKASFVLRPVCSEDVMT

SEQ ID NO: 2291045 - protein, 24 aa, Cryptosporidium parvum
EKATEVVKFLKFVNKGNLAMALDI

SEQ ID NO: 2291046 - protein, 18 aa, Cryptosporidium parvum
EKCKLLGEDCIVLSKYSL

SEQ ID NO: 2291047 - protein, 30 aa, Cryptosporidium parvum; identical to SEQ ID NO: 2170087

SEQ ID NO: 2291048 - protein, 40 aa, Cryptosporidium parvum
EKCQHKTDAIKRCLIDRLPPYLHVCLQRYCYDSISRARKK

SEQ ID NO: 2291049 - protein, 25 aa, Cryptosporidium parvum
EKCSVCSCHGTLLSCDICSKSIHKS

SEQ ID NO: 2291050 - protein, 24 aa, Cryptosporidium parvum
EKCWYCSSNIYPGHGVTFVRNDAK

SEQ ID NO: 2291051 - protein, 25 aa, Cryptosporidium parvum
EKDAFILICSDGVWEFISSQEAVDI

SEQ ID NO: 2291052 - protein, 24 aa, Cryptosporidium parvum
EKDALLKIFRLVDEKALAQESLEE

SEQ ID NO: 2291053 - protein, 18 aa, Cryptosporidium parvum
EKDELFVSLGVIKYKYPI

SEQ ID NO: 2291054 - protein, 23 aa, Cryptosporidium parvum
EKDLKSHIHWEIEREEDNMKLHE

SEQ ID NO: 2291055 - protein, 23 aa, Cryptosporidium parvum
EKDPRIVEPYAKIDKSKKKYRTN

SEQ ID NO: 2291056 - protein, 21 aa, Cryptosporidium parvum
EKDPRVLIKAFPLIQNMIENF

SEQ ID NO: 2291057 - protein, 23 aa, Cryptosporidium parvum
EKEAISSFLLGRTSLYSPTSVLS

SEQ ID NO: 2291058 - protein, 23 aa, Cryptosporidium parvum
EKEAKKALSNSLIKYNAKEYLFK

SEQ ID NO: 2291059 - protein, 19 aa, Cryptosporidium parvum
EKEFRLSSFDTQDAVVNAI

SEQ ID NO: 2291060 - protein, 18 aa, Cryptosporidium parvum
EKEFRNLRRIVISGLRCP

SEQ ID NO: 2291061 - protein, 20 aa, Cryptosporidium parvum
EKEGLQRYVRDDGSNTTTNK

SEQ ID NO: 2291062 - protein, 18 aa, Cryptosporidium parvum
EKEGRRVYSSFVIIGETN

SEQ ID NO: 2291063 - protein, 18 aa, Cryptosporidium parvum
EKEGWIRTGDICQLLPNG

SEQ ID NO: 2291064 - protein, 19 aa, Cryptosporidium parvum
EKELELHDIMSWIPEVKYN

SEQ ID NO: 2291065 - protein, 24 aa, Cryptosporidium parvum
EKELFPSFRIEVINYLKMRSQEYI

SEQ ID NO: 2291066 - protein, 23 aa, Cryptosporidium parvum
EKELKLQILEIYNSKLDERTYRK

SEQ ID NO: 2291067 - protein, 17 aa, Cryptosporidium parvum
EKELRRQARTCFNNSNV

SEQ ID NO: 2291068 - protein, 18 aa, Cryptosporidium parvum
EKEQFCQIVRSIQENTLF

SEQ ID NO: 2291069 - protein, 22 aa, Cryptosporidium parvum
EKEVGIKILIRLVEIQENKTQF

SEQ ID NO: 2291070 - protein, 25 aa, Cryptosporidium parvum
EKFHVGLPLQYAFGLLSLTIELLMN

SEQ ID NO: 2291071 - protein, 18 aa, Cryptosporidium parvum
EKFLEFNRQTLESSSNET

SEQ ID NO: 2291072 - protein, 22 aa, Cryptosporidium parvum
EKFRFDLRVENLHIFLHEQCEI

SEQ ID NO: 2291073 - protein, 18 aa, Cryptosporidium parvum
EKFWQLPLDPEFQEMVKS

SEQ ID NO: 2291074 - protein, 18 aa, Cryptosporidium parvum
EKHLGFKLSGKVSLDNIG

SEQ ID NO: 2291075 - protein, 20 aa, Cryptosporidium parvum
EKHVEMAIKLFKNATIEAIK

SEQ ID NO: 2291076 - protein, 24 aa, Cryptosporidium parvum
EKIAELENALAIGEANKIESLKTY

SEQ ID NO: 2291077 - protein, 17 aa, Cryptosporidium parvum
EKIAVFDFCSPGQPGDL

SEQ ID NO: 2291078 - protein, 20 aa, Cryptosporidium parvum
EKICKKRNKLGCEMNISQSV

SEQ ID NO: 2291079 - protein, 17 aa, Cryptosporidium parvum
EKICVNCEIGLPNCGAV

SEQ ID NO: 2291080 - protein, 24 aa, Cryptosporidium parvum
EKIDFWKSQFLYLVKKLLINYKKT

SEQ ID NO: 2291081 - protein, 24 aa, Cryptosporidium parvum
EKIEIKRLLELNIIENENKKKEII

SEQ ID NO: 2291082 - protein, 17 aa, Cryptosporidium parvum
EKIHLCVQDGCESSFQL

SEQ ID NO: 2291083 - protein, 23 aa, Cryptosporidium parvum
EKIIEPFPDYMLKKAYNSSKSGK

SEQ ID NO: 2291084 - protein, 21 aa, Cryptosporidium parvum
EKIISKWRFYRLESKSLQGIK

SEQ ID NO: 2291085 - protein, 25 aa, Cryptosporidium parvum
EKIIWRLAYISVMGYEIDFGWLEIL

SEQ ID NO: 2291086 - protein, 18 aa, Cryptosporidium parvum
EKIKEISAMINVEDEDFN

SEQ ID NO: 2291087 - protein, 17 aa, Cryptosporidium parvum
EKIKLIYPSLEIVKVSD

SEQ ID NO: 2291088 - protein, 17 aa, Cryptosporidium parvum
EKIKVLIPGAGLGRLLF

SEQ ID NO: 2291089 - protein, 20 aa, Cryptosporidium parvum
EKIMFAHELALYSGLNLLVP

SEQ ID NO: 2291090 - protein, 18 aa, Cryptosporidium parvum
EKIPTCRTHFCGYDENLE

SEQ ID NO: 2291091 - protein, 21 aa, Cryptosporidium parvum
EKIRTMLRMATNVNELNQAIK

SEQ ID NO: 2291092 - protein, 23 aa, Cryptosporidium parvum
EKISESFSQASFEVINKPKKVDI

SEQ ID NO: 2291093 - protein, 23 aa, Cryptosporidium parvum
EKISRHLIMNFGYTDLLLRFTTP

SEQ ID NO: 2291094 - protein, 25 aa, Cryptosporidium parvum
EKISSFIFQHGFEIDIRYHFTSIYN

SEQ ID NO: 2291095 - protein, 24 aa, Cryptosporidium parvum
EKIWLRGRITESRCKGSLGFVLLR

SEQ ID NO: 2291096 - protein, 23 aa, Cryptosporidium parvum
EKIYECLKNIVIILKNVISFPNN

SEQ ID NO: 2291097 - protein, 19 aa, Cryptosporidium parvum
EKIYWSNTHMKEMSDVIQE

SEQ ID NO: 2291098 - protein, 24 aa, Cryptosporidium parvum
EKKDLKLGRGHESDVRISDVSISR

SEQ ID NO: 2291099 - protein, 20 aa, Cryptosporidium parvum
EKKGNIAFIDVTLWDSKTNI

SEQ ID NO: 2291100 - protein, 25 aa, Cryptosporidium parvum
EKKLKKRRIEMLFLRGDLIILVKPA

SEQ ID NO: 2291101 - protein, 22 aa, Cryptosporidium parvum
EKKNFRRIFIRSVLSTDMSYHN

SEQ ID NO: 2291102 - protein, 37 aa, Cryptosporidium parvum
EKKNSWSWGHKLRWVKIFKCEMHYFLSPKESNIKAKA

SEQ ID NO: 2291103 - protein, 18 aa, Cryptosporidium parvum
EKKSLGINKDHIIKILRP

SEQ ID NO: 2291104 - protein, 19 aa, Cryptosporidium parvum
EKKSTGLLAKTIAKAKAKS

SEQ ID NO: 2291105 - protein, 20 aa, Cryptosporidium parvum
EKKSVIEIEIGRCIIDLKVA

SEQ ID NO: 2291106 - protein, 45 aa, Cryptosporidium parvum; identical to SEQ ID NO: 2170132

SEQ ID NO: 2291107 - protein, 26 aa, Cryptosporidium parvum
EKLIELVRLNVGLIFCIDEPSEVRKI

SEQ ID NO: 2291108 - protein, 17 aa, Cryptosporidium parvum
EKLILNRIESARKNVNL

SEQ ID NO: 2291109 - protein, 19 aa, Cryptosporidium parvum
EKLIYYVIIKKIFSSSIHL

SEQ ID NO: 2291110 - protein, 18 aa, Cryptosporidium parvum
EKLKGCKNSIITEEQSLK

SEQ ID NO: 2291111 - protein, 21 aa, Cryptosporidium parvum
EKLKIVKGVDVFDEPKRQSTV

SEQ ID NO: 2291112 - protein, 23 aa, Cryptosporidium parvum
EKLKRAELLGDLLAVQEAQNEEL

SEQ ID NO: 2291113 - protein, 19 aa, Cryptosporidium parvum
EKLLESFMFTSLDDDELKT

SEQ ID NO: 2291114 - protein, 17 aa, Cryptosporidium parvum
EKLLKVWSDSFPQDIVQ

SEQ ID NO: 2291115 - protein, 17 aa, Cryptosporidium parvum
EKLLLFSKECGISAQGL

SEQ ID NO: 2291116 - protein, 20 aa, Cryptosporidium parvum
EKLLRNGYCYIHGRDKLLRP

SEQ ID NO: 2291117 - protein, 22 aa, Cryptosporidium parvum
EKLNELMGIFKKREFSDSQLAI

SEQ ID NO: 2291118 - protein, 21 aa, Cryptosporidium parvum
EKLNNIILENCEKFQKINQNI

SEQ ID NO: 2291119 - protein, 21 aa, Cryptosporidium parvum
EKLSYLKIWVPSAHRPPKHQT

SEQ ID NO: 2291120 - protein, 25 aa, Cryptosporidium parvum
EKLVILFKLIHEFLNFYEINNTCRM

SEQ ID NO: 2291121 - protein, 20 aa, Cryptosporidium parvum
EKLVKRSNILTNLTSCDILS

SEQ ID NO: 2291122 - protein, 22 aa, Cryptosporidium parvum
EKLVRIRYAEVLRNLRGPAGSG

SEQ ID NO: 2291123 - protein, 27 aa, Cryptosporidium parvum
EKMDISNDLTFRYLLDILQESYHNFKF

SEQ ID NO: 2291124 - protein, 18 aa, Cryptosporidium parvum
EKMIWIVRTLFVMTILQN

SEQ ID NO: 2291125 - protein, 24 aa, Cryptosporidium parvum
EKNCGYKLLPFETRFHNECKWEYK

SEQ ID NO: 2291126 - protein, 25 aa, Cryptosporidium parvum
EKNHVSFKKGVQIVTPRPLVIDEDD

SEQ ID NO: 2291127 - protein, 18 aa, Cryptosporidium parvum
EKNKGFFGTWNCFRRDHK

SEQ ID NO: 2291128 - protein, 23 aa, Cryptosporidium parvum
EKNLKVGSIIFVRIKKYSFSDNG

SEQ ID NO: 2291129 - protein, 21 aa, Cryptosporidium parvum
EKNRCRSFFSFVANWSDDDVS

SEQ ID NO: 2291130 - protein, 30 aa, Cryptosporidium parvum
EKNRNALILQREWVQLVFWVISWMGNDINK

SEQ ID NO: 2291131 - protein, 27 aa, Cryptosporidium parvum
EKNSGIINLCIYFSFASFLDILGISKL

SEQ ID NO: 2291132 - protein, 22 aa, Cryptosporidium parvum
EKNSVCFKLNVKCTKDDINHEK

SEQ ID NO: 2291133 - protein, 24 aa, Cryptosporidium parvum
EKNTLLQMCRLISTLLEYFPNSFF

SEQ ID NO: 2291134 - protein, 23 aa, Cryptosporidium parvum
EKNWRAVFRLGIQQIVSICNKKM

SEQ ID NO: 2291135 - protein, 30 aa, Cryptosporidium parvum
EKNYKDYILKLIIIREINNLTMLLLKNQDN

SEQ ID NO: 2291136 - protein, 26 aa, Cryptosporidium parvum
EKNYSGRFGGKMGLPLVPETIATSGD

SEQ ID NO: 2291137 - protein, 19 aa, Cryptosporidium parvum
EKPKAIVCPMIEDIDRYTW

SEQ ID NO: 2291138 - protein, 28 aa, Cryptosporidium parvum
EKPLKGGKLFTCKSCPDEKAIVAFGGES

SEQ ID NO: 2291139 - protein, 19 aa, Cryptosporidium parvum
EKPLPSARAKDDYLQYEQY

SEQ ID NO: 2291140 - protein, 22 aa, Cryptosporidium parvum
EKQKLHCLNTLFSKLQINQAII

SEQ ID NO: 2291141 - protein, 35 aa, Cryptosporidium parvum
EKQVKNQHGMVGYSFQALECCSGKNDHPNISSEFI

SEQ ID NO: 2291142 - protein, 20 aa, Cryptosporidium parvum
EKQYLKLLVFGIHGECDELI

SEQ ID NO: 2291143 - protein, 20 aa, Cryptosporidium parvum
EKRGYRIAAMKLTIATPAIL

SEQ ID NO: 2291144 - protein, 19 aa, Cryptosporidium parvum
EKRIMVATDLFGRGIDIER

SEQ ID NO: 2291145 - protein, 29 aa, Cryptosporidium parvum
EKRKERTLKCFIKKLIIENFKSYNGRHII

SEQ ID NO: 2291146 - protein, 18 aa, Cryptosporidium parvum
EKRLKDHISSIGCNITDV

SEQ ID NO: 2291147 - protein, 21 aa, Cryptosporidium parvum
EKRMLTILSLVGYSYIEYLDT

SEQ ID NO: 2291148 - protein, 19 aa, Cryptosporidium parvum
EKRRKRREAFREMADEAAR

SEQ ID NO: 2291149 - protein, 21 aa, Cryptosporidium parvum
EKRYFGFDICIIKEVEYNKDK

SEQ ID NO: 2291150 - protein, 32 aa, Cryptosporidium parvum
EKSANINTGFFERFNCHGAKILEFTNSGNNAV

SEQ ID NO: 2291151 - protein, 28 aa, Cryptosporidium parvum
EKSDIWAIACCLLEIFGGPIPFYEYSSN

SEQ ID NO: 2291152 - protein, 31 aa, Cryptosporidium parvum; identical to SEQ ID NO: 2170171

SEQ ID NO: 2291153 - protein, 31 aa, Cryptosporidium parvum
EKSERLHLSYKLKFLIEKNAHLNCSINKAEE

SEQ ID NO: 2291154 - protein, 20 aa, Cryptosporidium parvum
EKSFRLPIFELTYDFQMPNT

SEQ ID NO: 2291155 - protein, 28 aa, Cryptosporidium parvum
EKSGSRMKYWWSKYIRRQKKKKEDSKEK

SEQ ID NO: 2291156 - protein, 24 aa, Cryptosporidium parvum
EKSLCNDFRKANNFQNVGNNNFNL

SEQ ID NO: 2291157 - protein, 25 aa, Cryptosporidium parvum
EKSRQLRESFEISKEDLFIGCEITC

SEQ ID NO: 2291158 - protein, 24 aa, Cryptosporidium parvum
EKSSKWKAKCYQLNDLNTTSINEC

SEQ ID NO: 2291159 - protein, 20 aa, Cryptosporidium parvum
EKSSLIGSVYDLINQIENEK

SEQ ID NO: 2291160 - protein, 20 aa, Cryptosporidium parvum
EKSWELSRHRFARAQRSLGN

SEQ ID NO: 2291161 - protein, 17 aa, Cryptosporidium parvum
EKSWRKKEVNIIINVGG

SEQ ID NO: 2291162 - protein, 21 aa, Cryptosporidium parvum
EKTEMSVLCLYSSSGSVSDSY

SEQ ID NO: 2291163 - protein, 22 aa, Cryptosporidium parvum
EKTGETRVCFESCMEENQNDVI

SEQ ID NO: 2291164 - protein, 25 aa, Cryptosporidium parvum
EKTGSYAIFMCYKLYSLFDPEDKGY

SEQ ID NO: 2291165 - protein, 23 aa, Cryptosporidium parvum
EKTHGNGLLCVNVRSEQCIEISS

SEQ ID NO: 2291166 - protein, 22 aa, Cryptosporidium parvum
EKTKRFDFVVLMLNENFQILNK

SEQ ID NO: 2291167 - protein, 26 aa, Cryptosporidium parvum
EKTLLICSRCKKVAYCNVDCQRKDWS

SEQ ID NO: 2291168 - protein, 26 aa, Cryptosporidium parvum
EKVCKYSRCCISPMAAFLGGIAAQEI

SEQ ID NO: 2291169 - protein, 22 aa, Cryptosporidium parvum
EKVFKIIKLMKIKKFLNKSECT

SEQ ID NO: 2291170 - protein, 20 aa, Cryptosporidium parvum
EKVINPEGKIDEKDSEKETL

SEQ ID NO: 2291171 - protein, 25 aa, Cryptosporidium parvum
EKVLGCLYKLYLNGNLYCFAIDEAH

SEQ ID NO: 2291172 - protein, 26 aa, Cryptosporidium parvum
EKVSELDCFFHMYGRFNQLNDICNEV

SEQ ID NO: 2291173 - protein, 21 aa, Cryptosporidium parvum
EKVSMRIISIFGPDAEIWREA

SEQ ID NO: 2291174 - protein, 33 aa, Cryptosporidium parvum
EKVSVKFSQYFSMFKKKMLKSFNSINELYHEMK

SEQ ID NO: 2291175 - protein, 28 aa, Cryptosporidium parvum
EKYFNYWMLAKKFEFEKIVTRWTSNIDN

SEQ ID NO: 2291176 - protein, 17 aa, Cryptosporidium parvum
EKYKISIYVNRKLLESN

SEQ ID NO: 2291177 - protein, 20 aa, Cryptosporidium parvum
EKYPIINPGLLFEFSLELPE

SEQ ID NO: 2291178 - protein, 26 aa, Cryptosporidium parvum
EKYQFPFSRLPPIIDFSFAESRHFDW

SEQ ID NO: 2291179 - protein, 18 aa, Cryptosporidium parvum
EKYRWGEATSLLSVTESL

SEQ ID NO: 2291180 - protein, 19 aa, Cryptosporidium parvum
ELAEKKAQLAKAVKNPAPI

SEQ ID NO: 2291181 - protein, 22 aa, Cryptosporidium parvum
ELAKLIEHISIIKVTTNNKNGK

SEQ ID NO: 2291182 - protein, 25 aa, Cryptosporidium parvum
ELALIWCILKTFAISTKYHHRQEFI

SEQ ID NO: 2291183 - protein, 24 aa, Cryptosporidium parvum
ELALNRLHRQFARIESRERIEVEL

SEQ ID NO: 2291184 - protein, 23 aa, Cryptosporidium parvum
ELAMSRYHIAVLLNNGHVYVSLN

SEQ ID NO: 2291185 - protein, 18 aa, Cryptosporidium parvum
ELAQKFVKIMGHCIGIEF

SEQ ID NO: 2291186 - protein, 21 aa, Cryptosporidium parvum
ELCKYLPQTHGLVMGGANRRT

SEQ ID NO: 2291187 - protein, 26 aa, Cryptosporidium parvum
ELCLGGYCKIGYPGIIIVEGLEDCCL

SEQ ID NO: 2291188 - protein, 22 aa, Cryptosporidium parvum
ELCRSRTTRWADVEAEEDDLDM

SEQ ID NO: 2291189 - protein, 31 aa, Cryptosporidium parvum
ELDCIALGPITRGALKFIFKAPSPDFTKIPP

SEQ ID NO: 2291190 - protein, 17 aa, Cryptosporidium parvum
ELDCYRKKVNLRGTIYS

SEQ ID NO: 2291191 - protein, 25 aa, Cryptosporidium parvum
ELDDVLCLYKCKLLINGIWRNIFVD

SEQ ID NO: 2291192 - protein, 19 aa, Cryptosporidium parvum
ELDEKELLCRYLRLKKELN

SEQ ID NO: 2291193 - protein, 19 aa, Cryptosporidium parvum
ELDFLKPFISCGSRSSAII

SEQ ID NO: 2291194 - protein, 21 aa, Cryptosporidium parvum
ELDISDLFVMFEIIDSEFMIS

SEQ ID NO: 2291195 - protein, 21 aa, Cryptosporidium parvum
ELDKLAILLIENFLNLNGKQR

SEQ ID NO: 2291196 - protein, 25 aa, Cryptosporidium parvum
ELDKLCNQCLNLLRQNKISSKNAFD

SEQ ID NO: 2291197 - protein, 18 aa, Cryptosporidium parvum
ELDLRMIAISARNAEYNP

SEQ ID NO: 2291198 - protein, 25 aa, Cryptosporidium parvum
ELDPDFGISAWIAIKALFVNLQTSR

SEQ ID NO: 2291199 - protein, 23 aa, Cryptosporidium parvum
ELDREMSFVLPLGAIQMLRRFYK

SEQ ID NO: 2291200 - protein, 23 aa, Cryptosporidium parvum
ELEAKISEMVPIFDKIQDEGKSE

SEQ ID NO: 2291201 - protein, 17 aa, Cryptosporidium parvum
ELEEEYSNWVIRLQGEN

SEQ ID NO: 2291202 - protein, 22 aa, Cryptosporidium parvum
ELEHIRTLLKYYKNQVKSDYIL

SEQ ID NO: 2291203 - protein, 23 aa, Cryptosporidium parvum
ELEKKLKCPVVMIGQRSILPRNY

SEQ ID NO: 2291204 - protein, 41 aa, Cryptosporidium parvum
ELELDYELICIDFFLRYISNLYPLWGEYGDNLMFHIAQIYG

SEQ ID NO: 2291205 - protein, 24 aa, Cryptosporidium parvum
ELELKPSHFIPLLKSYIEDTNNGK

SEQ ID NO: 2291206 - protein, 20 aa, Cryptosporidium parvum
ELENLLLYNINKLRHERIKL

SEQ ID NO: 2291207 - protein, 24 aa, Cryptosporidium parvum
ELENYKSASILSAIDSSRGRKIQN

SEQ ID NO: 2291208 - protein, 18 aa, Cryptosporidium parvum
ELERERQRLLRTDIIRQM

SEQ ID NO: 2291209 - protein, 17 aa, Cryptosporidium parvum
ELESIKLGQCLNSTRNI

SEQ ID NO: 2291210 - protein, 22 aa, Cryptosporidium parvum
ELESLKSKFLIQDVQDAEYEKI

SEQ ID NO: 2291211 - protein, 19 aa, Cryptosporidium parvum
ELFDICYQGTVGDFHDKLQ

SEQ ID NO: 2291212 - protein, 19 aa, Cryptosporidium parvum
ELFEHVIFACWNFHIAHAC

SEQ ID NO: 2291213 - protein, 19 aa, Cryptosporidium parvum
ELFEKELLPHVGVTSGSES

SEQ ID NO: 2291214 - protein, 20 aa, Cryptosporidium parvum
ELFFKIQLAKILVVGAGGIG

SEQ ID NO: 2291215 - protein, 27 aa, Cryptosporidium parvum
ELFRLECFETLTGLRFFLIASKDAQGL

SEQ ID NO: 2291216 - protein, 23 aa, Cryptosporidium parvum
ELGDLFKLLVHIIGKPIVEPQTM

SEQ ID NO: 2291217 - protein, 24 aa, Cryptosporidium parvum
ELGKRLRGGEVLHRDEWIPTQDNN

SEQ ID NO: 2291218 - protein, 29 aa, Cryptosporidium parvum
ELGLCKKAAVLSVQMLKGVLLQRIETILD

SEQ ID NO: 2291219 - protein, 18 aa, Cryptosporidium parvum
ELHFIIWKMDINEIQAPI

SEQ ID NO: 2291220 - protein, 20 aa, Cryptosporidium parvum
ELIDDAFVLTRCEYMIQLSY

SEQ ID NO: 2291221 - protein, 24 aa, Cryptosporidium parvum
ELIGSFPSKGTWNSYIPRSLTHKW

SEQ ID NO: 2291222 - protein, 18 aa, Cryptosporidium parvum
ELIKCADIDGFLVGGASL

SEQ ID NO: 2291223 - protein, 20 aa, Cryptosporidium parvum
ELILFRLRFNSGNNQGSVNF

SEQ ID NO: 2291224 - protein, 21 aa, Cryptosporidium parvum
ELIMRHPFPGPGLSINVICYD

SEQ ID NO: 2291225 - protein, 17 aa, Cryptosporidium parvum
ELINFHSSNKFALKPLR

SEQ ID NO: 2291226 - protein, 18 aa, Cryptosporidium parvum
ELIRILRIQEESRKSLEE

SEQ ID NO: 2291227 - protein, 17 aa, Cryptosporidium parvum
ELIRKYSVLEIKVSDIY

SEQ ID NO: 2291228 - protein, 19 aa, Cryptosporidium parvum
ELISFDRLIFYTIVSSIIS

SEQ ID NO: 2291229 - protein, 19 aa, Cryptosporidium parvum
ELISIFNIDVVVVMDDPST

SEQ ID NO: 2291230 - protein, 19 aa, Cryptosporidium parvum
ELISKIGLLNLNINRLNKA

SEQ ID NO: 2291231 - protein, 19 aa, Cryptosporidium parvum
ELKDGFLAIEDYFKQDKVF

SEQ ID NO: 2291232 - protein, 23 aa, Cryptosporidium parvum
ELKDVCSKLQLEISQRARKSDLI

SEQ ID NO: 2291233 - protein, 26 aa, Cryptosporidium parvum
ELKKFRMIKDINCFDILNNVERLSCL

SEQ ID NO: 2291234 - protein, 22 aa, Cryptosporidium parvum
ELKLDCKASFTVFSSSPLLLNR

SEQ ID NO: 2291235 - protein, 21 aa, Cryptosporidium parvum
ELKLRQFRHLQSMIDEERNLL

SEQ ID NO: 2291236 - protein, 21 aa, Cryptosporidium parvum
ELKRMIIHISSIRSLAKKTIS

SEQ ID NO: 2291237 - protein, 25 aa, Cryptosporidium parvum
ELKSIPKCFVLRKGKVVKQLKGLVM

SEQ ID NO: 2291238 - protein, 33 aa, Cryptosporidium parvum; identical to SEQ ID NO: 2170247

SEQ ID NO: 2291239 - protein, 31 aa, Cryptosporidium parvum
ELLEVRSGSIAFASFGKVCIWGGIDEKNDVL

SEQ ID NO: 2291240 - protein, 20 aa, Cryptosporidium parvum
ELLFNYEIGDIIHRIIETRH

SEQ ID NO: 2291241 - protein, 18 aa, Cryptosporidium parvum
ELLIPSFRRKCLPIDLLC

SEQ ID NO: 2291242 - protein, 18 aa, Cryptosporidium parvum
ELLISWDKETIIVSEIDS

SEQ ID NO: 2291243 - protein, 24 aa, Cryptosporidium parvum
ELLKCPKSSWPKIISELPTGIKSE

SEQ ID NO: 2291244 - protein, 20 aa, Cryptosporidium parvum
ELLNRLPFIVKHDDAELLGL

SEQ ID NO: 2291245 - protein, 25 aa, Cryptosporidium parvum
ELLNSFPSCSLAIIKSLTRGDEIDE

SEQ ID NO: 2291246 - protein, 17 aa, Cryptosporidium parvum
ELLRECCKIGREALDIA

SEQ ID NO: 2291247 - protein, 23 aa, Cryptosporidium parvum
ELLRGIRIHFTRIVKSFDSSIGD

SEQ ID NO: 2291248 - protein, 20 aa, Cryptosporidium parvum
ELLSFPHIFNQVFLSLNRFN

SEQ ID NO: 2291249 - protein, 22 aa, Cryptosporidium parvum
ELLSFSELYGSILDRRIIQSLT

SEQ ID NO: 2291250 - protein, 19 aa, Cryptosporidium parvum
ELLSLFKLGNITSSIHNDF

SEQ ID NO: 2291251 - protein, 21 aa, Cryptosporidium parvum
ELLVKLKQFWSEYPEKLNKKI

SEQ ID NO: 2291252 - protein, 21 aa, Cryptosporidium parvum
ELLYIKRKLSLVLDLDNTLIH

SEQ ID NO: 2291253 - protein, 17 aa, Cryptosporidium parvum
ELMFEMFQTQSLNIALQ

SEQ ID NO: 2291254 - protein, 20 aa, Cryptosporidium parvum
ELMFQLLNGMAYCHSHNIMH

SEQ ID NO: 2291255 - protein, 19 aa, Cryptosporidium parvum
ELNDFIVEFQRYLSEASPS

SEQ ID NO: 2291256 - protein, 39 aa, Cryptosporidium parvum
ELNIEGLFLPNSMYVILNGFKLLFPDIFTCNVSIESFAE

SEQ ID NO: 2291257 - protein, 18 aa, Cryptosporidium parvum
ELNKRISNNMLRLQISKK

SEQ ID NO: 2291258 - protein, 17 aa, Cryptosporidium parvum
ELNSIKVLDELRGPLKV

SEQ ID NO: 2291259 - protein, 19 aa, Cryptosporidium parvum
ELNSPLKLIDFGLAKRITR

SEQ ID NO: 2291260 - protein, 19 aa, Cryptosporidium parvum
ELNSRISTLDLKLQESSRD

SEQ ID NO: 2291261 - protein, 19 aa, Cryptosporidium parvum
ELNSSLSMVYICRNLEDFD

SEQ ID NO: 2291262 - protein, 21 aa, Cryptosporidium parvum
ELNVIPGIGYYPGQIQINSPI

SEQ ID NO: 2291263 - protein, 19 aa, Cryptosporidium parvum
ELNVKLWIFFELTFEEILK

SEQ ID NO: 2291264 - protein, 23 aa, Cryptosporidium parvum
ELNWPIENIILWGCSIGTGPSTR

SEQ ID NO: 2291265 - protein, 18 aa, Cryptosporidium parvum
ELPDAYRLRGHQRRVRLF

SEQ ID NO: 2291266 - protein, 26 aa, Cryptosporidium parvum
ELPFFVPSCVSLPFGTLNKLLNSSTF

SEQ ID NO: 2291267 - protein, 25 aa, Cryptosporidium parvum
ELPMPRFGHSMAWISEKTFLIYGGE

SEQ ID NO: 2291268 - protein, 25 aa, Cryptosporidium parvum
ELPNRPITCIIWSRFVNNIYLSHGI

SEQ ID NO: 2291269 - protein, 18 aa, Cryptosporidium parvum
ELPVPYMVPKPFVVPVHV

SEQ ID NO: 2291270 - protein, 21 aa, Cryptosporidium parvum
ELPVRRWTQDYKEWLESTLLP

SEQ ID NO: 2291271 - protein, 23 aa, Cryptosporidium parvum
ELQELRAKQFAILEQEGMLSHIK

SEQ ID NO: 2291272 - protein, 24 aa, Cryptosporidium parvum
ELQHLSVPYWNLFPDVIDDVLNDT

SEQ ID NO: 2291273 - protein, 25 aa, Cryptosporidium parvum
ELQNYKLKYFEAMRKLQRLETEMVI

SEQ ID NO: 2291274 - protein, 28 aa, Cryptosporidium parvum
ELRATFFDVLEIFLLTIYKFREKLSSSP

SEQ ID NO: 2291275 - protein, 19 aa, Cryptosporidium parvum
ELRECKLSLNTNKEHSNIL

SEQ ID NO: 2291276 - protein, 27 aa, Cryptosporidium parvum
ELRILRKEMKNLLLLTKKEAYQFSKNN

SEQ ID NO: 2291277 - protein, 18 aa, Cryptosporidium parvum
ELRMCVRTQIGPVATPDH

SEQ ID NO: 2291278 - protein, 26 aa, Cryptosporidium parvum
ELRPWSRLLDVSPWFNYGFTEKTFKE

SEQ ID NO: 2291279 - protein, 17 aa, Cryptosporidium parvum
ELRRINDDLAFIYQQRI

SEQ ID NO: 2291280 - protein, 21 aa, Cryptosporidium parvum
ELRSAISRKSANYGKDRNQLH

SEQ ID NO: 2291281 - protein, 27 aa, Cryptosporidium parvum
ELRSFGGKWPFIFFKSRIEFLETVTQS

SEQ ID NO: 2291282 - protein, 17 aa, Cryptosporidium parvum
ELRWYKENFEQIKNDLL

SEQ ID NO: 2291283 - protein, 23 aa, Cryptosporidium parvum
ELSDEHFRVLILLEIKEKCNNFK

SEQ ID NO: 2291284 - protein, 19 aa, Cryptosporidium parvum
ELSKCCGKLIDSINENYDR

SEQ ID NO: 2291285 - protein, 18 aa, Cryptosporidium parvum
ELSLAKLERCLAKYGDVS

SEQ ID NO: 2291286 - protein, 23 aa, Cryptosporidium parvum
ELTEMWKNICSKYDIASIEDPFD

SEQ ID NO: 2291287 - protein, 19 aa, Cryptosporidium parvum
ELTERKSLALELLKLLSNK

SEQ ID NO: 2291288 - protein, 18 aa, Cryptosporidium parvum
ELTILIPNKIDWERLEGK

SEQ ID NO: 2291289 - protein, 19 aa, Cryptosporidium parvum
ELTKGMLGYVSKHTLTNFK

SEQ ID NO: 2291290 - protein, 21 aa, Cryptosporidium parvum
ELTKQQFITWFVINQQNGPSI

SEQ ID NO: 2291291 - protein, 25 aa, Cryptosporidium parvum
ELTQINIKYCFPFIVIYDASNTGDQ

SEQ ID NO: 2291292 - protein, 30 aa, Cryptosporidium parvum
ELVAAEGLKCGWGFPTGCSLNHCAAHYTPN

SEQ ID NO: 2291293 - protein, 17 aa, Cryptosporidium parvum
ELVKICSEYVFSLRKDI

SEQ ID NO: 2291294 - protein, 17 aa, Cryptosporidium parvum
ELVPSRMSESIFWQSYF

SEQ ID NO: 2291295 - protein, 18 aa, Cryptosporidium parvum
ELYRCDLVYVSSRKKVPI

SEQ ID NO: 2291296 - protein, 29 aa, Cryptosporidium parvum
EMAIKEKWRLQKISWKYCILDEAHRIKNE

SEQ ID NO: 2291297 - protein, 17 aa, Cryptosporidium parvum
EMALICMNKKHSKYLGC

SEQ ID NO: 2291298 - protein, 18 aa, Cryptosporidium parvum
EMDKCNELLYPILGRSLI

SEQ ID NO: 2291299 - protein, 20 aa, Cryptosporidium parvum
EMDSSPWLSADFNIEPNSIF

SEQ ID NO: 2291300 - protein, 33 aa, Cryptosporidium parvum
EMEQLLALDDFKKVIGLLERAKESSLRRLDRTL

SEQ ID NO: 2291301 - protein, 20 aa, Cryptosporidium parvum
EMFTRVCDYIDRLYAMVKPR

SEQ ID NO: 2291302 - protein, 21 aa, Cryptosporidium parvum
EMGAIELLIVWENLETKRMVV

SEQ ID NO: 2291303 - protein, 26 aa, Cryptosporidium parvum
EMGKGSFKYAWVLDKLKAERERGITI

SEQ ID NO: 2291304 - protein, 19 aa, Cryptosporidium parvum
EMIYRHKVSEVHESKNEIL

SEQ ID NO: 2291305 - protein, 21 aa, Cryptosporidium parvum
EMKRELVFANHRFKEVSWYPI

SEQ ID NO: 2291306 - protein, 28 aa, Cryptosporidium parvum
EMKRIYNLKSRILNYWRKIWKPHHYIKV

SEQ ID NO: 2291307 - protein, 24 aa, Cryptosporidium parvum
EMLCLVRFAGDFSIYIVSSPSENE

SEQ ID NO: 2291308 - protein, 23 aa, Cryptosporidium parvum
EMLHIVTPAWILDSCSKRTKIDY

SEQ ID NO: 2291309 - protein, 25 aa, Cryptosporidium parvum
EMLSSRAVFILVEMIGQNFQQKDFK

SEQ ID NO: 2291310 - protein, 26 aa, Cryptosporidium parvum
EMMFLGPRARIGVFDLLEGKINFLPG

SEQ ID NO: 2291311 - protein, 25 aa, Cryptosporidium parvum
EMMNKKKSKKCCIFHKKRNFGESSS

SEQ ID NO: 2291312 - protein, 26 aa, Cryptosporidium parvum
EMMNLFCKTYPLGLKYNARITNEAIL

SEQ ID NO: 2291313 - protein, 21 aa, Cryptosporidium parvum
EMPVPYLGCVGKKFRPPEIFA

SEQ ID NO: 2291314 - protein, 24 aa, Cryptosporidium parvum
EMRQTKFNVCLTTFDFIIRESGAL

SEQ ID NO: 2291315 - protein, 26 aa, Cryptosporidium parvum
EMSELRQSLQLNLAMIYVKIQEWSKA

SEQ ID NO: 2291316 - protein, 27 aa, Cryptosporidium parvum
ENARINGFRECYSWIGSNGDIKKKFTY

SEQ ID NO: 2291317 - protein, 25 aa, Cryptosporidium parvum
ENCIQLFHPICAWLNGVQIEVDCDP

SEQ ID NO: 2291318 - protein, 17 aa, Cryptosporidium parvum
ENCLDRWRRNKVSLDPQ

SEQ ID NO: 2291319 - protein, 26 aa, Cryptosporidium parvum
ENCSKGKYCVFSSLFYTILSMCGDYQ

SEQ ID NO: 2291320 - protein, 27 aa, Cryptosporidium parvum
ENDELWFDSSLRIVILYFMIVSKKSND

SEQ ID NO: 2291321 - protein, 27 aa, Cryptosporidium parvum
ENDIGSIWLIREIYLSLTPQILKLSMS

SEQ ID NO: 2291322 - protein, 19 aa, Cryptosporidium parvum
  misc_feature (15)..(19): Xaa can be any naturally occurring amino acid
ENDPHKSLGAWRLEXXXXX

SEQ ID NO: 2291323 - protein, 21 aa, Cryptosporidium parvum
ENEASFFLSYIGYFIYSENKD

SEQ ID NO: 2291324 - protein, 17 aa, Cryptosporidium parvum
ENEGLKLTKSVISRIET

SEQ ID NO: 2291325 - protein, 22 aa, Cryptosporidium parvum
ENEIFDLLSKCPHFHTEETSEN

SEQ ID NO: 2291326 - protein, 28 aa, Cryptosporidium parvum
ENEIFNWLLEYDVPLFITNDLINSELNV

SEQ ID NO: 2291327 - protein, 19 aa, Cryptosporidium parvum
ENELILFDVLNCIYNSLSI

SEQ ID NO: 2291328 - protein, 26 aa, Cryptosporidium parvum
ENELKATSMGLLYGRKEKEQEREIAR

SEQ ID NO: 2291329 - protein, 17 aa, Cryptosporidium parvum
ENELLELYHLCGSGNER

SEQ ID NO: 2291330 - protein, 32 aa, Cryptosporidium parvum; identical to SEQ ID NO: 2170328

SEQ ID NO: 2291331 - protein, 24 aa, Cryptosporidium parvum
ENEYGISLLSIWVHLIPSEFIKTN

SEQ ID NO: 2291332 - protein, 22 aa, Cryptosporidium parvum
ENEYWMVVEFPKNSSLYRKHNC

SEQ ID NO: 2291333 - protein, 26 aa, Cryptosporidium parvum
ENFEICKDILKLFVKYISEEKKDFEG

SEQ ID NO: 2291334 - protein, 18 aa, Cryptosporidium parvum
ENFLDVIFGFLLRKTDFF

SEQ ID NO: 2291335 - protein, 20 aa, Cryptosporidium parvum
ENFPFCTIEPHEARMNVPDD

SEQ ID NO: 2291336 - protein, 23 aa, Cryptosporidium parvum
ENFRVSHSMKGEFASVAGGYYRG

SEQ ID NO: 2291337 - protein, 37 aa, Cryptosporidium parvum; identical to SEQ ID NO: 2170338

SEQ ID NO: 2291338 - protein, 18 aa, Cryptosporidium parvum
ENGGRIVIYNNFKESFSF

SEQ ID NO: 2291339 - protein, 18 aa, Cryptosporidium parvum
ENGIRRSRIFNVKQYGYD

SEQ ID NO: 2291340 - protein, 21 aa, Cryptosporidium parvum
ENGRLKFIFDTHIYSINTNKI

SEQ ID NO: 2291341 - protein, 18 aa, Cryptosporidium parvum
ENGWRTKLINSYMNLNEK

SEQ ID NO: 2291342 - protein, 18 aa, Cryptosporidium parvum
ENHGLKSLEFEINDNDSN

SEQ ID NO: 2291343 - protein, 17 aa, Cryptosporidium parvum
ENHHCNYIFSLLDKCQD

SEQ ID NO: 2291344 - protein, 21 aa, Cryptosporidium parvum
ENHKAYLLFYYRSDFNKYDLL

SEQ ID NO: 2291345 - protein, 22 aa, Cryptosporidium parvum
ENHMKLGAWQSSINQIETNIKY

SEQ ID NO: 2291346 - protein, 26 aa, Cryptosporidium parvum
ENIINCKGGWPIRILGLILQVYQIEE

SEQ ID NO: 2291347 - protein, 25 aa, Cryptosporidium parvum
ENIKFKSYQNFAFIKFYDLNILCDC

SEQ ID NO: 2291348 - protein, 17 aa, Cryptosporidium parvum
ENILQLYAWFEDKSRIW

SEQ ID NO: 2291349 - protein, 19 aa, Cryptosporidium parvum
ENILSRLISEVSNSLRNSS

SEQ ID NO: 2291350 - protein, 24 aa, Cryptosporidium parvum
ENINLNGLEMKFEREMTTLKESFI

SEQ ID NO: 2291351 - protein, 23 aa, Cryptosporidium parvum
ENIQCVIRWSFGGDEVFVTGSFN

SEQ ID NO: 2291352 - protein, 21 aa, Cryptosporidium parvum
ENKELREEITILLNKKQEITM

SEQ ID NO: 2291353 - protein, 20 aa, Cryptosporidium parvum
ENKISNDWWSDGEEDEEDEE

SEQ ID NO: 2291354 - protein, 26 aa, Cryptosporidium parvum
ENKLCQRFPWLEVLIRSMDMSILNPS

SEQ ID NO: 2291355 - protein, 21 aa, Cryptosporidium parvum
ENKQEVCIFDETLSKNLFEEE

SEQ ID NO: 2291356 - protein, 22 aa, Cryptosporidium parvum
ENLCLTSGCIILSIGSKYREYC

SEQ ID NO: 2291357 - protein, 32 aa, Cryptosporidium parvum
ENLILTFGRFLLKRLESQMIRRQKVDSDLSSY

SEQ ID NO: 2291358 - protein, 20 aa, Cryptosporidium parvum
ENLKKCLNILELLSMDIEEQ

SEQ ID NO: 2291359 - protein, 26 aa, Cryptosporidium parvum
ENLLGFDLKDLAARGALSTRARVPYN

SEQ ID NO: 2291360 - protein, 19 aa, Cryptosporidium parvum
ENLLKPCFNHEELFKTLNS

SEQ ID NO: 2291361 - protein, 17 aa, Cryptosporidium parvum
ENLLSLLEWGGIKLPLK

SEQ ID NO: 2291362 - protein, 17 aa, Cryptosporidium parvum
ENLSWRSSHPYIVSLRI

SEQ ID NO: 2291363 - protein, 25 aa, Cryptosporidium parvum
ENNEHLEILLGLSFLGNDVKLLSAF

SEQ ID NO: 2291364 - protein, 18 aa, Cryptosporidium parvum
ENNHELFNIYLLNKLENV

SEQ ID NO: 2291365 - protein, 18 aa, Cryptosporidium parvum
ENNIAYKVNFEINTHAES

SEQ ID NO: 2291366 - protein, 23 aa, Cryptosporidium parvum
ENNMPIDVFLPIFVNHDHLLLEM

SEQ ID NO: 2291367 - protein, 25 aa, Cryptosporidium parvum
ENNQHCLPCGRFISPEYLVPGTPGF

SEQ ID NO: 2291368 - protein, 19 aa, Cryptosporidium parvum
ENNVIPGVMRGILDDIYDK

SEQ ID NO: 2291369 - protein, 23 aa, Cryptosporidium parvum
ENPEIMGSFDIILGSDLVYNSDM

SEQ ID NO: 2291370 - protein, 20 aa, Cryptosporidium parvum
ENPLFLSVRAQDIESVTTLL

SEQ ID NO: 2291371 - protein, 17 aa, Cryptosporidium parvum
ENPSCAVNNDFNLFLIP

SEQ ID NO: 2291372 - protein, 32 aa, Cryptosporidium parvum; identical to SEQ ID NO: 2170371

SEQ ID NO: 2291373 - protein, 19 aa, Cryptosporidium parvum
ENRASVILVGLGFTQEMLK

SEQ ID NO: 2291374 - protein, 22 aa, Cryptosporidium parvum
ENREIPQAPELRVEKRPLVELQ

SEQ ID NO: 2291375 - protein, 26 aa, Cryptosporidium parvum
ENRGIGLRFPRFIRIRDDKSPEQATS

SEQ ID NO: 2291376 - protein, 21 aa, Cryptosporidium parvum
ENRLLVSYLLNCSKIKNLGIT

SEQ ID NO: 2291377 - protein, 25 aa, Cryptosporidium parvum
ENRNCPESLKIIDFGLAASLGSPAM

SEQ ID NO: 2291378 - protein, 24 aa, Cryptosporidium parvum
ENRQKYKICWLIDPLDGTKEFLRR

SEQ ID NO: 2291379 - protein, 23 aa, Cryptosporidium parvum
ENRSRGFINFYIVSDVYNKKIVE

SEQ ID NO: 2291380 - protein, 22 aa, Cryptosporidium parvum
ENRSSKEWVEFACSKWMEFFVK

SEQ ID NO: 2291381 - protein, 23 aa, Cryptosporidium parvum
ENRYWTPICYWYSDTMKPLIPKG

SEQ ID NO: 2291382 - protein, 20 aa, Cryptosporidium parvum
ENSGKMVLMDRLIKKLVSGG

SEQ ID NO: 2291383 - protein, 34 aa, Cryptosporidium parvum
ENSIKLFTSIGMWKSLFLTLNYSTYIRRKREMLY

SEQ ID NO: 2291384 - protein, 24 aa, Cryptosporidium parvum
ENSKPPIKMCVVSDIMEPFLPCPL

SEQ ID NO: 2291385 - protein, 21 aa, Cryptosporidium parvum
ENSLGRLLELERSFDYIVGID

SEQ ID NO: 2291386 - protein, 24 aa, Cryptosporidium parvum
ENSLRIFSEYIIKNSRNIIEYSEN

SEQ ID NO: 2291387 - protein, 19 aa, Cryptosporidium parvum
ENSRGIVNFAMKWESDKRQ

SEQ ID NO: 2291388 - protein, 24 aa, Cryptosporidium parvum
ENSRNNLGLAFCNTFLKESNEKIR

SEQ ID NO: 2291389 - protein, 21 aa, Cryptosporidium parvum
ENSTSSILFSVWNQLFRGNSR

SEQ ID NO: 2291390 - protein, 18 aa, Cryptosporidium parvum
ENTESWYLSEFEEYSDTW

SEQ ID NO: 2291391 - protein, 22 aa, Cryptosporidium parvum
ENVLRKRVHEMSTRLSKQGLLC

SEQ ID NO: 2291392 - protein, 18 aa, Cryptosporidium parvum
ENVSWILDGFHTMLKSRS

SEQ ID NO: 2291393 - protein, 23 aa, Cryptosporidium parvum
ENWIKIPCIYPSNSYESLEIIKM

SEQ ID NO: 2291394 - protein, 22 aa, Cryptosporidium parvum
ENYKSKVSMFGLDQDEIKSDIE

SEQ ID NO: 2291395 - protein, 23 aa, Cryptosporidium parvum
ENYLKLWLYGFLQRKESCRNALR

SEQ ID NO: 2291396 - protein, 35 aa, Cryptosporidium parvum
EPAKCLLIGSPFKLPCSKGCHLRTDILPFLHDIIG

SEQ ID NO: 2291397 - protein, 18 aa, Cryptosporidium parvum
EPCGLLLHLSQDCIPVTQ

SEQ ID NO: 2291398 - protein, 22 aa, Cryptosporidium parvum
EPDCRRTINLLNEFISKLDPGA

SEQ ID NO: 2291399 - protein, 23 aa, Cryptosporidium parvum
EPECKYPIIALKYVNDIYHLCSP

SEQ ID NO: 2291400 - protein, 25 aa, Cryptosporidium parvum
EPEFLRRHQRLFASQIMKSILNGLS

SEQ ID NO: 2291401 - protein, 20 aa, Cryptosporidium parvum
EPEFLTCLIYTINNNNNNNN

SEQ ID NO: 2291402 - protein, 27 aa, Cryptosporidium parvum
EPEFRSWIHRQLHIIYSNLAFKLQRLV

SEQ ID NO: 2291403 - protein, 18 aa, Cryptosporidium parvum
EPEILLANTCGPQTFENK

SEQ ID NO: 2291404 - protein, 17 aa, Cryptosporidium parvum
EPFLEPQRREYIGRKTL

SEQ ID NO: 2291405 - protein, 23 aa, Cryptosporidium parvum
EPGAFSFSFFEVYCEQIQDLLTG

SEQ ID NO: 2291406 - protein, 25 aa, Cryptosporidium parvum
EPGSKRAFCQFIMEPICQLFSSIMN

SEQ ID NO: 2291407 - protein, 24 aa, Cryptosporidium parvum
EPHPFAIAEWTYRRMLKDNRSQSI

SEQ ID NO: 2291408 - protein, 19 aa, Cryptosporidium parvum
EPIELDCNTPLPAPPSPRY

SEQ ID NO: 2291409 - protein, 24 aa, Cryptosporidium parvum
EPIKSLRIGIDYPVYDDDEEINIQ

SEQ ID NO: 2291410 - protein, 19 aa, Cryptosporidium parvum
EPKKILSITLIYNLQNALR

SEQ ID NO: 2291411 - protein, 32 aa, Cryptosporidium parvum; identical to SEQ ID NO: 2170409

SEQ ID NO: 2291412 - protein, 19 aa, Cryptosporidium parvum
EPLFKRIVNKEEKTFEELK

SEQ ID NO: 2291413 - protein, 26 aa, Cryptosporidium parvum
EPLKLGYSFCFGRPSKAILCNLAPSE

SEQ ID NO: 2291414 - protein, 22 aa, Cryptosporidium parvum
EPMKMRLLLDESKLKACISSVR

SEQ ID NO: 2291415 - protein, 18 aa, Cryptosporidium parvum
EPNFKMQSEEPINVNSEN

SEQ ID NO: 2291416 - protein, 25 aa, Cryptosporidium parvum
EPNIYLLERIVYFIPNELVYKTFNE

SEQ ID NO: 2291417 - protein, 18 aa, Cryptosporidium parvum
EPPAKRVRVVNNRTKNTI

SEQ ID NO: 2291418 - protein, 23 aa, Cryptosporidium parvum
EPPIKEFMCKSGNDYFERVNPAK

SEQ ID NO: 2291419 - protein, 22 aa, Cryptosporidium parvum
EPPTCGSIWCGTRQVDHAVTLI

SEQ ID NO: 2291420 - protein, 25 aa, Cryptosporidium parvum
EPSCGKSQLLRFVMSIAPLAISTTG

SEQ ID NO: 2291421 - protein, 25 aa, Cryptosporidium parvum
EPSVIFRRFLEDLARNSHLGGESIV

SEQ ID NO: 2291422 - protein, 18 aa, Cryptosporidium parvum
EPTNLMMTKNLFKSTNNL

SEQ ID NO: 2291423 - protein, 17 aa, Cryptosporidium parvum
EPVDFSMLSKLVLESSL

SEQ ID NO: 2291424 - protein, 23 aa, Cryptosporidium parvum
EPVHRLEWHSGGNGLLLSSSLDG

SEQ ID NO: 2291425 - protein, 19 aa, Cryptosporidium parvum
EPVVIHFSKTISRNRRVKY

SEQ ID NO: 2291426 - protein, 21 aa, Cryptosporidium parvum
EPYLEICNYISDILQVRLNSD

SEQ ID NO: 2291427 - protein, 24 aa, Cryptosporidium parvum
EPYLSTPFYMGIKVKDMLNQSKNL

SEQ ID NO: 2291428 - protein, 18 aa, Cryptosporidium parvum
EQDLKDFFSKVGEIKKLE

SEQ ID NO: 2291429 - protein, 23 aa, Cryptosporidium parvum
EQEFKRLAELLGRDIKMTNRGNS

SEQ ID NO: 2291430 - protein, 19 aa, Cryptosporidium parvum
EQEKHYNSHFGQYEGNNFS

SEQ ID NO: 2291431 - protein, 22 aa, Cryptosporidium parvum
EQEKPRLIIHKIVLENFKSYGG

SEQ ID NO: 2291432 - protein, 22 aa, Cryptosporidium parvum
EQEKSFIFELLYIKRKLSLVLD

SEQ ID NO: 2291433 - protein, 25 aa, Cryptosporidium parvum
EQELRLNILGILGVLMKYYPNVYWE

SEQ ID NO: 2291434 - protein, 20 aa, Cryptosporidium parvum
EQESLCKAAFKVFDLDMDGR

SEQ ID NO: 2291435 - protein, 24 aa, Cryptosporidium parvum
EQEVPLKFLFPTDRVANISFEAFI

SEQ ID NO: 2291436 - protein, 24 aa, Cryptosporidium parvum
EQFCKAAVLYSDFYQFALGENFVC

SEQ ID NO: 2291437 - protein, 18 aa, Cryptosporidium parvum
EQFEQFWAILNKESIDTH

SEQ ID NO: 2291438 - protein, 17 aa, Cryptosporidium parvum
EQFKVTPSFHIKDLQVE

SEQ ID NO: 2291439 - protein, 23 aa, Cryptosporidium parvum
EQFMCPICLGAFVDPCTLSCSHS

SEQ ID NO: 2291440 - protein, 18 aa, Cryptosporidium parvum
EQFSESGLEAMLEEELLK

SEQ ID NO: 2291441 - protein, 25 aa, Cryptosporidium parvum
EQGIVPGGGSALLWASRNLGKLYSQ

SEQ ID NO: 2291442 - protein, 22 aa, Cryptosporidium parvum
EQGVFRACCPSGASTGIYEAKE

SEQ ID NO: 2291443 - protein, 20 aa, Cryptosporidium parvum
EQIPDCKSSKCEIFNVIIGK

SEQ ID NO: 2291444 - protein, 19 aa, Cryptosporidium parvum
EQKRTGKIRKIKKIIQNKT

SEQ ID NO: 2291445 - protein, 26 aa, Cryptosporidium parvum
EQLFWEVDSAYPLREFQFGVMNEQTV

SEQ ID NO: 2291446 - protein, 19 aa, Cryptosporidium parvum
EQLKEWGVEHLIGSSFLKA

SEQ ID NO: 2291447 - protein, 32 aa, Cryptosporidium parvum
EQLKRGEIIFSDFISQGILEWIDVNEENNLLI

SEQ ID NO: 2291448 - protein, 19 aa, Cryptosporidium parvum
EQLNISRTMLASMGSPSSD

SEQ ID NO: 2291449 - protein, 17 aa, Cryptosporidium parvum
EQLPKGDYDEIISRHYS

SEQ ID NO: 2291450 - protein, 17 aa, Cryptosporidium parvum
EQLSLWKSLWTDANSFD

SEQ ID NO: 2291451 - protein, 20 aa, Cryptosporidium parvum
EQLYCEFETLILSIGDKGPF

SEQ ID NO: 2291452 - protein, 17 aa, Cryptosporidium parvum
EQMKLFLKELENHVEEE

SEQ ID NO: 2291453 - protein, 25 aa, Cryptosporidium parvum
EQNKNEIIGGLGLESSVISMNNGFG

SEQ ID NO: 2291454 - protein, 25 aa, Cryptosporidium parvum
EQPCASVFYPCMQCADIFQLKADIC

SEQ ID NO: 2291455 - protein, 23 aa, Cryptosporidium parvum
EQPTGYECLLCFLQDASNGLLQI

SEQ ID NO: 2291456 - protein, 22 aa, Cryptosporidium parvum
EQSFPWHLEIPFPSEEEDLSTI

SEQ ID NO: 2291457 - protein, 21 aa, Cryptosporidium parvum
EQSIRFLFEGERLRPEMTAED

SEQ ID NO: 2291458 - protein, 20 aa, Cryptosporidium parvum
EQSKIPLLVFPYGSTSTGFA

SEQ ID NO: 2291459 - protein, 24 aa, Cryptosporidium parvum
EQSVKFRLAIQSDKPSFTFNSNIC

SEQ ID NO: 2291460 - protein, 22 aa, Cryptosporidium parvum
EQTCKVPLFIQERICADEISFS

SEQ ID NO: 2291461 - protein, 25 aa, Cryptosporidium parvum
EQTIENLWMIYGIKMYLQDMICEII

SEQ ID NO: 2291462 - protein, 20 aa, Cryptosporidium parvum
EQTIKLFLIPGIDENTPLEP

SEQ ID NO: 2291463 - protein, 24 aa, Cryptosporidium parvum
EQTKKRPSDVAKEEQSKKVCTETS

SEQ ID NO: 2291464 - protein, 20 aa, Cryptosporidium parvum
EQVYDFKTKYILEVNNSLKG

SEQ ID NO: 2291465 - protein, 25 aa, Cryptosporidium parvum
EQYYFNLKGGMMFGTSKKDGSTLEV

SEQ ID NO: 2291466 - protein, 18 aa, Cryptosporidium parvum
ERACNNCNCGRADLEKEI

SEQ ID NO: 2291467 - protein, 17 aa, Cryptosporidium parvum
ERAFLRVMEKYEAGEIT

SEQ ID NO: 2291468 - protein, 18 aa, Cryptosporidium parvum
ERAKESSLRRLDRTLLLI

SEQ ID NO: 2291469 - protein, 22 aa, Cryptosporidium parvum
ERAKMMLKLSVDIVNKQNITKK

SEQ ID NO: 2291470 - protein, 24 aa, Cryptosporidium parvum
ERANLKLQLDFAIIQQGRLKGQSS

SEQ ID NO: 2291471 - protein, 25 aa, Cryptosporidium parvum
ERARASAPCIVFFDELDSLCAARSS

SEQ ID NO: 2291472 - protein, 26 aa, Cryptosporidium parvum
ERATPVNRLRFGILERKKDYKIRAKR

SEQ ID NO: 2291473 - protein, 26 aa, Cryptosporidium parvum
ERAVITFKALVKFYRDSLYSVDYNHD

SEQ ID NO: 2291474 - protein, 22 aa, Cryptosporidium parvum
EREIYIAKLLLHLEEQRDAIKH

SEQ ID NO: 2291475 - protein, 25 aa, Cryptosporidium parvum
EREYYKWDYIILLTTRYISPDSNTI

SEQ ID NO: 2291476 - protein, 24 aa, Cryptosporidium parvum
EREYYNGLYLQQWFEWLKQTGQVK

SEQ ID NO: 2291477 - protein, 17 aa, Cryptosporidium parvum
ERFDCPWFFSTLLTIIL

SEQ ID NO: 2291478 - protein, 21 aa, Cryptosporidium parvum
ERFISEFGISRFLNFGFTTTP

SEQ ID NO: 2291479 - protein, 24 aa, Cryptosporidium parvum
ERFLFFRRYLLKGATKVIFCGPPI

SEQ ID NO: 2291480 - protein, 19 aa, Cryptosporidium parvum
ERFLLKEIFQSCIESILVG

SEQ ID NO: 2291481 - protein, 22 aa, Cryptosporidium parvum
ERFNEVKLYFDFDHSNLAKTQN

SEQ ID NO: 2291482 - protein, 24 aa, Cryptosporidium parvum
ERFQRCLRLTFNETVMKNPQWFKL

SEQ ID NO: 2291483 - protein, 25 aa, Cryptosporidium parvum
ERFRCPEALFQPGFLGKEAVGIGET

SEQ ID NO: 2291484 - protein, 32 aa, Cryptosporidium parvum
ERFYQIIRIMRICTYFIIRGREDFVFPAAHQN

SEQ ID NO: 2291485 - protein, 20 aa, Cryptosporidium parvum
ERHKLPLSIYPNGSYSTIKD

SEQ ID NO: 2291486 - protein, 18 aa, Cryptosporidium parvum
ERICKSIINGLELVIIPD

SEQ ID NO: 2291487 - protein, 29 aa, Cryptosporidium parvum
ERIDGNVLWYSSIGISWCYINRYIELLDY

SEQ ID NO: 2291488 - protein, 17 aa, Cryptosporidium parvum
ERIEGIYLSSSSLIQHV

SEQ ID NO: 2291489 - protein, 17 aa, Cryptosporidium parvum
ERIHKFKVIPEVLSTSN

SEQ ID NO: 2291490 - protein, 23 aa, Cryptosporidium parvum
ERINDAFEFFSISALIDDQVLCL

SEQ ID NO: 2291491 - protein, 21 aa, Cryptosporidium parvum
ERINNLWLPRKNKTTQFDKDR

SEQ ID NO: 2291492 - protein, 31 aa, Cryptosporidium parvum
ERIYRIGNIHPNLRGLSSIIINNINDNNINK

SEQ ID NO: 2291493 - protein, 20 aa, Cryptosporidium parvum
ERKENIEIIKDSNITDKKVD

SEQ ID NO: 2291494 - protein, 21 aa, Cryptosporidium parvum
ERKEREKLERQCYWMQEENKT

SEQ ID NO: 2291495 - protein, 22 aa, Cryptosporidium parvum
ERKHLIAHLIEIYKIKRIEADS

SEQ ID NO: 2291496 - protein, 27 aa, Cryptosporidium parvum
ERKKKLGGLVLQCPYKSIKHAAESLAG

SEQ ID NO: 2291497 - protein, 21 aa, Cryptosporidium parvum
ERKKLVYYEALFNKLENDVVL

SEQ ID NO: 2291498 - protein, 20 aa, Cryptosporidium parvum
ERLEKLGFSQGVWNFDPIQP

SEQ ID NO: 2291499 - protein, 23 aa, Cryptosporidium parvum
ERLGECINNFFTPLIQIIHYWGG

SEQ ID NO: 2291500 - protein, 17 aa, Cryptosporidium parvum
ERLIPPRMSPLLRSQRQ

SEQ ID NO: 2291501 - protein, 24 aa, Cryptosporidium parvum
ERLKCKPFSWYVDKFRASFDRGGL

SEQ ID NO: 2291502 - protein, 21 aa, Cryptosporidium parvum
ERLKFSASIFHHIQLQKESII

SEQ ID NO: 2291503 - protein, 23 aa, Cryptosporidium parvum
ERLKRKLLIRSECLRSMRVSVRW

SEQ ID NO: 2291504 - protein, 23 aa, Cryptosporidium parvum
ERLKRSDFLNLSFYIQVIEGGAC

SEQ ID NO: 2291505 - protein, 20 aa, Cryptosporidium parvum
ERLLSYFSRDLFEMELRSKF

SEQ ID NO: 2291506 - protein, 18 aa, Cryptosporidium parvum
ERLLTCNKYIGLLQGIAY

SEQ ID NO: 2291507 - protein, 24 aa, Cryptosporidium parvum
ERLNEIISMRLSYNQDLISLQSTL

SEQ ID NO: 2291508 - protein, 19 aa, Cryptosporidium parvum
ERLRRLALESIDLSKDPYY

SEQ ID NO: 2291509 - protein, 17 aa, Cryptosporidium parvum
ERLRYVKSYSESYADCI

SEQ ID NO: 2291510 - protein, 17 aa, Cryptosporidium parvum
ERMCKAVGYSSAGTVEF

SEQ ID NO: 2291511 - protein, 19 aa, Cryptosporidium parvum
ERMEMAKQLGIDVSKENLK

SEQ ID NO: 2291512 - protein, 18 aa, Cryptosporidium parvum
ERMLKEERYRLIINQEEM

SEQ ID NO: 2291513 - protein, 20 aa, Cryptosporidium parvum
ERMNSGFLGFGRKPSNSIFS

SEQ ID NO: 2291514 - protein, 17 aa, Cryptosporidium parvum
ERMPPCFIYQKYGVCVD

SEQ ID NO: 2291515 - protein, 19 aa, Cryptosporidium parvum
ERMRMDEVLGHLKHILDKY

SEQ ID NO: 2291516 - protein, 25 aa, Cryptosporidium parvum
ERMVYEIFSVGGYCCDLMVSSFKNI

SEQ ID NO: 2291517 - protein, 24 aa, Cryptosporidium parvum
ERNEIRIRLSLPRSVLMEVSDFSL

SEQ ID NO: 2291518 - protein, 22 aa, Cryptosporidium parvum
ERNIVCLSQLYLIQHIFDTNLT

SEQ ID NO: 2291519 - protein, 25 aa, Cryptosporidium parvum
ERQIRNCLYNWKYKSQLERELSLQK

SEQ ID NO: 2291520 - protein, 20 aa, Cryptosporidium parvum
ERQLIPKKVWLIVRDLPSKS

SEQ ID NO: 2291521 - protein, 20 aa, Cryptosporidium parvum
ERRFGWYRRCMKEYEQQFGE

SEQ ID NO: 2291522 - protein, 26 aa, Cryptosporidium parvum
ERSDEILWYLPQLCEISLNRFEKSSL

SEQ ID NO: 2291523 - protein, 21 aa, Cryptosporidium parvum
ERTWFLRRNFHSVIIDEAHRI

SEQ ID NO: 2291524 - protein, 25 aa, Cryptosporidium parvum
ERVKDFKKDIDVLGELYKISNIITG

SEQ ID NO: 2291525 - protein, 25 aa, Cryptosporidium parvum
ERVPFPRVYHSAALCTEGPAAGMTV

SEQ ID NO: 2291526 - protein, 24 aa, Cryptosporidium parvum
ERVSTCDKYKSALNKSIKTMKKLY

SEQ ID NO: 2291527 - protein, 23 aa, Cryptosporidium parvum
ERVSWKLFKTGICKCCDPDKLIK

SEQ ID NO: 2291528 - protein, 24 aa, Cryptosporidium parvum
ERVTRLTHRVRYVPVTIIAIYKNR

SEQ ID NO: 2291529 - protein, 27 aa, Cryptosporidium parvum
ERYEDCMNCLYLLLPFTLTHGTSQNVS

SEQ ID NO: 2291530 - protein, 26 aa, Cryptosporidium parvum
ERYEEKRAKIRLMRRQTARQKWAKMA

SEQ ID NO: 2291531 - protein, 17 aa, Cryptosporidium parvum
ERYPCFVDALRDLDDAL

SEQ ID NO: 2291532 - protein, 19 aa, Cryptosporidium parvum
ERYRIGGIIGTGQFAEVFY

SEQ ID NO: 2291533 - protein, 26 aa, Cryptosporidium parvum
ERYTGKFLPFKGISWKTIIESLCSPN

SEQ ID NO: 2291534 - protein, 26 aa, Cryptosporidium parvum
ESAEGSRILREFSLGSLAMRRSGNLT

SEQ ID NO: 2291535 - protein, 30 aa, Cryptosporidium parvum
ESAESTKPFGGRFGATGFGSRGGRGGQRGR

SEQ ID NO: 2291536 - protein, 22 aa, Cryptosporidium parvum
ESAKIFSRDILKLRKQMERLSL

SEQ ID NO: 2291537 - protein, 24 aa, Cryptosporidium parvum
ESAKIRYHMCESILGIDQVHTFWE

SEQ ID NO: 2291538 - protein, 19 aa, Cryptosporidium parvum
ESCKQEFMNILNFGELDRD

SEQ ID NO: 2291539 - protein, 25 aa, Cryptosporidium parvum
ESCPSPRSGVQMVLCPNSDRIFIYG

SEQ ID NO: 2291540 - protein, 23 aa, Cryptosporidium parvum
ESCSKMRRKEIINLEDTLKELED

SEQ ID NO: 2291541 - protein, 22 aa, Cryptosporidium parvum
ESCVKVLLKHGADLKLTNDDGL

SEQ ID NO: 2291542 - protein, 28 aa, Cryptosporidium parvum
ESDELEMRLVLYLLKYFAPIWDTKAGNQ

SEQ ID NO: 2291543 - protein, 20 aa, Cryptosporidium parvum
ESDLKCPVSCKIRILDHHDL

SEQ ID NO: 2291544 - protein, 23 aa, Cryptosporidium parvum
ESDSSLSTRGRRKLVKTENGTPV

SEQ ID NO: 2291545 - protein, 25 aa, Cryptosporidium parvum
ESEDDIWELYNLILSGDSVRSVTYR

SEQ ID NO: 2291546 - protein, 26 aa, Cryptosporidium parvum
ESEFKEYRLGQILPVSIHQFFKEKSL

SEQ ID NO: 2291547 - protein, 18 aa, Cryptosporidium parvum
ESEISRVDEEWRTRQTHI

SEQ ID NO: 2291548 - protein, 22 aa, Cryptosporidium parvum
ESELTLSIDISRDFSSNEEEDN

SEQ ID NO: 2291549 - protein, 20 aa, Cryptosporidium parvum
ESEMPLTVEIFIEVLDSEAL

SEQ ID NO: 2291550 - protein, 21 aa, Cryptosporidium parvum
ESENGWVHWYCGLREHYFFIV

SEQ ID NO: 2291551 - protein, 18 aa, Cryptosporidium parvum
ESEPRRNSVADVSYNSSL

SEQ ID NO: 2291552 - protein, 24 aa, Cryptosporidium parvum
ESEYELMKILLLDAKEVSLIVENI

SEQ ID NO: 2291553 - protein, 18 aa, Cryptosporidium parvum
ESFPVYIGSFGHFLAEVI

SEQ ID NO: 2291554 - protein, 20 aa, Cryptosporidium parvum
ESFSGIYPLSPYVERESYDY

SEQ ID NO: 2291555 - protein, 19 aa, Cryptosporidium parvum
ESFVSEFFPSSMVPGTSHK

SEQ ID NO: 2291556 - protein, 36 aa, Cryptosporidium parvum
ESGKQIKCIIFFLTCRSVEFYFKYLSKLFHNHSKNK

SEQ ID NO: 2291557 - protein, 22 aa, Cryptosporidium parvum
ESGLCIKGGIKGEGDSYSNSKL

SEQ ID NO: 2291558 - protein, 23 aa, Cryptosporidium parvum
ESGLPVSFLLLALRCLIQTHLDS

SEQ ID NO: 2291559 - protein, 22 aa, Cryptosporidium parvum
ESGLPYDIILVFMDKTRGTKEE

SEQ ID NO: 2291560 - protein, 27 aa, Cryptosporidium parvum
ESHCSLPNPIIYKWPSNSVCIEDYKLY

SEQ ID NO: 2291561 - protein, 25 aa, Cryptosporidium parvum
ESHTIDLFPCLVHKPKNSKVASNYN

SEQ ID NO: 2291562 - protein, 18 aa, Cryptosporidium parvum
ESIFSQRSEMNFGEISEN

SEQ ID NO: 2291563 - protein, 24 aa, Cryptosporidium parvum
ESIIKFNRLPICIWRTISDFEESS

SEQ ID NO: 2291564 - protein, 18 aa, Cryptosporidium parvum
ESIIYYCVDKIMDEVKNN

SEQ ID NO: 2291565 - protein, 17 aa, Cryptosporidium parvum
ESIKCCEEVLKNEFQDK

SEQ ID NO: 2291566 - protein, 18 aa, Cryptosporidium parvum
ESINLSQIKTCLEMESQE

SEQ ID NO: 2291567 - protein, 19 aa, Cryptosporidium parvum
ESINVYLLRNKQLLLHTFI

SEQ ID NO: 2291568 - protein, 19 aa, Cryptosporidium parvum
ESITMQCRICLTEGEQEDD

SEQ ID NO: 2291569 - protein, 18 aa, Cryptosporidium parvum
ESIYNYYSQIYIPGYLFG

SEQ ID NO: 2291570 - protein, 23 aa, Cryptosporidium parvum
ESKCYRYRIFSLPPRAGASSSEN

SEQ ID NO: 2291571 - protein, 21 aa, Cryptosporidium parvum
ESKDNFCLKSLIKNTNEIYKD

SEQ ID NO: 2291572 - protein, 22 aa, Cryptosporidium parvum
ESKILINIGQRSEFGMNNIQNN

SEQ ID NO: 2291573 - protein, 23 aa, Cryptosporidium parvum
ESKLKYKLHIMKTSLQGLISETG

SEQ ID NO: 2291574 - protein, 28 aa, Cryptosporidium parvum
ESKLNFCCFTGYYYCDYCYGSNTCSILP

SEQ ID NO: 2291575 - protein, 28 aa, Cryptosporidium parvum
ESKLNNSVNCWLIFVYINELLIQILSSN

SEQ ID NO: 2291576 - protein, 24 aa, Cryptosporidium parvum
ESKNPLRLVVMSATLESTKFQSYF

SEQ ID NO: 2291577 - protein, 20 aa, Cryptosporidium parvum
ESKNRIFAIIKGFSFIMRYS

SEQ ID NO: 2291578 - protein, 23 aa, Cryptosporidium parvum
ESKSHLKSIVGLLKSAWNSSERI

SEQ ID NO: 2291579 - protein, 24 aa, Cryptosporidium parvum
ESLARYRIEGIPVNYNLTNKAQDL

SEQ ID NO: 2291580 - protein, 22 aa, Cryptosporidium parvum
ESLCMKKSFPIYESESKSVHEF

SEQ ID NO: 2291581 - protein, 23 aa, Cryptosporidium parvum
ESLKIAEGILRRRKIVDTDRRLK

SEQ ID NO: 2291582 - protein, 23 aa, Cryptosporidium parvum
ESLKRDVENLSIMKKSYDDQSFI

SEQ ID NO: 2291583 - protein, 20 aa, Cryptosporidium parvum
ESLLKPCIEHHNMLQSYKSS

SEQ ID NO: 2291584 - protein, 25 aa, Cryptosporidium parvum
ESLLYLTLHELFIFRTLQTDPNPAN

SEQ ID NO: 2291585 - protein, 19 aa, Cryptosporidium parvum
ESLSVPSFNCISQELLSVD

SEQ ID NO: 2291586 - protein, 24 aa, Cryptosporidium parvum
ESLYLKACKFVSVSQTNNKVIKML

SEQ ID NO: 2291587 - protein, 22 aa, Cryptosporidium parvum
ESLYYWCYKNNIPVFCPGITDG

SEQ ID NO: 2291588 - protein, 23 aa, Cryptosporidium parvum
ESMGGSPAWRCNPEFAQYYLHMA

SEQ ID NO: 2291589 - protein, 26 aa, Cryptosporidium parvum
ESMGRDFVGGGGISRGGGNRDGSDSK

SEQ ID NO: 2291590 - protein, 20 aa, Cryptosporidium parvum
ESNGIFYMHIPKMYENQIQD

SEQ ID NO: 2291591 - protein, 30 aa, Cryptosporidium parvum
ESNKKLLVFLKMRWLSNNVCSIECLSKFAK

SEQ ID NO: 2291592 - protein, 24 aa, Cryptosporidium parvum
ESNKSKMIWSEIGHIVHSNRKPQY

SEQ ID NO: 2291593 - protein, 24 aa, Cryptosporidium parvum
ESNLGRREAILIERERSMDRREAD

SEQ ID NO: 2291594 - protein, 19 aa, Cryptosporidium parvum
ESNLNSIPSLNPFYTQTIN

SEQ ID NO: 2291595 - protein, 33 aa, Cryptosporidium parvum
ESNMYWCDIMQFYLFFCPKCIYLKQSNVPYCPK

SEQ ID NO: 2291596 - protein, 24 aa, Cryptosporidium parvum
ESNSEESIKVFSPKNNYNIPKNSQ

SEQ ID NO: 2291597 - protein, 18 aa, Cryptosporidium parvum
ESNTCEWAFGAMDKNTTV

SEQ ID NO: 2291598 - protein, 25 aa, Cryptosporidium parvum
ESNVPFNIKYAYSLHKLNLNEDAAS

SEQ ID NO: 2291599 - protein, 23 aa, Cryptosporidium parvum
ESPDVLKAIGYCHTSSFYTVKSL

SEQ ID NO: 2291600 - protein, 26 aa, Cryptosporidium parvum
ESPYSKLKSWGIKTLLLKSSDDLRQE

SEQ ID NO: 2291601 - protein, 23 aa, Cryptosporidium parvum
ESQRECVRRGYSACLSIVLDRYK

SEQ ID NO: 2291602 - protein, 17 aa, Cryptosporidium parvum
ESQRVWLEYSLKRQQAQ

SEQ ID NO: 2291603 - protein, 24 aa, Cryptosporidium parvum
ESQYKLDKAVSMIQPLLDPFHPLH

SEQ ID NO: 2291604 - protein, 24 aa, Cryptosporidium parvum
ESRAEIVHGVLFIDEVHMLDVECF

SEQ ID NO: 2291605 - protein, 25 aa, Cryptosporidium parvum
ESRDGFSKTAIREIVLLTNLKHENI

SEQ ID NO: 2291606 - protein, 21 aa, Cryptosporidium parvum
ESRHFDWPNIVTIHQGMHEVF

SEQ ID NO: 2291607 - protein, 20 aa, Cryptosporidium parvum
ESRLEIPSEWFLHTGREYST

SEQ ID NO: 2291608 - protein, 21 aa, Cryptosporidium parvum
ESRLFPVGFKKEFCTFLEKPQ

SEQ ID NO: 2291609 - protein, 20 aa, Cryptosporidium parvum
ESRLKNTPLLIIPFKDTEYY

SEQ ID NO: 2291610 - protein, 22 aa, Cryptosporidium parvum
ESRLNIPSVNFTGGVSSSSISV

SEQ ID NO: 2291611 - protein, 22 aa, Cryptosporidium parvum
ESSCSSSIWVRFNDTKVYLSKE

SEQ ID NO: 2291612 - protein, 17 aa, Cryptosporidium parvum
ESSEFIDAMSFDLQEYI

SEQ ID NO: 2291613 - protein, 18 aa, Cryptosporidium parvum
ESSGNILQSLKCTMYLIN

SEQ ID NO: 2291614 - protein, 17 aa, Cryptosporidium parvum
ESSIIYYLGHLALAKQC

SEQ ID NO: 2291615 - protein, 23 aa, Cryptosporidium parvum
ESSIPIFQCFAWERGKFSMGGTL

SEQ ID NO: 2291616 - protein, 32 aa, Cryptosporidium parvum
ESSIVGRNWIRRMVYQISSSFVTIPIPRILQG

SEQ ID NO: 2291617 - protein, 19 aa, Cryptosporidium parvum
ESSLICLAQSTLFSGKIKD

SEQ ID NO: 2291618 - protein, 24 aa, Cryptosporidium parvum
ESSSLIKILVCTNYYIILLNIIKN

SEQ ID NO: 2291619 - protein, 21 aa, Cryptosporidium parvum
ESTLHLVLRLRGGVIEPSLAN

SEQ ID NO: 2291620 - protein, 21 aa, Cryptosporidium parvum
ESTTPRCLQKFQPLSNYLSLI

SEQ ID NO: 2291621 - protein, 18 aa, Cryptosporidium parvum
ESVCINREILKQTKIGVV

SEQ ID NO: 2291622 - protein, 17 aa, Cryptosporidium parvum
ESVHITVRMRPEKLQQA

SEQ ID NO: 2291623 - protein, 24 aa, Cryptosporidium parvum
ESVNFPFRNDRLIKQCENINSSNA

SEQ ID NO: 2291624 - protein, 25 aa, Cryptosporidium parvum
ESVSIPARHAFRIIGEIMPVLDDVV

SEQ ID NO: 2291625 - protein, 17 aa, Cryptosporidium parvum
ESWKYLCNWEKTNHNNI

SEQ ID NO: 2291626 - protein, 26 aa, Cryptosporidium parvum
ESYFILNFILCKSYYLLNIVGNYHQV

SEQ ID NO: 2291627 - protein, 17 aa, Cryptosporidium parvum
ESYLKNTILDRSKPFSL

SEQ ID NO: 2291628 - protein, 19 aa, Cryptosporidium parvum
ESYNIFPTYNFLLENKEKV

SEQ ID NO: 2291629 - protein, 19 aa, Cryptosporidium parvum
ETAQWRYLRNTLENNQNNI

SEQ ID NO: 2291630 - protein, 20 aa, Cryptosporidium parvum
ETAYIKLGFKAAAHSDDGKP

SEQ ID NO: 2291631 - protein, 23 aa, Cryptosporidium parvum
ETDKRLKIYFPLPPLDKYNDSCA

SEQ ID NO: 2291632 - protein, 33 aa, Cryptosporidium parvum
ETFEFLNILQVHGFPRVLGVLTHLDKIEDNKTV

SEQ ID NO: 2291633 - protein, 29 aa, Cryptosporidium parvum
ETFLPKDSRLVIYGKFKDNPLVSLIGEVP

SEQ ID NO: 2291634 - protein, 21 aa, Cryptosporidium parvum
ETGIIRPGMNVTFAPAGVTTE

SEQ ID NO: 2291635 - protein, 17 aa, Cryptosporidium parvum
ETIASSCGVGFARVLIE

SEQ ID NO: 2291636 - protein, 21 aa, Cryptosporidium parvum
ETILDWQFKVPPKRGSQLYQL

SEQ ID NO: 2291637 - protein, 28 aa, Cryptosporidium parvum
ETIVLDGCIKDIVFAGSLFVPNYTSVYK

SEQ ID NO: 2291638 - protein, 18 aa, Cryptosporidium parvum
ETKDIPCLRKFDTCIKGG

SEQ ID NO: 2291639 - protein, 19 aa, Cryptosporidium parvum
ETKETFVIISADNKVRTIL

SEQ ID NO: 2291640 - protein, 19 aa, Cryptosporidium parvum
ETKIVTSIDNFVIVWDFEA

SEQ ID NO: 2291641 - protein, 27 aa, Cryptosporidium parvum
ETKKISRFLICLVITDRPMECFKKRCY

SEQ ID NO: 2291642 - protein, 22 aa, Cryptosporidium parvum
ETKKRYNLEYKKFIQGIEELSK

SEQ ID NO: 2291643 - protein, 29 aa, Cryptosporidium parvum
ETKLNEFKSFASSFGFISFLADLRNENER

SEQ ID NO: 2291644 - protein, 30 aa, Cryptosporidium parvum
ETKLSRPWVFCPNIKCIKRAKSSGKLKGRI

SEQ ID NO: 2291645 - protein, 24 aa, Cryptosporidium parvum
ETKPEKLNSFWLGFMSNKNTSNSA

SEQ ID NO: 2291646 - protein, 21 aa, Cryptosporidium parvum
ETLCCKLAYFKTIDDFEECKK

SEQ ID NO: 2291647 - protein, 44 aa, Cryptosporidium parvum; identical to SEQ ID NO: 2170632

SEQ ID NO: 2291648 - protein, 28 aa, Cryptosporidium parvum
ETLELFDIPPVRVCIQILSAHQLPDNLS

SEQ ID NO: 2291649 - protein, 24 aa, Cryptosporidium parvum
ETLKFLEKVRVIWKHDNEFKHECL

SEQ ID NO: 2291650 - protein, 25 aa, Cryptosporidium parvum
ETLKSVGIYVCRRCFFQGKDDEYSK

SEQ ID NO: 2291651 - protein, 19 aa, Cryptosporidium parvum
ETLKSWKYVNYDFDEELEM

SEQ ID NO: 2291652 - protein, 24 aa, Cryptosporidium parvum
ETLMTELGCGYECEDSQITYFENL

SEQ ID NO: 2291653 - protein, 19 aa, Cryptosporidium parvum
ETLPLKFPWVNKSCTYIFP

SEQ ID NO: 2291654 - protein, 20 aa, Cryptosporidium parvum
ETLPRPNIDFNQTHKMLDPF

SEQ ID NO: 2291655 - protein, 19 aa, Cryptosporidium parvum
ETLREIFRLSKLRKQLKEF

SEQ ID NO: 2291656 - protein, 20 aa, Cryptosporidium parvum
ETLRFWQIFPTGRPKGPKNL

SEQ ID NO: 2291657 - protein, 17 aa, Cryptosporidium parvum
ETLSWDDIYSLFESSLR

SEQ ID NO: 2291658 - protein, 21 aa, Cryptosporidium parvum
ETLSWRYNIQKNIGICKQEIG

SEQ ID NO: 2291659 - protein, 38 aa, Cryptosporidium parvum; identical to SEQ ID NO: 2170645

SEQ ID NO: 2291660 - protein, 23 aa, Cryptosporidium parvum
ETNNFLSCIGKLDDEFIHLLFQF

SEQ ID NO: 2291661 - protein, 23 aa, Cryptosporidium parvum
ETNRLRHVTKFYSYLLSKDAIPW

SEQ ID NO: 2291662 - protein, 21 aa, Cryptosporidium parvum
ETPQKCPLCNSNRVFEFQIQP

SEQ ID NO: 2291663 - protein, 17 aa, Cryptosporidium parvum
ETPRLYCSLGDLTQDLS

SEQ ID NO: 2291664 - protein, 24 aa, Cryptosporidium parvum
ETQPKRWMIMFSRAQSSSSRDSKD

SEQ ID NO: 2291665 - protein, 23 aa, Cryptosporidium parvum
ETQRRWIYLQGIFLASTDIANLL

SEQ ID NO: 2291666 - protein, 34 aa, Cryptosporidium parvum
ETQVECLNLSKSMCLKCVESLYGILNISLKQSRI

SEQ ID NO: 2291667 - protein, 21 aa, Cryptosporidium parvum
ETRICKIYDSPNLPEGDATFS

SEQ ID NO: 2291668 - protein, 17 aa, Cryptosporidium parvum
ETRMCINKMSVCTGKKS

SEQ ID NO: 2291669 - protein, 19 aa, Cryptosporidium parvum
ETSINIFGFENFGFESSEI

SEQ ID NO: 2291670 - protein, 24 aa, Cryptosporidium parvum
ETSKHVLKYLSYVSNRQRMKNATN

SEQ ID NO: 2291671 - protein, 18 aa, Cryptosporidium parvum
ETSMLHFAYIINTKIRLQ

SEQ ID NO: 2291672 - protein, 17 aa, Cryptosporidium parvum
ETTCMKCPFNSESKLCQ

SEQ ID NO: 2291673 - protein, 17 aa, Cryptosporidium parvum
ETTPLLLRVDGLVGLLA

SEQ ID NO: 2291674 - protein, 25 aa, Cryptosporidium parvum
ETVPESISLPISETVSTTLSAPKQV

SEQ ID NO: 2291675 - protein, 18 aa, Cryptosporidium parvum
ETVRRYRDNYSQLRQLFE

SEQ ID NO: 2291676 - protein, 17 aa, Cryptosporidium parvum
ETYGEVCPANWKKGQKG

SEQ ID NO: 2291677 - protein, 19 aa, Cryptosporidium parvum
ETYLGRGVKHAVITVPAYF

SEQ ID NO: 2291678 - protein, 19 aa, Cryptosporidium parvum
ETYRIGPFPSSSMSNSKLN

SEQ ID NO: 2291679 - protein, 19 aa, Cryptosporidium parvum
EVAQYCIKRLQEANEAYIP

SEQ ID NO: 2291680 - protein, 18 aa, Cryptosporidium parvum
EVCPANWKKGQKGMSATH

SEQ ID NO: 2291681 - protein, 25 aa, Cryptosporidium parvum
EVDDELRQALLLSIQDFSGNDSTNN

SEQ ID NO: 2291682 - protein, 25 aa, Cryptosporidium parvum
EVDLRKCDVWNLGVLLHCLLVGVPP

SEQ ID NO: 2291683 - protein, 24 aa, Cryptosporidium parvum
EVDRLGPTAFEWILGEIEHQFYRS

SEQ ID NO: 2291684 - protein, 31 aa, Cryptosporidium parvum; identical to SEQ ID NO: 2170667

SEQ ID NO: 2291685 - protein, 37 aa, Cryptosporidium parvum; identical to SEQ ID NO: 2170668

SEQ ID NO: 2291686 - protein, 17 aa, Cryptosporidium parvum
EVECILKKAGVRVKIDD

SEQ ID NO: 2291687 - protein, 26 aa, Cryptosporidium parvum
EVEIKIKLIDSMPFDRFVCVFKTLDE

SEQ ID NO: 2291688 - protein, 18 aa, Cryptosporidium parvum
EVENTDLLVRLNDYKENQ

SEQ ID NO: 2291689 - protein, 24 aa, Cryptosporidium parvum
EVEVMVGVLMSWISELVEESKDVH

SEQ ID NO: 2291690 - protein, 20 aa, Cryptosporidium parvum
EVFARAILNGQVFKEFKNQR

SEQ ID NO: 2291691 - protein, 23 aa, Cryptosporidium parvum
EVFNKWYYPIRIILFHGKGESER

SEQ ID NO: 2291692 - protein, 19 aa, Cryptosporidium parvum
EVFPYLSCFFAVKHNSFSQ

SEQ ID NO: 2291693 - protein, 25 aa, Cryptosporidium parvum
EVFSRKKCIWRPCEELAKNNLTEMG

SEQ ID NO: 2291694 - protein, 17 aa, Cryptosporidium parvum
EVFSVFVSKAIERALLP

SEQ ID NO: 2291695 - protein, 19 aa, Cryptosporidium parvum
EVGIKVWILDGGECCSVGV

SEQ ID NO: 2291696 - protein, 28 aa, Cryptosporidium parvum
EVGISGICWFCQIMVLKVLDSKIRGFLS

SEQ ID NO: 2291697 - protein, 18 aa, Cryptosporidium parvum
EVGKSIGKKEQRKNLEAF

SEQ ID NO: 2291698 - protein, 24 aa, Cryptosporidium parvum
EVHKEVIELISFTIYRQANGPAAG

SEQ ID NO: 2291699 - protein, 24 aa, Cryptosporidium parvum
EVHLFKCRSEFIFIECFKNNSMFN

SEQ ID NO: 2291700 - protein, 21 aa, Cryptosporidium parvum
EVIAGSSGFGCNFDGDPEIIE

SEQ ID NO: 2291701 - protein, 25 aa, Cryptosporidium parvum
EVIASIAIKFCARIPDKDELHPGTG

SEQ ID NO: 2291702 - protein, 30 aa, Cryptosporidium parvum; identical to SEQ ID NO: 2170683

SEQ ID NO: 2291703 - protein, 20 aa, Cryptosporidium parvum
EVIFDPKLIMRDVQPVHELI

SEQ ID NO: 2291704 - protein, 20 aa, Cryptosporidium parvum
EVIHFKDPIPILKDTSLVEW

SEQ ID NO: 2291705 - protein, 25 aa, Cryptosporidium parvum
EVINSPWLFFSIRILDGYDTFCSDF

SEQ ID NO: 2291706 - protein, 20 aa, Cryptosporidium parvum
EVIRGELLLVIRNVPGKQEV

SEQ ID NO: 2291707 - protein, 18 aa, Cryptosporidium parvum
EVIRLFKAVNTDSIDVVS

SEQ ID NO: 2291708 - protein, 18 aa, Cryptosporidium parvum
EVKCVDWSPFNNFVAACC

SEQ ID NO: 2291709 - protein, 23 aa, Cryptosporidium parvum
EVKERLVFCLNNLLLYISSQNNN

SEQ ID NO: 2291710 - protein, 20 aa, Cryptosporidium parvum
EVKPVIKREITIVNVTLLEV

SEQ ID NO: 2291711 - protein, 18 aa, Cryptosporidium parvum
EVLCCKKGACWANKIGLS

SEQ ID NO: 2291712 - protein, 29 aa, Cryptosporidium parvum
EVLDRMLPKLIRFRHKVLIFCQMTQLMDI

SEQ ID NO: 2291713 - protein, 20 aa, Cryptosporidium parvum
EVLESRSLVWVKHPKLAWAP

SEQ ID NO: 2291714 - protein, 24 aa, Cryptosporidium parvum
EVLLGFNCTIFAYGQTGTGKTYTM

SEQ ID NO: 2291715 - protein, 27 aa, Cryptosporidium parvum
EVLMLTSFSGGFGFMGGAVMEPEEPRK

SEQ ID NO: 2291716 - protein, 24 aa, Cryptosporidium parvum
EVNKHCILQFFGILDLNNSLNNMK

SEQ ID NO: 2291717 - protein, 26 aa, Cryptosporidium parvum
EVNLLKKLRGCPHVIQLIDSEIALSC

SEQ ID NO: 2291718 - protein, 28 aa, Cryptosporidium parvum
EVNLLTKWMGCPPLPFKLDDKETGNLEK

SEQ ID NO: 2291719 - protein, 20 aa, Cryptosporidium parvum
EVPDIPRNIAIADYVEQILF

SEQ ID NO: 2291720 - protein, 18 aa, Cryptosporidium parvum
EVPLELSSFANSYRLAGY

SEQ ID NO: 2291721 - protein, 19 aa, Cryptosporidium parvum
EVPTGWKYFGNLMDAKMID

SEQ ID NO: 2291722 - protein, 17 aa, Cryptosporidium parvum
EVRECKTHDQIIRLTKK

SEQ ID NO: 2291723 - protein, 24 aa, Cryptosporidium parvum
EVREDLKDGISLISRELVNKLTNN

SEQ ID NO: 2291724 - protein, 17 aa, Cryptosporidium parvum
EVRKGLYSYQQRKVSEW

SEQ ID NO: 2291725 - protein, 25 aa, Cryptosporidium parvum
EVRNPHYWRYIGIIKLYKKVQGLLS

SEQ ID NO: 2291726 - protein, 17 aa, Cryptosporidium parvum
EVRSRVILTDGLELKNE

SEQ ID NO: 2291727 - protein, 17 aa, Cryptosporidium parvum
EVSDNYLALYLVLTDTG

SEQ ID NO: 2291728 - protein, 27 aa, Cryptosporidium parvum
EVSELWKIRFGIEVDIIQLFKMAGLYE

SEQ ID NO: 2291729 - protein, 17 aa, Cryptosporidium parvum
EVSHILEVWRIFMPFGC

SEQ ID NO: 2291730 - protein, 31 aa, Cryptosporidium parvum; identical to SEQ ID NO: 2170709

SEQ ID NO: 2291731 - protein, 27 aa, Cryptosporidium parvum
EVSIRRMAYCIGVALSRLHELGIVHRD

SEQ ID NO: 2291732 - protein, 25 aa, Cryptosporidium parvum
EVTDICFDLNMTLFLAWSPKEAGHI

SEQ ID NO: 2291733 - protein, 21 aa, Cryptosporidium parvum
EVTHSPILVKIKFLDSAEISS

SEQ ID NO: 2291734 - protein, 20 aa, Cryptosporidium parvum
EVTIFFSLKFYSEDEARDLK

SEQ ID NO: 2291735 - protein, 17 aa, Cryptosporidium parvum
EVTLRFRKRERLLSAGV

SEQ ID NO: 2291736 - protein, 21 aa, Cryptosporidium parvum
EVVEISSKITMGASEGGEGGF

SEQ ID NO: 2291737 - protein, 22 aa, Cryptosporidium parvum
EVVFKLPLEVGSNMAGGQLHIR

SEQ ID NO: 2291738 - protein, 19 aa, Cryptosporidium parvum
EVVGPPGANIFIFNVPYEW

SEQ ID NO: 2291739 - protein, 19 aa, Cryptosporidium parvum
EVVRPGIYRNYGVQLDFKQ

SEQ ID NO: 2291740 - protein, 21 aa, Cryptosporidium parvum
EVYAYRLLRHPNICSYIGVCL

SEQ ID NO: 2291741 - protein, 33 aa, Cryptosporidium parvum; identical to SEQ ID NO: 2170722

SEQ ID NO: 2291742 - protein, 18 aa, Cryptosporidium parvum
EVYLSSIIDKFNRLFETI

SEQ ID NO: 2291743 - protein, 29 aa, Cryptosporidium parvum
EVYNGRYLIVSKLGWGHFSTVWLAIDTLS

SEQ ID NO: 2291744 - protein, 23 aa, Cryptosporidium parvum
EVYRLDLESGMFLAPLETNLEYI

SEQ ID NO: 2291745 - protein, 23 aa, Cryptosporidium parvum
EWFKSLFCFECITTLKKTQFKRY

SEQ ID NO: 2291746 - protein, 19 aa, Cryptosporidium parvum
EWIEFAKMALGFDNSNCPY

SEQ ID NO: 2291747 - protein, 22 aa, Cryptosporidium parvum
EWLDEVCFNFGLELDCIEFDEE

SEQ ID NO: 2291748 - protein, 21 aa, Cryptosporidium parvum
EWLDPRVKKTEWSRAEEEKLL

SEQ ID NO: 2291749 - protein, 19 aa, Cryptosporidium parvum
EWLDVISRQGSKLSRTSFN

SEQ ID NO: 2291750 - protein, 18 aa, Cryptosporidium parvum
EWLSITWNTTYNNGLKET

SEQ ID NO: 2291751 - protein, 19 aa, Cryptosporidium parvum
EWMGYLLLYESMLDTVLFC

SEQ ID NO: 2291752 - protein, 29 aa, Cryptosporidium parvum
EWMSKFIPWKRYILFEKSNPLGLDKSHYF

SEQ ID NO: 2291753 - protein, 19 aa, Cryptosporidium parvum
EWQNLMISQAFILSSSISE

SEQ ID NO: 2291754 - protein, 18 aa, Cryptosporidium parvum
EWSNLRFWESAVVGASDS

SEQ ID NO: 2291755 - protein, 19 aa, Cryptosporidium parvum
EWTPKFSLCNNSNINRMVT

SEQ ID NO: 2291756 - protein, 28 aa, Cryptosporidium parvum
EWVMHYWKEIPLPFSFTSIINRIRNNYY

SEQ ID NO: 2291757 - protein, 24 aa, Cryptosporidium parvum
EWYKNCNWYHIYPIGLCGVERINS

SEQ ID NO: 2291758 - protein, 23 aa, Cryptosporidium parvum
EYCKFCIPHGSYLINLGNPDEEK

SEQ ID NO: 2291759 - protein, 21 aa, Cryptosporidium parvum
EYCKKISILSLERMSIVTCAC

SEQ ID NO: 2291760 - protein, 20 aa, Cryptosporidium parvum
EYDREMKLFMEYQSKLRALR

SEQ ID NO: 2291761 - protein, 22 aa, Cryptosporidium parvum
EYDRRGMYGIINRWNHINPCSQ

SEQ ID NO: 2291762 - protein, 27 aa, Cryptosporidium parvum
EYEEIGLKYGKKFRVVKEIYRNETCSI

SEQ ID NO: 2291763 - protein, 20 aa, Cryptosporidium parvum
EYEIKRSLIYETLSGKINLK

SEQ ID NO: 2291764 - protein, 21 aa, Cryptosporidium parvum
EYEIPCQWRKIDNIISQNVGS

SEQ ID NO: 2291765 - protein, 22 aa, Cryptosporidium parvum
EYFEKPLDVWSLCYGVRTKISK

SEQ ID NO: 2291766 - protein, 19 aa, Cryptosporidium parvum
EYFNGTFIDTCRINVQYAF

SEQ ID NO: 2291767 - protein, 24 aa, Cryptosporidium parvum
EYFREIFSSLLLKPFNKTEETTLL

SEQ ID NO: 2291768 - protein, 21 aa, Cryptosporidium parvum
EYFSYCPFSEGLLIDVSMEND

SEQ ID NO: 2291769 - protein, 19 aa, Cryptosporidium parvum
EYGGISLLTFIEEKCSHYN

SEQ ID NO: 2291770 - protein, 25 aa, Cryptosporidium parvum
EYGNLYKYKVDYEILSKQNETLMIE

SEQ ID NO: 2291771 - protein, 25 aa, Cryptosporidium parvum
EYHTRSGFLSSLSRRLWDLEETLSF

SEQ ID NO: 2291772 - protein, 20 aa, Cryptosporidium parvum
EYIFNSREVFGLKLIADDKK

SEQ ID NO: 2291773 - protein, 26 aa, Cryptosporidium parvum
EYIFPLKIYSSNMIKSNHNIMKNLSH

SEQ ID NO: 2291774 - protein, 19 aa, Cryptosporidium parvum
EYIGRKTLVLDLDETLIHS

SEQ ID NO: 2291775 - protein, 19 aa, Cryptosporidium parvum
EYIKALKIDDLIKNLMNPV

SEQ ID NO: 2291776 - protein, 18 aa, Cryptosporidium parvum
EYILPKFMESYLKCDEHK

SEQ ID NO: 2291777 - protein, 24 aa, Cryptosporidium parvum
EYISRVIKCRCLFSTHLHLLCDEF

SEQ ID NO: 2291778 - protein, 24 aa, Cryptosporidium parvum
EYKAGEFSRGYFLGRYEIPKIDEN

SEQ ID NO: 2291779 - protein, 25 aa, Cryptosporidium parvum
EYKNFSIYTLLALRTISSEFKNLDT

SEQ ID NO: 2291780 - protein, 21 aa, Cryptosporidium parvum
EYKNSLFILETFKLPEDTTES

SEQ ID NO: 2291781 - protein, 35 aa, Cryptosporidium parvum
EYKYRCKDCIPCIYCKEPLLRIPVILKPNELPNRS

SEQ ID NO: 2291782 - protein, 20 aa, Cryptosporidium parvum
EYLDKIPLYNVEDALNLLSS

SEQ ID NO: 2291783 - protein, 25 aa, Cryptosporidium parvum
EYLGTWWRTEFNYSPLPYLPPHSTR

SEQ ID NO: 2291784 - protein, 18 aa, Cryptosporidium parvum
EYLICGESKIDLLILKNH

SEQ ID NO: 2291785 - protein, 19 aa, Cryptosporidium parvum
EYLIEGYSVPFPYDAYKCQ

SEQ ID NO: 2291786 - protein, 24 aa, Cryptosporidium parvum
EYLIEIFQGLEIVLRLLERRQKPF

SEQ ID NO: 2291787 - protein, 17 aa, Cryptosporidium parvum
EYLIKWKVPGQPVQPTW

SEQ ID NO: 2291788 - protein, 20 aa, Cryptosporidium parvum
EYLKNYGLMKMFTLTLNDMI

SEQ ID NO: 2291789 - protein, 18 aa, Cryptosporidium parvum
EYLRSWKSGQASIAEIEF

SEQ ID NO: 2291790 - protein, 18 aa, Cryptosporidium parvum
EYLSRVDGIVNFENKLCE

SEQ ID NO: 2291791 - protein, 23 aa, Cryptosporidium parvum
EYNACKLPSLGIKQHNKEEDLNH

SEQ ID NO: 2291792 - protein, 22 aa, Cryptosporidium parvum
EYNLCEIKRVISIAESAISMPE

SEQ ID NO: 2291793 - protein, 26 aa, Cryptosporidium parvum
EYNLFLKLLHRFSQFKFRSIGATEDE

SEQ ID NO: 2291794 - protein, 21 aa, Cryptosporidium parvum
EYNRFLFTKVVEFQKLIDEII

SEQ ID NO: 2291795 - protein, 22 aa, Cryptosporidium parvum
EYNRNCNLLKGPFESKIDSNKA

SEQ ID NO: 2291796 - protein, 30 aa, Cryptosporidium parvum
EYPEFKGIFDLPGSIIIKLDMKKFGGNKPI

SEQ ID NO: 2291797 - protein, 17 aa, Cryptosporidium parvum
EYPKFEDVIVFTSDNVH

SEQ ID NO: 2291798 - protein, 17 aa, Cryptosporidium parvum
EYQIVGVSWLLALHQNS

SEQ ID NO: 2291799 - protein, 19 aa, Cryptosporidium parvum
EYRIREFTEVITPNIFSCD

SEQ ID NO: 2291800 - protein, 19 aa, Cryptosporidium parvum
EYRLLKTVHPRDNPWYKGC

SEQ ID NO: 2291801 - protein, 19 aa, Cryptosporidium parvum
EYRWLHFLHLALIVHLISS

SEQ ID NO: 2291802 - protein, 23 aa, Cryptosporidium parvum
EYSCPDCGKSILENFLMDILEAF

SEQ ID NO: 2291803 - protein, 23 aa, Cryptosporidium parvum
EYSDCSPLSFLTGGGATNFGMDF

SEQ ID NO: 2291804 - protein, 42 aa, Cryptosporidium parvum
EYSTSPCYYYLPRGYERIGNCFNEIRFRRKLDFLKDSVRDNR

SEQ ID NO: 2291805 - protein, 24 aa, Cryptosporidium parvum
EYTRDAFNLYGLRQYFPKNYDSLI

SEQ ID NO: 2291806 - protein, 25 aa, Cryptosporidium parvum
EYTRHQRCCIMFYPPGNELIRQDGL

SEQ ID NO: 2291807 - protein, 25 aa, Cryptosporidium parvum
EYVQEGAVLLGIWNDNTIFLRFEAT

SEQ ID NO: 2291808 - protein, 18 aa, Cryptosporidium parvum
EYYRQPWVPRAIEKYLSC

SEQ ID NO: 2291809 - protein, 20 aa, Cryptosporidium parvum
FAARAKFYFENTFLGEATFD

SEQ ID NO: 2291810 - protein, 23 aa, Cryptosporidium parvum
FACDIAIILSCWLQNKSISTLSR

SEQ ID NO: 2291811 - protein, 17 aa, Cryptosporidium parvum
FADFRAEFISNLSGQVL

SEQ ID NO: 2291812 - protein, 18 aa, Cryptosporidium parvum
FADLRTNQQLAYVVRATQ

SEQ ID NO: 2291813 - protein, 20 aa, Cryptosporidium parvum
FADRFANVINEFIIDIKRIN

SEQ ID NO: 2291814 - protein, 21 aa, Cryptosporidium parvum
FAEFRRAKEMIVLNNLDNGNN

SEQ ID NO: 2291815 - protein, 18 aa, Cryptosporidium parvum
FAELIWRNISELRGWWIK

SEQ ID NO: 2291816 - protein, 17 aa, Cryptosporidium parvum
FAENAWILEILVSLHEG

SEQ ID NO: 2291817 - protein, 23 aa, Cryptosporidium parvum
FAFLKHCRLPFPFDDQRIRPNTQ

SEQ ID NO: 2291818 - protein, 17 aa, Cryptosporidium parvum
FAGSFEIESNFLARWNK

SEQ ID NO: 2291819 - protein, 23 aa, Cryptosporidium parvum
FAIDEAHCISEWGHDFRTAYRRL

SEQ ID NO: 2291820 - protein, 27 aa, Cryptosporidium parvum
FAIDEAHCVCQWGFDFRPDYIQLCKLR

SEQ ID NO: 2291821 - protein, 17 aa, Cryptosporidium parvum
FAIEIGNILTHHYLFYP

SEQ ID NO: 2291822 - protein, 28 aa, Cryptosporidium parvum
FAKLIPFGYNCLTLHSGQDHYDRHSNLT

SEQ ID NO: 2291823 - protein, 25 aa, Cryptosporidium parvum
FAKLSSMHFYGWKKGLKTGIYYLRT

SEQ ID NO: 2291824 - protein, 18 aa, Cryptosporidium parvum
FAKYRRAAILFRDTSLPV

SEQ ID NO: 2291825 - protein, 25 aa, Cryptosporidium parvum
FALKQLKLLILTTMAFAKNGVFQSM

SEQ ID NO: 2291826 - protein, 17 aa, Cryptosporidium parvum
FALNLGRKPDLIYSHTL

SEQ ID NO: 2291827 - protein, 25 aa, Cryptosporidium parvum
FANCIKRQFCEGIDIENCSNRQQIM

SEQ ID NO: 2291828 - protein, 24 aa, Cryptosporidium parvum
FANTCFNLFSLLSLLKDSLISITS

SEQ ID NO: 2291829 - protein, 18 aa, Cryptosporidium parvum
FAQQPFLYMNSNLTDWEF

SEQ ID NO: 2291830 - protein, 18 aa, Cryptosporidium parvum
FARDALRQIKQKKLSRFI

SEQ ID NO: 2291831 - protein, 20 aa, Cryptosporidium parvum
FASCFRCGKTGHIVAFCPNN

SEQ ID NO: 2291832 - protein, 21 aa, Cryptosporidium parvum
FASDWWPSLMDEWSNFDDNSL

SEQ ID NO: 2291833 - protein, 17 aa, Cryptosporidium parvum
FASIEAFTQEFGELQTS

SEQ ID NO: 2291834 - protein, 27 aa, Cryptosporidium parvum
FASILKEWRLCTGIELILTAKVPIIKY

SEQ ID NO: 2291835 - protein, 27 aa, Cryptosporidium parvum
FASIVGTRCVVVWIGIRDCLSQESLFS

SEQ ID NO: 2291836 - protein, 17 aa, Cryptosporidium parvum
FASPGIDGAESFEADYT

SEQ ID NO: 2291837 - protein, 17 aa, Cryptosporidium parvum
FASYRACAVGTKEREGN

SEQ ID NO: 2291838 - protein, 24 aa, Cryptosporidium parvum
FATWCGPCNMIAPKLEEFSEQVKD

SEQ ID NO: 2291839 - protein, 19 aa, Cryptosporidium parvum
FAVFICLNCSSDHRKMGVH

SEQ ID NO: 2291840 - protein, 19 aa, Cryptosporidium parvum
FAVNSDRGVGTGGIGSNQL

SEQ ID NO: 2291841 - protein, 22 aa, Cryptosporidium parvum
FCDISKYHATIMVLNIAANIHK

SEQ ID NO: 2291842 - protein, 20 aa, Cryptosporidium parvum
FCDQIIFFLKKNWGIFYKKV

SEQ ID NO: 2291843 - protein, 24 aa, Cryptosporidium parvum
FCDREMRAGISLLEYLLSQGFLDE

SEQ ID NO: 2291844 - protein, 19 aa, Cryptosporidium parvum
FCELKRWCPSLRVVKLHGD

SEQ ID NO: 2291845 - protein, 19 aa, Cryptosporidium parvum
FCETVEFRTVYVTKQERLG

SEQ ID NO: 2291846 - protein, 17 aa, Cryptosporidium parvum
FCFSCILSDLGGKKQRL

SEQ ID NO: 2291847 - protein, 18 aa, Cryptosporidium parvum
FCGTLVIVFDLWTRVTRD

SEQ ID NO: 2291848 - protein, 19 aa, Cryptosporidium parvum
FCIMNRYDLAQSLFDDLIE

SEQ ID NO: 2291849 - protein, 24 aa, Cryptosporidium parvum
FCNNNCLIIMKWIDSLLYITQKIR

SEQ ID NO: 2291850 - protein, 17 aa, Cryptosporidium parvum
FCNYDMVSRIMRLNSSN

SEQ ID NO: 2291851 - protein, 18 aa, Cryptosporidium parvum
FCQEGIDLLSNMLCFDPN

SEQ ID NO: 2291852 - protein, 19 aa, Cryptosporidium parvum
FCQNMNWSNMQIVFQSYLR

SEQ ID NO: 2291853 - protein, 20 aa, Cryptosporidium parvum
FCSMKISQGFFQLEQDDSIE

SEQ ID NO: 2291854 - protein, 26 aa, Cryptosporidium parvum
FCTCSKNILKEKFKFNGIDKLKNIEF

SEQ ID NO: 2291855 - protein, 18 aa, Cryptosporidium parvum
FCTFPLNHRIYLPFHVNI

SEQ ID NO: 2291856 - protein, 17 aa, Cryptosporidium parvum
FCVTFKMISFRPYVGEV

SEQ ID NO: 2291857 - protein, 19 aa, Cryptosporidium parvum
FCYVKRPISDFDLTELRIH

SEQ ID NO: 2291858 - protein, 23 aa, Cryptosporidium parvum
FDAKTAKGSTVWCDSAPSVLNDP

SEQ ID NO: 2291859 - protein, 17 aa, Cryptosporidium parvum
FDAKWDLGWMNDTLSYL

SEQ ID NO: 2291860 - protein, 19 aa, Cryptosporidium parvum
FDCPWFFSTLLTIILFKDK

SEQ ID NO: 2291861 - protein, 26 aa, Cryptosporidium parvum
FDCVKRIPDGILLFFGSYSLMDQAVK

SEQ ID NO: 2291862 - protein, 22 aa, Cryptosporidium parvum
FDDELFNIISELDKINFKNQNN

SEQ ID NO: 2291863 - protein, 27 aa, Cryptosporidium parvum
FDDFPSFPYKYGMAITSLLADGQSNSI

SEQ ID NO: 2291864 - protein, 24 aa, Cryptosporidium parvum
FDDYLRKFGLNFIRRKSGNAKSLS

SEQ ID NO: 2291865 - protein, 17 aa, Cryptosporidium parvum
FDEEMHLFVTRDSFLES

SEQ ID NO: 2291866 - protein, 25 aa, Cryptosporidium parvum
FDEFMRFSVLLAVLFGLKDPIDPKV

SEQ ID NO: 2291867 - protein, 18 aa, Cryptosporidium parvum
FDEIVSFGYRESINLSQI

SEQ ID NO: 2291868 - protein, 23 aa, Cryptosporidium parvum
FDEKARFSYRVIKGENYMNLSDG

SEQ ID NO: 2291869 - protein, 19 aa, Cryptosporidium parvum
FDFDSYISFVIFIINYGNY

SEQ ID NO: 2291870 - protein, 26 aa, Cryptosporidium parvum
FDFLDGNCSRGFFLADIQNISEQFLL

SEQ ID NO: 2291871 - protein, 17 aa, Cryptosporidium parvum
FDGELITSVYMRNQFEE

SEQ ID NO: 2291872 - protein, 20 aa, Cryptosporidium parvum
FDGPLSFDTIMALKRKKSNV

SEQ ID NO: 2291873 - protein, 20 aa, Cryptosporidium parvum
FDGTCVFTLKSRSKINYSVI

SEQ ID NO: 2291874 - protein, 17 aa, Cryptosporidium parvum
FDHNFNAGMSRSYSKSY

SEQ ID NO: 2291875 - protein, 31 aa, Cryptosporidium parvum
FDHSRWMGSRGRVKAAYSFSWDSIARATSFL

SEQ ID NO: 2291876 - protein, 17 aa, Cryptosporidium parvum
FDILKEYNRQGVPISSG

SEQ ID NO: 2291877 - protein, 17 aa, Cryptosporidium parvum
FDILKKRIPDQIERAKM

SEQ ID NO: 2291878 - protein, 18 aa, Cryptosporidium parvum
FDILNNVERLSCLMKRFG

SEQ ID NO: 2291879 - protein, 20 aa, Cryptosporidium parvum
FDITIAEFILKIYPNIEPSN

SEQ ID NO: 2291880 - protein, 26 aa, Cryptosporidium parvum
FDKARAAAPCVLFFDELDSIGTQRGS

SEQ ID NO: 2291881 - protein, 18 aa, Cryptosporidium parvum
FDKAVIVFKAALKRENES

SEQ ID NO: 2291882 - protein, 28 aa, Cryptosporidium parvum
FDKELEPAIKFCFGHTIICEDENIAKMI

SEQ ID NO: 2291883 - protein, 17 aa, Cryptosporidium parvum
FDKGYQFNRNQFEYYDR

SEQ ID NO: 2291884 - protein, 17 aa, Cryptosporidium parvum
FDKNYKMEFSVFDEECN

SEQ ID NO: 2291885 - protein, 35 aa, Cryptosporidium parvum
FDKPGALPHLFRSFRATKFCKRCGAGNSIVVYDSK

SEQ ID NO: 2291886 - protein, 17 aa, Cryptosporidium parvum
FDKVMGYFRKYAGLEEG

SEQ ID NO: 2291887 - protein, 17 aa, Cryptosporidium parvum
FDLANSIITRFISDEQY

SEQ ID NO: 2291888 - protein, 31 aa, Cryptosporidium parvum
FDLDCTKIVFNKPISFWFSQILHGIIIETIF

SEQ ID NO: 2291889 - protein, 17 aa, Cryptosporidium parvum
FDLGVCVNGFVLDGFPR

SEQ ID NO: 2291890 - protein, 19 aa, Cryptosporidium parvum
FDLKIALIHSGICNISEKD

SEQ ID NO: 2291891 - protein, 17 aa, Cryptosporidium parvum
FDLKRPNTMNIDDKNLN

SEQ ID NO: 2291892 - protein, 17 aa, Cryptosporidium parvum
FDLKYNGFYILYAKSNK

SEQ ID NO: 2291893 - protein, 25 aa, Cryptosporidium parvum
FDLLAQICLKGGFVNDAIFYYNESL

SEQ ID NO: 2291894 - protein, 22 aa, Cryptosporidium parvum
FDLPCNDLKCVAYNKTKNSIAF

SEQ ID NO: 2291895 - protein, 20 aa, Cryptosporidium parvum
FDLPSIKAIKRFEALNKSGK

SEQ ID NO: 2291896 - protein, 25 aa, Cryptosporidium parvum
FDLWTRVTRDFFWPYIIVASGNYLS

SEQ ID NO: 2291897 - protein, 19 aa, Cryptosporidium parvum
FDMGGGFDGRMGGRMSREV

SEQ ID NO: 2291898 - protein, 19 aa, Cryptosporidium parvum
FDMNYLLERAKLFQLNDFF

SEQ ID NO: 2291899 - protein, 22 aa, Cryptosporidium parvum
FDNDIVRYFKMISGIASDINSE

SEQ ID NO: 2291900 - protein, 22 aa, Cryptosporidium parvum
FDNENLKFFGYNTESNLEILIE

SEQ ID NO: 2291901 - protein, 17 aa, Cryptosporidium parvum
FDNSCILITARGFSDLP

SEQ ID NO: 2291902 - protein, 18 aa, Cryptosporidium parvum
FDPEFAKGLLDVYRRCLF

SEQ ID NO: 2291903 - protein, 18 aa, Cryptosporidium parvum
FDPKNMFILLSIPENKAL

SEQ ID NO: 2291904 - protein, 17 aa, Cryptosporidium parvum
FDPNAIFIHYGHTAPIT

SEQ ID NO: 2291905 - protein, 17 aa, Cryptosporidium parvum
FDQEIIQNPNFNYNEDN

SEQ ID NO: 2291906 - protein, 18 aa, Cryptosporidium parvum
FDQIVKHFDYLDIEESEP

SEQ ID NO: 2291907 - protein, 17 aa, Cryptosporidium parvum
FDQVLKFGSYVVDELVN

SEQ ID NO: 2291908 - protein, 22 aa, Cryptosporidium parvum
FDQYGSLCLERSFEVFSNNDCY

SEQ ID NO: 2291909 - protein, 19 aa, Cryptosporidium parvum
FDRAFKFNIVIPQLTKLIS

SEQ ID NO: 2291910 - protein, 18 aa, Cryptosporidium parvum
FDRFVCVFKTLDENGHVC

SEQ ID NO: 2291911 - protein, 18 aa, Cryptosporidium parvum
FDRLIFYTIVSSIISIDR

SEQ ID NO: 2291912 - protein, 19 aa, Cryptosporidium parvum
FDSALCIYDHNCPPTIEED

SEQ ID NO: 2291913 - protein, 22 aa, Cryptosporidium parvum
FDSERLDYFTARAVEEGAKVIK

SEQ ID NO: 2291914 - protein, 20 aa, Cryptosporidium parvum
FDSFYIWLLMEQLLGFVCIE

SEQ ID NO: 2291915 - protein, 22 aa, Cryptosporidium parvum
FDSGFCLGGVGFYITTDNMDFD

SEQ ID NO: 2291916 - protein, 20 aa, Cryptosporidium parvum
FDSIKLCICQDINSPMNRNC

SEQ ID NO: 2291917 - protein, 20 aa, Cryptosporidium parvum
FDSILLAWDFFKDIKEEVFG

SEQ ID NO: 2291918 - protein, 26 aa, Cryptosporidium parvum
FDSIVDLFCLLNCNKELFMRLVSSLY

SEQ ID NO: 2291919 - protein, 23 aa, Cryptosporidium parvum
FDSNDAKSLFVLNPDGSGILKNI

SEQ ID NO: 2291920 - protein, 17 aa, Cryptosporidium parvum
FDSSFDLNLDLNLELDI

SEQ ID NO: 2291921 - protein, 23 aa, Cryptosporidium parvum
FDSSNSIFSRFDWHKDSIRYSLK

SEQ ID NO: 2291922 - protein, 18 aa, Cryptosporidium parvum
FDTKYCRKAIAMIPDSRI

SEQ ID NO: 2291923 - protein, 18 aa, Cryptosporidium parvum
FDVAFKVLFEIFSVDKDL

SEQ ID NO: 2291924 - protein, 21 aa, Cryptosporidium parvum
FDVGLTWKNAYYIAEPKVKRP

SEQ ID NO: 2291925 - protein, 17 aa, Cryptosporidium parvum
FDWCKLDDNCLSVVGSS

SEQ ID NO: 2291926 - protein, 24 aa, Cryptosporidium parvum
FDWIFKINKLPLWLHPYEILVIGS

SEQ ID NO: 2291927 - protein, 21 aa, Cryptosporidium parvum
FDYEICSICSGAISPYEAIRL

SEQ ID NO: 2291928 - protein, 19 aa, Cryptosporidium parvum
FDYKYSFNMILAAQELNLE

SEQ ID NO: 2291929 - protein, 31 aa, Cryptosporidium parvum
FDYLLSMPLWSLTKEKMELLEADLIKKTEEY

SEQ ID NO: 2291930 - protein, 17 aa, Cryptosporidium parvum
FDYRKEFDACLDTLVIS

SEQ ID NO: 2291931 - protein, 22 aa, Cryptosporidium parvum
FECGVCKYGKEFDKIQRIIKTK

SEQ ID NO: 2291932 - protein, 27 aa, Cryptosporidium parvum
FECVCSEGYTGDGFTCRDIDECKVGNY

SEQ ID NO: 2291933 - protein, 18 aa, Cryptosporidium parvum
FEDKILLSDIVFCKTWVS

SEQ ID NO: 2291934 - protein, 18 aa, Cryptosporidium parvum
FEDPMACIHEMLSQISGV

SEQ ID NO: 2291935 - protein, 24 aa, Cryptosporidium parvum
FEDSESPPICTIMTDCSGVIKTGD

SEQ ID NO: 2291936 - protein, 18 aa, Cryptosporidium parvum
FEEEEFVYFLSRIPNLSK

SEQ ID NO: 2291937 - protein, 18 aa, Cryptosporidium parvum
FEEIQEIIKKVADTHTEY

SEQ ID NO: 2291938 - protein, 17 aa, Cryptosporidium parvum
FEELCSNMSGYINNMVD

SEQ ID NO: 2291939 - protein, 21 aa, Cryptosporidium parvum
FEEMIKIFMLKNEQIMNNKNR

SEQ ID NO: 2291940 - protein, 17 aa, Cryptosporidium parvum
FEEQPLWLRPVIESKIS

SEQ ID NO: 2291941 - protein, 17 aa, Cryptosporidium parvum
FEFFFPFIYGLIVHSDK

SEQ ID NO: 2291942 - protein, 22 aa, Cryptosporidium parvum
FEFHGLDPLISFSIFQELEDAK

SEQ ID NO: 2291943 - protein, 21 aa, Cryptosporidium parvum
FEFPSAIQRRAIVPIIQGRDT

SEQ ID NO: 2291944 - protein, 20 aa, Cryptosporidium parvum
FEFSEFGLTLSHITLTEGTQ

SEQ ID NO: 2291945 - protein, 20 aa, Cryptosporidium parvum
FEFSEMIYSVLIHDKNQISH

SEQ ID NO: 2291946 - protein, 25 aa, Cryptosporidium parvum
FEGGIWRVLLGLLREEFNKKSNKKS

SEQ ID NO: 2291947 - protein, 21 aa, Cryptosporidium parvum
FEGIHCKICYLDFAQRWVYQQ

SEQ ID NO: 2291948 - protein, 17 aa, Cryptosporidium parvum
FEGLDHTFYRSSPVIPL

SEQ ID NO: 2291949 - protein, 28 aa, Cryptosporidium parvum
FEHCFEFKVLLLTSMGSKVFVRVHSMGS

SEQ ID NO: 2291950 - protein, 18 aa, Cryptosporidium parvum
FEHPADCIYMNGVDNRHF

SEQ ID NO: 2291951 - protein, 17 aa, Cryptosporidium parvum
FEIARLLLESGADCRAK

SEQ ID NO: 2291952 - protein, 17 aa, Cryptosporidium parvum
FEICHTTFPSVYHKYKK

SEQ ID NO: 2291953 - protein, 17 aa, Cryptosporidium parvum
FEIDESISLNPTLPSIT

SEQ ID NO: 2291954 - protein, 26 aa, Cryptosporidium parvum
FEIGQKLLEKMGWKQGEGLGKNNQGI

SEQ ID NO: 2291955 - protein, 18 aa, Cryptosporidium parvum
FEIGSTFRISMLEYAIPA

SEQ ID NO: 2291956 - protein, 19 aa, Cryptosporidium parvum
FEIHGCGHKLNEFSESAKS

SEQ ID NO: 2291957 - protein, 17 aa, Cryptosporidium parvum
FEIIPYTLAENAGLNPI

SEQ ID NO: 2291958 - protein, 20 aa, Cryptosporidium parvum
FEIISIQLSMHYMLINEETS

SEQ ID NO: 2291959 - protein, 20 aa, Cryptosporidium parvum
FEILDSPLILPQIVTCLNCT

SEQ ID NO: 2291960 - protein, 17 aa, Cryptosporidium parvum
FEILRTTLIQSLLKTIA

SEQ ID NO: 2291961 - protein, 17 aa, Cryptosporidium parvum
FEIPDPLTVPFISCGDL

SEQ ID NO: 2291962 - protein, 23 aa, Cryptosporidium parvum
FEITCKFEIFPTLVELVIHIDVN

SEQ ID NO: 2291963 - protein, 17 aa, Cryptosporidium parvum
FEKELFAFLTGETPKEN

SEQ ID NO: 2291964 - protein, 19 aa, Cryptosporidium parvum
FEKGELIMSVIPRYFEFKT

SEQ ID NO: 2291965 - protein, 22 aa, Cryptosporidium parvum
FEKGKCLIEELIIENKNQNSDK

SEQ ID NO: 2291966 - protein, 23 aa, Cryptosporidium parvum
FEKGNLFLFQFGLSIVDVCREDI

SEQ ID NO: 2291967 - protein, 18 aa, Cryptosporidium parvum
FEKKLPYVFKDSSNVPEW

SEQ ID NO: 2291968 - protein, 20 aa, Cryptosporidium parvum
FEKKLQLKRCRESRESIIKD

SEQ ID NO: 2291969 - protein, 18 aa, Cryptosporidium parvum
FEKLILLYYVIGQREYME

SEQ ID NO: 2291970 - protein, 23 aa, Cryptosporidium parvum
FEKNCNRLPILHSNCKLRTMNDS

SEQ ID NO: 2291971 - protein, 20 aa, Cryptosporidium parvum
FEKTLKCEIINLENQISKME

SEQ ID NO: 2291972 - protein, 17 aa, Cryptosporidium parvum
FEKVWIDPFFDRKTLHV

SEQ ID NO: 2291973 - protein, 22 aa, Cryptosporidium parvum
FELCSSYPRIIVVPENISDSQL

SEQ ID NO: 2291974 - protein, 17 aa, Cryptosporidium parvum
FELFPFQVLSTEKNERF

SEQ ID NO: 2291975 - protein, 17 aa, Cryptosporidium parvum
FELLASELFDVPRDSGV

SEQ ID NO: 2291976 - protein, 17 aa, Cryptosporidium parvum
FELLKTYYHPLIVELVY

SEQ ID NO: 2291977 - protein, 22 aa, Cryptosporidium parvum
FELLVSLMFNYGMREMFVSGLP

SEQ ID NO: 2291978 - protein, 17 aa, Cryptosporidium parvum
FEMAGNIAERFQFHDKY

SEQ ID NO: 2291979 - protein, 19 aa, Cryptosporidium parvum
FENELLKPLSVHYDLSNHD

SEQ ID NO: 2291980 - protein, 24 aa, Cryptosporidium parvum
FENFLKQWYLSFTNVLLRMLDDTL

SEQ ID NO: 2291981 - protein, 23 aa, Cryptosporidium parvum
FENICKRMIKAALFNDPNYISIL

SEQ ID NO: 2291982 - protein, 22 aa, Cryptosporidium parvum
FENKCKEIKEVNPYYYTILQDK

SEQ ID NO: 2291983 - protein, 17 aa, Cryptosporidium parvum
FENKGKEIALIMPFSIK

SEQ ID NO: 2291984 - protein, 21 aa, Cryptosporidium parvum
FENKWKWARKSGENNVGDLWK

SEQ ID NO: 2291985 - protein, 24 aa, Cryptosporidium parvum
FENSIKMGINFGTIRGSSKPSLIM

SEQ ID NO: 2291986 - protein, 24 aa, Cryptosporidium parvum
FEPAHARGALGVMPLPMQLPPQPP

SEQ ID NO: 2291987 - protein, 18 aa, Cryptosporidium parvum
FEPIRKCSESNWFKKVVI

SEQ ID NO: 2291988 - protein, 18 aa, Cryptosporidium parvum
FEPLLPYLVYYFNYNTRI

SEQ ID NO: 2291989 - protein, 39 aa, Cryptosporidium parvum
FEQEEGAKSAIQWNQTEYKGRMLRINMSADKPQPGSLSS

SEQ ID NO: 2291990 - protein, 26 aa, Cryptosporidium parvum
FEQFSWPHFHRGDILSMKYVFLGDYV

SEQ ID NO: 2291991 - protein, 26 aa, Cryptosporidium parvum
FERALEFFPTSPIVWKRYIEYLQSQK

SEQ ID NO: 2291992 - protein, 18 aa, Cryptosporidium parvum
FEREFSITSKNIYVNRIN

SEQ ID NO: 2291993 - protein, 18 aa, Cryptosporidium parvum
FERFGMSPSRGVLFYGPP

SEQ ID NO: 2291994 - protein, 27 aa, Cryptosporidium parvum
FERKPFKRPSSYEVLMILNGINSEDIK

SEQ ID NO: 2291995 - protein, 20 aa, Cryptosporidium parvum
FERNKFVSIQGIKTNHEKDA

SEQ ID NO: 2291996 - protein, 17 aa, Cryptosporidium parvum
FERVRPFISKSHPNIKK

SEQ ID NO: 2291997 - protein, 24 aa, Cryptosporidium parvum
FESFLLERPFEFRLIQNRIGRRRI

SEQ ID NO: 2291998 - protein, 17 aa, Cryptosporidium parvum
FESIKLYTLESRAWIHI

SEQ ID NO: 2291999 - protein, 24 aa, Cryptosporidium parvum
FESLPWKGQTMFSNFRELQISLQS

SEQ ID NO: 2292000 - protein, 18 aa, Cryptosporidium parvum
FESNAWISNVYFIKTPSL

SEQ ID NO: 2292001 - protein, 23 aa, Cryptosporidium parvum
FESSLRLLKDVLLVQPNKLVSSN

SEQ ID NO: 2292002 - protein, 32 aa, Cryptosporidium parvum; identical to SEQ ID NO: 2170934

SEQ ID NO: 2292003 - protein, 23 aa, Cryptosporidium parvum
FETDESWRSISVIFSDSNIPGEG

SEQ ID NO: 2292004 - protein, 24 aa, Cryptosporidium parvum
FETEMKLFYCKYNDPAYIKIEKLN

SEQ ID NO: 2292005 - protein, 18 aa, Cryptosporidium parvum
FETFMEWKKKKEKEEEEK

SEQ ID NO: 2292006 - protein, 17 aa, Cryptosporidium parvum
FETLILSIGDKGPFIAE

SEQ ID NO: 2292007 - protein, 28 aa, Cryptosporidium parvum
FETNLNWKGRELVALSVLQAYLGGGSSF

SEQ ID NO: 2292008 - protein, 17 aa, Cryptosporidium parvum
FEVEGSDIFTAKLKFEG

SEQ ID NO: 2292009 - protein, 26 aa, Cryptosporidium parvum
FEVIISPLLRRSCSSYGKELESELIR

SEQ ID NO: 2292010 - protein, 19 aa, Cryptosporidium parvum
FEVKKDWWRLIPTESTNSD

SEQ ID NO: 2292011 - protein, 17 aa, Cryptosporidium parvum
FEVLRLIHNASYISNYK

SEQ ID NO: 2292012 - protein, 21 aa, Cryptosporidium parvum
FEVLYKPWGIVRGSSKKFPTK

SEQ ID NO: 2292013 - protein, 17 aa, Cryptosporidium parvum
FEVPDGYKLQKQSIDFW

SEQ ID NO: 2292014 - protein, 23 aa, Cryptosporidium parvum
FEVPEGVEAISLMGYSFSVEDSD

SEQ ID NO: 2292015 - protein, 23 aa, Cryptosporidium parvum
FEVQQFVSLEWFLTSCFEKRSLD

SEQ ID NO: 2292016 - protein, 23 aa, Cryptosporidium parvum
FEWAKQMICGFCSREQGFSENCK

SEQ ID NO: 2292017 - protein, 17 aa, Cryptosporidium parvum
FEWQGRRIGIMGLVEKD

SEQ ID NO: 2292018 - protein, 21 aa, Cryptosporidium parvum
FEWSHEINQIFVALNNSSIIA

SEQ ID NO: 2292019 - protein, 26 aa, Cryptosporidium parvum
FEYFEDFLKFIGFHLSIRKDQKVILA

SEQ ID NO: 2292020 - protein, 19 aa, Cryptosporidium parvum
FEYHWEKPLFHSKLFEIDH

SEQ ID NO: 2292021 - protein, 19 aa, Cryptosporidium parvum
FEYIICKDDSLSLLNSNSL

SEQ ID NO: 2292022 - protein, 18 aa, Cryptosporidium parvum
FEYIKLINEIGGIPNDKQ

SEQ ID NO: 2292023 - protein, 25 aa, Cryptosporidium parvum
FEYKIPQLDLFIAMDADYSFSLTTF

SEQ ID NO: 2292024 - protein, 17 aa, Cryptosporidium parvum
FEYLPYDLSGYIEGLKL

SEQ ID NO: 2292025 - protein, 18 aa, Cryptosporidium parvum
FEYMRIKYSFVIPDKEYL

SEQ ID NO: 2292026 - protein, 18 aa, Cryptosporidium parvum
FFAFFPFQTAEMALENMK

SEQ ID NO: 2292027 - protein, 19 aa, Cryptosporidium parvum
FFCQLKLNRIQVLKVSLFK

SEQ ID NO: 2292028 - protein, 18 aa, Cryptosporidium parvum
FFCVHGGLSPELRSVDQI

SEQ ID NO: 2292029 - protein, 24 aa, Cryptosporidium parvum
FFDLKEIFRIGGVPPETNFLFLGD

SEQ ID NO: 2292030 - protein, 25 aa, Cryptosporidium parvum
FFDNYKGEESFDFVPIKENLDDFSI

SEQ ID NO: 2292031 - protein, 28 aa, Cryptosporidium parvum
FFEELNRSFPIICLLLFERRVRSKSDGI

SEQ ID NO: 2292032 - protein, 19 aa, Cryptosporidium parvum
FFESGFFFYIFSGETSSDQ

SEQ ID NO: 2292033 - protein, 20 aa, Cryptosporidium parvum
FFFLFNRHFIHFGDGDEEVR

SEQ ID NO: 2292034 - protein, 20 aa, Cryptosporidium parvum
FFFSAYIFELFYVVFYSDED

SEQ ID NO: 2292035 - protein, 22 aa, Cryptosporidium parvum
FFGCSEYFLSHIIKNLNLKTPI

SEQ ID NO: 2292036 - protein, 18 aa, Cryptosporidium parvum
FFGKLVVDSIMTVKATDP

SEQ ID NO: 2292037 - protein, 29 aa, Cryptosporidium parvum
FFGQSGIGYKICDRLGAGSASVVFRCKSV

SEQ ID NO: 2292038 - protein, 18 aa, Cryptosporidium parvum
FFHGRGGSIGRGGGPQHL

SEQ ID NO: 2292039 - protein, 18 aa, Cryptosporidium parvum
FFIFIKSDFQLENETIFL

SEQ ID NO: 2292040 - protein, 30 aa, Cryptosporidium parvum
FFIPIGRVLFLLEWIELIISEDQQNQHLFQ

SEQ ID NO: 2292041 - protein, 27 aa, Cryptosporidium parvum
FFKDLDYKAIFTWKRFNQIKYVLDTRS

SEQ ID NO: 2292042 - protein, 22 aa, Cryptosporidium parvum
FFKGMGAGLVAAVALPVTAVGV

SEQ ID NO: 2292043 - protein, 17 aa, Cryptosporidium parvum
FFKLEIMVSENLSRNER

SEQ ID NO: 2292044 - protein, 28 aa, Cryptosporidium parvum
FFKSYWKSQEIHITLKRIEVIRQNSQDS

SEQ ID NO: 2292045 - protein, 24 aa, Cryptosporidium parvum
FFLDRPDVMCKFRVRIEGDKTKSP

SEQ ID NO: 2292046 - protein, 23 aa, Cryptosporidium parvum
FFLEELYRQINIRSGISRLQYSV

SEQ ID NO: 2292047 - protein, 18 aa, Cryptosporidium parvum
FFLHENRYYLSLEYFPQT

SEQ ID NO: 2292048 - protein, 21 aa, Cryptosporidium parvum
FFLKKVPIFVSFSYLNDSIWV

SEQ ID NO: 2292049 - protein, 19 aa, Cryptosporidium parvum
FFLPNILNFLRIVTSPNNK

SEQ ID NO: 2292050 - protein, 17 aa, Cryptosporidium parvum
FFLVFLVSIGYTVLAPN

SEQ ID NO: 2292051 - protein, 18 aa, Cryptosporidium parvum
FFMKLSIRVHFDMISHPN

SEQ ID NO: 2292052 - protein, 24 aa, Cryptosporidium parvum
FFMPHCDRCVFGMIINYFNSGEGK

SEQ ID NO: 2292053 - protein, 17 aa, Cryptosporidium parvum
FFNSRPVIIKNINNNLI

SEQ ID NO: 2292054 - protein, 26 aa, Cryptosporidium parvum
FFPKFLKDNMKWFKNRIPSNNTNDDY

SEQ ID NO: 2292055 - protein, 21 aa, Cryptosporidium parvum
FFPVRTIGYCYSCWTEKFGVP

SEQ ID NO: 2292056 - protein, 23 aa, Cryptosporidium parvum
FFPYDLKRYLSMFPDKVPPVKFI

SEQ ID NO: 2292057 - protein, 23 aa, Cryptosporidium parvum
FFQALDFHWSNYIHRTEIEKNYI

SEQ ID NO: 2292058 - protein, 23 aa, Cryptosporidium parvum
FFQRAHLFDYSWKHLAEEQRRIE

SEQ ID NO: 2292059 - protein, 17 aa, Cryptosporidium parvum
FFRARRTLCEMLEDRGY

SEQ ID NO: 2292060 - protein, 24 aa, Cryptosporidium parvum
FFRDKFRLLPGWAQLVLFSSSVLK

SEQ ID NO: 2292061 - protein, 18 aa, Cryptosporidium parvum
FFRRKHVGMNKSTVVALE

SEQ ID NO: 2292062 - protein, 24 aa, Cryptosporidium parvum
FFSDLKLYGSELFTRNCLSKEDLV

SEQ ID NO: 2292063 - protein, 18 aa, Cryptosporidium parvum
FFSISALIDDQVLCLHSG

SEQ ID NO: 2292064 - protein, 18 aa, Cryptosporidium parvum
FFSQCLIKSITVGNLNKE

SEQ ID NO: 2292065 - protein, 18 aa, Cryptosporidium parvum
FFTAKISSIFSRFLSSNL

SEQ ID NO: 2292066 - protein, 17 aa, Cryptosporidium parvum
FFTHFYSAITFLEKLDG

SEQ ID NO: 2292067 - protein, 24 aa, Cryptosporidium parvum
FFTSHLFLDVFFKFLVSDKSSKDF

SEQ ID NO: 2292068 - protein, 18 aa, Cryptosporidium parvum
FFVLKGVHLLRGDELSIN

SEQ ID NO: 2292069 - protein, 19 aa, Cryptosporidium parvum
FGAAIGGALGLTFGNMIKN

SEQ ID NO: 2292070 - protein, 18 aa, Cryptosporidium parvum
FGAKGEWLAVGAAKTGQL

SEQ ID NO: 2292071 - protein, 25 aa, Cryptosporidium parvum
FGALPLHYRHFIGILCSSLYDNDYM

SEQ ID NO: 2292072 - protein, 26 aa, Cryptosporidium parvum
FGCILMELYTGVLLFKTHEHMEHLAM

SEQ ID NO: 2292073 - protein, 18 aa, Cryptosporidium parvum
FGCTVFQVICGYPPFNAP

SEQ ID NO: 2292074 - protein, 22 aa, Cryptosporidium parvum
FGDGIIRLLAIKTRSIEIYEIN

SEQ ID NO: 2292075 - protein, 34 aa, Cryptosporidium parvum
FGDIFKDFCLFLLSFRANFVLKIINELFLAIKNL

SEQ ID NO: 2292076 - protein, 17 aa, Cryptosporidium parvum
FGDIIVFIHDICILSDF

SEQ ID NO: 2292077 - protein, 19 aa, Cryptosporidium parvum
FGDLFWKLSKNQFNKNIFK

SEQ ID NO: 2292078 - protein, 25 aa, Cryptosporidium parvum
FGDSKIVSLLLEYGALANISDLNND

SEQ ID NO: 2292079 - protein, 24 aa, Cryptosporidium parvum
FGEDFKGKCKVKCDNCMRSELEKP

SEQ ID NO: 2292080 - protein, 17 aa, Cryptosporidium parvum
FGEDQVKIWRRSFDVPP

SEQ ID NO: 2292081 - protein, 19 aa, Cryptosporidium parvum
FGEECGKKAIRQICFCGSD

SEQ ID NO: 2292082 - protein, 23 aa, Cryptosporidium parvum
FGEESRVGITFDTYRKRNVLLNR

SEQ ID NO: 2292083 - protein, 31 aa, Cryptosporidium parvum
FGEIESLTLVLACKLNVFKFNCDVSQIRPTI

SEQ ID NO: 2292084 - protein, 20 aa, Cryptosporidium parvum
FGEYIKCNLNLYRLRNGVQL

SEQ ID NO: 2292085 - protein, 25 aa, Cryptosporidium parvum
FGFNRAREKAIKYLDARRKGIILTT

SEQ ID NO: 2292086 - protein, 22 aa, Cryptosporidium parvum
FGFREQDVFKLSFAYHPSSIIY

SEQ ID NO: 2292087 - protein, 23 aa, Cryptosporidium parvum
FGFSPKLLESIKIIGYSLPTPIQ

SEQ ID NO: 2292088 - protein, 21 aa, Cryptosporidium parvum
FGGDYYKSELLDMIYHPNYPD

SEQ ID NO: 2292089 - protein, 24 aa, Cryptosporidium parvum
FGGESHGGYTYCVVSGLCILGKSS

SEQ ID NO: 2292090 - protein, 26 aa, Cryptosporidium parvum
FGGFLAIPNDWWMCYVHGDDLEKILC

SEQ ID NO: 2292091 - protein, 24 aa, Cryptosporidium parvum
FGGFSSCFQFNFDGRLFDKFETGD

SEQ ID NO: 2292092 - protein, 21 aa, Cryptosporidium parvum
FGGNHYFDFNNFWELKYQGHM

SEQ ID NO: 2292093 - protein, 17 aa, Cryptosporidium parvum
FGGPFGGGSSGAIGVGN

SEQ ID NO: 2292094 - protein, 23 aa, Cryptosporidium parvum
FGGPFQEFLSWISNEIMSKNNDN

SEQ ID NO: 2292095 - protein, 27 aa, Cryptosporidium parvum
FGGSCFKKDVLCLAYLFDHFNLKDEAE

SEQ ID NO: 2292096 - protein, 27 aa, Cryptosporidium parvum
FGGVLLEVPLKFVLDVAFSDFSNYKKT

SEQ ID NO: 2292097 - protein, 22 aa, Cryptosporidium parvum
FGIAAVCLFTIFNLPETTDERR

SEQ ID NO: 2292098 - protein, 24 aa, Cryptosporidium parvum
FGIKEPKIKWVNDIYVNGKKIGGI

SEQ ID NO: 2292099 - protein, 20 aa, Cryptosporidium parvum
FGINIFFQIINSIQFLHNLG

SEQ ID NO: 2292100 - protein, 17 aa, Cryptosporidium parvum
FGIPKYAGEVIIVRFER

SEQ ID NO: 2292101 - protein, 25 aa, Cryptosporidium parvum
FGISRIMLSVTMPFTLTSIGTPQYM

SEQ ID NO: 2292102 - protein, 19 aa, Cryptosporidium parvum
FGKIFCGTLSKGDRVKVLG

SEQ ID NO: 2292103 - protein, 19 aa, Cryptosporidium parvum
FGKIWKSCHPNLIDSNAIK

SEQ ID NO: 2292104 - protein, 18 aa, Cryptosporidium parvum
FGKMILRMDIENIQYLIP

SEQ ID NO: 2292105 - protein, 33 aa, Cryptosporidium parvum
FGLAASLGSPAMKMRCGSPGYVAPEILEDKIYS

SEQ ID NO: 2292106 - protein, 17 aa, Cryptosporidium parvum
FGLARSIRNHSYTNFTN

SEQ ID NO: 2292107 - protein, 22 aa, Cryptosporidium parvum
FGLGKWRIILATSKLTNRDEVG

SEQ ID NO: 2292108 - protein, 19 aa, Cryptosporidium parvum
FGLLEKVIQFLLTFQDQSP

SEQ ID NO: 2292109 - protein, 27 aa, Cryptosporidium parvum
FGLLLRFKRLCGVKNIPCQISIQKLSK

SEQ ID NO: 2292110 - protein, 17 aa, Cryptosporidium parvum
FGMIREVYRAHGAVEID

SEQ ID NO: 2292111 - protein, 17 aa, Cryptosporidium parvum
FGMSPSRGVLFYGPPGC

SEQ ID NO: 2292112 - protein, 18 aa, Cryptosporidium parvum
FGMVNSRLENGRYKKIGS

SEQ ID NO: 2292113 - protein, 18 aa, Cryptosporidium parvum
FGNKSGTHNMVFQDLSGK

SEQ ID NO: 2292114 - protein, 20 aa, Cryptosporidium parvum
FGNNILCDIIQSMSIRDQER

SEQ ID NO: 2292115 - protein, 17 aa, Cryptosporidium parvum
FGNSCLMLANEKSSLGK

SEQ ID NO: 2292116 - protein, 18 aa, Cryptosporidium parvum
FGPSVIGAAMISLASVES

SEQ ID NO: 2292117 - protein, 17 aa, Cryptosporidium parvum
FGQCFRKMMKDVRRLLQ

SEQ ID NO: 2292118 - protein, 18 aa, Cryptosporidium parvum
FGRDPLCIKLIGITDNSS

SEQ ID NO: 2292119 - protein, 18 aa, Cryptosporidium parvum
FGSNEEFNLLSIFKDDNA

SEQ ID NO: 2292120 - protein, 17 aa, Cryptosporidium parvum
FGSPNFIANMYLKKGSV

SEQ ID NO: 2292121 - protein, 21 aa, Cryptosporidium parvum
FGSPVNFPAVQSIDEYKTLHS

SEQ ID NO: 2292122 - protein, 19 aa, Cryptosporidium parvum
FGSSDFKYVVNSFYNCETN

SEQ ID NO: 2292123 - protein, 18 aa, Cryptosporidium parvum
FGSSTAFVACFDPKTSKL

SEQ ID NO: 2292124 - protein, 18 aa, Cryptosporidium parvum
FGSVINKFIEFNRILLWS

SEQ ID NO: 2292125 - protein, 26 aa, Cryptosporidium parvum
FGTAIMFCNMSDYPFLSSIEKASKIS

SEQ ID NO: 2292126 - protein, 18 aa, Cryptosporidium parvum
FGTDSCGSMDECLTDSKN

SEQ ID NO: 2292127 - protein, 18 aa, Cryptosporidium parvum
FGTFVCSVCSGIHREFNH

SEQ ID NO: 2292128 - protein, 19 aa, Cryptosporidium parvum
FGTGNDWAKSFGWSSYGNM

SEQ ID NO: 2292129 - protein, 17 aa, Cryptosporidium parvum
FGTKCCSKCIFEGEKET

SEQ ID NO: 2292130 - protein, 17 aa, Cryptosporidium parvum
FGTLYSREGVGHVVTGD

SEQ ID NO: 2292131 - protein, 20 aa, Cryptosporidium parvum
FGVASLRSMNSNALSSYRST

SEQ ID NO: 2292132 - protein, 20 aa, Cryptosporidium parvum
FGVGIDWLDGMYRFIWLNDG

SEQ ID NO: 2292133 - protein, 17 aa, Cryptosporidium parvum
FGYKFGLKNDSQDQISI

SEQ ID NO: 2292134 - protein, 19 aa, Cryptosporidium parvum
FHCTFFYKTSSLFSLAFST

SEQ ID NO: 2292135 - protein, 17 aa, Cryptosporidium parvum
FHDQICFNQYSIFQRIQ

SEQ ID NO: 2292136 - protein, 19 aa, Cryptosporidium parvum
FHFLCLKIINEPQKTWYCP

SEQ ID NO: 2292137 - protein, 18 aa, Cryptosporidium parvum
FHGGTIRQLLRFKYKNGL

SEQ ID NO: 2292138 - protein, 17 aa, Cryptosporidium parvum
FHGLCTIARQISPIKTK

SEQ ID NO: 2292139 - protein, 17 aa, Cryptosporidium parvum
FHIAQIYGAISKEEFSP

SEQ ID NO: 2292140 - protein, 17 aa, Cryptosporidium parvum
FHILDIYPLSIQQRNIK

SEQ ID NO: 2292141 - protein, 18 aa, Cryptosporidium parvum
FHIPNNWMTYFAKLSLRW

SEQ ID NO: 2292142 - protein, 34 aa, Cryptosporidium parvum; identical to SEQ ID NO: 2171037

SEQ ID NO: 2292143 - protein, 23 aa, Cryptosporidium parvum
FHKGGCATFVRSFYKIYLKATKD

SEQ ID NO: 2292144 - protein, 20 aa, Cryptosporidium parvum
FHKNIKGFIIQGGDPTGTGK

SEQ ID NO: 2292145 - protein, 24 aa, Cryptosporidium parvum
FHKSDFRMGIFESFSSKTNLIYTY

SEQ ID NO: 2292146 - protein, 27 aa, Cryptosporidium parvum
FHLCREVLRLTKLVVDCHVQYRLGNID

SEQ ID NO: 2292147 - protein, 23 aa, Cryptosporidium parvum
FHLENDFLLLDGILNYGIAIHNS

SEQ ID NO: 2292148 - protein, 17 aa, Cryptosporidium parvum
FHLYCLFSENIQNGDLN

SEQ ID NO: 2292149 - protein, 26 aa, Cryptosporidium parvum
FHNKRWLLFSTCVEGFIIIYDLTTNK

SEQ ID NO: 2292150 - protein, 18 aa, Cryptosporidium parvum
FHPYRIPRHHLKEEEYPE

SEQ ID NO: 2292151 - protein, 29 aa, Cryptosporidium parvum
FHRSIFLFICTNCTCSVQAFRCQLPRMND

SEQ ID NO: 2292152 - protein, 18 aa, Cryptosporidium parvum
FHSCCKLKKNQKNDEYIF

SEQ ID NO: 2292153 - protein, 23 aa, Cryptosporidium parvum
FHSVIWPAMLLSVGLSLPKTIFA

SEQ ID NO: 2292154 - protein, 24 aa, Cryptosporidium parvum
FHTIFSLPGAHIFRDEINNSHQVH

SEQ ID NO: 2292155 - protein, 23 aa, Cryptosporidium parvum
FIAFDGCGTLAVLENSKNMKEIH

SEQ ID NO: 2292156 - protein, 25 aa, Cryptosporidium parvum
FIASSSFCLPNWFSSSKISKESYFK

SEQ ID NO: 2292157 - protein, 26 aa, Cryptosporidium parvum
FIAVLRGHVGPVYMISWSVDSRLIAS

SEQ ID NO: 2292158 - protein, 20 aa, Cryptosporidium parvum
FICHCERCTTSFLNCNDSYI

SEQ ID NO: 2292159 - protein, 18 aa, Cryptosporidium parvum
FICKDLWNFIFLKQADRL

SEQ ID NO: 2292160 - protein, 19 aa, Cryptosporidium parvum
FIDAMSFDLQEYIECKKKA

SEQ ID NO: 2292161 - protein, 17 aa, Cryptosporidium parvum
FIDEIDSIFSKRTSKDD

SEQ ID NO: 2292162 - protein, 17 aa, Cryptosporidium parvum
FIDIRTVGRQALLNYNK

SEQ ID NO: 2292163 - protein, 17 aa, Cryptosporidium parvum
FIDSGILFYEFRLPIIY

SEQ ID NO: 2292164 - protein, 19 aa, Cryptosporidium parvum
FIDTCRINVQYAFPPGSDL

SEQ ID NO: 2292165 - protein, 25 aa, Cryptosporidium parvum
FIEARDWCVLIGPKECIFPKTCYEL

SEQ ID NO: 2292166 - protein, 18 aa, Cryptosporidium parvum
FIEDIIISLPEGFTILGS

SEQ ID NO: 2292167 - protein, 34 aa, Cryptosporidium parvum
FIEDLQVQISYRWFCIHLLPKYYLIIQFSITNKS

SEQ ID NO: 2292168 - protein, 20 aa, Cryptosporidium parvum
FIEEHKRFFLSKFSISHFSD

SEQ ID NO: 2292169 - protein, 28 aa, Cryptosporidium parvum
FIEFRRRYLEEFLRRVFNRGYLISSNLV

SEQ ID NO: 2292170 - protein, 23 aa, Cryptosporidium parvum
FIESLKLPYMNGDVLTIENDLIP

SEQ ID NO: 2292171 - protein, 24 aa, Cryptosporidium parvum
FIFNTCKYGFVRVIHSSISMDLER

SEQ ID NO: 2292172 - protein, 20 aa, Cryptosporidium parvum
FIFPNSILQYSNSRLFLTLL

SEQ ID NO: 2292173 - protein, 17 aa, Cryptosporidium parvum
FIFYSETDDQYVLFSCN

SEQ ID NO: 2292174 - protein, 22 aa, Cryptosporidium parvum
FIGCKYSSIFDKNACIALNDSF

SEQ ID NO: 2292175 - protein, 18 aa, Cryptosporidium parvum
FIGEIPMTASHAEMRKYK

SEQ ID NO: 2292176 - protein, 25 aa, Cryptosporidium parvum
FIGHGLPVHYIWLLSPRTILKTSSG

SEQ ID NO: 2292177 - protein, 25 aa, Cryptosporidium parvum
FIGSYRNPISFNYQCYNSLVYPILG

SEQ ID NO: 2292178 - protein, 20 aa, Cryptosporidium parvum
FIHDICILSDFFKKPTSENN

SEQ ID NO: 2292179 - protein, 17 aa, Cryptosporidium parvum
FIHKNGIIHRDLKPENI

SEQ ID NO: 2292180 - protein, 24 aa, Cryptosporidium parvum
FIIHARKAWLNGINPSKNRTIPKL

SEQ ID NO: 2292181 - protein, 23 aa, Cryptosporidium parvum
FIIKRDIKGPSWLVISKPYQIVP

SEQ ID NO: 2292182 - protein, 17 aa, Cryptosporidium parvum
FIILSCTGIGFSNFARK

SEQ ID NO: 2292183 - protein, 31 aa, Cryptosporidium parvum; identical to SEQ ID NO: 2171070

SEQ ID NO: 2292184 - protein, 21 aa, Cryptosporidium parvum
FIKESINLILIEEFGLDLDLL

SEQ ID NO: 2292185 - protein, 23 aa, Cryptosporidium parvum
FIKKPYLWMQCMDKYNCSVSGAP

SEQ ID NO: 2292186 - protein, 23 aa, Cryptosporidium parvum
FIKSSRRPKKWRFIMSKEEVIIS

SEQ ID NO: 2292187 - protein, 17 aa, Cryptosporidium parvum
FILDRKHALEAVSYSIA

SEQ ID NO: 2292188 - protein, 22 aa, Cryptosporidium parvum
FILRNMDQFIFFGLPFFFPPVL

SEQ ID NO: 2292189 - protein, 24 aa, Cryptosporidium parvum
FIMTNFRIILAPLFQKNINNKALT

SEQ ID NO: 2292190 - protein, 24 aa, Cryptosporidium parvum
FINFWKQRFYRIWQRSLEGGIKFA

SEQ ID NO: 2292191 - protein, 25 aa, Cryptosporidium parvum
FINLPESIWLSGFLDQVNLKDVMLN

SEQ ID NO: 2292192 - protein, 19 aa, Cryptosporidium parvum
FINQFFQALDFHWSNYIHR

SEQ ID NO: 2292193 - protein, 20 aa, Cryptosporidium parvum
FINRRLSLFKTLYEKQCALL

SEQ ID NO: 2292194 - protein, 29 aa, Cryptosporidium parvum
FINSLEFLNELPLEFGNFMISDPNQVFEF

SEQ ID NO: 2292195 - protein, 31 aa, Cryptosporidium parvum
FINVKRPKFVEFFFDSSIPIFFPSRQLIWPT

SEQ ID NO: 2292196 - protein, 17 aa, Cryptosporidium parvum
FIPGITCEFILEDQIIS

SEQ ID NO: 2292197 - protein, 17 aa, Cryptosporidium parvum
FIPLISMLLHPKFDKSR

SEQ ID NO: 2292198 - protein, 20 aa, Cryptosporidium parvum
FIPLKPIGWRKRSFSKENST

SEQ ID NO: 2292199 - protein, 20 aa, Cryptosporidium parvum
FIPPPSKHIVEFLMGDSSIK

SEQ ID NO: 2292200 - protein, 22 aa, Cryptosporidium parvum
FIQPLELCPSIFVLMYDECVPI

SEQ ID NO: 2292201 - protein, 26 aa, Cryptosporidium parvum
FIRDLFLKMHAFEWKYESNSGNYRLK

SEQ ID NO: 2292202 - protein, 17 aa, Cryptosporidium parvum
FIRKKGNIFGMKLAKKD

SEQ ID NO: 2292203 - protein, 19 aa, Cryptosporidium parvum
FIRLWKPLEKIIGYMEKNL

SEQ ID NO: 2292204 - protein, 17 aa, Cryptosporidium parvum
FISESIYIRPDIYHINQ

SEQ ID NO: 2292205 - protein, 19 aa, Cryptosporidium parvum
FISEWRNGYFQLYKESCYI

SEQ ID NO: 2292206 - protein, 17 aa, Cryptosporidium parvum
FISFSVSIGTRIFLFFN

SEQ ID NO: 2292207 - protein, 18 aa, Cryptosporidium parvum
FISIKGFYFQAKILGETI

SEQ ID NO: 2292208 - protein, 25 aa, Cryptosporidium parvum
FISQKCWKYLFGHTGDLLKGQESDD

SEQ ID NO: 2292209 - protein, 28 aa, Cryptosporidium parvum
FISSAIWHPRQPWIFTAGINKDGKPSLI

SEQ ID NO: 2292210 - protein, 18 aa, Cryptosporidium parvum
FISWCNCFSIRDVFQENK

SEQ ID NO: 2292211 - protein, 21 aa, Cryptosporidium parvum
FISYLPRFIRNYFFGQSQSCI

SEQ ID NO: 2292212 - protein, 18 aa, Cryptosporidium parvum
FITKLQNILIYWTNLIHE

SEQ ID NO: 2292213 - protein, 38 aa, Cryptosporidium parvum
FITQEFIRVIPIHLRLYFSRKELRSFLITLYSNKLPII

SEQ ID NO: 2292214 - protein, 34 aa, Cryptosporidium parvum
FITYIKLLLRVSFIKSICLLKMYGKKLPIYLFDG

SEQ ID NO: 2292215 - protein, 21 aa, Cryptosporidium parvum
FIWIHNIRKLLSLVKDYDNNL

SEQ ID NO: 2292216 - protein, 17 aa, Cryptosporidium parvum
FKACSKGDFVAKINDLK

SEQ ID NO: 2292217 - protein, 24 aa, Cryptosporidium parvum
FKAIVSKIPSLRCNHSYSGNSKIL

SEQ ID NO: 2292218 - protein, 34 aa, Cryptosporidium parvum
FKAKLLLRDERLFVSLLLEYMGYKDKIDYQLGLT

SEQ ID NO: 2292219 - protein, 22 aa, Cryptosporidium parvum
FKALINSGKLVFLFQFNGPNGF

SEQ ID NO: 2292220 - protein, 26 aa, Cryptosporidium parvum
FKALVFKPKIGELLICRISHVSPSHV

SEQ ID NO: 2292221 - protein, 17 aa, Cryptosporidium parvum
FKAPNWYKIIKSTNEIS

SEQ ID NO: 2292222 - protein, 17 aa, Cryptosporidium parvum
FKATRFIFEISGNDDDT

SEQ ID NO: 2292223 - protein, 20 aa, Cryptosporidium parvum
FKATSLHGGKMQEVRENSLN

SEQ ID NO: 2292224 - protein, 20 aa, Cryptosporidium parvum
FKAVRDLLYIMVIKQVKLNS

SEQ ID NO: 2292225 - protein, 26 aa, Cryptosporidium parvum
FKCEICGNCSYWGRRAFERHFSETRH

SEQ ID NO: 2292226 - protein, 25 aa, Cryptosporidium parvum
FKDTFGEKIIICGISMGGAIALRLA

SEQ ID NO: 2292227 - protein, 20 aa, Cryptosporidium parvum
FKEERWKKLIPVQVLSKTGN

SEQ ID NO: 2292228 - protein, 19 aa, Cryptosporidium parvum
FKFIRSLSKMWGYSIMEHF

SEQ ID NO: 2292229 - protein, 24 aa, Cryptosporidium parvum
FKGDLKLSPELNVNRLKIVTFNIL

SEQ ID NO: 2292230 - protein, 19 aa, Cryptosporidium parvum
FKGLIKRKKLVNLDFINKY

SEQ ID NO: 2292231 - protein, 20 aa, Cryptosporidium parvum
FKGMIDIRPHIFSMQSNQCP

SEQ ID NO: 2292232 - protein, 20 aa, Cryptosporidium parvum
FKIDQIRSALKHFNLSNRFQ

SEQ ID NO: 2292233 - protein, 18 aa, Cryptosporidium parvum
FKIEGFPIESEKICYNLT

SEQ ID NO: 2292234 - protein, 27 aa, Cryptosporidium parvum
FKILTNNVFRFKVIIAKNLEEAMITGL

SEQ ID NO: 2292235 - protein, 17 aa, Cryptosporidium parvum
FKIPLLIDLNGEVVKIG

SEQ ID NO: 2292236 - protein, 17 aa, Cryptosporidium parvum
FKIRNMLLPLINVIQNL

SEQ ID NO: 2292237 - protein, 17 aa, Cryptosporidium parvum
FKISNKIFETLKLPTSA

SEQ ID NO: 2292238 - protein, 18 aa, Cryptosporidium parvum
FKIYDDMKIELSSYSIND

SEQ ID NO: 2292239 - protein, 17 aa, Cryptosporidium parvum
FKIYFQRFGNIKDAVLI

SEQ ID NO: 2292240 - protein, 23 aa, Cryptosporidium parvum
FKKCNNRLISIKKFVNTILDCIK

SEQ ID NO: 2292241 - protein, 20 aa, Cryptosporidium parvum
FKKGDLLTALVGLENSGNSC

SEQ ID NO: 2292242 - protein, 28 aa, Cryptosporidium parvum
FKKGVLKCLLLKIIRPDRIVTLFNKLIS

SEQ ID NO: 2292243 - protein, 30 aa, Cryptosporidium parvum
FKKIKELKSSLSLFFKSGFNLTDESENRDM

SEQ ID NO: 2292244 - protein, 21 aa, Cryptosporidium parvum
FKKKFYSSNIMKLVIESSLTF

SEQ ID NO: 2292245 - protein, 17 aa, Cryptosporidium parvum
FKKLDLNGIYYSLAKMI

SEQ ID NO: 2292246 - protein, 24 aa, Cryptosporidium parvum
FKKLSDPLLILWIMPNRLLTNRFS

SEQ ID NO: 2292247 - protein, 19 aa, Cryptosporidium parvum
FKKPLLQPFNTIREQISSN

SEQ ID NO: 2292248 - protein, 21 aa, Cryptosporidium parvum
FKKPSTILGTAFCPLPKRNDK

SEQ ID NO: 2292249 - protein, 17 aa, Cryptosporidium parvum
FKKTQGIDLSRDKLALQ

SEQ ID NO: 2292250 - protein, 24 aa, Cryptosporidium parvum
FKKYKKIFMITGVDFDENILLMLA

SEQ ID NO: 2292251 - protein, 17 aa, Cryptosporidium parvum
FKLCKKAPWKSRYLFEI

SEQ ID NO: 2292252 - protein, 18 aa, Cryptosporidium parvum
FKLEMFVSKGVKNKIGHI

SEQ ID NO: 2292253 - protein, 19 aa, Cryptosporidium parvum
FKLGKAYVDDTCVEVMREE

SEQ ID NO: 2292254 - protein, 24 aa, Cryptosporidium parvum
FKLISPKLAEKWYVNKYLELRTMG

SEQ ID NO: 2292255 - protein, 17 aa, Cryptosporidium parvum
FKLITYMKLISNKTKLE

SEQ ID NO: 2292256 - protein, 18 aa, Cryptosporidium parvum
FKLKYKLNTLKGINTNSN

SEQ ID NO: 2292257 - protein, 19 aa, Cryptosporidium parvum
FKLLKQVRDIWKFQDLYRA

SEQ ID NO: 2292258 - protein, 17 aa, Cryptosporidium parvum
FKLLMNHIEKWEVDNTY

SEQ ID NO: 2292259 - protein, 25 aa, Cryptosporidium parvum
FKLLQEVYHSLNFGSILLGINDIPS

SEQ ID NO: 2292260 - protein, 17 aa, Cryptosporidium parvum
FKLMLNIIKEFNNRYDQ

SEQ ID NO: 2292261 - protein, 19 aa, Cryptosporidium parvum
FKLNIPLTFVSTYNTNLGA

SEQ ID NO: 2292262 - protein, 27 aa, Cryptosporidium parvum
FKLNLTDNALLYWREEPTFPDQQPSGC

SEQ ID NO: 2292263 - protein, 18 aa, Cryptosporidium parvum
FKLSIVVNSGQLRSEKSD

SEQ ID NO: 2292264 - protein, 18 aa, Cryptosporidium parvum
FKLTCAKSQTNFVGINLE

SEQ ID NO: 2292265 - protein, 18 aa, Cryptosporidium parvum
FKMYCIKTISCTFGQEFF

SEQ ID NO: 2292266 - protein, 20 aa, Cryptosporidium parvum
FKNFIILKIDQDYNIIESLH

SEQ ID NO: 2292267 - protein, 20 aa, Cryptosporidium parvum
FKNGKLYLRHNSFSDEIPLC

SEQ ID NO: 2292268 - protein, 24 aa, Cryptosporidium parvum
FKNIEIPSSMELYDKLELEEFCGI

SEQ ID NO: 2292269 - protein, 17 aa, Cryptosporidium parvum
FKNIHYFHSNKQGEFII

SEQ ID NO: 2292270 - protein, 26 aa, Cryptosporidium parvum
FKNILSCYKLACIVQHNHISAIKKFL

SEQ ID NO: 2292271 - protein, 18 aa, Cryptosporidium parvum
FKNLLHAKIVNACPHENI

SEQ ID NO: 2292272 - protein, 18 aa, Cryptosporidium parvum
FKNNSYLQEVLKLNEEKK

SEQ ID NO: 2292273 - protein, 19 aa, Cryptosporidium parvum
FKNPLTHFGKDDKIHSMLF

SEQ ID NO: 2292274 - protein, 20 aa, Cryptosporidium parvum
FKPSEFMTPSGIHNGILNDF

SEQ ID NO: 2292275 - protein, 17 aa, Cryptosporidium parvum
FKPYVPHMSTLLGSGIN

SEQ ID NO: 2292276 - protein, 23 aa, Cryptosporidium parvum
FKQCGYIAASLIYRGNLELLRLL

SEQ ID NO: 2292277 - protein, 23 aa, Cryptosporidium parvum
FKRKLELLECTKVVVNKGSSHIK

SEQ ID NO: 2292278 - protein, 27 aa, Cryptosporidium parvum
FKRRLKEIQAEFDWMILVFLSEEQLPS

SEQ ID NO: 2292279 - protein, 28 aa, Cryptosporidium parvum
FKSKETIYCSCEFLDLESFYETERDQVE

SEQ ID NO: 2292280 - protein, 22 aa, Cryptosporidium parvum
FKSKEYFWIKWANFEEKYGNFE

SEQ ID NO: 2292281 - protein, 24 aa, Cryptosporidium parvum
FKSKSIWYRDIKDFDNVYESNLRL

SEQ ID NO: 2292282 - protein, 17 aa, Cryptosporidium parvum
FKSLFRLGINENILQLL

SEQ ID NO: 2292283 - protein, 17 aa, Cryptosporidium parvum
FKSLMVFMKGIKEEPYC

SEQ ID NO: 2292284 - protein, 28 aa, Cryptosporidium parvum
FKSNDYLKLLLLDLRILKKGVSLNNEFL

SEQ ID NO: 2292285 - protein, 19 aa, Cryptosporidium parvum
FKSSSLIINKEEITLGLRS

SEQ ID NO: 2292286 - protein, 17 aa, Cryptosporidium parvum
FKSYQKRTVIGKFNPKF

SEQ ID NO: 2292287 - protein, 19 aa, Cryptosporidium parvum
FKTALKFDKEDLVVLRDLA

SEQ ID NO: 2292288 - protein, 17 aa, Cryptosporidium parvum
FKTFGCGSAIASTSYAT

SEQ ID NO: 2292289 - protein, 25 aa, Cryptosporidium parvum
FKTNSAKVLSTWPPYRWSNNEIFVF

SEQ ID NO: 2292290 - protein, 30 aa, Cryptosporidium parvum; identical to SEQ ID NO: 2171152

SEQ ID NO: 2292291 - protein, 26 aa, Cryptosporidium parvum
FKTTPIPLLSPRVFIHDNIVLDKDLA

SEQ ID NO: 2292292 - protein, 20 aa, Cryptosporidium parvum
FKVGDIIGIGMFKSEPSKQF

SEQ ID NO: 2292293 - protein, 20 aa, Cryptosporidium parvum
FKVSELFLADNLNARLDASI

SEQ ID NO: 2292294 - protein, 17 aa, Cryptosporidium parvum
FKVTPSFHIKDLQVEFP

SEQ ID NO: 2292295 - protein, 21 aa, Cryptosporidium parvum
FKYLILNFSSLYMKKLVQPYY

SEQ ID NO: 2292296 - protein, 22 aa, Cryptosporidium parvum
FKYNDVRESFRLAFLDLVESRG

SEQ ID NO: 2292297 - protein, 25 aa, Cryptosporidium parvum
FLAACGDSICRIFQSNGEFITGTVQ

SEQ ID NO: 2292298 - protein, 17 aa, Cryptosporidium parvum
FLAAIREGSQWGNLTNS

SEQ ID NO: 2292299 - protein, 18 aa, Cryptosporidium parvum
FLADKGLVLVEDFINKLE

SEQ ID NO: 2292300 - protein, 20 aa, Cryptosporidium parvum
FLAQRISSINSFSRLCEATG

SEQ ID NO: 2292301 - protein, 19 aa, Cryptosporidium parvum
FLCAVHDAILRFQIMEAEL

SEQ ID NO: 2292302 - protein, 21 aa, Cryptosporidium parvum
FLCFGEYMYGSGLVLNPKVKW

SEQ ID NO: 2292303 - protein, 24 aa, Cryptosporidium parvum
FLDERPIDVSVIFWDKMSFNADNQ

SEQ ID NO: 2292304 - protein, 19 aa, Cryptosporidium parvum
FLDIKRWIINISKTKENNN

SEQ ID NO: 2292305 - protein, 20 aa, Cryptosporidium parvum
FLDLPSPWIAIKHADQVLQK

SEQ ID NO: 2292306 - protein, 23 aa, Cryptosporidium parvum
FLDNCIFGLVYIKRSNPIIPSLQ

SEQ ID NO: 2292307 - protein, 27 aa, Cryptosporidium parvum
FLDPKRFLSLLKRPSFTSIDLNLILPY

SEQ ID NO: 2292308 - protein, 17 aa, Cryptosporidium parvum
FLDSFSNLRLQGDENLN

SEQ ID NO: 2292309 - protein, 27 aa, Cryptosporidium parvum
FLDVYWKGDITFRISIFHPTELEQIAK

SEQ ID NO: 2292310 - protein, 17 aa, Cryptosporidium parvum
FLEESMNNFMIETMDLF

SEQ ID NO: 2292311 - protein, 28 aa, Cryptosporidium parvum
FLEFCGLQLRPLLPQIQTILVKFLLDPN

SEQ ID NO: 2292312 - protein, 29 aa, Cryptosporidium parvum
FLEGIRCPFCIIGFLVPSPIFKKSEVVEP

SEQ ID NO: 2292313 - protein, 17 aa, Cryptosporidium parvum
FLEIKVWEETRIEKYQH

SEQ ID NO: 2292314 - protein, 19 aa, Cryptosporidium parvum
FLEKCRIKLKSEFKEFSRL

SEQ ID NO: 2292315 - protein, 19 aa, Cryptosporidium parvum
FLEKEISVEYLLKLIDDKK

SEQ ID NO: 2292316 - protein, 19 aa, Cryptosporidium parvum
FLEPVNWKKLGLDDYPDIV

SEQ ID NO: 2292317 - protein, 19 aa, Cryptosporidium parvum
FLEQIRPQIPLIEAASPGA

SEQ ID NO: 2292318 - protein, 17 aa, Cryptosporidium parvum
FLFDLDGTLTLPRKPIM

SEQ ID NO: 2292319 - protein, 21 aa, Cryptosporidium parvum
FLFIQRLSYLPTHSIPIFADK

SEQ ID NO: 2292320 - protein, 21 aa, Cryptosporidium parvum
FLGGPKLGLILSLEIQTIEDD

SEQ ID NO: 2292321 - protein, 17 aa, Cryptosporidium parvum
FLGKLIYHSIEFGCTSE

SEQ ID NO: 2292322 - protein, 17 aa, Cryptosporidium parvum
FLGLNRETFEFVAVKSE

SEQ ID NO: 2292323 - protein, 24 aa, Cryptosporidium parvum
FLGPKLDDGHAFFANSRGGYESQR

SEQ ID NO: 2292324 - protein, 25 aa, Cryptosporidium parvum
FLGSPSRFHGICMANKKGLVLHITL

SEQ ID NO: 2292325 - protein, 27 aa, Cryptosporidium parvum
FLHLKSEQRLLVDFQEFPVMLVDLLNR

SEQ ID NO: 2292326 - protein, 22 aa, Cryptosporidium parvum
FLIDASKFYSLICPSLSSRLIC

SEQ ID NO: 2292327 - protein, 25 aa, Cryptosporidium parvum
FLIIPRKKCLEATSSISLSPKSDPW

SEQ ID NO: 2292328 - protein, 20 aa, Cryptosporidium parvum
FLIKAFGYQMCEDCEFEEKH

SEQ ID NO: 2292329 - protein, 21 aa, Cryptosporidium parvum
FLIKLFSSIISLQFRISSINN

SEQ ID NO: 2292330 - protein, 20 aa, Cryptosporidium parvum
FLINEKYYFFQIQYIKENKL

SEQ ID NO: 2292331 - protein, 20 aa, Cryptosporidium parvum
FLINSSMIKSIFELIFIKIQ

SEQ ID NO: 2292332 - protein, 25 aa, Cryptosporidium parvum
FLIVLDSSLPWTLNDDLVIWIQQIQ

SEQ ID NO: 2292333 - protein, 18 aa, Cryptosporidium parvum
FLKDYCHNSLEVLMKNSR

SEQ ID NO: 2292334 - protein, 17 aa, Cryptosporidium parvum
FLKEMKNRNNGVIGKMT

SEQ ID NO: 2292335 - protein, 19 aa, Cryptosporidium parvum
FLKGILSRKSSWRIRTILF

SEQ ID NO: 2292336 - protein, 23 aa, Cryptosporidium parvum
FLKGVSKERLKILLDLYPTPDEI

SEQ ID NO: 2292337 - protein, 22 aa, Cryptosporidium parvum
FLKKNGRTNMAMIGNKIKRPEG

SEQ ID NO: 2292338 - protein, 21 aa, Cryptosporidium parvum
FLKRDCVNVTLFFNKVLQSRK

SEQ ID NO: 2292339 - protein, 20 aa, Cryptosporidium parvum
FLKREQCCVEDFPIGSLRSD

SEQ ID NO: 2292340 - protein, 18 aa, Cryptosporidium parvum
FLLFRVHKLIIYLYYFEC

SEQ ID NO: 2292341 - protein, 18 aa, Cryptosporidium parvum
FLLGKIVFLDSIYYKLKL

SEQ ID NO: 2292342 - protein, 17 aa, Cryptosporidium parvum
FLLHKWDAPMNYSPETS

SEQ ID NO: 2292343 - protein, 27 aa, Cryptosporidium parvum
FLLLKLWCIRWKIWNHLKVNDQFRLSG

SEQ ID NO: 2292344 - protein, 17 aa, Cryptosporidium parvum
FLLRAVLVLLSLNKTQF

SEQ ID NO: 2292345 - protein, 25 aa, Cryptosporidium parvum
FLLSTRAGGIGINLATADVVILFDS

SEQ ID NO: 2292346 - protein, 24 aa, Cryptosporidium parvum
FLLSTRAGGLGINLATADIVILYD

SEQ ID NO: 2292347 - protein, 24 aa, Cryptosporidium parvum
FLLSTRAGGLGINLTSADTVIIFD

SEQ ID NO: 2292348 - protein, 24 aa, Cryptosporidium parvum
FLNIKPRVKPLMYCYEKEIVLYAH

SEQ ID NO: 2292349 - protein, 25 aa, Cryptosporidium parvum
FLNKLIIQKCCDKLVSAKEFICNEF

SEQ ID NO: 2292350 - protein, 25 aa, Cryptosporidium parvum
FLNKNETAFDCYFSSDLYIQEESEN

SEQ ID NO: 2292351 - protein, 17 aa, Cryptosporidium parvum
FLNKSECTIDDVNGNHE

SEQ ID NO: 2292352 - protein, 17 aa, Cryptosporidium parvum
FLNLLKRYYKEIYDDFS

SEQ ID NO: 2292353 - protein, 25 aa, Cryptosporidium parvum
FLNLSKDCIREVYNHKEIHTPNETV

SEQ ID NO: 2292354 - protein, 26 aa, Cryptosporidium parvum
FLNNKIEMLKILAANFGATQEDIEAT

SEQ ID NO: 2292355 - protein, 19 aa, Cryptosporidium parvum
FLNNLFLPSINTRNPGIRI

SEQ ID NO: 2292356 - protein, 17 aa, Cryptosporidium parvum
FLNNTLCMMDLMIIPLK

SEQ ID NO: 2292357 - protein, 32 aa, Cryptosporidium parvum
FLNNWKNCRKLLLKRKKLWITQKEKTELEISL

SEQ ID NO: 2292358 - protein, 20 aa, Cryptosporidium parvum
FLNSNLWNILSVFISQIVII

SEQ ID NO: 2292359 - protein, 23 aa, Cryptosporidium parvum
FLPEELRLQIPQNDCEYAAAFVK

SEQ ID NO: 2292360 - protein, 25 aa, Cryptosporidium parvum
FLPEMLQQLLMDFEYIIPIFVIYRI

SEQ ID NO: 2292361 - protein, 27 aa, Cryptosporidium parvum
FLPIDLCASTSISVCKVRIMKDKNYVN

SEQ ID NO: 2292362 - protein, 17 aa, Cryptosporidium parvum
FLQWMKGLFDESGAIDR

SEQ ID NO: 2292363 - protein, 22 aa, Cryptosporidium parvum
FLRDCFLSCNLHKIITPSGTAY

SEQ ID NO: 2292364 - protein, 19 aa, Cryptosporidium parvum
FLRETDVHCLIVGKEKVME

SEQ ID NO: 2292365 - protein, 18 aa, Cryptosporidium parvum
FLRFMPRSFSIKKISLSP

SEQ ID NO: 2292366 - protein, 26 aa, Cryptosporidium parvum
FLRKGEGKIKAFKLANLEKFDSKLSS

SEQ ID NO: 2292367 - protein, 22 aa, Cryptosporidium parvum
FLRKYINKWPEFNAKSFNSDNF

SEQ ID NO: 2292368 - protein, 21 aa, Cryptosporidium parvum
FLRLLEICDILNITSLDELSD

SEQ ID NO: 2292369 - protein, 21 aa, Cryptosporidium parvum
FLRNCELNREVGWREVENTDL

SEQ ID NO: 2292370 - protein, 17 aa, Cryptosporidium parvum
FLRNKPRNLLRHQTQNI

SEQ ID NO: 2292371 - protein, 24 aa, Cryptosporidium parvum
FLRSLWLISRFDWEKKPLIVDFDF

SEQ ID NO: 2292372 - protein, 18 aa, Cryptosporidium parvum
FLSAIKMLWKEGREQSFE

SEQ ID NO: 2292373 - protein, 24 aa, Cryptosporidium parvum
FLSDEASQFGTWVFQLVESSKNDY

SEQ ID NO: 2292374 - protein, 22 aa, Cryptosporidium parvum
FLSEDYKKLAFLMTDRVIEFHS

SEQ ID NO: 2292375 - protein, 17 aa, Cryptosporidium parvum
FLSFRFELEDEFDSCNK

SEQ ID NO: 2292376 - protein, 24 aa, Cryptosporidium parvum
FLSKFRFRILPSIPESSKLSKDSI

SEQ ID NO: 2292377 - protein, 18 aa, Cryptosporidium parvum
FLSNPFMNPFGLQVPPIL

SEQ ID NO: 2292378 - protein, 23 aa, Cryptosporidium parvum
FLSQLLSFFNMRAIAIVGNSEAA

SEQ ID NO: 2292379 - protein, 23 aa, Cryptosporidium parvum
FLSSAPRPDRFVFEDEDNDNSDI

SEQ ID NO: 2292380 - protein, 22 aa, Cryptosporidium parvum
FLTLELRKQWIQYFKDNAPNLK

SEQ ID NO: 2292381 - protein, 24 aa, Cryptosporidium parvum
FLVDLRLSYESCGIYDSKFKYLIL

SEQ ID NO: 2292382 - protein, 17 aa, Cryptosporidium parvum
FLVDSALSFIKSTINDK

SEQ ID NO: 2292383 - protein, 24 aa, Cryptosporidium parvum
FLVRELVMLFILLRPTIHKERLDS

SEQ ID NO: 2292384 - protein, 17 aa, Cryptosporidium parvum
FLVTKTFMRMDSACVQS

SEQ ID NO: 2292385 - protein, 24 aa, Cryptosporidium parvum
FLWYYEYINLLTIRNELEISKKRR

SEQ ID NO: 2292386 - protein, 26 aa, Cryptosporidium parvum
FLYCIMGEISIELIINQVCEQAKKYR

SEQ ID NO: 2292387 - protein, 20 aa, Cryptosporidium parvum
FLYRTCYRLTINNYGGMLYC

SEQ ID NO: 2292388 - protein, 17 aa, Cryptosporidium parvum
FLYSNCDAYAGEFQMSK

SEQ ID NO: 2292389 - protein, 25 aa, Cryptosporidium parvum
FMASCGYFAATFCPQQNYSSHKVFV

SEQ ID NO: 2292390 - protein, 24 aa, Cryptosporidium parvum
FMCSASVPEVLVERDAVLSSFGTV

SEQ ID NO: 2292391 - protein, 21 aa, Cryptosporidium parvum
FMCVASRAGRSVVLRRKEDDY

SEQ ID NO: 2292392 - protein, 17 aa, Cryptosporidium parvum
FMDPWNMQGHPYPAYAP

SEQ ID NO: 2292393 - protein, 34 aa, Cryptosporidium parvum
FMINKRLLFTLVRLKLWIVEEILYDEEILDGSQL

SEQ ID NO: 2292394 - protein, 18 aa, Cryptosporidium parvum
FMKFYSLKLPMKLANEFS

SEQ ID NO: 2292395 - protein, 19 aa, Cryptosporidium parvum
FMKRERLGIRTSTDDLLSS

SEQ ID NO: 2292396 - protein, 19 aa, Cryptosporidium parvum
FMLKSFIKKQMSIRKDSYY

SEQ ID NO: 2292397 - protein, 17 aa, Cryptosporidium parvum
FMLRRLKADVERDLPPK

SEQ ID NO: 2292398 - protein, 29 aa, Cryptosporidium parvum
FMNGFSPKSQWKFICRFRSCFNKGDTAML

SEQ ID NO: 2292399 - protein, 23 aa, Cryptosporidium parvum
FMRTKAYWLNLIMKEEMGRISDG

SEQ ID NO: 2292400 - protein, 19 aa, Cryptosporidium parvum
FMSRCFSDGLMFARSNLSQ

SEQ ID NO: 2292401 - protein, 18 aa, Cryptosporidium parvum
FMSRRALGGHPFGGSMAY

SEQ ID NO: 2292402 - protein, 19 aa, Cryptosporidium parvum
FMSTPRKKQVMMFSATMTK

SEQ ID NO: 2292403 - protein, 17 aa, Cryptosporidium parvum
FMTPSGIHNGILNDFNN

SEQ ID NO: 2292404 - protein, 21 aa, Cryptosporidium parvum
FMTSRCLKASLMVFVKNPGFQ

SEQ ID NO: 2292405 - protein, 27 aa, Cryptosporidium parvum
FNAEEWKPISLNAICELLSSKDFKDTI

SEQ ID NO: 2292406 - protein, 17 aa, Cryptosporidium parvum
FNAFSYIGINSFKIMCV

SEQ ID NO: 2292407 - protein, 25 aa, Cryptosporidium parvum
FNAHEGVSIGCQWHPVFPSRIASCG

SEQ ID NO: 2292408 - protein, 18 aa, Cryptosporidium parvum
FNALTVAFASRFKTQIVD

SEQ ID NO: 2292409 - protein, 17 aa, Cryptosporidium parvum
FNCFAARAKFYFENTFL

SEQ ID NO: 2292410 - protein, 19 aa, Cryptosporidium parvum
FNDEIKKIFEIDNWFNNYP

SEQ ID NO: 2292411 - protein, 20 aa, Cryptosporidium parvum
FNDFCLLLDSFMKYFTSITL

SEQ ID NO: 2292412 - protein, 18 aa, Cryptosporidium parvum
FNDGFSLSTGNLHRTRSH

SEQ ID NO: 2292413 - protein, 20 aa, Cryptosporidium parvum
FNDKLVREFSESSEFTEYHT

SEQ ID NO: 2292414 - protein, 25 aa, Cryptosporidium parvum
FNEDFRFCRMNKLYKYALRTKMSDL

SEQ ID NO: 2292415 - protein, 17 aa, Cryptosporidium parvum
FNFKEIIKKLSLNSIKL

SEQ ID NO: 2292416 - protein, 21 aa, Cryptosporidium parvum
FNFLISESFLKPENEFKFVLL

SEQ ID NO: 2292417 - protein, 19 aa, Cryptosporidium parvum
FNGILLKASFLGKTDIIKS

SEQ ID NO: 2292418 - protein, 30 aa, Cryptosporidium parvum
FNGIPDMFNRSGSPSFQGLDPAMWQMVTTI

SEQ ID NO: 2292419 - protein, 19 aa, Cryptosporidium parvum
FNGKCLFYGALFNLSNRIF

SEQ ID NO: 2292420 - protein, 18 aa, Cryptosporidium parvum
FNGMSIVVTGTFNNNSRQ

SEQ ID NO: 2292421 - protein, 18 aa, Cryptosporidium parvum
FNGMVPGIIGSGIGGGCL

SEQ ID NO: 2292422 - protein, 20 aa, Cryptosporidium parvum
FNGNCKLLLEYIPFSEPEDI

SEQ ID NO: 2292423 - protein, 17 aa, Cryptosporidium parvum
FNHCYCTSFYNIIPKYI

SEQ ID NO: 2292424 - protein, 24 aa, Cryptosporidium parvum
FNIAHYRFTLGLLNMAQDDPVTAS

SEQ ID NO: 2292425 - protein, 17 aa, Cryptosporidium parvum
FNIDDLVVWKYSNPYYT

SEQ ID NO: 2292426 - protein, 20 aa, Cryptosporidium parvum
FNIEVNWDPSNGLIFGGNIH

SEQ ID NO: 2292427 - protein, 24 aa, Cryptosporidium parvum
FNIHPGDIFGCAGDIGWITGHSYL

SEQ ID NO: 2292428 - protein, 21 aa, Cryptosporidium parvum
FNIICTQNLFIWGRNDKGQLG

SEQ ID NO: 2292429 - protein, 32 aa, Cryptosporidium parvum
FNIIEFFKQKIIPRIVPNIFYLSKNTSEETVH

SEQ ID NO: 2292430 - protein, 17 aa, Cryptosporidium parvum
FNIKYKYIVLESNLIPL

SEQ ID NO: 2292431 - protein, 18 aa, Cryptosporidium parvum
FNIMYLWGNFTVHEQTGG

SEQ ID NO: 2292432 - protein, 23 aa, Cryptosporidium parvum
FNIQLDCLYLFSPDYDGSPPLYV

SEQ ID NO: 2292433 - protein, 18 aa, Cryptosporidium parvum
FNITRIKRCCQIMGRQEN

SEQ ID NO: 2292434 - protein, 21 aa, Cryptosporidium parvum
FNIWKKLYMIEKFHRMKLLKQ

SEQ ID NO: 2292435 - protein, 25 aa, Cryptosporidium parvum
FNIYRYPLIFVYNYKKRKCFFAHLT

SEQ ID NO: 2292436 - protein, 26 aa, Cryptosporidium parvum
FNKEICMDCCKNLCKYNTIPVRCHFC

SEQ ID NO: 2292437 - protein, 18 aa, Cryptosporidium parvum
FNKNSCIISTKIYLSKQT

SEQ ID NO: 2292438 - protein, 23 aa, Cryptosporidium parvum
FNKRCEYCKVLSTSLSKMNFSTI

SEQ ID NO: 2292439 - protein, 32 aa, Cryptosporidium parvum
FNKTFKSMECKKCGYEWKKINVENDYRDLNSK

SEQ ID NO: 2292440 - protein, 23 aa, Cryptosporidium parvum
FNKYPCLEFQLDLAQSDLDLLVR

SEQ ID NO: 2292441 - protein, 17 aa, Cryptosporidium parvum
FNLCNRYRNPTIAHVEE

SEQ ID NO: 2292442 - protein, 17 aa, Cryptosporidium parvum
FNLDLIKLHALTPRTNN

SEQ ID NO: 2292443 - protein, 26 aa, Cryptosporidium parvum
FNLEFKPKCVLPLLIGDFTLYRVLQK

SEQ ID NO: 2292444 - protein, 17 aa, Cryptosporidium parvum
FNLELLLREILRNERFN

SEQ ID NO: 2292445 - protein, 19 aa, Cryptosporidium parvum
FNLQSCIHSGQLILPDNSE

SEQ ID NO: 2292446 - protein, 22 aa, Cryptosporidium parvum
FNLSRYWQYDVEVLQKVSEKSD

SEQ ID NO: 2292447 - protein, 17 aa, Cryptosporidium parvum
FNLSSALALSAGVLPQH

SEQ ID NO: 2292448 - protein, 17 aa, Cryptosporidium parvum
FNNAFCSESEFGKETSC

SEQ ID NO: 2292449 - protein, 17 aa, Cryptosporidium parvum
FNNAKGIVFSGGPSSVY

SEQ ID NO: 2292450 - protein, 21 aa, Cryptosporidium parvum
FNNFENFEWAFASPPWGGYSY

SEQ ID NO: 2292451 - protein, 18 aa, Cryptosporidium parvum
FNNICNTCGLPLSTESKC

SEQ ID NO: 2292452 - protein, 19 aa, Cryptosporidium parvum
FNNIIDPFLWLKTPDLFNI

SEQ ID NO: 2292453 - protein, 20 aa, Cryptosporidium parvum
FNNITLELTITVSNEPKNNG

SEQ ID NO: 2292454 - protein, 25 aa, Cryptosporidium parvum
FNNNFNFRINVQWHSVYVDGWPHII

SEQ ID NO: 2292455 - protein, 24 aa, Cryptosporidium parvum
FNNSLSRLGQAYVELNETKQSLKD

SEQ ID NO: 2292456 - protein, 22 aa, Cryptosporidium parvum
FNPKPGFFQKLIHSRDSKTLKE

SEQ ID NO: 2292457 - protein, 24 aa, Cryptosporidium parvum
FNPKWENLSPFTFNVLCPEISIIN

SEQ ID NO: 2292458 - protein, 22 aa, Cryptosporidium parvum
FNQFLRCDSVLYLLVYPQKPLC

SEQ ID NO: 2292459 - protein, 28 aa, Cryptosporidium parvum
FNQIRKTEIFWKFFLENLKVDMMNKTNF

SEQ ID NO: 2292460 - protein, 19 aa, Cryptosporidium parvum
FNQLILKYRGLRNGEISKV

SEQ ID NO: 2292461 - protein, 20 aa, Cryptosporidium parvum
FNRLRRCINPITNNEITTTK

SEQ ID NO: 2292462 - protein, 18 aa, Cryptosporidium parvum
FNSAINWVGNKTILEAEI

SEQ ID NO: 2292463 - protein, 35 aa, Cryptosporidium parvum
FNSESKLCQRRMNWRWKGDVFPISKGEMERMINHI

SEQ ID NO: 2292464 - protein, 18 aa, Cryptosporidium parvum
FNSFFSTAHWKEVNSGEV

SEQ ID NO: 2292465 - protein, 24 aa, Cryptosporidium parvum
FNSKMSIIICLLKNSKIAIYDIIN

SEQ ID NO: 2292466 - protein, 25 aa, Cryptosporidium parvum
FNSREFKIAIALAENCQLPVFITLR

SEQ ID NO: 2292467 - protein, 25 aa, Cryptosporidium parvum
FNSRTDPRFKPLIRKEHKVKIDKRF

SEQ ID NO: 2292468 - protein, 25 aa, Cryptosporidium parvum
FNSSAFPPLTSALIKQIPSSKDSTK

SEQ ID NO: 2292469 - protein, 18 aa, Cryptosporidium parvum
FNSTLSFKRNDPDLKISK

SEQ ID NO: 2292470 - protein, 20 aa, Cryptosporidium parvum
FNSVGGAFCASREIPIQRWN

SEQ ID NO: 2292471 - protein, 25 aa, Cryptosporidium parvum
FNTLIASFWLFEGFLSLKNGGNLDE

SEQ ID NO: 2292472 - protein, 26 aa, Cryptosporidium parvum
FNTLLPKGIVDFVALLPPSNIPTSSI

SEQ ID NO: 2292473 - protein, 26 aa, Cryptosporidium parvum
FNTRWKCPLCYQIIRPGMLKIDSFVK

SEQ ID NO: 2292474 - protein, 21 aa, Cryptosporidium parvum
FNVECNDVYFGVPTVIVKFLL

SEQ ID NO: 2292475 - protein, 26 aa, Cryptosporidium parvum
FNVIPGELSIPVMVIPVEMKKLNCNE

SEQ ID NO: 2292476 - protein, 17 aa, Cryptosporidium parvum
FNVLCPEISIINFEVKS

SEQ ID NO: 2292477 - protein, 19 aa, Cryptosporidium parvum
FNYECLSSIDILNAHAEVD

SEQ ID NO: 2292478 - protein, 23 aa, Cryptosporidium parvum
FNYERLKFVLNWYNKNCINTIEL

SEQ ID NO: 2292479 - protein, 20 aa, Cryptosporidium parvum
FNYKALSVTLEHLFEQQSST

SEQ ID NO: 2292480 - protein, 23 aa, Cryptosporidium parvum
FNYKVKYSWIAVHGIHTKQLLLK

SEQ ID NO: 2292481 - protein, 26 aa, Cryptosporidium parvum
FNYNLNHLFCLANLTGVKINLRSIHK

SEQ ID NO: 2292482 - protein, 17 aa, Cryptosporidium parvum
FPAFFAVFTREFENAVV

SEQ ID NO: 2292483 - protein, 23 aa, Cryptosporidium parvum
FPASEAFQLYSTYGFPMDLTELM

SEQ ID NO: 2292484 - protein, 26 aa, Cryptosporidium parvum
FPCNVPKWIAQQVWFKCSFLSNETDK

SEQ ID NO: 2292485 - protein, 30 aa, Cryptosporidium parvum; identical to SEQ ID NO: 2171315

SEQ ID NO: 2292486 - protein, 20 aa, Cryptosporidium parvum
FPDLAPLMWHSFGCITALLQ

SEQ ID NO: 2292487 - protein, 20 aa, Cryptosporidium parvum
FPDSRLVGRVDILSESALKH

SEQ ID NO: 2292488 - protein, 22 aa, Cryptosporidium parvum
FPESLLPINGVPIINYIIEMLL

SEQ ID NO: 2292489 - protein, 21 aa, Cryptosporidium parvum
FPEVVELLLSSGADLSLGLPH

SEQ ID NO: 2292490 - protein, 18 aa, Cryptosporidium parvum
FPFEILVSKISNLIEHPV

SEQ ID NO: 2292491 - protein, 20 aa, Cryptosporidium parvum
FPGPPACRPIFDENNKKHLR

SEQ ID NO: 2292492 - protein, 25 aa, Cryptosporidium parvum
FPGTIDRIRRWFGLYKAVENKDVAK

SEQ ID NO: 2292493 - protein, 17 aa, Cryptosporidium parvum
FPHTCYVVAGTQANMED

SEQ ID NO: 2292494 - protein, 43 aa, Cryptosporidium parvum
FPIKQPIIEFTWFYNKIASFDVDRKHILSFNKKWEKPSKYHKI

SEQ ID NO: 2292495 - protein, 20 aa, Cryptosporidium parvum
FPITLAPSISSISCRLFINE

SEQ ID NO: 2292496 - protein, 21 aa, Cryptosporidium parvum
FPKEPIVLLIQSMVRLEELKT

SEQ ID NO: 2292497 - protein, 18 aa, Cryptosporidium parvum
FPKISEFCFTELNNIIPI

SEQ ID NO: 2292498 - protein, 25 aa, Cryptosporidium parvum
FPKKDECYCCFWKKNPYKYRMTLPF

SEQ ID NO: 2292499 - protein, 20 aa, Cryptosporidium parvum
FPKLQSVSFDNLFKLNTPLQ

SEQ ID NO: 2292500 - protein, 19 aa, Cryptosporidium parvum
FPKQAEKLLGIFKGGHHFL

SEQ ID NO: 2292501 - protein, 21 aa, Cryptosporidium parvum
FPKTCYELRELLNKKGIKLKS

SEQ ID NO: 2292502 - protein, 17 aa, Cryptosporidium parvum
FPLLNEIKQLYIDAYSG

SEQ ID NO: 2292503 - protein, 19 aa, Cryptosporidium parvum
FPLMIYGINLVRPIRKLSG

SEQ ID NO: 2292504 - protein, 17 aa, Cryptosporidium parvum
FPLPNIVQQFLPSIVQL

SEQ ID NO: 2292505 - protein, 19 aa, Cryptosporidium parvum
FPLSPKLFVHRTGRTARAG

SEQ ID NO: 2292506 - protein, 17 aa, Cryptosporidium parvum
FPNEFLYLNIPIYDTPF

SEQ ID NO: 2292507 - protein, 25 aa, Cryptosporidium parvum
FPNIKEMCGSISFVDNIGIFGNTTT

SEQ ID NO: 2292508 - protein, 20 aa, Cryptosporidium parvum
FPNLNLLKTLVFKKGAFTHQ

SEQ ID NO: 2292509 - protein, 17 aa, Cryptosporidium parvum
FPPNGSAPMSMGSGAFA

SEQ ID NO: 2292510 - protein, 20 aa, Cryptosporidium parvum
FPQNVCERLRLLFNSQSGKL

SEQ ID NO: 2292511 - protein, 17 aa, Cryptosporidium parvum
FPQVKWQFVRRNVSSEN

SEQ ID NO: 2292512 - protein, 21 aa, Cryptosporidium parvum
FPRKFMAENAIMFLDKKYIFD

SEQ ID NO: 2292513 - protein, 21 aa, Cryptosporidium parvum
FPRLDEIHPFYSDLCNVLYDR

SEQ ID NO: 2292514 - protein, 17 aa, Cryptosporidium parvum
FPSALLKLRESVLSLSR

SEQ ID NO: 2292515 - protein, 17 aa, Cryptosporidium parvum
FPSKLLFVKPNFRKQLP

SEQ ID NO: 2292516 - protein, 27 aa, Cryptosporidium parvum
FPSLNTFYTYCTWKNPIGTAYFNKSHV

SEQ ID NO: 2292517 - protein, 17 aa, Cryptosporidium parvum
FPTELKPIISNKSKLVG

SEQ ID NO: 2292518 - protein, 29 aa, Cryptosporidium parvum
FPTNLRLKYMQIYIMGGYAKKHFHNKEQN

SEQ ID NO: 2292519 - protein, 17 aa, Cryptosporidium parvum
FPTPVNRSISNGSNPIL

SEQ ID NO: 2292520 - protein, 17 aa, Cryptosporidium parvum
FPTQIFWISCKSIKCFM

SEQ ID NO: 2292521 - protein, 17 aa, Cryptosporidium parvum
FPVDEVFINDGFKKFID

SEQ ID NO: 2292522 - protein, 17 aa, Cryptosporidium parvum
FPVECIDIINGNKLISC

SEQ ID NO: 2292523 - protein, 20 aa, Cryptosporidium parvum
FPVMGEQSVTMMINEEAQTV

SEQ ID NO: 2292524 - protein, 22 aa, Cryptosporidium parvum
FPVPMKKFGTLYSREGVGHVVT

SEQ ID NO: 2292525 - protein, 27 aa, Cryptosporidium parvum
FQALKILSNAFIKLSSRYDQLKEKSSK

SEQ ID NO: 2292526 - protein, 17 aa, Cryptosporidium parvum
FQCSISSCVIQNELSWY

SEQ ID NO: 2292527 - protein, 17 aa, Cryptosporidium parvum
FQDHSWKQLKCYIEEAK

SEQ ID NO: 2292528 - protein, 23 aa, Cryptosporidium parvum
FQDYEIRGILNLNPFLSSNVDEV

SEQ ID NO: 2292529 - protein, 23 aa, Cryptosporidium parvum
FQEFPVMLVDLLNRSKGNGFSES

SEQ ID NO: 2292530 - protein, 18 aa, Cryptosporidium parvum
FQEISGTINIVMSNSDEI

SEQ ID NO: 2292531 - protein, 41 aa, Cryptosporidium parvum
FQEKYRIFDLSLFIKMILILRFEVKLIRICNNKGGVDNNGQ

SEQ ID NO: 2292532 - protein, 25 aa, Cryptosporidium parvum
FQEPPRSGLYCDILWADPIDEKDET

SEQ ID NO: 2292533 - protein, 20 aa, Cryptosporidium parvum
FQGKELHWLIDIKVVCLSYD

SEQ ID NO: 2292534 - protein, 23 aa, Cryptosporidium parvum
FQGRKSRTGYNRFLNDDEVENVV

SEQ ID NO: 2292535 - protein, 21 aa, Cryptosporidium parvum
FQGTISFLILHWDDLFFELFE

SEQ ID NO: 2292536 - protein, 22 aa, Cryptosporidium parvum
FQHTHLYGRHLIIEVAENDDDS

SEQ ID NO: 2292537 - protein, 18 aa, Cryptosporidium parvum
FQIGELVWVNYKCTFWPA

SEQ ID NO: 2292538 - protein, 20 aa, Cryptosporidium parvum
FQIQAAYWWYEDMWYDKYSH

SEQ ID NO: 2292539 - protein, 17 aa, Cryptosporidium parvum
FQIRFILVLLQGNILEH

SEQ ID NO: 2292540 - protein, 19 aa, Cryptosporidium parvum
FQISKNVYDSYGVFMASCG

SEQ ID NO: 2292541 - protein, 27 aa, Cryptosporidium parvum
FQISRIRSFYMRKVKFCQQAIHDRLGM

SEQ ID NO: 2292542 - protein, 17 aa, Cryptosporidium parvum
FQKGSILATKFKKELEA

SEQ ID NO: 2292543 - protein, 19 aa, Cryptosporidium parvum
FQKKFLCYIYILKLISKRI

SEQ ID NO: 2292544 - protein, 17 aa, Cryptosporidium parvum
FQLGVGFGRLKQIFGSF

SEQ ID NO: 2292545 - protein, 19 aa, Cryptosporidium parvum
FQLIPSHFNFQEWIEETIL

SEQ ID NO: 2292546 - protein, 19 aa, Cryptosporidium parvum
FQLKVSICEVYMERIRDLL

SEQ ID NO: 2292547 - protein, 18 aa, Cryptosporidium parvum
FQLLEDILFQYALSRSRY

SEQ ID NO: 2292548 - protein, 22 aa, Cryptosporidium parvum
FQLLIRQMELVQAKLQYQQEAW

SEQ ID NO: 2292549 - protein, 21 aa, Cryptosporidium parvum
FQLSKLRIKNFQGFSNDYFKK

SEQ ID NO: 2292550 - protein, 23 aa, Cryptosporidium parvum
FQMEYCLCFDPAIVKGMQVCQVS

SEQ ID NO: 2292551 - protein, 20 aa, Cryptosporidium parvum
FQNGLPLVAGGGLLGQNGGI

SEQ ID NO: 2292552 - protein, 26 aa, Cryptosporidium parvum
FQRKSGSAYPFWDLKIINVISSSERK

SEQ ID NO: 2292553 - protein, 18 aa, Cryptosporidium parvum
FQRLPPAIRRRSMSYNVY

SEQ ID NO: 2292554 - protein, 25 aa, Cryptosporidium parvum
FQRPEHYIRFPVHKEFVSGIRLEDG

SEQ ID NO: 2292555 - protein, 20 aa, Cryptosporidium parvum
FQSDELLDEFTIGNSINDHR

SEQ ID NO: 2292556 - protein, 18 aa, Cryptosporidium parvum
FQTTSKWIAKHSKGKEGL

SEQ ID NO: 2292557 - protein, 26 aa, Cryptosporidium parvum
FQVSYLIFIHGWKLAFLTVSPMSKLF

SEQ ID NO: 2292558 - protein, 21 aa, Cryptosporidium parvum
FQYALSRSRYESCMNPGNDNS

SEQ ID NO: 2292559 - protein, 18 aa, Cryptosporidium parvum
FQYKALRYLQIHDIPNMT

SEQ ID NO: 2292560 - protein, 25 aa, Cryptosporidium parvum
FQYVECCEFYKKAADMFDMDEYSKT

SEQ ID NO: 2292561 - protein, 18 aa, Cryptosporidium parvum
FRATYILPTSPHFSDSDE

SEQ ID NO: 2292562 - protein, 18 aa, Cryptosporidium parvum
FRCDVCKKDTWDYRIRCA

SEQ ID NO: 2292563 - protein, 18 aa, Cryptosporidium parvum
FRDGYMIATGQPFRDFVD

SEQ ID NO: 2292564 - protein, 27 aa, Cryptosporidium parvum
FRDSHHLLEKREFIIVDIVDHLLTKNH

SEQ ID NO: 2292565 - protein, 22 aa, Cryptosporidium parvum
FRDVIKRNQLYAFRLLQYQARI

SEQ ID NO: 2292566 - protein, 17 aa, Cryptosporidium parvum
FRDYVEAMLQIGRNFSL

SEQ ID NO: 2292567 - protein, 17 aa, Cryptosporidium parvum
FREEFIYSLVKRKIDRF

SEQ ID NO: 2292568 - protein, 30 aa, Cryptosporidium parvum; identical to SEQ ID NO: 2171402

SEQ ID NO: 2292569 - protein, 26 aa, Cryptosporidium parvum
FRESVEYRYKVMYQLADSIRFLHSLS

SEQ ID NO: 2292570 - protein, 17 aa, Cryptosporidium parvum
FRFKSMTSLLCKPLSQQ

SEQ ID NO: 2292571 - protein, 17 aa, Cryptosporidium parvum
FRFLRLIQDKKYCDKPI

SEQ ID NO: 2292572 - protein, 24 aa, Cryptosporidium parvum
FRFNYSKEFLRWALCVPGQKKNWL

SEQ ID NO: 2292573 - protein, 17 aa, Cryptosporidium parvum
FRHGEGILTVNGKQKRV

SEQ ID NO: 2292574 - protein, 28 aa, Cryptosporidium parvum
FRILGRYNPLFFRPRIRSAVEEYQSILL

SEQ ID NO: 2292575 - protein, 17 aa, Cryptosporidium parvum
FRIPITAPFRKLIRYFR

SEQ ID NO: 2292576 - protein, 27 aa, Cryptosporidium parvum
FRKARQNSPCIIFFDEIDAIGVNRESM

SEQ ID NO: 2292577 - protein, 19 aa, Cryptosporidium parvum
FRKGYLEPIVMKKGYCGNY

SEQ ID NO: 2292578 - protein, 24 aa, Cryptosporidium parvum
FRKKKHWHISELNAYISPVLQPSI

SEQ ID NO: 2292579 - protein, 19 aa, Cryptosporidium parvum
FRKLIRYFRDVAAIHEGII

SEQ ID NO: 2292580 - protein, 21 aa, Cryptosporidium parvum
FRKSIWFPIVDIPLRYEKVSS

SEQ ID NO: 2292581 - protein, 17 aa, Cryptosporidium parvum
FRKVIEIEPGFYEAHLL

SEQ ID NO: 2292582 - protein, 20 aa, Cryptosporidium parvum
FRLICKKYGCDLGYSPMYHS

SEQ ID NO: 2292583 - protein, 20 aa, Cryptosporidium parvum
FRLIDEFYPILICKKNDYNL

SEQ ID NO: 2292584 - protein, 18 aa, Cryptosporidium parvum
FRLPIKKESGHISSDNLK

SEQ ID NO: 2292585 - protein, 19 aa, Cryptosporidium parvum
FRLQVPMGSILASLRSQDC

SEQ ID NO: 2292586 - protein, 21 aa, Cryptosporidium parvum
FRLVKYEFNEFQAIEKKKKER

SEQ ID NO: 2292587 - protein, 35 aa, Cryptosporidium parvum; identical to SEQ ID NO: 2171426

SEQ ID NO: 2292588 - protein, 32 aa, Cryptosporidium parvum; identical to SEQ ID NO: 2171428

SEQ ID NO: 2292589 - protein, 20 aa, Cryptosporidium parvum
FRPERIVQIADRFNLNASDC

SEQ ID NO: 2292590 - protein, 19 aa, Cryptosporidium parvum
FRPIFDRVLVQRIHPKAVT

SEQ ID NO: 2292591 - protein, 18 aa, Cryptosporidium parvum
FRQPMIPGVSCWNGSDGI

SEQ ID NO: 2292592 - protein, 19 aa, Cryptosporidium parvum
FRQTIMISACRIEDINSLF

SEQ ID NO: 2292593 - protein, 18 aa, Cryptosporidium parvum
FRRAIGLRIRDVKEVYEG

SEQ ID NO: 2292594 - protein, 21 aa, Cryptosporidium parvum
FRRFMNFDWFTSMFSSRRRGT

SEQ ID NO: 2292595 - protein, 21 aa, Cryptosporidium parvum
FRRLARMKILRLSRDDEIQLG

SEQ ID NO: 2292596 - protein, 17 aa, Cryptosporidium parvum
FRSEPYKKLGAIGTGPL

SEQ ID NO: 2292597 - protein, 17 aa, Cryptosporidium parvum
FRSFIIVIHQEYGCLLL

SEQ ID NO: 2292598 - protein, 24 aa, Cryptosporidium parvum
FRSHICLSILCSQNIDKIIETNLV

SEQ ID NO: 2292599 - protein, 25 aa, Cryptosporidium parvum
FRSKIPQLIRHLGWDESIPLRNSLI

SEQ ID NO: 2292600 - protein, 25 aa, Cryptosporidium parvum
FRSRKLPGIWHRILADGFRPGERVT

SEQ ID NO: 2292601 - protein, 17 aa, Cryptosporidium parvum
FRSRTMGLVSMETYKRH

SEQ ID NO: 2292602 - protein, 31 aa, Cryptosporidium parvum
FRSSWPEGLIQLRYIGIENFDFSFRGLLTPW

SEQ ID NO: 2292603 - protein, 25 aa, Cryptosporidium parvum
FRTEELRVNKMCLLQLESDLLEHQL

SEQ ID NO: 2292604 - protein, 18 aa, Cryptosporidium parvum
FRTGASPIMIATDVAARG

SEQ ID NO: 2292605 - protein, 18 aa, Cryptosporidium parvum
FRTLSIDYSKLIDEEGIK

SEQ ID NO: 2292606 - protein, 20 aa, Cryptosporidium parvum
FRTYKFPAILIYDNYSLSNG

SEQ ID NO: 2292607 - protein, 27 aa, Cryptosporidium parvum
FRVEELRLRLCSQLAALLNPIILSRLE

SEQ ID NO: 2292608 - protein, 18 aa, Cryptosporidium parvum
FRVIQGLIRRSYGNSGAV

SEQ ID NO: 2292609 - protein, 17 aa, Cryptosporidium parvum
FRVVKEIYRNETCSIAL

SEQ ID NO: 2292610 - protein, 21 aa, Cryptosporidium parvum
FRWHWINILKCTTIEEFSPYQ

SEQ ID NO: 2292611 - protein, 18 aa, Cryptosporidium parvum
FRYQCKQVKNSVSNLESI

SEQ ID NO: 2292612 - protein, 21 aa, Cryptosporidium parvum
FSANPFIPLKGEAIALDSTTA

SEQ ID NO: 2292613 - protein, 20 aa, Cryptosporidium parvum
FSAPVNLRFKTPRSDEELAF

SEQ ID NO: 2292614 - protein, 19 aa, Cryptosporidium parvum
FSATFPREIQQLAKDFLHN

SEQ ID NO: 2292615 - protein, 17 aa, Cryptosporidium parvum
FSCRECSWNPTSACSIQ

SEQ ID NO: 2292616 - protein, 17 aa, Cryptosporidium parvum
FSDGCIVSITDFSCGEF

SEQ ID NO: 2292617 - protein, 25 aa, Cryptosporidium parvum
FSDIKSIREAINFSINTKNREPDNN

SEQ ID NO: 2292618 - protein, 18 aa, Cryptosporidium parvum
FSDKYGIKSLYNACVPAI

SEQ ID NO: 2292619 - protein, 17 aa, Cryptosporidium parvum
FSDLGIRIFESIYERKS

SEQ ID NO: 2292620 - protein, 24 aa, Cryptosporidium parvum
FSDLKPPKLSVERLLTFDDPDYDY

SEQ ID NO: 2292621 - protein, 18 aa, Cryptosporidium parvum
FSDTTSVFDMKTRGWKIL

SEQ ID NO: 2292622 - protein, 20 aa, Cryptosporidium parvum
FSEAHLNSKKCCTVLTKVLN

SEQ ID NO: 2292623 - protein, 24 aa, Cryptosporidium parvum
FSEALNVLKSVGFVIVKLKPSQIH

SEQ ID NO: 2292624 - protein, 23 aa, Cryptosporidium parvum
FSEIFISWIHVKAMRCFVEAVLR

SEQ ID NO: 2292625 - protein, 19 aa, Cryptosporidium parvum
FSEKDRWFSLSSVTSPVDI

SEQ ID NO: 2292626 - protein, 28 aa, Cryptosporidium parvum
FSEVYLEYTSRFFIDSGLFKKIGGKNKG

SEQ ID NO: 2292627 - protein, 18 aa, Cryptosporidium parvum
FSEYFPLQSEAKFSKNPS

SEQ ID NO: 2292628 - protein, 17 aa, Cryptosporidium parvum
FSFEICDADGSEIRATC

SEQ ID NO: 2292629 - protein, 25 aa, Cryptosporidium parvum
FSFFPPKLSGLVLRDRDGSEIEFKK

SEQ ID NO: 2292630 - protein, 24 aa, Cryptosporidium parvum
FSFRETHSVFSLRLLPNEMAMVVN

SEQ ID NO: 2292631 - protein, 19 aa, Cryptosporidium parvum
FSGADLAELCQRAAKAAIR

SEQ ID NO: 2292632 - protein, 27 aa, Cryptosporidium parvum
FSGDFLLNLLIKFGILRSDASDLHSLI

SEQ ID NO: 2292633 - protein, 17 aa, Cryptosporidium parvum
FSGILAAHSIHLKILQD

SEQ ID NO: 2292634 - protein, 19 aa, Cryptosporidium parvum
FSGIVLAGNILRLTPASKG

SEQ ID NO: 2292635 - protein, 21 aa, Cryptosporidium parvum
FSGKIPQIGFWYIRHRHDKLD

SEQ ID NO: 2292636 - protein, 25 aa, Cryptosporidium parvum
FSGLPRLVSRPKLVSLNLERMNDIM

SEQ ID NO: 2292637 - protein, 20 aa, Cryptosporidium parvum
FSGNFGELIVDDFVHSPASI

SEQ ID NO: 2292638 - protein, 18 aa, Cryptosporidium parvum
FSGNYLLKALRDCDNSSI

SEQ ID NO: 2292639 - protein, 29 aa, Cryptosporidium parvum
FSGRSIGLLDIYGFEVFDCNSFEQFCINF

SEQ ID NO: 2292640 - protein, 21 aa, Cryptosporidium parvum
FSIDDTQVWAYKAFAQALEII

SEQ ID NO: 2292641 - protein, 17 aa, Cryptosporidium parvum
FSIELGKLINSNITNNN

SEQ ID NO: 2292642 - protein, 22 aa, Cryptosporidium parvum
FSIGAYGFEGSRQLAIEYRESM

SEQ ID NO: 2292643 - protein, 21 aa, Cryptosporidium parvum
FSIGETLLLKVVKLDETNKKI

SEQ ID NO: 2292644 - protein, 19 aa, Cryptosporidium parvum
FSIGNKWDGVIFTNYCDYL

SEQ ID NO: 2292645 - protein, 17 aa, Cryptosporidium parvum
FSIKEVVCRRCNKRQPA

SEQ ID NO: 2292646 - protein, 17 aa, Cryptosporidium parvum
FSIMVLQECLQRHGYSC

SEQ ID NO: 2292647 - protein, 23 aa, Cryptosporidium parvum
FSINDLRFLLKQMSTNIFNKNID

SEQ ID NO: 2292648 - protein, 17 aa, Cryptosporidium parvum
FSINSSRSFNYLNELPH

SEQ ID NO: 2292649 - protein, 26 aa, Cryptosporidium parvum
FSIQSRWRSFQIRKSFLAILGSRIQA

SEQ ID NO: 2292650 - protein, 25 aa, Cryptosporidium parvum
FSKDGLRFTLGLSTGNIVIYDVRSS

SEQ ID NO: 2292651 - protein, 21 aa, Cryptosporidium parvum
FSKDTWKNWVLVEISGINSSQ

SEQ ID NO: 2292652 - protein, 23 aa, Cryptosporidium parvum
FSKFGVSILPFYFEKVEFNNLND

SEQ ID NO: 2292653 - protein, 20 aa, Cryptosporidium parvum
FSKGALDFSLKVRNQCDGSK

SEQ ID NO: 2292654 - protein, 18 aa, Cryptosporidium parvum
FSKRVIWYTSQVSKLKNL

SEQ ID NO: 2292655 - protein, 17 aa, Cryptosporidium parvum
FSLCQIMDHPFSTNRFI

SEQ ID NO: 2292656 - protein, 18 aa, Cryptosporidium parvum
FSLDSEKRYFGFDICIIK

SEQ ID NO: 2292657 - protein, 19 aa, Cryptosporidium parvum
FSLEESLNYRRSSVGSRKS

SEQ ID NO: 2292658 - protein, 19 aa, Cryptosporidium parvum
FSLENCLLYSVIEDKDLND

SEQ ID NO: 2292659 - protein, 32 aa, Cryptosporidium parvum; identical to SEQ ID NO: 2171488

SEQ ID NO: 2292660 - protein, 19 aa, Cryptosporidium parvum
FSLICLKLDGLIIDSQNIK

SEQ ID NO: 2292661 - protein, 17 aa, Cryptosporidium parvum
FSLILSWMYQAMNEDNI

SEQ ID NO: 2292662 - protein, 17 aa, Cryptosporidium parvum
FSLKKCNFSEKSFIRAL

SEQ ID NO: 2292663 - protein, 17 aa, Cryptosporidium parvum
FSLQLSDYFRLLIDRSI

SEQ ID NO: 2292664 - protein, 17 aa, Cryptosporidium parvum
FSLTVDIEPSFNLENSL

SEQ ID NO: 2292665 - protein, 26 aa, Cryptosporidium parvum
FSLYSKIGNWYLPNLGKDYVNKPNNT

SEQ ID NO: 2292666 - protein, 24 aa, Cryptosporidium parvum
FSMFLKPSRGWNAPPLKQQTIDLF

SEQ ID NO: 2292667 - protein, 23 aa, Cryptosporidium parvum
FSMLKVLELRNLYIPLDTFDHLI

SEQ ID NO: 2292668 - protein, 20 aa, Cryptosporidium parvum
FSMQYPIIWEDFKNHLNSNN

SEQ ID NO: 2292669 - protein, 17 aa, Cryptosporidium parvum
FSMSSNWWDIAKFNENI

SEQ ID NO: 2292670 - protein, 18 aa, Cryptosporidium parvum
FSNDTNLYGNISMIDENI

SEQ ID NO: 2292671 - protein, 21 aa, Cryptosporidium parvum
FSNEELLDLYGFYKQATVGDA

SEQ ID NO: 2292672 - protein, 17 aa, Cryptosporidium parvum
FSNELLIKESDKKSVDE

SEQ ID NO: 2292673 - protein, 28 aa, Cryptosporidium parvum
FSNFRLVCRTHCCRTIFNSYVQNLTLFE

SEQ ID NO: 2292674 - protein, 29 aa, Cryptosporidium parvum
FSNLCKMVEFSLLWMALVITKFPNFIKAS

SEQ ID NO: 2292675 - protein, 21 aa, Cryptosporidium parvum
FSNLKGKYKVFSMNNAKHRIF

SEQ ID NO: 2292676 - protein, 23 aa, Cryptosporidium parvum
FSNLKSYLNFISIYNQISKQGSI

SEQ ID NO: 2292677 - protein, 17 aa, Cryptosporidium parvum
FSNNIYDLVFVYSGPVK

SEQ ID NO: 2292678 - protein, 17 aa, Cryptosporidium parvum
FSNWIGQFMIKINHRQL

SEQ ID NO: 2292679 - protein, 26 aa, Cryptosporidium parvum
FSNWQRLRWSIRMIPQKLPLDLIIAL

SEQ ID NO: 2292680 - protein, 18 aa, Cryptosporidium parvum
FSPEIQGFIVTKFDPLLS

SEQ ID NO: 2292681 - protein, 21 aa, Cryptosporidium parvum
FSQGYLKNLFLLSLDKNKDKI

SEQ ID NO: 2292682 - protein, 22 aa, Cryptosporidium parvum
FSQKDMYIYLILINQIMQEFHQ

SEQ ID NO: 2292683 - protein, 17 aa, Cryptosporidium parvum
FSQRNILSTTCNSDNAS

SEQ ID NO: 2292684 - protein, 18 aa, Cryptosporidium parvum
FSQVSGLKFRFNGDLPPG

SEQ ID NO: 2292685 - protein, 24 aa, Cryptosporidium parvum
FSRDELAKILKFGAQKLWSKGTNN

SEQ ID NO: 2292686 - protein, 17 aa, Cryptosporidium parvum
FSRDIIDDVIFRGKNQV

SEQ ID NO: 2292687 - protein, 23 aa, Cryptosporidium parvum
FSRPICSPLSQFLVGSDGSNSKN

SEQ ID NO: 2292688 - protein, 26 aa, Cryptosporidium parvum
FSSKIKLKKRMLYFTLTTGKMKLPTS

SEQ ID NO: 2292689 - protein, 28 aa, Cryptosporidium parvum
FSSKPKQARLAFPLLIQRFKDLREEAIA

SEQ ID NO: 2292690 - protein, 17 aa, Cryptosporidium parvum
FSSLMVNLLVKRKITAV

SEQ ID NO: 2292691 - protein, 27 aa, Cryptosporidium parvum
FSSLQEAFKPLEYDSFKQNEIFEQSWQ

SEQ ID NO: 2292692 - protein, 19 aa, Cryptosporidium parvum
FSSLYMKKLVQPYYSKIFK

SEQ ID NO: 2292693 - protein, 24 aa, Cryptosporidium parvum
FSSMGRPAFNIKVGGAQNIPPSIH

SEQ ID NO: 2292694 - protein, 17 aa, Cryptosporidium parvum
FSSNAHPIILRRFMLEG

SEQ ID NO: 2292695 - protein, 23 aa, Cryptosporidium parvum
FSSSCVICTLPIGVLKKSVQSSE

SEQ ID NO: 2292696 - protein, 30 aa, Cryptosporidium parvum; identical to SEQ ID NO: 2171526

SEQ ID NO: 2292697 - protein, 17 aa, Cryptosporidium parvum
FSSVSVMSRPTRKTFES

SEQ ID NO: 2292698 - protein, 18 aa, Cryptosporidium parvum
FSTAAPLFYFGLPEETLM

SEQ ID NO: 2292699 - protein, 18 aa, Cryptosporidium parvum
FSTAHWKEVNSGEVELDD

SEQ ID NO: 2292700 - protein, 17 aa, Cryptosporidium parvum
FSTELLLKVQRHSFLQL

SEQ ID NO: 2292701 - protein, 26 aa, Cryptosporidium parvum
FSTGSVGWYYGGKVPLPVGDDLEVLC

SEQ ID NO: 2292702 - protein, 18 aa, Cryptosporidium parvum
FSTHLHLLCDEFSNDTKV

SEQ ID NO: 2292703 - protein, 20 aa, Cryptosporidium parvum
FSTKDIFSLSSSGVSTKIND

SEQ ID NO: 2292704 - protein, 17 aa, Cryptosporidium parvum
FSTRVGIKAKKEQCFKL

SEQ ID NO: 2292705 - protein, 21 aa, Cryptosporidium parvum
FSTVCIIPCPSTTLASEELKL

SEQ ID NO: 2292706 - protein, 29 aa, Cryptosporidium parvum
FSVDLALRLSQRTGTQWRPKILNHNKHLK

SEQ ID NO: 2292707 - protein, 30 aa, Cryptosporidium parvum; identical to SEQ ID NO: 2171532

SEQ ID NO: 2292708 - protein, 17 aa, Cryptosporidium parvum
FSVEYHVGNLLSRTTYS

SEQ ID NO: 2292709 - protein, 20 aa, Cryptosporidium parvum
FSVIFRRAFASRVIPPKLLK

SEQ ID NO: 2292710 - protein, 23 aa, Cryptosporidium parvum
FSWFRDILSWFGLSNKSAKILFL

SEQ ID NO: 2292711 - protein, 17 aa, Cryptosporidium parvum
FSYAIKNTTLWLSKYFF

SEQ ID NO: 2292712 - protein, 23 aa, Cryptosporidium parvum
FSYNRYPMNYQWVSVKKILSKYL

SEQ ID NO: 2292713 - protein, 17 aa, Cryptosporidium parvum
FSYYRLNYMGTVRYLPR

SEQ ID NO: 2292714 - protein, 28 aa, Cryptosporidium parvum
FTCNYKFFPERSIEFSSYFNKAKFLLDS

SEQ ID NO: 2292715 - protein, 24 aa, Cryptosporidium parvum
FTCPICYESFDYNDIITLQPCGHQ

SEQ ID NO: 2292716 - protein, 19 aa, Cryptosporidium parvum
FTCPVCLDYYMLPVTIPCG

SEQ ID NO: 2292717 - protein, 20 aa, Cryptosporidium parvum
FTCTCRLCKKEERSNHTDSR

SEQ ID NO: 2292718 - protein, 22 aa, Cryptosporidium parvum
FTDYPPLGRFAVRDMKQTVAVG

SEQ ID NO: 2292719 - protein, 24 aa, Cryptosporidium parvum
FTEELCEISLEWSKLKSLMKSKDS

SEQ ID NO: 2292720 - protein, 26 aa, Cryptosporidium parvum
FTEHVKRFSIIYNQGIGITGTQTNGV

SEQ ID NO: 2292721 - protein, 32 aa, Cryptosporidium parvum; identical to SEQ ID NO: 2171542

SEQ ID NO: 2292722 - protein, 22 aa, Cryptosporidium parvum
FTELIFNLLVNFDFEASQKILN

SEQ ID NO: 2292723 - protein, 18 aa, Cryptosporidium parvum
FTEQELQESLVFTLPGSK

SEQ ID NO: 2292724 - protein, 24 aa, Cryptosporidium parvum
FTFDKCFTSEYVRAMETAAMLGLP

SEQ ID NO: 2292725 - protein, 17 aa, Cryptosporidium parvum
FTFGSYRLGVVAAGSDI

SEQ ID NO: 2292726 - protein, 23 aa, Cryptosporidium parvum
FTFPEKLDLSSFVNHNNKGETDT

SEQ ID NO: 2292727 - protein, 23 aa, Cryptosporidium parvum
FTHRATSCYIYDHFNGFSKDEKI

SEQ ID NO: 2292728 - protein, 28 aa, Cryptosporidium parvum
FTIDLNFFSIDTWAPLSLTIGIDSNSYN

SEQ ID NO: 2292729 - protein, 24 aa, Cryptosporidium parvum
FTIYRILDTFVFPFSIPNLKQPCL

SEQ ID NO: 2292730 - protein, 20 aa, Cryptosporidium parvum
FTKFIFKLITYMKLISNKTK

SEQ ID NO: 2292731 - protein, 26 aa, Cryptosporidium parvum
FTKLSKWTRYIFPEADDPLLTYLYDD

SEQ ID NO: 2292732 - protein, 17 aa, Cryptosporidium parvum
FTLEPKWDPLLEQQSQQ

SEQ ID NO: 2292733 - protein, 17 aa, Cryptosporidium parvum
FTLKENFNFFIDEISSV

SEQ ID NO: 2292734 - protein, 25 aa, Cryptosporidium parvum
FTMTSKHVWGPINLFYPDVKSTFTY

SEQ ID NO: 2292735 - protein, 18 aa, Cryptosporidium parvum
FTPINLIFRLNINTLKSE

SEQ ID NO: 2292736 - protein, 18 aa, Cryptosporidium parvum
FTPNANLRVGDIITGGDI

SEQ ID NO: 2292737 - protein, 17 aa, Cryptosporidium parvum
FTPYRQDELYAMYLSHK

SEQ ID NO: 2292738 - protein, 24 aa, Cryptosporidium parvum
FTQELKRIAGICSNNLKNSKKSDK

SEQ ID NO: 2292739 - protein, 20 aa, Cryptosporidium parvum
FTQLLPVPKAHFVSDFNSKD

SEQ ID NO: 2292740 - protein, 25 aa, Cryptosporidium parvum
FTRKHAYMRNELVFCNKPILEIDHG

SEQ ID NO: 2292741 - protein, 19 aa, Cryptosporidium parvum
FTRNCLSKEDLVVIDEIEK

SEQ ID NO: 2292742 - protein, 21 aa, Cryptosporidium parvum
FTRNDLCVIMTGIPYIDKKNF

SEQ ID NO: 2292743 - protein, 19 aa, Cryptosporidium parvum
FTRNLRILILVDMNHTPDA

SEQ ID NO: 2292744 - protein, 23 aa, Cryptosporidium parvum
FTRSPWLKQLFSIEIVSRTIKNL

SEQ ID NO: 2292745 - protein, 24 aa, Cryptosporidium parvum
FTSEKRPIVEFAIEDKRALFIQKK

SEQ ID NO: 2292746 - protein, 25 aa, Cryptosporidium parvum
FTSILKRKKHIFIITKTSSVFQSSI

SEQ ID NO: 2292747 - protein, 29 aa, Cryptosporidium parvum
FTSKEYIRDCCTIKPHWLVDFAPNLFQFA

SEQ ID NO: 2292748 - protein, 17 aa, Cryptosporidium parvum
FTSLPSCQVYSYQDKET

SEQ ID NO: 2292749 - protein, 18 aa, Cryptosporidium parvum
FTSMITYLCRSCFLPEIF

SEQ ID NO: 2292750 - protein, 20 aa, Cryptosporidium parvum
FTSNDFRGGGSLLSSPFNSL

SEQ ID NO: 2292751 - protein, 21 aa, Cryptosporidium parvum
FTSRIFLKGNFVKFKELIPGN

SEQ ID NO: 2292752 - protein, 19 aa, Cryptosporidium parvum
FTSRLKLQVFNILEDIKNI

SEQ ID NO: 2292753 - protein, 18 aa, Cryptosporidium parvum
FTSWKVFMESILDYRSRI

SEQ ID NO: 2292754 - protein, 20 aa, Cryptosporidium parvum
FTTCKSVEGTFHYGLAEEIY

SEQ ID NO: 2292755 - protein, 23 aa, Cryptosporidium parvum
FTTEMQRLELLKSLISLSKSIII

SEQ ID NO: 2292756 - protein, 18 aa, Cryptosporidium parvum
FTVHGGDLLTLLNVYNQW

SEQ ID NO: 2292757 - protein, 20 aa, Cryptosporidium parvum
FTYGSKFPPPIPNIGSFVDL

SEQ ID NO: 2292758 - protein, 20 aa, Cryptosporidium parvum
FTYLNRFYKINSFIIQIQGR

SEQ ID NO: 2292759 - protein, 20 aa, Cryptosporidium parvum
FTYNEIMVVILFNPELDLNT

SEQ ID NO: 2292760 - protein, 20 aa, Cryptosporidium parvum
FVCASTRIALTASAKWGLPS

SEQ ID NO: 2292761 - protein, 25 aa, Cryptosporidium parvum
FVCPCCRKPDSCFCGIEKDVNINQE

SEQ ID NO: 2292762 - protein, 19 aa, Cryptosporidium parvum
FVCQACIKGVRPENTSCIL

SEQ ID NO: 2292763 - protein, 17 aa, Cryptosporidium parvum
FVDNFRWQCIVLDEAHR

SEQ ID NO: 2292764 - protein, 26 aa, Cryptosporidium parvum
FVDSDLYKWCRYFGSSILDNNTKNYS

SEQ ID NO: 2292765 - protein, 23 aa, Cryptosporidium parvum
FVEEKVRLFTGLNFDHDGLSEGI

SEQ ID NO: 2292766 - protein, 17 aa, Cryptosporidium parvum
FVELVKVKRKINQLQKD

SEQ ID NO: 2292767 - protein, 19 aa, Cryptosporidium parvum
FVEMCMWEDAVDCLIVADR

SEQ ID NO: 2292768 - protein, 23 aa, Cryptosporidium parvum
FVFFKQLLLYSSIYLIDQIIYLN

SEQ ID NO: 2292769 - protein, 26 aa, Cryptosporidium parvum
FVFHPKIPFVCKIEMKSETKIGVITS

SEQ ID NO: 2292770 - protein, 18 aa, Cryptosporidium parvum
FVFPPFPLENGILPEQQL

SEQ ID NO: 2292771 - protein, 19 aa, Cryptosporidium parvum
FVGAEPYNTIGIRIPNIEL

SEQ ID NO: 2292772 - protein, 20 aa, Cryptosporidium parvum
FVGFCGNLLMETKVFNKVGN

SEQ ID NO: 2292773 - protein, 17 aa, Cryptosporidium parvum
FVGIGLNTGENVPFEMK

SEQ ID NO: 2292774 - protein, 23 aa, Cryptosporidium parvum
FVHKNIRLAVAHKVGHRTVASPQ

SEQ ID NO: 2292775 - protein, 18 aa, Cryptosporidium parvum
FVIDTGRVRISIYDPIRH

SEQ ID NO: 2292776 - protein, 18 aa, Cryptosporidium parvum
FVIKDWTYFLPILLSSSV

SEQ ID NO: 2292777 - protein, 19 aa, Cryptosporidium parvum
FVKELNLVIPNSFRINRGG

SEQ ID NO: 2292778 - protein, 17 aa, Cryptosporidium parvum
FVKLISWYDNESGYSNR

SEQ ID NO: 2292779 - protein, 17 aa, Cryptosporidium parvum
FVKRRLRRLDLVHLTSV

SEQ ID NO: 2292780 - protein, 21 aa, Cryptosporidium parvum
FVKSFFDLVSMILLKADVHIF

SEQ ID NO: 2292781 - protein, 18 aa, Cryptosporidium parvum
FVLAIIYVGRIIKFNKNF

SEQ ID NO: 2292782 - protein, 17 aa, Cryptosporidium parvum
FVLEDIKEMLSIKNIEI

SEQ ID NO: 2292783 - protein, 22 aa, Cryptosporidium parvum
FVLFNFKLKFNKEIGNSLCELE

SEQ ID NO: 2292784 - protein, 27 aa, Cryptosporidium parvum
FVLNLAYKFDPCVWLDDPLPISHPVIL

SEQ ID NO: 2292785 - protein, 17 aa, Cryptosporidium parvum
FVMKCLDKRNLNISSIQ

SEQ ID NO: 2292786 - protein, 19 aa, Cryptosporidium parvum
FVNKQDCESFEFFFPFIYG

SEQ ID NO: 2292787 - protein, 25 aa, Cryptosporidium parvum
FVNLFSWKFLTFIRIWSLSISNISQ

SEQ ID NO: 2292788 - protein, 18 aa, Cryptosporidium parvum
FVNLKLLSPNSITNNNNN

SEQ ID NO: 2292789 - protein, 23 aa, Cryptosporidium parvum
FVNLRHVFDDCVSRERNQLYSYY

SEQ ID NO: 2292790 - protein, 23 aa, Cryptosporidium parvum
FVNSPKFFSIVWNSFKSLLAART

SEQ ID NO: 2292791 - protein, 20 aa, Cryptosporidium parvum
FVPAHFCKDAWGLVYYDGTP

SEQ ID NO: 2292792 - protein, 20 aa, Cryptosporidium parvum
FVPQRYLRRGIFSSVDLSSS

SEQ ID NO: 2292793 - protein, 20 aa, Cryptosporidium parvum
FVPSCGHCQNYFLYKRIRSI

SEQ ID NO: 2292794 - protein, 23 aa, Cryptosporidium parvum
FVPSHWSPTAIKLFPLTSPVGRN

SEQ ID NO: 2292795 - protein, 32 aa, Cryptosporidium parvum; identical to SEQ ID NO: 2171603

SEQ ID NO: 2292796 - protein, 17 aa, Cryptosporidium parvum
FVQCLYASMPSEQQSKV

SEQ ID NO: 2292797 - protein, 18 aa, Cryptosporidium parvum
FVRSLSFGDYSPYESQVE

SEQ ID NO: 2292798 - protein, 22 aa, Cryptosporidium parvum
FVRVGRELVGRIKLRELTSGTI

SEQ ID NO: 2292799 - protein, 18 aa, Cryptosporidium parvum
FVSCGWDKIVKVWSHEFK

SEQ ID NO: 2292800 - protein, 17 aa, Cryptosporidium parvum
FVSLTPVDFCVMVILIR

SEQ ID NO: 2292801 - protein, 23 aa, Cryptosporidium parvum
FVSPLKFKFIIEELNEWRESLKN

SEQ ID NO: 2292802 - protein, 18 aa, Cryptosporidium parvum
FVSREFRGIEKSRQLRES

SEQ ID NO: 2292803 - protein, 26 aa, Cryptosporidium parvum
FVTEAKAAEFVIKFLDRMQSKKYAMN

SEQ ID NO: 2292804 - protein, 31 aa, Cryptosporidium parvum; identical to SEQ ID NO: 2171613

SEQ ID NO: 2292805 - protein, 17 aa, Cryptosporidium parvum
FVVLSIWLVELNSFVSF

SEQ ID NO: 2292806 - protein, 18 aa, Cryptosporidium parvum
FVVPRYVEKLVEIPFHPG

SEQ ID NO: 2292807 - protein, 25 aa, Cryptosporidium parvum
FVVPVHVPVLEFRDHFVPIPVRKRV

SEQ ID NO: 2292808 - protein, 18 aa, Cryptosporidium parvum
FVVYPLKHVISLSEQVTT

SEQ ID NO: 2292809 - protein, 18 aa, Cryptosporidium parvum
FVYFLSRIPNLSKRLECM

SEQ ID NO: 2292810 - protein, 19 aa, Cryptosporidium parvum
FWDTYRFEGNSQWIPIKNN

SEQ ID NO: 2292811 - protein, 26 aa, Cryptosporidium parvum
FWEPSWRIWIFFLRGIIPILERWIGN

SEQ ID NO: 2292812 - protein, 19 aa, Cryptosporidium parvum
FWFAAIRFFFLEAGRNLPL

SEQ ID NO: 2292813 - protein, 18 aa, Cryptosporidium parvum
FWGLWGICKSDIRSNNSS

SEQ ID NO: 2292814 - protein, 19 aa, Cryptosporidium parvum
FWGNPSFRLESIKCLTEIS

SEQ ID NO: 2292815 - protein, 21 aa, Cryptosporidium parvum
FWIDIQLRWGDYDSHDIERYC

SEQ ID NO: 2292816 - protein, 23 aa, Cryptosporidium parvum
FWITHPYINFSFLNNLNCKLDNF

SEQ ID NO: 2292817 - protein, 18 aa, Cryptosporidium parvum
FWKSERYSIDYSLSTYLS

SEQ ID NO: 2292818 - protein, 17 aa, Cryptosporidium parvum
FWLSRSSSIIKIGGVKY

SEQ ID NO: 2292819 - protein, 26 aa, Cryptosporidium parvum
FWPEIPEYNLSFGIHTQSAIKIAKGI

SEQ ID NO: 2292820 - protein, 18 aa, Cryptosporidium parvum
FWSKTMRPHLKFDHDKSI

SEQ ID NO: 2292821 - protein, 17 aa, Cryptosporidium parvum
FWSLVSINKLNEREATE

SEQ ID NO: 2292822 - protein, 25 aa, Cryptosporidium parvum
FWSQMARKELRWLRDFTKVRSSGTC

SEQ ID NO: 2292823 - protein, 26 aa, Cryptosporidium parvum
FYAFLKGCLELDPLKRLTALQLQGLK

SEQ ID NO: 2292824 - protein, 26 aa, Cryptosporidium parvum
FYAGKGEHPVQCMIFSGPFTTDKENL

SEQ ID NO: 2292825 - protein, 17 aa, Cryptosporidium parvum
FYAKDLASIITFYGRQI

SEQ ID NO: 2292826 - protein, 28 aa, Cryptosporidium parvum
FYCPGINKVRYWAMCFIGSERSTEPEFD

SEQ ID NO: 2292827 - protein, 18 aa, Cryptosporidium parvum
FYDRRVVSSKSKRLLKLC

SEQ ID NO: 2292828 - protein, 18 aa, Cryptosporidium parvum
FYDTLRKLSPISITSKII

SEQ ID NO: 2292829 - protein, 25 aa, Cryptosporidium parvum
FYGCKNYRFGGCGSVLDYHHLNKSS

SEQ ID NO: 2292830 - protein, 18 aa, Cryptosporidium parvum
FYGENFFHTVERGLSKFG

SEQ ID NO: 2292831 - protein, 33 aa, Cryptosporidium parvum
FYGLEPLTRTVLCLVQTHFIHWISSINTISPII

SEQ ID NO: 2292832 - protein, 37 aa, Cryptosporidium parvum
FYGLRWIESLRTLRCEKLGKLCSLRGTITRTSDVRPE

SEQ ID NO: 2292833 - protein, 21 aa, Cryptosporidium parvum
FYHFRDLWRLNLKNYSWQEVK

SEQ ID NO: 2292834 - protein, 28 aa, Cryptosporidium parvum
FYIKLLENFPLILLNIYLNQSLLFENKF

SEQ ID NO: 2292835 - protein, 18 aa, Cryptosporidium parvum
FYILSFVGISFNQATVSK

SEQ ID NO: 2292836 - protein, 20 aa, Cryptosporidium parvum
FYIYQILKALDFCHSQGIMH

SEQ ID NO: 2292837 - protein, 24 aa, Cryptosporidium parvum
FYKTKKCPWFAVGRCRMDKECNWA

SEQ ID NO: 2292838 - protein, 26 aa, Cryptosporidium parvum
FYLDDGSGLILIDWLVDNTGTKYKQD

SEQ ID NO: 2292839 - protein, 17 aa, Cryptosporidium parvum
FYLEKLWNWCILVISDI

SEQ ID NO: 2292840 - protein, 26 aa, Cryptosporidium parvum
FYLESVLRKKVNLIHMENLQLKEQIN

SEQ ID NO: 2292841 - protein, 19 aa, Cryptosporidium parvum
FYLIFEFFVAGNIILTDCN

SEQ ID NO: 2292842 - protein, 21 aa, Cryptosporidium parvum
FYLLESLCSILSNKLLEQSME

SEQ ID NO: 2292843 - protein, 18 aa, Cryptosporidium parvum
FYLQRYGVELGRRKNADE

SEQ ID NO: 2292844 - protein, 23 aa, Cryptosporidium parvum
FYLRGSCRFGDNCRDYHPNGSMF

SEQ ID NO: 2292845 - protein, 23 aa, Cryptosporidium parvum
FYLTEMKHIIGILEDMDTKRIKC

SEQ ID NO: 2292846 - protein, 24 aa, Cryptosporidium parvum
FYMMLKYPLKVRPFYTMPDFDEPE

SEQ ID NO: 2292847 - protein, 27 aa, Cryptosporidium parvum
FYNLPIWLEQSILYCFLGGKYTIKIPL

SEQ ID NO: 2292848 - protein, 27 aa, Cryptosporidium parvum
FYNPVIDLPTWRRMRTQAELRRELNIP

SEQ ID NO: 2292849 - protein, 17 aa, Cryptosporidium parvum
FYPFRFYPMNELDQKFP

SEQ ID NO: 2292850 - protein, 32 aa, Cryptosporidium parvum
FYPIFPLVCFPDFVRSGANMEHLMVMDMSYSL

SEQ ID NO: 2292851 - protein, 25 aa, Cryptosporidium parvum
FYQHLKELLVVASLYENYRNFQNQC

SEQ ID NO: 2292852 - protein, 19 aa, Cryptosporidium parvum
FYQLFKVKFIHQFYFLLGT

SEQ ID NO: 2292853 - protein, 19 aa, Cryptosporidium parvum
FYQPMVLIATLFQKSSQKQ

SEQ ID NO: 2292854 - protein, 27 aa, Cryptosporidium parvum
FYRNIWIKFLNRFGIWLRKNDESVFLE

SEQ ID NO: 2292855 - protein, 18 aa, Cryptosporidium parvum
FYSELTIISRIRHPNVTL

SEQ ID NO: 2292856 - protein, 24 aa, Cryptosporidium parvum
FYSSELNSVLKLMFERDPHKRPSA

SEQ ID NO: 2292857 - protein, 18 aa, Cryptosporidium parvum
FYSSIDIVKESKFATQEH

SEQ ID NO: 2292858 - protein, 18 aa, Cryptosporidium parvum
FYTKTCFEKNEAHCLKPF

SEQ ID NO: 2292859 - protein, 18 aa, Cryptosporidium parvum
FYTSPRCMCVSFHKYGDY

SEQ ID NO: 2292860 - protein, 24 aa, Cryptosporidium parvum
FYWERLPRFVGFEELPWREYWCYP

SEQ ID NO: 2292861 - protein, 23 aa, Cryptosporidium parvum
FYYDRSFIKLVLSIAHFLEGIKE

SEQ ID NO: 2292862 - protein, 18 aa, Cryptosporidium parvum
FYYLKGHIKRSSTRDRPR

SEQ ID NO: 2292863 - protein, 17 aa, Cryptosporidium parvum
FYYMFPSLEEFNRSWSR

SEQ ID NO: 2292864 - protein, 18 aa, Cryptosporidium parvum
FYYSYFLPNNHMMSVPQI

SEQ ID NO: 2292865 - protein, 23 aa, Cryptosporidium parvum
GADLKMLINESINRFLERTTNTE

SEQ ID NO: 2292866 - protein, 21 aa, Cryptosporidium parvum
GADLMAGGIIFELTSDLKNIR

SEQ ID NO: 2292867 - protein, 19 aa, Cryptosporidium parvum
GADSEFFGKLVVDSIMTVK

SEQ ID NO: 2292868 - protein, 22 aa, Cryptosporidium parvum
GAELALLCRETMMQVIRRTITN

SEQ ID NO: 2292869 - protein, 19 aa, Cryptosporidium parvum
GAEQFNWDSLRSIPRKERE

SEQ ID NO: 2292870 - protein, 18 aa, Cryptosporidium parvum
GAETIPGLKEKLKLKSLN

SEQ ID NO: 2292871 - protein, 21 aa, Cryptosporidium parvum
GAFGKCMRCGNGAAGNSGSCG

SEQ ID NO: 2292872 - protein, 18 aa, Cryptosporidium parvum
GAFGVVFKCMDLVTNEIV

SEQ ID NO: 2292873 - protein, 24 aa, Cryptosporidium parvum
GAFIKPNKSVVCLVMEYMEFGTLS

SEQ ID NO: 2292874 - protein, 22 aa, Cryptosporidium parvum
GAFNDCCEWLGPINKFNYCPAV

SEQ ID NO: 2292875 - protein, 27 aa, Cryptosporidium parvum
GAFSNFKEMLSITVLLHYLCIGNDSPL

SEQ ID NO: 2292876 - protein, 19 aa, Cryptosporidium parvum
GAGKSCLLHQFIENKFKKG

SEQ ID NO: 2292877 - protein, 23 aa, Cryptosporidium parvum
GAGNAILSYWFIKECGKPQNKIK

SEQ ID NO: 2292878 - protein, 18 aa, Cryptosporidium parvum
GAHINRSLLALANCINSL

SEQ ID NO: 2292879 - protein, 25 aa, Cryptosporidium parvum
GAHKRKKPGVLTFNLYSGQFEKSNP

SEQ ID NO: 2292880 - protein, 36 aa, Cryptosporidium parvum; identical to SEQ ID NO: 2171678

SEQ ID NO: 2292881 - protein, 22 aa, Cryptosporidium parvum
GAIMFCDASGFTALTAALDKQL

SEQ ID NO: 2292882 - protein, 18 aa, Cryptosporidium parvum
GAIPDWSKAGRMILRDYW

SEQ ID NO: 2292883 - protein, 28 aa, Cryptosporidium parvum
GAIRFFMLCKQIKHSFVNISLNDENINI

SEQ ID NO: 2292884 - protein, 24 aa, Cryptosporidium parvum
GAKFARQGTNPGLIHISHKEKQSS

SEQ ID NO: 2292885 - protein, 19 aa, Cryptosporidium parvum
GAKHLIILILVKFVKMNVK

SEQ ID NO: 2292886 - protein, 26 aa, Cryptosporidium parvum
GAKPLKRLSCPAIFFDCTHDNETPCE

SEQ ID NO: 2292887 - protein, 20 aa, Cryptosporidium parvum
GALAIDCPFMGKFVDGIQGD

SEQ ID NO: 2292888 - protein, 17 aa, Cryptosporidium parvum
GALCFQYISNLPRKFSS

SEQ ID NO: 2292889 - protein, 27 aa, Cryptosporidium parvum
GALGCEFLKSMALLGVGCGPNGTVTIT

SEQ ID NO: 2292890 - protein, 25 aa, Cryptosporidium parvum
GALGMHCVSEMTILLEKVAEICEIP

SEQ ID NO: 2292891 - protein, 24 aa, Cryptosporidium parvum
GALNELRVDLELRIISPIKNSHIY

SEQ ID NO: 2292892 - protein, 25 aa, Cryptosporidium parvum
GALVARMLSMLWSKPLIGVNHCVAH

SEQ ID NO: 2292893 - protein, 20 aa, Cryptosporidium parvum
GALVLRRLQFDTGKLEIVRR

SEQ ID NO: 2292894 - protein, 19 aa, Cryptosporidium parvum
GANEFKLSIVVNSGQLRSE

SEQ ID NO: 2292895 - protein, 17 aa, Cryptosporidium parvum
GANGINNGYSWRKNKPI

SEQ ID NO: 2292896 - protein, 37 aa, Cryptosporidium parvum; identical to SEQ ID NO: 2171689

SEQ ID NO: 2292897 - protein, 17 aa, Cryptosporidium parvum
GAPAFPGTQPGIPTQPG

SEQ ID NO: 2292898 - protein, 19 aa, Cryptosporidium parvum
GAPLPLFMLELFSLSREER

SEQ ID NO: 2292899 - protein, 25 aa, Cryptosporidium parvum
GAPNFKEALRYGAEVYHTLKSVIKK

SEQ ID NO: 2292900 - protein, 22 aa, Cryptosporidium parvum
GAQPIRCPTNFLKKVSQDVVVT

SEQ ID NO: 2292901 - protein, 25 aa, Cryptosporidium parvum
GARILRFIFELIQLSTFGVSERAQR

SEQ ID NO: 2292902 - protein, 21 aa, Cryptosporidium parvum
GARPIIKCRELALMGVKEVFD

SEQ ID NO: 2292903 - protein, 19 aa, Cryptosporidium parvum
GASHCYPMAAGSIKKNGYC

SEQ ID NO: 2292904 - protein, 20 aa, Cryptosporidium parvum
GASISNYLLEKCRLTNQQEG

SEQ ID NO: 2292905 - protein, 17 aa, Cryptosporidium parvum
GASIVIFSPCIEQVSKN

SEQ ID NO: 2292906 - protein, 17 aa, Cryptosporidium parvum
GATILKSLESLFISESM

SEQ ID NO: 2292907 - protein, 25 aa, Cryptosporidium parvum
GATKVIFCGPPIYPSIYLDCIQSIN

SEQ ID NO: 2292908 - protein, 23 aa, Cryptosporidium parvum
GAVKRSDCFNFLVKLSETHSKTR

SEQ ID NO: 2292909 - protein, 24 aa, Cryptosporidium parvum
GAVRKSGVPGVYWSQKPQGWRVVY

SEQ ID NO: 2292910 - protein, 19 aa, Cryptosporidium parvum
GAYSRINGVVTLRELKIAA

SEQ ID NO: 2292911 - protein, 18 aa, Cryptosporidium parvum
GCCFKDTFGEKIIICGIS

SEQ ID NO: 2292912 - protein, 17 aa, Cryptosporidium parvum
GCECSRSSSGRSGRKLR

SEQ ID NO: 2292913 - protein, 28 aa, Cryptosporidium parvum
GCEKDIYIKPIFKAERTTLILRDLENDV

SEQ ID NO: 2292914 - protein, 17 aa, Cryptosporidium parvum
GCERAILSLNRVNSIEL

SEQ ID NO: 2292915 - protein, 17 aa, Cryptosporidium parvum
GCFDKMFEALKSLIYLS

SEQ ID NO: 2292916 - protein, 19 aa, Cryptosporidium parvum
GCFKDKIGRFLSERYIISK

SEQ ID NO: 2292917 - protein, 17 aa, Cryptosporidium parvum
GCFVKIFGELTLMVSEP

SEQ ID NO: 2292918 - protein, 18 aa, Cryptosporidium parvum
GCGIGLERVIMLFLNLGN

SEQ ID NO: 2292919 - protein, 24 aa, Cryptosporidium parvum
GCIEFSRNPTIRNWLGSGLYLNKS

SEQ ID NO: 2292920 - protein, 43 aa, Cryptosporidium parvum; identical to SEQ ID NO: 2171704

SEQ ID NO: 2292921 - protein, 17 aa, Cryptosporidium parvum
GCIGRRVTISDSQEFKI

SEQ ID NO: 2292922 - protein, 20 aa, Cryptosporidium parvum
GCIGTHHWMAPEILRGEGFT

SEQ ID NO: 2292923 - protein, 25 aa, Cryptosporidium parvum
GCLDGTIRLWDFRTGENVKILKGHK

SEQ ID NO: 2292924 - protein, 20 aa, Cryptosporidium parvum
GCNSELILLIHRRISTISEL

SEQ ID NO: 2292925 - protein, 19 aa, Cryptosporidium parvum
GCSLSCIFNLSSAIEELYR

SEQ ID NO: 2292926 - protein, 18 aa, Cryptosporidium parvum
GCSNSGFIQTHPQINRPN

SEQ ID NO: 2292927 - protein, 24 aa, Cryptosporidium parvum
GCSVARNLIGWGIRNFKFIDHSKV

SEQ ID NO: 2292928 - protein, 25 aa, Cryptosporidium parvum
GCTLGSTVGFAIRFEDITTPETKIK

SEQ ID NO: 2292929 - protein, 17 aa, Cryptosporidium parvum
GCTLKLPIGNEDDDMMD

SEQ ID NO: 2292930 - protein, 21 aa, Cryptosporidium parvum
GCTLPYIGFEELKEMGITEIT

SEQ ID NO: 2292931 - protein, 24 aa, Cryptosporidium parvum
GCTSISRPSLMGMEKQRQEESNLS

SEQ ID NO: 2292932 - protein, 20 aa, Cryptosporidium parvum
GDAYGRLTYWFIPPSSSKEG

SEQ ID NO: 2292933 - protein, 17 aa, Cryptosporidium parvum
GDCRVGSTASVYAAAIL

SEQ ID NO: 2292934 - protein, 29 aa, Cryptosporidium parvum
GDDLTGINMVNWIIRVCFGVSDKKLIYKV

SEQ ID NO: 2292935 - protein, 23 aa, Cryptosporidium parvum
GDDLYLSISLIRFSEYVDGYVLF

SEQ ID NO: 2292936 - protein, 27 aa, Cryptosporidium parvum
GDEIIECVSFPSAVAIGLEIAIKGMGR

SEQ ID NO: 2292937 - protein, 18 aa, Cryptosporidium parvum
GDEILKWDPLSKFNDDNL

SEQ ID NO: 2292938 - protein, 18 aa, Cryptosporidium parvum
GDFHKFALFFIYKSNNSL

SEQ ID NO: 2292939 - protein, 21 aa, Cryptosporidium parvum
GDFKLKGPGFKVENVYIPIRN

SEQ ID NO: 2292940 - protein, 30 aa, Cryptosporidium parvum; identical to SEQ ID NO: 2171721

SEQ ID NO: 2292941 - protein, 25 aa, Cryptosporidium parvum
GDGFLKGIVIDSSFCSLRQLCHELV

SEQ ID NO: 2292942 - protein, 20 aa, Cryptosporidium parvum
GDGMKKHIGRNIAISQYNCD

SEQ ID NO: 2292943 - protein, 17 aa, Cryptosporidium parvum
GDGPICLVLAPTRELVE

SEQ ID NO: 2292944 - protein, 19 aa, Cryptosporidium parvum
GDGSAIWNSELEAWATIGS

SEQ ID NO: 2292945 - protein, 20 aa, Cryptosporidium parvum
GDGSRLGYNGPKGMYPIGKI

SEQ ID NO: 2292946 - protein, 17 aa, Cryptosporidium parvum
GDIKKKFTYREFFEKVV

SEQ ID NO: 2292947 - protein, 25 aa, Cryptosporidium parvum
GDILKRWELPWIAQKLFMGSNQQQI

SEQ ID NO: 2292948 - protein, 17 aa, Cryptosporidium parvum
GDIPRNISLHMTRGLID

SEQ ID NO: 2292949 - protein, 23 aa, Cryptosporidium parvum
GDISYSILIKFLKLHNGEKHTLK

SEQ ID NO: 2292950 - protein, 17 aa, Cryptosporidium parvum
GDKPSGYFPINYKNNKD

SEQ ID NO: 2292951 - protein, 22 aa, Cryptosporidium parvum
GDKRFPLNFLSYLEDVSVEPCL

SEQ ID NO: 2292952 - protein, 35 aa, Cryptosporidium parvum
GDKSKNILCKAFWKILRSYEISASISLIESKTNPD

SEQ ID NO: 2292953 - protein, 22 aa, Cryptosporidium parvum
GDKSSFCELNLGEVVVYKPKSK

SEQ ID NO: 2292954 - protein, 24 aa, Cryptosporidium parvum
GDLFAYRLRILFKQSNISIYMEPL

SEQ ID NO: 2292955 - protein, 18 aa, Cryptosporidium parvum
GDLKFSVEEINDLNMKYI

SEQ ID NO: 2292956 - protein, 17 aa, Cryptosporidium parvum
GDLKVGVNHLGRNVNDS

SEQ ID NO: 2292957 - protein, 20 aa, Cryptosporidium parvum
GDLKVWKFFIGYEQTNIEDD

SEQ ID NO: 2292958 - protein, 24 aa, Cryptosporidium parvum
GDLLRGIFAYGFEKPSAIQQRGIK

SEQ ID NO: 2292959 - protein, 17 aa, Cryptosporidium parvum
GDLRLPNGKEVVHRNLA

SEQ ID NO: 2292960 - protein, 22 aa, Cryptosporidium parvum
GDNHIKVALTLQDEVPSLDLTP

SEQ ID NO: 2292961 - protein, 17 aa, Cryptosporidium parvum
GDNKHGYGIQKWPDGAV

SEQ ID NO: 2292962 - protein, 18 aa, Cryptosporidium parvum
GDNLASFSDYRLAKNEKK

SEQ ID NO: 2292963 - protein, 18 aa, Cryptosporidium parvum
GDNTFYLIFEFFVAGNII

SEQ ID NO: 2292964 - protein, 25 aa, Cryptosporidium parvum
GDQESPFVYALVDWIKEKVGNFRIE

SEQ ID NO: 2292965 - protein, 18 aa, Cryptosporidium parvum
GDQTRKVLQHAFKERLKI

SEQ ID NO: 2292966 - protein, 30 aa, Cryptosporidium parvum
GDRLFDMGFAPQLLSIISIIRPDRQIAIFS

SEQ ID NO: 2292967 - protein, 17 aa, Cryptosporidium parvum
GDSEWFSILLFHQNRKK

SEQ ID NO: 2292968 - protein, 18 aa, Cryptosporidium parvum
GDSLSVLQHGLFNGSIVY

SEQ ID NO: 2292969 - protein, 24 aa, Cryptosporidium parvum
GDSQCLENYPFLNMLGQQPLNNVI

SEQ ID NO: 2292970 - protein, 22 aa, Cryptosporidium parvum
GDSWRLYDLITRHFFATISNDI

SEQ ID NO: 2292971 - protein, 20 aa, Cryptosporidium parvum
GDTRISRSLMEMTQVFITTP

SEQ ID NO: 2292972 - protein, 20 aa, Cryptosporidium parvum
GDVCLMVRYGPTDIRLLTEF

SEQ ID NO: 2292973 - protein, 29 aa, Cryptosporidium parvum
GDVIVWTLPFLVRSCENFINISLNSSFYD

SEQ ID NO: 2292974 - protein, 19 aa, Cryptosporidium parvum
GDVLRKVLDYCEYHVDNPS

SEQ ID NO: 2292975 - protein, 18 aa, Cryptosporidium parvum
GDVSFLLKLHAYLEFWGL

SEQ ID NO: 2292976 - protein, 24 aa, Cryptosporidium parvum
GDYCELRCHACVGGTSVRDDMNKL

SEQ ID NO: 2292977 - protein, 18 aa, Cryptosporidium parvum
GDYDEIISRHYSVNGNAN

SEQ ID NO: 2292978 - protein, 21 aa, Cryptosporidium parvum
GEASLEWSLNFLTRNCDFLNE

SEQ ID NO: 2292979 - protein, 20 aa, Cryptosporidium parvum
GEAYVLLPSIKAYELSLTLL

SEQ ID NO: 2292980 - protein, 19 aa, Cryptosporidium parvum
GECSKCIKDELDILLYNCN

SEQ ID NO: 2292981 - protein, 19 aa, Cryptosporidium parvum
GEDELRDATLLVLANKQDL

SEQ ID NO: 2292982 - protein, 24 aa, Cryptosporidium parvum
GEDIINALSSFGFGDYTDTLINYL

SEQ ID NO: 2292983 - protein, 35 aa, Cryptosporidium parvum
GEDNIKRFVNFCLRYIADLDIPIKRGTFIEYRTGM

SEQ ID NO: 2292984 - protein, 24 aa, Cryptosporidium parvum
GEDPRISGPSSIFEMRLSPSTNEL

SEQ ID NO: 2292985 - protein, 19 aa, Cryptosporidium parvum
GEDRLVIVWLLKVEAEKDS

SEQ ID NO: 2292986 - protein, 20 aa, Cryptosporidium parvum
GEEFPLFMGEDVLDPNNPHI

SEQ ID NO: 2292987 - protein, 24 aa, Cryptosporidium parvum
GEEIDEVGCLLIFDETYKSVIDSF

SEQ ID NO: 2292988 - protein, 24 aa, Cryptosporidium parvum
GEELPNLSCFNWGNVKCDEMRSLN

SEQ ID NO: 2292989 - protein, 26 aa, Cryptosporidium parvum
GEENAWNMARDAFKFINNNNKLPFDF

SEQ ID NO: 2292990 - protein, 17 aa, Cryptosporidium parvum
GEFAKLGKFSTLSQTTR

SEQ ID NO: 2292991 - protein, 17 aa, Cryptosporidium parvum
GEFARLYPMGKQILGKL

SEQ ID NO: 2292992 - protein, 18 aa, Cryptosporidium parvum
GEGGKMAFIDHFTNNEYY

SEQ ID NO: 2292993 - protein, 22 aa, Cryptosporidium parvum
GEGKTLCYVIPIANYLYNRTYP

SEQ ID NO: 2292994 - protein, 18 aa, Cryptosporidium parvum
GEGLSYLIILGISDGSWM

SEQ ID NO: 2292995 - protein, 24 aa, Cryptosporidium parvum
GEGRRAGGGMERGEHSSRGGGHSG

SEQ ID NO: 2292996 - protein, 25 aa, Cryptosporidium parvum
GEGTIKCKACPTVNYMIDIEAIKAC

SEQ ID NO: 2292997 - protein, 19 aa, Cryptosporidium parvum
GEHICGVLTKKIAGSSSGS

SEQ ID NO: 2292998 - protein, 17 aa, Cryptosporidium parvum
GEIDIFLALKLYLVQRE

SEQ ID NO: 2292999 - protein, 27 aa, Cryptosporidium parvum
GEIKKAYHKLAIKWHPDKNMGNDRQMC

SEQ ID NO: 2293000 - protein, 19 aa, Cryptosporidium parvum
GEIKKRIALVGKGITMDTG

SEQ ID NO: 2293001 - protein, 21 aa, Cryptosporidium parvum
GEISDSILIYDIFSHNLKLNG

SEQ ID NO: 2293002 - protein, 25 aa, Cryptosporidium parvum
GEISRFNIEGGILMKSYLIGQPELT

SEQ ID NO: 2293003 - protein, 18 aa, Cryptosporidium parvum
GEIYRWGLYDLKSPIVFK

SEQ ID NO: 2293004 - protein, 21 aa, Cryptosporidium parvum
GEKALREILKKEVVKARDNLK

SEQ ID NO: 2293005 - protein, 21 aa, Cryptosporidium parvum
GEKDLKINFLSSQINQLKDEN

SEQ ID NO: 2293006 - protein, 18 aa, Cryptosporidium parvum
GEKEKILIAKNVEAEQKM

SEQ ID NO: 2293007 - protein, 22 aa, Cryptosporidium parvum
GEKGIGYRSIFKITDNPCIFSG

SEQ ID NO: 2293008 - protein, 20 aa, Cryptosporidium parvum
GEKIELCVGIVDWKLESGEI

SEQ ID NO: 2293009 - protein, 20 aa, Cryptosporidium parvum
GEKKFGFSLKNSICKAQNNI

SEQ ID NO: 2293010 - protein, 17 aa, Cryptosporidium parvum
GEKLLGELFGMMDDLIV

SEQ ID NO: 2293011 - protein, 22 aa, Cryptosporidium parvum
GEKLRSLLFNSFNLKSESQGYG

SEQ ID NO: 2293012 - protein, 19 aa, Cryptosporidium parvum
GEKTLSSLALVFALHQFRP

SEQ ID NO: 2293013 - protein, 24 aa, Cryptosporidium parvum
GELCPIKTPFGLRNMVYSDWTASG

SEQ ID NO: 2293014 - protein, 21 aa, Cryptosporidium parvum
GELFKVMKIMVGDNLEDLQLQ

SEQ ID NO: 2293015 - protein, 17 aa, Cryptosporidium parvum
GELGRHPPYPGGVPGQV

SEQ ID NO: 2293016 - protein, 19 aa, Cryptosporidium parvum
GELIIECIGEILTDSDVRD

SEQ ID NO: 2293017 - protein, 23 aa, Cryptosporidium parvum
GELILAEKPLCWITTKIGNHFKD

SEQ ID NO: 2293018 - protein, 17 aa, Cryptosporidium parvum
GELKNILKACGLKSSTN

SEQ ID NO: 2293019 - protein, 20 aa, Cryptosporidium parvum
GELNCIFRKIKFDIPTECEE

SEQ ID NO: 2293020 - protein, 24 aa, Cryptosporidium parvum
GELNMYLKPVFGIFHGFSGTKFWR

SEQ ID NO: 2293021 - protein, 19 aa, Cryptosporidium parvum
GELRGIINCERINIDEEHL

SEQ ID NO: 2293022 - protein, 17 aa, Cryptosporidium parvum
GELSLFGTESVKNYKLN

SEQ ID NO: 2293023 - protein, 17 aa, Cryptosporidium parvum
GELYKISNIITGEIILE

SEQ ID NO: 2293024 - protein, 22 aa, Cryptosporidium parvum
GELYLFGKIMTFSGMDEKIHFS

SEQ ID NO: 2293025 - protein, 21 aa, Cryptosporidium parvum
GELYSLVRFIGFHPYAYNFCN

SEQ ID NO: 2293026 - protein, 17 aa, Cryptosporidium parvum
GEMISRQIVTLFELCQS

SEQ ID NO: 2293027 - protein, 17 aa, Cryptosporidium parvum
GEMVRRRLTLYRYNEFR

SEQ ID NO: 2293028 - protein, 20 aa, Cryptosporidium parvum
GENLKGLKIVALEKLDGENS

SEQ ID NO: 2293029 - protein, 23 aa, Cryptosporidium parvum
GENLKIPPLPALSDVAEKCGLNI

SEQ ID NO: 2293030 - protein, 20 aa, Cryptosporidium parvum
GENRFKKILSEKEEIINQLN

SEQ ID NO: 2293031 - protein, 25 aa, Cryptosporidium parvum
GENRKRSRCLSHLDVDLKFKGISSI

SEQ ID NO: 2293032 - protein, 26 aa, Cryptosporidium parvum
GENRNAFCAIRPPGHHLGTWGAAQTV

SEQ ID NO: 2293033 - protein, 23 aa, Cryptosporidium parvum
GENRSSLMFGTLVYTFREGSVSQ

SEQ ID NO: 2293034 - protein, 24 aa, Cryptosporidium parvum
GEPSKRWYERIAVISPYNEQVKII

SEQ ID NO: 2293035 - protein, 17 aa, Cryptosporidium parvum
GERAIEFVSELWEYISK

SEQ ID NO: 2293036 - protein, 27 aa, Cryptosporidium parvum
GERLELPPWVRVVFEVHSLATATLATV

SEQ ID NO: 2293037 - protein, 17 aa, Cryptosporidium parvum
GERTQFVHIICSLYTPG

SEQ ID NO: 2293038 - protein, 20 aa, Cryptosporidium parvum
GERVSPCPEDFDVVLENDSR

SEQ ID NO: 2293039 - protein, 20 aa, Cryptosporidium parvum
GESDLQWQLDYSRNCALISL

SEQ ID NO: 2293040 - protein, 26 aa, Cryptosporidium parvum
GESIKCCPSFSKAYYRRGIAYFNLLK

SEQ ID NO: 2293041 - protein, 18 aa, Cryptosporidium parvum
GETNILLVFDEFKTILSL

SEQ ID NO: 2293042 - protein, 25 aa, Cryptosporidium parvum
GETTKLHFSKFFSLGQLQCVDPETR

SEQ ID NO: 2293043 - protein, 22 aa, Cryptosporidium parvum
GETYKIYLGNVFQSVHPQILKS

SEQ ID NO: 2293044 - protein, 18 aa, Cryptosporidium parvum
GEVARITEQLSLRELDME

SEQ ID NO: 2293045 - protein, 17 aa, Cryptosporidium parvum
GEVKRQYGIGPLEPTFL

SEQ ID NO: 2293046 - protein, 18 aa, Cryptosporidium parvum
GEVKSCNIIRDYKTGDSL

SEQ ID NO: 2293047 - protein, 23 aa, Cryptosporidium parvum
GEVLSWGCNDDGALGRLSSKFKA

SEQ ID NO: 2293048 - protein, 19 aa, Cryptosporidium parvum
GEVQIKWKCSNCGEFSNEI

SEQ ID NO: 2293049 - protein, 22 aa, Cryptosporidium parvum
GEVSLQFIRCFIPNSHMRSDIW

SEQ ID NO: 2293050 - protein, 20 aa, Cryptosporidium parvum
GEYDLILAFDSPICKSSETT

SEQ ID NO: 2293051 - protein, 21 aa, Cryptosporidium parvum
GEYKKRVTIGSSIRNSNRTGF

SEQ ID NO: 2293052 - protein, 25 aa, Cryptosporidium parvum
GFAALRFLIRSSLNACNEFLKLGVF

SEQ ID NO: 2293053 - protein, 23 aa, Cryptosporidium parvum
GFASGRYNFFFTLNSFARKYLKH

SEQ ID NO: 2293054 - protein, 20 aa, Cryptosporidium parvum
GFCDFQHICRYVSHIQSFSA

SEQ ID NO: 2293055 - protein, 19 aa, Cryptosporidium parvum
GFCYTFSGNLLIFILPRVE

SEQ ID NO: 2293056 - protein, 24 aa, Cryptosporidium parvum
GFDNFNLRISSLMNSRSDWIDNLL

SEQ ID NO: 2293057 - protein, 25 aa, Cryptosporidium parvum
GFEEAQRRAIEFLRRKREEVRMKTQ

SEQ ID NO: 2293058 - protein, 22 aa, Cryptosporidium parvum
GFERLFPPLLYKLQQEYIQENA

SEQ ID NO: 2293059 - protein, 20 aa, Cryptosporidium parvum
GFERRVSSELGELISNEKIL

SEQ ID NO: 2293060 - protein, 18 aa, Cryptosporidium parvum
GFFSKLGSMLSFGKKSSS

SEQ ID NO: 2293061 - protein, 33 aa, Cryptosporidium parvum
GFGKSVIKPSIHFEMFFIPPFPADVVIPAPPST

SEQ ID NO: 2293062 - protein, 26 aa, Cryptosporidium parvum
GFGRIGRLVLRACMERNDITVVAIND

SEQ ID NO: 2293063 - protein, 18 aa, Cryptosporidium parvum
GFGVYKLATGRIYEGQYS

SEQ ID NO: 2293064 - protein, 21 aa, Cryptosporidium parvum
GFICAEVYKFTDLMELGSEAA

SEQ ID NO: 2293065 - protein, 18 aa, Cryptosporidium parvum
GFIFPSPVQYHILSQGAI

SEQ ID NO: 2293066 - protein, 27 aa, Cryptosporidium parvum
GFIPNTCLYPVCSRSTVVPNIELCIQK

SEQ ID NO: 2293067 - protein, 27 aa, Cryptosporidium parvum
GFIYSFGKIYLGYNIHKILLSIIDLYD

SEQ ID NO: 2293068 - protein, 22 aa, Cryptosporidium parvum
GFKKEFPNGLKYEVLSISKNVK

SEQ ID NO: 2293069 - protein, 26 aa, Cryptosporidium parvum
GFKSWLEYHKKFWLENFHAFNEKQSE

SEQ ID NO: 2293070 - protein, 23 aa, Cryptosporidium parvum
GFLKGGGITTYLLESSRCVKHSH

SEQ ID NO: 2293071 - protein, 28 aa, Cryptosporidium parvum
GFLSSFRFPHCSRYTAFPVGIADSASGG

SEQ ID NO: 2293072 - protein, 21 aa, Cryptosporidium parvum
GFLTKSFISIKGFYFQAKILG

SEQ ID NO: 2293073 - protein, 18 aa, Cryptosporidium parvum
GFMKTGIVSSDYIDSSIN

SEQ ID NO: 2293074 - protein, 18 aa, Cryptosporidium parvum
GFMLKKRLGKKMKQNRAV

SEQ ID NO: 2293075 - protein, 25 aa, Cryptosporidium parvum
GFNEAKKLAIQCRLNAVNSGEAVLR

SEQ ID NO: 2293076 - protein, 30 aa, Cryptosporidium parvum
GFNGCTSVKTCPGIVSLKKDIDIYFISLSK

SEQ ID NO: 2293077 - protein, 18 aa, Cryptosporidium parvum
GFPSVGFQFETYLTRSEI

SEQ ID NO: 2293078 - protein, 25 aa, Cryptosporidium parvum
GFPTLTPRFGLGKHQSRWFNCKDSD

SEQ ID NO: 2293079 - protein, 25 aa, Cryptosporidium parvum
GFRDFFLKPELIRAIGDAGFEHPSE

SEQ ID NO: 2293080 - protein, 32 aa, Cryptosporidium parvum
GFRRLIYSLIEWKNVFGLVCSFKSFIESDNFQ

SEQ ID NO: 2293081 - protein, 25 aa, Cryptosporidium parvum
GFRRSCLFELLSLSVGRGYIVSNPS

SEQ ID NO: 2293082 - protein, 19 aa, Cryptosporidium parvum
GFRSLSLKGIYYDRRNHGW

SEQ ID NO: 2293083 - protein, 17 aa, Cryptosporidium parvum
GFSARVYGFEDAKQMAI

SEQ ID NO: 2293084 - protein, 19 aa, Cryptosporidium parvum
GFSESQVINALRATNGNTE

SEQ ID NO: 2293085 - protein, 24 aa, Cryptosporidium parvum
GFSGRNLRKLPFVSLLSSYHHGIP

SEQ ID NO: 2293086 - protein, 24 aa, Cryptosporidium parvum
GFSMHRRSYILAAIYMARSDENTS

SEQ ID NO: 2293087 - protein, 24 aa, Cryptosporidium parvum
GFTECPKSYVFRGTKDVTSQQLQL

SEQ ID NO: 2293088 - protein, 19 aa, Cryptosporidium parvum
GFTGAPYMDRIRTLKTLFG

SEQ ID NO: 2293089 - protein, 22 aa, Cryptosporidium parvum
GFTNRTLPHFKMNCVDGRSRGF

SEQ ID NO: 2293090 - protein, 19 aa, Cryptosporidium parvum
GFVSPSFAVLKQWQRNFYI

SEQ ID NO: 2293091 - protein, 25 aa, Cryptosporidium parvum
GGAFRIWDIRTGRSILSQLAHSKKI

SEQ ID NO: 2293092 - protein, 17 aa, Cryptosporidium parvum
GGANFRENVKYGTSRRV

SEQ ID NO: 2293093 - protein, 27 aa, Cryptosporidium parvum
GGASGNRRWNFGASKEKGRYKQSGNES

SEQ ID NO: 2293094 - protein, 18 aa, Cryptosporidium parvum
GGDFKRQGEIEVVGGDDE

SEQ ID NO: 2293095 - protein, 21 aa, Cryptosporidium parvum
GGDGTLLWLSHLFQTSVPPVI

SEQ ID NO: 2293096 - protein, 17 aa, Cryptosporidium parvum
GGDIFGRIRSNKWITNT

SEQ ID NO: 2293097 - protein, 25 aa, Cryptosporidium parvum
GGDSFSMPSYIRIPSNNFPNSNNRN

SEQ ID NO: 2293098 - protein, 24 aa, Cryptosporidium parvum
GGEEFRIPFLVNYGTRCQPNKFER

SEQ ID NO: 2293099 - protein, 20 aa, Cryptosporidium parvum
GGEGKCLWIDTEGTFRPERI

SEQ ID NO: 2293100 - protein, 19 aa, Cryptosporidium parvum
GGEGLNLQVANYVFLLDPW

SEQ ID NO: 2293101 - protein, 21 aa, Cryptosporidium parvum
GGELQRVALILALGKKADIYL

SEQ ID NO: 2293102 - protein, 19 aa, Cryptosporidium parvum
GGELTRIGCEQAEELGKHL

SEQ ID NO: 2293103 - protein, 19 aa, Cryptosporidium parvum
GGEQSLCTILFILSLQVSL

SEQ ID NO: 2293104 - protein, 23 aa, Cryptosporidium parvum
GGEVCGLRISEFHYGSKSPLFEE

SEQ ID NO: 2293105 - protein, 22 aa, Cryptosporidium parvum
GGEYIGGLLPGALAAAGLNIGG

SEQ ID NO: 2293106 - protein, 19 aa, Cryptosporidium parvum
GGFELTWWRSRGAEEIIST

SEQ ID NO: 2293107 - protein, 24 aa, Cryptosporidium parvum
GGFRYDLCSEKIYKIFQASNWKND

SEQ ID NO: 2293108 - protein, 22 aa, Cryptosporidium parvum
GGFYGHPCKCLFINWHKLSIWM

SEQ ID NO: 2293109 - protein, 23 aa, Cryptosporidium parvum
GGGACNRLRVQIVAISKKLNNEE

SEQ ID NO: 2293110 - protein, 21 aa, Cryptosporidium parvum
GGGGSSMGIGGRIERNENKIS

SEQ ID NO: 2293111 - protein, 23 aa, Cryptosporidium parvum
GGGHCMDIAKVLRVLYEDPNTTL

SEQ ID NO: 2293112 - protein, 19 aa, Cryptosporidium parvum
GGGIFTFGSYRLGVVAAGS

SEQ ID NO: 2293113 - protein, 17 aa, Cryptosporidium parvum
GGGKRKGAIAIYLEPWH

SEQ ID NO: 2293114 - protein, 20 aa, Cryptosporidium parvum
GGGLALNEFGSFMGNMNEEP

SEQ ID NO: 2293115 - protein, 27 aa, Cryptosporidium parvum
GGGLTPLSMCLLIKYNCETLVDLELEG

SEQ ID NO: 2293116 - protein, 24 aa, Cryptosporidium parvum
GGGPHLGPHPHIFIHGNPQFHYHH

SEQ ID NO: 2293117 - protein, 19 aa, Cryptosporidium parvum
GGGRDGGQGRVWRGRSRYS

SEQ ID NO: 2293118 - protein, 21 aa, Cryptosporidium parvum
GGGVTCLNASSASLGFQNGLP

SEQ ID NO: 2293119 - protein, 20 aa, Cryptosporidium parvum
GGGWPERPGGSGIGNDENEE

SEQ ID NO: 2293120 - protein, 20 aa, Cryptosporidium parvum
GGHEFIDISLLPGVNLITGG

SEQ ID NO: 2293121 - protein, 19 aa, Cryptosporidium parvum
GGHFHSWVMSWHFSEVDNS

SEQ ID NO: 2293122 - protein, 26 aa, Cryptosporidium parvum
GGHGRFTFLLLRALERYSPVWEDLGY

SEQ ID NO: 2293123 - protein, 21 aa, Cryptosporidium parvum
GGHISEKVVVPKLFNSTPDLY

SEQ ID NO: 2293124 - protein, 17 aa, Cryptosporidium parvum
GGHTCMHFLCTRPLQML

SEQ ID NO: 2293125 - protein, 18 aa, Cryptosporidium parvum
GGIDARFDIDSETLGDEI

SEQ ID NO: 2293126 - protein, 19 aa, Cryptosporidium parvum
GGIIAPIIVVPGATIPGGM

SEQ ID NO: 2293127 - protein, 22 aa, Cryptosporidium parvum
GGILRKVFEAITNLVSDVNLEC

SEQ ID NO: 2293128 - protein, 21 aa, Cryptosporidium parvum
GGILRYKVDFQDYAVVEDDLD

SEQ ID NO: 2293129 - protein, 18 aa, Cryptosporidium parvum
GGINCLAYSPSAEKPYIA

SEQ ID NO: 2293130 - protein, 17 aa, Cryptosporidium parvum
GGIPFLLNLRHFYQFNF

SEQ ID NO: 2293131 - protein, 22 aa, Cryptosporidium parvum
GGISLPFVLKVVLSESLDMILL

SEQ ID NO: 2293132 - protein, 19 aa, Cryptosporidium parvum
GGKKDRHWPIIGESLPNRS

SEQ ID NO: 2293133 - protein, 19 aa, Cryptosporidium parvum
GGKKFSFANFSTEFLEDRF

SEQ ID NO: 2293134 - protein, 17 aa, Cryptosporidium parvum
GGLGRLLVHMKLINKNE

SEQ ID NO: 2293135 - protein, 19 aa, Cryptosporidium parvum
GGLIKSAFNAFSYIGINSF

SEQ ID NO: 2293136 - protein, 17 aa, Cryptosporidium parvum
GGLKCLLDSITIIDNEL

SEQ ID NO: 2293137 - protein, 23 aa, Cryptosporidium parvum
GGMGMMDKCYFTGKSDLLNWLNS

SEQ ID NO: 2293138 - protein, 21 aa, Cryptosporidium parvum
GGNIILPLALIDKCIGNRIYV

SEQ ID NO: 2293139 - protein, 23 aa, Cryptosporidium parvum
GGPKPRCSHQAVIFNECLYIHGG

SEQ ID NO: 2293140 - protein, 55 aa, Cryptosporidium parvum
GGRPSHALLICKRICHFDSRLSKLYRSMYIQNYRVGLKILKKRAALNNEEKINKL

SEQ ID NO: 2293141 - protein, 21 aa, Cryptosporidium parvum
GGRSSRHCCRKHHSRKHKKEA

SEQ ID NO: 2293142 - protein, 25 aa, Cryptosporidium parvum
GGSCNICGSVKHLARNCDQQISKTN

SEQ ID NO: 2293143 - protein, 30 aa, Cryptosporidium parvum; identical to SEQ ID NO: 2171899

SEQ ID NO: 2293144 - protein, 18 aa, Cryptosporidium parvum
GGSFLTKEILRLENSINT

SEQ ID NO: 2293145 - protein, 17 aa, Cryptosporidium parvum
GGSKKEWGIESISNNIF

SEQ ID NO: 2293146 - protein, 19 aa, Cryptosporidium parvum
GGSVFEFKLTSGIPSTVPT

SEQ ID NO: 2293147 - protein, 18 aa, Cryptosporidium parvum
GGVFTRLINRNTTIPTKK

SEQ ID NO: 2293148 - protein, 24 aa, Cryptosporidium parvum
GGVRGCAYCGGLGHRIGQCTKLLE

SEQ ID NO: 2293149 - protein, 18 aa, Cryptosporidium parvum
GGYNCLLLTGLLEHYQSF

SEQ ID NO: 2293150 - protein, 18 aa, Cryptosporidium parvum
GGYNFRILLTPYKLDSLN

SEQ ID NO: 2293151 - protein, 21 aa, Cryptosporidium parvum
GHAKAHIVGLDIFTNKKYEDV

SEQ ID NO: 2293152 - protein, 22 aa, Cryptosporidium parvum
GHCAGALVYKGMNGYLAVIRGL

SEQ ID NO: 2293153 - protein, 27 aa, Cryptosporidium parvum
GHCQNYFLYKRIRSIIGKGEKINLTNL

SEQ ID NO: 2293154 - protein, 23 aa, Cryptosporidium parvum
GHDIWPGACYVYKSNGSKSSLRY

SEQ ID NO: 2293155 - protein, 23 aa, Cryptosporidium parvum
GHEKEVNCIRFSSSGELLASGGQ

SEQ ID NO: 2293156 - protein, 18 aa, Cryptosporidium parvum
GHEYEVWDYLGNPESDIP

SEQ ID NO: 2293157 - protein, 17 aa, Cryptosporidium parvum
GHFSERYAAVIMRQVFS

SEQ ID NO: 2293158 - protein, 17 aa, Cryptosporidium parvum
GHGQRHGHGHGHGHTQT

SEQ ID NO: 2293159 - protein, 18 aa, Cryptosporidium parvum
GHHTAILLVTGKLYMFGG

SEQ ID NO: 2293160 - protein, 24 aa, Cryptosporidium parvum
GHITSIAVLRTHRGFGLAKKLLTQ

SEQ ID NO: 2293161 - protein, 20 aa, Cryptosporidium parvum
GHLELNRSIFCMGIKEYSLF

SEQ ID NO: 2293162 - protein, 18 aa, Cryptosporidium parvum
GHNDRIWTLNLLKESNFT

SEQ ID NO: 2293163 - protein, 29 aa, Cryptosporidium parvum
GHNLFLPYIFELHSGGLFPAPILINEMED

SEQ ID NO: 2293164 - protein, 20 aa, Cryptosporidium parvum
GHSMRLRSAYSMAKAMVEGH

SEQ ID NO: 2293165 - protein, 19 aa, Cryptosporidium parvum
GHVNCGRQAPMFSKGSKIK

SEQ ID NO: 2293166 - protein, 20 aa, Cryptosporidium parvum
GIAANEPFTFSMIDEISEKF

SEQ ID NO: 2293167 - protein, 29 aa, Cryptosporidium parvum
GIAARILKRSLPLVFSRYMSSKCEGKKSS

SEQ ID NO: 2293168 - protein, 18 aa, Cryptosporidium parvum
GIAEIVLLAADAEPLEIL

SEQ ID NO: 2293169 - protein, 19 aa, Cryptosporidium parvum
GIAPGCLKTYVITDSNLLC

SEQ ID NO: 2293170 - protein, 26 aa, Cryptosporidium parvum
GIATGCLYLKQRGIFHLNLKPTNILI

SEQ ID NO: 2293171 - protein, 20 aa, Cryptosporidium parvum
GIATICRIHRLHIAPDYDEF

SEQ ID NO: 2293172 - protein, 17 aa, Cryptosporidium parvum
GICGMRLNAERISTIAR

SEQ ID NO: 2293173 - protein, 24 aa, Cryptosporidium parvum
GIDFDRHYGRCVVMVGIPYQYTLS

SEQ ID NO: 2293174 - protein, 19 aa, Cryptosporidium parvum
GIDIFLRIPEYIRPKKDGA

SEQ ID NO: 2293175 - protein, 20 aa, Cryptosporidium parvum
GIEGFHQFFPGLNMGGEYIG

SEQ ID NO: 2293176 - protein, 18 aa, Cryptosporidium parvum
GIESISFTKVPEGKNQDI

SEQ ID NO: 2293177 - protein, 18 aa, Cryptosporidium parvum
GIETLGGVFTRLINRNTT

SEQ ID NO: 2293178 - protein, 34 aa, Cryptosporidium parvum; identical to SEQ ID NO: 2171931

SEQ ID NO: 2293179 - protein, 27 aa, Cryptosporidium parvum
GIGNLFPQEAIEYGSLMNSMECMGGLT

SEQ ID NO: 2293180 - protein, 27 aa, Cryptosporidium parvum
GIGTEILRCLIFSGFRRIDIVDYDYVE

SEQ ID NO: 2293181 - protein, 19 aa, Cryptosporidium parvum
GIIESYKFVIGNLQIDNQY

SEQ ID NO: 2293182 - protein, 23 aa, Cryptosporidium parvum
GIIPRAVQLIFERLESQYTEYGV

SEQ ID NO: 2293183 - protein, 21 aa, Cryptosporidium parvum
GIIRYCLIQLQSLGLVEFNPN

SEQ ID NO: 2293184 - protein, 19 aa, Cryptosporidium parvum
GIIVYNWNKQYSILLESDI

SEQ ID NO: 2293185 - protein, 28 aa, Cryptosporidium parvum
GIKAGDKVILCYTPGYDFVIAFTTCLVS

SEQ ID NO: 2293186 - protein, 23 aa, Cryptosporidium parvum
GIKEEPYCRFAKGLVSLLDSIKV

SEQ ID NO: 2293187 - protein, 23 aa, Cryptosporidium parvum
GIKERKNKVYGFAAGQDDGIEGE

SEQ ID NO: 2293188 - protein, 21 aa, Cryptosporidium parvum
GIKILKIVFLILINYNIFPGV

SEQ ID NO: 2293189 - protein, 24 aa, Cryptosporidium parvum
GIKNFPFAPSMKIDRLGAVCDFSY

SEQ ID NO: 2293190 - protein, 24 aa, Cryptosporidium parvum
GIKPLFPVKPLLSISSPDFEQIWK

SEQ ID NO: 2293191 - protein, 23 aa, Cryptosporidium parvum
GIKSEFDPSIFIGYNSARDRVIR

SEQ ID NO: 2293192 - protein, 28 aa, Cryptosporidium parvum
GILDSICYCVSCILSLYESKVNFDGENP

SEQ ID NO: 2293193 - protein, 19 aa, Cryptosporidium parvum
GILEGRYSFNFNSSKDKIK

SEQ ID NO: 2293194 - protein, 29 aa, Cryptosporidium parvum
GILEIKISIPFGYPLEASSFCISSWYFDV

SEQ ID NO: 2293195 - protein, 20 aa, Cryptosporidium parvum
GILNMNAFQLFGLENKFSIN

SEQ ID NO: 2293196 - protein, 17 aa, Cryptosporidium parvum
GILPIIADSLHEILEDF

SEQ ID NO: 2293197 - protein, 20 aa, Cryptosporidium parvum
GINCPARSIVFTSIKKYDGR

SEQ ID NO: 2293198 - protein, 20 aa, Cryptosporidium parvum
GINDLCWINPTLTPNIFSTV

SEQ ID NO: 2293199 - protein, 23 aa, Cryptosporidium parvum
GINELNPGFPLILPNQLYQVNNT

SEQ ID NO: 2293200 - protein, 19 aa, Cryptosporidium parvum
GINGKRSSLKIGNNNNNNN

SEQ ID NO: 2293201 - protein, 18 aa, Cryptosporidium parvum
GINKEWGISFVLYSISPH

SEQ ID NO: 2293202 - protein, 18 aa, Cryptosporidium parvum
GINLNEIRNELNISKSKN

SEQ ID NO: 2293203 - protein, 24 aa, Cryptosporidium parvum
GINLPSLRKPISLISRSPRNSYSK

SEQ ID NO: 2293204 - protein, 23 aa, Cryptosporidium parvum
GINNGGYEDIRFGNKSGTHNMVF

SEQ ID NO: 2293205 - protein, 24 aa, Cryptosporidium parvum
GINNGYSWRKNKPITDNNVNQESK

SEQ ID NO: 2293206 - protein, 18 aa, Cryptosporidium parvum
GINPSKWGGSVLPKSNGV

SEQ ID NO: 2293207 - protein, 21 aa, Cryptosporidium parvum
GINRNKIKVIFNGINCKTFDS

SEQ ID NO: 2293208 - protein, 17 aa, Cryptosporidium parvum
GIPEYVSLMPYYTSLCY

SEQ ID NO: 2293209 - protein, 18 aa, Cryptosporidium parvum
GIPSIVHYVTAICGHPKK

SEQ ID NO: 2293210 - protein, 17 aa, Cryptosporidium parvum
GIPTPFVVDALSEVGKS

SEQ ID NO: 2293211 - protein, 18 aa, Cryptosporidium parvum
GIQALNFGNKYRKIEQTV

SEQ ID NO: 2293212 - protein, 27 aa, Cryptosporidium parvum
GIQASLNARCSIFAAANPVYGHFDDFM

SEQ ID NO: 2293213 - protein, 30 aa, Cryptosporidium parvum
GIQRSLARLWFDYVFSVKCLSPSTSPYLSL

SEQ ID NO: 2293214 - protein, 18 aa, Cryptosporidium parvum
GIRAFGLRIPKFPVPKIT

SEQ ID NO: 2293215 - protein, 18 aa, Cryptosporidium parvum
GIRFLKRLSKELERQNGN

SEQ ID NO: 2293216 - protein, 18 aa, Cryptosporidium parvum
GIRGEFRASNMNTRVMKS

SEQ ID NO: 2293217 - protein, 22 aa, Cryptosporidium parvum
GIRRRFERRIYIPLPDEESRVL

SEQ ID NO: 2293218 - protein, 26 aa, Cryptosporidium parvum
GIRSEYRLTPVRSLAIFLEKLKKDTL

SEQ ID NO: 2293219 - protein, 18 aa, Cryptosporidium parvum
GISDLKFKPAFNPYTEPS

SEQ ID NO: 2293220 - protein, 23 aa, Cryptosporidium parvum
GISGKLLIYDDWLYFGPLSVQEL

SEQ ID NO: 2293221 - protein, 26 aa, Cryptosporidium parvum
GISIEPSSDWGLERHSKFALEKVTAL

SEQ ID NO: 2293222 - protein, 23 aa, Cryptosporidium parvum
GISIQGFNLLPFITSSNKLIEIA

SEQ ID NO: 2293223 - protein, 27 aa, Cryptosporidium parvum
GISMGGAIALRLAEYIGQICQEDNLDG

SEQ ID NO: 2293224 - protein, 19 aa, Cryptosporidium parvum
GISQRHICYYYKELSENFK

SEQ ID NO: 2293225 - protein, 19 aa, Cryptosporidium parvum
GISVIRRVRKSDNNRIARV

SEQ ID NO: 2293226 - protein, 25 aa, Cryptosporidium parvum
GITQLEWKLIEFFKRHNYRINADNG

SEQ ID NO: 2293227 - protein, 19 aa, Cryptosporidium parvum
GITRVPLKGSDQCDNIEQL

SEQ ID NO: 2293228 - protein, 17 aa, Cryptosporidium parvum
GIVNFAMKWESDKRQST

SEQ ID NO: 2293229 - protein, 21 aa, Cryptosporidium parvum
GIYDSKFKYLILNFSSLYMKK

SEQ ID NO: 2293230 - protein, 19 aa, Cryptosporidium parvum
GIYNKGFNRPSKIQAAALP

SEQ ID NO: 2293231 - protein, 25 aa, Cryptosporidium parvum
GIYWVLCCSDLIQFNICDQLHNARN

SEQ ID NO: 2293232 - protein, 19 aa, Cryptosporidium parvum
GKAECKMVICDPSYVLNEN

SEQ ID NO: 2293233 - protein, 20 aa, Cryptosporidium parvum
GKAFEIQNIFGLSNKSSKAS

SEQ ID NO: 2293234 - protein, 18 aa, Cryptosporidium parvum
GKALSGLLDGIGKMDNII

SEQ ID NO: 2293235 - protein, 20 aa, Cryptosporidium parvum
GKARARKLVILYGNLSFPSK

SEQ ID NO: 2293236 - protein, 18 aa, Cryptosporidium parvum
GKCSCGYWQTPSFQIHKS

SEQ ID NO: 2293237 - protein, 18 aa, Cryptosporidium parvum
GKCSFLLDLDYWKDINSI

SEQ ID NO: 2293238 - protein, 20 aa, Cryptosporidium parvum
GKDCAIIKWDLETGKKIIFP

SEQ ID NO: 2293239 - protein, 23 aa, Cryptosporidium parvum
GKDGRIRGNLMGKRVDFSARTVI

SEQ ID NO: 2293240 - protein, 22 aa, Cryptosporidium parvum
GKDIKCRPILIVKLAKLDTFVG

SEQ ID NO: 2293241 - protein, 17 aa, Cryptosporidium parvum
GKDRVGVVIAILLSILG

SEQ ID NO: 2293242 - protein, 26 aa, Cryptosporidium parvum
GKDSLLCIDGWGLIEHHKEDTPISPK

SEQ ID NO: 2293243 - protein, 23 aa, Cryptosporidium parvum
GKEDEIFIDYCINQLVYKIRKSA

SEQ ID NO: 2293244 - protein, 27 aa, Cryptosporidium parvum
GKERVRLFWIILKSLMLKTGAKMKHLI

SEQ ID NO: 2293245 - protein, 19 aa, Cryptosporidium parvum
GKETLKLPPGIRVYTKLSK

SEQ ID NO: 2293246 - protein, 26 aa, Cryptosporidium parvum
GKEVFKCFLCGELGHTLKDCKKPRND

SEQ ID NO: 2293247 - protein, 23 aa, Cryptosporidium parvum
GKEVKCFHDLYKWNIDKDEWRQV

SEQ ID NO: 2293248 - protein, 21 aa, Cryptosporidium parvum
GKEVRYSVMLSYEEKLIAHQI

SEQ ID NO: 2293249 - protein, 20 aa, Cryptosporidium parvum
GKFSGRFICIEGMYTFLDIS

SEQ ID NO: 2293250 - protein, 17 aa, Cryptosporidium parvum
GKGDIYLQNGIEKIEGI

SEQ ID NO: 2293251 - protein, 19 aa, Cryptosporidium parvum
GKGILRFAMGHSIQGVWKD

SEQ ID NO: 2293252 - protein, 39 aa, Cryptosporidium parvum; identical to SEQ ID NO: 2172000

SEQ ID NO: 2293253 - protein, 18 aa, Cryptosporidium parvum
GKGKRNGVFGTFLLAVYN

SEQ ID NO: 2293254 - protein, 21 aa, Cryptosporidium parvum
GKGSFAYAWIFDDCDDERERG

SEQ ID NO: 2293255 - protein, 23 aa, Cryptosporidium parvum
GKHDKWVIAWSFFEKEERTSILK

SEQ ID NO: 2293256 - protein, 18 aa, Cryptosporidium parvum
GKHKALLGSIRGFKGNNV

SEQ ID NO: 2293257 - protein, 18 aa, Cryptosporidium parvum
GKIKLSSMKAFDNSDNVN

SEQ ID NO: 2293258 - protein, 20 aa, Cryptosporidium parvum
GKIRLNDLIIALRRAFDNGT

SEQ ID NO: 2293259 - protein, 22 aa, Cryptosporidium parvum
GKISTKELFKLFSQADSSIQME

SEQ ID NO: 2293260 - protein, 17 aa, Cryptosporidium parvum
GKIYLPETCKFGTFESG

SEQ ID NO: 2293261 - protein, 29 aa, Cryptosporidium parvum
GKKELMQLLKWRFLVLKDIKANSIGKKDS

SEQ ID NO: 2293262 - protein, 24 aa, Cryptosporidium parvum
GKKLRCCTKEGLTLEETAEEKEAF

SEQ ID NO: 2293263 - protein, 19 aa, Cryptosporidium parvum
GKKQRLWSFGGQDKLLSLD

SEQ ID NO: 2293264 - protein, 24 aa, Cryptosporidium parvum
GKKSCELNELLGLNSQGIVSDRAN

SEQ ID NO: 2293265 - protein, 25 aa, Cryptosporidium parvum
GKKSFELKNRIALIDAQNLLSRYNL

SEQ ID NO: 2293266 - protein, 19 aa, Cryptosporidium parvum
GKKYRCRYISGKIDKAQES

SEQ ID NO: 2293267 - protein, 23 aa, Cryptosporidium parvum
GKLFDLSYEEVFIVKMTSTNKSF

SEQ ID NO: 2293268 - protein, 22 aa, Cryptosporidium parvum
GKLIKLRVLIVGLRGLGVEIAK

SEQ ID NO: 2293269 - protein, 17 aa, Cryptosporidium parvum
GKLKFVFSTHVFGINTE

SEQ ID NO: 2293270 - protein, 27 aa, Cryptosporidium parvum
GKLKGRIKVYEYCPGSDKMILSPRFLK

SEQ ID NO: 2293271 - protein, 23 aa, Cryptosporidium parvum
GKLLKNAFFPKFNKLEEFDSLSL

SEQ ID NO: 2293272 - protein, 24 aa, Cryptosporidium parvum
GKLLNLRLDDLLIMLHNTGILEND

SEQ ID NO: 2293273 - protein, 39 aa, Cryptosporidium parvum; identical to SEQ ID NO: 2172014

SEQ ID NO: 2293274 - protein, 22 aa, Cryptosporidium parvum
GKLTGLRIVRIATHPSAQRMGY

SEQ ID NO: 2293275 - protein, 18 aa, Cryptosporidium parvum
GKLVEIFSYIHFQDYFLQ

SEQ ID NO: 2293276 - protein, 20 aa, Cryptosporidium parvum
GKLYLIFDFFPIGPTMAPDT

SEQ ID NO: 2293277 - protein, 24 aa, Cryptosporidium parvum
GKLYRLVRSSFPFNLSSGPPNWGL

SEQ ID NO: 2293278 - protein, 18 aa, Cryptosporidium parvum
GKMYPGLAMSRAIGDTLG

SEQ ID NO: 2293279 - protein, 22 aa, Cryptosporidium parvum
GKNSLSDSFVWKDYHRGYISTE

SEQ ID NO: 2293280 - protein, 17 aa, Cryptosporidium parvum
GKPAVTITPKFAASPPK

SEQ ID NO: 2293281 - protein, 20 aa, Cryptosporidium parvum
GKPFKRKRISQKKIQGNIDN

SEQ ID NO: 2293282 - protein, 21 aa, Cryptosporidium parvum
GKPGVVGNLNISTGNVSYIDA

SEQ ID NO: 2293283 - protein, 24 aa, Cryptosporidium parvum
GKPSLKTSQGFKGCKLFLSNIEIV

SEQ ID NO: 2293284 - protein, 17 aa, Cryptosporidium parvum
GKPWKDSYIVIMSDGVS

SEQ ID NO: 2293285 - protein, 21 aa, Cryptosporidium parvum
GKRILAEGMLTVFSPKNIPLM

SEQ ID NO: 2293286 - protein, 20 aa, Cryptosporidium parvum
GKRKGAIAIYLEPWHVDVVE

SEQ ID NO: 2293287 - protein, 22 aa, Cryptosporidium parvum
GKRNRDGYEKGDDFRMISAYDF

SEQ ID NO: 2293288 - protein, 19 aa, Cryptosporidium parvum
GKRYIEVFISSFQELTTAR

SEQ ID NO: 2293289 - protein, 18 aa, Cryptosporidium parvum
GKSARVFSNSIMKNSLQY

SEQ ID NO: 2293290 - protein, 17 aa, Cryptosporidium parvum
GKSKWKDFIFWDQAKNS

SEQ ID NO: 2293291 - protein, 23 aa, Cryptosporidium parvum
GKSLEIITLILMNPRKEYYYYLN

SEQ ID NO: 2293292 - protein, 19 aa, Cryptosporidium parvum
GKSRGYGFVSFTNPNDMLN

SEQ ID NO: 2293293 - protein, 27 aa, Cryptosporidium parvum
GKSTGRCNCGYPIFIINGEVIAGSSGF

SEQ ID NO: 2293294 - protein, 23 aa, Cryptosporidium parvum
GKSYLFERYSRFGMSDSIIQRNF

SEQ ID NO: 2293295 - protein, 22 aa, Cryptosporidium parvum
GKSYLSKILLIYSLMDIDVGYV

SEQ ID NO: 2293296 - protein, 21 aa, Cryptosporidium parvum
GKTATFALAMLGKVDTRIIHP

SEQ ID NO: 2293297 - protein, 17 aa, Cryptosporidium parvum
GKTFATKWYKSSEQTIE

SEQ ID NO: 2293298 - protein, 19 aa, Cryptosporidium parvum
GKTLCYILPILGRLKNDKV

SEQ ID NO: 2293299 - protein, 22 aa, Cryptosporidium parvum
GKTNIAMLCILNIISQFIEPQN

SEQ ID NO: 2293300 - protein, 27 aa, Cryptosporidium parvum
GKVEHIWKSTCFIKLPSKLDDGGYFTC

SEQ ID NO: 2293301 - protein, 24 aa, Cryptosporidium parvum
GKVKIEHIEWVLSIRTEPKNFISE

SEQ ID NO: 2293302 - protein, 22 aa, Cryptosporidium parvum
GKVNGFSICKGVNKNGTLCTNP

SEQ ID NO: 2293303 - protein, 28 aa, Cryptosporidium parvum
GKVPKQLWLQWFHLERMSGSSIYSLNYL

SEQ ID NO: 2293304 - protein, 18 aa, Cryptosporidium parvum
GKVSPILYVRTLVYKLGN

SEQ ID NO: 2293305 - protein, 25 aa, Cryptosporidium parvum
GKVVIDCFRLISPHSVIAGQEPRQT

SEQ ID NO: 2293306 - protein, 17 aa, Cryptosporidium parvum
GKWEVLTNISGNEQHQQ

SEQ ID NO: 2293307 - protein, 25 aa, Cryptosporidium parvum
GKYDVIHFILKFVVDIDRQIQDKML

SEQ ID NO: 2293308 - protein, 20 aa, Cryptosporidium parvum
GKYELIGVICHLGKSVHSGH

SEQ ID NO: 2293309 - protein, 26 aa, Cryptosporidium parvum
GKYGLELYFKDCRFYYNNISKSQTLR

SEQ ID NO: 2293310 - protein, 26 aa, Cryptosporidium parvum
GKYNLRASLKLPEFTSYLINNNYQLY

SEQ ID NO: 2293311 - protein, 17 aa, Cryptosporidium parvum
GKYSIKGSDIIGKNYYS

SEQ ID NO: 2293312 - protein, 25 aa, Cryptosporidium parvum
GKYTIKIPLSIIFLFPPSELQVKSK

SEQ ID NO: 2293313 - protein, 22 aa, Cryptosporidium parvum
GLARQVFHSVRMSLQEQARATK

SEQ ID NO: 2293314 - protein, 17 aa, Cryptosporidium parvum
GLCGPIKAIYLGLNHQT

SEQ ID NO: 2293315 - protein, 19 aa, Cryptosporidium parvum
GLCTIRKFMYSDFEFYEKA

SEQ ID NO: 2293316 - protein, 20 aa, Cryptosporidium parvum
GLDDIFFKNMLEIATENKRL

SEQ ID NO: 2293317 - protein, 23 aa, Cryptosporidium parvum
GLDEFSHLWIIFIFDDVPQDITI

SEQ ID NO: 2293318 - protein, 18 aa, Cryptosporidium parvum
GLEKAIKWHQMMMTDYPY

SEQ ID NO: 2293319 - protein, 26 aa, Cryptosporidium parvum
GLENGLKIVLCIGESLSERETGKTND

SEQ ID NO: 2293320 - protein, 23 aa, Cryptosporidium parvum
GLETLPSVVLSFIVDKCNEQLLQ

SEQ ID NO: 2293321 - protein, 19 aa, Cryptosporidium parvum
GLFLKELIILILREENEAD

SEQ ID NO: 2293322 - protein, 20 aa, Cryptosporidium parvum
GLFPELKKILLTSNNPIPNE

SEQ ID NO: 2293323 - protein, 27 aa, Cryptosporidium parvum
GLFQRCVAQFDRLMKRGAFLDNYKKQS

SEQ ID NO: 2293324 - protein, 18 aa, Cryptosporidium parvum
GLFQSCLEKVEDYFTLDL

SEQ ID NO: 2293325 - protein, 51 aa, Cryptosporidium parvum; identical to SEQ ID NO: 2172068

SEQ ID NO: 2293326 - protein, 18 aa, Cryptosporidium parvum
GLGKEYMKLFDLKVFDND

SEQ ID NO: 2293327 - protein, 18 aa, Cryptosporidium parvum
GLIELIVHPLCIDDPAPW

SEQ ID NO: 2293328 - protein, 17 aa, Cryptosporidium parvum
GLIKTLRIIISGKRSKH

SEQ ID NO: 2293329 - protein, 19 aa, Cryptosporidium parvum
GLKKLPGTNLVKISSKPGE

SEQ ID NO: 2293330 - protein, 20 aa, Cryptosporidium parvum
GLLDETRLLGAVKVEELLLW

SEQ ID NO: 2293331 - protein, 18 aa, Cryptosporidium parvum
GLLDGKKYIPGSVGGGLI

SEQ ID NO: 2293332 - protein, 22 aa, Cryptosporidium parvum
GLLFEFRLSWSNHLIYTHWMER

SEQ ID NO: 2293333 - protein, 24 aa, Cryptosporidium parvum
GLLINLYYSFGFEVDSNNSPQTLP

SEQ ID NO: 2293334 - protein, 18 aa, Cryptosporidium parvum
GLLKGVLSGIANQITQVP

SEQ ID NO: 2293335 - protein, 18 aa, Cryptosporidium parvum
GLLKKELKIEDSVLLICN

SEQ ID NO: 2293336 - protein, 33 aa, Cryptosporidium parvum
GLLKMELLNGSKLKVVIMSATFQSSSFEDFFSS

SEQ ID NO: 2293337 - protein, 22 aa, Cryptosporidium parvum
GLLSNFDWRSSYLPHIYSATLG

SEQ ID NO: 2293338 - protein, 25 aa, Cryptosporidium parvum
GLNNWSRVASLLIMKSAKQCKSRWY

SEQ ID NO: 2293339 - protein, 17 aa, Cryptosporidium parvum
GLNTAVFHKGAFREENN

SEQ ID NO: 2293340 - protein, 25 aa, Cryptosporidium parvum
GLNVREIYGGLSLYKRNKKRITGII

SEQ ID NO: 2293341 - protein, 23 aa, Cryptosporidium parvum
GLPWKAAVLDIIAFFNPICRISS

SEQ ID NO: 2293342 - protein, 25 aa, Cryptosporidium parvum
GLQDPRANLFWDPAVMAAASSVSPF

SEQ ID NO: 2293343 - protein, 29 aa, Cryptosporidium parvum
GLQEIGPRFTLKLMWIQEGTFNTKKGIYE

SEQ ID NO: 2293344 - protein, 26 aa, Cryptosporidium parvum
GLQFILRLLFRYNILSASQYMSAIPS

SEQ ID NO: 2293345 - protein, 27 aa, Cryptosporidium parvum
GLQKLRWYCQLCEKQCRDENGFKCHRM

SEQ ID NO: 2293346 - protein, 18 aa, Cryptosporidium parvum
GLQLKLKAFDNFLQNYPY

SEQ ID NO: 2293347 - protein, 22 aa, Cryptosporidium parvum
GLRAEGYYQMTLIQRDTLPHSL

SEQ ID NO: 2293348 - protein, 20 aa, Cryptosporidium parvum
GLRKMSCILKLKILTLNDHI

SEQ ID NO: 2293349 - protein, 19 aa, Cryptosporidium parvum
GLSATCIKNQVSFGNKFEN

SEQ ID NO: 2293350 - protein, 24 aa, Cryptosporidium parvum
GLSISFPTIVAYVVDTVRSQKPVT

SEQ ID NO: 2293351 - protein, 18 aa, Cryptosporidium parvum
GLSRGFSFCEYRDIETCI

SEQ ID NO: 2293352 - protein, 18 aa, Cryptosporidium parvum
GLSSRSIQWGAWDEDGMA

SEQ ID NO: 2293353 - protein, 20 aa, Cryptosporidium parvum
GLSSSFKNPFISLAANTENS

SEQ ID NO: 2293354 - protein, 25 aa, Cryptosporidium parvum
GLSVCKHIFCFVCIKQWSDVATQCP

SEQ ID NO: 2293355 - protein, 18 aa, Cryptosporidium parvum
GLTGELRKGEQYLKELRF

SEQ ID NO: 2293356 - protein, 18 aa, Cryptosporidium parvum
GLTKVSCKLEFEFDTILM

SEQ ID NO: 2293357 - protein, 20 aa, Cryptosporidium parvum
GLTMKWTEGSFWTANVKIVP

SEQ ID NO: 2293358 - protein, 18 aa, Cryptosporidium parvum
GLTPKFKDVHTLIKAVNF

SEQ ID NO: 2293359 - protein, 19 aa, Cryptosporidium parvum
GLVCGGAAGLILGPIGVSF

SEQ ID NO: 2293360 - protein, 18 aa, Cryptosporidium parvum
GLVLCGSAFGMTQGAILA

SEQ ID NO: 2293361 - protein, 19 aa, Cryptosporidium parvum
GLVLPIFKTNWDLLKLINK

SEQ ID NO: 2293362 - protein, 17 aa, Cryptosporidium parvum
GLVRSATSFAFQRHIDM

SEQ ID NO: 2293363 - protein, 26 aa, Cryptosporidium parvum
GLYDLFCKFNILLQYFQYKALRYLQI

SEQ ID NO: 2293364 - protein, 18 aa, Cryptosporidium parvum
GLYKENVLDFNINGFDDF

SEQ ID NO: 2293365 - protein, 22 aa, Cryptosporidium parvum
GLYSIKELRCIAVDYIESNRKT

SEQ ID NO: 2293366 - protein, 22 aa, Cryptosporidium parvum
GLYSLTCQLFFTSNEARLTQKK

SEQ ID NO: 2293367 - protein, 21 aa, Cryptosporidium parvum
GMAASCHYDYHSFGVQSTNSA

SEQ ID NO: 2293368 - protein, 18 aa, Cryptosporidium parvum
GMFSSVVKCVDMETQNEV

SEQ ID NO: 2293369 - protein, 22 aa, Cryptosporidium parvum
GMGPFGNFGGPFGGGSSGAIGV

SEQ ID NO: 2293370 - protein, 34 aa, Cryptosporidium parvum
GMIEKYRLISIYRFYYACFLKDLCNPMITFELIM

SEQ ID NO: 2293371 - protein, 20 aa, Cryptosporidium parvum
GMIKDEWKKDLDKFVLDCDL

SEQ ID NO: 2293372 - protein, 24 aa, Cryptosporidium parvum
GMINSNWDSNDWGFDEDFEEEETE

SEQ ID NO: 2293373 - protein, 17 aa, Cryptosporidium parvum
GMLPNLIYLDFQKINKV

SEQ ID NO: 2293374 - protein, 21 aa, Cryptosporidium parvum
GMNEYRGGRTFEDWIKSKENS

SEQ ID NO: 2293375 - protein, 21 aa, Cryptosporidium parvum
GMNLLLFLTGRFICRQKGLDV

SEQ ID NO: 2293376 - protein, 17 aa, Cryptosporidium parvum
GMNPVCFSFTDQVRACI

SEQ ID NO: 2293377 - protein, 22 aa, Cryptosporidium parvum
GMRECHIYDGLALTKFLYYLYK

SEQ ID NO: 2293378 - protein, 20 aa, Cryptosporidium parvum
GMTACYCCAPPLVNFESNFS

SEQ ID NO: 2293379 - protein, 24 aa, Cryptosporidium parvum
GNAGKLCHILSCKVFENGQLGVIW

SEQ ID NO: 2293380 - protein, 23 aa, Cryptosporidium parvum
GNCLQIASLYGIVCGIRSLGDFS

SEQ ID NO: 2293381 - protein, 17 aa, Cryptosporidium parvum
GNDRMCALHCLNSILQG

SEQ ID NO: 2293382 - protein, 19 aa, Cryptosporidium parvum
GNDSYWLGTIDKVLQGISK

SEQ ID NO: 2293383 - protein, 18 aa, Cryptosporidium parvum
GNEVCLFVKDPQRKWKEL

SEQ ID NO: 2293384 - protein, 20 aa, Cryptosporidium parvum
GNFLFYSLFEALKVNLNVDQ

SEQ ID NO: 2293385 - protein, 25 aa, Cryptosporidium parvum
GNFVRVGTNFAFAFLGESYVEEAAT

SEQ ID NO: 2293386 - protein, 19 aa, Cryptosporidium parvum
GNGFSESYFDARVNNKGIN

SEQ ID NO: 2293387 - protein, 18 aa, Cryptosporidium parvum
GNGKISRQQFIWLTSIGG

SEQ ID NO: 2293388 - protein, 23 aa, Cryptosporidium parvum
GNGKNIWSLSGILIQMQGLEIKL

SEQ ID NO: 2293389 - protein, 18 aa, Cryptosporidium parvum
GNGKVCFIDTEGTFRPER

SEQ ID NO: 2293390 - protein, 25 aa, Cryptosporidium parvum
GNGKYCGDETCFLTSLRPMFSIIGQ

SEQ ID NO: 2293391 - protein, 26 aa, Cryptosporidium parvum
GNGMIPVLCIKLGSTILNKEFSGRLY

SEQ ID NO: 2293392 - protein, 18 aa, Cryptosporidium parvum
GNGSFPASSRKFIRYLSK

SEQ ID NO: 2293393 - protein, 19 aa, Cryptosporidium parvum
GNGSKEYLERIGLGHREEN

SEQ ID NO: 2293394 - protein, 20 aa, Cryptosporidium parvum
GNHLCEWAGFTCNWEYLPND

SEQ ID NO: 2293395 - protein, 29 aa, Cryptosporidium parvum
GNILPLNFCIPPLFGSCNPPFYGIGMNNS

SEQ ID NO: 2293396 - protein, 21 aa, Cryptosporidium parvum
GNINRLYFRGFQMKFDTQQNI

SEQ ID NO: 2293397 - protein, 22 aa, Cryptosporidium parvum
GNIRVEIWFSDFSNQSAHQALL

SEQ ID NO: 2293398 - protein, 26 aa, Cryptosporidium parvum
GNKFPRKSSKFVLSFKKSSDDIVKKT

SEQ ID NO: 2293399 - protein, 26 aa, Cryptosporidium parvum
GNKGYWNMYDWELLMRDIQYPAKNGE

SEQ ID NO: 2293400 - protein, 26 aa, Cryptosporidium parvum
GNKIKDFSELIVLKELPKLETLSLLL

SEQ ID NO: 2293401 - protein, 23 aa, Cryptosporidium parvum
GNKKELLDLILISEENIEFCFNK

SEQ ID NO: 2293402 - protein, 17 aa, Cryptosporidium parvum
GNKLKPGSKFQIGELVW

SEQ ID NO: 2293403 - protein, 20 aa, Cryptosporidium parvum
GNLAFPYKLFLRKSKTIPPT

SEQ ID NO: 2293404 - protein, 25 aa, Cryptosporidium parvum
GNLFEGSKYLLAWADKLTEIKTICR

SEQ ID NO: 2293405 - protein, 19 aa, Cryptosporidium parvum
GNLHGFGGLMAQDPDAPIP

SEQ ID NO: 2293406 - protein, 18 aa, Cryptosporidium parvum
GNLIFSPKVFLPCNPDKG

SEQ ID NO: 2293407 - protein, 20 aa, Cryptosporidium parvum
GNLLFFSWDNFGDCTDRMLI

SEQ ID NO: 2293408 - protein, 17 aa, Cryptosporidium parvum
GNLPILYNENNMLRCES

SEQ ID NO: 2293409 - protein, 19 aa, Cryptosporidium parvum
GNLPISFSAGSGKKVSITE

SEQ ID NO: 2293410 - protein, 17 aa, Cryptosporidium parvum
GNLPLKIMSSSQILSQY

SEQ ID NO: 2293411 - protein, 26 aa, Cryptosporidium parvum
GNLSKSFPSCWPLEYQNLNSIPLFRN

SEQ ID NO: 2293412 - protein, 18 aa, Cryptosporidium parvum
GNLTENILLNHLNQTQNQ

SEQ ID NO: 2293413 - protein, 21 aa, Cryptosporidium parvum
GNMPFKTFIFKILEDSGLSSK

SEQ ID NO: 2293414 - protein, 21 aa, Cryptosporidium parvum
GNNDLDWDTIIHIIDTDVIEG

SEQ ID NO: 2293415 - protein, 20 aa, Cryptosporidium parvum
GNNEGVAIVEFENFDDLSNS

SEQ ID NO: 2293416 - protein, 24 aa, Cryptosporidium parvum
GNNKRKLPKGGIWNFEDSNECVIC

SEQ ID NO: 2293417 - protein, 24 aa, Cryptosporidium parvum
GNNQRCYCSSIIGFQGISLTNTVT

SEQ ID NO: 2293418 - protein, 19 aa, Cryptosporidium parvum
GNPEWRSLWDYSCKNNSQF

SEQ ID NO: 2293419 - protein, 17 aa, Cryptosporidium parvum
GNPHICFNFSFENKMTE

SEQ ID NO: 2293420 - protein, 21 aa, Cryptosporidium parvum
GNPKECLDLSFSENDTVRDKI

SEQ ID NO: 2293421 - protein, 20 aa, Cryptosporidium parvum
GNPKNLWSSCHTNRTRHLGE

SEQ ID NO: 2293422 - protein, 19 aa, Cryptosporidium parvum
GNPTFKMLVQRHANQIRVC

SEQ ID NO: 2293423 - protein, 18 aa, Cryptosporidium parvum
GNQAIWRNLIPRIWSIFI

SEQ ID NO: 2293424 - protein, 23 aa, Cryptosporidium parvum
GNQCIYGVWFHFLCLKIINEPQK

SEQ ID NO: 2293425 - protein, 35 aa, Cryptosporidium parvum; identical to SEQ ID NO: 2172159

SEQ ID NO: 2293426 - protein, 19 aa, Cryptosporidium parvum
GNQLGRFVLVFNCDEQFDF

SEQ ID NO: 2293427 - protein, 24 aa, Cryptosporidium parvum
GNRGQLVPRNEMSGTVGYNNGVGF

SEQ ID NO: 2293428 - protein, 21 aa, Cryptosporidium parvum
GNRMITEILLKYGADINDVDE

SEQ ID NO: 2293429 - protein, 19 aa, Cryptosporidium parvum
GNRSKGFCFIEYTSQESAE

SEQ ID NO: 2293430 - protein, 19 aa, Cryptosporidium parvum
GNRVGVCISGGKDSSVLLN

SEQ ID NO: 2293431 - protein, 17 aa, Cryptosporidium parvum
GNRWKAIGVPIFIEGSQ

SEQ ID NO: 2293432 - protein, 19 aa, Cryptosporidium parvum
GNSGLKIGRNSDCDFPGKM

SEQ ID NO: 2293433 - protein, 25 aa, Cryptosporidium parvum
GNSIFFYKPWIPIMRISFKHNNEKY

SEQ ID NO: 2293434 - protein, 21 aa, Cryptosporidium parvum
GNSIIKVAIWFINHLSKSNIN

SEQ ID NO: 2293435 - protein, 18 aa, Cryptosporidium parvum
GNSIPNRRSLGSVSSTAG

SEQ ID NO: 2293436 - protein, 18 aa, Cryptosporidium parvum
GNSPLHWATTNKKKEVII

SEQ ID NO: 2293437 - protein, 32 aa, Cryptosporidium parvum; identical to SEQ ID NO: 2172167

SEQ ID NO: 2293438 - protein, 22 aa, Cryptosporidium parvum
GNSRSGAKPANFSYQSNPEPRR

SEQ ID NO: 2293439 - protein, 17 aa, Cryptosporidium parvum
GNSSCKIVLNQDSSVEN

SEQ ID NO: 2293440 - protein, 22 aa, Cryptosporidium parvum
GNSSMFLPGRAQNTAGQAGQVG

SEQ ID NO: 2293441 - protein, 26 aa, Cryptosporidium parvum
GNTIKIKCYLIWSIKFEIIKKKKRLK

SEQ ID NO: 2293442 - protein, 20 aa, Cryptosporidium parvum
GNTLEMFRILGRYNPLFFRP

SEQ ID NO: 2293443 - protein, 18 aa, Cryptosporidium parvum
GNTLFNFDPLDGLSDTEI

SEQ ID NO: 2293444 - protein, 26 aa, Cryptosporidium parvum
GNTRLTEIFSEYGLNGCDIKKKYNSQ

SEQ ID NO: 2293445 - protein, 34 aa, Cryptosporidium parvum
GNTSYHFALAFGHLDIIQLLSFKGVNPYITNNHD

SEQ ID NO: 2293446 - protein, 32 aa, Cryptosporidium parvum
GNTYLSLSSVERFFYIKQCESGYNSIINYKSQ

SEQ ID NO: 2293447 - protein, 20 aa, Cryptosporidium parvum
GNVAYWLYMPAISHIIDCHG

SEQ ID NO: 2293448 - protein, 25 aa, Cryptosporidium parvum
GNVIKWLKKQICKINPSLPPNEIIN

SEQ ID NO: 2293449 - protein, 19 aa, Cryptosporidium parvum
GNVMVLRINFEESIERCTS

SEQ ID NO: 2293450 - protein, 21 aa, Cryptosporidium parvum
GNVNNICPCDKAIDSCAAISK

SEQ ID NO: 2293451 - protein, 25 aa, Cryptosporidium parvum
GNVPEELAIIWIRQILEGILYLNNL

SEQ ID NO: 2293452 - protein, 21 aa, Cryptosporidium parvum
GNWIDCGTGFLKLNKDNDKFN

SEQ ID NO: 2293453 - protein, 17 aa, Cryptosporidium parvum
GNWKSCEEILEKAITKS

SEQ ID NO: 2293454 - protein, 24 aa, Cryptosporidium parvum
GNYIGEQAMNIWILTTKRNELEYA

SEQ ID NO: 2293455 - protein, 28 aa, Cryptosporidium parvum
GNYLLSEYILLCICSRQKLEFNAYEENV

SEQ ID NO: 2293456 - protein, 34 aa, Cryptosporidium parvum
GPAVEYYFRLILDYRSGDAFQGCILYVIKSIKFL

SEQ ID NO: 2293457 - protein, 17 aa, Cryptosporidium parvum
GPCALTLSMYFIKTCGR

SEQ ID NO: 2293458 - protein, 26 aa, Cryptosporidium parvum
GPDGRPMPYWLYKLNGLGIEFKCEIC

SEQ ID NO: 2293459 - protein, 23 aa, Cryptosporidium parvum
GPEWVWPMGHFLMAKYQLLKEKY

SEQ ID NO: 2293460 - protein, 24 aa, Cryptosporidium parvum
GPGCKARSSATWYPQNYQILKITS

SEQ ID NO: 2293461 - protein, 24 aa, Cryptosporidium parvum
GPGFFKDDFFKYLFDSDNQKNKEF

SEQ ID NO: 2293462 - protein, 21 aa, Cryptosporidium parvum
GPGKCYRLYTEAAFNTEMLPT

SEQ ID NO: 2293463 - protein, 24 aa, Cryptosporidium parvum
GPGNVPKALFISSIEEFVGDRPVY

SEQ ID NO: 2293464 - protein, 26 aa, Cryptosporidium parvum
GPIISLRAYYPERFASSKPKYIPGND

SEQ ID NO: 2293465 - protein, 17 aa, Cryptosporidium parvum
GPIKLAQDFLKEDEPFF

SEQ ID NO: 2293466 - protein, 18 aa, Cryptosporidium parvum
GPIKVLSFQCPDEKTSVS

SEQ ID NO: 2293467 - protein, 27 aa, Cryptosporidium parvum
GPKDAIQYCELCQGQGVRVQIRQIGPM

SEQ ID NO: 2293468 - protein, 25 aa, Cryptosporidium parvum
GPKRISGKEAVSCVNGSIIHPFYQP

SEQ ID NO: 2293469 - protein, 18 aa, Cryptosporidium parvum
GPKWPYSEFEDVKNANNK

SEQ ID NO: 2293470 - protein, 22 aa, Cryptosporidium parvum
GPLPNGLCFTHFQNNIVSSANI

SEQ ID NO: 2293471 - protein, 24 aa, Cryptosporidium parvum
GPNGQHVCMVFEVLGPNILQLISL

SEQ ID NO: 2293472 - protein, 25 aa, Cryptosporidium parvum
GPNRKTLKVPFCNGVKASSFNYFFF

SEQ ID NO: 2293473 - protein, 25 aa, Cryptosporidium parvum
GPNSWPEFSKLLAHLVESPHYSVRL

SEQ ID NO: 2293474 - protein, 20 aa, Cryptosporidium parvum
GPNYVCINFGTFVCSVCSGI

SEQ ID NO: 2293475 - protein, 22 aa, Cryptosporidium parvum
GPPGCGKTLLAKAVASECSANF

SEQ ID NO: 2293476 - protein, 22 aa, Cryptosporidium parvum
GPPGCSKTLMAKAVATESKMNF

SEQ ID NO: 2293477 - protein, 20 aa, Cryptosporidium parvum
GPQFEPVPMSYNWGPNYTNI

SEQ ID NO: 2293478 - protein, 30 aa, Cryptosporidium parvum; identical to SEQ ID NO: 2172199

SEQ ID NO: 2293479 - protein, 22 aa, Cryptosporidium parvum
GPTFVCPLCLMNSKIPNSSCLK

SEQ ID NO: 2293480 - protein, 20 aa, Cryptosporidium parvum
GPTKYCFNNGVNIITGLNGS

SEQ ID NO: 2293481 - protein, 19 aa, Cryptosporidium parvum
GPVKACICSKDKIFSSAND

SEQ ID NO: 2293482 - protein, 19 aa, Cryptosporidium parvum
GPYNMAIEFFTLEREIYIA

SEQ ID NO: 2293483 - protein, 23 aa, Cryptosporidium parvum
GPYNSIVMMSWIVKGYFGENSKL

SEQ ID NO: 2293484 - protein, 19 aa, Cryptosporidium parvum
GQAMGLSFSVPKGVPVPPS

SEQ ID NO: 2293485 - protein, 17 aa, Cryptosporidium parvum
GQCKMEILPYMIGALYS

SEQ ID NO: 2293486 - protein, 20 aa, Cryptosporidium parvum
GQDMMKWICKIPGKSGTLWE

SEQ ID NO: 2293487 - protein, 19 aa, Cryptosporidium parvum
GQFEECERLYSIMEPIIAK

SEQ ID NO: 2293488 - protein, 22 aa, Cryptosporidium parvum
GQFGVGFYSAYLVADKVTVITK

SEQ ID NO: 2293489 - protein, 20 aa, Cryptosporidium parvum
GQFICTCMGILREMKQDSKF

SEQ ID NO: 2293490 - protein, 20 aa, Cryptosporidium parvum
GQFIKTPAFYPVSKVLLDEK

SEQ ID NO: 2293491 - protein, 19 aa, Cryptosporidium parvum
GQFIPYFGQPLLFPNNNQN

SEQ ID NO: 2293492 - protein, 18 aa, Cryptosporidium parvum
GQGGRPFAKLDKDFNTQK

SEQ ID NO: 2293493 - protein, 17 aa, Cryptosporidium parvum
GQGIIDWNNPLNIENKL

SEQ ID NO: 2293494 - protein, 18 aa, Cryptosporidium parvum
GQGLLDDSSKVLGKLETD

SEQ ID NO: 2293495 - protein, 18 aa, Cryptosporidium parvum
GQGRVWRGRSRYSVNEQT

SEQ ID NO: 2293496 - protein, 18 aa, Cryptosporidium parvum
GQGSRPGSGTGIGIGIGT

SEQ ID NO: 2293497 - protein, 31 aa, Cryptosporidium parvum
GQIKSRLMVEKSLPNIFKIVNNDLLDDKTSE

SEQ ID NO: 2293498 - protein, 26 aa, Cryptosporidium parvum
GQINLPICGLLIYFISSLIHRSPIFN

SEQ ID NO: 2293499 - protein, 21 aa, Cryptosporidium parvum
GQIPDYAAPVILKRDKSTIAD

SEQ ID NO: 2293500 - protein, 21 aa, Cryptosporidium parvum
GQIRKFFRQNLQILLFSATYH

SEQ ID NO: 2293501 - protein, 26 aa, Cryptosporidium parvum
GQKGDLILEFDICFPKSLTPEQKKLI

SEQ ID NO: 2293502 - protein, 26 aa, Cryptosporidium parvum
GQKLARRAAGIIVRMVKQGKIAGRAI

SEQ ID NO: 2293503 - protein, 17 aa, Cryptosporidium parvum
GQKRLSQLAKWKTAEEV

SEQ ID NO: 2293504 - protein, 24 aa, Cryptosporidium parvum
GQKTLLPCCLVIANSKDSNISCIY

SEQ ID NO: 2293505 - protein, 24 aa, Cryptosporidium parvum
GQKVLDIWFPYIVQSLLQAFKREN

SEQ ID NO: 2293506 - protein, 19 aa, Cryptosporidium parvum
GQLMIEYIAVWGIINEDDH

SEQ ID NO: 2293507 - protein, 38 aa, Cryptosporidium parvum
GQNGNWACCKCSNVNFPRRFRCFKCGEYRDEIGDKIVA

SEQ ID NO: 2293508 - protein, 23 aa, Cryptosporidium parvum
GQSRLCMLILRKEHISQVQCSYW

SEQ ID NO: 2293509 - protein, 19 aa, Cryptosporidium parvum
GQVAQFFAFFPFQTAEMAL

SEQ ID NO: 2293510 - protein, 23 aa, Cryptosporidium parvum
GQVFMKLLRLLRLHVPNIDPSMF

SEQ ID NO: 2293511 - protein, 19 aa, Cryptosporidium parvum
GRADLKIRIPKSLWEYWEA

SEQ ID NO: 2293512 - protein, 20 aa, Cryptosporidium parvum
GRAGVPMEVMGLLLGEFIDD

SEQ ID NO: 2293513 - protein, 22 aa, Cryptosporidium parvum
GRCALPSNFDASYCFALGHTAA

SEQ ID NO: 2293514 - protein, 20 aa, Cryptosporidium parvum
GRCAMPSNFDSNYCYALGHC

SEQ ID NO: 2293515 - protein, 42 aa, Cryptosporidium parvum
GRCSAGQRVLACIIIRLALAESFCVNCGILALDEPTTNLDRF

SEQ ID NO: 2293516 - protein, 25 aa, Cryptosporidium parvum
GRDNFYYAMIAFQGCYKSQNYDWDD

SEQ ID NO: 2293517 - protein, 18 aa, Cryptosporidium parvum
GRELDSFNIGNNITNNNS

SEQ ID NO: 2293518 - protein, 23 aa, Cryptosporidium parvum
GRFERYDTISGYKIRRNYKYWLV

SEQ ID NO: 2293519 - protein, 19 aa, Cryptosporidium parvum
GRFSRCFGNNIEGRISINS

SEQ ID NO: 2293520 - protein, 20 aa, Cryptosporidium parvum
GRGAGRVRRVLHSAFFSGKS

SEQ ID NO: 2293521 - protein, 25 aa, Cryptosporidium parvum
GRGGQSALRFARLRMEKRHNYLRKV

SEQ ID NO: 2293522 - protein, 18 aa, Cryptosporidium parvum
GRGKGAFENKGKEIALIM

SEQ ID NO: 2293523 - protein, 21 aa, Cryptosporidium parvum
GRGRPRINREALAAAAAAAAA

SEQ ID NO: 2293524 - protein, 21 aa, Cryptosporidium parvum
GRGYVLRRILRRAIRYGSQYL

SEQ ID NO: 2293525 - protein, 26 aa, Cryptosporidium parvum
GRHFLPRGQGIVTRRPLILQLQQIKQ

SEQ ID NO: 2293526 - protein, 18 aa, Cryptosporidium parvum
GRHSVVCRHWIRNMCMKG

SEQ ID NO: 2293527 - protein, 20 aa, Cryptosporidium parvum
GRIFKMTWYDNMSKKSEENI

SEQ ID NO: 2293528 - protein, 20 aa, Cryptosporidium parvum
GRIGNGMAMTMIPNNDKDVT

SEQ ID NO: 2293529 - protein, 26 aa, Cryptosporidium parvum
GRIGSEIFAGASIIKHIVLKRIKYGF

SEQ ID NO: 2293530 - protein, 18 aa, Cryptosporidium parvum
GRIIPVPVEVEVEKIVEV

SEQ ID NO: 2293531 - protein, 18 aa, Cryptosporidium parvum
GRIKLIYKDVEELGVSGA

SEQ ID NO: 2293532 - protein, 20 aa, Cryptosporidium parvum
GRILLVKLIEEFKNMQIVCL

SEQ ID NO: 2293533 - protein, 19 aa, Cryptosporidium parvum
GRIRGPLIIQGYEIGFCER

SEQ ID NO: 2293534 - protein, 17 aa, Cryptosporidium parvum
GRISPIFIEGLKRGIGI

SEQ ID NO: 2293535 - protein, 17 aa, Cryptosporidium parvum
GRISRYLANKCSIAARI

SEQ ID NO: 2293536 - protein, 17 aa, Cryptosporidium parvum
GRISVVNPIGFVKTLGI

SEQ ID NO: 2293537 - protein, 23 aa, Cryptosporidium parvum
GRITTEIQSFVPVILGENQKLDT

SEQ ID NO: 2293538 - protein, 17 aa, Cryptosporidium parvum
GRIVGYAGFYIIPHLGR

SEQ ID NO: 2293539 - protein, 21 aa, Cryptosporidium parvum
GRKEKLALTKVFYRNIKQIKE

SEQ ID NO: 2293540 - protein, 18 aa, Cryptosporidium parvum
GRKLNGRIIHLSKSSHSI

SEQ ID NO: 2293541 - protein, 22 aa, Cryptosporidium parvum
GRKPNSIIAYWPPKEVLKIPIT

SEQ ID NO: 2293542 - protein, 18 aa, Cryptosporidium parvum
GRKRLRVTTVSYRYSEPN

SEQ ID NO: 2293543 - protein, 17 aa, Cryptosporidium parvum
GRKTPKVIVDFSSPNIA

SEQ ID NO: 2293544 - protein, 18 aa, Cryptosporidium parvum
GRLCEHYNQLVISQDQQE

SEQ ID NO: 2293545 - protein, 17 aa, Cryptosporidium parvum
GRLIKKVSAFKVNNSIL

SEQ ID NO: 2293546 - protein, 26 aa, Cryptosporidium parvum
GRLIQKTRWPIICICNDRMSEKVRNL

SEQ ID NO: 2293547 - protein, 18 aa, Cryptosporidium parvum
GRLIRRLEHTFPCTKPKE

SEQ ID NO: 2293548 - protein, 25 aa, Cryptosporidium parvum
GRLKEWKLRLHLWGNLDDLEYSNLI

SEQ ID NO: 2293549 - protein, 24 aa, Cryptosporidium parvum
GRLKGHCCTCFATAPEVYLNNDYD

SEQ ID NO: 2293550 - protein, 19 aa, Cryptosporidium parvum
GRLPCPISHGVCKSDEFLK

SEQ ID NO: 2293551 - protein, 18 aa, Cryptosporidium parvum
GRLYQGVISRYYPKERIF

SEQ ID NO: 2293552 - protein, 22 aa, Cryptosporidium parvum
GRMFPVELIYNIKPEKDYLEAS

SEQ ID NO: 2293553 - protein, 17 aa, Cryptosporidium parvum
GRMHLAILLLQHEPNLQ

SEQ ID NO: 2293554 - protein, 26 aa, Cryptosporidium parvum
GRMLLEKGFKFDVVYTSVLKRAIMTT

SEQ ID NO: 2293555 - protein, 20 aa, Cryptosporidium parvum
GRMQDCLEKTLTVLVQCSYV

SEQ ID NO: 2293556 - protein, 18 aa, Cryptosporidium parvum
GRMSKDRLFEIMDTFLRQ

SEQ ID NO: 2293557 - protein, 19 aa, Cryptosporidium parvum
GRNAFMCSASVPEVLVERD

SEQ ID NO: 2293558 - protein, 22 aa, Cryptosporidium parvum
GRNEIDQLFGIFRLVGTPLGTS

SEQ ID NO: 2293559 - protein, 21 aa, Cryptosporidium parvum
GRNGFGAKLTNIFSKEFKVEC

SEQ ID NO: 2293560 - protein, 19 aa, Cryptosporidium parvum
GRPCKEKKMSNRKKRKLKQ

SEQ ID NO: 2293561 - protein, 26 aa, Cryptosporidium parvum
GRPEKAPDVCYSWWIFSLLYFLGRAN

SEQ ID NO: 2293562 - protein, 26 aa, Cryptosporidium parvum
GRPKVLILGTGWGFMKLAKGLDVNSN

SEQ ID NO: 2293563 - protein, 18 aa, Cryptosporidium parvum
GRPSIDMECYNSMDGPKK

SEQ ID NO: 2293564 - protein, 23 aa, Cryptosporidium parvum
GRQFEHPDYWLVQSNPWEIERQD

SEQ ID NO: 2293565 - protein, 21 aa, Cryptosporidium parvum
GRRAIGGSVCSSGSSSCSTGV

SEQ ID NO: 2293566 - protein, 18 aa, Cryptosporidium parvum
GRREFKYFVGTPQFMAPE

SEQ ID NO: 2293567 - protein, 18 aa, Cryptosporidium parvum
GRRMSRRAAGRGTGASRS

SEQ ID NO: 2293568 - protein, 17 aa, Cryptosporidium parvum
GRSELVVGWYHSHPGFG

SEQ ID NO: 2293569 - protein, 28 aa, Cryptosporidium parvum
GRSFTAEILHEWSPSINLLTTVDSIIKF

SEQ ID NO: 2293570 - protein, 18 aa, Cryptosporidium parvum
GRSRGFVGNSFFSGLQPD

SEQ ID NO: 2293571 - protein, 24 aa, Cryptosporidium parvum
GRSTSILLCDWLFTILDYLDKKKS

SEQ ID NO: 2293572 - protein, 19 aa, Cryptosporidium parvum
GRTKTCIIATITASSIYLE

SEQ ID NO: 2293573 - protein, 18 aa, Cryptosporidium parvum
GRVFDMLDKGYLRVDNLK

SEQ ID NO: 2293574 - protein, 23 aa, Cryptosporidium parvum
GRVFPLKLLPHYQLMSLVADYRK

SEQ ID NO: 2293575 - protein, 25 aa, Cryptosporidium parvum
GRVFSGQIGSTGRRSIIRQPNENLW

SEQ ID NO: 2293576 - protein, 20 aa, Cryptosporidium parvum
GRVGDFDFGFRNGFQQQENG

SEQ ID NO: 2293577 - protein, 28 aa, Cryptosporidium parvum
GRVGPGHCYRLYSSPIYENIFPKFAPID

SEQ ID NO: 2293578 - protein, 18 aa, Cryptosporidium parvum
GRVLDFIERGILNVSKIS

SEQ ID NO: 2293579 - protein, 25 aa, Cryptosporidium parvum
GRVRMANVCNLTFNVNYGILSVGEM

SEQ ID NO: 2293580 - protein, 21 aa, Cryptosporidium parvum
GRVSSGICYRMYTEQTFLADM

SEQ ID NO: 2293581 - protein, 26 aa, Cryptosporidium parvum
GRVTRIIRLLTFINRSIEGSGILRIL

SEQ ID NO: 2293582 - protein, 20 aa, Cryptosporidium parvum
GRYDFIWIQWALQYLSDDEF

SEQ ID NO: 2293583 - protein, 23 aa, Cryptosporidium parvum
GSAEVRAQIRLIFREYQNKKKIQ

SEQ ID NO: 2293584 - protein, 19 aa, Cryptosporidium parvum
GSAFKSWNIDISKESKIPI

SEQ ID NO: 2293585 - protein, 19 aa, Cryptosporidium parvum
GSANTDYMCRSGIDTSPSI

SEQ ID NO: 2293586 - protein, 17 aa, Cryptosporidium parvum
GSASLGLNSGFSENYYS

SEQ ID NO: 2293587 - protein, 23 aa, Cryptosporidium parvum
GSCIDGRLTSAWNWCSNIEKKPY

SEQ ID NO: 2293588 - protein, 23 aa, Cryptosporidium parvum
GSDAPSHLGMRFIGGRYVPKTVA

SEQ ID NO: 2293589 - protein, 23 aa, Cryptosporidium parvum
GSDDNVICLWDIQSKPNNYERKL

SEQ ID NO: 2293590 - protein, 18 aa, Cryptosporidium parvum
GSDHGSCSEGYIYEENHL

SEQ ID NO: 2293591 - protein, 25 aa, Cryptosporidium parvum
GSDLLPRPWSKYSIGSSQYNRRNNI

SEQ ID NO: 2293592 - protein, 20 aa, Cryptosporidium parvum
GSDPFTISGFGPESTSTDPI

SEQ ID NO: 2293593 - protein, 18 aa, Cryptosporidium parvum
GSDSDFWRSKKCTKKEYI

SEQ ID NO: 2293594 - protein, 23 aa, Cryptosporidium parvum
GSDSSHFTVEWISKASASQRSGR

SEQ ID NO: 2293595 - protein, 25 aa, Cryptosporidium parvum
GSEEVKRYMYVEGLTNKNQGSFYFY

SEQ ID NO: 2293596 - protein, 22 aa, Cryptosporidium parvum
GSEGRNGFVSSLRNKPPSRKLR

SEQ ID NO: 2293597 - protein, 24 aa, Cryptosporidium parvum
GSEHAGMCNQRFRKSAVLGNSNGC

SEQ ID NO: 2293598 - protein, 22 aa, Cryptosporidium parvum
GSEICTRCGVVVEDRVINEEQE

SEQ ID NO: 2293599 - protein, 32 aa, Cryptosporidium parvum
GSENGYICLWDLQPDFGRSIFGIQYNKNNLNG

SEQ ID NO: 2293600 - protein, 18 aa, Cryptosporidium parvum
GSESELKPEHVLEEESPP

SEQ ID NO: 2293601 - protein, 25 aa, Cryptosporidium parvum
GSESRKAYFIGYMVHKLCLGALGRV

SEQ ID NO: 2293602 - protein, 20 aa, Cryptosporidium parvum
GSETVRKGWNAFSTLNNAID

SEQ ID NO: 2293603 - protein, 23 aa, Cryptosporidium parvum
GSFILPVNYYRKFGMSSNIIAIT

SEQ ID NO: 2293604 - protein, 32 aa, Cryptosporidium parvum
GSFVYLKRDLIVWSDCVKLKYGNCESESTFLW

SEQ ID NO: 2293605 - protein, 26 aa, Cryptosporidium parvum
GSGNVLKCLICIGGGNINKTFDYIKQ

SEQ ID NO: 2293606 - protein, 18 aa, Cryptosporidium parvum
GSGRMLGPLAKNISKAMI

SEQ ID NO: 2293607 - protein, 22 aa, Cryptosporidium parvum
GSGSGRNGMVSNIQSSFNEGLQ

SEQ ID NO: 2293608 - protein, 17 aa, Cryptosporidium parvum
GSGTGIGIGIGTGTGSG

SEQ ID NO: 2293609 - protein, 39 aa, Cryptosporidium parvum
GSHIKGLIINLIHYYWPSLIHFRGFLKQFVTPIVKAKKG

SEQ ID NO: 2293610 - protein, 23 aa, Cryptosporidium parvum
GSIFGESVVRGINDNLGNNIDGR

SEQ ID NO: 2293611 - protein, 23 aa, Cryptosporidium parvum
GSIKRYGIPALMNYSYRYTNKAL

SEQ ID NO: 2293612 - protein, 37 aa, Cryptosporidium parvum
GSIPKAPCSTCQFRTSTVYCIDCCEGFCSKCVKEFHN

SEQ ID NO: 2293613 - protein, 24 aa, Cryptosporidium parvum
GSITSRQIDIEVSKETTDTSVANN

SEQ ID NO: 2293614 - protein, 20 aa, Cryptosporidium parvum
GSIVTFKLRMELFPNESIDM

SEQ ID NO: 2293615 - protein, 23 aa, Cryptosporidium parvum
GSKFHRLKHLTIFIEENQDLKEK

SEQ ID NO: 2293616 - protein, 22 aa, Cryptosporidium parvum
GSKTLNFAHNWTKSDNESAALI

SEQ ID NO: 2293617 - protein, 17 aa, Cryptosporidium parvum
GSKVCSVAPIAGETKIW

SEQ ID NO: 2293618 - protein, 24 aa, Cryptosporidium parvum
GSKYKIDSVFGFLREFHVKKENQV

SEQ ID NO: 2293619 - protein, 24 aa, Cryptosporidium parvum
GSLDFKSFVIDTLFDISNEIPDIL

SEQ ID NO: 2293620 - protein, 23 aa, Cryptosporidium parvum
GSLFSGTQNGIFFIKKNNGGNGV

SEQ ID NO: 2293621 - protein, 17 aa, Cryptosporidium parvum
GSLGMIIRRPVTRSQTK

SEQ ID NO: 2293622 - protein, 24 aa, Cryptosporidium parvum
GSLISLKIATLVGGLDMVMQSLSL

SEQ ID NO: 2293623 - protein, 18 aa, Cryptosporidium parvum
GSLLHWINNFMYITLESQ

SEQ ID NO: 2293624 - protein, 18 aa, Cryptosporidium parvum
GSLLRLFQSDVFDAHLHL

SEQ ID NO: 2293625 - protein, 19 aa, Cryptosporidium parvum
GSLMLGRISSHFYLSPETI

SEQ ID NO: 2293626 - protein, 26 aa, Cryptosporidium parvum
GSLNIYISWSSYRLMESEKNNSDEIL

SEQ ID NO: 2293627 - protein, 22 aa, Cryptosporidium parvum
GSLPAPIMNRFDQEFRMYVNSD

SEQ ID NO: 2293628 - protein, 17 aa, Cryptosporidium parvum
GSLWSEGDIRTEVIEHL

SEQ ID NO: 2293629 - protein, 24 aa, Cryptosporidium parvum
GSMSQLFILCKFDFDLFSKIIASI

SEQ ID NO: 2293630 - protein, 29 aa, Cryptosporidium parvum
GSNEQFVCIRFCRRIHELYSNELSKPIED

SEQ ID NO: 2293631 - protein, 23 aa, Cryptosporidium parvum
GSNGEPWFYKLVDSVSNIMGNYY

SEQ ID NO: 2293632 - protein, 17 aa, Cryptosporidium parvum
GSNKLQFGLTSLAKSLL

SEQ ID NO: 2293633 - protein, 18 aa, Cryptosporidium parvum
GSNYCNRKSDLSLSSSSI

SEQ ID NO: 2293634 - protein, 31 aa, Cryptosporidium parvum; identical to SEQ ID NO: 2172344

SEQ ID NO: 2293635 - protein, 23 aa, Cryptosporidium parvum
GSPEIWAAIFRYINKLVYIAKPR

SEQ ID NO: 2293636 - protein, 24 aa, Cryptosporidium parvum
GSPGTKECIIFLFDLALLQNNKLL

SEQ ID NO: 2293637 - protein, 24 aa, Cryptosporidium parvum
GSPLPERHEIVLFKSMEDANNTTF

SEQ ID NO: 2293638 - protein, 21 aa, Cryptosporidium parvum
GSPQFLDEVDFCLEKEEDSYF

SEQ ID NO: 2293639 - protein, 19 aa, Cryptosporidium parvum
GSQGFCLLNNVAIGAAYCR

SEQ ID NO: 2293640 - protein, 24 aa, Cryptosporidium parvum
GSRFRRLDVSHAFHSPLVSEASDK

SEQ ID NO: 2293641 - protein, 20 aa, Cryptosporidium parvum
GSRGGRGGQRGRVFSGQIGS

SEQ ID NO: 2293642 - protein, 24 aa, Cryptosporidium parvum
GSRLRLLLDRSRFILSTKGDINQY

SEQ ID NO: 2293643 - protein, 22 aa, Cryptosporidium parvum
GSSCPFVKSVLGRIFVNPTGNK

SEQ ID NO: 2293644 - protein, 23 aa, Cryptosporidium parvum
GSSDFKSATLFSLGSDLNVLKNS

SEQ ID NO: 2293645 - protein, 18 aa, Cryptosporidium parvum
GSSFRSGSSITYTIFLFV

SEQ ID NO: 2293646 - protein, 29 aa, Cryptosporidium parvum
GSSKEMIKWLGCLPIESMIDVYGTIVVPE

SEQ ID NO: 2293647 - protein, 18 aa, Cryptosporidium parvum
GSSKLMFVHTMYSEEIEL

SEQ ID NO: 2293648 - protein, 26 aa, Cryptosporidium parvum
GSSLKKRPAVMQGVELVLLRLGISFY

SEQ ID NO: 2293649 - protein, 19 aa, Cryptosporidium parvum
GSSPRWAPVSNREFTHDEK

SEQ ID NO: 2293650 - protein, 18 aa, Cryptosporidium parvum
GSSQEFNDGFSLSTGNLH

SEQ ID NO: 2293651 - protein, 24 aa, Cryptosporidium parvum
GSSREVLLRFNVDLPKKHGRGGQS

SEQ ID NO: 2293652 - protein, 26 aa, Cryptosporidium parvum
GSSRFSVTVLEPLGASGLRSIRYIKE

SEQ ID NO: 2293653 - protein, 28 aa, Cryptosporidium parvum
GSSRMAKIGWSRFDSFFRKIPMGAKKDI

SEQ ID NO: 2293654 - protein, 19 aa, Cryptosporidium parvum
GSSSWKKFPARRIGVVLSG

SEQ ID NO: 2293655 - protein, 19 aa, Cryptosporidium parvum
GSVIDCSRNGHINHRFSNR

SEQ ID NO: 2293656 - protein, 26 aa, Cryptosporidium parvum
GSVTYVCLSWNYKYLISCGEDKVVCI

SEQ ID NO: 2293657 - protein, 18 aa, Cryptosporidium parvum
GSWMEGFESCLRISQPFF

SEQ ID NO: 2293658 - protein, 20 aa, Cryptosporidium parvum
GSYKRKNKSLAEYSESCDSI

SEQ ID NO: 2293659 - protein, 25 aa, Cryptosporidium parvum
GSYRFPNNGPLCFTIPEFSNNPTLV

SEQ ID NO: 2293660 - protein, 26 aa, Cryptosporidium parvum
GSYTRTCFAAIPFGLLKKELKIEDSV

SEQ ID NO: 2293661 - protein, 28 aa, Cryptosporidium parvum
GTAPSNGIQLCFLPDKFSIHLAPSQGLL

SEQ ID NO: 2293662 - protein, 26 aa, Cryptosporidium parvum
GTCGICYHGSCGNSFVPPLLFGGNNF

SEQ ID NO: 2293663 - protein, 33 aa, Cryptosporidium parvum; identical to SEQ ID NO: 2172368

SEQ ID NO: 2293664 - protein, 19 aa, Cryptosporidium parvum
GTEHFKKYASLMLLLSDIL

SEQ ID NO: 2293665 - protein, 20 aa, Cryptosporidium parvum
GTEIIPGRGRLSSGVVGTIE

SEQ ID NO: 2293666 - protein, 23 aa, Cryptosporidium parvum
GTEIPYIICKEVNSQSSDEVAPK

SEQ ID NO: 2293667 - protein, 24 aa, Cryptosporidium parvum
GTEPFRITHEMSKIEVRSRVILTD

SEQ ID NO: 2293668 - protein, 19 aa, Cryptosporidium parvum
GTEYFDAKLGQYIDYPITD

SEQ ID NO: 2293669 - protein, 17 aa, Cryptosporidium parvum
GTFPRVGIFTSDVEYLL

SEQ ID NO: 2293670 - protein, 17 aa, Cryptosporidium parvum
GTGGILISASHFGATCF

SEQ ID NO: 2293671 - protein, 18 aa, Cryptosporidium parvum
GTGGMRTKIFAARIAAAA

SEQ ID NO: 2293672 - protein, 29 aa, Cryptosporidium parvum
GTGKSYLSMCIAGELGLPFFKLSGPNIIN

SEQ ID NO: 2293673 - protein, 23 aa, Cryptosporidium parvum
GTGQLKTGAPCRSERVAKYNQLM

SEQ ID NO: 2293674 - protein, 20 aa, Cryptosporidium parvum
GTGWDVRDGRSLYRDDEDKI

SEQ ID NO: 2293675 - protein, 17 aa, Cryptosporidium parvum
GTGYSNLMLCIKCNGSG

SEQ ID NO: 2293676 - protein, 22 aa, Cryptosporidium parvum
GTHFCMYVKHKLLFNEMNNTQD

SEQ ID NO: 2293677 - protein, 18 aa, Cryptosporidium parvum
GTILWKYWNKPSEASTRN

SEQ ID NO: 2293678 - protein, 22 aa, Cryptosporidium parvum
GTKFWRRTLSEFIQKSLKKEDG

SEQ ID NO: 2293679 - protein, 21 aa, Cryptosporidium parvum
GTKIEAIIKHIKWILNNNNDK

SEQ ID NO: 2293680 - protein, 23 aa, Cryptosporidium parvum
GTKLLNSFIPWMGTCGAQPSVGQ

SEQ ID NO: 2293681 - protein, 24 aa, Cryptosporidium parvum
GTKTLRLAPQLSDVFQKEKVKVGD

SEQ ID NO: 2293682 - protein, 22 aa, Cryptosporidium parvum
GTLKTCGGHWGYIDLQQPVFHV

SEQ ID NO: 2293683 - protein, 23 aa, Cryptosporidium parvum
GTLRFFEISSCISASPNLKAVIP

SEQ ID NO: 2293684 - protein, 19 aa, Cryptosporidium parvum
GTLRKLRPPIVTLLTTSPP

SEQ ID NO: 2293685 - protein, 23 aa, Cryptosporidium parvum
GTLRLLIRICRSIIRNPHCSKTT

SEQ ID NO: 2293686 - protein, 21 aa, Cryptosporidium parvum
GTLRLPLKIDDLCDFTGINIG

SEQ ID NO: 2293687 - protein, 27 aa, Cryptosporidium parvum
GTMVYRMGLILEETWDKSLEGSRARYE

SEQ ID NO: 2293688 - protein, 17 aa, Cryptosporidium parvum
GTNAPIVRAYKATIQTI

SEQ ID NO: 2293689 - protein, 23 aa, Cryptosporidium parvum
GTNCVYCKFYFQEILEDHIPGYR

SEQ ID NO: 2293690 - protein, 18 aa, Cryptosporidium parvum
GTNGITFQPVVDRDSDAR

SEQ ID NO: 2293691 - protein, 31 aa, Cryptosporidium parvum; identical to SEQ ID NO: 2172392

SEQ ID NO: 2293692 - protein, 17 aa, Cryptosporidium parvum
GTNLVKISSKPGEPAQL

SEQ ID NO: 2293693 - protein, 31 aa, Cryptosporidium parvum
GTPNGPFLYPLSVRGRKPFSLLTDDESSDDS

SEQ ID NO: 2293694 - protein, 24 aa, Cryptosporidium parvum
GTPWRFDNIRSEFGPKFVQSSSNL

SEQ ID NO: 2293695 - protein, 21 aa, Cryptosporidium parvum
GTQCPDLTLIDLPGITRVPLK

SEQ ID NO: 2293696 - protein, 22 aa, Cryptosporidium parvum
GTRLLKRWITYPLVNTERINER

SEQ ID NO: 2293697 - protein, 27 aa, Cryptosporidium parvum
GTRLRRAEHQSGVPGVYWQESSQRWIA

SEQ ID NO: 2293698 - protein, 18 aa, Cryptosporidium parvum
GTSAGIFKAGLRDEGIEE

SEQ ID NO: 2293699 - protein, 21 aa, Cryptosporidium parvum
GTSKCIIRYDLLDIGLAICSP

SEQ ID NO: 2293700 - protein, 26 aa, Cryptosporidium parvum
GTTAGCFNPLLRQMYLGWQGNNNALT

SEQ ID NO: 2293701 - protein, 25 aa, Cryptosporidium parvum
GTTNLKKQMLLWLNDNEVSLFDNDS

SEQ ID NO: 2293702 - protein, 21 aa, Cryptosporidium parvum
GTVDYALKVSRFKNVNLLVMH

SEQ ID NO: 2293703 - protein, 25 aa, Cryptosporidium parvum
GTVNLLRCRNDIFLQKKNQSSSFSP

SEQ ID NO: 2293704 - protein, 20 aa, Cryptosporidium parvum
GTYFTCVWIQISKQRDSLFT

SEQ ID NO: 2293705 - protein, 19 aa, Cryptosporidium parvum
GVAMPWLYQNFDANGYSFY

SEQ ID NO: 2293706 - protein, 22 aa, Cryptosporidium parvum
GVCKFLFKPDHYALFSKLKSLL

SEQ ID NO: 2293707 - protein, 24 aa, Cryptosporidium parvum
GVCSNSFCKYRDNVRMEYSKCEYT

SEQ ID NO: 2293708 - protein, 26 aa, Cryptosporidium parvum
GVDLLLSYILHRLFDTPFTDEDGKIL

SEQ ID NO: 2293709 - protein, 18 aa, Cryptosporidium parvum
GVDQIDVPIEWCSVESYH

SEQ ID NO: 2293710 - protein, 24 aa, Cryptosporidium parvum
GVELNGWSRYPLKISKFEEENVKN

SEQ ID NO: 2293711 - protein, 18 aa, Cryptosporidium parvum
GVENTFYFDKEINQWCQR

SEQ ID NO: 2293712 - protein, 18 aa, Cryptosporidium parvum
GVFPVLCDPVSCGKSNFD

SEQ ID NO: 2293713 - protein, 25 aa, Cryptosporidium parvum
GVFSAIKYLLSKGVLQRKIIVLSLI

SEQ ID NO: 2293714 - protein, 19 aa, Cryptosporidium parvum
GVGGPNFAAPTMLAHPDEF

SEQ ID NO: 2293715 - protein, 19 aa, Cryptosporidium parvum
GVGKSCLLLRFADDTYTDS

SEQ ID NO: 2293716 - protein, 23 aa, Cryptosporidium parvum
GVGKSCLLLRFAQDDSFTDSYIT

SEQ ID NO: 2293717 - protein, 18 aa, Cryptosporidium parvum
GVGLSAGFDRYSQSNGFN

SEQ ID NO: 2293718 - protein, 25 aa, Cryptosporidium parvum
GVGPSQITSFCWITNQIFLVGFSNG

SEQ ID NO: 2293719 - protein, 27 aa, Cryptosporidium parvum
GVGYIGIEWKGPFPLHNSIIQHVKRVQ

SEQ ID NO: 2293720 - protein, 23 aa, Cryptosporidium parvum
GVGYPSGLLFGGLGSNLGQHNVA

SEQ ID NO: 2293721 - protein, 21 aa, Cryptosporidium parvum
GVIAGLACRFPGGCNTPDTLW

SEQ ID NO: 2293722 - protein, 19 aa, Cryptosporidium parvum
GVIDHCLLHVSLLLKQKIQ

SEQ ID NO: 2293723 - protein, 21 aa, Cryptosporidium parvum
GVIDKSIKIWDIRKANNPLKT

SEQ ID NO: 2293724 - protein, 18 aa, Cryptosporidium parvum
GVIKFWRLRSEKEILREK

SEQ ID NO: 2293725 - protein, 25 aa, Cryptosporidium parvum
GVKNQEIDCGFDFAPVDEYSNIGIW

SEQ ID NO: 2293726 - protein, 23 aa, Cryptosporidium parvum
GVLCIKNSWPGMFRGIFGAHYLH

SEQ ID NO: 2293727 - protein, 17 aa, Cryptosporidium parvum
GVLGRGAYSSVFKIRSK

SEQ ID NO: 2293728 - protein, 19 aa, Cryptosporidium parvum
GVLLLIIFGLPPVYHLDDP

SEQ ID NO: 2293729 - protein, 20 aa, Cryptosporidium parvum
GVLMKYYPNVYWERVGNITI

SEQ ID NO: 2293730 - protein, 27 aa, Cryptosporidium parvum
GVLYLLYKACRIFKQLGVEYVTIFEPN

SEQ ID NO: 2293731 - protein, 17 aa, Cryptosporidium parvum
GVNPQISPRIGVNSQVA

SEQ ID NO: 2293732 - protein, 17 aa, Cryptosporidium parvum
GVPPGKPSYVYRPPNNP

SEQ ID NO: 2293733 - protein, 20 aa, Cryptosporidium parvum
GVPQDFRWKIWNSLLQISSL

SEQ ID NO: 2293734 - protein, 21 aa, Cryptosporidium parvum
GVQGMGYRGGIGMQDQPNQQG

SEQ ID NO: 2293735 - protein, 19 aa, Cryptosporidium parvum
GVSDTHRGQHSEHFVTGSD

SEQ ID NO: 2293736 - protein, 21 aa, Cryptosporidium parvum
GVSGFGFGGCNTHVIVESTEK

SEQ ID NO: 2293737 - protein, 17 aa, Cryptosporidium parvum
GVSKEFHSKLVMMSDGG

SEQ ID NO: 2293738 - protein, 22 aa, Cryptosporidium parvum
GVSRGFGFVSFLSPDEATKAIT

SEQ ID NO: 2293739 - protein, 21 aa, Cryptosporidium parvum
GVSSFGFGGCNSHVILESASA

SEQ ID NO: 2293740 - protein, 37 aa, Cryptosporidium parvum; identical to SEQ ID NO: 2172450

SEQ ID NO: 2293741 - protein, 25 aa, Cryptosporidium parvum
GVSVLEHLIRCFKENNSLSNILKPF

SEQ ID NO: 2293742 - protein, 19 aa, Cryptosporidium parvum
GVTEKGPCICIRPKNESKY

SEQ ID NO: 2293743 - protein, 22 aa, Cryptosporidium parvum
GVTGSHLLNGWNTSGSSPSKDG

SEQ ID NO: 2293744 - protein, 19 aa, Cryptosporidium parvum
GVTIFCITELYIVSQSSSG

SEQ ID NO: 2293745 - protein, 25 aa, Cryptosporidium parvum
GVTPGHRIPMGLLLGGRDALENELE

SEQ ID NO: 2293746 - protein, 17 aa, Cryptosporidium parvum
GVVCGMNSINVGVGTPN

SEQ ID NO: 2293747 - protein, 28 aa, Cryptosporidium parvum
GVVGVLCGKDYLPLRWELNSTKESYNFE

SEQ ID NO: 2293748 - protein, 19 aa, Cryptosporidium parvum
GVVRRSVGVGKNLIWAGLD

SEQ ID NO: 2293749 - protein, 26 aa, Cryptosporidium parvum
GVYEPVSICCIEFWNTIADLEIELSL

SEQ ID NO: 2293750 - protein, 22 aa, Cryptosporidium parvum
GVYKSIFIRIAEYKVKQRSALF

SEQ ID NO: 2293751 - protein, 18 aa, Cryptosporidium parvum
GVYQMDWNRKYILKDDDW

SEQ ID NO: 2293752 - protein, 18 aa, Cryptosporidium parvum
GVYSMVSPLQSFRTPRLE

SEQ ID NO: 2293753 - protein, 26 aa, Cryptosporidium parvum
GWDDPRFPTVRGIVRRGLSPSALLQF

SEQ ID NO: 2293754 - protein, 19 aa, Cryptosporidium parvum
GWDKLAVKSLWAFGPDPSI

SEQ ID NO: 2293755 - protein, 18 aa, Cryptosporidium parvum
GWIAAARFEEFVGRLSHA

SEQ ID NO: 2293756 - protein, 19 aa, Cryptosporidium parvum
GWIPSSVTKMIAAKMVPGS

SEQ ID NO: 2293757 - protein, 26 aa, Cryptosporidium parvum
GWKRIPKERSCIFLDSIDEQDSSVND

SEQ ID NO: 2293758 - protein, 27 aa, Cryptosporidium parvum
GWLVRKKFCKLFMLKRCILALKRKSLI

SEQ ID NO: 2293759 - protein, 21 aa, Cryptosporidium parvum
GWNFTGCSTVPFVTYPEKNIS

SEQ ID NO: 2293760 - protein, 20 aa, Cryptosporidium parvum
GWTCETCGASTNLWLNLSDG

SEQ ID NO: 2293761 - protein, 18 aa, Cryptosporidium parvum
GWVYYSLENSAVIEKSWR

SEQ ID NO: 2293762 - protein, 17 aa, Cryptosporidium parvum
GYADPRSLVLTLQELST

SEQ ID NO: 2293763 - protein, 18 aa, Cryptosporidium parvum
GYCFLCYEDQKSTILAVD

SEQ ID NO: 2293764 - protein, 19 aa, Cryptosporidium parvum
GYCYSCWTEKFGVPRQSVL

SEQ ID NO: 2293765 - protein, 25 aa, Cryptosporidium parvum
GYDINCTDFDIGIFDSCLCTCNSGS

SEQ ID NO: 2293766 - protein, 19 aa, Cryptosporidium parvum
GYDKQILFWDAEYGKTKWK

SEQ ID NO: 2293767 - protein, 24 aa, Cryptosporidium parvum
GYDSLKEALNYVWGPSVELTPSMQ

SEQ ID NO: 2293768 - protein, 18 aa, Cryptosporidium parvum
GYFIARGMIEYFQEQELF

SEQ ID NO: 2293769 - protein, 18 aa, Cryptosporidium parvum
GYFIISFFYILKNTKCEP

SEQ ID NO: 2293770 - protein, 21 aa, Cryptosporidium parvum
GYFTCEGRQLLTLKTAESSRM

SEQ ID NO: 2293771 - protein, 17 aa, Cryptosporidium parvum
GYFYLCGTKQVPIDIRK

SEQ ID NO: 2293772 - protein, 17 aa, Cryptosporidium parvum
GYGIQKWPDGAVFEGNF

SEQ ID NO: 2293773 - protein, 23 aa, Cryptosporidium parvum
GYGKVYKAIWTTRGITVAVKAFR

SEQ ID NO: 2293774 - protein, 24 aa, Cryptosporidium parvum
GYIGFPNFQLMSGSLVGYKQYNPI

SEQ ID NO: 2293775 - protein, 23 aa, Cryptosporidium parvum
GYILPKDMDALISPFYNINIQNK

SEQ ID NO: 2293776 - protein, 25 aa, Cryptosporidium parvum
GYISREHCIFYYSSIRNREYEGLDY

SEQ ID NO: 2293777 - protein, 25 aa, Cryptosporidium parvum
GYITPECLAEVCSKLGVSLTDQDAR

SEQ ID NO: 2293778 - protein, 17 aa, Cryptosporidium parvum
GYKEMIEPTPLFIDAVK

SEQ ID NO: 2293779 - protein, 25 aa, Cryptosporidium parvum
GYLAKALCSEVWCPMTASYYREYLD

SEQ ID NO: 2293780 - protein, 17 aa, Cryptosporidium parvum
GYLRLSFNFKEKKVSYI

SEQ ID NO: 2293781 - protein, 19 aa, Cryptosporidium parvum
GYMPLRGDFDVEYDNDAEL

SEQ ID NO: 2293782 - protein, 18 aa, Cryptosporidium parvum
GYNGPKGMYPIGKISKDS

SEQ ID NO: 2293783 - protein, 25 aa, Cryptosporidium parvum
GYNHRRLEAESGTQISIRGKGTTKE

SEQ ID NO: 2293784 - protein, 24 aa, Cryptosporidium parvum
GYNIGIRLVDEFLAKSGISKCDSF

SEQ ID NO: 2293785 - protein, 36 aa, Cryptosporidium parvum
GYNLSCDAWAIGICLYEFLCGCLPFGNDAVDHLEIF

SEQ ID NO: 2293786 - protein, 21 aa, Cryptosporidium parvum
GYNMACIGMDGYLLGRKSKVL

SEQ ID NO: 2293787 - protein, 22 aa, Cryptosporidium parvum
GYNWKILNCKVVQSNMNQEEML

SEQ ID NO: 2293788 - protein, 24 aa, Cryptosporidium parvum
GYQVTSFDIIEWVKVGKIDIFKSE

SEQ ID NO: 2293789 - protein, 18 aa, Cryptosporidium parvum
GYRIYPFQSNNILINHHH

SEQ ID NO: 2293790 - protein, 24 aa, Cryptosporidium parvum
GYSMLLRKGIGIGYISLFSFDESC

SEQ ID NO: 2293791 - protein, 23 aa, Cryptosporidium parvum
GYSQLKKGILLLLVGGVEKRTKD

SEQ ID NO: 2293792 - protein, 20 aa, Cryptosporidium parvum
GYSSMARKGNTYGDIGSYMN

SEQ ID NO: 2293793 - protein, 17 aa, Cryptosporidium parvum
GYSVPFPYDAYKCQINY

SEQ ID NO: 2293794 - protein, 17 aa, Cryptosporidium parvum
GYSYRVITMDSFPLNNE

SEQ ID NO: 2293795 - protein, 24 aa, Cryptosporidium parvum
GYTWEEFQSILNLNYTMENYFGIL

SEQ ID NO: 2293796 - protein, 18 aa, Cryptosporidium parvum
GYVLRLFCIAFTRRMADQ

SEQ ID NO: 2293797 - protein, 22 aa, Cryptosporidium parvum
GYWKSVCEFVFTGTRCQLRNAY

SEQ ID NO: 2293798 - protein, 18 aa, Cryptosporidium parvum
GYYRSCGNNVNIPETKLN

SEQ ID NO: 2293799 - protein, 21 aa, Cryptosporidium parvum
HACNAFGICLAPLYDTLGEDN

SEQ ID NO: 2293800 - protein, 25 aa, Cryptosporidium parvum
HACSYNLKPAIGIYVCVQSSDFSNS

SEQ ID NO: 2293801 - protein, 18 aa, Cryptosporidium parvum
HAFSRLSDTCMVFTKTSN

SEQ ID NO: 2293802 - protein, 17 aa, Cryptosporidium parvum
HAIEHTIEWARDAFQGI

SEQ ID NO: 2293803 - protein, 32 aa, Cryptosporidium parvum
HAIIPPEYISGISIEIPPRFDLTKLPWLSQIP

SEQ ID NO: 2293804 - protein, 21 aa, Cryptosporidium parvum
HAKSICLNYGIAKIYDGRFHL

SEQ ID NO: 2293805 - protein, 17 aa, Cryptosporidium parvum
HAKWSPVCTASYRLLPE

SEQ ID NO: 2293806 - protein, 18 aa, Cryptosporidium parvum
HALAREFYSELTIISRIR

SEQ ID NO: 2293807 - protein, 24 aa, Cryptosporidium parvum
HALDLFSAFFICPLFDTKYVDREV

SEQ ID NO: 2293808 - protein, 19 aa, Cryptosporidium parvum
HALSKTCLDDETIEQINSG

SEQ ID NO: 2293809 - protein, 26 aa, Cryptosporidium parvum
HAPHWKKYELAGALPVGSSVKLMALH

SEQ ID NO: 2293810 - protein, 17 aa, Cryptosporidium parvum
HAPSLIFMDEIDSIGSQ

SEQ ID NO: 2293811 - protein, 30 aa, Cryptosporidium parvum
HARAGTGGNGFFRRCRSRSSKQTRKRYRFD

SEQ ID NO: 2293812 - protein, 24 aa, Cryptosporidium parvum
HASHVRLSLRKGKGEQRVCKVYGS

SEQ ID NO: 2293813 - protein, 18 aa, Cryptosporidium parvum
HATHLGVLCECLKEESLI

SEQ ID NO: 2293814 - protein, 21 aa, Cryptosporidium parvum
HCGEAGKISHLATMYLLADSI

SEQ ID NO: 2293815 - protein, 20 aa, Cryptosporidium parvum
HCIKMLRLLQIEDFRKNLSK

SEQ ID NO: 2293816 - protein, 17 aa, Cryptosporidium parvum
HCISRWLKTRNVCPLDN

SEQ ID NO: 2293817 - protein, 23 aa, Cryptosporidium parvum
HCLLHVSLLLKQKIQAFVCIGTV

SEQ ID NO: 2293818 - protein, 19 aa, Cryptosporidium parvum
HCLNFYPLLEKVKLDSKNY

SEQ ID NO: 2293819 - protein, 20 aa, Cryptosporidium parvum
HCLYMEKIVAPFLVVVPQST

SEQ ID NO: 2293820 - protein, 19 aa, Cryptosporidium parvum
HCNSAFQWATKEGILCEED

SEQ ID NO: 2293821 - protein, 20 aa, Cryptosporidium parvum
HCRRKVKQIIEVLGASTSTS

SEQ ID NO: 2293822 - protein, 24 aa, Cryptosporidium parvum
HCYICKNDIFGAIQLIKSFERACF

SEQ ID NO: 2293823 - protein, 18 aa, Cryptosporidium parvum
HDACLNSHAFKCINPKPL

SEQ ID NO: 2293824 - protein, 19 aa, Cryptosporidium parvum
HDEKPIWSFFIGSQDISIE

SEQ ID NO: 2293825 - protein, 20 aa, Cryptosporidium parvum
HDELKLLFIAKSKVNEQNKH

SEQ ID NO: 2293826 - protein, 22 aa, Cryptosporidium parvum
HDFFILHLRKCIIGILDSWIKN

SEQ ID NO: 2293827 - protein, 22 aa, Cryptosporidium parvum
HDFFTRYWQVIGILAKQESRQI

SEQ ID NO: 2293828 - protein, 24 aa, Cryptosporidium parvum
HDGEFLRLTWSFRFKDENKQVMEF

SEQ ID NO: 2293829 - protein, 24 aa, Cryptosporidium parvum
HDGLSEGIIPLWGTAFSNGLVRKY

SEQ ID NO: 2293830 - protein, 18 aa, Cryptosporidium parvum
HDICKDFKETGYCGFGDT

SEQ ID NO: 2293831 - protein, 17 aa, Cryptosporidium parvum
HDIKFNRTHVLGCEARS

SEQ ID NO: 2293832 - protein, 36 aa, Cryptosporidium parvum; identical to SEQ ID NO: 2172517

SEQ ID NO: 2293833 - protein, 17 aa, Cryptosporidium parvum
HDKLMGHFKIMEHDTQT

SEQ ID NO: 2293834 - protein, 21 aa, Cryptosporidium parvum
HDLRILVGANLVRISHLEGLT

SEQ ID NO: 2293835 - protein, 24 aa, Cryptosporidium parvum
HDMALRYHQCKSIIKQLDEELSSL

SEQ ID NO: 2293836 - protein, 18 aa, Cryptosporidium parvum
HDTFLFEIGSTFRISMLE

SEQ ID NO: 2293837 - protein, 22 aa, Cryptosporidium parvum
HDVSGCPYPLEVVKVSVPSGVT

SEQ ID NO: 2293838 - protein, 25 aa, Cryptosporidium parvum
HDYFCIPSIELLKTFSEERLAVVED

SEQ ID NO: 2293839 - protein, 29 aa, Cryptosporidium parvum
HECHPSRSLSYYIEFLLMFAQFGRDPLCI

SEQ ID NO: 2293840 - protein, 19 aa, Cryptosporidium parvum
HEFFYSQWIEQIGYLSSLT

SEQ ID NO: 2293841 - protein, 32 aa, Cryptosporidium parvum; identical to SEQ ID NO: 2172528

SEQ ID NO: 2293842 - protein, 17 aa, Cryptosporidium parvum
HEHRANYLLSFSKSNGK

SEQ ID NO: 2293843 - protein, 28 aa, Cryptosporidium parvum
HEIEPQLIFLRWIRLLFSREFSDLNNSI

SEQ ID NO: 2293844 - protein, 24 aa, Cryptosporidium parvum
HEIKCLKNELVYPILILLDEPMLC

SEQ ID NO: 2293845 - protein, 19 aa, Cryptosporidium parvum
HEINKCIINPLKFSKIYSS

SEQ ID NO: 2293846 - protein, 24 aa, Cryptosporidium parvum
HEIRSDCFVLGWYQLIRLDDFQDY

SEQ ID NO: 2293847 - protein, 34 aa, Cryptosporidium parvum
HEISGEIFWSLLFWKMPELFFLSVSKSTQISKEQ

SEQ ID NO: 2293848 - protein, 24 aa, Cryptosporidium parvum
HEITGNLLPSWKIVILDEAEMMTA

SEQ ID NO: 2293849 - protein, 17 aa, Cryptosporidium parvum
HEITRKYHKITFKPMIN

SEQ ID NO: 2293850 - protein, 19 aa, Cryptosporidium parvum
HEKALKASQAIQRSLLDLE

SEQ ID NO: 2293851 - protein, 19 aa, Cryptosporidium parvum
HEKLCPVLSIIRASDFNDG

SEQ ID NO: 2293852 - protein, 21 aa, Cryptosporidium parvum
HELEGWALSWNKIKESYLASG

SEQ ID NO: 2293853 - protein, 25 aa, Cryptosporidium parvum
HELGEHGIIVWMSRDPIGLKEKILN

SEQ ID NO: 2293854 - protein, 20 aa, Cryptosporidium parvum
HELIDFQERCRVLNASGEAM

SEQ ID NO: 2293855 - protein, 23 aa, Cryptosporidium parvum
HELKRIRTLSIVGGRNIDQQAFS

SEQ ID NO: 2293856 - protein, 19 aa, Cryptosporidium parvum
HELMFSTDELDNWKNLLPK

SEQ ID NO: 2293857 - protein, 17 aa, Cryptosporidium parvum
HELTIKVLKDWNEHLSL

SEQ ID NO: 2293858 - protein, 21 aa, Cryptosporidium parvum
HEMSLRLLLNTIITTAAKYQK

SEQ ID NO: 2293859 - protein, 18 aa, Cryptosporidium parvum
HEVLYVLGQMGLKSPLTR

SEQ ID NO: 2293860 - protein, 18 aa, Cryptosporidium parvum
HEYWNYKNSQNFSNLNDI

SEQ ID NO: 2293861 - protein, 24 aa, Cryptosporidium parvum
HFAKEGLSIFYSYDLCSSSCSVPT

SEQ ID NO: 2293862 - protein, 23 aa, Cryptosporidium parvum
HFENRLKDLVLRISSDQDFTLND

SEQ ID NO: 2293863 - protein, 18 aa, Cryptosporidium parvum
HFEPKYINPLQCDITANG

SEQ ID NO: 2293864 - protein, 19 aa, Cryptosporidium parvum
HFGRRECRPSVMWETKRNK

SEQ ID NO: 2293865 - protein, 28 aa, Cryptosporidium parvum
HFGTLAFCRRWLDQLGFNKHALALKSLV

SEQ ID NO: 2293866 - protein, 22 aa, Cryptosporidium parvum
HFHVAERVLYLWNNDIIVNLIN

SEQ ID NO: 2293867 - protein, 24 aa, Cryptosporidium parvum
HFIPEISLPFSIDSWSIGVIALEL

SEQ ID NO: 2293868 - protein, 23 aa, Cryptosporidium parvum
HFIPMYVELCDKLRDHLKDVTTI

SEQ ID NO: 2293869 - protein, 26 aa, Cryptosporidium parvum
HFITLKKSLNCLLNLSKSEKLFVSYF

SEQ ID NO: 2293870 - protein, 23 aa, Cryptosporidium parvum
HFLKEGDFLRGLILALAMNNFNI

SEQ ID NO: 2293871 - protein, 23 aa, Cryptosporidium parvum
HFMFEPFLRFSYIANKPYPRVFI

SEQ ID NO: 2293872 - protein, 23 aa, Cryptosporidium parvum
HFPNIKFIWSCNSSFSSLVILRI

SEQ ID NO: 2293873 - protein, 26 aa, Cryptosporidium parvum
HFPYLPKLRFNASMSTPFSRLAESYS

SEQ ID NO: 2293874 - protein, 20 aa, Cryptosporidium parvum
HFSLLLSIFNNHKWNIDIPD

SEQ ID NO: 2293875 - protein, 23 aa, Cryptosporidium parvum
HFVKDRLYLMIKIIKVDNIITFE

SEQ ID NO: 2293876 - protein, 18 aa, Cryptosporidium parvum
HFYSCIKLNNGNVRFFIF

SEQ ID NO: 2293877 - protein, 25 aa, Cryptosporidium parvum
HGDIPRRWLNEISECIQGRDGMVQY

SEQ ID NO: 2293878 - protein, 22 aa, Cryptosporidium parvum
HGDKIFSVLSHNGTVFNINSKN

SEQ ID NO: 2293879 - protein, 21 aa, Cryptosporidium parvum
HGDLRFRVLLGDRKFYSMPLY

SEQ ID NO: 2293880 - protein, 18 aa, Cryptosporidium parvum
HGFDGGGADNFFDAGSCI

SEQ ID NO: 2293881 - protein, 19 aa, Cryptosporidium parvum
HGFPSRMTIGMLLESMGGK

SEQ ID NO: 2293882 - protein, 17 aa, Cryptosporidium parvum
HGGHPKHIKEWFLSNSI

SEQ ID NO: 2293883 - protein, 17 aa, Cryptosporidium parvum
HGGIGGSIHKVEQIKEI

SEQ ID NO: 2293884 - protein, 24 aa, Cryptosporidium parvum
HGGRVGWDYCLWIDIPEFSCMYLK

SEQ ID NO: 2293885 - protein, 24 aa, Cryptosporidium parvum
HGHNAFPVSFPTPVNRSISNGSNP

SEQ ID NO: 2293886 - protein, 19 aa, Cryptosporidium parvum
HGIHPIWQIHENNLQFWYN

SEQ ID NO: 2293887 - protein, 24 aa, Cryptosporidium parvum
HGINRLRIVYKDMISSNVMTKSVQ

SEQ ID NO: 2293888 - protein, 17 aa, Cryptosporidium parvum
HGIPGSCERLEKILLQD

SEQ ID NO: 2293889 - protein, 26 aa, Cryptosporidium parvum
HGKKKKAPILRRIFGKKGSSNTDESS

SEQ ID NO: 2293890 - protein, 22 aa, Cryptosporidium parvum
HGKWLPCPHNSILKDDLHLLYF

SEQ ID NO: 2293891 - protein, 19 aa, Cryptosporidium parvum
HGLSRANMNNMIMQDRYNK

SEQ ID NO: 2293892 - protein, 24 aa, Cryptosporidium parvum
HGMEMDLLFACLNLSRIPNDLNTL

SEQ ID NO: 2293893 - protein, 23 aa, Cryptosporidium parvum
HGNPNLRDPILYRILKQSHPHTG

SEQ ID NO: 2293894 - protein, 24 aa, Cryptosporidium parvum
HGPLSDFDCLVFVRKDSVYDVEQD

SEQ ID NO: 2293895 - protein, 26 aa, Cryptosporidium parvum
HGRDYCLRPILTIRLSKVNKHFPLER

SEQ ID NO: 2293896 - protein, 19 aa, Cryptosporidium parvum
HGTKGGCERAILSLNRVNS

SEQ ID NO: 2293897 - protein, 20 aa, Cryptosporidium parvum
HGTTELRVTNDFYKTSVCRY

SEQ ID NO: 2293898 - protein, 27 aa, Cryptosporidium parvum
HGYKFPHSIWIQALRFLASSRFHVQTA

SEQ ID NO: 2293899 - protein, 26 aa, Cryptosporidium parvum
HHDIPKFGMITARFLKTSGIPKDVLH

SEQ ID NO: 2293900 - protein, 23 aa, Cryptosporidium parvum
HHGASKLNSLWNFDGYNHQGGIY

SEQ ID NO: 2293901 - protein, 24 aa, Cryptosporidium parvum
HHHKMCIKVIRFLHTSNLLVEGLN

SEQ ID NO: 2293902 - protein, 18 aa, Cryptosporidium parvum
HHHYYKKRSELISYIKNI

SEQ ID NO: 2293903 - protein, 28 aa, Cryptosporidium parvum
HHIFRLRIIQKFDWPLPLLFTKKNMEHY

SEQ ID NO: 2293904 - protein, 25 aa, Cryptosporidium parvum
HHIIDGPIIGLEWKCTGTNNVETVS

SEQ ID NO: 2293905 - protein, 17 aa, Cryptosporidium parvum
HHLKEWVFGSLDLLKTK

SEQ ID NO: 2293906 - protein, 17 aa, Cryptosporidium parvum
HHLPSSPLVYGPRNQSV

SEQ ID NO: 2293907 - protein, 22 aa, Cryptosporidium parvum
HHPPCGRAITLFDHNGMAVATT

SEQ ID NO: 2293908 - protein, 19 aa, Cryptosporidium parvum
HHSGFGFIEFEFVSDVEYA

SEQ ID NO: 2293909 - protein, 24 aa, Cryptosporidium parvum
HHTFFEMLGSWSFGDYFKEEAIEW

SEQ ID NO: 2293910 - protein, 20 aa, Cryptosporidium parvum
HHTYNIFPRDPWVSDVKGER

SEQ ID NO: 2293911 - protein, 18 aa, Cryptosporidium parvum
HIAKKLYSSLEFEKVNTE

SEQ ID NO: 2293912 - protein, 25 aa, Cryptosporidium parvum
HIALPRLDKHPELSLFGVFDGHGGS

SEQ ID NO: 2293913 - protein, 17 aa, Cryptosporidium parvum
HIEFQLKVSICEVYMER

SEQ ID NO: 2293914 - protein, 24 aa, Cryptosporidium parvum
HIELSGKRQGCWRRRKDGKRKHFS

SEQ ID NO: 2293915 - protein, 23 aa, Cryptosporidium parvum
HIERRINGNIPLMANERKNEILD

SEQ ID NO: 2293916 - protein, 21 aa, Cryptosporidium parvum
HIFGLRFDLIRVLTDKMFMDT

SEQ ID NO: 2293917 - protein, 17 aa, Cryptosporidium parvum
HIFHLAGVLSDSNIETQ

SEQ ID NO: 2293918 - protein, 18 aa, Cryptosporidium parvum
HIFNQVFLSLNRFNDYID

SEQ ID NO: 2293919 - protein, 21 aa, Cryptosporidium parvum
HIGQACYDQAMAFCNAVDVGS

SEQ ID NO: 2293920 - protein, 26 aa, Cryptosporidium parvum
HIIGPNWGEYFAIQIFNQLIVCSVGE

SEQ ID NO: 2293921 - protein, 26 aa, Cryptosporidium parvum
HIIQYLFYRWIRSIKCHSGSIAASTS

SEQ ID NO: 2293922 - protein, 20 aa, Cryptosporidium parvum
HIIWDHIIRQGGTIDMLATD

SEQ ID NO: 2293923 - protein, 21 aa, Cryptosporidium parvum
HIKPQIPTMFPAGYYHNVHYI

SEQ ID NO: 2293924 - protein, 18 aa, Cryptosporidium parvum
HIKSICNIHENIVQITKL

SEQ ID NO: 2293925 - protein, 22 aa, Cryptosporidium parvum
HILEKLRIIQTYHQICDELEAQ

SEQ ID NO: 2293926 - protein, 20 aa, Cryptosporidium parvum
HILEVWRIFMPFGCPMMDKK

SEQ ID NO: 2293927 - protein, 18 aa, Cryptosporidium parvum
HILLCGVPPFAGNTDTEI

SEQ ID NO: 2293928 - protein, 21 aa, Cryptosporidium parvum
HILRDWAVFVLQADPDSGSNL

SEQ ID NO: 2293929 - protein, 24 aa, Cryptosporidium parvum
HINDRLLWCNEWLPETPLEKFDGN

SEQ ID NO: 2293930 - protein, 24 aa, Cryptosporidium parvum
HINEFKWSRVGRSLCSKPDTSSMV

SEQ ID NO: 2293931 - protein, 26 aa, Cryptosporidium parvum
HINGLSIRYIPSLKRMRFEYDCIQDS

SEQ ID NO: 2293932 - protein, 26 aa, Cryptosporidium parvum
HINQSRFNEWINFHVIFLMNNRKINQ

SEQ ID NO: 2293933 - protein, 24 aa, Cryptosporidium parvum
HIPGYRIMSCWEQKVEKPNPKYQY

SEQ ID NO: 2293934 - protein, 17 aa, Cryptosporidium parvum
HIPHTGIVKAFKVTKNS

SEQ ID NO: 2293935 - protein, 26 aa, Cryptosporidium parvum
HIQFNWLLSQLFVWASIDISIVLRDY

SEQ ID NO: 2293936 - protein, 23 aa, Cryptosporidium parvum
HIRGKMRKKVWVNPGDIVLVSLR

SEQ ID NO: 2293937 - protein, 23 aa, Cryptosporidium parvum
HISDNVFRIFIYSNIKTFSNQMD

SEQ ID NO: 2293938 - protein, 22 aa, Cryptosporidium parvum
HISLKKLAPYRVDKKRKYSPPV

SEQ ID NO: 2293939 - protein, 24 aa, Cryptosporidium parvum
HISWFKVPPSIYFNRGCLEEALQD

SEQ ID NO: 2293940 - protein, 20 aa, Cryptosporidium parvum
HIYFSCNWFDVYVEVDLTAI

SEQ ID NO: 2293941 - protein, 23 aa, Cryptosporidium parvum
HKALKFLVKDEIFKELYIETIIS

SEQ ID NO: 2293942 - protein, 25 aa, Cryptosporidium parvum
HKAPEFNWRDFAIFNQFFMPYFLAK

SEQ ID NO: 2293943 - protein, 19 aa, Cryptosporidium parvum
HKCILCTNKHIFIIYITEN

SEQ ID NO: 2293944 - protein, 20 aa, Cryptosporidium parvum
HKDGGLGFDAKWDLGWMNDT

SEQ ID NO: 2293945 - protein, 23 aa, Cryptosporidium parvum
HKDILFSGMFIKLAKSFQNIFLG

SEQ ID NO: 2293946 - protein, 19 aa, Cryptosporidium parvum
HKEEVKIYLDEIAELRSQI

SEQ ID NO: 2293947 - protein, 28 aa, Cryptosporidium parvum
HKERLGHLSCRVCGVEYTSRIGKFDEAV

SEQ ID NO: 2293948 - protein, 18 aa, Cryptosporidium parvum
HKESIFLAIGGPGRYIYI

SEQ ID NO: 2293949 - protein, 17 aa, Cryptosporidium parvum
HKFTIKLLMMATRCKII

SEQ ID NO: 2293950 - protein, 17 aa, Cryptosporidium parvum
HKFTVRDDFKYSQEKYN

SEQ ID NO: 2293951 - protein, 30 aa, Cryptosporidium parvum; identical to SEQ ID NO: 2172618

SEQ ID NO: 2293952 - protein, 17 aa, Cryptosporidium parvum
HKHPSFSSDKFKYIVIN

SEQ ID NO: 2293953 - protein, 21 aa, Cryptosporidium parvum
HKIKRHWELDTPFIHYRNIGF

SEQ ID NO: 2293954 - protein, 17 aa, Cryptosporidium parvum
HKILGYEKIRAFKCIST

SEQ ID NO: 2293955 - protein, 21 aa, Cryptosporidium parvum
HKIPCNLLFGASIKICSKSVN

SEQ ID NO: 2293956 - protein, 19 aa, Cryptosporidium parvum
HKKGLKFTDFEKVKEEILI

SEQ ID NO: 2293957 - protein, 23 aa, Cryptosporidium parvum
HKKRRKRANSGWDAQSNNSCNSP

SEQ ID NO: 2293958 - protein, 34 aa, Cryptosporidium parvum
HKLLTEKGISCKIPVICTEPIFRFGNNILCDIIQ

SEQ ID NO: 2293959 - protein, 18 aa, Cryptosporidium parvum
HKLNFRKRNVILNNPSVF

SEQ ID NO: 2293960 - protein, 17 aa, Cryptosporidium parvum
HKLVINSCFDPEILTSS

SEQ ID NO: 2293961 - protein, 18 aa, Cryptosporidium parvum
HKLYRRAGTVINGNNSSI

SEQ ID NO: 2293962 - protein, 21 aa, Cryptosporidium parvum
HKPNVRFVIHSSIPDSIDSYY

SEQ ID NO: 2293963 - protein, 22 aa, Cryptosporidium parvum
HKQIEFRASLTHRQRVSKFNEK

SEQ ID NO: 2293964 - protein, 31 aa, Cryptosporidium parvum; identical to SEQ ID NO: 2172627

SEQ ID NO: 2293965 - protein, 23 aa, Cryptosporidium parvum
HKQKRIARRIGIIKEKIVNKSKS

SEQ ID NO: 2293966 - protein, 20 aa, Cryptosporidium parvum
HKQYVVYQLIKVIKYLHSGG

SEQ ID NO: 2293967 - protein, 21 aa, Cryptosporidium parvum
HKSNENIYEFIYNKIGKCENN

SEQ ID NO: 2293968 - protein, 18 aa, Cryptosporidium parvum
HKSNENKPSIGFNTFNPY

SEQ ID NO: 2293969 - protein, 23 aa, Cryptosporidium parvum
HKSPRMRKICQWKDIKEFCLMPP

SEQ ID NO: 2293970 - protein, 20 aa, Cryptosporidium parvum
HKTPRGAAALARLTTIDGCP

SEQ ID NO: 2293971 - protein, 36 aa, Cryptosporidium parvum
HKVDIWAIGCIFFEILHLRRPFGLRSNSIAEAFSLI

SEQ ID NO: 2293972 - protein, 33 aa, Cryptosporidium parvum
HKVIPFEYGNGYGYLYTRLKWILDNNETNGQFK

SEQ ID NO: 2293973 - protein, 20 aa, Cryptosporidium parvum
HKVRDSWNKLVSVIQKTSSN

SEQ ID NO: 2293974 - protein, 41 aa, Cryptosporidium parvum
HKYFKVSLHSFLRYEGWLYIRLAQLVMIYDFKFRSLLELCF

SEQ ID NO: 2293975 - protein, 22 aa, Cryptosporidium parvum
HKYTGLRFISSVILKRPEIYRP

SEQ ID NO: 2293976 - protein, 21 aa, Cryptosporidium parvum
HLDCFRWVERDSYLPCGSRGL

SEQ ID NO: 2293977 - protein, 28 aa, Cryptosporidium parvum
HLENCWRKDLLSHFLLKLCFMNNKEKQE

SEQ ID NO: 2293978 - protein, 20 aa, Cryptosporidium parvum
HLERCISDLQFVFAQIPLSV

SEQ ID NO: 2293979 - protein, 21 aa, Cryptosporidium parvum
HLESLGEIYIDLWVTSDNQSG

SEQ ID NO: 2293980 - protein, 25 aa, Cryptosporidium parvum
HLEYLAGSCNFQWILSNVYDAYTGE

SEQ ID NO: 2293981 - protein, 24 aa, Cryptosporidium parvum
HLFENLKDGFDWNIKSSLEILILD

SEQ ID NO: 2293982 - protein, 27 aa, Cryptosporidium parvum
HLFLFLPKSLLEWSYKSIDDVFSSIKV

SEQ ID NO: 2293983 - protein, 18 aa, Cryptosporidium parvum
HLINFPTLKMLIGNLEKI

SEQ ID NO: 2293984 - protein, 18 aa, Cryptosporidium parvum
HLKFPRKSMLEYVPSNSG

SEQ ID NO: 2293985 - protein, 22 aa, Cryptosporidium parvum
HLKMFTDWIELMSREYFELTIL

SEQ ID NO: 2293986 - protein, 20 aa, Cryptosporidium parvum
HLLDYLSLICIQWKSQYKIC

SEQ ID NO: 2293987 - protein, 27 aa, Cryptosporidium parvum
HLLPRIDEFWIKYIQMELILKNYINVR

SEQ ID NO: 2293988 - protein, 18 aa, Cryptosporidium parvum
HLNSGIDFLCFGEYMYGS

SEQ ID NO: 2293989 - protein, 19 aa, Cryptosporidium parvum
HLPSSSYLYLLATAATEIF

SEQ ID NO: 2293990 - protein, 17 aa, Cryptosporidium parvum
HLQENIIEFEKKSRAAK

SEQ ID NO: 2293991 - protein, 23 aa, Cryptosporidium parvum
HLQSVRLVWKLQVSKDHELNDVT

SEQ ID NO: 2293992 - protein, 21 aa, Cryptosporidium parvum
HLSELEELWLGKNKITTLDDI

SEQ ID NO: 2293993 - protein, 17 aa, Cryptosporidium parvum
HLTGFHWEKNIRIKLPF

SEQ ID NO: 2293994 - protein, 19 aa, Cryptosporidium parvum
HLVALKIINFEQIKTDSYH

SEQ ID NO: 2293995 - protein, 22 aa, Cryptosporidium parvum
HLVGSLIQIFSIRIKETNNGQS

SEQ ID NO: 2293996 - protein, 19 aa, Cryptosporidium parvum
HLVKLIALKNVFARQLPKM

SEQ ID NO: 2293997 - protein, 17 aa, Cryptosporidium parvum
HLVPRLFDGKSYDEIDN

SEQ ID NO: 2293998 - protein, 18 aa, Cryptosporidium parvum
HLYFQIQAAYWWYEDMWY

SEQ ID NO: 2293999 - protein, 29 aa, Cryptosporidium parvum
HLYGVLCCICKSCGAFLLKGEEKRQHLAR

SEQ ID NO: 2294000 - protein, 29 aa, Cryptosporidium parvum
HLYHSKRFKMCDAFGYKLPICSTSKRNRK

SEQ ID NO: 2294001 - protein, 23 aa, Cryptosporidium parvum
HMLQRRKSYNFNYRKQNSEKQIE

SEQ ID NO: 2294002 - protein, 21 aa, Cryptosporidium parvum
HMYLKALIWKSIIDSETCSSV

SEQ ID NO: 2294003 - protein, 25 aa, Cryptosporidium parvum
HNFVLWKLPILYPTEFLLDKKINTV

SEQ ID NO: 2294004 - protein, 19 aa, Cryptosporidium parvum
HNIDISFWDTYRFEGNSQW

SEQ ID NO: 2294005 - protein, 18 aa, Cryptosporidium parvum
HNIIDIICNLLFEEEMRK

SEQ ID NO: 2294006 - protein, 23 aa, Cryptosporidium parvum
HNKVCGMAGVLDSSRFRTFIAQH

SEQ ID NO: 2294007 - protein, 30 aa, Cryptosporidium parvum
HNKVLLKRRKIVYITAGFNGCTSVKTCPGI

SEQ ID NO: 2294008 - protein, 29 aa, Cryptosporidium parvum
HNMVYRIAYNVIRRLGSMLRILYIRISRT

SEQ ID NO: 2294009 - protein, 17 aa, Cryptosporidium parvum
HNNRYYFGYYLCDHTTF

SEQ ID NO: 2294010 - protein, 27 aa, Cryptosporidium parvum
HNQLIWKRPLEKFAPRLLNAVQISKLH

SEQ ID NO: 2294011 - protein, 26 aa, Cryptosporidium parvum
HNQYWKTKLCLMFSKGACKNGDNCRF

SEQ ID NO: 2294012 - protein, 26 aa, Cryptosporidium parvum
HNRLPEEVPIKWTGRLQRTAAQTLFI

SEQ ID NO: 2294013 - protein, 20 aa, Cryptosporidium parvum
HNSDVWGLVKLNRFEKKGNI

SEQ ID NO: 2294014 - protein, 23 aa, Cryptosporidium parvum
HNSKISICNLSFDKLPNITEKNG

SEQ ID NO: 2294015 - protein, 18 aa, Cryptosporidium parvum
HNTPRSATILVIEKGGLW

SEQ ID NO: 2294016 - protein, 20 aa, Cryptosporidium parvum
HNYHAWSLVNWLIYELIPTI

SEQ ID NO: 2294017 - protein, 21 aa, Cryptosporidium parvum
HNYKCPILDLFSEKFFQNNIK

SEQ ID NO: 2294018 - protein, 18 aa, Cryptosporidium parvum
HNYQREWILPLLNNLKNL

SEQ ID NO: 2294019 - protein, 20 aa, Cryptosporidium parvum
HPAILRLGMRMKDRKIVGTN

SEQ ID NO: 2294020 - protein, 20 aa, Cryptosporidium parvum
HPARFRSCQNYEIITHGGES

SEQ ID NO: 2294021 - protein, 23 aa, Cryptosporidium parvum
HPDLRGKIWRNFGEFDCNDGIDD

SEQ ID NO: 2294022 - protein, 30 aa, Cryptosporidium parvum; identical to SEQ ID NO: 2172686

SEQ ID NO: 2294023 - protein, 25 aa, Cryptosporidium parvum
HPGFLPEIYDSINITLYRMRRLLGV

SEQ ID NO: 2294024 - protein, 28 aa, Cryptosporidium parvum
HPHLRTDALIEIQKWLGLYQNEEQNDKD

SEQ ID NO: 2294025 - protein, 17 aa, Cryptosporidium parvum
HPICMRFFHTQCLLYYQ

SEQ ID NO: 2294026 - protein, 18 aa, Cryptosporidium parvum
HPIILRRFMLEGTSIIPV

SEQ ID NO: 2294027 - protein, 23 aa, Cryptosporidium parvum
HPILLRLVTLRTMMEKLKPIDVK

SEQ ID NO: 2294028 - protein, 33 aa, Cryptosporidium parvum
HPINDCFLSSGADWTIKLWIPNPLASSFTLLYT

SEQ ID NO: 2294029 - protein, 19 aa, Cryptosporidium parvum
HPKSSGLIFSPIKRSGTYH

SEQ ID NO: 2294030 - protein, 24 aa, Cryptosporidium parvum
HPLETRYRVLLLLESWSKSDLLTC

SEQ ID NO: 2294031 - protein, 20 aa, Cryptosporidium parvum
HPLLFRLQLLIWSLKLKQFL

SEQ ID NO: 2294032 - protein, 20 aa, Cryptosporidium parvum
HPLNHLLYRCYKLLTFWNVI

SEQ ID NO: 2294033 - protein, 17 aa, Cryptosporidium parvum
HPLVSISSGLLYIPNEW

SEQ ID NO: 2294034 - protein, 22 aa, Cryptosporidium parvum
HPMKDELLANFVVQSHMNSQEM

SEQ ID NO: 2294035 - protein, 22 aa, Cryptosporidium parvum
HPNLQFEAAWTLTNISSGTTEQ

SEQ ID NO: 2294036 - protein, 25 aa, Cryptosporidium parvum
HPRFTRDDCHLIMKVTIPLVRALTG

SEQ ID NO: 2294037 - protein, 21 aa, Cryptosporidium parvum
HPYEILVIGSHGGFIEYIQDT

SEQ ID NO: 2294038 - protein, 25 aa, Cryptosporidium parvum
HPYYLPNFLDIFSWSLPFVSEKVTE

SEQ ID NO: 2294039 - protein, 18 aa, Cryptosporidium parvum
HQDHLCRVYPSGTRISSS

SEQ ID NO: 2294040 - protein, 24 aa, Cryptosporidium parvum
HQERKCIPIALLIEQITKKKLHVT

SEQ ID NO: 2294041 - protein, 25 aa, Cryptosporidium parvum
HQFRSNECSFVFGLSATYIPEKYMN

SEQ ID NO: 2294042 - protein, 17 aa, Cryptosporidium parvum
HQFWKILADNYVTDNTG

SEQ ID NO: 2294043 - protein, 38 aa, Cryptosporidium parvum; identical to SEQ ID NO: 2172702

SEQ ID NO: 2294044 - protein, 18 aa, Cryptosporidium parvum
HQIILAIVYQNAYSAVSS

SEQ ID NO: 2294045 - protein, 21 aa, Cryptosporidium parvum
HQIRKMVALAIEIFRGTAPSN

SEQ ID NO: 2294046 - protein, 24 aa, Cryptosporidium parvum
HQKGIKIHCDAMVGGDTPLRDINL

SEQ ID NO: 2294047 - protein, 17 aa, Cryptosporidium parvum
HQKLVLLSRCSRLTNEI

SEQ ID NO: 2294048 - protein, 23 aa, Cryptosporidium parvum
HQMEWYLCHSFLKNIESIPNKIS

SEQ ID NO: 2294049 - protein, 17 aa, Cryptosporidium parvum
HQPGQAMGLSFSVPKGV

SEQ ID NO: 2294050 - protein, 21 aa, Cryptosporidium parvum
HQRICKENLFSSDDEGFIENL

SEQ ID NO: 2294051 - protein, 24 aa, Cryptosporidium parvum
HQTMQPCGFCFVQYYSHADALTAV

SEQ ID NO: 2294052 - protein, 29 aa, Cryptosporidium parvum
HQTQECPKRIILCRYCNNFVQAGTDGHYV

SEQ ID NO: 2294053 - protein, 18 aa, Cryptosporidium parvum
HRAGINFDAYDNIPVEMT

SEQ ID NO: 2294054 - protein, 25 aa, Cryptosporidium parvum
HRAYVCPKCGLIISSISKRAMAQSM

SEQ ID NO: 2294055 - protein, 17 aa, Cryptosporidium parvum
HRCLIDALFSNGFIFPS

SEQ ID NO: 2294056 - protein, 25 aa, Cryptosporidium parvum
HRDQVVFRPVGYHQFDVIPQVIHQI

SEQ ID NO: 2294057 - protein, 24 aa, Cryptosporidium parvum
HRDSELPPFFKVEKLMFERHEREN

SEQ ID NO: 2294058 - protein, 19 aa, Cryptosporidium parvum
HRFSEINIRCSDQNTIYTL

SEQ ID NO: 2294059 - protein, 23 aa, Cryptosporidium parvum
HRFSNRPRFVSMQDVHNHFRDNL

SEQ ID NO: 2294060 - protein, 19 aa, Cryptosporidium parvum
HRGEPYSLCVDLWSVGIIL

SEQ ID NO: 2294061 - protein, 18 aa, Cryptosporidium parvum
HRGLLKQQLELVIDEYIE

SEQ ID NO: 2294062 - protein, 22 aa, Cryptosporidium parvum
HRIHSGGNFFGGYIHANRIKVP

SEQ ID NO: 2294063 - protein, 38 aa, Cryptosporidium parvum
HRIYGKIMPRRSCIRKAMKHIFLRVIIDGEPYNGIAEL

SEQ ID NO: 2294064 - protein, 27 aa, Cryptosporidium parvum
HRLDSLYKFLLPREEFSQEFKNKSIVN

SEQ ID NO: 2294065 - protein, 30 aa, Cryptosporidium parvum; identical to SEQ ID NO: 2172718

SEQ ID NO: 2294066 - protein, 34 aa, Cryptosporidium parvum; identical to SEQ ID NO: 2172719

SEQ ID NO: 2294067 - protein, 20 aa, Cryptosporidium parvum
HRLPPSGGFGMNLGIQDSLN

SEQ ID NO: 2294068 - protein, 25 aa, Cryptosporidium parvum
HRLVRPRYVPCVQIGNTQNLKDPSL

SEQ ID NO: 2294069 - protein, 19 aa, Cryptosporidium parvum
HRNMMRMKLDLDKIRKDEF

SEQ ID NO: 2294070 - protein, 25 aa, Cryptosporidium parvum
HRQKPRHVPSFCSFADSMNISFEKE

SEQ ID NO: 2294071 - protein, 24 aa, Cryptosporidium parvum
HRSNLKPAPSMNLRKEFGSRMESK

SEQ ID NO: 2294072 - protein, 18 aa, Cryptosporidium parvum
HRSYEFSQKFAPDVRGNG

SEQ ID NO: 2294073 - protein, 23 aa, Cryptosporidium parvum
HRYMVRYYQCWVEKCDNTKDERN

SEQ ID NO: 2294074 - protein, 21 aa, Cryptosporidium parvum
HSAANLSCCVLINYPDDVKIS

SEQ ID NO: 2294075 - protein, 24 aa, Cryptosporidium parvum
HSAFQRRKLLAFITWRLTTNRSSH

SEQ ID NO: 2294076 - protein, 20 aa, Cryptosporidium parvum
HSCREFMYYSDIYDLQNFIK

SEQ ID NO: 2294077 - protein, 24 aa, Cryptosporidium parvum
HSDWTEFRQMAGLESQLERQRKHG

SEQ ID NO: 2294078 - protein, 24 aa, Cryptosporidium parvum
HSEMAVPFGISPGVCQSNNANANL

SEQ ID NO: 2294079 - protein, 22 aa, Cryptosporidium parvum
HSGGFRKSFHGYPPPQMEGGSA

SEQ ID NO: 2294080 - protein, 29 aa, Cryptosporidium parvum
HSGVGKGCAFVKYAFKEQGLFAIKSLHGA

SEQ ID NO: 2294081 - protein, 22 aa, Cryptosporidium parvum
HSGYIKCINMLSELSLNKNVLC

SEQ ID NO: 2294082 - protein, 23 aa, Cryptosporidium parvum
HSHLRFFGNMVLSLWDCGGQDIF

SEQ ID NO: 2294083 - protein, 20 aa, Cryptosporidium parvum
HSIECICLIMALKIRYKDKV

SEQ ID NO: 2294084 - protein, 18 aa, Cryptosporidium parvum
HSIHPLSCFYPQEFESSL

SEQ ID NO: 2294085 - protein, 18 aa, Cryptosporidium parvum
HSILGRTFGMCILQDFEA

SEQ ID NO: 2294086 - protein, 18 aa, Cryptosporidium parvum
HSILRKKRNNSWMLNKAI

SEQ ID NO: 2294087 - protein, 36 aa, Cryptosporidium parvum; identical to SEQ ID NO: 2172741

SEQ ID NO: 2294088 - protein, 32 aa, Cryptosporidium parvum
HSKKPIICMEWSKWSPNILMTGGVDNKVVVWD

SEQ ID NO: 2294089 - protein, 17 aa, Cryptosporidium parvum
HSKMIIKSERGIWQSES

SEQ ID NO: 2294090 - protein, 18 aa, Cryptosporidium parvum
HSKYCDWFKGLDFSKKSQ

SEQ ID NO: 2294091 - protein, 26 aa, Cryptosporidium parvum
HSLIGLDYLHRICGVIHTDIKPENIV

SEQ ID NO: 2294092 - protein, 23 aa, Cryptosporidium parvum
HSLPKPQTCIDYSHLQNKGKSIG

SEQ ID NO: 2294093 - protein, 19 aa, Cryptosporidium parvum
HSLSYKPDIKKGVRKTDKS

SEQ ID NO: 2294094 - protein, 19 aa, Cryptosporidium parvum
HSMPKQRRTGLFSATLNSQ

SEQ ID NO: 2294095 - protein, 17 aa, Cryptosporidium parvum
HSNMKISYITLKSNYRQ

SEQ ID NO: 2294096 - protein, 23 aa, Cryptosporidium parvum
HSNSMKLIWEKIIKVWMSVYQPI

SEQ ID NO: 2294097 - protein, 17 aa, Cryptosporidium parvum
HSPGHMLNSLFNCNTDN

SEQ ID NO: 2294098 - protein, 18 aa, Cryptosporidium parvum
HSPSLCLNNCGFYGNPTT

SEQ ID NO: 2294099 - protein, 21 aa, Cryptosporidium parvum
HSSGALAFSVEYIREVRPEMD

SEQ ID NO: 2294100 - protein, 19 aa, Cryptosporidium parvum
HSSIIFLPAIEDLESAYIT

SEQ ID NO: 2294101 - protein, 21 aa, Cryptosporidium parvum
HSSLFNWKLSADVLIQKSTNI

SEQ ID NO: 2294102 - protein, 24 aa, Cryptosporidium parvum
HSSMDKGGGLSFLVQVIVIHIFPI

SEQ ID NO: 2294103 - protein, 24 aa, Cryptosporidium parvum
HSVFKRKGGDLFIEKDITLVEALT

SEQ ID NO: 2294104 - protein, 26 aa, Cryptosporidium parvum
HSVQELRPLPDLRFTRLCELTKRGDV

SEQ ID NO: 2294105 - protein, 17 aa, Cryptosporidium parvum
HSWRLTSYCPLLVQFLG

SEQ ID NO: 2294106 - protein, 25 aa, Cryptosporidium parvum
HSYNCGFCHFSLNVNLEMDAGNETD

SEQ ID NO: 2294107 - protein, 19 aa, Cryptosporidium parvum
HSYPIPVPVPVITPRTRDL

SEQ ID NO: 2294108 - protein, 24 aa, Cryptosporidium parvum
HTCRHFIRLPCPIRIREILIGGRI

SEQ ID NO: 2294109 - protein, 17 aa, Cryptosporidium parvum
HTFYRSSPVIPLNDPTI

SEQ ID NO: 2294110 - protein, 20 aa, Cryptosporidium parvum
HTFYWSCLRSPSETNKPTSK

SEQ ID NO: 2294111 - protein, 17 aa, Cryptosporidium parvum
HTIPMSALEIFYKEMEK

SEQ ID NO: 2294112 - protein, 26 aa, Cryptosporidium parvum
HTSIKSSGIGNGYMGHSISGSAINNY

SEQ ID NO: 2294113 - protein, 17 aa, Cryptosporidium parvum
HTSPRKIGIDMKEIAKV

SEQ ID NO: 2294114 - protein, 26 aa, Cryptosporidium parvum
HTSPYKFSSSQGVIDWKPQHQQLSIF

SEQ ID NO: 2294115 - protein, 24 aa, Cryptosporidium parvum
HVAQFLLDSCIRPPHGQIFMKWGK

SEQ ID NO: 2294116 - protein, 20 aa, Cryptosporidium parvum
HVASACLYAICRREKTPHML

SEQ ID NO: 2294117 - protein, 25 aa, Cryptosporidium parvum
HVCIRGCSFFGCNIPFDACSYQMCN

SEQ ID NO: 2294118 - protein, 17 aa, Cryptosporidium parvum
HVCNICTDFESSLNESV

SEQ ID NO: 2294119 - protein, 18 aa, Cryptosporidium parvum
HVCNVPYDFQNIVPDFLV

SEQ ID NO: 2294120 - protein, 25 aa, Cryptosporidium parvum
HVEEACQIFKSSLSKIRYNDIDLGD

SEQ ID NO: 2294121 - protein, 26 aa, Cryptosporidium parvum
HVEIFKRKIFLGQWQSAYIILTKDKF

SEQ ID NO: 2294122 - protein, 19 aa, Cryptosporidium parvum
HVGCCMSGLVADAKTMIDH

SEQ ID NO: 2294123 - protein, 18 aa, Cryptosporidium parvum
HVGDWGTQFGMLIEYLKE

SEQ ID NO: 2294124 - protein, 25 aa, Cryptosporidium parvum
HVIPNELLWRIDWDEVIESITNSEI

SEQ ID NO: 2294125 - protein, 25 aa, Cryptosporidium parvum
HVISRLRFPLYMAHIEKLLGETCKY

SEQ ID NO: 2294126 - protein, 17 aa, Cryptosporidium parvum
HVKAMRCFVEAVLRYGV

SEQ ID NO: 2294127 - protein, 24 aa, Cryptosporidium parvum
HVKYSVRCPKMFLEDLYPPALESA

SEQ ID NO: 2294128 - protein, 23 aa, Cryptosporidium parvum
HVLRTVCGSLSPSQGILSLGFGF

SEQ ID NO: 2294129 - protein, 35 aa, Cryptosporidium parvum
HVMKMYWKPLMEWDLKCFVKILKQCPRISICLREL

SEQ ID NO: 2294130 - protein, 18 aa, Cryptosporidium parvum
HVRCEVDSALSIGDNNSF

SEQ ID NO: 2294131 - protein, 33 aa, Cryptosporidium parvum; identical to SEQ ID NO: 2172787

SEQ ID NO: 2294132 - protein, 18 aa, Cryptosporidium parvum
HWHEQRGDKILVFSDSLF

SEQ ID NO: 2294133 - protein, 25 aa, Cryptosporidium parvum
HWMAPEILRGEGFTKYADVYSFGII

SEQ ID NO: 2294134 - protein, 24 aa, Cryptosporidium parvum
HYCKEKKFSSTRFQSEKSGLMQCY

SEQ ID NO: 2294135 - protein, 25 aa, Cryptosporidium parvum
HYCRVLRFEDRPDYTYLRKLFRDLM

SEQ ID NO: 2294136 - protein, 19 aa, Cryptosporidium parvum
HYFCEKCAFSHYTNTSKCF

SEQ ID NO: 2294137 - protein, 22 aa, Cryptosporidium parvum
HYKKKRLVILLRIYSIKQAKAI

SEQ ID NO: 2294138 - protein, 18 aa, Cryptosporidium parvum
HYLFYPKNIQVMDLKENS

SEQ ID NO: 2294139 - protein, 17 aa, Cryptosporidium parvum
HYLGHSLHYNRSRGRGR

SEQ ID NO: 2294140 - protein, 21 aa, Cryptosporidium parvum
HYLGKRKNIFFQHPSPVTEIL

SEQ ID NO: 2294141 - protein, 23 aa, Cryptosporidium parvum
HYNTITCCTAVTWQYAPPEIVGC

SEQ ID NO: 2294142 - protein, 20 aa, Cryptosporidium parvum
HYQFVEWRISVYGKDKSEWK

SEQ ID NO: 2294143 - protein, 24 aa, Cryptosporidium parvum
HYRCDRPVVLGLDMQQLSKFMKFC

SEQ ID NO: 2294144 - protein, 21 aa, Cryptosporidium parvum
HYTNCKLEFLNIENIHKVRDS

SEQ ID NO: 2294145 - protein, 19 aa, Cryptosporidium parvum
IAAASIPVSCLRPGLRWIQ

SEQ ID NO: 2294146 - protein, 25 aa, Cryptosporidium parvum
IAAICKKQMRLLFEPQRLTIHDVYS

SEQ ID NO: 2294147 - protein, 17 aa, Cryptosporidium parvum
IAALEILAGRKLINAIQ

SEQ ID NO: 2294148 - protein, 23 aa, Cryptosporidium parvum
IAALTRIFTKFGIESGRKELKEF

SEQ ID NO: 2294149 - protein, 22 aa, Cryptosporidium parvum
IAAQYGSVVVVGERSNLVGNSA

SEQ ID NO: 2294150 - protein, 18 aa, Cryptosporidium parvum
IADGGIRYSGDIGKALAV

SEQ ID NO: 2294151 - protein, 20 aa, Cryptosporidium parvum
IADKCFIGPEIEFFVFESVS

SEQ ID NO: 2294152 - protein, 21 aa, Cryptosporidium parvum
IADRRRINVALTRAKYNLWIV

SEQ ID NO: 2294153 - protein, 20 aa, Cryptosporidium parvum
IADTWLKSKVLDEAYKNGFT

SEQ ID NO: 2294154 - protein, 19 aa, Cryptosporidium parvum
IAFCKARMLSVDGKCKTFD

SEQ ID NO: 2294155 - protein, 23 aa, Cryptosporidium parvum
IAFFDSVCGIWRNMKEKNINNLL

SEQ ID NO: 2294156 - protein, 21 aa, Cryptosporidium parvum
IAFNPKKAFFASGMFINHLKY

SEQ ID NO: 2294157 - protein, 26 aa, Cryptosporidium parvum
IAGFGASESLIWSLSIHFRSITLQDP

SEQ ID NO: 2294158 - protein, 20 aa, Cryptosporidium parvum
IAGLIKLVLVLKHETAIRIA

SEQ ID NO: 2294159 - protein, 20 aa, Cryptosporidium parvum
IAIGNCIDRFARVMKLDNYP

SEQ ID NO: 2294160 - protein, 17 aa, Cryptosporidium parvum
IAIKGMGRRVFQNKGPV

SEQ ID NO: 2294161 - protein, 24 aa, Cryptosporidium parvum
IAIRRLLNILLDFIAKLDPSLGTK

SEQ ID NO: 2294162 - protein, 18 aa, Cryptosporidium parvum
IAISADWLILATDVDALF

SEQ ID NO: 2294163 - protein, 19 aa, Cryptosporidium parvum
IAISLYFSGLNCIENISTA

SEQ ID NO: 2294164 - protein, 21 aa, Cryptosporidium parvum
IAISSCKGGVGKSTLAVNIAF

SEQ ID NO: 2294165 - protein, 17 aa, Cryptosporidium parvum
IAKEVWKDEPLSHITKL

SEQ ID NO: 2294166 - protein, 26 aa, Cryptosporidium parvum
IAKFTIIKPQVWFKRTEESLSQLEEE

SEQ ID NO: 2294167 - protein, 23 aa, Cryptosporidium parvum
IAKPRKLLYIAVDGVAPRAKMNQ

SEQ ID NO: 2294168 - protein, 17 aa, Cryptosporidium parvum
IAKRFRALGYYSEIALP

SEQ ID NO: 2294169 - protein, 32 aa, Cryptosporidium parvum
IAKVIRIFRRLLKGASIININCNIHKEMLQGL

SEQ ID NO: 2294170 - protein, 19 aa, Cryptosporidium parvum
IALGLCIINTILSDMLNIF

SEQ ID NO: 2294171 - protein, 19 aa, Cryptosporidium parvum
IALILCMHPYISVCDLAIS

SEQ ID NO: 2294172 - protein, 17 aa, Cryptosporidium parvum
IALQICLFLIEKLTDDS

SEQ ID NO: 2294173 - protein, 23 aa, Cryptosporidium parvum
IAMVISLLLERSCILVSKETEDS

SEQ ID NO: 2294174 - protein, 20 aa, Cryptosporidium parvum
IANIPIEYIISYIDMMFSSI

SEQ ID NO: 2294175 - protein, 18 aa, Cryptosporidium parvum
IANPFGGTTLGFGQGTVL

SEQ ID NO: 2294176 - protein, 19 aa, Cryptosporidium parvum
IAPLSRVAIYTWHGCILQI

SEQ ID NO: 2294177 - protein, 31 aa, Cryptosporidium parvum
IAPSCNKCLLPGFHPITAWLLPPSYFEKGGQ

SEQ ID NO: 2294178 - protein, 21 aa, Cryptosporidium parvum
IAQEEFKFWPIEVLSLPNIFK

SEQ ID NO: 2294179 - protein, 17 aa, Cryptosporidium parvum
IAQEFSFILGDELYNTG

SEQ ID NO: 2294180 - protein, 23 aa, Cryptosporidium parvum
IAQRKKLSLTFPIDHGHIDDWTK

SEQ ID NO: 2294181 - protein, 20 aa, Cryptosporidium parvum
IAQVLGFSMSSNWWDIAKFN

SEQ ID NO: 2294182 - protein, 23 aa, Cryptosporidium parvum
IARFHRILRPFMLRRVKSEVEID

SEQ ID NO: 2294183 - protein, 21 aa, Cryptosporidium parvum
IARGCLNRRTAAFIAKLRKSK

SEQ ID NO: 2294184 - protein, 22 aa, Cryptosporidium parvum
IARSIWPIFVYHPIPNPKYILE

SEQ ID NO: 2294185 - protein, 29 aa, Cryptosporidium parvum
IASFLTCEIPWKLEERHLPKSSTNCDYMI

SEQ ID NO: 2294186 - protein, 25 aa, Cryptosporidium parvum
IASIPHKWLNEAIIKFAKFSKHEAK

SEQ ID NO: 2294187 - protein, 25 aa, Cryptosporidium parvum
IASKMLRGEIWFHNIGIEEICDETF

SEQ ID NO: 2294188 - protein, 29 aa, Cryptosporidium parvum
IASNGLFILKIIKDFSIGNKWDGVIFTNY

SEQ ID NO: 2294189 - protein, 21 aa, Cryptosporidium parvum
IASPLGIRRVMGMSEGGKGSD

SEQ ID NO: 2294190 - protein, 20 aa, Cryptosporidium parvum
IASSCGVGFARVLIERSSFL

SEQ ID NO: 2294191 - protein, 24 aa, Cryptosporidium parvum
IASSLESAMSWVVTIGRYATYIQR

SEQ ID NO: 2294192 - protein, 31 aa, Cryptosporidium parvum; identical to SEQ ID NO: 2172840

SEQ ID NO: 2294193 - protein, 18 aa, Cryptosporidium parvum
IATGFPVVIKVVKKTRIM

SEQ ID NO: 2294194 - protein, 30 aa, Cryptosporidium parvum
IATKISYNGKQRWRVVTINGELIDSSGTMT

SEQ ID NO: 2294195 - protein, 21 aa, Cryptosporidium parvum
IATLEKRCKNLIEEKETIQNF

SEQ ID NO: 2294196 - protein, 24 aa, Cryptosporidium parvum
IAVVPCGLLYPIVFIGNIPPNVPY

SEQ ID NO: 2294197 - protein, 21 aa, Cryptosporidium parvum
IAWMDHIPVSIGWTLESTLLS

SEQ ID NO: 2294198 - protein, 24 aa, Cryptosporidium parvum
IAYKCPNLKVYVCDKNIKRIQEWN

SEQ ID NO: 2294199 - protein, 18 aa, Cryptosporidium parvum
ICAIFKRILDPKTMDVPE

SEQ ID NO: 2294200 - protein, 18 aa, Cryptosporidium parvum
ICEALDFDSGANLGSSSG

SEQ ID NO: 2294201 - protein, 19 aa, Cryptosporidium parvum
ICEITTPITVVGVRENIID

SEQ ID NO: 2294202 - protein, 18 aa, Cryptosporidium parvum
ICEVCGNLFPSATSLQRH

SEQ ID NO: 2294203 - protein, 24 aa, Cryptosporidium parvum
ICFYDWNECRLIRRIDVSSPINNV

SEQ ID NO: 2294204 - protein, 20 aa, Cryptosporidium parvum
ICGHVYKLLVEKKISSAYEW

SEQ ID NO: 2294205 - protein, 22 aa, Cryptosporidium parvum
ICGILTRKGLLSAYSMGVSAEQ

SEQ ID NO: 2294206 - protein, 17 aa, Cryptosporidium parvum
ICGYPPFNAPSEFLVFC

SEQ ID NO: 2294207 - protein, 17 aa, Cryptosporidium parvum
ICIDLLVCNEGSAYVTI

SEQ ID NO: 2294208 - protein, 18 aa, Cryptosporidium parvum
ICIIPNLDRNGGFQQKPG

SEQ ID NO: 2294209 - protein, 21 aa, Cryptosporidium parvum
ICILDGKYSMNECPIDNYHDE

SEQ ID NO: 2294210 - protein, 23 aa, Cryptosporidium parvum
ICIRLISGLKFLEFDDIETGKPS

SEQ ID NO: 2294211 - protein, 18 aa, Cryptosporidium parvum
ICKQEIGNNFSLEASIND

SEQ ID NO: 2294212 - protein, 18 aa, Cryptosporidium parvum
ICKRCLKNSQKFKVVGAH

SEQ ID NO: 2294213 - protein, 17 aa, Cryptosporidium parvum
ICLKEYFEKPLDVWSLC

SEQ ID NO: 2294214 - protein, 34 aa, Cryptosporidium parvum
ICNESFSCNIILLDRPRPSFKLDNEDVAKNSNSN

SEQ ID NO: 2294215 - protein, 19 aa, Cryptosporidium parvum
ICNPGFQSSSSSTCATSPY

SEQ ID NO: 2294216 - protein, 19 aa, Cryptosporidium parvum
ICNSAYKKLIFLFKQVIYS

SEQ ID NO: 2294217 - protein, 22 aa, Cryptosporidium parvum
ICNSIRGLVVWERVECSKGPIG

SEQ ID NO: 2294218 - protein, 20 aa, Cryptosporidium parvum
ICNTCGLPLSTESKCQQSNT

SEQ ID NO: 2294219 - protein, 24 aa, Cryptosporidium parvum
ICNYIVPICSSFLASLIDSENRMQ

SEQ ID NO: 2294220 - protein, 21 aa, Cryptosporidium parvum
ICQKSGFPKVKFTNFKMENII

SEQ ID NO: 2294221 - protein, 19 aa, Cryptosporidium parvum
ICQYISFLSKYALDLVPGI

SEQ ID NO: 2294222 - protein, 25 aa, Cryptosporidium parvum
ICRAYMRLALEWYPDGNRSDTELKG

SEQ ID NO: 2294223 - protein, 19 aa, Cryptosporidium parvum
ICREEELYTLFSHINGFKE

SEQ ID NO: 2294224 - protein, 23 aa, Cryptosporidium parvum
ICRREKTPHMLIDFSDVLQTPVK

SEQ ID NO: 2294225 - protein, 19 aa, Cryptosporidium parvum
ICSGVIKGNALRINNCLIW

SEQ ID NO: 2294226 - protein, 29 aa, Cryptosporidium parvum
ICSLYTPGIYRLACGQVYGAANYLGMTSL

SEQ ID NO: 2294227 - protein, 18 aa, Cryptosporidium parvum
ICSPRIRASNIINDQLSG

SEQ ID NO: 2294228 - protein, 26 aa, Cryptosporidium parvum
ICSQFRRLGCSLDWSREFFTLDENMS

SEQ ID NO: 2294229 - protein, 17 aa, Cryptosporidium parvum
ICSTCNVNSSGSVIVSP

SEQ ID NO: 2294230 - protein, 21 aa, Cryptosporidium parvum
ICSYLPLKDFSNFRLVCRTHC

SEQ ID NO: 2294231 - protein, 23 aa, Cryptosporidium parvum
ICTEPPFSHFFNLRIFNGYFSDE

SEQ ID NO: 2294232 - protein, 17 aa, Cryptosporidium parvum
ICTTRIVAGVGVPQITA

SEQ ID NO: 2294233 - protein, 17 aa, Cryptosporidium parvum
ICTVLRKNVDAVRFYTK

SEQ ID NO: 2294234 - protein, 22 aa, Cryptosporidium parvum
ICVADGVGGWISQGVSSAMYSR

SEQ ID NO: 2294235 - protein, 37 aa, Cryptosporidium parvum
ICVICGVNIGKYKFKCCLRKFCSLECFQIHSREECSL

SEQ ID NO: 2294236 - protein, 22 aa, Cryptosporidium parvum
ICVTENDVIFCFKNPSVRQQFE

SEQ ID NO: 2294237 - protein, 24 aa, Cryptosporidium parvum
ICYEFLTQSLVCFEEELAESKRQF

SEQ ID NO: 2294238 - protein, 22 aa, Cryptosporidium parvum
IDADKKIPCFFFAPRSNSKILV

SEQ ID NO: 2294239 - protein, 24 aa, Cryptosporidium parvum
IDAIKFLTELYFKLEDSPQSNENS

SEQ ID NO: 2294240 - protein, 17 aa, Cryptosporidium parvum
IDCAMFSGFISRQLDSA

SEQ ID NO: 2294241 - protein, 17 aa, Cryptosporidium parvum
IDCPSKYDMLMAIANNI

SEQ ID NO: 2294242 - protein, 17 aa, Cryptosporidium parvum
IDDALSIELINPNDDNS

SEQ ID NO: 2294243 - protein, 24 aa, Cryptosporidium parvum
IDDELRIVHTLGIKPINAEQVNQE

SEQ ID NO: 2294244 - protein, 20 aa, Cryptosporidium parvum
IDDWLCGSIPLSKKQEYQLF

SEQ ID NO: 2294245 - protein, 23 aa, Cryptosporidium parvum
IDDYSVRVVDVFSMPQSGNSVSV

SEQ ID NO: 2294246 - protein, 19 aa, Cryptosporidium parvum
IDEALGFATLMQSVKSMSY

SEQ ID NO: 2294247 - protein, 20 aa, Cryptosporidium parvum
IDEDDWYAGLGVVPISLEKT

SEQ ID NO: 2294248 - protein, 23 aa, Cryptosporidium parvum
IDEINKMLSWRLSDENIEPDEVE

SEQ ID NO: 2294249 - protein, 22 aa, Cryptosporidium parvum
IDELPLIPVVYWMIENWNKYDM

SEQ ID NO: 2294250 - protein, 17 aa, Cryptosporidium parvum
IDESISLNPTLPSITSS

SEQ ID NO: 2294251 - protein, 28 aa, Cryptosporidium parvum
IDFDSSFEILRFFLLDLFQISKKAQAII

SEQ ID NO: 2294252 - protein, 20 aa, Cryptosporidium parvum
IDFFECFDFSDSTKKKLFES

SEQ ID NO: 2294253 - protein, 24 aa, Cryptosporidium parvum
IDFFRERYIMFASRLFSQIVKEIE

SEQ ID NO: 2294254 - protein, 22 aa, Cryptosporidium parvum
IDFHASEPWILSGLYNGTITVH

SEQ ID NO: 2294255 - protein, 22 aa, Cryptosporidium parvum
IDGEKGCGCSIVKLYSKKIKIE

SEQ ID NO: 2294256 - protein, 23 aa, Cryptosporidium parvum
IDGNPSWMFEKAFKTLKEKIPTC

SEQ ID NO: 2294257 - protein, 18 aa, Cryptosporidium parvum
IDGTLDWVFCPSTDKDND

SEQ ID NO: 2294258 - protein, 24 aa, Cryptosporidium parvum
IDHASKIESIQCEIVKTFKNLTLS

SEQ ID NO: 2294259 - protein, 26 aa, Cryptosporidium parvum
IDHFMFKICLLFSIQIVPISNDHTER

SEQ ID NO: 2294260 - protein, 17 aa, Cryptosporidium parvum
IDHGFSVIQGRAACHES

SEQ ID NO: 2294261 - protein, 18 aa, Cryptosporidium parvum
IDICLPLHTSSCFIHLLR

SEQ ID NO: 2294262 - protein, 17 aa, Cryptosporidium parvum
IDIEAIKACKGKVPKYI

SEQ ID NO: 2294263 - protein, 29 aa, Cryptosporidium parvum
IDIELGKGWKIFLSRSVDLGRWTIIQKLS

SEQ ID NO: 2294264 - protein, 30 aa, Cryptosporidium parvum; identical to SEQ ID NO: 2172901

SEQ ID NO: 2294265 - protein, 20 aa, Cryptosporidium parvum
IDIFLALKLYLVQRESSMGL

SEQ ID NO: 2294266 - protein, 25 aa, Cryptosporidium parvum
IDIGSKLSFLRCYVRHYFSLCDDYD

SEQ ID NO: 2294267 - protein, 27 aa, Cryptosporidium parvum
IDIGVVPQCCWIWSTYVFLKIIKSFTF

SEQ ID NO: 2294268 - protein, 18 aa, Cryptosporidium parvum
IDIHSGGIDLRFPHHDNE

SEQ ID NO: 2294269 - protein, 23 aa, Cryptosporidium parvum
IDILPNLAIIILAMKVFQHSVLQ

SEQ ID NO: 2294270 - protein, 20 aa, Cryptosporidium parvum
IDILVCVALGADMFDCVYPC

SEQ ID NO: 2294271 - protein, 32 aa, Cryptosporidium parvum
IDIPGFRRCLIMAFVCNFCGIKTNELKPSGAY

SEQ ID NO: 2294272 - protein, 17 aa, Cryptosporidium parvum
IDIPIILGKIEKPRNSL

SEQ ID NO: 2294273 - protein, 26 aa, Cryptosporidium parvum
IDIRKLCRCAICYDPGKARFNETYEP

SEQ ID NO: 2294274 - protein, 17 aa, Cryptosporidium parvum
IDIVKMMLNTYLPVQSK

SEQ ID NO: 2294275 - protein, 18 aa, Cryptosporidium parvum
IDIYIQGVLLFLLEHVES

SEQ ID NO: 2294276 - protein, 21 aa, Cryptosporidium parvum
IDIYRRCKIYEDSGSFLRHVT

SEQ ID NO: 2294277 - protein, 29 aa, Cryptosporidium parvum
IDKGTHYEFKFLDGLFVFDPSIKGKNESN

SEQ ID NO: 2294278 - protein, 23 aa, Cryptosporidium parvum
IDKRFEDRLKLRDIRTKNMSAEI

SEQ ID NO: 2294279 - protein, 18 aa, Cryptosporidium parvum
IDLARGIFTSNLINFDTW

SEQ ID NO: 2294280 - protein, 24 aa, Cryptosporidium parvum
IDLDEIKKAYSLFIDVKRSTQYLI

SEQ ID NO: 2294281 - protein, 24 aa, Cryptosporidium parvum
IDLIKWRLIPNFEQIHFKNLKFLI

SEQ ID NO: 2294282 - protein, 17 aa, Cryptosporidium parvum
IDLKLGTSWIGESKNDS

SEQ ID NO: 2294283 - protein, 19 aa, Cryptosporidium parvum
IDLKMVKFKNVNFIQIYIS

SEQ ID NO: 2294284 - protein, 17 aa, Cryptosporidium parvum
IDLLIALPRPKVFEKVL

SEQ ID NO: 2294285 - protein, 20 aa, Cryptosporidium parvum
IDLNLTWQSSIYALKTKSSD

SEQ ID NO: 2294286 - protein, 27 aa, Cryptosporidium parvum
IDLPLPRINCGMFLRGNVIYIYGGLFE

SEQ ID NO: 2294287 - protein, 17 aa, Cryptosporidium parvum
IDLPTCLNSDNLYRALR

SEQ ID NO: 2294288 - protein, 18 aa, Cryptosporidium parvum
IDLSIPYAGIPISHLVLC

SEQ ID NO: 2294289 - protein, 27 aa, Cryptosporidium parvum
IDLSNSLFISNCANYKLGKRDDSWSKC

SEQ ID NO: 2294290 - protein, 20 aa, Cryptosporidium parvum
IDLVICDEAHRLKNDKTKTA

SEQ ID NO: 2294291 - protein, 18 aa, Cryptosporidium parvum
IDLVNYIIMIFNRYWIID

SEQ ID NO: 2294292 - protein, 17 aa, Cryptosporidium parvum
IDMKPFLNQGLPIWERV

SEQ ID NO: 2294293 - protein, 18 aa, Cryptosporidium parvum
IDMKSIYLTPDFMDKKNR

SEQ ID NO: 2294294 - protein, 18 aa, Cryptosporidium parvum
IDMLKQLLSIRRRSSQQS

SEQ ID NO: 2294295 - protein, 24 aa, Cryptosporidium parvum
IDMLNIPIWLYKESGSLTVNGPFS

SEQ ID NO: 2294296 - protein, 21 aa, Cryptosporidium parvum
IDMYTRINSLLTFMNEPAKSE

SEQ ID NO: 2294297 - protein, 19 aa, Cryptosporidium parvum
IDNALSLYLCSTFEINGSV

SEQ ID NO: 2294298 - protein, 22 aa, Cryptosporidium parvum
IDNELLRHFNFIKFSKNGNKPK

SEQ ID NO: 2294299 - protein, 25 aa, Cryptosporidium parvum
IDNLFKWYLKYGMRDSVSQLVGQLT

SEQ ID NO: 2294300 - protein, 24 aa, Cryptosporidium parvum
IDNRRKRGSISFHVKPKVNLSYPR

SEQ ID NO: 2294301 - protein, 30 aa, Cryptosporidium parvum
IDNSSLWNSFELILRPELKKLNFNIENIVK

SEQ ID NO: 2294302 - protein, 19 aa, Cryptosporidium parvum
IDPAGYFASYRACAVGTKE

SEQ ID NO: 2294303 - protein, 26 aa, Cryptosporidium parvum
IDPFLWLKTPDLFNIISSKLINNNNN

SEQ ID NO: 2294304 - protein, 17 aa, Cryptosporidium parvum
IDPHPAISKLPLSDTRL

SEQ ID NO: 2294305 - protein, 18 aa, Cryptosporidium parvum
IDPIVTIASFLTCEIPWK

SEQ ID NO: 2294306 - protein, 20 aa, Cryptosporidium parvum
IDPNEIFARFFASDRAGSFG

SEQ ID NO: 2294307 - protein, 17 aa, Cryptosporidium parvum
IDQDELFVNVNASKQLS

SEQ ID NO: 2294308 - protein, 20 aa, Cryptosporidium parvum
IDQEHFEIFDPVYPSMTEIF

SEQ ID NO: 2294309 - protein, 23 aa, Cryptosporidium parvum
IDQIETMGSYAIMINWSDGHTSI

SEQ ID NO: 2294310 - protein, 17 aa, Cryptosporidium parvum
IDQRLHDVFNFIRTGGI

SEQ ID NO: 2294311 - protein, 17 aa, Cryptosporidium parvum
IDRHIIAAVAGLTADAN

SEQ ID NO: 2294312 - protein, 18 aa, Cryptosporidium parvum
IDRILRLESGGVIQPVSF

SEQ ID NO: 2294313 - protein, 18 aa, Cryptosporidium parvum
IDRILTILYSKISAFSSS

SEQ ID NO: 2294314 - protein, 29 aa, Cryptosporidium parvum
IDRLPNCVFPKSFYLWLLNENNNKYFSVQ

SEQ ID NO: 2294315 - protein, 22 aa, Cryptosporidium parvum
IDRPSLPSVELLNAHDELINIH

SEQ ID NO: 2294316 - protein, 19 aa, Cryptosporidium parvum
IDSAWSGGVNGLFFVSYFL

SEQ ID NO: 2294317 - protein, 18 aa, Cryptosporidium parvum
IDSCAAISKKLIQNNYEK

SEQ ID NO: 2294318 - protein, 24 aa, Cryptosporidium parvum
IDSFELCKGAKSIRNKRRKIEDSN

SEQ ID NO: 2294319 - protein, 23 aa, Cryptosporidium parvum
IDSFEVSFRFLLFSEEYLCNLKE

SEQ ID NO: 2294320 - protein, 28 aa, Cryptosporidium parvum
IDSGVLCYSSLFGLKLSQLELILEGFYQ

SEQ ID NO: 2294321 - protein, 21 aa, Cryptosporidium parvum
IDSICELLRASIKMPPEQISP

SEQ ID NO: 2294322 - protein, 31 aa, Cryptosporidium parvum; identical to SEQ ID NO: 2172939

SEQ ID NO: 2294323 - protein, 18 aa, Cryptosporidium parvum
IDSLPILNRHGFGPLTIV

SEQ ID NO: 2294324 - protein, 25 aa, Cryptosporidium parvum
IDSLPPYLLVQLVRFEWKKSSEIAR

SEQ ID NO: 2294325 - protein, 27 aa, Cryptosporidium parvum
IDSNKSFKLSICNANELIIECKHSDSG

SEQ ID NO: 2294326 - protein, 23 aa, Cryptosporidium parvum
IDSTGWYDLISMILASSNKIVDH

SEQ ID NO: 2294327 - protein, 23 aa, Cryptosporidium parvum
IDSYNPHVSFCMQRIKRYLESND

SEQ ID NO: 2294328 - protein, 20 aa, Cryptosporidium parvum
IDTDSGFSIEVFTEKHLIPI

SEQ ID NO: 2294329 - protein, 24 aa, Cryptosporidium parvum
IDTLRKLVVLVWTFLQETSFGSSP

SEQ ID NO: 2294330 - protein, 17 aa, Cryptosporidium parvum
IDTYRIAASKMKDGSRS

SEQ ID NO: 2294331 - protein, 20 aa, Cryptosporidium parvum
IDVDFNMCFNYNVGIDAMQI

SEQ ID NO: 2294332 - protein, 19 aa, Cryptosporidium parvum
IDVPIEWCSVESYHGVYNC

SEQ ID NO: 2294333 - protein, 17 aa, Cryptosporidium parvum
IDWDEVIESITNSEIVS

SEQ ID NO: 2294334 - protein, 20 aa, Cryptosporidium parvum
IDYLEWIHARLEYMTKGSRI

SEQ ID NO: 2294335 - protein, 25 aa, Cryptosporidium parvum
IDYLRNDYKFGFMMQFFPNEKDDKL

SEQ ID NO: 2294336 - protein, 28 aa, Cryptosporidium parvum
IDYLYDLRYIPVVSIVLVLKSGKESKDL

SEQ ID NO: 2294337 - protein, 25 aa, Cryptosporidium parvum
IDYQKLRTPFWIWLSVNDEWNYSLE

SEQ ID NO: 2294338 - protein, 25 aa, Cryptosporidium parvum
IDYSLRFFLENDLIYLLNPIQSSVR

SEQ ID NO: 2294339 - protein, 25 aa, Cryptosporidium parvum
IEAAWKLTESLIRKGFERLFPPLLY

SEQ ID NO: 2294340 - protein, 20 aa, Cryptosporidium parvum
IEADRIFLNYLYRKPQGQGY

SEQ ID NO: 2294341 - protein, 26 aa, Cryptosporidium parvum
IEAIKACKGKVPKYINSFIVILCDEF

SEQ ID NO: 2294342 - protein, 17 aa, Cryptosporidium parvum
IEAVRRALLRELRTVIS

SEQ ID NO: 2294343 - protein, 19 aa, Cryptosporidium parvum
IECKNPLKSSKNVNNIEIL

SEQ ID NO: 2294344 - protein, 23 aa, Cryptosporidium parvum
IECNEMKNFIGPIIQGKVAKDIC

SEQ ID NO: 2294345 - protein, 19 aa, Cryptosporidium parvum
IEDGIPFNGIEIAISSDNL

SEQ ID NO: 2294346 - protein, 24 aa, Cryptosporidium parvum
IEDLKAQLEREIAELNSEYRSNLS

SEQ ID NO: 2294347 - protein, 23 aa, Cryptosporidium parvum
IEDLYQKRIHEINKLVNNDVWSL

SEQ ID NO: 2294348 - protein, 22 aa, Cryptosporidium parvum
IEDSKECQWVFSTGDHGKSIRA

SEQ ID NO: 2294349 - protein, 21 aa, Cryptosporidium parvum
IEDYSRFFGEPIKCMFINYDF

SEQ ID NO: 2294350 - protein, 24 aa, Cryptosporidium parvum
IEEALKLKDEFSIDIKESQAKEAE

SEQ ID NO: 2294351 - protein, 21 aa, Cryptosporidium parvum
IEEDVRWLGVDWGEHKYYASD

SEQ ID NO: 2294352 - protein, 24 aa, Cryptosporidium parvum
IEEFPHIRLGPSVSQVLTTLTNGF

SEQ ID NO: 2294353 - protein, 26 aa, Cryptosporidium parvum
IEEFYLMMRFRWDGMDHYRMDKFTFL

SEQ ID NO: 2294354 - protein, 26 aa, Cryptosporidium parvum
IEEIFFLKFSDLISELLIIGSKFIDS

SEQ ID NO: 2294355 - protein, 22 aa, Cryptosporidium parvum
IEEIKECLEVYIPIGSKSFVPC

SEQ ID NO: 2294356 - protein, 19 aa, Cryptosporidium parvum
IEEINKILLDLGKAADTYR

SEQ ID NO: 2294357 - protein, 21 aa, Cryptosporidium parvum
IEEITKMVGFWGEKVSFEAII

SEQ ID NO: 2294358 - protein, 19 aa, Cryptosporidium parvum
IEELNGIGSFHIMEDSSNL

SEQ ID NO: 2294359 - protein, 30 aa, Cryptosporidium parvum
IEELNLWLFYSRFSISISRTTFLLNSISLP

SEQ ID NO: 2294360 - protein, 28 aa, Cryptosporidium parvum
IEELPEWSRECFRCVSVSYLNEIQSRVF

SEQ ID NO: 2294361 - protein, 23 aa, Cryptosporidium parvum
IEELSKWFSKMVGKFETFGLNIQ

SEQ ID NO: 2294362 - protein, 17 aa, Cryptosporidium parvum
IEEPEILLANTCGPQTF

SEQ ID NO: 2294363 - protein, 38 aa, Cryptosporidium parvum
IEFDNFLTKNCIKLPEFIKPLILRVLMFNKRRHPNTYI

SEQ ID NO: 2294364 - protein, 21 aa, Cryptosporidium parvum
IEFIQEHFIFWQRSSNTPEGN

SEQ ID NO: 2294365 - protein, 23 aa, Cryptosporidium parvum
IEFKEKRLNERFLNGELSNSSNN

SEQ ID NO: 2294366 - protein, 20 aa, Cryptosporidium parvum
IEFLSEYIFLTKGRFHILDI

SEQ ID NO: 2294367 - protein, 24 aa, Cryptosporidium parvum
IEFVLELFNSLPLLVQTKTKYITQ

SEQ ID NO: 2294368 - protein, 19 aa, Cryptosporidium parvum
IEFWSNFMTNCINFCPILD

SEQ ID NO: 2294369 - protein, 24 aa, Cryptosporidium parvum
IEGFLYSQVPETWIKYFETKISEK

SEQ ID NO: 2294370 - protein, 27 aa, Cryptosporidium parvum
IEGGSIGARGADIWMGGGGSSMGIGGR

SEQ ID NO: 2294371 - protein, 18 aa, Cryptosporidium parvum
IEGKYSFVKNELFCNSYI

SEQ ID NO: 2294372 - protein, 17 aa, Cryptosporidium parvum
IEGLPPLIVEYSSLNAK

SEQ ID NO: 2294373 - protein, 28 aa, Cryptosporidium parvum
IEGNPDWRILKSHLLREGRVRKDHLLEI

SEQ ID NO: 2294374 - protein, 20 aa, Cryptosporidium parvum
IEGRILWDILETIRREHKLK

SEQ ID NO: 2294375 - protein, 19 aa, Cryptosporidium parvum
IEHIAKFSFSYKNIPSAVN

SEQ ID NO: 2294376 - protein, 24 aa, Cryptosporidium parvum
IEHLRPTFWFSGHHHCFFDASIEF

SEQ ID NO: 2294377 - protein, 17 aa, Cryptosporidium parvum
IEHVIKCPLSKRQKELY

SEQ ID NO: 2294378 - protein, 21 aa, Cryptosporidium parvum
IEIAINLSNSFGIVDIESIHF

SEQ ID NO: 2294379 - protein, 17 aa, Cryptosporidium parvum
IEICFKKIDSKLHIIEE

SEQ ID NO: 2294380 - protein, 18 aa, Cryptosporidium parvum
IEIGFLILDLGSFIMSIR

SEQ ID NO: 2294381 - protein, 19 aa, Cryptosporidium parvum
IEIGRCIIDLKVAKNNIYF

SEQ ID NO: 2294382 - protein, 18 aa, Cryptosporidium parvum
IEIGRCLTFDCYYCEPEK

SEQ ID NO: 2294383 - protein, 17 aa, Cryptosporidium parvum
IEIILKLIINLDKNNIK

SEQ ID NO: 2294384 - protein, 21 aa, Cryptosporidium parvum
IEILNYLLSLMVQYNNCQFYF

SEQ ID NO: 2294385 - protein, 24 aa, Cryptosporidium parvum
IEINGCKASHIYKSLIQQNMSHMS

SEQ ID NO: 2294386 - protein, 27 aa, Cryptosporidium parvum
IEINLWFCIKYLEYYGSGRKHERSLSD

SEQ ID NO: 2294387 - protein, 17 aa, Cryptosporidium parvum
IEIPKNFLARGPRTSVS

SEQ ID NO: 2294388 - protein, 17 aa, Cryptosporidium parvum
IEISPLVSYYGENLDHF

SEQ ID NO: 2294389 - protein, 17 aa, Cryptosporidium parvum
IEISVLTSSLGFESNFD

SEQ ID NO: 2294390 - protein, 24 aa, Cryptosporidium parvum
IEKDLYRPLLFTNIVTSICKEIPR

SEQ ID NO: 2294391 - protein, 25 aa, Cryptosporidium parvum
IEKEIPSWLVNQVFPFVTNKNKLLN

SEQ ID NO: 2294392 - protein, 22 aa, Cryptosporidium parvum
IEKEYLKDILIKQMSTYCILKS

SEQ ID NO: 2294393 - protein, 20 aa, Cryptosporidium parvum
IEKFPHLVFHSSGNSSQQPQ

SEQ ID NO: 2294394 - protein, 18 aa, Cryptosporidium parvum
IEKIHLAPKFELNRIHEH

SEQ ID NO: 2294395 - protein, 17 aa, Cryptosporidium parvum
IEKKIATIRGLRDLEST

SEQ ID NO: 2294396 - protein, 22 aa, Cryptosporidium parvum
IEKKNFTGFGIWEDLQKKYGKE

SEQ ID NO: 2294397 - protein, 18 aa, Cryptosporidium parvum
IEKKRIKREINIKRRQPL

SEQ ID NO: 2294398 - protein, 22 aa, Cryptosporidium parvum
IEKKVEVFFSIFNNIINQQNLI

SEQ ID NO: 2294399 - protein, 32 aa, Cryptosporidium parvum
IEKNFKPRSMKMIFTRWLSFEKEFGSLQSQKH

SEQ ID NO: 2294400 - protein, 18 aa, Cryptosporidium parvum
IEKNKWILDSACEIIRIP

SEQ ID NO: 2294401 - protein, 26 aa, Cryptosporidium parvum
IEKRKVSLQKGLSLQMNPTMTALTYQ

SEQ ID NO: 2294402 - protein, 20 aa, Cryptosporidium parvum
IEKVKFILYRNLMRRIRNWC

SEQ ID NO: 2294403 - protein, 17 aa, Cryptosporidium parvum
IELCTRSGVGLPENKPR

SEQ ID NO: 2294404 - protein, 18 aa, Cryptosporidium parvum
IELEFKSMELDWERRALE

SEQ ID NO: 2294405 - protein, 27 aa, Cryptosporidium parvum
IELEKKKFKWSFLHTEKFWLENVMNFE

SEQ ID NO: 2294406 - protein, 21 aa, Cryptosporidium parvum
IELKFSLNHIFDFIQDKHTHY

SEQ ID NO: 2294407 - protein, 24 aa, Cryptosporidium parvum
IELLKGSGVGALISSMIQYKPSDG

SEQ ID NO: 2294408 - protein, 17 aa, Cryptosporidium parvum
IELLKSLQYKSVGKWFS

SEQ ID NO: 2294409 - protein, 25 aa, Cryptosporidium parvum
IELLQQVCILVSYLSIGNLRDESFL

SEQ ID NO: 2294410 - protein, 34 aa, Cryptosporidium parvum; identical to SEQ ID NO: 2173003

SEQ ID NO: 2294411 - protein, 25 aa, Cryptosporidium parvum
IELSDDFFIKIPRNVFIGLNSIDFA

SEQ ID NO: 2294412 - protein, 24 aa, Cryptosporidium parvum
IELSHPIRLYCRFVDKLYIIIKLS

SEQ ID NO: 2294413 - protein, 20 aa, Cryptosporidium parvum
IELYNIKAFVSATRQLINSY

SEQ ID NO: 2294414 - protein, 19 aa, Cryptosporidium parvum
IELYWKFNQDRLKDTLKKL

SEQ ID NO: 2294415 - protein, 25 aa, Cryptosporidium parvum
IEMEWDLRCNICLNLQETLNLLDHL

SEQ ID NO: 2294416 - protein, 20 aa, Cryptosporidium parvum
IEMFPTLSMYSSFGETEDGA

SEQ ID NO: 2294417 - protein, 24 aa, Cryptosporidium parvum
IENELRENFPLIFCGLSNGEWRTY

SEQ ID NO: 2294418 - protein, 17 aa, Cryptosporidium parvum
IENESKFDRSALLDLEL

SEQ ID NO: 2294419 - protein, 25 aa, Cryptosporidium parvum
IENFPETFDIFGISLEFIKKTINEY

SEQ ID NO: 2294420 - protein, 21 aa, Cryptosporidium parvum
IENIKSLQFRAQDSIESVISE

SEQ ID NO: 2294421 - protein, 20 aa, Cryptosporidium parvum
IENKFYWSLCTSNVPSTSVD

SEQ ID NO: 2294422 - protein, 32 aa, Cryptosporidium parvum
IENPHEFERLVKLIFSNCMIFNPNSGECKWIY

SEQ ID NO: 2294423 - protein, 26 aa, Cryptosporidium parvum
IENRFPAILRRFYLGFFSFCCEDDFG

SEQ ID NO: 2294424 - protein, 25 aa, Cryptosporidium parvum
IENRKCANCNEIGPNYVCINFGTFV

SEQ ID NO: 2294425 - protein, 26 aa, Cryptosporidium parvum
IENSLSLQLFRDFIMGVSSYSSEHKL

SEQ ID NO: 2294426 - protein, 23 aa, Cryptosporidium parvum
IENYFDWRSQPLLAPANILRKFP

SEQ ID NO: 2294427 - protein, 18 aa, Cryptosporidium parvum
IENYWLKSSNGFEDSNLN

SEQ ID NO: 2294428 - protein, 24 aa, Cryptosporidium parvum
IEPCTEIPGNFTFSVTGVNLPHLI

SEQ ID NO: 2294429 - protein, 26 aa, Cryptosporidium parvum
IEPFPDCSTIELWKSNISRQMDTIFL

SEQ ID NO: 2294430 - protein, 28 aa, Cryptosporidium parvum
IEPISKDEGFNWCGNTVSRITNNESNKL

SEQ ID NO: 2294431 - protein, 17 aa, Cryptosporidium parvum
IEPLPSCYSSNLFKLIQ

SEQ ID NO: 2294432 - protein, 17 aa, Cryptosporidium parvum
IEPTPLFIDAVKMVKPE

SEQ ID NO: 2294433 - protein, 23 aa, Cryptosporidium parvum
IEQLKFEITRKAEIIEELKKVNK

SEQ ID NO: 2294434 - protein, 17 aa, Cryptosporidium parvum
IERIFKLGTYSNVNNQE

SEQ ID NO: 2294435 - protein, 29 aa, Cryptosporidium parvum
IERRCENEVWLTLPLFFPSATLHNVTHQR

SEQ ID NO: 2294436 - protein, 21 aa, Cryptosporidium parvum
IESAIEMKNFLSGYSNINIID

SEQ ID NO: 2294437 - protein, 20 aa, Cryptosporidium parvum
IESIESLKLFTERFDIKIFN

SEQ ID NO: 2294438 - protein, 17 aa, Cryptosporidium parvum
IESINEFILLNWTPGEQ

SEQ ID NO: 2294439 - protein, 17 aa, Cryptosporidium parvum
IESKRSISVPVQENQLS

SEQ ID NO: 2294440 - protein, 17 aa, Cryptosporidium parvum
IESSALRTAKNDSKVEY

SEQ ID NO: 2294441 - protein, 19 aa, Cryptosporidium parvum
IESSGIITGFDHWYRIQSL

SEQ ID NO: 2294442 - protein, 25 aa, Cryptosporidium parvum
IETDSSCSIYHFIPSERSFHQTKLI

SEQ ID NO: 2294443 - protein, 18 aa, Cryptosporidium parvum
IETLLIFSLSDEKWSLLP

SEQ ID NO: 2294444 - protein, 17 aa, Cryptosporidium parvum
IETLQLLLEHFSFEEQI

SEQ ID NO: 2294445 - protein, 26 aa, Cryptosporidium parvum
IETNELFKVWSPHIVSPYVLSLYLKS

SEQ ID NO: 2294446 - protein, 44 aa, Cryptosporidium parvum
IETTTSCSLIWEGVRPSRIFFRWKIYYCHSKEDAYRFFLDNNSL

SEQ ID NO: 2294447 - protein, 18 aa, Cryptosporidium parvum
IEVDSMLTKWLREHQRQG

SEQ ID NO: 2294448 - protein, 24 aa, Cryptosporidium parvum
IEVFPVLLEKGSTRLAIYGIGNIR

SEQ ID NO: 2294449 - protein, 23 aa, Cryptosporidium parvum
IEVFTEKHLIPIIEKKLLNQNFY

SEQ ID NO: 2294450 - protein, 20 aa, Cryptosporidium parvum
IEVKSKIPILKTITVVLSFV

SEQ ID NO: 2294451 - protein, 22 aa, Cryptosporidium parvum
IEVMLRPECHLETRIVQLRGAA

SEQ ID NO: 2294452 - protein, 21 aa, Cryptosporidium parvum
IEVRRAISWLFSESLLNANEM

SEQ ID NO: 2294453 - protein, 19 aa, Cryptosporidium parvum
IEWKVLKKALRKEIVLKSN

SEQ ID NO: 2294454 - protein, 17 aa, Cryptosporidium parvum
IEYARGDTHYLLYIYDI

SEQ ID NO: 2294455 - protein, 17 aa, Cryptosporidium parvum
IEYDWWSFGVLIYEMVF

SEQ ID NO: 2294456 - protein, 19 aa, Cryptosporidium parvum
IEYKKQRFAMDKLISNFKQ

SEQ ID NO: 2294457 - protein, 20 aa, Cryptosporidium parvum
IEYPLVISWGETYKIYLGNV

SEQ ID NO: 2294458 - protein, 22 aa, Cryptosporidium parvum
IEYRKKMEKEFYVVPNTKLSRS

SEQ ID NO: 2294459 - protein, 21 aa, Cryptosporidium parvum
IEYRLTQIINIIKGILDCANK

SEQ ID NO: 2294460 - protein, 18 aa, Cryptosporidium parvum
IFADGRAKLMVKKTNDNN

SEQ ID NO: 2294461 - protein, 17 aa, Cryptosporidium parvum
IFALEYLQNLGISNIPT

SEQ ID NO: 2294462 - protein, 20 aa, Cryptosporidium parvum
IFALKLSKLQWKYLDETISK

SEQ ID NO: 2294463 - protein, 26 aa, Cryptosporidium parvum
IFAPCKSCKLGMAYPISYNAVLCKKC

SEQ ID NO: 2294464 - protein, 21 aa, Cryptosporidium parvum
IFAQRFLKPSGIMIPQRYTSY

SEQ ID NO: 2294465 - protein, 19 aa, Cryptosporidium parvum
IFATSGFFVEVCFQAILKS

SEQ ID NO: 2294466 - protein, 22 aa, Cryptosporidium parvum
IFAWGSTEFGQFGIKPVEDKME

SEQ ID NO: 2294467 - protein, 20 aa, Cryptosporidium parvum
IFCENCLKINYPENSGFLSL

SEQ ID NO: 2294468 - protein, 18 aa, Cryptosporidium parvum
IFCMNRKNVFSFSDIAIK

SEQ ID NO: 2294469 - protein, 19 aa, Cryptosporidium parvum
IFCYQMINWIILGKLVDPF

SEQ ID NO: 2294470 - protein, 40 aa, Cryptosporidium parvum
IFDEVQFAPAPAFRRINGIVKAHCKLGLTATLVREDDLIQ

SEQ ID NO: 2294471 - protein, 26 aa, Cryptosporidium parvum
IFDIISSNLLDWVKFKSPAICCVFDH

SEQ ID NO: 2294472 - protein, 22 aa, Cryptosporidium parvum
IFDYSIECLNLIKINNQDYINE

SEQ ID NO: 2294473 - protein, 22 aa, Cryptosporidium parvum
IFEIIDLHWSVIHPIIIDVYTS

SEQ ID NO: 2294474 - protein, 20 aa, Cryptosporidium parvum
IFEKMKNYLVELSIDSHSSK

SEQ ID NO: 2294475 - protein, 24 aa, Cryptosporidium parvum
IFEMITNRCGVVFSECKSYPVEEA

SEQ ID NO: 2294476 - protein, 24 aa, Cryptosporidium parvum
IFENIPLFGCNIVQFHLISDSRIF

SEQ ID NO: 2294477 - protein, 21 aa, Cryptosporidium parvum
IFESLDLAWELLRTFPEDMLK

SEQ ID NO: 2294478 - protein, 18 aa, Cryptosporidium parvum
IFETSSFAKAYMHMRRMN

SEQ ID NO: 2294479 - protein, 18 aa, Cryptosporidium parvum
IFFGKPIRDFSSFSNVIR

SEQ ID NO: 2294480 - protein, 31 aa, Cryptosporidium parvum
IFGDLRPSWSLYYLLKKIICKEMSGYYAQEK

SEQ ID NO: 2294481 - protein, 18 aa, Cryptosporidium parvum
IFGGSGLTGATGLTGATG

SEQ ID NO: 2294482 - protein, 18 aa, Cryptosporidium parvum
IFGNFRWNNKRRRLGSYI

SEQ ID NO: 2294483 - protein, 20 aa, Cryptosporidium parvum
IFGSDIWISLLIDALTLKNF

SEQ ID NO: 2294484 - protein, 17 aa, Cryptosporidium parvum
IFGVTSINFENFTKLSF

SEQ ID NO: 2294485 - protein, 24 aa, Cryptosporidium parvum
IFIENCVGCIFLVNGVISSIEIVN

SEQ ID NO: 2294486 - protein, 23 aa, Cryptosporidium parvum
IFIKSHILSLYLYYNQEYDTQKS

SEQ ID NO: 2294487 - protein, 19 aa, Cryptosporidium parvum
IFIKVPIIISNYFLQESSQ

SEQ ID NO: 2294488 - protein, 25 aa, Cryptosporidium parvum
IFKENIINFSINFIIDSVRLIQLSY

SEQ ID NO: 2294489 - protein, 17 aa, Cryptosporidium parvum
IFKKREFSDSQLAIKES

SEQ ID NO: 2294490 - protein, 24 aa, Cryptosporidium parvum
IFKLLENIPMPWERVKYVDCLYHT

SEQ ID NO: 2294491 - protein, 18 aa, Cryptosporidium parvum
IFKRLDINYTNKQVNSCS

SEQ ID NO: 2294492 - protein, 20 aa, Cryptosporidium parvum
IFKTNWDLLKLINKEDKAFF

SEQ ID NO: 2294493 - protein, 19 aa, Cryptosporidium parvum
IFLEKSFEALKDVGYTIDT

SEQ ID NO: 2294494 - protein, 17 aa, Cryptosporidium parvum
IFLKYSKLMNNYYDEDI

SEQ ID NO: 2294495 - protein, 19 aa, Cryptosporidium parvum
IFLYILKLWLLCWPSPISL

SEQ ID NO: 2294496 - protein, 18 aa, Cryptosporidium parvum
IFMPFGCPMMDKKEVKDL

SEQ ID NO: 2294497 - protein, 19 aa, Cryptosporidium parvum
IFNCPICPYFGRNSISHSF

SEQ ID NO: 2294498 - protein, 17 aa, Cryptosporidium parvum
IFNECLYIHGGEYSTEN

SEQ ID NO: 2294499 - protein, 19 aa, Cryptosporidium parvum
IFNGIEWMNNLPKIKQTQI

SEQ ID NO: 2294500 - protein, 20 aa, Cryptosporidium parvum
IFNLKLDFLKKLFQEPGIFT

SEQ ID NO: 2294501 - protein, 18 aa, Cryptosporidium parvum
IFNWMINQSIDFIRKHCF

SEQ ID NO: 2294502 - protein, 23 aa, Cryptosporidium parvum
IFQDEFYFYPGYNQIEEFDKASK

SEQ ID NO: 2294503 - protein, 18 aa, Cryptosporidium parvum
IFQPPLFHPNIYPSGTVC

SEQ ID NO: 2294504 - protein, 24 aa, Cryptosporidium parvum
IFSKLELLRNYLLKVKKNESDFLE

SEQ ID NO: 2294505 - protein, 20 aa, Cryptosporidium parvum
IFSLARRALVSWAENHQDQT

SEQ ID NO: 2294506 - protein, 18 aa, Cryptosporidium parvum
IFSPVGGVHWMPRNEVNL

SEQ ID NO: 2294507 - protein, 19 aa, Cryptosporidium parvum
IFSSPAIIIGYYLQSSEYT

SEQ ID NO: 2294508 - protein, 22 aa, Cryptosporidium parvum
IFTAKLKFEGVKNVERSKDTII

SEQ ID NO: 2294509 - protein, 17 aa, Cryptosporidium parvum
IFTSNLINFDTWMIEVE

SEQ ID NO: 2294510 - protein, 32 aa, Cryptosporidium parvum
IFWERRPGLYCLPRSCIKGGGNLLGTGLDTIK

SEQ ID NO: 2294511 - protein, 34 aa, Cryptosporidium parvum
IFYFGMYYRHLFLDVSFMSCFVSFLLDTGKLQQA

SEQ ID NO: 2294512 - protein, 20 aa, Cryptosporidium parvum
IFYSCNKTVLNIEEQLTSNY

SEQ ID NO: 2294513 - protein, 18 aa, Cryptosporidium parvum
IGDEIEVRPGIYNKDADG

SEQ ID NO: 2294514 - protein, 27 aa, Cryptosporidium parvum
IGDSLLRKVCTDINLSLNYPIQSFEEK

SEQ ID NO: 2294515 - protein, 17 aa, Cryptosporidium parvum
IGDYLTLEGNIIPNSII

SEQ ID NO: 2294516 - protein, 27 aa, Cryptosporidium parvum
IGEGIPQVYILLRWDCLVFHINEKGMT

SEQ ID NO: 2294517 - protein, 26 aa, Cryptosporidium parvum
IGEMYECLGRLMGICVTTKSAMNINL

SEQ ID NO: 2294518 - protein, 25 aa, Cryptosporidium parvum
IGERKRLSLQNSFPYNYNYPGVYNS

SEQ ID NO: 2294519 - protein, 18 aa, Cryptosporidium parvum
IGESIKFRDGKIVTDLNN

SEQ ID NO: 2294520 - protein, 20 aa, Cryptosporidium parvum
IGESWPFDQYQATGLLPVDY

SEQ ID NO: 2294521 - protein, 18 aa, Cryptosporidium parvum
IGEVYEFVQVTKPSTKNE

SEQ ID NO: 2294522 - protein, 24 aa, Cryptosporidium parvum
IGFFPLKSSYIWVITTKKTVSERI

SEQ ID NO: 2294523 - protein, 30 aa, Cryptosporidium parvum; identical to SEQ ID NO: 2173112

SEQ ID NO: 2294524 - protein, 17 aa, Cryptosporidium parvum
IGFNILMSSEFNSAFDP

SEQ ID NO: 2294525 - protein, 17 aa, Cryptosporidium parvum
IGFTKCFYGRIQHNSDV

SEQ ID NO: 2294526 - protein, 30 aa, Cryptosporidium parvum
IGGGIDYKSHGIGVFLPEGRTIDPNANDGL

SEQ ID NO: 2294527 - protein, 26 aa, Cryptosporidium parvum
IGGHSFPIYCMELLGSKGSQSIITID

SEQ ID NO: 2294528 - protein, 19 aa, Cryptosporidium parvum
IGGIKGMRIAKYGTAEYER

SEQ ID NO: 2294529 - protein, 18 aa, Cryptosporidium parvum
IGGLPGLLLTLIGVGVQK

SEQ ID NO: 2294530 - protein, 18 aa, Cryptosporidium parvum
IGGLPPKPAETSLKELKN

SEQ ID NO: 2294531 - protein, 17 aa, Cryptosporidium parvum
IGHNSFHPYSCSQSSKS

SEQ ID NO: 2294532 - protein, 24 aa, Cryptosporidium parvum
IGHRVGQLGSRVWSMMCNPHLISR

SEQ ID NO: 2294533 - protein, 20 aa, Cryptosporidium parvum
IGICIPKFEVNICHLVSDSK

SEQ ID NO: 2294534 - protein, 18 aa, Cryptosporidium parvum
IGIHHAGLVRSDRKVVED

SEQ ID NO: 2294535 - protein, 18 aa, Cryptosporidium parvum
IGILKCFFNSRPVIIKNI

SEQ ID NO: 2294536 - protein, 18 aa, Cryptosporidium parvum
IGILLVLASICIELGFEC

SEQ ID NO: 2294537 - protein, 20 aa, Cryptosporidium parvum
IGIRVPECLLNPEMIINDSE

SEQ ID NO: 2294538 - protein, 27 aa, Cryptosporidium parvum
IGIWNIRTGKCLKRLSAHINAKSVSVI

SEQ ID NO: 2294539 - protein, 26 aa, Cryptosporidium parvum
IGKEFKELRRQLGWEKNTEKNFKNEE

SEQ ID NO: 2294540 - protein, 17 aa, Cryptosporidium parvum
IGKERRLDQEKINEYKN

SEQ ID NO: 2294541 - protein, 19 aa, Cryptosporidium parvum
IGKFHCLVTEFCKRQRVSK

SEQ ID NO: 2294542 - protein, 25 aa, Cryptosporidium parvum
IGKPIIKQRLNEMYTNRNLNTSTTN

SEQ ID NO: 2294543 - protein, 22 aa, Cryptosporidium parvum
IGKVLRCICILNSPINDTNDVS

SEQ ID NO: 2294544 - protein, 25 aa, Cryptosporidium parvum
IGKYYNWKDCEAVLSPSRSISSPIK

SEQ ID NO: 2294545 - protein, 25 aa, Cryptosporidium parvum
IGLKYVPEVIEWRISKNIGGNKAEY

SEQ ID NO: 2294546 - protein, 25 aa, Cryptosporidium parvum
IGLRECPQCRLHIASRRSLRNDSIM

SEQ ID NO: 2294547 - protein, 18 aa, Cryptosporidium parvum
IGLSKCLQKKLIKLNKEL

SEQ ID NO: 2294548 - protein, 19 aa, Cryptosporidium parvum
IGLYGSNPCSYRGNYENID

SEQ ID NO: 2294549 - protein, 19 aa, Cryptosporidium parvum
IGMEFWKQLCTEHGLDANG

SEQ ID NO: 2294550 - protein, 25 aa, Cryptosporidium parvum
IGMKNCAMTILPTMNGGVIGEIPNG

SEQ ID NO: 2294551 - protein, 17 aa, Cryptosporidium parvum
IGNACKLIVERSPVSRR

SEQ ID NO: 2294552 - protein, 25 aa, Cryptosporidium parvum
IGNALFPMFWSSFLASQQFNNTHSF

SEQ ID NO: 2294553 - protein, 25 aa, Cryptosporidium parvum
IGNGIGNNGYHGWSHNQYGQGQNAS

SEQ ID NO: 2294554 - protein, 17 aa, Cryptosporidium parvum
IGNGVANMFLVSSQKTT

SEQ ID NO: 2294555 - protein, 24 aa, Cryptosporidium parvum
IGNHARFMNHCCDPNSICKVISID

SEQ ID NO: 2294556 - protein, 19 aa, Cryptosporidium parvum
IGNLNYMICEHFLEWKDED

SEQ ID NO: 2294557 - protein, 19 aa, Cryptosporidium parvum
IGNVFLWCLENERRQLPSK

SEQ ID NO: 2294558 - protein, 17 aa, Cryptosporidium parvum
IGPCYSCSEQTLNTLRY

SEQ ID NO: 2294559 - protein, 19 aa, Cryptosporidium parvum
IGPEGGWTKEELTDLITMG

SEQ ID NO: 2294560 - protein, 17 aa, Cryptosporidium parvum
IGPFGLRVTGEDLETIK

SEQ ID NO: 2294561 - protein, 25 aa, Cryptosporidium parvum
IGPPGCGKTLLADMVSWLNGLNVFT

SEQ ID NO: 2294562 - protein, 33 aa, Cryptosporidium parvum; identical to SEQ ID NO: 2173144

SEQ ID NO: 2294563 - protein, 24 aa, Cryptosporidium parvum
IGQDIKLVPVFKIFEKIENSIDLN

SEQ ID NO: 2294564 - protein, 17 aa, Cryptosporidium parvum
IGQIISRVLGFLQDQFP

SEQ ID NO: 2294565 - protein, 18 aa, Cryptosporidium parvum
IGQKVTGYISRICIQSTQ

SEQ ID NO: 2294566 - protein, 31 aa, Cryptosporidium parvum
IGQLFCGFFLSRIVCHNCQYTSNTYDPFMDV

SEQ ID NO: 2294567 - protein, 22 aa, Cryptosporidium parvum
IGQRFQRGSSLVILEISAPLTP

SEQ ID NO: 2294568 - protein, 17 aa, Cryptosporidium parvum
IGRELYLLYSSLFNIVV

SEQ ID NO: 2294569 - protein, 17 aa, Cryptosporidium parvum
IGRHQVKINIYNSLSTR

SEQ ID NO: 2294570 - protein, 23 aa, Cryptosporidium parvum
IGRLVWEGVAFHLPPGSLLQEAG

SEQ ID NO: 2294571 - protein, 23 aa, Cryptosporidium parvum
IGSCGYNIYHFLKSGSIKVFVNI

SEQ ID NO: 2294572 - protein, 21 aa, Cryptosporidium parvum
IGSMLPWFVNLSLKLNAHVLA

SEQ ID NO: 2294573 - protein, 17 aa, Cryptosporidium parvum
IGSNCSFISSSIDVQKM

SEQ ID NO: 2294574 - protein, 27 aa, Cryptosporidium parvum
IGSSRWKYPIVDMSELLVIGWEALKKG

SEQ ID NO: 2294575 - protein, 25 aa, Cryptosporidium parvum
IGTPGRLSSIISYPGSNISDLLRNL

SEQ ID NO: 2294576 - protein, 19 aa, Cryptosporidium parvum
IGTQYSCINIHYLIAEETL

SEQ ID NO: 2294577 - protein, 23 aa, Cryptosporidium parvum
IGVPNIWKLGKICISVQNQKQSI

SEQ ID NO: 2294578 - protein, 18 aa, Cryptosporidium parvum
IGVTSAKIGKPIFGNSES

SEQ ID NO: 2294579 - protein, 18 aa, Cryptosporidium parvum
IHCFFPYLYCEVPKSTPP

SEQ ID NO: 2294580 - protein, 22 aa, Cryptosporidium parvum
IHDRLGMILTQFPRLDEIHPFY

SEQ ID NO: 2294581 - protein, 19 aa, Cryptosporidium parvum
IHEAIEFSEFLIPATNKKR

SEQ ID NO: 2294582 - protein, 18 aa, Cryptosporidium parvum
IHEIKRGLLKGVLSGIAN

SEQ ID NO: 2294583 - protein, 24 aa, Cryptosporidium parvum
IHEITAILSCFVFPEKMESLSNSN

SEQ ID NO: 2294584 - protein, 24 aa, Cryptosporidium parvum
IHFCKELVKNILLLSEKFAPSYNW

SEQ ID NO: 2294585 - protein, 18 aa, Cryptosporidium parvum
IHFFKFIVDGEWRYSPEY

SEQ ID NO: 2294586 - protein, 20 aa, Cryptosporidium parvum
IHGITPFYYGISGLSEVQPV

SEQ ID NO: 2294587 - protein, 25 aa, Cryptosporidium parvum
IHHHYAYLWLRECPNLLKDESKEGK

SEQ ID NO: 2294588 - protein, 18 aa, Cryptosporidium parvum
IHHLGRILPIRTSRGEKE

SEQ ID NO: 2294589 - protein, 17 aa, Cryptosporidium parvum
IHHPNFRSWTHEQIIEH

SEQ ID NO: 2294590 - protein, 18 aa, Cryptosporidium parvum
IHIFPICYKEMIETLQDD

SEQ ID NO: 2294591 - protein, 19 aa, Cryptosporidium parvum
IHINKNCLYNLYKTVTYLP

SEQ ID NO: 2294592 - protein, 25 aa, Cryptosporidium parvum
IHIPEKKMFLGLILRNIEILNQFLI

SEQ ID NO: 2294593 - protein, 21 aa, Cryptosporidium parvum
IHIRLRSVGYIKYTFTAEPYG

SEQ ID NO: 2294594 - protein, 18 aa, Cryptosporidium parvum
IHISLPILSTNSHESNQI

SEQ ID NO: 2294595 - protein, 24 aa, Cryptosporidium parvum
IHKWRILQQRSYIAIGKFKQTCES

SEQ ID NO: 2294596 - protein, 18 aa, Cryptosporidium parvum
IHLADRVEIIVKIRKIEE

SEQ ID NO: 2294597 - protein, 22 aa, Cryptosporidium parvum
IHLFCMKGSSLFYSRDETKPLD

SEQ ID NO: 2294598 - protein, 24 aa, Cryptosporidium parvum
IHLHWLAVEGKFVFNSENDTTYIK

SEQ ID NO: 2294599 - protein, 24 aa, Cryptosporidium parvum
IHLIAHYDGVFGFNAFYNSVKNNI

SEQ ID NO: 2294600 - protein, 25 aa, Cryptosporidium parvum
IHLKESGNCIPLFFNNSQDKERFVA

SEQ ID NO: 2294601 - protein, 21 aa, Cryptosporidium parvum
IHLLFQFSEIIILDNSSSKLV

SEQ ID NO: 2294602 - protein, 25 aa, Cryptosporidium parvum
IHNWLCFSTALWYRCYAEHHRGRTA

SEQ ID NO: 2294603 - protein, 23 aa, Cryptosporidium parvum
IHPNGWHPIYYVGYVTKHKTGSK

SEQ ID NO: 2294604 - protein, 26 aa, Cryptosporidium parvum
IHPNIMPRISPIIGPCLGSIYQNNLV

SEQ ID NO: 2294605 - protein, 53 aa, Cryptosporidium parvum
IHPSEACKSWPLCPYGPGCFFIHPTVPCRYGLACYNSLCNYSHPNGWDPNHVE

SEQ ID NO: 2294606 - protein, 17 aa, Cryptosporidium parvum
IHPSLILGVCASIIPFP

SEQ ID NO: 2294607 - protein, 23 aa, Cryptosporidium parvum
IHRDIKCANLLISGDGVVKLADF

SEQ ID NO: 2294608 - protein, 23 aa, Cryptosporidium parvum
IHRVIKDFVIQGGDFVNGDGTGS

SEQ ID NO: 2294609 - protein, 25 aa, Cryptosporidium parvum
IHSEMKYVHYICCDDQIVASFSRVM

SEQ ID NO: 2294610 - protein, 24 aa, Cryptosporidium parvum
IHSGLSCISHFNKGYIKYIKNENC

SEQ ID NO: 2294611 - protein, 17 aa, Cryptosporidium parvum
IHSKCFYLGQGNVGRSR

SEQ ID NO: 2294612 - protein, 28 aa, Cryptosporidium parvum
IHSKKPSVLWCYKKELGFSSHKKVRQKQ

SEQ ID NO: 2294613 - protein, 22 aa, Cryptosporidium parvum
IHSSLFSIPSIIILRNAKQFIF

SEQ ID NO: 2294614 - protein, 22 aa, Cryptosporidium parvum
IHSYELPEIIATKVVYGNENYI

SEQ ID NO: 2294615 - protein, 25 aa, Cryptosporidium parvum
IHTDPLWKHLEVVLSGADVPGEGEH

SEQ ID NO: 2294616 - protein, 18 aa, Cryptosporidium parvum
IHTKYIWRLAYTTLNPSS

SEQ ID NO: 2294617 - protein, 31 aa, Cryptosporidium parvum; identical to SEQ ID NO: 2173192

SEQ ID NO: 2294618 - protein, 33 aa, Cryptosporidium parvum
IHYDLKPGNIILHRGCCKIADFGLSKQSDQESG

SEQ ID NO: 2294619 - protein, 18 aa, Cryptosporidium parvum
IIAKCCGLTGELRKGEQY

SEQ ID NO: 2294620 - protein, 24 aa, Cryptosporidium parvum
IIAKLSHVFTLFSTAMRCIDDVIL

SEQ ID NO: 2294621 - protein, 18 aa, Cryptosporidium parvum
IIANRVSYTLGLTGSSVT

SEQ ID NO: 2294622 - protein, 18 aa, Cryptosporidium parvum
IICLHVKSGTCFYAGMEQ

SEQ ID NO: 2294623 - protein, 21 aa, Cryptosporidium parvum
IICSLLSKFDSGGMGFFTSQD

SEQ ID NO: 2294624 - protein, 20 aa, Cryptosporidium parvum
IIDCHGKLIFGNQGTLPEYI

SEQ ID NO: 2294625 - protein, 28 aa, Cryptosporidium parvum
IIDENKLILNIPILVGINGKNDIEINNN

SEQ ID NO: 2294626 - protein, 17 aa, Cryptosporidium parvum
IIDGEPYNGIAELLEIF

SEQ ID NO: 2294627 - protein, 25 aa, Cryptosporidium parvum
IIDGFSSSLIKHAPIKENGHLNNQE

SEQ ID NO: 2294628 - protein, 17 aa, Cryptosporidium parvum
IIDNFSLCFSISNHIIQ

SEQ ID NO: 2294629 - protein, 18 aa, Cryptosporidium parvum
IIEDEIRELFSPYGQINE

SEQ ID NO: 2294630 - protein, 25 aa, Cryptosporidium parvum
IIEEFKRISRNEGFQECIMYFMKQI

SEQ ID NO: 2294631 - protein, 17 aa, Cryptosporidium parvum
IIEESILGFNMKNRSSV

SEQ ID NO: 2294632 - protein, 18 aa, Cryptosporidium parvum
IIEFKGIKIQRAINSANR

SEQ ID NO: 2294633 - protein, 24 aa, Cryptosporidium parvum
IIEIPSGKMGLIIGTKGSVLNEIR

SEQ ID NO: 2294634 - protein, 26 aa, Cryptosporidium parvum
IIEKMPKLLGSYFIKANKMPIAIKIR

SEQ ID NO: 2294635 - protein, 22 aa, Cryptosporidium parvum
IIELCRPFINFSFFKKTPVPLS

SEQ ID NO: 2294636 - protein, 19 aa, Cryptosporidium parvum
IIESCKRPTVTMEVGTENI

SEQ ID NO: 2294637 - protein, 18 aa, Cryptosporidium parvum
IIETFKVGDIIGIGMFKS

SEQ ID NO: 2294638 - protein, 18 aa, Cryptosporidium parvum
IIFGKLWIEIVGISTIIN

SEQ ID NO: 2294639 - protein, 18 aa, Cryptosporidium parvum
IIFSDFQPVIDILSSAMH

SEQ ID NO: 2294640 - protein, 19 aa, Cryptosporidium parvum
IIGCLAFLKKNPIPINYHI

SEQ ID NO: 2294641 - protein, 31 aa, Cryptosporidium parvum
IIGEMSEIIWKYHLNEEILFLTVHFMDNVII

SEQ ID NO: 2294642 - protein, 18 aa, Cryptosporidium parvum
IIGGKARLGKLIGKKTAA

SEQ ID NO: 2294643 - protein, 18 aa, Cryptosporidium parvum
IIGLKSFLDDFVSHISGS

SEQ ID NO: 2294644 - protein, 25 aa, Cryptosporidium parvum
IIGPKDIKSILPFWGNNKKDTSSTI

SEQ ID NO: 2294645 - protein, 25 aa, Cryptosporidium parvum
IIGTGRLRYYVFNWKIPQISPSNVG

SEQ ID NO: 2294646 - protein, 27 aa, Cryptosporidium parvum
IIGTRGINMKRIFKLTQSKLRLRGKGS

SEQ ID NO: 2294647 - protein, 24 aa, Cryptosporidium parvum
IIHGPGFIKEGFSFSNAMQNYCEE

SEQ ID NO: 2294648 - protein, 20 aa, Cryptosporidium parvum
IIHMQRFYLSEDWRPKKINL

SEQ ID NO: 2294649 - protein, 26 aa, Cryptosporidium parvum
IIHVVYYWFEFVITNMLAWNRVEQWR

SEQ ID NO: 2294650 - protein, 26 aa, Cryptosporidium parvum
IIICHSMGGILLKLIISNHPEITKSI

SEQ ID NO: 2294651 - protein, 19 aa, Cryptosporidium parvum
IIIKRHIRYPFIIDPSGYA

SEQ ID NO: 2294652 - protein, 32 aa, Cryptosporidium parvum
IIINSLGMLSHWCVCEPEYLDPKCTKNWEKTS

SEQ ID NO: 2294653 - protein, 33 aa, Cryptosporidium parvum
IIIRNLRKYLPKLNCLFNFALNLGRKPDLIYSH

SEQ ID NO: 2294654 - protein, 17 aa, Cryptosporidium parvum
IIISILKIFEGIQGYLE

SEQ ID NO: 2294655 - protein, 29 aa, Cryptosporidium parvum
IIKAKICNFKLRSLLLCDNWITRSKSRRN

SEQ ID NO: 2294656 - protein, 18 aa, Cryptosporidium parvum
IIKEKNEEIEIISKEIDA

SEQ ID NO: 2294657 - protein, 18 aa, Cryptosporidium parvum
IIKEKNKEIEIISKEKEE

SEQ ID NO: 2294658 - protein, 17 aa, Cryptosporidium parvum
IIKGFSKNGIKRYLELY

SEQ ID NO: 2294659 - protein, 22 aa, Cryptosporidium parvum
IIKGKLYRNLPFLSSRSNSATM

SEQ ID NO: 2294660 - protein, 17 aa, Cryptosporidium parvum
IIKHIKWILNNNNDKII

SEQ ID NO: 2294661 - protein, 17 aa, Cryptosporidium parvum
IIKRSNIDYARAFIGHD

SEQ ID NO: 2294662 - protein, 17 aa, Cryptosporidium parvum
IIKSCLDNGANVLHTDK

SEQ ID NO: 2294663 - protein, 18 aa, Cryptosporidium parvum
IILDLILFFNHEDSSSNL

SEQ ID NO: 2294664 - protein, 26 aa, Cryptosporidium parvum
IILDVHFPLAVYKKLLGYKVDIGDLY

SEQ ID NO: 2294665 - protein, 24 aa, Cryptosporidium parvum
IILELYKFSILYYNRFRQNDLVDI

SEQ ID NO: 2294666 - protein, 24 aa, Cryptosporidium parvum
IILNPAYYLNNWRTHMNGKLHKAL

SEQ ID NO: 2294667 - protein, 25 aa, Cryptosporidium parvum
IILNTFRYIPVAGVLLESQKRPMLI

SEQ ID NO: 2294668 - protein, 23 aa, Cryptosporidium parvum
IILPTRESIIFPRENDLLLKNIN

SEQ ID NO: 2294669 - protein, 18 aa, Cryptosporidium parvum
IILSELILTPSILFANAF

SEQ ID NO: 2294670 - protein, 22 aa, Cryptosporidium parvum
IIMECPSIRYFEKILFNNIKSP

SEQ ID NO: 2294671 - protein, 18 aa, Cryptosporidium parvum
IIMGEIDIFLALKLYLVQ

SEQ ID NO: 2294672 - protein, 17 aa, Cryptosporidium parvum
IINEMKPLWLGSDYNIF

SEQ ID NO: 2294673 - protein, 24 aa, Cryptosporidium parvum
IINLSLRLIIKLGNMSFLLEILQE

SEQ ID NO: 2294674 - protein, 17 aa, Cryptosporidium parvum
IINSYCLSKIIQNILKE

SEQ ID NO: 2294675 - protein, 20 aa, Cryptosporidium parvum
IIPKAVKFLGSPSFEALGEE

SEQ ID NO: 2294676 - protein, 23 aa, Cryptosporidium parvum
IIPKCFILDIIYGIFTANSQKNI

SEQ ID NO: 2294677 - protein, 26 aa, Cryptosporidium parvum
IIPKPFPGLISKVSVPWKRVKTSSPC

SEQ ID NO: 2294678 - protein, 18 aa, Cryptosporidium parvum
IIPLLKPLLTGYMDDQIP

SEQ ID NO: 2294679 - protein, 18 aa, Cryptosporidium parvum
IIPLPMSSYGQFRKSRRD

SEQ ID NO: 2294680 - protein, 24 aa, Cryptosporidium parvum
IIPNIPFSLCISYLRQERSQICNK

SEQ ID NO: 2294681 - protein, 17 aa, Cryptosporidium parvum
IIPNKECIDKWCRLRQK

SEQ ID NO: 2294682 - protein, 26 aa, Cryptosporidium parvum
IIPPQGPWPLWGWNVYIIDSIKQRLS

SEQ ID NO: 2294683 - protein, 18 aa, Cryptosporidium parvum
IIPSEPRTSSIITKSNMN

SEQ ID NO: 2294684 - protein, 18 aa, Cryptosporidium parvum
IIQEFSLEELAYFQEWDV

SEQ ID NO: 2294685 - protein, 28 aa, Cryptosporidium parvum
IIQLLTRFESFRTKWARLILNHNQEALY

SEQ ID NO: 2294686 - protein, 29 aa, Cryptosporidium parvum
IIQRFRTGKIWILICTDLMARGVDFKNVS

SEQ ID NO: 2294687 - protein, 25 aa, Cryptosporidium parvum
IIREDWKPTLTISIVICGLLNLLIE

SEQ ID NO: 2294688 - protein, 20 aa, Cryptosporidium parvum
IIRKRLKKKLLKLSKISGQN

SEQ ID NO: 2294689 - protein, 20 aa, Cryptosporidium parvum
IIRNPHCSKTTYYIHKIIES

SEQ ID NO: 2294690 - protein, 19 aa, Cryptosporidium parvum
IIRSNTVICFAKLMNVLPE

SEQ ID NO: 2294691 - protein, 22 aa, Cryptosporidium parvum
IIRTLIQRWVRLISKDRPSSLE

SEQ ID NO: 2294692 - protein, 22 aa, Cryptosporidium parvum
IISDMNGSFIIGNKSNESENNQ

SEQ ID NO: 2294693 - protein, 17 aa, Cryptosporidium parvum
IISGFRKASQIAIDKVN

SEQ ID NO: 2294694 - protein, 18 aa, Cryptosporidium parvum
IISGSSFAYPNSSNESFI

SEQ ID NO: 2294695 - protein, 17 aa, Cryptosporidium parvum
IISKCIEVYRPGAIVLQ

SEQ ID NO: 2294696 - protein, 23 aa, Cryptosporidium parvum
IISKFPNCCLLRRHPEPKYDQLE

SEQ ID NO: 2294697 - protein, 30 aa, Cryptosporidium parvum; identical to SEQ ID NO: 2173260

SEQ ID NO: 2294698 - protein, 18 aa, Cryptosporidium parvum
IISKSIQSNIRFQYMESK

SEQ ID NO: 2294699 - protein, 30 aa, Cryptosporidium parvum
IISLKARSKLWWFCRMAEHCGLVGREGNSM

SEQ ID NO: 2294700 - protein, 20 aa, Cryptosporidium parvum
IISQIFKFPTVFRTNIKDDI

SEQ ID NO: 2294701 - protein, 17 aa, Cryptosporidium parvum
IISQIFLLDGIFDTILS

SEQ ID NO: 2294702 - protein, 18 aa, Cryptosporidium parvum
IISSFKSWTHSLIAHSSR

SEQ ID NO: 2294703 - protein, 17 aa, Cryptosporidium parvum
IISVFGVDEIIIYEDKC

SEQ ID NO: 2294704 - protein, 21 aa, Cryptosporidium parvum
IITDCIYKEIEMLNNLESKKA

SEQ ID NO: 2294705 - protein, 24 aa, Cryptosporidium parvum
IITDRVMVSLGFVDNLIEGLKSVG

SEQ ID NO: 2294706 - protein, 17 aa, Cryptosporidium parvum
IITLIASETKYCGNGVE

SEQ ID NO: 2294707 - protein, 28 aa, Cryptosporidium parvum
IITPRAIFHFVRCIPFINTSFREPPKRT

SEQ ID NO: 2294708 - protein, 25 aa, Cryptosporidium parvum
IITRKGKCLLPVFAIGRAQELLLIL

SEQ ID NO: 2294709 - protein, 20 aa, Cryptosporidium parvum
IITYTTKLYSIRADQQEIRM

SEQ ID NO: 2294710 - protein, 18 aa, Cryptosporidium parvum
IIVCSALSIDGDYIVSSF

SEQ ID NO: 2294711 - protein, 23 aa, Cryptosporidium parvum
IIVLRPSNDYIYSLRNVRQNTSA

SEQ ID NO: 2294712 - protein, 18 aa, Cryptosporidium parvum
IIVPCNLLPYKSSLNNAY

SEQ ID NO: 2294713 - protein, 23 aa, Cryptosporidium parvum
IIVSLELPVKVVRLEKMEFNNEI

SEQ ID NO: 2294714 - protein, 18 aa, Cryptosporidium parvum
IIYFSIGDFSSFESKMKQ

SEQ ID NO: 2294715 - protein, 24 aa, Cryptosporidium parvum
IIYLDGAWRPPFITSGSVRRLSIQ

SEQ ID NO: 2294716 - protein, 22 aa, Cryptosporidium parvum
IIYLLEILRICIRIPTEGNWLF

SEQ ID NO: 2294717 - protein, 22 aa, Cryptosporidium parvum
IIYNPGPCVVMAAPGMLQNGTS

SEQ ID NO: 2294718 - protein, 19 aa, Cryptosporidium parvum
IIYRDTYRAWNMGADDSGD

SEQ ID NO: 2294719 - protein, 17 aa, Cryptosporidium parvum
IIYYSCSISSKWQINEP

SEQ ID NO: 2294720 - protein, 18 aa, Cryptosporidium parvum
IKADPKYDTGIIQPSESV

SEQ ID NO: 2294721 - protein, 20 aa, Cryptosporidium parvum
IKAEQWLLEIRRKYDDKFID

SEQ ID NO: 2294722 - protein, 29 aa, Cryptosporidium parvum
IKAKAPLGVINFKIAEWSLQISDSDEKTF

SEQ ID NO: 2294723 - protein, 26 aa, Cryptosporidium parvum
IKAKKGFKKLQLMNSLVYDTVIKDIT

SEQ ID NO: 2294724 - protein, 18 aa, Cryptosporidium parvum
IKATWKLVSEEISMASII

SEQ ID NO: 2294725 - protein, 18 aa, Cryptosporidium parvum
IKAWKWSNQNNNISLINS

SEQ ID NO: 2294726 - protein, 19 aa, Cryptosporidium parvum
IKAYLPVADSFKFTTVLRA

SEQ ID NO: 2294727 - protein, 19 aa, Cryptosporidium parvum
IKCILDTLMKMMVYEMSYV

SEQ ID NO: 2294728 - protein, 18 aa, Cryptosporidium parvum
IKCKIIKDQINEIIFNVL

SEQ ID NO: 2294729 - protein, 18 aa, Cryptosporidium parvum
IKCMRVFETYINQCGDSV

SEQ ID NO: 2294730 - protein, 29 aa, Cryptosporidium parvum
IKCQIWKTQYIEYCFKSSVVPAKKVITFI

SEQ ID NO: 2294731 - protein, 18 aa, Cryptosporidium parvum
IKDALDWLEHNQTAEKDE

SEQ ID NO: 2294732 - protein, 20 aa, Cryptosporidium parvum
IKDAVNLDELMCNRCNAKYS

SEQ ID NO: 2294733 - protein, 28 aa, Cryptosporidium parvum
IKDGCKREVLELMKLLLKASEADLTNLK

SEQ ID NO: 2294734 - protein, 19 aa, Cryptosporidium parvum
IKDIREILSREIGDDIPTN

SEQ ID NO: 2294735 - protein, 21 aa, Cryptosporidium parvum
IKDKELCDIFDFYSELENSCD

SEQ ID NO: 2294736 - protein, 22 aa, Cryptosporidium parvum
IKDKKISSVIIFDSSVKSEYYD

SEQ ID NO: 2294737 - protein, 20 aa, Cryptosporidium parvum
IKDKPSCMDWCNNAKSICIG

SEQ ID NO: 2294738 - protein, 19 aa, Cryptosporidium parvum
IKDLIKWSNPKYEELMEWL

SEQ ID NO: 2294739 - protein, 21 aa, Cryptosporidium parvum
IKDPFPICRKAAIQALLSTIH

SEQ ID NO: 2294740 - protein, 19 aa, Cryptosporidium parvum
IKDRFPITLAPSISSISCR

SEQ ID NO: 2294741 - protein, 17 aa, Cryptosporidium parvum
IKDSIGGLMDSYVASYD

SEQ ID NO: 2294742 - protein, 22 aa, Cryptosporidium parvum
IKDYHQGLGFVVAFFLLQLTPE

SEQ ID NO: 2294743 - protein, 18 aa, Cryptosporidium parvum
IKDYKYDYYRGIVDVTLT

SEQ ID NO: 2294744 - protein, 20 aa, Cryptosporidium parvum
IKEAIIIGSVLSKVSIPVLH

SEQ ID NO: 2294745 - protein, 18 aa, Cryptosporidium parvum
IKEFPRTPIHCIAYANFI

SEQ ID NO: 2294746 - protein, 19 aa, Cryptosporidium parvum
IKEGERLVVLLSKGASQKA

SEQ ID NO: 2294747 - protein, 22 aa, Cryptosporidium parvum
IKEIPHLLVTEAIHHPSNFITI

SEQ ID NO: 2294748 - protein, 21 aa, Cryptosporidium parvum
IKEKLLSFNLVNIVIDQIELR

SEQ ID NO: 2294749 - protein, 35 aa, Cryptosporidium parvum
IKELFRRNIDICLPKDSKFSSIIDFADPSWEGYSE

SEQ ID NO: 2294750 - protein, 22 aa, Cryptosporidium parvum
IKELHAIWIISILRQLRSEVDT

SEQ ID NO: 2294751 - protein, 21 aa, Cryptosporidium parvum
IKEMWKSLISKKGMNLEDIIR

SEQ ID NO: 2294752 - protein, 23 aa, Cryptosporidium parvum
IKENICAVLAQLLTNTDHSKNGG

SEQ ID NO: 2294753 - protein, 22 aa, Cryptosporidium parvum
IKEPRKGKIRRIKMKNPKFAST

SEQ ID NO: 2294754 - protein, 25 aa, Cryptosporidium parvum
IKFFMKRYWLDIKLFGKMLYENKRE

SEQ ID NO: 2294755 - protein, 20 aa, Cryptosporidium parvum
IKFKTCLFELLKAMDHTEDF

SEQ ID NO: 2294756 - protein, 20 aa, Cryptosporidium parvum
IKFLNNYLLLAFNFNLLENI

SEQ ID NO: 2294757 - protein, 27 aa, Cryptosporidium parvum
IKFSSFNWLIARALTFYHNSICNSNEI

SEQ ID NO: 2294758 - protein, 17 aa, Cryptosporidium parvum
IKFSSSRNYESRTVCTK

SEQ ID NO: 2294759 - protein, 21 aa, Cryptosporidium parvum
IKGEKYWAFVQLKSSDKDSAI

SEQ ID NO: 2294760 - protein, 20 aa, Cryptosporidium parvum
IKGEVPFSKLTVLRSNTNSK

SEQ ID NO: 2294761 - protein, 17 aa, Cryptosporidium parvum
IKGGNLLINNEKDPDNE

SEQ ID NO: 2294762 - protein, 30 aa, Cryptosporidium parvum
IKGHAECVEFCKKFNIPLLILGGGGYTIRN

SEQ ID NO: 2294763 - protein, 18 aa, Cryptosporidium parvum
IKGIGYWYEQGMNNTMDD

SEQ ID NO: 2294764 - protein, 19 aa, Cryptosporidium parvum
IKGIYKFLKREQCCVEDFP

SEQ ID NO: 2294765 - protein, 20 aa, Cryptosporidium parvum
IKGKCSRAARRQQKLNALDD

SEQ ID NO: 2294766 - protein, 22 aa, Cryptosporidium parvum
IKGKGRTSGSIYRLDKTENEKD

SEQ ID NO: 2294767 - protein, 21 aa, Cryptosporidium parvum
IKGKYVINPIISTEKETTLVD

SEQ ID NO: 2294768 - protein, 31 aa, Cryptosporidium parvum
IKGNALRINNCLIWFDFGIENESKFDRSALL

SEQ ID NO: 2294769 - protein, 43 aa, Cryptosporidium parvum
IKGNFTFPPVCLARRYFPRSISCPGILLRNGLIVTDRYIVDNE

SEQ ID NO: 2294770 - protein, 18 aa, Cryptosporidium parvum
IKGNNSVRIFGGIHGQLI

SEQ ID NO: 2294771 - protein, 21 aa, Cryptosporidium parvum
IKGQQIVEVFSPVIDDLKIKY

SEQ ID NO: 2294772 - protein, 26 aa, Cryptosporidium parvum
IKGSAFLWHQVRLMMGILFEIGQQKF

SEQ ID NO: 2294773 - protein, 21 aa, Cryptosporidium parvum
IKGSHALVFCTDWNTFKDINF

SEQ ID NO: 2294774 - protein, 26 aa, Cryptosporidium parvum
IKHIVLKRIKYGFSQLSKNAISKKDE

SEQ ID NO: 2294775 - protein, 17 aa, Cryptosporidium parvum
IKHKLVINSCFDPEILT

SEQ ID NO: 2294776 - protein, 21 aa, Cryptosporidium parvum
IKHSRPQSEHLIKYPVPEINR

SEQ ID NO: 2294777 - protein, 22 aa, Cryptosporidium parvum
IKHWTEYLFEWQVLSRRSSIIY

SEQ ID NO: 2294778 - protein, 17 aa, Cryptosporidium parvum
IKIAMDMHGHVLGEQDP

SEQ ID NO: 2294779 - protein, 20 aa, Cryptosporidium parvum
IKIFRAKYKIPFDEDTIIEA

SEQ ID NO: 2294780 - protein, 20 aa, Cryptosporidium parvum
IKIIEGLLSICFNDLQREFF

SEQ ID NO: 2294781 - protein, 19 aa, Cryptosporidium parvum
IKIIKAVMFLGNITFIENE

SEQ ID NO: 2294782 - protein, 23 aa, Cryptosporidium parvum
IKIIKKWKWIEFMITGQKPILNS

SEQ ID NO: 2294783 - protein, 17 aa, Cryptosporidium parvum
IKIKEEAIRLKEEQVQQ

SEQ ID NO: 2294784 - protein, 18 aa, Cryptosporidium parvum
IKILKGSGFVKLDDNEEI

SEQ ID NO: 2294785 - protein, 20 aa, Cryptosporidium parvum
IKILKKKVSSYIIELSSHYN

SEQ ID NO: 2294786 - protein, 21 aa, Cryptosporidium parvum
IKISEKWCMIFIYSKGVEITL

SEQ ID NO: 2294787 - protein, 21 aa, Cryptosporidium parvum
IKISETKPIFEISEKEGNQYS

SEQ ID NO: 2294788 - protein, 17 aa, Cryptosporidium parvum
IKISGFVNDISVSDKLI

SEQ ID NO: 2294789 - protein, 20 aa, Cryptosporidium parvum
IKISKKCKMNKNNIRNRTKQ

SEQ ID NO: 2294790 - protein, 19 aa, Cryptosporidium parvum
IKIVPKIIPKPAITKEQPT

SEQ ID NO: 2294791 - protein, 19 aa, Cryptosporidium parvum
IKIVSLIMKPTLYIFSPNF

SEQ ID NO: 2294792 - protein, 24 aa, Cryptosporidium parvum
IKKFKHWFTYLGITNYILKVIKRL

SEQ ID NO: 2294793 - protein, 23 aa, Cryptosporidium parvum
IKKFKRFLRLQGFQSQDQYKRKI

SEQ ID NO: 2294794 - protein, 19 aa, Cryptosporidium parvum
IKKIFPYEKLKEFRERALN

SEQ ID NO: 2294795 - protein, 17 aa, Cryptosporidium parvum
IKKKIYRSFSYKIEEYR

SEQ ID NO: 2294796 - protein, 18 aa, Cryptosporidium parvum
IKKNGYCMLKGKPCKVVD

SEQ ID NO: 2294797 - protein, 25 aa, Cryptosporidium parvum
IKKNLRKETNFELANDEEKNSSSSV

SEQ ID NO: 2294798 - protein, 29 aa, Cryptosporidium parvum
IKKNNRYLLKIARFEEAFITIIPTLKGYY

SEQ ID NO: 2294799 - protein, 18 aa, Cryptosporidium parvum
IKKPIKLLKYKNSNSKLG

SEQ ID NO: 2294800 - protein, 24 aa, Cryptosporidium parvum
IKKRCKLKYFNKDGADASMSKRPL

SEQ ID NO: 2294801 - protein, 28 aa, Cryptosporidium parvum
IKKSENVVCHFFRPSTLRCEIFDRHLEI

SEQ ID NO: 2294802 - protein, 22 aa, Cryptosporidium parvum
IKKSNTRPNLSLQNYKTTEKKV

SEQ ID NO: 2294803 - protein, 28 aa, Cryptosporidium parvum
IKKVLKNRWSIYFCTILGQAPSDSEREK

SEQ ID NO: 2294804 - protein, 18 aa, Cryptosporidium parvum
IKLAFHRGSCSSGDLREN

SEQ ID NO: 2294805 - protein, 24 aa, Cryptosporidium parvum
IKLEEKKREFMLASEKFEEYEREN

SEQ ID NO: 2294806 - protein, 17 aa, Cryptosporidium parvum
IKLFKDLIEGCIPAVLR

SEQ ID NO: 2294807 - protein, 17 aa, Cryptosporidium parvum
IKLFVGRVPRNIEEDDL

SEQ ID NO: 2294808 - protein, 17 aa, Cryptosporidium parvum
IKLGQCLNSTRNIEKIQ

SEQ ID NO: 2294809 - protein, 19 aa, Cryptosporidium parvum
IKLIEWCERKSGSIARVEL

SEQ ID NO: 2294810 - protein, 25 aa, Cryptosporidium parvum
IKLIITNCYTYNKIGTMVYRMGLIL

SEQ ID NO: 2294811 - protein, 31 aa, Cryptosporidium parvum
IKLKLLLENDLRLSLLKSIKSIEHIYLQTLK

SEQ ID NO: 2294812 - protein, 24 aa, Cryptosporidium parvum
IKLLKDKFHFIFSIETTGCIPPVE

SEQ ID NO: 2294813 - protein, 21 aa, Cryptosporidium parvum
IKLLMMATRCKIILGCRDLMF

SEQ ID NO: 2294814 - protein, 19 aa, Cryptosporidium parvum
IKLLQRHPSHYGGYHALVN

SEQ ID NO: 2294815 - protein, 17 aa, Cryptosporidium parvum
IKLLSREDLEDAIRRLN

SEQ ID NO: 2294816 - protein, 24 aa, Cryptosporidium parvum
IKLLSSFIELCKFNKNNIVGTENL

SEQ ID NO: 2294817 - protein, 20 aa, Cryptosporidium parvum
IKLNIMRKFIPRVNLLQLEE

SEQ ID NO: 2294818 - protein, 20 aa, Cryptosporidium parvum
IKLNMEFEVMKNLLMLVLSY

SEQ ID NO: 2294819 - protein, 21 aa, Cryptosporidium parvum
IKLNRLCWAVGSISGSLSKNI

SEQ ID NO: 2294820 - protein, 29 aa, Cryptosporidium parvum
IKLNVKVYKRKESDIIVIKTLVVALYRND

SEQ ID NO: 2294821 - protein, 21 aa, Cryptosporidium parvum
IKLRSKEALCYAHEKQIEYLK

SEQ ID NO: 2294822 - protein, 17 aa, Cryptosporidium parvum
IKLSDEFIQNNLSKLQE

SEQ ID NO: 2294823 - protein, 27 aa, Cryptosporidium parvum
IKLSKYLMRCLCSFCSKTTLIKLVNNQ

SEQ ID NO: 2294824 - protein, 20 aa, Cryptosporidium parvum
IKLSRPYVAPNPGFLNQLYN

SEQ ID NO: 2294825 - protein, 25 aa, Cryptosporidium parvum
IKLTRLQRMGTIWCNSILSISVGNT

SEQ ID NO: 2294826 - protein, 24 aa, Cryptosporidium parvum
IKLWRYNDTKAWEIDTLRGHFNNV

SEQ ID NO: 2294827 - protein, 18 aa, Cryptosporidium parvum
IKLYELFIELIEILVDYY

SEQ ID NO: 2294828 - protein, 21 aa, Cryptosporidium parvum
IKMDKEFLIETLLHAADISNP

SEQ ID NO: 2294829 - protein, 17 aa, Cryptosporidium parvum
IKMNRYQFERIGYFTRD

SEQ ID NO: 2294830 - protein, 22 aa, Cryptosporidium parvum
IKMRICCSHPRGLVARGSQLDK

SEQ ID NO: 2294831 - protein, 17 aa, Cryptosporidium parvum
IKMWSSLELSRPLLKAL

SEQ ID NO: 2294832 - protein, 25 aa, Cryptosporidium parvum
IKNDLSIPLYRHWNLMDSVYHSEYL

SEQ ID NO: 2294833 - protein, 31 aa, Cryptosporidium parvum
IKNISIDIQFVWNIVLCRKYKYLSENNLLKT

SEQ ID NO: 2294834 - protein, 26 aa, Cryptosporidium parvum
IKNITSYLHRWRIVGRVVSKSDIRKF

SEQ ID NO: 2294835 - protein, 19 aa, Cryptosporidium parvum
IKNKKCLDGIVNIVSGKDI

SEQ ID NO: 2294836 - protein, 23 aa, Cryptosporidium parvum
IKNLCIKAAEFSYDETIEKYNGI

SEQ ID NO: 2294837 - protein, 23 aa, Cryptosporidium parvum
IKNLFTIHVYELNARVALENHDL

SEQ ID NO: 2294838 - protein, 17 aa, Cryptosporidium parvum
IKNLIISAIQKLKSGGN

SEQ ID NO: 2294839 - protein, 28 aa, Cryptosporidium parvum
IKNLIPRLIKTLFLPGAISYMKKESGNL

SEQ ID NO: 2294840 - protein, 24 aa, Cryptosporidium parvum
IKNLKDGFKYVGYRCRVAVSRQKT

SEQ ID NO: 2294841 - protein, 21 aa, Cryptosporidium parvum
IKNNPQCYGMMNYIHSSGACF

SEQ ID NO: 2294842 - protein, 20 aa, Cryptosporidium parvum
IKNNTFVKLWLSDIELKYSG

SEQ ID NO: 2294843 - protein, 18 aa, Cryptosporidium parvum
IKNPMDFSTMRKKVSQDE

SEQ ID NO: 2294844 - protein, 19 aa, Cryptosporidium parvum
IKNRRERFGTMSRVNDPDH

SEQ ID NO: 2294845 - protein, 20 aa, Cryptosporidium parvum
IKNSLKIVIDMKSIKIFLKG

SEQ ID NO: 2294846 - protein, 28 aa, Cryptosporidium parvum
IKNTTLWLSKYFFGRSVCDCSLIIVVLY

SEQ ID NO: 2294847 - protein, 28 aa, Cryptosporidium parvum
IKNWRFHKIPMFWLQVKLIEILELFPEV

SEQ ID NO: 2294848 - protein, 20 aa, Cryptosporidium parvum
IKNYLCGLEANKAVKYIEKH

SEQ ID NO: 2294849 - protein, 32 aa, Cryptosporidium parvum
IKPEKKSIMLAKFKIIRCKPVPILTRSYKTAI

SEQ ID NO: 2294850 - protein, 17 aa, Cryptosporidium parvum
IKPFYAKDGCVEKNDII

SEQ ID NO: 2294851 - protein, 32 aa, Cryptosporidium parvum; identical to SEQ ID NO: 2173382

SEQ ID NO: 2294852 - protein, 24 aa, Cryptosporidium parvum
IKPKKGRKRRLLFPSTVTKKQIRR

SEQ ID NO: 2294853 - protein, 21 aa, Cryptosporidium parvum
IKPNELYSIFQEYNISMKRMG

SEQ ID NO: 2294854 - protein, 22 aa, Cryptosporidium parvum
IKPNTLFPWKYIQNTLNYISPK

SEQ ID NO: 2294855 - protein, 20 aa, Cryptosporidium parvum
IKPSALRELAIEIPKTDWND

SEQ ID NO: 2294856 - protein, 17 aa, Cryptosporidium parvum
IKQELRSAISRKSANYG

SEQ ID NO: 2294857 - protein, 19 aa, Cryptosporidium parvum
IKQFIKMKFILGTESEDFI

SEQ ID NO: 2294858 - protein, 24 aa, Cryptosporidium parvum
IKQFLMDLLEVIKELTLVCENMKS

SEQ ID NO: 2294859 - protein, 25 aa, Cryptosporidium parvum
IKQGGCFVLNCPWSTLEELNHELPS

SEQ ID NO: 2294860 - protein, 19 aa, Cryptosporidium parvum
IKQLKMRSPAIFSLSFDRP

SEQ ID NO: 2294861 - protein, 19 aa, Cryptosporidium parvum
IKQNHDWNNHLGLVSELRN

SEQ ID NO: 2294862 - protein, 19 aa, Cryptosporidium parvum
IKQNTVYCIRTLHRPVPLK

SEQ ID NO: 2294863 - protein, 18 aa, Cryptosporidium parvum
IKQPSVICDQALLIRNLP

SEQ ID NO: 2294864 - protein, 17 aa, Cryptosporidium parvum
IKQSWTGIFSTNIENLQ

SEQ ID NO: 2294865 - protein, 19 aa, Cryptosporidium parvum
IKQVFACRPDLVELGMTNF

SEQ ID NO: 2294866 - protein, 23 aa, Cryptosporidium parvum
IKQVQELTQWVGVGGSNLAQNSI

SEQ ID NO: 2294867 - protein, 24 aa, Cryptosporidium parvum
IKRDEMKEKFVILGGSLKDIELEE

SEQ ID NO: 2294868 - protein, 19 aa, Cryptosporidium parvum
IKRKETLSICYIESEYIQD

SEQ ID NO: 2294869 - protein, 21 aa, Cryptosporidium parvum
IKRKIKVFLNGNWVGCFDDSE

SEQ ID NO: 2294870 - protein, 17 aa, Cryptosporidium parvum
IKRLYQGSINFIKLKLL

SEQ ID NO: 2294871 - protein, 29 aa, Cryptosporidium parvum
IKRPEGVSKKLGSFIAERTDLFKVENNMI

SEQ ID NO: 2294872 - protein, 21 aa, Cryptosporidium parvum
IKRRLLKHLYRFDEATNAIDH

SEQ ID NO: 2294873 - protein, 28 aa, Cryptosporidium parvum
IKRRLLREYDIIYQFGRYEYFSVNQLTE

SEQ ID NO: 2294874 - protein, 20 aa, Cryptosporidium parvum
IKRSISIASISKCEISKMDP

SEQ ID NO: 2294875 - protein, 27 aa, Cryptosporidium parvum
IKRSLHFIYHRYKRYVAYNEMLNSERD

SEQ ID NO: 2294876 - protein, 19 aa, Cryptosporidium parvum
IKRSLKLLINNNSSSWTKN

SEQ ID NO: 2294877 - protein, 24 aa, Cryptosporidium parvum
IKRWDLDEDSRWISCPSSVSITFS

SEQ ID NO: 2294878 - protein, 20 aa, Cryptosporidium parvum
IKSAGKRAAKKLKDKSKSLK

SEQ ID NO: 2294879 - protein, 17 aa, Cryptosporidium parvum
IKSCVKDASKNMEATSY

SEQ ID NO: 2294880 - protein, 26 aa, Cryptosporidium parvum
IKSELPEPILKYYIGLKILSYPSILE

SEQ ID NO: 2294881 - protein, 24 aa, Cryptosporidium parvum
IKSFPIKVIHELLGSPGTKECIIF

SEQ ID NO: 2294882 - protein, 17 aa, Cryptosporidium parvum
IKSGIKFAEYSLELSKR

SEQ ID NO: 2294883 - protein, 31 aa, Cryptosporidium parvum
IKSICNHILCWKCIINVDEIFYLDSNTSKND

SEQ ID NO: 2294884 - protein, 24 aa, Cryptosporidium parvum
IKSITLLQQWWRVTFTLRKHIDSG

SEQ ID NO: 2294885 - protein, 17 aa, Cryptosporidium parvum
IKSKIVYNCYKLRNIVG

SEQ ID NO: 2294886 - protein, 18 aa, Cryptosporidium parvum
IKSKMNIDVIVGNVVTEE

SEQ ID NO: 2294887 - protein, 21 aa, Cryptosporidium parvum
IKSKTWRKNRRKQMQIEEEKL

SEQ ID NO: 2294888 - protein, 22 aa, Cryptosporidium parvum
IKSLCMKCSGTGYSNLMLCIKC

SEQ ID NO: 2294889 - protein, 20 aa, Cryptosporidium parvum
IKSLNIFLSLPIKSNADVPI

SEQ ID NO: 2294890 - protein, 18 aa, Cryptosporidium parvum
IKSNISIGLKNSVKKNSS

SEQ ID NO: 2294891 - protein, 26 aa, Cryptosporidium parvum
IKSRLFKSLDPCKSFSITFKIQKLND

SEQ ID NO: 2294892 - protein, 17 aa, Cryptosporidium parvum
IKSSYGVKVTFKLENSL

SEQ ID NO: 2294893 - protein, 24 aa, Cryptosporidium parvum
IKSYPKHKIGLIIDNPIKSPDLSL

SEQ ID NO: 2294894 - protein, 18 aa, Cryptosporidium parvum
IKTGCHFNEPINYYKASE

SEQ ID NO: 2294895 - protein, 20 aa, Cryptosporidium parvum
IKTKLDQHGNFLSKEQSSQG

SEQ ID NO: 2294896 - protein, 17 aa, Cryptosporidium parvum
IKTKRLREDTSWIHPRE

SEQ ID NO: 2294897 - protein, 25 aa, Cryptosporidium parvum
IKTKSDFMPFLFFTNGHVWKMAFSP

SEQ ID NO: 2294898 - protein, 20 aa, Cryptosporidium parvum
IKTLIVGGSLQLSPKTQIRL

SEQ ID NO: 2294899 - protein, 18 aa, Cryptosporidium parvum
IKTLRYILRPKLLTKPII

SEQ ID NO: 2294900 - protein, 20 aa, Cryptosporidium parvum
IKTNFERCFYIPSCDSNEYY

SEQ ID NO: 2294901 - protein, 23 aa, Cryptosporidium parvum
IKTRISGQISPWNALEMAMKEYK

SEQ ID NO: 2294902 - protein, 24 aa, Cryptosporidium parvum
IKTVFKVLFSLEFRESPQSINWFW

SEQ ID NO: 2294903 - protein, 22 aa, Cryptosporidium parvum
IKTVHPWFKSTATVECYNSNNG

SEQ ID NO: 2294904 - protein, 18 aa, Cryptosporidium parvum
IKTVLPFLDPNYSLFYYI

SEQ ID NO: 2294905 - protein, 19 aa, Cryptosporidium parvum
IKTYRFIKDSSKTGNHQYY

SEQ ID NO: 2294906 - protein, 17 aa, Cryptosporidium parvum
IKVKGLSAFWDDESAPF

SEQ ID NO: 2294907 - protein, 18 aa, Cryptosporidium parvum
IKVKWPNFIEYLLDKILT

SEQ ID NO: 2294908 - protein, 31 aa, Cryptosporidium parvum; identical to SEQ ID NO: 2173437

SEQ ID NO: 2294909 - protein, 19 aa, Cryptosporidium parvum
IKVMQWEKLLLLPHPCRKI

SEQ ID NO: 2294910 - protein, 25 aa, Cryptosporidium parvum
IKVNNFRFGNSIWKTNKDSKINEMP

SEQ ID NO: 2294911 - protein, 25 aa, Cryptosporidium parvum
IKWAPRFKLNKVISGHKGWVRSIAV

SEQ ID NO: 2294912 - protein, 17 aa, Cryptosporidium parvum
IKYFKSLIILQLKFQNV

SEQ ID NO: 2294913 - protein, 25 aa, Cryptosporidium parvum
IKYGELDDLVAIYGLNKVVWCRIHI

SEQ ID NO: 2294914 - protein, 17 aa, Cryptosporidium parvum
IKYKCKLMYEHNYKCEL

SEQ ID NO: 2294915 - protein, 20 aa, Cryptosporidium parvum
IKYLDARRKGIILTTPPPLS

SEQ ID NO: 2294916 - protein, 20 aa, Cryptosporidium parvum
IKYLWETKRDFNIHEVFDDE

SEQ ID NO: 2294917 - protein, 25 aa, Cryptosporidium parvum
IKYNIPDFYLRLDGTTPILERQNMI

SEQ ID NO: 2294918 - protein, 19 aa, Cryptosporidium parvum
IKYNTNIGEIGMKNCAMTI

SEQ ID NO: 2294919 - protein, 18 aa, Cryptosporidium parvum
IKYNYILPIRSVGVQGDF

SEQ ID NO: 2294920 - protein, 19 aa, Cryptosporidium parvum
IKYPEYFIKPNNKYVNELG

SEQ ID NO: 2294921 - protein, 22 aa, Cryptosporidium parvum
IKYPLNCLRTAESDSEKKNIFQ

SEQ ID NO: 2294922 - protein, 26 aa, Cryptosporidium parvum
IKYPVLSEAFLLDWITSDVLQSTIDY

SEQ ID NO: 2294923 - protein, 20 aa, Cryptosporidium parvum
IKYSESWSECIEIDSHGNKK

SEQ ID NO: 2294924 - protein, 17 aa, Cryptosporidium parvum
IKYSFVIPDKEYLVDYK

SEQ ID NO: 2294925 - protein, 25 aa, Cryptosporidium parvum
IKYVFKIWQHRSDGLYITRHCGELL

SEQ ID NO: 2294926 - protein, 18 aa, Cryptosporidium parvum
IKYVINFDFPLSPKLFVH

SEQ ID NO: 2294927 - protein, 22 aa, Cryptosporidium parvum
ILADGFRPGERVTRLTHRVRYV

SEQ ID NO: 2294928 - protein, 24 aa, Cryptosporidium parvum
ILAEREFEIEFALFQNSSTIQKKQ

SEQ ID NO: 2294929 - protein, 25 aa, Cryptosporidium parvum
ILAIDASIWLKQFLMGLKDKEGKIP

SEQ ID NO: 2294930 - protein, 19 aa, Cryptosporidium parvum
ILASGDWNGEVLLTCVNEG

SEQ ID NO: 2294931 - protein, 29 aa, Cryptosporidium parvum
ILCGEEFWAWIMIWMRFNSLGVLDWQRNY

SEQ ID NO: 2294932 - protein, 19 aa, Cryptosporidium parvum
ILCTRAHLPVISFNPKDPN

SEQ ID NO: 2294933 - protein, 26 aa, Cryptosporidium parvum
ILDIPRLKWMILLRIIPVDFFSLSIH

SEQ ID NO: 2294934 - protein, 24 aa, Cryptosporidium parvum
ILDLPFFVLTSFLIKKGFFELSDY

SEQ ID NO: 2294935 - protein, 23 aa, Cryptosporidium parvum
ILDLRIGGEFSQTLFLDKKTTNL

SEQ ID NO: 2294936 - protein, 18 aa, Cryptosporidium parvum
ILDSYPLSMTLIRCENDK

SEQ ID NO: 2294937 - protein, 25 aa, Cryptosporidium parvum
ILECLIPVKFRLGFIPNISLLKKYN

SEQ ID NO: 2294938 - protein, 23 aa, Cryptosporidium parvum
ILECQECKKIKFCSKKCMEESKT

SEQ ID NO: 2294939 - protein, 27 aa, Cryptosporidium parvum
ILEDYCHMRGFPYCRIDGNTSGDDRDR

SEQ ID NO: 2294940 - protein, 25 aa, Cryptosporidium parvum
ILEEAKELFSYSGIWLDTHSIPLLW

SEQ ID NO: 2294941 - protein, 21 aa, Cryptosporidium parvum
ILEELKTLNLDSVTKNSTIGE

SEQ ID NO: 2294942 - protein, 18 aa, Cryptosporidium parvum
ILEKCIQFQWKILPFDQK

SEQ ID NO: 2294943 - protein, 17 aa, Cryptosporidium parvum
ILELCLGSTAAQFIACS

SEQ ID NO: 2294944 - protein, 23 aa, Cryptosporidium parvum
ILELKGLRFAFFKDDLDILDTCI

SEQ ID NO: 2294945 - protein, 20 aa, Cryptosporidium parvum
ILELLKYHARVMYIDIDVHH

SEQ ID NO: 2294946 - protein, 26 aa, Cryptosporidium parvum
ILENFLMDILEAFDCHTDFPPTIQRI

SEQ ID NO: 2294947 - protein, 36 aa, Cryptosporidium parvum; identical to SEQ ID NO: 2173477

SEQ ID NO: 2294948 - protein, 32 aa, Cryptosporidium parvum
ILESKGIPGIFRGQSIHLVENMMIGRGHGIML

SEQ ID NO: 2294949 - protein, 17 aa, Cryptosporidium parvum
ILESVNHLHCLKMLHRD

SEQ ID NO: 2294950 - protein, 18 aa, Cryptosporidium parvum
ILEVGCGRGGGSVVVCSV

SEQ ID NO: 2294951 - protein, 25 aa, Cryptosporidium parvum
ILEVVKGCNCKKLLLDFNNLGPNKT

SEQ ID NO: 2294952 - protein, 18 aa, Cryptosporidium parvum
ILEYEKWLDPEIYEEIRQ

SEQ ID NO: 2294953 - protein, 17 aa, Cryptosporidium parvum
ILFDDSTCIYINTDEII

SEQ ID NO: 2294954 - protein, 21 aa, Cryptosporidium parvum
ILFLMCIHRLGAFQKNDLPDL

SEQ ID NO: 2294955 - protein, 19 aa, Cryptosporidium parvum
ILFLNELEELFEITPTNYI

SEQ ID NO: 2294956 - protein, 27 aa, Cryptosporidium parvum
ILGENVCRLRYYQSFNIQLLHNDNNMN

SEQ ID NO: 2294957 - protein, 27 aa, Cryptosporidium parvum
ILGFDPVKCNPSWFINTVIPIPPPAVR

SEQ ID NO: 2294958 - protein, 17 aa, Cryptosporidium parvum
ILGPYVPSIIQFIDNIV

SEQ ID NO: 2294959 - protein, 18 aa, Cryptosporidium parvum
ILGSRSWTCSSFLHHAIF

SEQ ID NO: 2294960 - protein, 18 aa, Cryptosporidium parvum
ILGTKIIFEDDVFKHIFE

SEQ ID NO: 2294961 - protein, 17 aa, Cryptosporidium parvum
ILGWGLFSYSSLFNHSC

SEQ ID NO: 2294962 - protein, 27 aa, Cryptosporidium parvum
ILHEYCILNILLGRCHKAIEMYCCYNL

SEQ ID NO: 2294963 - protein, 29 aa, Cryptosporidium parvum
ILHQGGNALELFPYRCVKINGLPENIEFK

SEQ ID NO: 2294964 - protein, 18 aa, Cryptosporidium parvum
ILHQSLRNLELWFISDPE

SEQ ID NO: 2294965 - protein, 31 aa, Cryptosporidium parvum
ILIDFTSHLKLWIKLLFGYSIDKKDIIYLCS

SEQ ID NO: 2294966 - protein, 17 aa, Cryptosporidium parvum
ILIDLKFTGKLIQDLSI

SEQ ID NO: 2294967 - protein, 19 aa, Cryptosporidium parvum
ILIESCLLIYYIMEDCNSS

SEQ ID NO: 2294968 - protein, 19 aa, Cryptosporidium parvum
ILIGIFGEEYILSESHSGI

SEQ ID NO: 2294969 - protein, 18 aa, Cryptosporidium parvum
ILIHGIPGSCERLEKILL

SEQ ID NO: 2294970 - protein, 29 aa, Cryptosporidium parvum
ILINEWKKLRWSNKLNLVINIDDYNKGEH

SEQ ID NO: 2294971 - protein, 19 aa, Cryptosporidium parvum
ILIQEAKYHLSLNSKTRKG

SEQ ID NO: 2294972 - protein, 25 aa, Cryptosporidium parvum
ILISCKLCKFSFKKPYWEKKIKNTN

SEQ ID NO: 2294973 - protein, 30 aa, Cryptosporidium parvum
ILISNPYGLIGIPFLLHYNNYCNYLESLDS

SEQ ID NO: 2294974 - protein, 23 aa, Cryptosporidium parvum
ILKCYKALSLRPLELESETSKHK

SEQ ID NO: 2294975 - protein, 21 aa, Cryptosporidium parvum
ILKDRLSLFMDEYLKYSNDDI

SEQ ID NO: 2294976 - protein, 17 aa, Cryptosporidium parvum
ILKEVNKSVFVPVAKSR

SEQ ID NO: 2294977 - protein, 19 aa, Cryptosporidium parvum
ILKGGVGVIDCSWNKIDQV

SEQ ID NO: 2294978 - protein, 23 aa, Cryptosporidium parvum
ILKHGLSLFEFNKRYNIDVSGLA

SEQ ID NO: 2294979 - protein, 25 aa, Cryptosporidium parvum
ILKICECQSFLLGDTFLIYSTLQNQ

SEQ ID NO: 2294980 - protein, 23 aa, Cryptosporidium parvum
ILKLSMSIDGEWLILGSQDGSIR

SEQ ID NO: 2294981 - protein, 21 aa, Cryptosporidium parvum
ILKMIERRKIAVIGSGQIGGN

SEQ ID NO: 2294982 - protein, 23 aa, Cryptosporidium parvum
ILKMLKNLSIVWTIWKPIKYCAV

SEQ ID NO: 2294983 - protein, 40 aa, Cryptosporidium parvum
ILKNISTKFEIKFELGLINGSWLGGDIFILDRKHALEAVS

SEQ ID NO: 2294984 - protein, 20 aa, Cryptosporidium parvum
ILKQRLKSIQTKLSIEENIS

SEQ ID NO: 2294985 - protein, 28 aa, Cryptosporidium parvum
ILKSDDVLTFSIGWRRFQSIPLYSIEDR

SEQ ID NO: 2294986 - protein, 18 aa, Cryptosporidium parvum
ILKSHALDSIKIDNIQQI

SEQ ID NO: 2294987 - protein, 20 aa, Cryptosporidium parvum
ILKTENWGLFGVFDGHGPFG

SEQ ID NO: 2294988 - protein, 17 aa, Cryptosporidium parvum
ILLCDRLIMTGTFTEYD

SEQ ID NO: 2294989 - protein, 20 aa, Cryptosporidium parvum
ILLCGTGYGEVRLYAPQLQR

SEQ ID NO: 2294990 - protein, 36 aa, Cryptosporidium parvum
ILLDNPFRWVLFPIKYSRLWSLYKKYEVSFWTAEVI

SEQ ID NO: 2294991 - protein, 17 aa, Cryptosporidium parvum
ILLEIYNIIPTWGSFKE

SEQ ID NO: 2294992 - protein, 27 aa, Cryptosporidium parvum
ILLFSSCIGCSIIPTKIREEKKLFIEY

SEQ ID NO: 2294993 - protein, 17 aa, Cryptosporidium parvum
ILLIIIICFDTMPNRWK

SEQ ID NO: 2294994 - protein, 20 aa, Cryptosporidium parvum
ILLKRFLKCDLGKLCNCLLS

SEQ ID NO: 2294995 - protein, 25 aa, Cryptosporidium parvum
ILLLKMKFNYSWSEFAILARTNDTL

SEQ ID NO: 2294996 - protein, 19 aa, Cryptosporidium parvum
ILLPGEKLLLFSKECGISA

SEQ ID NO: 2294997 - protein, 24 aa, Cryptosporidium parvum
ILLQNGMLWNWDRRQAQTEEPEQS

SEQ ID NO: 2294998 - protein, 17 aa, Cryptosporidium parvum
ILLRTSIINHRRDLARK

SEQ ID NO: 2294999 - protein, 25 aa, Cryptosporidium parvum
ILLVFDEFKTILSLKTIPSYGKRHN

SEQ ID NO: 2295000 - protein, 18 aa, Cryptosporidium parvum
ILLYLLFHTLELNRDVLN

SEQ ID NO: 2295001 - protein, 19 aa, Cryptosporidium parvum
ILLYLSRYVEYKTNNNPKW

SEQ ID NO: 2295002 - protein, 21 aa, Cryptosporidium parvum
ILMPFGFTMMHHYLGYEGRCA

SEQ ID NO: 2295003 - protein, 19 aa, Cryptosporidium parvum
ILMYECLYGGVPFNDDTHN

SEQ ID NO: 2295004 - protein, 28 aa, Cryptosporidium parvum
ILNCCTDIKTKLRVKGGIYFTPDSDISP

SEQ ID NO: 2295005 - protein, 23 aa, Cryptosporidium parvum
ILNEFYLRNGMTMEEPILLFLTY

SEQ ID NO: 2295006 - protein, 40 aa, Cryptosporidium parvum
ILNEMKRKLLSFKPRVTFKKGTCFKPRGRDIKALSLSQYL

SEQ ID NO: 2295007 - protein, 23 aa, Cryptosporidium parvum
ILNEPRAAIDMAKEAFEMAIEQL

SEQ ID NO: 2295008 - protein, 18 aa, Cryptosporidium parvum
ILNFIIKNGLAIILSPQS

SEQ ID NO: 2295009 - protein, 18 aa, Cryptosporidium parvum
ILNFYIKLLENFPLILLN

SEQ ID NO: 2295010 - protein, 18 aa, Cryptosporidium parvum
ILNIKWIMLYDCDSKEDE

SEQ ID NO: 2295011 - protein, 18 aa, Cryptosporidium parvum
ILNILLSRWSGIPIVSKL

SEQ ID NO: 2295012 - protein, 24 aa, Cryptosporidium parvum
ILNLGGIPPRKECINSIRRQTVDS

SEQ ID NO: 2295013 - protein, 23 aa, Cryptosporidium parvum
ILNNCTYCSQGRVFLFDSNLGIE

SEQ ID NO: 2295014 - protein, 30 aa, Cryptosporidium parvum
ILNNVPEFIWRKIIHEFAFPINETATVWKL

SEQ ID NO: 2295015 - protein, 21 aa, Cryptosporidium parvum
ILNPGRLILFNSFSLTGKSLP

SEQ ID NO: 2295016 - protein, 31 aa, Cryptosporidium parvum
ILNPKEAFKRLCWKFHGQKVNKNKIEKMLRN

SEQ ID NO: 2295017 - protein, 21 aa, Cryptosporidium parvum
ILNRHPLVLTINGCIGTEGIG

SEQ ID NO: 2295018 - protein, 18 aa, Cryptosporidium parvum
ILNSLNWPSEILTSLLEK

SEQ ID NO: 2295019 - protein, 18 aa, Cryptosporidium parvum
ILNSLSILVYPKIYSDNR

SEQ ID NO: 2295020 - protein, 24 aa, Cryptosporidium parvum
ILNWPKVDCLISFYSTGFPLNKAI

SEQ ID NO: 2295021 - protein, 26 aa, Cryptosporidium parvum
ILPDSLKLTLIYVSSLFKHPSLMPLN

SEQ ID NO: 2295022 - protein, 24 aa, Cryptosporidium parvum
ILPHLRKIQAPVMECLDKVTSALE

SEQ ID NO: 2295023 - protein, 17 aa, Cryptosporidium parvum
ILPISKRRVSLHCSIKS

SEQ ID NO: 2295024 - protein, 19 aa, Cryptosporidium parvum
ILPKSEDSLSMQLHALPHD

SEQ ID NO: 2295025 - protein, 26 aa, Cryptosporidium parvum
ILPNRIKFKTCRQLFNKAGEILTGSH

SEQ ID NO: 2295026 - protein, 18 aa, Cryptosporidium parvum
ILPPADFLFAWLKHCHYR

SEQ ID NO: 2295027 - protein, 19 aa, Cryptosporidium parvum
ILPTGEYDLILAFDSPICK

SEQ ID NO: 2295028 - protein, 31 aa, Cryptosporidium parvum; identical to SEQ ID NO: 2173555

SEQ ID NO: 2295029 - protein, 17 aa, Cryptosporidium parvum
ILQILILNGLHFSIKKD

SEQ ID NO: 2295030 - protein, 18 aa, Cryptosporidium parvum
ILQILSFISQKCWKYLFG

SEQ ID NO: 2295031 - protein, 18 aa, Cryptosporidium parvum
ILQKKARDLNNFQYGDDD

SEQ ID NO: 2295032 - protein, 26 aa, Cryptosporidium parvum
ILQLKMFCGLIIKPGQKVKLDSTQGE

SEQ ID NO: 2295033 - protein, 23 aa, Cryptosporidium parvum
ILQSHYLYSIIVGFEKSISYWKL

SEQ ID NO: 2295034 - protein, 26 aa, Cryptosporidium parvum
ILRDRVFSSIYWKGECFALDSETILD

SEQ ID NO: 2295035 - protein, 22 aa, Cryptosporidium parvum
ILREEYKLLKAHKVALENKLET

SEQ ID NO: 2295036 - protein, 20 aa, Cryptosporidium parvum
ILRKDFKSIISNSELLIKKE

SEQ ID NO: 2295037 - protein, 23 aa, Cryptosporidium parvum
ILRKHGSFIIKCFNILHHTTISI

SEQ ID NO: 2295038 - protein, 20 aa, Cryptosporidium parvum
ILRLYLFKNSWFVEVIKDIN

SEQ ID NO: 2295039 - protein, 27 aa, Cryptosporidium parvum
ILRPFLPRLLICLLENSIFTDFDYIEM

SEQ ID NO: 2295040 - protein, 20 aa, Cryptosporidium parvum
ILRRICKRAIIEFFDAKRSS

SEQ ID NO: 2295041 - protein, 22 aa, Cryptosporidium parvum
ILRYLKNNLISISLGKVHIDNY

SEQ ID NO: 2295042 - protein, 24 aa, Cryptosporidium parvum
ILSCSSELDIEIVLMKQDQSEEKG

SEQ ID NO: 2295043 - protein, 29 aa, Cryptosporidium parvum
ILSDCQIDFNVINWNHLILLYGSPGTGKT

SEQ ID NO: 2295044 - protein, 19 aa, Cryptosporidium parvum
ILSGIILLGNIVFKDSEGK

SEQ ID NO: 2295045 - protein, 24 aa, Cryptosporidium parvum
ILSLCKRSRDSLEFDAGSDSPTEL

SEQ ID NO: 2295046 - protein, 18 aa, Cryptosporidium parvum
ILSMLWPQENMPFSESGM

SEQ ID NO: 2295047 - protein, 25 aa, Cryptosporidium parvum
ILSSSECLFGYGFIPKTEPVSGLFD

SEQ ID NO: 2295048 - protein, 22 aa, Cryptosporidium parvum
ILSSSWTKYKVFKKLYSGGKVE

SEQ ID NO: 2295049 - protein, 18 aa, Cryptosporidium parvum
ILTCRNLSSSNSMTYNNF

SEQ ID NO: 2295050 - protein, 19 aa, Cryptosporidium parvum
ILTPIIYYNMDSFRDIISD

SEQ ID NO: 2295051 - protein, 17 aa, Cryptosporidium parvum
ILTRYLRDNALPACISY

SEQ ID NO: 2295052 - protein, 26 aa, Cryptosporidium parvum
ILTSGILEFFSTYGICLRFEDEKLGK

SEQ ID NO: 2295053 - protein, 22 aa, Cryptosporidium parvum
ILTTIVKCFLKAPIHNQQLVTD

SEQ ID NO: 2295054 - protein, 19 aa, Cryptosporidium parvum
ILTVKWPYQEPEIIFYHPP

SEQ ID NO: 2295055 - protein, 25 aa, Cryptosporidium parvum
ILVKHVSPPSSWRQIQRNAIEDKDQ

SEQ ID NO: 2295056 - protein, 36 aa, Cryptosporidium parvum
ILVPPYSSFIKFCVKRLGFSITYNKRRAWFSVRSRG

SEQ ID NO: 2295057 - protein, 20 aa, Cryptosporidium parvum
ILVSRVANFLANFLLQPRAS

SEQ ID NO: 2295058 - protein, 17 aa, Cryptosporidium parvum
ILYEEKLSLVRRTNKNE

SEQ ID NO: 2295059 - protein, 18 aa, Cryptosporidium parvum
ILYLPPKGGNLMVPRCVY

SEQ ID NO: 2295060 - protein, 17 aa, Cryptosporidium parvum
ILYNSLCLLDYDTGIRP

SEQ ID NO: 2295061 - protein, 23 aa, Cryptosporidium parvum
ILYSKRFSPYFVEPIVAGLDNNN

SEQ ID NO: 2295062 - protein, 20 aa, Cryptosporidium parvum
IMALKRKKSNVIFSNNEKIL

SEQ ID NO: 2295063 - protein, 25 aa, Cryptosporidium parvum
IMDFKTKYIFPFSFESVLDAILYKA

SEQ ID NO: 2295064 - protein, 19 aa, Cryptosporidium parvum
IMDLYYSFWNHLISRFTNT

SEQ ID NO: 2295065 - protein, 21 aa, Cryptosporidium parvum
IMELYDFLYNRNDSIIKENQD

SEQ ID NO: 2295066 - protein, 30 aa, Cryptosporidium parvum
IMFSQEFPNRVKSLILCNAFVSTLNLPLPS

SEQ ID NO: 2295067 - protein, 19 aa, Cryptosporidium parvum
IMFVKRKVNLISQIYPINI

SEQ ID NO: 2295068 - protein, 26 aa, Cryptosporidium parvum
IMGDCLLSAAFICFAGGLDQILRSHY

SEQ ID NO: 2295069 - protein, 18 aa, Cryptosporidium parvum
IMGLFSIDNYILIILGTW

SEQ ID NO: 2295070 - protein, 27 aa, Cryptosporidium parvum
IMGNDHVCCFMRYYQIIYERLKKAKST

SEQ ID NO: 2295071 - protein, 21 aa, Cryptosporidium parvum
IMGPVFMKVLLFMFVVDPPYH

SEQ ID NO: 2295072 - protein, 22 aa, Cryptosporidium parvum
IMIALNLIKFGGNIIISLKTAL

SEQ ID NO: 2295073 - protein, 18 aa, Cryptosporidium parvum
IMIRCWDPQPSKRGTMLV

SEQ ID NO: 2295074 - protein, 20 aa, Cryptosporidium parvum
IMKAGGFCDFQHICRYVSHI

SEQ ID NO: 2295075 - protein, 24 aa, Cryptosporidium parvum
IMKNEIRYAWEHGIKSRMYDKIQG

SEQ ID NO: 2295076 - protein, 19 aa, Cryptosporidium parvum
IMKRSDLQKAIPYFLKAVE

SEQ ID NO: 2295077 - protein, 21 aa, Cryptosporidium parvum
IMLCTDGWYIVKILTNITLIK

SEQ ID NO: 2295078 - protein, 24 aa, Cryptosporidium parvum
IMLGTSWKGYEFVSKSGKEKVISK

SEQ ID NO: 2295079 - protein, 18 aa, Cryptosporidium parvum
IMNHEIIEFIFLENSEIT

SEQ ID NO: 2295080 - protein, 21 aa, Cryptosporidium parvum
IMNRLKFISVKLLDSKMAFFQ

SEQ ID NO: 2295081 - protein, 17 aa, Cryptosporidium parvum
IMNYIGVLSSNIEKDPI

SEQ ID NO: 2295082 - protein, 24 aa, Cryptosporidium parvum
IMRKTRTIGGFGIGGDKTVISGPF

SEQ ID NO: 2295083 - protein, 19 aa, Cryptosporidium parvum
IMSASSIKQVFACRPDLVE

SEQ ID NO: 2295084 - protein, 29 aa, Cryptosporidium parvum
IMSDYFRRSRYQNRMVILNLIKKKRTKSS

SEQ ID NO: 2295085 - protein, 17 aa, Cryptosporidium parvum
IMSPCCHHRCLISQHLG

SEQ ID NO: 2295086 - protein, 19 aa, Cryptosporidium parvum
IMSVIPRYFEFKTNYEAET

SEQ ID NO: 2295087 - protein, 18 aa, Cryptosporidium parvum
IMTTEILRTMLYRNDPCI

SEQ ID NO: 2295088 - protein, 19 aa, Cryptosporidium parvum
IMWVRRLYYLYTPTLFMNS

SEQ ID NO: 2295089 - protein, 25 aa, Cryptosporidium parvum
INAKWPNYELTKGRSHEDLVELLKK

SEQ ID NO: 2295090 - protein, 23 aa, Cryptosporidium parvum
INAPESLPIFPPNPIEIDENTVV

SEQ ID NO: 2295091 - protein, 24 aa, Cryptosporidium parvum
INARKLVERLLLKIYQEYDDFLLS

SEQ ID NO: 2295092 - protein, 18 aa, Cryptosporidium parvum
INASGRRAIGGSVCSSGS

SEQ ID NO: 2295093 - protein, 17 aa, Cryptosporidium parvum
INCKSTENCSKNASSSS

SEQ ID NO: 2295094 - protein, 18 aa, Cryptosporidium parvum
INCKYDLPSETPINSEGY

SEQ ID NO: 2295095 - protein, 22 aa, Cryptosporidium parvum
INCLPEGFYSTLLEIGSIESSK

SEQ ID NO: 2295096 - protein, 19 aa, Cryptosporidium parvum
INDCLKPTLIIPPENADFT

SEQ ID NO: 2295097 - protein, 28 aa, Cryptosporidium parvum
INDHLILPITWKQISSIFNGILKELHPN

SEQ ID NO: 2295098 - protein, 25 aa, Cryptosporidium parvum
INDKFKSCMGLGIFGLDKSITNQTS

SEQ ID NO: 2295099 - protein, 24 aa, Cryptosporidium parvum
INDRLGSLPYNWKIMSDAPELFNL

SEQ ID NO: 2295100 - protein, 18 aa, Cryptosporidium parvum
INDSCFLPPLLIDKKPGT

SEQ ID NO: 2295101 - protein, 24 aa, Cryptosporidium parvum
INEAFPPVFPLFTLPPLPPKRNGP

SEQ ID NO: 2295102 - protein, 19 aa, Cryptosporidium parvum
INEGEPLYRENVISMSNEW

SEQ ID NO: 2295103 - protein, 19 aa, Cryptosporidium parvum
INELHNWFIIHRDLAPANI

SEQ ID NO: 2295104 - protein, 24 aa, Cryptosporidium parvum
INELLKHRGGDCTIETILNELSTS

SEQ ID NO: 2295105 - protein, 19 aa, Cryptosporidium parvum
INEQILRKDFKSIISNSEL

SEQ ID NO: 2295106 - protein, 25 aa, Cryptosporidium parvum
INEYFRLLFEFNKNGVHFVNIIQGN

SEQ ID NO: 2295107 - protein, 21 aa, Cryptosporidium parvum
INEYSCYPVSFAGRDELEGGN

SEQ ID NO: 2295108 - protein, 17 aa, Cryptosporidium parvum
INFEKCELWGLVKDEET

SEQ ID NO: 2295109 - protein, 22 aa, Cryptosporidium parvum
INFRDFHVRLIAILRSSQLVEI

SEQ ID NO: 2295110 - protein, 26 aa, Cryptosporidium parvum
INFSQCTPSVFPLVLTLMEPFKDVTT

SEQ ID NO: 2295111 - protein, 21 aa, Cryptosporidium parvum
INFSSAVGIDYIPSAIELAKK

SEQ ID NO: 2295112 - protein, 17 aa, Cryptosporidium parvum
INFVLGHLLINLIYETW

SEQ ID NO: 2295113 - protein, 18 aa, Cryptosporidium parvum
INGDLYLNGTDDIKSNFI

SEQ ID NO: 2295114 - protein, 23 aa, Cryptosporidium parvum
INGELLPGFDSGKMGNMNQNLFG

SEQ ID NO: 2295115 - protein, 17 aa, Cryptosporidium parvum
INGGSVMDSFLVKGVAF

SEQ ID NO: 2295116 - protein, 26 aa, Cryptosporidium parvum
INGKIYKRWVFPFTYYLTYDNKFNLL

SEQ ID NO: 2295117 - protein, 34 aa, Cryptosporidium parvum; identical to SEQ ID NO: 2173620

SEQ ID NO: 2295118 - protein, 22 aa, Cryptosporidium parvum
INGKSRIGIVGKYIASDDTYLS

SEQ ID NO: 2295119 - protein, 25 aa, Cryptosporidium parvum
INGLKIKILKLILNILLDISEFQDE

SEQ ID NO: 2295120 - protein, 18 aa, Cryptosporidium parvum
INGMIKKIISQENGILVP

SEQ ID NO: 2295121 - protein, 17 aa, Cryptosporidium parvum
INGPLALSGTWDGKLII

SEQ ID NO: 2295122 - protein, 17 aa, Cryptosporidium parvum
INGSIECNSLDRVKRIF

SEQ ID NO: 2295123 - protein, 27 aa, Cryptosporidium parvum
INGYYMIFCGLKILYLLLNTTDISFFL

SEQ ID NO: 2295124 - protein, 24 aa, Cryptosporidium parvum
INHEVINYPPIIKNYYKEVNEIKK

SEQ ID NO: 2295125 - protein, 22 aa, Cryptosporidium parvum
INHPNYIIGYFKLEKMEKNVIW

SEQ ID NO: 2295126 - protein, 23 aa, Cryptosporidium parvum
INICLKEQYILIVEQMVRSLMLS

SEQ ID NO: 2295127 - protein, 18 aa, Cryptosporidium parvum
INIDFVFNNTNVMLFDST

SEQ ID NO: 2295128 - protein, 19 aa, Cryptosporidium parvum
INIEICYDVELPISEFTYK

SEQ ID NO: 2295129 - protein, 20 aa, Cryptosporidium parvum
INIFDCKSFILSIQKQKFGI

SEQ ID NO: 2295130 - protein, 17 aa, Cryptosporidium parvum
INIFEYIISECRNLKFQ

SEQ ID NO: 2295131 - protein, 19 aa, Cryptosporidium parvum
INIGGKILKKIFGTENVNE

SEQ ID NO: 2295132 - protein, 20 aa, Cryptosporidium parvum
INIKIPYRETSHIPSCLFEQ

SEQ ID NO: 2295133 - protein, 19 aa, Cryptosporidium parvum
INIKRVIMKNVNMNERYHF

SEQ ID NO: 2295134 - protein, 26 aa, Cryptosporidium parvum
ININNGNKWKGWGIKSGESTNADLFE

SEQ ID NO: 2295135 - protein, 27 aa, Cryptosporidium parvum
INISLSRRILICLSYFIITESYREINI

SEQ ID NO: 2295136 - protein, 24 aa, Cryptosporidium parvum
INISNRFLLIKVLHRGNFGQVYVG

SEQ ID NO: 2295137 - protein, 24 aa, Cryptosporidium parvum
INISRIPFWIKQDVDTENKSSKFF

SEQ ID NO: 2295138 - protein, 17 aa, Cryptosporidium parvum
INITIPIGNSVVNHVSS

SEQ ID NO: 2295139 - protein, 23 aa, Cryptosporidium parvum
INKEQFSHLLAEYAEIIDLKDQN

SEQ ID NO: 2295140 - protein, 17 aa, Cryptosporidium parvum
INKGVAVQAILNQINSL

SEQ ID NO: 2295141 - protein, 23 aa, Cryptosporidium parvum
INKHKRLTIELEQICDKFNSYTK

SEQ ID NO: 2295142 - protein, 22 aa, Cryptosporidium parvum
INKINNCQIVWYTRRDPEKGSI

SEQ ID NO: 2295143 - protein, 17 aa, Cryptosporidium parvum
INKISYCIYPISIEKKT

SEQ ID NO: 2295144 - protein, 20 aa, Cryptosporidium parvum
INKLRMIGYWNWLCGDDLCS

SEQ ID NO: 2295145 - protein, 23 aa, Cryptosporidium parvum
INKRFSMDLIYSYAGRLLVAVNP

SEQ ID NO: 2295146 - protein, 24 aa, Cryptosporidium parvum
INLDFEWCKSREQGLISPDIVVFL

SEQ ID NO: 2295147 - protein, 19 aa, Cryptosporidium parvum
INLGQRMHRKSSIINDNEH

SEQ ID NO: 2295148 - protein, 17 aa, Cryptosporidium parvum
INLGSDILMDFFDGGFL

SEQ ID NO: 2295149 - protein, 17 aa, Cryptosporidium parvum
INLIFRLNINTLKSELS

SEQ ID NO: 2295150 - protein, 18 aa, Cryptosporidium parvum
INLIQNWVITHFSDLIIN

SEQ ID NO: 2295151 - protein, 17 aa, Cryptosporidium parvum
INLKGVHLLQLIEAEDV

SEQ ID NO: 2295152 - protein, 24 aa, Cryptosporidium parvum
INLKSELELLYLDFIKKQFQETHI

SEQ ID NO: 2295153 - protein, 17 aa, Cryptosporidium parvum
INLLEYILNFLSFSTQE

SEQ ID NO: 2295154 - protein, 28 aa, Cryptosporidium parvum
INLLVPFYLPSFVNLEIMFRIIKTKIKT

SEQ ID NO: 2295155 - protein, 20 aa, Cryptosporidium parvum
INLMPEYEYETLYVASTEKQ

SEQ ID NO: 2295156 - protein, 22 aa, Cryptosporidium parvum
INLNPLIWKKFSGLPLSLKDLV

SEQ ID NO: 2295157 - protein, 22 aa, Cryptosporidium parvum
INLPGRTPFPIEVSYLPLKQKK

SEQ ID NO: 2295158 - protein, 22 aa, Cryptosporidium parvum
INLQTDLECEFGPESEHENKQD

SEQ ID NO: 2295159 - protein, 18 aa, Cryptosporidium parvum
INLSEFILREIKIHNRNI

SEQ ID NO: 2295160 - protein, 20 aa, Cryptosporidium parvum
INLSNRLKCFSTKVENLPSI

SEQ ID NO: 2295161 - protein, 17 aa, Cryptosporidium parvum
INLTESHFKEIVSELEN

SEQ ID NO: 2295162 - protein, 25 aa, Cryptosporidium parvum
INLTGNPINEFFILNKSFPENIHII

SEQ ID NO: 2295163 - protein, 19 aa, Cryptosporidium parvum
INLVKLLIIRSIISSNSDT

SEQ ID NO: 2295164 - protein, 17 aa, Cryptosporidium parvum
INLYTGHVYSNWPTART

SEQ ID NO: 2295165 - protein, 18 aa, Cryptosporidium parvum
INNCSILTLPSGMDIDEI

SEQ ID NO: 2295166 - protein, 19 aa, Cryptosporidium parvum
INNCVANYMNFNWFDFKLN

SEQ ID NO: 2295167 - protein, 23 aa, Cryptosporidium parvum
INNEGIELWELVLEKDQQYGFAN

SEQ ID NO: 2295168 - protein, 17 aa, Cryptosporidium parvum
INNEMLALSKSNNVCSI

SEQ ID NO: 2295169 - protein, 19 aa, Cryptosporidium parvum
INNGYKSYCPVQIFNSDTI

SEQ ID NO: 2295170 - protein, 22 aa, Cryptosporidium parvum
INNHLKSSVSIRNIKYLYKITQ

SEQ ID NO: 2295171 - protein, 25 aa, Cryptosporidium parvum
INNISPSRLKIWSKKNKKNCNNNIK

SEQ ID NO: 2295172 - protein, 30 aa, Cryptosporidium parvum; identical to SEQ ID NO: 2173651

SEQ ID NO: 2295173 - protein, 18 aa, Cryptosporidium parvum
INNLCIDYSHPIKGVGTY

SEQ ID NO: 2295174 - protein, 25 aa, Cryptosporidium parvum
INNLLDLLLPWWFPNYNVEVNRNNN

SEQ ID NO: 2295175 - protein, 17 aa, Cryptosporidium parvum
INNPVLIWEKLIPLLNT

SEQ ID NO: 2295176 - protein, 25 aa, Cryptosporidium parvum
INNSNICFFSSIYFLAIHKINEFFS

SEQ ID NO: 2295177 - protein, 25 aa, Cryptosporidium parvum
INNSRILLCAITWMREVSSGNNSNN

SEQ ID NO: 2295178 - protein, 29 aa, Cryptosporidium parvum
INPFYFWDLRFGQSIVCDDAPKICNILKC

SEQ ID NO: 2295179 - protein, 24 aa, Cryptosporidium parvum
INPKEFHNSLAFAIGSIASCCSPS

SEQ ID NO: 2295180 - protein, 18 aa, Cryptosporidium parvum
INPSAWRWYHSVVGEERC

SEQ ID NO: 2295181 - protein, 21 aa, Cryptosporidium parvum
INPVDVIRTFLVLRKNSEHSH

SEQ ID NO: 2295182 - protein, 24 aa, Cryptosporidium parvum
INQNSKVYGCFQWLDQPEIGESIV

SEQ ID NO: 2295183 - protein, 22 aa, Cryptosporidium parvum
INRAESWLDIALNPNNDIKQLN

SEQ ID NO: 2295184 - protein, 18 aa, Cryptosporidium parvum
INRDFLLNSHATINNYNL

SEQ ID NO: 2295185 - protein, 24 aa, Cryptosporidium parvum
INRFVLEWRNIYRFENVIAGSVSI

SEQ ID NO: 2295186 - protein, 17 aa, Cryptosporidium parvum
INRRACGACLSDKEEDM

SEQ ID NO: 2295187 - protein, 17 aa, Cryptosporidium parvum
INRSEIELGSYISSNYN

SEQ ID NO: 2295188 - protein, 18 aa, Cryptosporidium parvum
INSAAMIVLTDWFNGKIS

SEQ ID NO: 2295189 - protein, 21 aa, Cryptosporidium parvum
INSDVGWGCMYRVTQMSIAHG

SEQ ID NO: 2295190 - protein, 25 aa, Cryptosporidium parvum
INSLIDLFHRIYRIMFQDLRNEVER

SEQ ID NO: 2295191 - protein, 21 aa, Cryptosporidium parvum
INSLRFSDCFMQPEKKCGSYP

SEQ ID NO: 2295192 - protein, 25 aa, Cryptosporidium parvum
INSMLRPALNIGKRTKSTGNLDDKD

SEQ ID NO: 2295193 - protein, 23 aa, Cryptosporidium parvum
INSPKVFACMCSRCLDDSENNLF

SEQ ID NO: 2295194 - protein, 17 aa, Cryptosporidium parvum
INSQAYLYFDILKVLGI

SEQ ID NO: 2295195 - protein, 17 aa, Cryptosporidium parvum
INSRRIEVIKAKLKVLQ

SEQ ID NO: 2295196 - protein, 17 aa, Cryptosporidium parvum
INSSCFRFGSLTLEGDK

SEQ ID NO: 2295197 - protein, 25 aa, Cryptosporidium parvum
INSWLEKQILIWNGIPINKLSGKNK

SEQ ID NO: 2295198 - protein, 23 aa, Cryptosporidium parvum
INTCLKILYTFQIRSELGYINPM

SEQ ID NO: 2295199 - protein, 19 aa, Cryptosporidium parvum
INTEFSLQPCRILDKSKKI

SEQ ID NO: 2295200 - protein, 18 aa, Cryptosporidium parvum
INTGECIKSFSGHNDRIW

SEQ ID NO: 2295201 - protein, 18 aa, Cryptosporidium parvum
INTNSNFCISKSFHSDVK

SEQ ID NO: 2295202 - protein, 26 aa, Cryptosporidium parvum
INVISCLKEMVELIKLENFNLHENLR

SEQ ID NO: 2295203 - protein, 26 aa, Cryptosporidium parvum
INWIKKIEIEIGIKIDLKYFLLSDYV

SEQ ID NO: 2295204 - protein, 30 aa, Cryptosporidium parvum
INWPETHGWWLYCCHNGWLTIKRSVLIEVP

SEQ ID NO: 2295205 - protein, 24 aa, Cryptosporidium parvum
INYRVLLCNHLNVGKGVNITAANH

SEQ ID NO: 2295206 - protein, 21 aa, Cryptosporidium parvum
IPASSPRFVRVNTNLVESSIN

SEQ ID NO: 2295207 - protein, 20 aa, Cryptosporidium parvum
IPAVGFSVGVERIMSIIEKK

SEQ ID NO: 2295208 - protein, 22 aa, Cryptosporidium parvum
IPCLRYLAKKLGEYGRNYYIDF

SEQ ID NO: 2295209 - protein, 19 aa, Cryptosporidium parvum
IPDAICFLSNSFFFKRVVI

SEQ ID NO: 2295210 - protein, 27 aa, Cryptosporidium parvum
IPDCAVRALSHCLLELTGINNDLKKIP

SEQ ID NO: 2295211 - protein, 31 aa, Cryptosporidium parvum; identical to SEQ ID NO: 2173700

SEQ ID NO: 2295212 - protein, 20 aa, Cryptosporidium parvum
IPDPLTVPFISCGDLSEYDP

SEQ ID NO: 2295213 - protein, 18 aa, Cryptosporidium parvum
IPDPPRFPTAALKIKQHT

SEQ ID NO: 2295214 - protein, 17 aa, Cryptosporidium parvum
IPDSCSLTSNIYIASSE

SEQ ID NO: 2295215 - protein, 26 aa, Cryptosporidium parvum
IPDVILKEYLYLMALVDDSKFIDVDK

SEQ ID NO: 2295216 - protein, 18 aa, Cryptosporidium parvum
IPECFLSKYGDMIRHSEI

SEQ ID NO: 2295217 - protein, 20 aa, Cryptosporidium parvum
IPEDLYFLIKRAVSIRKHLE

SEQ ID NO: 2295218 - protein, 17 aa, Cryptosporidium parvum
IPEDVGRPWCDIEKPYK

SEQ ID NO: 2295219 - protein, 24 aa, Cryptosporidium parvum
IPEIRLLTAKLCRALVTVTGQEKA

SEQ ID NO: 2295220 - protein, 22 aa, Cryptosporidium parvum
IPELEHWDMPFVKPKENVSEDE

SEQ ID NO: 2295221 - protein, 31 aa, Cryptosporidium parvum
IPELLCIECKRGLFSFEGFRYQCKQVKNSVS

SEQ ID NO: 2295222 - protein, 17 aa, Cryptosporidium parvum
IPELLNFDELKAQGNTD

SEQ ID NO: 2295223 - protein, 26 aa, Cryptosporidium parvum
IPENAIKVVLYKNGFIIDDEEFRDIS

SEQ ID NO: 2295224 - protein, 22 aa, Cryptosporidium parvum
IPERLLMERRMIMSRSSDSNSI

SEQ ID NO: 2295225 - protein, 19 aa, Cryptosporidium parvum
IPESFKLSKVTPENSSNYQ

SEQ ID NO: 2295226 - protein, 19 aa, Cryptosporidium parvum
IPETECFYATIDLPDPNGQ

SEQ ID NO: 2295227 - protein, 24 aa, Cryptosporidium parvum
IPETFLPVYMSQTFCTKNISYDFM

SEQ ID NO: 2295228 - protein, 24 aa, Cryptosporidium parvum
IPEVGELFSIHFQDLLEIYSKYFI

SEQ ID NO: 2295229 - protein, 17 aa, Cryptosporidium parvum
IPFDSALCIYDHNCPPT

SEQ ID NO: 2295230 - protein, 20 aa, Cryptosporidium parvum
IPFEMLKWMEFLIRMTRELV

SEQ ID NO: 2295231 - protein, 29 aa, Cryptosporidium parvum
IPFHSYEFLKHILCRSCSNCASYGSTTCL

SEQ ID NO: 2295232 - protein, 17 aa, Cryptosporidium parvum
IPFVAISGFVGDNMVER

SEQ ID NO: 2295233 - protein, 18 aa, Cryptosporidium parvum
IPGRRFPVNIYYTKSPEA

SEQ ID NO: 2295234 - protein, 19 aa, Cryptosporidium parvum
IPGSCERLEKILLQDLQSY

SEQ ID NO: 2295235 - protein, 23 aa, Cryptosporidium parvum
IPHFMKSRVYSIILDENKLESFL

SEQ ID NO: 2295236 - protein, 21 aa, Cryptosporidium parvum
IPICSIGSNFFHTRGTSGIIY

SEQ ID NO: 2295237 - protein, 24 aa, Cryptosporidium parvum
IPIDCFGLLCLEIVEFIGQKISEL

SEQ ID NO: 2295238 - protein, 21 aa, Cryptosporidium parvum
IPIILPKIDAIYKFNKVSPFN

SEQ ID NO: 2295239 - protein, 26 aa, Cryptosporidium parvum
IPIKDFKSYTLLYLKSRMNNTNNIEN

SEQ ID NO: 2295240 - protein, 17 aa, Cryptosporidium parvum
IPIKKRIENAVEGKKKT

SEQ ID NO: 2295241 - protein, 17 aa, Cryptosporidium parvum
IPIKRGTFIEYRTGMLN

SEQ ID NO: 2295242 - protein, 19 aa, Cryptosporidium parvum
IPILKTITVVLSFVTYIPI

SEQ ID NO: 2295243 - protein, 20 aa, Cryptosporidium parvum
IPILLTSSINPIWNVNQINQ

SEQ ID NO: 2295244 - protein, 19 aa, Cryptosporidium parvum
IPIPASPLVTILAFVPAIE

SEQ ID NO: 2295245 - protein, 24 aa, Cryptosporidium parvum
IPIPQEMRITIVLDLFSDMKKEIA

SEQ ID NO: 2295246 - protein, 17 aa, Cryptosporidium parvum
IPIPVKRTIEKPVPIGL

SEQ ID NO: 2295247 - protein, 17 aa, Cryptosporidium parvum
IPIQIGQLLAKKSTSAT

SEQ ID NO: 2295248 - protein, 23 aa, Cryptosporidium parvum
IPISHLVLCKAIFPERYEDCMNC

SEQ ID NO: 2295249 - protein, 17 aa, Cryptosporidium parvum
IPISMVYSRNLLGGAGL

SEQ ID NO: 2295250 - protein, 20 aa, Cryptosporidium parvum
IPITAPFRKLIRYFRDVAAI

SEQ ID NO: 2295251 - protein, 27 aa, Cryptosporidium parvum
IPKAKLPRKKMGNCNLINSFQNSDKRI

SEQ ID NO: 2295252 - protein, 22 aa, Cryptosporidium parvum
IPKIQIKPVVRNFCFSEKDVKY

SEQ ID NO: 2295253 - protein, 21 aa, Cryptosporidium parvum
IPKLIIRDDCEEFSEQDEESI

SEQ ID NO: 2295254 - protein, 23 aa, Cryptosporidium parvum
IPKLNYIHYILAIIQRINEIDFK

SEQ ID NO: 2295255 - protein, 23 aa, Cryptosporidium parvum
IPKLRINVLQVYYDIFGQDLELL

SEQ ID NO: 2295256 - protein, 27 aa, Cryptosporidium parvum
IPKRDFKRILLLIGDYAIHRFQDYGLQ

SEQ ID NO: 2295257 - protein, 26 aa, Cryptosporidium parvum
IPKTPPKLRIGWLLKQLGRVRLIHAL

SEQ ID NO: 2295258 - protein, 23 aa, Cryptosporidium parvum
IPKYAGEVIIVRFERSQIFPEEA

SEQ ID NO: 2295259 - protein, 22 aa, Cryptosporidium parvum
IPKYYEGIKISLGEAGREILRC

SEQ ID NO: 2295260 - protein, 29 aa, Cryptosporidium parvum
IPLDPRIVMRILFNFRKLYPVSYKTRIIK

SEQ ID NO: 2295261 - protein, 18 aa, Cryptosporidium parvum
IPLEDVIASISWIHCNAE

SEQ ID NO: 2295262 - protein, 18 aa, Cryptosporidium parvum
IPLEICFINENNIPIQLF

SEQ ID NO: 2295263 - protein, 30 aa, Cryptosporidium parvum
IPLISPIPHQFWYNHLIPQCNFGHIVPPPP

SEQ ID NO: 2295264 - protein, 22 aa, Cryptosporidium parvum
IPLLSISVDFYVRVFVKVKTSA

SEQ ID NO: 2295265 - protein, 23 aa, Cryptosporidium parvum
IPLNTRGLRRETMNWRIEKPCIN

SEQ ID NO: 2295266 - protein, 18 aa, Cryptosporidium parvum
IPLPESRLRDRYGQIHHP

SEQ ID NO: 2295267 - protein, 26 aa, Cryptosporidium parvum
IPLSRYKKSVISWNFQRKSGSAYPFW

SEQ ID NO: 2295268 - protein, 26 aa, Cryptosporidium parvum
IPMQMLKLPATHYVELKLRLNSKDLR

SEQ ID NO: 2295269 - protein, 20 aa, Cryptosporidium parvum
IPNAYALGDCALVRPRKLAE

SEQ ID NO: 2295270 - protein, 17 aa, Cryptosporidium parvum
IPNLPFLGKSIRVEEDI

SEQ ID NO: 2295271 - protein, 20 aa, Cryptosporidium parvum
IPNLPRGRRLQSLENLENCY

SEQ ID NO: 2295272 - protein, 31 aa, Cryptosporidium parvum
IPNNWKFQATVARKQLRQFTGLEETDFNLKE

SEQ ID NO: 2295273 - protein, 22 aa, Cryptosporidium parvum
IPNPEAILLIFSKIDLNQNYHL

SEQ ID NO: 2295274 - protein, 17 aa, Cryptosporidium parvum
IPNQLVLNASLLNELRQ

SEQ ID NO: 2295275 - protein, 18 aa, Cryptosporidium parvum
IPNSEPFGSPNFIANMYL

SEQ ID NO: 2295276 - protein, 18 aa, Cryptosporidium parvum
IPPDQQRLIFAGKQLEDG

SEQ ID NO: 2295277 - protein, 19 aa, Cryptosporidium parvum
IPPKLLKELGIQHVKGLIL

SEQ ID NO: 2295278 - protein, 18 aa, Cryptosporidium parvum
IPPNLHTKIARFLEIQGY

SEQ ID NO: 2295279 - protein, 18 aa, Cryptosporidium parvum
IPPNLPINADGSYLEKRQ

SEQ ID NO: 2295280 - protein, 20 aa, Cryptosporidium parvum
IPPRMSPLLRSQRQRLKQIL

SEQ ID NO: 2295281 - protein, 26 aa, Cryptosporidium parvum
IPPTIKCPRDFEIIFPTYPTEDTIKG

SEQ ID NO: 2295282 - protein, 17 aa, Cryptosporidium parvum
IPQCPPNGLNDLILDQI

SEQ ID NO: 2295283 - protein, 24 aa, Cryptosporidium parvum
IPQNRISDIQTIFHLFDKDKDGSI

SEQ ID NO: 2295284 - protein, 19 aa, Cryptosporidium parvum
IPQTCLKDQIKLFLENKNH

SEQ ID NO: 2295285 - protein, 19 aa, Cryptosporidium parvum
IPRIPRRRSRSPSLEEGQS

SEQ ID NO: 2295286 - protein, 24 aa, Cryptosporidium parvum
IPRKECQIPHEFVGIGLNTGENVP

SEQ ID NO: 2295287 - protein, 29 aa, Cryptosporidium parvum
IPRSDIPRKYVLLCLVDSIVRKCRSGSIF

SEQ ID NO: 2295288 - protein, 22 aa, Cryptosporidium parvum
IPRVSRCYECYPPPTQKTFPVC

SEQ ID NO: 2295289 - protein, 17 aa, Cryptosporidium parvum
IPSGVSFCSSSNTSRDL

SEQ ID NO: 2295290 - protein, 30 aa, Cryptosporidium parvum
IPSHGSHLPLLPPSRFPFQSEARRTINRLS

SEQ ID NO: 2295291 - protein, 19 aa, Cryptosporidium parvum
IPSIFLKGGQILPRNHSLE

SEQ ID NO: 2295292 - protein, 23 aa, Cryptosporidium parvum
IPSQNWPSNWVWLNTRYSVTLIN

SEQ ID NO: 2295293 - protein, 31 aa, Cryptosporidium parvum
IPSSVKSYQAYECWLCVREFANVLIHQPTHT

SEQ ID NO: 2295294 - protein, 25 aa, Cryptosporidium parvum
IPSVFRIVYILPEYAKALLKSYKIN

SEQ ID NO: 2295295 - protein, 17 aa, Cryptosporidium parvum
IPTIGVVADVSYKSKAQ

SEQ ID NO: 2295296 - protein, 28 aa, Cryptosporidium parvum
IPTLNSRISKLFGHSGPVKACICSKDKI

SEQ ID NO: 2295297 - protein, 23 aa, Cryptosporidium parvum
IPVCNKPMIWYPLSNLIQHRIRD

SEQ ID NO: 2295298 - protein, 17 aa, Cryptosporidium parvum
IPVLSLFLKLRLFLEGR

SEQ ID NO: 2295299 - protein, 17 aa, Cryptosporidium parvum
IPVMLRSKVCILHGKTA

SEQ ID NO: 2295300 - protein, 17 aa, Cryptosporidium parvum
IPVSIGWTLESTLLSIF

SEQ ID NO: 2295301 - protein, 17 aa, Cryptosporidium parvum
IPYETSIVLDVVNREVK

SEQ ID NO: 2295302 - protein, 18 aa, Cryptosporidium parvum
IPYLFWYHSSGKMQKEEL

SEQ ID NO: 2295303 - protein, 18 aa, Cryptosporidium parvum
IQAFKIKFEHILIDMESN

SEQ ID NO: 2295304 - protein, 27 aa, Cryptosporidium parvum
IQARHALKGLVLILSDLIIKLDESDSS

SEQ ID NO: 2295305 - protein, 17 aa, Cryptosporidium parvum
IQAWWRGEMVRRRLTLY

SEQ ID NO: 2295306 - protein, 17 aa, Cryptosporidium parvum
IQCLAAYTPKVKKMIFT

SEQ ID NO: 2295307 - protein, 18 aa, Cryptosporidium parvum
IQDILCPKIEAIYKDIPI

SEQ ID NO: 2295308 - protein, 24 aa, Cryptosporidium parvum
IQDIYCGRASTFFVLKDVNKNILQ

SEQ ID NO: 2295309 - protein, 17 aa, Cryptosporidium parvum
IQDSKLILDDLINDLNT

SEQ ID NO: 2295310 - protein, 24 aa, Cryptosporidium parvum
IQDSPEFLSFFGIITPNILESYDL

SEQ ID NO: 2295311 - protein, 24 aa, Cryptosporidium parvum
IQELLHKLQYIFREEEFSVVTRSE

SEQ ID NO: 2295312 - protein, 25 aa, Cryptosporidium parvum
IQFFKSLRISVGINDVTCARMLLSK

SEQ ID NO: 2295313 - protein, 19 aa, Cryptosporidium parvum
IQFPTHLVELALQEQEVKD

SEQ ID NO: 2295314 - protein, 18 aa, Cryptosporidium parvum
IQFQWKILPFDQKTGIKQ

SEQ ID NO: 2295315 - protein, 23 aa, Cryptosporidium parvum
IQFWDYRIGSLLDTFEEHEGPVR

SEQ ID NO: 2295316 - protein, 17 aa, Cryptosporidium parvum
IQGDLGFISSVYSSSDE

SEQ ID NO: 2295317 - protein, 25 aa, Cryptosporidium parvum
IQGKRLEVLESYLIEYLSTDQEDSS

SEQ ID NO: 2295318 - protein, 18 aa, Cryptosporidium parvum
IQGLLNLCGTSDEIEPNF

SEQ ID NO: 2295319 - protein, 26 aa, Cryptosporidium parvum
IQGRNRLDILLSQWVSYFSGRQSIDI

SEQ ID NO: 2295320 - protein, 20 aa, Cryptosporidium parvum
IQGYKFKIKYPLLGKAENSG

SEQ ID NO: 2295321 - protein, 43 aa, Cryptosporidium parvum
IQHLEYVVGSLFYRREMKQVKEEICIPPAFYGNTYLSLSSVER

SEQ ID NO: 2295322 - protein, 26 aa, Cryptosporidium parvum
IQHNFGIPIPFCLDNKATTVRLAIFL

SEQ ID NO: 2295323 - protein, 17 aa, Cryptosporidium parvum
IQIAQLALKHRLNKNLR

SEQ ID NO: 2295324 - protein, 21 aa, Cryptosporidium parvum
IQIASMVYYFKVYEFNRNQEF

SEQ ID NO: 2295325 - protein, 19 aa, Cryptosporidium parvum
IQIEIDYLYDLRYIPVVSI

SEQ ID NO: 2295326 - protein, 19 aa, Cryptosporidium parvum
IQIIHYWGGDVIKFSGDAI

SEQ ID NO: 2295327 - protein, 17 aa, Cryptosporidium parvum
IQILLGFNTKSEIIKFI

SEQ ID NO: 2295328 - protein, 25 aa, Cryptosporidium parvum
IQILSENILQFWKSYFHPNSTYITP

SEQ ID NO: 2295329 - protein, 21 aa, Cryptosporidium parvum
IQINARIGALERFQRCLRLTF

SEQ ID NO: 2295330 - protein, 28 aa, Cryptosporidium parvum
IQINNSKLCICLNCNQTGHVNCGRQAPM

SEQ ID NO: 2295331 - protein, 21 aa, Cryptosporidium parvum
IQKERLGMLLGELKGYSLYQT

SEQ ID NO: 2295332 - protein, 29 aa, Cryptosporidium parvum
IQKGTNWPVWENLGSIYLRGTIADLENCF

SEQ ID NO: 2295333 - protein, 18 aa, Cryptosporidium parvum
IQKILSIPVFVNPDLCEV

SEQ ID NO: 2295334 - protein, 22 aa, Cryptosporidium parvum
IQKKFSLLMVLGRPSRELDTGI

SEQ ID NO: 2295335 - protein, 29 aa, Cryptosporidium parvum
IQKLREYSAIFGRSWNRIILDEAHRIKAR

SEQ ID NO: 2295336 - protein, 26 aa, Cryptosporidium parvum
IQKLSFFFNKFRVVDEDLSWPIIDQG

SEQ ID NO: 2295337 - protein, 23 aa, Cryptosporidium parvum
IQKRFSEFVLLQSLLVERGLSLL

SEQ ID NO: 2295338 - protein, 27 aa, Cryptosporidium parvum
IQKSVLPNKRRSISIGQSRNDDSETTR

SEQ ID NO: 2295339 - protein, 25 aa, Cryptosporidium parvum
IQLACPRLSTDWGAYYKKPILNSYE

SEQ ID NO: 2295340 - protein, 17 aa, Cryptosporidium parvum
IQLFKVGPRALPFDPLN

SEQ ID NO: 2295341 - protein, 26 aa, Cryptosporidium parvum
IQLIAIPLYASMSFDEQKKAFKLPES

SEQ ID NO: 2295342 - protein, 19 aa, Cryptosporidium parvum
IQLPSGTHFCMYVKHKLLF

SEQ ID NO: 2295343 - protein, 26 aa, Cryptosporidium parvum
IQLRDFKKFFKTICSTLSLDYKTTSP

SEQ ID NO: 2295344 - protein, 24 aa, Cryptosporidium parvum
IQLSCLDSSIAMRPILKRYQSIVL

SEQ ID NO: 2295345 - protein, 24 aa, Cryptosporidium parvum
IQLTQLPVILGIPLKQIDFLDLLS

SEQ ID NO: 2295346 - protein, 17 aa, Cryptosporidium parvum
IQLVLNLVFILRNYVSV

SEQ ID NO: 2295347 - protein, 25 aa, Cryptosporidium parvum
IQMQCIPIGLKLRDMIGIAETGSGK

SEQ ID NO: 2295348 - protein, 18 aa, Cryptosporidium parvum
IQMQICAIFKRILDPKTM

SEQ ID NO: 2295349 - protein, 18 aa, Cryptosporidium parvum
IQNALPVSKFDLSRSQNL

SEQ ID NO: 2295350 - protein, 25 aa, Cryptosporidium parvum
IQNDLKELWSLIDFVYPGKLGTLPV

SEQ ID NO: 2295351 - protein, 19 aa, Cryptosporidium parvum
IQNKICRDFHCCGEGGEYE

SEQ ID NO: 2295352 - protein, 25 aa, Cryptosporidium parvum
IQNMPRNIFLCGGNWLNSNIEHGHP

SEQ ID NO: 2295353 - protein, 22 aa, Cryptosporidium parvum
IQNWKRRLEITSKLNYNMVHFT

SEQ ID NO: 2295354 - protein, 24 aa, Cryptosporidium parvum
IQNYLACRLCEFDVVVVKKKDAKF

SEQ ID NO: 2295355 - protein, 18 aa, Cryptosporidium parvum
IQPFAEVFVVKSIDINAD

SEQ ID NO: 2295356 - protein, 17 aa, Cryptosporidium parvum
IQPLQGIEQNIGENIQI

SEQ ID NO: 2295357 - protein, 21 aa, Cryptosporidium parvum
IQQRPCIWILYGPNNQLRDEF

SEQ ID NO: 2295358 - protein, 22 aa, Cryptosporidium parvum
IQRKCFPSILAGRDVVAMARTG

SEQ ID NO: 2295359 - protein, 22 aa, Cryptosporidium parvum
IQRNKCCIACSDKLIDKIHKDE

SEQ ID NO: 2295360 - protein, 17 aa, Cryptosporidium parvum
IQRPFILTRSFYIGSHC

SEQ ID NO: 2295361 - protein, 24 aa, Cryptosporidium parvum
IQSFFPKGVPSYIIYGNKIDFSVK

SEQ ID NO: 2295362 - protein, 20 aa, Cryptosporidium parvum
IQSILKWGSNTYRKAIFEKM

SEQ ID NO: 2295363 - protein, 18 aa, Cryptosporidium parvum
IQSLKHWNEYGGMSPEEH

SEQ ID NO: 2295364 - protein, 25 aa, Cryptosporidium parvum
IQSLRMIQKIDQFRVGSINQSSDIK

SEQ ID NO: 2295365 - protein, 18 aa, Cryptosporidium parvum
IQSNIRFQYMESKALAEK

SEQ ID NO: 2295366 - protein, 18 aa, Cryptosporidium parvum
IQSSIPINEMNGFNVKVD

SEQ ID NO: 2295367 - protein, 23 aa, Cryptosporidium parvum
IQTCNLMSLIKALICITNPNSLS

SEQ ID NO: 2295368 - protein, 18 aa, Cryptosporidium parvum
IQTEFGWNTYKSSDELPH

SEQ ID NO: 2295369 - protein, 26 aa, Cryptosporidium parvum
IQTKLKSFCILLDYDSVIILKNTYLY

SEQ ID NO: 2295370 - protein, 25 aa, Cryptosporidium parvum
IQTRRVSLKNGFNCPQSHCKSKKSL

SEQ ID NO: 2295371 - protein, 26 aa, Cryptosporidium parvum
IQVYLYKSWLVHWSLFPLFTQYFRES

SEQ ID NO: 2295372 - protein, 17 aa, Cryptosporidium parvum
IQYAKELFEKELLPHVG

SEQ ID NO: 2295373 - protein, 24 aa, Cryptosporidium parvum
IQYSRLNFCDELLIENILSIEKMD

SEQ ID NO: 2295374 - protein, 17 aa, Cryptosporidium parvum
IRAACRVLNSIGNYVDI

SEQ ID NO: 2295375 - protein, 21 aa, Cryptosporidium parvum
IRAHLKYIGFPIVRDILYSDK

SEQ ID NO: 2295376 - protein, 17 aa, Cryptosporidium parvum
IRALCAGFMIVHDENSA

SEQ ID NO: 2295377 - protein, 26 aa, Cryptosporidium parvum
IRAYLIRLAQNFGCSNECFVLAIIYV

SEQ ID NO: 2295378 - protein, 21 aa, Cryptosporidium parvum
IRCLLPEKYIYGLSDRMIVEF

SEQ ID NO: 2295379 - protein, 25 aa, Cryptosporidium parvum
IRDERFEPIFKFFRSKIYLDSFSND

SEQ ID NO: 2295380 - protein, 33 aa, Cryptosporidium parvum
IRDWPINVLEKFACCLRIEIFMDNDIILEMGPC

SEQ ID NO: 2295381 - protein, 17 aa, Cryptosporidium parvum
IREGKIKASDAYTLKDN

SEQ ID NO: 2295382 - protein, 22 aa, Cryptosporidium parvum
IREIPVPSIVDLIGIVRHFSPS

SEQ ID NO: 2295383 - protein, 20 aa, Cryptosporidium parvum
IREKINYAYLFEKIMFAHEL

SEQ ID NO: 2295384 - protein, 23 aa, Cryptosporidium parvum
IREKKDCIHFTGFKTEDYSVIKS

SEQ ID NO: 2295385 - protein, 19 aa, Cryptosporidium parvum
IRELFEIPMQMLKLPATHY

SEQ ID NO: 2295386 - protein, 19 aa, Cryptosporidium parvum
IRELYRFIPDISEEELLNR

SEQ ID NO: 2295387 - protein, 22 aa, Cryptosporidium parvum
IRESLKLIPRKSKIEFEQNRNP

SEQ ID NO: 2295388 - protein, 17 aa, Cryptosporidium parvum
IRFDKKGIPKDCKGEDK

SEQ ID NO: 2295389 - protein, 18 aa, Cryptosporidium parvum
IRFRAKKAFMISTTDLNS

SEQ ID NO: 2295390 - protein, 24 aa, Cryptosporidium parvum
IRFSESHIKCLLKQIILGINELHN

SEQ ID NO: 2295391 - protein, 18 aa, Cryptosporidium parvum
IRFYSILNGIEWSGIFAI

SEQ ID NO: 2295392 - protein, 19 aa, Cryptosporidium parvum
IRGEGLKSSEMINEVEGSK

SEQ ID NO: 2295393 - protein, 26 aa, Cryptosporidium parvum
IRGEILKLIQVCLLTIWSQYKGLGAF

SEQ ID NO: 2295394 - protein, 19 aa, Cryptosporidium parvum
IRGEWLLEISPKYYNLEDF

SEQ ID NO: 2295395 - protein, 20 aa, Cryptosporidium parvum
IRGGFLCDEMGLGKSLEIIT

SEQ ID NO: 2295396 - protein, 18 aa, Cryptosporidium parvum
IRGHCKLFGKLKIVLLEG

SEQ ID NO: 2295397 - protein, 27 aa, Cryptosporidium parvum
IRGIFQSCIVLLWRLESIVFEILNIIK

SEQ ID NO: 2295398 - protein, 19 aa, Cryptosporidium parvum
IRGSSSLNNLRSWDSNSKS

SEQ ID NO: 2295399 - protein, 19 aa, Cryptosporidium parvum
IRIDLWLELANFISTTTNC

SEQ ID NO: 2295400 - protein, 17 aa, Cryptosporidium parvum
IRIFRYNGDLLKRVNFD

SEQ ID NO: 2295401 - protein, 26 aa, Cryptosporidium parvum
IRILFQRDKLFLSWVNYHKGSLRRLC

SEQ ID NO: 2295402 - protein, 21 aa, Cryptosporidium parvum
IRILRDYKRVMNIRDNEVVQK

SEQ ID NO: 2295403 - protein, 26 aa, Cryptosporidium parvum
IRIPTEGNWLFSLFCSINNKLVEFNI

SEQ ID NO: 2295404 - protein, 26 aa, Cryptosporidium parvum
IRIRIQYEFTNHLPVLFLSENSELVK

SEQ ID NO: 2295405 - protein, 17 aa, Cryptosporidium parvum
IRISHIVYKEGMKGYSI

SEQ ID NO: 2295406 - protein, 20 aa, Cryptosporidium parvum
IRIVLEGSYYISILLSPFIT

SEQ ID NO: 2295407 - protein, 18 aa, Cryptosporidium parvum
IRIVSIRCDIEGIKMDKE

SEQ ID NO: 2295408 - protein, 18 aa, Cryptosporidium parvum
IRIWRCGGEIVAEKKSRV

SEQ ID NO: 2295409 - protein, 23 aa, Cryptosporidium parvum
IRKAYLKAAMKWHPDKMNSSTNG

SEQ ID NO: 2295410 - protein, 17 aa, Cryptosporidium parvum
IRKEHKVKIDKRFGRMF

SEQ ID NO: 2295411 - protein, 19 aa, Cryptosporidium parvum
IRKEYRRELLDNSLRKFEM

SEQ ID NO: 2295412 - protein, 19 aa, Cryptosporidium parvum
IRKFEGWENLEKVFTDDKE

SEQ ID NO: 2295413 - protein, 18 aa, Cryptosporidium parvum
IRKHCIYPVIGHQDRILL

SEQ ID NO: 2295414 - protein, 17 aa, Cryptosporidium parvum
IRKIGFDLSDKLSKTEF

SEQ ID NO: 2295415 - protein, 25 aa, Cryptosporidium parvum
IRKKIGPLFLNFEIPMFNLSNIQVK

SEQ ID NO: 2295416 - protein, 22 aa, Cryptosporidium parvum
IRLELLPFLAKNQHVPGSELWG

SEQ ID NO: 2295417 - protein, 20 aa, Cryptosporidium parvum
IRLSNKWPEYIKLGDSTVDR

SEQ ID NO: 2295418 - protein, 31 aa, Cryptosporidium parvum; identical to SEQ ID NO: 2173890

SEQ ID NO: 2295419 - protein, 18 aa, Cryptosporidium parvum
IRNDIDFQEELKFKVQER

SEQ ID NO: 2295420 - protein, 18 aa, Cryptosporidium parvum
IRNGIHSIKSYKEVDDDA

SEQ ID NO: 2295421 - protein, 28 aa, Cryptosporidium parvum
IRNHQEWEDFVGVCWPGKVKYPDFLNPK

SEQ ID NO: 2295422 - protein, 19 aa, Cryptosporidium parvum
IRNIPDLMTMLDLSDIPPH

SEQ ID NO: 2295423 - protein, 22 aa, Cryptosporidium parvum
IRNLERYERFIGSTKLLEEVSI

SEQ ID NO: 2295424 - protein, 19 aa, Cryptosporidium parvum
IRNLIPFVINDLVIALFWD

SEQ ID NO: 2295425 - protein, 20 aa, Cryptosporidium parvum
IRNLSRFIAVQKFENLSWRS

SEQ ID NO: 2295426 - protein, 17 aa, Cryptosporidium parvum
IRNMLLPLINVIQNLDN

SEQ ID NO: 2295427 - protein, 20 aa, Cryptosporidium parvum
IRNQFPYNLVGCIDDVEYWN

SEQ ID NO: 2295428 - protein, 17 aa, Cryptosporidium parvum
IRNSISFRYSFMKSKVA

SEQ ID NO: 2295429 - protein, 22 aa, Cryptosporidium parvum
IRNWKDCHVLEIQTELIRNIGY

SEQ ID NO: 2295430 - protein, 21 aa, Cryptosporidium parvum
IRPKRAAAIKAEESIQKKIQS

SEQ ID NO: 2295431 - protein, 17 aa, Cryptosporidium parvum
IRPKTDLTRYVRYPRYI

SEQ ID NO: 2295432 - protein, 17 aa, Cryptosporidium parvum
IRQLLRFKYKNGLPINS

SEQ ID NO: 2295433 - protein, 19 aa, Cryptosporidium parvum
IRQNLTLAINFLVSLLKKN

SEQ ID NO: 2295434 - protein, 24 aa, Cryptosporidium parvum
IRQNSIRFYALFWDTVKHVVYRVN

SEQ ID NO: 2295435 - protein, 18 aa, Cryptosporidium parvum
IRQWKFKGDEFGDSGMIS

SEQ ID NO: 2295436 - protein, 17 aa, Cryptosporidium parvum
IRRCQRLASQSSEMGNL

SEQ ID NO: 2295437 - protein, 24 aa, Cryptosporidium parvum
IRRGPTQHCVDSFKAFDSSLTSTI

SEQ ID NO: 2295438 - protein, 27 aa, Cryptosporidium parvum
IRRKAYLALICALEIKPAIIEENADIL

SEQ ID NO: 2295439 - protein, 21 aa, Cryptosporidium parvum
IRRRLHFSRQKSDIMIDGTRI

SEQ ID NO: 2295440 - protein, 28 aa, Cryptosporidium parvum
IRRRVYDVLNVLLAIGVVRRSVGVGKNL

SEQ ID NO: 2295441 - protein, 30 aa, Cryptosporidium parvum
IRRTCLSPRSTPIVLEINFCPKLLSEEKSL

SEQ ID NO: 2295442 - protein, 25 aa, Cryptosporidium parvum
IRSFKPNPMCFHRTVTPIQRRRKIT

SEQ ID NO: 2295443 - protein, 28 aa, Cryptosporidium parvum
IRSKAICCLTKLFQCCPDRLRANEWGER

SEQ ID NO: 2295444 - protein, 18 aa, Cryptosporidium parvum
IRSKRSGNIYALKVMSVE

SEQ ID NO: 2295445 - protein, 18 aa, Cryptosporidium parvum
IRSKYWIEALRAYVNQSK

SEQ ID NO: 2295446 - protein, 21 aa, Cryptosporidium parvum
IRSLGCSFSKLVPSPKTSLTA

SEQ ID NO: 2295447 - protein, 19 aa, Cryptosporidium parvum
IRSRIRRIREKLGNYQNSD

SEQ ID NO: 2295448 - protein, 30 aa, Cryptosporidium parvum; identical to SEQ ID NO: 2173915

SEQ ID NO: 2295449 - protein, 18 aa, Cryptosporidium parvum
IRSSSFILFHSLLDKYFK

SEQ ID NO: 2295450 - protein, 23 aa, Cryptosporidium parvum
IRSVCTEAGMFAIRARRKSISEK

SEQ ID NO: 2295451 - protein, 20 aa, Cryptosporidium parvum
IRTDFLLGLLKMELLNGSKL

SEQ ID NO: 2295452 - protein, 21 aa, Cryptosporidium parvum
IRTGDLLLEFGSLKSESELHS

SEQ ID NO: 2295453 - protein, 20 aa, Cryptosporidium parvum
IRTLVLPKLYTYINYLFINQ

SEQ ID NO: 2295454 - protein, 20 aa, Cryptosporidium parvum
IRTVKVCPLPSAGSSMKSNR

SEQ ID NO: 2295455 - protein, 18 aa, Cryptosporidium parvum
IRTYSKVCIKIILNNADW

SEQ ID NO: 2295456 - protein, 26 aa, Cryptosporidium parvum
IRWHPRGPCIFGGGVDGTGWLWMAPD

SEQ ID NO: 2295457 - protein, 18 aa, Cryptosporidium parvum
IRYGRKDPIESWLHNLLC

SEQ ID NO: 2295458 - protein, 18 aa, Cryptosporidium parvum
IRYIFNRLILESSAVRAA

SEQ ID NO: 2295459 - protein, 17 aa, Cryptosporidium parvum
IRYISALKDSNCEVDPH

SEQ ID NO: 2295460 - protein, 25 aa, Cryptosporidium parvum
IRYKWKEVYDDIPVVKYVPKFDVEV

SEQ ID NO: 2295461 - protein, 20 aa, Cryptosporidium parvum
ISAAKKLFYAPLLPNTLIEI

SEQ ID NO: 2295462 - protein, 25 aa, Cryptosporidium parvum
ISAKCKLTTGIPCEPMLARPTKGIQ

SEQ ID NO: 2295463 - protein, 24 aa, Cryptosporidium parvum
ISAKPCPKVFTILMEIIKIKVDMK

SEQ ID NO: 2295464 - protein, 19 aa, Cryptosporidium parvum
ISALYGEEQFCPIVGDTKE

SEQ ID NO: 2295465 - protein, 19 aa, Cryptosporidium parvum
ISAPTPIKIVPKIIPKPAI

SEQ ID NO: 2295466 - protein, 20 aa, Cryptosporidium parvum
ISARAMLKFVKGLTPTQLGI

SEQ ID NO: 2295467 - protein, 22 aa, Cryptosporidium parvum
ISCIYKCHCDIIQDKFWHENDH

SEQ ID NO: 2295468 - protein, 23 aa, Cryptosporidium parvum
ISCVDSRCLLSYSDVIIANSLNL

SEQ ID NO: 2295469 - protein, 18 aa, Cryptosporidium parvum
ISCYLCTFNPLKADEVVI

SEQ ID NO: 2295470 - protein, 25 aa, Cryptosporidium parvum
ISCYTCNKRVHYTCIWQDYERFIEQ

SEQ ID NO: 2295471 - protein, 18 aa, Cryptosporidium parvum
ISDMLAFEVARKFIQTRF

SEQ ID NO: 2295472 - protein, 17 aa, Cryptosporidium parvum
ISDNYSRRFILRLFRQF

SEQ ID NO: 2295473 - protein, 19 aa, Cryptosporidium parvum
ISDWACVDSVIGIIKCIFA

SEQ ID NO: 2295474 - protein, 21 aa, Cryptosporidium parvum
ISEALGFGTKCCSKCIFEGEK

SEQ ID NO: 2295475 - protein, 17 aa, Cryptosporidium parvum
ISEALKTQHSRSKVNKI

SEQ ID NO: 2295476 - protein, 27 aa, Cryptosporidium parvum
ISEAYCLRLRFLIFRRRNIIEWEKMTK

SEQ ID NO: 2295477 - protein, 18 aa, Cryptosporidium parvum
ISEECCLNVAKTVLSSKL

SEQ ID NO: 2295478 - protein, 27 aa, Cryptosporidium parvum
ISEENCFFRRLLLLIPFSLSLLKSVDE

SEQ ID NO: 2295479 - protein, 17 aa, Cryptosporidium parvum
ISEFCFTELNNIIPISL

SEQ ID NO: 2295480 - protein, 17 aa, Cryptosporidium parvum
ISEGIYWKFRNKLQESV

SEQ ID NO: 2295481 - protein, 21 aa, Cryptosporidium parvum
ISEHLFKLWSKEFGELHFHSN

SEQ ID NO: 2295482 - protein, 26 aa, Cryptosporidium parvum
ISEIRWFSFTSLPNWHANQSLRHRKP

SEQ ID NO: 2295483 - protein, 17 aa, Cryptosporidium parvum
ISEKYGQQNNYRWVRYV

SEQ ID NO: 2295484 - protein, 18 aa, Cryptosporidium parvum
ISELLVRLNSSIGRANNK

SEQ ID NO: 2295485 - protein, 23 aa, Cryptosporidium parvum
ISEMHVYETYWNAMRIVHENIVN

SEQ ID NO: 2295486 - protein, 22 aa, Cryptosporidium parvum
ISEQFLLALSFLRKMKLTHTDL

SEQ ID NO: 2295487 - protein, 18 aa, Cryptosporidium parvum
ISERCFGSVINKFIEFNR

SEQ ID NO: 2295488 - protein, 18 aa, Cryptosporidium parvum
ISERINILKSMIKSTKKE

SEQ ID NO: 2295489 - protein, 23 aa, Cryptosporidium parvum
ISEVEGRLSVYMTIASKGFNGCW

SEQ ID NO: 2295490 - protein, 21 aa, Cryptosporidium parvum
ISEVNPELIFEFQKYSKSSIQ

SEQ ID NO: 2295491 - protein, 24 aa, Cryptosporidium parvum
ISEVPYLAGPFVYKKKNFVTIQIE

SEQ ID NO: 2295492 - protein, 25 aa, Cryptosporidium parvum
ISEVTYGWSCLPIGIRDEFLDLCTK

SEQ ID NO: 2295493 - protein, 20 aa, Cryptosporidium parvum
ISEYKRMLWTEVNVKTLKTN

SEQ ID NO: 2295494 - protein, 24 aa, Cryptosporidium parvum
ISFDEALQICRERGLSSIKNQQAL

SEQ ID NO: 2295495 - protein, 19 aa, Cryptosporidium parvum
ISFFKKCIVPPRRIIEDDC

SEQ ID NO: 2295496 - protein, 19 aa, Cryptosporidium parvum
ISFFLPLVRHIFSNLQVAY

SEQ ID NO: 2295497 - protein, 25 aa, Cryptosporidium parvum
ISGGLEFWDPWTMTLPRRNIQDNEL

SEQ ID NO: 2295498 - protein, 17 aa, Cryptosporidium parvum
ISGHKGWVRSIAVDPSN

SEQ ID NO: 2295499 - protein, 30 aa, Cryptosporidium parvum; identical to SEQ ID NO: 2173959

SEQ ID NO: 2295500 - protein, 24 aa, Cryptosporidium parvum
ISGLKLSYCLNFKANALIQILSNC

SEQ ID NO: 2295501 - protein, 25 aa, Cryptosporidium parvum
ISGLYEIIKGLKFLHNDGKLLHGNI

SEQ ID NO: 2295502 - protein, 25 aa, Cryptosporidium parvum
ISGMEYCYINRICHRDLKPENILLD

SEQ ID NO: 2295503 - protein, 24 aa, Cryptosporidium parvum
ISGRFKFSASEGIQLIKESICLHP

SEQ ID NO: 2295504 - protein, 21 aa, Cryptosporidium parvum
ISGRIKDMIIIRGRNFYPQDI

SEQ ID NO: 2295505 - protein, 18 aa, Cryptosporidium parvum
ISGSLLAIGLEDGVVDIW

SEQ ID NO: 2295506 - protein, 17 aa, Cryptosporidium parvum
ISGSLWNANNWHWEEKD

SEQ ID NO: 2295507 - protein, 17 aa, Cryptosporidium parvum
ISGTINIVMSNSDEIEK

SEQ ID NO: 2295508 - protein, 20 aa, Cryptosporidium parvum
ISGTPILGVMLDSIWMKDSD

SEQ ID NO: 2295509 - protein, 18 aa, Cryptosporidium parvum
ISGVSFVGPEPGFKDHPI

SEQ ID NO: 2295510 - protein, 17 aa, Cryptosporidium parvum
ISHLICHLVTLHGNSED

SEQ ID NO: 2295511 - protein, 17 aa, Cryptosporidium parvum
ISHPVILGISKILSDTL

SEQ ID NO: 2295512 - protein, 24 aa, Cryptosporidium parvum
ISHSRFKVFSWNVLAEIYASQEAF

SEQ ID NO: 2295513 - protein, 22 aa, Cryptosporidium parvum
ISHSTMVLCIIRDLDNYYLSTW

SEQ ID NO: 2295514 - protein, 27 aa, Cryptosporidium parvum
ISHYFEFPDLITIIYRFPFYINPMKLS

SEQ ID NO: 2295515 - protein, 31 aa, Cryptosporidium parvum
ISIEDFWFDYRIWCFLFKVRLEKIQSINQFI

SEQ ID NO: 2295516 - protein, 20 aa, Cryptosporidium parvum
ISIEFWRIFRDFCKTKFGEN

SEQ ID NO: 2295517 - protein, 18 aa, Cryptosporidium parvum
ISIIKKFKTSYINQNLFK

SEQ ID NO: 2295518 - protein, 29 aa, Cryptosporidium parvum
ISIIRIPIYPNRCVFLSSIGGGLSSSSIN

SEQ ID NO: 2295519 - protein, 25 aa, Cryptosporidium parvum
ISIIRPDRQIAIFSATFPNIIEQFT

SEQ ID NO: 2295520 - protein, 24 aa, Cryptosporidium parvum
ISIKEAACHVGITLCSHLRHSDRV

SEQ ID NO: 2295521 - protein, 23 aa, Cryptosporidium parvum
ISIPSCGKKTIAVDKTENKDIHQ

SEQ ID NO: 2295522 - protein, 19 aa, Cryptosporidium parvum
ISIVFKVSGGTQFNISVPR

SEQ ID NO: 2295523 - protein, 19 aa, Cryptosporidium parvum
ISKCREIAGKFAFEKGVEI

SEQ ID NO: 2295524 - protein, 23 aa, Cryptosporidium parvum
ISKDEWRILTAVEMGMRNHEYVS

SEQ ID NO: 2295525 - protein, 28 aa, Cryptosporidium parvum
ISKDKKMICSMLYDIPNFVKQLSNHNQG

SEQ ID NO: 2295526 - protein, 17 aa, Cryptosporidium parvum
ISKELKEKLGLDNSSKS

SEQ ID NO: 2295527 - protein, 27 aa, Cryptosporidium parvum
ISKEMRRLCSILTFLFDSKNSGCLEFT

SEQ ID NO: 2295528 - protein, 25 aa, Cryptosporidium parvum
ISKFPRQIIRYCFGGTPLYSESPKK

SEQ ID NO: 2295529 - protein, 23 aa, Cryptosporidium parvum
ISKGEGLIPVLFKFDLAEDRCTK

SEQ ID NO: 2295530 - protein, 17 aa, Cryptosporidium parvum
ISKKEGSIHKFIENIEK

SEQ ID NO: 2295531 - protein, 20 aa, Cryptosporidium parvum
ISKKLSIKFLENIIKKFNNC

SEQ ID NO: 2295532 - protein, 17 aa, Cryptosporidium parvum
ISKLAPNYKILVSYFKQ

SEQ ID NO: 2295533 - protein, 20 aa, Cryptosporidium parvum
ISKLFLKSGQYGLLLDQVNE

SEQ ID NO: 2295534 - protein, 18 aa, Cryptosporidium parvum
ISKLKPIFAKLAPPNIVK

SEQ ID NO: 2295535 - protein, 21 aa, Cryptosporidium parvum
ISKLPQIVLHISMCNKEFVER

SEQ ID NO: 2295536 - protein, 26 aa, Cryptosporidium parvum
ISKLPYYLFIHFSRFSKANLNLEKNK

SEQ ID NO: 2295537 - protein, 24 aa, Cryptosporidium parvum
ISKNGFSNQEWVMHYWKEIPLPFS

SEQ ID NO: 2295538 - protein, 26 aa, Cryptosporidium parvum
ISKNKKLLVFLIWQIVNNPEIHYKVS

SEQ ID NO: 2295539 - protein, 21 aa, Cryptosporidium parvum
ISKNLYDWALILAKNGNVSNS

SEQ ID NO: 2295540 - protein, 22 aa, Cryptosporidium parvum
ISKNYNHRFGFFGHLINKIIIY

SEQ ID NO: 2295541 - protein, 30 aa, Cryptosporidium parvum
ISKPNTKVFWTWGVLDGEISFSAKFYTDKI

SEQ ID NO: 2295542 - protein, 23 aa, Cryptosporidium parvum
ISKRSSFENVERWLKELRDHADP

SEQ ID NO: 2295543 - protein, 22 aa, Cryptosporidium parvum
ISKSPIRLCNSVGLIDAGYRGE

SEQ ID NO: 2295544 - protein, 23 aa, Cryptosporidium parvum
ISKSYCPYCIKAINSLKSAGYSP

SEQ ID NO: 2295545 - protein, 21 aa, Cryptosporidium parvum
ISKTRSCTVTDEIFKEDACNS

SEQ ID NO: 2295546 - protein, 18 aa, Cryptosporidium parvum
ISKVLLEEARAKRANKLT

SEQ ID NO: 2295547 - protein, 25 aa, Cryptosporidium parvum
ISKYKLRGMDWYKYLNVSNCYDVQN

SEQ ID NO: 2295548 - protein, 29 aa, Cryptosporidium parvum
ISLDKWNSDWIKRCMKIGNYISNKYYEHK

SEQ ID NO: 2295549 - protein, 21 aa, Cryptosporidium parvum
ISLEELKRGYELNNVLQDHLM

SEQ ID NO: 2295550 - protein, 26 aa, Cryptosporidium parvum
ISLESKLLVLDYWKFMNLKERNQQKI

SEQ ID NO: 2295551 - protein, 26 aa, Cryptosporidium parvum
ISLFGKYTWSWISPRLLHGVSSTPTT

SEQ ID NO: 2295552 - protein, 19 aa, Cryptosporidium parvum
ISLIKRLIKKEGNEKENSQ

SEQ ID NO: 2295553 - protein, 18 aa, Cryptosporidium parvum
ISLKSELLISSSTISSKL

SEQ ID NO: 2295554 - protein, 28 aa, Cryptosporidium parvum
ISLLKKEWKKAFYLILGFDEEKMISYST

SEQ ID NO: 2295555 - protein, 21 aa, Cryptosporidium parvum
ISLLTFCYGYFPDQVILFILK

SEQ ID NO: 2295556 - protein, 21 aa, Cryptosporidium parvum
ISLPEGFTILGSIQSKSDCSE

SEQ ID NO: 2295557 - protein, 19 aa, Cryptosporidium parvum
ISLQDVWYSLISLGVVNEH

SEQ ID NO: 2295558 - protein, 24 aa, Cryptosporidium parvum
ISLQRFCAGLNFILQGKVIITNRL

SEQ ID NO: 2295559 - protein, 17 aa, Cryptosporidium parvum
ISLSEILTSEIINELKQ

SEQ ID NO: 2295560 - protein, 23 aa, Cryptosporidium parvum
ISLSILLRLNIKSVQEKNLDEIY

SEQ ID NO: 2295561 - protein, 18 aa, Cryptosporidium parvum
ISLSNCDVPWPLTGGDQF

SEQ ID NO: 2295562 - protein, 25 aa, Cryptosporidium parvum
ISLSWFCLNCLQTIVGDSVCLCGVD

SEQ ID NO: 2295563 - protein, 20 aa, Cryptosporidium parvum
ISLYHALSFYNAIYSEDFGY

SEQ ID NO: 2295564 - protein, 17 aa, Cryptosporidium parvum
ISMLLHPKFDKSRIDTC

SEQ ID NO: 2295565 - protein, 18 aa, Cryptosporidium parvum
ISNDGSFKSQQLFNNNIV

SEQ ID NO: 2295566 - protein, 31 aa, Cryptosporidium parvum
ISNETKLLWENLEKLVFSYSNFVYKYNILTL

SEQ ID NO: 2295567 - protein, 18 aa, Cryptosporidium parvum
ISNFIYSWLNVTRFYCVF

SEQ ID NO: 2295568 - protein, 22 aa, Cryptosporidium parvum
ISNHAKFTWRDISFALNKVKPR

SEQ ID NO: 2295569 - protein, 27 aa, Cryptosporidium parvum
ISNIITGEIILEMFLEQSILSIKERGI

SEQ ID NO: 2295570 - protein, 17 aa, Cryptosporidium parvum
ISNIKRSLHFIYHRYKR

SEQ ID NO: 2295571 - protein, 20 aa, Cryptosporidium parvum
ISNKLLKLGDFFISTSNYII

SEQ ID NO: 2295572 - protein, 22 aa, Cryptosporidium parvum
ISNKRAKFIVFIDEIDLARSNR

SEQ ID NO: 2295573 - protein, 17 aa, Cryptosporidium parvum
ISNLLSIRNPNLLHYLQ

SEQ ID NO: 2295574 - protein, 20 aa, Cryptosporidium parvum
ISNLMWWINDIHVRELATEF

SEQ ID NO: 2295575 - protein, 24 aa, Cryptosporidium parvum
ISNLNRLSTFIACNNEIEYIESGF

SEQ ID NO: 2295576 - protein, 17 aa, Cryptosporidium parvum
ISNNMLRLQISKKVYKR

SEQ ID NO: 2295577 - protein, 18 aa, Cryptosporidium parvum
ISNSCVIPSEGDSNQKIS

SEQ ID NO: 2295578 - protein, 20 aa, Cryptosporidium parvum
ISNWCVLDYILYLFHNLEVY

SEQ ID NO: 2295579 - protein, 17 aa, Cryptosporidium parvum
ISPELFNELLILIHNIL

SEQ ID NO: 2295580 - protein, 22 aa, Cryptosporidium parvum
ISPETICLGGLQGLSSYSIDQS

SEQ ID NO: 2295581 - protein, 23 aa, Cryptosporidium parvum
ISPFCLNCMRRYKGMEFESSRKH

SEQ ID NO: 2295582 - protein, 19 aa, Cryptosporidium parvum
ISPFPLITAWFKGVGKPSD

SEQ ID NO: 2295583 - protein, 18 aa, Cryptosporidium parvum
ISPKGWTCETCGASTNLW

SEQ ID NO: 2295584 - protein, 23 aa, Cryptosporidium parvum
ISPKRITVCYNHSISHSLIEELM

SEQ ID NO: 2295585 - protein, 23 aa, Cryptosporidium parvum
ISPLNCNSSWIVCEECSRWYHQD

SEQ ID NO: 2295586 - protein, 28 aa, Cryptosporidium parvum
ISPNGKYLACGFKDGGVAFYDARTLKYR

SEQ ID NO: 2295587 - protein, 26 aa, Cryptosporidium parvum
ISPPSSPTCFSFKASVPVNILGENPF

SEQ ID NO: 2295588 - protein, 17 aa, Cryptosporidium parvum
ISPRSAIIPSSNQSNKK

SEQ ID NO: 2295589 - protein, 20 aa, Cryptosporidium parvum
ISPSEKCIRDSGIPKEKIND

SEQ ID NO: 2295590 - protein, 18 aa, Cryptosporidium parvum
ISPSLPIPSSIQGRNRLD

SEQ ID NO: 2295591 - protein, 17 aa, Cryptosporidium parvum
ISPYLFKGMNGLKFSYY

SEQ ID NO: 2295592 - protein, 24 aa, Cryptosporidium parvum
ISQIPRQTPSVVRPPTAPNSISKS

SEQ ID NO: 2295593 - protein, 18 aa, Cryptosporidium parvum
ISRCKWIIENVPFNLCNR

SEQ ID NO: 2295594 - protein, 17 aa, Cryptosporidium parvum
ISRDFASEIKIVRSRSE

SEQ ID NO: 2295595 - protein, 22 aa, Cryptosporidium parvum
ISRDFRTDIDIIKDVDNLQDGV

SEQ ID NO: 2295596 - protein, 22 aa, Cryptosporidium parvum
ISRKESLECIEWSGEERVFSPE

SEQ ID NO: 2295597 - protein, 22 aa, Cryptosporidium parvum
ISRLKAEYMKERHWKLLLSKVI

SEQ ID NO: 2295598 - protein, 24 aa, Cryptosporidium parvum
ISRMIVSALNRFRGLFRCSETNKL

SEQ ID NO: 2295599 - protein, 21 aa, Cryptosporidium parvum
ISRTRACTVVLSLKEGSLEDC

SEQ ID NO: 2295600 - protein, 27 aa, Cryptosporidium parvum
ISRVKWPIRIIDGFNHILECVSSVNVV

SEQ ID NO: 2295601 - protein, 32 aa, Cryptosporidium parvum; identical to SEQ ID NO: 2174040

SEQ ID NO: 2295602 - protein, 21 aa, Cryptosporidium parvum
ISSAYEWCIEIIRNVSAGKSD

SEQ ID NO: 2295603 - protein, 23 aa, Cryptosporidium parvum
ISSDKFLFENTMLISEKQVKNQH

SEQ ID NO: 2295604 - protein, 17 aa, Cryptosporidium parvum
ISSEVICGLLNGMEYCI

SEQ ID NO: 2295605 - protein, 17 aa, Cryptosporidium parvum
ISSFFIEYSEFIINVIR

SEQ ID NO: 2295606 - protein, 21 aa, Cryptosporidium parvum
ISSGLLKDIFGYMEIKESKMT

SEQ ID NO: 2295607 - protein, 18 aa, Cryptosporidium parvum
ISSIMAFLIQGCKDMEVH

SEQ ID NO: 2295608 - protein, 19 aa, Cryptosporidium parvum
ISSISCRLFINEYVQLLGL

SEQ ID NO: 2295609 - protein, 24 aa, Cryptosporidium parvum
ISSISSTMSILWVKHRRKTYISQI

SEQ ID NO: 2295610 - protein, 17 aa, Cryptosporidium parvum
ISSKCIRETIKSTMATM

SEQ ID NO: 2295611 - protein, 24 aa, Cryptosporidium parvum
ISSKIIRHRALIGIQAEIILKDGS

SEQ ID NO: 2295612 - protein, 26 aa, Cryptosporidium parvum
ISSLLRISSPFLWHFFQNGGNVHDLP

SEQ ID NO: 2295613 - protein, 21 aa, Cryptosporidium parvum
ISSLRFASKVQNCVTNRNREK

SEQ ID NO: 2295614 - protein, 18 aa, Cryptosporidium parvum
ISSNGEWLITASNSGSRF

SEQ ID NO: 2295615 - protein, 17 aa, Cryptosporidium parvum
ISSQAGVICTSNKRRVL

SEQ ID NO: 2295616 - protein, 25 aa, Cryptosporidium parvum
ISSQATCCEICLPPLTEKGLDESQD

SEQ ID NO: 2295617 - protein, 17 aa, Cryptosporidium parvum
ISSRVFSAIPYFSKRTL

SEQ ID NO: 2295618 - protein, 25 aa, Cryptosporidium parvum
ISSSHCFYCKHLIYVMRAGAIIQIA

SEQ ID NO: 2295619 - protein, 17 aa, Cryptosporidium parvum
ISSSIAIAAGRTQVNIV

SEQ ID NO: 2295620 - protein, 17 aa, Cryptosporidium parvum
ISSYSNFGLKELTLDDS

SEQ ID NO: 2295621 - protein, 18 aa, Cryptosporidium parvum
ISTCDCKSETCCSKNKKK

SEQ ID NO: 2295622 - protein, 20 aa, Cryptosporidium parvum
ISTECPWGAQIFLESEIINF

SEQ ID NO: 2295623 - protein, 17 aa, Cryptosporidium parvum
ISTFKIYSVDRMGNKTK

SEQ ID NO: 2295624 - protein, 24 aa, Cryptosporidium parvum
ISTNCVRIMFGISEFMKESQDAEL

SEQ ID NO: 2295625 - protein, 25 aa, Cryptosporidium parvum
ISTSKGNRCLFRYCKKSENINKINI

SEQ ID NO: 2295626 - protein, 21 aa, Cryptosporidium parvum
ISTSLYQLWSLGALDDNGSLT

SEQ ID NO: 2295627 - protein, 22 aa, Cryptosporidium parvum
ISTSRIAFKLDISKLAQQVNIY

SEQ ID NO: 2295628 - protein, 17 aa, Cryptosporidium parvum
ISTWRVPIPRKQLKKNK

SEQ ID NO: 2295629 - protein, 23 aa, Cryptosporidium parvum
ISTYISCYTVLKIEEMGEYAYYH

SEQ ID NO: 2295630 - protein, 18 aa, Cryptosporidium parvum
ISTYLGVKTDKILDMIQN

SEQ ID NO: 2295631 - protein, 23 aa, Cryptosporidium parvum
ISVDIVLDFLCEWKDCIESDIKV

SEQ ID NO: 2295632 - protein, 25 aa, Cryptosporidium parvum
ISVFLKLIRDFIHQIVPLKDQQIDF

SEQ ID NO: 2295633 - protein, 18 aa, Cryptosporidium parvum
ISVGFKIVELISIRDKAH

SEQ ID NO: 2295634 - protein, 24 aa, Cryptosporidium parvum
ISVISLGSGILFEFNELSKRKNPD

SEQ ID NO: 2295635 - protein, 24 aa, Cryptosporidium parvum
ISVKGPELLTLWFGESEANVREVF

SEQ ID NO: 2295636 - protein, 17 aa, Cryptosporidium parvum
ISVPCKLNMDLESLFYY

SEQ ID NO: 2295637 - protein, 19 aa, Cryptosporidium parvum
ISVSGCGNYVVVGYSDGSI

SEQ ID NO: 2295638 - protein, 20 aa, Cryptosporidium parvum
ISVSLIIAKALQFNFLPTVR

SEQ ID NO: 2295639 - protein, 26 aa, Cryptosporidium parvum
ISWCVRRKTWRVWFITSGGTRATRSF

SEQ ID NO: 2295640 - protein, 21 aa, Cryptosporidium parvum
ISWPILRKPIHVDINDIIITL

SEQ ID NO: 2295641 - protein, 24 aa, Cryptosporidium parvum
ISYKDIFEQNGFRFIFNSNSEIGS

SEQ ID NO: 2295642 - protein, 17 aa, Cryptosporidium parvum
ISYLLEFTKSSLNRTNV

SEQ ID NO: 2295643 - protein, 19 aa, Cryptosporidium parvum
ISYNYHLFKLISPKLAEKW

SEQ ID NO: 2295644 - protein, 24 aa, Cryptosporidium parvum
ISYSAPLWLEFEGYNSSLDTVSKH

SEQ ID NO: 2295645 - protein, 36 aa, Cryptosporidium parvum; identical to SEQ ID NO: 2174075

SEQ ID NO: 2295646 - protein, 25 aa, Cryptosporidium parvum
ISYVYRLAPLLSLVLVCKDTHEKEL

SEQ ID NO: 2295647 - protein, 17 aa, Cryptosporidium parvum
ITADARGPKHLQIKLSR

SEQ ID NO: 2295648 - protein, 26 aa, Cryptosporidium parvum
ITADKQIPCRFHLISVPPNSRVGSSG

SEQ ID NO: 2295649 - protein, 17 aa, Cryptosporidium parvum
ITAEEALSHPYFNGINI

SEQ ID NO: 2295650 - protein, 32 aa, Cryptosporidium parvum
ITANGFMLIMVLLYQMGWIDTAILCQMYYVPK

SEQ ID NO: 2295651 - protein, 27 aa, Cryptosporidium parvum
ITANLMPRCIGMWKEYFTSDGKPYYHN

SEQ ID NO: 2295652 - protein, 23 aa, Cryptosporidium parvum
ITDDFVPRWGRNSIKKIQKKHNE

SEQ ID NO: 2295653 - protein, 19 aa, Cryptosporidium parvum
ITDFKRILIDLKFTGKLIQ

SEQ ID NO: 2295654 - protein, 24 aa, Cryptosporidium parvum
ITDIYHGLGIPISMVYSRNLLGGA

SEQ ID NO: 2295655 - protein, 18 aa, Cryptosporidium parvum
ITDLSYVFIRLGDILQLA

SEQ ID NO: 2295656 - protein, 21 aa, Cryptosporidium parvum
ITEAAQVLWLIRASGRVGLVS

SEQ ID NO: 2295657 - protein, 23 aa, Cryptosporidium parvum
ITEAHFSWAQPIVRIPNAQKLKI

SEQ ID NO: 2295658 - protein, 21 aa, Cryptosporidium parvum
ITEAWFCRNLGLAGTLPSISD

SEQ ID NO: 2295659 - protein, 17 aa, Cryptosporidium parvum
ITEFIKFSDLFRRICIF

SEQ ID NO: 2295660 - protein, 18 aa, Cryptosporidium parvum
ITEFQRLYNKSVFLRLET

SEQ ID NO: 2295661 - protein, 23 aa, Cryptosporidium parvum
ITEIKVDPTLKWKDQSNQYINLL

SEQ ID NO: 2295662 - protein, 25 aa, Cryptosporidium parvum
ITEKLFGFKGVKVIQFLDSTDKLFE

SEQ ID NO: 2295663 - protein, 25 aa, Cryptosporidium parvum
ITEKSGYQALPWVRYITQNGNYEIR

SEQ ID NO: 2295664 - protein, 19 aa, Cryptosporidium parvum
ITEKSKLILSSYITSNNSD

SEQ ID NO: 2295665 - protein, 25 aa, Cryptosporidium parvum
ITESLYNFISAFHFNQADFPDSNEF

SEQ ID NO: 2295666 - protein, 25 aa, Cryptosporidium parvum
ITFEEMKYFFGRGGIIKIDPTTLSP

SEQ ID NO: 2295667 - protein, 17 aa, Cryptosporidium parvum
ITFHSWLKILSIEQYSL

SEQ ID NO: 2295668 - protein, 22 aa, Cryptosporidium parvum
ITFPEIRCVYELMNESNSNIYI

SEQ ID NO: 2295669 - protein, 20 aa, Cryptosporidium parvum
ITGDWIPVSLSSDIANNLEF

SEQ ID NO: 2295670 - protein, 17 aa, Cryptosporidium parvum
ITGYYILISSLRNNNEN

SEQ ID NO: 2295671 - protein, 23 aa, Cryptosporidium parvum
ITHLFYKTLVYISAISGINSNGI

SEQ ID NO: 2295672 - protein, 25 aa, Cryptosporidium parvum
ITHREILASRMIFRVSDGTGGIDAR

SEQ ID NO: 2295673 - protein, 31 aa, Cryptosporidium parvum
ITIERFSLKLASRISQVSIFCERLNSRRSCE

SEQ ID NO: 2295674 - protein, 21 aa, Cryptosporidium parvum
ITIKMVETFAFNADIQQLMSL

SEQ ID NO: 2295675 - protein, 27 aa, Cryptosporidium parvum
ITINWIRISPSFLRKIIESDYISCLLS

SEQ ID NO: 2295676 - protein, 27 aa, Cryptosporidium parvum
ITITCKREIKCWIYKNQIKEWVNSSII

SEQ ID NO: 2295677 - protein, 24 aa, Cryptosporidium parvum
ITIYTVCFSELITQFESWRVNHRI

SEQ ID NO: 2295678 - protein, 27 aa, Cryptosporidium parvum
ITKLNDLICCLNIWENIKITIIQENEN

SEQ ID NO: 2295679 - protein, 26 aa, Cryptosporidium parvum
ITKQKIDVCFYIGFVPFYSKVILRLL

SEQ ID NO: 2295680 - protein, 18 aa, Cryptosporidium parvum
ITKSIKGIIFFGTPHFGT

SEQ ID NO: 2295681 - protein, 18 aa, Cryptosporidium parvum
ITLIWKIALILCMHPYIS

SEQ ID NO: 2295682 - protein, 18 aa, Cryptosporidium parvum
ITLKSLIEEISRNMFHYL

SEQ ID NO: 2295683 - protein, 17 aa, Cryptosporidium parvum
ITLLIPRIKCLMKESRA

SEQ ID NO: 2295684 - protein, 18 aa, Cryptosporidium parvum
ITLMKWGNAIIQDISQID

SEQ ID NO: 2295685 - protein, 18 aa, Cryptosporidium parvum
ITLRFPKKTKVSVIDLYL

SEQ ID NO: 2295686 - protein, 19 aa, Cryptosporidium parvum
ITLRQGFHLFDQRTQGTLS

SEQ ID NO: 2295687 - protein, 18 aa, Cryptosporidium parvum
ITLVEALTGFKFIITHLD

SEQ ID NO: 2295688 - protein, 18 aa, Cryptosporidium parvum
ITMKSTWFGEEMRNKINK

SEQ ID NO: 2295689 - protein, 26 aa, Cryptosporidium parvum
ITNDFKGNMFKLGYDKIVSTISSALI

SEQ ID NO: 2295690 - protein, 20 aa, Cryptosporidium parvum
ITNEAILCFTYMDILKKSLT

SEQ ID NO: 2295691 - protein, 18 aa, Cryptosporidium parvum
ITNFKLNIPLTFVSTYNT

SEQ ID NO: 2295692 - protein, 19 aa, Cryptosporidium parvum
ITNICDLEISVYLNNRPIY

SEQ ID NO: 2295693 - protein, 18 aa, Cryptosporidium parvum
ITNPLDAMVYYFKEKSGI

SEQ ID NO: 2295694 - protein, 29 aa, Cryptosporidium parvum
ITNTYKYAKYFAVIRRYKISKAMFESIKL

SEQ ID NO: 2295695 - protein, 17 aa, Cryptosporidium parvum
ITPFMDLKDDITKIEAQ

SEQ ID NO: 2295696 - protein, 27 aa, Cryptosporidium parvum
ITPNKSNFRWVWPAHVFVTHTGTIIFS

SEQ ID NO: 2295697 - protein, 24 aa, Cryptosporidium parvum
ITPTCRRVMYAAALTASPRLLEPM

SEQ ID NO: 2295698 - protein, 32 aa, Cryptosporidium parvum
ITQELWIPLLRELAYINALVRFDVLRQSTLGS

SEQ ID NO: 2295699 - protein, 24 aa, Cryptosporidium parvum
ITQKIRFSIQFIVDIYYGYFSMQY

SEQ ID NO: 2295700 - protein, 25 aa, Cryptosporidium parvum
ITQQFVCFVWQFLDCYSKNCIKSNR

SEQ ID NO: 2295701 - protein, 26 aa, Cryptosporidium parvum
ITRIYGLHALRFKKPLLQPFNTIREQ

SEQ ID NO: 2295702 - protein, 22 aa, Cryptosporidium parvum
ITRYYPCNLLLRESTHEKTPLK

SEQ ID NO: 2295703 - protein, 20 aa, Cryptosporidium parvum
ITSAVTLFFQQLRKIKGAAS

SEQ ID NO: 2295704 - protein, 18 aa, Cryptosporidium parvum
ITSHFCQLHHFYGPGCKA

SEQ ID NO: 2295705 - protein, 18 aa, Cryptosporidium parvum
ITSICCTSISNMLVSCDL

SEQ ID NO: 2295706 - protein, 20 aa, Cryptosporidium parvum
ITSIPGLRPPPIPISNEANF

SEQ ID NO: 2295707 - protein, 24 aa, Cryptosporidium parvum
ITSKICIGNVFLIKTIPITIYNEF

SEQ ID NO: 2295708 - protein, 19 aa, Cryptosporidium parvum
ITSLCYVPVIGYIYAGTNF

SEQ ID NO: 2295709 - protein, 28 aa, Cryptosporidium parvum
ITSPDYPVRCAFSLLNEYLKTYIDSSKN

SEQ ID NO: 2295710 - protein, 24 aa, Cryptosporidium parvum
ITSPWAMSLCMLHISRHIYNSRQL

SEQ ID NO: 2295711 - protein, 20 aa, Cryptosporidium parvum
ITSSFSSLYCLKQVSNEVAI

SEQ ID NO: 2295712 - protein, 19 aa, Cryptosporidium parvum
ITSVYGWDLCYEVILLDFH

SEQ ID NO: 2295713 - protein, 19 aa, Cryptosporidium parvum
ITTERCRKLIFDELNGIPV

SEQ ID NO: 2295714 - protein, 25 aa, Cryptosporidium parvum
ITTILKARCSILAAANPTFGSYDDS

SEQ ID NO: 2295715 - protein, 18 aa, Cryptosporidium parvum
ITTSFQLPTREDLLPSLM

SEQ ID NO: 2295716 - protein, 30 aa, Cryptosporidium parvum
ITVGIKMQLIYSLLCKSEFQSLTQLIFQLL

SEQ ID NO: 2295717 - protein, 20 aa, Cryptosporidium parvum
ITVQMLLARSWDWSIEDQDL

SEQ ID NO: 2295718 - protein, 17 aa, Cryptosporidium parvum
ITWCVYMHGALIGGHSI

SEQ ID NO: 2295719 - protein, 17 aa, Cryptosporidium parvum
ITYELLKIFKTSNGEFI

SEQ ID NO: 2295720 - protein, 29 aa, Cryptosporidium parvum
ITYKEIRYNTWFRYNLPFYLEPQYYHLLS

SEQ ID NO: 2295721 - protein, 26 aa, Cryptosporidium parvum
ITYLCRSCFLPEIFSTNSKLNNFQHE

SEQ ID NO: 2295722 - protein, 20 aa, Cryptosporidium parvum
IVALKRIRLDAEDEGIPSTA

SEQ ID NO: 2295723 - protein, 19 aa, Cryptosporidium parvum
IVALNAHLFLKNNGYFIIS

SEQ ID NO: 2295724 - protein, 24 aa, Cryptosporidium parvum
IVCDRCLGESKFLRMTKSNQERSC

SEQ ID NO: 2295725 - protein, 23 aa, Cryptosporidium parvum
IVCHTRIAWKEVADNLKTGTAYF

SEQ ID NO: 2295726 - protein, 18 aa, Cryptosporidium parvum
IVDFPSKFKSVGENNSKS

SEQ ID NO: 2295727 - protein, 20 aa, Cryptosporidium parvum
IVDGEWRYSPEYPIESDSEG

SEQ ID NO: 2295728 - protein, 21 aa, Cryptosporidium parvum
IVDIPLRYEKVSSIIQMDLVN

SEQ ID NO: 2295729 - protein, 18 aa, Cryptosporidium parvum
IVDMLLFECTCPSKDKSF

SEQ ID NO: 2295730 - protein, 24 aa, Cryptosporidium parvum
IVEKKLMINYSFSSLIFFPNICIT

SEQ ID NO: 2295731 - protein, 19 aa, Cryptosporidium parvum
IVENILICKRCLKNSQKFK

SEQ ID NO: 2295732 - protein, 17 aa, Cryptosporidium parvum
IVFAEDLTRCIIDHLSK

SEQ ID NO: 2295733 - protein, 19 aa, Cryptosporidium parvum
IVFCTPHNFGAGYFTVPNA

SEQ ID NO: 2295734 - protein, 25 aa, Cryptosporidium parvum
IVFDLTCGAGAFTLPLIKIKDCTLF

SEQ ID NO: 2295735 - protein, 23 aa, Cryptosporidium parvum
IVFENIKIPLISGEYDDIRKYWE

SEQ ID NO: 2295736 - protein, 23 aa, Cryptosporidium parvum
IVGNDFLPHIPFHTVDQGLARII

SEQ ID NO: 2295737 - protein, 18 aa, Cryptosporidium parvum
IVIKTAYRKRRSKRKQNE

SEQ ID NO: 2295738 - protein, 20 aa, Cryptosporidium parvum
IVILHLHLKHSIWLGKKKTQ

SEQ ID NO: 2295739 - protein, 26 aa, Cryptosporidium parvum
IVILSYPSLKLFTTFFGNTPDYIQLA

SEQ ID NO: 2295740 - protein, 26 aa, Cryptosporidium parvum
IVISGLRCPIPIYIKKHIFVMSYIGD

SEQ ID NO: 2295741 - protein, 17 aa, Cryptosporidium parvum
IVKACTDKGKLQFIKEL

SEQ ID NO: 2295742 - protein, 21 aa, Cryptosporidium parvum
IVKDFPSFITTITIQISEELS

SEQ ID NO: 2295743 - protein, 23 aa, Cryptosporidium parvum
IVKRDIEPIYQLIVLNQKNPENL

SEQ ID NO: 2295744 - protein, 19 aa, Cryptosporidium parvum
IVKTDWRQINHTFKSDPRD

SEQ ID NO: 2295745 - protein, 17 aa, Cryptosporidium parvum
IVLFLRANLGINVAKNF

SEQ ID NO: 2295746 - protein, 25 aa, Cryptosporidium parvum
IVLNICCAYSWTAELEMASKKYLEN

SEQ ID NO: 2295747 - protein, 26 aa, Cryptosporidium parvum
IVLRLLERRQKPFFYPTFIKEQVENI

SEQ ID NO: 2295748 - protein, 18 aa, Cryptosporidium parvum
IVLSKSFRGRKLNGRIIH

SEQ ID NO: 2295749 - protein, 28 aa, Cryptosporidium parvum
IVLSKYSLSYNWFIYWNDNFPKSTGISN

SEQ ID NO: 2295750 - protein, 26 aa, Cryptosporidium parvum
IVMAFLYTKIRIFKELSKQISIKKIY

SEQ ID NO: 2295751 - protein, 23 aa, Cryptosporidium parvum
IVMELIDAVPLNSIRHLDDPYGA

SEQ ID NO: 2295752 - protein, 17 aa, Cryptosporidium parvum
IVNEEFEQLKAYDENMN

SEQ ID NO: 2295753 - protein, 18 aa, Cryptosporidium parvum
IVNILYEYLIHIDKQIDR

SEQ ID NO: 2295754 - protein, 20 aa, Cryptosporidium parvum
IVPGCYAVSVSGDMVSDDEG

SEQ ID NO: 2295755 - protein, 19 aa, Cryptosporidium parvum
IVPSEFSFGSNYCNRKSDL

SEQ ID NO: 2295756 - protein, 18 aa, Cryptosporidium parvum
IVQGLSYLHGKRVIHRDL

SEQ ID NO: 2295757 - protein, 17 aa, Cryptosporidium parvum
IVQLLKKHIRNFEMEKV

SEQ ID NO: 2295758 - protein, 24 aa, Cryptosporidium parvum
IVQLRGAAKLSLWNECFTTAEEIF

SEQ ID NO: 2295759 - protein, 19 aa, Cryptosporidium parvum
IVREQCITMVAVIAGVIEN

SEQ ID NO: 2295760 - protein, 31 aa, Cryptosporidium parvum
IVRILYNRFEILFLNIFVIWNVHAIIQEIYD

SEQ ID NO: 2295761 - protein, 28 aa, Cryptosporidium parvum
IVSKEKFGCIIGIQFASKITRSIDKGPF

SEQ ID NO: 2295762 - protein, 17 aa, Cryptosporidium parvum
IVTNARSTGWLKVVDTM

SEQ ID NO: 2295763 - protein, 29 aa, Cryptosporidium parvum
IVTRCGHLYCWSCICSWLDRGYEDCPVCK

SEQ ID NO: 2295764 - protein, 22 aa, Cryptosporidium parvum
IVTSICKEIPRSIVSEYLQDRL

SEQ ID NO: 2295765 - protein, 25 aa, Cryptosporidium parvum
IVTTLRARCSIIAAANPIFGKYDSS

SEQ ID NO: 2295766 - protein, 17 aa, Cryptosporidium parvum
IVVPGNLNAQGRSFWVR

SEQ ID NO: 2295767 - protein, 21 aa, Cryptosporidium parvum
IVVYFPKKCIEYIIEGLSNNI

SEQ ID NO: 2295768 - protein, 26 aa, Cryptosporidium parvum
IVWTIWKPIKYCAVENIIPRDNLVEF

SEQ ID NO: 2295769 - protein, 19 aa, Cryptosporidium parvum
IVYNLRDGYFSGCSVALEL

SEQ ID NO: 2295770 - protein, 27 aa, Cryptosporidium parvum
IWDKCRAECPFCHISLDWTKMKPYIVL

SEQ ID NO: 2295771 - protein, 18 aa, Cryptosporidium parvum
IWELSHKSIYDVSKKTNY

SEQ ID NO: 2295772 - protein, 18 aa, Cryptosporidium parvum
IWENIKITIIQENENIDF

SEQ ID NO: 2295773 - protein, 17 aa, Cryptosporidium parvum
IWHALKSIITISSQYMK

SEQ ID NO: 2295774 - protein, 26 aa, Cryptosporidium parvum
IWIAKHGWKFLPLYIFEESLGTWRHR

SEQ ID NO: 2295775 - protein, 22 aa, Cryptosporidium parvum
IWIFIKCLIVNPSFDSQTKETL

SEQ ID NO: 2295776 - protein, 22 aa, Cryptosporidium parvum
IWIQQIQECWAKSLELSNLSPD

SEQ ID NO: 2295777 - protein, 31 aa, Cryptosporidium parvum
IWKQLGNRWNRDFHKWKGIYKQWFSSAPDKR

SEQ ID NO: 2295778 - protein, 19 aa, Cryptosporidium parvum
IWLHNLIPIGISRVKLLNF

SEQ ID NO: 2295779 - protein, 24 aa, Cryptosporidium parvum
IWNIIKAIFTRRRWSSNSKSYSMY

SEQ ID NO: 2295780 - protein, 25 aa, Cryptosporidium parvum
IWQYYFWLMGDFLPKILFKNEQFKV

SEQ ID NO: 2295781 - protein, 29 aa, Cryptosporidium parvum
IWRYCKGNCGIKFKSRRDSIENMLFEQQK

SEQ ID NO: 2295782 - protein, 25 aa, Cryptosporidium parvum
IWSLGCTIFELLTGDLLFTPKATED

SEQ ID NO: 2295783 - protein, 23 aa, Cryptosporidium parvum
IWSVGCIFIELLIGRPIFSGDSE

SEQ ID NO: 2295784 - protein, 22 aa, Cryptosporidium parvum
IWYEKRVVKSLELFDSSIDGYV

SEQ ID NO: 2295785 - protein, 19 aa, Cryptosporidium parvum
IYAAMCTKCAGELQQKLNP

SEQ ID NO: 2295786 - protein, 19 aa, Cryptosporidium parvum
IYCHIKKFYFSHLIKQVLQ

SEQ ID NO: 2295787 - protein, 24 aa, Cryptosporidium parvum
IYERPGEFVLLALLDQFEERLLFY

SEQ ID NO: 2295788 - protein, 21 aa, Cryptosporidium parvum
IYESVPKWEIVISESDGGQFQ

SEQ ID NO: 2295789 - protein, 19 aa, Cryptosporidium parvum
IYFEYILEFYLHILNNYPN

SEQ ID NO: 2295790 - protein, 17 aa, Cryptosporidium parvum
IYGAMNVSELLNLCSYH

SEQ ID NO: 2295791 - protein, 19 aa, Cryptosporidium parvum
IYGHNHIKTAIACSLFSGV

SEQ ID NO: 2295792 - protein, 24 aa, Cryptosporidium parvum
IYGMSCLRSVLSMNDLVNNVSENR

SEQ ID NO: 2295793 - protein, 18 aa, Cryptosporidium parvum
IYGRDSHLVFYEIESKNF

SEQ ID NO: 2295794 - protein, 25 aa, Cryptosporidium parvum
IYHASISIFLFWAIWKTPSIVKNIN

SEQ ID NO: 2295795 - protein, 17 aa, Cryptosporidium parvum
IYHSIEFGCTSEAITLV

SEQ ID NO: 2295796 - protein, 35 aa, Cryptosporidium parvum
IYHWNDGRVYTGYWLKNHMFGYGKFDWTDHRCYEG

SEQ ID NO: 2295797 - protein, 26 aa, Cryptosporidium parvum
IYIFGRNCLLGALFSEHIVFWDLFSK

SEQ ID NO: 2295798 - protein, 20 aa, Cryptosporidium parvum
IYIHHLLKNQMEIVSLNNGI

SEQ ID NO: 2295799 - protein, 21 aa, Cryptosporidium parvum
IYINFEFIKDIAYDFNYKILK

SEQ ID NO: 2295800 - protein, 23 aa, Cryptosporidium parvum
IYISIPCGYILDYFYLGVSSGDL

SEQ ID NO: 2295801 - protein, 18 aa, Cryptosporidium parvum
IYITGARVTFDIYSYSIF

SEQ ID NO: 2295802 - protein, 17 aa, Cryptosporidium parvum
IYITGIRKSLCFGTNNK

SEQ ID NO: 2295803 - protein, 22 aa, Cryptosporidium parvum
IYIYCFKPYNSHFPEINIENNI

SEQ ID NO: 2295804 - protein, 21 aa, Cryptosporidium parvum
IYKDIPIPIPVKRTIEKPVPI

SEQ ID NO: 2295805 - protein, 24 aa, Cryptosporidium parvum
IYKYLPPRIQTVLVSATLPDDILV

SEQ ID NO: 2295806 - protein, 25 aa, Cryptosporidium parvum
IYKYRYQCLRCFQMFGRQTKINDET

SEQ ID NO: 2295807 - protein, 33 aa, Cryptosporidium parvum; identical to SEQ ID NO: 2174227

SEQ ID NO: 2295808 - protein, 18 aa, Cryptosporidium parvum
IYLIDCPGIVPPENASSY

SEQ ID NO: 2295809 - protein, 21 aa, Cryptosporidium parvum
IYLLKVCKHPLLLLKPEFQSW

SEQ ID NO: 2295810 - protein, 20 aa, Cryptosporidium parvum
IYLPETCKFGTFESGFYFHP

SEQ ID NO: 2295811 - protein, 28 aa, Cryptosporidium parvum
IYMDVCRTYPSISYFKFEGKSYLSKILL

SEQ ID NO: 2295812 - protein, 20 aa, Cryptosporidium parvum
IYMKSCSLDAIVDLVSKSIL

SEQ ID NO: 2295813 - protein, 20 aa, Cryptosporidium parvum
IYMKVLRDLVKLASLQTAFF

SEQ ID NO: 2295814 - protein, 19 aa, Cryptosporidium parvum
IYNCEKFHVGLPLQYAFGL

SEQ ID NO: 2295815 - protein, 24 aa, Cryptosporidium parvum
IYNDLKILRFHDGISGKTYKALPS

SEQ ID NO: 2295816 - protein, 18 aa, Cryptosporidium parvum
IYNDYNVFCYWISSRYLR

SEQ ID NO: 2295817 - protein, 22 aa, Cryptosporidium parvum
IYNFKLETPLAVQSTKNKTPIS

SEQ ID NO: 2295818 - protein, 25 aa, Cryptosporidium parvum
IYNKTLRYYLFNDIGHLENNYNEIK

SEQ ID NO: 2295819 - protein, 31 aa, Cryptosporidium parvum
IYNNFKESFSFLPSFFVDEIFGGQLLGVKSN

SEQ ID NO: 2295820 - protein, 17 aa, Cryptosporidium parvum
IYNSCKFQSFTTLCTET

SEQ ID NO: 2295821 - protein, 24 aa, Cryptosporidium parvum
IYPELKYDRRGILSMASKGASKKP

SEQ ID NO: 2295822 - protein, 18 aa, Cryptosporidium parvum
IYPIDPVRDGCLDYFEVI

SEQ ID NO: 2295823 - protein, 44 aa, Cryptosporidium parvum
IYPSLEVGGPIARMNGACGGFVPCFPGPYLNMHYDPHFGNFSGN

SEQ ID NO: 2295824 - protein, 20 aa, Cryptosporidium parvum
IYPVDDWKVHFLSIIKKNLS

SEQ ID NO: 2295825 - protein, 25 aa, Cryptosporidium parvum
IYRRRFKDCFNIWRGLSLRLRNQKK

SEQ ID NO: 2295826 - protein, 27 aa, Cryptosporidium parvum
IYRSEWKRPPMYLLITHKGRHCKGNYP

SEQ ID NO: 2295827 - protein, 21 aa, Cryptosporidium parvum
IYRVLKRFIERAMMQENFNIH

SEQ ID NO: 2295828 - protein, 18 aa, Cryptosporidium parvum
IYSCKLCNKTFKSKQQYN

SEQ ID NO: 2295829 - protein, 18 aa, Cryptosporidium parvum
IYSILLNPLCNRLFTAGS

SEQ ID NO: 2295830 - protein, 25 aa, Cryptosporidium parvum
IYSNLVELIFPYSLLNFTVCSTETT

SEQ ID NO: 2295831 - protein, 18 aa, Cryptosporidium parvum
IYSRVVIQRIPWRELKEI

SEQ ID NO: 2295832 - protein, 26 aa, Cryptosporidium parvum
IYSTCFSHAFNKLFLASSKGIIVYNW

SEQ ID NO: 2295833 - protein, 17 aa, Cryptosporidium parvum
IYTILFIDEIDLICGSR

SEQ ID NO: 2295834 - protein, 26 aa, Cryptosporidium parvum
IYTSLRCPLFYMALMKLLFDEYPMIT

SEQ ID NO: 2295835 - protein, 19 aa, Cryptosporidium parvum
IYTYVSSYFGVIFIITRGG

SEQ ID NO: 2295836 - protein, 17 aa, Cryptosporidium parvum
IYWNDNFPKSTGISNDI

SEQ ID NO: 2295837 - protein, 18 aa, Cryptosporidium parvum
IYWTPCSQPSNIDHYDKE

SEQ ID NO: 2295838 - protein, 19 aa, Cryptosporidium parvum
IYYENEIIFWNWSKDDPIY

SEQ ID NO: 2295839 - protein, 24 aa, Cryptosporidium parvum
KAAAQLKAAILARASSKKNISADN

SEQ ID NO: 2295840 - protein, 19 aa, Cryptosporidium parvum
KAAEMNKNFQLIVVDSKNN

SEQ ID NO: 2295841 - protein, 26 aa, Cryptosporidium parvum
KAAKFTCPICLEDWDNIMSRTLTINQ

SEQ ID NO: 2295842 - protein, 18 aa, Cryptosporidium parvum
KAALPLPATVYIKSLFLW

SEQ ID NO: 2295843 - protein, 19 aa, Cryptosporidium parvum
KACEKGFFSVLGLLLRDID

SEQ ID NO: 2295844 - protein, 19 aa, Cryptosporidium parvum
KADGSTVTTVDQVFQDCSR

SEQ ID NO: 2295845 - protein, 25 aa, Cryptosporidium parvum
KADHAFRTGKYYDFPRFGINLNEIR

SEQ ID NO: 2295846 - protein, 19 aa, Cryptosporidium parvum
KADIIGVCSISIDMSSIGI

SEQ ID NO: 2295847 - protein, 18 aa, Cryptosporidium parvum
KADRIIIRSIGLGKINNL

SEQ ID NO: 2295848 - protein, 20 aa, Cryptosporidium parvum
KAEANSFFKEGQFEKSIEMY

SEQ ID NO: 2295849 - protein, 26 aa, Cryptosporidium parvum
KAEEEKEVWNIFSFSPVEDKSVYDID

SEQ ID NO: 2295850 - protein, 20 aa, Cryptosporidium parvum
KAEEKLRMEEELKVLKSMKR

SEQ ID NO: 2295851 - protein, 24 aa, Cryptosporidium parvum
KAEERSVFESCPITDSKADVSYNS

SEQ ID NO: 2295852 - protein, 25 aa, Cryptosporidium parvum
KAEKLRLIYKTRFEEDLRAFMVSHK

SEQ ID NO: 2295853 - protein, 25 aa, Cryptosporidium parvum
KAFAKNWKALCLIIINKTELTKVRI

SEQ ID NO: 2295854 - protein, 24 aa, Cryptosporidium parvum
KAFDRIELIISIFSLLLEIINRGI

SEQ ID NO: 2295855 - protein, 23 aa, Cryptosporidium parvum
KAFFPKLLTWLSLPQTLQRYFLA

SEQ ID NO: 2295856 - protein, 25 aa, Cryptosporidium parvum
KAGLGRTGTLLGCYAIKNYRFTASA

SEQ ID NO: 2295857 - protein, 17 aa, Cryptosporidium parvum
KAGRMHLAILLLQHEPN

SEQ ID NO: 2295858 - protein, 20 aa, Cryptosporidium parvum
KAGSGWDVESMFALNEQKFG

SEQ ID NO: 2295859 - protein, 23 aa, Cryptosporidium parvum
KAIFKRWPNTVLQWEDLTTSRAI

SEQ ID NO: 2295860 - protein, 18 aa, Cryptosporidium parvum
KAIGLDWKIISSMQKLIS

SEQ ID NO: 2295861 - protein, 27 aa, Cryptosporidium parvum
KAIILSFVKDILCFKKREDITSNGTLT

SEQ ID NO: 2295862 - protein, 21 aa, Cryptosporidium parvum
KAIKSYKCFTTMMCKFNSKNG

SEQ ID NO: 2295863 - protein, 18 aa, Cryptosporidium parvum
KAITAGFFLQSARINKGG

SEQ ID NO: 2295864 - protein, 24 aa, Cryptosporidium parvum
KAIYPEAVRMLLLFIYGHTTSLRG

SEQ ID NO: 2295865 - protein, 24 aa, Cryptosporidium parvum
KAKIEMLTFYAIEICFKKIDSKLH

SEQ ID NO: 2295866 - protein, 23 aa, Cryptosporidium parvum
KAKLDLFKMRFLGRNMKISYYCE

SEQ ID NO: 2295867 - protein, 21 aa, Cryptosporidium parvum
KAKLKMFLGQVMVESAPKVLI

SEQ ID NO: 2295868 - protein, 20 aa, Cryptosporidium parvum
KAKLRKIRQMRSIRNQLESS

SEQ ID NO: 2295869 - protein, 21 aa, Cryptosporidium parvum
KAKRIIEESVSYWRTKDDQVK

SEQ ID NO: 2295870 - protein, 22 aa, Cryptosporidium parvum
KAKSGLSDFVLKSKRISSSGSL

SEQ ID NO: 2295871 - protein, 27 aa, Cryptosporidium parvum
KALFALPICAIVKYMGYSVLCEPLVPF

SEQ ID NO: 2295872 - protein, 34 aa, Cryptosporidium parvum; identical to SEQ ID NO: 2174284

SEQ ID NO: 2295873 - protein, 20 aa, Cryptosporidium parvum
KALFLCLMAKRVLDASEDNS

SEQ ID NO: 2295874 - protein, 20 aa, Cryptosporidium parvum
KALPASIILQNAWRTLKPRL

SEQ ID NO: 2295875 - protein, 20 aa, Cryptosporidium parvum
KALQLDGFACMGSKIKVSRP

SEQ ID NO: 2295876 - protein, 19 aa, Cryptosporidium parvum
KALTIDGGYQLNINLDPTY

SEQ ID NO: 2295877 - protein, 17 aa, Cryptosporidium parvum
KALVLESILSPVASVRG

SEQ ID NO: 2295878 - protein, 17 aa, Cryptosporidium parvum
KAMKILIQKGDLIERSD

SEQ ID NO: 2295879 - protein, 31 aa, Cryptosporidium parvum; identical to SEQ ID NO: 2174291

SEQ ID NO: 2295880 - protein, 24 aa, Cryptosporidium parvum
KANENFLKFIIKLETEMSIASSLI

SEQ ID NO: 2295881 - protein, 17 aa, Cryptosporidium parvum
KANSLPIIQSRLGILTW

SEQ ID NO: 2295882 - protein, 22 aa, Cryptosporidium parvum
KAPEGSKRFFDLVKFKDPKFKI

SEQ ID NO: 2295883 - protein, 19 aa, Cryptosporidium parvum
KAQEFKQKYLAEMAAYRAS

SEQ ID NO: 2295884 - protein, 25 aa, Cryptosporidium parvum
KAQFFKEPACSLVVAVHSTNCTPLQ

SEQ ID NO: 2295885 - protein, 18 aa, Cryptosporidium parvum
KAQRLKSGYANNDQVEIE

SEQ ID NO: 2295886 - protein, 18 aa, Cryptosporidium parvum
KARCQICSSRFHHPQDCP

SEQ ID NO: 2295887 - protein, 18 aa, Cryptosporidium parvum
KAREAFEILNKAYEELQK

SEQ ID NO: 2295888 - protein, 18 aa, Cryptosporidium parvum
KARELLLTRYKSDEIQFM

SEQ ID NO: 2295889 - protein, 19 aa, Cryptosporidium parvum
KAREYAIHLIAHYDGVFGF

SEQ ID NO: 2295890 - protein, 20 aa, Cryptosporidium parvum
KARISFRMLESMIPASLKKR

SEQ ID NO: 2295891 - protein, 27 aa, Cryptosporidium parvum
KARKCFVESHAAYSLVSYFLQVKDRHN

SEQ ID NO: 2295892 - protein, 20 aa, Cryptosporidium parvum
KARVAKIIRNLMDMMSKIPD

SEQ ID NO: 2295893 - protein, 24 aa, Cryptosporidium parvum
KASDYRWFYSSVVSHSVNYQATST

SEQ ID NO: 2295894 - protein, 22 aa, Cryptosporidium parvum
KASKSVSFVRRDRVVFLGSPPE

SEQ ID NO: 2295895 - protein, 17 aa, Cryptosporidium parvum
KASLMVFVKNPGFQVSE

SEQ ID NO: 2295896 - protein, 24 aa, Cryptosporidium parvum
KATHICDLVKPSLYLDGEKDPKPY

SEQ ID NO: 2295897 - protein, 25 aa, Cryptosporidium parvum
KATWHDVWSPFLFFEKHKHFIQVKM

SEQ ID NO: 2295898 - protein, 19 aa, Cryptosporidium parvum
KAVGYSSAGTVEFLYDIER

SEQ ID NO: 2295899 - protein, 20 aa, Cryptosporidium parvum
KAVIIGINYVETEGISLRGC

SEQ ID NO: 2295900 - protein, 24 aa, Cryptosporidium parvum
KAVKEYGLKCPWDPNDKLTEINWP

SEQ ID NO: 2295901 - protein, 20 aa, Cryptosporidium parvum
KAWENPRIVLANFLKSMFLT

SEQ ID NO: 2295902 - protein, 20 aa, Cryptosporidium parvum
KAWNDTRVRAALEPYSKYSA

SEQ ID NO: 2295903 - protein, 20 aa, Cryptosporidium parvum
KAYLYLKYLVQQKHGPVTID

SEQ ID NO: 2295904 - protein, 17 aa, Cryptosporidium parvum
KCDFKLISFYKAVKGNI

SEQ ID NO: 2295905 - protein, 33 aa, Cryptosporidium parvum
KCDLGKLCNCLLSFNLVEEFFFLFNRHFIHFGD

SEQ ID NO: 2295906 - protein, 27 aa, Cryptosporidium parvum
KCEFLKTVILELKFDIIELKKVIMKFI

SEQ ID NO: 2295907 - protein, 24 aa, Cryptosporidium parvum
KCESDLKAIVSIVNILSKNKYEVN

SEQ ID NO: 2295908 - protein, 21 aa, Cryptosporidium parvum
KCFNMHMLIRFLAKNLSLYKY

SEQ ID NO: 2295909 - protein, 17 aa, Cryptosporidium parvum
KCGEYRDEIGDKIVAEY

SEQ ID NO: 2295910 - protein, 18 aa, Cryptosporidium parvum
KCGFYDSDFRNFEIKIKT

SEQ ID NO: 2295911 - protein, 20 aa, Cryptosporidium parvum
KCGNLLACLEFIHGNINGPT

SEQ ID NO: 2295912 - protein, 19 aa, Cryptosporidium parvum
KCGYRIISVQYPIYDDIND

SEQ ID NO: 2295913 - protein, 21 aa, Cryptosporidium parvum
KCHRMSDAHLRQMEVFEQNSK

SEQ ID NO: 2295914 - protein, 18 aa, Cryptosporidium parvum
KCIDASICKFHEEETCIK

SEQ ID NO: 2295915 - protein, 18 aa, Cryptosporidium parvum
KCIECSYDKISIDKLKSM

SEQ ID NO: 2295916 - protein, 23 aa, Cryptosporidium parvum
KCIEVYRPGAIVLQCGADSVRGD

SEQ ID NO: 2295917 - protein, 27 aa, Cryptosporidium parvum
KCINGNYELKCYEITKLNDEINNFQNS

SEQ ID NO: 2295918 - protein, 32 aa, Cryptosporidium parvum
KCKMLKRAALGRMCTCLKKLQAPLEYLEEVRQ

SEQ ID NO: 2295919 - protein, 17 aa, Cryptosporidium parvum
KCLVKIHACSFLKNTAH

SEQ ID NO: 2295920 - protein, 25 aa, Cryptosporidium parvum
KCNAVRRHFEKCLTSKMNGYELCKL

SEQ ID NO: 2295921 - protein, 18 aa, Cryptosporidium parvum
KCNKRVAFRYHNRQPEKF

SEQ ID NO: 2295922 - protein, 25 aa, Cryptosporidium parvum
KCNPKCLICSQVLVKIKIVSFDKWN

SEQ ID NO: 2295923 - protein, 17 aa, Cryptosporidium parvum
KCPHGSYVRSKVSGKTV

SEQ ID NO: 2295924 - protein, 17 aa, Cryptosporidium parvum
KCQEFQSLLLAYRIDYL

SEQ ID NO: 2295925 - protein, 18 aa, Cryptosporidium parvum
KCQLEKLKSWRSNVQSAI

SEQ ID NO: 2295926 - protein, 26 aa, Cryptosporidium parvum
KCSDYKIRLFLIQTGKCYKIFDENIS

SEQ ID NO: 2295927 - protein, 21 aa, Cryptosporidium parvum
KCSESNWFKKVVIMNNNDEIT

SEQ ID NO: 2295928 - protein, 20 aa, Cryptosporidium parvum
KCSEYTPLYIYKSFGSSVRS

SEQ ID NO: 2295929 - protein, 20 aa, Cryptosporidium parvum
KCSQLDLLKFLKYSNDKLSK

SEQ ID NO: 2295930 - protein, 17 aa, Cryptosporidium parvum
KCVDEFYSSIDIVKESK

SEQ ID NO: 2295931 - protein, 19 aa, Cryptosporidium parvum
KCYCRIVGTTFEYTTSSNV

SEQ ID NO: 2295932 - protein, 28 aa, Cryptosporidium parvum
KCYQSWWHMRVIRELLGFDIEELNFISK

SEQ ID NO: 2295933 - protein, 27 aa, Cryptosporidium parvum
KDAFKGRCVIAGSLIRKDDFVLEYKGN

SEQ ID NO: 2295934 - protein, 20 aa, Cryptosporidium parvum
KDALKSLYIDRTRPHLQELI

SEQ ID NO: 2295935 - protein, 24 aa, Cryptosporidium parvum
KDAYEYAKQLWLKARNKSKLNKCQ

SEQ ID NO: 2295936 - protein, 19 aa, Cryptosporidium parvum
KDCHFVKEMESFKVNSIYS

SEQ ID NO: 2295937 - protein, 18 aa, Cryptosporidium parvum
KDCKSCCVLVTGPNDHSI

SEQ ID NO: 2295938 - protein, 18 aa, Cryptosporidium parvum
KDDGCLILPISKRRVSLH

SEQ ID NO: 2295939 - protein, 17 aa, Cryptosporidium parvum
KDDMEIFSSMKELVNTL

SEQ ID NO: 2295940 - protein, 19 aa, Cryptosporidium parvum
KDDMLICSTDSLFKLRIQV

SEQ ID NO: 2295941 - protein, 24 aa, Cryptosporidium parvum
KDEATLEWSHRWNSQCEYIVRCFK

SEQ ID NO: 2295942 - protein, 29 aa, Cryptosporidium parvum
KDEHCYNIFILKGIGWRKLSDYENEENED

SEQ ID NO: 2295943 - protein, 17 aa, Cryptosporidium parvum
KDEKFVFESNPNVDSNA

SEQ ID NO: 2295944 - protein, 23 aa, Cryptosporidium parvum
KDEKLDELVTIFSHKNNRKFSRD

SEQ ID NO: 2295945 - protein, 26 aa, Cryptosporidium parvum
KDELIKYLACLSPGFVGSEIRNLCNE

SEQ ID NO: 2295946 - protein, 19 aa, Cryptosporidium parvum
KDELLELFPENSKEEVNEK

SEQ ID NO: 2295947 - protein, 25 aa, Cryptosporidium parvum
KDELRKPYFVKCMKKVQERRNYAKV

SEQ ID NO: 2295948 - protein, 20 aa, Cryptosporidium parvum
KDETVLWTWISKRSSKLETL

SEQ ID NO: 2295949 - protein, 19 aa, Cryptosporidium parvum
KDFEKGWKIHVKKSDRDFD

SEQ ID NO: 2295950 - protein, 21 aa, Cryptosporidium parvum
KDFIGCISSQAGVICTSNKRR

SEQ ID NO: 2295951 - protein, 25 aa, Cryptosporidium parvum
KDFKEIWNQLNVFFVMISEYKRMLW

SEQ ID NO: 2295952 - protein, 22 aa, Cryptosporidium parvum
KDFKRIGALTEVFFALSKTQKK

SEQ ID NO: 2295953 - protein, 19 aa, Cryptosporidium parvum
KDFQHRFVFFPSSTIHTKS

SEQ ID NO: 2295954 - protein, 20 aa, Cryptosporidium parvum
KDFRNQLLLLRRNLAAEFGI

SEQ ID NO: 2295955 - protein, 17 aa, Cryptosporidium parvum
KDFSFYGENFFHTVERG

SEQ ID NO: 2295956 - protein, 25 aa, Cryptosporidium parvum
KDFVHAFIVWFDIIFGCGHKPVTFT

SEQ ID NO: 2295957 - protein, 17 aa, Cryptosporidium parvum
KDGFIFESLVPLHACNK

SEQ ID NO: 2295958 - protein, 17 aa, Cryptosporidium parvum
KDGIMLISSPLLCYGSM

SEQ ID NO: 2295959 - protein, 29 aa, Cryptosporidium parvum
KDGIWVHLVCAIWHLPLVTCEDWKNLSNW

SEQ ID NO: 2295960 - protein, 26 aa, Cryptosporidium parvum
KDGKNSFKILFSWLNEELKLPSIENY

SEQ ID NO: 2295961 - protein, 25 aa, Cryptosporidium parvum
KDGKSRGYAFVTFKTIESALLACKN

SEQ ID NO: 2295962 - protein, 23 aa, Cryptosporidium parvum
KDGLWAVLAWLSILAHKNPDPTK

SEQ ID NO: 2295963 - protein, 22 aa, Cryptosporidium parvum
KDGRTCNCMINENLLIYYNEKG

SEQ ID NO: 2295964 - protein, 19 aa, Cryptosporidium parvum
KDGVKEGFGVYKLATGRIY

SEQ ID NO: 2295965 - protein, 19 aa, Cryptosporidium parvum
KDGWIAVERFFRSVTKSLA

SEQ ID NO: 2295966 - protein, 20 aa, Cryptosporidium parvum
KDGYHSCVLIQLLSELIKLK

SEQ ID NO: 2295967 - protein, 20 aa, Cryptosporidium parvum
KDHMRQAGNVIRADVFEDEV

SEQ ID NO: 2295968 - protein, 17 aa, Cryptosporidium parvum
KDHPHLYQQVSIQEIDD

SEQ ID NO: 2295969 - protein, 34 aa, Cryptosporidium parvum
KDHYSEAGIPLGLYYMLSISYLWSKIIHIPEKKM

SEQ ID NO: 2295970 - protein, 20 aa, Cryptosporidium parvum
KDIDFWKQQCENLNKTDITS

SEQ ID NO: 2295971 - protein, 17 aa, Cryptosporidium parvum
KDIDIYFISLSKDANMY

SEQ ID NO: 2295972 - protein, 17 aa, Cryptosporidium parvum
KDIFPIMIVGTRVTNET

SEQ ID NO: 2295973 - protein, 19 aa, Cryptosporidium parvum
KDIGLAYCKVLLVGVGGIG

SEQ ID NO: 2295974 - protein, 30 aa, Cryptosporidium parvum
KDIGWGCTYRSLQMVFSWYLINNYTNKHIL

SEQ ID NO: 2295975 - protein, 25 aa, Cryptosporidium parvum
KDIIVSICCLILRIISCTWSNNFSS

SEQ ID NO: 2295976 - protein, 20 aa, Cryptosporidium parvum
KDILHRIFGDHLIRTLELFQ

SEQ ID NO: 2295977 - protein, 21 aa, Cryptosporidium parvum
KDILSDWRNSTLLKTHSDMVI

SEQ ID NO: 2295978 - protein, 19 aa, Cryptosporidium parvum
KDILSIFWKFYLDGKFTMV

SEQ ID NO: 2295979 - protein, 21 aa, Cryptosporidium parvum
KDILTILIRRIINALSTSSSG

SEQ ID NO: 2295980 - protein, 24 aa, Cryptosporidium parvum
KDIMYEIIHRLYKRDKQQIFAEPV

SEQ ID NO: 2295981 - protein, 27 aa, Cryptosporidium parvum
KDINLFSMRCREWYSWHFPELAKIITD

SEQ ID NO: 2295982 - protein, 32 aa, Cryptosporidium parvum; identical to SEQ ID NO: 2174377

SEQ ID NO: 2295983 - protein, 18 aa, Cryptosporidium parvum
KDIYELRKKLEYYDNKNN

SEQ ID NO: 2295984 - protein, 22 aa, Cryptosporidium parvum
KDKEKIDFVEWFINDHKEIMFE

SEQ ID NO: 2295985 - protein, 18 aa, Cryptosporidium parvum
KDKKLFKLLDEVFITHPN

SEQ ID NO: 2295986 - protein, 18 aa, Cryptosporidium parvum
KDKLIFIEGCSKSKAVTV

SEQ ID NO: 2295987 - protein, 19 aa, Cryptosporidium parvum
KDKPWDTDDIDHWNVPKLT

SEQ ID NO: 2295988 - protein, 18 aa, Cryptosporidium parvum
KDKVVLIVNICKILLSYM

SEQ ID NO: 2295989 - protein, 21 aa, Cryptosporidium parvum
KDLDKFVLDCDLREYFIGESI

SEQ ID NO: 2295990 - protein, 21 aa, Cryptosporidium parvum
KDLEPILSFYGLDNQNIQGKL

SEQ ID NO: 2295991 - protein, 23 aa, Cryptosporidium parvum
KDLFEFPPCIGKAYNGNKPSLSL

SEQ ID NO: 2295992 - protein, 17 aa, Cryptosporidium parvum
KDLFSLNLMKYYEYMDK

SEQ ID NO: 2295993 - protein, 27 aa, Cryptosporidium parvum
KDLKILLFELFIQFGLIDKITIRGGSP

SEQ ID NO: 2295994 - protein, 20 aa, Cryptosporidium parvum
KDLKPKIFKGTSNFQFPYLR

SEQ ID NO: 2295995 - protein, 19 aa, Cryptosporidium parvum
KDLKSRYVNNFIFDDNPIA

SEQ ID NO: 2295996 - protein, 21 aa, Cryptosporidium parvum
KDLLCSKYSVILIDEAHERTV

SEQ ID NO: 2295997 - protein, 25 aa, Cryptosporidium parvum
KDLNSFPIQIPVFFSQNIQHIESNS

SEQ ID NO: 2295998 - protein, 21 aa, Cryptosporidium parvum
KDLQGFHAIIIHLIRENIKQI

SEQ ID NO: 2295999 - protein, 21 aa, Cryptosporidium parvum
KDMLVGLGLDIPVEVVSPTRV

SEQ ID NO: 2296000 - protein, 22 aa, Cryptosporidium parvum
KDMPEFRLLSVEEIDNYLTNIA

SEQ ID NO: 2296001 - protein, 33 aa, Cryptosporidium parvum
KDNDKELFKNCILCRDYSSPICKECSKHNSKTS

SEQ ID NO: 2296002 - protein, 18 aa, Cryptosporidium parvum
KDNIEVLPNIIVVDSNNE

SEQ ID NO: 2296003 - protein, 25 aa, Cryptosporidium parvum
KDNLLRGIYSYGFEFPSAIQRRAIV

SEQ ID NO: 2296004 - protein, 22 aa, Cryptosporidium parvum
KDNLYHWNKQMNVIKNVSSSIV

SEQ ID NO: 2296005 - protein, 25 aa, Cryptosporidium parvum
KDPFEIEYFWKVFNPDIHFKPTLGY

SEQ ID NO: 2296006 - protein, 29 aa, Cryptosporidium parvum
KDPIKSDFCMLQFSRFISHYFEFPDLITI

SEQ ID NO: 2296007 - protein, 21 aa, Cryptosporidium parvum
KDPSLSLGIFEDWRSIHNQEK

SEQ ID NO: 2296008 - protein, 25 aa, Cryptosporidium parvum
KDPVYKAQCQLSFKDSFSEGGLYVN

SEQ ID NO: 2296009 - protein, 18 aa, Cryptosporidium parvum
KDQFEFERYFKLNEEFPK

SEQ ID NO: 2296010 - protein, 18 aa, Cryptosporidium parvum
KDQIETILREYGVIDRVP

SEQ ID NO: 2296011 - protein, 17 aa, Cryptosporidium parvum
KDQIWVLISGGDKNKTI

SEQ ID NO: 2296012 - protein, 19 aa, Cryptosporidium parvum
KDQSILLYLSRYVEYKTNN

SEQ ID NO: 2296013 - protein, 18 aa, Cryptosporidium parvum
KDRIHGFGNPNFIDKIEP

SEQ ID NO: 2296014 - protein, 25 aa, Cryptosporidium parvum
KDRRELCSGYDLFLSDDRIIEKMPK

SEQ ID NO: 2296015 - protein, 23 aa, Cryptosporidium parvum
KDRSDRLALRNAKKQQIEESEKD

SEQ ID NO: 2296016 - protein, 21 aa, Cryptosporidium parvum
KDSDFCLLDSTGIKGPKEFET

SEQ ID NO: 2296017 - protein, 26 aa, Cryptosporidium parvum
KDSDKPCTRFRGFVFDIVHSDIPTYI

SEQ ID NO: 2296018 - protein, 37 aa, Cryptosporidium parvum
KDSEIRQCYRLQFKGSDGKWYFAPKIKIEEFEEKFPN

SEQ ID NO: 2296019 - protein, 21 aa, Cryptosporidium parvum
KDSEIVVCFIMQLPYYIKVQA

SEQ ID NO: 2296020 - protein, 20 aa, Cryptosporidium parvum
KDSESLKCFVPINRSDILHP

SEQ ID NO: 2296021 - protein, 18 aa, Cryptosporidium parvum
KDSIKIGIPSYLDFDYDL

SEQ ID NO: 2296022 - protein, 20 aa, Cryptosporidium parvum
KDSKGNIYYNVDGFVDNTIT

SEQ ID NO: 2296023 - protein, 17 aa, Cryptosporidium parvum
KDSNIVKTDWRQINHTF

SEQ ID NO: 2296024 - protein, 18 aa, Cryptosporidium parvum
KDSVKPLAKETFFSEGTD

SEQ ID NO: 2296025 - protein, 19 aa, Cryptosporidium parvum
KDTFLFRNHRKLLIADEKA

SEQ ID NO: 2296026 - protein, 23 aa, Cryptosporidium parvum
KDTLPPSWLRKINKESMNSNNFQ

SEQ ID NO: 2296027 - protein, 17 aa, Cryptosporidium parvum
KDVLSAVAYCHKLNVAH

SEQ ID NO: 2296028 - protein, 17 aa, Cryptosporidium parvum
KDVPAGILIEKFAQQLK

SEQ ID NO: 2296029 - protein, 20 aa, Cryptosporidium parvum
KDVQRLGGGVGYMNGIADDL

SEQ ID NO: 2296030 - protein, 18 aa, Cryptosporidium parvum
KDVTTCPKFILRSFYTVT

SEQ ID NO: 2296031 - protein, 17 aa, Cryptosporidium parvum
KDWNLSSKLSISVQDSC

SEQ ID NO: 2296032 - protein, 21 aa, Cryptosporidium parvum
KDWQLGYMVIEDFSIYIYDSG

SEQ ID NO: 2296033 - protein, 17 aa, Cryptosporidium parvum
KEAIINWNSEKCVQNNE

SEQ ID NO: 2296034 - protein, 28 aa, Cryptosporidium parvum
KEAIRIGFIDCFRLFTNGNIDWILVSGN

SEQ ID NO: 2296035 - protein, 21 aa, Cryptosporidium parvum
KEAWKNDQFLSILQNVTNVDI

SEQ ID NO: 2296036 - protein, 17 aa, Cryptosporidium parvum
KECISRLDASQYKETQL

SEQ ID NO: 2296037 - protein, 26 aa, Cryptosporidium parvum
KEDILDFIDIYSLSSYFMGLTKIEGE

SEQ ID NO: 2296038 - protein, 18 aa, Cryptosporidium parvum
KEDIYRESINLLPKNSYS

SEQ ID NO: 2296039 - protein, 22 aa, Cryptosporidium parvum
KEDKVKISKCITWDEETIAMHD

SEQ ID NO: 2296040 - protein, 21 aa, Cryptosporidium parvum
KEDLVTRLFIFTADQKSKLSK

SEQ ID NO: 2296041 - protein, 19 aa, Cryptosporidium parvum
KEECFKKNSSLPIFKYKDN

SEQ ID NO: 2296042 - protein, 26 aa, Cryptosporidium parvum
KEEFSPYLKIIESIGLKINEKMKPDN

SEQ ID NO: 2296043 - protein, 20 aa, Cryptosporidium parvum
KEEISRLNGDISELKDILEN

SEQ ID NO: 2296044 - protein, 17 aa, Cryptosporidium parvum
KEEKEILEVINSSEASI

SEQ ID NO: 2296045 - protein, 26 aa, Cryptosporidium parvum
KEELKYIYCIILKFIYQSKTKYCQEK

SEQ ID NO: 2296046 - protein, 21 aa, Cryptosporidium parvum
KEELRRKKIKTSEINNLSLKD

SEQ ID NO: 2296047 - protein, 20 aa, Cryptosporidium parvum
KEELTDLITMGFKVVNMGDR

SEQ ID NO: 2296048 - protein, 25 aa, Cryptosporidium parvum
KEEMERWNIWIAYINMEIVYGKNEL

SEQ ID NO: 2296049 - protein, 25 aa, Cryptosporidium parvum
KEENGRTGVRGELFLNFEEVGRIQK

SEQ ID NO: 2296050 - protein, 22 aa, Cryptosporidium parvum
KEENWWVILIKIAVPNSSKENK

SEQ ID NO: 2296051 - protein, 22 aa, Cryptosporidium parvum
KEEWEERFGCPYPEEKTNEVPK

SEQ ID NO: 2296052 - protein, 23 aa, Cryptosporidium parvum
KEFEGISGLPIIPTREGKRVSIE

SEQ ID NO: 2296053 - protein, 20 aa, Cryptosporidium parvum
KEFFPKETLNFIANKLDMFN

SEQ ID NO: 2296054 - protein, 21 aa, Cryptosporidium parvum
KEFGETVNWRWILINYCLPLS

SEQ ID NO: 2296055 - protein, 21 aa, Cryptosporidium parvum
KEFGFELKLAISTQEESPFTG

SEQ ID NO: 2296056 - protein, 23 aa, Cryptosporidium parvum
KEFMLQNLTEWYREIVKQYKEGI

SEQ ID NO: 2296057 - protein, 20 aa, Cryptosporidium parvum
KEFNSFVSIERDLIFVFQLM

SEQ ID NO: 2296058 - protein, 22 aa, Cryptosporidium parvum
KEFQRLERIGAHSHIRGLGLND

SEQ ID NO: 2296059 - protein, 21 aa, Cryptosporidium parvum
KEFSYRFSPGLEKWQMTSVVE

SEQ ID NO: 2296060 - protein, 20 aa, Cryptosporidium parvum
KEFTPGMALAVWENMISEKP

SEQ ID NO: 2296061 - protein, 21 aa, Cryptosporidium parvum
KEFTVPVSWGMDLGSEHEKYI

SEQ ID NO: 2296062 - protein, 17 aa, Cryptosporidium parvum
KEFVIESLTPILTKHDY

SEQ ID NO: 2296063 - protein, 24 aa, Cryptosporidium parvum
KEFVYKADDGFGYKDNSQLRNLNI

SEQ ID NO: 2296064 - protein, 21 aa, Cryptosporidium parvum
KEGFFKESDVWSFGMSMLEVL

SEQ ID NO: 2296065 - protein, 23 aa, Cryptosporidium parvum
KEGGELYNIWYGKYQFDYDKRGK

SEQ ID NO: 2296066 - protein, 25 aa, Cryptosporidium parvum
KEGIFPRKLQELIVIEPYSLSIRNS

SEQ ID NO: 2296067 - protein, 21 aa, Cryptosporidium parvum
KEGKIKFESFINVSINTFLKV

SEQ ID NO: 2296068 - protein, 39 aa, Cryptosporidium parvum; identical to SEQ ID NO: 2174460

SEQ ID NO: 2296069 - protein, 19 aa, Cryptosporidium parvum
KEGKVFSFEICDADGSEIR

SEQ ID NO: 2296070 - protein, 32 aa, Cryptosporidium parvum; identical to SEQ ID NO: 2174464

SEQ ID NO: 2296071 - protein, 24 aa, Cryptosporidium parvum
KEGVDSLVVLLGFAKAQQRKKLLK

SEQ ID NO: 2296072 - protein, 19 aa, Cryptosporidium parvum
KEHCRKARCQICSSRFHHP

SEQ ID NO: 2296073 - protein, 21 aa, Cryptosporidium parvum
KEHFDKLLFFKMGKFYELFYI

SEQ ID NO: 2296074 - protein, 23 aa, Cryptosporidium parvum
KEIDRLFLNAGQFFKYIERCSPI

SEQ ID NO: 2296075 - protein, 17 aa, Cryptosporidium parvum
KEIFQRIETPLKVILDL

SEQ ID NO: 2296076 - protein, 19 aa, Cryptosporidium parvum
KEIIMGICYFLEPKDTISL

SEQ ID NO: 2296077 - protein, 19 aa, Cryptosporidium parvum
KEIIYLFYRDMRNHPQQIP

SEQ ID NO: 2296078 - protein, 18 aa, Cryptosporidium parvum
KEIKEQNFELAVFSFTNI

SEQ ID NO: 2296079 - protein, 17 aa, Cryptosporidium parvum
KEIKYNTNIGEIGMKNC

SEQ ID NO: 2296080 - protein, 17 aa, Cryptosporidium parvum
KEILTSGILEFFSTYGI

SEQ ID NO: 2296081 - protein, 21 aa, Cryptosporidium parvum
KEINASIPMGVYGGIQKNEEP

SEQ ID NO: 2296082 - protein, 25 aa, Cryptosporidium parvum
KEIQEKLRLKMEGWTIHGSGLQDPR

SEQ ID NO: 2296083 - protein, 21 aa, Cryptosporidium parvum
KEIQSSIHFNQVAALCFQLKQ

SEQ ID NO: 2296084 - protein, 26 aa, Cryptosporidium parvum
KEIRKRLDSYFSIVVRNIRDSVPKII

SEQ ID NO: 2296085 - protein, 21 aa, Cryptosporidium parvum
KEIRQIAKMLVWLQENNPKTS

SEQ ID NO: 2296086 - protein, 17 aa, Cryptosporidium parvum
KEIRSKCMHLYKEYTST

SEQ ID NO: 2296087 - protein, 21 aa, Cryptosporidium parvum
KEISCGGHHTAILLVTGKLYM

SEQ ID NO: 2296088 - protein, 18 aa, Cryptosporidium parvum
KEISGIDILFNLDKISGS

SEQ ID NO: 2296089 - protein, 17 aa, Cryptosporidium parvum
KEIVDFYYCIWKRTSRY

SEQ ID NO: 2296090 - protein, 20 aa, Cryptosporidium parvum
KEIYFGKSLDDFLIEKKYSL

SEQ ID NO: 2296091 - protein, 21 aa, Cryptosporidium parvum
KEKDLKLARHVLYVHKNEKAP

SEQ ID NO: 2296092 - protein, 23 aa, Cryptosporidium parvum
KEKELKEDFSREIGEKELKIQSL

SEQ ID NO: 2296093 - protein, 23 aa, Cryptosporidium parvum
KEKERFLTYLVTYIMENLKSISC

SEQ ID NO: 2296094 - protein, 20 aa, Cryptosporidium parvum
KEKGIPCINILWLETIIYTW

SEQ ID NO: 2296095 - protein, 23 aa, Cryptosporidium parvum
KEKIKSGILGAINSRSSLSLIDF

SEQ ID NO: 2296096 - protein, 18 aa, Cryptosporidium parvum
KEKIKWSSLTPRQQSEIL

SEQ ID NO: 2296097 - protein, 17 aa, Cryptosporidium parvum
KEKLRMKRFEEKNKKFE

SEQ ID NO: 2296098 - protein, 17 aa, Cryptosporidium parvum
KEKNKYRSSWEHISDLS

SEQ ID NO: 2296099 - protein, 24 aa, Cryptosporidium parvum
KEKNRESWFLAFIMDTNEEERSKG

SEQ ID NO: 2296100 - protein, 23 aa, Cryptosporidium parvum
KEKRKMHYREFITAKSKLPKAND

SEQ ID NO: 2296101 - protein, 26 aa, Cryptosporidium parvum
KEKSTWSRIFSPLSFGFDKRELSYSG

SEQ ID NO: 2296102 - protein, 17 aa, Cryptosporidium parvum
KEKWKNKKERYLYELDD

SEQ ID NO: 2296103 - protein, 19 aa, Cryptosporidium parvum
KEKYKGLATTLAMLCHALS

SEQ ID NO: 2296104 - protein, 18 aa, Cryptosporidium parvum
KEKYNLKSTDNWKNSDEF

SEQ ID NO: 2296105 - protein, 19 aa, Cryptosporidium parvum
KELEWKEVIAYFRGSELQT

SEQ ID NO: 2296106 - protein, 23 aa, Cryptosporidium parvum
KELFKEDLNLILIGRNREKLQNV

SEQ ID NO: 2296107 - protein, 17 aa, Cryptosporidium parvum
KELFLIRKELNKMIQNY

SEQ ID NO: 2296108 - protein, 20 aa, Cryptosporidium parvum
KELGEMAGLCKVDREGNPRK

SEQ ID NO: 2296109 - protein, 19 aa, Cryptosporidium parvum
KELGWKAKHSIFDACKSAY

SEQ ID NO: 2296110 - protein, 19 aa, Cryptosporidium parvum
KELIWGFIKLIQTLRPHII

SEQ ID NO: 2296111 - protein, 17 aa, Cryptosporidium parvum
KELKCDEDVKIVMHSNE

SEQ ID NO: 2296112 - protein, 25 aa, Cryptosporidium parvum
KELKEFNLDISFIINSFEAVIATLL

SEQ ID NO: 2296113 - protein, 27 aa, Cryptosporidium parvum
KELKRQIMLHRCSMPIMNNKGSEGTSS

SEQ ID NO: 2296114 - protein, 20 aa, Cryptosporidium parvum
KELNNRCIIEIEKKESLEKV

SEQ ID NO: 2296115 - protein, 20 aa, Cryptosporidium parvum
KELRKKSVIRSDTFHSDKYS

SEQ ID NO: 2296116 - protein, 27 aa, Cryptosporidium parvum
KELSALSFLIPIDFFCQLKLNRIQVLK

SEQ ID NO: 2296117 - protein, 24 aa, Cryptosporidium parvum
KELTHPSFHWTLHKLKPVLQGLVL

SEQ ID NO: 2296118 - protein, 32 aa, Cryptosporidium parvum; identical to SEQ ID NO: 2174512

SEQ ID NO: 2296119 - protein, 28 aa, Cryptosporidium parvum
KELTYCCTSCNYMLICETCIIIDGHGSH

SEQ ID NO: 2296120 - protein, 17 aa, Cryptosporidium parvum
KELVASGIVVKKRPPPN

SEQ ID NO: 2296121 - protein, 19 aa, Cryptosporidium parvum
KEMKAAMQSLGFESQNPTM

SEQ ID NO: 2296122 - protein, 23 aa, Cryptosporidium parvum
KEMKSGSMLIIIMSPCCHHRCLI

SEQ ID NO: 2296123 - protein, 29 aa, Cryptosporidium parvum
KEMNKYKLPWKHITSLLGEESSIKSLIYP

SEQ ID NO: 2296124 - protein, 17 aa, Cryptosporidium parvum
KEMRILVLGLDNAGKTT

SEQ ID NO: 2296125 - protein, 21 aa, Cryptosporidium parvum
KEMSEKPFFVNFLNDKVKIDN

SEQ ID NO: 2296126 - protein, 18 aa, Cryptosporidium parvum
KENFELIQKLRISQENVR

SEQ ID NO: 2296127 - protein, 23 aa, Cryptosporidium parvum
KENISACVDYDCMERNNKSIEEI

SEQ ID NO: 2296128 - protein, 21 aa, Cryptosporidium parvum
KENKFHPPVTTWWIEGANHNL

SEQ ID NO: 2296129 - protein, 25 aa, Cryptosporidium parvum
KENKSKVLYIDFFINKLFGYFHKRL

SEQ ID NO: 2296130 - protein, 19 aa, Cryptosporidium parvum
KENLAALLQSVSKLDTDLR

SEQ ID NO: 2296131 - protein, 18 aa, Cryptosporidium parvum
KENLEKMALYLGEPQNTI

SEQ ID NO: 2296132 - protein, 20 aa, Cryptosporidium parvum
KENLWYSIEPIISLLYDREI

SEQ ID NO: 2296133 - protein, 21 aa, Cryptosporidium parvum
KENNWQCVVEIVPNCPKVIRK

SEQ ID NO: 2296134 - protein, 18 aa, Cryptosporidium parvum
KENSEIFASLKSDLTQIL

SEQ ID NO: 2296135 - protein, 23 aa, Cryptosporidium parvum
KEPVRLGFEASQAMQQVIQSENL

SEQ ID NO: 2296136 - protein, 28 aa, Cryptosporidium parvum
KEQFKIHKEFIIPISWSSDGLRLSKISF

SEQ ID NO: 2296137 - protein, 22 aa, Cryptosporidium parvum
KEQIGGIIPAIGFNSSNANATL

SEQ ID NO: 2296138 - protein, 23 aa, Cryptosporidium parvum
KEQKIWISSLFKLMNGILQLSLL

SEQ ID NO: 2296139 - protein, 23 aa, Cryptosporidium parvum
KERCWRIGQKKEVIVYRLITRDT

SEQ ID NO: 2296140 - protein, 19 aa, Cryptosporidium parvum
KEREHYLGHSLHYNRSRGR

SEQ ID NO: 2296141 - protein, 38 aa, Cryptosporidium parvum
KERFRPGDIFEGYYFPGVLCGRTLCYYRDVVRLLRGYR

SEQ ID NO: 2296142 - protein, 25 aa, Cryptosporidium parvum
KERKHWRYNLLDTRILGKKHVEAWA

SEQ ID NO: 2296143 - protein, 21 aa, Cryptosporidium parvum
KERNFKESKKNVKIMSGLINL

SEQ ID NO: 2296144 - protein, 17 aa, Cryptosporidium parvum
KERRKKRKLLKVVKDNK

SEQ ID NO: 2296145 - protein, 20 aa, Cryptosporidium parvum
KERRLEAGATVLADRGIVCI

SEQ ID NO: 2296146 - protein, 17 aa, Cryptosporidium parvum
KERSHAFFVKKVAKDKA

SEQ ID NO: 2296147 - protein, 24 aa, Cryptosporidium parvum
KERTFYLDHIFPMDTNQSYVYKTA

SEQ ID NO: 2296148 - protein, 24 aa, Cryptosporidium parvum
KERVLFERVIFEWSQFNQKNGPKI

SEQ ID NO: 2296149 - protein, 21 aa, Cryptosporidium parvum
KESCLSCPKDIIVSICCLILR

SEQ ID NO: 2296150 - protein, 19 aa, Cryptosporidium parvum
KESGFELINKVEIRIQDSS

SEQ ID NO: 2296151 - protein, 24 aa, Cryptosporidium parvum
KESKGCSYLVLWLDCDREGENICF

SEQ ID NO: 2296152 - protein, 21 aa, Cryptosporidium parvum
KESKIPIIIDDNFQSNIIAEH

SEQ ID NO: 2296153 - protein, 21 aa, Cryptosporidium parvum
KESKKWWQIVVEIVQKPNSYV

SEQ ID NO: 2296154 - protein, 29 aa, Cryptosporidium parvum
KESKRMIGEILKWYFGMSHVSLNDITPDI

SEQ ID NO: 2296155 - protein, 26 aa, Cryptosporidium parvum
KESMNMCVNCGYIYHLTCQSQANKIT

SEQ ID NO: 2296156 - protein, 24 aa, Cryptosporidium parvum
KESPNFHLIIILKIEAIISNSSIS

SEQ ID NO: 2296157 - protein, 23 aa, Cryptosporidium parvum
KESQKRINILLSRINLPENENGI

SEQ ID NO: 2296158 - protein, 20 aa, Cryptosporidium parvum
KESRWKNKQRVLVLSTRGIN

SEQ ID NO: 2296159 - protein, 22 aa, Cryptosporidium parvum
KESRWLPTVLIGLINRYYNRRR

SEQ ID NO: 2296160 - protein, 21 aa, Cryptosporidium parvum
KESSFKCKFERLKTGLEVFLI

SEQ ID NO: 2296161 - protein, 22 aa, Cryptosporidium parvum
KESSLVRTALAWLQCLKGEYNS

SEQ ID NO: 2296162 - protein, 19 aa, Cryptosporidium parvum
KESTSGLVFVGHDISNDFQ

SEQ ID NO: 2296163 - protein, 22 aa, Cryptosporidium parvum
KESWLCKSCNERIYSINGYLNP

SEQ ID NO: 2296164 - protein, 24 aa, Cryptosporidium parvum
KETEITRLINLWKKMCPKTLEGKS

SEQ ID NO: 2296165 - protein, 18 aa, Cryptosporidium parvum
KETFSEKSIIKRDLENKL

SEQ ID NO: 2296166 - protein, 26 aa, Cryptosporidium parvum
KETLLKRNLLSNIFLDILGKLNAILD

SEQ ID NO: 2296167 - protein, 21 aa, Cryptosporidium parvum
KETRRKKVISDWIEEMNQFSN

SEQ ID NO: 2296168 - protein, 37 aa, Cryptosporidium parvum
KETTCTANLIKCCIDKSAWRCLHTLLTDSEYQQHPIS

SEQ ID NO: 2296169 - protein, 19 aa, Cryptosporidium parvum
KETYCTHTMIVFIKILNGE

SEQ ID NO: 2296170 - protein, 20 aa, Cryptosporidium parvum
KEVAQYIWGKSVLGNSLDFK

SEQ ID NO: 2296171 - protein, 26 aa, Cryptosporidium parvum
KEVPKNTPGLMGFRVWNPNLNPQDRA

SEQ ID NO: 2296172 - protein, 34 aa, Cryptosporidium parvum
KEVPRQLCNCPSYSELFLFSIIYDDSILIKENSK

SEQ ID NO: 2296173 - protein, 17 aa, Cryptosporidium parvum
KEVRDFLSHGGNDFGSR

SEQ ID NO: 2296174 - protein, 18 aa, Cryptosporidium parvum
KEVSIWAPRIRAVKYHGS

SEQ ID NO: 2296175 - protein, 25 aa, Cryptosporidium parvum
KEVSKGIVTKGLFLGGSYLYQNESR

SEQ ID NO: 2296176 - protein, 26 aa, Cryptosporidium parvum
KEVYKSKLLLDFILCIEVYNNIQNNP

SEQ ID NO: 2296177 - protein, 19 aa, Cryptosporidium parvum
KEVYLKCFEYLIDLVNKAI

SEQ ID NO: 2296178 - protein, 21 aa, Cryptosporidium parvum
KEYKVLLELFDICYQGTVGDF

SEQ ID NO: 2296179 - protein, 20 aa, Cryptosporidium parvum
KEYLFSFIEEFYLMMRFRWD

SEQ ID NO: 2296180 - protein, 25 aa, Cryptosporidium parvum
KEYLVSNIFLYRSCISDSHRVELEF

SEQ ID NO: 2296181 - protein, 23 aa, Cryptosporidium parvum
KEYPRFLTQYFKIRKEWKEYNRS

SEQ ID NO: 2296182 - protein, 35 aa, Cryptosporidium parvum; identical to SEQ ID NO: 2174570

SEQ ID NO: 2296183 - protein, 18 aa, Cryptosporidium parvum
KEYYPRANAHSIDAKFLR

SEQ ID NO: 2296184 - protein, 18 aa, Cryptosporidium parvum
KFAFLQAYSLDYEDGTNR

SEQ ID NO: 2296185 - protein, 17 aa, Cryptosporidium parvum
KFAHVPCTIGAFEAEEV

SEQ ID NO: 2296186 - protein, 32 aa, Cryptosporidium parvum
KFASDLLYRAEILDILSYCRLMIDETADDCFL

SEQ ID NO: 2296187 - protein, 19 aa, Cryptosporidium parvum
KFATSCGFVSTIVDLGLLH

SEQ ID NO: 2296188 - protein, 20 aa, Cryptosporidium parvum
KFCRSGNYLSCGSFDTEVTL

SEQ ID NO: 2296189 - protein, 18 aa, Cryptosporidium parvum
KFEEILHWNNFYKILDGF

SEQ ID NO: 2296190 - protein, 17 aa, Cryptosporidium parvum
KFELLALQLRNSTAPGR

SEQ ID NO: 2296191 - protein, 19 aa, Cryptosporidium parvum
KFELSNCKSIEKIKNLQDS

SEQ ID NO: 2296192 - protein, 18 aa, Cryptosporidium parvum
KFENCNRASLGQLIGVDY

SEQ ID NO: 2296193 - protein, 22 aa, Cryptosporidium parvum
KFERGRIFFSLLSLCLQLEDEE

SEQ ID NO: 2296194 - protein, 20 aa, Cryptosporidium parvum
KFFGCELGALSKWEDKEEKS

SEQ ID NO: 2296195 - protein, 18 aa, Cryptosporidium parvum
KFFHLWRYFFNRLSSKSV

SEQ ID NO: 2296196 - protein, 20 aa, Cryptosporidium parvum
KFFRFFDFFISFSNKDPTKK

SEQ ID NO: 2296197 - protein, 25 aa, Cryptosporidium parvum
KFGIRNLLPAFGHIRDYFNVNKNGS

SEQ ID NO: 2296198 - protein, 18 aa, Cryptosporidium parvum
KFGKEGAAKRAIQFLEKI

SEQ ID NO: 2296199 - protein, 18 aa, Cryptosporidium parvum
KFGWIAYHEYLFTKERLH

SEQ ID NO: 2296200 - protein, 24 aa, Cryptosporidium parvum
KFIEFNRILLWSIKGKDFKQIPEI

SEQ ID NO: 2296201 - protein, 18 aa, Cryptosporidium parvum
KFIENTISRCKWIIENVP

SEQ ID NO: 2296202 - protein, 28 aa, Cryptosporidium parvum
KFIKDWKLSKVWSKELIEYTWLSKLSEG

SEQ ID NO: 2296203 - protein, 18 aa, Cryptosporidium parvum
KFKGDEFGDSGMISSSGH

SEQ ID NO: 2296204 - protein, 19 aa, Cryptosporidium parvum
KFKNIRPGKLSQRLKDALG

SEQ ID NO: 2296205 - protein, 23 aa, Cryptosporidium parvum
KFKSHLYYSRFLLEQLVNSNWKK

SEQ ID NO: 2296206 - protein, 24 aa, Cryptosporidium parvum
KFKTEVYRLQVFLKLLEKNDQLPV

SEQ ID NO: 2296207 - protein, 22 aa, Cryptosporidium parvum
KFLQICRKPVYSRGIQSILKWG

SEQ ID NO: 2296208 - protein, 31 aa, Cryptosporidium parvum
KFLVDKLGIPLNWLLEAIIYKLESSGNILQS

SEQ ID NO: 2296209 - protein, 19 aa, Cryptosporidium parvum
KFMSFGVASLRSMNSNALS

SEQ ID NO: 2296210 - protein, 19 aa, Cryptosporidium parvum
KFNKLEEFDSLSLTYNSKN

SEQ ID NO: 2296211 - protein, 18 aa, Cryptosporidium parvum
KFPKLRVLLDPEGIPCND

SEQ ID NO: 2296212 - protein, 18 aa, Cryptosporidium parvum
KFPLFSLIVPKLSLLVFQ

SEQ ID NO: 2296213 - protein, 23 aa, Cryptosporidium parvum
KFPLMEICKVNGPDALEFVQKLK

SEQ ID NO: 2296214 - protein, 22 aa, Cryptosporidium parvum
KFPNFFDFGVNLTLPASFQVSE

SEQ ID NO: 2296215 - protein, 17 aa, Cryptosporidium parvum
KFQEIYRQFAPLIDQRS

SEQ ID NO: 2296216 - protein, 19 aa, Cryptosporidium parvum
KFQYLRFIISVTRSGNLLK

SEQ ID NO: 2296217 - protein, 17 aa, Cryptosporidium parvum
KFRSIAHAMGFRSTVPP

SEQ ID NO: 2296218 - protein, 18 aa, Cryptosporidium parvum
KFSAYFLLIRKQIQQGSS

SEQ ID NO: 2296219 - protein, 32 aa, Cryptosporidium parvum
KFSEIFGIEHLLRLLIILPKLIGDHISFGEYN

SEQ ID NO: 2296220 - protein, 21 aa, Cryptosporidium parvum
KFSGDAICVVWPVDDESINLN

SEQ ID NO: 2296221 - protein, 26 aa, Cryptosporidium parvum
KFSKLEESRKFWGISESRYISTIKSN

SEQ ID NO: 2296222 - protein, 18 aa, Cryptosporidium parvum
KFSRNRYGFNFLKNPSLD

SEQ ID NO: 2296223 - protein, 20 aa, Cryptosporidium parvum
KFSYYSKIKFVLVVEKDTIF

SEQ ID NO: 2296224 - protein, 25 aa, Cryptosporidium parvum
KFTEYLCGSYVKVPIINPSTNSEIF

SEQ ID NO: 2296225 - protein, 23 aa, Cryptosporidium parvum
KFTWPDGRAYIGQWKNGKQHGIG

SEQ ID NO: 2296226 - protein, 20 aa, Cryptosporidium parvum
KFVLGGLTAVALEWKQESKL

SEQ ID NO: 2296227 - protein, 30 aa, Cryptosporidium parvum
KFYTFPFKVLQKIPVCISFDVHSSINKEKT

SEQ ID NO: 2296228 - protein, 27 aa, Cryptosporidium parvum
KFYYNKELKSWVVRGEEHLVEQKQNLP

SEQ ID NO: 2296229 - protein, 24 aa, Cryptosporidium parvum
KGAKLKFDIGYSMEERTEPQNELD

SEQ ID NO: 2296230 - protein, 18 aa, Cryptosporidium parvum
KGAPELFTGGIYGLNLTS

SEQ ID NO: 2296231 - protein, 18 aa, Cryptosporidium parvum
KGASMFSNIHQFSAESAL

SEQ ID NO: 2296232 - protein, 22 aa, Cryptosporidium parvum
KGDAGINWSQYLVFKRLNIKII

SEQ ID NO: 2296233 - protein, 20 aa, Cryptosporidium parvum
KGDFLSELVELVNCLEEPDD

SEQ ID NO: 2296234 - protein, 19 aa, Cryptosporidium parvum
KGDGNFRVFKFDNEEDSLT

SEQ ID NO: 2296235 - protein, 24 aa, Cryptosporidium parvum
KGDRLKYKTVWMGPGGGYSLMEEY

SEQ ID NO: 2296236 - protein, 23 aa, Cryptosporidium parvum
KGDRRRGRGRGRGRGMRGRGRGG

SEQ ID NO: 2296237 - protein, 18 aa, Cryptosporidium parvum
KGDTKLLFANANGRCLII

SEQ ID NO: 2296238 - protein, 20 aa, Cryptosporidium parvum
KGDVGGPLFNISPLQDLTLG

SEQ ID NO: 2296239 - protein, 21 aa, Cryptosporidium parvum
KGELLISLYRRLYILRPFIEK

SEQ ID NO: 2296240 - protein, 19 aa, Cryptosporidium parvum
KGELSVMQTGFFGYDSQLE

SEQ ID NO: 2296241 - protein, 17 aa, Cryptosporidium parvum
KGELVNILVIQDSRSGF

SEQ ID NO: 2296242 - protein, 18 aa, Cryptosporidium parvum
KGENRYGDKWEEEWKEDF

SEQ ID NO: 2296243 - protein, 18 aa, Cryptosporidium parvum
KGFAPFLDVYWKGDITFR

SEQ ID NO: 2296244 - protein, 27 aa, Cryptosporidium parvum
KGFTDHGWRMAVEFILFGSIPNMPYYT

SEQ ID NO: 2296245 - protein, 17 aa, Cryptosporidium parvum
KGFWEMCNSDSLHKSYM

SEQ ID NO: 2296246 - protein, 21 aa, Cryptosporidium parvum
KGGQIIISFTQLLPVPKAHFV

SEQ ID NO: 2296247 - protein, 20 aa, Cryptosporidium parvum
KGGQYCMQMSNGIYTLLDIK

SEQ ID NO: 2296248 - protein, 20 aa, Cryptosporidium parvum
KGGTRLKQFLSEISNVTNGI

SEQ ID NO: 2296249 - protein, 29 aa, Cryptosporidium parvum
KGGVLRQILKLILKIGNFLNHGTNRGKSC

SEQ ID NO: 2296250 - protein, 21 aa, Cryptosporidium parvum
KGHGHAVSFLKKFNVPLLILG

SEQ ID NO: 2296251 - protein, 30 aa, Cryptosporidium parvum
KGHLKLLDFGLCKFSPLIEGDENREYQTEN

SEQ ID NO: 2296252 - protein, 18 aa, Cryptosporidium parvum
KGIIFAKDLRDGYWDYGR

SEQ ID NO: 2296253 - protein, 21 aa, Cryptosporidium parvum
KGIPYQSALEKFWLVDSKGLI

SEQ ID NO: 2296254 - protein, 18 aa, Cryptosporidium parvum
KGIQRWGEKVTNELTKVT

SEQ ID NO: 2296255 - protein, 17 aa, Cryptosporidium parvum
KGKDIKLSFDVEELNDP

SEQ ID NO: 2296256 - protein, 23 aa, Cryptosporidium parvum
KGKESLAVIYSRLYDYFTDEDFE

SEQ ID NO: 2296257 - protein, 17 aa, Cryptosporidium parvum
KGKLCTFAHSKEEQLYH

SEQ ID NO: 2296258 - protein, 24 aa, Cryptosporidium parvum
KGKSLNKRGKLVIEPHEHESFNKR

SEQ ID NO: 2296259 - protein, 21 aa, Cryptosporidium parvum
KGLAEALSYLIKFRKQQKNFQ

SEQ ID NO: 2296260 - protein, 18 aa, Cryptosporidium parvum
KGLDVDRLMLVSAVVTHA

SEQ ID NO: 2296261 - protein, 27 aa, Cryptosporidium parvum
KGLDYWEFKEILLYCGEASSCGNDPIS

SEQ ID NO: 2296262 - protein, 24 aa, Cryptosporidium parvum
KGLGCSFLDIIYSFAIKDEDIMEI

SEQ ID NO: 2296263 - protein, 18 aa, Cryptosporidium parvum
KGLGELGFVIGRHGPDSD

SEQ ID NO: 2296264 - protein, 18 aa, Cryptosporidium parvum
KGLIFSTPIFDRNDLLEI

SEQ ID NO: 2296265 - protein, 23 aa, Cryptosporidium parvum
KGLKGNDLTLFLLRKEQLSLFAE

SEQ ID NO: 2296266 - protein, 17 aa, Cryptosporidium parvum
KGLRYQLPMRGHTGYLS

SEQ ID NO: 2296267 - protein, 18 aa, Cryptosporidium parvum
KGLSCIRWNPHDNNVFST

SEQ ID NO: 2296268 - protein, 25 aa, Cryptosporidium parvum
KGLSFHPKLPWVLVSLHNGVIQFWD

SEQ ID NO: 2296269 - protein, 26 aa, Cryptosporidium parvum
KGLSRKSVNVLLHFLTLYSQVIKLVN

SEQ ID NO: 2296270 - protein, 25 aa, Cryptosporidium parvum
KGLTPTQLGINWHACTQRFCVTYTT

SEQ ID NO: 2296271 - protein, 33 aa, Cryptosporidium parvum
KGNHLLKISLGFCILNGFKLQWLSDDSFNIYTE

SEQ ID NO: 2296272 - protein, 18 aa, Cryptosporidium parvum
KGNLLLSLVAIYNKCMAS

SEQ ID NO: 2296273 - protein, 17 aa, Cryptosporidium parvum
KGNTVHRGGRGGYTSSH

SEQ ID NO: 2296274 - protein, 17 aa, Cryptosporidium parvum
KGNYGFVEFRTVEETEK

SEQ ID NO: 2296275 - protein, 24 aa, Cryptosporidium parvum
KGPELKFPLGYVLTEKEQNRVKRG

SEQ ID NO: 2296276 - protein, 23 aa, Cryptosporidium parvum
KGPELSYDFNLYLEKYVHDQIKP

SEQ ID NO: 2296277 - protein, 18 aa, Cryptosporidium parvum
KGPLKEFRGYSLAGNDDG

SEQ ID NO: 2296278 - protein, 21 aa, Cryptosporidium parvum
KGPMVLFCYFLGKLYMQQDRF

SEQ ID NO: 2296279 - protein, 22 aa, Cryptosporidium parvum
KGPSPFPISPIINYNNYKQNIH

SEQ ID NO: 2296280 - protein, 17 aa, Cryptosporidium parvum
KGPTLADICKGGVTSIK

SEQ ID NO: 2296281 - protein, 27 aa, Cryptosporidium parvum
KGQTFLSNVLKCIWRVNNVNILNSVVH

SEQ ID NO: 2296282 - protein, 18 aa, Cryptosporidium parvum
KGRFHILDIYPLSIQQRN

SEQ ID NO: 2296283 - protein, 20 aa, Cryptosporidium parvum
KGRFYAFGRVFSGTVATGQK

SEQ ID NO: 2296284 - protein, 21 aa, Cryptosporidium parvum
KGRHCKGNYPLAKEDNINYDI

SEQ ID NO: 2296285 - protein, 24 aa, Cryptosporidium parvum
KGRKCSSSRCILRGRCICYNNVFF

SEQ ID NO: 2296286 - protein, 24 aa, Cryptosporidium parvum
KGRKIRYVPIPKLENFMASSPSLY

SEQ ID NO: 2296287 - protein, 18 aa, Cryptosporidium parvum
KGRLISIVCQLNKGVFKV

SEQ ID NO: 2296288 - protein, 23 aa, Cryptosporidium parvum
KGRLKVVKYQGVRYIQNYLKNRA

SEQ ID NO: 2296289 - protein, 19 aa, Cryptosporidium parvum
KGRSDSKCRERYMNMLLPD

SEQ ID NO: 2296290 - protein, 28 aa, Cryptosporidium parvum
KGSAGLLFCVLGDGVAYLLSIPLLNNMI

SEQ ID NO: 2296291 - protein, 26 aa, Cryptosporidium parvum
KGSERRRGGGRYKFGGGYAEEDRRRE

SEQ ID NO: 2296292 - protein, 21 aa, Cryptosporidium parvum
KGSEVLDLFSKPSLWKNKDSD

SEQ ID NO: 2296293 - protein, 19 aa, Cryptosporidium parvum
KGSFGASLFKNPLRVAKIV

SEQ ID NO: 2296294 - protein, 18 aa, Cryptosporidium parvum
KGSLDQILGIYIRVLPRI

SEQ ID NO: 2296295 - protein, 18 aa, Cryptosporidium parvum
KGSLPEDCYYSADEDFQL

SEQ ID NO: 2296296 - protein, 19 aa, Cryptosporidium parvum
KGSMAYKHSLELKHHLFIN

SEQ ID NO: 2296297 - protein, 24 aa, Cryptosporidium parvum
KGTAAWKGMKVCVKLTVQNRQAKI

SEQ ID NO: 2296298 - protein, 18 aa, Cryptosporidium parvum
KGTMFKKISNAYQILSND

SEQ ID NO: 2296299 - protein, 23 aa, Cryptosporidium parvum
KGVAFKKTFSYAGFEQQPKHFVN

SEQ ID NO: 2296300 - protein, 21 aa, Cryptosporidium parvum
KGVFDLLKPGGMMLFADISPT

SEQ ID NO: 2296301 - protein, 22 aa, Cryptosporidium parvum
KGVKIIGPIALHIFPKSEFYYN

SEQ ID NO: 2296302 - protein, 26 aa, Cryptosporidium parvum
KGYISLKSIEQWAKMQYNSFCQDNNS

SEQ ID NO: 2296303 - protein, 21 aa, Cryptosporidium parvum
KGYLIHFTQDISWIYSKMDTS

SEQ ID NO: 2296304 - protein, 28 aa, Cryptosporidium parvum
KHAMSKSQLKALFSIFKISNYTQTFRSI

SEQ ID NO: 2296305 - protein, 22 aa, Cryptosporidium parvum
KHDRLNCPICRGMHLEDAPLLY

SEQ ID NO: 2296306 - protein, 24 aa, Cryptosporidium parvum
KHESEFKNRVEILQNFDFSVASSR

SEQ ID NO: 2296307 - protein, 20 aa, Cryptosporidium parvum
KHEVAKLLCLDRIPSSNELI

SEQ ID NO: 2296308 - protein, 22 aa, Cryptosporidium parvum
KHGVLIPKRIHTILVSVQHDEN

SEQ ID NO: 2296309 - protein, 19 aa, Cryptosporidium parvum
KHICNKCGCSGKPPDENHR

SEQ ID NO: 2296310 - protein, 22 aa, Cryptosporidium parvum
KHIKRKKIMIRNEISNIKRSLH

SEQ ID NO: 2296311 - protein, 20 aa, Cryptosporidium parvum
KHILELDESITRAGRLDIHI

SEQ ID NO: 2296312 - protein, 17 aa, Cryptosporidium parvum
KHINWLESEISRVDEEW

SEQ ID NO: 2296313 - protein, 24 aa, Cryptosporidium parvum
KHKKMPCKSALNFGENIINMGAPS

SEQ ID NO: 2296314 - protein, 28 aa, Cryptosporidium parvum
KHKRWRKFFPCLKKNINYDVNTINNTTN

SEQ ID NO: 2296315 - protein, 19 aa, Cryptosporidium parvum
KHLILYFNLIIFSIKSGKS

SEQ ID NO: 2296316 - protein, 24 aa, Cryptosporidium parvum
KHLKLPLKLIKDLFIQVFGTPRYH

SEQ ID NO: 2296317 - protein, 24 aa, Cryptosporidium parvum
KHMKDHLVCIMCMFEDHVNIMLDN

SEQ ID NO: 2296318 - protein, 17 aa, Cryptosporidium parvum
KHPHYCGVNMVRGMSSP

SEQ ID NO: 2296319 - protein, 20 aa, Cryptosporidium parvum
KHPLLLLKPEFQSWRILLKN

SEQ ID NO: 2296320 - protein, 24 aa, Cryptosporidium parvum
KHPRGELKLWPTSYDRVISQNSSK

SEQ ID NO: 2296321 - protein, 26 aa, Cryptosporidium parvum
KHSKYLGCSIIRKSLYKVRKQIKKNN

SEQ ID NO: 2296322 - protein, 20 aa, Cryptosporidium parvum
KHSMRAKVPISIYFNDNISS

SEQ ID NO: 2296323 - protein, 22 aa, Cryptosporidium parvum
KHSMRIPGLVLDSCPFQSSQGA

SEQ ID NO: 2296324 - protein, 25 aa, Cryptosporidium parvum
KHTFVKDKLNGIVHSFKNCTDYYSS

SEQ ID NO: 2296325 - protein, 27 aa, Cryptosporidium parvum
KHTHCNKCIKFGLSLDQIQIHDKLYHQ

SEQ ID NO: 2296326 - protein, 19 aa, Cryptosporidium parvum
KHTPDVISPLFAYNKSYSR

SEQ ID NO: 2296327 - protein, 17 aa, Cryptosporidium parvum
KHTSAYKRLEHLRESGL

SEQ ID NO: 2296328 - protein, 22 aa, Cryptosporidium parvum
KHYCQVCKIWIENHPNNIRSHQ

SEQ ID NO: 2296329 - protein, 18 aa, Cryptosporidium parvum
KHYESMLWDTYEDVKLDS

SEQ ID NO: 2296330 - protein, 18 aa, Cryptosporidium parvum
KHYKKWIDQLKMIEDVVS

SEQ ID NO: 2296331 - protein, 19 aa, Cryptosporidium parvum
KHYLLPLILLYSDLKESEA

SEQ ID NO: 2296332 - protein, 19 aa, Cryptosporidium parvum
KIAAARELYEETGLDFRNR

SEQ ID NO: 2296333 - protein, 28 aa, Cryptosporidium parvum
KIAALRDIRNLFPIYRNPLYAGFGNRDT

SEQ ID NO: 2296334 - protein, 21 aa, Cryptosporidium parvum
KIACTQPRRVAAMSVAQRVSE

SEQ ID NO: 2296335 - protein, 17 aa, Cryptosporidium parvum
KIALSLLCIIFKDYKFE

SEQ ID NO: 2296336 - protein, 26 aa, Cryptosporidium parvum
KIASEWRPSCDYPHLLDESVQIFHSN

SEQ ID NO: 2296337 - protein, 20 aa, Cryptosporidium parvum
KICCTLCGRVKCSNCNISNT

SEQ ID NO: 2296338 - protein, 23 aa, Cryptosporidium parvum
KICNFSFQLIGRFIHSKRLNISI

SEQ ID NO: 2296339 - protein, 23 aa, Cryptosporidium parvum
KICSCLSESSAKIWEYLPENIRE

SEQ ID NO: 2296340 - protein, 25 aa, Cryptosporidium parvum
KICSRSCFKKISGVNFEDYDPNSSS

SEQ ID NO: 2296341 - protein, 23 aa, Cryptosporidium parvum
KIDESRVPSFLLIETAHQIIHIC

SEQ ID NO: 2296342 - protein, 18 aa, Cryptosporidium parvum
KIDVRRLDDYVLRLDNYD

SEQ ID NO: 2296343 - protein, 28 aa, Cryptosporidium parvum
KIDYQLGLTRVFFKFNVLDKVEQFIQKC

SEQ ID NO: 2296344 - protein, 21 aa, Cryptosporidium parvum
KIEAQIGFLEFIIIPQWKLLS

SEQ ID NO: 2296345 - protein, 23 aa, Cryptosporidium parvum
KIEDSDVFALSWEGKLLECFSSN

SEQ ID NO: 2296346 - protein, 18 aa, Cryptosporidium parvum
KIEFPFLINWNKILNYSC

SEQ ID NO: 2296347 - protein, 18 aa, Cryptosporidium parvum
KIEIRRKYYVKVTPINTK

SEQ ID NO: 2296348 - protein, 20 aa, Cryptosporidium parvum
KIELKKDEKFVFESNPNVDS

SEQ ID NO: 2296349 - protein, 21 aa, Cryptosporidium parvum
KIESECIIMGFVTKEMKNRPT

SEQ ID NO: 2296350 - protein, 17 aa, Cryptosporidium parvum
KIFAARIAAAAGISTFL

SEQ ID NO: 2296351 - protein, 18 aa, Cryptosporidium parvum
KIFPKLLSYFKIDLQVEQ

SEQ ID NO: 2296352 - protein, 19 aa, Cryptosporidium parvum
KIFSLGPLENWLSTYETIK

SEQ ID NO: 2296353 - protein, 18 aa, Cryptosporidium parvum
KIGAWKLRNCIMNIFPYL

SEQ ID NO: 2296354 - protein, 20 aa, Cryptosporidium parvum
KIGDEYFCFLTESKTPKACS

SEQ ID NO: 2296355 - protein, 22 aa, Cryptosporidium parvum
KIGDTWIHYIAFELLNGDFQSQ

SEQ ID NO: 2296356 - protein, 19 aa, Cryptosporidium parvum
KIGEYGIDAYRDYALDIFS

SEQ ID NO: 2296357 - protein, 25 aa, Cryptosporidium parvum
KIGFGDFRIEYCTRIIQLLKKNFPI

SEQ ID NO: 2296358 - protein, 25 aa, Cryptosporidium parvum
KIGMEILKMIYLNWVPEEKILMMNV

SEQ ID NO: 2296359 - protein, 25 aa, Cryptosporidium parvum
KIGNEDYLRYGVRYIGNKAINGNNE

SEQ ID NO: 2296360 - protein, 18 aa, Cryptosporidium parvum
KIGNEFIGEIGIDLDIEK

SEQ ID NO: 2296361 - protein, 23 aa, Cryptosporidium parvum
KIHFSTESCCLVIKETWRSLYVY

SEQ ID NO: 2296362 - protein, 22 aa, Cryptosporidium parvum
KIHKVNIIPEFGIFKNEDKNGA

SEQ ID NO: 2296363 - protein, 19 aa, Cryptosporidium parvum
KIIIPEILSLYTVTKEQNS

SEQ ID NO: 2296364 - protein, 24 aa, Cryptosporidium parvum
KIIKPAYLFYGCRTENEIIYKDEL

SEQ ID NO: 2296365 - protein, 18 aa, Cryptosporidium parvum
KIILKILVFVNFSSSNYD

SEQ ID NO: 2296366 - protein, 19 aa, Cryptosporidium parvum
KIINELFLAIKNLFLEQES

SEQ ID NO: 2296367 - protein, 25 aa, Cryptosporidium parvum
KIIPMSLEIGDYVISRDVCIERKSL

SEQ ID NO: 2296368 - protein, 24 aa, Cryptosporidium parvum
KIIPVGGDILCFLPGQQEIEEAQA

SEQ ID NO: 2296369 - protein, 20 aa, Cryptosporidium parvum
KIISEWGAPVSKNLSSQAEK

SEQ ID NO: 2296370 - protein, 26 aa, Cryptosporidium parvum
KIITEISSIISVCIETKVDIKDSIDV

SEQ ID NO: 2296371 - protein, 20 aa, Cryptosporidium parvum
KIIVIFVINIEYFPREDKKL

SEQ ID NO: 2296372 - protein, 19 aa, Cryptosporidium parvum
KIKASLLRPEYKIKAIYPE

SEQ ID NO: 2296373 - protein, 23 aa, Cryptosporidium parvum
KIKETQHLFKYCIMLLEKENNIN

SEQ ID NO: 2296374 - protein, 22 aa, Cryptosporidium parvum
KIKFHPSFEYRGSYYDIEKEKL

SEQ ID NO: 2296375 - protein, 21 aa, Cryptosporidium parvum
KIKFKRLGLDPSKKSNQSEKV

SEQ ID NO: 2296376 - protein, 27 aa, Cryptosporidium parvum
KIKIGALNLYVWCSIPLSELNYIPEWF

SEQ ID NO: 2296377 - protein, 23 aa, Cryptosporidium parvum
KIKNIIIKFGRDFPIKFRKFEEI

SEQ ID NO: 2296378 - protein, 22 aa, Cryptosporidium parvum
KIKRPICAIPNLAIHLTTSEER

SEQ ID NO: 2296379 - protein, 17 aa, Cryptosporidium parvum
KIKSLQFSTLRLIRENL

SEQ ID NO: 2296380 - protein, 26 aa, Cryptosporidium parvum
KILCRQCKGTRNINIPIWRQGTMLPR

SEQ ID NO: 2296381 - protein, 18 aa, Cryptosporidium parvum
KILDGCANTPRFLHTSLT

SEQ ID NO: 2296382 - protein, 19 aa, Cryptosporidium parvum
KILFLSSLTQISWLLNLRG

SEQ ID NO: 2296383 - protein, 17 aa, Cryptosporidium parvum
KILILFRHDSFGVVELC

SEQ ID NO: 2296384 - protein, 21 aa, Cryptosporidium parvum
KILKDVICIGIGGSYLGPEFV

SEQ ID NO: 2296385 - protein, 23 aa, Cryptosporidium parvum
KILKHGCNVFINRQLIYNYPDQL

SEQ ID NO: 2296386 - protein, 23 aa, Cryptosporidium parvum
KILKIKSKILVYKRYEDYIRLLP

SEQ ID NO: 2296387 - protein, 20 aa, Cryptosporidium parvum
KILKLCLSSLKVIVESKTWD

SEQ ID NO: 2296388 - protein, 18 aa, Cryptosporidium parvum
KILKPKLLLVPSDVLTLF

SEQ ID NO: 2296389 - protein, 23 aa, Cryptosporidium parvum
KILKRQLEILTHVNTSFGINYTP

SEQ ID NO: 2296390 - protein, 25 aa, Cryptosporidium parvum
KILLSDIVFCKTWVSMTPREFYNPV

SEQ ID NO: 2296391 - protein, 18 aa, Cryptosporidium parvum
KILPKRFSSKPKQARLAF

SEQ ID NO: 2296392 - protein, 18 aa, Cryptosporidium parvum
KILSIVCNICKQTFMCTA

SEQ ID NO: 2296393 - protein, 25 aa, Cryptosporidium parvum
KILVSYFKQFPCSYLLINSNFKTNR

SEQ ID NO: 2296394 - protein, 19 aa, Cryptosporidium parvum
KILVVPDYINYVGLNISEK

SEQ ID NO: 2296395 - protein, 17 aa, Cryptosporidium parvum
KIMESEGKLLLPAINVN

SEQ ID NO: 2296396 - protein, 23 aa, Cryptosporidium parvum
KINFLTRISDKWISLSTNQFSKD

SEQ ID NO: 2296397 - protein, 19 aa, Cryptosporidium parvum
KINPIQVYLYKSWLVHWSL

SEQ ID NO: 2296398 - protein, 18 aa, Cryptosporidium parvum
KINPRTNVMFNISSVQFL

SEQ ID NO: 2296399 - protein, 26 aa, Cryptosporidium parvum
KINQWTSIVRWEFKHPTPFIRTREFL

SEQ ID NO: 2296400 - protein, 21 aa, Cryptosporidium parvum
KIPDYCLEMISQVSSEFGLLK

SEQ ID NO: 2296401 - protein, 19 aa, Cryptosporidium parvum
KIPKDFYGIDSFLEHAKQY

SEQ ID NO: 2296402 - protein, 18 aa, Cryptosporidium parvum
KIPKSFLPIHESLQQEDD

SEQ ID NO: 2296403 - protein, 23 aa, Cryptosporidium parvum
KIPLEIKDKVGIKMIKELLADPN

SEQ ID NO: 2296404 - protein, 18 aa, Cryptosporidium parvum
KIPPDICYLSHYNMSKSF

SEQ ID NO: 2296405 - protein, 18 aa, Cryptosporidium parvum
KIPVVIPTCSEWFDMDSV

SEQ ID NO: 2296406 - protein, 19 aa, Cryptosporidium parvum
KIQCLIKYNKLEEATTEFN

SEQ ID NO: 2296407 - protein, 24 aa, Cryptosporidium parvum
KIQEKRFPFSNCERKSLLLNDKNF

SEQ ID NO: 2296408 - protein, 18 aa, Cryptosporidium parvum
KIQGESFVSEFFPSSMVP

SEQ ID NO: 2296409 - protein, 26 aa, Cryptosporidium parvum
KIQKSSFPHGSYRPSSSNISINNGIN

SEQ ID NO: 2296410 - protein, 25 aa, Cryptosporidium parvum
KIQSFMIWICKDFIAPRVIHSETDA

SEQ ID NO: 2296411 - protein, 20 aa, Cryptosporidium parvum
KIRDYFTCMLFITLKFQDIF

SEQ ID NO: 2296412 - protein, 22 aa, Cryptosporidium parvum
KIREVNKGDNLCMVAVDDIALE

SEQ ID NO: 2296413 - protein, 24 aa, Cryptosporidium parvum
KIRKKGYILIEWVNRIRILLRMRN

SEQ ID NO: 2296414 - protein, 26 aa, Cryptosporidium parvum
KIRPVKLKWSVGWRRMNKKLTNQGAT

SEQ ID NO: 2296415 - protein, 20 aa, Cryptosporidium parvum
KIRRLFKLDLDEYTPGGGSG

SEQ ID NO: 2296416 - protein, 19 aa, Cryptosporidium parvum
KISALDYGIQLGMKNVPFI

SEQ ID NO: 2296417 - protein, 26 aa, Cryptosporidium parvum
KISDSLRFPVPIKKLLFALELVQHKF

SEQ ID NO: 2296418 - protein, 19 aa, Cryptosporidium parvum
KISDVYVCVCCNSGDKIPK

SEQ ID NO: 2296419 - protein, 24 aa, Cryptosporidium parvum
KISEISKLLVDWASQFFNVDDNIL

SEQ ID NO: 2296420 - protein, 25 aa, Cryptosporidium parvum
KISEIYRGLVRLNFGLDQRIKSLEE

SEQ ID NO: 2296421 - protein, 18 aa, Cryptosporidium parvum
KISEPEYSPSNFEFNPNI

SEQ ID NO: 2296422 - protein, 22 aa, Cryptosporidium parvum
KISFKSKRGVSIETIQNENETD

SEQ ID NO: 2296423 - protein, 24 aa, Cryptosporidium parvum
KISMIPKLHDILLILANSISSTVV

SEQ ID NO: 2296424 - protein, 29 aa, Cryptosporidium parvum
KISNCGHIYCWPCIIKLMNIILENDEYAK

SEQ ID NO: 2296425 - protein, 19 aa, Cryptosporidium parvum
KISSVVWTHTNELLMLVDD

SEQ ID NO: 2296426 - protein, 23 aa, Cryptosporidium parvum
KISVMLTECIRQCTIKDLSSGIY

SEQ ID NO: 2296427 - protein, 18 aa, Cryptosporidium parvum
KISYSVIEHYFKVDANSK

SEQ ID NO: 2296428 - protein, 19 aa, Cryptosporidium parvum
KITAFPDVRIIPLTNEDEF

SEQ ID NO: 2296429 - protein, 21 aa, Cryptosporidium parvum
KITANELLNVFSYNSEQGSAG

SEQ ID NO: 2296430 - protein, 30 aa, Cryptosporidium parvum; identical to SEQ ID NO: 2174802

SEQ ID NO: 2296431 - protein, 20 aa, Cryptosporidium parvum
KIVAEYAKHVYLHHLKAYRS

SEQ ID NO: 2296432 - protein, 21 aa, Cryptosporidium parvum
KIVFRRYASLYFIMGLENSNT

SEQ ID NO: 2296433 - protein, 23 aa, Cryptosporidium parvum
KIVILLYKYLVCIENNNFQNSSN

SEQ ID NO: 2296434 - protein, 19 aa, Cryptosporidium parvum
KIVINKAIEGFLSEEQREF

SEQ ID NO: 2296435 - protein, 25 aa, Cryptosporidium parvum
KIVQDACKVPCHLISSNAGFDGSVI

SEQ ID NO: 2296436 - protein, 37 aa, Cryptosporidium parvum
KIVRLGIKLYPNWKWSQRWHGIREKFYLWVTNPNDGA

SEQ ID NO: 2296437 - protein, 17 aa, Cryptosporidium parvum
KIYLCIMNSLNYEECTH

SEQ ID NO: 2296438 - protein, 22 aa, Cryptosporidium parvum
KIYLKVRTSQFFPSKITESQNK

SEQ ID NO: 2296439 - protein, 21 aa, Cryptosporidium parvum
KIYLYQLLRGVAHCHQHRILH

SEQ ID NO: 2296440 - protein, 18 aa, Cryptosporidium parvum
KKAEEIRQIFNIENDFTP

SEQ ID NO: 2296441 - protein, 20 aa, Cryptosporidium parvum
KKAIRQICFCGSDSEESYDD

SEQ ID NO: 2296442 - protein, 18 aa, Cryptosporidium parvum
KKALTWGLGLQGRLGHGD

SEQ ID NO: 2296443 - protein, 24 aa, Cryptosporidium parvum
KKANIGCVMLAGSMSILQRNSILY

SEQ ID NO: 2296444 - protein, 20 aa, Cryptosporidium parvum
KKAPKLTIFIGGNHETPNVL

SEQ ID NO: 2296445 - protein, 20 aa, Cryptosporidium parvum
KKAQIPIYWEDFENCCYTKD

SEQ ID NO: 2296446 - protein, 18 aa, Cryptosporidium parvum
KKASEWRNELLSFPHIFN

SEQ ID NO: 2296447 - protein, 18 aa, Cryptosporidium parvum
KKATFKWHPKKPALKSFI

SEQ ID NO: 2296448 - protein, 20 aa, Cryptosporidium parvum
KKAVVPCSAFCSNHYGVKGI

SEQ ID NO: 2296449 - protein, 18 aa, Cryptosporidium parvum
KKCHSMGIIHRDVKPENI

SEQ ID NO: 2296450 - protein, 21 aa, Cryptosporidium parvum
KKCVCKKLPVKSLISGRANCI

SEQ ID NO: 2296451 - protein, 20 aa, Cryptosporidium parvum
KKDEMFWKKSIVNNEDVATH

SEQ ID NO: 2296452 - protein, 22 aa, Cryptosporidium parvum
KKDEPVPWWLANVDKPNLVEVD

SEQ ID NO: 2296453 - protein, 23 aa, Cryptosporidium parvum
KKDFEGVELVYLVMGDISSNEVA

SEQ ID NO: 2296454 - protein, 20 aa, Cryptosporidium parvum
KKDIPPRVLFALNTPEGSQL

SEQ ID NO: 2296455 - protein, 18 aa, Cryptosporidium parvum
KKDSFGFERDFLNLQRYY

SEQ ID NO: 2296456 - protein, 37 aa, Cryptosporidium parvum
KKDTWDYRIRCAECIEYDLCLDCFCQGKSSNDHKPNH

SEQ ID NO: 2296457 - protein, 19 aa, Cryptosporidium parvum
KKDVEFILGNICELDQVHN

SEQ ID NO: 2296458 - protein, 23 aa, Cryptosporidium parvum
KKDVRLVIHLSMPKSLENYYQES

SEQ ID NO: 2296459 - protein, 17 aa, Cryptosporidium parvum
KKEELLIGGLSVCKHIF

SEQ ID NO: 2296460 - protein, 18 aa, Cryptosporidium parvum
KKEGIIMDLQNELGQIKS

SEQ ID NO: 2296461 - protein, 31 aa, Cryptosporidium parvum
KKEGKFLFKPFAEVARAVGIPAHSSYKEKSE

SEQ ID NO: 2296462 - protein, 18 aa, Cryptosporidium parvum
KKELDRWMNSENNSDESK

SEQ ID NO: 2296463 - protein, 23 aa, Cryptosporidium parvum
KKENFRFGSIGIHLFKLQFIQEI

SEQ ID NO: 2296464 - protein, 31 aa, Cryptosporidium parvum
KKEQCFKLFKSRSFPIKDFRGTANKKVFYHY

SEQ ID NO: 2296465 - protein, 20 aa, Cryptosporidium parvum
KKERDLRKLMGVRGTKSSES

SEQ ID NO: 2296466 - protein, 19 aa, Cryptosporidium parvum
KKESHGIGGRSRRVSTLNF

SEQ ID NO: 2296467 - protein, 26 aa, Cryptosporidium parvum
KKESKLSRLSFRGDKESKGLDKINSM

SEQ ID NO: 2296468 - protein, 19 aa, Cryptosporidium parvum
KKESPRSIIEKKFIDTEEN

SEQ ID NO: 2296469 - protein, 19 aa, Cryptosporidium parvum
KKESWREICKKMNNIKIND

SEQ ID NO: 2296470 - protein, 19 aa, Cryptosporidium parvum
KKFKEFEIGISRFYKNNDI

SEQ ID NO: 2296471 - protein, 24 aa, Cryptosporidium parvum
KKFKENLCIDGLFIGNLDRAELEK

SEQ ID NO: 2296472 - protein, 18 aa, Cryptosporidium parvum
KKFLYIWTKCSNLKSEMI

SEQ ID NO: 2296473 - protein, 19 aa, Cryptosporidium parvum
KKFPIPIRFDKKGIPKDCK

SEQ ID NO: 2296474 - protein, 23 aa, Cryptosporidium parvum
KKFREINNKISIFNQEESYTKKD

SEQ ID NO: 2296475 - protein, 26 aa, Cryptosporidium parvum
KKFRKAVYISSEWLKVFKINHFNIID

SEQ ID NO: 2296476 - protein, 17 aa, Cryptosporidium parvum
KKFRSNEDFPEYYHDLF

SEQ ID NO: 2296477 - protein, 35 aa, Cryptosporidium parvum; identical to SEQ ID NO: 2174838

SEQ ID NO: 2296478 - protein, 23 aa, Cryptosporidium parvum
KKGDPETCPAFLFVTPEKLKHSK

SEQ ID NO: 2296479 - protein, 21 aa, Cryptosporidium parvum
KKGGILGNFFSQVYNTFISGS

SEQ ID NO: 2296480 - protein, 24 aa, Cryptosporidium parvum
KKGKHIRGKILVLISSLSSAYSNI

SEQ ID NO: 2296481 - protein, 24 aa, Cryptosporidium parvum
KKGKIKVECNYAFTPTKSSLRVRC

SEQ ID NO: 2296482 - protein, 24 aa, Cryptosporidium parvum
KKGLEPMMAITYLLNYILHRDDYG

SEQ ID NO: 2296483 - protein, 26 aa, Cryptosporidium parvum
KKGLKEIEGFTGFFPIQQKVIPYILD

SEQ ID NO: 2296484 - protein, 19 aa, Cryptosporidium parvum
KKGLPEFVLECSNMDEKEL

SEQ ID NO: 2296485 - protein, 19 aa, Cryptosporidium parvum
KKGMKQWDSEFSASSHNKQ

SEQ ID NO: 2296486 - protein, 24 aa, Cryptosporidium parvum
KKGNVHKGLYISWHPKTRRFVVAL

SEQ ID NO: 2296487 - protein, 23 aa, Cryptosporidium parvum
KKGRPTINLRGDFFNSIRKKRQG

SEQ ID NO: 2296488 - protein, 20 aa, Cryptosporidium parvum
KKGSFAIFYGIGFRIIQSEE

SEQ ID NO: 2296489 - protein, 17 aa, Cryptosporidium parvum
KKGVDIVVGCPGRVLDF

SEQ ID NO: 2296490 - protein, 25 aa, Cryptosporidium parvum
KKHIMLAKFIRYILRPDPNLRPTPE

SEQ ID NO: 2296491 - protein, 18 aa, Cryptosporidium parvum
KKHIRNFEMEKVYYIFEK

SEQ ID NO: 2296492 - protein, 19 aa, Cryptosporidium parvum
KKHLLDNIDLYFSQDKEDE

SEQ ID NO: 2296493 - protein, 21 aa, Cryptosporidium parvum
KKHSYRELLIDEILNTLTIES

SEQ ID NO: 2296494 - protein, 19 aa, Cryptosporidium parvum
KKHVLAIVYLACREEGVSR

SEQ ID NO: 2296495 - protein, 18 aa, Cryptosporidium parvum
KKICGINIIKKIFVFENE

SEQ ID NO: 2296496 - protein, 19 aa, Cryptosporidium parvum
KKIDLLVSCVDNYSARSII

SEQ ID NO: 2296497 - protein, 27 aa, Cryptosporidium parvum
KKIGCFGIGFKSVFLITNTPFIFSNGY

SEQ ID NO: 2296498 - protein, 27 aa, Cryptosporidium parvum
KKIGLKTIWVGGVCDPGAFFTASKQYA

SEQ ID NO: 2296499 - protein, 20 aa, Cryptosporidium parvum
KKIIKGLCSSFLFEFDLNLP

SEQ ID NO: 2296500 - protein, 17 aa, Cryptosporidium parvum
KKIIVFVSCCKQVRFLS

SEQ ID NO: 2296501 - protein, 26 aa, Cryptosporidium parvum
KKIKNRPFKNCPICHTKWSRNPESLQ

SEQ ID NO: 2296502 - protein, 19 aa, Cryptosporidium parvum
KKINEHFSNFEINPVDVIR

SEQ ID NO: 2296503 - protein, 21 aa, Cryptosporidium parvum
KKIPWGLYICHLPIGPTSYFR

SEQ ID NO: 2296504 - protein, 21 aa, Cryptosporidium parvum
KKIQEVSGISCISDEKLDLEG

SEQ ID NO: 2296505 - protein, 27 aa, Cryptosporidium parvum
KKIQFPLDYYQKWVLEYNQIINNLYNT

SEQ ID NO: 2296506 - protein, 27 aa, Cryptosporidium parvum
KKIQKSIDFIYWLLKKKTDFHCSESET

SEQ ID NO: 2296507 - protein, 23 aa, Cryptosporidium parvum
KKIQKSLLFRLFKSEIHIYEKKM

SEQ ID NO: 2296508 - protein, 21 aa, Cryptosporidium parvum
KKIRSHRGLRHHWGVRVRGQH

SEQ ID NO: 2296509 - protein, 19 aa, Cryptosporidium parvum
KKISLEYLKADIQSRILRK

SEQ ID NO: 2296510 - protein, 17 aa, Cryptosporidium parvum
KKITAFVPRDGCLNYID

SEQ ID NO: 2296511 - protein, 22 aa, Cryptosporidium parvum
KKKCRQFLLKVMHYHSMRQFVD

SEQ ID NO: 2296512 - protein, 19 aa, Cryptosporidium parvum
KKKFTYREFFEKVVELSWY

SEQ ID NO: 2296513 - protein, 24 aa, Cryptosporidium parvum
KKKILPLIREYVSFKISTDKFKKN

SEQ ID NO: 2296514 - protein, 23 aa, Cryptosporidium parvum
KKKKYKRNLIFSGENNTIVSNPE

SEQ ID NO: 2296515 - protein, 21 aa, Cryptosporidium parvum
KKKLIACCITFNFTNNTYSNL

SEQ ID NO: 2296516 - protein, 33 aa, Cryptosporidium parvum
KKKNMGGISYKSGIPGVYWKTRDQEWVAEWYDQ

SEQ ID NO: 2296517 - protein, 24 aa, Cryptosporidium parvum
KKKNQIKGLIKFMGEDIVSIKSCA

SEQ ID NO: 2296518 - protein, 26 aa, Cryptosporidium parvum
KKKRSRVIYCHVCCQYKPRSTRARFQ

SEQ ID NO: 2296519 - protein, 25 aa, Cryptosporidium parvum
KKKSMSRPFGVAMLIAGADSDGSSS

SEQ ID NO: 2296520 - protein, 19 aa, Cryptosporidium parvum
KKKTLICSRKVVFIQTLYL

SEQ ID NO: 2296521 - protein, 25 aa, Cryptosporidium parvum
KKKVLPLGRRIHWKPLTEEMAQKTI

SEQ ID NO: 2296522 - protein, 20 aa, Cryptosporidium parvum
KKKYACIQIVDFHRKQLKLE

SEQ ID NO: 2296523 - protein, 17 aa, Cryptosporidium parvum
KKLALKIFKKCTPQNPT

SEQ ID NO: 2296524 - protein, 19 aa, Cryptosporidium parvum
KKLDKVMHLYHSMIYIESS

SEQ ID NO: 2296525 - protein, 29 aa, Cryptosporidium parvum
KKLEDYASWEMIKDLAICELKHIVYSDAE

SEQ ID NO: 2296526 - protein, 27 aa, Cryptosporidium parvum
KKLEIMSFSGLIDFSSIFVPYMSTAKR

SEQ ID NO: 2296527 - protein, 21 aa, Cryptosporidium parvum
KKLELKQRFCFIEYEDETQAE

SEQ ID NO: 2296528 - protein, 20 aa, Cryptosporidium parvum
KKLFQEPGIFTFIVPPLPQF

SEQ ID NO: 2296529 - protein, 19 aa, Cryptosporidium parvum
KKLGISKGYCFLCYEDQKS

SEQ ID NO: 2296530 - protein, 17 aa, Cryptosporidium parvum
KKLHITLGLVRAETPQE

SEQ ID NO: 2296531 - protein, 20 aa, Cryptosporidium parvum
KKLHLGHVASSFGINEQPNK

SEQ ID NO: 2296532 - protein, 25 aa, Cryptosporidium parvum
KKLIKILKKFCVLVSGNWVYKSELM

SEQ ID NO: 2296533 - protein, 19 aa, Cryptosporidium parvum
KKLIKQTIIPLIPDAEYNS

SEQ ID NO: 2296534 - protein, 17 aa, Cryptosporidium parvum
KKLILPLNIVSLVEIPS

SEQ ID NO: 2296535 - protein, 18 aa, Cryptosporidium parvum
KKLKAIESIEQFENKSKA

SEQ ID NO: 2296536 - protein, 17 aa, Cryptosporidium parvum
KKLKPILPKLAGKKEYF

SEQ ID NO: 2296537 - protein, 24 aa, Cryptosporidium parvum
KKLKRINFLDVNRFPNLIKLSWNS

SEQ ID NO: 2296538 - protein, 19 aa, Cryptosporidium parvum
KKLLDEISIEANVREINSI

SEQ ID NO: 2296539 - protein, 20 aa, Cryptosporidium parvum
KKLNEFNVFPISSEEKHNTY

SEQ ID NO: 2296540 - protein, 27 aa, Cryptosporidium parvum
KKLNFILNLQCMWRHYNLKIQLKAEEY

SEQ ID NO: 2296541 - protein, 17 aa, Cryptosporidium parvum
KKLNQWMGHLTSLSSIL

SEQ ID NO: 2296542 - protein, 17 aa, Cryptosporidium parvum
KKLPIYLFDGSQLLIKI

SEQ ID NO: 2296543 - protein, 22 aa, Cryptosporidium parvum
KKLQLRYLKQIILLPSTLLNII

SEQ ID NO: 2296544 - protein, 21 aa, Cryptosporidium parvum
KKLWTEKRISDVIKNCGEEEI

SEQ ID NO: 2296545 - protein, 23 aa, Cryptosporidium parvum
KKMFGESCKLLIGLDHENILEEK

SEQ ID NO: 2296546 - protein, 17 aa, Cryptosporidium parvum
KKMGEGVIRSKLKRMVD

SEQ ID NO: 2296547 - protein, 23 aa, Cryptosporidium parvum
KKMGIEVATSFLWFSILNNSQKE

SEQ ID NO: 2296548 - protein, 18 aa, Cryptosporidium parvum
KKMKAARQVVTNGSPKVE

SEQ ID NO: 2296549 - protein, 17 aa, Cryptosporidium parvum
KKMKSVLSWSQILNSGD

SEQ ID NO: 2296550 - protein, 36 aa, Cryptosporidium parvum; identical to SEQ ID NO: 2174902

SEQ ID NO: 2296551 - protein, 20 aa, Cryptosporidium parvum
KKNEESFSMYSIRAEYQNQF

SEQ ID NO: 2296552 - protein, 21 aa, Cryptosporidium parvum
KKNFIYMLLPMIIKKAFLAYN

SEQ ID NO: 2296553 - protein, 18 aa, Cryptosporidium parvum
KKNFLENQVVRWLTQALL

SEQ ID NO: 2296554 - protein, 18 aa, Cryptosporidium parvum
KKNGVSWKNASFFKSISK

SEQ ID NO: 2296555 - protein, 33 aa, Cryptosporidium parvum; identical to SEQ ID NO: 2174909

SEQ ID NO: 2296556 - protein, 20 aa, Cryptosporidium parvum
KKNKADVIIFGLINEQKKLT

SEQ ID NO: 2296557 - protein, 25 aa, Cryptosporidium parvum
KKNPYKYRMTLPFLQQKPRFNLWAS

SEQ ID NO: 2296558 - protein, 26 aa, Cryptosporidium parvum
KKNQKLEEFFLFFAQFLEKIVHISEK

SEQ ID NO: 2296559 - protein, 20 aa, Cryptosporidium parvum
KKNRLEVLKLRAAESNQRKI

SEQ ID NO: 2296560 - protein, 22 aa, Cryptosporidium parvum
KKNRLFYISKICSKKIEKVIPE

SEQ ID NO: 2296561 - protein, 17 aa, Cryptosporidium parvum
KKNRWIMEGECFEVVHK

SEQ ID NO: 2296562 - protein, 18 aa, Cryptosporidium parvum
KKNSSLPIFKYKDNNNNN

SEQ ID NO: 2296563 - protein, 17 aa, Cryptosporidium parvum
KKNVKIMSGLINLLLLF

SEQ ID NO: 2296564 - protein, 17 aa, Cryptosporidium parvum
KKNWNMYNEILNRERKN

SEQ ID NO: 2296565 - protein, 18 aa, Cryptosporidium parvum
KKPALLQRIVASKVNPKI

SEQ ID NO: 2296566 - protein, 20 aa, Cryptosporidium parvum
KKPIIKDIIENNNFEIEKNI

SEQ ID NO: 2296567 - protein, 18 aa, Cryptosporidium parvum
KKPIRLYYCKSLDFLWDW

SEQ ID NO: 2296568 - protein, 18 aa, Cryptosporidium parvum
KKPLKIMVFVVGGVTLEE

SEQ ID NO: 2296569 - protein, 20 aa, Cryptosporidium parvum
KKPMELFEIYKVKSYYIQHR

SEQ ID NO: 2296570 - protein, 22 aa, Cryptosporidium parvum
KKPYDCSFVSREFRGIEKSRQL

SEQ ID NO: 2296571 - protein, 25 aa, Cryptosporidium parvum
KKQFFDFVKRILIEDVTLQDENISL

SEQ ID NO: 2296572 - protein, 21 aa, Cryptosporidium parvum
KKQKKMVVKWKKLNSNVELFP

SEQ ID NO: 2296573 - protein, 21 aa, Cryptosporidium parvum
KKRALLASVHIIRVLEDAEIE

SEQ ID NO: 2296574 - protein, 25 aa, Cryptosporidium parvum
KKRCASCGYPSAKMRSYNWGQKAKR

SEQ ID NO: 2296575 - protein, 24 aa, Cryptosporidium parvum
KKRDGKCLPLQIGMNNNLNCSTIG

SEQ ID NO: 2296576 - protein, 18 aa, Cryptosporidium parvum
KKRISSLLTSLVNKIVFL

SEQ ID NO: 2296577 - protein, 18 aa, Cryptosporidium parvum
KKRKFLMISDHIGSGDEV

SEQ ID NO: 2296578 - protein, 18 aa, Cryptosporidium parvum
KKRMEIRELSKVYDKTED

SEQ ID NO: 2296579 - protein, 25 aa, Cryptosporidium parvum
KKRQICASVEKYLRSLSILKLNENE

SEQ ID NO: 2296580 - protein, 25 aa, Cryptosporidium parvum
KKRREWRQNFQINRIFFEEFPIYRK

SEQ ID NO: 2296581 - protein, 23 aa, Cryptosporidium parvum
KKRTRYNQLLGREVEVDSDDSNS

SEQ ID NO: 2296582 - protein, 17 aa, Cryptosporidium parvum
KKRVVLIKYDLYILCIL

SEQ ID NO: 2296583 - protein, 20 aa, Cryptosporidium parvum
KKSDCIDIILNNSPDTPLSS

SEQ ID NO: 2296584 - protein, 20 aa, Cryptosporidium parvum
KKSFLPPLFISRPLNLYSYS

SEQ ID NO: 2296585 - protein, 20 aa, Cryptosporidium parvum
KKSGIGRGFGFVTFTSTSVV

SEQ ID NO: 2296586 - protein, 19 aa, Cryptosporidium parvum
KKSHSMGVTCIQKSNRNHQ

SEQ ID NO: 2296587 - protein, 18 aa, Cryptosporidium parvum
KKSICKTASKSCNSKSSK

SEQ ID NO: 2296588 - protein, 20 aa, Cryptosporidium parvum
KKSIKECCEILNLKISNLNN

SEQ ID NO: 2296589 - protein, 25 aa, Cryptosporidium parvum
KKSIKFYNEHPELLKDFDRSNKVKR

SEQ ID NO: 2296590 - protein, 19 aa, Cryptosporidium parvum
KKSKFCMNFIIESFINLCS

SEQ ID NO: 2296591 - protein, 19 aa, Cryptosporidium parvum
KKSKYNYIGPWRKDQKEKV

SEQ ID NO: 2296592 - protein, 21 aa, Cryptosporidium parvum
KKSLEISEKFYSKCGNLSLNG

SEQ ID NO: 2296593 - protein, 19 aa, Cryptosporidium parvum
KKSLKRKLPSKSDESTEEE

SEQ ID NO: 2296594 - protein, 17 aa, Cryptosporidium parvum
KKSLLEKWLDLKKIYES

SEQ ID NO: 2296595 - protein, 19 aa, Cryptosporidium parvum
KKSLSFPKFLGGIELDINQ

SEQ ID NO: 2296596 - protein, 26 aa, Cryptosporidium parvum
KKSNSLVGLYAEWVDKNTIWDVRKGP

SEQ ID NO: 2296597 - protein, 26 aa, Cryptosporidium parvum
KKSPLEFLKMIKAMVNKDVFEVCDTI

SEQ ID NO: 2296598 - protein, 20 aa, Cryptosporidium parvum
KKSQRLSLDVNYSMKNSKPC

SEQ ID NO: 2296599 - protein, 17 aa, Cryptosporidium parvum
KKSRANTKLALDIDSDI

SEQ ID NO: 2296600 - protein, 24 aa, Cryptosporidium parvum
KKSTSSGRCQFCGSSKCDRKAKNC

SEQ ID NO: 2296601 - protein, 17 aa, Cryptosporidium parvum
KKTLIIFVLDYEFCLSL

SEQ ID NO: 2296602 - protein, 25 aa, Cryptosporidium parvum
KKTVLRFPISISMYSLLLFASDSLQ

SEQ ID NO: 2296603 - protein, 25 aa, Cryptosporidium parvum
KKVDSIFRNEIYKILDNTRLVKKAQ

SEQ ID NO: 2296604 - protein, 24 aa, Cryptosporidium parvum
KKVKFYLDPIMDFDINLYNQTNLV

SEQ ID NO: 2296605 - protein, 24 aa, Cryptosporidium parvum
KKVKLEIVTKMLLDLNKQISEARK

SEQ ID NO: 2296606 - protein, 17 aa, Cryptosporidium parvum
KKVLESCVARLLRDLFP

SEQ ID NO: 2296607 - protein, 26 aa, Cryptosporidium parvum
KKWHQKFKLSFLLFSYNKNIEKNKVK

SEQ ID NO: 2296608 - protein, 23 aa, Cryptosporidium parvum
KKWQFHKKCFAWFYKRSDSKITT

SEQ ID NO: 2296609 - protein, 27 aa, Cryptosporidium parvum
KKYDIDVSKEWGIRMEIDHSSGGGLQS

SEQ ID NO: 2296610 - protein, 24 aa, Cryptosporidium parvum
KKYFLKEFHDIILFTYRNEFKNII

SEQ ID NO: 2296611 - protein, 22 aa, Cryptosporidium parvum
KKYGKNCILNYWANAYKTNINN

SEQ ID NO: 2296612 - protein, 25 aa, Cryptosporidium parvum
KKYIKPKLINRLEISEEGISGENAL

SEQ ID NO: 2296613 - protein, 32 aa, Cryptosporidium parvum; identical to SEQ ID NO: 2174943

SEQ ID NO: 2296614 - protein, 24 aa, Cryptosporidium parvum
KKYKLRSYISILRYITMMIENCAS

SEQ ID NO: 2296615 - protein, 21 aa, Cryptosporidium parvum
KKYNKYMLDGFYALARQTQSI

SEQ ID NO: 2296616 - protein, 20 aa, Cryptosporidium parvum
KKYRKAFDIFSMKFDSYSEY

SEQ ID NO: 2296617 - protein, 18 aa, Cryptosporidium parvum
KKYSLKLNDIKGIINEYN

SEQ ID NO: 2296618 - protein, 23 aa, Cryptosporidium parvum
KKYVFKIKYILANKYNLSVEFND

SEQ ID NO: 2296619 - protein, 17 aa, Cryptosporidium parvum
KKYVPCMILRRKIQKTV

SEQ ID NO: 2296620 - protein, 30 aa, Cryptosporidium parvum; identical to SEQ ID NO: 2174949

SEQ ID NO: 2296621 - protein, 23 aa, Cryptosporidium parvum
KKYYLCLWAGFYSTIPQTLPQGL

SEQ ID NO: 2296622 - protein, 18 aa, Cryptosporidium parvum
KLASRFRFLRLIQDKKYC

SEQ ID NO: 2296623 - protein, 19 aa, Cryptosporidium parvum
KLCGVFECNYTDTGGEIIH

SEQ ID NO: 2296624 - protein, 20 aa, Cryptosporidium parvum
KLDAGYGIKSNVFINDLSSQ

SEQ ID NO: 2296625 - protein, 18 aa, Cryptosporidium parvum
KLDDGGYFTCEGRQLLTL

SEQ ID NO: 2296626 - protein, 23 aa, Cryptosporidium parvum
KLDFKGFLSNLLVPLFSSSHYSY

SEQ ID NO: 2296627 - protein, 27 aa, Cryptosporidium parvum
KLDGRLFCFLCTFKYKKLKHEEVKKTN

SEQ ID NO: 2296628 - protein, 21 aa, Cryptosporidium parvum
KLDGVLPVKIESVPKKSDISE

SEQ ID NO: 2296629 - protein, 20 aa, Cryptosporidium parvum
KLDKGIAFPTCISVNEICGN

SEQ ID NO: 2296630 - protein, 17 aa, Cryptosporidium parvum
KLDKMIIKGSARDDNHN

SEQ ID NO: 2296631 - protein, 21 aa, Cryptosporidium parvum
KLDLEFYKSEYCKLKEKLKSI

SEQ ID NO: 2296632 - protein, 24 aa, Cryptosporidium parvum
KLDLRAKQKFEYNRRFSREKTGNF

SEQ ID NO: 2296633 - protein, 20 aa, Cryptosporidium parvum
KLDLYFLMYEYQKILSYNRY

SEQ ID NO: 2296634 - protein, 18 aa, Cryptosporidium parvum
KLDSNFPKNCHNPKWNSY

SEQ ID NO: 2296635 - protein, 27 aa, Cryptosporidium parvum
KLEASLLDIYSFISWYIYDYNNEITQK

SEQ ID NO: 2296636 - protein, 19 aa, Cryptosporidium parvum
KLEECIDERVNLRNIDKQK

SEQ ID NO: 2296637 - protein, 21 aa, Cryptosporidium parvum
KLEEVKPLPSYYGDMSQVLTL

SEQ ID NO: 2296638 - protein, 27 aa, Cryptosporidium parvum
KLEFRCSSCEIYLRRMHGLENELQILT

SEQ ID NO: 2296639 - protein, 22 aa, Cryptosporidium parvum
KLEHLAHAAAYFSSSLKSKKSL

SEQ ID NO: 2296640 - protein, 21 aa, Cryptosporidium parvum
KLEIFFIDFDLMPLLLEENYI

SEQ ID NO: 2296641 - protein, 21 aa, Cryptosporidium parvum
KLEIIRLKQIIKESEESHLQL

SEQ ID NO: 2296642 - protein, 25 aa, Cryptosporidium parvum
KLELSRPKTMWEFIGNKDCADELYN

SEQ ID NO: 2296643 - protein, 18 aa, Cryptosporidium parvum
KLENIFVICCELISQALV

SEQ ID NO: 2296644 - protein, 17 aa, Cryptosporidium parvum
KLESVCINREILKQTKI

SEQ ID NO: 2296645 - protein, 20 aa, Cryptosporidium parvum
KLETELFSILSPELLNEIMI

SEQ ID NO: 2296646 - protein, 18 aa, Cryptosporidium parvum
KLEYCLKSNSGRIQRKLY

SEQ ID NO: 2296647 - protein, 17 aa, Cryptosporidium parvum
KLFGFREQDVFKLSFAY

SEQ ID NO: 2296648 - protein, 18 aa, Cryptosporidium parvum
KLFIVELLISKGANVNTF

SEQ ID NO: 2296649 - protein, 19 aa, Cryptosporidium parvum
KLFKCHECSKAFGRSDHLR

SEQ ID NO: 2296650 - protein, 18 aa, Cryptosporidium parvum
KLFNELALIWCILKTFAI

SEQ ID NO: 2296651 - protein, 17 aa, Cryptosporidium parvum
KLFNISYLLEFTKSSLN

SEQ ID NO: 2296652 - protein, 22 aa, Cryptosporidium parvum
KLFREFSTGIVLGDEGDSREKM

SEQ ID NO: 2296653 - protein, 22 aa, Cryptosporidium parvum
KLFRNKISSILLLNNISRDFRT

SEQ ID NO: 2296654 - protein, 27 aa, Cryptosporidium parvum
KLFRTEWGIKYDFWLIEHINQYEYVVP

SEQ ID NO: 2296655 - protein, 19 aa, Cryptosporidium parvum
KLFSSEIIPDFNSIMPEGQ

SEQ ID NO: 2296656 - protein, 20 aa, Cryptosporidium parvum
KLGGRLSSMLSIDSNNTAFA

SEQ ID NO: 2296657 - protein, 18 aa, Cryptosporidium parvum
KLGNIFREISLRNESNAY

SEQ ID NO: 2296658 - protein, 20 aa, Cryptosporidium parvum
KLGSKDIWHIEAFLAQVMNC

SEQ ID NO: 2296659 - protein, 20 aa, Cryptosporidium parvum
KLGSLGIQMDLNFESKLDKS

SEQ ID NO: 2296660 - protein, 25 aa, Cryptosporidium parvum
KLGVPRRRLYDITNVLEAVGLFTKP

SEQ ID NO: 2296661 - protein, 30 aa, Cryptosporidium parvum; identical to SEQ ID NO: 2174986

SEQ ID NO: 2296662 - protein, 24 aa, Cryptosporidium parvum
KLICLKLHRLGRVSFRNVKNTRDY

SEQ ID NO: 2296663 - protein, 20 aa, Cryptosporidium parvum
KLIDHLSINIGKISFEGLKN

SEQ ID NO: 2296664 - protein, 17 aa, Cryptosporidium parvum
KLIEGFSDFSKIRNEQF

SEQ ID NO: 2296665 - protein, 23 aa, Cryptosporidium parvum
KLIGEGSFAKVYKGKNMITGEDV

SEQ ID NO: 2296666 - protein, 22 aa, Cryptosporidium parvum
KLIKGCRRELEFGNESSAGVYD

SEQ ID NO: 2296667 - protein, 25 aa, Cryptosporidium parvum
KLILSETYNGFFLIPEDGVWSYNSM

SEQ ID NO: 2296668 - protein, 27 aa, Cryptosporidium parvum
KLIRVSPKFRVPRSFKVFSKVFSEFLS

SEQ ID NO: 2296669 - protein, 22 aa, Cryptosporidium parvum
KLIYKVVEILFRNLVIDNTLYN

SEQ ID NO: 2296670 - protein, 17 aa, Cryptosporidium parvum
KLKDLQIEFNLIEKEYL

SEQ ID NO: 2296671 - protein, 31 aa, Cryptosporidium parvum; identical to SEQ ID NO: 2174994

SEQ ID NO: 2296672 - protein, 24 aa, Cryptosporidium parvum
KLKENVKLLFSFPFKTNSAKVLST

SEQ ID NO: 2296673 - protein, 18 aa, Cryptosporidium parvum
KLKFPAIRKLPMAPKALR

SEQ ID NO: 2296674 - protein, 26 aa, Cryptosporidium parvum
KLKGHSKAVVSLAWQPLHLMNFSAET

SEQ ID NO: 2296675 - protein, 34 aa, Cryptosporidium parvum
KLKKMSLSNNCLKQFPFSLNFNMVQELRLNNNKI

SEQ ID NO: 2296676 - protein, 28 aa, Cryptosporidium parvum
KLKLELFHKEMIKFSGISLQGRESLPPL

SEQ ID NO: 2296677 - protein, 23 aa, Cryptosporidium parvum
KLKLHIVELNDTFQKRWDETQKE

SEQ ID NO: 2296678 - protein, 22 aa, Cryptosporidium parvum
KLKLRRRGRRRRPGKLNISKQL

SEQ ID NO: 2296679 - protein, 21 aa, Cryptosporidium parvum
KLKLSAWKYHNFRLNTLDAMF

SEQ ID NO: 2296680 - protein, 21 aa, Cryptosporidium parvum
KLKLYDCLDGNILSSRLENYQ

SEQ ID NO: 2296681 - protein, 22 aa, Cryptosporidium parvum
KLKPRHVPDFVLISPEDVDRLL

SEQ ID NO: 2296682 - protein, 18 aa, Cryptosporidium parvum
KLKSAGMDEAKQMVLNST

SEQ ID NO: 2296683 - protein, 19 aa, Cryptosporidium parvum
KLKSLRFATEAAITLLRID

SEQ ID NO: 2296684 - protein, 18 aa, Cryptosporidium parvum
KLLDISSNLVLRNINKHL

SEQ ID NO: 2296685 - protein, 17 aa, Cryptosporidium parvum
KLLGESLSEVSTKKITL

SEQ ID NO: 2296686 - protein, 33 aa, Cryptosporidium parvum; identical to SEQ ID NO: 2175002

SEQ ID NO: 2296687 - protein, 18 aa, Cryptosporidium parvum
KLLGGSPMQSFTINGMMV

SEQ ID NO: 2296688 - protein, 30 aa, Cryptosporidium parvum; identical to SEQ ID NO: 2175004

SEQ ID NO: 2296689 - protein, 25 aa, Cryptosporidium parvum
KLLKEERWFVCESGLDYITNEYISM

SEQ ID NO: 2296690 - protein, 18 aa, Cryptosporidium parvum
KLLKRKKAQAELAQKSKY

SEQ ID NO: 2296691 - protein, 21 aa, Cryptosporidium parvum
KLLLEFFERLEVIQSQDILCS

SEQ ID NO: 2296692 - protein, 20 aa, Cryptosporidium parvum
KLLLTFSFEGGIWRVLLGLL

SEQ ID NO: 2296693 - protein, 23 aa, Cryptosporidium parvum
KLLMRLYMKLVIKQLVEPAFDVV

SEQ ID NO: 2296694 - protein, 17 aa, Cryptosporidium parvum
KLLNFGVNEQFLQIPNG

SEQ ID NO: 2296695 - protein, 25 aa, Cryptosporidium parvum
KLLRCVCYACSKLFVDTLDPKFKQI

SEQ ID NO: 2296696 - protein, 18 aa, Cryptosporidium parvum
KLLRDSRSRAMMPTTLEE

SEQ ID NO: 2296697 - protein, 19 aa, Cryptosporidium parvum
KLLREPIILLIDPKRMQII

SEQ ID NO: 2296698 - protein, 30 aa, Cryptosporidium parvum
KLLRKIIHCLCDHYCIISRSISTIGNSNNN

SEQ ID NO: 2296699 - protein, 21 aa, Cryptosporidium parvum
KLLRLLSEEVFDFGEDQMVSK

SEQ ID NO: 2296700 - protein, 18 aa, Cryptosporidium parvum
KLLSGLWVSNLIAMHSRM

SEQ ID NO: 2296701 - protein, 21 aa, Cryptosporidium parvum
KLLSPFIPFTCELLYSNLKNA

SEQ ID NO: 2296702 - protein, 23 aa, Cryptosporidium parvum
KLLTLPSPQLFTGLETLMSSGTL

SEQ ID NO: 2296703 - protein, 20 aa, Cryptosporidium parvum
KLLVEKKISSAYEWCIEIIR

SEQ ID NO: 2296704 - protein, 25 aa, Cryptosporidium parvum
KLMIEKSNIISFMYIILEKNISNNN

SEQ ID NO: 2296705 - protein, 28 aa, Cryptosporidium parvum
KLMKLNTLYLRSCANISDKSFFYLGESL

SEQ ID NO: 2296706 - protein, 29 aa, Cryptosporidium parvum
KLMLKFPRIIHTKIFPNFLSKILKIEDYQ

SEQ ID NO: 2296707 - protein, 19 aa, Cryptosporidium parvum
KLNECPHDPGGYFVVKGTE

SEQ ID NO: 2296708 - protein, 19 aa, Cryptosporidium parvum
KLNKLSNEEYLVFCSIEDA

SEQ ID NO: 2296709 - protein, 18 aa, Cryptosporidium parvum
KLNLDPKVAEYAKEYKNT

SEQ ID NO: 2296710 - protein, 25 aa, Cryptosporidium parvum
KLNSCKIFYLNLPKLRSIKLKCKSI

SEQ ID NO: 2296711 - protein, 20 aa, Cryptosporidium parvum
KLNVVYIIDFGLAKKYRDPK

SEQ ID NO: 2296712 - protein, 27 aa, Cryptosporidium parvum
KLNWTEIETPWEWERDFAIDEMDPLKR

SEQ ID NO: 2296713 - protein, 23 aa, Cryptosporidium parvum
KLPLWHLFSSLCWQGYHNQQECC

SEQ ID NO: 2296714 - protein, 19 aa, Cryptosporidium parvum
KLPNRVVAISEALQRTYIK

SEQ ID NO: 2296715 - protein, 34 aa, Cryptosporidium parvum
KLPPMDSLTEFFSRWLIWSLIWGFSSSMNLSDRI

SEQ ID NO: 2296716 - protein, 22 aa, Cryptosporidium parvum
KLPSIFKKSSSGVFTIDNLKTS

SEQ ID NO: 2296717 - protein, 17 aa, Cryptosporidium parvum
KLPTFGMNAKFLKNQRF

SEQ ID NO: 2296718 - protein, 23 aa, Cryptosporidium parvum
KLQDIMPCMEWNIVEGILKEELG

SEQ ID NO: 2296719 - protein, 30 aa, Cryptosporidium parvum
KLQFSSNYARKWPGIILSPRAKKKVSMEDL

SEQ ID NO: 2296720 - protein, 20 aa, Cryptosporidium parvum
KLQLLIGVSIRRIHEALEDL

SEQ ID NO: 2296721 - protein, 19 aa, Cryptosporidium parvum
KLQNGFKLLLELVQYHQMR

SEQ ID NO: 2296722 - protein, 18 aa, Cryptosporidium parvum
KLQSRLSVLDSCQDEITS

SEQ ID NO: 2296723 - protein, 20 aa, Cryptosporidium parvum
KLRARIHVCCCGYDGIDAVR

SEQ ID NO: 2296724 - protein, 20 aa, Cryptosporidium parvum
KLRCRPKSSFSLTSTNSTDE

SEQ ID NO: 2296725 - protein, 23 aa, Cryptosporidium parvum
KLRKEVYQGIRVMPFSQNMMYCQ

SEQ ID NO: 2296726 - protein, 19 aa, Cryptosporidium parvum
KLRLIEMSTNFELEEVSNK

SEQ ID NO: 2296727 - protein, 25 aa, Cryptosporidium parvum
KLRLISQKLFPGWLSSDMLNCNSEL

SEQ ID NO: 2296728 - protein, 18 aa, Cryptosporidium parvum
KLRMELFPNESIDMGDDR

SEQ ID NO: 2296729 - protein, 21 aa, Cryptosporidium parvum
KLRNEALLNQGLWYSSLSEED

SEQ ID NO: 2296730 - protein, 26 aa, Cryptosporidium parvum
KLRNEEIKTYWSIRVAYDTLTQERDS

SEQ ID NO: 2296731 - protein, 23 aa, Cryptosporidium parvum
KLRRGCNLSKLLVEVAKNRCTHR

SEQ ID NO: 2296732 - protein, 20 aa, Cryptosporidium parvum
KLRSKRLAPVLIKEITRRIR

SEQ ID NO: 2296733 - protein, 22 aa, Cryptosporidium parvum
KLSEALFSQGLIRVLITTATLA

SEQ ID NO: 2296734 - protein, 23 aa, Cryptosporidium parvum
KLSELNFKIMVHKNIEKDSKIFK

SEQ ID NO: 2296735 - protein, 20 aa, Cryptosporidium parvum
KLSESCLIIELFNSRQSNEN

SEQ ID NO: 2296736 - protein, 28 aa, Cryptosporidium parvum
KLSGFKLGFHLKPLLFRISKLLNSSEIS

SEQ ID NO: 2296737 - protein, 20 aa, Cryptosporidium parvum
KLSIPGSAKISRESKMLMQQ

SEQ ID NO: 2296738 - protein, 25 aa, Cryptosporidium parvum
KLSKIPGSRWFLQPVDPELDGVPDY

SEQ ID NO: 2296739 - protein, 18 aa, Cryptosporidium parvum
KLSKSECVQAYDDQIMEM

SEQ ID NO: 2296740 - protein, 21 aa, Cryptosporidium parvum
KLSLKEGKWGHPERPLSDLGR

SEQ ID NO: 2296741 - protein, 20 aa, Cryptosporidium parvum
KLSSPNGGFVRKSTRFTEAR

SEQ ID NO: 2296742 - protein, 20 aa, Cryptosporidium parvum
KLSTFRSSSVRLFWKMIGKL

SEQ ID NO: 2296743 - protein, 24 aa, Cryptosporidium parvum
KLTECGCVFVFYVADWFALLNNKM

SEQ ID NO: 2296744 - protein, 23 aa, Cryptosporidium parvum
KLTLFGIKLFNSFQLIYHHHKMC

SEQ ID NO: 2296745 - protein, 23 aa, Cryptosporidium parvum
KLTWIYWYGECVLDYKLPTPNGT

SEQ ID NO: 2296746 - protein, 23 aa, Cryptosporidium parvum
KLVDSCYSFWFTGLLFCIEEILR

SEQ ID NO: 2296747 - protein, 26 aa, Cryptosporidium parvum
KLVITPKLKFGFGGTNLISGSISKIG

SEQ ID NO: 2296748 - protein, 19 aa, Cryptosporidium parvum
KLVLHCGMLDRTIRGKKSW

SEQ ID NO: 2296749 - protein, 20 aa, Cryptosporidium parvum
KLVNGVCICYKHIHDQSDMI

SEQ ID NO: 2296750 - protein, 19 aa, Cryptosporidium parvum
KLVPRNWGILLKDIEKDLN

SEQ ID NO: 2296751 - protein, 19 aa, Cryptosporidium parvum
KLWREINYKLEECIDERVN

SEQ ID NO: 2296752 - protein, 24 aa, Cryptosporidium parvum
KLYHKSKPIDILGRMFPSSQENLP

SEQ ID NO: 2296753 - protein, 26 aa, Cryptosporidium parvum
KLYLRSYYTMKECHTLVSPYTIDNSE

SEQ ID NO: 2296754 - protein, 22 aa, Cryptosporidium parvum
KLYQDFSKFVVFVESDNKNEEI

SEQ ID NO: 2296755 - protein, 17 aa, Cryptosporidium parvum
KMACYNLSLLSKADIFG

SEQ ID NO: 2296756 - protein, 20 aa, Cryptosporidium parvum
KMCHIPGLIMDPTLPPCLFE

SEQ ID NO: 2296757 - protein, 17 aa, Cryptosporidium parvum
KMEFSVFDEECNFNLNI

SEQ ID NO: 2296758 - protein, 19 aa, Cryptosporidium parvum
KMEILSIIFQYIKLSQEST

SEQ ID NO: 2296759 - protein, 26 aa, Cryptosporidium parvum
KMELLKNPFRWRGMLKDLYGVSEETT

SEQ ID NO: 2296760 - protein, 20 aa, Cryptosporidium parvum
KMFRLESSAESWVVKQKEQK

SEQ ID NO: 2296761 - protein, 17 aa, Cryptosporidium parvum
KMFVWDVGIPIVVKHIA

SEQ ID NO: 2296762 - protein, 29 aa, Cryptosporidium parvum
KMGHSNIFCPYPFRFGDSSEYGTMIVASS

SEQ ID NO: 2296763 - protein, 19 aa, Cryptosporidium parvum
KMGKFYELFYIDAYICQKH

SEQ ID NO: 2296764 - protein, 20 aa, Cryptosporidium parvum
KMGVIPRMVHDVFETISNAE

SEQ ID NO: 2296765 - protein, 23 aa, Cryptosporidium parvum
KMHKRNSGFIGFKLKPLKLKFDY

SEQ ID NO: 2296766 - protein, 18 aa, Cryptosporidium parvum
KMICRKCYARLPPRATNC

SEQ ID NO: 2296767 - protein, 25 aa, Cryptosporidium parvum
KMIELSGKMVLMGKLLPKLKAEGHR

SEQ ID NO: 2296768 - protein, 19 aa, Cryptosporidium parvum
KMIFYNSLFQIRRITFSIR

SEQ ID NO: 2296769 - protein, 25 aa, Cryptosporidium parvum
KMKEQRNVDPFSIFGDSCMFMDLED

SEQ ID NO: 2296770 - protein, 23 aa, Cryptosporidium parvum
KMKLSGIRSGDDFPKYPMYSFAG

SEQ ID NO: 2296771 - protein, 17 aa, Cryptosporidium parvum
KMMIELGHEVNYNTEAT

SEQ ID NO: 2296772 - protein, 18 aa, Cryptosporidium parvum
KMMNRGTTTLGFIYQGGV

SEQ ID NO: 2296773 - protein, 36 aa, Cryptosporidium parvum
KMPLEIQKPYFLLFKLPRTLSLVALEPKSPLELGIS

SEQ ID NO: 2296774 - protein, 22 aa, Cryptosporidium parvum
KMPREYIVRLIFDRNHYSFCLL

SEQ ID NO: 2296775 - protein, 20 aa, Cryptosporidium parvum
KMPTRFPPVVFYTPKELGGL

SEQ ID NO: 2296776 - protein, 22 aa, Cryptosporidium parvum
KMQCIFESILSTSLFDDYNDEE

SEQ ID NO: 2296777 - protein, 23 aa, Cryptosporidium parvum
KMRIEAHKRLKAIRKKRMKLKRK

SEQ ID NO: 2296778 - protein, 20 aa, Cryptosporidium parvum
KMRITEFIKTVNLKLEKGEK

SEQ ID NO: 2296779 - protein, 30 aa, Cryptosporidium parvum; identical to SEQ ID NO: 2175081

SEQ ID NO: 2296780 - protein, 30 aa, Cryptosporidium parvum; identical to SEQ ID NO: 2175082

SEQ ID NO: 2296781 - protein, 21 aa, Cryptosporidium parvum
KMSGLFWGIGSMKLLFNNLQS

SEQ ID NO: 2296782 - protein, 24 aa, Cryptosporidium parvum
KMSKKLSGRSIRHVCLEAEREWAS

SEQ ID NO: 2296783 - protein, 24 aa, Cryptosporidium parvum
KMSLPYWVLECLFSLNQKSLIMLR

SEQ ID NO: 2296784 - protein, 22 aa, Cryptosporidium parvum
KMVKPEIIAYPISLQRNQTINT

SEQ ID NO: 2296785 - protein, 19 aa, Cryptosporidium parvum
KMVRDRRLAICKYHDTQIS

SEQ ID NO: 2296786 - protein, 18 aa, Cryptosporidium parvum
KMYEEMSSEITFDDLYSK

SEQ ID NO: 2296787 - protein, 25 aa, Cryptosporidium parvum
KMYHKCLVEWSCLTLDILPDKLGDN

SEQ ID NO: 2296788 - protein, 25 aa, Cryptosporidium parvum
KMYKRCNQCDLILKKSDFEKHTHCN

SEQ ID NO: 2296789 - protein, 17 aa, Cryptosporidium parvum
KMYRCPITGQLIPDEEI

SEQ ID NO: 2296790 - protein, 26 aa, Cryptosporidium parvum
KNAIKKAYCALCGNPGHNYQLCNRFN

SEQ ID NO: 2296791 - protein, 20 aa, Cryptosporidium parvum
KNALLRTIIGLIRFSPTAAS

SEQ ID NO: 2296792 - protein, 25 aa, Cryptosporidium parvum
KNCRQECKSFCPVVRTGKLCVEVDS

SEQ ID NO: 2296793 - protein, 24 aa, Cryptosporidium parvum
KNCTHFRISCKLFEGKSDSNLVKK

SEQ ID NO: 2296794 - protein, 20 aa, Cryptosporidium parvum
KNDHIFSFDWFIKTRSSNDI

SEQ ID NO: 2296795 - protein, 18 aa, Cryptosporidium parvum
KNDIIICLQQDYMSLINP

SEQ ID NO: 2296796 - protein, 22 aa, Cryptosporidium parvum
KNDIITEFVGWVIDRKEALRLR

SEQ ID NO: 2296797 - protein, 19 aa, Cryptosporidium parvum
KNDKICFTPDGFDCHFDDN

SEQ ID NO: 2296798 - protein, 20 aa, Cryptosporidium parvum
KNDPWMKIKCENEPNMADIQ

SEQ ID NO: 2296799 - protein, 24 aa, Cryptosporidium parvum
KNDWFCDYCKAHGNKLKPGSKFQI

SEQ ID NO: 2296800 - protein, 21 aa, Cryptosporidium parvum
KNEDIVELIRILRIQEESRKS

SEQ ID NO: 2296801 - protein, 18 aa, Cryptosporidium parvum
KNEISGLAWPMYYKFDEK

SEQ ID NO: 2296802 - protein, 20 aa, Cryptosporidium parvum
KNELFLPNWTENITFVQYFT

SEQ ID NO: 2296803 - protein, 23 aa, Cryptosporidium parvum
KNESKILPCFGIIDLPGTGQIQD

SEQ ID NO: 2296804 - protein, 24 aa, Cryptosporidium parvum
KNEVSLLLYEIYETVVPVGEFVSL

SEQ ID NO: 2296805 - protein, 20 aa, Cryptosporidium parvum
KNFLRLMCLLDRSTPHTTTS

SEQ ID NO: 2296806 - protein, 22 aa, Cryptosporidium parvum
KNFPNIRFSNWLNNPKNSGLIT

SEQ ID NO: 2296807 - protein, 17 aa, Cryptosporidium parvum
KNFQFQKIKAISRQRIY

SEQ ID NO: 2296808 - protein, 18 aa, Cryptosporidium parvum
KNFSPGYRSNSLYNNYRH

SEQ ID NO: 2296809 - protein, 19 aa, Cryptosporidium parvum
KNGDCVELYIGQVKLDPNW

SEQ ID NO: 2296810 - protein, 18 aa, Cryptosporidium parvum
KNGIAISFITPEDSGLFP

SEQ ID NO: 2296811 - protein, 25 aa, Cryptosporidium parvum
KNGKSIKFQCCLFRITQNSLGIMKT

SEQ ID NO: 2296812 - protein, 20 aa, Cryptosporidium parvum
KNGTKFRVIQGLIRRSYGNS

SEQ ID NO: 2296813 - protein, 18 aa, Cryptosporidium parvum
KNHCPKLKKMSLSNNCLK

SEQ ID NO: 2296814 - protein, 26 aa, Cryptosporidium parvum
KNHIKSRFPLLHWIVQIVRGSFGDNR

SEQ ID NO: 2296815 - protein, 18 aa, Cryptosporidium parvum
KNICERLSLGERCEKCGS

SEQ ID NO: 2296816 - protein, 37 aa, Cryptosporidium parvum
KNIIDLVRVCISVGLRVGGILEEKCKLLGEDCIVLSK

SEQ ID NO: 2296817 - protein, 26 aa, Cryptosporidium parvum
KNIIKLRPLCLFVITFLTFGVIQDHE

SEQ ID NO: 2296818 - protein, 27 aa, Cryptosporidium parvum
KNILEIFPDLPISLAVPPDLSHITPRY

SEQ ID NO: 2296819 - protein, 18 aa, Cryptosporidium parvum
KNILKACGLKSSTNTSSN

SEQ ID NO: 2296820 - protein, 20 aa, Cryptosporidium parvum
KNILKPCINFTQDSTNLIQN

SEQ ID NO: 2296821 - protein, 19 aa, Cryptosporidium parvum
KNILTLLAYGLHIQTDSSV

SEQ ID NO: 2296822 - protein, 20 aa, Cryptosporidium parvum
KNIPELKNELSLLLSGEESV

SEQ ID NO: 2296823 - protein, 24 aa, Cryptosporidium parvum
KNIPKLYLCHNVEIPDSCSLTSNI

SEQ ID NO: 2296824 - protein, 17 aa, Cryptosporidium parvum
KNIRESLKLIPRKSKIE

SEQ ID NO: 2296825 - protein, 22 aa, Cryptosporidium parvum
KNIRIGNEYAVTKLPTFLSLLN

SEQ ID NO: 2296826 - protein, 18 aa, Cryptosporidium parvum
KNIRTGFYNVYKVDTHVH

SEQ ID NO: 2296827 - protein, 25 aa, Cryptosporidium parvum
KNISSSVKDLIKWMMTKDPESRCTA

SEQ ID NO: 2296828 - protein, 31 aa, Cryptosporidium parvum
KNIYPIEVLLKLYKPLNVPRSIFKLETAIQR

SEQ ID NO: 2296829 - protein, 24 aa, Cryptosporidium parvum
KNKEITDLFSFFIIESTVINNERF

SEQ ID NO: 2296830 - protein, 19 aa, Cryptosporidium parvum
KNKIEACRMMLETIKKLAF

SEQ ID NO: 2296831 - protein, 18 aa, Cryptosporidium parvum
KNKIIYNKTLRYYLFNDI

SEQ ID NO: 2296832 - protein, 26 aa, Cryptosporidium parvum
KNKILNWRSGVEWDLDEVLQIRTIFA

SEQ ID NO: 2296833 - protein, 19 aa, Cryptosporidium parvum
KNKKGLVFILDYQDLNRFV

SEQ ID NO: 2296834 - protein, 18 aa, Cryptosporidium parvum
KNKLLEWTSGINGMLELG

SEQ ID NO: 2296835 - protein, 17 aa, Cryptosporidium parvum
KNKLLKCQVLDSIDSTE

SEQ ID NO: 2296836 - protein, 28 aa, Cryptosporidium parvum
KNKLNGILFSLHLRKDFEVPGPAVEYYF

SEQ ID NO: 2296837 - protein, 25 aa, Cryptosporidium parvum
KNKPMICDFILFSILFDDISLIEFN

SEQ ID NO: 2296838 - protein, 20 aa, Cryptosporidium parvum
KNKQIFRLFDISNYAMDAHV

SEQ ID NO: 2296839 - protein, 17 aa, Cryptosporidium parvum
KNKSLAEYSESCDSIKT

SEQ ID NO: 2296840 - protein, 19 aa, Cryptosporidium parvum
KNKSLGCNEVIFKNYLNLL

SEQ ID NO: 2296841 - protein, 24 aa, Cryptosporidium parvum
KNKTQYFKSIRVVIKIENPENDAS

SEQ ID NO: 2296842 - protein, 24 aa, Cryptosporidium parvum
KNLEFWRQLWRTIERSHVVVEIID

SEQ ID NO: 2296843 - protein, 26 aa, Cryptosporidium parvum
KNLFYEISKGFGILTYKLFKHIFELS

SEQ ID NO: 2296844 - protein, 18 aa, Cryptosporidium parvum
KNLHFLPLDSYKSYYKEI

SEQ ID NO: 2296845 - protein, 21 aa, Cryptosporidium parvum
KNLKENYLFILKIIKMLKYNI

SEQ ID NO: 2296846 - protein, 17 aa, Cryptosporidium parvum
KNLKHIFHLAGVLSDSN

SEQ ID NO: 2296847 - protein, 23 aa, Cryptosporidium parvum
KNLLRTFFISSFIDHIAVRNDGN

SEQ ID NO: 2296848 - protein, 25 aa, Cryptosporidium parvum
KNLLSDLWIRYHVISSIARNGHPLR

SEQ ID NO: 2296849 - protein, 19 aa, Cryptosporidium parvum
KNLLSNIFLDILERLNDLL

SEQ ID NO: 2296850 - protein, 17 aa, Cryptosporidium parvum
KNLRRVARELGESISDD

SEQ ID NO: 2296851 - protein, 25 aa, Cryptosporidium parvum
KNLRSRVLMNYALWLVETDLCDPAI

SEQ ID NO: 2296852 - protein, 19 aa, Cryptosporidium parvum
KNLSIEWVHRPFFNKKKTS

SEQ ID NO: 2296853 - protein, 26 aa, Cryptosporidium parvum
KNMHLTNVCSICFNWETDTLKPFVEC

SEQ ID NO: 2296854 - protein, 25 aa, Cryptosporidium parvum
KNMLKSIKCIQSWWRGDRVRQIIRE

SEQ ID NO: 2296855 - protein, 26 aa, Cryptosporidium parvum
KNMMYRQKLSLIISGFISKPSDKRKL

SEQ ID NO: 2296856 - protein, 42 aa, Cryptosporidium parvum
KNMSAEIYKEFAMLREKNFRPSINTLQEWLSITWNTTYNNGL

SEQ ID NO: 2296857 - protein, 24 aa, Cryptosporidium parvum
KNNDRISAVGFEIVLERIIYKILR

SEQ ID NO: 2296858 - protein, 18 aa, Cryptosporidium parvum
KNNECGIINLEEEYFEYI

SEQ ID NO: 2296859 - protein, 20 aa, Cryptosporidium parvum
KNNIGFTFDKCFTSEYVRAM

SEQ ID NO: 2296860 - protein, 19 aa, Cryptosporidium parvum
KNNISGIISSALFSDVFLI

SEQ ID NO: 2296861 - protein, 20 aa, Cryptosporidium parvum
KNNRLCLDNGGFSNKEKEEY

SEQ ID NO: 2296862 - protein, 28 aa, Cryptosporidium parvum
KNNSILCVLPRTPIDRLCLSPIPNVKSD

SEQ ID NO: 2296863 - protein, 25 aa, Cryptosporidium parvum
KNNSIWSWTFVCEVAKELNEKVNEN

SEQ ID NO: 2296864 - protein, 18 aa, Cryptosporidium parvum
KNNSSNLNGWRFKYYKGL

SEQ ID NO: 2296865 - protein, 23 aa, Cryptosporidium parvum
KNNVILTRSWVCKLYILSGITGK

SEQ ID NO: 2296866 - protein, 21 aa, Cryptosporidium parvum
KNPDFEISNSFIQSIKLLDEK

SEQ ID NO: 2296867 - protein, 24 aa, Cryptosporidium parvum
KNPNGLFCFDFKLRINPNSSESDR

SEQ ID NO: 2296868 - protein, 23 aa, Cryptosporidium parvum
KNPQWFKLYIHYEPDSYKEINGF

SEQ ID NO: 2296869 - protein, 19 aa, Cryptosporidium parvum
KNPSLDFCLGFGALLPNFI

SEQ ID NO: 2296870 - protein, 31 aa, Cryptosporidium parvum
KNQFKLRLQSLFWYVDIMKQFLSGRILLLNK

SEQ ID NO: 2296871 - protein, 19 aa, Cryptosporidium parvum
KNQIKEWVNSSIIHPESEI

SEQ ID NO: 2296872 - protein, 25 aa, Cryptosporidium parvum
KNQLFLEKFGRIFIHWINNKIENYN

SEQ ID NO: 2296873 - protein, 19 aa, Cryptosporidium parvum
KNQRAIYSYLFKEGAIVVH

SEQ ID NO: 2296874 - protein, 26 aa, Cryptosporidium parvum
KNQSSCLKRNWRIEFWSNFMTNCINF

SEQ ID NO: 2296875 - protein, 17 aa, Cryptosporidium parvum
KNQVMKRNIPRDSQSIS

SEQ ID NO: 2296876 - protein, 18 aa, Cryptosporidium parvum
KNQVPSFITSNNRLASGY

SEQ ID NO: 2296877 - protein, 19 aa, Cryptosporidium parvum
KNRFMKLYYKFQVEEAAIK

SEQ ID NO: 2296878 - protein, 21 aa, Cryptosporidium parvum
KNRFRNLSTKHLIDSKENNEM

SEQ ID NO: 2296879 - protein, 24 aa, Cryptosporidium parvum
KNRKYFIKDGICFIPDTEIESLFI

SEQ ID NO: 2296880 - protein, 25 aa, Cryptosporidium parvum
KNRMLGKHCFSLVSVDWDSDEEKKV

SEQ ID NO: 2296881 - protein, 27 aa, Cryptosporidium parvum
KNRRYWRRTHIYSRLTVYYNEKYPIIN

SEQ ID NO: 2296882 - protein, 20 aa, Cryptosporidium parvum
KNRTALCRWAENVSINPTEF

SEQ ID NO: 2296883 - protein, 17 aa, Cryptosporidium parvum
KNRYSIRTYVPTTFSNL

SEQ ID NO: 2296884 - protein, 24 aa, Cryptosporidium parvum
KNSDFIKILSFKEIMKYSNHTGNN

SEQ ID NO: 2296885 - protein, 23 aa, Cryptosporidium parvum
KNSDSCPFSHCLTWQRRNPNDHY

SEQ ID NO: 2296886 - protein, 17 aa, Cryptosporidium parvum
KNSEQFEQFWAILNKES

SEQ ID NO: 2296887 - protein, 24 aa, Cryptosporidium parvum
KNSESYRSIVFETLPNLQILDEMN

SEQ ID NO: 2296888 - protein, 25 aa, Cryptosporidium parvum
KNSFPWACSECISCTVCKRSDRPSI

SEQ ID NO: 2296889 - protein, 18 aa, Cryptosporidium parvum
KNSITLKFDYVVVMDTKK

SEQ ID NO: 2296890 - protein, 19 aa, Cryptosporidium parvum
KNSKEILSLRGKIIQKGGL

SEQ ID NO: 2296891 - protein, 17 aa, Cryptosporidium parvum
KNSNVVCLCCRKKGHQM

SEQ ID NO: 2296892 - protein, 19 aa, Cryptosporidium parvum
KNTAFLMSNMVSVPINLLQ

SEQ ID NO: 2296893 - protein, 20 aa, Cryptosporidium parvum
KNTHGFIVVHILSCKADSLI

SEQ ID NO: 2296894 - protein, 18 aa, Cryptosporidium parvum
KNTLKRVEFLSVKDITEI

SEQ ID NO: 2296895 - protein, 20 aa, Cryptosporidium parvum
KNTVIPCILLQMLDKSNLKA

SEQ ID NO: 2296896 - protein, 20 aa, Cryptosporidium parvum
KNVFLEFSFGGTLTEVRLLN

SEQ ID NO: 2296897 - protein, 24 aa, Cryptosporidium parvum
KNVIFRIEPISGFYYETSGLHSVK

SEQ ID NO: 2296898 - protein, 20 aa, Cryptosporidium parvum
KNVKCTIWLSFTSNMISSGL

SEQ ID NO: 2296899 - protein, 26 aa, Cryptosporidium parvum
KNVNLQFKHYFSIFWSKTMRPHLKFD

SEQ ID NO: 2296900 - protein, 20 aa, Cryptosporidium parvum
KNVPEMLGELDIKGRNLIVI

SEQ ID NO: 2296901 - protein, 24 aa, Cryptosporidium parvum
KNVREFLKGLPIQKSDLILKIDQM

SEQ ID NO: 2296902 - protein, 21 aa, Cryptosporidium parvum
KNVSCVVNYDFPHSPSNYIHR

SEQ ID NO: 2296903 - protein, 26 aa, Cryptosporidium parvum
KNWPNCDKGDHCFYIHPSEACKSWPL

SEQ ID NO: 2296904 - protein, 19 aa, Cryptosporidium parvum
KNWSQEMMNEMIIKHFPNL

SEQ ID NO: 2296905 - protein, 18 aa, Cryptosporidium parvum
KNYLKSRFCGYTFQCSIS

SEQ ID NO: 2296906 - protein, 27 aa, Cryptosporidium parvum
KNYSEKFGLWSFELYKNSNACITKPNS

SEQ ID NO: 2296907 - protein, 18 aa, Cryptosporidium parvum
KPAGLYGGNLVPFGLSGG

SEQ ID NO: 2296908 - protein, 19 aa, Cryptosporidium parvum
KPAIRRLARRGGVKRISAL

SEQ ID NO: 2296909 - protein, 23 aa, Cryptosporidium parvum
KPCIKFGSPFNVVYGKDCRNFIF

SEQ ID NO: 2296910 - protein, 18 aa, Cryptosporidium parvum
KPEEKALPLLNSQSSTFS

SEQ ID NO: 2296911 - protein, 24 aa, Cryptosporidium parvum
KPELLGYKSVEDWVSSQPKTVLTY

SEQ ID NO: 2296912 - protein, 17 aa, Cryptosporidium parvum
KPFFFKSKYDNFDHKRY

SEQ ID NO: 2296913 - protein, 17 aa, Cryptosporidium parvum
KPFGWEELCKLVNYQAE

SEQ ID NO: 2296914 - protein, 17 aa, Cryptosporidium parvum
KPFVQSKLMEVCRKNLM

SEQ ID NO: 2296915 - protein, 21 aa, Cryptosporidium parvum
KPFWEVFPLSQIVVLSPDSSE

SEQ ID NO: 2296916 - protein, 17 aa, Cryptosporidium parvum
KPFYKRFLYDSLPLESC

SEQ ID NO: 2296917 - protein, 17 aa, Cryptosporidium parvum
KPGEVILDISDLNNGQL

SEQ ID NO: 2296918 - protein, 21 aa, Cryptosporidium parvum
KPGLMVECLIHAYSHTNQKDQ

SEQ ID NO: 2296919 - protein, 21 aa, Cryptosporidium parvum
KPGNLQRFLHLFIINQLFSEN

SEQ ID NO: 2296920 - protein, 20 aa, Cryptosporidium parvum
KPGNSMLPAGRFIVAKESKN

SEQ ID NO: 2296921 - protein, 20 aa, Cryptosporidium parvum
KPGSLKVHIYHGSKRNKNQG

SEQ ID NO: 2296922 - protein, 26 aa, Cryptosporidium parvum
KPIKISWSSPFVYNSRNCRLYIIPNQ

SEQ ID NO: 2296923 - protein, 17 aa, Cryptosporidium parvum
KPIKLLWSFQIKDKPSC

SEQ ID NO: 2296924 - protein, 18 aa, Cryptosporidium parvum
KPILPKLAGKKEYFVCRN

SEQ ID NO: 2296925 - protein, 18 aa, Cryptosporidium parvum
KPISLCPRQTPTIRSLIP

SEQ ID NO: 2296926 - protein, 18 aa, Cryptosporidium parvum
KPKIPSWFHPSISNLLSK

SEQ ID NO: 2296927 - protein, 19 aa, Cryptosporidium parvum
KPKSIRELVSYWTEEKYYT

SEQ ID NO: 2296928 - protein, 19 aa, Cryptosporidium parvum
KPKYIPGNDSFKFRDESKL

SEQ ID NO: 2296929 - protein, 25 aa, Cryptosporidium parvum
KPLDSRFHPLISMIQLLSKFTHQME

SEQ ID NO: 2296930 - protein, 20 aa, Cryptosporidium parvum
KPLKVKRPKGPKDIMYEIIH

SEQ ID NO: 2296931 - protein, 23 aa, Cryptosporidium parvum
KPLLRIQRFIKYCETIQESINQC

SEQ ID NO: 2296932 - protein, 20 aa, Cryptosporidium parvum
KPLRTGSICSHKFRITSKLS

SEQ ID NO: 2296933 - protein, 22 aa, Cryptosporidium parvum
KPLTKKEIEAMLPNDPMSKTRS

SEQ ID NO: 2296934 - protein, 23 aa, Cryptosporidium parvum
KPMLKPLNWLLFEFKNHDLIGKN

SEQ ID NO: 2296935 - protein, 19 aa, Cryptosporidium parvum
KPNIESLYTFQCLTNSIES

SEQ ID NO: 2296936 - protein, 18 aa, Cryptosporidium parvum
KPNPATMKDCFEYRKVIS

SEQ ID NO: 2296937 - protein, 18 aa, Cryptosporidium parvum
KPNRLIKLSIKLALLTKK

SEQ ID NO: 2296938 - protein, 20 aa, Cryptosporidium parvum
KPNTNFSILMGMNSSMSNRI

SEQ ID NO: 2296939 - protein, 18 aa, Cryptosporidium parvum
KPPFKSHNDLSASQDSFF

SEQ ID NO: 2296940 - protein, 19 aa, Cryptosporidium parvum
KPQGYHPAPITNYPYSFGS

SEQ ID NO: 2296941 - protein, 20 aa, Cryptosporidium parvum
KPQIATFIPCYDVIPPKFIN

SEQ ID NO: 2296942 - protein, 19 aa, Cryptosporidium parvum
KPQKHTFLRKGEGKIKAFK

SEQ ID NO: 2296943 - protein, 20 aa, Cryptosporidium parvum
KPQRIRMAHNLILSYDLYKH

SEQ ID NO: 2296944 - protein, 22 aa, Cryptosporidium parvum
KPQTLLCLIYQLLLNKKQRKSL

SEQ ID NO: 2296945 - protein, 20 aa, Cryptosporidium parvum
KPRCTCVKIAAAALSMDVDQ

SEQ ID NO: 2296946 - protein, 24 aa, Cryptosporidium parvum
KPRRRIKPLIFGGGQERGMRSGTM

SEQ ID NO: 2296947 - protein, 40 aa, Cryptosporidium parvum
KPRSTKARFKVCKHVSCYHCLRKALHVEYWAAKNDIWDKC

SEQ ID NO: 2296948 - protein, 26 aa, Cryptosporidium parvum
KPSIPGRCYHCNKKVGIYGFNCRCGF

SEQ ID NO: 2296949 - protein, 18 aa, Cryptosporidium parvum
KPSLGFVSGYLVHNIQQL

SEQ ID NO: 2296950 - protein, 20 aa, Cryptosporidium parvum
KPSPYRKVIVATNIAETSLT

SEQ ID NO: 2296951 - protein, 17 aa, Cryptosporidium parvum
KPSRRKVLQRQNQEVKA

SEQ ID NO: 2296952 - protein, 18 aa, Cryptosporidium parvum
KPTIPAWPGSSGRPSGIP

SEQ ID NO: 2296953 - protein, 17 aa, Cryptosporidium parvum
KPYGLSCVPDISIISLN

SEQ ID NO: 2296954 - protein, 19 aa, Cryptosporidium parvum
KPYIFKIAALRDIRNLFPI

SEQ ID NO: 2296955 - protein, 17 aa, Cryptosporidium parvum
KPYSVALSFISSQATCC

SEQ ID NO: 2296956 - protein, 34 aa, Cryptosporidium parvum
KQAKAIKIQRVWRYYYLRQIMIHYIRIATPARKI

SEQ ID NO: 2296957 - protein, 30 aa, Cryptosporidium parvum
KQCPRISICLRELFSYFANTRWKNNETQMS

SEQ ID NO: 2296958 - protein, 21 aa, Cryptosporidium parvum
KQCVECADIALKVEPNNVVFK

SEQ ID NO: 2296959 - protein, 17 aa, Cryptosporidium parvum
KQECPAFIYYWNGSTCY

SEQ ID NO: 2296960 - protein, 28 aa, Cryptosporidium parvum
KQEIKGDLYFRCLLALEYSKSKDLSVDC

SEQ ID NO: 2296961 - protein, 17 aa, Cryptosporidium parvum
KQELELMEKFSREQDEH

SEQ ID NO: 2296962 - protein, 18 aa, Cryptosporidium parvum
KQEQYKGHFFVMKSQYNF

SEQ ID NO: 2296963 - protein, 25 aa, Cryptosporidium parvum
KQFFRLERHLIWVESIIRIHGNTFL

SEQ ID NO: 2296964 - protein, 33 aa, Cryptosporidium parvum; identical to SEQ ID NO: 2175238

SEQ ID NO: 2296965 - protein, 23 aa, Cryptosporidium parvum
KQGELAKSFILIFEGSVSLIVDE

SEQ ID NO: 2296966 - protein, 27 aa, Cryptosporidium parvum
KQGHPFVKCRLCFLVKKDHCICMDLSR

SEQ ID NO: 2296967 - protein, 18 aa, Cryptosporidium parvum
KQHKERLVLLEFQGSLSI

SEQ ID NO: 2296968 - protein, 20 aa, Cryptosporidium parvum
KQIKFNFGVVIDGNKMKTGL

SEQ ID NO: 2296969 - protein, 24 aa, Cryptosporidium parvum
KQIKYLRFPLCGRIIKSHKYVKRM

SEQ ID NO: 2296970 - protein, 27 aa, Cryptosporidium parvum
KQILEWKRSGVNLLFGLQITFNVPDEV

SEQ ID NO: 2296971 - protein, 18 aa, Cryptosporidium parvum
KQILRKNIYLNIEVDILD

SEQ ID NO: 2296972 - protein, 19 aa, Cryptosporidium parvum
KQIQCRIVILTAGDEDFNT

SEQ ID NO: 2296973 - protein, 23 aa, Cryptosporidium parvum
KQKAHIPVGLVFQPLASPPPGYP

SEQ ID NO: 2296974 - protein, 21 aa, Cryptosporidium parvum
KQKCPRCRGNLTKKDFINFYV

SEQ ID NO: 2296975 - protein, 18 aa, Cryptosporidium parvum
KQKLKLKRARSIETSSKS

SEQ ID NO: 2296976 - protein, 17 aa, Cryptosporidium parvum
KQKRFYYSYFLPNNHMM

SEQ ID NO: 2296977 - protein, 20 aa, Cryptosporidium parvum
KQKTMRFVELVKVKRKINQL

SEQ ID NO: 2296978 - protein, 23 aa, Cryptosporidium parvum
KQKVKKPESSICEHIESETLNSD

SEQ ID NO: 2296979 - protein, 19 aa, Cryptosporidium parvum
KQLECVKKYVKNYENSFNE

SEQ ID NO: 2296980 - protein, 19 aa, Cryptosporidium parvum
KQLLNLCELLSVLSSEIPN

SEQ ID NO: 2296981 - protein, 22 aa, Cryptosporidium parvum
KQLNNCLSCLLRGFKCQDVLIR

SEQ ID NO: 2296982 - protein, 17 aa, Cryptosporidium parvum
KQLPFNVNQNLLNSLIE

SEQ ID NO: 2296983 - protein, 19 aa, Cryptosporidium parvum
KQNKCNIRKLSALVHGVSG

SEQ ID NO: 2296984 - protein, 29 aa, Cryptosporidium parvum
KQPKPKLIGWRAQVGGGYDHQFFNIKRLD

SEQ ID NO: 2296985 - protein, 28 aa, Cryptosporidium parvum
KQPLYRLLRVTLNCINRSLPYAEVQIKI

SEQ ID NO: 2296986 - protein, 19 aa, Cryptosporidium parvum
KQPVFILGYELLRVHTTES

SEQ ID NO: 2296987 - protein, 17 aa, Cryptosporidium parvum
KQQCENLNKTDITSIQN

SEQ ID NO: 2296988 - protein, 18 aa, Cryptosporidium parvum
KQQIRDFLRVVATSKGSY

SEQ ID NO: 2296989 - protein, 25 aa, Cryptosporidium parvum
KQRDCKSFYSCGYDKQILFWDAEYG

SEQ ID NO: 2296990 - protein, 24 aa, Cryptosporidium parvum
KQRILEILKSISIEHSHYLHSLKR

SEQ ID NO: 2296991 - protein, 17 aa, Cryptosporidium parvum
KQRLEFIEEMLKKEDAP

SEQ ID NO: 2296992 - protein, 19 aa, Cryptosporidium parvum
KQRLRNIEINLSRFEPLIK

SEQ ID NO: 2296993 - protein, 25 aa, Cryptosporidium parvum
KQSLETICLLFAYKIKYPENFFLLR

SEQ ID NO: 2296994 - protein, 24 aa, Cryptosporidium parvum
KQSQFRHDLVFTLLRQTLQYYENV

SEQ ID NO: 2296995 - protein, 20 aa, Cryptosporidium parvum
KQSRPIVGRFAHMDASASSF

SEQ ID NO: 2296996 - protein, 24 aa, Cryptosporidium parvum
KQSYQEIFIPLNFIISELNKDEID

SEQ ID NO: 2296997 - protein, 27 aa, Cryptosporidium parvum
KQTIPSVILSPSFKMIFHDDGVTTKWL

SEQ ID NO: 2296998 - protein, 27 aa, Cryptosporidium parvum
KQVEDVKKLLGFLGMPCIDAPSEAEAQ

SEQ ID NO: 2296999 - protein, 19 aa, Cryptosporidium parvum
KQVKDYIVKFNNRRETIER

SEQ ID NO: 2297000 - protein, 25 aa, Cryptosporidium parvum
KQVQEFNIPITLLKSESSETLNSNF

SEQ ID NO: 2297001 - protein, 20 aa, Cryptosporidium parvum
KQVVSASWVKYASRVLESSQ

SEQ ID NO: 2297002 - protein, 17 aa, Cryptosporidium parvum
KQWKVRRLIATLEAARG

SEQ ID NO: 2297003 - protein, 19 aa, Cryptosporidium parvum
KQYKLADEVLLKMKKMLEF

SEQ ID NO: 2297004 - protein, 18 aa, Cryptosporidium parvum
KQYLKLSTFIPLSDLDHI

SEQ ID NO: 2297005 - protein, 24 aa, Cryptosporidium parvum
KRAKRLLDEIIILFSQSLNIEFIR

SEQ ID NO: 2297006 - protein, 19 aa, Cryptosporidium parvum
KRAKSSGKLKGRIKVYEYC

SEQ ID NO: 2297007 - protein, 25 aa, Cryptosporidium parvum
KRAPRAIKGIREFAGKVMKTEDVRI

SEQ ID NO: 2297008 - protein, 24 aa, Cryptosporidium parvum
KRAQNMAIVLARLSVPTDYIIEIL

SEQ ID NO: 2297009 - protein, 18 aa, Cryptosporidium parvum
KRCISNLSAKRFVHSRDD

SEQ ID NO: 2297010 - protein, 23 aa, Cryptosporidium parvum
KRCMACKRLVIKPQLNPLSQPPF

SEQ ID NO: 2297011 - protein, 22 aa, Cryptosporidium parvum
KRCVPFRRFNGGVGRTAKANEF

SEQ ID NO: 2297012 - protein, 21 aa, Cryptosporidium parvum
KRDAIKSCFVFQYVSEQQLSL

SEQ ID NO: 2297013 - protein, 20 aa, Cryptosporidium parvum
KRDSLCIFLEHGAIDVFEGV

SEQ ID NO: 2297014 - protein, 18 aa, Cryptosporidium parvum
KRDYIEVLHPLQYNIQEK

SEQ ID NO: 2297015 - protein, 19 aa, Cryptosporidium parvum
KREETSWRVPKKYSSLSAS

SEQ ID NO: 2297016 - protein, 23 aa, Cryptosporidium parvum
KRELKAALRALGFDVKKKDIELV

SEQ ID NO: 2297017 - protein, 23 aa, Cryptosporidium parvum
KREVPFDIAANFAQENNLFFSEA

SEQ ID NO: 2297018 - protein, 22 aa, Cryptosporidium parvum
KREVSAPIFGSSDMESKNPASD

SEQ ID NO: 2297019 - protein, 30 aa, Cryptosporidium parvum
KRFESNLRELISWWMKIVINDIPVIRFGDD

SEQ ID NO: 2297020 - protein, 18 aa, Cryptosporidium parvum
KRFGRMFTDDDFSVISVK

SEQ ID NO: 2297021 - protein, 19 aa, Cryptosporidium parvum
KRFLRRIRNVLPGINTPIY

SEQ ID NO: 2297022 - protein, 24 aa, Cryptosporidium parvum
KRFLYLCLLDRLIIGNATYLQLAY

SEQ ID NO: 2297023 - protein, 25 aa, Cryptosporidium parvum
KRFMGLTHWCTLRFIQDELLPRLDP

SEQ ID NO: 2297024 - protein, 17 aa, Cryptosporidium parvum
KRFNVRRGNKSAHNLES

SEQ ID NO: 2297025 - protein, 25 aa, Cryptosporidium parvum
KRGDNATHSWTCFLRSPDNEDISYY

SEQ ID NO: 2297026 - protein, 20 aa, Cryptosporidium parvum
KRGKRCLSIRFKKQKFFTKK

SEQ ID NO: 2297027 - protein, 17 aa, Cryptosporidium parvum
KRGLYHFGPEFRPVPLL

SEQ ID NO: 2297028 - protein, 21 aa, Cryptosporidium parvum
KRIATVYPRDIVNIRYLHGYN

SEQ ID NO: 2297029 - protein, 36 aa, Cryptosporidium parvum
KRIDEVDKFLLSFGLRKVGMHIIFLFEIDPKVHYKI

SEQ ID NO: 2297030 - protein, 23 aa, Cryptosporidium parvum
KRIDLKGNLPLEYNQYSNQNVIM

SEQ ID NO: 2297031 - protein, 20 aa, Cryptosporidium parvum
KRIFPELFIIMSSFPPNIPE

SEQ ID NO: 2297032 - protein, 25 aa, Cryptosporidium parvum
KRIGYLACSIFLNKNHELLVLLVNT

SEQ ID NO: 2297033 - protein, 20 aa, Cryptosporidium parvum
KRIKLNVGGIFYETTNTTLL

SEQ ID NO: 2297034 - protein, 28 aa, Cryptosporidium parvum
KRIKNPRLRLKKILEMRSSSSRCIISSD

SEQ ID NO: 2297035 - protein, 20 aa, Cryptosporidium parvum
KRILEIQGLCNRTIEFISLI

SEQ ID NO: 2297036 - protein, 19 aa, Cryptosporidium parvum
KRILSQMGFEEMPTNRWVE

SEQ ID NO: 2297037 - protein, 19 aa, Cryptosporidium parvum
KRINKSMVNQDDFCIVKLA

SEQ ID NO: 2297038 - protein, 25 aa, Cryptosporidium parvum
KRISANDALKHPFVSIFHNPNEEPN

SEQ ID NO: 2297039 - protein, 21 aa, Cryptosporidium parvum
KRISCKNALLHPWFDDIDRSK

SEQ ID NO: 2297040 - protein, 18 aa, Cryptosporidium parvum
KRISSPLLEPRNLEKIMI

SEQ ID NO: 2297041 - protein, 17 aa, Cryptosporidium parvum
KRITALEALQHPWLNTN

SEQ ID NO: 2297042 - protein, 20 aa, Cryptosporidium parvum
KRKAAMNIDYSYSVSENATR

SEQ ID NO: 2297043 - protein, 23 aa, Cryptosporidium parvum
KRKDHKFTPGFLFVSMDVSRALV

SEQ ID NO: 2297044 - protein, 22 aa, Cryptosporidium parvum
KRKIDRFSIKKLISVFYYRKIF

SEQ ID NO: 2297045 - protein, 21 aa, Cryptosporidium parvum
KRKKKGLSLLGYMHPNIPSGV

SEQ ID NO: 2297046 - protein, 25 aa, Cryptosporidium parvum
KRKKKWKLAFCNAQECVNALDYMLE

SEQ ID NO: 2297047 - protein, 17 aa, Cryptosporidium parvum
KRKLVELQKRFGGKKEE

SEQ ID NO: 2297048 - protein, 32 aa, Cryptosporidium parvum
KRKLWVCNPNKLRVCEFLIHWHEQRGDKILVF

SEQ ID NO: 2297049 - protein, 19 aa, Cryptosporidium parvum
KRKMMERYGHLFENEAEES

SEQ ID NO: 2297050 - protein, 24 aa, Cryptosporidium parvum
KRKNEISDNWSFGSNEEFNLLSIF

SEQ ID NO: 2297051 - protein, 19 aa, Cryptosporidium parvum
KRKPPSICSKYLPQCKQRQ

SEQ ID NO: 2297052 - protein, 21 aa, Cryptosporidium parvum
KRKQISMSIEEFLEKSQTLSL

SEQ ID NO: 2297053 - protein, 17 aa, Cryptosporidium parvum
KRKSDALSNKFRGMLKE

SEQ ID NO: 2297054 - protein, 34 aa, Cryptosporidium parvum; identical to SEQ ID NO: 2175321

SEQ ID NO: 2297055 - protein, 20 aa, Cryptosporidium parvum
KRLAEHLCALYTSYNSNEKP

SEQ ID NO: 2297056 - protein, 19 aa, Cryptosporidium parvum
KRLERAKKFGIAIDLNLEK

SEQ ID NO: 2297057 - protein, 18 aa, Cryptosporidium parvum
KRLFMHRSPLPSLEESAI

SEQ ID NO: 2297058 - protein, 20 aa, Cryptosporidium parvum
KRLGKAKTFLEQTISGIKDA

SEQ ID NO: 2297059 - protein, 25 aa, Cryptosporidium parvum
KRLIEEYYIRMIILYRKRIQIKEKY

SEQ ID NO: 2297060 - protein, 17 aa, Cryptosporidium parvum
KRLIPIDQDELFVNVNA

SEQ ID NO: 2297061 - protein, 23 aa, Cryptosporidium parvum
KRLKAYVYCLLGFYDSAMSVCLK

SEQ ID NO: 2297062 - protein, 27 aa, Cryptosporidium parvum
KRLKYKIASKFMSLIFYRRSRKGFSKI

SEQ ID NO: 2297063 - protein, 21 aa, Cryptosporidium parvum
KRLLNQGVFTKSHFSECLTQF

SEQ ID NO: 2297064 - protein, 18 aa, Cryptosporidium parvum
KRLLRINPVGLYIHAVAK

SEQ ID NO: 2297065 - protein, 25 aa, Cryptosporidium parvum
KRLNEKNQEIHFLKKTVKDLETRII

SEQ ID NO: 2297066 - protein, 21 aa, Cryptosporidium parvum
KRLNSDFGDSPLCFISLIDCP

SEQ ID NO: 2297067 - protein, 25 aa, Cryptosporidium parvum
KRLQNTLELKEFVSLIETCDQLPIQ

SEQ ID NO: 2297068 - protein, 18 aa, Cryptosporidium parvum
KRLREFHQNKVFKTKGNE

SEQ ID NO: 2297069 - protein, 21 aa, Cryptosporidium parvum
KRLRLLGEPITLFGEDDNERY

SEQ ID NO: 2297070 - protein, 18 aa, Cryptosporidium parvum
KRLRSDILNLTYYGKLYD

SEQ ID NO: 2297071 - protein, 25 aa, Cryptosporidium parvum
KRLTALQLQGLKWLNFGTCNRYEFL

SEQ ID NO: 2297072 - protein, 19 aa, Cryptosporidium parvum
KRLTESKLKVFVNAITDSS

SEQ ID NO: 2297073 - protein, 17 aa, Cryptosporidium parvum
KRLYFWRRSNLSVFQSL

SEQ ID NO: 2297074 - protein, 21 aa, Cryptosporidium parvum
KRMCFAGFSEIFISWIHVKAM

SEQ ID NO: 2297075 - protein, 20 aa, Cryptosporidium parvum
KRNFHRNRKSLGLHPNPISE

SEQ ID NO: 2297076 - protein, 17 aa, Cryptosporidium parvum
KRNGIILTGYAVRGTPA

SEQ ID NO: 2297077 - protein, 36 aa, Cryptosporidium parvum; identical to SEQ ID NO: 2175345

SEQ ID NO: 2297078 - protein, 19 aa, Cryptosporidium parvum
KRNKRKCNIEHSGIKETHF

SEQ ID NO: 2297079 - protein, 18 aa, Cryptosporidium parvum
KRNLAVFWAKCEAGTYIR

SEQ ID NO: 2297080 - protein, 19 aa, Cryptosporidium parvum
KRNLFNLVIINRNPIIPLP

SEQ ID NO: 2297081 - protein, 19 aa, Cryptosporidium parvum
KRNSLPLDVEFISESDGEA

SEQ ID NO: 2297082 - protein, 37 aa, Cryptosporidium parvum
KRNWMRIMVRLNGFIYFKSKMILIKQYLVDEEVQLLE

SEQ ID NO: 2297083 - protein, 21 aa, Cryptosporidium parvum
KRPHTAYTLWCEHIRQKVREN

SEQ ID NO: 2297084 - protein, 17 aa, Cryptosporidium parvum
KRPLVELQDKITYEGEW

SEQ ID NO: 2297085 - protein, 27 aa, Cryptosporidium parvum
KRQLILKLRWYGAKTLDYYSSRADYVI

SEQ ID NO: 2297086 - protein, 41 aa, Cryptosporidium parvum
KRQLLTELLLIEWMEAFFAHLRLALLPSDFLVYSHRHDLVC

SEQ ID NO: 2297087 - protein, 20 aa, Cryptosporidium parvum
KRQTEISRYFSAKRYGVEKS

SEQ ID NO: 2297088 - protein, 25 aa, Cryptosporidium parvum
KRQYKMLKSSICFFEKQEINKYYEY

SEQ ID NO: 2297089 - protein, 24 aa, Cryptosporidium parvum
KRRCKPDYYQFFFGYLDYEKEKKD

SEQ ID NO: 2297090 - protein, 18 aa, Cryptosporidium parvum
KRRELKAAGMLSHASIMR

SEQ ID NO: 2297091 - protein, 20 aa, Cryptosporidium parvum
KRRGELQLIKILQEELFPAF

SEQ ID NO: 2297092 - protein, 20 aa, Cryptosporidium parvum
KRRIKTYTRLRIINEAKSKG

SEQ ID NO: 2297093 - protein, 19 aa, Cryptosporidium parvum
KRRKREFLKEMKNRNNGVI

SEQ ID NO: 2297094 - protein, 21 aa, Cryptosporidium parvum
KRRLLPYHMHLSLEVIDCIYL

SEQ ID NO: 2297095 - protein, 17 aa, Cryptosporidium parvum
KRRLSGATWLYSPIELL

SEQ ID NO: 2297096 - protein, 18 aa, Cryptosporidium parvum
KRRLSSEICFYREKRDTR

SEQ ID NO: 2297097 - protein, 25 aa, Cryptosporidium parvum
KRRSKRGYAPVKLFVNRVPKHMTNE

SEQ ID NO: 2297098 - protein, 17 aa, Cryptosporidium parvum
KRRSRIGLFESELESSS

SEQ ID NO: 2297099 - protein, 19 aa, Cryptosporidium parvum
KRSDACLNKLASLNEYVQV

SEQ ID NO: 2297100 - protein, 17 aa, Cryptosporidium parvum
KRSELISYIKNIFKTHG

SEQ ID NO: 2297101 - protein, 18 aa, Cryptosporidium parvum
KRSLKCHVLPKESIHPYI

SEQ ID NO: 2297102 - protein, 41 aa, Cryptosporidium parvum
KRSMRFKKSYPILASLITNIDWWRIVLDEAQMTEGYSLVSK

SEQ ID NO: 2297103 - protein, 21 aa, Cryptosporidium parvum
KRSNCNGVLEYLYIGHSFILS

SEQ ID NO: 2297104 - protein, 20 aa, Cryptosporidium parvum
KRSYQELGMDYDIKLNNEEK

SEQ ID NO: 2297105 - protein, 25 aa, Cryptosporidium parvum
KRTCLLLKKILGFGVKNNTTITKNK

SEQ ID NO: 2297106 - protein, 18 aa, Cryptosporidium parvum
KRTLKYPYIKKISTTKKY

SEQ ID NO: 2297107 - protein, 21 aa, Cryptosporidium parvum
KRTNLEIVQDILLLSIIRGPL

SEQ ID NO: 2297108 - protein, 26 aa, Cryptosporidium parvum
KRTQMELKLLSTCLHDMALRYHQCKS

SEQ ID NO: 2297109 - protein, 17 aa, Cryptosporidium parvum
KRTSIRSSLAISQNSSS

SEQ ID NO: 2297110 - protein, 24 aa, Cryptosporidium parvum
KRVEECKKRHQSIIHQLVHISCMI

SEQ ID NO: 2297111 - protein, 17 aa, Cryptosporidium parvum
KRVLSLFGETVLSREKL

SEQ ID NO: 2297112 - protein, 31 aa, Cryptosporidium parvum
KRVNGSRVIACYLEDEFGRLGFFGTSSGQLL

SEQ ID NO: 2297113 - protein, 22 aa, Cryptosporidium parvum
KRVNSTLLQREVDSYMTNYDIE

SEQ ID NO: 2297114 - protein, 18 aa, Cryptosporidium parvum
KRVTFKRIEEIPPKKKLI

SEQ ID NO: 2297115 - protein, 19 aa, Cryptosporidium parvum
KRVTVDYSRFEEALRELEL

SEQ ID NO: 2297116 - protein, 23 aa, Cryptosporidium parvum
KRYENSLNFSVEYHVGNLLSRTT

SEQ ID NO: 2297117 - protein, 18 aa, Cryptosporidium parvum
KRYGCSVEYYDCMNLLCG

SEQ ID NO: 2297118 - protein, 23 aa, Cryptosporidium parvum
KRYILRYLIYDCICIERDDTVKS

SEQ ID NO: 2297119 - protein, 23 aa, Cryptosporidium parvum
KSAFFCKLLHEFYQVDKHPDNID

SEQ ID NO: 2297120 - protein, 19 aa, Cryptosporidium parvum
KSAISELQFPIKNSEKSQI

SEQ ID NO: 2297121 - protein, 20 aa, Cryptosporidium parvum
KSANGKAKFGLDIFADALLA

SEQ ID NO: 2297122 - protein, 18 aa, Cryptosporidium parvum
KSARIYFMDLDLMKKNQI

SEQ ID NO: 2297123 - protein, 19 aa, Cryptosporidium parvum
KSAYLLQRCDYVAVHHPSY

SEQ ID NO: 2297124 - protein, 19 aa, Cryptosporidium parvum
KSCELQCNDRRAELWVEVF

SEQ ID NO: 2297125 - protein, 25 aa, Cryptosporidium parvum
KSCFPPPLDCPINLFRQILVLTSER

SEQ ID NO: 2297126 - protein, 31 aa, Cryptosporidium parvum; identical to SEQ ID NO: 2175387

SEQ ID NO: 2297127 - protein, 25 aa, Cryptosporidium parvum
KSDEILKIYLSYLLDSGGIRIHELR

SEQ ID NO: 2297128 - protein, 28 aa, Cryptosporidium parvum
KSDEYKFNYDLIKRIIKYENYINMMKEY

SEQ ID NO: 2297129 - protein, 28 aa, Cryptosporidium parvum
KSDFCDFKKVSLLPLLFGETTCNQQLTN

SEQ ID NO: 2297130 - protein, 19 aa, Cryptosporidium parvum
KSDFPRDYSRESSKRNYDY

SEQ ID NO: 2297131 - protein, 27 aa, Cryptosporidium parvum
KSDGRLFVWKKICYENMTQQEKIQIVN

SEQ ID NO: 2297132 - protein, 20 aa, Cryptosporidium parvum
KSDILKTLFLKQDIDHDKLK

SEQ ID NO: 2297133 - protein, 25 aa, Cryptosporidium parvum
KSDKGVFNYFELVEKYTSRNSYNRR

SEQ ID NO: 2297134 - protein, 18 aa, Cryptosporidium parvum
KSDQQKCNTFSWIEETNS

SEQ ID NO: 2297135 - protein, 17 aa, Cryptosporidium parvum
KSEALIFEIDGYTRKKS

SEQ ID NO: 2297136 - protein, 32 aa, Cryptosporidium parvum
KSEEFQGRCNYIKYSTQWYLWAKRRNAETYSQ

SEQ ID NO: 2297137 - protein, 26 aa, Cryptosporidium parvum
KSEFKDFILESDLDWLVLLKSPSPTP

SEQ ID NO: 2297138 - protein, 19 aa, Cryptosporidium parvum
KSEIPVVFVPVCLENSISH

SEQ ID NO: 2297139 - protein, 30 aa, Cryptosporidium parvum
KSELFRSTPDWKRLETYKDLISCEWGSAKV

SEQ ID NO: 2297140 - protein, 22 aa, Cryptosporidium parvum
KSELSFEYPFSLPFKSTYESNF

SEQ ID NO: 2297141 - protein, 24 aa, Cryptosporidium parvum
KSESSYIYKLWAVVCHSGNTLSCG

SEQ ID NO: 2297142 - protein, 18 aa, Cryptosporidium parvum
KSEYCKLKEKLKSIENKE

SEQ ID NO: 2297143 - protein, 30 aa, Cryptosporidium parvum
KSEYVMKIQCLIKRYWILAHLDRLFWVADV

SEQ ID NO: 2297144 - protein, 25 aa, Cryptosporidium parvum
KSFKEMFRSINLPIFHRNLNRKLKR

SEQ ID NO: 2297145 - protein, 24 aa, Cryptosporidium parvum
KSFKLRQLLLLKGIKCQRNISLNN

SEQ ID NO: 2297146 - protein, 26 aa, Cryptosporidium parvum
KSFLLSVKTLIEWMSLEIRSEFCDSR

SEQ ID NO: 2297147 - protein, 21 aa, Cryptosporidium parvum
KSFMKKLKFILFQQQRENKRL

SEQ ID NO: 2297148 - protein, 27 aa, Cryptosporidium parvum
KSFNEFCQLFLWPLFHNVLNPEELSNA

SEQ ID NO: 2297149 - protein, 26 aa, Cryptosporidium parvum
KSFNKKSIDGWKVLVDVERGRTVENW

SEQ ID NO: 2297150 - protein, 17 aa, Cryptosporidium parvum
KSFSIDDTQVWAYKAFA

SEQ ID NO: 2297151 - protein, 22 aa, Cryptosporidium parvum
KSFSTCRRWMISGRFQDILPKE

SEQ ID NO: 2297152 - protein, 21 aa, Cryptosporidium parvum
KSGALKTYFEEMIIKQNEIYE

SEQ ID NO: 2297153 - protein, 20 aa, Cryptosporidium parvum
KSGEKIHIGKFIDFMHLNLI

SEQ ID NO: 2297154 - protein, 18 aa, Cryptosporidium parvum
KSGFSRMFHGGLYSDKQQ

SEQ ID NO: 2297155 - protein, 22 aa, Cryptosporidium parvum
KSGHFLHVDFGYIFGEDPKPFP

SEQ ID NO: 2297156 - protein, 17 aa, Cryptosporidium parvum
KSGILSMKIVEFGFQGT

SEQ ID NO: 2297157 - protein, 19 aa, Cryptosporidium parvum
KSGISTPFVYEGQARAIKK

SEQ ID NO: 2297158 - protein, 18 aa, Cryptosporidium parvum
KSGKDIQKGIAFDSSSVR

SEQ ID NO: 2297159 - protein, 24 aa, Cryptosporidium parvum
KSGLLDYYGTLFIPSEQDLSSKID

SEQ ID NO: 2297160 - protein, 23 aa, Cryptosporidium parvum
KSGLPGVTSVIFLSRNRLAALEN

SEQ ID NO: 2297161 - protein, 17 aa, Cryptosporidium parvum
KSGNCSNGKVLISNINK

SEQ ID NO: 2297162 - protein, 18 aa, Cryptosporidium parvum
KSGSLLGLTVMNLENTHE

SEQ ID NO: 2297163 - protein, 26 aa, Cryptosporidium parvum
KSGTRIRVIGLFLPYISRRTQFLRNI

SEQ ID NO: 2297164 - protein, 27 aa, Cryptosporidium parvum
KSGTRWAIRTFLRFGRSSFISRSMMNS

SEQ ID NO: 2297165 - protein, 28 aa, Cryptosporidium parvum
KSGVWNRISQVLPRDSYFSLLNFVRQYH

SEQ ID NO: 2297166 - protein, 21 aa, Cryptosporidium parvum
KSHLDPYDWYYSSSNNENGDN

SEQ ID NO: 2297167 - protein, 20 aa, Cryptosporidium parvum
KSHMRRTITHFLKTEIIFHL

SEQ ID NO: 2297168 - protein, 20 aa, Cryptosporidium parvum
KSHMVCFALVAMDVGFDNPM

SEQ ID NO: 2297169 - protein, 25 aa, Cryptosporidium parvum
KSHPTFPEYFIVAYGTKFSQNSSFE

SEQ ID NO: 2297170 - protein, 21 aa, Cryptosporidium parvum
KSICGGLRVLNSYFVCQDATY

SEQ ID NO: 2297171 - protein, 17 aa, Cryptosporidium parvum
KSICGLSDHLHDVYCNN

SEQ ID NO: 2297172 - protein, 29 aa, Cryptosporidium parvum
KSIEFNFSINFGINVFNLFENNLFGLIIN

SEQ ID NO: 2297173 - protein, 23 aa, Cryptosporidium parvum
KSIFRRGECYMMLGRFEEAKKDF

SEQ ID NO: 2297174 - protein, 20 aa, Cryptosporidium parvum
KSIFWNCVETIAVNNAGIIK

SEQ ID NO: 2297175 - protein, 25 aa, Cryptosporidium parvum
KSIFWNSLISTIRCMEIIKYKKHSY

SEQ ID NO: 2297176 - protein, 26 aa, Cryptosporidium parvum
KSIIKQKCSFIKFIVNSIQSNIVENK

SEQ ID NO: 2297177 - protein, 27 aa, Cryptosporidium parvum
KSIKMSDLRPLIWVCDLHHRVEELISY

SEQ ID NO: 2297178 - protein, 36 aa, Cryptosporidium parvum
KSINISKTILCRYIWRLRIPTWNRIFITSSKESKDS

SEQ ID NO: 2297179 - protein, 26 aa, Cryptosporidium parvum
KSINKKRKIAFCLDNDLDTKELKLSE

SEQ ID NO: 2297180 - protein, 24 aa, Cryptosporidium parvum
KSIRCYRKKLRVHIFNTYESQKPT

SEQ ID NO: 2297181 - protein, 27 aa, Cryptosporidium parvum
KSIVFSGLCSRCLVQVSYGIGIARPLS

SEQ ID NO: 2297182 - protein, 22 aa, Cryptosporidium parvum
KSKDFKNLLIIGPRKVEKLYNL

SEQ ID NO: 2297183 - protein, 17 aa, Cryptosporidium parvum
KSKFHVVLADFKSENRL

SEQ ID NO: 2297184 - protein, 28 aa, Cryptosporidium parvum
KSKHNLIRLSVFFKRESPITFFKLQIIN

SEQ ID NO: 2297185 - protein, 24 aa, Cryptosporidium parvum
KSKIKSIECFLVLTNFMDEQASVT

SEQ ID NO: 2297186 - protein, 24 aa, Cryptosporidium parvum
KSKIPIGALFYALKHHTGVKFFLD

SEQ ID NO: 2297187 - protein, 21 aa, Cryptosporidium parvum
KSKKAFCDILIQIGAKALFAL

SEQ ID NO: 2297188 - protein, 23 aa, Cryptosporidium parvum
KSKKLASQVIRDYLNKEFCSYDD

SEQ ID NO: 2297189 - protein, 21 aa, Cryptosporidium parvum
KSKKRHRGMLQFEWSNNEDTF

SEQ ID NO: 2297190 - protein, 25 aa, Cryptosporidium parvum
KSKLNFCTWPSPQLSTAVVEPYNAV

SEQ ID NO: 2297191 - protein, 20 aa, Cryptosporidium parvum
KSKQELLEFQQRVYDSEIIS

SEQ ID NO: 2297192 - protein, 19 aa, Cryptosporidium parvum
KSKRHEGRPFLFVINETKL

SEQ ID NO: 2297193 - protein, 18 aa, Cryptosporidium parvum
KSKSCPFKGIGKDSQGKS

SEQ ID NO: 2297194 - protein, 29 aa, Cryptosporidium parvum
KSKSEFRYWFKIYIKFSLDSLDLECIKEI

SEQ ID NO: 2297195 - protein, 19 aa, Cryptosporidium parvum
KSKSGSNCRQHFITEKEED

SEQ ID NO: 2297196 - protein, 19 aa, Cryptosporidium parvum
KSKSKLSSISLKYVNNCNS

SEQ ID NO: 2297197 - protein, 21 aa, Cryptosporidium parvum
KSKTEPYPILFSSNKDINQNN

SEQ ID NO: 2297198 - protein, 20 aa, Cryptosporidium parvum
KSKTLELLQVTDIIKNVHKE

SEQ ID NO: 2297199 - protein, 19 aa, Cryptosporidium parvum
KSKTVCNLTDKLSSIDQAK

SEQ ID NO: 2297200 - protein, 20 aa, Cryptosporidium parvum
KSKVNRCCRICLSDDADGFT

SEQ ID NO: 2297201 - protein, 22 aa, Cryptosporidium parvum
KSLCGSDFYLAPELVRQQEYGP

SEQ ID NO: 2297202 - protein, 19 aa, Cryptosporidium parvum
KSLCVEVKLVKWRENTWCP

SEQ ID NO: 2297203 - protein, 26 aa, Cryptosporidium parvum
KSLDLWNLGCLIYWSYQVSSNLNPSD

SEQ ID NO: 2297204 - protein, 17 aa, Cryptosporidium parvum
KSLEEVVIFPNQNLWLQ

SEQ ID NO: 2297205 - protein, 28 aa, Cryptosporidium parvum
KSLEFKCGIGSWPYKGGEYSWMGQYLCE

SEQ ID NO: 2297206 - protein, 27 aa, Cryptosporidium parvum
KSLEYMRFSTLFLKKLIIGPIQVKCND

SEQ ID NO: 2297207 - protein, 22 aa, Cryptosporidium parvum
KSLFPSFILSMFDMITKYSHFS

SEQ ID NO: 2297208 - protein, 20 aa, Cryptosporidium parvum
KSLFPYLHLMCKEFHSELSS

SEQ ID NO: 2297209 - protein, 17 aa, Cryptosporidium parvum
KSLIDIYLLRSVANEKT

SEQ ID NO: 2297210 - protein, 17 aa, Cryptosporidium parvum
KSLIHPCILKVYDTLEV

SEQ ID NO: 2297211 - protein, 19 aa, Cryptosporidium parvum
KSLIKYKVLYEYIGHRVGQ

SEQ ID NO: 2297212 - protein, 17 aa, Cryptosporidium parvum
KSLKTLSNALAFDQFDA

SEQ ID NO: 2297213 - protein, 17 aa, Cryptosporidium parvum
KSLLLPKEVEYAVKYLE

SEQ ID NO: 2297214 - protein, 19 aa, Cryptosporidium parvum
KSLLRYIQVSHYFEKPTVT

SEQ ID NO: 2297215 - protein, 22 aa, Cryptosporidium parvum
KSLPLAKAISVSGCGNYVVVGY

SEQ ID NO: 2297216 - protein, 25 aa, Cryptosporidium parvum
KSLPRFIRREILSLDVDSAFSAIET

SEQ ID NO: 2297217 - protein, 17 aa, Cryptosporidium parvum
KSLRLVKFTSGEKIVVQ

SEQ ID NO: 2297218 - protein, 18 aa, Cryptosporidium parvum
KSLRSALRGHIEYDKAEK

SEQ ID NO: 2297219 - protein, 18 aa, Cryptosporidium parvum
KSLRVRAGDFANIHVSKH

SEQ ID NO: 2297220 - protein, 21 aa, Cryptosporidium parvum
KSLVVQLSISYSCIRKSKIPL

SEQ ID NO: 2297221 - protein, 20 aa, Cryptosporidium parvum
KSLWNKCPKYFVTTPSSVSL

SEQ ID NO: 2297222 - protein, 18 aa, Cryptosporidium parvum
KSMFSNQVYLEYEDHLDN

SEQ ID NO: 2297223 - protein, 20 aa, Cryptosporidium parvum
KSMGFTALRKRNCKNYKDKS

SEQ ID NO: 2297224 - protein, 25 aa, Cryptosporidium parvum
KSMLEKRIGPVFSRNINGEKSDGTY

SEQ ID NO: 2297225 - protein, 19 aa, Cryptosporidium parvum
KSNGLNIDIEWYKTQQLLP

SEQ ID NO: 2297226 - protein, 24 aa, Cryptosporidium parvum
KSNKCHFGYLRNKFAKLFIHERKN

SEQ ID NO: 2297227 - protein, 18 aa, Cryptosporidium parvum
KSNLRGCEGLIERIQCMT

SEQ ID NO: 2297228 - protein, 23 aa, Cryptosporidium parvum
KSNNILPCIIEYTELNKLGDKKE

SEQ ID NO: 2297229 - protein, 35 aa, Cryptosporidium parvum
KSNNVCSISEAMNVCKSNVVLIPYYGGLTKGNYLR

SEQ ID NO: 2297230 - protein, 18 aa, Cryptosporidium parvum
KSNPLGLDKSHYFNRVSY

SEQ ID NO: 2297231 - protein, 28 aa, Cryptosporidium parvum
KSNQKRISNAFAMVGGIDFHEFNNNLNG

SEQ ID NO: 2297232 - protein, 24 aa, Cryptosporidium parvum
KSNRLKIRCEIATYSAVVVLRELF

SEQ ID NO: 2297233 - protein, 24 aa, Cryptosporidium parvum
KSNSFIKYFLSILLFEINQCEPQY

SEQ ID NO: 2297234 - protein, 20 aa, Cryptosporidium parvum
KSNSFYEKVCKLVRDDISEV

SEQ ID NO: 2297235 - protein, 19 aa, Cryptosporidium parvum
KSNYWAFVSVRIPSETIDP

SEQ ID NO: 2297236 - protein, 21 aa, Cryptosporidium parvum
KSPDLVIHPSILKGLSELGFL

SEQ ID NO: 2297237 - protein, 25 aa, Cryptosporidium parvum
KSPNSGGIGSVFCCAPEKSGIMTPE

SEQ ID NO: 2297238 - protein, 20 aa, Cryptosporidium parvum
KSPQTFGVGIDWLDGMYRFI

SEQ ID NO: 2297239 - protein, 30 aa, Cryptosporidium parvum; identical to SEQ ID NO: 2175480

SEQ ID NO: 2297240 - protein, 18 aa, Cryptosporidium parvum
KSPTCIFPSMVGQYRSRY

SEQ ID NO: 2297241 - protein, 28 aa, Cryptosporidium parvum
KSPWMRPPGEWLRLCDNCLLPFHDVSGC

SEQ ID NO: 2297242 - protein, 30 aa, Cryptosporidium parvum
KSPYFDRFSLRLPIIMLFESLLKVDLHRER

SEQ ID NO: 2297243 - protein, 17 aa, Cryptosporidium parvum
KSPYGPGPLEFKGKDGW

SEQ ID NO: 2297244 - protein, 25 aa, Cryptosporidium parvum
KSQEKIKFECCFTDHIFSKMEKLPK

SEQ ID NO: 2297245 - protein, 23 aa, Cryptosporidium parvum
KSQILRFVNEFSTRTVYTSGKSS

SEQ ID NO: 2297246 - protein, 19 aa, Cryptosporidium parvum
KSQQKFLCHLKLQQRSKKD

SEQ ID NO: 2297247 - protein, 17 aa, Cryptosporidium parvum
KSRCEWMGGTMGNPNWL

SEQ ID NO: 2297248 - protein, 24 aa, Cryptosporidium parvum
KSREKELYEGKSFSNKDKEICELR

SEQ ID NO: 2297249 - protein, 25 aa, Cryptosporidium parvum
KSRFKNIESSFRYAYTAAQVLSICI

SEQ ID NO: 2297250 - protein, 25 aa, Cryptosporidium parvum
KSRIPKFRNPWDVYGELQPRRSKDL

SEQ ID NO: 2297251 - protein, 24 aa, Cryptosporidium parvum
KSRMKDLPASEQFLYGSHYSTPGY

SEQ ID NO: 2297252 - protein, 24 aa, Cryptosporidium parvum
KSRRNLATIFYLKKLKKLGLSMNY

SEQ ID NO: 2297253 - protein, 18 aa, Cryptosporidium parvum
KSRSEAVSLEASRGICDI

SEQ ID NO: 2297254 - protein, 20 aa, Cryptosporidium parvum
KSRTCYLKLVPSVIEIFKIV

SEQ ID NO: 2297255 - protein, 18 aa, Cryptosporidium parvum
KSSAFKFTGAVVSGSHQQ

SEQ ID NO: 2297256 - protein, 17 aa, Cryptosporidium parvum
KSSASSSSFIVGGVNML

SEQ ID NO: 2297257 - protein, 24 aa, Cryptosporidium parvum
KSSDELPHGLTIVKARTIPRQTDS

SEQ ID NO: 2297258 - protein, 24 aa, Cryptosporidium parvum
KSSFELLLNMNIRRTFSLDHNSPD

SEQ ID NO: 2297259 - protein, 19 aa, Cryptosporidium parvum
KSSFYEIEFILITENEKNI

SEQ ID NO: 2297260 - protein, 26 aa, Cryptosporidium parvum
KSSLDFLPLDILESEFSQFYEIPLNI

SEQ ID NO: 2297261 - protein, 17 aa, Cryptosporidium parvum
KSSLSGNNYSSFSDDLD

SEQ ID NO: 2297262 - protein, 19 aa, Cryptosporidium parvum
KSSLVSFQINSLIGSAENK

SEQ ID NO: 2297263 - protein, 19 aa, Cryptosporidium parvum
KSSLWKYFLDKSSENMNFS

SEQ ID NO: 2297264 - protein, 20 aa, Cryptosporidium parvum
KSSNLLAFICRNIMTNWLPL

SEQ ID NO: 2297265 - protein, 20 aa, Cryptosporidium parvum
KSSSISETFLSGPANLSLFD

SEQ ID NO: 2297266 - protein, 23 aa, Cryptosporidium parvum
KSSSPFFSLSFSFSLSLKISSSR

SEQ ID NO: 2297267 - protein, 19 aa, Cryptosporidium parvum
KSSSTLNLTLAWTKAFIYL

SEQ ID NO: 2297268 - protein, 19 aa, Cryptosporidium parvum
KSSTKCKAKEDIYRESINL

SEQ ID NO: 2297269 - protein, 18 aa, Cryptosporidium parvum
KSSVVPAKKVITFISNAF

SEQ ID NO: 2297270 - protein, 26 aa, Cryptosporidium parvum
KSSYHPKCWCNLFGFAMKKDSKDGNL

SEQ ID NO: 2297271 - protein, 31 aa, Cryptosporidium parvum
KSTDLRFKVMNNLKMAYSLTHNFTKNISATF

SEQ ID NO: 2297272 - protein, 23 aa, Cryptosporidium parvum
KSTFEKRVANLFQRLSTIQKEKT

SEQ ID NO: 2297273 - protein, 26 aa, Cryptosporidium parvum
KSTSCDRELYALASTHKISFKSKRGV

SEQ ID NO: 2297274 - protein, 17 aa, Cryptosporidium parvum
KSVGKTLEEAVCTENSN

SEQ ID NO: 2297275 - protein, 21 aa, Cryptosporidium parvum
KSWKDDPYYLGSIPIHSSNSK

SEQ ID NO: 2297276 - protein, 21 aa, Cryptosporidium parvum
KSWNLFFSKFLNGFRLEMSDG

SEQ ID NO: 2297277 - protein, 20 aa, Cryptosporidium parvum
KSYFCLYFAKGACVNGSKCK

SEQ ID NO: 2297278 - protein, 19 aa, Cryptosporidium parvum
KSYKLLELVPGAIEAPKRE

SEQ ID NO: 2297279 - protein, 17 aa, Cryptosporidium parvum
KSYLRIHITKALRKKSN

SEQ ID NO: 2297280 - protein, 21 aa, Cryptosporidium parvum
KSYRCICYISTPIYIHEYHEI

SEQ ID NO: 2297281 - protein, 25 aa, Cryptosporidium parvum
KSYRFAISGQGAWKYLDVLPDKGGK

SEQ ID NO: 2297282 - protein, 23 aa, Cryptosporidium parvum
KSYSMCHSWPVRVPRPCLEKLQG

SEQ ID NO: 2297283 - protein, 19 aa, Cryptosporidium parvum
KTAAFLFPIVMKMLNDGPP

SEQ ID NO: 2297284 - protein, 19 aa, Cryptosporidium parvum
KTACDEIARLVKSYWEDIS

SEQ ID NO: 2297285 - protein, 20 aa, Cryptosporidium parvum
KTAETFLRLVRNLQQENMLP

SEQ ID NO: 2297286 - protein, 20 aa, Cryptosporidium parvum
KTALKKNLLLIGSHRANALE

SEQ ID NO: 2297287 - protein, 21 aa, Cryptosporidium parvum
KTALLEGWPGLDIQSDETKDK

SEQ ID NO: 2297288 - protein, 20 aa, Cryptosporidium parvum
KTAMRKGTWVMLKNVHLSSG

SEQ ID NO: 2297289 - protein, 24 aa, Cryptosporidium parvum
KTAQTCVWLQYLFDSGKLVKPVII

SEQ ID NO: 2297290 - protein, 20 aa, Cryptosporidium parvum
KTCDELRRVKSELDFAKGHY

SEQ ID NO: 2297291 - protein, 17 aa, Cryptosporidium parvum
KTDLWSRKNDKILTHVV

SEQ ID NO: 2297292 - protein, 24 aa, Cryptosporidium parvum
KTDSKLLSLCWMNEHTIYTGGSTG

SEQ ID NO: 2297293 - protein, 19 aa, Cryptosporidium parvum
KTEQRLECQSKEPSLQKIS

SEQ ID NO: 2297294 - protein, 19 aa, Cryptosporidium parvum
KTFHQARMSLLALILEKQE

SEQ ID NO: 2297295 - protein, 17 aa, Cryptosporidium parvum
KTFLKYKIFGNAIKIIW

SEQ ID NO: 2297296 - protein, 19 aa, Cryptosporidium parvum
KTFPFYPFIFPSGPFSDPK

SEQ ID NO: 2297297 - protein, 24 aa, Cryptosporidium parvum
KTFTDCFNCLPVAAIIDEKILCMH

SEQ ID NO: 2297298 - protein, 20 aa, Cryptosporidium parvum
KTGEARVGLIGFPSVGKSTL

SEQ ID NO: 2297299 - protein, 26 aa, Cryptosporidium parvum
KTGELYALKCVRVFTKNHDHSNAHKE

SEQ ID NO: 2297300 - protein, 22 aa, Cryptosporidium parvum
KTGIKRPTVFIPNLAINIKQNN

SEQ ID NO: 2297301 - protein, 19 aa, Cryptosporidium parvum
KTGKRVGQYISRKNEISGL

SEQ ID NO: 2297302 - protein, 20 aa, Cryptosporidium parvum
KTIEILEMMNLFCKTYPLGL

SEQ ID NO: 2297303 - protein, 17 aa, Cryptosporidium parvum
KTIFLRNIPFEMSEFSL

SEQ ID NO: 2297304 - protein, 21 aa, Cryptosporidium parvum
KTIIRNCIDLEKAIESDPEIK

SEQ ID NO: 2297305 - protein, 18 aa, Cryptosporidium parvum
KTIKDCIDFYYKYKYTLG

SEQ ID NO: 2297306 - protein, 17 aa, Cryptosporidium parvum
KTINLIQNWVITHFSDL

SEQ ID NO: 2297307 - protein, 17 aa, Cryptosporidium parvum
KTIPYKNNISGIISSAL

SEQ ID NO: 2297308 - protein, 32 aa, Cryptosporidium parvum
KTIQVCVFIGALYRSEIATFIFLILPTSLISQ

SEQ ID NO: 2297309 - protein, 23 aa, Cryptosporidium parvum
KTIRISDFGSMHFTTDASPACYL

SEQ ID NO: 2297310 - protein, 18 aa, Cryptosporidium parvum
KTIWKLKLTIHKLNSTWI

SEQ ID NO: 2297311 - protein, 18 aa, Cryptosporidium parvum
KTIWNVLAILCSKLDEGE

SEQ ID NO: 2297312 - protein, 26 aa, Cryptosporidium parvum
KTKDFLRRVFDPVFGFPNIVRFSWST

SEQ ID NO: 2297313 - protein, 24 aa, Cryptosporidium parvum
KTKFWLPYKEDIIFEDLKLNDNII

SEQ ID NO: 2297314 - protein, 17 aa, Cryptosporidium parvum
KTKIKLIEWCERKSGSI

SEQ ID NO: 2297315 - protein, 22 aa, Cryptosporidium parvum
KTKNWLKCDWNRWIDTDEEENP

SEQ ID NO: 2297316 - protein, 18 aa, Cryptosporidium parvum
KTKYILEVNNSLKGNNGK

SEQ ID NO: 2297317 - protein, 18 aa, Cryptosporidium parvum
KTLAFLIPAANLLYNVEF

SEQ ID NO: 2297318 - protein, 22 aa, Cryptosporidium parvum
KTLCYCLPILQILAEDPFSVFG

SEQ ID NO: 2297319 - protein, 22 aa, Cryptosporidium parvum
KTLEMYIKLLIKENESCCNTNP

SEQ ID NO: 2297320 - protein, 20 aa, Cryptosporidium parvum
KTLFCGWSSPLWSQADSGKR

SEQ ID NO: 2297321 - protein, 21 aa, Cryptosporidium parvum
KTLNVNLFFSHEIEKVIEECD

SEQ ID NO: 2297322 - protein, 18 aa, Cryptosporidium parvum
KTLNYLALQLMFGKEHQI

SEQ ID NO: 2297323 - protein, 25 aa, Cryptosporidium parvum
KTLQEFKWNHEIVYYSFQTIHKYLS

SEQ ID NO: 2297324 - protein, 29 aa, Cryptosporidium parvum
KTLSPNGVFWLARRLFRKPVNTLLPGTYL

SEQ ID NO: 2297325 - protein, 18 aa, Cryptosporidium parvum
KTMKCWDLEQNRIVRNYA

SEQ ID NO: 2297326 - protein, 17 aa, Cryptosporidium parvum
KTNDVYEFFSIARCYAT

SEQ ID NO: 2297327 - protein, 27 aa, Cryptosporidium parvum
KTNELKPSGAYGELAKKWILTVESELD

SEQ ID NO: 2297328 - protein, 17 aa, Cryptosporidium parvum
KTNFCLVDYIHKESNIV

SEQ ID NO: 2297329 - protein, 24 aa, Cryptosporidium parvum
KTNGEIVFSLVFPKSKSFYDRRVV

SEQ ID NO: 2297330 - protein, 22 aa, Cryptosporidium parvum
KTNILIRWIIHISKQLLHPIMN

SEQ ID NO: 2297331 - protein, 28 aa, Cryptosporidium parvum
KTNLISMSNLKGGIFDDSYMNNESIISA

SEQ ID NO: 2297332 - protein, 17 aa, Cryptosporidium parvum
KTNLKKSDLDDFSQSNK

SEQ ID NO: 2297333 - protein, 24 aa, Cryptosporidium parvum
KTNREIIKRLGILNSSNNFEVNDD

SEQ ID NO: 2297334 - protein, 22 aa, Cryptosporidium parvum
KTNSRLQVIGWYSTCSGINSVS

SEQ ID NO: 2297335 - protein, 17 aa, Cryptosporidium parvum
KTNTLSLVGIINFCTTI

SEQ ID NO: 2297336 - protein, 31 aa, Cryptosporidium parvum; identical to SEQ ID NO: 2175569

SEQ ID NO: 2297337 - protein, 17 aa, Cryptosporidium parvum
KTPEPMKGMQIQETISL

SEQ ID NO: 2297338 - protein, 18 aa, Cryptosporidium parvum
KTPFRRSIPFMGSSQDSV

SEQ ID NO: 2297339 - protein, 18 aa, Cryptosporidium parvum
KTPIPIRRQRVDEPHIKL

SEQ ID NO: 2297340 - protein, 25 aa, Cryptosporidium parvum
KTQVKELFDRVSLSTASYGRRDKAL

SEQ ID NO: 2297341 - protein, 18 aa, Cryptosporidium parvum
KTRECLEILYNDLNQDLL

SEQ ID NO: 2297342 - protein, 22 aa, Cryptosporidium parvum
KTRKYCIYVAIGQKRSSVAQIV

SEQ ID NO: 2297343 - protein, 17 aa, Cryptosporidium parvum
KTRTLVQIRSHAQKYFL

SEQ ID NO: 2297344 - protein, 18 aa, Cryptosporidium parvum
KTRWEKFAELKGIKKRKR

SEQ ID NO: 2297345 - protein, 26 aa, Cryptosporidium parvum
KTSCPIMIKLLREWILNANRGEFDHI

SEQ ID NO: 2297346 - protein, 18 aa, Cryptosporidium parvum
KTSFSPVEFIAQLKQDNI

SEQ ID NO: 2297347 - protein, 23 aa, Cryptosporidium parvum
KTSGDLTYIFGFNSYLHGQKLRE

SEQ ID NO: 2297348 - protein, 17 aa, Cryptosporidium parvum
KTSIPIHINKNCLYNLY

SEQ ID NO: 2297349 - protein, 26 aa, Cryptosporidium parvum
KTSLKEAVILPAKFPELFQGKLKPWK

SEQ ID NO: 2297350 - protein, 23 aa, Cryptosporidium parvum
KTSRYTFYMPVFFGLTLSEIQVS

SEQ ID NO: 2297351 - protein, 17 aa, Cryptosporidium parvum
KTTFWKPVLHMIPQKMF

SEQ ID NO: 2297352 - protein, 19 aa, Cryptosporidium parvum
KTTILRCLCNNNIKILEWD

SEQ ID NO: 2297353 - protein, 23 aa, Cryptosporidium parvum
KTTRRELQHLYAVNDIIQIINMA

SEQ ID NO: 2297354 - protein, 27 aa, Cryptosporidium parvum
KTVVSKPGWGAVRWADLSISDASNSWI

SEQ ID NO: 2297355 - protein, 19 aa, Cryptosporidium parvum
KTWYCPGCTRDEEYRALWS

SEQ ID NO: 2297356 - protein, 25 aa, Cryptosporidium parvum
KTYFLRGLLYRIWKYNRNGKVINNS

SEQ ID NO: 2297357 - protein, 22 aa, Cryptosporidium parvum
KTYILPCLYPGIYSTNIPCLAP

SEQ ID NO: 2297358 - protein, 40 aa, Cryptosporidium parvum; identical to SEQ ID NO: 2175590

SEQ ID NO: 2297359 - protein, 17 aa, Cryptosporidium parvum
KVADFVLLSGFGFSAAV

SEQ ID NO: 2297360 - protein, 25 aa, Cryptosporidium parvum
KVALGRACGVSRPVIAAAITSKDGS

SEQ ID NO: 2297361 - protein, 20 aa, Cryptosporidium parvum
KVCEMFKLSFLKSLLLTNIG

SEQ ID NO: 2297362 - protein, 17 aa, Cryptosporidium parvum
KVCLGYRSTVKSIRNGT

SEQ ID NO: 2297363 - protein, 20 aa, Cryptosporidium parvum
KVCNHPFLFSTEIQYPSDES

SEQ ID NO: 2297364 - protein, 18 aa, Cryptosporidium parvum
KVDETWGIAKKQFNKLVS

SEQ ID NO: 2297365 - protein, 21 aa, Cryptosporidium parvum
KVDLILCCGDMQTIRDENDLQ

SEQ ID NO: 2297366 - protein, 17 aa, Cryptosporidium parvum
KVDLLLGSNERWDPNIP

SEQ ID NO: 2297367 - protein, 19 aa, Cryptosporidium parvum
KVDLNRISSQLAISEELQN

SEQ ID NO: 2297368 - protein, 22 aa, Cryptosporidium parvum
KVDSSLLAFGIRSDKPRNLNYD

SEQ ID NO: 2297369 - protein, 20 aa, Cryptosporidium parvum
KVDSWSVGILIYELYMGNVP

SEQ ID NO: 2297370 - protein, 35 aa, Cryptosporidium parvum
KVDVWSMGCIFLEILCKRTPLQHILDKVDESGKHS

SEQ ID NO: 2297371 - protein, 25 aa, Cryptosporidium parvum
KVEDLYKILLCFIYTDFLIWDPFSD

SEQ ID NO: 2297372 - protein, 23 aa, Cryptosporidium parvum
KVEKICKFFWQDLSNLILNNCLS

SEQ ID NO: 2297373 - protein, 25 aa, Cryptosporidium parvum
KVEQNNCYWLVGFKEERWKKLIPVQ

SEQ ID NO: 2297374 - protein, 22 aa, Cryptosporidium parvum
KVEQNRMALLMNRNIGMNGNIN

SEQ ID NO: 2297375 - protein, 19 aa, Cryptosporidium parvum
KVETDFYYGFPLIENHPDN

SEQ ID NO: 2297376 - protein, 21 aa, Cryptosporidium parvum
KVFDWARKSNKGMLLFIDEAE

SEQ ID NO: 2297377 - protein, 23 aa, Cryptosporidium parvum
KVFIDKEVVDWSQYTTMDSTQED

SEQ ID NO: 2297378 - protein, 23 aa, Cryptosporidium parvum
KVFKLVLTCNYFKVETFIDNRLI

SEQ ID NO: 2297379 - protein, 21 aa, Cryptosporidium parvum
KVFMESILDYRSRIISLDKPG

SEQ ID NO: 2297380 - protein, 19 aa, Cryptosporidium parvum
KVFNFRKSISTLKFLCDRN

SEQ ID NO: 2297381 - protein, 28 aa, Cryptosporidium parvum
KVFNPDIHFKPTLGYAVVPVELNLNQET

SEQ ID NO: 2297382 - protein, 17 aa, Cryptosporidium parvum
KVGFSKNNFSLWKKQED

SEQ ID NO: 2297383 - protein, 18 aa, Cryptosporidium parvum
KVGKMTWDGKIVKACTDK

SEQ ID NO: 2297384 - protein, 27 aa, Cryptosporidium parvum
KVGQSYHVLPFSESVKCKAISIHDHTY

SEQ ID NO: 2297385 - protein, 29 aa, Cryptosporidium parvum
KVGSELILYKRSWDWLARTRLDEACKKKI

SEQ ID NO: 2297386 - protein, 26 aa, Cryptosporidium parvum
KVHCNALPKLVCKTVKIEENNPEQTK

SEQ ID NO: 2297387 - protein, 21 aa, Cryptosporidium parvum
KVHHFIHSFPYLPTTNNEIWR

SEQ ID NO: 2297388 - protein, 25 aa, Cryptosporidium parvum
KVHNWKVKWGPRIIVYKDKSISELN

SEQ ID NO: 2297389 - protein, 17 aa, Cryptosporidium parvum
KVIKRLPPDIILKQNIE

SEQ ID NO: 2297390 - protein, 19 aa, Cryptosporidium parvum
KVINKLPYRTLDLLVNNKN

SEQ ID NO: 2297391 - protein, 21 aa, Cryptosporidium parvum
KVIRKEACWTVSNITAGNKEQ

SEQ ID NO: 2297392 - protein, 20 aa, Cryptosporidium parvum
KVKIDKRFGRMFTDDDFSVI

SEQ ID NO: 2297393 - protein, 24 aa, Cryptosporidium parvum
KVKLWDISSGYNFATFSDHIAPVS

SEQ ID NO: 2297394 - protein, 29 aa, Cryptosporidium parvum
KVKQRSALFKALILYSLKNKEYMNGESAK

SEQ ID NO: 2297395 - protein, 24 aa, Cryptosporidium parvum
KVLCGIYGPNLCKQNPIEDGLSVS

SEQ ID NO: 2297396 - protein, 18 aa, Cryptosporidium parvum
KVLECKRKLLKSEFWGTI

SEQ ID NO: 2297397 - protein, 19 aa, Cryptosporidium parvum
KVLESINLKLMKSVHLTKD

SEQ ID NO: 2297398 - protein, 19 aa, Cryptosporidium parvum
KVLKFNSEKRRVWVGIKPS

SEQ ID NO: 2297399 - protein, 49 aa, Cryptosporidium parvum; identical to SEQ ID NO: 2175627

SEQ ID NO: 2297400 - protein, 17 aa, Cryptosporidium parvum
KVLLDRFLHSFNLMELQ

SEQ ID NO: 2297401 - protein, 17 aa, Cryptosporidium parvum
KVLPSIINVLLCYCGNS

SEQ ID NO: 2297402 - protein, 28 aa, Cryptosporidium parvum
KVLQHAFKERLKIILVLNKMDRLILELG

SEQ ID NO: 2297403 - protein, 24 aa, Cryptosporidium parvum
KVLRKVPVSGVYELSGSRIPSISS

SEQ ID NO: 2297404 - protein, 18 aa, Cryptosporidium parvum
KVMHLCRQKELNISQLYI

SEQ ID NO: 2297405 - protein, 17 aa, Cryptosporidium parvum
KVMLSAWISGNEPVSSC

SEQ ID NO: 2297406 - protein, 25 aa, Cryptosporidium parvum
KVNHLIKKCLIHLFSDFSVKPNIIL

SEQ ID NO: 2297407 - protein, 26 aa, Cryptosporidium parvum
KVNILPEILYNLGIWVIGEYGSCVEN

SEQ ID NO: 2297408 - protein, 24 aa, Cryptosporidium parvum
KVNKKFPFNWIECISNPEDLLEKK

SEQ ID NO: 2297409 - protein, 21 aa, Cryptosporidium parvum
KVNNILCEFCGYLNENCIGAR

SEQ ID NO: 2297410 - protein, 18 aa, Cryptosporidium parvum
KVPFPILILHGTNDQVIH

SEQ ID NO: 2297411 - protein, 25 aa, Cryptosporidium parvum
KVPISVEVCIRSDINLIQNESDSNE

SEQ ID NO: 2297412 - protein, 27 aa, Cryptosporidium parvum
KVPKLDKEFNCPFCNNVKTVGVRMNHK

SEQ ID NO: 2297413 - protein, 18 aa, Cryptosporidium parvum
KVQDFTCVSLQMSPYCDD

SEQ ID NO: 2297414 - protein, 22 aa, Cryptosporidium parvum
KVQRLRCIKKIKELKISRAKIR

SEQ ID NO: 2297415 - protein, 18 aa, Cryptosporidium parvum
KVRCPVTIAGDIHGQFFD

SEQ ID NO: 2297416 - protein, 24 aa, Cryptosporidium parvum
KVREELEKALGLPLDSLKPKKNQI

SEQ ID NO: 2297417 - protein, 18 aa, Cryptosporidium parvum
KVSAFKVNNSILIVIVMT

SEQ ID NO: 2297418 - protein, 18 aa, Cryptosporidium parvum
KVSALYCYAIALDWNPVL

SEQ ID NO: 2297419 - protein, 18 aa, Cryptosporidium parvum
KVSEGFSGRNLRKLPFVS

SEQ ID NO: 2297420 - protein, 37 aa, Cryptosporidium parvum; identical to SEQ ID NO: 2175645

SEQ ID NO: 2297421 - protein, 22 aa, Cryptosporidium parvum
KVSIDYWTRFEALWFVELSSVT

SEQ ID NO: 2297422 - protein, 24 aa, Cryptosporidium parvum
KVSLNFCAKYSYYILLKQSIVNQY

SEQ ID NO: 2297423 - protein, 19 aa, Cryptosporidium parvum
KVSVIDLYLAYKIDESYTP

SEQ ID NO: 2297424 - protein, 20 aa, Cryptosporidium parvum
KVVDECRKSLNLIVVNPGMV

SEQ ID NO: 2297425 - protein, 20 aa, Cryptosporidium parvum
KVVGIGKIFCCHARTRFIDS

SEQ ID NO: 2297426 - protein, 22 aa, Cryptosporidium parvum
KVVIPKLNFAFKGGDKSLEDHS

SEQ ID NO: 2297427 - protein, 25 aa, Cryptosporidium parvum
KVVKKLCKKYDLFLASQVLLPQIPR

SEQ ID NO: 2297428 - protein, 17 aa, Cryptosporidium parvum
KVVRLITDIARLEFEYG

SEQ ID NO: 2297429 - protein, 19 aa, Cryptosporidium parvum
KVVRVTLNLLKNVMNNDAA

SEQ ID NO: 2297430 - protein, 17 aa, Cryptosporidium parvum
KVWILKRGMEKFGDLLF

SEQ ID NO: 2297431 - protein, 29 aa, Cryptosporidium parvum
KVWNYKERKCLFTLLGHLDYIRTVEFHKE

SEQ ID NO: 2297432 - protein, 21 aa, Cryptosporidium parvum
KVYFDGDCVNMEMEIKEIGIE

SEQ ID NO: 2297433 - protein, 17 aa, Cryptosporidium parvum
KVYGHSYIVNPFDDDNF

SEQ ID NO: 2297434 - protein, 29 aa, Cryptosporidium parvum
KVYHGLIKYCFRFGILTLYNSLENKGEPH

SEQ ID NO: 2297435 - protein, 23 aa, Cryptosporidium parvum
KVYLEIWTKPDISCMYNIGSTSA

SEQ ID NO: 2297436 - protein, 32 aa, Cryptosporidium parvum
KWAKEDKVPLTFSLRGKKMFLRAKGIQRSLAR

SEQ ID NO: 2297437 - protein, 19 aa, Cryptosporidium parvum
KWERSYISACRDLRIVKAV

SEQ ID NO: 2297438 - protein, 23 aa, Cryptosporidium parvum
KWESFTRRWWAKSRSFVQDIKLI

SEQ ID NO: 2297439 - protein, 21 aa, Cryptosporidium parvum
KWFMKLHEKPFWEVFPLSQIV

SEQ ID NO: 2297440 - protein, 17 aa, Cryptosporidium parvum
KWGHPERPLSDLGRAIY

SEQ ID NO: 2297441 - protein, 19 aa, Cryptosporidium parvum
KWGVSEGMHIRSFNLKIFL

SEQ ID NO: 2297442 - protein, 20 aa, Cryptosporidium parvum
KWIDQLKMIEDVVSHCFGIF

SEQ ID NO: 2297443 - protein, 18 aa, Cryptosporidium parvum
KWILNLIKPLGYNRDIQG

SEQ ID NO: 2297444 - protein, 19 aa, Cryptosporidium parvum
KWINKIKGVMIGREVMNNP

SEQ ID NO: 2297445 - protein, 22 aa, Cryptosporidium parvum
KWIPFYKCLTKSFWQNVAKLDP

SEQ ID NO: 2297446 - protein, 20 aa, Cryptosporidium parvum
KWKCSNCGEFSNEINTCCNE

SEQ ID NO: 2297447 - protein, 18 aa, Cryptosporidium parvum
KWKIPRPECIIINHSELS

SEQ ID NO: 2297448 - protein, 19 aa, Cryptosporidium parvum
KWKKIIYKYCILNEIHSCT

SEQ ID NO: 2297449 - protein, 18 aa, Cryptosporidium parvum
KWLIGSSTGKIRLCQFEQ

SEQ ID NO: 2297450 - protein, 23 aa, Cryptosporidium parvum
KWLSCPYDQCTWESYETLEEHKF

SEQ ID NO: 2297451 - protein, 17 aa, Cryptosporidium parvum
KWMDAIILWTLKSRKYR

SEQ ID NO: 2297452 - protein, 19 aa, Cryptosporidium parvum
KWNHSRFHWADLTSVHPLL

SEQ ID NO: 2297453 - protein, 18 aa, Cryptosporidium parvum
KWSNYSMHNQYYIPSNNS

SEQ ID NO: 2297454 - protein, 18 aa, Cryptosporidium parvum
KWVNLDFEIDFNLRPALD

SEQ ID NO: 2297455 - protein, 17 aa, Cryptosporidium parvum
KWYKKKKTLICSRKVVF

SEQ ID NO: 2297456 - protein, 21 aa, Cryptosporidium parvum
KWYLESFHSVHLIPQKEFFSL

SEQ ID NO: 2297457 - protein, 26 aa, Cryptosporidium parvum
KYADIPERLYLLYGSRWKSLKERKIS

SEQ ID NO: 2297458 - protein, 18 aa, Cryptosporidium parvum
KYAFDLPQWRTISDDAKD

SEQ ID NO: 2297459 - protein, 19 aa, Cryptosporidium parvum
KYAKSRSKSIGILLEMSDS

SEQ ID NO: 2297460 - protein, 19 aa, Cryptosporidium parvum
KYDALKYTIVIAATASNAA

SEQ ID NO: 2297461 - protein, 23 aa, Cryptosporidium parvum
KYDKQCDMWSLGVILYILLCGYP

SEQ ID NO: 2297462 - protein, 20 aa, Cryptosporidium parvum
KYDLICLHIPNSDKNKAIVS

SEQ ID NO: 2297463 - protein, 18 aa, Cryptosporidium parvum
KYDNIVRFSIPMPTNHKK

SEQ ID NO: 2297464 - protein, 17 aa, Cryptosporidium parvum
KYDWKSSEVELLNEHQF

SEQ ID NO: 2297465 - protein, 19 aa, Cryptosporidium parvum
KYDYYRGIVDVTLTSDINK

SEQ ID NO: 2297466 - protein, 17 aa, Cryptosporidium parvum
KYFHAVKLFLSENNIKS

SEQ ID NO: 2297467 - protein, 20 aa, Cryptosporidium parvum
KYFLGFGENSNFLGYHMIDD

SEQ ID NO: 2297468 - protein, 18 aa, Cryptosporidium parvum
KYGFITFNNLGDMMKVLQ

SEQ ID NO: 2297469 - protein, 19 aa, Cryptosporidium parvum
KYGQEIAVAEAFPRTINNS

SEQ ID NO: 2297470 - protein, 18 aa, Cryptosporidium parvum
KYGSFRYNILISTPGDIL

SEQ ID NO: 2297471 - protein, 34 aa, Cryptosporidium parvum
KYGVRFGVSGMQGWRVSMEDAHIALPRLDKHPEL

SEQ ID NO: 2297472 - protein, 20 aa, Cryptosporidium parvum
KYHKITFKPMINSMMTFLSN

SEQ ID NO: 2297473 - protein, 20 aa, Cryptosporidium parvum
KYHRIIKSGIKFAEYSLELS

SEQ ID NO: 2297474 - protein, 25 aa, Cryptosporidium parvum
KYIELKIKIPKSINNFIIPIVNEYN

SEQ ID NO: 2297475 - protein, 20 aa, Cryptosporidium parvum
KYIERCSPIKPISLNCIISK

SEQ ID NO: 2297476 - protein, 18 aa, Cryptosporidium parvum
KYIIYALIFHKGKTTNSG

SEQ ID NO: 2297477 - protein, 18 aa, Cryptosporidium parvum
KYILNIFEILLLYHKNPE

SEQ ID NO: 2297478 - protein, 20 aa, Cryptosporidium parvum
KYKAQYGCFNNFETMESSLD

SEQ ID NO: 2297479 - protein, 19 aa, Cryptosporidium parvum
KYKNGLPINSVRNLMYTLL

SEQ ID NO: 2297480 - protein, 24 aa, Cryptosporidium parvum
KYKSGKLPKAFSIIPKLENWEEVV

SEQ ID NO: 2297481 - protein, 18 aa, Cryptosporidium parvum
KYLALRYSRNNVKKLKTL

SEQ ID NO: 2297482 - protein, 30 aa, Cryptosporidium parvum; identical to SEQ ID NO: 2175695

SEQ ID NO: 2297483 - protein, 24 aa, Cryptosporidium parvum
KYLECSGALEMLYRSFLSLYISIE

SEQ ID NO: 2297484 - protein, 20 aa, Cryptosporidium parvum
KYLEQIRDLYSYDFHVAYIP

SEQ ID NO: 2297485 - protein, 25 aa, Cryptosporidium parvum
KYLEYRFNHIIGHGISIGDNNYSSN

SEQ ID NO: 2297486 - protein, 32 aa, Cryptosporidium parvum
KYLIKRFIQNNVRFFFTRNIHCHAKYITIDGI

SEQ ID NO: 2297487 - protein, 19 aa, Cryptosporidium parvum
KYLIQRIKKYFSLQANVEL

SEQ ID NO: 2297488 - protein, 24 aa, Cryptosporidium parvum
KYLKQDRFRICRSLPSSMNNQQLQ

SEQ ID NO: 2297489 - protein, 19 aa, Cryptosporidium parvum
KYLPEDRILSCGSKENFWE

SEQ ID NO: 2297490 - protein, 29 aa, Cryptosporidium parvum
KYLRESLHWEWPAGLLPASRGVRSRKYRN

SEQ ID NO: 2297491 - protein, 24 aa, Cryptosporidium parvum
KYLRIPIPMLIEQHRQLLLPYPEG

SEQ ID NO: 2297492 - protein, 18 aa, Cryptosporidium parvum
KYLSRYKSFYGRLHSPSN

SEQ ID NO: 2297493 - protein, 20 aa, Cryptosporidium parvum
KYLTDGMLIRECVTTNGERS

SEQ ID NO: 2297494 - protein, 18 aa, Cryptosporidium parvum
KYMEPVYLRWRKWNKKYK

SEQ ID NO: 2297495 - protein, 24 aa, Cryptosporidium parvum
KYNEIRMIESWVIKLLQRHPSHYG

SEQ ID NO: 2297496 - protein, 26 aa, Cryptosporidium parvum
KYNHVKICPWLAISNFVDEFVLRTPI

SEQ ID NO: 2297497 - protein, 18 aa, Cryptosporidium parvum
KYNLWIVGNSRYLLGNPE

SEQ ID NO: 2297498 - protein, 18 aa, Cryptosporidium parvum
KYNRERYIKPGNNRYDII

SEQ ID NO: 2297499 - protein, 22 aa, Cryptosporidium parvum
KYNYAVGSFFSFVYSHYDNMVN

SEQ ID NO: 2297500 - protein, 26 aa, Cryptosporidium parvum
KYNYSVKPKHFWKLIEPTVVSPAHGL

SEQ ID NO: 2297501 - protein, 22 aa, Cryptosporidium parvum
KYPSYPRNGLSSALNNSKGTQF

SEQ ID NO: 2297502 - protein, 29 aa, Cryptosporidium parvum
KYQIVLSWIYKFLNDFGRLPVNKELPEMH

SEQ ID NO: 2297503 - protein, 18 aa, Cryptosporidium parvum
KYSETYLHRIGRSGRFGH

SEQ ID NO: 2297504 - protein, 43 aa, Cryptosporidium parvum
KYSFLRLNYESEYLFRLLWHFSHCCIYHGNLLNSSTLNRDFES

SEQ ID NO: 2297505 - protein, 34 aa, Cryptosporidium parvum
KYSHLRDLIEIVRICILHGILIGINYLNKSEDNY

SEQ ID NO: 2297506 - protein, 23 aa, Cryptosporidium parvum
KYSLLKEKYLFLVQKNEYLLSRL

SEQ ID NO: 2297507 - protein, 23 aa, Cryptosporidium parvum
KYSLNILRHVFRALRRIVSDDFV

SEQ ID NO: 2297508 - protein, 23 aa, Cryptosporidium parvum
KYSNIRLKLLINELELCNRLFEV

SEQ ID NO: 2297509 - protein, 27 aa, Cryptosporidium parvum
KYSSQRSLINWKFSDGCIVSITDFSCG

SEQ ID NO: 2297510 - protein, 18 aa, Cryptosporidium parvum
KYTFTIMENLGKMSNPNQ

SEQ ID NO: 2297511 - protein, 19 aa, Cryptosporidium parvum
KYTREFSEKILTKEKDDFL

SEQ ID NO: 2297512 - protein, 37 aa, Cryptosporidium parvum; identical to SEQ ID NO: 2175721

SEQ ID NO: 2297513 - protein, 23 aa, Cryptosporidium parvum
KYVKTPYPHVYKPDSYLKNEISI

SEQ ID NO: 2297514 - protein, 30 aa, Cryptosporidium parvum; identical to SEQ ID NO: 2175723

SEQ ID NO: 2297515 - protein, 21 aa, Cryptosporidium parvum
KYVVECFRLPIKKESGHISSD

SEQ ID NO: 2297516 - protein, 18 aa, Cryptosporidium parvum
KYYEASIEYKNSLFILET

SEQ ID NO: 2297517 - protein, 17 aa, Cryptosporidium parvum
KYYRGMGSVGAMKSGSG

SEQ ID NO: 2297518 - protein, 30 aa, Cryptosporidium parvum
KYYSICKLIFPIEILQLFKGFVYVIKLKPK

SEQ ID NO: 2297519 - protein, 20 aa, Cryptosporidium parvum
LAACINLDWNVDEWVPAVAI

SEQ ID NO: 2297520 - protein, 28 aa, Cryptosporidium parvum
LAAFDFEKELDLLYGILSTCFEFVSEGE

SEQ ID NO: 2297521 - protein, 24 aa, Cryptosporidium parvum
LAATSPAYFPAWLAEEHDIGTNVG

SEQ ID NO: 2297522 - protein, 21 aa, Cryptosporidium parvum
LACADGSIKMFSLLNNELSFS

SEQ ID NO: 2297523 - protein, 18 aa, Cryptosporidium parvum
LACKEVFNRLGTPEKIIP

SEQ ID NO: 2297524 - protein, 19 aa, Cryptosporidium parvum
LACLKSRKVIPPTLILIDH

SEQ ID NO: 2297525 - protein, 19 aa, Cryptosporidium parvum
LADEGICLIDEFDKMSDKD

SEQ ID NO: 2297526 - protein, 25 aa, Cryptosporidium parvum
LADEPRVCTNICWIIHQIAESSQYV

SEQ ID NO: 2297527 - protein, 17 aa, Cryptosporidium parvum
LADEVLLKMKKMLEFLR

SEQ ID NO: 2297528 - protein, 18 aa, Cryptosporidium parvum
LADICKGGVTSIKENLEK

SEQ ID NO: 2297529 - protein, 21 aa, Cryptosporidium parvum
LADKVCRRLGLSIREPGKLLA

SEQ ID NO: 2297530 - protein, 18 aa, Cryptosporidium parvum
LADLLKRRKVTLQQCEYF

SEQ ID NO: 2297531 - protein, 18 aa, Cryptosporidium parvum
LAEDCLRVSSISPASIRG

SEQ ID NO: 2297532 - protein, 17 aa, Cryptosporidium parvum
LAELCQRAAKAAIRDAI

SEQ ID NO: 2297533 - protein, 19 aa, Cryptosporidium parvum
LAENIPPNYSELVKETMKV

SEQ ID NO: 2297534 - protein, 24 aa, Cryptosporidium parvum
LAENWPWMLGKSIIVPFMNMKYET

SEQ ID NO: 2297535 - protein, 23 aa, Cryptosporidium parvum
LAEWERNEVKNIMPYLIDNTINR

SEQ ID NO: 2297536 - protein, 17 aa, Cryptosporidium parvum
LAEWLIFPFEDEQSLSL

SEQ ID NO: 2297537 - protein, 32 aa, Cryptosporidium parvum
LAFEVARKFIQTRFGCKFSMRLYDDLNVIQDK

SEQ ID NO: 2297538 - protein, 23 aa, Cryptosporidium parvum
LAFLQSHFNYWKSRDLGFFILWK

SEQ ID NO: 2297539 - protein, 19 aa, Cryptosporidium parvum
LAGKIGRFLISQRWNIQSE

SEQ ID NO: 2297540 - protein, 19 aa, Cryptosporidium parvum
LAGTCISLGGLGYDQVQKS

SEQ ID NO: 2297541 - protein, 49 aa, Cryptosporidium parvum
LAILYRKRKLHVLGIIRLIGELFIRKMFPMRSLNELVFDLVMIQENPDE

SEQ ID NO: 2297542 - protein, 18 aa, Cryptosporidium parvum
LAISEFEYIYNFKIEKEM

SEQ ID NO: 2297543 - protein, 26 aa, Cryptosporidium parvum
LAKEYWRFLVGYNYELLISLLHSAPS

SEQ ID NO: 2297544 - protein, 25 aa, Cryptosporidium parvum
LAKLLERKGPIVIDVWRKNKSSMAQ

SEQ ID NO: 2297545 - protein, 17 aa, Cryptosporidium parvum
LALELLKLLSNKYREEF

SEQ ID NO: 2297546 - protein, 19 aa, Cryptosporidium parvum
LALQVGRTVVNLRLSEEPC

SEQ ID NO: 2297547 - protein, 23 aa, Cryptosporidium parvum
LALTRIAQYSALGIRHNDIKPDN

SEQ ID NO: 2297548 - protein, 25 aa, Cryptosporidium parvum
LALYEFYKDLKFVGVSSFLGTGMKS

SEQ ID NO: 2297549 - protein, 24 aa, Cryptosporidium parvum
LANNVILGLRYTRVAKDFRQKNPC

SEQ ID NO: 2297550 - protein, 23 aa, Cryptosporidium parvum
LANQPCWLYFDIEYNKSQYNLDD

SEQ ID NO: 2297551 - protein, 23 aa, Cryptosporidium parvum
LANSLSSEAWRFRASVENYSDDT

SEQ ID NO: 2297552 - protein, 17 aa, Cryptosporidium parvum
LAPFCPIIDDENAFFSK

SEQ ID NO: 2297553 - protein, 18 aa, Cryptosporidium parvum
LAPIEFDAFIKIFRAKYK

SEQ ID NO: 2297554 - protein, 25 aa, Cryptosporidium parvum
LAPKCYDLRFSRPSKVQIIKRMQEI

SEQ ID NO: 2297555 - protein, 18 aa, Cryptosporidium parvum
LAPNYKILVSYFKQFPCS

SEQ ID NO: 2297556 - protein, 20 aa, Cryptosporidium parvum
LAPQEFMIFPVGAPNFKEAL

SEQ ID NO: 2297557 - protein, 19 aa, Cryptosporidium parvum
LAQCANIVAACKLMSQSEF

SEQ ID NO: 2297558 - protein, 28 aa, Cryptosporidium parvum
LAQFFPKYCALIIQCPELFEIVCNSECA

SEQ ID NO: 2297559 - protein, 25 aa, Cryptosporidium parvum
LARAIFKSGCEKVDAGLNPMDLLRG

SEQ ID NO: 2297560 - protein, 17 aa, Cryptosporidium parvum
LARDALCSLILGTPPGK

SEQ ID NO: 2297561 - protein, 18 aa, Cryptosporidium parvum
LARSFGWGIQVSHRSGET

SEQ ID NO: 2297562 - protein, 23 aa, Cryptosporidium parvum
LASASWDGTVRIWDLYARVGKGA

SEQ ID NO: 2297563 - protein, 22 aa, Cryptosporidium parvum
LASCIWVCYENFLSIKNLKSVS

SEQ ID NO: 2297564 - protein, 23 aa, Cryptosporidium parvum
LASEAAECFRFVLEDLGDSNNDS

SEQ ID NO: 2297565 - protein, 28 aa, Cryptosporidium parvum
LASENEFWHFLSLGAIFLKYSKKNSIAV

SEQ ID NO: 2297566 - protein, 18 aa, Cryptosporidium parvum
LASICIELGFECRELNGS

SEQ ID NO: 2297567 - protein, 17 aa, Cryptosporidium parvum
LASQLLQQFDWIFKINK

SEQ ID NO: 2297568 - protein, 18 aa, Cryptosporidium parvum
LATAGADEFIHIWEITRE

SEQ ID NO: 2297569 - protein, 18 aa, Cryptosporidium parvum
LATCRLMAMNLAYRDTVF

SEQ ID NO: 2297570 - protein, 25 aa, Cryptosporidium parvum
LATQPCIRTPTVDDWYVFDKQLSEI

SEQ ID NO: 2297571 - protein, 19 aa, Cryptosporidium parvum
LAVACFDIGEFARLYPMGK

SEQ ID NO: 2297572 - protein, 24 aa, Cryptosporidium parvum
LAVEGYGLLKLMGINGIIGTTTVS

SEQ ID NO: 2297573 - protein, 18 aa, Cryptosporidium parvum
LAYHLRYATKVIIGSCAI

SEQ ID NO: 2297574 - protein, 23 aa, Cryptosporidium parvum
LAYNGSHFKVNWNNYLQIFSELT

SEQ ID NO: 2297575 - protein, 23 aa, Cryptosporidium parvum
LCDAKFWGFNSFIFLVSNHTIIA

SEQ ID NO: 2297576 - protein, 18 aa, Cryptosporidium parvum
LCDSKYSIGKKIFPENSD

SEQ ID NO: 2297577 - protein, 26 aa, Cryptosporidium parvum
LCEEIIEIIQTIFIFKSRYQVRKYDS

SEQ ID NO: 2297578 - protein, 21 aa, Cryptosporidium parvum
LCEKGWRVGQIKRVIINDIGG

SEQ ID NO: 2297579 - protein, 18 aa, Cryptosporidium parvum
LCELLDYEQAVFPHLNYS

SEQ ID NO: 2297580 - protein, 20 aa, Cryptosporidium parvum
LCENIKLIILDEADMMTSTA

SEQ ID NO: 2297581 - protein, 32 aa, Cryptosporidium parvum
LCESEIFEILRICAGILHLCNFDFIQESASDA

SEQ ID NO: 2297582 - protein, 19 aa, Cryptosporidium parvum
LCFQLKQVVSASWVKYASR

SEQ ID NO: 2297583 - protein, 19 aa, Cryptosporidium parvum
LCGEFDFDITHWNVEPYPN

SEQ ID NO: 2297584 - protein, 25 aa, Cryptosporidium parvum
LCGNGKVVRIEVWFGTPRHQSAINT

SEQ ID NO: 2297585 - protein, 18 aa, Cryptosporidium parvum
LCGYPPFSAPTDSEVMLK

SEQ ID NO: 2297586 - protein, 17 aa, Cryptosporidium parvum
LCHCIPFNRFCYNLCNS

SEQ ID NO: 2297587 - protein, 17 aa, Cryptosporidium parvum
LCHELKYPYKIKRSISI

SEQ ID NO: 2297588 - protein, 25 aa, Cryptosporidium parvum
LCHNSGEFIKFWSYENLYCKHSVVE

SEQ ID NO: 2297589 - protein, 19 aa, Cryptosporidium parvum
LCIISEWPSSELISNSKKV

SEQ ID NO: 2297590 - protein, 18 aa, Cryptosporidium parvum
LCKEKKEELLIGGLSVCK

SEQ ID NO: 2297591 - protein, 18 aa, Cryptosporidium parvum
LCKEVNLRNDVDFREISR

SEQ ID NO: 2297592 - protein, 28 aa, Cryptosporidium parvum
LCKKAPWKSRYLFEIFRNRQLIIALTTM

SEQ ID NO: 2297593 - protein, 20 aa, Cryptosporidium parvum
LCKLKFYNNCEFYKIEKDFI

SEQ ID NO: 2297594 - protein, 18 aa, Cryptosporidium parvum
LCKSGCLSDILILNLDGK

SEQ ID NO: 2297595 - protein, 17 aa, Cryptosporidium parvum
LCLDLLFESSFFLCKIN

SEQ ID NO: 2297596 - protein, 17 aa, Cryptosporidium parvum
LCLGLTFDGDRIICGFL

SEQ ID NO: 2297597 - protein, 17 aa, Cryptosporidium parvum
LCLNLLETAPFWFSKLL

SEQ ID NO: 2297598 - protein, 18 aa, Cryptosporidium parvum
LCNHYFCEKCAFSHYTNT

SEQ ID NO: 2297599 - protein, 22 aa, Cryptosporidium parvum
LCNICGIIPDHINKLLFQDTKY

SEQ ID NO: 2297600 - protein, 20 aa, Cryptosporidium parvum
LCNLAASCLNKWYEKYSSVN

SEQ ID NO: 2297601 - protein, 20 aa, Cryptosporidium parvum
LCNLPADSIGAIDQENQQLA

SEQ ID NO: 2297602 - protein, 20 aa, Cryptosporidium parvum
LCNLVKISIITGTFNNIESY

SEQ ID NO: 2297603 - protein, 18 aa, Cryptosporidium parvum
LCQFISENILLKRANNQF

SEQ ID NO: 2297604 - protein, 17 aa, Cryptosporidium parvum
LCQHLSVQPTDKFAQFI

SEQ ID NO: 2297605 - protein, 24 aa, Cryptosporidium parvum
LCQIQFRATLLWIHRISVEDCKRE

SEQ ID NO: 2297606 - protein, 18 aa, Cryptosporidium parvum
LCQYLTRRVKGVNIGLFL

SEQ ID NO: 2297607 - protein, 25 aa, Cryptosporidium parvum
LCREFIKGIDRVICMIKEIYNEKNE

SEQ ID NO: 2297608 - protein, 17 aa, Cryptosporidium parvum
LCSDFPNRIKVITQNID

SEQ ID NO: 2297609 - protein, 22 aa, Cryptosporidium parvum
LCSKGKITFNRQVLFITPHSEI

SEQ ID NO: 2297610 - protein, 29 aa, Cryptosporidium parvum
LCSKPDTSSMVKFRFETYPIKNNSITGVK

SEQ ID NO: 2297611 - protein, 19 aa, Cryptosporidium parvum
LCSLTELGHEKQNFFFYDD

SEQ ID NO: 2297612 - protein, 34 aa, Cryptosporidium parvum; identical to SEQ ID NO: 2175798

SEQ ID NO: 2297613 - protein, 18 aa, Cryptosporidium parvum
LCTCGKHICPAPLHDSIS

SEQ ID NO: 2297614 - protein, 20 aa, Cryptosporidium parvum
LCTKLYLSFVNDFKEIGIRH

SEQ ID NO: 2297615 - protein, 20 aa, Cryptosporidium parvum
LCTPLHFSASNGFDEIVNKL

SEQ ID NO: 2297616 - protein, 22 aa, Cryptosporidium parvum
LCVDCMNCSISQFSMALNKEIS

SEQ ID NO: 2297617 - protein, 18 aa, Cryptosporidium parvum
LCVEGLSERAFLRVMEKY

SEQ ID NO: 2297618 - protein, 23 aa, Cryptosporidium parvum
LCVKSLNKRNSFKMSNSKLTKNP

SEQ ID NO: 2297619 - protein, 20 aa, Cryptosporidium parvum
LCYDIKWNYFGNILATTNKD

SEQ ID NO: 2297620 - protein, 20 aa, Cryptosporidium parvum
LCYTGSFFHRIIPQFMIQGG

SEQ ID NO: 2297621 - protein, 23 aa, Cryptosporidium parvum
LDADSFIPIFYQFVTIYMQETSA

SEQ ID NO: 2297622 - protein, 25 aa, Cryptosporidium parvum
LDAFKRELIELFKIEVEILNGIQES

SEQ ID NO: 2297623 - protein, 20 aa, Cryptosporidium parvum
LDAPCTGLGIIARDPSVKVK

SEQ ID NO: 2297624 - protein, 19 aa, Cryptosporidium parvum
LDAPIKICGDIHGQYYDLL

SEQ ID NO: 2297625 - protein, 19 aa, Cryptosporidium parvum
LDAPYSPERLECLVDCAIV

SEQ ID NO: 2297626 - protein, 23 aa, Cryptosporidium parvum
LDCFSHLELWFNKDLVGKSLVSQ

SEQ ID NO: 2297627 - protein, 28 aa, Cryptosporidium parvum
LDCGYQCCFSVPFFQGSPIYKACRRLDI

SEQ ID NO: 2297628 - protein, 18 aa, Cryptosporidium parvum
LDCIKKNKTGTILIPMQL

SEQ ID NO: 2297629 - protein, 19 aa, Cryptosporidium parvum
LDDEITCISTGGTCEGIFF

SEQ ID NO: 2297630 - protein, 24 aa, Cryptosporidium parvum
LDDIGALCACIRVFQDSLSPISQH

SEQ ID NO: 2297631 - protein, 24 aa, Cryptosporidium parvum
LDDIPDPWSPVPNSIFLYRDANGN

SEQ ID NO: 2297632 - protein, 22 aa, Cryptosporidium parvum
LDDITVVVAWVVSERDQIILNS

SEQ ID NO: 2297633 - protein, 18 aa, Cryptosporidium parvum
LDDLDIVFISKFSACDLT

SEQ ID NO: 2297634 - protein, 20 aa, Cryptosporidium parvum
LDDSIKHLQENIIEFEKKSR

SEQ ID NO: 2297635 - protein, 22 aa, Cryptosporidium parvum
LDEALLRPGRLDQLIYIPLPDL

SEQ ID NO: 2297636 - protein, 23 aa, Cryptosporidium parvum
LDECDKCLESLDMRKDVQEIFMS

SEQ ID NO: 2297637 - protein, 26 aa, Cryptosporidium parvum
LDEIIAKVTSCFFCQQGQNSQIEDNQ

SEQ ID NO: 2297638 - protein, 21 aa, Cryptosporidium parvum
LDEIYEGCEIPVLVSTFKDTF

SEQ ID NO: 2297639 - protein, 23 aa, Cryptosporidium parvum
LDEKNMPGFFFGQGNSDGTSTKS

SEQ ID NO: 2297640 - protein, 20 aa, Cryptosporidium parvum
LDELNTFYGIVNGYIDVEYS

SEQ ID NO: 2297641 - protein, 19 aa, Cryptosporidium parvum
LDEMILFPPVKAVEIRDNI

SEQ ID NO: 2297642 - protein, 18 aa, Cryptosporidium parvum
LDEMLFKYSSEEFEKQLF

SEQ ID NO: 2297643 - protein, 18 aa, Cryptosporidium parvum
LDERIAKYELFKFNHSQR

SEQ ID NO: 2297644 - protein, 21 aa, Cryptosporidium parvum
LDERLLRIEQLEMNYQNVNLE

SEQ ID NO: 2297645 - protein, 20 aa, Cryptosporidium parvum
LDFCLGFGALLPNFINKSIF

SEQ ID NO: 2297646 - protein, 17 aa, Cryptosporidium parvum
LDFFKHIFPSLISQVCK

SEQ ID NO: 2297647 - protein, 22 aa, Cryptosporidium parvum
LDFKFLARPVVSLDMKILCKMH

SEQ ID NO: 2297648 - protein, 25 aa, Cryptosporidium parvum
LDFKVVIPTGEWRKWSLECKETEDL

SEQ ID NO: 2297649 - protein, 18 aa, Cryptosporidium parvum
LDFLWDWNSRIFIDCQSK

SEQ ID NO: 2297650 - protein, 25 aa, Cryptosporidium parvum
LDFYEFGRALAIMISDNFDEKARFS

SEQ ID NO: 2297651 - protein, 19 aa, Cryptosporidium parvum
LDGCKRLIVTSADVALNER

SEQ ID NO: 2297652 - protein, 18 aa, Cryptosporidium parvum
LDGKGLNEGIDWIVNDIA

SEQ ID NO: 2297653 - protein, 24 aa, Cryptosporidium parvum
LDGLKPGQRKVLFATFKKKLNNEL

SEQ ID NO: 2297654 - protein, 19 aa, Cryptosporidium parvum
LDGTLTLPRKPIMEDMVMT

SEQ ID NO: 2297655 - protein, 24 aa, Cryptosporidium parvum
LDHIPCDLDSLSIEFFTIQKSGNF

SEQ ID NO: 2297656 - protein, 25 aa, Cryptosporidium parvum
LDHLKRYQIGKVYRRDEPQMARGRF

SEQ ID NO: 2297657 - protein, 18 aa, Cryptosporidium parvum
LDHPNIIKLFEVFEDTNY

SEQ ID NO: 2297658 - protein, 19 aa, Cryptosporidium parvum
LDHTYRHLFLFLPKSLLEW

SEQ ID NO: 2297659 - protein, 23 aa, Cryptosporidium parvum
LDHWKRTFEDWTDLNVVSYYDEG

SEQ ID NO: 2297660 - protein, 19 aa, Cryptosporidium parvum
LDIFPLPFLNIEVAEQYCA

SEQ ID NO: 2297661 - protein, 24 aa, Cryptosporidium parvum
LDIGCGYGGLLVWLSEHFKDKLAL

SEQ ID NO: 2297662 - protein, 29 aa, Cryptosporidium parvum
LDIHGIKFKIPWKYPKIIHEHVIQQLESI

SEQ ID NO: 2297663 - protein, 26 aa, Cryptosporidium parvum
LDIITDLIGFCFLFLEYSFYNSEMYN

SEQ ID NO: 2297664 - protein, 20 aa, Cryptosporidium parvum
LDIKHEWLNYKINTHSKGDL

SEQ ID NO: 2297665 - protein, 18 aa, Cryptosporidium parvum
LDILKDKWSPALQIRTVL

SEQ ID NO: 2297666 - protein, 18 aa, Cryptosporidium parvum
LDILVKCSEELKTRFLLS

SEQ ID NO: 2297667 - protein, 19 aa, Cryptosporidium parvum
LDINYGYIKPIRYLNDGLP

SEQ ID NO: 2297668 - protein, 17 aa, Cryptosporidium parvum
LDIPLVWRDKSFGHKNN

SEQ ID NO: 2297669 - protein, 17 aa, Cryptosporidium parvum
LDITKMRFFELHDNIEI

SEQ ID NO: 2297670 - protein, 17 aa, Cryptosporidium parvum
LDKADEIISRFLNSDLN

SEQ ID NO: 2297671 - protein, 17 aa, Cryptosporidium parvum
LDKAHIIIEEIIMCGRI

SEQ ID NO: 2297672 - protein, 25 aa, Cryptosporidium parvum
LDKDIVSILSIWPIKSRLPVWKVWR

SEQ ID NO: 2297673 - protein, 26 aa, Cryptosporidium parvum
LDKFDICPIDRLFTLKPVDKFPLTID

SEQ ID NO: 2297674 - protein, 17 aa, Cryptosporidium parvum
LDKFKVPFIRKNIDRSI

SEQ ID NO: 2297675 - protein, 19 aa, Cryptosporidium parvum
LDKIYTFTGPILIAVNPYR

SEQ ID NO: 2297676 - protein, 25 aa, Cryptosporidium parvum
LDKLEPFLAQWLIWIDKNSSSISTL

SEQ ID NO: 2297677 - protein, 18 aa, Cryptosporidium parvum
LDKLLKFSNEEFIESSAL

SEQ ID NO: 2297678 - protein, 18 aa, Cryptosporidium parvum
LDKNLGLHSSKFAFYKGN

SEQ ID NO: 2297679 - protein, 19 aa, Cryptosporidium parvum
LDKSIRIHGKFCGDDLLEI

SEQ ID NO: 2297680 - protein, 29 aa, Cryptosporidium parvum
LDKYFRFTLGNLYAHKLFWGNNIPISCMI

SEQ ID NO: 2297681 - protein, 28 aa, Cryptosporidium parvum
LDLDPKFTKAWSRKGNIHYFLKEYHKAL

SEQ ID NO: 2297682 - protein, 17 aa, Cryptosporidium parvum
LDLEAVFELEGFNEYSE

SEQ ID NO: 2297683 - protein, 19 aa, Cryptosporidium parvum
LDLFLNLANWFGLHSGIPF

SEQ ID NO: 2297684 - protein, 20 aa, Cryptosporidium parvum
LDLGKSCYTIRGGVSSMTER

SEQ ID NO: 2297685 - protein, 17 aa, Cryptosporidium parvum
LDLIKLHALTPRTNNLL

SEQ ID NO: 2297686 - protein, 24 aa, Cryptosporidium parvum
LDLINRYRIAQLIIQQQQQQQQQQ

SEQ ID NO: 2297687 - protein, 22 aa, Cryptosporidium parvum
LDLKEFYTCIGLVSDLLVSILK

SEQ ID NO: 2297688 - protein, 20 aa, Cryptosporidium parvum
LDLKVMRDVENFLGNSGGID

SEQ ID NO: 2297689 - protein, 19 aa, Cryptosporidium parvum
LDLKYLIKISNYDKDYLLN

SEQ ID NO: 2297690 - protein, 28 aa, Cryptosporidium parvum
LDLLFESSFFLCKINHTILNNLLIYEND

SEQ ID NO: 2297691 - protein, 28 aa, Cryptosporidium parvum
LDLLKSDCLKLLKLIALLQIKTTNKVMN

SEQ ID NO: 2297692 - protein, 19 aa, Cryptosporidium parvum
LDLMELFHEFVFLQIQSVS

SEQ ID NO: 2297693 - protein, 21 aa, Cryptosporidium parvum
LDLPCLVLGTVYGMKLNRGYN

SEQ ID NO: 2297694 - protein, 18 aa, Cryptosporidium parvum
LDLPEPVDFSMLSKLVLE

SEQ ID NO: 2297695 - protein, 17 aa, Cryptosporidium parvum
LDLPVICRKVFCGSNSD

SEQ ID NO: 2297696 - protein, 35 aa, Cryptosporidium parvum
LDLQKSKIEWWKKPRGWKVTYFKQGQKLSQIFRVS

SEQ ID NO: 2297697 - protein, 17 aa, Cryptosporidium parvum
LDLRGCKNILNIELEHF

SEQ ID NO: 2297698 - protein, 17 aa, Cryptosporidium parvum
LDLSFSENDTVRDKILK

SEQ ID NO: 2297699 - protein, 25 aa, Cryptosporidium parvum
LDMERIYRLISYFLSCCQNRDCNCN

SEQ ID NO: 2297700 - protein, 18 aa, Cryptosporidium parvum
LDMGFAPQIREIVEDSEM

SEQ ID NO: 2297701 - protein, 29 aa, Cryptosporidium parvum
LDMPEKVDLTLPCEFVGEIYSIIDDGAIF

SEQ ID NO: 2297702 - protein, 18 aa, Cryptosporidium parvum
LDNMTIDTFLRVIGFGHR

SEQ ID NO: 2297703 - protein, 17 aa, Cryptosporidium parvum
LDNPQFCYALLHSQFIL

SEQ ID NO: 2297704 - protein, 26 aa, Cryptosporidium parvum
LDNYCGCTGYAGLVSHMFEYEGTNLL

SEQ ID NO: 2297705 - protein, 17 aa, Cryptosporidium parvum
LDPALLRPGRLDRKVEF

SEQ ID NO: 2297706 - protein, 21 aa, Cryptosporidium parvum
LDPALTRPGRFDRIINIERPN

SEQ ID NO: 2297707 - protein, 23 aa, Cryptosporidium parvum
LDPHLVKHLSVFGINVGQLEKTE

SEQ ID NO: 2297708 - protein, 18 aa, Cryptosporidium parvum
LDPIDFAGCRNVAEYYFM

SEQ ID NO: 2297709 - protein, 24 aa, Cryptosporidium parvum
LDPIRRLKVVNIRENVEILMITGG

SEQ ID NO: 2297710 - protein, 19 aa, Cryptosporidium parvum
LDPKLFRPLYESNNPDKCD

SEQ ID NO: 2297711 - protein, 25 aa, Cryptosporidium parvum
LDPKLYTGMHKYRFDKDGNGLGKAG

SEQ ID NO: 2297712 - protein, 26 aa, Cryptosporidium parvum
LDPMNKCPYRLFRENCTVEGNSYIKD

SEQ ID NO: 2297713 - protein, 20 aa, Cryptosporidium parvum
LDPNELLNVFQWKKLKDPET

SEQ ID NO: 2297714 - protein, 36 aa, Cryptosporidium parvum
LDPRSVPCGSFIWWDRRVWEYNFVYMARRLSTNDEK

SEQ ID NO: 2297715 - protein, 19 aa, Cryptosporidium parvum
LDPYKPIKLTREVKDKDRF

SEQ ID NO: 2297716 - protein, 25 aa, Cryptosporidium parvum
LDQLIKYPLLDSFNPKPGFFQKLIH

SEQ ID NO: 2297717 - protein, 17 aa, Cryptosporidium parvum
LDQLSGLQLKLKAFDNF

SEQ ID NO: 2297718 - protein, 18 aa, Cryptosporidium parvum
LDQRVARTYDMQIITYDQ

SEQ ID NO: 2297719 - protein, 17 aa, Cryptosporidium parvum
LDQTCHLAHRMGLAPSK

SEQ ID NO: 2297720 - protein, 19 aa, Cryptosporidium parvum
LDREYKDVIPFTDIQNRMM

SEQ ID NO: 2297721 - protein, 22 aa, Cryptosporidium parvum
LDRLCSNIAIFGECKLDHNTCK

SEQ ID NO: 2297722 - protein, 23 aa, Cryptosporidium parvum
LDRLKNEFCRFIDFKYHASTIGN

SEQ ID NO: 2297723 - protein, 21 aa, Cryptosporidium parvum
LDRLKSEWQNLMISQAFILSS

SEQ ID NO: 2297724 - protein, 32 aa, Cryptosporidium parvum
LDSDLFFKGNRPAFNLGLSISRIGSSTQNKSI

SEQ ID NO: 2297725 - protein, 23 aa, Cryptosporidium parvum
LDSETRMFLVLKDYFGHSKKVFR

SEQ ID NO: 2297726 - protein, 18 aa, Cryptosporidium parvum
LDSFMGPSHKFTIKLLMM

SEQ ID NO: 2297727 - protein, 20 aa, Cryptosporidium parvum
LDSICKKSIYSLQNMVPPSQ

SEQ ID NO: 2297728 - protein, 21 aa, Cryptosporidium parvum
LDSKNGILFKLVTSIYNPNSK

SEQ ID NO: 2297729 - protein, 17 aa, Cryptosporidium parvum
LDSLSSFSMKVISNTKS

SEQ ID NO: 2297730 - protein, 27 aa, Cryptosporidium parvum
LDSNYTPRLAFRGSVAPNSYYTVNDGR

SEQ ID NO: 2297731 - protein, 26 aa, Cryptosporidium parvum
LDSQMLLHLIRWFREMKIYDLESLKA

SEQ ID NO: 2297732 - protein, 32 aa, Cryptosporidium parvum
LDSTRGSSIARCFKKGLGGSILSSCMGVSDTH

SEQ ID NO: 2297733 - protein, 21 aa, Cryptosporidium parvum
LDSTTAASCLGKFYESKYLGS

SEQ ID NO: 2297734 - protein, 18 aa, Cryptosporidium parvum
LDTRLTAVHLIDSTLLSS

SEQ ID NO: 2297735 - protein, 22 aa, Cryptosporidium parvum
LDTSALLPFSFGKQQWGDYGGY

SEQ ID NO: 2297736 - protein, 17 aa, Cryptosporidium parvum
LDTTLNFGIKDSGTTID

SEQ ID NO: 2297737 - protein, 18 aa, Cryptosporidium parvum
LDTVLFCRDKWLKEDGLI

SEQ ID NO: 2297738 - protein, 19 aa, Cryptosporidium parvum
LDVAFRASNMVGGFLQRLD

SEQ ID NO: 2297739 - protein, 19 aa, Cryptosporidium parvum
LDVDLKFKGISSINKNQLE

SEQ ID NO: 2297740 - protein, 20 aa, Cryptosporidium parvum
LDVFRYLSNINIAPNIIADF

SEQ ID NO: 2297741 - protein, 20 aa, Cryptosporidium parvum
LDVGCGTGILSMLAAKCGAK

SEQ ID NO: 2297742 - protein, 17 aa, Cryptosporidium parvum
LDVGFLTDASKFVAGSV

SEQ ID NO: 2297743 - protein, 21 aa, Cryptosporidium parvum
LDVIEILPLTEWLVNTYQNYG

SEQ ID NO: 2297744 - protein, 23 aa, Cryptosporidium parvum
LDVIFGFLLRKTDFFTAMNQGEE

SEQ ID NO: 2297745 - protein, 27 aa, Cryptosporidium parvum
LDVLEPVYLRRLIRLMSNKLYELEMNR

SEQ ID NO: 2297746 - protein, 26 aa, Cryptosporidium parvum
LDVLRMLKCEFEVFGKVQGVSFRKYT

SEQ ID NO: 2297747 - protein, 26 aa, Cryptosporidium parvum
LDVLRWLDRKLIRLVSRFADYQKDDP

SEQ ID NO: 2297748 - protein, 19 aa, Cryptosporidium parvum
LDVQIRMMITLRRKTDVTL

SEQ ID NO: 2297749 - protein, 22 aa, Cryptosporidium parvum
LDVWSVGVIMYSVITGRHPFSG

SEQ ID NO: 2297750 - protein, 20 aa, Cryptosporidium parvum
LDWIPYHVSSGIGITVAISN

SEQ ID NO: 2297751 - protein, 24 aa, Cryptosporidium parvum
LDWLFDCYEEGRIVSYKKYIYNSK

SEQ ID NO: 2297752 - protein, 17 aa, Cryptosporidium parvum
LDYEFCLSLANELSLFI

SEQ ID NO: 2297753 - protein, 17 aa, Cryptosporidium parvum
LDYFIPLIETLNEILPL

SEQ ID NO: 2297754 - protein, 24 aa, Cryptosporidium parvum
LDYISCNSWIEWIPNLDLFDKNCY

SEQ ID NO: 2297755 - protein, 17 aa, Cryptosporidium parvum
LDYRSRRPRGFGFVEYV

SEQ ID NO: 2297756 - protein, 26 aa, Cryptosporidium parvum
LDYYQFKWFHSWKKMLRNSSGYLFPH

SEQ ID NO: 2297757 - protein, 17 aa, Cryptosporidium parvum
LEACWREERINRFKGDL

SEQ ID NO: 2297758 - protein, 28 aa, Cryptosporidium parvum
LEAGENSISTIGYWSIIDGFSSSLIKHA

SEQ ID NO: 2297759 - protein, 20 aa, Cryptosporidium parvum
LEAGIKPVFVFDGAPPEMKK

SEQ ID NO: 2297760 - protein, 19 aa, Cryptosporidium parvum
LEAIIGGGVSWIPKNSTVN

SEQ ID NO: 2297761 - protein, 17 aa, Cryptosporidium parvum
LEAKLQLLIGVSIRRIH

SEQ ID NO: 2297762 - protein, 37 aa, Cryptosporidium parvum
LEAKRLKCKFITPQNRFSIESGYRWDGVIRGNGFEEN

SEQ ID NO: 2297763 - protein, 20 aa, Cryptosporidium parvum
LEAVGLFTKPRHNIYKLNMD

SEQ ID NO: 2297764 - protein, 17 aa, Cryptosporidium parvum
LECEKSIEFYELEKDDG

SEQ ID NO: 2297765 - protein, 19 aa, Cryptosporidium parvum
LECKADLQAEKFENLNKST

SEQ ID NO: 2297766 - protein, 25 aa, Cryptosporidium parvum
LEDGESMYLWLGRAIPTTFIQQVFG

SEQ ID NO: 2297767 - protein, 18 aa, Cryptosporidium parvum
LEDGKWVIGSILNSEEIL

SEQ ID NO: 2297768 - protein, 18 aa, Cryptosporidium parvum
LEDGRIFAIGGFNGENII

SEQ ID NO: 2297769 - protein, 24 aa, Cryptosporidium parvum
LEDLKWDINQGLQVDHVRANSQSI

SEQ ID NO: 2297770 - protein, 27 aa, Cryptosporidium parvum
LEDVKSLWLRRFHQEITKITNLPRVTN

SEQ ID NO: 2297771 - protein, 24 aa, Cryptosporidium parvum
LEDYRFKTLYGHLAEYDTVSSNAN

SEQ ID NO: 2297772 - protein, 18 aa, Cryptosporidium parvum
LEECDVIALLALPKICCI

SEQ ID NO: 2297773 - protein, 18 aa, Cryptosporidium parvum
LEEFKIYFQRFGNIKDAV

SEQ ID NO: 2297774 - protein, 17 aa, Cryptosporidium parvum
LEEFVVCGTCGICYHGS

SEQ ID NO: 2297775 - protein, 20 aa, Cryptosporidium parvum
LEEILWCPLSGLQQYLYKEL

SEQ ID NO: 2297776 - protein, 18 aa, Cryptosporidium parvum
LEEISAYSYDPVKNITII

SEQ ID NO: 2297777 - protein, 24 aa, Cryptosporidium parvum
LEEKAKNYFIMFSKERKEREKLER

SEQ ID NO: 2297778 - protein, 30 aa, Cryptosporidium parvum; identical to SEQ ID NO: 2175923

SEQ ID NO: 2297779 - protein, 22 aa, Cryptosporidium parvum
LEENKSKCEFVILNDKFEKENI

SEQ ID NO: 2297780 - protein, 21 aa, Cryptosporidium parvum
LEERKLCGLSSKENGKNEEGI

SEQ ID NO: 2297781 - protein, 23 aa, Cryptosporidium parvum
LEESLKLLIKHVIAQCKREYLRE

SEQ ID NO: 2297782 - protein, 18 aa, Cryptosporidium parvum
LEETLSFSNLDSISGIKT

SEQ ID NO: 2297783 - protein, 22 aa, Cryptosporidium parvum
LEFDSCIMISYPNSFHNIQLSY

SEQ ID NO: 2297784 - protein, 20 aa, Cryptosporidium parvum
LEFITEFYNLTGFSSITEIK

SEQ ID NO: 2297785 - protein, 20 aa, Cryptosporidium parvum
LEFLFKDLIESVKMSKEPIE

SEQ ID NO: 2297786 - protein, 20 aa, Cryptosporidium parvum
LEGAAGIAGLIKLVLVLKHE

SEQ ID NO: 2297787 - protein, 18 aa, Cryptosporidium parvum
LEGAAGMAGIFKVILSLI

SEQ ID NO: 2297788 - protein, 17 aa, Cryptosporidium parvum
LEGAINISSAFSSEYVD

SEQ ID NO: 2297789 - protein, 24 aa, Cryptosporidium parvum
LEGGRAALVVFPFVSLVSEKRDSY

SEQ ID NO: 2297790 - protein, 33 aa, Cryptosporidium parvum
LEGKIGKPEIEWKPANLSGELVLPLVYQTYVTM

SEQ ID NO: 2297791 - protein, 19 aa, Cryptosporidium parvum
LEGKINFLPGIAGRKDKRY

SEQ ID NO: 2297792 - protein, 26 aa, Cryptosporidium parvum
LEGLTKLKPCYLCYSSSTISNQMIGI

SEQ ID NO: 2297793 - protein, 19 aa, Cryptosporidium parvum
LEGQILAIDASIWLKQFLM

SEQ ID NO: 2297794 - protein, 17 aa, Cryptosporidium parvum
LEHANGFMFSMVVSYTW

SEQ ID NO: 2297795 - protein, 23 aa, Cryptosporidium parvum
LEHIVICRMMFILFPVTDAQHPI

SEQ ID NO: 2297796 - protein, 17 aa, Cryptosporidium parvum
LEHKITNVIYVFANTHF

SEQ ID NO: 2297797 - protein, 19 aa, Cryptosporidium parvum
LEHNPDLWGAKRYTLKPPQ

SEQ ID NO: 2297798 - protein, 21 aa, Cryptosporidium parvum
LEHSKKLLFEMLKVDTEKAQT

SEQ ID NO: 2297799 - protein, 18 aa, Cryptosporidium parvum
LEICLRKFQIRGFEKDNF

SEQ ID NO: 2297800 - protein, 17 aa, Cryptosporidium parvum
LEIDYGILSACDVVLNH

SEQ ID NO: 2297801 - protein, 24 aa, Cryptosporidium parvum
LEIFCPRPKVIEEFHSCSGAGKVF

SEQ ID NO: 2297802 - protein, 17 aa, Cryptosporidium parvum
LEIGSKIWIGTVEASYL

SEQ ID NO: 2297803 - protein, 21 aa, Cryptosporidium parvum
LEIHFLRLVRFQLFVTEHEYE

SEQ ID NO: 2297804 - protein, 19 aa, Cryptosporidium parvum
LEIIDLILCQIQFRATLLW

SEQ ID NO: 2297805 - protein, 19 aa, Cryptosporidium parvum
LEIIFNFLVLFKATPVIPE

SEQ ID NO: 2297806 - protein, 19 aa, Cryptosporidium parvum
LEIILNYFVCNEFSTDELI

SEQ ID NO: 2297807 - protein, 18 aa, Cryptosporidium parvum
LEIIRILFQRDKLFLSWV

SEQ ID NO: 2297808 - protein, 18 aa, Cryptosporidium parvum
LEIIRYDKVYVICPDSIK

SEQ ID NO: 2297809 - protein, 17 aa, Cryptosporidium parvum
LEIKTLAYILSRELKTS

SEQ ID NO: 2297810 - protein, 17 aa, Cryptosporidium parvum
LEILKIPKLKAEIDKLE

SEQ ID NO: 2297811 - protein, 23 aa, Cryptosporidium parvum
LEIPENIYSLFGRKKLKTNKNRQ

SEQ ID NO: 2297812 - protein, 20 aa, Cryptosporidium parvum
LEIPIFLQLLNFCVYSVMDS

SEQ ID NO: 2297813 - protein, 20 aa, Cryptosporidium parvum
LEIYNIIPTWGSFKENFYFH

SEQ ID NO: 2297814 - protein, 23 aa, Cryptosporidium parvum
LEKEWWIDCLIEIGLNHENLNVR

SEQ ID NO: 2297815 - protein, 23 aa, Cryptosporidium parvum
LEKFKAAHPEMDFSQAKINYGSG

SEQ ID NO: 2297816 - protein, 22 aa, Cryptosporidium parvum
LEKFKMMDCYFITGTSFEEILE

SEQ ID NO: 2297817 - protein, 38 aa, Cryptosporidium parvum
LEKGRFSMAIACYREVQDLDSLLLIYSCIGDIQGLKYV

SEQ ID NO: 2297818 - protein, 24 aa, Cryptosporidium parvum
LEKHIQLPSIVSFRDLCMEAFGEE

SEQ ID NO: 2297819 - protein, 21 aa, Cryptosporidium parvum
LEKKFILAIEILEEIVVKAPG

SEQ ID NO: 2297820 - protein, 24 aa, Cryptosporidium parvum
LEKKRFSLQFHCEVNDTPCGNIIF

SEQ ID NO: 2297821 - protein, 22 aa, Cryptosporidium parvum
LEKKRLLDIITKMTLEPHNYSF

SEQ ID NO: 2297822 - protein, 18 aa, Cryptosporidium parvum
LEKLSPTAFKGFQKRFFK

SEQ ID NO: 2297823 - protein, 21 aa, Cryptosporidium parvum
LEKQLSFSNFKIFLKLPNRLQ

SEQ ID NO: 2297824 - protein, 22 aa, Cryptosporidium parvum
LEKTYKIWNYVWFKTITNKMII

SEQ ID NO: 2297825 - protein, 33 aa, Cryptosporidium parvum
LELANQEILSWKYRLQRHSILLNDTRRKLFNEL

SEQ ID NO: 2297826 - protein, 20 aa, Cryptosporidium parvum
LELATRCFMSTFITSLEPQN

SEQ ID NO: 2297827 - protein, 20 aa, Cryptosporidium parvum
LELAYLYFLEQFRKVCLGDY

SEQ ID NO: 2297828 - protein, 19 aa, Cryptosporidium parvum
LELEEFCGIVSLENDYQSD

SEQ ID NO: 2297829 - protein, 26 aa, Cryptosporidium parvum
LELENLCLIRQLFKDFVRIITQGRIE

SEQ ID NO: 2297830 - protein, 23 aa, Cryptosporidium parvum
LELFPEVINDYFVNYKMNKIMED

SEQ ID NO: 2297831 - protein, 18 aa, Cryptosporidium parvum
LELIFSRFGEVKSCNIIR

SEQ ID NO: 2297832 - protein, 17 aa, Cryptosporidium parvum
LELIRLSKRTIMLRRKL

SEQ ID NO: 2297833 - protein, 17 aa, Cryptosporidium parvum
LELISSMDLIKRGVESA

SEQ ID NO: 2297834 - protein, 25 aa, Cryptosporidium parvum
LELIYRAESPFGLEIPNSSDDNIED

SEQ ID NO: 2297835 - protein, 17 aa, Cryptosporidium parvum
LELKGWSSFFNIENCVE

SEQ ID NO: 2297836 - protein, 19 aa, Cryptosporidium parvum
LELKHRINNEYSRIGKITE

SEQ ID NO: 2297837 - protein, 34 aa, Cryptosporidium parvum
LELKKRILRNLELFSNLIIYSGFYLPPNSNISIN

SEQ ID NO: 2297838 - protein, 25 aa, Cryptosporidium parvum
LELKNEISSLLPLLNCSNPKTIILV

SEQ ID NO: 2297839 - protein, 17 aa, Cryptosporidium parvum
LELKVLLKKTIRSPQRI

SEQ ID NO: 2297840 - protein, 17 aa, Cryptosporidium parvum
LELLRKNRYGLSEDQTR

SEQ ID NO: 2297841 - protein, 17 aa, Cryptosporidium parvum
LELLRLLINTIKNDLNN

SEQ ID NO: 2297842 - protein, 18 aa, Cryptosporidium parvum
LELMIKGHILKRFSSVNF

SEQ ID NO: 2297843 - protein, 18 aa, Cryptosporidium parvum
LELMPIVEYCGEWGYNPR

SEQ ID NO: 2297844 - protein, 27 aa, Cryptosporidium parvum
LELNFDFNVYRILNEFMEECRKNSNKQ

SEQ ID NO: 2297845 - protein, 20 aa, Cryptosporidium parvum
LELRKKIWRLYSIIETKSSV

SEQ ID NO: 2297846 - protein, 17 aa, Cryptosporidium parvum
LELSTSITSYGRAMIDI

SEQ ID NO: 2297847 - protein, 20 aa, Cryptosporidium parvum
LELVCTFFTILGSYSKGFIV

SEQ ID NO: 2297848 - protein, 18 aa, Cryptosporidium parvum
LEMAQGKLNLSMVSEKGY

SEQ ID NO: 2297849 - protein, 19 aa, Cryptosporidium parvum
LEMEVCLRCVQSSNKNTLS

SEQ ID NO: 2297850 - protein, 18 aa, Cryptosporidium parvum
LEMGVLAAIEITRNSILE

SEQ ID NO: 2297851 - protein, 17 aa, Cryptosporidium parvum
LEMKLLNAVDPFKQKFH

SEQ ID NO: 2297852 - protein, 18 aa, Cryptosporidium parvum
LEMLSWLRDIAIGMEHAH

SEQ ID NO: 2297853 - protein, 19 aa, Cryptosporidium parvum
LEMPQYRYQIRLIAQSIIR

SEQ ID NO: 2297854 - protein, 17 aa, Cryptosporidium parvum
LEMYPGDMNSAINEYFS

SEQ ID NO: 2297855 - protein, 24 aa, Cryptosporidium parvum
LENCDFGDWQKLRIQEHATEIPPG

SEQ ID NO: 2297856 - protein, 24 aa, Cryptosporidium parvum
LENGKEIYLYFGPQVDSKVISEIF

SEQ ID NO: 2297857 - protein, 18 aa, Cryptosporidium parvum
LENIFDLLSDIHLQVLKM

SEQ ID NO: 2297858 - protein, 19 aa, Cryptosporidium parvum
LENKEKMFIENEVNNKKKI

SEQ ID NO: 2297859 - protein, 23 aa, Cryptosporidium parvum
LENLENCYLVISPNISNMLSSCY

SEQ ID NO: 2297860 - protein, 19 aa, Cryptosporidium parvum
LENLIFCENCLKINYPENS

SEQ ID NO: 2297861 - protein, 18 aa, Cryptosporidium parvum
LENLRLVLREKKIAKFTI

SEQ ID NO: 2297862 - protein, 20 aa, Cryptosporidium parvum
LENMKPPPLIILPVYSSQPS

SEQ ID NO: 2297863 - protein, 18 aa, Cryptosporidium parvum
LENNFLCLKEYMVNLNNE

SEQ ID NO: 2297864 - protein, 18 aa, Cryptosporidium parvum
LENPDFNGINLLLSSTNT

SEQ ID NO: 2297865 - protein, 17 aa, Cryptosporidium parvum
LEPARLYLENKFERCQS

SEQ ID NO: 2297866 - protein, 21 aa, Cryptosporidium parvum
LEPAVKYPGYKLEVNGKYYEI

SEQ ID NO: 2297867 - protein, 27 aa, Cryptosporidium parvum
LEPKDLIQLCSWIERYGKNLNYIHIRV

SEQ ID NO: 2297868 - protein, 20 aa, Cryptosporidium parvum
LEQCMLGWERNFWDRFEKIM

SEQ ID NO: 2297869 - protein, 18 aa, Cryptosporidium parvum
LERAKLFQLNDFFFFTRL

SEQ ID NO: 2297870 - protein, 17 aa, Cryptosporidium parvum
LERELRKKLPDNVIELL

SEQ ID NO: 2297871 - protein, 28 aa, Cryptosporidium parvum
LERFDDLEFYLGPSLDCEGIIIYGYYED

SEQ ID NO: 2297872 - protein, 17 aa, Cryptosporidium parvum
LERHSKFALEKVTALKK

SEQ ID NO: 2297873 - protein, 18 aa, Cryptosporidium parvum
LERISSKFFPSATESTSM

SEQ ID NO: 2297874 - protein, 23 aa, Cryptosporidium parvum
LERKEILELMLIDIPNNLNDSEI

SEQ ID NO: 2297875 - protein, 25 aa, Cryptosporidium parvum
LERKKKNLTWLLWKRKKRKTMNPKP

SEQ ID NO: 2297876 - protein, 26 aa, Cryptosporidium parvum
LERLRTYPGPIPWNYGAFPQTWEDPN

SEQ ID NO: 2297877 - protein, 19 aa, Cryptosporidium parvum
LERTGSKLISLKHSLVSKE

SEQ ID NO: 2297878 - protein, 17 aa, Cryptosporidium parvum
LERWEIAQQAFSRVVSL

SEQ ID NO: 2297879 - protein, 24 aa, Cryptosporidium parvum
LERYIRPTGLRFKKAHVTHPELKT

SEQ ID NO: 2297880 - protein, 22 aa, Cryptosporidium parvum
LESCGFNRAKLCKQSLPHRSPS

SEQ ID NO: 2297881 - protein, 20 aa, Cryptosporidium parvum
LESFGVKWNPVININYSTNK

SEQ ID NO: 2297882 - protein, 26 aa, Cryptosporidium parvum
LESGEIRYGQCTGFLNRLPILDSESK

SEQ ID NO: 2297883 - protein, 23 aa, Cryptosporidium parvum
LESIFEWIRVCGVSIESEFLIKA

SEQ ID NO: 2297884 - protein, 24 aa, Cryptosporidium parvum
LESIPENKNRLIFAVLPFGTGNDW

SEQ ID NO: 2297885 - protein, 26 aa, Cryptosporidium parvum
LESIVFEILNIIKVFNLAILDIIDEN

SEQ ID NO: 2297886 - protein, 24 aa, Cryptosporidium parvum
LESKIFKIGRYVRIRIDNIDKEWI

SEQ ID NO: 2297887 - protein, 22 aa, Cryptosporidium parvum
LESLRTNPLFQQLRSVVQQDPR

SEQ ID NO: 2297888 - protein, 22 aa, Cryptosporidium parvum
LESNAKWKGYVKLLVDQISKKN

SEQ ID NO: 2297889 - protein, 22 aa, Cryptosporidium parvum
LESQFGLPITPFMDLKDDITKI

SEQ ID NO: 2297890 - protein, 22 aa, Cryptosporidium parvum
LESQRHGWGFLADKNKIIYEGM

SEQ ID NO: 2297891 - protein, 23 aa, Cryptosporidium parvum
LESRAERSLKEIITDTLGKSSKL

SEQ ID NO: 2297892 - protein, 21 aa, Cryptosporidium parvum
LESSPSVFKMFERRISSVTLV

SEQ ID NO: 2297893 - protein, 18 aa, Cryptosporidium parvum
LESSWGKQFGSFRYPEIK

SEQ ID NO: 2297894 - protein, 26 aa, Cryptosporidium parvum
LESVKRRLSELIHDYDHGLGIFSKHN

SEQ ID NO: 2297895 - protein, 17 aa, Cryptosporidium parvum
LETCYEALVAAKIKEET

SEQ ID NO: 2297896 - protein, 25 aa, Cryptosporidium parvum
LETDCRFSYCALSSLTILNRINEID

SEQ ID NO: 2297897 - protein, 17 aa, Cryptosporidium parvum
LETEFCRKIDNSSTNDQ

SEQ ID NO: 2297898 - protein, 33 aa, Cryptosporidium parvum; identical to SEQ ID NO: 2176034

SEQ ID NO: 2297899 - protein, 29 aa, Cryptosporidium parvum
LETFYQFIWRPHPPSLLSQEKFDEIPRKL

SEQ ID NO: 2297900 - protein, 26 aa, Cryptosporidium parvum
LETGFWSEMPSKMKIESLKSQEISGV

SEQ ID NO: 2297901 - protein, 19 aa, Cryptosporidium parvum
LETLGLELTENGIINIPNN

SEQ ID NO: 2297902 - protein, 20 aa, Cryptosporidium parvum
LETLTGALFQRPPVISAVKR

SEQ ID NO: 2297903 - protein, 24 aa, Cryptosporidium parvum
LETNLEAIFAYHCTDGVGLLDYET

SEQ ID NO: 2297904 - protein, 27 aa, Cryptosporidium parvum
LETNLRYYQDREMYLQHELELKENELN

SEQ ID NO: 2297905 - protein, 17 aa, Cryptosporidium parvum
LETNSATSLKAEYIVGA

SEQ ID NO: 2297906 - protein, 19 aa, Cryptosporidium parvum
LETSLKFQELRKHGIKLVN

SEQ ID NO: 2297907 - protein, 18 aa, Cryptosporidium parvum
LEVLKVISDQGGFQFDAP

SEQ ID NO: 2297908 - protein, 25 aa, Cryptosporidium parvum
LEVMKEANCNILVFSSSATVYLPKS

SEQ ID NO: 2297909 - protein, 25 aa, Cryptosporidium parvum
LEVSEYPIRCAIFVSRKQWIITCGD

SEQ ID NO: 2297910 - protein, 17 aa, Cryptosporidium parvum
LEWKTAISSSDFEDEEV

SEQ ID NO: 2297911 - protein, 25 aa, Cryptosporidium parvum
LEWSNCGGYIYLPGESEIRVISLNE

SEQ ID NO: 2297912 - protein, 20 aa, Cryptosporidium parvum
LEWYQFWREIFSKGAMASAK

SEQ ID NO: 2297913 - protein, 22 aa, Cryptosporidium parvum
LEYFISCYLLEICLYDIEILKY

SEQ ID NO: 2297914 - protein, 19 aa, Cryptosporidium parvum
LEYFPQTLLQYLEKSPKGL

SEQ ID NO: 2297915 - protein, 19 aa, Cryptosporidium parvum
LEYNLKIPILIDAEKNEIE

SEQ ID NO: 2297916 - protein, 19 aa, Cryptosporidium parvum
LFCEGVVLDALDWSIEFPK

SEQ ID NO: 2297917 - protein, 17 aa, Cryptosporidium parvum
LFCRRGVEVTVISQGEF

SEQ ID NO: 2297918 - protein, 26 aa, Cryptosporidium parvum
LFDFKRKTKVFIDYEIVMIIDYREVN

SEQ ID NO: 2297919 - protein, 21 aa, Cryptosporidium parvum
LFDIFNSMCIAFDIYISNYKD

SEQ ID NO: 2297920 - protein, 24 aa, Cryptosporidium parvum
LFDKNLVYRAYRVMPYSTACATPL

SEQ ID NO: 2297921 - protein, 23 aa, Cryptosporidium parvum
LFDPELYTAMIISFQPNGIYSNE

SEQ ID NO: 2297922 - protein, 21 aa, Cryptosporidium parvum
LFDTFFWKLLIYSYFKLNSTL

SEQ ID NO: 2297923 - protein, 25 aa, Cryptosporidium parvum
LFDVLNCIYNSLSIIIPGQLSKKGL

SEQ ID NO: 2297924 - protein, 20 aa, Cryptosporidium parvum
LFEEKCLWEDAPIFESTSGA

SEQ ID NO: 2297925 - protein, 26 aa, Cryptosporidium parvum
LFEFSLELPESINIKLIEEIQEILSN

SEQ ID NO: 2297926 - protein, 24 aa, Cryptosporidium parvum
LFEMPNIQLIFSFLYNPSSFNFIS

SEQ ID NO: 2297927 - protein, 18 aa, Cryptosporidium parvum
LFENWKDELLELFPENSK

SEQ ID NO: 2297928 - protein, 18 aa, Cryptosporidium parvum
LFETIALNSVNNFSTNQI

SEQ ID NO: 2297929 - protein, 18 aa, Cryptosporidium parvum
LFETRVNIDLHQSLTDSP

SEQ ID NO: 2297930 - protein, 17 aa, Cryptosporidium parvum
LFFFSAPSLLPYVDEIV

SEQ ID NO: 2297931 - protein, 17 aa, Cryptosporidium parvum
LFFGNFVPNIDFLPELF

SEQ ID NO: 2297932 - protein, 19 aa, Cryptosporidium parvum
LFFGYHYFVLLSFMPGSGL

SEQ ID NO: 2297933 - protein, 20 aa, Cryptosporidium parvum
LFIDKWPHLVVLTIPGIEIK

SEQ ID NO: 2297934 - protein, 19 aa, Cryptosporidium parvum
LFIEWSIGCEIFRKIWGPD

SEQ ID NO: 2297935 - protein, 18 aa, Cryptosporidium parvum
LFIFFILKMIERRKIAVI

SEQ ID NO: 2297936 - protein, 23 aa, Cryptosporidium parvum
LFILTSRVGGVGLNITGANRVIL

SEQ ID NO: 2297937 - protein, 25 aa, Cryptosporidium parvum
LFILVLKLPSICFAEDSEASTDIEQ

SEQ ID NO: 2297938 - protein, 17 aa, Cryptosporidium parvum
LFINELREKVPLKNNYV

SEQ ID NO: 2297939 - protein, 25 aa, Cryptosporidium parvum
LFIPDNYKGMLIWKSTNFIRHCDII

SEQ ID NO: 2297940 - protein, 22 aa, Cryptosporidium parvum
LFKKWCAEYGPELVLEACAIRI

SEQ ID NO: 2297941 - protein, 23 aa, Cryptosporidium parvum
LFKNYCSPEIVSMAPKQRVQSWK

SEQ ID NO: 2297942 - protein, 21 aa, Cryptosporidium parvum
LFKPCMDVIWEFNKHVMTRSP

SEQ ID NO: 2297943 - protein, 19 aa, Cryptosporidium parvum
LFKRPLIQNPIILAPKTHH

SEQ ID NO: 2297944 - protein, 27 aa, Cryptosporidium parvum
LFKTSLCVYWIKGSCVVGDSCRYAHGI

SEQ ID NO: 2297945 - protein, 17 aa, Cryptosporidium parvum
LFLAESATTSFFRRLDW

SEQ ID NO: 2297946 - protein, 21 aa, Cryptosporidium parvum
LFLCKEGGFKCDLLSSKEILD

SEQ ID NO: 2297947 - protein, 31 aa, Cryptosporidium parvum; identical to SEQ ID NO: 2176089

SEQ ID NO: 2297948 - protein, 18 aa, Cryptosporidium parvum
LFLIPGIDENTPLEPKKR

SEQ ID NO: 2297949 - protein, 20 aa, Cryptosporidium parvum
LFLKGFDHLILVTAYETDNE

SEQ ID NO: 2297950 - protein, 28 aa, Cryptosporidium parvum
LFLLISRVYSSICIDQFLKNICPNDFLP

SEQ ID NO: 2297951 - protein, 17 aa, Cryptosporidium parvum
LFLNQSNEFPLWKNACM

SEQ ID NO: 2297952 - protein, 21 aa, Cryptosporidium parvum
LFMLCDGCILAVSIEKGPFVI

SEQ ID NO: 2297953 - protein, 21 aa, Cryptosporidium parvum
LFNICQLLLCKNLKEIEKNSA

SEQ ID NO: 2297954 - protein, 30 aa, Cryptosporidium parvum
LFNTTEWKLEWTMNTLGGWIDELISPNGFS

SEQ ID NO: 2297955 - protein, 19 aa, Cryptosporidium parvum
LFPERRKVVVDTRKGLHNK

SEQ ID NO: 2297956 - protein, 21 aa, Cryptosporidium parvum
LFPLKEFVAPLIPLNISCPCC

SEQ ID NO: 2297957 - protein, 28 aa, Cryptosporidium parvum
LFQDCLEAKAGLNLKCLSKLERCVNESK

SEQ ID NO: 2297958 - protein, 27 aa, Cryptosporidium parvum
LFQGKLKPWKGILLYGPPGTGKTFLAK

SEQ ID NO: 2297959 - protein, 25 aa, Cryptosporidium parvum
LFQKHPSCIPIFLELHLVFVKEFNN

SEQ ID NO: 2297960 - protein, 18 aa, Cryptosporidium parvum
LFQLLPMIDYIIGNQEEF

SEQ ID NO: 2297961 - protein, 19 aa, Cryptosporidium parvum
LFQSGSCWHVDNILGSHII

SEQ ID NO: 2297962 - protein, 19 aa, Cryptosporidium parvum
LFQYNIELFDAFTNNDFSG

SEQ ID NO: 2297963 - protein, 21 aa, Cryptosporidium parvum
LFRKYCPDPLYLIADVTADDF

SEQ ID NO: 2297964 - protein, 17 aa, Cryptosporidium parvum
LFSAILLMGNFELGEHE

SEQ ID NO: 2297965 - protein, 18 aa, Cryptosporidium parvum
LFSFPLLSSACIRHIKDN

SEQ ID NO: 2297966 - protein, 18 aa, Cryptosporidium parvum
LFSIFDFITQEFIRVIPI

SEQ ID NO: 2297967 - protein, 20 aa, Cryptosporidium parvum
LFSNGMVKLSDFGISNILSS

SEQ ID NO: 2297968 - protein, 18 aa, Cryptosporidium parvum
LFTEVLQMLCFYDEKRNS

SEQ ID NO: 2297969 - protein, 25 aa, Cryptosporidium parvum
LFTFNLRLPIHVKITYLRQFILGKL

SEQ ID NO: 2297970 - protein, 42 aa, Cryptosporidium parvum; identical to SEQ ID NO: 2176114

SEQ ID NO: 2297971 - protein, 17 aa, Cryptosporidium parvum
LFTHNPLSLAISNLLKS

SEQ ID NO: 2297972 - protein, 18 aa, Cryptosporidium parvum
LFTKEMIEQFHAMSKDPM

SEQ ID NO: 2297973 - protein, 20 aa, Cryptosporidium parvum
LFTKHDIFKYIFLIMDQLKV

SEQ ID NO: 2297974 - protein, 22 aa, Cryptosporidium parvum
LFTKQIRCCKASNDRKPLDIGA

SEQ ID NO: 2297975 - protein, 24 aa, Cryptosporidium parvum
LFTVFKRLLLYDSKAVRKCAVKVI

SEQ ID NO: 2297976 - protein, 24 aa, Cryptosporidium parvum
LFTYCLESILLLYGKQISSVYCNQ

SEQ ID NO: 2297977 - protein, 18 aa, Cryptosporidium parvum
LFVRKWKKSDIIDYENYN

SEQ ID NO: 2297978 - protein, 27 aa, Cryptosporidium parvum
LFWSTCISKLCSWEFSIAETSISKSKI

SEQ ID NO: 2297979 - protein, 19 aa, Cryptosporidium parvum
LFYWCSLFKLLAVCPKCSF

SEQ ID NO: 2297980 - protein, 22 aa, Cryptosporidium parvum
LGACAPAIFNYQIPYFQPYSLR

SEQ ID NO: 2297981 - protein, 25 aa, Cryptosporidium parvum
LGADMFDCVYPCRTARFGTAMVHNG

SEQ ID NO: 2297982 - protein, 25 aa, Cryptosporidium parvum
LGASFYRFIFNSVFFSKSNLNEKVL

SEQ ID NO: 2297983 - protein, 18 aa, Cryptosporidium parvum
LGCGSWGHTSTAEGIGVK

SEQ ID NO: 2297984 - protein, 27 aa, Cryptosporidium parvum
LGDDFLKEFALPKVRVFDNINICNMRE

SEQ ID NO: 2297985 - protein, 27 aa, Cryptosporidium parvum
LGDSRAILCKCGRAYSLTKDHRIKSNL

SEQ ID NO: 2297986 - protein, 30 aa, Cryptosporidium parvum
LGEAHVKYRKGACTNCGSMTHQARDCLERP

SEQ ID NO: 2297987 - protein, 22 aa, Cryptosporidium parvum
LGEDELRDAVLLVFANKQDLPN

SEQ ID NO: 2297988 - protein, 22 aa, Cryptosporidium parvum
LGEGLLKYTVEYVLINNMPDLL

SEQ ID NO: 2297989 - protein, 30 aa, Cryptosporidium parvum
LGELLSRWPVDLSIGILFIYGLIFDCIDPI

SEQ ID NO: 2297990 - protein, 19 aa, Cryptosporidium parvum
LGFESGLLLYGEGALGTHR

SEQ ID NO: 2297991 - protein, 20 aa, Cryptosporidium parvum
LGFFILWKIIEDFEPVISYD

SEQ ID NO: 2297992 - protein, 19 aa, Cryptosporidium parvum
LGFGGGTTSNFSFGNPSST

SEQ ID NO: 2297993 - protein, 17 aa, Cryptosporidium parvum
LGFSLLFMHNYWQYQGL

SEQ ID NO: 2297994 - protein, 18 aa, Cryptosporidium parvum
LGGELGYSIKGEHEHLFE

SEQ ID NO: 2297995 - protein, 25 aa, Cryptosporidium parvum
LGGFSQGSAIVFLISMASRKYTLGS

SEQ ID NO: 2297996 - protein, 25 aa, Cryptosporidium parvum
LGGIPRIGGISGIPGMAKGGIPGIG

SEQ ID NO: 2297997 - protein, 25 aa, Cryptosporidium parvum
LGGLLGFPNCIANLTAPKVSGFGSS

SEQ ID NO: 2297998 - protein, 25 aa, Cryptosporidium parvum
LGGNSRTIIICNCSPDRVNYYETLS

SEQ ID NO: 2297999 - protein, 23 aa, Cryptosporidium parvum
LGGSPPFPGSNMKEILKKNIQGN

SEQ ID NO: 2298000 - protein, 22 aa, Cryptosporidium parvum
LGHGRSSVVFSAIHKLSGKIVA

SEQ ID NO: 2298001 - protein, 28 aa, Cryptosporidium parvum
LGHLALAKQCYRGMMGVQGREFLIMGRN

SEQ ID NO: 2298002 - protein, 25 aa, Cryptosporidium parvum
LGHMAVKFGVSFGCEVAVITRSESK

SEQ ID NO: 2298003 - protein, 23 aa, Cryptosporidium parvum
LGHPLEGIMVVELIIIAKCCGLT

SEQ ID NO: 2298004 - protein, 20 aa, Cryptosporidium parvum
LGIDAPEFKECKKVNPKNPP

SEQ ID NO: 2298005 - protein, 26 aa, Cryptosporidium parvum
LGIEKQEQFYILAILLGCDYTVGVNG

SEQ ID NO: 2298006 - protein, 17 aa, Cryptosporidium parvum
LGIEKSVIEEELDWKLQ

SEQ ID NO: 2298007 - protein, 20 aa, Cryptosporidium parvum
LGIKEKLSIDARSFIESLVH

SEQ ID NO: 2298008 - protein, 18 aa, Cryptosporidium parvum
LGILLKAGPITTITVKST

SEQ ID NO: 2298009 - protein, 25 aa, Cryptosporidium parvum
LGILLLKCIESILLESTKLSEIHHF

SEQ ID NO: 2298010 - protein, 17 aa, Cryptosporidium parvum
LGIPDIVDFPFPTPPEK

SEQ ID NO: 2298011 - protein, 20 aa, Cryptosporidium parvum
LGKECKYMKLGDGTVNIDRK

SEQ ID NO: 2298012 - protein, 23 aa, Cryptosporidium parvum
LGKELPGLYPVGVGTINALPNTN

SEQ ID NO: 2298013 - protein, 17 aa, Cryptosporidium parvum
LGKLLSDLCKIKIINKI

SEQ ID NO: 2298014 - protein, 17 aa, Cryptosporidium parvum
LGKRVDLGVDIPISAIH

SEQ ID NO: 2298015 - protein, 22 aa, Cryptosporidium parvum
LGKTLCKLWKNSAETIENRQII

SEQ ID NO: 2298016 - protein, 18 aa, Cryptosporidium parvum
LGLALNFSVFHYEILNEP

SEQ ID NO: 2298017 - protein, 17 aa, Cryptosporidium parvum
LGLDPSKKSNQSEKVDY

SEQ ID NO: 2298018 - protein, 27 aa, Cryptosporidium parvum
LGLELDPGMELRIIWQRSSYTIQQYLR

SEQ ID NO: 2298019 - protein, 24 aa, Cryptosporidium parvum
LGLGSEFERVFSIAVEIATNDESE

SEQ ID NO: 2298020 - protein, 17 aa, Cryptosporidium parvum
LGLILSLEIQTIEDDLL

SEQ ID NO: 2298021 - protein, 17 aa, Cryptosporidium parvum
LGLMEGRVYINENMAGT

SEQ ID NO: 2298022 - protein, 25 aa, Cryptosporidium parvum
LGLSLACAVSQGFSNIFITAPSAEN

SEQ ID NO: 2298023 - protein, 26 aa, Cryptosporidium parvum
LGLTNIAKCYSRICEITTPITVVGVR

SEQ ID NO: 2298024 - protein, 19 aa, Cryptosporidium parvum
LGMGAKVKCIYDNDLYKKQ

SEQ ID NO: 2298025 - protein, 25 aa, Cryptosporidium parvum
LGMMKQRVGWMYGYYREDSTYPMGI

SEQ ID NO: 2298026 - protein, 18 aa, Cryptosporidium parvum
LGMQLSVVEFCKNVLKLP

SEQ ID NO: 2298027 - protein, 18 aa, Cryptosporidium parvum
LGNASHILRIPKQGVGNM

SEQ ID NO: 2298028 - protein, 17 aa, Cryptosporidium parvum
LGNCIACNDYVALIHTD

SEQ ID NO: 2298029 - protein, 19 aa, Cryptosporidium parvum
LGNCLSAILILSGKEEIDG

SEQ ID NO: 2298030 - protein, 20 aa, Cryptosporidium parvum
LGNINCPIINHWRLNERHYG

SEQ ID NO: 2298031 - protein, 17 aa, Cryptosporidium parvum
LGNPRVRTNPALAAAST

SEQ ID NO: 2298032 - protein, 20 aa, Cryptosporidium parvum
LGNSTPIWVHKLEKLLLNAQ

SEQ ID NO: 2298033 - protein, 19 aa, Cryptosporidium parvum
LGNVNWKTLLRVCNEISAS

SEQ ID NO: 2298034 - protein, 19 aa, Cryptosporidium parvum
LGPILRPVSLKARDDELGL

SEQ ID NO: 2298035 - protein, 18 aa, Cryptosporidium parvum
LGPIYGFQWRHYNGEYKT

SEQ ID NO: 2298036 - protein, 19 aa, Cryptosporidium parvum
LGPKVPFCPMVASEVYSAE

SEQ ID NO: 2298037 - protein, 18 aa, Cryptosporidium parvum
LGPLENWLSTYETIKAYL

SEQ ID NO: 2298038 - protein, 20 aa, Cryptosporidium parvum
LGQETFCFIDFYYYQIANIY

SEQ ID NO: 2298039 - protein, 28 aa, Cryptosporidium parvum
LGQISSFFYIKCCTISKMNKFLNYKVLK

SEQ ID NO: 2298040 - protein, 21 aa, Cryptosporidium parvum
LGRHPPYPGGVPGQVHQNTKP

SEQ ID NO: 2298041 - protein, 23 aa, Cryptosporidium parvum
LGRIKGWGCNHVGRSASLTAPNG

SEQ ID NO: 2298042 - protein, 23 aa, Cryptosporidium parvum
LGRVRRFFEKPAYDNIVRAISKA

SEQ ID NO: 2298043 - protein, 25 aa, Cryptosporidium parvum
LGSFSSILGYIPYNILLASENIQNE

SEQ ID NO: 2298044 - protein, 25 aa, Cryptosporidium parvum
LGSIFRLELKIGFTKEMLKPQIKIG

SEQ ID NO: 2298045 - protein, 17 aa, Cryptosporidium parvum
LGSLIGVDESYIRRTNI

SEQ ID NO: 2298046 - protein, 26 aa, Cryptosporidium parvum
LGSLKNCFIRGSVVRYIFFPPSEVDI

SEQ ID NO: 2298047 - protein, 18 aa, Cryptosporidium parvum
LGSLWCLDNVPGSSLHAF

SEQ ID NO: 2298048 - protein, 17 aa, Cryptosporidium parvum
LGSNFALNYMFKVNSIV

SEQ ID NO: 2298049 - protein, 17 aa, Cryptosporidium parvum
LGSSCFYIHARMLQSHR

SEQ ID NO: 2298050 - protein, 17 aa, Cryptosporidium parvum
LGSYYYIYQRTEFIDDS

SEQ ID NO: 2298051 - protein, 18 aa, Cryptosporidium parvum
LGTCNRLLLSGSPIQNDL

SEQ ID NO: 2298052 - protein, 19 aa, Cryptosporidium parvum
LGTDIANKVKPLFFSRNSS

SEQ ID NO: 2298053 - protein, 27 aa, Cryptosporidium parvum
LGTGIIGRFFIFSSFNHRGNELMLTQF

SEQ ID NO: 2298054 - protein, 17 aa, Cryptosporidium parvum
LGVGFGRLKQIFGSFSD

SEQ ID NO: 2298055 - protein, 20 aa, Cryptosporidium parvum
LGVLEIPECFLSKYGDMIRH

SEQ ID NO: 2298056 - protein, 17 aa, Cryptosporidium parvum
LGVRDLAYRLCFLACHI

SEQ ID NO: 2298057 - protein, 25 aa, Cryptosporidium parvum
LGYFPEIRAFVALDLSSSFDELYKS

SEQ ID NO: 2298058 - protein, 22 aa, Cryptosporidium parvum
LGYLGGISWAILTARICQLYPN

SEQ ID NO: 2298059 - protein, 20 aa, Cryptosporidium parvum
LGYQYAINWAGGLHHGKKHE

SEQ ID NO: 2298060 - protein, 30 aa, Cryptosporidium parvum
LGYSRRLISAWFRLYFEIIGNKTSNNCSGV

SEQ ID NO: 2298061 - protein, 17 aa, Cryptosporidium parvum
LHAILNCAGNRGIYSKE

SEQ ID NO: 2298062 - protein, 24 aa, Cryptosporidium parvum
LHALQNLAPIQGMHHMQSFPHIGA

SEQ ID NO: 2298063 - protein, 19 aa, Cryptosporidium parvum
LHCDAIKMVSEVFKYSPSP

SEQ ID NO: 2298064 - protein, 26 aa, Cryptosporidium parvum
LHCGSSLDLGKLLDICLEKILKRTND

SEQ ID NO: 2298065 - protein, 17 aa, Cryptosporidium parvum
LHDIVPLKWEYLDDNNV

SEQ ID NO: 2298066 - protein, 25 aa, Cryptosporidium parvum
LHELGIKCFITISGSGLKFIPVDET

SEQ ID NO: 2298067 - protein, 27 aa, Cryptosporidium parvum
LHESGHAIAGWYLKHADPILKVSIVPR

SEQ ID NO: 2298068 - protein, 19 aa, Cryptosporidium parvum
LHESWICLVTLIFQMKDLI

SEQ ID NO: 2298069 - protein, 19 aa, Cryptosporidium parvum
LHFKGELLEKIKASKEKIN

SEQ ID NO: 2298070 - protein, 17 aa, Cryptosporidium parvum
LHGELHIALDNITPHWS

SEQ ID NO: 2298071 - protein, 18 aa, Cryptosporidium parvum
LHHLKAYRSFNNGNTGGN

SEQ ID NO: 2298072 - protein, 25 aa, Cryptosporidium parvum
LHHNEIMSRLGFYDSVKGAELAGHR

SEQ ID NO: 2298073 - protein, 20 aa, Cryptosporidium parvum
LHIMSHPWLLAINNLTNIDI

SEQ ID NO: 2298074 - protein, 31 aa, Cryptosporidium parvum; identical to SEQ ID NO: 2176191

SEQ ID NO: 2298075 - protein, 26 aa, Cryptosporidium parvum
LHIPGIEFNKKISFDPSKRISLGFSN

SEQ ID NO: 2298076 - protein, 22 aa, Cryptosporidium parvum
LHKKLCSDFNKFGRYSEIKSYF

SEQ ID NO: 2298077 - protein, 25 aa, Cryptosporidium parvum
LHMPEHPFIIASRVVNGDILVFDYS

SEQ ID NO: 2298078 - protein, 24 aa, Cryptosporidium parvum
LHNDLKYKLSFSLVYLNLNKRGEV

SEQ ID NO: 2298079 - protein, 25 aa, Cryptosporidium parvum
LHNDRIVFGLHLMRIYIESYCNLSL

SEQ ID NO: 2298080 - protein, 18 aa, Cryptosporidium parvum
LHNLCSLTELGHEKQNFF

SEQ ID NO: 2298081 - protein, 25 aa, Cryptosporidium parvum
LHNRNGTNIILRFLMIPNGDIKCIL

SEQ ID NO: 2298082 - protein, 26 aa, Cryptosporidium parvum
LHPKFDKSRIDTCKKIFLEKLMSKGE

SEQ ID NO: 2298083 - protein, 20 aa, Cryptosporidium parvum
LHPYLRSDFREIIFKVQCLW

SEQ ID NO: 2298084 - protein, 17 aa, Cryptosporidium parvum
LHQLKRKTPEPMKGMQI

SEQ ID NO: 2298085 - protein, 19 aa, Cryptosporidium parvum
LHSAIPFSSNIGINLLQKM

SEQ ID NO: 2298086 - protein, 25 aa, Cryptosporidium parvum
LHSKELRNPLSFFFGHLNVTDDLQL

SEQ ID NO: 2298087 - protein, 26 aa, Cryptosporidium parvum
LHSLKYKFKYEIPKEKAIKMIKQLIK

SEQ ID NO: 2298088 - protein, 18 aa, Cryptosporidium parvum
LHSLNGHSGQINRLSFLL

SEQ ID NO: 2298089 - protein, 17 aa, Cryptosporidium parvum
LHSNSRTGLGFNTQSIQ

SEQ ID NO: 2298090 - protein, 20 aa, Cryptosporidium parvum
LHSRIAFSLLLRSNAIKAME

SEQ ID NO: 2298091 - protein, 19 aa, Cryptosporidium parvum
LHTFCKACIIEHIESKGAE

SEQ ID NO: 2298092 - protein, 25 aa, Cryptosporidium parvum
LHVKIPGVLVNMWCTLRDLVNEGII

SEQ ID NO: 2298093 - protein, 17 aa, Cryptosporidium parvum
LHWCCIQTIELLKRSFD

SEQ ID NO: 2298094 - protein, 24 aa, Cryptosporidium parvum
LHYKGCKFHRIIPEFMCQGGDISS

SEQ ID NO: 2298095 - protein, 19 aa, Cryptosporidium parvum
LIAACGFGSGGALKSICNG

SEQ ID NO: 2298096 - protein, 17 aa, Cryptosporidium parvum
LIAAIVCSDNSIKIIDL

SEQ ID NO: 2298097 - protein, 19 aa, Cryptosporidium parvum
LIAILRSSQLVEILENMLR

SEQ ID NO: 2298098 - protein, 23 aa, Cryptosporidium parvum
LIAKKCGYIPIEMNASDDRTKEV

SEQ ID NO: 2298099 - protein, 27 aa, Cryptosporidium parvum
LIANNCFDVIFAFDEIVSFGYRESINL

SEQ ID NO: 2298100 - protein, 24 aa, Cryptosporidium parvum
LIAPAPNWFCTSALSLEEKKGIYV

SEQ ID NO: 2298101 - protein, 19 aa, Cryptosporidium parvum
LICDSCQGTTCKISKVGVM

SEQ ID NO: 2298102 - protein, 20 aa, Cryptosporidium parvum
LICNQFSPKWGIHAGKSAKT

SEQ ID NO: 2298103 - protein, 20 aa, Cryptosporidium parvum
LICSFLSVLFELSYNENKLS

SEQ ID NO: 2298104 - protein, 25 aa, Cryptosporidium parvum
LIDCPSELFSTLLLNPDLESLSVQK

SEQ ID NO: 2298105 - protein, 26 aa, Cryptosporidium parvum
LIDENIKLSRFCGKMRDICLSENHIN

SEQ ID NO: 2298106 - protein, 29 aa, Cryptosporidium parvum
LIDPTIFVKSCILRGSKHISKCIENFEIA

SEQ ID NO: 2298107 - protein, 25 aa, Cryptosporidium parvum
LIDSFRFERGLSLFLEIPKETIKYI

SEQ ID NO: 2298108 - protein, 29 aa, Cryptosporidium parvum
LIDTSLRQDFGFKHILWLYSGRRGVHCWV

SEQ ID NO: 2298109 - protein, 24 aa, Cryptosporidium parvum
LIDYRNKYKIAICEGDLNTDITDK

SEQ ID NO: 2298110 - protein, 17 aa, Cryptosporidium parvum
LIEADFYLLESLCSILS

SEQ ID NO: 2298111 - protein, 25 aa, Cryptosporidium parvum
LIEAFKVFDRDGNGFISAAELRHVM

SEQ ID NO: 2298112 - protein, 25 aa, Cryptosporidium parvum
LIEFRSLFCQCIICKFNTYYQESHP

SEQ ID NO: 2298113 - protein, 22 aa, Cryptosporidium parvum
LIEHISSLMLKNQVRTYDKVDS

SEQ ID NO: 2298114 - protein, 23 aa, Cryptosporidium parvum
LIEILKRDIDIFLKSGDVLLNLI

SEQ ID NO: 2298115 - protein, 24 aa, Cryptosporidium parvum
LIELELKIMMSIHLYELITQFSLL

SEQ ID NO: 2298116 - protein, 18 aa, Cryptosporidium parvum
LIELKCIRISFCRQDDHS

SEQ ID NO: 2298117 - protein, 23 aa, Cryptosporidium parvum
LIENWKHIFSIDFPYMQTLGGGL

SEQ ID NO: 2298118 - protein, 20 aa, Cryptosporidium parvum
LIERMKYLPMVSSSLNSTSY

SEQ ID NO: 2298119 - protein, 22 aa, Cryptosporidium parvum
LIESLYMRFLYLIETLSIIFLK

SEQ ID NO: 2298120 - protein, 17 aa, Cryptosporidium parvum
LIEYSNDDFIHFLNTIS

SEQ ID NO: 2298121 - protein, 18 aa, Cryptosporidium parvum
LIFDCIDPIVTIASFLTC

SEQ ID NO: 2298122 - protein, 35 aa, Cryptosporidium parvum
LIFNNIFYVFPIPFDMKSIRSLQTFSNQHSISHSF

SEQ ID NO: 2298123 - protein, 20 aa, Cryptosporidium parvum
LIFYRRSRKGFSKIHSRRRS

SEQ ID NO: 2298124 - protein, 33 aa, Cryptosporidium parvum
LIGLDGAVEFEWLYCILKYLVFFNSKFGFYNEN

SEQ ID NO: 2298125 - protein, 18 aa, Cryptosporidium parvum
LIGRKCEFLKTVILELKF

SEQ ID NO: 2298126 - protein, 18 aa, Cryptosporidium parvum
LIGSLSWTVPTDKDDIIL

SEQ ID NO: 2298127 - protein, 18 aa, Cryptosporidium parvum
LIHGSCKEGNDCGEYYTP

SEQ ID NO: 2298128 - protein, 25 aa, Cryptosporidium parvum
LIHRKEYRRAIKILRDKSEQKVIIN

SEQ ID NO: 2298129 - protein, 23 aa, Cryptosporidium parvum
LIHRPELDPSQGITVASIQHQLV

SEQ ID NO: 2298130 - protein, 30 aa, Cryptosporidium parvum
LIIDFPLFIKLVEYRIIKGTSQILRIELPG

SEQ ID NO: 2298131 - protein, 17 aa, Cryptosporidium parvum
LIIEHCLSVKAYRELLG

SEQ ID NO: 2298132 - protein, 18 aa, Cryptosporidium parvum
LIIEKVINGITVFNNLQN

SEQ ID NO: 2298133 - protein, 19 aa, Cryptosporidium parvum
LIIEVIKSLLMLCERKRGK

SEQ ID NO: 2298134 - protein, 17 aa, Cryptosporidium parvum
LIIIEGRLKNSILDLNK

SEQ ID NO: 2298135 - protein, 20 aa, Cryptosporidium parvum
LIILNSYLAFLVFKISKKNQ

SEQ ID NO: 2298136 - protein, 18 aa, Cryptosporidium parvum
LIIMSATLRVTDFSENPK

SEQ ID NO: 2298137 - protein, 25 aa, Cryptosporidium parvum
LIIPFILLLHRTWYRIQDSTEILRK

SEQ ID NO: 2298138 - protein, 24 aa, Cryptosporidium parvum
LIIQRSLVKLSLREKPVYRILACY

SEQ ID NO: 2298139 - protein, 25 aa, Cryptosporidium parvum
LIIVWYRIMHDYSRMIDCYNGDLEE

SEQ ID NO: 2298140 - protein, 20 aa, Cryptosporidium parvum
LIKALICITNPNSLSQEDEN

SEQ ID NO: 2298141 - protein, 18 aa, Cryptosporidium parvum
LIKCSDPNSYIEIYISCS

SEQ ID NO: 2298142 - protein, 30 aa, Cryptosporidium parvum
LIKDCIFGRIFDLRIIRFIKINDIHALTGS

SEQ ID NO: 2298143 - protein, 20 aa, Cryptosporidium parvum
LIKGIGKRNRDGYEKGDDFR

SEQ ID NO: 2298144 - protein, 17 aa, Cryptosporidium parvum
LIKLHALTPRTNNLLDD

SEQ ID NO: 2298145 - protein, 21 aa, Cryptosporidium parvum
LIKLLCFSNNIGIKDEQGKNK

SEQ ID NO: 2298146 - protein, 41 aa, Cryptosporidium parvum; identical to SEQ ID NO: 2176249

SEQ ID NO: 2298147 - protein, 23 aa, Cryptosporidium parvum
LIKMSLFTCLNRNRGLFEIIIFN

SEQ ID NO: 2298148 - protein, 29 aa, Cryptosporidium parvum
LIKRLFKIPFWPDGFRFIKNRKYFIKDGI

SEQ ID NO: 2298149 - protein, 23 aa, Cryptosporidium parvum
LIKSFLPEFWPAYEPSSSLELFS

SEQ ID NO: 2298150 - protein, 17 aa, Cryptosporidium parvum
LIKSMKTGITNFAKNKG

SEQ ID NO: 2298151 - protein, 30 aa, Cryptosporidium parvum
LIKVAAFRSKGRIPILSWTNPDLKCTLWRS

SEQ ID NO: 2298152 - protein, 17 aa, Cryptosporidium parvum
LILFNSFSLTGKSLPMF

SEQ ID NO: 2298153 - protein, 27 aa, Cryptosporidium parvum
LILIEELEILGLWEWAVFIIMHTNMNS

SEQ ID NO: 2298154 - protein, 25 aa, Cryptosporidium parvum
LILNHQRLPLLFKAVVDSRNILNSK

SEQ ID NO: 2298155 - protein, 17 aa, Cryptosporidium parvum
LILPNRLRYLQKRKVGI

SEQ ID NO: 2298156 - protein, 24 aa, Cryptosporidium parvum
LILPPRWDPLDGRLDHEFDHARYI

SEQ ID NO: 2298157 - protein, 22 aa, Cryptosporidium parvum
LILRNIEILNQFLINNTEKSHI

SEQ ID NO: 2298158 - protein, 18 aa, Cryptosporidium parvum
LILYIFKMYCIKTISCTF

SEQ ID NO: 2298159 - protein, 27 aa, Cryptosporidium parvum
LIMDPTLPPCLFEWKKQAKISRVTIEN

SEQ ID NO: 2298160 - protein, 21 aa, Cryptosporidium parvum
LIMELCTGGELFDRLSHVGRF

SEQ ID NO: 2298161 - protein, 23 aa, Cryptosporidium parvum
LIMFKNEIKQLLNDRMRDNKEII

SEQ ID NO: 2298162 - protein, 17 aa, Cryptosporidium parvum
LIMLCGLGSSGKTSIIK

SEQ ID NO: 2298163 - protein, 18 aa, Cryptosporidium parvum
LIMLRGENIVTFVAEAPP

SEQ ID NO: 2298164 - protein, 18 aa, Cryptosporidium parvum
LINAHLWRDTTIEELDLA

SEQ ID NO: 2298165 - protein, 23 aa, Cryptosporidium parvum
LINEFKHALVWGTSVKHNPQCVG

SEQ ID NO: 2298166 - protein, 25 aa, Cryptosporidium parvum
LINIWQSICCLINILNSSEDKFVNY

SEQ ID NO: 2298167 - protein, 27 aa, Cryptosporidium parvum
LINKNNGSCPFCFFKGNNKGQKLSISI

SEQ ID NO: 2298168 - protein, 23 aa, Cryptosporidium parvum
LINSKRFGFQFVSKTANPHEILM

SEQ ID NO: 2298169 - protein, 19 aa, Cryptosporidium parvum
LIPPFPQVSGIPMFEDGTP

SEQ ID NO: 2298170 - protein, 17 aa, Cryptosporidium parvum
LIPYSLYWFTGEAVDED

SEQ ID NO: 2298171 - protein, 23 aa, Cryptosporidium parvum
LIQAFAGICSYITFNEPTDRREI

SEQ ID NO: 2298172 - protein, 18 aa, Cryptosporidium parvum
LIQDLSICECWIKSVKGD

SEQ ID NO: 2298173 - protein, 26 aa, Cryptosporidium parvum
LIQFSRPLRTCLWILSECEYGNDKRK

SEQ ID NO: 2298174 - protein, 23 aa, Cryptosporidium parvum
LIQGGLLPGLGIPMTQPGVPGVP

SEQ ID NO: 2298175 - protein, 23 aa, Cryptosporidium parvum
LIQKQESCIFCIIQTHIEELEYS

SEQ ID NO: 2298176 - protein, 31 aa, Cryptosporidium parvum
LIQMGVKFQFSENIGSFSLYLGNKLPNRLED

SEQ ID NO: 2298177 - protein, 17 aa, Cryptosporidium parvum
LIQSILWKIIKSAHKSN

SEQ ID NO: 2298178 - protein, 28 aa, Cryptosporidium parvum
LIRCLRRNGTLLIYVWAFEQKKGTVGSR

SEQ ID NO: 2298179 - protein, 20 aa, Cryptosporidium parvum
LIRETCGFSSNNECPESTLY

SEQ ID NO: 2298180 - protein, 19 aa, Cryptosporidium parvum
LIRKIAWSPCGGMIISASF

SEQ ID NO: 2298181 - protein, 17 aa, Cryptosporidium parvum
LIRLCRSVNRLTKHRNK

SEQ ID NO: 2298182 - protein, 18 aa, Cryptosporidium parvum
LIRLGPGIVPIVIQHIEN

SEQ ID NO: 2298183 - protein, 17 aa, Cryptosporidium parvum
LIRLIKISEKWCMIFIY

SEQ ID NO: 2298184 - protein, 18 aa, Cryptosporidium parvum
LIRLYIEFINAMDSKKIK

SEQ ID NO: 2298185 - protein, 19 aa, Cryptosporidium parvum
LIRMTRELVPSSLLVHQKI

SEQ ID NO: 2298186 - protein, 24 aa, Cryptosporidium parvum
LIRNIKQNFIWESIEVTWKQEESN

SEQ ID NO: 2298187 - protein, 33 aa, Cryptosporidium parvum
LIRPLKSYGRRAPEPYIGFFAMMAQRLDNDIIQ

SEQ ID NO: 2298188 - protein, 24 aa, Cryptosporidium parvum
LIRQIVQFHGFIGILSFCEEPIIQ

SEQ ID NO: 2298189 - protein, 19 aa, Cryptosporidium parvum
LIRRCRKGKLCTFAHSKEE

SEQ ID NO: 2298190 - protein, 23 aa, Cryptosporidium parvum
LIRSRFLSWRSKDYTEKEKESQK

SEQ ID NO: 2298191 - protein, 25 aa, Cryptosporidium parvum
LISDLKEWQVIDAKIIIPEILSLYT

SEQ ID NO: 2298192 - protein, 17 aa, Cryptosporidium parvum
LISFLDTLCNWYVRLNR

SEQ ID NO: 2298193 - protein, 34 aa, Cryptosporidium parvum
LISGVKGLSFLSALELRSTLSVKTPNQFLTIPKK

SEQ ID NO: 2298194 - protein, 18 aa, Cryptosporidium parvum
LISKFKTKRDFLLKNILQ

SEQ ID NO: 2298195 - protein, 17 aa, Cryptosporidium parvum
LISKMICFGLKFEDQTR

SEQ ID NO: 2298196 - protein, 21 aa, Cryptosporidium parvum
LISLPLKLRFHCENLEKQPNS

SEQ ID NO: 2298197 - protein, 27 aa, Cryptosporidium parvum
LISRLKIIRDYFICFNGDFSDLLIKNM

SEQ ID NO: 2298198 - protein, 23 aa, Cryptosporidium parvum
LISRPLPLSHEWIVWEQLNVETR

SEQ ID NO: 2298199 - protein, 18 aa, Cryptosporidium parvum
LISYKLLVECAIKIQSLL

SEQ ID NO: 2298200 - protein, 26 aa, Cryptosporidium parvum
LITEVLKRLTILGVLDDAIFDIPNSI

SEQ ID NO: 2298201 - protein, 19 aa, Cryptosporidium parvum
LITIYRCGFASSIVIQNFI

SEQ ID NO: 2298202 - protein, 30 aa, Cryptosporidium parvum
LITKFKACRVFKDAITPISNMDWSEDGDSL

SEQ ID NO: 2298203 - protein, 26 aa, Cryptosporidium parvum
LITMKSSAVSLKFKYEEEIKLEVEDG

SEQ ID NO: 2298204 - protein, 22 aa, Cryptosporidium parvum
LITSAWWSPGIDTYRIAASKMK

SEQ ID NO: 2298205 - protein, 17 aa, Cryptosporidium parvum
LITYTAINTFKHHHGDV

SEQ ID NO: 2298206 - protein, 23 aa, Cryptosporidium parvum
LIVACDTFRAGAIEQLKTHANCL

SEQ ID NO: 2298207 - protein, 17 aa, Cryptosporidium parvum
LIWCKKAYDRIEWVHDF

SEQ ID NO: 2298208 - protein, 17 aa, Cryptosporidium parvum
LIYSWKINSEEELILNG

SEQ ID NO: 2298209 - protein, 24 aa, Cryptosporidium parvum
LKAIKRLLPTVGKYIIKLTRLQRM

SEQ ID NO: 2298210 - protein, 23 aa, Cryptosporidium parvum
LKALDFRMVDFIKAAINPDTTKY

SEQ ID NO: 2298211 - protein, 20 aa, Cryptosporidium parvum
LKAPFCIHHSTGRLCIPIDT

SEQ ID NO: 2298212 - protein, 23 aa, Cryptosporidium parvum
LKAVANMCLYTPNIAVFASSHIE

SEQ ID NO: 2298213 - protein, 20 aa, Cryptosporidium parvum
LKCDEDVKIVMHSNELGVEL

SEQ ID NO: 2298214 - protein, 22 aa, Cryptosporidium parvum
LKCINTFSGTCFSLFVRWNLGI

SEQ ID NO: 2298215 - protein, 22 aa, Cryptosporidium parvum
LKCKIEGLYYGHLVSLENKTID

SEQ ID NO: 2298216 - protein, 18 aa, Cryptosporidium parvum
LKCNYPGLYSSLRPFQKV

SEQ ID NO: 2298217 - protein, 17 aa, Cryptosporidium parvum
LKDEITQGLTLIKDQIE

SEQ ID NO: 2298218 - protein, 23 aa, Cryptosporidium parvum
LKDERLQDILDLYSPGNLRGEAK

SEQ ID NO: 2298219 - protein, 22 aa, Cryptosporidium parvum
LKDLQIQVCEEVEKLLEPFKED

SEQ ID NO: 2298220 - protein, 33 aa, Cryptosporidium parvum
LKDNNWSCCNSCLRFIWTLIQYKSLRYNDIDEK

SEQ ID NO: 2298221 - protein, 23 aa, Cryptosporidium parvum
LKDPYNCLVLEWSNCGGYIYLPG

SEQ ID NO: 2298222 - protein, 25 aa, Cryptosporidium parvum
LKDSIKLFPLNGFDPLDIPNVGYSS

SEQ ID NO: 2298223 - protein, 21 aa, Cryptosporidium parvum
LKDSMSRRFEWLLDKNFTNKI

SEQ ID NO: 2298224 - protein, 28 aa, Cryptosporidium parvum
LKDSQSFPLCIFKSNIITSKNHPLEGRS

SEQ ID NO: 2298225 - protein, 24 aa, Cryptosporidium parvum
LKDTGNCIPLKFNSKKGKEDFLNF

SEQ ID NO: 2298226 - protein, 31 aa, Cryptosporidium parvum
LKDYQRYGVHWLLCAFSIKGGAILADEMGLG

SEQ ID NO: 2298227 - protein, 17 aa, Cryptosporidium parvum
LKDYRVVTIRVACRLLI

SEQ ID NO: 2298228 - protein, 20 aa, Cryptosporidium parvum
LKEAEDLALIVLRQVMEEKI

SEQ ID NO: 2298229 - protein, 17 aa, Cryptosporidium parvum
LKEALRKAFKARTSLLL

SEQ ID NO: 2298230 - protein, 27 aa, Cryptosporidium parvum
LKEAQSLLRFPPEWRSLNNEEVLGHSP

SEQ ID NO: 2298231 - protein, 17 aa, Cryptosporidium parvum
LKEARDLGVSDLQNVKK

SEQ ID NO: 2298232 - protein, 18 aa, Cryptosporidium parvum
LKEDVRVSRIKIRNFENE

SEQ ID NO: 2298233 - protein, 29 aa, Cryptosporidium parvum
LKEDYKILIGKCLPFFTARDNYMNLFFSN

SEQ ID NO: 2298234 - protein, 18 aa, Cryptosporidium parvum
LKEEELYNSLIMELNDWK

SEQ ID NO: 2298235 - protein, 20 aa, Cryptosporidium parvum
LKEEHKIFLETALIPLHKAK

SEQ ID NO: 2298236 - protein, 17 aa, Cryptosporidium parvum
LKEENAWGIVRALVDLL

SEQ ID NO: 2298237 - protein, 17 aa, Cryptosporidium parvum
LKEFIPIRLEMYEKRKN

SEQ ID NO: 2298238 - protein, 31 aa, Cryptosporidium parvum; identical to SEQ ID NO: 2176329

SEQ ID NO: 2298239 - protein, 17 aa, Cryptosporidium parvum
LKEILPCGIGIHHAGLV

SEQ ID NO: 2298240 - protein, 20 aa, Cryptosporidium parvum
LKEKIEMAGSASERTSMNSS

SEQ ID NO: 2298241 - protein, 19 aa, Cryptosporidium parvum
LKEKVGMKINCDRNLSNVI

SEQ ID NO: 2298242 - protein, 23 aa, Cryptosporidium parvum
LKELGPRISMRLVKVVDEVCDGA

SEQ ID NO: 2298243 - protein, 17 aa, Cryptosporidium parvum
LKELKGFELKRRGELQL

SEQ ID NO: 2298244 - protein, 17 aa, Cryptosporidium parvum
LKELLTFGNRVEKMDVD

SEQ ID NO: 2298245 - protein, 18 aa, Cryptosporidium parvum
LKELNNFCFIVKEVDFEN

SEQ ID NO: 2298246 - protein, 18 aa, Cryptosporidium parvum
LKELPKLETLSLLLNPIA

SEQ ID NO: 2298247 - protein, 24 aa, Cryptosporidium parvum
LKELVQRGPHEWPGATSIIQEDGT

SEQ ID NO: 2298248 - protein, 26 aa, Cryptosporidium parvum
LKENPRKVCLMDAVLKEGELEEEPIN

SEQ ID NO: 2298249 - protein, 19 aa, Cryptosporidium parvum
LKENYKLTIEDCSSDIKVL

SEQ ID NO: 2298250 - protein, 25 aa, Cryptosporidium parvum
LKESYIGRVCLFDIIENLQVFIDDI

SEQ ID NO: 2298251 - protein, 25 aa, Cryptosporidium parvum
LKETCIKRPKFRLIVTSATLEADKF

SEQ ID NO: 2298252 - protein, 18 aa, Cryptosporidium parvum
LKETILFVIQALAVPAIE

SEQ ID NO: 2298253 - protein, 23 aa, Cryptosporidium parvum
LKEYSLKGLMEFMNGFSPKSQWK

SEQ ID NO: 2298254 - protein, 17 aa, Cryptosporidium parvum
LKFAEFLNLLNYNISKY

SEQ ID NO: 2298255 - protein, 22 aa, Cryptosporidium parvum
LKFDLPNKWRFFYLNITNYEIV

SEQ ID NO: 2298256 - protein, 34 aa, Cryptosporidium parvum; identical to SEQ ID NO: 2176344

SEQ ID NO: 2298257 - protein, 27 aa, Cryptosporidium parvum
LKFINKWYLPNNMCLFIVGDIPASNEL

SEQ ID NO: 2298258 - protein, 26 aa, Cryptosporidium parvum
LKFIYCVLRVKIEWINEYLKYIACNI

SEQ ID NO: 2298259 - protein, 35 aa, Cryptosporidium parvum
LKFKHLEFFNTLLIRLEKFLSWIAKNNIQDYGVNY

SEQ ID NO: 2298260 - protein, 20 aa, Cryptosporidium parvum
LKFNHLRTSFLLEHISNKSA

SEQ ID NO: 2298261 - protein, 17 aa, Cryptosporidium parvum
LKFVSEFIKSQIDSSDN

SEQ ID NO: 2298262 - protein, 19 aa, Cryptosporidium parvum
LKFVTLIESKLLKDIKDFL

SEQ ID NO: 2298263 - protein, 21 aa, Cryptosporidium parvum
LKFYSLNPFDFVRPSILSILS

SEQ ID NO: 2298264 - protein, 23 aa, Cryptosporidium parvum
LKGKAYRWLKIVQEHWAMQDRFC

SEQ ID NO: 2298265 - protein, 19 aa, Cryptosporidium parvum
LKGKEVIKNTKNRHRTSSL

SEQ ID NO: 2298266 - protein, 23 aa, Cryptosporidium parvum
LKGKKRRDTICIVLVDPDLEEGK

SEQ ID NO: 2298267 - protein, 22 aa, Cryptosporidium parvum
LKGLVMDLRYLMSPWSAIKLQE

SEQ ID NO: 2298268 - protein, 24 aa, Cryptosporidium parvum
LKGNKICGINAFRTDNEISHDDRH

SEQ ID NO: 2298269 - protein, 21 aa, Cryptosporidium parvum
LKGNREMMNFDISLVKQSLDC

SEQ ID NO: 2298270 - protein, 20 aa, Cryptosporidium parvum
LKGRDIHSLSYWYIPNSVKH

SEQ ID NO: 2298271 - protein, 19 aa, Cryptosporidium parvum
LKGRIRIGSKSIIIEPDDS

SEQ ID NO: 2298272 - protein, 17 aa, Cryptosporidium parvum
LKGRPIRVGRPTNAASS

SEQ ID NO: 2298273 - protein, 23 aa, Cryptosporidium parvum
LKGSKCRLYLFGEVFEQFQNELI

SEQ ID NO: 2298274 - protein, 19 aa, Cryptosporidium parvum
LKHADPILKVSIVPRTGGA

SEQ ID NO: 2298275 - protein, 24 aa, Cryptosporidium parvum
LKHARSKSVASFIGIDMTGPSSYI

SEQ ID NO: 2298276 - protein, 17 aa, Cryptosporidium parvum
LKHDEKPIWSFFIGSQD

SEQ ID NO: 2298277 - protein, 17 aa, Cryptosporidium parvum
LKHIFHLAGVLSDSNIE

SEQ ID NO: 2298278 - protein, 25 aa, Cryptosporidium parvum
LKHLSLKKSGSWNDFLSFLYSKGHS

SEQ ID NO: 2298279 - protein, 18 aa, Cryptosporidium parvum
LKHVFAILSGAEPIRKTT

SEQ ID NO: 2298280 - protein, 19 aa, Cryptosporidium parvum
LKHWNEYGGMSPEEHEEFV

SEQ ID NO: 2298281 - protein, 18 aa, Cryptosporidium parvum
LKIDIKKFQFSIGKETIR

SEQ ID NO: 2298282 - protein, 30 aa, Cryptosporidium parvum; identical to SEQ ID NO: 2176368

SEQ ID NO: 2298283 - protein, 39 aa, Cryptosporidium parvum; identical to SEQ ID NO: 2176369

SEQ ID NO: 2298284 - protein, 18 aa, Cryptosporidium parvum
LKIIIPLMKYMEPVYLRW

SEQ ID NO: 2298285 - protein, 17 aa, Cryptosporidium parvum
LKIKRGINGMIKDWNII

SEQ ID NO: 2298286 - protein, 17 aa, Cryptosporidium parvum
LKINNCISKNVINDNLA

SEQ ID NO: 2298287 - protein, 24 aa, Cryptosporidium parvum
LKINQEYYNILLILIFHTKRESLL

SEQ ID NO: 2298288 - protein, 17 aa, Cryptosporidium parvum
LKIPFNSFEEIKQEIYN

SEQ ID NO: 2298289 - protein, 23 aa, Cryptosporidium parvum
LKIPKLTVCALRFTETARKHIEK

SEQ ID NO: 2298290 - protein, 20 aa, Cryptosporidium parvum
LKIQGGGALARLVRKNKDKL

SEQ ID NO: 2298291 - protein, 20 aa, Cryptosporidium parvum
LKIQNCLKVIGINDNEAKLR

SEQ ID NO: 2298292 - protein, 22 aa, Cryptosporidium parvum
LKIRDGYSLFKIVFSGDTATPC

SEQ ID NO: 2298293 - protein, 18 aa, Cryptosporidium parvum
LKIRHEIFSNLAENGPEY

SEQ ID NO: 2298294 - protein, 17 aa, Cryptosporidium parvum
LKIRIFAYSKCISNANE

SEQ ID NO: 2298295 - protein, 19 aa, Cryptosporidium parvum
LKIRIPKSLWEYWEAFAND

SEQ ID NO: 2298296 - protein, 28 aa, Cryptosporidium parvum
LKISLIQIFRAHLWQKIHESIVMDICQV

SEQ ID NO: 2298297 - protein, 24 aa, Cryptosporidium parvum
LKISRDICCGMAYLHENGVLHCDL

SEQ ID NO: 2298298 - protein, 32 aa, Cryptosporidium parvum; identical to SEQ ID NO: 2176381

SEQ ID NO: 2298299 - protein, 27 aa, Cryptosporidium parvum
LKKAAEISRPLSLQAYADVLTHLISAQ

SEQ ID NO: 2298300 - protein, 25 aa, Cryptosporidium parvum
LKKACSIRKIKIYFCPINEMEIRKN

SEQ ID NO: 2298301 - protein, 19 aa, Cryptosporidium parvum
LKKAFLKAAEGLDESEDEL

SEQ ID NO: 2298302 - protein, 26 aa, Cryptosporidium parvum
LKKDPVQRLLILLAHVYLTKPMTRNS

SEQ ID NO: 2298303 - protein, 23 aa, Cryptosporidium parvum
LKKFFKPRYSYGLPDMNGPNFRV

SEQ ID NO: 2298304 - protein, 19 aa, Cryptosporidium parvum
LKKGCKGSMSIQNGLEKAK

SEQ ID NO: 2298305 - protein, 17 aa, Cryptosporidium parvum
LKKGVTIDVEKKEVLVK

SEQ ID NO: 2298306 - protein, 17 aa, Cryptosporidium parvum
LKKHCCIPSTSLSSTSV

SEQ ID NO: 2298307 - protein, 21 aa, Cryptosporidium parvum
LKKIQELAEDFSIKRQKKYTE

SEQ ID NO: 2298308 - protein, 18 aa, Cryptosporidium parvum
LKKIRDIEEYRKLRKQGN

SEQ ID NO: 2298309 - protein, 25 aa, Cryptosporidium parvum
LKKKERRKVIIAAILEEAKRRKLAE

SEQ ID NO: 2298310 - protein, 20 aa, Cryptosporidium parvum
LKKKETILITGINKKFVLED

SEQ ID NO: 2298311 - protein, 20 aa, Cryptosporidium parvum
LKKKLQVFLASPLCKESYNE

SEQ ID NO: 2298312 - protein, 31 aa, Cryptosporidium parvum; identical to SEQ ID NO: 2176395

SEQ ID NO: 2298313 - protein, 17 aa, Cryptosporidium parvum
LKKLALTCVAYHLNDAD

SEQ ID NO: 2298314 - protein, 22 aa, Cryptosporidium parvum
LKKLLGLGLCNSFDDIAAGNGK

SEQ ID NO: 2298315 - protein, 17 aa, Cryptosporidium parvum
LKKLLIERNQLEMQKEY

SEQ ID NO: 2298316 - protein, 18 aa, Cryptosporidium parvum
LKKLVPIMDLQKEFESRQ

SEQ ID NO: 2298317 - protein, 26 aa, Cryptosporidium parvum
LKKRSFPTEFMKLMVIDEADEMIDHR

SEQ ID NO: 2298318 - protein, 25 aa, Cryptosporidium parvum
LKKRVCGYLYDYLCDDEISEILYNS

SEQ ID NO: 2298319 - protein, 28 aa, Cryptosporidium parvum
LKKSAYNGICFRSGMYIGSNSFVVVPHR

SEQ ID NO: 2298320 - protein, 21 aa, Cryptosporidium parvum
LKKVRSFCGWRQDTFPGSQPV

SEQ ID NO: 2298321 - protein, 25 aa, Cryptosporidium parvum
LKLDLFKIGLFLLQGKTKKAVQYIN

SEQ ID NO: 2298322 - protein, 17 aa, Cryptosporidium parvum
LKLEDKLNLELLGDENQ

SEQ ID NO: 2298323 - protein, 22 aa, Cryptosporidium parvum
LKLEEFGLHFTLEKLFGDVPGL

SEQ ID NO: 2298324 - protein, 21 aa, Cryptosporidium parvum
LKLEVFLVFKSGLDPNSELFE

SEQ ID NO: 2298325 - protein, 20 aa, Cryptosporidium parvum
LKLGCKRLILVGDPKQLPAT

SEQ ID NO: 2298326 - protein, 19 aa, Cryptosporidium parvum
LKLGLILPKPNQFVSTDFS

SEQ ID NO: 2298327 - protein, 20 aa, Cryptosporidium parvum
LKLGSKTRCISRIIENLNLI

SEQ ID NO: 2298328 - protein, 17 aa, Cryptosporidium parvum
LKLGSSSSIEWNPSGVE

SEQ ID NO: 2298329 - protein, 17 aa, Cryptosporidium parvum
LKLGTSWIGESKNDSIY

SEQ ID NO: 2298330 - protein, 25 aa, Cryptosporidium parvum
LKLHAYLEFWGLINFQADIKTLPPK

SEQ ID NO: 2298331 - protein, 17 aa, Cryptosporidium parvum
LKLIPKVGIGKNLKIEK

SEQ ID NO: 2298332 - protein, 18 aa, Cryptosporidium parvum
LKLIPNIRIQLGKYFPLS

SEQ ID NO: 2298333 - protein, 19 aa, Cryptosporidium parvum
LKLKEKFLEFNRQTLESSS

SEQ ID NO: 2298334 - protein, 23 aa, Cryptosporidium parvum
LKLKQKECLDYSSKIQQIELDMR

SEQ ID NO: 2298335 - protein, 20 aa, Cryptosporidium parvum
LKLLPQFKGLSVGEKVQVLF

SEQ ID NO: 2298336 - protein, 24 aa, Cryptosporidium parvum
LKLLSPKSHLFCLVHKMDKLSAIE

SEQ ID NO: 2298337 - protein, 17 aa, Cryptosporidium parvum
LKLMKSVHLTKDRIEFM

SEQ ID NO: 2298338 - protein, 18 aa, Cryptosporidium parvum
LKLNQLKHELNFKFISSS

SEQ ID NO: 2298339 - protein, 18 aa, Cryptosporidium parvum
LKLPDIYRAVGVNSPCGV

SEQ ID NO: 2298340 - protein, 27 aa, Cryptosporidium parvum
LKLQGTCKGHLSGVWQSSFSPIEKIVA

SEQ ID NO: 2298341 - protein, 20 aa, Cryptosporidium parvum
LKLQKKLLFFVTGSDRVPMK

SEQ ID NO: 2298342 - protein, 17 aa, Cryptosporidium parvum
LKLQSLYSAFKIDDNLI

SEQ ID NO: 2298343 - protein, 19 aa, Cryptosporidium parvum
LKLSESLEDLNGLNNINNE

SEQ ID NO: 2298344 - protein, 23 aa, Cryptosporidium parvum
LKLVEFRVGIQLLEDLFELLGIN

SEQ ID NO: 2298345 - protein, 20 aa, Cryptosporidium parvum
LKLVFERLLQLVGINDIFLH

SEQ ID NO: 2298346 - protein, 27 aa, Cryptosporidium parvum
LKLWLLCWPSPISLCSIDERFRQTVLE

SEQ ID NO: 2298347 - protein, 33 aa, Cryptosporidium parvum
LKLYISLNSQNYWKLLLRQPAINILKMASIDEI

SEQ ID NO: 2298348 - protein, 17 aa, Cryptosporidium parvum
LKLYKIELGTLEMKNLS

SEQ ID NO: 2298349 - protein, 28 aa, Cryptosporidium parvum
LKLYVASCYYFGDISTFLPIGAKSIQRK

SEQ ID NO: 2298350 - protein, 25 aa, Cryptosporidium parvum
LKMHERWTKCYLTNVSLSFHCTFFY

SEQ ID NO: 2298351 - protein, 18 aa, Cryptosporidium parvum
LKMIRELSKKMVANSNNF

SEQ ID NO: 2298352 - protein, 23 aa, Cryptosporidium parvum
LKMLFESVAVLPLIDQWVKGKYF

SEQ ID NO: 2298353 - protein, 21 aa, Cryptosporidium parvum
LKMNIASAIFIQLASKSMKEY

SEQ ID NO: 2298354 - protein, 19 aa, Cryptosporidium parvum
LKMSIRIWKERMLKEERYR

SEQ ID NO: 2298355 - protein, 23 aa, Cryptosporidium parvum
LKNACKRNVILAGDFNIILEKID

SEQ ID NO: 2298356 - protein, 18 aa, Cryptosporidium parvum
LKNDLKLIQIFERETKSM

SEQ ID NO: 2298357 - protein, 27 aa, Cryptosporidium parvum
LKNDLLINIWINYDFIQMFMIPSSFSC

SEQ ID NO: 2298358 - protein, 18 aa, Cryptosporidium parvum
LKNELSLLLSGEESVTAP

SEQ ID NO: 2298359 - protein, 17 aa, Cryptosporidium parvum
LKNGSILFISSCNSTPE

SEQ ID NO: 2298360 - protein, 18 aa, Cryptosporidium parvum
LKNIRIVKKLGGTVEDTE

SEQ ID NO: 2298361 - protein, 19 aa, Cryptosporidium parvum
LKNKKIISEDSCVNSKDNI

SEQ ID NO: 2298362 - protein, 20 aa, Cryptosporidium parvum
LKNLLLPLFQSYPQIFYLIS

SEQ ID NO: 2298363 - protein, 18 aa, Cryptosporidium parvum
LKNLRNLQTLYLERNPIQ

SEQ ID NO: 2298364 - protein, 20 aa, Cryptosporidium parvum
LKNPAIEVSFGFDTAARTYA

SEQ ID NO: 2298365 - protein, 19 aa, Cryptosporidium parvum
LKNPLPLKVTKIRVNDLEM

SEQ ID NO: 2298366 - protein, 24 aa, Cryptosporidium parvum
LKNQCPKCRLNFQDTNVVLIVPDN

SEQ ID NO: 2298367 - protein, 17 aa, Cryptosporidium parvum
LKNRIVIELPCRGKSWN

SEQ ID NO: 2298368 - protein, 19 aa, Cryptosporidium parvum
LKNRMPIDVTKLAFLQENP

SEQ ID NO: 2298369 - protein, 18 aa, Cryptosporidium parvum
LKNSLKIEKSENYTIPFI

SEQ ID NO: 2298370 - protein, 18 aa, Cryptosporidium parvum
LKNSNCSTFESIYISATE

SEQ ID NO: 2298371 - protein, 23 aa, Cryptosporidium parvum
LKNSNEGFAIAINRNNDEAIIQV

SEQ ID NO: 2298372 - protein, 26 aa, Cryptosporidium parvum
LKNSRIRSNIFYWEYVTKSFETWGRQ

SEQ ID NO: 2298373 - protein, 18 aa, Cryptosporidium parvum
LKPAPLITKNAMIGKSPK

SEQ ID NO: 2298374 - protein, 21 aa, Cryptosporidium parvum
LKPGSKFQIGELVWVNYKCTF

SEQ ID NO: 2298375 - protein, 22 aa, Cryptosporidium parvum
LKPKMCLKKCFDGRVFDPMNPL

SEQ ID NO: 2298376 - protein, 30 aa, Cryptosporidium parvum; identical to SEQ ID NO: 2176444

SEQ ID NO: 2298377 - protein, 17 aa, Cryptosporidium parvum
LKPPEGEIIVMNYRISK

SEQ ID NO: 2298378 - protein, 19 aa, Cryptosporidium parvum
LKPTCIILCTRAHLPVISF

SEQ ID NO: 2298379 - protein, 19 aa, Cryptosporidium parvum
LKPYYKLNLVNSLWNDILK

SEQ ID NO: 2298380 - protein, 18 aa, Cryptosporidium parvum
LKQEIIEVVFSYWDGSGH

SEQ ID NO: 2298381 - protein, 20 aa, Cryptosporidium parvum
LKQIERYGSNLSYLSNNYNN

SEQ ID NO: 2298382 - protein, 19 aa, Cryptosporidium parvum
LKQKHYDRAFAIAISADQS

SEQ ID NO: 2298383 - protein, 20 aa, Cryptosporidium parvum
LKQKIKFMADLISEFQNKES

SEQ ID NO: 2298384 - protein, 22 aa, Cryptosporidium parvum
LKQKIQAFVCIGTVAGGHFHSW

SEQ ID NO: 2298385 - protein, 20 aa, Cryptosporidium parvum
LKQLIEIGNELTIYEMTILQ

SEQ ID NO: 2298386 - protein, 28 aa, Cryptosporidium parvum
LKQVAVRICTLLKVWRISTQTDIADNLI

SEQ ID NO: 2298387 - protein, 17 aa, Cryptosporidium parvum
LKREILIMKRLDHPNII

SEQ ID NO: 2298388 - protein, 19 aa, Cryptosporidium parvum
LKRKEHPICYDGFEPSGRM

SEQ ID NO: 2298389 - protein, 19 aa, Cryptosporidium parvum
LKRKSLIELQQWYLENDFS

SEQ ID NO: 2298390 - protein, 25 aa, Cryptosporidium parvum
LKRMLKGEMMVPMTPWYKSFKGKIF

SEQ ID NO: 2298391 - protein, 24 aa, Cryptosporidium parvum
LKRPIKKIEYMIGGNQTRNSSNTK

SEQ ID NO: 2298392 - protein, 19 aa, Cryptosporidium parvum
LKRQLTGHVVTRWYRAPEL

SEQ ID NO: 2298393 - protein, 18 aa, Cryptosporidium parvum
LKRVSSMFSSTLPINIYL

SEQ ID NO: 2298394 - protein, 26 aa, Cryptosporidium parvum
LKRVYFRPRNCQCIRKSEEILSLSPI

SEQ ID NO: 2298395 - protein, 22 aa, Cryptosporidium parvum
LKSFHSPCIIKRMESLTSTPVT

SEQ ID NO: 2298396 - protein, 24 aa, Cryptosporidium parvum
LKSIKRLLKVWCMEMCPEEYLDAG

SEQ ID NO: 2298397 - protein, 25 aa, Cryptosporidium parvum
LKSISCWNLHSRILFLKKITKTLSI

SEQ ID NO: 2298398 - protein, 20 aa, Cryptosporidium parvum
LKSKCRQVDLAVSRQVEIEI

SEQ ID NO: 2298399 - protein, 23 aa, Cryptosporidium parvum
LKSKMPFVIDVFVLYCIERYTGK

SEQ ID NO: 2298400 - protein, 21 aa, Cryptosporidium parvum
LKSLCEFTNRFIIVSTSKGSK

SEQ ID NO: 2298401 - protein, 19 aa, Cryptosporidium parvum
LKSLEEILIRNGEKSISEI

SEQ ID NO: 2298402 - protein, 24 aa, Cryptosporidium parvum
LKSLFSLKTLKWIFVGGKGGVGKT

SEQ ID NO: 2298403 - protein, 22 aa, Cryptosporidium parvum
LKSLKEGSCHTALVGGVNLMLS

SEQ ID NO: 2298404 - protein, 19 aa, Cryptosporidium parvum
LKSLRRYYVSPLLKKIALT

SEQ ID NO: 2298405 - protein, 20 aa, Cryptosporidium parvum
LKSLRSNLDLEFLKNENDVE

SEQ ID NO: 2298406 - protein, 18 aa, Cryptosporidium parvum
LKSMETIQLIPLDTNEGC

SEQ ID NO: 2298407 - protein, 20 aa, Cryptosporidium parvum
LKSNEIYSALVEISAQKVQD

SEQ ID NO: 2298408 - protein, 20 aa, Cryptosporidium parvum
LKSPIPRQFLSEVNKRFPTL

SEQ ID NO: 2298409 - protein, 26 aa, Cryptosporidium parvum
LKSPIVFKPKLETFFGGKNKVVEVES

SEQ ID NO: 2298410 - protein, 26 aa, Cryptosporidium parvum
LKSRITALKSLIGYLIKLDSKKKFLI

SEQ ID NO: 2298411 - protein, 21 aa, Cryptosporidium parvum
LKSSEFMDFFSRASRLIERAL

SEQ ID NO: 2298412 - protein, 18 aa, Cryptosporidium parvum
LKSSEMINEVEGSKKNII

SEQ ID NO: 2298413 - protein, 17 aa, Cryptosporidium parvum
LKSSRIYDEYQFVTQEQ

SEQ ID NO: 2298414 - protein, 19 aa, Cryptosporidium parvum
LKSTFKVEGPHIILTPRST

SEQ ID NO: 2298415 - protein, 20 aa, Cryptosporidium parvum
LKTGLIRFPVEIIKDEFESL

SEQ ID NO: 2298416 - protein, 19 aa, Cryptosporidium parvum
LKTGSIYIYSIKGGNLLIN

SEQ ID NO: 2298417 - protein, 21 aa, Cryptosporidium parvum
LKTGYLYVYRFSNGMPIICKD

SEQ ID NO: 2298418 - protein, 22 aa, Cryptosporidium parvum
LKTNRDIEGREKLESSIPASDN

SEQ ID NO: 2298419 - protein, 25 aa, Cryptosporidium parvum
LKTQCKRDGVKMILSNQIRLLEEKQ

SEQ ID NO: 2298420 - protein, 19 aa, Cryptosporidium parvum
LKTQLFIGCLFEHIESQAQ

SEQ ID NO: 2298421 - protein, 17 aa, Cryptosporidium parvum
LKTSGIGSFSVFASGSF

SEQ ID NO: 2298422 - protein, 17 aa, Cryptosporidium parvum
LKTSSKNWFCFQCLSLT

SEQ ID NO: 2298423 - protein, 29 aa, Cryptosporidium parvum
LKTVKSIISWLYVNGCIEVKYSIDAPNDN

SEQ ID NO: 2298424 - protein, 28 aa, Cryptosporidium parvum
LKVDRMIIGGGMAFTFKKVMDNMQIGKS

SEQ ID NO: 2298425 - protein, 19 aa, Cryptosporidium parvum
LKVGAIYWHGKDIKCRPIL

SEQ ID NO: 2298426 - protein, 18 aa, Cryptosporidium parvum
LKVGVSYLEQFINLQIED

SEQ ID NO: 2298427 - protein, 20 aa, Cryptosporidium parvum
LKVHGGGYVIDIERARVSGR

SEQ ID NO: 2298428 - protein, 17 aa, Cryptosporidium parvum
LKVLIGYVALLKDSGEE

SEQ ID NO: 2298429 - protein, 22 aa, Cryptosporidium parvum
LKWELKHFKGFELAHGKKMYLT

SEQ ID NO: 2298430 - protein, 26 aa, Cryptosporidium parvum
LKWKSFVMVLKCCFSLLQRGNQLNEQ

SEQ ID NO: 2298431 - protein, 17 aa, Cryptosporidium parvum
LKYCEHLSEKINSLHGT

SEQ ID NO: 2298432 - protein, 19 aa, Cryptosporidium parvum
LKYICKHVKFLNNTSLSKN

SEQ ID NO: 2298433 - protein, 23 aa, Cryptosporidium parvum
LKYKKAIKMIKCIQVKKLNNIII

SEQ ID NO: 2298434 - protein, 20 aa, Cryptosporidium parvum
LKYNGFYILYAKSNKPDSQW

SEQ ID NO: 2298435 - protein, 18 aa, Cryptosporidium parvum
LKYNILKESLIKEASGSI

SEQ ID NO: 2298436 - protein, 17 aa, Cryptosporidium parvum
LKYNIMLIINYLLNIGF

SEQ ID NO: 2298437 - protein, 20 aa, Cryptosporidium parvum
LKYTIVIAATASNAASLQFL

SEQ ID NO: 2298438 - protein, 23 aa, Cryptosporidium parvum
LKYWRQILDGIIVRHRRITRSPK

SEQ ID NO: 2298439 - protein, 18 aa, Cryptosporidium parvum
LLARRSAIVNSDFNHTLK

SEQ ID NO: 2298440 - protein, 24 aa, Cryptosporidium parvum
LLASCKASAIPVKDFKESIERFLT

SEQ ID NO: 2298441 - protein, 17 aa, Cryptosporidium parvum
LLASELFDVPRDSGVAY

SEQ ID NO: 2298442 - protein, 30 aa, Cryptosporidium parvum; identical to SEQ ID NO: 2176511

SEQ ID NO: 2298443 - protein, 18 aa, Cryptosporidium parvum
LLCGYNLALRGHGDIPRR

SEQ ID NO: 2298444 - protein, 35 aa, Cryptosporidium parvum
LLCPCQCRGSIKFVHLECLRHWINGRLNLANENGS

SEQ ID NO: 2298445 - protein, 19 aa, Cryptosporidium parvum
LLCPLCMTPQCFGRGNSPP

SEQ ID NO: 2298446 - protein, 17 aa, Cryptosporidium parvum
LLCSLCQSIELNERLIV

SEQ ID NO: 2298447 - protein, 18 aa, Cryptosporidium parvum
LLCYCFQNVHIVKPIMSK

SEQ ID NO: 2298448 - protein, 19 aa, Cryptosporidium parvum
LLDALKFIHKNGIIHRDLK

SEQ ID NO: 2298449 - protein, 20 aa, Cryptosporidium parvum
LLDKCGFTGAPYMDRIRTLK

SEQ ID NO: 2298450 - protein, 23 aa, Cryptosporidium parvum
LLDLELPHLILLTNFPKTFIGGL

SEQ ID NO: 2298451 - protein, 18 aa, Cryptosporidium parvum
LLDSTGIKGPKEFETKQG

SEQ ID NO: 2298452 - protein, 20 aa, Cryptosporidium parvum
LLDYKVTAGCTIHMVLQLRG

SEQ ID NO: 2298453 - protein, 17 aa, Cryptosporidium parvum
LLDYSYLEDIKEIIQKE

SEQ ID NO: 2298454 - protein, 17 aa, Cryptosporidium parvum
LLEEAMILHKLRHPNIV

SEQ ID NO: 2298455 - protein, 19 aa, Cryptosporidium parvum
LLEEFPKLHDLFQAVMSYP

SEQ ID NO: 2298456 - protein, 17 aa, Cryptosporidium parvum
LLEEYSVGLGVKSKISF

SEQ ID NO: 2298457 - protein, 21 aa, Cryptosporidium parvum
LLEGYSTIFILGELPEVKNRC

SEQ ID NO: 2298458 - protein, 24 aa, Cryptosporidium parvum
LLEIKRNYSELTHLFNELNCNEEN

SEQ ID NO: 2298459 - protein, 24 aa, Cryptosporidium parvum
LLEISYKLLNEWNANSSIITYKVT

SEQ ID NO: 2298460 - protein, 28 aa, Cryptosporidium parvum
LLEKKKKCWWDSCFLGESKLDLSQVQGR

SEQ ID NO: 2298461 - protein, 29 aa, Cryptosporidium parvum
LLENLRKDPNFELFIYPIDPVRDGCLDYF

SEQ ID NO: 2298462 - protein, 19 aa, Cryptosporidium parvum
LLEQCICNGYNVPGYGKIP

SEQ ID NO: 2298463 - protein, 18 aa, Cryptosporidium parvum
LLEQRPLITSGYECIIHC

SEQ ID NO: 2298464 - protein, 18 aa, Cryptosporidium parvum
LLERCLKLVKKVQEYEKE

SEQ ID NO: 2298465 - protein, 17 aa, Cryptosporidium parvum
LLESGADCRAKTSSGCT

SEQ ID NO: 2298466 - protein, 17 aa, Cryptosporidium parvum
LLETKGFSLSSLLRLVE

SEQ ID NO: 2298467 - protein, 21 aa, Cryptosporidium parvum
LLEVTNYHFLIWISSREISIY

SEQ ID NO: 2298468 - protein, 19 aa, Cryptosporidium parvum
LLEYRICGVKLYQNPPYTS

SEQ ID NO: 2298469 - protein, 17 aa, Cryptosporidium parvum
LLFAFGYDKDMSKVLDL

SEQ ID NO: 2298470 - protein, 18 aa, Cryptosporidium parvum
LLFGENLLLRFFNVIKKE

SEQ ID NO: 2298471 - protein, 22 aa, Cryptosporidium parvum
LLFKSTEFSSVFKTTIDHFCLE

SEQ ID NO: 2298472 - protein, 19 aa, Cryptosporidium parvum
LLFLYKFRLSNSYRTNMNV

SEQ ID NO: 2298473 - protein, 18 aa, Cryptosporidium parvum
LLFRRYLEKNDRYIHADI

SEQ ID NO: 2298474 - protein, 17 aa, Cryptosporidium parvum
LLFRWDKKSLPPDLHRL

SEQ ID NO: 2298475 - protein, 19 aa, Cryptosporidium parvum
LLGARRFQVNVTWQQQSST

SEQ ID NO: 2298476 - protein, 17 aa, Cryptosporidium parvum
LLGFELQDAIALLRLDD

SEQ ID NO: 2298477 - protein, 26 aa, Cryptosporidium parvum
LLGKFSPRWFIFKGTNLAVFHSAHEE

SEQ ID NO: 2298478 - protein, 17 aa, Cryptosporidium parvum
LLGLEVGASTKEIKSSF

SEQ ID NO: 2298479 - protein, 20 aa, Cryptosporidium parvum
LLGLVIKMRICCSHPRGLVA

SEQ ID NO: 2298480 - protein, 26 aa, Cryptosporidium parvum
LLGQFEMMGIPPAPRGVPQIEVTFDI

SEQ ID NO: 2298481 - protein, 23 aa, Cryptosporidium parvum
LLGWVKDRCIVFVGETRYFFLVL

SEQ ID NO: 2298482 - protein, 29 aa, Cryptosporidium parvum
LLHKCSNVLFRFKPMHHYNIYQLSSEMKL

SEQ ID NO: 2298483 - protein, 19 aa, Cryptosporidium parvum
LLIDLLRFICNELQIYKII

SEQ ID NO: 2298484 - protein, 18 aa, Cryptosporidium parvum
LLIEWLIYNFHMNSRNLQ

SEQ ID NO: 2298485 - protein, 33 aa, Cryptosporidium parvum
LLIHCSECPTTFCIDCFPPEYARHQVLDSFFEN

SEQ ID NO: 2298486 - protein, 17 aa, Cryptosporidium parvum
LLIKGEAPLVLVEKNSN

SEQ ID NO: 2298487 - protein, 26 aa, Cryptosporidium parvum
LLIPKWYDFCKIKYFKSLIILQLKFQ

SEQ ID NO: 2298488 - protein, 21 aa, Cryptosporidium parvum
LLIQKSCPLFENYGICHLGLN

SEQ ID NO: 2298489 - protein, 17 aa, Cryptosporidium parvum
LLISRKNFDTRREQFEH

SEQ ID NO: 2298490 - protein, 25 aa, Cryptosporidium parvum
LLKAHSIGPPFLVRLMRYNLLENKF

SEQ ID NO: 2298491 - protein, 19 aa, Cryptosporidium parvum
LLKDNVAVVILLEYRQNDL

SEQ ID NO: 2298492 - protein, 18 aa, Cryptosporidium parvum
LLKDPKLYSSPHNISKAL

SEQ ID NO: 2298493 - protein, 17 aa, Cryptosporidium parvum
LLKEKNNECGIINLEEE

SEQ ID NO: 2298494 - protein, 39 aa, Cryptosporidium parvum
LLKKEGYDGCTVVGSDCLCWRCYFNQRPFFEEMDYSRIP

SEQ ID NO: 2298495 - protein, 17 aa, Cryptosporidium parvum
LLKKTIRSPQRILRSDF

SEQ ID NO: 2298496 - protein, 30 aa, Cryptosporidium parvum
LLKNITFRLKEEFPGRFLIAEVVPENPNYL

SEQ ID NO: 2298497 - protein, 17 aa, Cryptosporidium parvum
LLKQEFEQKINFKDYNI

SEQ ID NO: 2298498 - protein, 17 aa, Cryptosporidium parvum
LLKRKSDALSNKFRGML

SEQ ID NO: 2298499 - protein, 25 aa, Cryptosporidium parvum
LLKRNWKINPLLSINIRNQLEKYAR

SEQ ID NO: 2298500 - protein, 22 aa, Cryptosporidium parvum
LLKSLCFTDNNLLRAAGLEGLC

SEQ ID NO: 2298501 - protein, 20 aa, Cryptosporidium parvum
LLKSVLRKKGLNKLPPSIDL

SEQ ID NO: 2298502 - protein, 20 aa, Cryptosporidium parvum
LLKYCIEFFESVSVPLDIQN

SEQ ID NO: 2298503 - protein, 20 aa, Cryptosporidium parvum
LLLAPNCHRDQAFSIVIDMD

SEQ ID NO: 2298504 - protein, 25 aa, Cryptosporidium parvum
LLLEGFRLGCKHALYYSIRSTLTIF

SEQ ID NO: 2298505 - protein, 18 aa, Cryptosporidium parvum
LLLFDLAINMYQKYTHLS

SEQ ID NO: 2298506 - protein, 17 aa, Cryptosporidium parvum
LLLNAQILWKCQYLIKS

SEQ ID NO: 2298507 - protein, 23 aa, Cryptosporidium parvum
LLLNNPVSFFVCMEQTFVKPLLY

SEQ ID NO: 2298508 - protein, 26 aa, Cryptosporidium parvum
LLLPNEIPQSFDLIELAMKYSNNNAS

SEQ ID NO: 2298509 - protein, 25 aa, Cryptosporidium parvum
LLLQSSKLLGSWGSYYNIYSSPRYL

SEQ ID NO: 2298510 - protein, 22 aa, Cryptosporidium parvum
LLLRRRCSNITYGDLPWLSSSI

SEQ ID NO: 2298511 - protein, 25 aa, Cryptosporidium parvum
LLLRVDGLVGLLARIRRDEIESLFS

SEQ ID NO: 2298512 - protein, 19 aa, Cryptosporidium parvum
LLLVPSDVLTLFIDYRLLS

SEQ ID NO: 2298513 - protein, 24 aa, Cryptosporidium parvum
LLMASRPVITITFNITNSLFMSVG

SEQ ID NO: 2298514 - protein, 20 aa, Cryptosporidium parvum
LLMCSICTIFGVDLNPLEEN

SEQ ID NO: 2298515 - protein, 22 aa, Cryptosporidium parvum
LLMEQLLGFVCIENYYNFEENF

SEQ ID NO: 2298516 - protein, 25 aa, Cryptosporidium parvum
LLMNSCKMYQDFGASYLTDFSDIAI

SEQ ID NO: 2298517 - protein, 24 aa, Cryptosporidium parvum
LLMRVSCGIHCGDIEAALETYELL

SEQ ID NO: 2298518 - protein, 19 aa, Cryptosporidium parvum
LLMYSEEGARAFCIKLKGD

SEQ ID NO: 2298519 - protein, 20 aa, Cryptosporidium parvum
LLNAFRVCKELSNKDEKNKD

SEQ ID NO: 2298520 - protein, 17 aa, Cryptosporidium parvum
LLNDEIWELNRIIKSNN

SEQ ID NO: 2298521 - protein, 19 aa, Cryptosporidium parvum
LLNEFGFKFICDRHYCSSC

SEQ ID NO: 2298522 - protein, 34 aa, Cryptosporidium parvum; identical to SEQ ID NO: 2176587

SEQ ID NO: 2298523 - protein, 25 aa, Cryptosporidium parvum
LLNHYKYHFDSSLQLSGAINLSIGM

SEQ ID NO: 2298524 - protein, 27 aa, Cryptosporidium parvum
LLNIWISLLRKCIDTFIKFIPNTPNSL

SEQ ID NO: 2298525 - protein, 24 aa, Cryptosporidium parvum
LLNKAGIELCVRKVASIYGDCRRT

SEQ ID NO: 2298526 - protein, 24 aa, Cryptosporidium parvum
LLNKARRAYIAFVRSYMSYDREFS

SEQ ID NO: 2298527 - protein, 35 aa, Cryptosporidium parvum; identical to SEQ ID NO: 2176593

SEQ ID NO: 2298528 - protein, 23 aa, Cryptosporidium parvum
LLNRKDFKMAFDSMHGVAGPYAR

SEQ ID NO: 2298529 - protein, 17 aa, Cryptosporidium parvum
LLNTCIQESKQLRNIFQ

SEQ ID NO: 2298530 - protein, 23 aa, Cryptosporidium parvum
LLNTIKVSLEFNDLMKSKLNKAI

SEQ ID NO: 2298531 - protein, 21 aa, Cryptosporidium parvum
LLNTIRLRVAKKVKDKVRKRK

SEQ ID NO: 2298532 - protein, 25 aa, Cryptosporidium parvum
LLPGTFKIALCVGLRHEPIKDVSCV

SEQ ID NO: 2298533 - protein, 20 aa, Cryptosporidium parvum
LLPMIIKKAFLAYNSLKEIC

SEQ ID NO: 2298534 - protein, 22 aa, Cryptosporidium parvum
LLPNQKRPTLSVIIKVNQKGEV

SEQ ID NO: 2298535 - protein, 24 aa, Cryptosporidium parvum
LLPSKFFIQVAFCTFDAIYPFLEG

SEQ ID NO: 2298536 - protein, 18 aa, Cryptosporidium parvum
LLPSLSTPIHWLEYNGDR

SEQ ID NO: 2298537 - protein, 25 aa, Cryptosporidium parvum
LLPVLYLCKILRSMFENKERLIPRV

SEQ ID NO: 2298538 - protein, 17 aa, Cryptosporidium parvum
LLPWKTLCTDIVESWRL

SEQ ID NO: 2298539 - protein, 44 aa, Cryptosporidium parvum
LLPYLLKLTKFQIIRNEFSLNYGWRPICNVPTPIQESILKERKL

SEQ ID NO: 2298540 - protein, 18 aa, Cryptosporidium parvum
LLQEIHKAASISGVAISA

SEQ ID NO: 2298541 - protein, 24 aa, Cryptosporidium parvum
LLQELLTEIGIEFEFHITNKANLE

SEQ ID NO: 2298542 - protein, 17 aa, Cryptosporidium parvum
LLQNKVYEEIADFHPEI

SEQ ID NO: 2298543 - protein, 24 aa, Cryptosporidium parvum
LLQNTSTCFQEYLSDLLSITEKSK

SEQ ID NO: 2298544 - protein, 17 aa, Cryptosporidium parvum
LLQRYNDLFPEFVNNHI

SEQ ID NO: 2298545 - protein, 19 aa, Cryptosporidium parvum
LLQYSRFILSKKISLCIKS

SEQ ID NO: 2298546 - protein, 27 aa, Cryptosporidium parvum
LLRDLFPVMMSRFIATFTRAEKRNSCC

SEQ ID NO: 2298547 - protein, 17 aa, Cryptosporidium parvum
LLREIAMVVPDRQRIAE

SEQ ID NO: 2298548 - protein, 18 aa, Cryptosporidium parvum
LLRENDLEAYLELVKETK

SEQ ID NO: 2298549 - protein, 22 aa, Cryptosporidium parvum
LLRIIAGRSFCKECGTSTACQH

SEQ ID NO: 2298550 - protein, 27 aa, Cryptosporidium parvum
LLRKKLHKVPGVPLIYLNNQVPILEQP

SEQ ID NO: 2298551 - protein, 19 aa, Cryptosporidium parvum
LLRKNRYGLSEDQTRICIK

SEQ ID NO: 2298552 - protein, 18 aa, Cryptosporidium parvum
LLRLKRKKLAMLESQLKR

SEQ ID NO: 2298553 - protein, 17 aa, Cryptosporidium parvum
LLRLSSYPFSKLGLLES

SEQ ID NO: 2298554 - protein, 25 aa, Cryptosporidium parvum
LLRNNPRLVEMIKFIEHSENKTEAL

SEQ ID NO: 2298555 - protein, 17 aa, Cryptosporidium parvum
LLRPEYKIKAIYPEAVR

SEQ ID NO: 2298556 - protein, 20 aa, Cryptosporidium parvum
LLRPHLLRRVKEDVMKEIPP

SEQ ID NO: 2298557 - protein, 23 aa, Cryptosporidium parvum
LLRPTILQRLIWFVASQVAAGTY

SEQ ID NO: 2298558 - protein, 22 aa, Cryptosporidium parvum
LLRQSSCLIRSLIITLNTIQNL

SEQ ID NO: 2298559 - protein, 35 aa, Cryptosporidium parvum; identical to SEQ ID NO: 2176614

SEQ ID NO: 2298560 - protein, 26 aa, Cryptosporidium parvum
LLSCFLVCPHWLLTITEFINEYYCKS

SEQ ID NO: 2298561 - protein, 19 aa, Cryptosporidium parvum
LLSCIPFELLSSSHNGKNN

SEQ ID NO: 2298562 - protein, 22 aa, Cryptosporidium parvum
LLSECSCINIFAFGSSGTGKTF

SEQ ID NO: 2298563 - protein, 26 aa, Cryptosporidium parvum
LLSEWTRLRGITFVKNPFLMLDQIGV

SEQ ID NO: 2298564 - protein, 26 aa, Cryptosporidium parvum
LLSFKLVCLKRLMGSLSDDQYLRNSI

SEQ ID NO: 2298565 - protein, 19 aa, Cryptosporidium parvum
LLSGLAFCHGKRILHRDLK

SEQ ID NO: 2298566 - protein, 18 aa, Cryptosporidium parvum
LLSILDKFIETFTLLHGE

SEQ ID NO: 2298567 - protein, 17 aa, Cryptosporidium parvum
LLSIQGKLPVSIDLICQ

SEQ ID NO: 2298568 - protein, 18 aa, Cryptosporidium parvum
LLSMKAFILGAMHPESKD

SEQ ID NO: 2298569 - protein, 23 aa, Cryptosporidium parvum
LLSNFYFCCLYFHRLDSMVRKET

SEQ ID NO: 2298570 - protein, 18 aa, Cryptosporidium parvum
LLSNRSQCYLKLGQEDNY

SEQ ID NO: 2298571 - protein, 19 aa, Cryptosporidium parvum
LLSQRGIYIQGLKYKVSNV

SEQ ID NO: 2298572 - protein, 18 aa, Cryptosporidium parvum
LLSSRGALHLIARENEYE

SEQ ID NO: 2298573 - protein, 22 aa, Cryptosporidium parvum
LLSTKAGGFGINLQSADTVILF

SEQ ID NO: 2298574 - protein, 17 aa, Cryptosporidium parvum
LLTGKALFNGRNEIDQL

SEQ ID NO: 2298575 - protein, 22 aa, Cryptosporidium parvum
LLTHPFIDTCIVSRYVMQQIPK

SEQ ID NO: 2298576 - protein, 17 aa, Cryptosporidium parvum
LLTKNVRRVFAWHPLTK

SEQ ID NO: 2298577 - protein, 18 aa, Cryptosporidium parvum
LLTMARKKIIKIITENLD

SEQ ID NO: 2298578 - protein, 18 aa, Cryptosporidium parvum
LLTNNIFNGIEWMNNLPK

SEQ ID NO: 2298579 - protein, 26 aa, Cryptosporidium parvum
LLTNRFSTLLSRIWTMNKYILLKQGA

SEQ ID NO: 2298580 - protein, 25 aa, Cryptosporidium parvum
LLTRFPVPAASTFSFSLICNDDELP

SEQ ID NO: 2298581 - protein, 22 aa, Cryptosporidium parvum
LLTRKSTFLTRDKFLQLLLCIP

SEQ ID NO: 2298582 - protein, 17 aa, Cryptosporidium parvum
LLTTLLLCLDNVEKKNQ

SEQ ID NO: 2298583 - protein, 19 aa, Cryptosporidium parvum
LLTVLLEYCEKNWNSSNLN

SEQ ID NO: 2298584 - protein, 18 aa, Cryptosporidium parvum
LLVAKWGGELTRIGCEQA

SEQ ID NO: 2298585 - protein, 19 aa, Cryptosporidium parvum
LLVGLKYIHSAGIYHRDLK

SEQ ID NO: 2298586 - protein, 23 aa, Cryptosporidium parvum
LLVHYAHSCLIPFEELAMSKDIN

SEQ ID NO: 2298587 - protein, 25 aa, Cryptosporidium parvum
LLVPGSRIAACVLINILISYDPILQ

SEQ ID NO: 2298588 - protein, 24 aa, Cryptosporidium parvum
LLVQLRTDCWVYYSPKNAQQNKEQ

SEQ ID NO: 2298589 - protein, 18 aa, Cryptosporidium parvum
LLVSRLISKLAPNYKILV

SEQ ID NO: 2298590 - protein, 22 aa, Cryptosporidium parvum
LLYEDSFKKFGLDGVKLEPSMV

SEQ ID NO: 2298591 - protein, 25 aa, Cryptosporidium parvum
LLYGESVCFVLARMIELTYGRVANN

SEQ ID NO: 2298592 - protein, 20 aa, Cryptosporidium parvum
LLYNEISIFLSIDSDIPFLS

SEQ ID NO: 2298593 - protein, 19 aa, Cryptosporidium parvum
LLYRCNRHPNILNLIGGIR

SEQ ID NO: 2298594 - protein, 25 aa, Cryptosporidium parvum
LLYRCYKLLTFWNVIVKDWNSVNYY

SEQ ID NO: 2298595 - protein, 17 aa, Cryptosporidium parvum
LLYTLLIGSLDVFSQGI

SEQ ID NO: 2298596 - protein, 22 aa, Cryptosporidium parvum
LMAVGMARLGGIGIIHKNMDME

SEQ ID NO: 2298597 - protein, 17 aa, Cryptosporidium parvum
LMDALSFALGLSSNDMR

SEQ ID NO: 2298598 - protein, 18 aa, Cryptosporidium parvum
LMDEAILEMGWQERYSIL

SEQ ID NO: 2298599 - protein, 25 aa, Cryptosporidium parvum
LMDEQDYRYSIIFYQAIPNYSRLTS

SEQ ID NO: 2298600 - protein, 19 aa, Cryptosporidium parvum
LMDGLCIYMEAQLILEEAE

SEQ ID NO: 2298601 - protein, 17 aa, Cryptosporidium parvum
LMDRIPPNLPINADGSY

SEQ ID NO: 2298602 - protein, 17 aa, Cryptosporidium parvum
LMEFVFPPFPLENGILP

SEQ ID NO: 2298603 - protein, 17 aa, Cryptosporidium parvum
LMFHIAQIYGAISKEEF

SEQ ID NO: 2298604 - protein, 30 aa, Cryptosporidium parvum
LMIKAISGIHKYFLNKAFEHESEKELELHD

SEQ ID NO: 2298605 - protein, 30 aa, Cryptosporidium parvum
LMIPNGDIKCILWPFSLLFIHKNELSDDVN

SEQ ID NO: 2298606 - protein, 21 aa, Cryptosporidium parvum
LMIQSPIYWNEIFKALNENNW

SEQ ID NO: 2298607 - protein, 17 aa, Cryptosporidium parvum
LMKESLERLILNKESES

SEQ ID NO: 2298608 - protein, 17 aa, Cryptosporidium parvum
LMKGCKWADEIVIGTPY

SEQ ID NO: 2298609 - protein, 20 aa, Cryptosporidium parvum
LMKIKKFLNKSECTIDDVNG

SEQ ID NO: 2298610 - protein, 19 aa, Cryptosporidium parvum
LMKKNCQWANILINGTVIL

SEQ ID NO: 2298611 - protein, 17 aa, Cryptosporidium parvum
LMNKPWIILPFAFNSRE

SEQ ID NO: 2298612 - protein, 23 aa, Cryptosporidium parvum
LMNNLFRKKLQVIQHRLDSLYKF

SEQ ID NO: 2298613 - protein, 18 aa, Cryptosporidium parvum
LMNPDAFNRIPMIYEKKD

SEQ ID NO: 2298614 - protein, 24 aa, Cryptosporidium parvum
LMPLNSFIEIFGFYIESIESLKLF

SEQ ID NO: 2298615 - protein, 23 aa, Cryptosporidium parvum
LMQEFPDKFGFSISHTSRSPRGK

SEQ ID NO: 2298616 - protein, 24 aa, Cryptosporidium parvum
LMQLCQRFGHIVGIRLPTANNNGK

SEQ ID NO: 2298617 - protein, 19 aa, Cryptosporidium parvum
LMRELRIAVEKGYTESAKI

SEQ ID NO: 2298618 - protein, 21 aa, Cryptosporidium parvum
LMRIKAIEFLNLSLYASSTIY

SEQ ID NO: 2298619 - protein, 23 aa, Cryptosporidium parvum
LMRSFGWDASDAFTQHDAQELNR

SEQ ID NO: 2298620 - protein, 23 aa, Cryptosporidium parvum
LMSDLCRRYHRAGLWDSSCPTLY

SEQ ID NO: 2298621 - protein, 17 aa, Cryptosporidium parvum
LMSQYALFKTPQIFHEY

SEQ ID NO: 2298622 - protein, 17 aa, Cryptosporidium parvum
LMVCINCVKESFDNFLF

SEQ ID NO: 2298623 - protein, 18 aa, Cryptosporidium parvum
LNACQVLLLAPTRELAQQ

SEQ ID NO: 2298624 - protein, 17 aa, Cryptosporidium parvum
LNAKLGRNLNILSKSIY

SEQ ID NO: 2298625 - protein, 24 aa, Cryptosporidium parvum
LNALKCFFCGNSGATIKCSGNDKC

SEQ ID NO: 2298626 - protein, 17 aa, Cryptosporidium parvum
LNANFYLLGITKSKRVF

SEQ ID NO: 2298627 - protein, 21 aa, Cryptosporidium parvum
LNAQILWKCQYLIKSLNTYNS

SEQ ID NO: 2298628 - protein, 20 aa, Cryptosporidium parvum
LNAQLPFLKSRSFMEEDKEE

SEQ ID NO: 2298629 - protein, 18 aa, Cryptosporidium parvum
LNATKCAIEQGIVPGGGS

SEQ ID NO: 2298630 - protein, 25 aa, Cryptosporidium parvum
LNAYPEMLEILLSCQSEDLRPNNST

SEQ ID NO: 2298631 - protein, 24 aa, Cryptosporidium parvum
LNCGTELFHVPKFALAARSKYFQN

SEQ ID NO: 2298632 - protein, 19 aa, Cryptosporidium parvum
LNCTLDRLVGPKCLELKVS

SEQ ID NO: 2298633 - protein, 17 aa, Cryptosporidium parvum
LNDELKGKEVIKNTKNR

SEQ ID NO: 2298634 - protein, 18 aa, Cryptosporidium parvum
LNDGFWNHSHNSVALQNN

SEQ ID NO: 2298635 - protein, 17 aa, Cryptosporidium parvum
LNDIKGIINEYNQNEMN

SEQ ID NO: 2298636 - protein, 19 aa, Cryptosporidium parvum
LNDIQYTRGHMVLTNNNEI

SEQ ID NO: 2298637 - protein, 23 aa, Cryptosporidium parvum
LNDQFWRIFGISLTTSSRSERVY

SEQ ID NO: 2298638 - protein, 17 aa, Cryptosporidium parvum
LNDSFVKLISWYDNESG

SEQ ID NO: 2298639 - protein, 23 aa, Cryptosporidium parvum
LNDVKIKVCISSHLQNFIFDTIN

SEQ ID NO: 2298640 - protein, 19 aa, Cryptosporidium parvum
LNECTEWGQIYILNVVAEW

SEQ ID NO: 2298641 - protein, 25 aa, Cryptosporidium parvum
LNEFEVCKSNIYGLASRKNNENSQE

SEQ ID NO: 2298642 - protein, 18 aa, Cryptosporidium parvum
LNEFGITMKSTWFGEEMR

SEQ ID NO: 2298643 - protein, 21 aa, Cryptosporidium parvum
LNEGKNYVCGSTRSVFEPINE

SEQ ID NO: 2298644 - protein, 20 aa, Cryptosporidium parvum
LNEISCAPPPQVIEALKNLC

SEQ ID NO: 2298645 - protein, 17 aa, Cryptosporidium parvum
LNEKLNELMGIFKKREF

SEQ ID NO: 2298646 - protein, 18 aa, Cryptosporidium parvum
LNELSCDKENELVPPGKS

SEQ ID NO: 2298647 - protein, 30 aa, Cryptosporidium parvum; identical to SEQ ID NO: 2176696

SEQ ID NO: 2298648 - protein, 22 aa, Cryptosporidium parvum
LNESFLPFDFILLREYFSEEEF

SEQ ID NO: 2298649 - protein, 25 aa, Cryptosporidium parvum
LNETEIRPGFKVKIEKAIFNKSSKS

SEQ ID NO: 2298650 - protein, 20 aa, Cryptosporidium parvum
LNFDFSRGMRTLSAPSMSTP

SEQ ID NO: 2298651 - protein, 25 aa, Cryptosporidium parvum
LNFEGSWKLGGFENAISLSDTSSYY

SEQ ID NO: 2298652 - protein, 19 aa, Cryptosporidium parvum
LNFGTCNRYEFLAWLQQIQ

SEQ ID NO: 2298653 - protein, 23 aa, Cryptosporidium parvum
LNFPFRLSSIVEEWTNMESEINK

SEQ ID NO: 2298654 - protein, 17 aa, Cryptosporidium parvum
LNFPTDRIFLLGQSIGS

SEQ ID NO: 2298655 - protein, 25 aa, Cryptosporidium parvum
LNFSQCGLPLPIHHYLKKKNIIKPF

SEQ ID NO: 2298656 - protein, 23 aa, Cryptosporidium parvum
LNFTPCQRLTLAQVEHELRRIND

SEQ ID NO: 2298657 - protein, 24 aa, Cryptosporidium parvum
LNGCYKCTLRTSGVGLGSYKCDVI

SEQ ID NO: 2298658 - protein, 17 aa, Cryptosporidium parvum
LNGFLTQGLNSIEMLNS

SEQ ID NO: 2298659 - protein, 26 aa, Cryptosporidium parvum
LNGKLPEFLKRTVLSSSLSTIKVLKD

SEQ ID NO: 2298660 - protein, 17 aa, Cryptosporidium parvum
LNGLEVININDLNKAID

SEQ ID NO: 2298661 - protein, 20 aa, Cryptosporidium parvum
LNGLHVWSFNEAIFTSENDL

SEQ ID NO: 2298662 - protein, 18 aa, Cryptosporidium parvum
LNGSFFRVNFKAISQGEL

SEQ ID NO: 2298663 - protein, 20 aa, Cryptosporidium parvum
LNGVLPWDIRVIGYCEVRPD

SEQ ID NO: 2298664 - protein, 24 aa, Cryptosporidium parvum
LNGVWIKNGLSFVVSQKYGSFEIY

SEQ ID NO: 2298665 - protein, 18 aa, Cryptosporidium parvum
LNHRIYLPFHVNIQDLIL

SEQ ID NO: 2298666 - protein, 26 aa, Cryptosporidium parvum
LNIAPSFWRFCYNACNSLFTKLQYTS

SEQ ID NO: 2298667 - protein, 19 aa, Cryptosporidium parvum
LNIDIEWYKTQQLLPPLSR

SEQ ID NO: 2298668 - protein, 20 aa, Cryptosporidium parvum
LNIEHLFKYHSCEDSITNEY

SEQ ID NO: 2298669 - protein, 25 aa, Cryptosporidium parvum
LNIEYPPYWYCLKIPKKEENEQDLL

SEQ ID NO: 2298670 - protein, 30 aa, Cryptosporidium parvum
LNIFLQRVIPGICLNHKIDAIFIDSITNLY

SEQ ID NO: 2298671 - protein, 19 aa, Cryptosporidium parvum
LNIINEFNQNILLKSKENE

SEQ ID NO: 2298672 - protein, 28 aa, Cryptosporidium parvum
LNIKVKSFFLKLIIYIDWLIYLINHSNK

SEQ ID NO: 2298673 - protein, 17 aa, Cryptosporidium parvum
LNIKWPPSLPNYTQKNL

SEQ ID NO: 2298674 - protein, 20 aa, Cryptosporidium parvum
LNILELLSMDIEEQVKYKDK

SEQ ID NO: 2298675 - protein, 18 aa, Cryptosporidium parvum
LNILKEFNYFGIKFYDNS

SEQ ID NO: 2298676 - protein, 25 aa, Cryptosporidium parvum
LNINCKKCGFLLSEYYENWVTAPLP

SEQ ID NO: 2298677 - protein, 24 aa, Cryptosporidium parvum
LNIPILGLCYGHYIVNIGYGGQVH

SEQ ID NO: 2298678 - protein, 41 aa, Cryptosporidium parvum; identical to SEQ ID NO: 2176721

SEQ ID NO: 2298679 - protein, 35 aa, Cryptosporidium parvum
LNIRRAHCLANYSFKYRRGGIVVAPEICIPKQHAT

SEQ ID NO: 2298680 - protein, 26 aa, Cryptosporidium parvum
LNIRRHSELAFKPLVLSAVENRRATA

SEQ ID NO: 2298681 - protein, 26 aa, Cryptosporidium parvum
LNISFSKLRQMVWCGNESVALNAVIS

SEQ ID NO: 2298682 - protein, 23 aa, Cryptosporidium parvum
LNISLKFLENAQIQWMNEKESLL

SEQ ID NO: 2298683 - protein, 22 aa, Cryptosporidium parvum
LNISLKQSRIIYEIMRTDITNE

SEQ ID NO: 2298684 - protein, 18 aa, Cryptosporidium parvum
LNISRYNLILTISDITNP

SEQ ID NO: 2298685 - protein, 19 aa, Cryptosporidium parvum
LNIVALFLIELGYKPSEVI

SEQ ID NO: 2298686 - protein, 22 aa, Cryptosporidium parvum
LNKDILLSLSFMVMNQLVSFDS

SEQ ID NO: 2298687 - protein, 19 aa, Cryptosporidium parvum
LNKELKLALIQKIVNHLES

SEQ ID NO: 2298688 - protein, 24 aa, Cryptosporidium parvum
LNKFPSAKNSLSFVYVKNEDYTEQ

SEQ ID NO: 2298689 - protein, 29 aa, Cryptosporidium parvum
LNKIPTRFPWILEELPIAQSFKNQFLLFN

SEQ ID NO: 2298690 - protein, 19 aa, Cryptosporidium parvum
LNKKLSERLTFFNCDVRQI

SEQ ID NO: 2298691 - protein, 18 aa, Cryptosporidium parvum
LNKNLRQRIVCFVGSPLE

SEQ ID NO: 2298692 - protein, 17 aa, Cryptosporidium parvum
LNKRLFLDKIKSFGNKQ

SEQ ID NO: 2298693 - protein, 33 aa, Cryptosporidium parvum
LNKSFPENIHIIFDYSLPLTFSDDLINNLYSSF

SEQ ID NO: 2298694 - protein, 22 aa, Cryptosporidium parvum
LNKTFKKALLFGDKENITKKNS

SEQ ID NO: 2298695 - protein, 27 aa, Cryptosporidium parvum
LNKTLPIRLSDGFLMSFISNEGHRVKN

SEQ ID NO: 2298696 - protein, 24 aa, Cryptosporidium parvum
LNKVKPRIPHSLIEFYENYNKKNN

SEQ ID NO: 2298697 - protein, 18 aa, Cryptosporidium parvum
LNKVRRWISSKTEQILGK

SEQ ID NO: 2298698 - protein, 24 aa, Cryptosporidium parvum
LNLENLKFLIFFKINNDINPCKED

SEQ ID NO: 2298699 - protein, 17 aa, Cryptosporidium parvum
LNLFKSGVFDILVSTDV

SEQ ID NO: 2298700 - protein, 18 aa, Cryptosporidium parvum
LNLFRLILELIQTDLVRD

SEQ ID NO: 2298701 - protein, 22 aa, Cryptosporidium parvum
LNLIKLFKFCNILFQPQFQNSN

SEQ ID NO: 2298702 - protein, 20 aa, Cryptosporidium parvum
LNLLAKRCVELSKYSVDTCV

SEQ ID NO: 2298703 - protein, 23 aa, Cryptosporidium parvum
LNLLEPCGQFGSRKEGGKDASAA

SEQ ID NO: 2298704 - protein, 25 aa, Cryptosporidium parvum
LNLLETAPFWFSKLLSILFIICKEE

SEQ ID NO: 2298705 - protein, 20 aa, Cryptosporidium parvum
LNLLKKYKFLKEFISTNSDI

SEQ ID NO: 2298706 - protein, 17 aa, Cryptosporidium parvum
LNLLKYIHIRTFEVLYK

SEQ ID NO: 2298707 - protein, 18 aa, Cryptosporidium parvum
LNLMDDWIRSISFTETNK

SEQ ID NO: 2298708 - protein, 19 aa, Cryptosporidium parvum
LNLPCIYPTVYSFGNILAS

SEQ ID NO: 2298709 - protein, 18 aa, Cryptosporidium parvum
LNLPCMYSVPFIEQEHLI

SEQ ID NO: 2298710 - protein, 19 aa, Cryptosporidium parvum
LNLQFGINIFFQIINSIQF

SEQ ID NO: 2298711 - protein, 20 aa, Cryptosporidium parvum
LNLQLPIILKKSEEEIKYIR

SEQ ID NO: 2298712 - protein, 17 aa, Cryptosporidium parvum
LNLRCIYKYCKKVDNLL

SEQ ID NO: 2298713 - protein, 20 aa, Cryptosporidium parvum
LNLRPQKGIVYNILHDYQTK

SEQ ID NO: 2298714 - protein, 20 aa, Cryptosporidium parvum
LNLSDTVSLIAMELFPCGKW

SEQ ID NO: 2298715 - protein, 31 aa, Cryptosporidium parvum; identical to SEQ ID NO: 2176757

SEQ ID NO: 2298716 - protein, 18 aa, Cryptosporidium parvum
LNLTNSFSDISIISIGGD

SEQ ID NO: 2298717 - protein, 20 aa, Cryptosporidium parvum
LNLVVSFLLSCDYADIISNK

SEQ ID NO: 2298718 - protein, 20 aa, Cryptosporidium parvum
LNLWWELMVYILRWSFELGP

SEQ ID NO: 2298719 - protein, 22 aa, Cryptosporidium parvum
LNLYPTPVIECFNQCAYEVVTS

SEQ ID NO: 2298720 - protein, 23 aa, Cryptosporidium parvum
LNMDYCISNGYGPNMNTNNLPAS

SEQ ID NO: 2298721 - protein, 23 aa, Cryptosporidium parvum
LNMNIKMYLNRTSLDGKLLSRKK

SEQ ID NO: 2298722 - protein, 25 aa, Cryptosporidium parvum
LNMNYLKKQVCKRLTISLDKSNPKL

SEQ ID NO: 2298723 - protein, 22 aa, Cryptosporidium parvum
LNMPGWITGVGLEISSIITAFS

SEQ ID NO: 2298724 - protein, 20 aa, Cryptosporidium parvum
LNNCCLKRNCDFRIRLDDER

SEQ ID NO: 2298725 - protein, 18 aa, Cryptosporidium parvum
LNNILSGSGSKGFSGSKN

SEQ ID NO: 2298726 - protein, 18 aa, Cryptosporidium parvum
LNNINLCLNFILNPPEKS

SEQ ID NO: 2298727 - protein, 24 aa, Cryptosporidium parvum
LNNKYKFIYLYVVYDHFKDENIKM

SEQ ID NO: 2298728 - protein, 23 aa, Cryptosporidium parvum
LNNLKASFKLMGYKTKCNDKSIL

SEQ ID NO: 2298729 - protein, 31 aa, Cryptosporidium parvum
LNNPYFEEWKFLYKRLCFIEKEVDSMLLKLT

SEQ ID NO: 2298730 - protein, 25 aa, Cryptosporidium parvum
LNNPYKWRTFCGSKPENIFQDLIIE

SEQ ID NO: 2298731 - protein, 23 aa, Cryptosporidium parvum
LNNRELYSGISLDPTVEYKAMIQ

SEQ ID NO: 2298732 - protein, 22 aa, Cryptosporidium parvum
LNNRFPGGFLLISQFKDIQQEE

SEQ ID NO: 2298733 - protein, 26 aa, Cryptosporidium parvum
LNPDDGLFLCRFCNEKLKSVDSASFR

SEQ ID NO: 2298734 - protein, 27 aa, Cryptosporidium parvum
LNPEIFNAYHFTSWLSEDFQEFLKELE

SEQ ID NO: 2298735 - protein, 19 aa, Cryptosporidium parvum
LNPISSLFLLQFQMGIIME

SEQ ID NO: 2298736 - protein, 17 aa, Cryptosporidium parvum
LNPLCNRLFTAGSSGEI

SEQ ID NO: 2298737 - protein, 31 aa, Cryptosporidium parvum; identical to SEQ ID NO: 2176773

SEQ ID NO: 2298738 - protein, 18 aa, Cryptosporidium parvum
LNPNWFALLVSIVIGSNI

SEQ ID NO: 2298739 - protein, 21 aa, Cryptosporidium parvum
LNPPYFRIGPQFEPVPMSYNW

SEQ ID NO: 2298740 - protein, 26 aa, Cryptosporidium parvum
LNPVKIPVCDPLAWGETLGCTSAIID

SEQ ID NO: 2298741 - protein, 20 aa, Cryptosporidium parvum
LNPVTLEWTDGVFTAILRKI

SEQ ID NO: 2298742 - protein, 27 aa, Cryptosporidium parvum
LNQAIKMAYSVGLTYEAGLGERKLKKL

SEQ ID NO: 2298743 - protein, 23 aa, Cryptosporidium parvum
LNQDECDEIISLVQDRLEDSKIS

SEQ ID NO: 2298744 - protein, 17 aa, Cryptosporidium parvum
LNQFSWLIPSYFNSNSG

SEQ ID NO: 2298745 - protein, 21 aa, Cryptosporidium parvum
LNQLIRVSGIITRRTDILTKF

SEQ ID NO: 2298746 - protein, 18 aa, Cryptosporidium parvum
LNQLKVHGGGYVIDIERA

SEQ ID NO: 2298747 - protein, 19 aa, Cryptosporidium parvum
LNQLNLKHVFAILSGAEPI

SEQ ID NO: 2298748 - protein, 19 aa, Cryptosporidium parvum
LNQMERLNEIISMRLSYNQ

SEQ ID NO: 2298749 - protein, 24 aa, Cryptosporidium parvum
LNQRKEFMRLGGITVLVSLLNPPT

SEQ ID NO: 2298750 - protein, 25 aa, Cryptosporidium parvum
LNQSSFKTGYSFTLEINQSYKRTFM

SEQ ID NO: 2298751 - protein, 17 aa, Cryptosporidium parvum
LNQWMGHLTSLSSILAN

SEQ ID NO: 2298752 - protein, 24 aa, Cryptosporidium parvum
LNRLKEMINEFLSLDVDFLQKIGS

SEQ ID NO: 2298753 - protein, 24 aa, Cryptosporidium parvum
LNRPFSGFCYRALSTIYVDQKKLE

SEQ ID NO: 2298754 - protein, 17 aa, Cryptosporidium parvum
LNSAFGALLARMLDPNK

SEQ ID NO: 2298755 - protein, 17 aa, Cryptosporidium parvum
LNSCGPDVGISGKLVDS

SEQ ID NO: 2298756 - protein, 19 aa, Cryptosporidium parvum
LNSDCSFIDSIVEYSNESM

SEQ ID NO: 2298757 - protein, 31 aa, Cryptosporidium parvum; identical to SEQ ID NO: 2176789

SEQ ID NO: 2298758 - protein, 19 aa, Cryptosporidium parvum
LNSDQEMCFSLKNCLRNLL

SEQ ID NO: 2298759 - protein, 17 aa, Cryptosporidium parvum
LNSEKLKFVTLIESKLL

SEQ ID NO: 2298760 - protein, 17 aa, Cryptosporidium parvum
LNSFIIPSIVVGTYGDF

SEQ ID NO: 2298761 - protein, 32 aa, Cryptosporidium parvum; identical to SEQ ID NO: 2176790

SEQ ID NO: 2298762 - protein, 25 aa, Cryptosporidium parvum
LNSFLLNHFPRLNWINADISTLNNG

SEQ ID NO: 2298763 - protein, 25 aa, Cryptosporidium parvum
LNSIARPKFGGILKSQKGDMLCDYD

SEQ ID NO: 2298764 - protein, 21 aa, Cryptosporidium parvum
LNSKFQRKSFHLKAIQSQSEL

SEQ ID NO: 2298765 - protein, 28 aa, Cryptosporidium parvum
LNSNLLRWTQRYGYQGTDEFSIRMFNES

SEQ ID NO: 2298766 - protein, 18 aa, Cryptosporidium parvum
LNSQEIQGLLNLCGTSDE

SEQ ID NO: 2298767 - protein, 25 aa, Cryptosporidium parvum
LNSQMAELLKFCGINEFDDEEPLNS

SEQ ID NO: 2298768 - protein, 21 aa, Cryptosporidium parvum
LNSRIKLLIAQTGPNNLQSFA

SEQ ID NO: 2298769 - protein, 19 aa, Cryptosporidium parvum
LNSRLHAMQILKFEHPADC

SEQ ID NO: 2298770 - protein, 21 aa, Cryptosporidium parvum
LNSRLLLKVQLPESINQLYSL

SEQ ID NO: 2298771 - protein, 25 aa, Cryptosporidium parvum
LNSRYLEMSEYLSVKNKLQEIIQEY

SEQ ID NO: 2298772 - protein, 26 aa, Cryptosporidium parvum
LNSSECLYLNFDSPWSSSKPAQPESE

SEQ ID NO: 2298773 - protein, 19 aa, Cryptosporidium parvum
LNSSLKWNGLPLINLKFVH

SEQ ID NO: 2298774 - protein, 25 aa, Cryptosporidium parvum
LNTAFGKFYFSITIKYHNLHNYYVH

SEQ ID NO: 2298775 - protein, 18 aa, Cryptosporidium parvum
LNTELSWNRTLRNRRSDD

SEQ ID NO: 2298776 - protein, 30 aa, Cryptosporidium parvum
LNTIRFSAIEILAWTQSRLSEIFIKETSLN

SEQ ID NO: 2298777 - protein, 19 aa, Cryptosporidium parvum
LNTKLLVEFSRKIAQLPDL

SEQ ID NO: 2298778 - protein, 28 aa, Cryptosporidium parvum
LNTLCEAGQMSICYSKAWVNKTVISAWW

SEQ ID NO: 2298779 - protein, 19 aa, Cryptosporidium parvum
LNTLKGINTNSNFCISKSF

SEQ ID NO: 2298780 - protein, 26 aa, Cryptosporidium parvum
LNTSIRLWWKRIFKGSIETDISKFNR

SEQ ID NO: 2298781 - protein, 18 aa, Cryptosporidium parvum
LNTVYIYDFLDLFEEAIK

SEQ ID NO: 2298782 - protein, 23 aa, Cryptosporidium parvum
LNVGCPSCKVASKGSFGASLFKN

SEQ ID NO: 2298783 - protein, 21 aa, Cryptosporidium parvum
LNVGISPKFDSFIIKKISEVT

SEQ ID NO: 2298784 - protein, 17 aa, Cryptosporidium parvum
LNVILDCNGGQTILDPA

SEQ ID NO: 2298785 - protein, 28 aa, Cryptosporidium parvum
LNVITLRKLYAILSICFNINLLNIDIQN

SEQ ID NO: 2298786 - protein, 23 aa, Cryptosporidium parvum
LNVVERILAVSIELLENGVCNQI

SEQ ID NO: 2298787 - protein, 25 aa, Cryptosporidium parvum
LNYDKGRYICISYGQPNYRLNYLKS

SEQ ID NO: 2298788 - protein, 33 aa, Cryptosporidium parvum; identical to SEQ ID NO: 2176813

SEQ ID NO: 2298789 - protein, 19 aa, Cryptosporidium parvum
LNYIKTFKFHSTEVSSIQF

SEQ ID NO: 2298790 - protein, 17 aa, Cryptosporidium parvum
LNYKEMIIRLSSVANNI

SEQ ID NO: 2298791 - protein, 17 aa, Cryptosporidium parvum
LNYLFYRGLDIDPIDSS

SEQ ID NO: 2298792 - protein, 23 aa, Cryptosporidium parvum
LNYLSHLVIRVWESKSVSESNQD

SEQ ID NO: 2298793 - protein, 28 aa, Cryptosporidium parvum
LNYSMKFTLIETICCFAKKHPMITQIEN

SEQ ID NO: 2298794 - protein, 30 aa, Cryptosporidium parvum
LNYSTYIRRKREMLYSKQVKDYIVKFNNRR

SEQ ID NO: 2298795 - protein, 19 aa, Cryptosporidium parvum
LPARHVIIKGTNVYDSKKG

SEQ ID NO: 2298796 - protein, 19 aa, Cryptosporidium parvum
LPATVYIKSLFLWVDSQIS

SEQ ID NO: 2298797 - protein, 19 aa, Cryptosporidium parvum
LPCGIGIHHAGLVRSDRKV

SEQ ID NO: 2298798 - protein, 26 aa, Cryptosporidium parvum
LPCPLSELCVPVAQGLEFLHELIDRI

SEQ ID NO: 2298799 - protein, 24 aa, Cryptosporidium parvum
LPCRHACLCKICSNTLFKNTQDCP

SEQ ID NO: 2298800 - protein, 17 aa, Cryptosporidium parvum
LPDACLAISQVKNGYDY

SEQ ID NO: 2298801 - protein, 26 aa, Cryptosporidium parvum
LPDCNLCKGCIYDSICYNSLNHLKCN

SEQ ID NO: 2298802 - protein, 17 aa, Cryptosporidium parvum
LPDLIIRRGEKRGERFA

SEQ ID NO: 2298803 - protein, 18 aa, Cryptosporidium parvum
LPDVMSIRLDRKLSAKKT

SEQ ID NO: 2298804 - protein, 17 aa, Cryptosporidium parvum
LPEDVSCNVWMMDSIGE

SEQ ID NO: 2298805 - protein, 25 aa, Cryptosporidium parvum
LPEFEELKFDPGEIPLIDYQEHEDR

SEQ ID NO: 2298806 - protein, 19 aa, Cryptosporidium parvum
LPEKCTFIGNLETYKITDT

SEQ ID NO: 2298807 - protein, 21 aa, Cryptosporidium parvum
LPEMLSLLLMLHVKIPGVLVN

SEQ ID NO: 2298808 - protein, 17 aa, Cryptosporidium parvum
LPEPALETYTFDGMKGR

SEQ ID NO: 2298809 - protein, 24 aa, Cryptosporidium parvum
LPEPDRYGTQRVIMFIRQLIECKG

SEQ ID NO: 2298810 - protein, 25 aa, Cryptosporidium parvum
LPERSIRYIPCFCFPDGNYKFASLK

SEQ ID NO: 2298811 - protein, 20 aa, Cryptosporidium parvum
LPFEISKLYKEYKIPTNQEI

SEQ ID NO: 2298812 - protein, 19 aa, Cryptosporidium parvum
LPFEKSYCLYRTNNYKDAL

SEQ ID NO: 2298813 - protein, 17 aa, Cryptosporidium parvum
LPFFKLSGPNIINGVSG

SEQ ID NO: 2298814 - protein, 24 aa, Cryptosporidium parvum
LPGTDVGMRIAFGHLDENSTGSRT

SEQ ID NO: 2298815 - protein, 19 aa, Cryptosporidium parvum
LPHILSFFNRYLSFISISN

SEQ ID NO: 2298816 - protein, 25 aa, Cryptosporidium parvum
LPHTCAPCRGGPISSKAIHFAAIRG

SEQ ID NO: 2298817 - protein, 20 aa, Cryptosporidium parvum
LPIAQSFKNQFLLFNENSSL

SEQ ID NO: 2298818 - protein, 25 aa, Cryptosporidium parvum
LPIDPRNRLSILFRKKKHWHISELN

SEQ ID NO: 2298819 - protein, 19 aa, Cryptosporidium parvum
LPIKEIKSSFLTQPKNDII

SEQ ID NO: 2298820 - protein, 17 aa, Cryptosporidium parvum
LPIKKRVFIIFKGNYIF

SEQ ID NO: 2298821 - protein, 24 aa, Cryptosporidium parvum
LPIKWTEEHVELYLEATIVSCWSS

SEQ ID NO: 2298822 - protein, 18 aa, Cryptosporidium parvum
LPIKYAGISTCFRKEAGA

SEQ ID NO: 2298823 - protein, 22 aa, Cryptosporidium parvum
LPILNRHGFGPLTIVATSLNNK

SEQ ID NO: 2298824 - protein, 24 aa, Cryptosporidium parvum
LPILRLSLKTTRIVKIPLENEKDR

SEQ ID NO: 2298825 - protein, 22 aa, Cryptosporidium parvum
LPINITEGFPSVGFQFETYLTR

SEQ ID NO: 2298826 - protein, 17 aa, Cryptosporidium parvum
LPISHPVILGISKILSD

SEQ ID NO: 2298827 - protein, 24 aa, Cryptosporidium parvum
LPIVKKFLGNHLFIFSSTINGYEG

SEQ ID NO: 2298828 - protein, 25 aa, Cryptosporidium parvum
LPKALLRARRKIIWIGPSAESMETV

SEQ ID NO: 2298829 - protein, 23 aa, Cryptosporidium parvum
LPKFKNRILGGTKREEMVPILRP

SEQ ID NO: 2298830 - protein, 25 aa, Cryptosporidium parvum
LPKHHVLKSLPLFDLDPNIFGIACG

SEQ ID NO: 2298831 - protein, 22 aa, Cryptosporidium parvum
LPKKEFFKPYYTTTTTTTTTTT

SEQ ID NO: 2298832 - protein, 22 aa, Cryptosporidium parvum
LPKLTSVQLDWLYALAPKDLFG

SEQ ID NO: 2298833 - protein, 26 aa, Cryptosporidium parvum
LPKNCTEDQLLLLFKQFGHVDEVHII

SEQ ID NO: 2298834 - protein, 23 aa, Cryptosporidium parvum
LPKSCTGRQTLLFSATLTNAIKE

SEQ ID NO: 2298835 - protein, 24 aa, Cryptosporidium parvum
LPKTFGFPNIPSFICKTEGEFHKS

SEQ ID NO: 2298836 - protein, 26 aa, Cryptosporidium parvum
LPKVIRFLIKTIRKFQFITGKCVSVE

SEQ ID NO: 2298837 - protein, 17 aa, Cryptosporidium parvum
LPLGFGVLAKSSADMKN

SEQ ID NO: 2298838 - protein, 20 aa, Cryptosporidium parvum
LPLIILANWRGFSGGQKDMF

SEQ ID NO: 2298839 - protein, 18 aa, Cryptosporidium parvum
LPLSSLYHQFGFIGENSV

SEQ ID NO: 2298840 - protein, 22 aa, Cryptosporidium parvum
LPLSTPINWISCEDIEHILHTV

SEQ ID NO: 2298841 - protein, 18 aa, Cryptosporidium parvum
LPLTCLAWSNSSKFLACG

SEQ ID NO: 2298842 - protein, 20 aa, Cryptosporidium parvum
LPLTNCMHQIVGTKEFNPYI

SEQ ID NO: 2298843 - protein, 26 aa, Cryptosporidium parvum
LPLTNPELFKRVGIKTPKGVLLYGPP

SEQ ID NO: 2298844 - protein, 24 aa, Cryptosporidium parvum
LPLTQGRMGFIFVCDINDIDSIKA

SEQ ID NO: 2298845 - protein, 26 aa, Cryptosporidium parvum
LPLVCPELYQQIGIDPPTGVLLYGPP

SEQ ID NO: 2298846 - protein, 20 aa, Cryptosporidium parvum
LPMIISHCPGWICYSEKSLN

SEQ ID NO: 2298847 - protein, 21 aa, Cryptosporidium parvum
LPNCGAVNFSSLCNYTNVYIF

SEQ ID NO: 2298848 - protein, 25 aa, Cryptosporidium parvum
LPNPNPPFLFSFLKKSNRLYTFHTL

SEQ ID NO: 2298849 - protein, 23 aa, Cryptosporidium parvum
LPPEHLRKLINIHGDMSSRKFQN

SEQ ID NO: 2298850 - protein, 20 aa, Cryptosporidium parvum
LPPEIGIQFNGRRIFARLAL

SEQ ID NO: 2298851 - protein, 23 aa, Cryptosporidium parvum
LPPEMRLDTKIPLIARKVQDAVQ

SEQ ID NO: 2298852 - protein, 17 aa, Cryptosporidium parvum
LPPGIRVYTKLSKMTTN

SEQ ID NO: 2298853 - protein, 24 aa, Cryptosporidium parvum
LPPKLRKLRDYRLNDIDIKRSNNK

SEQ ID NO: 2298854 - protein, 25 aa, Cryptosporidium parvum
LPPKYPFKYLMLISFGENKKTSPVF

SEQ ID NO: 2298855 - protein, 23 aa, Cryptosporidium parvum
LPPSLMSRFDLIYLMLDKQSEES

SEQ ID NO: 2298856 - protein, 18 aa, Cryptosporidium parvum
LPQFPRLTSLNLNISLEK

SEQ ID NO: 2298857 - protein, 21 aa, Cryptosporidium parvum
LPQKPCRCILLSNILTVEELL

SEQ ID NO: 2298858 - protein, 18 aa, Cryptosporidium parvum
LPRGNIHPLTRTSRKFKR

SEQ ID NO: 2298859 - protein, 22 aa, Cryptosporidium parvum
LPRIISVSLSCRRIMKQIENLE

SEQ ID NO: 2298860 - protein, 17 aa, Cryptosporidium parvum
LPSAEIKVDGNIVNSGY

SEQ ID NO: 2298861 - protein, 18 aa, Cryptosporidium parvum
LPSAIPGQVDTSTPQANP

SEQ ID NO: 2298862 - protein, 20 aa, Cryptosporidium parvum
LPSALSIISVCISKISDDSE

SEQ ID NO: 2298863 - protein, 20 aa, Cryptosporidium parvum
LPSARDGIISSFRNCVALGL

SEQ ID NO: 2298864 - protein, 18 aa, Cryptosporidium parvum
LPSDLLAILNDIDSDGSG

SEQ ID NO: 2298865 - protein, 21 aa, Cryptosporidium parvum
LPSEAFPEYSITEDPRFQFKT

SEQ ID NO: 2298866 - protein, 17 aa, Cryptosporidium parvum
LPSIINVLLCYCGNSEW

SEQ ID NO: 2298867 - protein, 22 aa, Cryptosporidium parvum
LPSIVKRIWQYVEMKGLQNSKA

SEQ ID NO: 2298868 - protein, 20 aa, Cryptosporidium parvum
LPSIYTRYTILLECIEELIF

SEQ ID NO: 2298869 - protein, 20 aa, Cryptosporidium parvum
LPSLESRLYISEGIFCKTKL

SEQ ID NO: 2298870 - protein, 22 aa, Cryptosporidium parvum
LPSLKQLIVFKSLSDFSEGKAL

SEQ ID NO: 2298871 - protein, 19 aa, Cryptosporidium parvum
LPSNFGYTIGEKVKGEDYS

SEQ ID NO: 2298872 - protein, 26 aa, Cryptosporidium parvum
LPSNREIFHSMLFKYVNKVNIFFDHD

SEQ ID NO: 2298873 - protein, 17 aa, Cryptosporidium parvum
LPSRKNSFFGINRTAER

SEQ ID NO: 2298874 - protein, 20 aa, Cryptosporidium parvum
LPSTELIKYGNYKSDFVRQN

SEQ ID NO: 2298875 - protein, 28 aa, Cryptosporidium parvum
LPTHEIFNPKIFLDASVNTEIIPKFNNN

SEQ ID NO: 2298876 - protein, 24 aa, Cryptosporidium parvum
LPTLRTAGLPKIYTAYQYPPCCPN

SEQ ID NO: 2298877 - protein, 25 aa, Cryptosporidium parvum
LPTSPRKEMYENLKSNLSTQNENML

SEQ ID NO: 2298878 - protein, 19 aa, Cryptosporidium parvum
LPVCCVDAIMNINISLSIL

SEQ ID NO: 2298879 - protein, 17 aa, Cryptosporidium parvum
LPVICRKVFCGSNSDFG

SEQ ID NO: 2298880 - protein, 35 aa, Cryptosporidium parvum
LPVYHDMGLIGFFCTPLFFGCNIFQMSPIDFIKKP

SEQ ID NO: 2298881 - protein, 20 aa, Cryptosporidium parvum
LPWREYWCYPKNNLERLKFS

SEQ ID NO: 2298882 - protein, 17 aa, Cryptosporidium parvum
LPYETIRSIKLLEMNSY

SEQ ID NO: 2298883 - protein, 25 aa, Cryptosporidium parvum
LPYHFLLCSIGEFGELRYQDVSTGQ

SEQ ID NO: 2298884 - protein, 22 aa, Cryptosporidium parvum
LPYLQHSMIAFANRIPYQTTPE

SEQ ID NO: 2298885 - protein, 22 aa, Cryptosporidium parvum
LPYQISSPFVFKLLSLQNKYRC

SEQ ID NO: 2298886 - protein, 18 aa, Cryptosporidium parvum
LPYSTFRLNLSVTSPYNA

SEQ ID NO: 2298887 - protein, 17 aa, Cryptosporidium parvum
LQCIFLLNLKDEFISKV

SEQ ID NO: 2298888 - protein, 24 aa, Cryptosporidium parvum
LQDEILRINLELEQLKKEQERRNI

SEQ ID NO: 2298889 - protein, 21 aa, Cryptosporidium parvum
LQDFQMHVERVIKDLNKTESS

SEQ ID NO: 2298890 - protein, 22 aa, Cryptosporidium parvum
LQDLFKSCGSINRITIMNDKRT

SEQ ID NO: 2298891 - protein, 17 aa, Cryptosporidium parvum
LQDMILESLSEKHVEKK

SEQ ID NO: 2298892 - protein, 18 aa, Cryptosporidium parvum
LQDPRSAKKLLLVDDNTC

SEQ ID NO: 2298893 - protein, 21 aa, Cryptosporidium parvum
LQEKGLTCFINLVKNSEDVPQ

SEQ ID NO: 2298894 - protein, 20 aa, Cryptosporidium parvum
LQEQLLFSICKDVPRNDSPL

SEQ ID NO: 2298895 - protein, 19 aa, Cryptosporidium parvum
LQESLVFTLPGSKFHRLKH

SEQ ID NO: 2298896 - protein, 19 aa, Cryptosporidium parvum
LQFDTGKLEIVRRVKEMQH

SEQ ID NO: 2298897 - protein, 19 aa, Cryptosporidium parvum
LQGACKFPNEFLYLNIPIY

SEQ ID NO: 2298898 - protein, 22 aa, Cryptosporidium parvum
LQGELEGKCVEINSMRKSQDAI

SEQ ID NO: 2298899 - protein, 25 aa, Cryptosporidium parvum
LQGKGLIPVCVFDGATLPMKRVTEE

SEQ ID NO: 2298900 - protein, 21 aa, Cryptosporidium parvum
LQGRLRIGIQQTTVYQALASA

SEQ ID NO: 2298901 - protein, 23 aa, Cryptosporidium parvum
LQGSYPLSFPVQSGYFYDYYNAL

SEQ ID NO: 2298902 - protein, 24 aa, Cryptosporidium parvum
LQHKPELGRNFTIKRYSSNDRKSP

SEQ ID NO: 2298903 - protein, 21 aa, Cryptosporidium parvum
LQHPWLRSWDTPNIPLCGIGM

SEQ ID NO: 2298904 - protein, 17 aa, Cryptosporidium parvum
LQHQCYLMRLGDGHTLE

SEQ ID NO: 2298905 - protein, 19 aa, Cryptosporidium parvum
LQHRILKKAFKVFNKEICM

SEQ ID NO: 2298906 - protein, 20 aa, Cryptosporidium parvum
LQIAMGIPLKKIRDIEEYRK

SEQ ID NO: 2298907 - protein, 18 aa, Cryptosporidium parvum
LQIENCKGNLLSDSTINT

SEQ ID NO: 2298908 - protein, 21 aa, Cryptosporidium parvum
LQILELIGVVVNSGVWPFGRI

SEQ ID NO: 2298909 - protein, 23 aa, Cryptosporidium parvum
LQIPNEKLFEWFVKKESINSKKV

SEQ ID NO: 2298910 - protein, 19 aa, Cryptosporidium parvum
LQIRSDLRLDISKNNEILD

SEQ ID NO: 2298911 - protein, 19 aa, Cryptosporidium parvum
LQISIEIIFHISKSQNCLK

SEQ ID NO: 2298912 - protein, 22 aa, Cryptosporidium parvum
LQIWMNGFIDLVAYLPEKTMYH

SEQ ID NO: 2298913 - protein, 26 aa, Cryptosporidium parvum
LQKDHFKAGLLFYKKKYHEVVTPSLL

SEQ ID NO: 2298914 - protein, 24 aa, Cryptosporidium parvum
LQKICSPFGRINRLCLSPSKTIAI

SEQ ID NO: 2298915 - protein, 25 aa, Cryptosporidium parvum
LQKIVFELLTSVLFYLDIPYITAIE

SEQ ID NO: 2298916 - protein, 18 aa, Cryptosporidium parvum
LQKLGNSMIDYINDQNKQ

SEQ ID NO: 2298917 - protein, 26 aa, Cryptosporidium parvum
LQKLKRLPLFLTEEGRYIEPIDTNSK

SEQ ID NO: 2298918 - protein, 22 aa, Cryptosporidium parvum
LQKLLRFVSGRSRLPQVNNNSS

SEQ ID NO: 2298919 - protein, 24 aa, Cryptosporidium parvum
LQKNIKEFEFMLSKLIEKKNSINS

SEQ ID NO: 2298920 - protein, 20 aa, Cryptosporidium parvum
LQKNKCYAINMVVSNDERNL

SEQ ID NO: 2298921 - protein, 22 aa, Cryptosporidium parvum
LQKRLSEELERASEFASKAEAN

SEQ ID NO: 2298922 - protein, 35 aa, Cryptosporidium parvum
LQLAHKCILNSFYGYVMRKGSRWFSMEMAAIVTWV

SEQ ID NO: 2298923 - protein, 24 aa, Cryptosporidium parvum
LQLEKRYAALFALRNILTGIIDSN

SEQ ID NO: 2298924 - protein, 27 aa, Cryptosporidium parvum
LQLGKWRECRDYVFSLSIWDYNQEDLQ

SEQ ID NO: 2298925 - protein, 23 aa, Cryptosporidium parvum
LQLKPRVAFNMACGNRRCVHLRH

SEQ ID NO: 2298926 - protein, 17 aa, Cryptosporidium parvum
LQLMMGITNTRMNNRQK

SEQ ID NO: 2298927 - protein, 19 aa, Cryptosporidium parvum
LQLNGCHKVDVLNHHRQKN

SEQ ID NO: 2298928 - protein, 19 aa, Cryptosporidium parvum
LQLPNLVPTCRSMIENGNL

SEQ ID NO: 2298929 - protein, 19 aa, Cryptosporidium parvum
LQLRKGGIQSLQISDDGSG

SEQ ID NO: 2298930 - protein, 26 aa, Cryptosporidium parvum
LQLSDYFRLLIDRSIEIRNWRRGEKY

SEQ ID NO: 2298931 - protein, 37 aa, Cryptosporidium parvum; identical to SEQ ID NO: 2176943

SEQ ID NO: 2298932 - protein, 32 aa, Cryptosporidium parvum
LQLSLELSKALRLPVLYLLQFKKNLTNFLYDI

SEQ ID NO: 2298933 - protein, 19 aa, Cryptosporidium parvum
LQLYSWLDMKLSQYESKQR

SEQ ID NO: 2298934 - protein, 19 aa, Cryptosporidium parvum
LQNACNLKGNREMMNFDIS

SEQ ID NO: 2298935 - protein, 24 aa, Cryptosporidium parvum
LQNALRIFLRRALYKDGAAIRDNK

SEQ ID NO: 2298936 - protein, 18 aa, Cryptosporidium parvum
LQNFKISSVVWTHTNELL

SEQ ID NO: 2298937 - protein, 19 aa, Cryptosporidium parvum
LQNILIYWTNLIHEYETEK

SEQ ID NO: 2298938 - protein, 17 aa, Cryptosporidium parvum
LQNNLMELWSLLHFLMP

SEQ ID NO: 2298939 - protein, 26 aa, Cryptosporidium parvum
LQNNLRELWSLLNFLMPNLFSSSEDF

SEQ ID NO: 2298940 - protein, 24 aa, Cryptosporidium parvum
LQNPRFVRDYCFVPSVMARFVNSG

SEQ ID NO: 2298941 - protein, 27 aa, Cryptosporidium parvum
LQNSLRELWSLLNFLYPEIFSSSEEFE

SEQ ID NO: 2298942 - protein, 18 aa, Cryptosporidium parvum
LQNWKKARTFLDLARSKN

SEQ ID NO: 2298943 - protein, 18 aa, Cryptosporidium parvum
LQPLELILNAEIRQQDIF

SEQ ID NO: 2298944 - protein, 18 aa, Cryptosporidium parvum
LQQFDWIFKINKLPLWLH

SEQ ID NO: 2298945 - protein, 19 aa, Cryptosporidium parvum
LQQLSGWTVVADRLNFNRF

SEQ ID NO: 2298946 - protein, 27 aa, Cryptosporidium parvum
LQQRIRGGAVPPVLRPGAIPPGPPGVH

SEQ ID NO: 2298947 - protein, 23 aa, Cryptosporidium parvum
LQRLRWKHFIVRGEIIKDVSIDK

SEQ ID NO: 2298948 - protein, 45 aa, Cryptosporidium parvum; identical to SEQ ID NO: 2176961

SEQ ID NO: 2298949 - protein, 25 aa, Cryptosporidium parvum
LQRSCKRLMTHINIRETEFGNKLLD

SEQ ID NO: 2298950 - protein, 25 aa, Cryptosporidium parvum
LQRWFYELFHDFPFFSISPYTKTLK

SEQ ID NO: 2298951 - protein, 40 aa, Cryptosporidium parvum
LQSEEVIELFIDRNGFLFQYILDYLRTGTIVAIPNKDHII

SEQ ID NO: 2298952 - protein, 22 aa, Cryptosporidium parvum
LQSELIFEMSLFDTHVKEIKEM

SEQ ID NO: 2298953 - protein, 17 aa, Cryptosporidium parvum
LQSGIILADEEDFKTSF

SEQ ID NO: 2298954 - protein, 21 aa, Cryptosporidium parvum
LQSGRESMIFSDSRRGSNDGV

SEQ ID NO: 2298955 - protein, 17 aa, Cryptosporidium parvum
LQSLKYMLLSKIMSQQT

SEQ ID NO: 2298956 - protein, 20 aa, Cryptosporidium parvum
LQSLQCEYIYLACKFKNDST

SEQ ID NO: 2298957 - protein, 24 aa, Cryptosporidium parvum
LQSRCTRFRFSPLPIEDIRNRISE

SEQ ID NO: 2298958 - protein, 23 aa, Cryptosporidium parvum
LQSREFLDLNLDYSFESNSASME

SEQ ID NO: 2298959 - protein, 25 aa, Cryptosporidium parvum
LQTDWSTKCCCTSRVKFSDTDIQED

SEQ ID NO: 2298960 - protein, 20 aa, Cryptosporidium parvum
LQTFIGIKAKKGFKKLQLMN

SEQ ID NO: 2298961 - protein, 36 aa, Cryptosporidium parvum; identical to SEQ ID NO: 2176973

SEQ ID NO: 2298962 - protein, 32 aa, Cryptosporidium parvum
LQTMINKAILPWFRLGSRPILSDESDEYSETC

SEQ ID NO: 2298963 - protein, 24 aa, Cryptosporidium parvum
LQVKEISNLLLLFKKLQENVDASI

SEQ ID NO: 2298964 - protein, 20 aa, Cryptosporidium parvum
LQVLLSLPFIGRSYDFQVSY

SEQ ID NO: 2298965 - protein, 17 aa, Cryptosporidium parvum
LQVPPILGQNANLIAQM

SEQ ID NO: 2298966 - protein, 24 aa, Cryptosporidium parvum
LQVTLYCRLLDWVVFICNENLRPA

SEQ ID NO: 2298967 - protein, 18 aa, Cryptosporidium parvum
LQVVQVCYIILRNFGIML

SEQ ID NO: 2298968 - protein, 25 aa, Cryptosporidium parvum
LQVYRFGETVSIPFFDGSWQPSSFY

SEQ ID NO: 2298969 - protein, 17 aa, Cryptosporidium parvum
LQWDNSWSLFSGKTVHF

SEQ ID NO: 2298970 - protein, 19 aa, Cryptosporidium parvum
LQWHLGEGSAIINVNLKSR

SEQ ID NO: 2298971 - protein, 17 aa, Cryptosporidium parvum
LQYKRFYSLTEWISKYC

SEQ ID NO: 2298972 - protein, 21 aa, Cryptosporidium parvum
LQYRCIDSIAPLNTHQVNNGY

SEQ ID NO: 2298973 - protein, 24 aa, Cryptosporidium parvum
LRAHKEWVKRFAISAESSSLIATV

SEQ ID NO: 2298974 - protein, 19 aa, Cryptosporidium parvum
LRAIGSSSRLAMSLMTTGY

SEQ ID NO: 2298975 - protein, 17 aa, Cryptosporidium parvum
LRAKRLFQNAIQVKPGI

SEQ ID NO: 2298976 - protein, 21 aa, Cryptosporidium parvum
LRAKRNLFDFVEDKYLLELRL

SEQ ID NO: 2298977 - protein, 29 aa, Cryptosporidium parvum
LRAKYGKGFDIIRKMGFKGGGLGVDGSGI

SEQ ID NO: 2298978 - protein, 19 aa, Cryptosporidium parvum
LRALSPGDKDIWLESICMV

SEQ ID NO: 2298979 - protein, 21 aa, Cryptosporidium parvum
LRANLGINVAKNFKEEVEALG

SEQ ID NO: 2298980 - protein, 17 aa, Cryptosporidium parvum
LRCEYCSNYKSINIFDC

SEQ ID NO: 2298981 - protein, 22 aa, Cryptosporidium parvum
LRDEIFSSLLFPGSKVSAGTLY

SEQ ID NO: 2298982 - protein, 18 aa, Cryptosporidium parvum
LRDFTKVRSSGTCLQDRL

SEQ ID NO: 2298983 - protein, 17 aa, Cryptosporidium parvum
LRDGGKLCIFRRLTQEL

SEQ ID NO: 2298984 - protein, 30 aa, Cryptosporidium parvum
LRDNALPACISYFYKCFYDDKSAIKNSIDS

SEQ ID NO: 2298985 - protein, 18 aa, Cryptosporidium parvum
LREASPFFRNNYEYDHSY

SEQ ID NO: 2298986 - protein, 17 aa, Cryptosporidium parvum
LREEYDREMKLFMEYQS

SEQ ID NO: 2298987 - protein, 21 aa, Cryptosporidium parvum
LREEYIPIIFFDIYAKCCSPN

SEQ ID NO: 2298988 - protein, 18 aa, Cryptosporidium parvum
LREHQRQGVTFIFECLMG

SEQ ID NO: 2298989 - protein, 18 aa, Cryptosporidium parvum
LREITIFSITPYVSSIGR

SEQ ID NO: 2298990 - protein, 18 aa, Cryptosporidium parvum
LREIYKIRESYELAQNSC

SEQ ID NO: 2298991 - protein, 22 aa, Cryptosporidium parvum
LREKGSRVLIFSQMVRMLNIIS

SEQ ID NO: 2298992 - protein, 23 aa, Cryptosporidium parvum
LRELGAYEVLRVWHLYESKDEII

SEQ ID NO: 2298993 - protein, 18 aa, Cryptosporidium parvum
LRELKKPYDCSFVSREFR

SEQ ID NO: 2298994 - protein, 23 aa, Cryptosporidium parvum
LRELYKDEVRMIGKKIGLNDELI

SEQ ID NO: 2298995 - protein, 24 aa, Cryptosporidium parvum
LREMSLDDSCLFSIRQFLHLVPRL

SEQ ID NO: 2298996 - protein, 22 aa, Cryptosporidium parvum
LRESAIEFAKSIPLPDEPPADH

SEQ ID NO: 2298997 - protein, 18 aa, Cryptosporidium parvum
LRETFSLLDINGDGYITP

SEQ ID NO: 2298998 - protein, 24 aa, Cryptosporidium parvum
LREVGLKPDFLFGRCEVPIDDICR

SEQ ID NO: 2298999 - protein, 18 aa, Cryptosporidium parvum
LREVIKHSYENGDIQFEE

SEQ ID NO: 2299000 - protein, 19 aa, Cryptosporidium parvum
LREYLNFDFGEIRDQIGYI

SEQ ID NO: 2299001 - protein, 20 aa, Cryptosporidium parvum
LREYWIKYDPIIRLVSSDSR

SEQ ID NO: 2299002 - protein, 20 aa, Cryptosporidium parvum
LRFAMGHSIQGVWKDGVLSQ

SEQ ID NO: 2299003 - protein, 20 aa, Cryptosporidium parvum
LRFATEAAITLLRIDDYIKV

SEQ ID NO: 2299004 - protein, 17 aa, Cryptosporidium parvum
LRFKDFKNTDLVDILIN

SEQ ID NO: 2299005 - protein, 21 aa, Cryptosporidium parvum
LRFLHKSLETIYMAYYSKPNY

SEQ ID NO: 2299006 - protein, 17 aa, Cryptosporidium parvum
LRFSAQVVQCRAYTCLE

SEQ ID NO: 2299007 - protein, 29 aa, Cryptosporidium parvum
LRGHEGPVWQVCWAHPTFGSVLASCSYDK

SEQ ID NO: 2299008 - protein, 22 aa, Cryptosporidium parvum
LRGKVVSSFSFFPPKLSGLVLR

SEQ ID NO: 2299009 - protein, 20 aa, Cryptosporidium parvum
LRGVALKFAQFINLNNIGIP

SEQ ID NO: 2299010 - protein, 19 aa, Cryptosporidium parvum
LRGVLDSMLLSEKKEGNSN

SEQ ID NO: 2299011 - protein, 21 aa, Cryptosporidium parvum
LRGWIEVLKRIPLYNPSNPGG

SEQ ID NO: 2299012 - protein, 20 aa, Cryptosporidium parvum
LRGWWIKVGQFLSTRGDLLP

SEQ ID NO: 2299013 - protein, 18 aa, Cryptosporidium parvum
LRHRSWFIQSTCATAGDG

SEQ ID NO: 2299014 - protein, 17 aa, Cryptosporidium parvum
LRIEKRLENENKKRMLK

SEQ ID NO: 2299015 - protein, 17 aa, Cryptosporidium parvum
LRIHPGMLDSVFQASSV

SEQ ID NO: 2299016 - protein, 17 aa, Cryptosporidium parvum
LRIIDARMVAKEIRKER

SEQ ID NO: 2299017 - protein, 19 aa, Cryptosporidium parvum
LRINGIFTYVESNFSLTKY

SEQ ID NO: 2299018 - protein, 27 aa, Cryptosporidium parvum
LRIQKGASITPRFSLEESLNYRRSSVG

SEQ ID NO: 2299019 - protein, 19 aa, Cryptosporidium parvum
LRIRIPVLYLYNQGCNPEF

SEQ ID NO: 2299020 - protein, 18 aa, Cryptosporidium parvum
LRIYWDYYSRGILQESVK

SEQ ID NO: 2299021 - protein, 26 aa, Cryptosporidium parvum
LRKAFKARTSLLLGQGIIEEPEDTGL

SEQ ID NO: 2299022 - protein, 19 aa, Cryptosporidium parvum
LRKGLVPYLELVKAVRSGD

SEQ ID NO: 2299023 - protein, 18 aa, Cryptosporidium parvum
LRKKVWPAVIVRQRKAFR

SEQ ID NO: 2299024 - protein, 20 aa, Cryptosporidium parvum
LRKMYCKYNQPYLTCLDCLE

SEQ ID NO: 2299025 - protein, 25 aa, Cryptosporidium parvum
LRKNPDIWTIWKPEKALSLHKKQVS

SEQ ID NO: 2299026 - protein, 21 aa, Cryptosporidium parvum
LRKRSILELYDLIANGSEVYD

SEQ ID NO: 2299027 - protein, 17 aa, Cryptosporidium parvum
LRKSLEEVVIFPNQNLW

SEQ ID NO: 2299028 - protein, 18 aa, Cryptosporidium parvum
LRKTDFFTAMNQGEEEKI

SEQ ID NO: 2299029 - protein, 24 aa, Cryptosporidium parvum
LRKTIGSLVRWIGNFEYSSLKEKE

SEQ ID NO: 2299030 - protein, 25 aa, Cryptosporidium parvum
LRKVGINLPPYVPFSLGSVVIPESD

SEQ ID NO: 2299031 - protein, 20 aa, Cryptosporidium parvum
LRKYKEWYNDVVVVCNFSSR

SEQ ID NO: 2299032 - protein, 26 aa, Cryptosporidium parvum
LRLAMESLKLAMKWDEDRFGLEYDLE

SEQ ID NO: 2299033 - protein, 19 aa, Cryptosporidium parvum
LRLAPGGTFGRLTIFTKGA

SEQ ID NO: 2299034 - protein, 17 aa, Cryptosporidium parvum
LRLCSLSRISLKRKYVL

SEQ ID NO: 2299035 - protein, 32 aa, Cryptosporidium parvum
LRLESQMILFYPRMFCLSSWNLQQQETDQSLV

SEQ ID NO: 2299036 - protein, 25 aa, Cryptosporidium parvum
LRLFLEGRDGVVINGVIGCSDISQA

SEQ ID NO: 2299037 - protein, 18 aa, Cryptosporidium parvum
LRLFRSGQRPILVATDVA

SEQ ID NO: 2299038 - protein, 18 aa, Cryptosporidium parvum
LRLIIAPLALALVPVGEV

SEQ ID NO: 2299039 - protein, 20 aa, Cryptosporidium parvum
LRLILKAFLLLGNYVNHGIN

SEQ ID NO: 2299040 - protein, 24 aa, Cryptosporidium parvum
LRLKKELNEYISILLLDKNYDTFL

SEQ ID NO: 2299041 - protein, 25 aa, Cryptosporidium parvum
LRLKQQYFFVCATIQDILRRFKKSG

SEQ ID NO: 2299042 - protein, 29 aa, Cryptosporidium parvum
LRLKREFKNLDIEFIIRVLAVYKSYNLAQ

SEQ ID NO: 2299043 - protein, 28 aa, Cryptosporidium parvum
LRLLDYSEYILSIDIFTGSLVIRDSNFG

SEQ ID NO: 2299044 - protein, 18 aa, Cryptosporidium parvum
LRLLKLQRWFYELFHDFP

SEQ ID NO: 2299045 - protein, 18 aa, Cryptosporidium parvum
LRLLLEDRMRTYPSGSDE

SEQ ID NO: 2299046 - protein, 18 aa, Cryptosporidium parvum
LRLLQPVKIEKVSELDCF

SEQ ID NO: 2299047 - protein, 27 aa, Cryptosporidium parvum
LRLNSLYGSIYYFKLGIIKDLPPPIQP

SEQ ID NO: 2299048 - protein, 20 aa, Cryptosporidium parvum
LRLRGLPWSTTEIEIVQFFI

SEQ ID NO: 2299049 - protein, 17 aa, Cryptosporidium parvum
LRLVKFTSGEKIVVQGD

SEQ ID NO: 2299050 - protein, 19 aa, Cryptosporidium parvum
LRLYEKWSNTRSNHVTITQ

SEQ ID NO: 2299051 - protein, 19 aa, Cryptosporidium parvum
LRMVNTRAAIFKDPTLIIA

SEQ ID NO: 2299052 - protein, 18 aa, Cryptosporidium parvum
LRMYARLANKLSEVSFEC

SEQ ID NO: 2299053 - protein, 23 aa, Cryptosporidium parvum
LRNEQFSSVSLELVKQKSLFAKE

SEQ ID NO: 2299054 - protein, 17 aa, Cryptosporidium parvum
LRNGGKLKIVLDGKSRD

SEQ ID NO: 2299055 - protein, 17 aa, Cryptosporidium parvum
LRNIFDLILNKMEIKLS

SEQ ID NO: 2299056 - protein, 22 aa, Cryptosporidium parvum
LRNISSCIFPFIQDQGTEKDIS

SEQ ID NO: 2299057 - protein, 23 aa, Cryptosporidium parvum
LRNITGFFMSWVDEYYLEISKID

SEQ ID NO: 2299058 - protein, 21 aa, Cryptosporidium parvum
LRNKFAKLFIHERKNKNEMNV

SEQ ID NO: 2299059 - protein, 19 aa, Cryptosporidium parvum
LRNKHLISFAEKQDPSFES

SEQ ID NO: 2299060 - protein, 18 aa, Cryptosporidium parvum
LRNKMVLVLERRREEYLK

SEQ ID NO: 2299061 - protein, 18 aa, Cryptosporidium parvum
LRNLELWFISDPEITSIK

SEQ ID NO: 2299062 - protein, 19 aa, Cryptosporidium parvum
LRNLLKFDTRTGVSDRIKT

SEQ ID NO: 2299063 - protein, 17 aa, Cryptosporidium parvum
LRNLRFLVLDEADRLLS

SEQ ID NO: 2299064 - protein, 19 aa, Cryptosporidium parvum
LRNSESLRIESDFETFQGR

SEQ ID NO: 2299065 - protein, 19 aa, Cryptosporidium parvum
LRNSFKLIQLIHSLQDFFT

SEQ ID NO: 2299066 - protein, 23 aa, Cryptosporidium parvum
LRNSFQFTVCIIVEKKPYNFYQE

SEQ ID NO: 2299067 - protein, 31 aa, Cryptosporidium parvum
LRNSIIRLVPKEQLNSVFFLVSSLISKSINF

SEQ ID NO: 2299068 - protein, 21 aa, Cryptosporidium parvum
LRNVPKCWTYETSLIVDTYID

SEQ ID NO: 2299069 - protein, 32 aa, Cryptosporidium parvum; identical to SEQ ID NO: 2177055

SEQ ID NO: 2299070 - protein, 17 aa, Cryptosporidium parvum
LRPDEYLNRFLEQGVRC

SEQ ID NO: 2299071 - protein, 17 aa, Cryptosporidium parvum
LRPFLLKAVQRKWKCHL

SEQ ID NO: 2299072 - protein, 33 aa, Cryptosporidium parvum; identical to SEQ ID NO: 2177058

SEQ ID NO: 2299073 - protein, 25 aa, Cryptosporidium parvum
LRPLSGDCLTCLYSVGQEEPLVEVP

SEQ ID NO: 2299074 - protein, 19 aa, Cryptosporidium parvum
LRPQLPHSIASNGNNNIIY

SEQ ID NO: 2299075 - protein, 17 aa, Cryptosporidium parvum
LRPSLEETFEFFSQDVC

SEQ ID NO: 2299076 - protein, 19 aa, Cryptosporidium parvum
LRQEPCGNKSISQINGDKP

SEQ ID NO: 2299077 - protein, 21 aa, Cryptosporidium parvum
LRQGEFKNVWNILETSGIEHI

SEQ ID NO: 2299078 - protein, 25 aa, Cryptosporidium parvum
LRQLRCAGMLESIRIRRSGYSVRRK

SEQ ID NO: 2299079 - protein, 32 aa, Cryptosporidium parvum
LRQPFKIELSDEFSFFTSLVVSFNAEFYSQFK

SEQ ID NO: 2299080 - protein, 18 aa, Cryptosporidium parvum
LRQSCNQKRKHQVSITFI

SEQ ID NO: 2299081 - protein, 23 aa, Cryptosporidium parvum
LRQYKMRMNLYIDKSNEVYVTEP

SEQ ID NO: 2299082 - protein, 18 aa, Cryptosporidium parvum
LRRCIKEVLEQSEVNTVF

SEQ ID NO: 2299083 - protein, 20 aa, Cryptosporidium parvum
LRRFMLEGTSIIPVNVETQL

SEQ ID NO: 2299084 - protein, 35 aa, Cryptosporidium parvum; identical to SEQ ID NO: 2177067

SEQ ID NO: 2299085 - protein, 19 aa, Cryptosporidium parvum
LRRQLEFFIYHQIHTDPLW

SEQ ID NO: 2299086 - protein, 20 aa, Cryptosporidium parvum
LRRREWLLWHSKNFDKIELF

SEQ ID NO: 2299087 - protein, 21 aa, Cryptosporidium parvum
LRRRLARGVPQDFRWKIWNSL

SEQ ID NO: 2299088 - protein, 24 aa, Cryptosporidium parvum
LRRSCSDPDPYVRKTAAICIAKLY

SEQ ID NO: 2299089 - protein, 23 aa, Cryptosporidium parvum
LRSAAIRFGMRYISSGKELSFGG

SEQ ID NO: 2299090 - protein, 20 aa, Cryptosporidium parvum
LRSAPYLVGHYVRLLAQLVK

SEQ ID NO: 2299091 - protein, 17 aa, Cryptosporidium parvum
LRSAYSMAKAMVEGHNP

SEQ ID NO: 2299092 - protein, 21 aa, Cryptosporidium parvum
LRSDFVVKYIEWLKEDEEDDE

SEQ ID NO: 2299093 - protein, 25 aa, Cryptosporidium parvum
LRSEACPRLVELLGHPSPLVQTPAL

SEQ ID NO: 2299094 - protein, 23 aa, Cryptosporidium parvum
LRSEVDTIFLLSRLIEITELLDP

SEQ ID NO: 2299095 - protein, 20 aa, Cryptosporidium parvum
LRSIANILFPSYIMDEKELT

SEQ ID NO: 2299096 - protein, 18 aa, Cryptosporidium parvum
LRSIRYIKELSHEIDHVV

SEQ ID NO: 2299097 - protein, 20 aa, Cryptosporidium parvum
LRSLDFIQFQSWFSNSLKNV

SEQ ID NO: 2299098 - protein, 18 aa, Cryptosporidium parvum
LRSLKGMAGNLPIENNRL

SEQ ID NO: 2299099 - protein, 21 aa, Cryptosporidium parvum
LRSLRRTGSRFLPPNSSIYSF

SEQ ID NO: 2299100 - protein, 24 aa, Cryptosporidium parvum
LRSMKSVLRSAGKLKKSAISENKE

SEQ ID NO: 2299101 - protein, 21 aa, Cryptosporidium parvum
LRSPLSIKEVSAFEGMGKMER

SEQ ID NO: 2299102 - protein, 20 aa, Cryptosporidium parvum
LRSRCLCIRVPLPSPEEVLQ

SEQ ID NO: 2299103 - protein, 37 aa, Cryptosporidium parvum
LRSRTPLDIFTLACKYYLKDLYDKGGRELENYNLQQL

SEQ ID NO: 2299104 - protein, 20 aa, Cryptosporidium parvum
LRSSIPSKLNILSQCKHIKS

SEQ ID NO: 2299105 - protein, 20 aa, Cryptosporidium parvum
LRSSQLVEILENMLRDYFQL

SEQ ID NO: 2299106 - protein, 20 aa, Cryptosporidium parvum
LRTDIIRQMRSSIHEGPEEV

SEQ ID NO: 2299107 - protein, 20 aa, Cryptosporidium parvum
LRTDILPFLHDIIGKLLDDS

SEQ ID NO: 2299108 - protein, 17 aa, Cryptosporidium parvum
LRTGKRQKKSWKRVVNK

SEQ ID NO: 2299109 - protein, 24 aa, Cryptosporidium parvum
LRTLKGKCIECITIIGFSIDYSIF

SEQ ID NO: 2299110 - protein, 26 aa, Cryptosporidium parvum
LRTMIEFSQHINLIFWTVLSPTWNQE

SEQ ID NO: 2299111 - protein, 19 aa, Cryptosporidium parvum
LRTQFLMSLQCPIAKLRKP

SEQ ID NO: 2299112 - protein, 27 aa, Cryptosporidium parvum
LRTVELFYLKYCLPKLGDILKKYNVEI

SEQ ID NO: 2299113 - protein, 18 aa, Cryptosporidium parvum
LRTYKWFRPPFGRLTKQQ

SEQ ID NO: 2299114 - protein, 17 aa, Cryptosporidium parvum
LRVAKKVKDKVRKRKDK

SEQ ID NO: 2299115 - protein, 19 aa, Cryptosporidium parvum
LRVDNAIRIFRYNGDLLKR

SEQ ID NO: 2299116 - protein, 17 aa, Cryptosporidium parvum
LRVDSIVFSCKYLPFKF

SEQ ID NO: 2299117 - protein, 21 aa, Cryptosporidium parvum
LRVKCVISTDTIRHVLRSTEK

SEQ ID NO: 2299118 - protein, 17 aa, Cryptosporidium parvum
LRVKLRRDTEKPEYNPF

SEQ ID NO: 2299119 - protein, 27 aa, Cryptosporidium parvum
LRVKPNWRKPKGIDCRVRRKFKGNYLM

SEQ ID NO: 2299120 - protein, 23 aa, Cryptosporidium parvum
LRVLLSRLQKNLFLLAHLSNQPK

SEQ ID NO: 2299121 - protein, 17 aa, Cryptosporidium parvum
LRVLPTRYARFNSTLSF

SEQ ID NO: 2299122 - protein, 18 aa, Cryptosporidium parvum
LRVRKLIQSILWKIIKSA

SEQ ID NO: 2299123 - protein, 18 aa, Cryptosporidium parvum
LRVSCVIGGEDSGKQLAE

SEQ ID NO: 2299124 - protein, 26 aa, Cryptosporidium parvum
LRVSLPNKLFCIFSAPMDMDVLRLKR

SEQ ID NO: 2299125 - protein, 22 aa, Cryptosporidium parvum
LRYLADKCKLMGKSPEERNKIE

SEQ ID NO: 2299126 - protein, 17 aa, Cryptosporidium parvum
LRYQLPMRGHTGYLSFA

SEQ ID NO: 2299127 - protein, 19 aa, Cryptosporidium parvum
LRYRRAVETLYRMGYLCII

SEQ ID NO: 2299128 - protein, 21 aa, Cryptosporidium parvum
LRYVPESSYGVLLTSAFQNGV

SEQ ID NO: 2299129 - protein, 21 aa, Cryptosporidium parvum
LSACASRLGLSMSEEELKTML

SEQ ID NO: 2299130 - protein, 27 aa, Cryptosporidium parvum
LSACMKTLPGVDLKPILTNLMNRLSNY

SEQ ID NO: 2299131 - protein, 17 aa, Cryptosporidium parvum
LSADVLIQKSTNIHEDI

SEQ ID NO: 2299132 - protein, 18 aa, Cryptosporidium parvum
LSAEINIGIINTINMNTD

SEQ ID NO: 2299133 - protein, 19 aa, Cryptosporidium parvum
LSAGFDRYSQSNGFNSGGG

SEQ ID NO: 2299134 - protein, 17 aa, Cryptosporidium parvum
LSALGIPNTCHFKEITK

SEQ ID NO: 2299135 - protein, 17 aa, Cryptosporidium parvum
LSARRQLLMNGFHSFKQ

SEQ ID NO: 2299136 - protein, 19 aa, Cryptosporidium parvum
LSAVIWLTRFFDINLIPRE

SEQ ID NO: 2299137 - protein, 19 aa, Cryptosporidium parvum
LSCIAHLHVGESITTFQQG

SEQ ID NO: 2299138 - protein, 23 aa, Cryptosporidium parvum
LSCPQCKKLGLKTSFFCSQVCFK

SEQ ID NO: 2299139 - protein, 17 aa, Cryptosporidium parvum
LSDCESSQCKNNKRTGN

SEQ ID NO: 2299140 - protein, 21 aa, Cryptosporidium parvum
LSDCRFCILFNTFGSNSDSWP

SEQ ID NO: 2299141 - protein, 21 aa, Cryptosporidium parvum
LSDDYLSQFGIILDNNKCTKS

SEQ ID NO: 2299142 - protein, 38 aa, Cryptosporidium parvum; identical to SEQ ID NO: 2177116

SEQ ID NO: 2299143 - protein, 27 aa, Cryptosporidium parvum
LSDIELKYSGLFAFGGDIATVKGQKGL

SEQ ID NO: 2299144 - protein, 17 aa, Cryptosporidium parvum
LSDIVRAFGRILRLIPY

SEQ ID NO: 2299145 - protein, 39 aa, Cryptosporidium parvum; identical to SEQ ID NO: 2177117

SEQ ID NO: 2299146 - protein, 17 aa, Cryptosporidium parvum
LSDQELQLMMGITNTRM

SEQ ID NO: 2299147 - protein, 20 aa, Cryptosporidium parvum
LSDRMIVEFFLSAYSIPSNT

SEQ ID NO: 2299148 - protein, 19 aa, Cryptosporidium parvum
LSDTKFLKSFLRSNTKSNF

SEQ ID NO: 2299149 - protein, 23 aa, Cryptosporidium parvum
LSEAKCLFCDSSSNLTEEIWNHM

SEQ ID NO: 2299150 - protein, 17 aa, Cryptosporidium parvum
LSECLKYSGISLIQGPP

SEQ ID NO: 2299151 - protein, 25 aa, Cryptosporidium parvum
LSEICSGVIKLLYHWNENIQLEILD

SEQ ID NO: 2299152 - protein, 17 aa, Cryptosporidium parvum
LSEIKWAEITTDDLDRL

SEQ ID NO: 2299153 - protein, 31 aa, Cryptosporidium parvum; identical to SEQ ID NO: 2177123

SEQ ID NO: 2299154 - protein, 20 aa, Cryptosporidium parvum
LSEIQYRNSVKRFIGDDSIQ

SEQ ID NO: 2299155 - protein, 20 aa, Cryptosporidium parvum
LSEIRLMSIQLFNITKKKYL

SEQ ID NO: 2299156 - protein, 21 aa, Cryptosporidium parvum
LSEKFKYIVSVIVLQRSPAGF

SEQ ID NO: 2299157 - protein, 21 aa, Cryptosporidium parvum
LSEKLKLIIFDEVHMLHDSRG

SEQ ID NO: 2299158 - protein, 24 aa, Cryptosporidium parvum
LSELKRIEIELVKEMDSARSTSRN

SEQ ID NO: 2299159 - protein, 28 aa, Cryptosporidium parvum
LSELNYIPEWFRIGLRILTVSNALELRG

SEQ ID NO: 2299160 - protein, 18 aa, Cryptosporidium parvum
LSEMKKKVVVKLRKKLME

SEQ ID NO: 2299161 - protein, 21 aa, Cryptosporidium parvum
LSENTRLLGIKKVELDEARSL

SEQ ID NO: 2299162 - protein, 26 aa, Cryptosporidium parvum
LSERKRAKEYLAWLIAQRTSTVSVDT

SEQ ID NO: 2299163 - protein, 19 aa, Cryptosporidium parvum
LSERLTFFNCDVRQILPKT

SEQ ID NO: 2299164 - protein, 27 aa, Cryptosporidium parvum
LSESGMCPQRIALELSEDRVAALKSGS

SEQ ID NO: 2299165 - protein, 21 aa, Cryptosporidium parvum
LSESNLRWFITPKYIQNIIHL

SEQ ID NO: 2299166 - protein, 24 aa, Cryptosporidium parvum
LSETFRSLSNWEIIYNPRNLPFQE

SEQ ID NO: 2299167 - protein, 25 aa, Cryptosporidium parvum
LSFIDRLKNLFAILNNKKIQFPLDY

SEQ ID NO: 2299168 - protein, 19 aa, Cryptosporidium parvum
LSFIPKLSYDILLAHVPGC

SEQ ID NO: 2299169 - protein, 20 aa, Cryptosporidium parvum
LSFIQWKFPTRVLNNSNQII

SEQ ID NO: 2299170 - protein, 19 aa, Cryptosporidium parvum
LSFLYSKGHSVDWKIEAIE

SEQ ID NO: 2299171 - protein, 25 aa, Cryptosporidium parvum
LSFWYTISSLYSFQGKPMLKPLNWL

SEQ ID NO: 2299172 - protein, 17 aa, Cryptosporidium parvum
LSGTFRYLTTILLCDRL

SEQ ID NO: 2299173 - protein, 26 aa, Cryptosporidium parvum
LSGTVSRIGSPMIIKGNEMNYSQMTK

SEQ ID NO: 2299174 - protein, 26 aa, Cryptosporidium parvum
LSHKLNYLISIMFEKLYHGTEVRKYY

SEQ ID NO: 2299175 - protein, 23 aa, Cryptosporidium parvum
LSHLPKLECLMLNGNRLKEISFI

SEQ ID NO: 2299176 - protein, 27 aa, Cryptosporidium parvum
LSHLWRASLNILLLLARCSNSVLISES

SEQ ID NO: 2299177 - protein, 18 aa, Cryptosporidium parvum
LSICQGTWLYYENPVAHF

SEQ ID NO: 2299178 - protein, 19 aa, Cryptosporidium parvum
LSIDIWKYLDKKGFKSEII

SEQ ID NO: 2299179 - protein, 22 aa, Cryptosporidium parvum
LSIGEIAASFALLRIPRVKEIL

SEQ ID NO: 2299180 - protein, 17 aa, Cryptosporidium parvum
LSIILLPILRLSLKTTR

SEQ ID NO: 2299181 - protein, 25 aa, Cryptosporidium parvum
LSIREPGKLLADWFNIIDLSILTDK

SEQ ID NO: 2299182 - protein, 18 aa, Cryptosporidium parvum
LSISKSRDEYGRWCRSIL

SEQ ID NO: 2299183 - protein, 19 aa, Cryptosporidium parvum
LSISLNVKECLALFPIKKF

SEQ ID NO: 2299184 - protein, 25 aa, Cryptosporidium parvum
LSISNSRIVLSFGFDNLIYSGYMLG

SEQ ID NO: 2299185 - protein, 24 aa, Cryptosporidium parvum
LSISRASFSWGVPVPNDQEHVMYV

SEQ ID NO: 2299186 - protein, 38 aa, Cryptosporidium parvum; identical to SEQ ID NO: 2177156

SEQ ID NO: 2299187 - protein, 19 aa, Cryptosporidium parvum
LSIWMPFYRVHSHIDSPKR

SEQ ID NO: 2299188 - protein, 31 aa, Cryptosporidium parvum
LSKATRSRLLLKERIFSMNPFEVNINGQIET

SEQ ID NO: 2299189 - protein, 25 aa, Cryptosporidium parvum
LSKFIWERIKNIFNYHEFEINENDS

SEQ ID NO: 2299190 - protein, 27 aa, Cryptosporidium parvum
LSKFKEAFEWLKIKFDYTQSERKDLKN

SEQ ID NO: 2299191 - protein, 25 aa, Cryptosporidium parvum
LSKIPFPILLVYIGLNAGLFRGSEF

SEQ ID NO: 2299192 - protein, 21 aa, Cryptosporidium parvum
LSKIPLKLAYFNISKFWEEAE

SEQ ID NO: 2299193 - protein, 25 aa, Cryptosporidium parvum
LSKIWPLSFLKPRFTPEVLSDQVQH

SEQ ID NO: 2299194 - protein, 26 aa, Cryptosporidium parvum
LSKLEYSECLVIILGYDFLFEKSPIL

SEQ ID NO: 2299195 - protein, 23 aa, Cryptosporidium parvum
LSKNTFKSLGFNGVIEIKNDYTE

SEQ ID NO: 2299196 - protein, 25 aa, Cryptosporidium parvum
LSKRNCISLSFLLEEERLIINSPCI

SEQ ID NO: 2299197 - protein, 22 aa, Cryptosporidium parvum
LSKSELEAECKLRGLNSKGSKE

SEQ ID NO: 2299198 - protein, 26 aa, Cryptosporidium parvum
LSKWKFDEIRLICSLGNKKDFLTFLG

SEQ ID NO: 2299199 - protein, 17 aa, Cryptosporidium parvum
LSKYKGFEFEYCKLGRN

SEQ ID NO: 2299200 - protein, 17 aa, Cryptosporidium parvum
LSLDAAAILENFYVKIR

SEQ ID NO: 2299201 - protein, 25 aa, Cryptosporidium parvum
LSLDALKTLPGWGARQKLERFGLRF

SEQ ID NO: 2299202 - protein, 26 aa, Cryptosporidium parvum
LSLECISESLSPFFFNRQEKLNVLES

SEQ ID NO: 2299203 - protein, 24 aa, Cryptosporidium parvum
LSLELIKLFIYIWGLDKSFSIDES

SEQ ID NO: 2299204 - protein, 22 aa, Cryptosporidium parvum
LSLFCSTNCYYLYLDLSISLSE

SEQ ID NO: 2299205 - protein, 27 aa, Cryptosporidium parvum
LSLFKDLRIIQSYAYRVPYSVKVLADE

SEQ ID NO: 2299206 - protein, 21 aa, Cryptosporidium parvum
LSLFKLKKLPQFPRLTSLNLN

SEQ ID NO: 2299207 - protein, 19 aa, Cryptosporidium parvum
LSLFLKLRLFLEGRDGVVI

SEQ ID NO: 2299208 - protein, 17 aa, Cryptosporidium parvum
LSLFRSKIPQLIRHLGW

SEQ ID NO: 2299209 - protein, 18 aa, Cryptosporidium parvum
LSLHKALLIKVSLKVFIH

SEQ ID NO: 2299210 - protein, 25 aa, Cryptosporidium parvum
LSLKHPRILFRIYGKHVGKFYDSKV

SEQ ID NO: 2299211 - protein, 17 aa, Cryptosporidium parvum
LSLNEFEVCKSNIYGLA

SEQ ID NO: 2299212 - protein, 20 aa, Cryptosporidium parvum
LSLNNRSKFFIFMQRNSSFE

SEQ ID NO: 2299213 - protein, 18 aa, Cryptosporidium parvum
LSLPKTIFAHGFVTAPDG

SEQ ID NO: 2299214 - protein, 20 aa, Cryptosporidium parvum
LSLRSLCSIKDQIPIELYEH

SEQ ID NO: 2299215 - protein, 25 aa, Cryptosporidium parvum
LSLRYDLTVPLARYIATSGLDHLKR

SEQ ID NO: 2299216 - protein, 28 aa, Cryptosporidium parvum
LSLRYHPFENICGFTNPYYGENNGLTEL

SEQ ID NO: 2299217 - protein, 22 aa, Cryptosporidium parvum
LSLYCVIYLLSMNVAMDEYGNP

SEQ ID NO: 2299218 - protein, 17 aa, Cryptosporidium parvum
LSLYYKLHTVFNKNFKI

SEQ ID NO: 2299219 - protein, 22 aa, Cryptosporidium parvum
LSNAEVINFPSALLKLRESVLS

SEQ ID NO: 2299220 - protein, 19 aa, Cryptosporidium parvum
LSNAKFTLSVIKIGGNTKT

SEQ ID NO: 2299221 - protein, 21 aa, Cryptosporidium parvum
LSNDFKHWSIKLAKRNSERQA

SEQ ID NO: 2299222 - protein, 39 aa, Cryptosporidium parvum
LSNEASHISKWIRDEYRFNNPMFLIPKKVKKNFKNEVCS

SEQ ID NO: 2299223 - protein, 21 aa, Cryptosporidium parvum
LSNGELYTWGCSKNGKLGHGQ

SEQ ID NO: 2299224 - protein, 24 aa, Cryptosporidium parvum
LSNGTYLLTLDYFIPLIETLNEIL

SEQ ID NO: 2299225 - protein, 27 aa, Cryptosporidium parvum
LSNIIPWGRMVNSLGYWASNLDINTFF

SEQ ID NO: 2299226 - protein, 18 aa, Cryptosporidium parvum
LSNLSILYMFEFPEKRGK

SEQ ID NO: 2299227 - protein, 17 aa, Cryptosporidium parvum
LSNMWVPYISYSKCFYN

SEQ ID NO: 2299228 - protein, 17 aa, Cryptosporidium parvum
LSNNFLVAISQINDNLK

SEQ ID NO: 2299229 - protein, 18 aa, Cryptosporidium parvum
LSNTTVCSIWKIERLIGG

SEQ ID NO: 2299230 - protein, 24 aa, Cryptosporidium parvum
LSNYLSELLINFPVNVISGNDFVE

SEQ ID NO: 2299231 - protein, 17 aa, Cryptosporidium parvum
LSPDLYESYGIKSYKYE

SEQ ID NO: 2299232 - protein, 20 aa, Cryptosporidium parvum
LSPECLIFAQRFLKPSGIMI

SEQ ID NO: 2299233 - protein, 24 aa, Cryptosporidium parvum
LSPFKLKLEIARWLSNCISCLTSS

SEQ ID NO: 2299234 - protein, 18 aa, Cryptosporidium parvum
LSPIKGMLGYTRQSLIGG

SEQ ID NO: 2299235 - protein, 20 aa, Cryptosporidium parvum
LSPSCENLALACADGSIKMF

SEQ ID NO: 2299236 - protein, 18 aa, Cryptosporidium parvum
LSPSEWPGTLEINPPEVL

SEQ ID NO: 2299237 - protein, 18 aa, Cryptosporidium parvum
LSPSLAVFAPEILQKVGL

SEQ ID NO: 2299238 - protein, 23 aa, Cryptosporidium parvum
LSPSPDYWLMFKRSIYNDIHNTS

SEQ ID NO: 2299239 - protein, 17 aa, Cryptosporidium parvum
LSPSWILCIDIAAILLT

SEQ ID NO: 2299240 - protein, 27 aa, Cryptosporidium parvum
LSPTAFKGFQKRFFKLNLTDNALLYWR

SEQ ID NO: 2299241 - protein, 24 aa, Cryptosporidium parvum
LSQCKFEKYLACSKNKVQKNEIIE

SEQ ID NO: 2299242 - protein, 18 aa, Cryptosporidium parvum
LSQNCLLISSICKKLDIK

SEQ ID NO: 2299243 - protein, 18 aa, Cryptosporidium parvum
LSQNILICGGLASVPGFE

SEQ ID NO: 2299244 - protein, 19 aa, Cryptosporidium parvum
LSRALPLDLGIDFNSNSSQ

SEQ ID NO: 2299245 - protein, 23 aa, Cryptosporidium parvum
LSRENLRLGVLSGNLVLENLKLK

SEQ ID NO: 2299246 - protein, 22 aa, Cryptosporidium parvum
LSRLEYYEDFNLLSKRITRDNQ

SEQ ID NO: 2299247 - protein, 25 aa, Cryptosporidium parvum
LSRLHSVLRPFLLRRLKKDVEKEMP

SEQ ID NO: 2299248 - protein, 21 aa, Cryptosporidium parvum
LSRQLAGLLLKNAVSGIEPRI

SEQ ID NO: 2299249 - protein, 19 aa, Cryptosporidium parvum
LSRRLWDLEETLSFSNLDS

SEQ ID NO: 2299250 - protein, 25 aa, Cryptosporidium parvum
LSRSKDCIYPFGFKPILNEIVNRHK

SEQ ID NO: 2299251 - protein, 17 aa, Cryptosporidium parvum
LSSALALSAGVLPQHTF

SEQ ID NO: 2299252 - protein, 18 aa, Cryptosporidium parvum
LSSALPWFTSRRKSQQLV

SEQ ID NO: 2299253 - protein, 17 aa, Cryptosporidium parvum
LSSCMGVSDTHRGQHSE

SEQ ID NO: 2299254 - protein, 24 aa, Cryptosporidium parvum
LSSDSWGSFLPYSKITDYCFENSP

SEQ ID NO: 2299255 - protein, 23 aa, Cryptosporidium parvum
LSSEMKLQYKVRIMLETNSLSEF

SEQ ID NO: 2299256 - protein, 17 aa, Cryptosporidium parvum
LSSFGLCEFDSPEGVIN

SEQ ID NO: 2299257 - protein, 24 aa, Cryptosporidium parvum
LSSGLIKKRITIIPLDKIMDPSIP

SEQ ID NO: 2299258 - protein, 17 aa, Cryptosporidium parvum
LSSGVGTMFYMAPEQCK

SEQ ID NO: 2299259 - protein, 17 aa, Cryptosporidium parvum
LSSICIDELVKKPVFMN

SEQ ID NO: 2299260 - protein, 29 aa, Cryptosporidium parvum
LSSIECSILFQKRCTLSFRNQNFDPANWI

SEQ ID NO: 2299261 - protein, 17 aa, Cryptosporidium parvum
LSSISLKYVNNCNSQIP

SEQ ID NO: 2299262 - protein, 25 aa, Cryptosporidium parvum
LSSKAGGCGINLIGANRLVMFDPDW

SEQ ID NO: 2299263 - protein, 34 aa, Cryptosporidium parvum
LSSKKWNNICFIDHFSIKFNHWVGTIIDSISNIT

SEQ ID NO: 2299264 - protein, 23 aa, Cryptosporidium parvum
LSSKLPLPFPIPIQQQPQLQMVN

SEQ ID NO: 2299265 - protein, 20 aa, Cryptosporidium parvum
LSSLALVFALHQFRPSPLYF

SEQ ID NO: 2299266 - protein, 31 aa, Cryptosporidium parvum
LSSLFLELPSYFPAMYVPRAYVNNVKVIMSK

SEQ ID NO: 2299267 - protein, 21 aa, Cryptosporidium parvum
LSSLKSMNGMYLSNMISGRNL

SEQ ID NO: 2299268 - protein, 20 aa, Cryptosporidium parvum
LSSLLELHAAFLAFTLTLYP

SEQ ID NO: 2299269 - protein, 18 aa, Cryptosporidium parvum
LSSLLVKLKNSLEEYQAE

SEQ ID NO: 2299270 - protein, 20 aa, Cryptosporidium parvum
LSSLPPAKLFQLRDQTQDEM

SEQ ID NO: 2299271 - protein, 21 aa, Cryptosporidium parvum
LSSLPYLLNFEIFSSIENSLL

SEQ ID NO: 2299272 - protein, 18 aa, Cryptosporidium parvum
LSSLVRCAILGGADFIVT

SEQ ID NO: 2299273 - protein, 35 aa, Cryptosporidium parvum
LSSLYRISRIKLISFTWRKIVLNAKLSSFKTLPTV

SEQ ID NO: 2299274 - protein, 18 aa, Cryptosporidium parvum
LSSMLSIDSNNTAFANNI

SEQ ID NO: 2299275 - protein, 20 aa, Cryptosporidium parvum
LSSMRWNIVTNGNFLFYSLF

SEQ ID NO: 2299276 - protein, 23 aa, Cryptosporidium parvum
LSSPRSSEVIGEMIYDSGNNSVD

SEQ ID NO: 2299277 - protein, 21 aa, Cryptosporidium parvum
LSSRLICKVANLTSEISQTKS

SEQ ID NO: 2299278 - protein, 40 aa, Cryptosporidium parvum; identical to SEQ ID NO: 2177234

SEQ ID NO: 2299279 - protein, 18 aa, Cryptosporidium parvum
LSSTLPLSSKSHIQGCLT

SEQ ID NO: 2299280 - protein, 21 aa, Cryptosporidium parvum
LSSTNWPTWLGLSPLAENVIS

SEQ ID NO: 2299281 - protein, 19 aa, Cryptosporidium parvum
LSSYLNIGGLREFDLEIVN

SEQ ID NO: 2299282 - protein, 18 aa, Cryptosporidium parvum
LSTFGFQISPNIQSGCSE

SEQ ID NO: 2299283 - protein, 17 aa, Cryptosporidium parvum
LSTFVKFKGHINEETLL

SEQ ID NO: 2299284 - protein, 23 aa, Cryptosporidium parvum
LSTIKFRAIVYVVNLLQGDKLIF

SEQ ID NO: 2299285 - protein, 22 aa, Cryptosporidium parvum
LSTLEYFNCCLNLSGDIEPFPD

SEQ ID NO: 2299286 - protein, 17 aa, Cryptosporidium parvum
LSTMWLQNFHKGLNIKD

SEQ ID NO: 2299287 - protein, 17 aa, Cryptosporidium parvum
LSTSMYVHLVRHLDHYD

SEQ ID NO: 2299288 - protein, 17 aa, Cryptosporidium parvum
LSTYLSWLYLNKTQKIF

SEQ ID NO: 2299289 - protein, 26 aa, Cryptosporidium parvum
LSVKTIKRWGLLCCGCYTYERDTSRK

SEQ ID NO: 2299290 - protein, 29 aa, Cryptosporidium parvum
LSVQLPSCRSLRTSIRINRSSTLSHLGKN

SEQ ID NO: 2299291 - protein, 24 aa, Cryptosporidium parvum
LSVVEFFKYPIPFFSKKNISKNGF

SEQ ID NO: 2299292 - protein, 31 aa, Cryptosporidium parvum; identical to SEQ ID NO: 2177249

SEQ ID NO: 2299293 - protein, 25 aa, Cryptosporidium parvum
LSYEYEIYGFLSFSHVKIIVVLQDH

SEQ ID NO: 2299294 - protein, 24 aa, Cryptosporidium parvum
LSYKRSDIKLVIMSASIDVFEFVK

SEQ ID NO: 2299295 - protein, 24 aa, Cryptosporidium parvum
LSYLEFLDLPTLELIGIDPAVLGG

SEQ ID NO: 2299296 - protein, 17 aa, Cryptosporidium parvum
LSYLPTHSIPIFADKCK

SEQ ID NO: 2299297 - protein, 23 aa, Cryptosporidium parvum
LSYNLNDSKLWYSFFPKKTDQFN

SEQ ID NO: 2299298 - protein, 20 aa, Cryptosporidium parvum
LSYTLEWPTLTIDWLPNSYK

SEQ ID NO: 2299299 - protein, 20 aa, Cryptosporidium parvum
LSYVFIRLGDILQLAEKYYE

SEQ ID NO: 2299300 - protein, 19 aa, Cryptosporidium parvum
LTAPLPVMYPYHRGIGRAI

SEQ ID NO: 2299301 - protein, 20 aa, Cryptosporidium parvum
LTATQSYPAFMAYTCLEEFH

SEQ ID NO: 2299302 - protein, 19 aa, Cryptosporidium parvum
LTCDIGILVHNDWDKYKDK

SEQ ID NO: 2299303 - protein, 43 aa, Cryptosporidium parvum
LTCPSKFRTAFECFRFGSIYPNSSWTEFYLFDGEEGRNNYLGG

SEQ ID NO: 2299304 - protein, 23 aa, Cryptosporidium parvum
LTDSQNVVFQWAIQDGIDPNNNT

SEQ ID NO: 2299305 - protein, 29 aa, Cryptosporidium parvum
LTEDCNVLWKWILRQGFVNRDNHSNYSSS

SEQ ID NO: 2299306 - protein, 24 aa, Cryptosporidium parvum
LTEIEMALRKCVKNDYNPSLELNE

SEQ ID NO: 2299307 - protein, 25 aa, Cryptosporidium parvum
LTEIFKNPVKIEWKKYLNDKIKPGE

SEQ ID NO: 2299308 - protein, 24 aa, Cryptosporidium parvum
LTEILPIKLFRSMITFLNTRTFSK

SEQ ID NO: 2299309 - protein, 20 aa, Cryptosporidium parvum
LTEPDGWVRIPLSPREIADN

SEQ ID NO: 2299310 - protein, 21 aa, Cryptosporidium parvum
LTEPSTINWNFGKIKSNNSNI

SEQ ID NO: 2299311 - protein, 21 aa, Cryptosporidium parvum
LTEWEKIGWLTASRLLLEIDS

SEQ ID NO: 2299312 - protein, 23 aa, Cryptosporidium parvum
LTEWISKYCKYHLFQKHPSCIPI

SEQ ID NO: 2299313 - protein, 25 aa, Cryptosporidium parvum
LTEYEKWERSMSIAGFINSDTTNNA

SEQ ID NO: 2299314 - protein, 18 aa, Cryptosporidium parvum
LTEYFMKRERLGIRTSTD

SEQ ID NO: 2299315 - protein, 24 aa, Cryptosporidium parvum
LTFSVFDAGFKWQSDELFDQQEMA

SEQ ID NO: 2299316 - protein, 17 aa, Cryptosporidium parvum
LTFTSALSYLRRLNTPL

SEQ ID NO: 2299317 - protein, 18 aa, Cryptosporidium parvum
LTGERNFENICKRMIKAA

SEQ ID NO: 2299318 - protein, 17 aa, Cryptosporidium parvum
LTGRGRLGSGTTNHSNC

SEQ ID NO: 2299319 - protein, 18 aa, Cryptosporidium parvum
LTHFPLFLNEPFTSNENN

SEQ ID NO: 2299320 - protein, 18 aa, Cryptosporidium parvum
LTHLNWIKLFKDLIEGCI

SEQ ID NO: 2299321 - protein, 18 aa, Cryptosporidium parvum
LTIDEILGLFNLLPTMAS

SEQ ID NO: 2299322 - protein, 32 aa, Cryptosporidium parvum; identical to SEQ ID NO: 2177275

SEQ ID NO: 2299323 - protein, 22 aa, Cryptosporidium parvum
LTIKVLKDWNEHLSLNGLILQS

SEQ ID NO: 2299324 - protein, 24 aa, Cryptosporidium parvum
LTILKPCYLLLWNYNIRNCNNTIK

SEQ ID NO: 2299325 - protein, 19 aa, Cryptosporidium parvum
LTISISKLKKMVMGKDNFA

SEQ ID NO: 2299326 - protein, 23 aa, Cryptosporidium parvum
LTITTPVKFKKLYNDEHSIQSTG

SEQ ID NO: 2299327 - protein, 26 aa, Cryptosporidium parvum
LTIVKRFSVSWMYKSGFLHIPIHSIT

SEQ ID NO: 2299328 - protein, 18 aa, Cryptosporidium parvum
LTIVPSIIIVIARSIWPI

SEQ ID NO: 2299329 - protein, 19 aa, Cryptosporidium parvum
LTIWSQYKGLGAFPVTDGF

SEQ ID NO: 2299330 - protein, 34 aa, Cryptosporidium parvum
LTKGNYLRFGFNVPRTDLLPISISFFDSNDAKSL

SEQ ID NO: 2299331 - protein, 20 aa, Cryptosporidium parvum
LTKKLEFYRGLEAEILALYH

SEQ ID NO: 2299332 - protein, 20 aa, Cryptosporidium parvum
LTKNPKFICRTYSSEIPQLS

SEQ ID NO: 2299333 - protein, 18 aa, Cryptosporidium parvum
LTKQILLKGLDLLGVETL

SEQ ID NO: 2299334 - protein, 18 aa, Cryptosporidium parvum
LTKYIWKTVGANLNQKID

SEQ ID NO: 2299335 - protein, 17 aa, Cryptosporidium parvum
LTLADALVYACNLKVET

SEQ ID NO: 2299336 - protein, 26 aa, Cryptosporidium parvum
LTLAKVKLKSCCLELTSDNEDHFDKM

SEQ ID NO: 2299337 - protein, 18 aa, Cryptosporidium parvum
LTLAWTKAFIYLILVSSM

SEQ ID NO: 2299338 - protein, 20 aa, Cryptosporidium parvum
LTLDEFLKFSVSGFDGNFPG

SEQ ID NO: 2299339 - protein, 26 aa, Cryptosporidium parvum
LTLKFISVFFKPSWRESNFQELNKSN

SEQ ID NO: 2299340 - protein, 20 aa, Cryptosporidium parvum
LTLKHKYGLIGRNGIGKSTL

SEQ ID NO: 2299341 - protein, 25 aa, Cryptosporidium parvum
LTLLKEIVFAYSYPRLDINVSKDLG

SEQ ID NO: 2299342 - protein, 32 aa, Cryptosporidium parvum; identical to SEQ ID NO: 2177294

SEQ ID NO: 2299343 - protein, 21 aa, Cryptosporidium parvum
LTLRLDFSNLFFGGNTILTLF

SEQ ID NO: 2299344 - protein, 18 aa, Cryptosporidium parvum
LTLSGNVSSVKPIMITSL

SEQ ID NO: 2299345 - protein, 19 aa, Cryptosporidium parvum
LTMCLHAYIRRKFETDESW

SEQ ID NO: 2299346 - protein, 17 aa, Cryptosporidium parvum
LTMLHILLFLQRVAPVK

SEQ ID NO: 2299347 - protein, 26 aa, Cryptosporidium parvum
LTNQYSFRLYRMFILHDSLFIQTVWS

SEQ ID NO: 2299348 - protein, 25 aa, Cryptosporidium parvum
LTNTILKIVIIPAINQGVPNPLPEL

SEQ ID NO: 2299349 - protein, 22 aa, Cryptosporidium parvum
LTPDLWKEYSFTPSPYKQFSDF

SEQ ID NO: 2299350 - protein, 21 aa, Cryptosporidium parvum
LTPFEYQVFLGITEWSTRYLN

SEQ ID NO: 2299351 - protein, 18 aa, Cryptosporidium parvum
LTPLKNILYDSILEIERK

SEQ ID NO: 2299352 - protein, 23 aa, Cryptosporidium parvum
LTPNIRSLYNLKIVSNLVNLEEN

SEQ ID NO: 2299353 - protein, 23 aa, Cryptosporidium parvum
LTPSSNLKPLFKVDVNIENISAT

SEQ ID NO: 2299354 - protein, 31 aa, Cryptosporidium parvum
LTPTVIKCFFHSYRDGISRLQCKSKRHEGRP

SEQ ID NO: 2299355 - protein, 27 aa, Cryptosporidium parvum
LTQIFHYRLFRCIQILQILILNGLHFS

SEQ ID NO: 2299356 - protein, 19 aa, Cryptosporidium parvum
LTQLIRLVLYEGERIFQDR

SEQ ID NO: 2299357 - protein, 26 aa, Cryptosporidium parvum
LTRELTNLAGFLWSKSLLFLRAERNE

SEQ ID NO: 2299358 - protein, 18 aa, Cryptosporidium parvum
LTRGFPVMGEQSVTMMIN

SEQ ID NO: 2299359 - protein, 22 aa, Cryptosporidium parvum
LTRKEKLCLWNCAQNFLESSEF

SEQ ID NO: 2299360 - protein, 17 aa, Cryptosporidium parvum
LTRTRVAIFVYDVANIE

SEQ ID NO: 2299361 - protein, 20 aa, Cryptosporidium parvum
LTRVGRLEVVVVLRVDKNKG

SEQ ID NO: 2299362 - protein, 18 aa, Cryptosporidium parvum
LTSLIVAMSHDFSPYVNE

SEQ ID NO: 2299363 - protein, 18 aa, Cryptosporidium parvum
LTSLQLLGIMALNSPHQL

SEQ ID NO: 2299364 - protein, 25 aa, Cryptosporidium parvum
LTSNAAKCPTEWRVRGITWHAERKA

SEQ ID NO: 2299365 - protein, 17 aa, Cryptosporidium parvum
LTSNCSSIGKSKPSLSL

SEQ ID NO: 2299366 - protein, 18 aa, Cryptosporidium parvum
LTSYCNWDEQIADVSCRL

SEQ ID NO: 2299367 - protein, 25 aa, Cryptosporidium parvum
LTTLWSRIRLALTRITKKNMHISDR

SEQ ID NO: 2299368 - protein, 24 aa, Cryptosporidium parvum
LTTPICPLKDLFEKSCTEIIKNDR

SEQ ID NO: 2299369 - protein, 21 aa, Cryptosporidium parvum
LTVCNTLKFHLYILNPRNTLE

SEQ ID NO: 2299370 - protein, 28 aa, Cryptosporidium parvum
LTVCPHLIRYLACFGIIMRRNKDILDNI

SEQ ID NO: 2299371 - protein, 17 aa, Cryptosporidium parvum
LTVKLLSPFIPFTCELL

SEQ ID NO: 2299372 - protein, 23 aa, Cryptosporidium parvum
LTVLQLRITIWATKNSTIESAEI

SEQ ID NO: 2299373 - protein, 28 aa, Cryptosporidium parvum
LTYDACPICKKKVLFSTSYCEKCDESVV

SEQ ID NO: 2299374 - protein, 18 aa, Cryptosporidium parvum
LTYFFPLISCLDINEAKK

SEQ ID NO: 2299375 - protein, 18 aa, Cryptosporidium parvum
LTYFSIRSDQLLKKSNSN

SEQ ID NO: 2299376 - protein, 20 aa, Cryptosporidium parvum
LTYKLFKHIFELSNQNDKIM

SEQ ID NO: 2299377 - protein, 22 aa, Cryptosporidium parvum
LTYLRREHPTLAFKSALNSSTE

SEQ ID NO: 2299378 - protein, 17 aa, Cryptosporidium parvum
LTYNFKYKNTSIIKDCL

SEQ ID NO: 2299379 - protein, 17 aa, Cryptosporidium parvum
LVAAAQSKYSWHILVTN

SEQ ID NO: 2299380 - protein, 22 aa, Cryptosporidium parvum
LVDGWCFGCVGSTVLVTLSDHY

SEQ ID NO: 2299381 - protein, 21 aa, Cryptosporidium parvum
LVDRLAEIEAIIKVDHVLAER

SEQ ID NO: 2299382 - protein, 21 aa, Cryptosporidium parvum
LVDRLQLFIGSMMDNIFSIWN

SEQ ID NO: 2299383 - protein, 18 aa, Cryptosporidium parvum
LVDYACPGEEIIVTGIYR

SEQ ID NO: 2299384 - protein, 18 aa, Cryptosporidium parvum
LVDYPRMKVAELVSIKTL

SEQ ID NO: 2299385 - protein, 19 aa, Cryptosporidium parvum
LVELYKLYSNFIAGEVQRK

SEQ ID NO: 2299386 - protein, 28 aa, Cryptosporidium parvum
LVEPAFDVVRMFNFPKSFQIALEQAEKS

SEQ ID NO: 2299387 - protein, 29 aa, Cryptosporidium parvum
LVEPCKDSIAWGCCEILKNFDHSRWMGSR

SEQ ID NO: 2299388 - protein, 24 aa, Cryptosporidium parvum
LVERCKKVKTCPRCMSQQGQLRRT

SEQ ID NO: 2299389 - protein, 26 aa, Cryptosporidium parvum
LVERGSLLLFSWSRSRLEWVQTPILY

SEQ ID NO: 2299390 - protein, 17 aa, Cryptosporidium parvum
LVERLSVFRHRIYDQKE

SEQ ID NO: 2299391 - protein, 22 aa, Cryptosporidium parvum
LVESLTILGMVKYDISPEIINK

SEQ ID NO: 2299392 - protein, 24 aa, Cryptosporidium parvum
LVFERRIKEEFIFVAINIDTKSVE

SEQ ID NO: 2299393 - protein, 17 aa, Cryptosporidium parvum
LVFLLPLMVSDANIVIP

SEQ ID NO: 2299394 - protein, 17 aa, Cryptosporidium parvum
LVFQFKYCEPYFGAWQA

SEQ ID NO: 2299395 - protein, 17 aa, Cryptosporidium parvum
LVGEASLEWSLNFLTRN

SEQ ID NO: 2299396 - protein, 28 aa, Cryptosporidium parvum
LVGLEIWKQEIFSFVGYKKNKRYNYLIH

SEQ ID NO: 2299397 - protein, 17 aa, Cryptosporidium parvum
LVGLISAARLLVHLYES

SEQ ID NO: 2299398 - protein, 23 aa, Cryptosporidium parvum
LVGLSGWKRFRVFFNKYQGSEME

SEQ ID NO: 2299399 - protein, 19 aa, Cryptosporidium parvum
LVGPGLFLLLSRNILSTIQ

SEQ ID NO: 2299400 - protein, 18 aa, Cryptosporidium parvum
LVGSLIKELECLIQKLQV

SEQ ID NO: 2299401 - protein, 18 aa, Cryptosporidium parvum
LVGTDEPICLINNNVNND

SEQ ID NO: 2299402 - protein, 20 aa, Cryptosporidium parvum
LVHSRISKVFYMHKDKERGF

SEQ ID NO: 2299403 - protein, 25 aa, Cryptosporidium parvum
LVIARDVLEISALVSVRKKDSFGFE

SEQ ID NO: 2299404 - protein, 19 aa, Cryptosporidium parvum
LVICPSSIRFQWYQQALDW

SEQ ID NO: 2299405 - protein, 18 aa, Cryptosporidium parvum
LVIKFLVDFLHFVSTKSS

SEQ ID NO: 2299406 - protein, 23 aa, Cryptosporidium parvum
LVIPVSGKWSQLVLAKGDVGGPL

SEQ ID NO: 2299407 - protein, 18 aa, Cryptosporidium parvum
LVKDCYNLLKINEHYLEY

SEQ ID NO: 2299408 - protein, 20 aa, Cryptosporidium parvum
LVKIWEFIVPNLIFTLSRIR

SEQ ID NO: 2299409 - protein, 25 aa, Cryptosporidium parvum
LVKKLKLLVIDGIEFINSNNSNGSV

SEQ ID NO: 2299410 - protein, 22 aa, Cryptosporidium parvum
LVKKNIATVFAWKNETIEDYWV

SEQ ID NO: 2299411 - protein, 17 aa, Cryptosporidium parvum
LVKKVSYIVEDTYRRQI

SEQ ID NO: 2299412 - protein, 26 aa, Cryptosporidium parvum
LVKRSIDDPANWSWRQKSFLLEELGL

SEQ ID NO: 2299413 - protein, 20 aa, Cryptosporidium parvum
LVLCQKFIVRSHFQIGNIYQ

SEQ ID NO: 2299414 - protein, 17 aa, Cryptosporidium parvum
LVLHPIVQEFSSIVKGN

SEQ ID NO: 2299415 - protein, 23 aa, Cryptosporidium parvum
LVLKSNGTTATWSIKISAIDTLC

SEQ ID NO: 2299416 - protein, 18 aa, Cryptosporidium parvum
LVLLLIDASFSFEMETFE

SEQ ID NO: 2299417 - protein, 22 aa, Cryptosporidium parvum
LVLMTKRFIQYLYEQGESRIID

SEQ ID NO: 2299418 - protein, 17 aa, Cryptosporidium parvum
LVLRRAMGIAWKHKNYI

SEQ ID NO: 2299419 - protein, 19 aa, Cryptosporidium parvum
LVLSPCKNLLMGLTCYGWI

SEQ ID NO: 2299420 - protein, 24 aa, Cryptosporidium parvum
LVMDEADRLLSMDFEIALNKIVES

SEQ ID NO: 2299421 - protein, 23 aa, Cryptosporidium parvum
LVMELCSGGELFDRIISQGSFDE

SEQ ID NO: 2299422 - protein, 24 aa, Cryptosporidium parvum
LVNDCLKIVCDLVSESLLKSNRID

SEQ ID NO: 2299423 - protein, 22 aa, Cryptosporidium parvum
LVNKIYMEVCESVRQGKEKELA

SEQ ID NO: 2299424 - protein, 17 aa, Cryptosporidium parvum
LVNPFLMMQRMSAANPM

SEQ ID NO: 2299425 - protein, 18 aa, Cryptosporidium parvum
LVPGGRPSHALLICKRIC

SEQ ID NO: 2299426 - protein, 18 aa, Cryptosporidium parvum
LVPGSSRGGRIFDGGLNS

SEQ ID NO: 2299427 - protein, 30 aa, Cryptosporidium parvum; identical to SEQ ID NO: 2177379

SEQ ID NO: 2299428 - protein, 18 aa, Cryptosporidium parvum
LVQKHILTLLSPYVGQSE

SEQ ID NO: 2299429 - protein, 26 aa, Cryptosporidium parvum
LVQSYLNIWISLFWNSLINNSKKKKV

SEQ ID NO: 2299430 - protein, 17 aa, Cryptosporidium parvum
LVRHIFSNLQVAYCLLS

SEQ ID NO: 2299431 - protein, 21 aa, Cryptosporidium parvum
LVRKELKQIWDFSDLDEDGKL

SEQ ID NO: 2299432 - protein, 20 aa, Cryptosporidium parvum
LVRREFERFGAIRDVYLPLD

SEQ ID NO: 2299433 - protein, 22 aa, Cryptosporidium parvum
LVSACWGGKIVFWKFDQASGTF

SEQ ID NO: 2299434 - protein, 25 aa, Cryptosporidium parvum
LVSATCFWIALKYEAAYVQGENLKI

SEQ ID NO: 2299435 - protein, 26 aa, Cryptosporidium parvum
LVSCSNCSNFLRIREFFVGKQYSVNC

SEQ ID NO: 2299436 - protein, 18 aa, Cryptosporidium parvum
LVSDCLLGSGILNEEEIT

SEQ ID NO: 2299437 - protein, 24 aa, Cryptosporidium parvum
LVSKESKPAFSKKVTLNKSIMLKG

SEQ ID NO: 2299438 - protein, 18 aa, Cryptosporidium parvum
LVSLDIVKVFGISMKRLG

SEQ ID NO: 2299439 - protein, 19 aa, Cryptosporidium parvum
LVSRCCGFSKLSHILHFKE

SEQ ID NO: 2299440 - protein, 21 aa, Cryptosporidium parvum
LVSRSGVAGLKARHEGEDFHG

SEQ ID NO: 2299441 - protein, 19 aa, Cryptosporidium parvum
LVSTGLRFSEEVQNEVDWK

SEQ ID NO: 2299442 - protein, 25 aa, Cryptosporidium parvum
LVSTWSELGKVCMWDITESINNLNT

SEQ ID NO: 2299443 - protein, 20 aa, Cryptosporidium parvum
LVTAHDWMPDMFIRILCTFD

SEQ ID NO: 2299444 - protein, 19 aa, Cryptosporidium parvum
LVTEFCKRQRVSKDALIIN

SEQ ID NO: 2299445 - protein, 25 aa, Cryptosporidium parvum
LVYHGKKYYFGPVIEGIRYDKIQNR

SEQ ID NO: 2299446 - protein, 26 aa, Cryptosporidium parvum
LVYSLWKGQLWKAIILDTSLKIHPNG

SEQ ID NO: 2299447 - protein, 19 aa, Cryptosporidium parvum
LWEKIKLSNNFLVAISQIN

SEQ ID NO: 2299448 - protein, 26 aa, Cryptosporidium parvum
LWIDAKSRDWILEWQTKNGRWSVRKF

SEQ ID NO: 2299449 - protein, 17 aa, Cryptosporidium parvum
LWIDTEGTFRPERIVQI

SEQ ID NO: 2299450 - protein, 19 aa, Cryptosporidium parvum
LWIEIVGISTIINRKTLEF

SEQ ID NO: 2299451 - protein, 26 aa, Cryptosporidium parvum
LWIKCLDIYSSCLWQLSRSIDLINLS

SEQ ID NO: 2299452 - protein, 20 aa, Cryptosporidium parvum
LWITEWEKSDVLKFSKNISK

SEQ ID NO: 2299453 - protein, 27 aa, Cryptosporidium parvum
LWKNPFYWTEIFSINSLYFKSSFLDHS

SEQ ID NO: 2299454 - protein, 27 aa, Cryptosporidium parvum
LWLYSGRRGVHCWVCDTKARLLPSEAR

SEQ ID NO: 2299455 - protein, 20 aa, Cryptosporidium parvum
LWNACKFAFGNIENVANHMK

SEQ ID NO: 2299456 - protein, 23 aa, Cryptosporidium parvum
LWRISEQLGVIFIMVINKETFSL

SEQ ID NO: 2299457 - protein, 20 aa, Cryptosporidium parvum
LWSHMVIPLLYQGDRAPQNL

SEQ ID NO: 2299458 - protein, 17 aa, Cryptosporidium parvum
LWSLIHCMHSAFQRRKL

SEQ ID NO: 2299459 - protein, 17 aa, Cryptosporidium parvum
LWVSNLIAMHSRMSQPN

SEQ ID NO: 2299460 - protein, 17 aa, Cryptosporidium parvum
LWYGENIIETFKVGDII

SEQ ID NO: 2299461 - protein, 18 aa, Cryptosporidium parvum
LWYRCYAEHHRGRTADRA

SEQ ID NO: 2299462 - protein, 22 aa, Cryptosporidium parvum
LWYRPPELLLGAQFYDTPVDMW

SEQ ID NO: 2299463 - protein, 25 aa, Cryptosporidium parvum
LYASWKHGLSLNRLVSLIEGYSSNV

SEQ ID NO: 2299464 - protein, 25 aa, Cryptosporidium parvum
LYAYARICAIFRKVEFIQSDNSMVI

SEQ ID NO: 2299465 - protein, 21 aa, Cryptosporidium parvum
LYCGILDIFGFECFPNNSFEQ

SEQ ID NO: 2299466 - protein, 23 aa, Cryptosporidium parvum
LYCLRKMTLCRYLDFINMQDKLF

SEQ ID NO: 2299467 - protein, 22 aa, Cryptosporidium parvum
LYCRELKFLLLIIRELANNSHP

SEQ ID NO: 2299468 - protein, 19 aa, Cryptosporidium parvum
LYDDIGIKPPKGVILYGPP

SEQ ID NO: 2299469 - protein, 18 aa, Cryptosporidium parvum
LYECERNIMISLSLGLGL

SEQ ID NO: 2299470 - protein, 18 aa, Cryptosporidium parvum
LYESFIHILMEFKGYSGV

SEQ ID NO: 2299471 - protein, 18 aa, Cryptosporidium parvum
LYESLQLAHKCILNSFYG

SEQ ID NO: 2299472 - protein, 18 aa, Cryptosporidium parvum
LYESYGIKSYKYEKIQKM

SEQ ID NO: 2299473 - protein, 18 aa, Cryptosporidium parvum
LYFCPQFILVKLISEIFK

SEQ ID NO: 2299474 - protein, 18 aa, Cryptosporidium parvum
LYFGNLPINLGLTESSFQ

SEQ ID NO: 2299475 - protein, 23 aa, Cryptosporidium parvum
LYFLEQFRKVCLGDYAKQFIQPE

SEQ ID NO: 2299476 - protein, 27 aa, Cryptosporidium parvum
LYFMDEVDAALDFRNVSIIATFIKEKT

SEQ ID NO: 2299477 - protein, 22 aa, Cryptosporidium parvum
LYFNIKCLNHHISENINPIETH

SEQ ID NO: 2299478 - protein, 19 aa, Cryptosporidium parvum
LYFQIISCRSKLFTIPQSF

SEQ ID NO: 2299479 - protein, 17 aa, Cryptosporidium parvum
LYFTNLFQGNHGFMPPM

SEQ ID NO: 2299480 - protein, 27 aa, Cryptosporidium parvum
LYHFGPEFRPVPLLQTFIGIKAKKGFK

SEQ ID NO: 2299481 - protein, 19 aa, Cryptosporidium parvum
LYIDEIDYFNSVFSECDGN

SEQ ID NO: 2299482 - protein, 24 aa, Cryptosporidium parvum
LYIEIIGIMYIMFNECHLIHGDMS

SEQ ID NO: 2299483 - protein, 24 aa, Cryptosporidium parvum
LYIKNIPSFYQFQVVKAQYEENNI

SEQ ID NO: 2299484 - protein, 18 aa, Cryptosporidium parvum
LYINFVFSTKIPTHLEHA

SEQ ID NO: 2299485 - protein, 19 aa, Cryptosporidium parvum
LYIPLMKSTLYNWVPIDYN

SEQ ID NO: 2299486 - protein, 19 aa, Cryptosporidium parvum
LYISEGIFCKTKLFIVGPP

SEQ ID NO: 2299487 - protein, 24 aa, Cryptosporidium parvum
LYIYDANCLPKWFITSQGVNISSI

SEQ ID NO: 2299488 - protein, 18 aa, Cryptosporidium parvum
LYKLFPAPLDEAWLSMDT

SEQ ID NO: 2299489 - protein, 25 aa, Cryptosporidium parvum
LYKLLFLLCKLNFINFSIDDSKEID

SEQ ID NO: 2299490 - protein, 19 aa, Cryptosporidium parvum
LYKSIIYNILNYFNVNHAN

SEQ ID NO: 2299491 - protein, 18 aa, Cryptosporidium parvum
LYLAFSSCSKGFVGASVF

SEQ ID NO: 2299492 - protein, 18 aa, Cryptosporidium parvum
LYLCKLPYDMTEDSVREL

SEQ ID NO: 2299493 - protein, 25 aa, Cryptosporidium parvum
LYLDMNGIIHPCCNPSGGDKPKDEA

SEQ ID NO: 2299494 - protein, 18 aa, Cryptosporidium parvum
LYLENKFERCQSIDSYSI

SEQ ID NO: 2299495 - protein, 27 aa, Cryptosporidium parvum
LYLGDLLNCNNLVFYGNFYNIKKSCDN

SEQ ID NO: 2299496 - protein, 26 aa, Cryptosporidium parvum
LYLKIIEFLKTFILFTSDFVIDNLIF

SEQ ID NO: 2299497 - protein, 18 aa, Cryptosporidium parvum
LYLNHKYMLIGHENTFVG

SEQ ID NO: 2299498 - protein, 18 aa, Cryptosporidium parvum
LYLPLSNTPLTFIKEPGD

SEQ ID NO: 2299499 - protein, 19 aa, Cryptosporidium parvum
LYLSELLKLNGLGEEIPRI

SEQ ID NO: 2299500 - protein, 21 aa, Cryptosporidium parvum
LYLSFWCFSAAAALSSLVSAG

SEQ ID NO: 2299501 - protein, 27 aa, Cryptosporidium parvum
LYLSNRKRIPCMFKIIPCNEHSESFRE

SEQ ID NO: 2299502 - protein, 21 aa, Cryptosporidium parvum
LYMFGGGAFGKLGFGSTDDVL

SEQ ID NO: 2299503 - protein, 19 aa, Cryptosporidium parvum
LYMNDFKSALSITECAPPS

SEQ ID NO: 2299504 - protein, 18 aa, Cryptosporidium parvum
LYNFISLVSGCNINNQNK

SEQ ID NO: 2299505 - protein, 23 aa, Cryptosporidium parvum
LYNKAFYVWHENFLKNSDNTVNT

SEQ ID NO: 2299506 - protein, 23 aa, Cryptosporidium parvum
LYNLIIKNCQLFNLNPLGIQNLI

SEQ ID NO: 2299507 - protein, 32 aa, Cryptosporidium parvum
LYNNGLYCKHVRWIIQIPRLYNIFHKDGCVKT

SEQ ID NO: 2299508 - protein, 23 aa, Cryptosporidium parvum
LYNNILNCIPKCISSSKMTIRSL

SEQ ID NO: 2299509 - protein, 19 aa, Cryptosporidium parvum
LYNSIAFKIVLDCLEKNEQ

SEQ ID NO: 2299510 - protein, 18 aa, Cryptosporidium parvum
LYNSLIMELNDWKVKKDS

SEQ ID NO: 2299511 - protein, 17 aa, Cryptosporidium parvum
LYPKLLGFIPVVSQSLT

SEQ ID NO: 2299512 - protein, 19 aa, Cryptosporidium parvum
LYPLIKFQALYAGRNLHQL

SEQ ID NO: 2299513 - protein, 19 aa, Cryptosporidium parvum
LYQRNCMDYQYSKREGCIR

SEQ ID NO: 2299514 - protein, 19 aa, Cryptosporidium parvum
LYQSECLTLAMSIYLKHPL

SEQ ID NO: 2299515 - protein, 18 aa, Cryptosporidium parvum
LYRGEGIEKTWKSYYDSL

SEQ ID NO: 2299516 - protein, 20 aa, Cryptosporidium parvum
LYRMRRLLGVRAHDGSKAQA

SEQ ID NO: 2299517 - protein, 19 aa, Cryptosporidium parvum
LYRRFLRSSACKKLLDSDS

SEQ ID NO: 2299518 - protein, 25 aa, Cryptosporidium parvum
LYRVPECLESVFGIGSCEPSAMLYF

SEQ ID NO: 2299519 - protein, 20 aa, Cryptosporidium parvum
LYSCKFNLKNGKGRNPDLFP

SEQ ID NO: 2299520 - protein, 19 aa, Cryptosporidium parvum
LYSCRKRKDVDFTVISNPE

SEQ ID NO: 2299521 - protein, 26 aa, Cryptosporidium parvum
LYSDFNCLICFRILQRTMVVKDCLHR

SEQ ID NO: 2299522 - protein, 26 aa, Cryptosporidium parvum
LYSEIKYKIEWCFSSDSNLTIYAKEF

SEQ ID NO: 2299523 - protein, 19 aa, Cryptosporidium parvum
LYSLDIWLSDLIRKLSQNC

SEQ ID NO: 2299524 - protein, 22 aa, Cryptosporidium parvum
LYSPALFKNWKNWVLPENTVWR

SEQ ID NO: 2299525 - protein, 27 aa, Cryptosporidium parvum
LYSSEFKGVIFAGGSGRMLGPLAKNIS

SEQ ID NO: 2299526 - protein, 17 aa, Cryptosporidium parvum
LYSTYGFPMDLTELMAN

SEQ ID NO: 2299527 - protein, 17 aa, Cryptosporidium parvum
LYTEAAFNTEMLPTTVP

SEQ ID NO: 2299528 - protein, 27 aa, Cryptosporidium parvum
LYVDVKHIFTFCYKLWDYLNLYPTPVI

SEQ ID NO: 2299529 - protein, 21 aa, Cryptosporidium parvum
LYWCAQLAAGLYYLHNECRII

SEQ ID NO: 2299530 - protein, 18 aa, Cryptosporidium parvum
LYWSCPKSDQQKCNTFSW

SEQ ID NO: 2299531 - protein, 20 aa, Cryptosporidium parvum
LYYFECLDWITPEQEKTLLE

SEQ ID NO: 2299532 - protein, 17 aa, Cryptosporidium parvum
LYYKLHTVFNKNFKIII

SEQ ID NO: 2299533 - protein, 17 aa, Cryptosporidium parvum
LYYLCHNIQCGSIRIVI

SEQ ID NO: 2299534 - protein, 23 aa, Cryptosporidium parvum
LYYLRSEDLFLWLNEENIQKRWA

SEQ ID NO: 2299535 - protein, 18 aa, Cryptosporidium parvum
LYYWFLNNECGFDSNLNE

SEQ ID NO: 2299536 - protein, 17 aa, Cryptosporidium parvum
MAAKIASAFTFAFTASE

SEQ ID NO: 2299537 - protein, 18 aa, Cryptosporidium parvum
MADRLVGIYKTFDITKSV

SEQ ID NO: 2299538 - protein, 17 aa, Cryptosporidium parvum
MADWIPPTRCFSNAESG

SEQ ID NO: 2299539 - protein, 19 aa, Cryptosporidium parvum
MAEKGLIVLYNFLINLINH

SEQ ID NO: 2299540 - protein, 32 aa, Cryptosporidium parvum; identical to SEQ ID NO: 2177479

SEQ ID NO: 2299541 - protein, 17 aa, Cryptosporidium parvum
MAFKSEMIEKKIWKDEN

SEQ ID NO: 2299542 - protein, 20 aa, Cryptosporidium parvum
MAFYCPTCPYVFKIVSQISK

SEQ ID NO: 2299543 - protein, 23 aa, Cryptosporidium parvum
MAGDKRKRVQETEVDSEGNEEET

SEQ ID NO: 2299544 - protein, 22 aa, Cryptosporidium parvum
MAGGDIGKCALLMRNVAFQVVF

SEQ ID NO: 2299545 - protein, 19 aa, Cryptosporidium parvum
MAIEFFTLEREIYIAKLLL

SEQ ID NO: 2299546 - protein, 24 aa, Cryptosporidium parvum
MALSHYAMGFLLKKGYLAIQPPYF

SEQ ID NO: 2299547 - protein, 26 aa, Cryptosporidium parvum
MAMKIPEYEAYISLPSQTIFPDYYQI

SEQ ID NO: 2299548 - protein, 24 aa, Cryptosporidium parvum
MARVKRITEVGAFVSLLEYNDIEG

SEQ ID NO: 2299549 - protein, 20 aa, Cryptosporidium parvum
MASNPLNFYFENIYEKSLKT

SEQ ID NO: 2299550 - protein, 23 aa, Cryptosporidium parvum
MASSIPYLLPLLMGSGSNNDQNI

SEQ ID NO: 2299551 - protein, 17 aa, Cryptosporidium parvum
MASTAIRTAMAAQSLQS

SEQ ID NO: 2299552 - protein, 25 aa, Cryptosporidium parvum
MCFSLKNCLRNLLLSQITSDEGMNT

SEQ ID NO: 2299553 - protein, 17 aa, Cryptosporidium parvum
MCKKAVRCLRQQQTAGR

SEQ ID NO: 2299554 - protein, 20 aa, Cryptosporidium parvum
MCLSGLKSQVARDFVSERQD

SEQ ID NO: 2299555 - protein, 25 aa, Cryptosporidium parvum
MCMQLYRQALNFALHGLKYEPENPE

SEQ ID NO: 2299556 - protein, 27 aa, Cryptosporidium parvum
MCSNSDFRRISPLLGVLNDSYHNNNFH

SEQ ID NO: 2299557 - protein, 23 aa, Cryptosporidium parvum
MDDLIVRRGFDLFKYGENEQKEN

SEQ ID NO: 2299558 - protein, 17 aa, Cryptosporidium parvum
MDEDPFADFACEVCRLN

SEQ ID NO: 2299559 - protein, 26 aa, Cryptosporidium parvum
MDENHIWKIFFDIIFGLQHLHHRGIL

SEQ ID NO: 2299560 - protein, 25 aa, Cryptosporidium parvum
MDERLRGWDSYKWWQTETQKNEKSQ

SEQ ID NO: 2299561 - protein, 18 aa, Cryptosporidium parvum
MDGYKWWFEQNLVTVWSA

SEQ ID NO: 2299562 - protein, 19 aa, Cryptosporidium parvum
MDHDSRIPPIDTNNNNNNT

SEQ ID NO: 2299563 - protein, 25 aa, Cryptosporidium parvum
MDIKTCPGHFAHIELGKPMFHIGFI

SEQ ID NO: 2299564 - protein, 20 aa, Cryptosporidium parvum
MDINMAFKHFEFSYMIVDEA

SEQ ID NO: 2299565 - protein, 22 aa, Cryptosporidium parvum
MDKKEVKDLISISENKGIPNYL

SEQ ID NO: 2299566 - protein, 32 aa, Cryptosporidium parvum
MDKVWIHPFFERFSSINLFEFFLIGAKNDLQQ

SEQ ID NO: 2299567 - protein, 26 aa, Cryptosporidium parvum
MDLFKDAQMAWGFVSNVCHCPLMRAH

SEQ ID NO: 2299568 - protein, 21 aa, Cryptosporidium parvum
MDLLRGIKLGVEHVVNELDLL

SEQ ID NO: 2299569 - protein, 20 aa, Cryptosporidium parvum
MDMDVLRLKREFKNLDIEFI

SEQ ID NO: 2299570 - protein, 25 aa, Cryptosporidium parvum
MDPKMVFQHLKYLYKYDNIVRFSIP

SEQ ID NO: 2299571 - protein, 26 aa, Cryptosporidium parvum
MDRLFPTMHLLWIHSSLFSIPSIIIL

SEQ ID NO: 2299572 - protein, 18 aa, Cryptosporidium parvum
MDRWEYVVGGPPFEEIAI

SEQ ID NO: 2299573 - protein, 17 aa, Cryptosporidium parvum
MDSGMDVSMDFSLSQSS

SEQ ID NO: 2299574 - protein, 19 aa, Cryptosporidium parvum
MDSLITMLRLACIHPQLGI

SEQ ID NO: 2299575 - protein, 26 aa, Cryptosporidium parvum
MDSVRAGPFGSLFRPDNFIFGQSGAG

SEQ ID NO: 2299576 - protein, 23 aa, Cryptosporidium parvum
MDTLQLFCQVLYDCCNNPPPITE

SEQ ID NO: 2299577 - protein, 20 aa, Cryptosporidium parvum
MDTRASIPLYLYGDLEPFIE

SEQ ID NO: 2299578 - protein, 24 aa, Cryptosporidium parvum
MDYDPRIIIFTSISLALKLEEFGL

SEQ ID NO: 2299579 - protein, 17 aa, Cryptosporidium parvum
MDYSLLIGIHYVQDDAM

SEQ ID NO: 2299580 - protein, 18 aa, Cryptosporidium parvum
MEAKRIIEKNGLKNKFDG

SEQ ID NO: 2299581 - protein, 20 aa, Cryptosporidium parvum
MEAVSRYGLGNWSEISKYIT

SEQ ID NO: 2299582 - protein, 28 aa, Cryptosporidium parvum
MEDISLLPGWILRNLSLMREIDKKSNDL

SEQ ID NO: 2299583 - protein, 31 aa, Cryptosporidium parvum
MEEEVPLFSIKPWKCNIEIYENSKQFVLTRT

SEQ ID NO: 2299584 - protein, 30 aa, Cryptosporidium parvum; identical to SEQ ID NO: 2177524

SEQ ID NO: 2299585 - protein, 18 aa, Cryptosporidium parvum
MEELPLIILANWRGFSGG

SEQ ID NO: 2299586 - protein, 25 aa, Cryptosporidium parvum
MEERCQSCNLFIRDIVETSTRNKNI

SEQ ID NO: 2299587 - protein, 19 aa, Cryptosporidium parvum
MEEVKRRIELQNEDSSHGE

SEQ ID NO: 2299588 - protein, 18 aa, Cryptosporidium parvum
MEFCSPRFGEFNYSEENS

SEQ ID NO: 2299589 - protein, 22 aa, Cryptosporidium parvum
MEIIKIKVDMKLKINQEYYNIL

SEQ ID NO: 2299590 - protein, 19 aa, Cryptosporidium parvum
MEISVPFLANYETAVDAGK

SEQ ID NO: 2299591 - protein, 24 aa, Cryptosporidium parvum
MEKAIEIAYKYGFQNFNLNVGCPS

SEQ ID NO: 2299592 - protein, 17 aa, Cryptosporidium parvum
MEKTLIQRKEQLLQACQ

SEQ ID NO: 2299593 - protein, 19 aa, Cryptosporidium parvum
MELDWERRALEHTKEALRQ

SEQ ID NO: 2299594 - protein, 20 aa, Cryptosporidium parvum
MELREIGVLMSQKAKIQAKR

SEQ ID NO: 2299595 - protein, 24 aa, Cryptosporidium parvum
MEPEDCGWLEPIRLKVHAMEVQQY

SEQ ID NO: 2299596 - protein, 27 aa, Cryptosporidium parvum
MEQESWKIAKMIARIAMIRRKRKVEHD

SEQ ID NO: 2299597 - protein, 17 aa, Cryptosporidium parvum
MEQRYFLVNSLVHKFGD

SEQ ID NO: 2299598 - protein, 17 aa, Cryptosporidium parvum
MEREIYNRIPCLVITGK

SEQ ID NO: 2299599 - protein, 28 aa, Cryptosporidium parvum
MESCNEFVCIYGPGQFIGLRLCSKNYLI

SEQ ID NO: 2299600 - protein, 17 aa, Cryptosporidium parvum
MESEINKGLVWDKKSSY

SEQ ID NO: 2299601 - protein, 22 aa, Cryptosporidium parvum
MESIIPPAINWIGGNITNDNLN

SEQ ID NO: 2299602 - protein, 25 aa, Cryptosporidium parvum
MESLVLRGDCIGMVGEGYEDLTQNF

SEQ ID NO: 2299603 - protein, 26 aa, Cryptosporidium parvum
MESSILELISFFGFKYDEKSQKLLDN

SEQ ID NO: 2299604 - protein, 31 aa, Cryptosporidium parvum; identical to SEQ ID NO: 2177545

SEQ ID NO: 2299605 - protein, 26 aa, Cryptosporidium parvum
METDFKLSIPILIELIKKDNLDEIED

SEQ ID NO: 2299606 - protein, 26 aa, Cryptosporidium parvum
MEYDLLRFSIRNEKILENEKFVKNSD

SEQ ID NO: 2299607 - protein, 23 aa, Cryptosporidium parvum
MEYIKLSILYLRVLSKSIALRVV

SEQ ID NO: 2299608 - protein, 28 aa, Cryptosporidium parvum
MEYRYMPELDEFISFWCKYTEHIEKNGD

SEQ ID NO: 2299609 - protein, 18 aa, Cryptosporidium parvum
MFDEPRSATVIANATTEC

SEQ ID NO: 2299610 - protein, 27 aa, Cryptosporidium parvum
MFERRISSVTLVGWITHREILASRMIF

SEQ ID NO: 2299611 - protein, 18 aa, Cryptosporidium parvum
MFIFKDKICEPVIIQGNY

SEQ ID NO: 2299612 - protein, 26 aa, Cryptosporidium parvum
MFIPFKYKWSYFIGMLQNLGQYTGII

SEQ ID NO: 2299613 - protein, 18 aa, Cryptosporidium parvum
MFLEQSILSIKERGIAGI

SEQ ID NO: 2299614 - protein, 24 aa, Cryptosporidium parvum
MFLGCKTHRAASIVLRGANEVLLD

SEQ ID NO: 2299615 - protein, 18 aa, Cryptosporidium parvum
MFLNRDFVDQASKLIGNM

SEQ ID NO: 2299616 - protein, 25 aa, Cryptosporidium parvum
MFLTLLRNLYKYAFLDGQNDLPINE

SEQ ID NO: 2299617 - protein, 23 aa, Cryptosporidium parvum
MFMWGHLRVRSLIKRFVSKDQDK

SEQ ID NO: 2299618 - protein, 28 aa, Cryptosporidium parvum
MFPSLEEFNRSWSRLREGGIQEILPEDK

SEQ ID NO: 2299619 - protein, 17 aa, Cryptosporidium parvum
MFSSFSVTKYVPIKLTS

SEQ ID NO: 2299620 - protein, 25 aa, Cryptosporidium parvum
MFTSKLAIVPLIFGIQGSNKSSVII

SEQ ID NO: 2299621 - protein, 22 aa, Cryptosporidium parvum
MFYFNKLRAIEILYEELNEKKI

SEQ ID NO: 2299622 - protein, 20 aa, Cryptosporidium parvum
MGARKRARFTVYDDNQELNQ

SEQ ID NO: 2299623 - protein, 23 aa, Cryptosporidium parvum
MGEIRYDDIFLIFSKILGDQVLH

SEQ ID NO: 2299624 - protein, 19 aa, Cryptosporidium parvum
MGELLRFRPGVFDGAISIS

SEQ ID NO: 2299625 - protein, 27 aa, Cryptosporidium parvum
MGGGSHPSFPFMYGNFPNNGSQQGQKI

SEQ ID NO: 2299626 - protein, 24 aa, Cryptosporidium parvum
MGKSCKYSSLLSLINEVSTGLINS

SEQ ID NO: 2299627 - protein, 19 aa, Cryptosporidium parvum
MGLVPGMSLGGELGVKECE

SEQ ID NO: 2299628 - protein, 22 aa, Cryptosporidium parvum
MGNLKSCCSFADEHSLTSTQLV

SEQ ID NO: 2299629 - protein, 18 aa, Cryptosporidium parvum
MGNPNWLLTTGFSDKGER

SEQ ID NO: 2299630 - protein, 19 aa, Cryptosporidium parvum
MGNTFSDFVYCGDSLGVDL

SEQ ID NO: 2299631 - protein, 21 aa, Cryptosporidium parvum
MGNVSLLFSIEFHQSDCYIVA

SEQ ID NO: 2299632 - protein, 17 aa, Cryptosporidium parvum
MGPCKNIHSEVLREKYL

SEQ ID NO: 2299633 - protein, 32 aa, Cryptosporidium parvum; identical to SEQ ID NO: 2177573

SEQ ID NO: 2299634 - protein, 21 aa, Cryptosporidium parvum
MGPNIWPSFLRYENPPKHVKM

SEQ ID NO: 2299635 - protein, 22 aa, Cryptosporidium parvum
MGPQKWEYSLIPSLKSLIQNNN

SEQ ID NO: 2299636 - protein, 26 aa, Cryptosporidium parvum
MGRIFVGLCQVGAWGCFDEFNRLQAR

SEQ ID NO: 2299637 - protein, 23 aa, Cryptosporidium parvum
MGSGEGRMCWLYLKNDWKEIKEF

SEQ ID NO: 2299638 - protein, 22 aa, Cryptosporidium parvum
MGSGSLCARSILEARYRDGLTE

SEQ ID NO: 2299639 - protein, 17 aa, Cryptosporidium parvum
MGSKVFVRVHSMGSHDS

SEQ ID NO: 2299640 - protein, 17 aa, Cryptosporidium parvum
MGSLSRYDSCYHSNLSP

SEQ ID NO: 2299641 - protein, 24 aa, Cryptosporidium parvum
MGTKSFGGSRMGVAQSKGMAHTQQ

SEQ ID NO: 2299642 - protein, 19 aa, Cryptosporidium parvum
MGVRCLPASTAITSLGSII

SEQ ID NO: 2299643 - protein, 30 aa, Cryptosporidium parvum; identical to SEQ ID NO: 2177582

SEQ ID NO: 2299644 - protein, 18 aa, Cryptosporidium parvum
MHELRRQLEFFIYHQIHT

SEQ ID NO: 2299645 - protein, 25 aa, Cryptosporidium parvum
MHGKGTYIFPCGNVYEGEWVNDVKE

SEQ ID NO: 2299646 - protein, 30 aa, Cryptosporidium parvum; identical to SEQ ID NO: 2177585

SEQ ID NO: 2299647 - protein, 25 aa, Cryptosporidium parvum
MHMRRMNIEMIKGYCLVDAYRHYYP

SEQ ID NO: 2299648 - protein, 17 aa, Cryptosporidium parvum
MHNNWWVKFKEISENKN

SEQ ID NO: 2299649 - protein, 17 aa, Cryptosporidium parvum
MHQPPARWMQYYRENGL

SEQ ID NO: 2299650 - protein, 18 aa, Cryptosporidium parvum
MHSLGIPDIVDFPFPTPP

SEQ ID NO: 2299651 - protein, 18 aa, Cryptosporidium parvum
MHTRRSCPLLPDEAEQEY

SEQ ID NO: 2299652 - protein, 23 aa, Cryptosporidium parvum
MHYICSRWHSLLGKDRIEYIYES

SEQ ID NO: 2299653 - protein, 19 aa, Cryptosporidium parvum
MIEHPLIKLSLGIHCSFRF

SEQ ID NO: 2299654 - protein, 17 aa, Cryptosporidium parvum
MIEKCGYFYLCGTKQVP

SEQ ID NO: 2299655 - protein, 21 aa, Cryptosporidium parvum
MIESILGRCVAFWGNMNIMIE

SEQ ID NO: 2299656 - protein, 26 aa, Cryptosporidium parvum
MIFLRMGLKLLGKWEMSDPYTRDYYK

SEQ ID NO: 2299657 - protein, 27 aa, Cryptosporidium parvum
MIFNPNSGECKWIYDSAKQSLNKFNNL

SEQ ID NO: 2299658 - protein, 28 aa, Cryptosporidium parvum
MIGSEVPALLAIACELFVRDLTSFSWNF

SEQ ID NO: 2299659 - protein, 19 aa, Cryptosporidium parvum
MIGSGWHYYHQILNQYKPC

SEQ ID NO: 2299660 - protein, 30 aa, Cryptosporidium parvum
MIHIRLKYRRVWCNECWGIYKTIIEPETSF

SEQ ID NO: 2299661 - protein, 18 aa, Cryptosporidium parvum
MIIIPTRELALQVYKQTT

SEQ ID NO: 2299662 - protein, 17 aa, Cryptosporidium parvum
MIIIRSFDVNKPGEDAQ

SEQ ID NO: 2299663 - protein, 19 aa, Cryptosporidium parvum
MIKALLVLKSIIKDEISQV

SEQ ID NO: 2299664 - protein, 17 aa, Cryptosporidium parvum
MIKFCGKDNFHLRIRVH

SEQ ID NO: 2299665 - protein, 20 aa, Cryptosporidium parvum
MIKGHILKRFSSVNFEGQKI

SEQ ID NO: 2299666 - protein, 24 aa, Cryptosporidium parvum
MIKLLKLTLEYGGIKGIISRKLDN

SEQ ID NO: 2299667 - protein, 25 aa, Cryptosporidium parvum
MIKRDPKIRIGYFAQHHIESLDLTL

SEQ ID NO: 2299668 - protein, 18 aa, Cryptosporidium parvum
MILHKLRHPNIVSLVDFS

SEQ ID NO: 2299669 - protein, 21 aa, Cryptosporidium parvum
MILKKMMDKLENFTNVMKTSM

SEQ ID NO: 2299670 - protein, 26 aa, Cryptosporidium parvum
MIPQKLPLDLIIALECVLQLHSTPID

SEQ ID NO: 2299671 - protein, 20 aa, Cryptosporidium parvum
MIREVYRAHGAVEIDTPVFE

SEQ ID NO: 2299672 - protein, 18 aa, Cryptosporidium parvum
MIRLWRLAEDDLLDGNNG

SEQ ID NO: 2299673 - protein, 26 aa, Cryptosporidium parvum
MIRMKKRLVGTFGYLAPEVLNGGEYS

SEQ ID NO: 2299674 - protein, 17 aa, Cryptosporidium parvum
MISAINHILERSHFKNL

SEQ ID NO: 2299675 - protein, 23 aa, Cryptosporidium parvum
MISVFDRNTLCWADVEYTAGKPY

SEQ ID NO: 2299676 - protein, 24 aa, Cryptosporidium parvum
MITECISNVPFLFEKISSLKKRLV

SEQ ID NO: 2299677 - protein, 17 aa, Cryptosporidium parvum
MIVICFKSLKGGTRLKQ

SEQ ID NO: 2299678 - protein, 24 aa, Cryptosporidium parvum
MIVIKPGKHCLVCPNSDSKLHLES

SEQ ID NO: 2299679 - protein, 30 aa, Cryptosporidium parvum
MIVSCKWDPINYNRFFTCSIDNTIRLFDLN

SEQ ID NO: 2299680 - protein, 25 aa, Cryptosporidium parvum
MIYCSEPRRLAAISVSTRVRNEAIK

SEQ ID NO: 2299681 - protein, 20 aa, Cryptosporidium parvum
MIYKAFISIFEFTRQLFDSA

SEQ ID NO: 2299682 - protein, 29 aa, Cryptosporidium parvum
MKADIKRKEIMDSLFACQVGDNGNNSEKK

SEQ ID NO: 2299683 - protein, 20 aa, Cryptosporidium parvum
MKDDFSPLIDLARGIFTSNL

SEQ ID NO: 2299684 - protein, 22 aa, Cryptosporidium parvum
MKDKHYLRKFDWEYIIVDEAHR

SEQ ID NO: 2299685 - protein, 25 aa, Cryptosporidium parvum
MKEILKKNIQGNVQFTSSRWKNISS

SEQ ID NO: 2299686 - protein, 17 aa, Cryptosporidium parvum
MKESIGILVHDPIDNKK

SEQ ID NO: 2299687 - protein, 25 aa, Cryptosporidium parvum
MKEVLECLKCIGLCESEIFEILRIC

SEQ ID NO: 2299688 - protein, 20 aa, Cryptosporidium parvum
MKFLKRKATCDLEFCVELFW

SEQ ID NO: 2299689 - protein, 28 aa, Cryptosporidium parvum
MKFMNIQELFLFLSLFYHNYQREWILPL

SEQ ID NO: 2299690 - protein, 23 aa, Cryptosporidium parvum
MKFMRRFDFEVHDFIFLSEDYKK

SEQ ID NO: 2299691 - protein, 17 aa, Cryptosporidium parvum
MKFSDLDLSNSTSHDNH

SEQ ID NO: 2299692 - protein, 25 aa, Cryptosporidium parvum
MKGNMIFMASLVRKKVIASTVVLMC

SEQ ID NO: 2299693 - protein, 17 aa, Cryptosporidium parvum
MKGRCSVGNISDLKDYA

SEQ ID NO: 2299694 - protein, 18 aa, Cryptosporidium parvum
MKGSILNPLMFSFSDTET

SEQ ID NO: 2299695 - protein, 22 aa, Cryptosporidium parvum
MKIDRLGAVCDFSYTSYSRGRD

SEQ ID NO: 2299696 - protein, 17 aa, Cryptosporidium parvum
MKIHLEISLGDFHKFAL

SEQ ID NO: 2299697 - protein, 19 aa, Cryptosporidium parvum
MKINCDRNLSNVIKKNEEL

SEQ ID NO: 2299698 - protein, 18 aa, Cryptosporidium parvum
MKKKVVVKLRKKLMEFHN

SEQ ID NO: 2299699 - protein, 33 aa, Cryptosporidium parvum
MKKLIQFFKGFMLYKNKMELFWNSDKEKIDLED

SEQ ID NO: 2299700 - protein, 18 aa, Cryptosporidium parvum
MKKNCTGKLRDHIKISED

SEQ ID NO: 2299701 - protein, 25 aa, Cryptosporidium parvum
MKKSSIEFLDLFLRDTIKEEIVSEN

SEQ ID NO: 2299702 - protein, 17 aa, Cryptosporidium parvum
MKLAEAIARGSDVEDPL

SEQ ID NO: 2299703 - protein, 20 aa, Cryptosporidium parvum
MKLPCAAIIQPFPLLNDFEN

SEQ ID NO: 2299704 - protein, 19 aa, Cryptosporidium parvum
MKLYYKFQVEEAAIKKYGS

SEQ ID NO: 2299705 - protein, 20 aa, Cryptosporidium parvum
MKMDNCKVLLNLVSEIESIS

SEQ ID NO: 2299706 - protein, 20 aa, Cryptosporidium parvum
MKNHKRWIMSLPISGKIFLD

SEQ ID NO: 2299707 - protein, 19 aa, Cryptosporidium parvum
MKNMLKCGYRIISVQYPIY

SEQ ID NO: 2299708 - protein, 19 aa, Cryptosporidium parvum
MKNSGNLPPIITSNQSPTS

SEQ ID NO: 2299709 - protein, 17 aa, Cryptosporidium parvum
MKNSKFKNIIVDFPSKF

SEQ ID NO: 2299710 - protein, 24 aa, Cryptosporidium parvum
MKPDGNFRLGSSIELSFTTEQPES

SEQ ID NO: 2299711 - protein, 22 aa, Cryptosporidium parvum
MKPFLNQGLPIWERVSKKGNPP

SEQ ID NO: 2299712 - protein, 20 aa, Cryptosporidium parvum
MKPKELLSMVEEAAGTRMYE

SEQ ID NO: 2299713 - protein, 19 aa, Cryptosporidium parvum
MKPLWLGSDYNIFRRNCLT

SEQ ID NO: 2299714 - protein, 21 aa, Cryptosporidium parvum
MKQKEELLYTILHLHKQINSI

SEQ ID NO: 2299715 - protein, 26 aa, Cryptosporidium parvum
MKRKSVRGCIVSHDLSVLSLVVVERG

SEQ ID NO: 2299716 - protein, 24 aa, Cryptosporidium parvum
MKSLEHRESILLSALEDSSYRMTD

SEQ ID NO: 2299717 - protein, 21 aa, Cryptosporidium parvum
MKSSLSELIKGIGKRNRDGYE

SEQ ID NO: 2299718 - protein, 26 aa, Cryptosporidium parvum
MKSVHLTKDRIEFMLEHPKFTEYLCG

SEQ ID NO: 2299719 - protein, 18 aa, Cryptosporidium parvum
MKVAELVSIKTLRYILRP

SEQ ID NO: 2299720 - protein, 18 aa, Cryptosporidium parvum
MKVIEIAQDIVLSSRPLE

SEQ ID NO: 2299721 - protein, 17 aa, Cryptosporidium parvum
MKVKTTKTVTTQEVKPS

SEQ ID NO: 2299722 - protein, 17 aa, Cryptosporidium parvum
MKYAILTFPCNVPKWIA

SEQ ID NO: 2299723 - protein, 24 aa, Cryptosporidium parvum
MLADKGICCIDEFDKMDDKDVVAI

SEQ ID NO: 2299724 - protein, 19 aa, Cryptosporidium parvum
MLAEKARELLLTRYKSDEI

SEQ ID NO: 2299725 - protein, 17 aa, Cryptosporidium parvum
MLARLERPLTLVDEENI

SEQ ID NO: 2299726 - protein, 27 aa, Cryptosporidium parvum
MLDFQCKLLLEKLESFPLDMENRQIEL

SEQ ID NO: 2299727 - protein, 25 aa, Cryptosporidium parvum
MLDLFLKERYNAVIHFAGLKAVGVS

SEQ ID NO: 2299728 - protein, 27 aa, Cryptosporidium parvum
MLECTFKPEILWPIGKFINKNNKSWLK

SEQ ID NO: 2299729 - protein, 23 aa, Cryptosporidium parvum
MLEMLKRVGRSELVVGWYHSHPG

SEQ ID NO: 2299730 - protein, 25 aa, Cryptosporidium parvum
MLEMSFWSIELMDTIYATNGGMTTL

SEQ ID NO: 2299731 - protein, 24 aa, Cryptosporidium parvum
MLENLPWLHHIDIFGIASTIHCLI

SEQ ID NO: 2299732 - protein, 20 aa, Cryptosporidium parvum
MLENLRLRDSGGIQISQRQN

SEQ ID NO: 2299733 - protein, 22 aa, Cryptosporidium parvum
MLETDWRKGRDGGDLQRTNSKS

SEQ ID NO: 2299734 - protein, 19 aa, Cryptosporidium parvum
MLFKLLIHPVHELVNNLKT

SEQ ID NO: 2299735 - protein, 18 aa, Cryptosporidium parvum
MLFVLCSGNNVLSGSTSI

SEQ ID NO: 2299736 - protein, 26 aa, Cryptosporidium parvum
MLHGDEVPLRLGYTGVKNRSSADLKA

SEQ ID NO: 2299737 - protein, 18 aa, Cryptosporidium parvum
MLIFSIRNKDQFKKEINN

SEQ ID NO: 2299738 - protein, 23 aa, Cryptosporidium parvum
MLISSPLLCYGSMKMNSDISRFH

SEQ ID NO: 2299739 - protein, 32 aa, Cryptosporidium parvum; identical to SEQ ID NO: 2177650

SEQ ID NO: 2299740 - protein, 20 aa, Cryptosporidium parvum
MLKGVLLQRIETILDKELKE

SEQ ID NO: 2299741 - protein, 18 aa, Cryptosporidium parvum
MLKRSCSTPLLYSMNNAY

SEQ ID NO: 2299742 - protein, 20 aa, Cryptosporidium parvum
MLKVIDPFVAYGYPSISMIR

SEQ ID NO: 2299743 - protein, 18 aa, Cryptosporidium parvum
MLLANRVTAEFTVKNRPE

SEQ ID NO: 2299744 - protein, 32 aa, Cryptosporidium parvum; identical to SEQ ID NO: 2177656

SEQ ID NO: 2299745 - protein, 19 aa, Cryptosporidium parvum
MLMNLMRLGAASIMASYYG

SEQ ID NO: 2299746 - protein, 18 aa, Cryptosporidium parvum
MLMSRKSVKFGLDDVNER

SEQ ID NO: 2299747 - protein, 27 aa, Cryptosporidium parvum
MLMTSCPDLKGAVPLRGEIQNFNNILG

SEQ ID NO: 2299748 - protein, 27 aa, Cryptosporidium parvum
MLNNQLEWVRRYSPQVYEAMLENTYQY

SEQ ID NO: 2299749 - protein, 20 aa, Cryptosporidium parvum
MLNSIDFNYLSPLQMLNDST

SEQ ID NO: 2299750 - protein, 20 aa, Cryptosporidium parvum
MLRRCEKVLESINLKLMKSV

SEQ ID NO: 2299751 - protein, 20 aa, Cryptosporidium parvum
MLRSEYCWTHNISERELQSA

SEQ ID NO: 2299752 - protein, 24 aa, Cryptosporidium parvum
MLSENCAKSKFSVVANHNSKPITS

SEQ ID NO: 2299753 - protein, 19 aa, Cryptosporidium parvum
MLSKLVLESSLDMLNENDR

SEQ ID NO: 2299754 - protein, 26 aa, Cryptosporidium parvum
MLSNCQQLPCSALEFLTGEYELEEEG

SEQ ID NO: 2299755 - protein, 18 aa, Cryptosporidium parvum
MLSTIDWDKFNYPVRNSE

SEQ ID NO: 2299756 - protein, 24 aa, Cryptosporidium parvum
MLSTLRFRLYEVMENLTVNTQPCF

SEQ ID NO: 2299757 - protein, 23 aa, Cryptosporidium parvum
MLTNRVVTLWYRPPELLLGAQFY

SEQ ID NO: 2299758 - protein, 24 aa, Cryptosporidium parvum
MLYCDGCPKSAHLGCLGLEEEPDS

SEQ ID NO: 2299759 - protein, 22 aa, Cryptosporidium parvum
MMEVRKRVAVAFYTYKLPEGHI

SEQ ID NO: 2299760 - protein, 30 aa, Cryptosporidium parvum; identical to SEQ ID NO: 2177671

SEQ ID NO: 2299761 - protein, 24 aa, Cryptosporidium parvum
MMHSLRNNWKFVVSLKGPLHYGTL

SEQ ID NO: 2299762 - protein, 27 aa, Cryptosporidium parvum
MMKKGLICFSCGSILRSNFGSKINSDI

SEQ ID NO: 2299763 - protein, 24 aa, Cryptosporidium parvum
MMMMIEIINGIQICNNNNNNNQLV

SEQ ID NO: 2299764 - protein, 22 aa, Cryptosporidium parvum
MMTESRFALMIVDSATALYRSE

SEQ ID NO: 2299765 - protein, 18 aa, Cryptosporidium parvum
MNAKRFDKELDIEKEEEE

SEQ ID NO: 2299766 - protein, 22 aa, Cryptosporidium parvum
MNCNNSIEFLRIWQNIYQNNQF

SEQ ID NO: 2299767 - protein, 26 aa, Cryptosporidium parvum
MNFISVKGPELFSKWVGESEKSIREI

SEQ ID NO: 2299768 - protein, 18 aa, Cryptosporidium parvum
MNIAIGLIDEVLKMRDEW

SEQ ID NO: 2299769 - protein, 24 aa, Cryptosporidium parvum
MNIELRKGKSVPVIKKYLVDLKGQ

SEQ ID NO: 2299770 - protein, 20 aa, Cryptosporidium parvum
MNIERSWEVILFSKIIGMIK

SEQ ID NO: 2299771 - protein, 25 aa, Cryptosporidium parvum
MNISFKEAFLSEKWNLNSNLNSETR

SEQ ID NO: 2299772 - protein, 27 aa, Cryptosporidium parvum
MNKGSVIRFISTVFHHYLIPYLRVNSK

SEQ ID NO: 2299773 - protein, 25 aa, Cryptosporidium parvum
MNKIKDCPLFLSFSYGRALQASVLK

SEQ ID NO: 2299774 - protein, 18 aa, Cryptosporidium parvum
MNKRGSKGRSERNEVKSI

SEQ ID NO: 2299775 - protein, 20 aa, Cryptosporidium parvum
MNKRMPIKYSTVQRKTKAKG

SEQ ID NO: 2299776 - protein, 17 aa, Cryptosporidium parvum
MNLDLKQRLEFIEEMLK

SEQ ID NO: 2299777 - protein, 17 aa, Cryptosporidium parvum
MNLGDSYGISFFTTSIQ

SEQ ID NO: 2299778 - protein, 22 aa, Cryptosporidium parvum
MNLINLKWLLVRSSESIRNKLN

SEQ ID NO: 2299779 - protein, 27 aa, Cryptosporidium parvum
MNLISIYIYQLFRAVGFIHSLGICHRD

SEQ ID NO: 2299780 - protein, 26 aa, Cryptosporidium parvum
MNMIAAKLLEDWDVIGHFFQDCMSEE

SEQ ID NO: 2299781 - protein, 18 aa, Cryptosporidium parvum
MNNCNYLTSNVNSALIED

SEQ ID NO: 2299782 - protein, 18 aa, Cryptosporidium parvum
MNNFIKYKTIDEVENNQI

SEQ ID NO: 2299783 - protein, 23 aa, Cryptosporidium parvum
MNNIKILINILIHRKEYRRAIKI

SEQ ID NO: 2299784 - protein, 24 aa, Cryptosporidium parvum
MNNYELGTIVLRRLCISESSEIKA

SEQ ID NO: 2299785 - protein, 17 aa, Cryptosporidium parvum
MNPHYLNSVPLLAQIRI

SEQ ID NO: 2299786 - protein, 23 aa, Cryptosporidium parvum
MNPRKEYYYYLNLNNKEECFKKN

SEQ ID NO: 2299787 - protein, 17 aa, Cryptosporidium parvum
MNTGIVIGGVVPVSESA

SEQ ID NO: 2299788 - protein, 21 aa, Cryptosporidium parvum
MNTQFLQDYFFLFKFDNPKRK

SEQ ID NO: 2299789 - protein, 37 aa, Cryptosporidium parvum; identical to SEQ ID NO: 2177697

SEQ ID NO: 2299790 - protein, 20 aa, Cryptosporidium parvum
MNVYHPKLLLSIVSNVMIVS

SEQ ID NO: 2299791 - protein, 21 aa, Cryptosporidium parvum
MNYRALLRIKKIVELRKLDQA

SEQ ID NO: 2299792 - protein, 20 aa, Cryptosporidium parvum
MPDQFKQGKIITFEDKHILE

SEQ ID NO: 2299793 - protein, 17 aa, Cryptosporidium parvum
MPEISWPPLEITFQNSF

SEQ ID NO: 2299794 - protein, 17 aa, Cryptosporidium parvum
MPHGRAMVTGGFPNQNA

SEQ ID NO: 2299795 - protein, 23 aa, Cryptosporidium parvum
MPIPAHLPTPMPMPVPMPMPMSM

SEQ ID NO: 2299796 - protein, 20 aa, Cryptosporidium parvum
MPISRAYRAQLERHNKPHPC

SEQ ID NO: 2299797 - protein, 20 aa, Cryptosporidium parvum
MPLLDMDGSGSIEYSEFIAS

SEQ ID NO: 2299798 - protein, 17 aa, Cryptosporidium parvum
MPLSDCESSQCKNNKRT

SEQ ID NO: 2299799 - protein, 29 aa, Cryptosporidium parvum
MPLSGVCKWFDSTKGFGFITPDDGSEDIF

SEQ ID NO: 2299800 - protein, 26 aa, Cryptosporidium parvum
MPLSVNPIFCEYEWVLWIKAETPQQM

SEQ ID NO: 2299801 - protein, 18 aa, Cryptosporidium parvum
MPSKIGLINIFKLYNTII

SEQ ID NO: 2299802 - protein, 25 aa, Cryptosporidium parvum
MPYGARIAYEIAEVCYIRRKALLLN

SEQ ID NO: 2299803 - protein, 20 aa, Cryptosporidium parvum
MPYLDPLVRRVISMSMESIQ

SEQ ID NO: 2299804 - protein, 18 aa, Cryptosporidium parvum
MQCADIFQLKADICQLGM

SEQ ID NO: 2299805 - protein, 17 aa, Cryptosporidium parvum
MQDRFSGLHIVTSRHTV

SEQ ID NO: 2299806 - protein, 19 aa, Cryptosporidium parvum
MQIICKFVNKQDCESFEFF

SEQ ID NO: 2299807 - protein, 30 aa, Cryptosporidium parvum
MQIIDTWPYAFPRYKYDIDDQLEISIYYKL

SEQ ID NO: 2299808 - protein, 24 aa, Cryptosporidium parvum
MQIIKLSLILSELDINMDQFIDLC

SEQ ID NO: 2299809 - protein, 23 aa, Cryptosporidium parvum
MQKKELLEDILLEATKKKDRLSD

SEQ ID NO: 2299810 - protein, 17 aa, Cryptosporidium parvum
MQMSNGIYTLLDIKYGI

SEQ ID NO: 2299811 - protein, 28 aa, Cryptosporidium parvum
MQMSSCLYTKDYVCIGFSNGSVRLYNFP

SEQ ID NO: 2299812 - protein, 22 aa, Cryptosporidium parvum
MQNVIAHPWLKISSNKASKYFT

SEQ ID NO: 2299813 - protein, 21 aa, Cryptosporidium parvum
MREEIWSFSSFGLIDDQIGNF

SEQ ID NO: 2299814 - protein, 23 aa, Cryptosporidium parvum
MRFRHGVGIWELFIPHLGPGEKY

SEQ ID NO: 2299815 - protein, 18 aa, Cryptosporidium parvum
MRIIKDKIEFARIQTDSS

SEQ ID NO: 2299816 - protein, 19 aa, Cryptosporidium parvum
MRKATRLVDQLLIKTSNDF

SEQ ID NO: 2299817 - protein, 18 aa, Cryptosporidium parvum
MRKGGTFVAKIFRGENIS

SEQ ID NO: 2299818 - protein, 17 aa, Cryptosporidium parvum
MRKGRAETKFKGNMEIN

SEQ ID NO: 2299819 - protein, 26 aa, Cryptosporidium parvum
MRKPKKRGFSDFSLKSLNSIGKMSIS

SEQ ID NO: 2299820 - protein, 29 aa, Cryptosporidium parvum
MRLKQIGVRSLRHFSKIPIVVSELDQMEE

SEQ ID NO: 2299821 - protein, 19 aa, Cryptosporidium parvum
MRLYEELYNKFQTCKNDIE

SEQ ID NO: 2299822 - protein, 26 aa, Cryptosporidium parvum
MRMTACKGIGKFHAKWIPVSVATFTN

SEQ ID NO: 2299823 - protein, 25 aa, Cryptosporidium parvum
MRNPMSWHCLGTLYKGDFDYNEAIK

SEQ ID NO: 2299824 - protein, 17 aa, Cryptosporidium parvum
MRPVKRKLNRLISESDE

SEQ ID NO: 2299825 - protein, 38 aa, Cryptosporidium parvum
MRRATELFTFKCSLYQRELKLYLPEPVPKHRRWIDTFD

SEQ ID NO: 2299826 - protein, 17 aa, Cryptosporidium parvum
MRRTPRDFFDFLKHIIK

SEQ ID NO: 2299827 - protein, 29 aa, Cryptosporidium parvum
MRTQAELRRELNIPLAIKADSEYVTKQDR

SEQ ID NO: 2299828 - protein, 25 aa, Cryptosporidium parvum
MRVDFSYKRIQGILATSILKKHQVL

SEQ ID NO: 2299829 - protein, 19 aa, Cryptosporidium parvum
MRVKEFKKTSIISEDSEEK

SEQ ID NO: 2299830 - protein, 17 aa, Cryptosporidium parvum
MRWRYYFVKMAINIDKF

SEQ ID NO: 2299831 - protein, 20 aa, Cryptosporidium parvum
MSADLAKNGIVFGGENSIGN

SEQ ID NO: 2299832 - protein, 22 aa, Cryptosporidium parvum
MSASSDGFWLAVGVGNLLTVFE

SEQ ID NO: 2299833 - protein, 18 aa, Cryptosporidium parvum
MSDWAKSVIVGRGRIGGI

SEQ ID NO: 2299834 - protein, 23 aa, Cryptosporidium parvum
MSEARSYLPFDVIVQEPKSRRLN

SEQ ID NO: 2299835 - protein, 23 aa, Cryptosporidium parvum
MSEISCGRSLCLSTKEQYKVINR

SEQ ID NO: 2299836 - protein, 18 aa, Cryptosporidium parvum
MSELKETILFVIQALAVP

SEQ ID NO: 2299837 - protein, 20 aa, Cryptosporidium parvum
MSELRSCNNIILLEARRHEE

SEQ ID NO: 2299838 - protein, 24 aa, Cryptosporidium parvum
MSGVTCCLRFPGQLNSDLRKMCVN

SEQ ID NO: 2299839 - protein, 20 aa, Cryptosporidium parvum
MSHEIGWNASNSFTPTNSGS

SEQ ID NO: 2299840 - protein, 25 aa, Cryptosporidium parvum
MSIHLYELITQFSLLVISNGNKIEV

SEQ ID NO: 2299841 - protein, 24 aa, Cryptosporidium parvum
MSILSIILERLFNSPFEELQKLHS

SEQ ID NO: 2299842 - protein, 19 aa, Cryptosporidium parvum
MSKIALKQSLICRLGYIPL

SEQ ID NO: 2299843 - protein, 31 aa, Cryptosporidium parvum; identical to SEQ ID NO: 2177745

SEQ ID NO: 2299844 - protein, 22 aa, Cryptosporidium parvum
MSNEGYFLKSLYEKGINTIKKV

SEQ ID NO: 2299845 - protein, 24 aa, Cryptosporidium parvum
MSNKLSCKGSEYLDGNNKSADFNI

SEQ ID NO: 2299846 - protein, 23 aa, Cryptosporidium parvum
MSNWNVIKLLAYVDKIGDQEIES

SEQ ID NO: 2299847 - protein, 17 aa, Cryptosporidium parvum
MSPSRGVLFYGPPGCGK

SEQ ID NO: 2299848 - protein, 17 aa, Cryptosporidium parvum
MSQLLISIENSLICLEL

SEQ ID NO: 2299849 - protein, 25 aa, Cryptosporidium parvum
MSRLSPELLALVVRHIYSQDQQIIQ

SEQ ID NO: 2299850 - protein, 23 aa, Cryptosporidium parvum
MSRRKTIGGVFCYLLKQLVAEDQ

SEQ ID NO: 2299851 - protein, 22 aa, Cryptosporidium parvum
MSRRRFSISYVQNLPNKGIENR

SEQ ID NO: 2299852 - protein, 18 aa, Cryptosporidium parvum
MSSFRPINHGGLMHNDSA

SEQ ID NO: 2299853 - protein, 18 aa, Cryptosporidium parvum
MSVELSLHQLEVFGFIDL

SEQ ID NO: 2299854 - protein, 30 aa, Cryptosporidium parvum
MSVLPPKSGKICLPKEFYNMMIDKDNPLSE

SEQ ID NO: 2299855 - protein, 17 aa, Cryptosporidium parvum
MSVYRTRGSGLSLSDNY

SEQ ID NO: 2299856 - protein, 17 aa, Cryptosporidium parvum
MSWVDEYYLEISKIDIE

SEQ ID NO: 2299857 - protein, 26 aa, Cryptosporidium parvum
MSYDREFSKIFSIKKLHLGHVASSFG

SEQ ID NO: 2299858 - protein, 20 aa, Cryptosporidium parvum
MSYFICDGCEKRHEIFSKGD

SEQ ID NO: 2299859 - protein, 18 aa, Cryptosporidium parvum
MSYHDFIYFYISDEDKTT

SEQ ID NO: 2299860 - protein, 20 aa, Cryptosporidium parvum
MSYLPKIFIENQFVNSVSKD

SEQ ID NO: 2299861 - protein, 22 aa, Cryptosporidium parvum
MSYQRYGGLSAVGGREGYSTSY

SEQ ID NO: 2299862 - protein, 20 aa, Cryptosporidium parvum
MTAIPFNCLMKIVPSNDETH

SEQ ID NO: 2299863 - protein, 24 aa, Cryptosporidium parvum
MTELSRFRTRICERKALHGVCELD

SEQ ID NO: 2299864 - protein, 17 aa, Cryptosporidium parvum
MTIPIMSKIVYLELLEK

SEQ ID NO: 2299865 - protein, 18 aa, Cryptosporidium parvum
MTNCINFCPILDSRSIPN

SEQ ID NO: 2299866 - protein, 18 aa, Cryptosporidium parvum
MTPWSLALFKSLPRFIRR

SEQ ID NO: 2299867 - protein, 26 aa, Cryptosporidium parvum
MTRMDRLLNFLSFVQDLFKNYCSPEI

SEQ ID NO: 2299868 - protein, 21 aa, Cryptosporidium parvum
MTSVDICAMVHGISKDLKGQK

SEQ ID NO: 2299869 - protein, 17 aa, Cryptosporidium parvum
MTVRRFLTATGHAISLF

SEQ ID NO: 2299870 - protein, 21 aa, Cryptosporidium parvum
MVCEINPGLLRHAIHESTSQY

SEQ ID NO: 2299871 - protein, 18 aa, Cryptosporidium parvum
MVEAKLVTKPGVDKNKPL

SEQ ID NO: 2299872 - protein, 17 aa, Cryptosporidium parvum
MVFDCSSTILTIVTERK

SEQ ID NO: 2299873 - protein, 24 aa, Cryptosporidium parvum
MVFSKANIKLSEFVSADIDERAIT

SEQ ID NO: 2299874 - protein, 20 aa, Cryptosporidium parvum
MVIAKSIALSAYYKSLDPFS

SEQ ID NO: 2299875 - protein, 24 aa, Cryptosporidium parvum
MVKLGRFKLRVKQLVKNEDQIPEL

SEQ ID NO: 2299876 - protein, 21 aa, Cryptosporidium parvum
MVLGALPYIVSMLKKVGYLEF

SEQ ID NO: 2299877 - protein, 18 aa, Cryptosporidium parvum
MVLLCKKYSMPKKVIDEL

SEQ ID NO: 2299878 - protein, 26 aa, Cryptosporidium parvum
MVLQECLQRHGYSCIPAANPRVQDYI

SEQ ID NO: 2299879 - protein, 28 aa, Cryptosporidium parvum
MVNPNIEFLRFGFLFSKDTLAPFEMTIS

SEQ ID NO: 2299880 - protein, 20 aa, Cryptosporidium parvum
MVPLGPLAFSPGYIINTNKV

SEQ ID NO: 2299881 - protein, 18 aa, Cryptosporidium parvum
MVRDRWEALVYNRNSITN

SEQ ID NO: 2299882 - protein, 32 aa, Cryptosporidium parvum; identical to SEQ ID NO: 2177786

SEQ ID NO: 2299883 - protein, 33 aa, Cryptosporidium parvum; identical to SEQ ID NO: 2177787

SEQ ID NO: 2299884 - protein, 25 aa, Cryptosporidium parvum
MVSHSLPVLCRLLYFSDLEVMTDAC

SEQ ID NO: 2299885 - protein, 20 aa, Cryptosporidium parvum
MVSPLQSFRTPRLENQNHNN

SEQ ID NO: 2299886 - protein, 24 aa, Cryptosporidium parvum
MVTRTGYMLIYKRKDWAPRQPTCN

SEQ ID NO: 2299887 - protein, 20 aa, Cryptosporidium parvum
MVYILRWSFELGPSKSRSLL

SEQ ID NO: 2299888 - protein, 22 aa, Cryptosporidium parvum
MVYSEKISIIILYQLLVCVDYL

SEQ ID NO: 2299889 - protein, 20 aa, Cryptosporidium parvum
MWGTLCRKQKIMASTLDGID

SEQ ID NO: 2299890 - protein, 18 aa, Cryptosporidium parvum
MWKESRRFMFKKLEDELL

SEQ ID NO: 2299891 - protein, 17 aa, Cryptosporidium parvum
MWYSYFRGNIYLENTSR

SEQ ID NO: 2299892 - protein, 22 aa, Cryptosporidium parvum
MYAKMFKDCYGFISPTKFINTC

SEQ ID NO: 2299893 - protein, 19 aa, Cryptosporidium parvum
MYEIYKRKSEIMVNKIHLN

SEQ ID NO: 2299894 - protein, 26 aa, Cryptosporidium parvum
MYELYDPVSVMFFFRNKHIMVDLGTG

SEQ ID NO: 2299895 - protein, 17 aa, Cryptosporidium parvum
MYENWPFVKSFFDLVSM

SEQ ID NO: 2299896 - protein, 43 aa, Cryptosporidium parvum
MYEVECHVDFDLWCNFFTSIGISLCNFRSLFHTTKLIGEGSFA

SEQ ID NO: 2299897 - protein, 23 aa, Cryptosporidium parvum
MYFMVPRYGDYIIAEVAKQLNQK

SEQ ID NO: 2299898 - protein, 17 aa, Cryptosporidium parvum
MYGELVIGLGETLVSNT

SEQ ID NO: 2299899 - protein, 23 aa, Cryptosporidium parvum
MYHTVQEPMWDAAMYNPNTIKAN

SEQ ID NO: 2299900 - protein, 20 aa, Cryptosporidium parvum
MYIIGGGISTILLNADISSE

SEQ ID NO: 2299901 - protein, 17 aa, Cryptosporidium parvum
MYLCGCDLTPTYKNLQN

SEQ ID NO: 2299902 - protein, 39 aa, Cryptosporidium parvum
MYLQDMICEIIYLILRDCCEYDPRLPIKYVSSKLGNVFD

SEQ ID NO: 2299903 - protein, 26 aa, Cryptosporidium parvum
MYLYAAISCLPKYIVAKILKRRNPGI

SEQ ID NO: 2299904 - protein, 31 aa, Cryptosporidium parvum; identical to SEQ ID NO: 2177803

SEQ ID NO: 2299905 - protein, 17 aa, Cryptosporidium parvum
MYNKWKKPLEILSNDDD

SEQ ID NO: 2299906 - protein, 24 aa, Cryptosporidium parvum
MYSTSSWLPLSRNTGFNYNCLYSN

SEQ ID NO: 2299907 - protein, 25 aa, Cryptosporidium parvum
MYYGDPCGHKFCSECSTKANNNKKS

SEQ ID NO: 2299908 - protein, 17 aa, Cryptosporidium parvum
NAAKDKAERVRSQLQIL

SEQ ID NO: 2299909 - protein, 39 aa, Cryptosporidium parvum
NAAKVQTMRALNCTRILQELIKACILRRRKHELQDILKL

SEQ ID NO: 2299910 - protein, 17 aa, Cryptosporidium parvum
NAAPNCCGSNYNYFIDR

SEQ ID NO: 2299911 - protein, 20 aa, Cryptosporidium parvum
NACWELFCLEHGINPDGTMP

SEQ ID NO: 2299912 - protein, 26 aa, Cryptosporidium parvum
NADDICRFKLTWPLQKSFEIADEEMK

SEQ ID NO: 2299913 - protein, 24 aa, Cryptosporidium parvum
NADPELYMALRMSMEEERNRQMRL

SEQ ID NO: 2299914 - protein, 22 aa, Cryptosporidium parvum
NADSWLVSWNLLGIADGVSSVE

SEQ ID NO: 2299915 - protein, 19 aa, Cryptosporidium parvum
NAEIARLILSKGYSSSLND

SEQ ID NO: 2299916 - protein, 21 aa, Cryptosporidium parvum
NAEYGLGMVVGYRQRRDRFRE

SEQ ID NO: 2299917 - protein, 18 aa, Cryptosporidium parvum
NAFDILLIDHLNDIVNVQ

SEQ ID NO: 2299918 - protein, 18 aa, Cryptosporidium parvum
NAFKAFTLNSEYASKLKD

SEQ ID NO: 2299919 - protein, 20 aa, Cryptosporidium parvum
NAGALWGSIMGGTNRTSTVP

SEQ ID NO: 2299920 - protein, 19 aa, Cryptosporidium parvum
NAGIGGAGFNMGVAEHSSV

SEQ ID NO: 2299921 - protein, 19 aa, Cryptosporidium parvum
NAICSVSLNYICNNCNKLS

SEQ ID NO: 2299922 - protein, 23 aa, Cryptosporidium parvum
NAILCIHGKTVLDKEVGPIQVKY

SEQ ID NO: 2299923 - protein, 25 aa, Cryptosporidium parvum
NAIPKWLKDAGFKWDNDINSITQTR

SEQ ID NO: 2299924 - protein, 23 aa, Cryptosporidium parvum
NAKCRLRLLKYERIKDYLMMEQE

SEQ ID NO: 2299925 - protein, 21 aa, Cryptosporidium parvum
NAKEFLPRAISNNSKMCGDRL

SEQ ID NO: 2299926 - protein, 20 aa, Cryptosporidium parvum
NAKELSSWLEVGASGYYNFP

SEQ ID NO: 2299927 - protein, 19 aa, Cryptosporidium parvum
NAKILGILHRHFGYNRGKK

SEQ ID NO: 2299928 - protein, 23 aa, Cryptosporidium parvum
NAKLECLILMFIKLIKLQLNEIR

SEQ ID NO: 2299929 - protein, 17 aa, Cryptosporidium parvum
NALDYILTGDCRLLSDE

SEQ ID NO: 2299930 - protein, 20 aa, Cryptosporidium parvum
NALPFFSGCIGRRVTISDSQ

SEQ ID NO: 2299931 - protein, 28 aa, Cryptosporidium parvum
NALPKKSVRIGSCIGVLEILKNVRKSEL

SEQ ID NO: 2299932 - protein, 17 aa, Cryptosporidium parvum
NAMGVCMYTLLDGQHND

SEQ ID NO: 2299933 - protein, 20 aa, Cryptosporidium parvum
NANEKILRFDFSNIEKKINE

SEQ ID NO: 2299934 - protein, 19 aa, Cryptosporidium parvum
NANGRCLIINILQNICDNS

SEQ ID NO: 2299935 - protein, 33 aa, Cryptosporidium parvum; identical to SEQ ID NO: 2177833

SEQ ID NO: 2299936 - protein, 24 aa, Cryptosporidium parvum
NAPNLKVYFFSALNEINKREHLES

SEQ ID NO: 2299937 - protein, 32 aa, Cryptosporidium parvum; identical to SEQ ID NO: 2177835

SEQ ID NO: 2299938 - protein, 17 aa, Cryptosporidium parvum
NAPSRLVTGASITPAAV

SEQ ID NO: 2299939 - protein, 23 aa, Cryptosporidium parvum
NAQWEPIEFSKLMSDIELVKKAY

SEQ ID NO: 2299940 - protein, 31 aa, Cryptosporidium parvum; identical to SEQ ID NO: 2177838

SEQ ID NO: 2299941 - protein, 17 aa, Cryptosporidium parvum
NARIGLIQFCLSAPKTD

SEQ ID NO: 2299942 - protein, 19 aa, Cryptosporidium parvum
NARISRSILDEFSKLRDSN

SEQ ID NO: 2299943 - protein, 22 aa, Cryptosporidium parvum
NARSTGWLKVVDTMFPELSNAL

SEQ ID NO: 2299944 - protein, 23 aa, Cryptosporidium parvum
NASWRIVTIASILVPSSKIELSN

SEQ ID NO: 2299945 - protein, 26 aa, Cryptosporidium parvum
NATKPIEVFLIFSLNAIKSVIADLSS

SEQ ID NO: 2299946 - protein, 20 aa, Cryptosporidium parvum
NAVELFALIDLELGEVYSNG

SEQ ID NO: 2299947 - protein, 27 aa, Cryptosporidium parvum
NAVINCSDWPTSVSFHPIQKNIIFIGS

SEQ ID NO: 2299948 - protein, 17 aa, Cryptosporidium parvum
NAWEKSARIYFMDLDLM

SEQ ID NO: 2299949 - protein, 20 aa, Cryptosporidium parvum
NAYICSGLDDIFFKNMLEIA

SEQ ID NO: 2299950 - protein, 26 aa, Cryptosporidium parvum
NCASYGSTTCLLCFLDGNQLWVSNVG

SEQ ID NO: 2299951 - protein, 25 aa, Cryptosporidium parvum
NCDACYRPFHSRCVGFDIKRAEFNN

SEQ ID NO: 2299952 - protein, 20 aa, Cryptosporidium parvum
NCDILPYYIEYYRFQNVAFQ

SEQ ID NO: 2299953 - protein, 25 aa, Cryptosporidium parvum
NCDLRTSMKDCFTEFAVSEYRLARE

SEQ ID NO: 2299954 - protein, 18 aa, Cryptosporidium parvum
NCDMKGLDVDRLMLVSAV

SEQ ID NO: 2299955 - protein, 19 aa, Cryptosporidium parvum
NCDSGVLISTDLTARGIDI

SEQ ID NO: 2299956 - protein, 18 aa, Cryptosporidium parvum
NCDVFFHKICYGISNHNA

SEQ ID NO: 2299957 - protein, 19 aa, Cryptosporidium parvum
NCKCYKPTESGIHREIFLR

SEQ ID NO: 2299958 - protein, 19 aa, Cryptosporidium parvum
NCKGELGKAISILEESREI

SEQ ID NO: 2299959 - protein, 17 aa, Cryptosporidium parvum
NCLDKISGKFVVVVGTT

SEQ ID NO: 2299960 - protein, 29 aa, Cryptosporidium parvum
NCLPDQYKDLFSRFIRVMNTLQFIGLLYL

SEQ ID NO: 2299961 - protein, 18 aa, Cryptosporidium parvum
NCMDYQYSKREGCIRERR

SEQ ID NO: 2299962 - protein, 34 aa, Cryptosporidium parvum
NCNHFSDNIVKFLIGEGIPSYILDLPNEVMRTPF

SEQ ID NO: 2299963 - protein, 23 aa, Cryptosporidium parvum
NCNNILSGLNFRNTAIGKSKTIS

SEQ ID NO: 2299964 - protein, 18 aa, Cryptosporidium parvum
NCNQVFKTIVPPELVYSG

SEQ ID NO: 2299965 - protein, 19 aa, Cryptosporidium parvum
NCNSELPPTIIESLTKLIQ

SEQ ID NO: 2299966 - protein, 23 aa, Cryptosporidium parvum
NCNWKDDNVLTWLSRPVLSDLII

SEQ ID NO: 2299967 - protein, 25 aa, Cryptosporidium parvum
NCRNCFKELKIKADGLIVGNEIFNV

SEQ ID NO: 2299968 - protein, 18 aa, Cryptosporidium parvum
NCSSCLDSILGKLDGSTD

SEQ ID NO: 2299969 - protein, 22 aa, Cryptosporidium parvum
NCVPLLRRFTCSPENCGDVRLW

SEQ ID NO: 2299970 - protein, 24 aa, Cryptosporidium parvum
NDEEIKEEIDLMINRIKEMDEIEL

SEQ ID NO: 2299971 - protein, 19 aa, Cryptosporidium parvum
NDEIFKVCVDFWLHFTQQL

SEQ ID NO: 2299972 - protein, 17 aa, Cryptosporidium parvum
NDEKWKFLVDKLGIPLN

SEQ ID NO: 2299973 - protein, 22 aa, Cryptosporidium parvum
NDERSNPVVDWNLKKIQDNLID

SEQ ID NO: 2299974 - protein, 19 aa, Cryptosporidium parvum
NDFALLKDQIETILREYGV

SEQ ID NO: 2299975 - protein, 17 aa, Cryptosporidium parvum
NDFEEFSEIVAFDENIP

SEQ ID NO: 2299976 - protein, 24 aa, Cryptosporidium parvum
NDFLQDLLNFIGYHIESESILESN

SEQ ID NO: 2299977 - protein, 25 aa, Cryptosporidium parvum
NDFLQKAKVIWLYKNGDKYDKGTIY

SEQ ID NO: 2299978 - protein, 28 aa, Cryptosporidium parvum
NDFPIDANCILSAWKYQEVSLYYIFNEI

SEQ ID NO: 2299979 - protein, 29 aa, Cryptosporidium parvum
NDFYRILKWDPFEFSEFNSSVFFDPAEIQ

SEQ ID NO: 2299980 - protein, 24 aa, Cryptosporidium parvum
NDHIWKYSKIRNIKGVNNFEERDK

SEQ ID NO: 2299981 - protein, 23 aa, Cryptosporidium parvum
NDICFVCYRGLFNYQGFTFEDIR

SEQ ID NO: 2299982 - protein, 17 aa, Cryptosporidium parvum
NDIGEMMECISRNCKDV

SEQ ID NO: 2299983 - protein, 26 aa, Cryptosporidium parvum
NDILKRAKNFLSLCETIGNEKVTQSY

SEQ ID NO: 2299984 - protein, 23 aa, Cryptosporidium parvum
NDILPEAVFRLKLDNENYKAGVI

SEQ ID NO: 2299985 - protein, 26 aa, Cryptosporidium parvum
NDKDILEWFKFRVLCENVAEFTAAKL

SEQ ID NO: 2299986 - protein, 18 aa, Cryptosporidium parvum
NDKICVICGVNIGKYKFK

SEQ ID NO: 2299987 - protein, 18 aa, Cryptosporidium parvum
NDKLCSAYNSVIIFFFLY

SEQ ID NO: 2299988 - protein, 17 aa, Cryptosporidium parvum
NDKRVLSLFGETVLSRE

SEQ ID NO: 2299989 - protein, 24 aa, Cryptosporidium parvum
NDKSILWKIFVKRRLRRLDLVHLT

SEQ ID NO: 2299990 - protein, 17 aa, Cryptosporidium parvum
NDLEMKVIPSLKISTDN

SEQ ID NO: 2299991 - protein, 24 aa, Cryptosporidium parvum
NDLIPRWLHDWLSELLTCMNTNRE

SEQ ID NO: 2299992 - protein, 25 aa, Cryptosporidium parvum
NDLKYWKYRAFNCVIQQFSNSFQGI

SEQ ID NO: 2299993 - protein, 17 aa, Cryptosporidium parvum
NDLLRPVFSCDYSSENK

SEQ ID NO: 2299994 - protein, 21 aa, Cryptosporidium parvum
NDLNEIMELYLQFFNNTLEIR

SEQ ID NO: 2299995 - protein, 26 aa, Cryptosporidium parvum
NDLPDLILVVFYRYILLMRRLQSIYL

SEQ ID NO: 2299996 - protein, 33 aa, Cryptosporidium parvum
NDLRIKEEFAGFTWDLFTINKFQTIIILNNNCH

SEQ ID NO: 2299997 - protein, 17 aa, Cryptosporidium parvum
NDLRNCDSEYAIDKTAE

SEQ ID NO: 2299998 - protein, 21 aa, Cryptosporidium parvum
NDLSVWFQFMESIESVLASSR

SEQ ID NO: 2299999 - protein, 17 aa, Cryptosporidium parvum
NDMVKLGRFKLRVKQLV

SEQ ID NO: 2300000 - protein, 18 aa, Cryptosporidium parvum
NDMVYVLVAWTRRYMWVY

SEQ ID NO: 2300001 - protein, 22 aa, Cryptosporidium parvum
NDNFRPSKLAIMLEDLEDFDTE

SEQ ID NO: 2300002 - protein, 19 aa, Cryptosporidium parvum
NDNGLKFVSEFIKSQIDSS

SEQ ID NO: 2300003 - protein, 27 aa, Cryptosporidium parvum
NDPKVKFKALRLIKHLCENGNPTFKML

SEQ ID NO: 2300004 - protein, 24 aa, Cryptosporidium parvum
NDPLLLEFLFYIVGYTGLKEENIR

SEQ ID NO: 2300005 - protein, 24 aa, Cryptosporidium parvum
NDPLLRLGAGLPHNSSGTPCIPPF

SEQ ID NO: 2300006 - protein, 27 aa, Cryptosporidium parvum
NDPSCTLYVCRLSLKTKEDDLRRLFED

SEQ ID NO: 2300007 - protein, 25 aa, Cryptosporidium parvum
NDQLPVILFGFSRRKVEQLATNLPN

SEQ ID NO: 2300008 - protein, 24 aa, Cryptosporidium parvum
NDQNKEFIVHIGLLEENKSKCEFV

SEQ ID NO: 2300009 - protein, 23 aa, Cryptosporidium parvum
NDRFKDNLLRSFRFDEELSSNQA

SEQ ID NO: 2300010 - protein, 25 aa, Cryptosporidium parvum
NDRKRLSFVRFLKLDKVGPHCDCDK

SEQ ID NO: 2300011 - protein, 22 aa, Cryptosporidium parvum
NDRNIHRFKLLPPSNEVVNHLI

SEQ ID NO: 2300012 - protein, 24 aa, Cryptosporidium parvum
NDRWKGIWSDIVFDIINAEVEWGS

SEQ ID NO: 2300013 - protein, 17 aa, Cryptosporidium parvum
NDSFKFRDESKLLKDSS

SEQ ID NO: 2300014 - protein, 25 aa, Cryptosporidium parvum
NDSKFGIKSAKMWKRVSELKDQGMG

SEQ ID NO: 2300015 - protein, 21 aa, Cryptosporidium parvum
NDSLIEFVRYILSSRSSSFPK

SEQ ID NO: 2300016 - protein, 25 aa, Cryptosporidium parvum
NDSYIQGFCCSKCFNINDFDYKSNN

SEQ ID NO: 2300017 - protein, 18 aa, Cryptosporidium parvum
NDTIKWLLFKNESFEILL

SEQ ID NO: 2300018 - protein, 21 aa, Cryptosporidium parvum
NDVAWKIIKQFGELKELDFSE

SEQ ID NO: 2300019 - protein, 18 aa, Cryptosporidium parvum
NDVLCIGHTHGIETIIAP

SEQ ID NO: 2300020 - protein, 20 aa, Cryptosporidium parvum
NDVSSRFSIISSNLKESPTS

SEQ ID NO: 2300021 - protein, 24 aa, Cryptosporidium parvum
NDWTRKVPPSWTLKILGSIIQGDA

SEQ ID NO: 2300022 - protein, 25 aa, Cryptosporidium parvum
NDYFAREGLLGVCESRLNTHRWERN

SEQ ID NO: 2300023 - protein, 20 aa, Cryptosporidium parvum
NDYLPIKFKALINSGKLVFL

SEQ ID NO: 2300024 - protein, 24 aa, Cryptosporidium parvum
NDYNPSLELNEWLPTQCIDVRSEV

SEQ ID NO: 2300025 - protein, 18 aa, Cryptosporidium parvum
NDYRGFMKPVQFIDYNPM

SEQ ID NO: 2300026 - protein, 19 aa, Cryptosporidium parvum
NEAIDCIRDILGKFQHFAI

SEQ ID NO: 2300027 - protein, 19 aa, Cryptosporidium parvum
NEAIKCFKTALKFDKEDLV

SEQ ID NO: 2300028 - protein, 30 aa, Cryptosporidium parvum
NEARIKAMEDAICTVDLWVKSPIDCVPDEL

SEQ ID NO: 2300029 - protein, 24 aa, Cryptosporidium parvum
NECSSRPSISLATSVRRKVYHIDS

SEQ ID NO: 2300030 - protein, 25 aa, Cryptosporidium parvum
NECVICKRDKFGVATGLGTELPNVI

SEQ ID NO: 2300031 - protein, 24 aa, Cryptosporidium parvum
NEDIELRFTLNLEEDLSKFKEAFE

SEQ ID NO: 2300032 - protein, 18 aa, Cryptosporidium parvum
NEDLKLISLFYTAETNVP

SEQ ID NO: 2300033 - protein, 25 aa, Cryptosporidium parvum
NEDYYRRINVQPAIVDTPMSPRTAK

SEQ ID NO: 2300034 - protein, 24 aa, Cryptosporidium parvum
NEEEMIGLLKLVFDKATTQHHFIP

SEQ ID NO: 2300035 - protein, 17 aa, Cryptosporidium parvum
NEEFPKFFWKRKSNCSL

SEQ ID NO: 2300036 - protein, 18 aa, Cryptosporidium parvum
NEEIEIISKEIDAINKER

SEQ ID NO: 2300037 - protein, 24 aa, Cryptosporidium parvum
NEELEEYKHLVLRFMHQQNGNDDY

SEQ ID NO: 2300038 - protein, 24 aa, Cryptosporidium parvum
NEELKILLKKKEGIIMDLQNELGQ

SEQ ID NO: 2300039 - protein, 26 aa, Cryptosporidium parvum
NEESCLPLRILIKFERKTLKDKDREK

SEQ ID NO: 2300040 - protein, 19 aa, Cryptosporidium parvum
NEFGIVFVKVKFETENILN

SEQ ID NO: 2300041 - protein, 17 aa, Cryptosporidium parvum
NEFLKLGVFELITKKLG

SEQ ID NO: 2300042 - protein, 19 aa, Cryptosporidium parvum
NEFMEIIGGFRSCAKEESK

SEQ ID NO: 2300043 - protein, 24 aa, Cryptosporidium parvum
NEFNRWLPDFVKVIYEGNKEIRKQ

SEQ ID NO: 2300044 - protein, 17 aa, Cryptosporidium parvum
NEFRGCSVGRKNSIPRF

SEQ ID NO: 2300045 - protein, 18 aa, Cryptosporidium parvum
NEGFNWFKIAQELNSGRT

SEQ ID NO: 2300046 - protein, 20 aa, Cryptosporidium parvum
NEGFPNYNLNNFDTENNQFS

SEQ ID NO: 2300047 - protein, 20 aa, Cryptosporidium parvum
NEGLWSPYWEAFKVNNAYSH

SEQ ID NO: 2300048 - protein, 22 aa, Cryptosporidium parvum
NEGNFDFARYSLVGTGLNNSNI

SEQ ID NO: 2300049 - protein, 20 aa, Cryptosporidium parvum
NEGWSDVFQYNKLVSNSMNY

SEQ ID NO: 2300050 - protein, 20 aa, Cryptosporidium parvum
NEHGEFPSHYIFVGNTQKLK

SEQ ID NO: 2300051 - protein, 24 aa, Cryptosporidium parvum
NEHYPRKLIKTFSVFPMLNNESSD

SEQ ID NO: 2300052 - protein, 30 aa, Cryptosporidium parvum
NEICCLLNWKEIFCSYKLLIQQIKYNFAST

SEQ ID NO: 2300053 - protein, 30 aa, Cryptosporidium parvum
NEIGKLRVESELVEGLSWEDDVWEEEEEEE

SEQ ID NO: 2300054 - protein, 28 aa, Cryptosporidium parvum
NEIINFTSCWKLPTFLFYSDKKGNLLNY

SEQ ID NO: 2300055 - protein, 25 aa, Cryptosporidium parvum
NEIITCARFSSFLRNNSGRLHWLRV

SEQ ID NO: 2300056 - protein, 22 aa, Cryptosporidium parvum
NEIKGEINLIKIIIKGQSFLLH

SEQ ID NO: 2300057 - protein, 20 aa, Cryptosporidium parvum
NEIKHFKGLITGTREENRKY

SEQ ID NO: 2300058 - protein, 23 aa, Cryptosporidium parvum
NEILDNHLLLGMNCNNNTGNNNM

SEQ ID NO: 2300059 - protein, 19 aa, Cryptosporidium parvum
NEIMIIKAQVENLVEEKSK

SEQ ID NO: 2300060 - protein, 20 aa, Cryptosporidium parvum
NEIPVQIILYKDFPFSPPDI

SEQ ID NO: 2300061 - protein, 17 aa, Cryptosporidium parvum
NEIQKILSIPVFVNPDL

SEQ ID NO: 2300062 - protein, 17 aa, Cryptosporidium parvum
NEIRIRIQYEFTNHLPV

SEQ ID NO: 2300063 - protein, 25 aa, Cryptosporidium parvum
NEIRSTAWIPKGEYIPEDIIMGYHT

SEQ ID NO: 2300064 - protein, 25 aa, Cryptosporidium parvum
NEISDLIHRCHYDANQIELAVGNVI

SEQ ID NO: 2300065 - protein, 21 aa, Cryptosporidium parvum
NEISELRLKLSNSKEKESSNY

SEQ ID NO: 2300066 - protein, 21 aa, Cryptosporidium parvum
NEISMLRTGRFQDAQNYREGI

SEQ ID NO: 2300067 - protein, 18 aa, Cryptosporidium parvum
NEISSYYAFARVDNISAK

SEQ ID NO: 2300068 - protein, 21 aa, Cryptosporidium parvum
NEIYTSISRTIIKKCNISDGG

SEQ ID NO: 2300069 - protein, 25 aa, Cryptosporidium parvum
NEKCKALRELIIWMTHGESYNRLLM

SEQ ID NO: 2300070 - protein, 24 aa, Cryptosporidium parvum
NEKDPVGCIVFLRFSDTLIEATNS

SEQ ID NO: 2300071 - protein, 18 aa, Cryptosporidium parvum
NEKFEIMTDSLLLLQRLE

SEQ ID NO: 2300072 - protein, 23 aa, Cryptosporidium parvum
NEKFKKIVERLIFMNVEKETNRI

SEQ ID NO: 2300073 - protein, 24 aa, Cryptosporidium parvum
NELCNRIEGIFGIIDQDQSGSWEY

SEQ ID NO: 2300074 - protein, 17 aa, Cryptosporidium parvum
NELEELFEITPTNYIEP

SEQ ID NO: 2300075 - protein, 28 aa, Cryptosporidium parvum
NELFERISGYFFGEGRNIFLKKAIIDWK

SEQ ID NO: 2300076 - protein, 18 aa, Cryptosporidium parvum
NELGELVHSISHLGEKKL

SEQ ID NO: 2300077 - protein, 17 aa, Cryptosporidium parvum
NELGYQYAINWAGGLHH

SEQ ID NO: 2300078 - protein, 24 aa, Cryptosporidium parvum
NELHKFSKYWLKKLGIPKEVPPSA

SEQ ID NO: 2300079 - protein, 21 aa, Cryptosporidium parvum
NELKASIKFQLKKVLCLGVAI

SEQ ID NO: 2300080 - protein, 17 aa, Cryptosporidium parvum
NELLCFMVTCETIIQPE

SEQ ID NO: 2300081 - protein, 17 aa, Cryptosporidium parvum
NELLKEWFDNEDIILKE

SEQ ID NO: 2300082 - protein, 18 aa, Cryptosporidium parvum
NELLPIWKISINSQAKNE

SEQ ID NO: 2300083 - protein, 20 aa, Cryptosporidium parvum
NELLSGSLVRKSNQNNGLSD

SEQ ID NO: 2300084 - protein, 17 aa, Cryptosporidium parvum
NELNAKLGRNLNILSKS

SEQ ID NO: 2300085 - protein, 17 aa, Cryptosporidium parvum
NELRPGGNGHRIGSIRS

SEQ ID NO: 2300086 - protein, 22 aa, Cryptosporidium parvum
NELRTRIERKLSINKELSQAAA

SEQ ID NO: 2300087 - protein, 19 aa, Cryptosporidium parvum
NELVWWRMTRKQRYLPGRT

SEQ ID NO: 2300088 - protein, 21 aa, Cryptosporidium parvum
NELYFPVSDNLFAKCSSPPSN

SEQ ID NO: 2300089 - protein, 21 aa, Cryptosporidium parvum
NEMDFCMSGMMVINSLNNTTG

SEQ ID NO: 2300090 - protein, 23 aa, Cryptosporidium parvum
NENFKLAYPFYSNIFNIENHTCK

SEQ ID NO: 2300091 - protein, 26 aa, Cryptosporidium parvum
NENIRLSTGVSEIFGFFETSEDKQMP

SEQ ID NO: 2300092 - protein, 22 aa, Cryptosporidium parvum
NENKLCFDIFKTEELPISSQKS

SEQ ID NO: 2300093 - protein, 20 aa, Cryptosporidium parvum
NENKPSIGFNTFNPYSLFVG

SEQ ID NO: 2300094 - protein, 26 aa, Cryptosporidium parvum
NENLLRRKGCLTDKSFTKYYAERIVE

SEQ ID NO: 2300095 - protein, 25 aa, Cryptosporidium parvum
NENLWDMPCSEMTSMTLGDIREAEN

SEQ ID NO: 2300096 - protein, 20 aa, Cryptosporidium parvum
NENNLHCAYYCEGFKDINEH

SEQ ID NO: 2300097 - protein, 21 aa, Cryptosporidium parvum
NENPIRFLGLLECNCDFENCR

SEQ ID NO: 2300098 - protein, 25 aa, Cryptosporidium parvum
NENQRLSMQNVFKRFYSPGNPNSNT

SEQ ID NO: 2300099 - protein, 24 aa, Cryptosporidium parvum
NENTSRFPLRFTNVNQNFELCSSY

SEQ ID NO: 2300100 - protein, 31 aa, Cryptosporidium parvum; identical to SEQ ID NO: 2177977

SEQ ID NO: 2300101 - protein, 18 aa, Cryptosporidium parvum
NEPINYYKASEMERSVII

SEQ ID NO: 2300102 - protein, 23 aa, Cryptosporidium parvum
NEPTHIRPAFANFQKNKEIQNEG

SEQ ID NO: 2300103 - protein, 24 aa, Cryptosporidium parvum
NEPVSSCRDDFCVFSTPEFESRDS

SEQ ID NO: 2300104 - protein, 20 aa, Cryptosporidium parvum
NEPYFLKGLINSEKEKFELT

SEQ ID NO: 2300105 - protein, 20 aa, Cryptosporidium parvum
NEQIMDLSERVRVLTDEMKK

SEQ ID NO: 2300106 - protein, 26 aa, Cryptosporidium parvum
NEQIRMLRERIIVLSTNIEDKSSPQA

SEQ ID NO: 2300107 - protein, 24 aa, Cryptosporidium parvum
NEQLSRITIYITLQVVFILENLKN

SEQ ID NO: 2300108 - protein, 27 aa, Cryptosporidium parvum
NERDLLMKRIQSLEVIESSQKMLILET

SEQ ID NO: 2300109 - protein, 17 aa, Cryptosporidium parvum
NERIFSEICDFSILNEM

SEQ ID NO: 2300110 - protein, 20 aa, Cryptosporidium parvum
NERIRPVLHVNKVDRALLEL

SEQ ID NO: 2300111 - protein, 18 aa, Cryptosporidium parvum
NESFKFKPLSRIESKRSI

SEQ ID NO: 2300112 - protein, 27 aa, Cryptosporidium parvum
NESIKFIKIKVAFLINQGYPEKSPPEI

SEQ ID NO: 2300113 - protein, 21 aa, Cryptosporidium parvum
NESRLRIAIVEADRCKPKNCR

SEQ ID NO: 2300114 - protein, 19 aa, Cryptosporidium parvum
NESSFEFIPPPSKHIVEFL

SEQ ID NO: 2300115 - protein, 22 aa, Cryptosporidium parvum
NETCNWYTTFDSILPKRKKDNT

SEQ ID NO: 2300116 - protein, 21 aa, Cryptosporidium parvum
NETIEDYWVCLNDAMTWRNPN

SEQ ID NO: 2300117 - protein, 25 aa, Cryptosporidium parvum
NEVCSFNLLQPLSLNISYSGSNDKS

SEQ ID NO: 2300118 - protein, 20 aa, Cryptosporidium parvum
NEVFMDFYILFWYLDLSDIS

SEQ ID NO: 2300119 - protein, 26 aa, Cryptosporidium parvum
NEVFQRYNITLSLCGHLLYGGEEDSR

SEQ ID NO: 2300120 - protein, 20 aa, Cryptosporidium parvum
NEVIETWLSSGMMPGDNQID

SEQ ID NO: 2300121 - protein, 23 aa, Cryptosporidium parvum
NEVMDGVANKHCEDILDIPDKFV

SEQ ID NO: 2300122 - protein, 34 aa, Cryptosporidium parvum
NEVSKLVLEYIIRVYIESLLLFALSYSVIQSEIL

SEQ ID NO: 2300123 - protein, 25 aa, Cryptosporidium parvum
NEVVVICTGTGLLLLYRFDDESVLS

SEQ ID NO: 2300124 - protein, 18 aa, Cryptosporidium parvum
NEWDDILYRNTINKKNLE

SEQ ID NO: 2300125 - protein, 20 aa, Cryptosporidium parvum
NEWFPGIFPMVPGHEIIGIV

SEQ ID NO: 2300126 - protein, 24 aa, Cryptosporidium parvum
NEWGNSWGDMWNWSKKVKSWGEKW

SEQ ID NO: 2300127 - protein, 25 aa, Cryptosporidium parvum
NEYGMIPRALKLIFDNIDRNCEKGW

SEQ ID NO: 2300128 - protein, 30 aa, Cryptosporidium parvum
NEYGNIYGIIFLFKFTEKFKGNHFSQPIEA

SEQ ID NO: 2300129 - protein, 25 aa, Cryptosporidium parvum
NEYMKRSLDSFAFPITSEKGKKQLI

SEQ ID NO: 2300130 - protein, 26 aa, Cryptosporidium parvum
NEYSFSFNFTEFYKRMSGNLLLSLES

SEQ ID NO: 2300131 - protein, 18 aa, Cryptosporidium parvum
NEYYLYNKWLIWCKKAYD

SEQ ID NO: 2300132 - protein, 19 aa, Cryptosporidium parvum
NFADQSILVLPNLQNSSES

SEQ ID NO: 2300133 - protein, 24 aa, Cryptosporidium parvum
NFDFPYENFHAISISRVKWPIRII

SEQ ID NO: 2300134 - protein, 23 aa, Cryptosporidium parvum
NFDPLRYAVFVGEVLSRSPISIQ

SEQ ID NO: 2300135 - protein, 26 aa, Cryptosporidium parvum
NFDTRIGYRIGRQLASLFPFNPDFAG

SEQ ID NO: 2300136 - protein, 24 aa, Cryptosporidium parvum
NFEAAKLAYIKLIYLKKRGDYDAY

SEQ ID NO: 2300137 - protein, 24 aa, Cryptosporidium parvum
NFEEICLWENIFVEKLEECDVIAL

SEQ ID NO: 2300138 - protein, 24 aa, Cryptosporidium parvum
NFEKPFLWLARRLTNQPALQLVGQ

SEQ ID NO: 2300139 - protein, 25 aa, Cryptosporidium parvum
NFELKTEPYINLSKEQLYKIIYQKH

SEQ ID NO: 2300140 - protein, 24 aa, Cryptosporidium parvum
NFEVIVCWIVKLEAFFSSLFEFFL

SEQ ID NO: 2300141 - protein, 20 aa, Cryptosporidium parvum
NFFKELEKRFELLENENKEK

SEQ ID NO: 2300142 - protein, 32 aa, Cryptosporidium parvum; identical to SEQ ID NO: 2178013

SEQ ID NO: 2300143 - protein, 19 aa, Cryptosporidium parvum
NFGGLMCSNSDFRRISPLL

SEQ ID NO: 2300144 - protein, 18 aa, Cryptosporidium parvum
NFGQRSQLRISILQQVLH

SEQ ID NO: 2300145 - protein, 18 aa, Cryptosporidium parvum
NFHFPLTFRIYSSKWIQF

SEQ ID NO: 2300146 - protein, 24 aa, Cryptosporidium parvum
NFIEVRKSLLLEVIGDSLKYKSTL

SEQ ID NO: 2300147 - protein, 18 aa, Cryptosporidium parvum
NFISELIFNPQIKLNKIE

SEQ ID NO: 2300148 - protein, 23 aa, Cryptosporidium parvum
NFITEIDPLLSLTKLKSLNISKN

SEQ ID NO: 2300149 - protein, 20 aa, Cryptosporidium parvum
NFIYCILSMKLGEISEFRIY

SEQ ID NO: 2300150 - protein, 24 aa, Cryptosporidium parvum
NFKAKREVVNFQDILREEEITSKE

SEQ ID NO: 2300151 - protein, 24 aa, Cryptosporidium parvum
NFKDLRYFFLKNILNFLNKYSEGL

SEQ ID NO: 2300152 - protein, 22 aa, Cryptosporidium parvum
NFKILDFNGSQFLDNFGGNLWM

SEQ ID NO: 2300153 - protein, 22 aa, Cryptosporidium parvum
NFKKRCKFERLLSGSDDNTMFL

SEQ ID NO: 2300154 - protein, 23 aa, Cryptosporidium parvum
NFKLDIPFNLKKVFLNESDTENN

SEQ ID NO: 2300155 - protein, 20 aa, Cryptosporidium parvum
NFKSKGWFDPIGVKLSVFSQ

SEQ ID NO: 2300156 - protein, 24 aa, Cryptosporidium parvum
NFKSQKWQVMLSFNTERRLLLTGT

SEQ ID NO: 2300157 - protein, 24 aa, Cryptosporidium parvum
NFNELFIKFSLNILTEVYKKYYYK

SEQ ID NO: 2300158 - protein, 24 aa, Cryptosporidium parvum
NFPPIYRFNCGFNSYLHYSHGLSL

SEQ ID NO: 2300159 - protein, 18 aa, Cryptosporidium parvum
NFQKFVIEFVLDRHNEQQ

SEQ ID NO: 2300160 - protein, 42 aa, Cryptosporidium parvum
NFQLNIPVFFRHSLPKDSEWKCYICKVPRNGKESMNMCVNCG

SEQ ID NO: 2300161 - protein, 29 aa, Cryptosporidium parvum
NFQVSSDESLFCFIWKNILIIWNTQYPDK

SEQ ID NO: 2300162 - protein, 18 aa, Cryptosporidium parvum
NFRFSVISYSEFLKETLK

SEQ ID NO: 2300163 - protein, 27 aa, Cryptosporidium parvum
NFRIPVDKFGIAMLRGMGYNPEIHNTK

SEQ ID NO: 2300164 - protein, 21 aa, Cryptosporidium parvum
NFRKKYEWNNNIWLPNEIKKL

SEQ ID NO: 2300165 - protein, 23 aa, Cryptosporidium parvum
NFRKTCYSISDGRVFIIRNSEII

SEQ ID NO: 2300166 - protein, 20 aa, Cryptosporidium parvum
NFRSGDLFLNKTLLNIAKNT

SEQ ID NO: 2300167 - protein, 23 aa, Cryptosporidium parvum
NFSKVTNCHLLFNKFNVLGKLYY

SEQ ID NO: 2300168 - protein, 18 aa, Cryptosporidium parvum
NFVLSMPRFLAAATGLDA

SEQ ID NO: 2300169 - protein, 29 aa, Cryptosporidium parvum
NFYIVDFICEIPVNIKTLFMKIVKESAEG

SEQ ID NO: 2300170 - protein, 25 aa, Cryptosporidium parvum
NGEFEYMNILKLFGAINRLERDSNI

SEQ ID NO: 2300171 - protein, 22 aa, Cryptosporidium parvum
NGEFVLGYSILPLVSAYYTEKL

SEQ ID NO: 2300172 - protein, 27 aa, Cryptosporidium parvum
NGEPTCPLCRVPCSVFTLCDLVNITID

SEQ ID NO: 2300173 - protein, 31 aa, Cryptosporidium parvum; identical to SEQ ID NO: 2178042

SEQ ID NO: 2300174 - protein, 18 aa, Cryptosporidium parvum
NGEYVILKFAEFLNLLNY

SEQ ID NO: 2300175 - protein, 17 aa, Cryptosporidium parvum
NGFEYACSIALKKLEEI

SEQ ID NO: 2300176 - protein, 25 aa, Cryptosporidium parvum
NGGEITGIIQWVCNLTIEIGFLILD

SEQ ID NO: 2300177 - protein, 21 aa, Cryptosporidium parvum
NGGELDFPYAGIKIKPKKGFA

SEQ ID NO: 2300178 - protein, 25 aa, Cryptosporidium parvum
NGGGSRVGLGLGVGLGSGGIGTGTG

SEQ ID NO: 2300179 - protein, 17 aa, Cryptosporidium parvum
NGGMLPSAIPGQVDTST

SEQ ID NO: 2300180 - protein, 17 aa, Cryptosporidium parvum
NGGRIGNGMAMTMIPNN

SEQ ID NO: 2300181 - protein, 20 aa, Cryptosporidium parvum
NGHRARIGAMDWCGPILATG

SEQ ID NO: 2300182 - protein, 20 aa, Cryptosporidium parvum
NGHVWKMAFSPPSHSINKIF

SEQ ID NO: 2300183 - protein, 17 aa, Cryptosporidium parvum
NGIEHTNHLIIFNNEEL

SEQ ID NO: 2300184 - protein, 17 aa, Cryptosporidium parvum
NGIGSFHIMEDSSNLPL

SEQ ID NO: 2300185 - protein, 26 aa, Cryptosporidium parvum
NGIHPIKLILVGGIVFERQLSEIEIS

SEQ ID NO: 2300186 - protein, 23 aa, Cryptosporidium parvum
NGIIRIPLLDGYRDNGVIAMGKI

SEQ ID NO: 2300187 - protein, 23 aa, Cryptosporidium parvum
NGKIPRIRFGSTETCLQLCGTDL

SEQ ID NO: 2300188 - protein, 31 aa, Cryptosporidium parvum; identical to SEQ ID NO: 2178055

SEQ ID NO: 2300189 - protein, 23 aa, Cryptosporidium parvum
NGKMICNHCNYPVSKGNNVSNKD

SEQ ID NO: 2300190 - protein, 20 aa, Cryptosporidium parvum
NGKQHGIGIFYNIKKEGKVG

SEQ ID NO: 2300191 - protein, 18 aa, Cryptosporidium parvum
NGMGRLTGRGGLGSGTAG

SEQ ID NO: 2300192 - protein, 18 aa, Cryptosporidium parvum
NGMLSDWRVPTCEMLYYS

SEQ ID NO: 2300193 - protein, 24 aa, Cryptosporidium parvum
NGNELLERFSIGYFTLSLSCLKWL

SEQ ID NO: 2300194 - protein, 26 aa, Cryptosporidium parvum
NGNFIAKLFIRFGMKPEQTQIHDQES

SEQ ID NO: 2300195 - protein, 20 aa, Cryptosporidium parvum
NGNFNFERVRPFISKSHPNI

SEQ ID NO: 2300196 - protein, 17 aa, Cryptosporidium parvum
NGNFPVNRNDIIIANSV

SEQ ID NO: 2300197 - protein, 19 aa, Cryptosporidium parvum
NGNIGFRVNYKGNQQVVSL

SEQ ID NO: 2300198 - protein, 30 aa, Cryptosporidium parvum
NGNKGKCCAFWKKWCCCCLSDKGPTKSGNY

SEQ ID NO: 2300199 - protein, 26 aa, Cryptosporidium parvum
NGNKQRWKWVALLPFIDQKVLLETVI

SEQ ID NO: 2300200 - protein, 24 aa, Cryptosporidium parvum
NGNKRLSWQQILALGKSTEKIVGL

SEQ ID NO: 2300201 - protein, 19 aa, Cryptosporidium parvum
NGNNCIYCNASLERTSNTR

SEQ ID NO: 2300202 - protein, 21 aa, Cryptosporidium parvum
NGNRAWLIREFIGDELTDQVF

SEQ ID NO: 2300203 - protein, 19 aa, Cryptosporidium parvum
NGNVPWIISTLLEQKIWMH

SEQ ID NO: 2300204 - protein, 21 aa, Cryptosporidium parvum
NGQCIKPISFRSSPYSASSNL

SEQ ID NO: 2300205 - protein, 28 aa, Cryptosporidium parvum
NGQFLNDLCKIYHIYQVNLVKRSQETSQ

SEQ ID NO: 2300206 - protein, 18 aa, Cryptosporidium parvum
NGQLPWSISEDLKFFSKI

SEQ ID NO: 2300207 - protein, 17 aa, Cryptosporidium parvum
NGRDLLRHYEFYHQCLQ

SEQ ID NO: 2300208 - protein, 20 aa, Cryptosporidium parvum
NGRQVLGFIGDICEKENSVL

SEQ ID NO: 2300209 - protein, 33 aa, Cryptosporidium parvum; identical to SEQ ID NO: 2178071

SEQ ID NO: 2300210 - protein, 22 aa, Cryptosporidium parvum
NGSLMSTCLDKLMSGYLDVLYY

SEQ ID NO: 2300211 - protein, 24 aa, Cryptosporidium parvum
NGSPEYRLIKIILEKSDHKIKQDE

SEQ ID NO: 2300212 - protein, 27 aa, Cryptosporidium parvum
NGTIDFPEFLSLMARKMKDTDTEDELI

SEQ ID NO: 2300213 - protein, 23 aa, Cryptosporidium parvum
NGTLCAIQRTMCCIVENYQTPDG

SEQ ID NO: 2300214 - protein, 24 aa, Cryptosporidium parvum
NGTNLLWRIIKKIVANVQLEIQDI

SEQ ID NO: 2300215 - protein, 38 aa, Cryptosporidium parvum
NGTSQGKFALSPLNGTEVAPLFSKFVPNEDTSDSVKFG

SEQ ID NO: 2300216 - protein, 18 aa, Cryptosporidium parvum
NGVEVWFREGHIGSNQVS

SEQ ID NO: 2300217 - protein, 18 aa, Cryptosporidium parvum
NGVTGCTILQDFMEREEK

SEQ ID NO: 2300218 - protein, 25 aa, Cryptosporidium parvum
NGVVGGSIYRQLCNIGSLYEISMNK

SEQ ID NO: 2300219 - protein, 19 aa, Cryptosporidium parvum
NGYCFKFNLNSKHGSYIFP

SEQ ID NO: 2300220 - protein, 17 aa, Cryptosporidium parvum
NGYFPKKIKQAILNNLK

SEQ ID NO: 2300221 - protein, 19 aa, Cryptosporidium parvum
NGYQLFDYQLAGLNWLLQL

SEQ ID NO: 2300222 - protein, 18 aa, Cryptosporidium parvum
NHEYNLFFNNFYKDYELG

SEQ ID NO: 2300223 - protein, 29 aa, Cryptosporidium parvum
NHFGPKCYNYWKFPDINVFVNNDSHLNNE

SEQ ID NO: 2300224 - protein, 17 aa, Cryptosporidium parvum
NHFKLCTRLATLGNASF

SEQ ID NO: 2300225 - protein, 25 aa, Cryptosporidium parvum
NHFMRDFYKRSCFSSLGNMNMYTER

SEQ ID NO: 2300226 - protein, 22 aa, Cryptosporidium parvum
NHFRPARSSDILSFNEIPIDTV

SEQ ID NO: 2300227 - protein, 23 aa, Cryptosporidium parvum
NHGVDVRIARIFNTYGPKMLFND

SEQ ID NO: 2300228 - protein, 19 aa, Cryptosporidium parvum
NHKHSWTLPLKDFTSSTKK

SEQ ID NO: 2300229 - protein, 32 aa, Cryptosporidium parvum; identical to SEQ ID NO: 2178084

SEQ ID NO: 2300230 - protein, 19 aa, Cryptosporidium parvum
NHKSLFSSYGGGLGGGDSG

SEQ ID NO: 2300231 - protein, 25 aa, Cryptosporidium parvum
NHKVFKNEGFFDIAREIKLRKLSYS

SEQ ID NO: 2300232 - protein, 20 aa, Cryptosporidium parvum
NHLHPRFSKLNTRNTGKQSK

SEQ ID NO: 2300233 - protein, 18 aa, Cryptosporidium parvum
NHLIWSLFRQILEILSYC

SEQ ID NO: 2300234 - protein, 24 aa, Cryptosporidium parvum
NHLPDLKHPFSLLYSYKRLNELNI

SEQ ID NO: 2300235 - protein, 25 aa, Cryptosporidium parvum
NHPPHLSIVILLKFITTVIPSIELD

SEQ ID NO: 2300236 - protein, 20 aa, Cryptosporidium parvum
NHPTTRFSLYNKIENKLYKY

SEQ ID NO: 2300237 - protein, 19 aa, Cryptosporidium parvum
NHRIFKLAANILKKITHLF

SEQ ID NO: 2300238 - protein, 24 aa, Cryptosporidium parvum
NHSFLSLYLLFLIYNKIHVSNQLI

SEQ ID NO: 2300239 - protein, 25 aa, Cryptosporidium parvum
NHSKKRWKWVHFDDSEVQEWTPKFS

SEQ ID NO: 2300240 - protein, 23 aa, Cryptosporidium parvum
NHSLPNFIAKIILPLFASKNEKD

SEQ ID NO: 2300241 - protein, 18 aa, Cryptosporidium parvum
NHVKNHIWIFIKCLIVNP

SEQ ID NO: 2300242 - protein, 17 aa, Cryptosporidium parvum
NHVPNANQIRFISNDGS

SEQ ID NO: 2300243 - protein, 17 aa, Cryptosporidium parvum
NHYECVFNNNFNFRINV

SEQ ID NO: 2300244 - protein, 38 aa, Cryptosporidium parvum; identical to SEQ ID NO: 2178100

SEQ ID NO: 2300245 - protein, 28 aa, Cryptosporidium parvum
NIAANIHKLLNCSPHMIQITDFPPTIIE

SEQ ID NO: 2300246 - protein, 22 aa, Cryptosporidium parvum
NIACKTSMEFTCAPTTQKVAQV

SEQ ID NO: 2300247 - protein, 22 aa, Cryptosporidium parvum
NIAFVRYFLRSSAEFAKAAMEN

SEQ ID NO: 2300248 - protein, 26 aa, Cryptosporidium parvum
NIAINWRKHLLKCIHCQYQNKNSKKD

SEQ ID NO: 2300249 - protein, 21 aa, Cryptosporidium parvum
NIAQGRLNYLLSDNGEPTCPL

SEQ ID NO: 2300250 - protein, 25 aa, Cryptosporidium parvum
NIDGVCGRLAVRLLDNYPISNSFPP

SEQ ID NO: 2300251 - protein, 24 aa, Cryptosporidium parvum
NIDQYICNFGQWTISPELFNELLI

SEQ ID NO: 2300252 - protein, 21 aa, Cryptosporidium parvum
NIEFKECIEFSSVFAEANSDS

SEQ ID NO: 2300253 - protein, 21 aa, Cryptosporidium parvum
NIEIFTIICILSLQKLADKNY

SEQ ID NO: 2300254 - protein, 28 aa, Cryptosporidium parvum
NIELIGEVIIEIMLYFGKYYQNDEEIKE

SEQ ID NO: 2300255 - protein, 18 aa, Cryptosporidium parvum
NIELKFDIQSPIPNSLEK

SEQ ID NO: 2300256 - protein, 23 aa, Cryptosporidium parvum
NIEMLKLEFYRISSRLSDSLKEK

SEQ ID NO: 2300257 - protein, 32 aa, Cryptosporidium parvum
NIEMPSIELSLFLINFGKKFVKFELKEFSNLC

SEQ ID NO: 2300258 - protein, 26 aa, Cryptosporidium parvum
NIENVLKKRFLFWIINNYENQRIPNL

SEQ ID NO: 2300259 - protein, 23 aa, Cryptosporidium parvum
NIEPKLDSILGLEKIEENDESKQ

SEQ ID NO: 2300260 - protein, 27 aa, Cryptosporidium parvum
NIESISAIFFLRNLKRLSLVNNPITKI

SEQ ID NO: 2300261 - protein, 19 aa, Cryptosporidium parvum
NIFHGSNLIQMFNTNLNSR

SEQ ID NO: 2300262 - protein, 33 aa, Cryptosporidium parvum
NIFLKNRRKAILPKVEWILCFPVNQCSTNTGSN

SEQ ID NO: 2300263 - protein, 26 aa, Cryptosporidium parvum
NIFLTGRSSLFIGLPQRIQVNLTQLF

SEQ ID NO: 2300264 - protein, 25 aa, Cryptosporidium parvum
NIFNKPRLVSPITFNTIGMPERGIN

SEQ ID NO: 2300265 - protein, 17 aa, Cryptosporidium parvum
NIFQLGVGFGRLKQIFG

SEQ ID NO: 2300266 - protein, 23 aa, Cryptosporidium parvum
NIFSCDLWKTSGHYFAYKENMFI

SEQ ID NO: 2300267 - protein, 26 aa, Cryptosporidium parvum
NIFSSHGGELIFVIRPAPSMGGEGGN

SEQ ID NO: 2300268 - protein, 24 aa, Cryptosporidium parvum
NIGLCAEHGYYLKLPKSIDPIHPN

SEQ ID NO: 2300269 - protein, 20 aa, Cryptosporidium parvum
NIGMECFKFIMNDSRFNDIP

SEQ ID NO: 2300270 - protein, 30 aa, Cryptosporidium parvum
NIHEDLSTLGFRGEGLNSIINSSEIVEIDT

SEQ ID NO: 2300271 - protein, 23 aa, Cryptosporidium parvum
NIHFLSNPCELYINDIKISITSS

SEQ ID NO: 2300272 - protein, 25 aa, Cryptosporidium parvum
NIHIKSEKGFPFLNFQYNNIEETVI

SEQ ID NO: 2300273 - protein, 34 aa, Cryptosporidium parvum; identical to SEQ ID NO: 2178128

SEQ ID NO: 2300274 - protein, 26 aa, Cryptosporidium parvum
NIHSIKPCFYLFITDWIQTILTPILA

SEQ ID NO: 2300275 - protein, 17 aa, Cryptosporidium parvum
NIIFNRLPELILEQMER

SEQ ID NO: 2300276 - protein, 18 aa, Cryptosporidium parvum
NIIKLGFGADSCFAIDAN

SEQ ID NO: 2300277 - protein, 19 aa, Cryptosporidium parvum
NIILETSSKFFTLFFGDFI

SEQ ID NO: 2300278 - protein, 18 aa, Cryptosporidium parvum
NIILRYDLSIQRSVGLIF

SEQ ID NO: 2300279 - protein, 25 aa, Cryptosporidium parvum
NIINEGGALWKEWLYVGMYEEALIS

SEQ ID NO: 2300280 - protein, 27 aa, Cryptosporidium parvum
NIIPLEIRKMWCVQLVKAVAYLHEGCA

SEQ ID NO: 2300281 - protein, 28 aa, Cryptosporidium parvum
NIIRPRFTWYCSHCNFSIDNEILEEKLL

SEQ ID NO: 2300282 - protein, 22 aa, Cryptosporidium parvum
NIIRSLLLMRLDKLQFKLNSLN

SEQ ID NO: 2300283 - protein, 21 aa, Cryptosporidium parvum
NIKDSIGFSAWWDAIEKSKQS

SEQ ID NO: 2300284 - protein, 41 aa, Cryptosporidium parvum
NIKEGILGRGTISWLNLKPKIPYFNVRKALILLQDAGFITF

SEQ ID NO: 2300285 - protein, 18 aa, Cryptosporidium parvum
NIKHCIVKNCAALSQKNK

SEQ ID NO: 2300286 - protein, 23 aa, Cryptosporidium parvum
NIKHKINESIGWWIISVNEYGYL

SEQ ID NO: 2300287 - protein, 23 aa, Cryptosporidium parvum
NIKKELLELGWVNSVNIFVEKKI

SEQ ID NO: 2300288 - protein, 20 aa, Cryptosporidium parvum
NIKLSHLIKSLKINHNKETE

SEQ ID NO: 2300289 - protein, 25 aa, Cryptosporidium parvum
NIKMRCLFSGRVLLTPVPGSEPDIY

SEQ ID NO: 2300290 - protein, 23 aa, Cryptosporidium parvum
NIKRDSIYLLGWVVEAIQALILI

SEQ ID NO: 2300291 - protein, 21 aa, Cryptosporidium parvum
NIKTVLLFLIDFVKRLYNQHI

SEQ ID NO: 2300292 - protein, 27 aa, Cryptosporidium parvum
NILALEVFDKFLYVSILLPFYSKLNNC

SEQ ID NO: 2300293 - protein, 17 aa, Cryptosporidium parvum
NILEWIASVHLSVSNRD

SEQ ID NO: 2300294 - protein, 29 aa, Cryptosporidium parvum
NILHSLRLWLGEDLEIWIFDFHRPAIDEL

SEQ ID NO: 2300295 - protein, 19 aa, Cryptosporidium parvum
NILIHLTGFHWEKNIRIKL

SEQ ID NO: 2300296 - protein, 18 aa, Cryptosporidium parvum
NILIPKVRLKKLIENGSL

SEQ ID NO: 2300297 - protein, 17 aa, Cryptosporidium parvum
NILIVLREIVFNENSKV

SEQ ID NO: 2300298 - protein, 21 aa, Cryptosporidium parvum
NILKNKCVNIWNEFKDFSNIF

SEQ ID NO: 2300299 - protein, 19 aa, Cryptosporidium parvum
NILLKRANNQFQFKNNTGY

SEQ ID NO: 2300300 - protein, 18 aa, Cryptosporidium parvum
NILLKVVLEIGEINEASR

SEQ ID NO: 2300301 - protein, 24 aa, Cryptosporidium parvum
NILQSLKCTMYLINRLQENKYKAG

SEQ ID NO: 2300302 - protein, 24 aa, Cryptosporidium parvum
NILRRCATYVYKILSILGLCGEDN

SEQ ID NO: 2300303 - protein, 24 aa, Cryptosporidium parvum
NILSNCFPCLKDIVITRLFHETNT

SEQ ID NO: 2300304 - protein, 27 aa, Cryptosporidium parvum
NILSQCKHIKSAISTPRDPVEQINNHH

SEQ ID NO: 2300305 - protein, 17 aa, Cryptosporidium parvum
NINAIKRTLKYPYIKKI

SEQ ID NO: 2300306 - protein, 25 aa, Cryptosporidium parvum
NINEIFQEIELIFSNCREYNTSPLC

SEQ ID NO: 2300307 - protein, 20 aa, Cryptosporidium parvum
NINIKTNRLKVVVKGEVIID

SEQ ID NO: 2300308 - protein, 20 aa, Cryptosporidium parvum
NINRVGLCTIRKFMYSDFEF

SEQ ID NO: 2300309 - protein, 22 aa, Cryptosporidium parvum
NINSIFCYSVDLVYSLFSSLQN

SEQ ID NO: 2300310 - protein, 27 aa, Cryptosporidium parvum
NINSVKICNAVRCKKCGIWTEGNANLI

SEQ ID NO: 2300311 - protein, 23 aa, Cryptosporidium parvum
NIPDNDPLCWIWIDLDGTINNMN

SEQ ID NO: 2300312 - protein, 22 aa, Cryptosporidium parvum
NIPEWRIHFRQILGGTEPFRIT

SEQ ID NO: 2300313 - protein, 24 aa, Cryptosporidium parvum
NIQDKRFADDLTVDRMSILSELDD

SEQ ID NO: 2300314 - protein, 19 aa, Cryptosporidium parvum
NIQISDSFLEKWNLTKKCN

SEQ ID NO: 2300315 - protein, 20 aa, Cryptosporidium parvum
NIQLRYFVRLTVLRAYASNI

SEQ ID NO: 2300316 - protein, 20 aa, Cryptosporidium parvum
NIQRTVLMMGRYVEQIPDVP

SEQ ID NO: 2300317 - protein, 17 aa, Cryptosporidium parvum
NIQSFTVVLGFDNVVSS

SEQ ID NO: 2300318 - protein, 24 aa, Cryptosporidium parvum
NIQYKPNFCLKVINKLPYRTLDLL

SEQ ID NO: 2300319 - protein, 19 aa, Cryptosporidium parvum
NIRFVALGLLENMKEFPNN

SEQ ID NO: 2300320 - protein, 18 aa, Cryptosporidium parvum
NIRIQLGKYFPLSKDSLL

SEQ ID NO: 2300321 - protein, 20 aa, Cryptosporidium parvum
NIRKTLWIYQIENISGTNLI

SEQ ID NO: 2300322 - protein, 17 aa, Cryptosporidium parvum
NIRWRRKMGEKLIDIQG

SEQ ID NO: 2300323 - protein, 25 aa, Cryptosporidium parvum
NISDKICCLNNYFLKDEEHKSNEVY

SEQ ID NO: 2300324 - protein, 20 aa, Cryptosporidium parvum
NISDSCSFFTEKAGNSEINN

SEQ ID NO: 2300325 - protein, 22 aa, Cryptosporidium parvum
NISECGFCGSSINVYEVEKSLN

SEQ ID NO: 2300326 - protein, 24 aa, Cryptosporidium parvum
NISGKKPCGSNCMPESPSEHCPAI

SEQ ID NO: 2300327 - protein, 17 aa, Cryptosporidium parvum
NISGYITSIEWIFHTKL

SEQ ID NO: 2300328 - protein, 31 aa, Cryptosporidium parvum; identical to SEQ ID NO: 2178169

SEQ ID NO: 2300329 - protein, 26 aa, Cryptosporidium parvum
NISIRTDICGRIRIVGANSSEFKTWD

SEQ ID NO: 2300330 - protein, 25 aa, Cryptosporidium parvum
NISKIRFSINFFTAIGLGALTHKLR

SEQ ID NO: 2300331 - protein, 23 aa, Cryptosporidium parvum
NISKPSDRVRIFVVFESPSMAQI

SEQ ID NO: 2300332 - protein, 35 aa, Cryptosporidium parvum
NISLIRRILKVMISYKLRSCFISSIANSFIEMKNK

SEQ ID NO: 2300333 - protein, 22 aa, Cryptosporidium parvum
NISYFCSKGFCIRKIGKARARK

SEQ ID NO: 2300334 - protein, 20 aa, Cryptosporidium parvum
NITCNSWYSLTGFLENGISF

SEQ ID NO: 2300335 - protein, 25 aa, Cryptosporidium parvum
NITEFSALLSILGFYAIEIEAIRDT

SEQ ID NO: 2300336 - protein, 20 aa, Cryptosporidium parvum
NITGNLLLNPSIRFQRQMVE

SEQ ID NO: 2300337 - protein, 27 aa, Cryptosporidium parvum
NITPHWSRGGIITEEILAMICQLVGVD

SEQ ID NO: 2300338 - protein, 17 aa, Cryptosporidium parvum
NITSCLIKDAGRTQIAA

SEQ ID NO: 2300339 - protein, 19 aa, Cryptosporidium parvum
NIVELYGVVFSRPHNDLNE

SEQ ID NO: 2300340 - protein, 19 aa, Cryptosporidium parvum
NIVLIKLMSSFSISDLNNN

SEQ ID NO: 2300341 - protein, 25 aa, Cryptosporidium parvum
NIWKIREIFDNDTLRKLDCALLGLT

SEQ ID NO: 2300342 - protein, 19 aa, Cryptosporidium parvum
NIYFPFHFLHIQIVSGLRN

SEQ ID NO: 2300343 - protein, 28 aa, Cryptosporidium parvum
NIYVDMMPKVLFCRGHLVEMILSCNISG

SEQ ID NO: 2300344 - protein, 25 aa, Cryptosporidium parvum
NIYYSRSLIPWRVPKSQSNIENSDH

SEQ ID NO: 2300345 - protein, 20 aa, Cryptosporidium parvum
NKAGDFVNDIGIFESLPKST

SEQ ID NO: 2300346 - protein, 25 aa, Cryptosporidium parvum
NKAKLLVIDSINFWNADLSSLIINN

SEQ ID NO: 2300347 - protein, 18 aa, Cryptosporidium parvum
NKALKINLMENVLKSEHQ

SEQ ID NO: 2300348 - protein, 21 aa, Cryptosporidium parvum
NKARKILGIGLGRVPCINLFD

SEQ ID NO: 2300349 - protein, 18 aa, Cryptosporidium parvum
NKARMLNSELLKKQRELS

SEQ ID NO: 2300350 - protein, 22 aa, Cryptosporidium parvum
NKCTRLENDLKRLSSQVQAQNQ

SEQ ID NO: 2300351 - protein, 21 aa, Cryptosporidium parvum
NKDHIIRGLLIEADFYLLESL

SEQ ID NO: 2300352 - protein, 24 aa, Cryptosporidium parvum
NKDPRNLCMLEFFNYSDGVFRNKM

SEQ ID NO: 2300353 - protein, 23 aa, Cryptosporidium parvum
NKDRLSFTCNWEINENAEIRNVY

SEQ ID NO: 2300354 - protein, 24 aa, Cryptosporidium parvum
NKDRRAIKSKGRRPYSNTNNQNYN

SEQ ID NO: 2300355 - protein, 28 aa, Cryptosporidium parvum
NKDSREVYCGNLPYSCTEEEIRGLFEEC

SEQ ID NO: 2300356 - protein, 28 aa, Cryptosporidium parvum
NKDVKLIPKLFWDKDFILKLNAGATQKE

SEQ ID NO: 2300357 - protein, 21 aa, Cryptosporidium parvum
NKECIDKWCRLRQKEKEYNKN

SEQ ID NO: 2300358 - protein, 24 aa, Cryptosporidium parvum
NKEEWKFWMVGLLVSHALAQREKL

SEQ ID NO: 2300359 - protein, 18 aa, Cryptosporidium parvum
NKEFRFLKETDIQSTDST

SEQ ID NO: 2300360 - protein, 23 aa, Cryptosporidium parvum
NKEIRRKKELMFNKEKTRIKKLN

SEQ ID NO: 2300361 - protein, 21 aa, Cryptosporidium parvum
NKELFRGIIVTRRITNLPIRY

SEQ ID NO: 2300362 - protein, 18 aa, Cryptosporidium parvum
NKESCVISSVSSPNKPGK

SEQ ID NO: 2300363 - protein, 29 aa, Cryptosporidium parvum
NKESFRTALRFVKHWSKARGIYSNVLGYL

SEQ ID NO: 2300364 - protein, 17 aa, Cryptosporidium parvum
NKESLKEIMEFVHNSEM

SEQ ID NO: 2300365 - protein, 20 aa, Cryptosporidium parvum
NKEYGNCFLADIKGYNTHSN

SEQ ID NO: 2300366 - protein, 25 aa, Cryptosporidium parvum
NKFLLEHYNNFFLPYISRTGNEHIL

SEQ ID NO: 2300367 - protein, 17 aa, Cryptosporidium parvum
NKFNEMDFCMSGMMVIN

SEQ ID NO: 2300368 - protein, 19 aa, Cryptosporidium parvum
NKFVKLCIQHYLNTKSLTG

SEQ ID NO: 2300369 - protein, 31 aa, Cryptosporidium parvum; identical to SEQ ID NO: 2178213

SEQ ID NO: 2300370 - protein, 23 aa, Cryptosporidium parvum
NKGFKQRRLDSWVRVRKNTEGGS

SEQ ID NO: 2300371 - protein, 24 aa, Cryptosporidium parvum
NKGKEIALIMPFSIKINKIKADLQ

SEQ ID NO: 2300372 - protein, 20 aa, Cryptosporidium parvum
NKGLEIKAIIGHSRGGVETL

SEQ ID NO: 2300373 - protein, 18 aa, Cryptosporidium parvum
NKGMFRYVVILNDPKGKE

SEQ ID NO: 2300374 - protein, 21 aa, Cryptosporidium parvum
NKGTFVRRFGGIEGSVQQFPF

SEQ ID NO: 2300375 - protein, 18 aa, Cryptosporidium parvum
NKIFTKRVIVFFQTKKEA

SEQ ID NO: 2300376 - protein, 24 aa, Cryptosporidium parvum
NKIIKYNKIELIMFKNEIKQLLND

SEQ ID NO: 2300377 - protein, 26 aa, Cryptosporidium parvum
NKIKCSCTSFLWKGVNMDLGTSDEGM

SEQ ID NO: 2300378 - protein, 17 aa, Cryptosporidium parvum
NKIKNGMNPVCFSFTDQ

SEQ ID NO: 2300379 - protein, 17 aa, Cryptosporidium parvum
NKILELKGLRFAFFKDD

SEQ ID NO: 2300380 - protein, 24 aa, Cryptosporidium parvum
NKILRELYKLYLFNRNKDELPSTK

SEQ ID NO: 2300381 - protein, 19 aa, Cryptosporidium parvum
NKILSEFTCPVCLDYYMLP

SEQ ID NO: 2300382 - protein, 18 aa, Cryptosporidium parvum
NKIPFLFEYVSDNLETEA

SEQ ID NO: 2300383 - protein, 18 aa, Cryptosporidium parvum
NKIPRRYSLSNSEKTTLG

SEQ ID NO: 2300384 - protein, 25 aa, Cryptosporidium parvum
NKIWLPENFCNLAAMDTLFKVLNPR

SEQ ID NO: 2300385 - protein, 25 aa, Cryptosporidium parvum
NKIWLTLEFWGILILLFKHKSLDIY

SEQ ID NO: 2300386 - protein, 26 aa, Cryptosporidium parvum
NKKENFVACLYTCYEFLRPDTVMEMA

SEQ ID NO: 2300387 - protein, 18 aa, Cryptosporidium parvum
NKKIDGFVEFESELAKLR

SEQ ID NO: 2300388 - protein, 32 aa, Cryptosporidium parvum; identical to SEQ ID NO: 2178233

SEQ ID NO: 2300389 - protein, 23 aa, Cryptosporidium parvum
NKKSCLQNSFSKRIDYAVQNSIF

SEQ ID NO: 2300390 - protein, 20 aa, Cryptosporidium parvum
NKKYARVMCLDWETININIA

SEQ ID NO: 2300391 - protein, 24 aa, Cryptosporidium parvum
NKKYQRLSFIGGYKDKIVNRRATF

SEQ ID NO: 2300392 - protein, 22 aa, Cryptosporidium parvum
NKLEAIELLDWIDNNGQWETKL

SEQ ID NO: 2300393 - protein, 22 aa, Cryptosporidium parvum
NKLEGWSVFQLPKYMPESKKNY

SEQ ID NO: 2300394 - protein, 25 aa, Cryptosporidium parvum
NKLESVSFLKYCWNLTDINLSNNNL

SEQ ID NO: 2300395 - protein, 22 aa, Cryptosporidium parvum
NKLKKDLPRRGPTLSSSAAELM

SEQ ID NO: 2300396 - protein, 17 aa, Cryptosporidium parvum
NKLKKYLGEYFIKKQEE

SEQ ID NO: 2300397 - protein, 20 aa, Cryptosporidium parvum
NKLKLIFDRVSGIISELETI

SEQ ID NO: 2300398 - protein, 23 aa, Cryptosporidium parvum
NKLKQMNFLVGKIFKSLQDSSSE

SEQ ID NO: 2300399 - protein, 20 aa, Cryptosporidium parvum
NKLKSGVHMVVGTPGRVFDM

SEQ ID NO: 2300400 - protein, 21 aa, Cryptosporidium parvum
NKLLFQYFTTVFKFHTLNQFE

SEQ ID NO: 2300401 - protein, 18 aa, Cryptosporidium parvum
NKLLKQKIKFMADLISEF

SEQ ID NO: 2300402 - protein, 21 aa, Cryptosporidium parvum
NKLLVGNKCDLVSKRVVTSDE

SEQ ID NO: 2300403 - protein, 23 aa, Cryptosporidium parvum
NKLREQLFMMGFELQNQNIEKDQ

SEQ ID NO: 2300404 - protein, 23 aa, Cryptosporidium parvum
NKLVREWIYEASLEHSMNEEEAL

SEQ ID NO: 2300405 - protein, 23 aa, Cryptosporidium parvum
NKMCYCVSCAIHSRTVRVRSVTD

SEQ ID NO: 2300406 - protein, 24 aa, Cryptosporidium parvum
NKMDRLILELGFDVKEAYIHITKL

SEQ ID NO: 2300407 - protein, 23 aa, Cryptosporidium parvum
NKMKMWPSFDHIFKAARRDNKWY

SEQ ID NO: 2300408 - protein, 22 aa, Cryptosporidium parvum
NKMNRPGFKLAVVGLGGLGHMA

SEQ ID NO: 2300409 - protein, 17 aa, Cryptosporidium parvum
NKNFGRWYLSNNTKARS

SEQ ID NO: 2300410 - protein, 24 aa, Cryptosporidium parvum
NKNIIWKGISSINHILCSENSQSC

SEQ ID NO: 2300411 - protein, 21 aa, Cryptosporidium parvum
NKNLLRLSRNHAYLYVKKNNK

SEQ ID NO: 2300412 - protein, 26 aa, Cryptosporidium parvum
NKNLRNLMLKVFRKDMFSDYCQKCKK

SEQ ID NO: 2300413 - protein, 17 aa, Cryptosporidium parvum
NKNRFARKELTSTKLIW

SEQ ID NO: 2300414 - protein, 23 aa, Cryptosporidium parvum
NKNSLRKAIYIHSLYDGSNLGTI

SEQ ID NO: 2300415 - protein, 23 aa, Cryptosporidium parvum
NKPDSQWKQFYSARMRTNAFNSR

SEQ ID NO: 2300416 - protein, 27 aa, Cryptosporidium parvum
NKPLLRIVSRGKLYTLADFVNTHENEE

SEQ ID NO: 2300417 - protein, 25 aa, Cryptosporidium parvum
NKPRDEIFTSLKLIERDFKLIQELF

SEQ ID NO: 2300418 - protein, 22 aa, Cryptosporidium parvum
NKPRYVMGVGYPIDILVCVALG

SEQ ID NO: 2300419 - protein, 30 aa, Cryptosporidium parvum; identical to SEQ ID NO: 2178263

SEQ ID NO: 2300420 - protein, 18 aa, Cryptosporidium parvum
NKQFSINSSRSFNYLNEL

SEQ ID NO: 2300421 - protein, 19 aa, Cryptosporidium parvum
NKQLKKRVANLNELNSNYQ

SEQ ID NO: 2300422 - protein, 25 aa, Cryptosporidium parvum
NKQTKEFNIEFGLEKNTGIKQSNNS

SEQ ID NO: 2300423 - protein, 24 aa, Cryptosporidium parvum
NKQVMEFCIKLYWHTKHLRSLLNT

SEQ ID NO: 2300424 - protein, 32 aa, Cryptosporidium parvum
NKRDALDWIKKTFLYIRIIRNPSLYGLDIDEI

SEQ ID NO: 2300425 - protein, 30 aa, Cryptosporidium parvum
NKRLNCLEKICLLSMDFGVKIQYFRDFYDS

SEQ ID NO: 2300426 - protein, 25 aa, Cryptosporidium parvum
NKRNLRWALNHARVDKIIDRFSEFE

SEQ ID NO: 2300427 - protein, 25 aa, Cryptosporidium parvum
NKRTPSYFNTGFIPNQLVLNASLLN

SEQ ID NO: 2300428 - protein, 27 aa, Cryptosporidium parvum
NKSEYRFLQEWTKLGFSDKSTKKKLEE

SEQ ID NO: 2300429 - protein, 19 aa, Cryptosporidium parvum
NKSRLTIMKTMPAPVTDIK

SEQ ID NO: 2300430 - protein, 21 aa, Cryptosporidium parvum
NKSSHLLPVGSLGPYSFQPYK

SEQ ID NO: 2300431 - protein, 18 aa, Cryptosporidium parvum
NKSSYGFDSQGMRFLTQS

SEQ ID NO: 2300432 - protein, 17 aa, Cryptosporidium parvum
NKTALLCPLCMTPQCFG

SEQ ID NO: 2300433 - protein, 26 aa, Cryptosporidium parvum
NKTDKSKCILFLDYLILRTKKLSYII

SEQ ID NO: 2300434 - protein, 24 aa, Cryptosporidium parvum
NKTEFLKWRESFLSTVPTKYRMKY

SEQ ID NO: 2300435 - protein, 22 aa, Cryptosporidium parvum
NKTGLVLWSYRSEDAGPEEILE

SEQ ID NO: 2300436 - protein, 21 aa, Cryptosporidium parvum
NKTKFNICNNLTFIDISKEFK

SEQ ID NO: 2300437 - protein, 25 aa, Cryptosporidium parvum
NKTRYRLSVSLYNLFGCGDVFSDEI

SEQ ID NO: 2300438 - protein, 18 aa, Cryptosporidium parvum
NKTWNILALEVFDKFLYV

SEQ ID NO: 2300439 - protein, 17 aa, Cryptosporidium parvum
NKVFPKVWIFSSNDVDS

SEQ ID NO: 2300440 - protein, 18 aa, Cryptosporidium parvum
NKVLRCLNINPNDSDFKS

SEQ ID NO: 2300441 - protein, 19 aa, Cryptosporidium parvum
NKVMVEFEAVIGLKYLKAM

SEQ ID NO: 2300442 - protein, 17 aa, Cryptosporidium parvum
NKVPDWCNRDIPSKFGK

SEQ ID NO: 2300443 - protein, 20 aa, Cryptosporidium parvum
NKVSIPYFFFSKLGSPFDLI

SEQ ID NO: 2300444 - protein, 20 aa, Cryptosporidium parvum
NKVVMDILRSWAILNPSKNK

SEQ ID NO: 2300445 - protein, 24 aa, Cryptosporidium parvum
NKWILDSACEIIRIPLPENPIENV

SEQ ID NO: 2300446 - protein, 22 aa, Cryptosporidium parvum
NKWKLRQNTFWTSNESFNTLIR

SEQ ID NO: 2300447 - protein, 19 aa, Cryptosporidium parvum
NKWPLPRLYSDVNIYKPRE

SEQ ID NO: 2300448 - protein, 18 aa, Cryptosporidium parvum
NKYFCFTPLLTQIVSNRL

SEQ ID NO: 2300449 - protein, 24 aa, Cryptosporidium parvum
NKYGQCRRSYLLGYFGEKFNREKS

SEQ ID NO: 2300450 - protein, 17 aa, Cryptosporidium parvum
NKYPFYKSTLIGHTSTV

SEQ ID NO: 2300451 - protein, 21 aa, Cryptosporidium parvum
NLAKSPIWDGGNFKQPPLSVL

SEQ ID NO: 2300452 - protein, 17 aa, Cryptosporidium parvum
NLARIEAIINESNMINA

SEQ ID NO: 2300453 - protein, 18 aa, Cryptosporidium parvum
NLASMVMRSDSIVFKNGL

SEQ ID NO: 2300454 - protein, 18 aa, Cryptosporidium parvum
NLCCNGRIVSVLEGGYNT

SEQ ID NO: 2300455 - protein, 26 aa, Cryptosporidium parvum
NLCHRRFTMKTILMIADQMLQRVEYI

SEQ ID NO: 2300456 - protein, 20 aa, Cryptosporidium parvum
NLCKLHGQMCQKSREKSYEI

SEQ ID NO: 2300457 - protein, 17 aa, Cryptosporidium parvum
NLCSLLPNQKRPTLSVI

SEQ ID NO: 2300458 - protein, 19 aa, Cryptosporidium parvum
NLDAFLFACVISYDSKQKI

SEQ ID NO: 2300459 - protein, 29 aa, Cryptosporidium parvum
NLDAKCIYWKLGNNFLYTLYSLILKDDTE

SEQ ID NO: 2300460 - protein, 18 aa, Cryptosporidium parvum
NLDDFSIGNTDLRLNQVN

SEQ ID NO: 2300461 - protein, 20 aa, Cryptosporidium parvum
NLDFGVNLNFGLGLSLETDI

SEQ ID NO: 2300462 - protein, 26 aa, Cryptosporidium parvum
NLDFQWPEILEYIGIITNDYQESSHN

SEQ ID NO: 2300463 - protein, 18 aa, Cryptosporidium parvum
NLEEEFRKLTLIRQETIM

SEQ ID NO: 2300464 - protein, 27 aa, Cryptosporidium parvum
NLEEFYYKNIESIPRCYDELIDMSESS

SEQ ID NO: 2300465 - protein, 24 aa, Cryptosporidium parvum
NLEEPFSCGVIFHAMPPSKRFRDI

SEQ ID NO: 2300466 - protein, 20 aa, Cryptosporidium parvum
NLEHLCLRNNIILNNTTIDL

SEQ ID NO: 2300467 - protein, 17 aa, Cryptosporidium parvum
NLEIKWNAYRKRTQRLE

SEQ ID NO: 2300468 - protein, 19 aa, Cryptosporidium parvum
NLEILSGAITRDFESSYSD

SEQ ID NO: 2300469 - protein, 26 aa, Cryptosporidium parvum
NLEKLKIDRFEPFNSLIKQLATQPCI

SEQ ID NO: 2300470 - protein, 27 aa, Cryptosporidium parvum
NLEMSKNISIHPCIKKGYEESILAIGD

SEQ ID NO: 2300471 - protein, 25 aa, Cryptosporidium parvum
NLENFPRILAIFIDIYGTSMSNDSL

SEQ ID NO: 2300472 - protein, 17 aa, Cryptosporidium parvum
NLFFFKNIILETSSKFF

SEQ ID NO: 2300473 - protein, 19 aa, Cryptosporidium parvum
NLFKDEFLYEPIIDEEKIQ

SEQ ID NO: 2300474 - protein, 24 aa, Cryptosporidium parvum
NLFLPELINMMGPLLSGTLFPYNN

SEQ ID NO: 2300475 - protein, 18 aa, Cryptosporidium parvum
NLFNRTLFESEYVYTRNL

SEQ ID NO: 2300476 - protein, 19 aa, Cryptosporidium parvum
NLFTSLRFYHYSVEVRNVL

SEQ ID NO: 2300477 - protein, 25 aa, Cryptosporidium parvum
NLGATCYMGSYLQYLFMNLDFRSTF

SEQ ID NO: 2300478 - protein, 18 aa, Cryptosporidium parvum
NLGIYWIKMDKIEDIGED

SEQ ID NO: 2300479 - protein, 22 aa, Cryptosporidium parvum
NLGKLRARTSVSRRKQNVSKSK

SEQ ID NO: 2300480 - protein, 25 aa, Cryptosporidium parvum
NLGRLRAPLLRNRVVKAAEAANPEV

SEQ ID NO: 2300481 - protein, 33 aa, Cryptosporidium parvum
NLHERIYPSPLNEIVKILNMHQLTLQSIESEAQ

SEQ ID NO: 2300482 - protein, 23 aa, Cryptosporidium parvum
NLHLKTLRTFKSFILENEEDFFS

SEQ ID NO: 2300483 - protein, 22 aa, Cryptosporidium parvum
NLHPYILIIICMLRERYQKAVK

SEQ ID NO: 2300484 - protein, 17 aa, Cryptosporidium parvum
NLIFKFEREFSITSKNI

SEQ ID NO: 2300485 - protein, 25 aa, Cryptosporidium parvum
NLIGEAMKLEFPFKISENYSSNESL

SEQ ID NO: 2300486 - protein, 17 aa, Cryptosporidium parvum
NLIKLSWNSSPINYYDK

SEQ ID NO: 2300487 - protein, 20 aa, Cryptosporidium parvum
NLINNFTFKFIPRLLSKPYS

SEQ ID NO: 2300488 - protein, 20 aa, Cryptosporidium parvum
NLIPELVKKVSYIVEDTYRR

SEQ ID NO: 2300489 - protein, 26 aa, Cryptosporidium parvum
NLIRIWRPALVVHCRERRRAKLKGSN

SEQ ID NO: 2300490 - protein, 24 aa, Cryptosporidium parvum
NLISELQGKIMLAEKARELLLTRY

SEQ ID NO: 2300491 - protein, 28 aa, Cryptosporidium parvum
NLISTRIYRWYLFYKHIILPLRRQVEYR

SEQ ID NO: 2300492 - protein, 21 aa, Cryptosporidium parvum
NLKAFSVKSAFIILNEDAIPF

SEQ ID NO: 2300493 - protein, 23 aa, Cryptosporidium parvum
NLKIPKYVCLVSKLDGYKNPYFF

SEQ ID NO: 2300494 - protein, 30 aa, Cryptosporidium parvum
NLKKHIGNFIKLRFSQSLKVEISVKIQDNN

SEQ ID NO: 2300495 - protein, 19 aa, Cryptosporidium parvum
NLKKIVTFGLPFVPFSIRA

SEQ ID NO: 2300496 - protein, 22 aa, Cryptosporidium parvum
NLKNGLRYKCRGLMMNRDQEKE

SEQ ID NO: 2300497 - protein, 23 aa, Cryptosporidium parvum
NLKNSGFLRLDFFGNDKDEEDFV

SEQ ID NO: 2300498 - protein, 24 aa, Cryptosporidium parvum
NLKPPLLFDIAYEFEKLKLSKEKD

SEQ ID NO: 2300499 - protein, 26 aa, Cryptosporidium parvum
NLKQPCLELLTFILIDIIMDNEIHFN

SEQ ID NO: 2300500 - protein, 17 aa, Cryptosporidium parvum
NLKSIALGLCIINTILS

SEQ ID NO: 2300501 - protein, 22 aa, Cryptosporidium parvum
NLKSSEWIFFFFKHLLSENPCT

SEQ ID NO: 2300502 - protein, 21 aa, Cryptosporidium parvum
NLKTKIKHYFSNNIQEEINVC

SEQ ID NO: 2300503 - protein, 29 aa, Cryptosporidium parvum
NLKYKDIIDWKGCNPLILISSFFCNGKKL

SEQ ID NO: 2300504 - protein, 28 aa, Cryptosporidium parvum
NLKYWCKLFKVNLLFPPCKSDNIRRVGN

SEQ ID NO: 2300505 - protein, 19 aa, Cryptosporidium parvum
NLLCFKATLDSIVNIVDVL

SEQ ID NO: 2300506 - protein, 25 aa, Cryptosporidium parvum
NLLCKGVSSVSIWKDSFNINTFQTK

SEQ ID NO: 2300507 - protein, 18 aa, Cryptosporidium parvum
NLLFPKSRQLNFLQNHEK

SEQ ID NO: 2300508 - protein, 24 aa, Cryptosporidium parvum
NLLHFVEAFPDVWTVENVGPDEFT

SEQ ID NO: 2300509 - protein, 22 aa, Cryptosporidium parvum
NLLKLLSYHGVMACVGAPPAGE

SEQ ID NO: 2300510 - protein, 18 aa, Cryptosporidium parvum
NLLLELSKTYASINNSVP

SEQ ID NO: 2300511 - protein, 25 aa, Cryptosporidium parvum
NLLLPFETASSYVIYGTQKYNLETF

SEQ ID NO: 2300512 - protein, 17 aa, Cryptosporidium parvum
NLLLSQRLERVFESIQI

SEQ ID NO: 2300513 - protein, 20 aa, Cryptosporidium parvum
NLLMKSPLVKNALRRLNKSD

SEQ ID NO: 2300514 - protein, 29 aa, Cryptosporidium parvum
NLLQKGFKLWTRREFNLLLRCLETNGVEN

SEQ ID NO: 2300515 - protein, 29 aa, Cryptosporidium parvum
NLLRIVWISPQLISIRWCEANKINNSRLE

SEQ ID NO: 2300516 - protein, 17 aa, Cryptosporidium parvum
NLLSLKFVSSHNIESLK

SEQ ID NO: 2300517 - protein, 23 aa, Cryptosporidium parvum
NLLVCKLCKKSSTTVIGYKYLIK

SEQ ID NO: 2300518 - protein, 24 aa, Cryptosporidium parvum
NLLVYRYLIENGFVHTAFSFNSEA

SEQ ID NO: 2300519 - protein, 31 aa, Cryptosporidium parvum
NLMDAISNILGWRIEIIYVEGGLTAYKLSNI

SEQ ID NO: 2300520 - protein, 18 aa, Cryptosporidium parvum
NLMNLRILSFHSNHLNDE

SEQ ID NO: 2300521 - protein, 20 aa, Cryptosporidium parvum
NLMVPRCVYEAYGDVVDDCN

SEQ ID NO: 2300522 - protein, 27 aa, Cryptosporidium parvum
NLNEARKLLDWCDFIGYHAVIISIDKL

SEQ ID NO: 2300523 - protein, 17 aa, Cryptosporidium parvum
NLNISRILAPIAATAFA

SEQ ID NO: 2300524 - protein, 20 aa, Cryptosporidium parvum
NLNLYRLRNGVQLSTTATAN

SEQ ID NO: 2300525 - protein, 21 aa, Cryptosporidium parvum
NLNSLKIVLNLNISEGGIEQS

SEQ ID NO: 2300526 - protein, 23 aa, Cryptosporidium parvum
NLPCSISDCSLVTVSDDGKCRIL

SEQ ID NO: 2300527 - protein, 25 aa, Cryptosporidium parvum
NLPDDWYSCMSFTIKTFACDSNGNQ

SEQ ID NO: 2300528 - protein, 18 aa, Cryptosporidium parvum
NLPFSVNLKKILKEYSLK

SEQ ID NO: 2300529 - protein, 21 aa, Cryptosporidium parvum
NLPIESSCALSIINKQTKESN

SEQ ID NO: 2300530 - protein, 26 aa, Cryptosporidium parvum
NLPILACGVEEYLFILVLKLPSICFA

SEQ ID NO: 2300531 - protein, 24 aa, Cryptosporidium parvum
NLPKREVIQNFKLKASDQSEDSNS

SEQ ID NO: 2300532 - protein, 23 aa, Cryptosporidium parvum
NLPQLTSAISIYGHHHSNHQPQQ

SEQ ID NO: 2300533 - protein, 26 aa, Cryptosporidium parvum
NLPSIYLKCEILFIITAYIRELSTFE

SEQ ID NO: 2300534 - protein, 20 aa, Cryptosporidium parvum
NLPSSINWAISNNFREKMKS

SEQ ID NO: 2300535 - protein, 18 aa, Cryptosporidium parvum
NLPWKAKWHDLKDHMRQA

SEQ ID NO: 2300536 - protein, 18 aa, Cryptosporidium parvum
NLQFEKAFQSFKQAHIDP

SEQ ID NO: 2300537 - protein, 19 aa, Cryptosporidium parvum
NLQIGSRINNPVCEYITSF

SEQ ID NO: 2300538 - protein, 20 aa, Cryptosporidium parvum
NLQKRLRVLPPKHPGKDETM

SEQ ID NO: 2300539 - protein, 18 aa, Cryptosporidium parvum
NLQLELAQNYKATKLEKI

SEQ ID NO: 2300540 - protein, 22 aa, Cryptosporidium parvum
NLQRQLWDPLPMSPGNPLMMTY

SEQ ID NO: 2300541 - protein, 22 aa, Cryptosporidium parvum
NLQSIRTWRGWKPLKKLKKFFK

SEQ ID NO: 2300542 - protein, 30 aa, Cryptosporidium parvum
NLQTSWKTLKIFWFEECNLIGKEGTFLALG

SEQ ID NO: 2300543 - protein, 26 aa, Cryptosporidium parvum
NLRAVIVQIFMKWLKDDIMIRNYKNM

SEQ ID NO: 2300544 - protein, 21 aa, Cryptosporidium parvum
NLRQDISICRNIFLFYQSNKY

SEQ ID NO: 2300545 - protein, 21 aa, Cryptosporidium parvum
NLRQRIVCFVGSPLEDDLTEK

SEQ ID NO: 2300546 - protein, 17 aa, Cryptosporidium parvum
NLSEFTSRFSFFSSCEI

SEQ ID NO: 2300547 - protein, 23 aa, Cryptosporidium parvum
NLSEKEIQRFTGLSPIMTGKFWD

SEQ ID NO: 2300548 - protein, 17 aa, Cryptosporidium parvum
NLSEPLWLAEKVKKTEE

SEQ ID NO: 2300549 - protein, 21 aa, Cryptosporidium parvum
NLSHLFSLLRLHNIMEYYPKS

SEQ ID NO: 2300550 - protein, 26 aa, Cryptosporidium parvum
NLSIDIKPAYTLSMVFKHFNEMKKMG

SEQ ID NO: 2300551 - protein, 18 aa, Cryptosporidium parvum
NLSIKLIYNKGIKDDERE

SEQ ID NO: 2300552 - protein, 25 aa, Cryptosporidium parvum
NLSIYRKAMGITRNGFKRLIISLNL

SEQ ID NO: 2300553 - protein, 33 aa, Cryptosporidium parvum
NLSKAICMKFAIKLCVACGIASKESIDHLKRQA

SEQ ID NO: 2300554 - protein, 26 aa, Cryptosporidium parvum
NLSLTPYVLGLRVFKLINSNKKQVSN

SEQ ID NO: 2300555 - protein, 17 aa, Cryptosporidium parvum
NLSRIAMNLIEKAENNE

SEQ ID NO: 2300556 - protein, 21 aa, Cryptosporidium parvum
NLSYLLSRCSSYYGYYTNYMA

SEQ ID NO: 2300557 - protein, 26 aa, Cryptosporidium parvum
NLTCFLDCNYSYMFLSDYTKGEEYCN

SEQ ID NO: 2300558 - protein, 25 aa, Cryptosporidium parvum
NLTDDGKCSLEFVHEMYLSPSMSEI

SEQ ID NO: 2300559 - protein, 23 aa, Cryptosporidium parvum
NLTEIKTDWLLEVAPHYYHTDDF

SEQ ID NO: 2300560 - protein, 23 aa, Cryptosporidium parvum
NLTGGSLMGNVLMMSGNGTNGGG

SEQ ID NO: 2300561 - protein, 18 aa, Cryptosporidium parvum
NLTGRDLLQASIRMISNP

SEQ ID NO: 2300562 - protein, 21 aa, Cryptosporidium parvum
NLTHKFCQGVAPSLSQSLLLD

SEQ ID NO: 2300563 - protein, 26 aa, Cryptosporidium parvum
NLTSLKIGITIGIKIAHLINNYVETL

SEQ ID NO: 2300564 - protein, 19 aa, Cryptosporidium parvum
NLVGILSMAGERIELRVTP

SEQ ID NO: 2300565 - protein, 25 aa, Cryptosporidium parvum
NLVKRPMWLQLMINKCKKREYKSRK

SEQ ID NO: 2300566 - protein, 17 aa, Cryptosporidium parvum
NLYCFAIDEAHCISEWG

SEQ ID NO: 2300567 - protein, 21 aa, Cryptosporidium parvum
NLYNTCFWSLVSINKLNEREA

SEQ ID NO: 2300568 - protein, 24 aa, Cryptosporidium parvum
NLYPKVNLGIPIGVVLSKSDIGQR

SEQ ID NO: 2300569 - protein, 17 aa, Cryptosporidium parvum
NLYQPGINVSSFNTTAP

SEQ ID NO: 2300570 - protein, 22 aa, Cryptosporidium parvum
NMDAIRNCFQRFDRFNEKYNPF

SEQ ID NO: 2300571 - protein, 28 aa, Cryptosporidium parvum
NMDEFTRWNIALQFGGFINGVTKSCMSK

SEQ ID NO: 2300572 - protein, 23 aa, Cryptosporidium parvum
NMDYYSRLRYVFPNNEYYLNSHF

SEQ ID NO: 2300573 - protein, 23 aa, Cryptosporidium parvum
NMEEYSNIFSFLLEVKRCSLFLN

SEQ ID NO: 2300574 - protein, 23 aa, Cryptosporidium parvum
NMGESKASIGIEALAYYELSEED

SEQ ID NO: 2300575 - protein, 18 aa, Cryptosporidium parvum
NMGGLGIGRFQNFLYCIM

SEQ ID NO: 2300576 - protein, 17 aa, Cryptosporidium parvum
NMGKYYFEREIVYREWF

SEQ ID NO: 2300577 - protein, 19 aa, Cryptosporidium parvum
NMHYDPHFGNFSGNNYNRS

SEQ ID NO: 2300578 - protein, 20 aa, Cryptosporidium parvum
NMINPGIYGAHAHFQPFVEP

SEQ ID NO: 2300579 - protein, 24 aa, Cryptosporidium parvum
NMIRSCSRCGSFFEVVNDSDDELD

SEQ ID NO: 2300580 - protein, 24 aa, Cryptosporidium parvum
NMKHSCKRCIVEVEMWKRKLKTQE

SEQ ID NO: 2300581 - protein, 24 aa, Cryptosporidium parvum
NMKMVYKTINYVPGLYKIFDEILV

SEQ ID NO: 2300582 - protein, 24 aa, Cryptosporidium parvum
NMKNCFEGGCTRCSNPNRVEGKSL

SEQ ID NO: 2300583 - protein, 25 aa, Cryptosporidium parvum
NMLLLLKLVDNILIRIILLTIENIV

SEQ ID NO: 2300584 - protein, 29 aa, Cryptosporidium parvum
NMLYSCSVMYRCKLPFILIFNKIDVTDHL

SEQ ID NO: 2300585 - protein, 32 aa, Cryptosporidium parvum; identical to SEQ ID NO: 2178402

SEQ ID NO: 2300586 - protein, 30 aa, Cryptosporidium parvum
NMNKRRLGISKRAICMANFGNLKNKNLGDD

SEQ ID NO: 2300587 - protein, 19 aa, Cryptosporidium parvum
NMNLIKGIIDQASQTVEIS

SEQ ID NO: 2300588 - protein, 17 aa, Cryptosporidium parvum
NMRIRIASIDLFSNLNR

SEQ ID NO: 2300589 - protein, 25 aa, Cryptosporidium parvum
NMRLRACNLFLHKIEDLMYEIPIIS

SEQ ID NO: 2300590 - protein, 17 aa, Cryptosporidium parvum
NMSCNGISSLNATNLST

SEQ ID NO: 2300591 - protein, 29 aa, Cryptosporidium parvum
NMSTCTSLRVSSCFKRMELIVWNYNDSNL

SEQ ID NO: 2300592 - protein, 25 aa, Cryptosporidium parvum
NMTERFAYEVLLFWQNSAGSSDFKS

SEQ ID NO: 2300593 - protein, 19 aa, Cryptosporidium parvum
NMWVPYISYSKCFYNFSRV

SEQ ID NO: 2300594 - protein, 30 aa, Cryptosporidium parvum
NMYKIAGELWPCVFHVTARAIATSSLSIFG

SEQ ID NO: 2300595 - protein, 21 aa, Cryptosporidium parvum
NNAKEAVLIFGEKDLKINFLS

SEQ ID NO: 2300596 - protein, 24 aa, Cryptosporidium parvum
NNANRYQPPFLRTTSSSAFERGSN

SEQ ID NO: 2300597 - protein, 17 aa, Cryptosporidium parvum
NNCKCKKLFIKSIKMDT

SEQ ID NO: 2300598 - protein, 20 aa, Cryptosporidium parvum
NNCKGFDVFERNLCELESNE

SEQ ID NO: 2300599 - protein, 23 aa, Cryptosporidium parvum
NNCLDIFQFLLKHLQDISLQNYK

SEQ ID NO: 2300600 - protein, 18 aa, Cryptosporidium parvum
NNCNCGRADLEKEIGVEA

SEQ ID NO: 2300601 - protein, 23 aa, Cryptosporidium parvum
NNDCYRANSLRVISKIADGTMIG

SEQ ID NO: 2300602 - protein, 24 aa, Cryptosporidium parvum
NNDMIKLIMEYRGNFPKRLLNQGV

SEQ ID NO: 2300603 - protein, 17 aa, Cryptosporidium parvum
NNDSFAFAPILKINVHS

SEQ ID NO: 2300604 - protein, 24 aa, Cryptosporidium parvum
NNEGIDNKGRWSIDSFGSNDYHKA

SEQ ID NO: 2300605 - protein, 22 aa, Cryptosporidium parvum
NNELINFIVNWNKYSKYIPIPQ

SEQ ID NO: 2300606 - protein, 17 aa, Cryptosporidium parvum
NNELPCYNVDYDNFAPQ

SEQ ID NO: 2300607 - protein, 21 aa, Cryptosporidium parvum
NNERFPTINIAYSYFNIANTC

SEQ ID NO: 2300608 - protein, 27 aa, Cryptosporidium parvum
NNESEWEFFWQELLIYLFFKPILNKNS

SEQ ID NO: 2300609 - protein, 28 aa, Cryptosporidium parvum
NNESILWPECLKSPFSYKFETNIQANQG

SEQ ID NO: 2300610 - protein, 20 aa, Cryptosporidium parvum
NNFFMKKKILFGILKGIDYI

SEQ ID NO: 2300611 - protein, 30 aa, Cryptosporidium parvum
NNFQECLEFSKILFDYCRRSTSQTMDQLIS

SEQ ID NO: 2300612 - protein, 17 aa, Cryptosporidium parvum
NNFSEWLLPFLRSKKIQ

SEQ ID NO: 2300613 - protein, 19 aa, Cryptosporidium parvum
NNFTCGRKQLQFNETKEFK

SEQ ID NO: 2300614 - protein, 17 aa, Cryptosporidium parvum
NNFVYAIEDVENGGQMK

SEQ ID NO: 2300615 - protein, 22 aa, Cryptosporidium parvum
NNGFRAKHRLALTGTPLQNDLQ

SEQ ID NO: 2300616 - protein, 18 aa, Cryptosporidium parvum
NNGGMIFENCCQSRSYTD

SEQ ID NO: 2300617 - protein, 20 aa, Cryptosporidium parvum
NNGSINWSLLETKGFSLSSL

SEQ ID NO: 2300618 - protein, 25 aa, Cryptosporidium parvum
NNGYEILKIRIARITKLLGDNITFL

SEQ ID NO: 2300619 - protein, 18 aa, Cryptosporidium parvum
NNHIKYNYILPIRSVGVQ

SEQ ID NO: 2300620 - protein, 23 aa, Cryptosporidium parvum
NNHILLMKWSRMHKTKRDRDEND

SEQ ID NO: 2300621 - protein, 22 aa, Cryptosporidium parvum
NNHLKVLFCTSLHMMDSEIKAD

SEQ ID NO: 2300622 - protein, 23 aa, Cryptosporidium parvum
NNHLPMLTGFSVVWRDQVFVPRI

SEQ ID NO: 2300623 - protein, 20 aa, Cryptosporidium parvum
NNICRKRSLVSIGTHDLDMI

SEQ ID NO: 2300624 - protein, 26 aa, Cryptosporidium parvum
NNIFTNEDLLEWKAMIKEFYSNDPDY

SEQ ID NO: 2300625 - protein, 18 aa, Cryptosporidium parvum
NNIFVCCNQIKTNRKKVL

SEQ ID NO: 2300626 - protein, 17 aa, Cryptosporidium parvum
NNIIGISIEDFWFDYRI

SEQ ID NO: 2300627 - protein, 20 aa, Cryptosporidium parvum
NNIIKKRESYSIINNDENNN

SEQ ID NO: 2300628 - protein, 19 aa, Cryptosporidium parvum
NNIIRRQSLIYSKIDSETE

SEQ ID NO: 2300629 - protein, 21 aa, Cryptosporidium parvum
NNIKIAISLCNDIKQLRVLED

SEQ ID NO: 2300630 - protein, 23 aa, Cryptosporidium parvum
NNILAYKLNFCGIRYLKENLMNN

SEQ ID NO: 2300631 - protein, 24 aa, Cryptosporidium parvum
NNILKGGAELLRINNDQTEVPKNS

SEQ ID NO: 2300632 - protein, 28 aa, Cryptosporidium parvum
NNILKGTGWLLRTHLDLVDFINDNINAE

SEQ ID NO: 2300633 - protein, 17 aa, Cryptosporidium parvum
NNILLQCIFLLNLKDEF

SEQ ID NO: 2300634 - protein, 21 aa, Cryptosporidium parvum
NNILQYGWKVERHMKNDDLVL

SEQ ID NO: 2300635 - protein, 17 aa, Cryptosporidium parvum
NNINFFLDRHWIDKEFK

SEQ ID NO: 2300636 - protein, 17 aa, Cryptosporidium parvum
NNIPRIGTTGGSFSGSH

SEQ ID NO: 2300637 - protein, 18 aa, Cryptosporidium parvum
NNIQSIRILILVVHPLKS

SEQ ID NO: 2300638 - protein, 17 aa, Cryptosporidium parvum
NNIRMGNNSSRLINGSG

SEQ ID NO: 2300639 - protein, 27 aa, Cryptosporidium parvum
NNKIEDVKIKLPMRNGNNEGVAIVEFE

SEQ ID NO: 2300640 - protein, 20 aa, Cryptosporidium parvum
NNKISFKICPNNNNNNINEE

SEQ ID NO: 2300641 - protein, 22 aa, Cryptosporidium parvum
NNKKIPIPISWDDIQRKNYIDR

SEQ ID NO: 2300642 - protein, 19 aa, Cryptosporidium parvum
NNKKYYAIKAFDKDLSKKG

SEQ ID NO: 2300643 - protein, 26 aa, Cryptosporidium parvum
NNKNRLCSIVHSLDVLRMLKCEFEVF

SEQ ID NO: 2300644 - protein, 19 aa, Cryptosporidium parvum
NNKSIKHNVHGHGHNHNHN

SEQ ID NO: 2300645 - protein, 21 aa, Cryptosporidium parvum
NNKYGRWSIIRVTTDLSTKFK

SEQ ID NO: 2300646 - protein, 17 aa, Cryptosporidium parvum
NNLAACINLDWNVDEWV

SEQ ID NO: 2300647 - protein, 27 aa, Cryptosporidium parvum
NNLCRGRPPPPFEMVSHSLPVLCRLLY

SEQ ID NO: 2300648 - protein, 18 aa, Cryptosporidium parvum
NNLDEFLDELLILDYIVT

SEQ ID NO: 2300649 - protein, 25 aa, Cryptosporidium parvum
NNLECKYRELGLLVFSWLQNIFNKP

SEQ ID NO: 2300650 - protein, 24 aa, Cryptosporidium parvum
NNLEELWSLLHFLNPLRFQNYQEF

SEQ ID NO: 2300651 - protein, 30 aa, Cryptosporidium parvum
NNLFSKYGLKYSQLRNATIHELCRMAYVCG

SEQ ID NO: 2300652 - protein, 17 aa, Cryptosporidium parvum
NNLKEISSCFEIIDNSI

SEQ ID NO: 2300653 - protein, 26 aa, Cryptosporidium parvum
NNLKIYWKKWFEYINSIRIYKSKSQI

SEQ ID NO: 2300654 - protein, 21 aa, Cryptosporidium parvum
NNLLCLPKSAPFSMISSLVSL

SEQ ID NO: 2300655 - protein, 23 aa, Cryptosporidium parvum
NNLMCLIIPKFIDNSVIDLRYEF

SEQ ID NO: 2300656 - protein, 20 aa, Cryptosporidium parvum
NNLREGFIPLIYKGVQLISY

SEQ ID NO: 2300657 - protein, 26 aa, Cryptosporidium parvum
NNLRELSDFLKYEFISLIKDILFFSK

SEQ ID NO: 2300658 - protein, 25 aa, Cryptosporidium parvum
NNLSATEFDVCHSLLQKIKTRDEDL

SEQ ID NO: 2300659 - protein, 19 aa, Cryptosporidium parvum
NNLSLPFIWEKKFEQEKKG

SEQ ID NO: 2300660 - protein, 20 aa, Cryptosporidium parvum
NNLTEMGISFACVKGKRINK

SEQ ID NO: 2300661 - protein, 17 aa, Cryptosporidium parvum
NNLVKPPFKSHNDLSAS

SEQ ID NO: 2300662 - protein, 37 aa, Cryptosporidium parvum
NNMHATCSWSSNPFLCRKCCKKSSIQPSITYDIEYSA

SEQ ID NO: 2300663 - protein, 25 aa, Cryptosporidium parvum
NNMIGIEKKEEWGLYDDLIYKFLFR

SEQ ID NO: 2300664 - protein, 17 aa, Cryptosporidium parvum
NNMLRCESNMLRHTSRS

SEQ ID NO: 2300665 - protein, 38 aa, Cryptosporidium parvum
NNMSGNIGMGFIPRGGIVAPIQIEWPKTPPASPVEFEW

SEQ ID NO: 2300666 - protein, 23 aa, Cryptosporidium parvum
NNNFGMRDFHAISRQSSFPPHYQ

SEQ ID NO: 2300667 - protein, 25 aa, Cryptosporidium parvum
NNNIEWQGGIPIRNIPDLMTMLDLS

SEQ ID NO: 2300668 - protein, 26 aa, Cryptosporidium parvum
NNNIFGMLSCRPYSSSISTITSSNQS

SEQ ID NO: 2300669 - protein, 25 aa, Cryptosporidium parvum
NNNIILRMDILWIGDLNGKLPEFLK

SEQ ID NO: 2300670 - protein, 25 aa, Cryptosporidium parvum
NNNILYEEPLDFGISSTLELLKKRG

SEQ ID NO: 2300671 - protein, 27 aa, Cryptosporidium parvum
NNNKLPFDFSDPWKMKLINKRGRKSLS

SEQ ID NO: 2300672 - protein, 25 aa, Cryptosporidium parvum
NNNKVPLGTVWVWGSGECDQLGIKE

SEQ ID NO: 2300673 - protein, 23 aa, Cryptosporidium parvum
NNNLCLGGGLLSVGGTGGGTPVQ

SEQ ID NO: 2300674 - protein, 18 aa, Cryptosporidium parvum
NNNLLEWYNSLKQKIKNT

SEQ ID NO: 2300675 - protein, 21 aa, Cryptosporidium parvum
NNNPCKLKDQYPMANANNSMN

SEQ ID NO: 2300676 - protein, 22 aa, Cryptosporidium parvum
NNNPKWSQPILISSESNGIFYM

SEQ ID NO: 2300677 - protein, 24 aa, Cryptosporidium parvum
NNNRPKLYWAKHIATGFPVVIKVV

SEQ ID NO: 2300678 - protein, 24 aa, Cryptosporidium parvum
NNPGTLITCDYCYDSFHKYCLYNN

SEQ ID NO: 2300679 - protein, 24 aa, Cryptosporidium parvum
NNPIIWRFYCHKFGFVQNKKGKKW

SEQ ID NO: 2300680 - protein, 25 aa, Cryptosporidium parvum
NNPPRILICNPLKYLILERDSQIII

SEQ ID NO: 2300681 - protein, 24 aa, Cryptosporidium parvum
NNPRFKYLTALGIVYLRLTESSIV

SEQ ID NO: 2300682 - protein, 18 aa, Cryptosporidium parvum
NNQEPFEIHGCGHKLNEF

SEQ ID NO: 2300683 - protein, 35 aa, Cryptosporidium parvum; identical to SEQ ID NO: 2178472

SEQ ID NO: 2300684 - protein, 25 aa, Cryptosporidium parvum
NNQILFPVSYIFLRDEYSFPAAVLP

SEQ ID NO: 2300685 - protein, 21 aa, Cryptosporidium parvum
NNQILRGVIWWEDSSNQSSSI

SEQ ID NO: 2300686 - protein, 27 aa, Cryptosporidium parvum
NNQNLLNLVALCISTPPPFTGLPQNNP

SEQ ID NO: 2300687 - protein, 19 aa, Cryptosporidium parvum
NNQPRAVVVPHQLVSEFLR

SEQ ID NO: 2300688 - protein, 22 aa, Cryptosporidium parvum
NNQSIRSGMNFRVSLQQFDSIL

SEQ ID NO: 2300689 - protein, 17 aa, Cryptosporidium parvum
NNREFDSSFDLNLDLNL

SEQ ID NO: 2300690 - protein, 24 aa, Cryptosporidium parvum
NNRIDFFNKFLIDMDINESEQEEL

SEQ ID NO: 2300691 - protein, 24 aa, Cryptosporidium parvum
NNRIGEGIGSIGNIVGSDNNTGNG

SEQ ID NO: 2300692 - protein, 22 aa, Cryptosporidium parvum
NNSEIHLRCLLLSNMFTEQSIK

SEQ ID NO: 2300693 - protein, 22 aa, Cryptosporidium parvum
NNSHPCVVLGVLCDSESEFGNR

SEQ ID NO: 2300694 - protein, 24 aa, Cryptosporidium parvum
NNSKYPGICSYYPRSINSVNYSRS

SEQ ID NO: 2300695 - protein, 24 aa, Cryptosporidium parvum
NNSLKRMNVILSFQGILKNNSQTT

SEQ ID NO: 2300696 - protein, 21 aa, Cryptosporidium parvum
NNSRVLKVWFEDSEFIFDSIN

SEQ ID NO: 2300697 - protein, 27 aa, Cryptosporidium parvum
NNSSRFGRFIKLCLERSNGIVGGAISS

SEQ ID NO: 2300698 - protein, 27 aa, Cryptosporidium parvum
NNSTNPQLWCKISFIDLAGSERASATQ

SEQ ID NO: 2300699 - protein, 23 aa, Cryptosporidium parvum
NNTLKLPTVHNWISNNPEHSESL

SEQ ID NO: 2300700 - protein, 21 aa, Cryptosporidium parvum
NNTPKHEWKYLATQNNSPPAN

SEQ ID NO: 2300701 - protein, 19 aa, Cryptosporidium parvum
NNVGDLWKEEWREEIDTTN

SEQ ID NO: 2300702 - protein, 29 aa, Cryptosporidium parvum
NNVKNGYRFNICHCHDWLAAPVLTSLRRI

SEQ ID NO: 2300703 - protein, 24 aa, Cryptosporidium parvum
NNVNSNLLLPGFAGLGNFGNIPNF

SEQ ID NO: 2300704 - protein, 24 aa, Cryptosporidium parvum
NNVRITDIPFIWMNVVQRYQIVNS

SEQ ID NO: 2300705 - protein, 24 aa, Cryptosporidium parvum
NNVYICNFHGWKGGRNSQKCPECV

SEQ ID NO: 2300706 - protein, 23 aa, Cryptosporidium parvum
NNYCSMNWTTFRSSVESNLHNAT

SEQ ID NO: 2300707 - protein, 21 aa, Cryptosporidium parvum
NNYLNMHAHIRRHDYNINNNI

SEQ ID NO: 2300708 - protein, 24 aa, Cryptosporidium parvum
NNYYDRVSSLSFPNHNNNRVSSLS

SEQ ID NO: 2300709 - protein, 21 aa, Cryptosporidium parvum
NPAAIKRLLKDNVAVVILLEY

SEQ ID NO: 2300710 - protein, 17 aa, Cryptosporidium parvum
NPALYVLRERIRKGLQL

SEQ ID NO: 2300711 - protein, 22 aa, Cryptosporidium parvum
NPDCLYPILNICKNNRYLSPEI

SEQ ID NO: 2300712 - protein, 27 aa, Cryptosporidium parvum
NPDEYAVECLCQLIMTTGYYLDSNEKS

SEQ ID NO: 2300713 - protein, 19 aa, Cryptosporidium parvum
NPEMMRMMLNPQMIQSVLN

SEQ ID NO: 2300714 - protein, 21 aa, Cryptosporidium parvum
NPENFKTFVQILLRLFHDSPA

SEQ ID NO: 2300715 - protein, 17 aa, Cryptosporidium parvum
NPFFAHDLLSNSLNMNK

SEQ ID NO: 2300716 - protein, 20 aa, Cryptosporidium parvum
NPFQMICIALNKPCIEFYDL

SEQ ID NO: 2300717 - protein, 18 aa, Cryptosporidium parvum
NPGCVIKTVHPWFKSTAT

SEQ ID NO: 2300718 - protein, 20 aa, Cryptosporidium parvum
NPHIPQFIAKAPWYINQQES

SEQ ID NO: 2300719 - protein, 23 aa, Cryptosporidium parvum
NPIKRWISKKGKNRNQRNILSSF

SEQ ID NO: 2300720 - protein, 25 aa, Cryptosporidium parvum
NPKLSCSRKSCLINQKYSLFMSNLL

SEQ ID NO: 2300721 - protein, 17 aa, Cryptosporidium parvum
NPLEYEFGIIWSNCQEK

SEQ ID NO: 2300722 - protein, 17 aa, Cryptosporidium parvum
NPLFKKNEESFSMYSIR

SEQ ID NO: 2300723 - protein, 21 aa, Cryptosporidium parvum
NPLHSLVICHPDLHLIEQRFF

SEQ ID NO: 2300724 - protein, 33 aa, Cryptosporidium parvum
NPLKFSKIYSSFGIKPSKGILLYGPPGTGKTLI

SEQ ID NO: 2300725 - protein, 23 aa, Cryptosporidium parvum
NPLPELEVPSWVRYHSEIVGTNQ

SEQ ID NO: 2300726 - protein, 26 aa, Cryptosporidium parvum
NPLPGRPRCIWTLKNGIDPSLSGSQA

SEQ ID NO: 2300727 - protein, 17 aa, Cryptosporidium parvum
NPLPTKCTSTWSECYEK

SEQ ID NO: 2300728 - protein, 22 aa, Cryptosporidium parvum
NPNENPILCVWFAQKKGNYGFV

SEQ ID NO: 2300729 - protein, 24 aa, Cryptosporidium parvum
NPNFKLTDFMSFFEEYILPKFMES

SEQ ID NO: 2300730 - protein, 19 aa, Cryptosporidium parvum
NPNKLSWKLVRNNKYGKII

SEQ ID NO: 2300731 - protein, 28 aa, Cryptosporidium parvum
NPPFLICEFCSGGTLFNLLHGDSKKCLG

SEQ ID NO: 2300732 - protein, 19 aa, Cryptosporidium parvum
NPPGSFKPSFAQTVGAIVG

SEQ ID NO: 2300733 - protein, 25 aa, Cryptosporidium parvum
NPPLSSLQKFFALLISSRPIANNEA

SEQ ID NO: 2300734 - protein, 19 aa, Cryptosporidium parvum
NPQFCYALLHSQFILGMVN

SEQ ID NO: 2300735 - protein, 20 aa, Cryptosporidium parvum
NPRGFVCGLFNPSIPTDGVA

SEQ ID NO: 2300736 - protein, 20 aa, Cryptosporidium parvum
NPRINEFSLKYSRNQEIPNL

SEQ ID NO: 2300737 - protein, 24 aa, Cryptosporidium parvum
NPRSFRPIFRAVLRVLSAGFSSRL

SEQ ID NO: 2300738 - protein, 25 aa, Cryptosporidium parvum
NPSKMCLIHSIRLLDPIRRLKVVNI

SEQ ID NO: 2300739 - protein, 27 aa, Cryptosporidium parvum
NPSKYKDSICWATIKAVKEVYEPQVEY

SEQ ID NO: 2300740 - protein, 25 aa, Cryptosporidium parvum
NPSQLCDSCTFIFLYDKNTKQSIEK

SEQ ID NO: 2300741 - protein, 24 aa, Cryptosporidium parvum
NPTLKRSQLLQMLQKNWKKSPENP

SEQ ID NO: 2300742 - protein, 27 aa, Cryptosporidium parvum
NPVQMLIRLSRLFYFAGKYRESQNTLD

SEQ ID NO: 2300743 - protein, 20 aa, Cryptosporidium parvum
NPYCPVDFRSKVWTCPFSLQ

SEQ ID NO: 2300744 - protein, 22 aa, Cryptosporidium parvum
NPYFKSGHKFSASNPYGVRDKN

SEQ ID NO: 2300745 - protein, 26 aa, Cryptosporidium parvum
NQAKLVCFYCDLLLKNSYSEIGNDFN

SEQ ID NO: 2300746 - protein, 18 aa, Cryptosporidium parvum
NQALLALKLGKYNDSIQS

SEQ ID NO: 2300747 - protein, 20 aa, Cryptosporidium parvum
NQCGLFGYNNYCHYCKSSQD

SEQ ID NO: 2300748 - protein, 24 aa, Cryptosporidium parvum
NQDRPRLLPYLNRMLRELKKPYDC

SEQ ID NO: 2300749 - protein, 26 aa, Cryptosporidium parvum
NQEAISFPVIIRINPEYITGNKPHED

SEQ ID NO: 2300750 - protein, 26 aa, Cryptosporidium parvum
NQEFLKGIVKRSGRPGITLIDKNFNW

SEQ ID NO: 2300751 - protein, 26 aa, Cryptosporidium parvum
NQEILCYSCESWSTLDLILNKTKGAC

SEQ ID NO: 2300752 - protein, 18 aa, Cryptosporidium parvum
NQFEEIDEIYSLEFIYSE

SEQ ID NO: 2300753 - protein, 25 aa, Cryptosporidium parvum
NQFFFKRITPQGGEDSWIFSKNGNH

SEQ ID NO: 2300754 - protein, 19 aa, Cryptosporidium parvum
NQHKKKEKTLIVQEENVIE

SEQ ID NO: 2300755 - protein, 25 aa, Cryptosporidium parvum
NQHNSCPVCRFELPTDDEFYESRRR

SEQ ID NO: 2300756 - protein, 18 aa, Cryptosporidium parvum
NQIEELYKPLEYPKLCNR

SEQ ID NO: 2300757 - protein, 23 aa, Cryptosporidium parvum
NQIELPFSFSYWPLDAGNGYTNV

SEQ ID NO: 2300758 - protein, 17 aa, Cryptosporidium parvum
NQIISWLNFPFRLSSIV

SEQ ID NO: 2300759 - protein, 24 aa, Cryptosporidium parvum
NQILMKLRINYLINNNQVTEYSNV

SEQ ID NO: 2300760 - protein, 24 aa, Cryptosporidium parvum
NQIPNRRFTLWWSPTINRANVYIG

SEQ ID NO: 2300761 - protein, 23 aa, Cryptosporidium parvum
NQISNYWLLLVLAYEQLFGNLKI

SEQ ID NO: 2300762 - protein, 24 aa, Cryptosporidium parvum
NQKSYEHFNLLSPGRGDTRHTQLV

SEQ ID NO: 2300763 - protein, 20 aa, Cryptosporidium parvum
NQLESIPAFAPYDSVTLENF

SEQ ID NO: 2300764 - protein, 26 aa, Cryptosporidium parvum
NQLLCSLLERDPCRLNSSGLYSYNSN

SEQ ID NO: 2300765 - protein, 21 aa, Cryptosporidium parvum
NQLPRKLLRIATRPFHKIFSI

SEQ ID NO: 2300766 - protein, 26 aa, Cryptosporidium parvum
NQLYAFRLLQYQARIELKGRIGSEIF

SEQ ID NO: 2300767 - protein, 20 aa, Cryptosporidium parvum
NQNCTWSKLFPNINKVTEIF

SEQ ID NO: 2300768 - protein, 20 aa, Cryptosporidium parvum
NQNSELYINFVFSTKIPTHL

SEQ ID NO: 2300769 - protein, 24 aa, Cryptosporidium parvum
NQQFPQILSLILFVLTSYLENPQN

SEQ ID NO: 2300770 - protein, 20 aa, Cryptosporidium parvum
NQRIKEFISIIHLSDQTNSK

SEQ ID NO: 2300771 - protein, 19 aa, Cryptosporidium parvum
NQRRRLASLGKFRSKTSKL

SEQ ID NO: 2300772 - protein, 19 aa, Cryptosporidium parvum
NQSFIPNWYDSVIGGSGTE

SEQ ID NO: 2300773 - protein, 24 aa, Cryptosporidium parvum
NQSTLLDSLKFGGGLEPPQVSQYG

SEQ ID NO: 2300774 - protein, 25 aa, Cryptosporidium parvum
NQVKSDYILSPAIEQIIKVEPCRIP

SEQ ID NO: 2300775 - protein, 27 aa, Cryptosporidium parvum
NQYHKRLFRLFLLASYLKRGDKLVNLK

SEQ ID NO: 2300776 - protein, 19 aa, Cryptosporidium parvum
NQYKTNCETNMTSEQTKKR

SEQ ID NO: 2300777 - protein, 22 aa, Cryptosporidium parvum
NQYPMFRSGYLGYPYNPINYYR

SEQ ID NO: 2300778 - protein, 25 aa, Cryptosporidium parvum
NRASEFKTLCELLRTHYQLLVSNRH

SEQ ID NO: 2300779 - protein, 17 aa, Cryptosporidium parvum
NRDDLFFIVNTKDENNN

SEQ ID NO: 2300780 - protein, 22 aa, Cryptosporidium parvum
NRDISLIVIKSFLALRRKNLSE

SEQ ID NO: 2300781 - protein, 19 aa, Cryptosporidium parvum
NRDRMRGIYGMNDTKNSLE

SEQ ID NO: 2300782 - protein, 18 aa, Cryptosporidium parvum
NREILKQTKIGVVMTAVK

SEQ ID NO: 2300783 - protein, 19 aa, Cryptosporidium parvum
NRESFDVAKEHYLRGQQEW

SEQ ID NO: 2300784 - protein, 22 aa, Cryptosporidium parvum
NRFDDEFMRRMETPEMLVNRLN

SEQ ID NO: 2300785 - protein, 17 aa, Cryptosporidium parvum
NRFNIDDLVVWKYSNPY

SEQ ID NO: 2300786 - protein, 20 aa, Cryptosporidium parvum
NRFREYPAHSSFTQRNRIGI

SEQ ID NO: 2300787 - protein, 30 aa, Cryptosporidium parvum
NRFWTEIYNGAKLFYLSGIHNGFYNKTEIR

SEQ ID NO: 2300788 - protein, 19 aa, Cryptosporidium parvum
NRGIIYISRIPPKMQPHHI

SEQ ID NO: 2300789 - protein, 18 aa, Cryptosporidium parvum
NRGLHSFGSVDIRSNQGG

SEQ ID NO: 2300790 - protein, 18 aa, Cryptosporidium parvum
NRGYVAVMCRDSRQKAGG

SEQ ID NO: 2300791 - protein, 17 aa, Cryptosporidium parvum
NRHPNILNLIGGIRINE

SEQ ID NO: 2300792 - protein, 22 aa, Cryptosporidium parvum
NRHPYIRYSYNFEQDRNRRVAL

SEQ ID NO: 2300793 - protein, 26 aa, Cryptosporidium parvum
NRICKSYFQLCQRLKEYLRNMSPFFK

SEQ ID NO: 2300794 - protein, 24 aa, Cryptosporidium parvum
NRIKLFKDEVCWSINKSQDSMTTQ

SEQ ID NO: 2300795 - protein, 17 aa, Cryptosporidium parvum
NRIKSYYLINNDSGQII

SEQ ID NO: 2300796 - protein, 17 aa, Cryptosporidium parvum
NRILFDDSTCIYINTDE

SEQ ID NO: 2300797 - protein, 19 aa, Cryptosporidium parvum
NRITMCFEDNSGILSSKEC

SEQ ID NO: 2300798 - protein, 17 aa, Cryptosporidium parvum
NRIVIELPCRGKSWNNP

SEQ ID NO: 2300799 - protein, 23 aa, Cryptosporidium parvum
NRIYIGSVPYSFTTDDLRHIFKT

SEQ ID NO: 2300800 - protein, 25 aa, Cryptosporidium parvum
NRKKLLEEWGLPGTYVTLWLKEELG

SEQ ID NO: 2300801 - protein, 24 aa, Cryptosporidium parvum
NRKKRYILGQNVGKWTDEEHNRFV

SEQ ID NO: 2300802 - protein, 19 aa, Cryptosporidium parvum
NRKLPSYMKSTISSRNKSV

SEQ ID NO: 2300803 - protein, 23 aa, Cryptosporidium parvum
NRKPRVAHAVSMLSDHLYKYQGY

SEQ ID NO: 2300804 - protein, 25 aa, Cryptosporidium parvum
NRKRHSRHFYVKKYGFNEAKKLAIQ

SEQ ID NO: 2300805 - protein, 18 aa, Cryptosporidium parvum
NRKRVSLIHTYRRRSNIS

SEQ ID NO: 2300806 - protein, 21 aa, Cryptosporidium parvum
NRKRWKVLGDIALEKGRFSMA

SEQ ID NO: 2300807 - protein, 21 aa, Cryptosporidium parvum
NRKSFSGFVPISISILKDNLL

SEQ ID NO: 2300808 - protein, 18 aa, Cryptosporidium parvum
NRLAPQIFIETSISSFLS

SEQ ID NO: 2300809 - protein, 20 aa, Cryptosporidium parvum
NRLASGYARLIHSFIMDQNP

SEQ ID NO: 2300810 - protein, 17 aa, Cryptosporidium parvum
NRLDDRFVTNFQVLENV

SEQ ID NO: 2300811 - protein, 31 aa, Cryptosporidium parvum
NRLEEVCHRLRLQSFCFMWMLPEHALLNSII

SEQ ID NO: 2300812 - protein, 19 aa, Cryptosporidium parvum
NRLILTIGSKGIFRLWKVI

SEQ ID NO: 2300813 - protein, 17 aa, Cryptosporidium parvum
NRLKCINTFSGTCFSLF

SEQ ID NO: 2300814 - protein, 18 aa, Cryptosporidium parvum
NRLKEENQRLLAENEKLK

SEQ ID NO: 2300815 - protein, 24 aa, Cryptosporidium parvum
NRLNLRGLNEFDLKESRLSMSFDA

SEQ ID NO: 2300816 - protein, 20 aa, Cryptosporidium parvum
NRLNRWLLKRIIASESHENT

SEQ ID NO: 2300817 - protein, 29 aa, Cryptosporidium parvum
NRLPIATTCGFRLSLPRYSSIEILRSRLL

SEQ ID NO: 2300818 - protein, 17 aa, Cryptosporidium parvum
NRMDFELNMEFEKTGNP

SEQ ID NO: 2300819 - protein, 18 aa, Cryptosporidium parvum
NRPESGCIIRIHDEIANT

SEQ ID NO: 2300820 - protein, 27 aa, Cryptosporidium parvum
NRPHANMAFPTIEVWCPGLNEHGEFPS

SEQ ID NO: 2300821 - protein, 17 aa, Cryptosporidium parvum
NRPHLLGLEALKSNQNY

SEQ ID NO: 2300822 - protein, 29 aa, Cryptosporidium parvum
NRPKWWQLCFCKPIISVTLFARIISDEIL

SEQ ID NO: 2300823 - protein, 22 aa, Cryptosporidium parvum
NRPVPKRGFIPSKWEAKKITHL

SEQ ID NO: 2300824 - protein, 25 aa, Cryptosporidium parvum
NRQDLKNQFFLASLCCVDVILLDDV

SEQ ID NO: 2300825 - protein, 26 aa, Cryptosporidium parvum
NRQEKLNVLESFTFELFCSIRQHFLS

SEQ ID NO: 2300826 - protein, 25 aa, Cryptosporidium parvum
NRQGSSNLVYWRLKGGVSTSINIPD

SEQ ID NO: 2300827 - protein, 24 aa, Cryptosporidium parvum
NRQREYGRRIGFNIEESGKNIINS

SEQ ID NO: 2300828 - protein, 30 aa, Cryptosporidium parvum
NRQWESLSSKSGWNKKQLFGNEVNIITKKQ

SEQ ID NO: 2300829 - protein, 23 aa, Cryptosporidium parvum
NRRCILNRLQAWNGAPLSGAGHP

SEQ ID NO: 2300830 - protein, 21 aa, Cryptosporidium parvum
NRRLSESYKLFLNGQNDGGLL

SEQ ID NO: 2300831 - protein, 20 aa, Cryptosporidium parvum
NRRLSTCNSIRSDKDNDPNI

SEQ ID NO: 2300832 - protein, 23 aa, Cryptosporidium parvum
NRRRGRSNLNVIFEEAESSEGSS

SEQ ID NO: 2300833 - protein, 22 aa, Cryptosporidium parvum
NRRVGLGCLTRGPSNVVENSIL

SEQ ID NO: 2300834 - protein, 20 aa, Cryptosporidium parvum
NRSSELRLIIAPLALALVPV

SEQ ID NO: 2300835 - protein, 21 aa, Cryptosporidium parvum
NRTRDGYCLSNNFDKKKLNHG

SEQ ID NO: 2300836 - protein, 27 aa, Cryptosporidium parvum
NRVHFFTLRMNDLLQRHIEDVDTLNKK

SEQ ID NO: 2300837 - protein, 20 aa, Cryptosporidium parvum
NRVLPRKGVEVRLLDRSGRG

SEQ ID NO: 2300838 - protein, 26 aa, Cryptosporidium parvum
NRVNKCKTRYGAILNFLIANSSAIPI

SEQ ID NO: 2300839 - protein, 26 aa, Cryptosporidium parvum
NRVRLLFRKGMKCYRPRRTGEMKRKS

SEQ ID NO: 2300840 - protein, 17 aa, Cryptosporidium parvum
NRVSYTLGLTGSSVTVD

SEQ ID NO: 2300841 - protein, 17 aa, Cryptosporidium parvum
NRYDYNLQFGIDKDNSN

SEQ ID NO: 2300842 - protein, 20 aa, Cryptosporidium parvum
NRYGFNFLKNPSLDFCLGFG

SEQ ID NO: 2300843 - protein, 24 aa, Cryptosporidium parvum
NRYKEVIPEACDYITIEKRLNNKS

SEQ ID NO: 2300844 - protein, 18 aa, Cryptosporidium parvum
NRYKICIGIPYTTFINIL

SEQ ID NO: 2300845 - protein, 18 aa, Cryptosporidium parvum
NSALRSAIETIRRTKNDS

SEQ ID NO: 2300846 - protein, 19 aa, Cryptosporidium parvum
NSARVCLYDTLTFTLVSTV

SEQ ID NO: 2300847 - protein, 19 aa, Cryptosporidium parvum
NSAVPRWFAKGKRLSSSVL

SEQ ID NO: 2300848 - protein, 24 aa, Cryptosporidium parvum
NSCELFKFTLDYLKNNTIGGKDVL

SEQ ID NO: 2300849 - protein, 26 aa, Cryptosporidium parvum
NSCISVPTGSFLIRAFYSNNGVNNNN

SEQ ID NO: 2300850 - protein, 24 aa, Cryptosporidium parvum
NSCRDLSLLKGFRLTSNLLGHLTY

SEQ ID NO: 2300851 - protein, 18 aa, Cryptosporidium parvum
NSDDFCFLLSTKAGGLGI

SEQ ID NO: 2300852 - protein, 23 aa, Cryptosporidium parvum
NSDDWKYGGAMFGPGNNSTVHAS

SEQ ID NO: 2300853 - protein, 27 aa, Cryptosporidium parvum
NSEAPTSYFPVMGFLSERRRLDEMPEI

SEQ ID NO: 2300854 - protein, 21 aa, Cryptosporidium parvum
NSECYKIPPIFNEQAEGVEME

SEQ ID NO: 2300855 - protein, 37 aa, Cryptosporidium parvum
NSEGEIYYYPGYFFQRIICSLSQFFTSSFYVSIASGV

SEQ ID NO: 2300856 - protein, 29 aa, Cryptosporidium parvum
NSEKGYKSWWALKSEIFNLIQMTKQSCNK

SEQ ID NO: 2300857 - protein, 23 aa, Cryptosporidium parvum
NSEKPSSFCIYRYNDGCTDAVKM

SEQ ID NO: 2300858 - protein, 18 aa, Cryptosporidium parvum
NSELAMLHMERMRRKNSE

SEQ ID NO: 2300859 - protein, 24 aa, Cryptosporidium parvum
NSESSIYLSLETEFCRKIDNSSTN

SEQ ID NO: 2300860 - protein, 25 aa, Cryptosporidium parvum
NSEVKNKFIGHGIDIIMEEFRCLKE

SEQ ID NO: 2300861 - protein, 32 aa, Cryptosporidium parvum
NSEVSELRDEVKFWRCRAEASSKEQGKVLIRS

SEQ ID NO: 2300862 - protein, 18 aa, Cryptosporidium parvum
NSFINLSLPLYVITEPLP

SEQ ID NO: 2300863 - protein, 25 aa, Cryptosporidium parvum
NSFSDEIPLCIVLKAMGIETEQEIF

SEQ ID NO: 2300864 - protein, 21 aa, Cryptosporidium parvum
NSFSFSLIRIMFKKRNVSKEQ

SEQ ID NO: 2300865 - protein, 18 aa, Cryptosporidium parvum
NSFTANYQVKFCDQILPT

SEQ ID NO: 2300866 - protein, 18 aa, Cryptosporidium parvum
NSGFKKSIILSYLVSSGY

SEQ ID NO: 2300867 - protein, 21 aa, Cryptosporidium parvum
NSGKEGVFVRVGRELVGRIKL

SEQ ID NO: 2300868 - protein, 20 aa, Cryptosporidium parvum
NSGNGFGYVKLKIESEDDIW

SEQ ID NO: 2300869 - protein, 23 aa, Cryptosporidium parvum
NSGRLHWLRVMYHYLDTVDARKI

SEQ ID NO: 2300870 - protein, 18 aa, Cryptosporidium parvum
NSGSCGRSTCVKSSVECV

SEQ ID NO: 2300871 - protein, 19 aa, Cryptosporidium parvum
NSHAFKCINPKPLRTGSIC

SEQ ID NO: 2300872 - protein, 19 aa, Cryptosporidium parvum
NSHFKYKVHDNIIIEYIII

SEQ ID NO: 2300873 - protein, 19 aa, Cryptosporidium parvum
NSHLYYKEFEGLSNDGAHI

SEQ ID NO: 2300874 - protein, 24 aa, Cryptosporidium parvum
NSIAEAFSLIPLEAEKGAIFENHV

SEQ ID NO: 2300875 - protein, 24 aa, Cryptosporidium parvum
NSICIRCLKIHPKEHCRKARCQIC

SEQ ID NO: 2300876 - protein, 20 aa, Cryptosporidium parvum
NSIIKGCFEKVEILNSNKLK

SEQ ID NO: 2300877 - protein, 24 aa, Cryptosporidium parvum
NSIIRYMRRWNYLSLVMLPPNNST

SEQ ID NO: 2300878 - protein, 17 aa, Cryptosporidium parvum
NSIKRANTNTSRRNNRI

SEQ ID NO: 2300879 - protein, 19 aa, Cryptosporidium parvum
NSINWRIFLSKSISPSFEK

SEQ ID NO: 2300880 - protein, 22 aa, Cryptosporidium parvum
NSIPLFRNRFFESFEKSRSKNN

SEQ ID NO: 2300881 - protein, 35 aa, Cryptosporidium parvum
NSIQFKISRYFLEVMKAIILSGGYGSRLRPLTLTK

SEQ ID NO: 2300882 - protein, 22 aa, Cryptosporidium parvum
NSIRLKNQFLQMIDGVQSDLSK

SEQ ID NO: 2300883 - protein, 17 aa, Cryptosporidium parvum
NSIRLPIPISSLKKNKR

SEQ ID NO: 2300884 - protein, 30 aa, Cryptosporidium parvum
NSITELWSLLNFLLPQVFHSVEDFQVWFSK

SEQ ID NO: 2300885 - protein, 22 aa, Cryptosporidium parvum
NSIYFKEIELIQEFEKTLKCEI

SEQ ID NO: 2300886 - protein, 24 aa, Cryptosporidium parvum
NSKAPMKLLFCREDPYNRPIYSDF

SEQ ID NO: 2300887 - protein, 25 aa, Cryptosporidium parvum
NSKDFLKVMFLQSMLGEYGTNNINR

SEQ ID NO: 2300888 - protein, 27 aa, Cryptosporidium parvum
NSKELMWKCLVCNQVFESRNKLFAHVK

SEQ ID NO: 2300889 - protein, 25 aa, Cryptosporidium parvum
NSKEVIKCKSILGSLTNLSKYLKNS

SEQ ID NO: 2300890 - protein, 21 aa, Cryptosporidium parvum
NSKFISCCDFPSPFPNKESSI

SEQ ID NO: 2300891 - protein, 24 aa, Cryptosporidium parvum
NSKHGSYIFPEWVDEELYNLIPNH

SEQ ID NO: 2300892 - protein, 27 aa, Cryptosporidium parvum
NSKIIKQGRVNSVVVFFDLWIDDGNVL

SEQ ID NO: 2300893 - protein, 22 aa, Cryptosporidium parvum
NSKISFLLNRPLIMSIQDFIAT

SEQ ID NO: 2300894 - protein, 20 aa, Cryptosporidium parvum
NSKKKCPWIILSGNEKSGLQ

SEQ ID NO: 2300895 - protein, 27 aa, Cryptosporidium parvum
NSKKLVNKFCRLFSGMPFELPPLPYDK

SEQ ID NO: 2300896 - protein, 21 aa, Cryptosporidium parvum
NSKLDHIQILLGFNTKSEIIK

SEQ ID NO: 2300897 - protein, 23 aa, Cryptosporidium parvum
NSKLSVPFSTWISGEKMDRKRSS

SEQ ID NO: 2300898 - protein, 27 aa, Cryptosporidium parvum
NSKMVSSGICINGKYELIGNEINIVHT

SEQ ID NO: 2300899 - protein, 22 aa, Cryptosporidium parvum
NSKNWFKECLDQREATQSVELT

SEQ ID NO: 2300900 - protein, 17 aa, Cryptosporidium parvum
NSKWWISFHKGGCATFV

SEQ ID NO: 2300901 - protein, 20 aa, Cryptosporidium parvum
NSLFKRKPGKHMASETNREH

SEQ ID NO: 2300902 - protein, 21 aa, Cryptosporidium parvum
NSLFKSHRIMLPPNVQGRVVR

SEQ ID NO: 2300903 - protein, 17 aa, Cryptosporidium parvum
NSLFPYPGSQIEWNNTM

SEQ ID NO: 2300904 - protein, 26 aa, Cryptosporidium parvum
NSLGFKLFVDKCCDYYRYIRRKSWLI

SEQ ID NO: 2300905 - protein, 19 aa, Cryptosporidium parvum
NSLILLLTSYCNWDEQIAD

SEQ ID NO: 2300906 - protein, 17 aa, Cryptosporidium parvum
NSLKEARDLGVSDLQNV

SEQ ID NO: 2300907 - protein, 24 aa, Cryptosporidium parvum
NSLKELFTLLNFLYPDILQDSEIF

SEQ ID NO: 2300908 - protein, 31 aa, Cryptosporidium parvum
NSLKLMLGLMLKGPLFMRSCKDTINERSQGY

SEQ ID NO: 2300909 - protein, 22 aa, Cryptosporidium parvum
NSLLEVLEKIIFHVNNTEFSQN

SEQ ID NO: 2300910 - protein, 22 aa, Cryptosporidium parvum
NSLLEWFGVIIIPKTFSLSLLI

SEQ ID NO: 2300911 - protein, 21 aa, Cryptosporidium parvum
NSLLNPSILGWGLFSYSSLFN

SEQ ID NO: 2300912 - protein, 17 aa, Cryptosporidium parvum
NSLLSRGEKFPFGIQPT

SEQ ID NO: 2300913 - protein, 22 aa, Cryptosporidium parvum
NSLNNFFGIKFEQRYNNNNNNN

SEQ ID NO: 2300914 - protein, 20 aa, Cryptosporidium parvum
NSLPIGKIRNIWKGLQSTVL

SEQ ID NO: 2300915 - protein, 22 aa, Cryptosporidium parvum
NSLPKFISCNINDISCECPDSK

SEQ ID NO: 2300916 - protein, 22 aa, Cryptosporidium parvum
NSLRRKLIHLVNWELGTSGDEG

SEQ ID NO: 2300917 - protein, 17 aa, Cryptosporidium parvum
NSLVYPILGTKIIFEDD

SEQ ID NO: 2300918 - protein, 23 aa, Cryptosporidium parvum
NSLYCFLDSMKLWLSEYDSDALI

SEQ ID NO: 2300919 - protein, 21 aa, Cryptosporidium parvum
NSLYICEEFLLFGSSGQEVSE

SEQ ID NO: 2300920 - protein, 27 aa, Cryptosporidium parvum
NSLYSDDHWWYIFKKKFNMSTKGGISE

SEQ ID NO: 2300921 - protein, 37 aa, Cryptosporidium parvum
NSMDWKIECINSLYKHWLRKKCNNYLVMIRCSIKFFS

SEQ ID NO: 2300922 - protein, 24 aa, Cryptosporidium parvum
NSMKGHAWKDIFHDNTVTWLAYYR

SEQ ID NO: 2300923 - protein, 23 aa, Cryptosporidium parvum
NSMRCKMNFLYLKVSTFEEYDVE

SEQ ID NO: 2300924 - protein, 27 aa, Cryptosporidium parvum
NSNCPYKYKICEEAAKYVFNMLVQVNS

SEQ ID NO: 2300925 - protein, 24 aa, Cryptosporidium parvum
NSNKLKGKFLASIFRVSIGHLLDT

SEQ ID NO: 2300926 - protein, 23 aa, Cryptosporidium parvum
NSNLMEWDKLWTINKQLMDPVVP

SEQ ID NO: 2300927 - protein, 22 aa, Cryptosporidium parvum
NSNMCLVFEKLGPSLFDFLDGN

SEQ ID NO: 2300928 - protein, 23 aa, Cryptosporidium parvum
NSNNIPSFTGFVSNIKSFFNDER

SEQ ID NO: 2300929 - protein, 23 aa, Cryptosporidium parvum
NSNPDLWLSWLLMGRNNSKENDT

SEQ ID NO: 2300930 - protein, 24 aa, Cryptosporidium parvum
NSPDAPCYFALIFSGMNSEGLDVR

SEQ ID NO: 2300931 - protein, 34 aa, Cryptosporidium parvum
NSPKKKLECSVHWMYRSERGWMPFSERNNVYIES

SEQ ID NO: 2300932 - protein, 21 aa, Cryptosporidium parvum
NSPKYRFVVRLTNTKVICQII

SEQ ID NO: 2300933 - protein, 27 aa, Cryptosporidium parvum
NSPLILEKFHPIWIRKIIDERRNLVLK

SEQ ID NO: 2300934 - protein, 18 aa, Cryptosporidium parvum
NSPLRIVEEGQIDDEEHI

SEQ ID NO: 2300935 - protein, 22 aa, Cryptosporidium parvum
NSQCEIKFLVTKTFMRMDSACV

SEQ ID NO: 2300936 - protein, 25 aa, Cryptosporidium parvum
NSQTQQIWSIYSLCNHNSKFENFEI

SEQ ID NO: 2300937 - protein, 21 aa, Cryptosporidium parvum
NSQVRLRLRGVNNETLSAVAE

SEQ ID NO: 2300938 - protein, 22 aa, Cryptosporidium parvum
NSRENKILFTRVKQGTYVYGRL

SEQ ID NO: 2300939 - protein, 18 aa, Cryptosporidium parvum
NSRILKVIMHEYGHLMKL

SEQ ID NO: 2300940 - protein, 22 aa, Cryptosporidium parvum
NSRLFARRITKNYSNEHPYINP

SEQ ID NO: 2300941 - protein, 28 aa, Cryptosporidium parvum
NSRVFRPASKWRRPMNAIGDGIYNLENS

SEQ ID NO: 2300942 - protein, 25 aa, Cryptosporidium parvum
NSRVKGMLVLGELLISWDKETIIVS

SEQ ID NO: 2300943 - protein, 25 aa, Cryptosporidium parvum
NSSCKCDACNGAGIIKGLKLAKCSN

SEQ ID NO: 2300944 - protein, 18 aa, Cryptosporidium parvum
NSSGFILNFETWKYAKSR

SEQ ID NO: 2300945 - protein, 18 aa, Cryptosporidium parvum
NSSHPAFGFEQEKHYNSH

SEQ ID NO: 2300946 - protein, 22 aa, Cryptosporidium parvum
NSSKWPRLSYKDSPLKKTSATS

SEQ ID NO: 2300947 - protein, 34 aa, Cryptosporidium parvum; identical to SEQ ID NO: 2178701

SEQ ID NO: 2300948 - protein, 27 aa, Cryptosporidium parvum
NSSNISACFSWPIINLVTDTTSNKPGK

SEQ ID NO: 2300949 - protein, 30 aa, Cryptosporidium parvum; identical to SEQ ID NO: 2178704

SEQ ID NO: 2300950 - protein, 24 aa, Cryptosporidium parvum
NSSTALSTVVAWPRGDGCSEAIDA

SEQ ID NO: 2300951 - protein, 26 aa, Cryptosporidium parvum
NSSYLYRLIIVIAEISLVLCKSGEVD

SEQ ID NO: 2300952 - protein, 24 aa, Cryptosporidium parvum
NSTEDLRVLSAMNILKFDKELEPA

SEQ ID NO: 2300953 - protein, 19 aa, Cryptosporidium parvum
NSTEKVWQSAFIRPDGGSF

SEQ ID NO: 2300954 - protein, 18 aa, Cryptosporidium parvum
NSTKRCFQRLPPAIRRRS

SEQ ID NO: 2300955 - protein, 17 aa, Cryptosporidium parvum
NSTLVSCIECCISYFSR

SEQ ID NO: 2300956 - protein, 23 aa, Cryptosporidium parvum
NSTRLVHFSKLYINIIVYQNSFN

SEQ ID NO: 2300957 - protein, 24 aa, Cryptosporidium parvum
NSTVKFSKCRIITLYRELNRFKDH

SEQ ID NO: 2300958 - protein, 28 aa, Cryptosporidium parvum
NSVCCTTCLKKSFNIIFGINKKFDYPFS

SEQ ID NO: 2300959 - protein, 18 aa, Cryptosporidium parvum
NSVLLSAVLQVIASIQKL

SEQ ID NO: 2300960 - protein, 21 aa, Cryptosporidium parvum
NSVMVKSEILSGSKKEKDQMI

SEQ ID NO: 2300961 - protein, 19 aa, Cryptosporidium parvum
NSYAAFPLPQGVGMSPHML

SEQ ID NO: 2300962 - protein, 25 aa, Cryptosporidium parvum
NSYFIKPYYVIKQLEGIEEGGGSNM

SEQ ID NO: 2300963 - protein, 17 aa, Cryptosporidium parvum
NSYIPRSLTHKWVDYKT

SEQ ID NO: 2300964 - protein, 21 aa, Cryptosporidium parvum
NSYKFTNIKSFSNFMKDFGNE

SEQ ID NO: 2300965 - protein, 18 aa, Cryptosporidium parvum
NSYLNCLDSFSGDTSHVI

SEQ ID NO: 2300966 - protein, 22 aa, Cryptosporidium parvum
NTCSLKELFNEMLITAKNNNCD

SEQ ID NO: 2300967 - protein, 23 aa, Cryptosporidium parvum
NTCSWLDNKHVVFGQLLGHDSFA

SEQ ID NO: 2300968 - protein, 25 aa, Cryptosporidium parvum
NTDEYKHSIGFRMDVSKHLNTDILD

SEQ ID NO: 2300969 - protein, 23 aa, Cryptosporidium parvum
NTDIYGKCLLVPELCSKGDEPLV

SEQ ID NO: 2300970 - protein, 20 aa, Cryptosporidium parvum
NTDKVILLWTGCTPTSKDME

SEQ ID NO: 2300971 - protein, 23 aa, Cryptosporidium parvum
NTDSIFSGHCERLDGKPIKLNSS

SEQ ID NO: 2300972 - protein, 24 aa, Cryptosporidium parvum
NTEELWPLLNYIEPIKFASIEAFT

SEQ ID NO: 2300973 - protein, 24 aa, Cryptosporidium parvum
NTEFFSMGFSPKFTWSAPTDATWI

SEQ ID NO: 2300974 - protein, 24 aa, Cryptosporidium parvum
NTELKADINALLLLEKQDQTSYIN

SEQ ID NO: 2300975 - protein, 25 aa, Cryptosporidium parvum
NTEQFGDLCCITFTPSGEHIFATSK

SEQ ID NO: 2300976 - protein, 18 aa, Cryptosporidium parvum
NTFAHYIWNKELELRRSD

SEQ ID NO: 2300977 - protein, 23 aa, Cryptosporidium parvum
NTFECDYPTFGFAITNGDPILNT

SEQ ID NO: 2300978 - protein, 19 aa, Cryptosporidium parvum
NTFIPVFLNYAVDNPEIIS

SEQ ID NO: 2300979 - protein, 25 aa, Cryptosporidium parvum
NTFPNCKRFYCPFIHDSETNLINFN

SEQ ID NO: 2300980 - protein, 19 aa, Cryptosporidium parvum
NTFYGRYISDLGCYLQPAT

SEQ ID NO: 2300981 - protein, 17 aa, Cryptosporidium parvum
NTGGSWKNQNGGDHTYG

SEQ ID NO: 2300982 - protein, 22 aa, Cryptosporidium parvum
NTGTLLLDCFGLGDDRQTLHIK

SEQ ID NO: 2300983 - protein, 18 aa, Cryptosporidium parvum
NTGYKVSTSMLFDIQVKR

SEQ ID NO: 2300984 - protein, 30 aa, Cryptosporidium parvum; identical to SEQ ID NO: 2178735

SEQ ID NO: 2300985 - protein, 25 aa, Cryptosporidium parvum
NTIDYKIWLAKCIDLSQMDEDDKKR

SEQ ID NO: 2300986 - protein, 25 aa, Cryptosporidium parvum
NTIFWSIKDVESFDKVQNKRIINKM

SEQ ID NO: 2300987 - protein, 20 aa, Cryptosporidium parvum
NTILCPWVHIEGIVEEITLR

SEQ ID NO: 2300988 - protein, 18 aa, Cryptosporidium parvum
NTIYLWLGANTILEYPLE

SEQ ID NO: 2300989 - protein, 17 aa, Cryptosporidium parvum
NTIYPLLRRRLTLNDLI

SEQ ID NO: 2300990 - protein, 25 aa, Cryptosporidium parvum
NTKIRLQMVDAFWRIQTRPSKRNLV

SEQ ID NO: 2300991 - protein, 18 aa, Cryptosporidium parvum
NTKLDHMSKLSLDKNKMD

SEQ ID NO: 2300992 - protein, 26 aa, Cryptosporidium parvum
NTKRSFPRFEFEDHFQVSLLDSQQYN

SEQ ID NO: 2300993 - protein, 17 aa, Cryptosporidium parvum
NTLFPYDHRTLVILDDI

SEQ ID NO: 2300994 - protein, 19 aa, Cryptosporidium parvum
NTLGDWVSKIGLRQESRKA

SEQ ID NO: 2300995 - protein, 23 aa, Cryptosporidium parvum
NTLGGGGLFGFGSNSSQQNPIGG

SEQ ID NO: 2300996 - protein, 17 aa, Cryptosporidium parvum
NTLKGPYNMAIEFFTLE

SEQ ID NO: 2300997 - protein, 29 aa, Cryptosporidium parvum
NTLLLMYIGYLCYYMMLKTSPDINIKEHP

SEQ ID NO: 2300998 - protein, 18 aa, Cryptosporidium parvum
NTLLSLMFFFDIISRSNK

SEQ ID NO: 2300999 - protein, 32 aa, Cryptosporidium parvum; identical to SEQ ID NO: 2178747

SEQ ID NO: 2301000 - protein, 24 aa, Cryptosporidium parvum
NTLSAIKWNFSRFLIDKNGKVVAF

SEQ ID NO: 2301001 - protein, 17 aa, Cryptosporidium parvum
NTLYIVYHIHLFANGPH

SEQ ID NO: 2301002 - protein, 26 aa, Cryptosporidium parvum
NTMKDKWRLLPYFLKTEGLVKHHIDS

SEQ ID NO: 2301003 - protein, 18 aa, Cryptosporidium parvum
NTMSSASVFSWLPVYHDM

SEQ ID NO: 2301004 - protein, 25 aa, Cryptosporidium parvum
NTNRKELMHAIGISTGMSEVLNLSI

SEQ ID NO: 2301005 - protein, 23 aa, Cryptosporidium parvum
NTPLCGVCALPVSTESTVNTHYF

SEQ ID NO: 2301006 - protein, 33 aa, Cryptosporidium parvum; identical to SEQ ID NO: 2178757

SEQ ID NO: 2301007 - protein, 23 aa, Cryptosporidium parvum
NTQLKIQVSRLIEGIELDSQIQI

SEQ ID NO: 2301008 - protein, 17 aa, Cryptosporidium parvum
NTQLKKSAWEYFDSLHS

SEQ ID NO: 2301009 - protein, 18 aa, Cryptosporidium parvum
NTQVPFQLVEYVHRASGG

SEQ ID NO: 2301010 - protein, 18 aa, Cryptosporidium parvum
NTQYKVFNFRKSISTLKF

SEQ ID NO: 2301011 - protein, 23 aa, Cryptosporidium parvum
NTRRKRGTGGIDVGTFELNSTRS

SEQ ID NO: 2301012 - protein, 22 aa, Cryptosporidium parvum
NTRSCSIVSIFNLNNSNKISCI

SEQ ID NO: 2301013 - protein, 31 aa, Cryptosporidium parvum; identical to SEQ ID NO: 2178762

SEQ ID NO: 2301014 - protein, 23 aa, Cryptosporidium parvum
NTSEFIKFSWLPPKLDNLNQCQN

SEQ ID NO: 2301015 - protein, 24 aa, Cryptosporidium parvum
NTSFKPGDILGIMGSIGSGKSLLI

SEQ ID NO: 2301016 - protein, 19 aa, Cryptosporidium parvum
NTSFRWGEIHNKISNVDPA

SEQ ID NO: 2301017 - protein, 24 aa, Cryptosporidium parvum
NTSKCFQCGLPTKGTFNIASIPQE

SEQ ID NO: 2301018 - protein, 35 aa, Cryptosporidium parvum; identical to SEQ ID NO: 2178764

SEQ ID NO: 2301019 - protein, 24 aa, Cryptosporidium parvum
NTSSEPIKGIGITIAQIHLIILEI

SEQ ID NO: 2301020 - protein, 18 aa, Cryptosporidium parvum
NTSSLPYLVRYQLESSTI

SEQ ID NO: 2301021 - protein, 22 aa, Cryptosporidium parvum
NTSYRGGGFLFKLKDNILDKMS

SEQ ID NO: 2301022 - protein, 26 aa, Cryptosporidium parvum
NTTISNRVSYVFGMRGPSMTVDTACA

SEQ ID NO: 2301023 - protein, 21 aa, Cryptosporidium parvum
NTVFDYKLRIDVLESESKDKS

SEQ ID NO: 2301024 - protein, 17 aa, Cryptosporidium parvum
NTVILQLYMRVVEEYSS

SEQ ID NO: 2301025 - protein, 26 aa, Cryptosporidium parvum
NTVMIPHSWTILREEYIPIIFFDIYA

SEQ ID NO: 2301026 - protein, 17 aa, Cryptosporidium parvum
NTYRSGNLPILYNENNM

SEQ ID NO: 2301027 - protein, 19 aa, Cryptosporidium parvum
NVACIRLPKRIKYVESGNG

SEQ ID NO: 2301028 - protein, 25 aa, Cryptosporidium parvum
NVDAAPGCIGFKYHGTDQIICATGK

SEQ ID NO: 2301029 - protein, 20 aa, Cryptosporidium parvum
NVDIKIRFFPLRTLTLYLLY

SEQ ID NO: 2301030 - protein, 18 aa, Cryptosporidium parvum
NVEFLPRNGTGVIVISPT

SEQ ID NO: 2301031 - protein, 23 aa, Cryptosporidium parvum
NVEKAMWSAFVSVRHTLAKYCDR

SEQ ID NO: 2301032 - protein, 18 aa, Cryptosporidium parvum
NVEKYSCFEHSSNIDRLS

SEQ ID NO: 2301033 - protein, 30 aa, Cryptosporidium parvum
NVERLSCLMKRFGIPEVPIITLFAKVCSQN

SEQ ID NO: 2301034 - protein, 28 aa, Cryptosporidium parvum
NVESIPPRSVHILMGKTFSRDNNIDKKI

SEQ ID NO: 2301035 - protein, 24 aa, Cryptosporidium parvum
NVGIPGICRNNPMNVGTSPNGRLQ

SEQ ID NO: 2301036 - protein, 27 aa, Cryptosporidium parvum
NVGKIASVNRRLRENTNSSQKASKSSL

SEQ ID NO: 2301037 - protein, 19 aa, Cryptosporidium parvum
NVHHFPLSISIGYINGKEG

SEQ ID NO: 2301038 - protein, 25 aa, Cryptosporidium parvum
NVIREVGCCHIKYIMPFPKDLKPKI

SEQ ID NO: 2301039 - protein, 17 aa, Cryptosporidium parvum
NVIRLNERLNLLKDQEI

SEQ ID NO: 2301040 - protein, 17 aa, Cryptosporidium parvum
NVIRPKRAAAIKAEESI

SEQ ID NO: 2301041 - protein, 38 aa, Cryptosporidium parvum
NVKAHCPFCQIELDWNRVKPFIVLFKPKSEAIIEEDTN

SEQ ID NO: 2301042 - protein, 26 aa, Cryptosporidium parvum
NVKALYRRGLARLGFGMYEESKEDFQ

SEQ ID NO: 2301043 - protein, 23 aa, Cryptosporidium parvum
NVKECLALFPIKKFKRFLRLQGF

SEQ ID NO: 2301044 - protein, 28 aa, Cryptosporidium parvum
NVKIVHTLWLWACDGQWQRVSEDLFEGE

SEQ ID NO: 2301045 - protein, 23 aa, Cryptosporidium parvum
NVKWDILQTLDLSYYQFKYIERY

SEQ ID NO: 2301046 - protein, 17 aa, Cryptosporidium parvum
NVLDFNINGFDDFQIID

SEQ ID NO: 2301047 - protein, 34 aa, Cryptosporidium parvum; identical to SEQ ID NO: 2178792

SEQ ID NO: 2301048 - protein, 25 aa, Cryptosporidium parvum
NVMHPLPSVCCYIPNTNNSCIDEEQ

SEQ ID NO: 2301049 - protein, 25 aa, Cryptosporidium parvum
NVNCWFSLGCVALRLERWEIAQQAF

SEQ ID NO: 2301050 - protein, 17 aa, Cryptosporidium parvum
NVNLGVGSDYVIDNNNN

SEQ ID NO: 2301051 - protein, 18 aa, Cryptosporidium parvum
NVNLIDIDGAFFGTSFPH

SEQ ID NO: 2301052 - protein, 19 aa, Cryptosporidium parvum
NVPAYLRSNFEVYIKASKR

SEQ ID NO: 2301053 - protein, 19 aa, Cryptosporidium parvum
NVPELPLVISNEIQNINKT

SEQ ID NO: 2301054 - protein, 27 aa, Cryptosporidium parvum
NVPRIKKLRAQYWFEKFYWFISSDGYL

SEQ ID NO: 2301055 - protein, 24 aa, Cryptosporidium parvum
NVQGTSWRTVWPNSNLMSNGGIGD

SEQ ID NO: 2301056 - protein, 19 aa, Cryptosporidium parvum
NVQRLKGFEVRPDSKYTGR

SEQ ID NO: 2301057 - protein, 19 aa, Cryptosporidium parvum
NVQSYERLRTIRILLNTCI

SEQ ID NO: 2301058 - protein, 23 aa, Cryptosporidium parvum
NVRARLAARGQKVDFLNAKDAIS

SEQ ID NO: 2301059 - protein, 19 aa, Cryptosporidium parvum
NVRSCSRLSPKPESLSLFP

SEQ ID NO: 2301060 - protein, 19 aa, Cryptosporidium parvum
NVSAEIFLVCLGYKAPKKI

SEQ ID NO: 2301061 - protein, 21 aa, Cryptosporidium parvum
NVSARWCIAMNQSIQYGQMRY

SEQ ID NO: 2301062 - protein, 25 aa, Cryptosporidium parvum
NVSFRPRLNTCSVPFSNSNNSSSTN

SEQ ID NO: 2301063 - protein, 18 aa, Cryptosporidium parvum
NVSIWCLVTLESDNILFS

SEQ ID NO: 2301064 - protein, 24 aa, Cryptosporidium parvum
NVSLELPTICGFTGNPNHSNFVSN

SEQ ID NO: 2301065 - protein, 23 aa, Cryptosporidium parvum
NVSSAAQHFVQWLLESDPKKRPT

SEQ ID NO: 2301066 - protein, 34 aa, Cryptosporidium parvum; identical to SEQ ID NO: 2178804

SEQ ID NO: 2301067 - protein, 18 aa, Cryptosporidium parvum
NVTLILYSREILLFPYQN

SEQ ID NO: 2301068 - protein, 25 aa, Cryptosporidium parvum
NVVAEYAFRFIVERFSFKGIRLVDC

SEQ ID NO: 2301069 - protein, 22 aa, Cryptosporidium parvum
NVYKEKRSEIFLSNNNQNNDVL

SEQ ID NO: 2301070 - protein, 18 aa, Cryptosporidium parvum
NVYRFVPIPFENRLHWNH

SEQ ID NO: 2301071 - protein, 24 aa, Cryptosporidium parvum
NWGISVRLSEYFSGRIYAEHLFNS

SEQ ID NO: 2301072 - protein, 19 aa, Cryptosporidium parvum
NWKNWVLPENTVWRVNRIE

SEQ ID NO: 2301073 - protein, 26 aa, Cryptosporidium parvum
NWLREFKKWLPDANVVLYHGNAYARE

SEQ ID NO: 2301074 - protein, 24 aa, Cryptosporidium parvum
NWMTYFAKLSLRWNNFGNDQTTEI

SEQ ID NO: 2301075 - protein, 23 aa, Cryptosporidium parvum
NWPDEVVPLLMRRLADIEYRLSR

SEQ ID NO: 2301076 - protein, 17 aa, Cryptosporidium parvum
NWPKADCILILRNMPFD

SEQ ID NO: 2301077 - protein, 23 aa, Cryptosporidium parvum
NWPTARTPLKYVTSMDFSEYGGY

SEQ ID NO: 2301078 - protein, 28 aa, Cryptosporidium parvum
NYAMRLKEWYGWHFPELGKIISDRDVYA

SEQ ID NO: 2301079 - protein, 25 aa, Cryptosporidium parvum
NYCARKLKWWLDAFQPIVSPIFPNM

SEQ ID NO: 2301080 - protein, 18 aa, Cryptosporidium parvum
NYCVKRQILSIAPTLAQQ

SEQ ID NO: 2301081 - protein, 26 aa, Cryptosporidium parvum
NYDNKEVFSFLPIRSYGLKFILQADF

SEQ ID NO: 2301082 - protein, 24 aa, Cryptosporidium parvum
NYEINYWLDWLFNNITLNGKYGLE

SEQ ID NO: 2301083 - protein, 24 aa, Cryptosporidium parvum
NYEPELFPGLVYRYHPDNSPTKAV

SEQ ID NO: 2301084 - protein, 24 aa, Cryptosporidium parvum
NYERKLKPILKFMGHEKSVQDISW

SEQ ID NO: 2301085 - protein, 18 aa, Cryptosporidium parvum
NYFKFSYLQDWMPEWTRN

SEQ ID NO: 2301086 - protein, 17 aa, Cryptosporidium parvum
NYFNYLWQVGDEFSEIH

SEQ ID NO: 2301087 - protein, 19 aa, Cryptosporidium parvum
NYFRSPYTYKFYIDPKSKE

SEQ ID NO: 2301088 - protein, 23 aa, Cryptosporidium parvum
NYHSLKLKCAHQNKWITNDNNSN

SEQ ID NO: 2301089 - protein, 25 aa, Cryptosporidium parvum
NYIARKCTICGYISSSTICNGCNLI

SEQ ID NO: 2301090 - protein, 20 aa, Cryptosporidium parvum
NYIEPIKFASIEAFTQEFGE

SEQ ID NO: 2301091 - protein, 30 aa, Cryptosporidium parvum
NYIFGSNTFRIWPTRILLYPASKSQVPNDH

SEQ ID NO: 2301092 - protein, 20 aa, Cryptosporidium parvum
NYITGLKWADFDNDLEENSL

SEQ ID NO: 2301093 - protein, 17 aa, Cryptosporidium parvum
NYKDCNGSFDSRKEIGF

SEQ ID NO: 2301094 - protein, 24 aa, Cryptosporidium parvum
NYKHKRKFPFLYYYGRQPSINNDY

SEQ ID NO: 2301095 - protein, 27 aa, Cryptosporidium parvum
NYKSFLLSYPKLFRIFGKDDNHSIQWI

SEQ ID NO: 2301096 - protein, 25 aa, Cryptosporidium parvum
NYLEFPCCTEIKVHLSCIQLWGESN

SEQ ID NO: 2301097 - protein, 24 aa, Cryptosporidium parvum
NYLKECGFDSCWIHSSYYDIISQF

SEQ ID NO: 2301098 - protein, 22 aa, Cryptosporidium parvum
NYLPELRCICYTGEFKNVSHIV

SEQ ID NO: 2301099 - protein, 19 aa, Cryptosporidium parvum
NYLSLLVSTGLRFSEEVQN

SEQ ID NO: 2301100 - protein, 24 aa, Cryptosporidium parvum
NYMDPRISVAFCKKYDLPIDKIFN

SEQ ID NO: 2301101 - protein, 17 aa, Cryptosporidium parvum
NYMPLSDCESSQCKNNK

SEQ ID NO: 2301102 - protein, 17 aa, Cryptosporidium parvum
NYNFKMIPLRTCSASIH

SEQ ID NO: 2301103 - protein, 17 aa, Cryptosporidium parvum
NYNSMIWHKSVNLEELE

SEQ ID NO: 2301104 - protein, 19 aa, Cryptosporidium parvum
NYNYRYKRIHKDIKSNNIM

SEQ ID NO: 2301105 - protein, 21 aa, Cryptosporidium parvum
NYPEGMSYVIFVNSPKFFSIV

SEQ ID NO: 2301106 - protein, 28 aa, Cryptosporidium parvum
NYPIGLKRPRFATFDSFGSEYAVLMRSL

SEQ ID NO: 2301107 - protein, 19 aa, Cryptosporidium parvum
NYQLEVLSNMGFTDTEACI

SEQ ID NO: 2301108 - protein, 19 aa, Cryptosporidium parvum
NYSDYRINKVFNENDKNEI

SEQ ID NO: 2301109 - protein, 26 aa, Cryptosporidium parvum
NYSKKWKFGTYWNLIYRNILNRRISI

SEQ ID NO: 2301110 - protein, 27 aa, Cryptosporidium parvum
NYSKSLLCNLWFRSIKIIQEIQNYNFQ

SEQ ID NO: 2301111 - protein, 18 aa, Cryptosporidium parvum
NYSLICRKILEKFQSDLQ

SEQ ID NO: 2301112 - protein, 24 aa, Cryptosporidium parvum
NYSPNLFNDISFRINSHKEKIKNM

SEQ ID NO: 2301113 - protein, 26 aa, Cryptosporidium parvum
NYSRRFILRLFRQFWGFLDYMDLSLI

SEQ ID NO: 2301114 - protein, 19 aa, Cryptosporidium parvum
NYSSFKFNSNFDNYSKVSK

SEQ ID NO: 2301115 - protein, 30 aa, Cryptosporidium parvum
NYSSKYCLLKNKYLFLGIEFLHETLGKIIS

SEQ ID NO: 2301116 - protein, 20 aa, Cryptosporidium parvum
NYSSNCIRGRMDYISTDVFV

SEQ ID NO: 2301117 - protein, 22 aa, Cryptosporidium parvum
NYTCEVCGSSIWQSVEGTNYMP

SEQ ID NO: 2301118 - protein, 20 aa, Cryptosporidium parvum
NYTTIKWRHIVDIHPSSTLF

SEQ ID NO: 2301119 - protein, 18 aa, Cryptosporidium parvum
NYTVSLREASPFFRNNYE

SEQ ID NO: 2301120 - protein, 22 aa, Cryptosporidium parvum
NYVKTRQYEIVFKKIKDSEIVV

SEQ ID NO: 2301121 - protein, 25 aa, Cryptosporidium parvum
NYYDKYGRFCGFFNNGIFHSFYYYY

SEQ ID NO: 2301122 - protein, 25 aa, Cryptosporidium parvum
NYYSLRPSEVASMFPQQHIADQSPI

SEQ ID NO: 2301123 - protein, 24 aa, Cryptosporidium parvum
NYYYPCRSIFKKKLLDIHVSQLKN

SEQ ID NO: 2301124 - protein, 18 aa, Cryptosporidium parvum
PACCLDVLNIKKSHSDLV

SEQ ID NO: 2301125 - protein, 21 aa, Cryptosporidium parvum
PADFLFAWLKHCHYREEVFQL

SEQ ID NO: 2301126 - protein, 17 aa, Cryptosporidium parvum
PADSWWNFHRKTCGGCF

SEQ ID NO: 2301127 - protein, 20 aa, Cryptosporidium parvum
PAENDFKIAAARELYEETGL

SEQ ID NO: 2301128 - protein, 25 aa, Cryptosporidium parvum
PAFLNDLRISSNLLRILFDANKERG

SEQ ID NO: 2301129 - protein, 35 aa, Cryptosporidium parvum; identical to SEQ ID NO: 2178864

SEQ ID NO: 2301130 - protein, 18 aa, Cryptosporidium parvum
PAGLPSYIVQNFQGQKGG

SEQ ID NO: 2301131 - protein, 21 aa, Cryptosporidium parvum
PAHKLPISVFTKHLLECEHLI

SEQ ID NO: 2301132 - protein, 27 aa, Cryptosporidium parvum
PAIKLKAEQFLVFLIKLIIKLREDEDQ

SEQ ID NO: 2301133 - protein, 18 aa, Cryptosporidium parvum
PAILRPQPLWTGKQIITV

SEQ ID NO: 2301134 - protein, 18 aa, Cryptosporidium parvum
PAISDHKYRYGSPAEDYH

SEQ ID NO: 2301135 - protein, 21 aa, Cryptosporidium parvum
PAKPVVPSWPGMPGGTSGPAM

SEQ ID NO: 2301136 - protein, 19 aa, Cryptosporidium parvum
PAKYLKYKCKFEEILSSGF

SEQ ID NO: 2301137 - protein, 17 aa, Cryptosporidium parvum
PALLKEEMIEDDKSLSL

SEQ ID NO: 2301138 - protein, 23 aa, Cryptosporidium parvum
PALLRPGRLDRKIEFPLPDRRQR

SEQ ID NO: 2301139 - protein, 25 aa, Cryptosporidium parvum
PAMIHIRAQPLLRYGDGPICLVLAP

SEQ ID NO: 2301140 - protein, 26 aa, Cryptosporidium parvum
PANCSPRLKINITWPTTLKNYTMYSN

SEQ ID NO: 2301141 - protein, 19 aa, Cryptosporidium parvum
PANMSVPIASFQNVIGRIH

SEQ ID NO: 2301142 - protein, 24 aa, Cryptosporidium parvum
PAQETSWFTGWFGIGAESSPPPPP

SEQ ID NO: 2301143 - protein, 19 aa, Cryptosporidium parvum
PAQINDIIFLKSALELLHP

SEQ ID NO: 2301144 - protein, 27 aa, Cryptosporidium parvum
PASSTVFEMIVFRGSDITDLAVCQPAA

SEQ ID NO: 2301145 - protein, 37 aa, Cryptosporidium parvum
PATERCSRSFIWKSNNVFMFPIPIWKSPTQKKNLNGR

SEQ ID NO: 2301146 - protein, 18 aa, Cryptosporidium parvum
PATMASLMHGNPHAMMMD

SEQ ID NO: 2301147 - protein, 20 aa, Cryptosporidium parvum
PAVRFEIFILIYELIENIKI

SEQ ID NO: 2301148 - protein, 17 aa, Cryptosporidium parvum
PAVRPYVQFGSDRSEDD

SEQ ID NO: 2301149 - protein, 18 aa, Cryptosporidium parvum
PCENCAISQIVLYDHNIR

SEQ ID NO: 2301150 - protein, 20 aa, Cryptosporidium parvum
PCFDEVLFENTFRIHPDKNR

SEQ ID NO: 2301151 - protein, 19 aa, Cryptosporidium parvum
PCHWIPFNCDLSYCTKSQQ

SEQ ID NO: 2301152 - protein, 18 aa, Cryptosporidium parvum
PCICIRPKNESKYKTIEI

SEQ ID NO: 2301153 - protein, 20 aa, Cryptosporidium parvum
PCIEFYDLRSGLSHFEITIP

SEQ ID NO: 2301154 - protein, 21 aa, Cryptosporidium parvum
PCISCSMALVHSRISKVFYMH

SEQ ID NO: 2301155 - protein, 25 aa, Cryptosporidium parvum
PCKNLLMGLTCYGWIYIWNIEQLGN

SEQ ID NO: 2301156 - protein, 20 aa, Cryptosporidium parvum
PCNLLPYKSSLNNAYSECTN

SEQ ID NO: 2301157 - protein, 18 aa, Cryptosporidium parvum
PCNLSSLNSPKCNTDFNS

SEQ ID NO: 2301158 - protein, 18 aa, Cryptosporidium parvum
PCQSPIFLILKPEIPKES

SEQ ID NO: 2301159 - protein, 26 aa, Cryptosporidium parvum
PCRRYHKRLKLLPPVNPDECYVLTDS

SEQ ID NO: 2301160 - protein, 19 aa, Cryptosporidium parvum
PCSESRNSTPWTFSSNKNE

SEQ ID NO: 2301161 - protein, 18 aa, Cryptosporidium parvum
PDAEFLIVVMGSGGLTIE

SEQ ID NO: 2301162 - protein, 18 aa, Cryptosporidium parvum
PDAPLCMFVSKMVPTSDK

SEQ ID NO: 2301163 - protein, 20 aa, Cryptosporidium parvum
PDCFRNLPTDIITRGMQTAL

SEQ ID NO: 2301164 - protein, 19 aa, Cryptosporidium parvum
PDCIIPFAEWAAALLSQMD

SEQ ID NO: 2301165 - protein, 31 aa, Cryptosporidium parvum
PDCTNIEVPLIMRVECYFGSIANGIVSNLSK

SEQ ID NO: 2301166 - protein, 17 aa, Cryptosporidium parvum
PDDCLWSIIDGKTIQIV

SEQ ID NO: 2301167 - protein, 23 aa, Cryptosporidium parvum
PDDRFRALCKHFSPKSEVPATLT

SEQ ID NO: 2301168 - protein, 20 aa, Cryptosporidium parvum
PDDVGICRSIIGYLRNNGNE

SEQ ID NO: 2301169 - protein, 19 aa, Cryptosporidium parvum
PDEAVAMGAAIQAGVLKGE

SEQ ID NO: 2301170 - protein, 21 aa, Cryptosporidium parvum
PDEDPPFFLNIRIISDKWVNL

SEQ ID NO: 2301171 - protein, 18 aa, Cryptosporidium parvum
PDEESRVLLIKNGLKSIN

SEQ ID NO: 2301172 - protein, 34 aa, Cryptosporidium parvum; identical to SEQ ID NO: 2178906

SEQ ID NO: 2301173 - protein, 21 aa, Cryptosporidium parvum
PDGRKRFFIGPHIDGVSYNPT

SEQ ID NO: 2301174 - protein, 17 aa, Cryptosporidium parvum
PDIIERMDFGSYHNFLI

SEQ ID NO: 2301175 - protein, 17 aa, Cryptosporidium parvum
PDIYRAVGVNSPCGVLL

SEQ ID NO: 2301176 - protein, 25 aa, Cryptosporidium parvum
PDKIIRFRHSEYILSLTLSEDQQFV

SEQ ID NO: 2301177 - protein, 25 aa, Cryptosporidium parvum
PDKLDDFRKLYAMWNRCMLSDEDFI

SEQ ID NO: 2301178 - protein, 22 aa, Cryptosporidium parvum
PDKRFLTPELISYVPYSTIELV

SEQ ID NO: 2301179 - protein, 26 aa, Cryptosporidium parvum
PDKTGKCYSYKACFIDSIDMFDNSKF

SEQ ID NO: 2301180 - protein, 20 aa, Cryptosporidium parvum
PDLEGFQWLCRITAINALSR

SEQ ID NO: 2301181 - protein, 18 aa, Cryptosporidium parvum
PDLFPCVILNSIYTLNML

SEQ ID NO: 2301182 - protein, 25 aa, Cryptosporidium parvum
PDLHLFPRSFLKCISSELINYNSEN

SEQ ID NO: 2301183 - protein, 17 aa, Cryptosporidium parvum
PDLKLIPKVGIGKNLKI

SEQ ID NO: 2301184 - protein, 27 aa, Cryptosporidium parvum
PDLLDSALLRPGRLDRIIYIGLPDSKA

SEQ ID NO: 2301185 - protein, 18 aa, Cryptosporidium parvum
PDLLKGIYNKGFNRPSKI

SEQ ID NO: 2301186 - protein, 24 aa, Cryptosporidium parvum
PDLLRYQFKGGRYGVAMEIHKAKI

SEQ ID NO: 2301187 - protein, 18 aa, Cryptosporidium parvum
PDLRKFRKGLPEMYFTNI

SEQ ID NO: 2301188 - protein, 23 aa, Cryptosporidium parvum
PDLWLKLLPILLYSLDIWLSDLI

SEQ ID NO: 2301189 - protein, 20 aa, Cryptosporidium parvum
PDLYHYIYVCTVVNKNVPEI

SEQ ID NO: 2301190 - protein, 20 aa, Cryptosporidium parvum
PDMFTPICRPTFSIQNTNKL

SEQ ID NO: 2301191 - protein, 25 aa, Cryptosporidium parvum
PDNKFLLEFIESFYYGRYSQFFERL

SEQ ID NO: 2301192 - protein, 27 aa, Cryptosporidium parvum
PDPHLKWQIPSFIIGGNPRLQGSTIID

SEQ ID NO: 2301193 - protein, 25 aa, Cryptosporidium parvum
PDPIKFKIVFIAPMKSLVSEITRKY

SEQ ID NO: 2301194 - protein, 24 aa, Cryptosporidium parvum
PDPNLRPTPEMALRHEFFRYKFEE

SEQ ID NO: 2301195 - protein, 19 aa, Cryptosporidium parvum
PDPPACITTSFDLWIKNED

SEQ ID NO: 2301196 - protein, 23 aa, Cryptosporidium parvum
PDPRPHMNIVFIGHVDAGKSTTC

SEQ ID NO: 2301197 - protein, 19 aa, Cryptosporidium parvum
PDQLVPLPIGYFKHDFRFK

SEQ ID NO: 2301198 - protein, 25 aa, Cryptosporidium parvum
PDRVAALRFEWAWQHPNICKVTRDN

SEQ ID NO: 2301199 - protein, 20 aa, Cryptosporidium parvum
PDSLKSLGWDNSVIVRVLNI

SEQ ID NO: 2301200 - protein, 24 aa, Cryptosporidium parvum
PDSLLSRFDLIFIVKDSRNSQQDR

SEQ ID NO: 2301201 - protein, 21 aa, Cryptosporidium parvum
PDSYKLLQHPFILSKKKSIKI

SEQ ID NO: 2301202 - protein, 23 aa, Cryptosporidium parvum
PDVGYCQGMNFIAALLLITSNFD

SEQ ID NO: 2301203 - protein, 32 aa, Cryptosporidium parvum; identical to SEQ ID NO: 2178928

SEQ ID NO: 2301204 - protein, 20 aa, Cryptosporidium parvum
PDVVRRRLARKSALKSVKYL

SEQ ID NO: 2301205 - protein, 21 aa, Cryptosporidium parvum
PDYIQLCKLREEFPNVPIIAL

SEQ ID NO: 2301206 - protein, 19 aa, Cryptosporidium parvum
PECNNILCPKENIERRKLL

SEQ ID NO: 2301207 - protein, 31 aa, Cryptosporidium parvum
PEDERACEILKKLMKIEPKFNYDPPGKIVYT

SEQ ID NO: 2301208 - protein, 24 aa, Cryptosporidium parvum
PEDIHGMAVVLILGSYRNEEFIRI

SEQ ID NO: 2301209 - protein, 23 aa, Cryptosporidium parvum
PEEHPRLGVWSGAGFDNPRSFRP

SEQ ID NO: 2301210 - protein, 23 aa, Cryptosporidium parvum
PEEIPRMGALGIASWTKEEVQKL

SEQ ID NO: 2301211 - protein, 19 aa, Cryptosporidium parvum
PEEKMKFAFDIYDVNSDGW

SEQ ID NO: 2301212 - protein, 17 aa, Cryptosporidium parvum
PEEPCWDSPWGKGRPGW

SEQ ID NO: 2301213 - protein, 18 aa, Cryptosporidium parvum
PEFATYLHYCRVLRFEDR

SEQ ID NO: 2301214 - protein, 21 aa, Cryptosporidium parvum
PEFEIKPKFESELEPEPELEL

SEQ ID NO: 2301215 - protein, 25 aa, Cryptosporidium parvum
PEFLKWLVQACSPINRYISKIDFPK

SEQ ID NO: 2301216 - protein, 18 aa, Cryptosporidium parvum
PEFLSFRPNFSREVVGPP

SEQ ID NO: 2301217 - protein, 17 aa, Cryptosporidium parvum
PEFMKFYSLKLPMKLAN

SEQ ID NO: 2301218 - protein, 18 aa, Cryptosporidium parvum
PEFQSWRILLKNKSNHDL

SEQ ID NO: 2301219 - protein, 24 aa, Cryptosporidium parvum
PEFVNNHIFKNCYSFIIEENNNHN

SEQ ID NO: 2301220 - protein, 20 aa, Cryptosporidium parvum
PEGCRSIRSLLIGDDEGINK

SEQ ID NO: 2301221 - protein, 29 aa, Cryptosporidium parvum
PEGNRASIIQPFFETMNIFILQFSSCCKE

SEQ ID NO: 2301222 - protein, 23 aa, Cryptosporidium parvum
PEHIEALGPFVPLLVKILNTISM

SEQ ID NO: 2301223 - protein, 20 aa, Cryptosporidium parvum
PEHIKRTLLQLLSHKAISIS

SEQ ID NO: 2301224 - protein, 36 aa, Cryptosporidium parvum
PEHMHCYCTTYGPIIPCNFGILAIRSSERTSNFRIA

SEQ ID NO: 2301225 - protein, 27 aa, Cryptosporidium parvum
PEIAIALSEFETFCGFRNTIEILSIIE

SEQ ID NO: 2301226 - protein, 26 aa, Cryptosporidium parvum
PEIHYKVSLSLLKRSIQISVHNNDIS

SEQ ID NO: 2301227 - protein, 22 aa, Cryptosporidium parvum
PEIIKLPRYNSFSVISTPTISQ

SEQ ID NO: 2301228 - protein, 17 aa, Cryptosporidium parvum
PEIKEIISNISLSNASR

SEQ ID NO: 2301229 - protein, 20 aa, Cryptosporidium parvum
PEIKTCIVFRHLNGPIEFVK

SEQ ID NO: 2301230 - protein, 17 aa, Cryptosporidium parvum
PEILQLFSADKRLIRSL

SEQ ID NO: 2301231 - protein, 17 aa, Cryptosporidium parvum
PEIPFPNILIRTSGETR

SEQ ID NO: 2301232 - protein, 26 aa, Cryptosporidium parvum
PEIQKLILEFLFSFKTSQKLSLVNKE

SEQ ID NO: 2301233 - protein, 20 aa, Cryptosporidium parvum
PEISGGLKLSEMDFGPSPPL

SEQ ID NO: 2301234 - protein, 17 aa, Cryptosporidium parvum
PEIVAGVAPGIPGPSGV

SEQ ID NO: 2301235 - protein, 25 aa, Cryptosporidium parvum
PEKEQESIFTYIWNIIKAIFTRRRW

SEQ ID NO: 2301236 - protein, 17 aa, Cryptosporidium parvum
PEKFCLNTDTLKHLIKI

SEQ ID NO: 2301237 - protein, 20 aa, Cryptosporidium parvum
PEKIDTMIIQAVALLDDLDR

SEQ ID NO: 2301238 - protein, 27 aa, Cryptosporidium parvum
PEKILEDGDCCWIHGFVVDVEIDQDGE

SEQ ID NO: 2301239 - protein, 22 aa, Cryptosporidium parvum
PEKKLTSFGSWAIITGASDGIG

SEQ ID NO: 2301240 - protein, 34 aa, Cryptosporidium parvum
PEKKRSSRISKRFSNLLGRRPSKTYSDVQFSKKL

SEQ ID NO: 2301241 - protein, 17 aa, Cryptosporidium parvum
PELDYLEAVMITILTIH

SEQ ID NO: 2301242 - protein, 19 aa, Cryptosporidium parvum
PELELRPFLINLPLNKNEN

SEQ ID NO: 2301243 - protein, 27 aa, Cryptosporidium parvum
PELFTPNLLKVIYRIFLFNNLLNNTNL

SEQ ID NO: 2301244 - protein, 19 aa, Cryptosporidium parvum
PELIFGHLLTSDNYDDNED

SEQ ID NO: 2301245 - protein, 23 aa, Cryptosporidium parvum
PELKIYNVFHPYDPVAFRLEPLL

SEQ ID NO: 2301246 - protein, 22 aa, Cryptosporidium parvum
PELSLPYKLWIDAKSRDWILEW

SEQ ID NO: 2301247 - protein, 25 aa, Cryptosporidium parvum
PEMCLKGHLNWVLTLAWSPDSTLLA

SEQ ID NO: 2301248 - protein, 22 aa, Cryptosporidium parvum
PEMFASEIPQNFPIETNPEATL

SEQ ID NO: 2301249 - protein, 17 aa, Cryptosporidium parvum
PEMIGMYLGEFSITYKP

SEQ ID NO: 2301250 - protein, 27 aa, Cryptosporidium parvum
PENCGDVRLWICIGDCYLAKNEVANNY

SEQ ID NO: 2301251 - protein, 27 aa, Cryptosporidium parvum
PENEFKFVLLILNWAASVLMVTKAFQV

SEQ ID NO: 2301252 - protein, 27 aa, Cryptosporidium parvum
PENEVFGLYCVFAFKKIENSNINLDEQ

SEQ ID NO: 2301253 - protein, 23 aa, Cryptosporidium parvum
PENRLHRKYAYMIVYDLIQVLKE

SEQ ID NO: 2301254 - protein, 20 aa, Cryptosporidium parvum
PENWPSAFLDIVSLVTAHDW

SEQ ID NO: 2301255 - protein, 19 aa, Cryptosporidium parvum
PENYRKVILSTNIAETSVT

SEQ ID NO: 2301256 - protein, 18 aa, Cryptosporidium parvum
PEPGHVRMNQKYESSILL

SEQ ID NO: 2301257 - protein, 24 aa, Cryptosporidium parvum
PEPITRYLIMFGYIIRTQKKYENS

SEQ ID NO: 2301258 - protein, 18 aa, Cryptosporidium parvum
PEPWKTDRIPGGVRTYNE

SEQ ID NO: 2301259 - protein, 21 aa, Cryptosporidium parvum
PEQRLVMGVPLSFLSTPHKAG

SEQ ID NO: 2301260 - protein, 24 aa, Cryptosporidium parvum
PERLDYYALCSLQILELPNSQNYL

SEQ ID NO: 2301261 - protein, 28 aa, Cryptosporidium parvum
PESDIIKLCTMYPYLNPRYFLNKNAKKG

SEQ ID NO: 2301262 - protein, 24 aa, Cryptosporidium parvum
PESHELPIFMSIIDFGRSLDIGEI

SEQ ID NO: 2301263 - protein, 32 aa, Cryptosporidium parvum
PESRCTAAQAIYHPWFEKIQLSPGIMISYNNN

SEQ ID NO: 2301264 - protein, 18 aa, Cryptosporidium parvum
PESRLESISESRPESELE

SEQ ID NO: 2301265 - protein, 21 aa, Cryptosporidium parvum
PETFEVKALNGYFPKKIKQAI

SEQ ID NO: 2301266 - protein, 32 aa, Cryptosporidium parvum; identical to SEQ ID NO: 2178976

SEQ ID NO: 2301267 - protein, 17 aa, Cryptosporidium parvum
PETKFLFPVTIEDHTCS

SEQ ID NO: 2301268 - protein, 22 aa, Cryptosporidium parvum
PETKFPLSKIEFYSNWKNIINH

SEQ ID NO: 2301269 - protein, 42 aa, Cryptosporidium parvum
PETRKRIAIYCLKDSILPLRLMKHLKLFPNIIEMARVTGTTI

SEQ ID NO: 2301270 - protein, 18 aa, Cryptosporidium parvum
PETVHLLLIPEVEEEFID

SEQ ID NO: 2301271 - protein, 19 aa, Cryptosporidium parvum
PEVESLMAVGFFDGDIAYY

SEQ ID NO: 2301272 - protein, 22 aa, Cryptosporidium parvum
PEVESSRKFGFVGFYSEEDAKK

SEQ ID NO: 2301273 - protein, 18 aa, Cryptosporidium parvum
PEYSRLWLDSTLGTGTCL

SEQ ID NO: 2301274 - protein, 19 aa, Cryptosporidium parvum
PFADFACEVCRLNDHEEVL

SEQ ID NO: 2301275 - protein, 18 aa, Cryptosporidium parvum
PFECFKCRKKFCIEHVNS

SEQ ID NO: 2301276 - protein, 18 aa, Cryptosporidium parvum
PFFELSWTPGLAEDKTGQ

SEQ ID NO: 2301277 - protein, 30 aa, Cryptosporidium parvum
PFFQPIAEWIVRNIYRFHVYNLIKLNKSTK

SEQ ID NO: 2301278 - protein, 18 aa, Cryptosporidium parvum
PFGGFGMDDLNESGGFMI

SEQ ID NO: 2301279 - protein, 26 aa, Cryptosporidium parvum
PFHLYYKKRIEDFKNGVSIDNSGPTI

SEQ ID NO: 2301280 - protein, 20 aa, Cryptosporidium parvum
PFHVRLLKNVVCTQEEGRKS

SEQ ID NO: 2301281 - protein, 26 aa, Cryptosporidium parvum
PFIKLLTNFVNLVFGITLFLNNKKPN

SEQ ID NO: 2301282 - protein, 18 aa, Cryptosporidium parvum
PFISCGSRSSAIISPTGK

SEQ ID NO: 2301283 - protein, 20 aa, Cryptosporidium parvum
PFKPIEGCVQIKKNSLSQKV

SEQ ID NO: 2301284 - protein, 19 aa, Cryptosporidium parvum
PFLGICLGMQLSVVEFCKN

SEQ ID NO: 2301285 - protein, 20 aa, Cryptosporidium parvum
PFLLNLRHFYQFNFITQRHR

SEQ ID NO: 2301286 - protein, 18 aa, Cryptosporidium parvum
PFMLELLLMSTTYQQWVS

SEQ ID NO: 2301287 - protein, 19 aa, Cryptosporidium parvum
PFMPEFEIKIGNSISKSHQ

SEQ ID NO: 2301288 - protein, 21 aa, Cryptosporidium parvum
PFNPDFAGRRVIAFHNQRDFI

SEQ ID NO: 2301289 - protein, 21 aa, Cryptosporidium parvum
PFNVKLEYWNRVLSDGCQEII

SEQ ID NO: 2301290 - protein, 28 aa, Cryptosporidium parvum
PFPPFQVKITQIFRRNRNNSVPPPRPKN

SEQ ID NO: 2301291 - protein, 17 aa, Cryptosporidium parvum
PFQKVGILVGLKKHGRV

SEQ ID NO: 2301292 - protein, 20 aa, Cryptosporidium parvum
PFQSEARRTINRLSDSTTKY

SEQ ID NO: 2301293 - protein, 18 aa, Cryptosporidium parvum
PFQVCVFAPNLLLGCVMT

SEQ ID NO: 2301294 - protein, 22 aa, Cryptosporidium parvum
PFSHIERFTRILLYSPKLNEYV

SEQ ID NO: 2301295 - protein, 21 aa, Cryptosporidium parvum
PFSSMMNFTFFDQAKKILQSE

SEQ ID NO: 2301296 - protein, 22 aa, Cryptosporidium parvum
PFSSSQSWIFGAIAHLTDNSFS

SEQ ID NO: 2301297 - protein, 25 aa, Cryptosporidium parvum
PFVECVRCGVVSHVACYGVNIPLNE

SEQ ID NO: 2301298 - protein, 33 aa, Cryptosporidium parvum
PFVIPSKRIIIEWPLHLLKNLKALDFENNDFSK

SEQ ID NO: 2301299 - protein, 18 aa, Cryptosporidium parvum
PFYIPVIVGLIGKDSCKE

SEQ ID NO: 2301300 - protein, 24 aa, Cryptosporidium parvum
PGAFQCSSLFYSLGGSRCYVDDKT

SEQ ID NO: 2301301 - protein, 18 aa, Cryptosporidium parvum
PGAGLGHLNGHRIQSTNL

SEQ ID NO: 2301302 - protein, 19 aa, Cryptosporidium parvum
PGAILPMILLFISSKMNKS

SEQ ID NO: 2301303 - protein, 20 aa, Cryptosporidium parvum
PGCRKCVIATNIAEASLTID

SEQ ID NO: 2301304 - protein, 25 aa, Cryptosporidium parvum
PGDLKCKECFSGKYCIGGPIYTGKL

SEQ ID NO: 2301305 - protein, 23 aa, Cryptosporidium parvum
PGDSICLAIQFSERLKNTKLMYD

SEQ ID NO: 2301306 - protein, 25 aa, Cryptosporidium parvum
PGDTRFHFGCHCGNPIVLNHICQGN

SEQ ID NO: 2301307 - protein, 24 aa, Cryptosporidium parvum
PGGEIRPIPSFPMFDEERGNREFL

SEQ ID NO: 2301308 - protein, 19 aa, Cryptosporidium parvum
PGGFGKRGINGKIEAINYS

SEQ ID NO: 2301309 - protein, 17 aa, Cryptosporidium parvum
PGGKCLLFGGYDGNCWK

SEQ ID NO: 2301310 - protein, 19 aa, Cryptosporidium parvum
PGGRFLCLEFSKVNNPLIS

SEQ ID NO: 2301311 - protein, 27 aa, Cryptosporidium parvum
PGHVVTAVASMEWRLLPKVRPDILNLF

SEQ ID NO: 2301312 - protein, 20 aa, Cryptosporidium parvum
PGICCDIRNPFPGPPACRPI

SEQ ID NO: 2301313 - protein, 19 aa, Cryptosporidium parvum
PGIGAGAAGLGGRTYKSDP

SEQ ID NO: 2301314 - protein, 18 aa, Cryptosporidium parvum
PGITSICWGGDRNNTLIA

SEQ ID NO: 2301315 - protein, 19 aa, Cryptosporidium parvum
PGKNKFGSLFGKMQNNIIA

SEQ ID NO: 2301316 - protein, 18 aa, Cryptosporidium parvum
PGLADRVSKSLAEDDKLS

SEQ ID NO: 2301317 - protein, 20 aa, Cryptosporidium parvum
PGMRLVEIMSRITISFGSVL

SEQ ID NO: 2301318 - protein, 22 aa, Cryptosporidium parvum
PGNIPLSILRYLSSIVPSIQLT

SEQ ID NO: 2301319 - protein, 26 aa, Cryptosporidium parvum
PGNTCIKNILLYPSFSLLNLSPAIMD

SEQ ID NO: 2301320 - protein, 31 aa, Cryptosporidium parvum; identical to SEQ ID NO: 2179023

SEQ ID NO: 2301321 - protein, 24 aa, Cryptosporidium parvum
PGQNSWAAFCARNDIPRKKNADLN

SEQ ID NO: 2301322 - protein, 22 aa, Cryptosporidium parvum
PGSRKDFECGGHFEQVKTICYH

SEQ ID NO: 2301323 - protein, 17 aa, Cryptosporidium parvum
PGSSGILYEALLKKHLE

SEQ ID NO: 2301324 - protein, 18 aa, Cryptosporidium parvum
PGSSREGITYSVKSGLVG

SEQ ID NO: 2301325 - protein, 26 aa, Cryptosporidium parvum
PGSYSIWKKLCLKLLNLPYHPNVMKI

SEQ ID NO: 2301326 - protein, 19 aa, Cryptosporidium parvum
PGTGKYSLVKDMLKKNDSI

SEQ ID NO: 2301327 - protein, 19 aa, Cryptosporidium parvum
PGTHRGYGFIEFGTADQAK

SEQ ID NO: 2301328 - protein, 21 aa, Cryptosporidium parvum
PGTPVTFETFMEWKKKKEKEE

SEQ ID NO: 2301329 - protein, 18 aa, Cryptosporidium parvum
PGVSCWNGSDGILVQTES

SEQ ID NO: 2301330 - protein, 19 aa, Cryptosporidium parvum
PGWICYSEKSLNSSVLPLL

SEQ ID NO: 2301331 - protein, 18 aa, Cryptosporidium parvum
PGWLQYLPGEIDLRDMLD

SEQ ID NO: 2301332 - protein, 28 aa, Cryptosporidium parvum
PGYISYYLVRQFPEYQLKLHGGDFDVWN

SEQ ID NO: 2301333 - protein, 26 aa, Cryptosporidium parvum
PGYTFYKNRWEIVLSNIQYLSLFSPR

SEQ ID NO: 2301334 - protein, 17 aa, Cryptosporidium parvum
PHALMGAIAIHLSLLDH

SEQ ID NO: 2301335 - protein, 27 aa, Cryptosporidium parvum
PHFLTMNWNLFPKLMEFVFPPFPLENG

SEQ ID NO: 2301336 - protein, 17 aa, Cryptosporidium parvum
PHICFNFSFENKMTEKE

SEQ ID NO: 2301337 - protein, 24 aa, Cryptosporidium parvum
PHIRCQRGVIGIHYLLQIPQFRHR

SEQ ID NO: 2301338 - protein, 18 aa, Cryptosporidium parvum
PHIWNFIIHNSIDELIFQ

SEQ ID NO: 2301339 - protein, 27 aa, Cryptosporidium parvum
PHKIWLYLDHWLFWLSLTNENNNSSNQ

SEQ ID NO: 2301340 - protein, 17 aa, Cryptosporidium parvum
PHNCKQIKLGEKRLNKV

SEQ ID NO: 2301341 - protein, 27 aa, Cryptosporidium parvum
PHPMGLQPFPMHSILLPTLLQAQIQAQ

SEQ ID NO: 2301342 - protein, 22 aa, Cryptosporidium parvum
PHPRPKLGMEIGNWDTPEYEPH

SEQ ID NO: 2301343 - protein, 22 aa, Cryptosporidium parvum
PHSEIKFVPLIGSTEVDGNQLL

SEQ ID NO: 2301344 - protein, 19 aa, Cryptosporidium parvum
PHSGFGLGFERLIMMVTGV

SEQ ID NO: 2301345 - protein, 20 aa, Cryptosporidium parvum
PHYFTLIRFLGLISNTSMAI

SEQ ID NO: 2301346 - protein, 17 aa, Cryptosporidium parvum
PIAEKFPYLIYPMNADE

SEQ ID NO: 2301347 - protein, 19 aa, Cryptosporidium parvum
PIASFPGIESILSTQNNLL

SEQ ID NO: 2301348 - protein, 26 aa, Cryptosporidium parvum
PIASNSYVWRCLKSNLRGCEGLIERI

SEQ ID NO: 2301349 - protein, 21 aa, Cryptosporidium parvum
PIDIWSIGCVLYECFTGDIMF

SEQ ID NO: 2301350 - protein, 22 aa, Cryptosporidium parvum
PIDQKLLCKYIRYARKYCKPQI

SEQ ID NO: 2301351 - protein, 21 aa, Cryptosporidium parvum
PIDRQRIIAIVNFSSGFFPVS

SEQ ID NO: 2301352 - protein, 18 aa, Cryptosporidium parvum
PIDRWDQFEENLNKFGIQ

SEQ ID NO: 2301353 - protein, 27 aa, Cryptosporidium parvum
PIEDYCMFPLGSVYRLSTTNTNGIPTR

SEQ ID NO: 2301354 - protein, 18 aa, Cryptosporidium parvum
PIELEMLSPIFNNEMIDL

SEQ ID NO: 2301355 - protein, 23 aa, Cryptosporidium parvum
PIEVLSLPNIFKGLIKRKKLVNL

SEQ ID NO: 2301356 - protein, 25 aa, Cryptosporidium parvum
PIFIQWLDCVYQCYNQFPTEFQFHP

SEQ ID NO: 2301357 - protein, 17 aa, Cryptosporidium parvum
PIFKIIKAVSRFIVDSS

SEQ ID NO: 2301358 - protein, 18 aa, Cryptosporidium parvum
PIFKNGYQLFDYQLAGLN

SEQ ID NO: 2301359 - protein, 20 aa, Cryptosporidium parvum
PIFSPLMIRNINALRIYWDY

SEQ ID NO: 2301360 - protein, 26 aa, Cryptosporidium parvum
PIFSSKMITYCWIKYNNLYLVLLSRK

SEQ ID NO: 2301361 - protein, 18 aa, Cryptosporidium parvum
PIGIPGNMFILNPYLEVG

SEQ ID NO: 2301362 - protein, 18 aa, Cryptosporidium parvum
PIHIPDICVNEYIKQGHD

SEQ ID NO: 2301363 - protein, 23 aa, Cryptosporidium parvum
PIHSEVYIRYGILSSSECLFGYG

SEQ ID NO: 2301364 - protein, 17 aa, Cryptosporidium parvum
PIHTFKRGLIFAQNQNS

SEQ ID NO: 2301365 - protein, 19 aa, Cryptosporidium parvum
PIIAFRAARKITQITDKVF

SEQ ID NO: 2301366 - protein, 17 aa, Cryptosporidium parvum
PIIDKFSGIVLAGNILR

SEQ ID NO: 2301367 - protein, 26 aa, Cryptosporidium parvum
PIIKEMTEILFTRGLIKVLFATETIS

SEQ ID NO: 2301368 - protein, 20 aa, Cryptosporidium parvum
PIILAIGPEGGWTKEELTDL

SEQ ID NO: 2301369 - protein, 19 aa, Cryptosporidium parvum
PIIPLPISRKFQCENKVNM

SEQ ID NO: 2301370 - protein, 24 aa, Cryptosporidium parvum
PIIQSRLGILTWYARMDPRVVHVV

SEQ ID NO: 2301371 - protein, 19 aa, Cryptosporidium parvum
PIIRMLHIHTDIVLDISIA

SEQ ID NO: 2301372 - protein, 24 aa, Cryptosporidium parvum
PIISRYWLNHSIACSGERILSDGI

SEQ ID NO: 2301373 - protein, 20 aa, Cryptosporidium parvum
PIKCDDQIYLYLGNSQSKHE

SEQ ID NO: 2301374 - protein, 17 aa, Cryptosporidium parvum
PILESGLSPDIRYNNYM

SEQ ID NO: 2301375 - protein, 17 aa, Cryptosporidium parvum
PILLRIFSKKAINLTLV

SEQ ID NO: 2301376 - protein, 23 aa, Cryptosporidium parvum
PILLRIPSLFSDIYSNPADVAPF

SEQ ID NO: 2301377 - protein, 22 aa, Cryptosporidium parvum
PILNERNLHCFLTDNDCVRLTR

SEQ ID NO: 2301378 - protein, 21 aa, Cryptosporidium parvum
PILRYYVSEISKFYRGFKNIW

SEQ ID NO: 2301379 - protein, 20 aa, Cryptosporidium parvum
PINILKYRLSYYNRKFNAQI

SEQ ID NO: 2301380 - protein, 24 aa, Cryptosporidium parvum
PINPRAPIEWHWTFHTPEDLTFLR

SEQ ID NO: 2301381 - protein, 18 aa, Cryptosporidium parvum
PIPSMISLGGLNGNLTRN

SEQ ID NO: 2301382 - protein, 24 aa, Cryptosporidium parvum
PIPVRKRVVPKFKMTEEVYEVECV

SEQ ID NO: 2301383 - protein, 24 aa, Cryptosporidium parvum
PIRDPRYQCHICHALYSTHPAMIS

SEQ ID NO: 2301384 - protein, 25 aa, Cryptosporidium parvum
PIRIEEVDHFFTFMEQLLYNEIVGS

SEQ ID NO: 2301385 - protein, 24 aa, Cryptosporidium parvum
PIRNIRSSYMLSRSISPTLTPNNV

SEQ ID NO: 2301386 - protein, 30 aa, Cryptosporidium parvum
PISGIHTRNKFLWCIEILHQFYYLNLDLLR

SEQ ID NO: 2301387 - protein, 25 aa, Cryptosporidium parvum
PISNLRLKSPIRLMNVEFAINQESV

SEQ ID NO: 2301388 - protein, 25 aa, Cryptosporidium parvum
PISSLHTPLAWSFYLVSGNMLPIDG

SEQ ID NO: 2301389 - protein, 26 aa, Cryptosporidium parvum
PITERWDKERVAICGEKGVHIWSFEY

SEQ ID NO: 2301390 - protein, 27 aa, Cryptosporidium parvum
PITHPLRYIKGLKQCFEYIKSIEEDNI

SEQ ID NO: 2301391 - protein, 19 aa, Cryptosporidium parvum
PITISEFITFVSPLFDNVE

SEQ ID NO: 2301392 - protein, 27 aa, Cryptosporidium parvum
PITPFPICAKWSSLIVEEFNYQSKLES

SEQ ID NO: 2301393 - protein, 20 aa, Cryptosporidium parvum
PIVHTFLHLLSIAKTYKDDV

SEQ ID NO: 2301394 - protein, 25 aa, Cryptosporidium parvum
PIVKQWKKGHFFKLFEDSESPPICT

SEQ ID NO: 2301395 - protein, 22 aa, Cryptosporidium parvum
PKACSILLRGGSKDVLNELERN

SEQ ID NO: 2301396 - protein, 30 aa, Cryptosporidium parvum
PKAFCWLLCDSCNQLLMLLNGFIKLVELES

SEQ ID NO: 2301397 - protein, 21 aa, Cryptosporidium parvum
PKDGRSLGICLIEYVNSDSAP

SEQ ID NO: 2301398 - protein, 18 aa, Cryptosporidium parvum
PKDTHVFASVSLDRTVKI

SEQ ID NO: 2301399 - protein, 18 aa, Cryptosporidium parvum
PKDVAKICDLVMADPENN

SEQ ID NO: 2301400 - protein, 18 aa, Cryptosporidium parvum
PKDYPIASCTGRIKSDQE

SEQ ID NO: 2301401 - protein, 20 aa, Cryptosporidium parvum
PKEDLKILVTKGAANISPKI

SEQ ID NO: 2301402 - protein, 24 aa, Cryptosporidium parvum
PKEKINDVILVGGMTRMPKVSETV

SEQ ID NO: 2301403 - protein, 19 aa, Cryptosporidium parvum
PKELSSWYQGPSLFEILSS

SEQ ID NO: 2301404 - protein, 19 aa, Cryptosporidium parvum
PKEVKVLLLSLLKVDPLLR

SEQ ID NO: 2301405 - protein, 17 aa, Cryptosporidium parvum
PKEVLKIPITIEKFSSF

SEQ ID NO: 2301406 - protein, 24 aa, Cryptosporidium parvum
PKGKRGRPRLRPLEPEEKVEPEAA

SEQ ID NO: 2301407 - protein, 21 aa, Cryptosporidium parvum
PKGLPIEIIRSSIYQLLTALK

SEQ ID NO: 2301408 - protein, 19 aa, Cryptosporidium parvum
PKGSHLIRSPGIVPQDLEA

SEQ ID NO: 2301409 - protein, 17 aa, Cryptosporidium parvum
PKGWIPSSVTKMIAAKM

SEQ ID NO: 2301410 - protein, 20 aa, Cryptosporidium parvum
PKHIKEWFLSNSICPSGCGH

SEQ ID NO: 2301411 - protein, 24 aa, Cryptosporidium parvum
PKHILKKIVEEIAVQAGRGGRRHI

SEQ ID NO: 2301412 - protein, 25 aa, Cryptosporidium parvum
PKHYIAWLCIMWLSIHLKENDLPQL

SEQ ID NO: 2301413 - protein, 27 aa, Cryptosporidium parvum
PKIAEWVKEHIDGVIIPYSAEFEAALA

SEQ ID NO: 2301414 - protein, 23 aa, Cryptosporidium parvum
PKIDFKIGIRVQFVYNPEGLNDE

SEQ ID NO: 2301415 - protein, 20 aa, Cryptosporidium parvum
PKIEAIIFCKFDEELGPIVL

SEQ ID NO: 2301416 - protein, 36 aa, Cryptosporidium parvum
PKIEKLALITGFGNWIPFGWCEFFVKLFETNSKHYL

SEQ ID NO: 2301417 - protein, 18 aa, Cryptosporidium parvum
PKIELSFILRDGEKKVFN

SEQ ID NO: 2301418 - protein, 24 aa, Cryptosporidium parvum
PKIFYYDFMERCFGSAFQTNDVYN

SEQ ID NO: 2301419 - protein, 27 aa, Cryptosporidium parvum
PKIISELPTGIKSELIAILSNKKANST

SEQ ID NO: 2301420 - protein, 22 aa, Cryptosporidium parvum
PKILTPIVLCIEKIDKLSNSSI

SEQ ID NO: 2301421 - protein, 44 aa, Cryptosporidium parvum
PKIQEHWLWKKNVPFIYDYLFITPLRWPTLTFSIPPIRFNSEDM

SEQ ID NO: 2301422 - protein, 23 aa, Cryptosporidium parvum
PKIQTRIGAVIKPLVYSKHLKNI

SEQ ID NO: 2301423 - protein, 22 aa, Cryptosporidium parvum
PKIRTANIVKWAFFDKNTILCV

SEQ ID NO: 2301424 - protein, 19 aa, Cryptosporidium parvum
PKISFIKHLASYSVTIPSL

SEQ ID NO: 2301425 - protein, 25 aa, Cryptosporidium parvum
PKISKFRGNALIKNCRKITKEGKCK

SEQ ID NO: 2301426 - protein, 18 aa, Cryptosporidium parvum
PKKCVDTGMGLERLVSIL

SEQ ID NO: 2301427 - protein, 20 aa, Cryptosporidium parvum
PKKEFKVIIRFLYTSYLDET

SEQ ID NO: 2301428 - protein, 21 aa, Cryptosporidium parvum
PKKHTFIEFCELTKIQKKQYD

SEQ ID NO: 2301429 - protein, 18 aa, Cryptosporidium parvum
PKKKVEFMRYEYNSTSGC

SEQ ID NO: 2301430 - protein, 18 aa, Cryptosporidium parvum
PKKVFKIEEIFFKSQKMI

SEQ ID NO: 2301431 - protein, 22 aa, Cryptosporidium parvum
PKLEVLEPKTLLTPNLGEEAVV

SEQ ID NO: 2301432 - protein, 19 aa, Cryptosporidium parvum
PKLICRDIDRSLVKKKGHA

SEQ ID NO: 2301433 - protein, 18 aa, Cryptosporidium parvum
PKLLLSIVSNVMIVSEGM

SEQ ID NO: 2301434 - protein, 20 aa, Cryptosporidium parvum
PKLSCFARDALRQIKQKKLS

SEQ ID NO: 2301435 - protein, 18 aa, Cryptosporidium parvum
PKLSERVVEFYGFNQDEI

SEQ ID NO: 2301436 - protein, 22 aa, Cryptosporidium parvum
PKMLQFHLLLAIRSVVANLGVQ

SEQ ID NO: 2301437 - protein, 21 aa, Cryptosporidium parvum
PKMSLSETVMKYFSANKKSGV

SEQ ID NO: 2301438 - protein, 23 aa, Cryptosporidium parvum
PKNAEILGHCDISPCSKIKDQSE

SEQ ID NO: 2301439 - protein, 18 aa, Cryptosporidium parvum
PKNLLSLNVKSSIDYLLK

SEQ ID NO: 2301440 - protein, 19 aa, Cryptosporidium parvum
PKNSWAIGKTMVFLSKDAA

SEQ ID NO: 2301441 - protein, 33 aa, Cryptosporidium parvum; identical to SEQ ID NO: 2179136

SEQ ID NO: 2301442 - protein, 17 aa, Cryptosporidium parvum
PKPLIKWNAHSASINDF

SEQ ID NO: 2301443 - protein, 19 aa, Cryptosporidium parvum
PKPLQMLFHFALKQKERSN

SEQ ID NO: 2301444 - protein, 26 aa, Cryptosporidium parvum
PKPNEPCERCSLYINNRQLARVISKR

SEQ ID NO: 2301445 - protein, 20 aa, Cryptosporidium parvum
PKPYLKRKSKSIVPSKGTDI

SEQ ID NO: 2301446 - protein, 22 aa, Cryptosporidium parvum
PKQSLRLLLFINEQEKQSKKST

SEQ ID NO: 2301447 - protein, 19 aa, Cryptosporidium parvum
PKQVLPVHGKNVLDDFDDI

SEQ ID NO: 2301448 - protein, 23 aa, Cryptosporidium parvum
PKRPHNAYTLWCEHIRQKVREKD

SEQ ID NO: 2301449 - protein, 23 aa, Cryptosporidium parvum
PKRRLGIWRKVFGEKGESKKCFV

SEQ ID NO: 2301450 - protein, 30 aa, Cryptosporidium parvum
PKRWVFCPCRSCLFKGKAHDKLMGHFKIME

SEQ ID NO: 2301451 - protein, 18 aa, Cryptosporidium parvum
PKSINARIELYKQYLAQW

SEQ ID NO: 2301452 - protein, 24 aa, Cryptosporidium parvum
PKSNEFLLCKGIIPPELTLNSGID

SEQ ID NO: 2301453 - protein, 33 aa, Cryptosporidium parvum
PKSPFFDLDYGKFYYTRALELLSNIEYIIRVSG

SEQ ID NO: 2301454 - protein, 26 aa, Cryptosporidium parvum
PKSYNLWSNRAWLLEFIVNLKDADKI

SEQ ID NO: 2301455 - protein, 19 aa, Cryptosporidium parvum
PKTGILNNIIVNGPGNINN

SEQ ID NO: 2301456 - protein, 20 aa, Cryptosporidium parvum
PKTLHLKLVLLGDASVGKSC

SEQ ID NO: 2301457 - protein, 32 aa, Cryptosporidium parvum; identical to SEQ ID NO: 2179155

SEQ ID NO: 2301458 - protein, 22 aa, Cryptosporidium parvum
PKVFKLRIPYISKAVEGSLRSN

SEQ ID NO: 2301459 - protein, 23 aa, Cryptosporidium parvum
PKVHYKIKISLFDVQNIQVGGNT

SEQ ID NO: 2301460 - protein, 19 aa, Cryptosporidium parvum
PKVIKGICKKNLCKKNSEI

SEQ ID NO: 2301461 - protein, 21 aa, Cryptosporidium parvum
PKWVYDVVLDFTIIKPTSKRN

SEQ ID NO: 2301462 - protein, 17 aa, Cryptosporidium parvum
PKYKASWLGVKNYSHLN

SEQ ID NO: 2301463 - protein, 17 aa, Cryptosporidium parvum
PKYSWGNEFSRLSKLYG

SEQ ID NO: 2301464 - protein, 19 aa, Cryptosporidium parvum
PKYWGWQLNNKLSISKALN

SEQ ID NO: 2301465 - protein, 22 aa, Cryptosporidium parvum
PLAVELKSLLSININKKKNGLD

SEQ ID NO: 2301466 - protein, 31 aa, Cryptosporidium parvum
PLCAGYTKYILRTDILYRRVNPILTSEADQR

SEQ ID NO: 2301467 - protein, 24 aa, Cryptosporidium parvum
PLDKYPDYNFMGLIIGPRGYNHRR

SEQ ID NO: 2301468 - protein, 20 aa, Cryptosporidium parvum
PLEAYTSITKYSWDQSDKSV

SEQ ID NO: 2301469 - protein, 21 aa, Cryptosporidium parvum
PLEICDTLRWCECLFNLADYS

SEQ ID NO: 2301470 - protein, 20 aa, Cryptosporidium parvum
PLEIDEIMNLYIIGSLIGLD

SEQ ID NO: 2301471 - protein, 17 aa, Cryptosporidium parvum
PLEKRFLEIEGVIDSTE

SEQ ID NO: 2301472 - protein, 24 aa, Cryptosporidium parvum
PLEPTFLCVARMALQKGVDLLIEA

SEQ ID NO: 2301473 - protein, 26 aa, Cryptosporidium parvum
PLESSDRTQLMWAMITDYCEMIKNTI

SEQ ID NO: 2301474 - protein, 18 aa, Cryptosporidium parvum
PLETFIFHREPILSVDWH

SEQ ID NO: 2301475 - protein, 28 aa, Cryptosporidium parvum
PLFRVPRPRFPYLVLVPLEGDFSSKIGQ

SEQ ID NO: 2301476 - protein, 20 aa, Cryptosporidium parvum
PLGASGLRSIRYIKELSHEI

SEQ ID NO: 2301477 - protein, 18 aa, Cryptosporidium parvum
PLGRMRMLFNYQKIEYLI

SEQ ID NO: 2301478 - protein, 18 aa, Cryptosporidium parvum
PLHTSSCFIHLLRHNDHA

SEQ ID NO: 2301479 - protein, 29 aa, Cryptosporidium parvum
PLHVAKHMLRVCRETRPNIWVYAELFTGD

SEQ ID NO: 2301480 - protein, 28 aa, Cryptosporidium parvum
PLIETLNEILPLIAQRIAFSNIINSNNT

SEQ ID NO: 2301481 - protein, 17 aa, Cryptosporidium parvum
PLIQNPIILAPKTHHMI

SEQ ID NO: 2301482 - protein, 24 aa, Cryptosporidium parvum
PLIRQIENRLGILVDSSNLYMEPI

SEQ ID NO: 2301483 - protein, 24 aa, Cryptosporidium parvum
PLKLEMGCALYFIKSKQNFNQVDS

SEQ ID NO: 2301484 - protein, 23 aa, Cryptosporidium parvum
PLKMYGLGFKHAFSRLSDTCMVF

SEQ ID NO: 2301485 - protein, 25 aa, Cryptosporidium parvum
PLLERLKLAYLKVVIPKCKYDQNRS

SEQ ID NO: 2301486 - protein, 22 aa, Cryptosporidium parvum
PLLHKARRAILLSGTPALNNPT

SEQ ID NO: 2301487 - protein, 18 aa, Cryptosporidium parvum
PLLNCLNTKCGLDATKSL

SEQ ID NO: 2301488 - protein, 17 aa, Cryptosporidium parvum
PLLPNFLVDSALSFIKS

SEQ ID NO: 2301489 - protein, 17 aa, Cryptosporidium parvum
PLLTLIFVRVCNSICNA

SEQ ID NO: 2301490 - protein, 21 aa, Cryptosporidium parvum
PLLVIVKHLQYQNGLKHKDFA

SEQ ID NO: 2301491 - protein, 17 aa, Cryptosporidium parvum
PLMYKTKICEQFQRGDC

SEQ ID NO: 2301492 - protein, 19 aa, Cryptosporidium parvum
PLNIEILGWTNLLHFVEAF

SEQ ID NO: 2301493 - protein, 18 aa, Cryptosporidium parvum
PLNKSGRLLVYIRTMSNV

SEQ ID NO: 2301494 - protein, 25 aa, Cryptosporidium parvum
PLRARPEGFTAWDKLVIEQKDGTVQ

SEQ ID NO: 2301495 - protein, 20 aa, Cryptosporidium parvum
PLRHPGLFKALGVKPPRGVL

SEQ ID NO: 2301496 - protein, 18 aa, Cryptosporidium parvum
PLRLPLQDVYKIGGVGTV

SEQ ID NO: 2301497 - protein, 25 aa, Cryptosporidium parvum
PLSDRFLRHSPILFVDFPGKSSLNQ

SEQ ID NO: 2301498 - protein, 20 aa, Cryptosporidium parvum
PLSGESRCFGFVTMGNEEEA

SEQ ID NO: 2301499 - protein, 25 aa, Cryptosporidium parvum
PLSTKTRFLPILPTSPRKEMYENLK

SEQ ID NO: 2301500 - protein, 26 aa, Cryptosporidium parvum
PLTENEARWLFSQIFNAVINLHNKNM

SEQ ID NO: 2301501 - protein, 21 aa, Cryptosporidium parvum
PLTHPELYDDIGIKPPKGVIL

SEQ ID NO: 2301502 - protein, 22 aa, Cryptosporidium parvum
PLVELQDKITYEGEWLGDNKHG

SEQ ID NO: 2301503 - protein, 18 aa, Cryptosporidium parvum
PLVIKLKELHVVVRPKDY

SEQ ID NO: 2301504 - protein, 19 aa, Cryptosporidium parvum
PLVKNDLIDILRFVMDLLF

SEQ ID NO: 2301505 - protein, 25 aa, Cryptosporidium parvum
PMFPRWCKSRLFAWPVDKWLEIIRK

SEQ ID NO: 2301506 - protein, 17 aa, Cryptosporidium parvum
PMGAGKLPSSYDNNVIS

SEQ ID NO: 2301507 - protein, 17 aa, Cryptosporidium parvum
PMHDWQFYDKKRIMELH

SEQ ID NO: 2301508 - protein, 19 aa, Cryptosporidium parvum
PMHRFIRIMGPEICNYIVP

SEQ ID NO: 2301509 - protein, 19 aa, Cryptosporidium parvum
PMIDFPIGVPSSQATVDLT

SEQ ID NO: 2301510 - protein, 30 aa, Cryptosporidium parvum; identical to SEQ ID NO: 2179208

SEQ ID NO: 2301511 - protein, 31 aa, Cryptosporidium parvum
PMLSKSYSFKSWLFDNCNNFSGLPRLVSRPK

SEQ ID NO: 2301512 - protein, 17 aa, Cryptosporidium parvum
PMNGCLFSCKGISSETI

SEQ ID NO: 2301513 - protein, 25 aa, Cryptosporidium parvum
PMNRNCLLGLLKHYSQFLGINSNVE

SEQ ID NO: 2301514 - protein, 20 aa, Cryptosporidium parvum
PNAFNWVEGIIKFWDPKFKL

SEQ ID NO: 2301515 - protein, 19 aa, Cryptosporidium parvum
PNAPMVILYKGELSVMQTG

SEQ ID NO: 2301516 - protein, 23 aa, Cryptosporidium parvum
PNAQEFIPRGWVNPTNEPFINHL

SEQ ID NO: 2301517 - protein, 17 aa, Cryptosporidium parvum
PNCAYVHEIVDPNDCIS

SEQ ID NO: 2301518 - protein, 20 aa, Cryptosporidium parvum
PNCTCSLSISTCDCKSETCC

SEQ ID NO: 2301519 - protein, 19 aa, Cryptosporidium parvum
PNELCFLVYYKRDAFNGLN

SEQ ID NO: 2301520 - protein, 19 aa, Cryptosporidium parvum
PNEMGRLDILMKVSKKTPL

SEQ ID NO: 2301521 - protein, 25 aa, Cryptosporidium parvum
PNFGKKLRIYSWWSDIEIVDLSMLR

SEQ ID NO: 2301522 - protein, 26 aa, Cryptosporidium parvum
PNFKAVKIQAVFRGWLVRKKFCKLFM

SEQ ID NO: 2301523 - protein, 19 aa, Cryptosporidium parvum
PNGALVYCMEYLQVNIDWL

SEQ ID NO: 2301524 - protein, 21 aa, Cryptosporidium parvum
PNGRSWDIFVNVPKKFANVTT

SEQ ID NO: 2301525 - protein, 18 aa, Cryptosporidium parvum
PNGSAPMSMGSGAFASVG

SEQ ID NO: 2301526 - protein, 17 aa, Cryptosporidium parvum
PNGSFLVNVEFKALVFK

SEQ ID NO: 2301527 - protein, 25 aa, Cryptosporidium parvum
PNHIFWLRIGTCIDIMTPITSVKID

SEQ ID NO: 2301528 - protein, 19 aa, Cryptosporidium parvum
PNIFKKLGKINFKLSRKGT

SEQ ID NO: 2301529 - protein, 23 aa, Cryptosporidium parvum
PNIHKGPCKIIEIYTESRMGTRK

SEQ ID NO: 2301530 - protein, 19 aa, Cryptosporidium parvum
PNINKCNIWLPELINLKDL

SEQ ID NO: 2301531 - protein, 23 aa, Cryptosporidium parvum
PNIPCSIAKQLFRKLVSDISQRA

SEQ ID NO: 2301532 - protein, 17 aa, Cryptosporidium parvum
PNIPSGVSFCSSSNTSR

SEQ ID NO: 2301533 - protein, 19 aa, Cryptosporidium parvum
PNIQSFTRMRSHLDNVLFG

SEQ ID NO: 2301534 - protein, 27 aa, Cryptosporidium parvum
PNISCMIGVICLLEISSIGYANSKSNN

SEQ ID NO: 2301535 - protein, 22 aa, Cryptosporidium parvum
PNKEFRLKVSSVVSDLRNWLEQ

SEQ ID NO: 2301536 - protein, 25 aa, Cryptosporidium parvum
PNKFLKFSNLVLVPGKPRKWKRVQR

SEQ ID NO: 2301537 - protein, 19 aa, Cryptosporidium parvum
PNKGFRLFLATELPKKILN

SEQ ID NO: 2301538 - protein, 23 aa, Cryptosporidium parvum
PNKIEFPLDMKYCQVKSIISGDC

SEQ ID NO: 2301539 - protein, 21 aa, Cryptosporidium parvum
PNKRCSCIQAFQILENFKSNN

SEQ ID NO: 2301540 - protein, 21 aa, Cryptosporidium parvum
PNKVQHEIMVPLGPLAFSPGY

SEQ ID NO: 2301541 - protein, 24 aa, Cryptosporidium parvum
PNKVRFFIMDGTDPIAFLSYYTKS

SEQ ID NO: 2301542 - protein, 21 aa, Cryptosporidium parvum
PNLPGAFLSVVMQNLSSVNFP

SEQ ID NO: 2301543 - protein, 25 aa, Cryptosporidium parvum
PNLRDIGLWLDAVVYQSNFRPVPLR

SEQ ID NO: 2301544 - protein, 20 aa, Cryptosporidium parvum
PNNIKTYIHRAGRTARAGKI

SEQ ID NO: 2301545 - protein, 17 aa, Cryptosporidium parvum
PNNLSFSMSSDFGNDFK

SEQ ID NO: 2301546 - protein, 19 aa, Cryptosporidium parvum
PNNSLKLEISWSDRFALSG

SEQ ID NO: 2301547 - protein, 17 aa, Cryptosporidium parvum
PNNTIRRKFIVGITETA

SEQ ID NO: 2301548 - protein, 23 aa, Cryptosporidium parvum
PNPNTRWSIKKALFHPDCIQQLL

SEQ ID NO: 2301549 - protein, 18 aa, Cryptosporidium parvum
PNQLESFSLDNIGALPKN

SEQ ID NO: 2301550 - protein, 18 aa, Cryptosporidium parvum
PNQLFNFEFIQTLGGTNQ

SEQ ID NO: 2301551 - protein, 18 aa, Cryptosporidium parvum
PNQLRILQFNVIPSPNPK

SEQ ID NO: 2301552 - protein, 21 aa, Cryptosporidium parvum
PNRGSIWMVFEYLPYDLSGYI

SEQ ID NO: 2301553 - protein, 23 aa, Cryptosporidium parvum
PNSEALPNPWSINRNSSNNSSNS

SEQ ID NO: 2301554 - protein, 19 aa, Cryptosporidium parvum
PNSQLFWSTCISKLCSWEF

SEQ ID NO: 2301555 - protein, 21 aa, Cryptosporidium parvum
PNSRPDCTVDPQFQPQNIDHI

SEQ ID NO: 2301556 - protein, 24 aa, Cryptosporidium parvum
PNSSSLRSGWGYYINGTKGILNLR

SEQ ID NO: 2301557 - protein, 25 aa, Cryptosporidium parvum
PNSVGPRWGQCTVRIETIGNILTHG

SEQ ID NO: 2301558 - protein, 17 aa, Cryptosporidium parvum
PNSYYIITEPCVSLYNL

SEQ ID NO: 2301559 - protein, 25 aa, Cryptosporidium parvum
PNTPFAVKIARIFGNKFGQLNGNVF

SEQ ID NO: 2301560 - protein, 27 aa, Cryptosporidium parvum
PNVFREMIKWCKLKLNIPILEGTSKKD

SEQ ID NO: 2301561 - protein, 20 aa, Cryptosporidium parvum
PNVGKSSIVNALFGSQKSSI

SEQ ID NO: 2301562 - protein, 24 aa, Cryptosporidium parvum
PNVPYEYLKSVILSSFDTRSEEDN

SEQ ID NO: 2301563 - protein, 18 aa, Cryptosporidium parvum
PNVWRQLNIESSTEDRPS

SEQ ID NO: 2301564 - protein, 17 aa, Cryptosporidium parvum
PNYAAPEVVSGKAYTGP

SEQ ID NO: 2301565 - protein, 22 aa, Cryptosporidium parvum
PNYEWLANWMKIILSAICMPLI

SEQ ID NO: 2301566 - protein, 20 aa, Cryptosporidium parvum
PNYHCPSCQQSIENPIKKYI

SEQ ID NO: 2301567 - protein, 20 aa, Cryptosporidium parvum
PNYLDPVWQLNFDPIKHYTQ

SEQ ID NO: 2301568 - protein, 21 aa, Cryptosporidium parvum
PNYVISPSIWIRLCSDDELHE

SEQ ID NO: 2301569 - protein, 24 aa, Cryptosporidium parvum
PPAEESSWFGGWFGASTPEEPPKE

SEQ ID NO: 2301570 - protein, 22 aa, Cryptosporidium parvum
PPAIPGNSLFQLSNSQSGISNS

SEQ ID NO: 2301571 - protein, 23 aa, Cryptosporidium parvum
PPCCDPSLLEPVKLPFGENDELN

SEQ ID NO: 2301572 - protein, 17 aa, Cryptosporidium parvum
PPCRVFLSDNFKSSKLS

SEQ ID NO: 2301573 - protein, 27 aa, Cryptosporidium parvum
PPDITFPSTFCFPSLSDGRSFTAEILH

SEQ ID NO: 2301574 - protein, 23 aa, Cryptosporidium parvum
PPDLHRLDAPWIHLLKVQVQRDK

SEQ ID NO: 2301575 - protein, 25 aa, Cryptosporidium parvum
PPDSRPFWFQDWGERAISYYSSQID

SEQ ID NO: 2301576 - protein, 25 aa, Cryptosporidium parvum
PPEEWPLSLLTIWKPILETEKDYEA

SEQ ID NO: 2301577 - protein, 24 aa, Cryptosporidium parvum
PPEIRPVPCTVYISGFQEKNYCPR

SEQ ID NO: 2301578 - protein, 22 aa, Cryptosporidium parvum
PPEKIPGYDVWQPPPPQKVDQK

SEQ ID NO: 2301579 - protein, 26 aa, Cryptosporidium parvum
PPFNAPSEFLVFCRVFQNGLRFPPDF

SEQ ID NO: 2301580 - protein, 19 aa, Cryptosporidium parvum
PPGCKDIDDALSIELINPN

SEQ ID NO: 2301581 - protein, 17 aa, Cryptosporidium parvum
PPGDILVFLTGQEEIDN

SEQ ID NO: 2301582 - protein, 21 aa, Cryptosporidium parvum
PPHGIQIGGGIDYKSHGIGVF

SEQ ID NO: 2301583 - protein, 18 aa, Cryptosporidium parvum
PPHKSLKLNVNNDVSNGN

SEQ ID NO: 2301584 - protein, 25 aa, Cryptosporidium parvum
PPHPGIHAPPPFMDPWNMQGHPYPA

SEQ ID NO: 2301585 - protein, 21 aa, Cryptosporidium parvum
PPIGICLHSLLYILPPSVPTE

SEQ ID NO: 2301586 - protein, 17 aa, Cryptosporidium parvum
PPIRVVSAIAPKSNQFN

SEQ ID NO: 2301587 - protein, 19 aa, Cryptosporidium parvum
PPKIRLMSVKAIFSENFLS

SEQ ID NO: 2301588 - protein, 25 aa, Cryptosporidium parvum
PPKSPGLIPRFTIDMWDSSITSGPI

SEQ ID NO: 2301589 - protein, 24 aa, Cryptosporidium parvum
PPLEACTAMSSFGCPLKVYIKNSG

SEQ ID NO: 2301590 - protein, 23 aa, Cryptosporidium parvum
PPLESANLFKARRYDHLSASMNA

SEQ ID NO: 2301591 - protein, 19 aa, Cryptosporidium parvum
PPLKLIIMSATLRVTDFSE

SEQ ID NO: 2301592 - protein, 18 aa, Cryptosporidium parvum
PPLNDFLLGKIVFLDSIY

SEQ ID NO: 2301593 - protein, 23 aa, Cryptosporidium parvum
PPLPPKRNGPGWNSHSTGNKLED

SEQ ID NO: 2301594 - protein, 23 aa, Cryptosporidium parvum
PPLSSLPLFVRVKFNANERRGQP

SEQ ID NO: 2301595 - protein, 17 aa, Cryptosporidium parvum
PPLVMSMSFTNQVLAQM

SEQ ID NO: 2301596 - protein, 19 aa, Cryptosporidium parvum
PPMRRYLDERIKLQETRVQ

SEQ ID NO: 2301597 - protein, 20 aa, Cryptosporidium parvum
PPNGISCFESSFLPYYCTQQ

SEQ ID NO: 2301598 - protein, 17 aa, Cryptosporidium parvum
PPPKRGTTSQGFGGPSG

SEQ ID NO: 2301599 - protein, 25 aa, Cryptosporidium parvum
PPPNRKGRYSVVSSYGTNNPKFVNY

SEQ ID NO: 2301600 - protein, 23 aa, Cryptosporidium parvum
PPPPLEMILCIGDDRSDEDMFSV

SEQ ID NO: 2301601 - protein, 17 aa, Cryptosporidium parvum
PPPSYPAPVLKTNIHHF

SEQ ID NO: 2301602 - protein, 24 aa, Cryptosporidium parvum
PPRFTRGILNRHCYVLFDNMKNRD

SEQ ID NO: 2301603 - protein, 20 aa, Cryptosporidium parvum
PPRTLGDAVVAWEVSSTLLN

SEQ ID NO: 2301604 - protein, 29 aa, Cryptosporidium parvum
PPSALKLPWQKVCIDIATSIVKNPHPKTL

SEQ ID NO: 2301605 - protein, 17 aa, Cryptosporidium parvum
PPSALSNVISWRPEGIK

SEQ ID NO: 2301606 - protein, 17 aa, Cryptosporidium parvum
PPSFMLMALQGNKVVLY

SEQ ID NO: 2301607 - protein, 36 aa, Cryptosporidium parvum
PPSGFKVFCGMLDIFGFEVFKNNSLEQFFINVTNEY

SEQ ID NO: 2301608 - protein, 18 aa, Cryptosporidium parvum
PPTTGYCLKNDEGVTSAT

SEQ ID NO: 2301609 - protein, 17 aa, Cryptosporidium parvum
PPVIPKNADLVFEITLL

SEQ ID NO: 2301610 - protein, 18 aa, Cryptosporidium parvum
PPVLASDAFMEVKDNLII

SEQ ID NO: 2301611 - protein, 20 aa, Cryptosporidium parvum
PPVPGLSCVINLPDKKTLCL

SEQ ID NO: 2301612 - protein, 19 aa, Cryptosporidium parvum
PPYYPIKAFYPVITSIIAF

SEQ ID NO: 2301613 - protein, 17 aa, Cryptosporidium parvum
PQAPRPSSSYMSGGDAI

SEQ ID NO: 2301614 - protein, 18 aa, Cryptosporidium parvum
PQCSSASIEVHEGRGETI

SEQ ID NO: 2301615 - protein, 23 aa, Cryptosporidium parvum
PQESHSGCNNCNSSIKYRFDTKD

SEQ ID NO: 2301616 - protein, 26 aa, Cryptosporidium parvum
PQFIQASKYFTCFYGSNNIENSSLVN

SEQ ID NO: 2301617 - protein, 20 aa, Cryptosporidium parvum
PQHPCLILDIGCGTGISGSV

SEQ ID NO: 2301618 - protein, 17 aa, Cryptosporidium parvum
PQIIPICNPNKSSNSDK

SEQ ID NO: 2301619 - protein, 20 aa, Cryptosporidium parvum
PQILKSLGIKTIMDFTPNKI

SEQ ID NO: 2301620 - protein, 20 aa, Cryptosporidium parvum
PQITPGVGINPQITTGIGVN

SEQ ID NO: 2301621 - protein, 22 aa, Cryptosporidium parvum
PQITVALCKARMLSMDCRCKSF

SEQ ID NO: 2301622 - protein, 34 aa, Cryptosporidium parvum
PQIWDRRAVLIGELLQRIGLESEYMRFLSSELNL

SEQ ID NO: 2301623 - protein, 26 aa, Cryptosporidium parvum
PQIYGEKWSIIVIIAILQILKPCKDI

SEQ ID NO: 2301624 - protein, 22 aa, Cryptosporidium parvum
PQKLMECLVVIKSPNSDITQKD

SEQ ID NO: 2301625 - protein, 20 aa, Cryptosporidium parvum
PQLPNLMNLYSPFANSNPNT

SEQ ID NO: 2301626 - protein, 22 aa, Cryptosporidium parvum
PQMHLHVLKRLTLLPPESKSTK

SEQ ID NO: 2301627 - protein, 24 aa, Cryptosporidium parvum
PQMSAAYASYGFVPSQNLGYTTVG

SEQ ID NO: 2301628 - protein, 20 aa, Cryptosporidium parvum
PQPPRIVREQCITMVAVIAG

SEQ ID NO: 2301629 - protein, 23 aa, Cryptosporidium parvum
PQRLYCSFCEIYLDIPQRGTIKI

SEQ ID NO: 2301630 - protein, 25 aa, Cryptosporidium parvum
PQSEELWLRYARLSEYCDAQKILNE

SEQ ID NO: 2301631 - protein, 26 aa, Cryptosporidium parvum
PQTKGRGSLNFALSVQKFAIVVQMLM

SEQ ID NO: 2301632 - protein, 30 aa, Cryptosporidium parvum
PQWYIDTYIKLFCLAGNIIKEEERDYFISY

SEQ ID NO: 2301633 - protein, 24 aa, Cryptosporidium parvum
PQYYVPRIYGFAVYRNKRDLLAEE

SEQ ID NO: 2301634 - protein, 20 aa, Cryptosporidium parvum
PRDELGIYFGSDEKIECIYV

SEQ ID NO: 2301635 - protein, 23 aa, Cryptosporidium parvum
PRDVIRITHPFSPCSETESETNN

SEQ ID NO: 2301636 - protein, 18 aa, Cryptosporidium parvum
PREAINLKRDMMINKQRL

SEQ ID NO: 2301637 - protein, 18 aa, Cryptosporidium parvum
PRFNLWASIKESITKDIS

SEQ ID NO: 2301638 - protein, 27 aa, Cryptosporidium parvum
PRHGRYLTASVMFRGRMSTKEVDEQML

SEQ ID NO: 2301639 - protein, 20 aa, Cryptosporidium parvum
PRHIRMLFLLHKWDAPMNYS

SEQ ID NO: 2301640 - protein, 18 aa, Cryptosporidium parvum
PRIDAIRTIVIDYFNCGD

SEQ ID NO: 2301641 - protein, 18 aa, Cryptosporidium parvum
PRIDSNVVKLQYKSNQDK

SEQ ID NO: 2301642 - protein, 30 aa, Cryptosporidium parvum
PRIDWKPNPLCWDNLRKAFCSGYFHNSAKI

SEQ ID NO: 2301643 - protein, 27 aa, Cryptosporidium parvum
PRIFRAIFNLAIKRRWSTLARRSLKIA

SEQ ID NO: 2301644 - protein, 20 aa, Cryptosporidium parvum
PRIINHIIIKIPSLCEYRTK

SEQ ID NO: 2301645 - protein, 17 aa, Cryptosporidium parvum
PRISFKKDGELKMNKIR

SEQ ID NO: 2301646 - protein, 18 aa, Cryptosporidium parvum
PRKIKSFYNKYLDYYNEK

SEQ ID NO: 2301647 - protein, 20 aa, Cryptosporidium parvum
PRKIRPTLFYEMAKAPPRIS

SEQ ID NO: 2301648 - protein, 21 aa, Cryptosporidium parvum
PRLHSALTRLYWKNMLKSIKC

SEQ ID NO: 2301649 - protein, 17 aa, Cryptosporidium parvum
PRLSMSYNIRKKTIGIV

SEQ ID NO: 2301650 - protein, 20 aa, Cryptosporidium parvum
PRLYCSLGDLTQDLSFYEKS

SEQ ID NO: 2301651 - protein, 18 aa, Cryptosporidium parvum
PRMVRDVFRLARENSPAI

SEQ ID NO: 2301652 - protein, 21 aa, Cryptosporidium parvum
PRNCTTCRACIEKFPNKIKLL

SEQ ID NO: 2301653 - protein, 19 aa, Cryptosporidium parvum
PRNHSSLLLNLLGNNINDN

SEQ ID NO: 2301654 - protein, 19 aa, Cryptosporidium parvum
PRNISLMIHRSGRTARASR

SEQ ID NO: 2301655 - protein, 27 aa, Cryptosporidium parvum
PRNLTKIRLKNCIPVESIMELRYNKTE

SEQ ID NO: 2301656 - protein, 19 aa, Cryptosporidium parvum
PRPINWWFNHSVRHITVKF

SEQ ID NO: 2301657 - protein, 23 aa, Cryptosporidium parvum
PRPNARVCVMGDAADCERAQKLG

SEQ ID NO: 2301658 - protein, 19 aa, Cryptosporidium parvum
PRPRPQFANSSTLGGLEFD

SEQ ID NO: 2301659 - protein, 26 aa, Cryptosporidium parvum
PRQPKLRLLYRDHVTTFVDTRIRHFR

SEQ ID NO: 2301660 - protein, 18 aa, Cryptosporidium parvum
PRSCFPICVDFANHVCIR

SEQ ID NO: 2301661 - protein, 22 aa, Cryptosporidium parvum
PRSDEELAFLFAFDTDEYNRFD

SEQ ID NO: 2301662 - protein, 26 aa, Cryptosporidium parvum
PRTARIPINTGYNFKVIPQNDNSSIE

SEQ ID NO: 2301663 - protein, 20 aa, Cryptosporidium parvum
PRTASLFLSIGNNKTSILQM

SEQ ID NO: 2301664 - protein, 18 aa, Cryptosporidium parvum
PRTLLCTLKTTPRPYLVW

SEQ ID NO: 2301665 - protein, 18 aa, Cryptosporidium parvum
PRTPLVLDSRYFPSKFGG

SEQ ID NO: 2301666 - protein, 20 aa, Cryptosporidium parvum
PRTPQFRATYILPTSPHFSD

SEQ ID NO: 2301667 - protein, 25 aa, Cryptosporidium parvum
PRTRFDCLKELLLVCKNSSGAGGLV

SEQ ID NO: 2301668 - protein, 21 aa, Cryptosporidium parvum
PRVDILRFVHDKYVIPILMVI

SEQ ID NO: 2301669 - protein, 18 aa, Cryptosporidium parvum
PRVFGFKDIKSLREHVIS

SEQ ID NO: 2301670 - protein, 19 aa, Cryptosporidium parvum
PRVLCNGYKVLPVGITNEL

SEQ ID NO: 2301671 - protein, 18 aa, Cryptosporidium parvum
PRVLDKMMPFFTEKFGNS

SEQ ID NO: 2301672 - protein, 17 aa, Cryptosporidium parvum
PRVPFSPDYWQKQILDI

SEQ ID NO: 2301673 - protein, 17 aa, Cryptosporidium parvum
PRYGVPVGLANFSAAYC

SEQ ID NO: 2301674 - protein, 25 aa, Cryptosporidium parvum
PSAHQGAVWGVAWHPLGHLVVSSGQ

SEQ ID NO: 2301675 - protein, 17 aa, Cryptosporidium parvum
PSALLTVLHNSRQICLK

SEQ ID NO: 2301676 - protein, 20 aa, Cryptosporidium parvum
PSARKGHSLALLDDVSAVMF

SEQ ID NO: 2301677 - protein, 26 aa, Cryptosporidium parvum
PSCDIISFLDIFLLSLFRSKIPQLIR

SEQ ID NO: 2301678 - protein, 20 aa, Cryptosporidium parvum
PSDRSNLLTSIFTTLNMEEK

SEQ ID NO: 2301679 - protein, 19 aa, Cryptosporidium parvum
PSEEYKYILNWPEGSSSNT

SEQ ID NO: 2301680 - protein, 25 aa, Cryptosporidium parvum
PSENGICGGINNYSICTNNHIGGPI

SEQ ID NO: 2301681 - protein, 21 aa, Cryptosporidium parvum
PSEVLQRLNIRNENISEQDNL

SEQ ID NO: 2301682 - protein, 17 aa, Cryptosporidium parvum
PSFERMNSGFLGFGRKP

SEQ ID NO: 2301683 - protein, 26 aa, Cryptosporidium parvum
PSFLSFKPKFMYSIPFKCNENKYSRS

SEQ ID NO: 2301684 - protein, 34 aa, Cryptosporidium parvum
PSGCINLSSVIAIHIEDALNFVIRTFGRDYCLRA

SEQ ID NO: 2301685 - protein, 25 aa, Cryptosporidium parvum
PSGDFMMCKVCGFKSAVLGKTGLPV

SEQ ID NO: 2301686 - protein, 25 aa, Cryptosporidium parvum
PSGDLIPWTLCNHLARDDFGKLTGL

SEQ ID NO: 2301687 - protein, 18 aa, Cryptosporidium parvum
PSGECFVLNLAYKFDPCV

SEQ ID NO: 2301688 - protein, 18 aa, Cryptosporidium parvum
PSGIVPRPRRIWSILASK

SEQ ID NO: 2301689 - protein, 18 aa, Cryptosporidium parvum
PSIIIRDAHHFDKNANIN

SEQ ID NO: 2301690 - protein, 24 aa, Cryptosporidium parvum
PSKFDCLRRVPAYDKLITERFERC

SEQ ID NO: 2301691 - protein, 18 aa, Cryptosporidium parvum
PSKILFRAVRGMIPHKTP

SEQ ID NO: 2301692 - protein, 19 aa, Cryptosporidium parvum
PSKTYSDVQFSKKLSEPKI

SEQ ID NO: 2301693 - protein, 25 aa, Cryptosporidium parvum
PSLCEYRTKQAFFFESPILFEVDIA

SEQ ID NO: 2301694 - protein, 30 aa, Cryptosporidium parvum
PSLCNFLGIEMIRPLLFHSALRHLGYKSSH

SEQ ID NO: 2301695 - protein, 17 aa, Cryptosporidium parvum
PSLEETFEFFSQDVCLD

SEQ ID NO: 2301696 - protein, 19 aa, Cryptosporidium parvum
PSLGLIWSNSINWRIFLSK

SEQ ID NO: 2301697 - protein, 17 aa, Cryptosporidium parvum
PSLNMLNSIDFNYLSPL

SEQ ID NO: 2301698 - protein, 23 aa, Cryptosporidium parvum
PSLPEIKAILKWTDNVSQDTLND

SEQ ID NO: 2301699 - protein, 22 aa, Cryptosporidium parvum
PSLVRRCFEIFVSIGGSVLKRD

SEQ ID NO: 2301700 - protein, 18 aa, Cryptosporidium parvum
PSNAGLFSPFSINITTGD

SEQ ID NO: 2301701 - protein, 25 aa, Cryptosporidium parvum
PSPRKDWPFDEAILYPPHPRIGSPV

SEQ ID NO: 2301702 - protein, 23 aa, Cryptosporidium parvum
PSPRLLKHIIRCYLRLSENSKVR

SEQ ID NO: 2301703 - protein, 27 aa, Cryptosporidium parvum
PSQMRNRCKLGVFSHRVCEKVSAIKVA

SEQ ID NO: 2301704 - protein, 19 aa, Cryptosporidium parvum
PSQRPAMAGNEIKGQDLKS

SEQ ID NO: 2301705 - protein, 29 aa, Cryptosporidium parvum
PSQTTYGKCGVKYETTQSGKTQIKITETY

SEQ ID NO: 2301706 - protein, 18 aa, Cryptosporidium parvum
PSREIMKFIQNIDGKNGL

SEQ ID NO: 2301707 - protein, 22 aa, Cryptosporidium parvum
PSRTCKLLERLVKYKCPNLNGI

SEQ ID NO: 2301708 - protein, 26 aa, Cryptosporidium parvum
PSSAIIKFLWTVRATNFIQRFIENLI

SEQ ID NO: 2301709 - protein, 21 aa, Cryptosporidium parvum
PSSAKAALFSSVPGQKQAQRD

SEQ ID NO: 2301710 - protein, 18 aa, Cryptosporidium parvum
PSSCCGYIINSSEHWTSI

SEQ ID NO: 2301711 - protein, 18 aa, Cryptosporidium parvum
PSSEVSLENSILYEESSE

SEQ ID NO: 2301712 - protein, 24 aa, Cryptosporidium parvum
PSSFSLKTSRGMIDSSGGGTIGSR

SEQ ID NO: 2301713 - protein, 19 aa, Cryptosporidium parvum
PSSGKLFIWNITSMELIHQ

SEQ ID NO: 2301714 - protein, 20 aa, Cryptosporidium parvum
PSSIRFQWYQQALDWLSPEI

SEQ ID NO: 2301715 - protein, 31 aa, Cryptosporidium parvum
PSSLIKIEIMFWKLVTCLHILREEYKLLKAH

SEQ ID NO: 2301716 - protein, 26 aa, Cryptosporidium parvum
PSSLYSISLLLIIGLALKKNGENETL

SEQ ID NO: 2301717 - protein, 21 aa, Cryptosporidium parvum
PSSYIKWNVSFMCFITAEIPN

SEQ ID NO: 2301718 - protein, 17 aa, Cryptosporidium parvum
PSTFRVVGVSPYSSSIK

SEQ ID NO: 2301719 - protein, 23 aa, Cryptosporidium parvum
PSVSRDLLFHLYCLFSENIQNGD

SEQ ID NO: 2301720 - protein, 23 aa, Cryptosporidium parvum
PSVVCSLFPVLINNNFLKNEGSC

SEQ ID NO: 2301721 - protein, 21 aa, Cryptosporidium parvum
PSWILCIDIAAILLTNTDNKM

SEQ ID NO: 2301722 - protein, 17 aa, Cryptosporidium parvum
PSYPIRYISALKDSNCE

SEQ ID NO: 2301723 - protein, 17 aa, Cryptosporidium parvum
PSYPYLRVPGVNSQIPN

SEQ ID NO: 2301724 - protein, 19 aa, Cryptosporidium parvum
PTACPLVLELDDYLKVTKK

SEQ ID NO: 2301725 - protein, 18 aa, Cryptosporidium parvum
PTAGRVSGVTGLPAPPTL

SEQ ID NO: 2301726 - protein, 19 aa, Cryptosporidium parvum
PTCRTHFCGYDENLENSNI

SEQ ID NO: 2301727 - protein, 23 aa, Cryptosporidium parvum
PTDLECFNDLSVIGFNLYPSLAK

SEQ ID NO: 2301728 - protein, 22 aa, Cryptosporidium parvum
PTDPESPAFWFAEASYLRDEKE

SEQ ID NO: 2301729 - protein, 24 aa, Cryptosporidium parvum
PTEFPEGCVFIPEQRLVMGVPLSF

SEQ ID NO: 2301730 - protein, 19 aa, Cryptosporidium parvum
PTGNGLKLETTFVLPCGIP

SEQ ID NO: 2301731 - protein, 27 aa, Cryptosporidium parvum
PTHASGASVLWSLRSILINNVNKYHKE

SEQ ID NO: 2301732 - protein, 21 aa, Cryptosporidium parvum
PTHPIRLGLALNFSVFHYEIL

SEQ ID NO: 2301733 - protein, 22 aa, Cryptosporidium parvum
PTIEEIKRFFGVSDLSEVNIDS

SEQ ID NO: 2301734 - protein, 20 aa, Cryptosporidium parvum
PTIEWCRKSLQIISMEISEI

SEQ ID NO: 2301735 - protein, 24 aa, Cryptosporidium parvum
PTINRANVYIGFQVQLDLTGIFMH

SEQ ID NO: 2301736 - protein, 26 aa, Cryptosporidium parvum
PTIQRICELLLFPDCYNNTKSFLYAL

SEQ ID NO: 2301737 - protein, 19 aa, Cryptosporidium parvum
PTISAAGLFSLPSTEGSSD

SEQ ID NO: 2301738 - protein, 24 aa, Cryptosporidium parvum
PTKSELDYIFGILSRESFSSGFSA

SEQ ID NO: 2301739 - protein, 19 aa, Cryptosporidium parvum
PTNAIRTVKVCPLPSAGSS

SEQ ID NO: 2301740 - protein, 23 aa, Cryptosporidium parvum
PTPDELFKQLSLINTKFEDICLN

SEQ ID NO: 2301741 - protein, 24 aa, Cryptosporidium parvum
PTPIPSTFVSPAFSVYSAPNHSQY

SEQ ID NO: 2301742 - protein, 23 aa, Cryptosporidium parvum
PTQSCSFSTLSGGFVPPLTDVSS

SEQ ID NO: 2301743 - protein, 24 aa, Cryptosporidium parvum
PTQVLLVAWMSWWTKLTEESFSSG

SEQ ID NO: 2301744 - protein, 18 aa, Cryptosporidium parvum
PTREYRKIFSRFSTQNLC

SEQ ID NO: 2301745 - protein, 19 aa, Cryptosporidium parvum
PTRRMLMEGQWSFDPNSRL

SEQ ID NO: 2301746 - protein, 23 aa, Cryptosporidium parvum
PTSGRPAIYRVMTSTTVAFPPYN

SEQ ID NO: 2301747 - protein, 17 aa, Cryptosporidium parvum
PTSISIQLWNKSWSVPY

SEQ ID NO: 2301748 - protein, 22 aa, Cryptosporidium parvum
PTSRDPKLWLVKVDRAGLEKDI

SEQ ID NO: 2301749 - protein, 24 aa, Cryptosporidium parvum
PTSRGASEFGTPNAFSHRNNQVPQ

SEQ ID NO: 2301750 - protein, 18 aa, Cryptosporidium parvum
PTSSIAISAISKISELSK

SEQ ID NO: 2301751 - protein, 21 aa, Cryptosporidium parvum
PTTYFALKFQKGAQEYRQAAY

SEQ ID NO: 2301752 - protein, 25 aa, Cryptosporidium parvum
PTVEESSWFSGWFGASETTPAPPPT

SEQ ID NO: 2301753 - protein, 27 aa, Cryptosporidium parvum
PTYQPLVYWRVYKGLSPSISFPSDEIS

SEQ ID NO: 2301754 - protein, 17 aa, Cryptosporidium parvum
PVAEYMPVTTPIIMARQ

SEQ ID NO: 2301755 - protein, 23 aa, Cryptosporidium parvum
PVEERWPHLDVVTDIGTTITDLK

SEQ ID NO: 2301756 - protein, 24 aa, Cryptosporidium parvum
PVEICPLNVPKLIAFQRPEHYIRF

SEQ ID NO: 2301757 - protein, 20 aa, Cryptosporidium parvum
PVEIIKDEFESLINPENSSK

SEQ ID NO: 2301758 - protein, 18 aa, Cryptosporidium parvum
PVFSCDYSSENKRATPQQ

SEQ ID NO: 2301759 - protein, 18 aa, Cryptosporidium parvum
PVGTCSSTSIGNSNGVAF

SEQ ID NO: 2301760 - protein, 18 aa, Cryptosporidium parvum
PVHYHFRSKKGIPIYKYN

SEQ ID NO: 2301761 - protein, 22 aa, Cryptosporidium parvum
PVIPFIEVFELLNAIIELINSI

SEQ ID NO: 2301762 - protein, 17 aa, Cryptosporidium parvum
PVKEMTRVFSVDMQEKE

SEQ ID NO: 2301763 - protein, 24 aa, Cryptosporidium parvum
PVKKFKFNIGQIFTNRILSKQNDY

SEQ ID NO: 2301764 - protein, 22 aa, Cryptosporidium parvum
PVKRTIEKPVPIGLYDQPELLQ

SEQ ID NO: 2301765 - protein, 17 aa, Cryptosporidium parvum
PVLDVCSILTCIQSLLN

SEQ ID NO: 2301766 - protein, 19 aa, Cryptosporidium parvum
PVLEEREVIVARREVQERI

SEQ ID NO: 2301767 - protein, 25 aa, Cryptosporidium parvum
PVMEASRLKLIFAGRILNDSQTVQD

SEQ ID NO: 2301768 - protein, 22 aa, Cryptosporidium parvum
PVMQQIFIIWSIIQKTEIIEDQ

SEQ ID NO: 2301769 - protein, 17 aa, Cryptosporidium parvum
PVNEIKTNLDITTNLDE

SEQ ID NO: 2301770 - protein, 26 aa, Cryptosporidium parvum
PVNHFWNYIFYCRWVLQVTIGEYYSF

SEQ ID NO: 2301771 - protein, 23 aa, Cryptosporidium parvum
PVNKNEVRLVYRIKNSSVSGENG

SEQ ID NO: 2301772 - protein, 21 aa, Cryptosporidium parvum
PVNSVCFHPQFANVLATGGSD

SEQ ID NO: 2301773 - protein, 31 aa, Cryptosporidium parvum; identical to SEQ ID NO: 2179444

SEQ ID NO: 2301774 - protein, 25 aa, Cryptosporidium parvum
PVPKKFKPSELITELVGNVYKYGDS

SEQ ID NO: 2301775 - protein, 24 aa, Cryptosporidium parvum
PVPPNCIRPSVTMGESGSNEDDLT

SEQ ID NO: 2301776 - protein, 25 aa, Cryptosporidium parvum
PVQSKFRLTYQMILQLSCRHSLKIE

SEQ ID NO: 2301777 - protein, 26 aa, Cryptosporidium parvum
PVQVRKEPNLGFKSLISSGIKVNMAE

SEQ ID NO: 2301778 - protein, 23 aa, Cryptosporidium parvum
PVRCHFCDCWSAWNSHLLCDRCS

SEQ ID NO: 2301779 - protein, 32 aa, Cryptosporidium parvum; identical to SEQ ID NO: 2179448

SEQ ID NO: 2301780 - protein, 18 aa, Cryptosporidium parvum
PVRVYEFEILDAIENNDV

SEQ ID NO: 2301781 - protein, 17 aa, Cryptosporidium parvum
PVSFKKFNVFQHCNIQG

SEQ ID NO: 2301782 - protein, 19 aa, Cryptosporidium parvum
PVSGCQWLGYNRVHIRESR

SEQ ID NO: 2301783 - protein, 22 aa, Cryptosporidium parvum
PVSHIQSGLGRFGMSSVGGSVP

SEQ ID NO: 2301784 - protein, 18 aa, Cryptosporidium parvum
PVSLDLLLINGEELINKE

SEQ ID NO: 2301785 - protein, 20 aa, Cryptosporidium parvum
PVSLSLKFAKAMVDHYPERL

SEQ ID NO: 2301786 - protein, 17 aa, Cryptosporidium parvum
PVSNRPVPKRGFIPSKW

SEQ ID NO: 2301787 - protein, 20 aa, Cryptosporidium parvum
PVTLRNGYKIPKSRENNEPC

SEQ ID NO: 2301788 - protein, 18 aa, Cryptosporidium parvum
PVTYKYPKSLSFPGYIET

SEQ ID NO: 2301789 - protein, 24 aa, Cryptosporidium parvum
PVVDLRGAILDFVGFIMNWSEVEN

SEQ ID NO: 2301790 - protein, 20 aa, Cryptosporidium parvum
PVYMSFPYNQGRNINVPYTV

SEQ ID NO: 2301791 - protein, 19 aa, Cryptosporidium parvum
PVYSRGIQSILKWGSNTYR

SEQ ID NO: 2301792 - protein, 23 aa, Cryptosporidium parvum
PWCDECQDSPAILWCQADTARLC

SEQ ID NO: 2301793 - protein, 24 aa, Cryptosporidium parvum
PWESFCGLASKVGLELVQYSDFPS

SEQ ID NO: 2301794 - protein, 19 aa, Cryptosporidium parvum
PWGGVTLIPFIDEFLLLDS

SEQ ID NO: 2301795 - protein, 23 aa, Cryptosporidium parvum
PWITRFADDILFLSPRNYFYSND

SEQ ID NO: 2301796 - protein, 23 aa, Cryptosporidium parvum
PWLKYHAGIVLLELERYEEALTM

SEQ ID NO: 2301797 - protein, 17 aa, Cryptosporidium parvum
PWNGNRFMFPRGKMDEM

SEQ ID NO: 2301798 - protein, 24 aa, Cryptosporidium parvum
PWNMQGHPYPAYAPDGASHHFHPG

SEQ ID NO: 2301799 - protein, 22 aa, Cryptosporidium parvum
PWPEIDVSKPIPYVKQKQPPKL

SEQ ID NO: 2301800 - protein, 20 aa, Cryptosporidium parvum
PYEMTVVPELDRILEDQKKR

SEQ ID NO: 2301801 - protein, 19 aa, Cryptosporidium parvum
PYERFIGQPILVWGDSQLF

SEQ ID NO: 2301802 - protein, 17 aa, Cryptosporidium parvum
PYFKGILRLSSAFNSFK

SEQ ID NO: 2301803 - protein, 17 aa, Cryptosporidium parvum
PYFYLEAQKAVDIHWIL

SEQ ID NO: 2301804 - protein, 19 aa, Cryptosporidium parvum
PYGKSGCRRIVPGHYLAVD

SEQ ID NO: 2301805 - protein, 30 aa, Cryptosporidium parvum
PYGPGPLEFKGKDGWLIEPQEWIEFAKMAL

SEQ ID NO: 2301806 - protein, 24 aa, Cryptosporidium parvum
PYGSRPALKFAQHTGAHAMVGRFT

SEQ ID NO: 2301807 - protein, 18 aa, Cryptosporidium parvum
PYGVIPFNCKIENRTFSK

SEQ ID NO: 2301808 - protein, 35 aa, Cryptosporidium parvum
PYIASKVDSWCLGWSTFYLLFGTELFESVHNIDND

SEQ ID NO: 2301809 - protein, 21 aa, Cryptosporidium parvum
PYIDESFNIGKFHCLVTEFCK

SEQ ID NO: 2301810 - protein, 17 aa, Cryptosporidium parvum
PYISWPIKTSFAKLENL

SEQ ID NO: 2301811 - protein, 20 aa, Cryptosporidium parvum
PYISYSKCFYNFSRVSKLVQ

SEQ ID NO: 2301812 - protein, 20 aa, Cryptosporidium parvum
PYLASRYGIREWINMNRTKD

SEQ ID NO: 2301813 - protein, 24 aa, Cryptosporidium parvum
PYLEVGEIKTIIEIEIMSASSIKQ

SEQ ID NO: 2301814 - protein, 17 aa, Cryptosporidium parvum
PYLILTVLHEARRFKVQ

SEQ ID NO: 2301815 - protein, 18 aa, Cryptosporidium parvum
PYLPTKNSRRLILEQLKI

SEQ ID NO: 2301816 - protein, 17 aa, Cryptosporidium parvum
PYLRAPRMYSISDLALA

SEQ ID NO: 2301817 - protein, 19 aa, Cryptosporidium parvum
PYLYYRIRVGESYYHASED

SEQ ID NO: 2301818 - protein, 17 aa, Cryptosporidium parvum
PYMKKLSVQISKRCMAC

SEQ ID NO: 2301819 - protein, 21 aa, Cryptosporidium parvum
PYNPTRIVQALVWSIYDDEEE

SEQ ID NO: 2301820 - protein, 40 aa, Cryptosporidium parvum; identical to SEQ ID NO: 2179487

SEQ ID NO: 2301821 - protein, 26 aa, Cryptosporidium parvum
PYSIIALKYCVENGILMGAKHTSAYK

SEQ ID NO: 2301822 - protein, 25 aa, Cryptosporidium parvum
PYVERESYDYPLLLVPIISSMSNLN

SEQ ID NO: 2301823 - protein, 23 aa, Cryptosporidium parvum
PYVRKTAAICIAKLYDISPTLME

SEQ ID NO: 2301824 - protein, 18 aa, Cryptosporidium parvum
PYWEAFKVNNAYSHIKYI

SEQ ID NO: 2301825 - protein, 19 aa, Cryptosporidium parvum
PYYFPYFFPNYSENNELIV

SEQ ID NO: 2301826 - protein, 25 aa, Cryptosporidium parvum
QAALMAANPFFMFGAAAAAAAAAAV

SEQ ID NO: 2301827 - protein, 23 aa, Cryptosporidium parvum
QACKYPIYNILYKLGNDIKSQEG

SEQ ID NO: 2301828 - protein, 22 aa, Cryptosporidium parvum
QAFHKWIGWIESKLRFLVRKLE

SEQ ID NO: 2301829 - protein, 23 aa, Cryptosporidium parvum
QAFKEGRYRCLVATDVAARGLHI

SEQ ID NO: 2301830 - protein, 27 aa, Cryptosporidium parvum
QAFRTARQKVKICVLPGRIKELDQFIN

SEQ ID NO: 2301831 - protein, 21 aa, Cryptosporidium parvum
QAGSLYWARKIIIKAIELGFL

SEQ ID NO: 2301832 - protein, 34 aa, Cryptosporidium parvum
QAHIDPRVLIILFWKDLIPIEWDLKYSNGSLSDL

SEQ ID NO: 2301833 - protein, 22 aa, Cryptosporidium parvum
QAHSNAIISLHWENDEGSHRFL

SEQ ID NO: 2301834 - protein, 20 aa, Cryptosporidium parvum
QAIFCCKLIEGFGMSECIGT

SEQ ID NO: 2301835 - protein, 35 aa, Cryptosporidium parvum; identical to SEQ ID NO: 2179500

SEQ ID NO: 2301836 - protein, 20 aa, Cryptosporidium parvum
QAKDLKEWIKAHSPNRDSNY

SEQ ID NO: 2301837 - protein, 27 aa, Cryptosporidium parvum
QAKIAMKRVLLALQWLHANNVVHRDLK

SEQ ID NO: 2301838 - protein, 19 aa, Cryptosporidium parvum
QAKPPFIVLENIYGNVHRG

SEQ ID NO: 2301839 - protein, 19 aa, Cryptosporidium parvum
QALEILIGIFGEEYILSES

SEQ ID NO: 2301840 - protein, 28 aa, Cryptosporidium parvum
QALLKERNLRLVSIDDWEEAPDVDEDGF

SEQ ID NO: 2301841 - protein, 22 aa, Cryptosporidium parvum
QANQRFLLLYTFLKKNRDKKVM

SEQ ID NO: 2301842 - protein, 22 aa, Cryptosporidium parvum
QANTQFIAGFHILQSQSIGHTL

SEQ ID NO: 2301843 - protein, 19 aa, Cryptosporidium parvum
QARHSEFISGFKIIASQLK

SEQ ID NO: 2301844 - protein, 19 aa, Cryptosporidium parvum
QARYRPEPGHVRMNQKYES

SEQ ID NO: 2301845 - protein, 23 aa, Cryptosporidium parvum
QAVMSYPLITQWYKEMEQSADTE

SEQ ID NO: 2301846 - protein, 24 aa, Cryptosporidium parvum
QAYRKLKFFTEFKLWKIFKDEYSN

SEQ ID NO: 2301847 - protein, 28 aa, Cryptosporidium parvum
QCASCEHCSIGGYPYYCNCYKMPSESAA

SEQ ID NO: 2301848 - protein, 23 aa, Cryptosporidium parvum
QCCSYPTLAFFEGYNRLNSWSKE

SEQ ID NO: 2301849 - protein, 21 aa, Cryptosporidium parvum
QCIDRYKYCRSLVVNKESEKK

SEQ ID NO: 2301850 - protein, 21 aa, Cryptosporidium parvum
QCIPMAVLGAAPLSMPKDIIP

SEQ ID NO: 2301851 - protein, 21 aa, Cryptosporidium parvum
QCIYHDYRTGLIDLKTDVTPR

SEQ ID NO: 2301852 - protein, 21 aa, Cryptosporidium parvum
QCKYSQIMLGTSWKGYEFVSK

SEQ ID NO: 2301853 - protein, 23 aa, Cryptosporidium parvum
QCPPICIYGCSMILESGFVRNAV

SEQ ID NO: 2301854 - protein, 24 aa, Cryptosporidium parvum
QCPPKLGKRPPIKNELLAMNDQKN

SEQ ID NO: 2301855 - protein, 26 aa, Cryptosporidium parvum
QCQARLKELYSLGIVEFEGSNREEFL

SEQ ID NO: 2301856 - protein, 20 aa, Cryptosporidium parvum
QCRCKALFSHIIYYFDENDH

SEQ ID NO: 2301857 - protein, 35 aa, Cryptosporidium parvum
QDCPWKTDPDHPIRLCDSCSGGNYYLNSRLDFSTY

SEQ ID NO: 2301858 - protein, 25 aa, Cryptosporidium parvum
QDDIYGWLKRCGKFKATQRTKGVST

SEQ ID NO: 2301859 - protein, 24 aa, Cryptosporidium parvum
QDDKFCSFMRFGIFGLGDSNYVFF

SEQ ID NO: 2301860 - protein, 21 aa, Cryptosporidium parvum
QDDLSALIWTDIRHFAFILFK

SEQ ID NO: 2301861 - protein, 19 aa, Cryptosporidium parvum
QDDSLCIWKPTTEKQQVAF

SEQ ID NO: 2301862 - protein, 23 aa, Cryptosporidium parvum
QDEAAKCLQEFYSEWAQNKGMVS

SEQ ID NO: 2301863 - protein, 23 aa, Cryptosporidium parvum
QDELKSSILPLVKIKEIDKELKI

SEQ ID NO: 2301864 - protein, 18 aa, Cryptosporidium parvum
QDELYAMYLSHKESNNAG

SEQ ID NO: 2301865 - protein, 17 aa, Cryptosporidium parvum
QDFKFNVMIKIIKGKLY

SEQ ID NO: 2301866 - protein, 17 aa, Cryptosporidium parvum
QDFRKSIWFPIVDIPLR

SEQ ID NO: 2301867 - protein, 18 aa, Cryptosporidium parvum
QDFSRFIFGTIDGFSTEA

SEQ ID NO: 2301868 - protein, 23 aa, Cryptosporidium parvum
QDHDICPICLNKLKDDYSQVLLP

SEQ ID NO: 2301869 - protein, 17 aa, Cryptosporidium parvum
QDICIKGGIDQNKQFEI

SEQ ID NO: 2301870 - protein, 23 aa, Cryptosporidium parvum
QDIKRAYRKLAIKYHPDKQANST

SEQ ID NO: 2301871 - protein, 20 aa, Cryptosporidium parvum
QDILASFGWEDDIILCSETI

SEQ ID NO: 2301872 - protein, 19 aa, Cryptosporidium parvum
QDINAFKLTKIIGKLDELN

SEQ ID NO: 2301873 - protein, 17 aa, Cryptosporidium parvum
QDISALAEDCLRVSSIS

SEQ ID NO: 2301874 - protein, 23 aa, Cryptosporidium parvum
QDISGFIKTCFGLESGIKKNEVF

SEQ ID NO: 2301875 - protein, 17 aa, Cryptosporidium parvum
QDIYGRTAIFMSACSGK

SEQ ID NO: 2301876 - protein, 30 aa, Cryptosporidium parvum
QDKIFKDFISFCFWFPITEFQRLYNKSVFL

SEQ ID NO: 2301877 - protein, 25 aa, Cryptosporidium parvum
QDKKLKSMIWSNGIYMIGPLEVNLL

SEQ ID NO: 2301878 - protein, 25 aa, Cryptosporidium parvum
QDKPDCIEIKFGKDNVEMYVKNLDN

SEQ ID NO: 2301879 - protein, 28 aa, Cryptosporidium parvum
QDKRVRILLLIFQWIKKQQCELVDPSVL

SEQ ID NO: 2301880 - protein, 21 aa, Cryptosporidium parvum
QDKYKFFGLDLINGTVRDNVQ

SEQ ID NO: 2301881 - protein, 24 aa, Cryptosporidium parvum
QDLEISTTLGFSLHYLQLIYNILE

SEQ ID NO: 2301882 - protein, 20 aa, Cryptosporidium parvum
QDLLEIYSKYFIQKTRPRES

SEQ ID NO: 2301883 - protein, 26 aa, Cryptosporidium parvum
QDLLSFLSCLLLPFLIFTKSKMIKNQ

SEQ ID NO: 2301884 - protein, 19 aa, Cryptosporidium parvum
QDLTGGLVRSFSKAQNDNN

SEQ ID NO: 2301885 - protein, 28 aa, Cryptosporidium parvum
QDLTRTGFIIFWGGRELDSFNIGNNITN

SEQ ID NO: 2301886 - protein, 25 aa, Cryptosporidium parvum
QDMIKGLYLLYLLSCDKISDFHIAL

SEQ ID NO: 2301887 - protein, 32 aa, Cryptosporidium parvum
QDNGIFWIEWNDILKWFSHIYLAWDPEKVSKH

SEQ ID NO: 2301888 - protein, 20 aa, Cryptosporidium parvum
QDNLEFLQWMKGLFDESGAI

SEQ ID NO: 2301889 - protein, 27 aa, Cryptosporidium parvum
QDNTHLRKVCNWPAIEFSKQTSPPTVP

SEQ ID NO: 2301890 - protein, 23 aa, Cryptosporidium parvum
QDPSIRVGWSCRYNRLDTPVGTS

SEQ ID NO: 2301891 - protein, 31 aa, Cryptosporidium parvum
QDRILLHETIFWKRRHGLRISSGLLKDIFGY

SEQ ID NO: 2301892 - protein, 17 aa, Cryptosporidium parvum
QDSEAFLEPVNWKKLGL

SEQ ID NO: 2301893 - protein, 26 aa, Cryptosporidium parvum
QDSELESIVSLELWNLYKEMGPNIWP

SEQ ID NO: 2301894 - protein, 24 aa, Cryptosporidium parvum
QDSLCRYNRLIGKEVLWIPGTDHA

SEQ ID NO: 2301895 - protein, 19 aa, Cryptosporidium parvum
QDTEIWLPSYNRIEKNKGF

SEQ ID NO: 2301896 - protein, 19 aa, Cryptosporidium parvum
QDVFDCILVLISTVNGRTF

SEQ ID NO: 2301897 - protein, 24 aa, Cryptosporidium parvum
QDYEILKRDFALLKDEKEMLKNKY

SEQ ID NO: 2301898 - protein, 17 aa, Cryptosporidium parvum
QDYFFLFKFDNPKRKLI

SEQ ID NO: 2301899 - protein, 23 aa, Cryptosporidium parvum
QEADEPLHLCISSTNSEQYINAR

SEQ ID NO: 2301900 - protein, 24 aa, Cryptosporidium parvum
QEAEFSRLGFGFDIGLGLGPGPGH

SEQ ID NO: 2301901 - protein, 33 aa, Cryptosporidium parvum; identical to SEQ ID NO: 2179550

SEQ ID NO: 2301902 - protein, 24 aa, Cryptosporidium parvum
QEEIKEWNIPPSISNWKNPMGYTV

SEQ ID NO: 2301903 - protein, 26 aa, Cryptosporidium parvum
QEEYKLEWWLGIIEKFCDKNKSLLIE

SEQ ID NO: 2301904 - protein, 22 aa, Cryptosporidium parvum
QEFDFLKQYFAKILQNHINSSQ

SEQ ID NO: 2301905 - protein, 17 aa, Cryptosporidium parvum
QEFLRIMRDFKHGSINA

SEQ ID NO: 2301906 - protein, 17 aa, Cryptosporidium parvum
QEFPKEPIVLLIQSMVR

SEQ ID NO: 2301907 - protein, 20 aa, Cryptosporidium parvum
QEFTLCSGYDIHKQKISIKT

SEQ ID NO: 2301908 - protein, 26 aa, Cryptosporidium parvum
QEHFKRASQTILSRIDEMGSRIDQLE

SEQ ID NO: 2301909 - protein, 20 aa, Cryptosporidium parvum
QEHPELLNSLLMLTLKPKKS

SEQ ID NO: 2301910 - protein, 17 aa, Cryptosporidium parvum
QEIEMPVPYLGCVGKKF

SEQ ID NO: 2301911 - protein, 17 aa, Cryptosporidium parvum
QEIGKFYAAARASAVAL

SEQ ID NO: 2301912 - protein, 21 aa, Cryptosporidium parvum
QEIKFLKYMIGYSHELKQHLD

SEQ ID NO: 2301913 - protein, 19 aa, Cryptosporidium parvum
QEILPKLLNVVLSCEDVLA

SEQ ID NO: 2301914 - protein, 19 aa, Cryptosporidium parvum
QEIPNLYNLGLIMVSQSTT

SEQ ID NO: 2301915 - protein, 17 aa, Cryptosporidium parvum
QEIQGLILNNTRLLKSG

SEQ ID NO: 2301916 - protein, 25 aa, Cryptosporidium parvum
QEIYNKGLIKLREMCFVFNELIKEY

SEQ ID NO: 2301917 - protein, 24 aa, Cryptosporidium parvum
QEKASSLLSWLFKTLSMEVGQTLK

SEQ ID NO: 2301918 - protein, 22 aa, Cryptosporidium parvum
QEKKAVSYWSNFLSSQFGILNN

SEQ ID NO: 2301919 - protein, 39 aa, Cryptosporidium parvum
QEKKMGAMFYKEFGICIFRLWVVHCKNVWLVNSGTNESF

SEQ ID NO: 2301920 - protein, 24 aa, Cryptosporidium parvum
QELDLKIGVAFSRLQTKYLKSKFG

SEQ ID NO: 2301921 - protein, 18 aa, Cryptosporidium parvum
QELHSMGYVNLKHILIQT

SEQ ID NO: 2301922 - protein, 24 aa, Cryptosporidium parvum
QELKEVWYSLFGKDPNTNRKELMH

SEQ ID NO: 2301923 - protein, 22 aa, Cryptosporidium parvum
QELKPTILVCVPQVLTRIIQTV

SEQ ID NO: 2301924 - protein, 20 aa, Cryptosporidium parvum
QELLRRSDLEELKRTIKDQK

SEQ ID NO: 2301925 - protein, 17 aa, Cryptosporidium parvum
QELNIPTIFALNRHRIG

SEQ ID NO: 2301926 - protein, 23 aa, Cryptosporidium parvum
QELSTLFTFMLEWITISKTVWIS

SEQ ID NO: 2301927 - protein, 17 aa, Cryptosporidium parvum
QEMHLSKLVPDILSSIC

SEQ ID NO: 2301928 - protein, 23 aa, Cryptosporidium parvum
QEMKDFKTNLNIIKESQEKNTKT

SEQ ID NO: 2301929 - protein, 26 aa, Cryptosporidium parvum
QEQRVFSTVFMRYFIEKAQTYTPLVP

SEQ ID NO: 2301930 - protein, 24 aa, Cryptosporidium parvum
QERFRSLIPSYIRDSSVAVVVYDI

SEQ ID NO: 2301931 - protein, 24 aa, Cryptosporidium parvum
QERYKSINLLYLVGQKKLIREIIN

SEQ ID NO: 2301932 - protein, 17 aa, Cryptosporidium parvum
QESKQLRNIFQGMENYS

SEQ ID NO: 2301933 - protein, 18 aa, Cryptosporidium parvum
QESKSEWNTFCMQMQQDQ

SEQ ID NO: 2301934 - protein, 19 aa, Cryptosporidium parvum
QESWLELLGYFSYLEYDKK

SEQ ID NO: 2301935 - protein, 24 aa, Cryptosporidium parvum
QEVISIELHDRFYNHFKTLFDVLD

SEQ ID NO: 2301936 - protein, 27 aa, Cryptosporidium parvum
QEVKKLRIPDCSICREYLTRNLTVITV

SEQ ID NO: 2301937 - protein, 18 aa, Cryptosporidium parvum
QEVPEFVQNLTLDCSVLE

SEQ ID NO: 2301938 - protein, 25 aa, Cryptosporidium parvum
QEYHHCSLCKPTFDYKNSILMCNQK

SEQ ID NO: 2301939 - protein, 18 aa, Cryptosporidium parvum
QFEILCLSILLLNIYMQS

SEQ ID NO: 2301940 - protein, 28 aa, Cryptosporidium parvum
QFGEPLPCDMCRKSCAFDRGEEARKKLD

SEQ ID NO: 2301941 - protein, 27 aa, Cryptosporidium parvum
QFGGLRPFGVSFLFAGYDKNYGYQLYQ

SEQ ID NO: 2301942 - protein, 32 aa, Cryptosporidium parvum
QFHLPHHLEALCVFLHHVGPFLDSERWKHYED

SEQ ID NO: 2301943 - protein, 26 aa, Cryptosporidium parvum
QFIDLCILSGCDYCGTIRGIGTSTAY

SEQ ID NO: 2301944 - protein, 23 aa, Cryptosporidium parvum
QFLAPFTGCTMGEWFRDNGQHCI

SEQ ID NO: 2301945 - protein, 24 aa, Cryptosporidium parvum
QFLKEEIPFQFAIVKNTKQKALIS

SEQ ID NO: 2301946 - protein, 21 aa, Cryptosporidium parvum
QFLLDHFWGNPSFRLESIKCL

SEQ ID NO: 2301947 - protein, 25 aa, Cryptosporidium parvum
QFLPNIRTPVVITRCGHHFCLNCAG

SEQ ID NO: 2301948 - protein, 18 aa, Cryptosporidium parvum
QFLSGRILLLNKFNDISR

SEQ ID NO: 2301949 - protein, 24 aa, Cryptosporidium parvum
QFPTEFQFHPNLLIIIADHLNNSL

SEQ ID NO: 2301950 - protein, 18 aa, Cryptosporidium parvum
QFQFWTQVRRFRPIERPG

SEQ ID NO: 2301951 - protein, 19 aa, Cryptosporidium parvum
QFQIILGKRNVEFSNVKDE

SEQ ID NO: 2301952 - protein, 28 aa, Cryptosporidium parvum
QFSQFRGVLNRLCEIFGSTNQENNKECK

SEQ ID NO: 2301953 - protein, 18 aa, Cryptosporidium parvum
QFTPRILIYNSRNNLNGS

SEQ ID NO: 2301954 - protein, 27 aa, Cryptosporidium parvum
QFVNYRAAAALGVWDLCRGMGKGLKNV

SEQ ID NO: 2301955 - protein, 25 aa, Cryptosporidium parvum
QFVVGKARWRPGFPSQIAFCCSAID

SEQ ID NO: 2301956 - protein, 19 aa, Cryptosporidium parvum
QFYSCEIHISLPILSTNSH

SEQ ID NO: 2301957 - protein, 21 aa, Cryptosporidium parvum
QGDIPYCDTILYLDNPKPKKY

SEQ ID NO: 2301958 - protein, 23 aa, Cryptosporidium parvum
QGELQVLNLLSLVKIEQPESDET

SEQ ID NO: 2301959 - protein, 25 aa, Cryptosporidium parvum
QGFDPTEWCNLGSGINTMVQVETSP

SEQ ID NO: 2301960 - protein, 20 aa, Cryptosporidium parvum
QGFITIKLSDEFIQNNLSKL

SEQ ID NO: 2301961 - protein, 35 aa, Cryptosporidium parvum
QGGIFIRSGLYAGAFYRFQIELALEREYVSDGSEL

SEQ ID NO: 2301962 - protein, 19 aa, Cryptosporidium parvum
QGIELSVPILEQINDIVRL

SEQ ID NO: 2301963 - protein, 25 aa, Cryptosporidium parvum
QGIFKASKELFGWKNRRTNATYHYK

SEQ ID NO: 2301964 - protein, 20 aa, Cryptosporidium parvum
QGIGHPRYSDMVEFPSEISA

SEQ ID NO: 2301965 - protein, 24 aa, Cryptosporidium parvum
QGIKAVNCDLVFDFGISLLEYIHG

SEQ ID NO: 2301966 - protein, 27 aa, Cryptosporidium parvum
QGIQDLFGSISICNSPEIFKITYKIPF

SEQ ID NO: 2301967 - protein, 18 aa, Cryptosporidium parvum
QGISSCFIISLKSRGELG

SEQ ID NO: 2301968 - protein, 19 aa, Cryptosporidium parvum
QGKQMSGRDLFVYDPSLFV

SEQ ID NO: 2301969 - protein, 24 aa, Cryptosporidium parvum
QGKRIELSLPFKSTENIKKALLQV

SEQ ID NO: 2301970 - protein, 19 aa, Cryptosporidium parvum
QGLSSIFYPIFPLVCFPDF

SEQ ID NO: 2301971 - protein, 24 aa, Cryptosporidium parvum
QGMKELWNGFEIEFTGLPNNPNTK

SEQ ID NO: 2301972 - protein, 26 aa, Cryptosporidium parvum
QGMTFKSPFFFRPYFYLEAQKAVDIH

SEQ ID NO: 2301973 - protein, 17 aa, Cryptosporidium parvum
QGNGFSVKGKLLGNENI

SEQ ID NO: 2301974 - protein, 27 aa, Cryptosporidium parvum
QGNHGFMPPMYPYGSSYAPYIPGAKNG

SEQ ID NO: 2301975 - protein, 27 aa, Cryptosporidium parvum
QGNMFCSCCTCPMQQQFPSCQCGTNYF

SEQ ID NO: 2301976 - protein, 18 aa, Cryptosporidium parvum
QGSKKCKMHKILIFTQFQ

SEQ ID NO: 2301977 - protein, 24 aa, Cryptosporidium parvum
QGVELRWFYSEHDLLDLGKIIDKS

SEQ ID NO: 2301978 - protein, 22 aa, Cryptosporidium parvum
QGYIFRKTRLVSWCSYLRTALS

SEQ ID NO: 2301979 - protein, 34 aa, Cryptosporidium parvum
QHERVEDVIKSWESRLAKQVKLFNKASSDVLEVD

SEQ ID NO: 2301980 - protein, 17 aa, Cryptosporidium parvum
QHFYFLIKKNVPLIESV

SEQ ID NO: 2301981 - protein, 25 aa, Cryptosporidium parvum
QHHILRYTEKMNFLFCSEQDDILTV

SEQ ID NO: 2301982 - protein, 24 aa, Cryptosporidium parvum
QHKKFKRMLLFSLRSLSDLCVPPT

SEQ ID NO: 2301983 - protein, 25 aa, Cryptosporidium parvum
QHLGWTEIHWKDILIKTNHSNYSGN

SEQ ID NO: 2301984 - protein, 26 aa, Cryptosporidium parvum
QHNLFKSFHWLLNHLCAVFLDDTIWF

SEQ ID NO: 2301985 - protein, 18 aa, Cryptosporidium parvum
QHPISPEIQTLIQSPMIA

SEQ ID NO: 2301986 - protein, 30 aa, Cryptosporidium parvum; identical to SEQ ID NO: 2179630

SEQ ID NO: 2301987 - protein, 19 aa, Cryptosporidium parvum
QHRGNIITTRYYKMASQLR

SEQ ID NO: 2301988 - protein, 17 aa, Cryptosporidium parvum
QHVIKRREKILAMEQAK

SEQ ID NO: 2301989 - protein, 23 aa, Cryptosporidium parvum
QIAEFKEAFSLFDKDGDGSITTK

SEQ ID NO: 2301990 - protein, 22 aa, Cryptosporidium parvum
QICAELAALGCGYDIKIYRGSD

SEQ ID NO: 2301991 - protein, 17 aa, Cryptosporidium parvum
QICKLFENYFMKYKDVS

SEQ ID NO: 2301992 - protein, 17 aa, Cryptosporidium parvum
QICLMLFDCMGFNGESL

SEQ ID NO: 2301993 - protein, 19 aa, Cryptosporidium parvum
QICNKLHSVWKGYKTRSIL

SEQ ID NO: 2301994 - protein, 22 aa, Cryptosporidium parvum
QICSALKALHSIGIMHGDIKAE

SEQ ID NO: 2301995 - protein, 21 aa, Cryptosporidium parvum
QIDFSRKLIVERFNQVTLELQ

SEQ ID NO: 2301996 - protein, 23 aa, Cryptosporidium parvum
QIECYLRYLRINQEIERLKVRMA

SEQ ID NO: 2301997 - protein, 19 aa, Cryptosporidium parvum
QIENQGIRNDIDFQEELKF

SEQ ID NO: 2301998 - protein, 18 aa, Cryptosporidium parvum
QIEQVWKLLWSLTTFGSQ

SEQ ID NO: 2301999 - protein, 20 aa, Cryptosporidium parvum
QIEVFNWSASGSIILEGLSI

SEQ ID NO: 2302000 - protein, 19 aa, Cryptosporidium parvum
QIEYLKCDLKELSKTNNEI

SEQ ID NO: 2302001 - protein, 27 aa, Cryptosporidium parvum
QIFWISCKSIKCFMQPVLLEYESILND

SEQ ID NO: 2302002 - protein, 23 aa, Cryptosporidium parvum
QIGKKELLAWGSSLLGEELNWKS

SEQ ID NO: 2302003 - protein, 18 aa, Cryptosporidium parvum
QIGNACWELFCLEHGINP

SEQ ID NO: 2302004 - protein, 18 aa, Cryptosporidium parvum
QIGSEINLCLLYRNVSSP

SEQ ID NO: 2302005 - protein, 19 aa, Cryptosporidium parvum
QIIFPRLEKIIGKCTNDLV

SEQ ID NO: 2302006 - protein, 18 aa, Cryptosporidium parvum
QIINNGVLRSGYQTLSSI

SEQ ID NO: 2302007 - protein, 24 aa, Cryptosporidium parvum
QIKELCSGFESFPELLVVSKYQSE

SEQ ID NO: 2302008 - protein, 21 aa, Cryptosporidium parvum
QIKIADFGLARSIRNHSYTNF

SEQ ID NO: 2302009 - protein, 23 aa, Cryptosporidium parvum
QIKKHILSVFGFEELYRMNILER

SEQ ID NO: 2302010 - protein, 20 aa, Cryptosporidium parvum
QIKLELSDKFEVEIINIAIH

SEQ ID NO: 2302011 - protein, 23 aa, Cryptosporidium parvum
QIKRIIDEFIEFLTGKSNKSDEY

SEQ ID NO: 2302012 - protein, 27 aa, Cryptosporidium parvum
QILAIQYFVPYVIKHSYKLEDDEIPDN

SEQ ID NO: 2302013 - protein, 17 aa, Cryptosporidium parvum
QILELLKVYYLTKGTPE

SEQ ID NO: 2302014 - protein, 18 aa, Cryptosporidium parvum
QILESVEIYKAIKRSNRE

SEQ ID NO: 2302015 - protein, 17 aa, Cryptosporidium parvum
QILFDGRLPKENPFNRL

SEQ ID NO: 2302016 - protein, 18 aa, Cryptosporidium parvum
QILGIYIRVLPRIGDYLT

SEQ ID NO: 2302017 - protein, 26 aa, Cryptosporidium parvum
QILHRRIEWFLHWYIESASSIDQEDR

SEQ ID NO: 2302018 - protein, 21 aa, Cryptosporidium parvum
QILKHLFTFYSKVLLLDLDEL

SEQ ID NO: 2302019 - protein, 20 aa, Cryptosporidium parvum
QILKSGLRFFHLDIIDKDND

SEQ ID NO: 2302020 - protein, 23 aa, Cryptosporidium parvum
QILLRLYFELLRQGGSSEESILS

SEQ ID NO: 2302021 - protein, 19 aa, Cryptosporidium parvum
QILSEKKCWERYNTTFNLF

SEQ ID NO: 2302022 - protein, 25 aa, Cryptosporidium parvum
QILYNRSLVQLGLSAFRLGQISEAQ

SEQ ID NO: 2302023 - protein, 26 aa, Cryptosporidium parvum
QIMEFSKEQFEVFIFHIEKRIEKSSN

SEQ ID NO: 2302024 - protein, 25 aa, Cryptosporidium parvum
QIMKHKYDKGCFGKCPRVLCNGYKV

SEQ ID NO: 2302025 - protein, 20 aa, Cryptosporidium parvum
QIMMISCMFEGQGYLITNRE

SEQ ID NO: 2302026 - protein, 19 aa, Cryptosporidium parvum
QINGFGIYHWNDGRVYTGY

SEQ ID NO: 2302027 - protein, 24 aa, Cryptosporidium parvum
QINPGDVIGCLIKLSGVPYELEDP

SEQ ID NO: 2302028 - protein, 23 aa, Cryptosporidium parvum
QIPASLLKRLSFKPTSEVQVIKE

SEQ ID NO: 2302029 - protein, 19 aa, Cryptosporidium parvum
QIPLAIALAHTYGYNQVKE

SEQ ID NO: 2302030 - protein, 28 aa, Cryptosporidium parvum
QIPNGCEFGFRPGEWGKPPLDDQGKPIW

SEQ ID NO: 2302031 - protein, 19 aa, Cryptosporidium parvum
QIQEREWGLLIFDEVQFAP

SEQ ID NO: 2302032 - protein, 28 aa, Cryptosporidium parvum
QIQPVLQFVYRKCVELRFTVNNENLNLD

SEQ ID NO: 2302033 - protein, 17 aa, Cryptosporidium parvum
QIQRLFECHIFKINNKD

SEQ ID NO: 2302034 - protein, 25 aa, Cryptosporidium parvum
QIQTLNCAIPFFSLPRKRLNPSSQI

SEQ ID NO: 2302035 - protein, 20 aa, Cryptosporidium parvum
QIRRSFPCMIDNSAGTLQIN

SEQ ID NO: 2302036 - protein, 18 aa, Cryptosporidium parvum
QISEAINIFEYIISECRN

SEQ ID NO: 2302037 - protein, 22 aa, Cryptosporidium parvum
QISGIRDVASWEIDRPQETRPN

SEQ ID NO: 2302038 - protein, 19 aa, Cryptosporidium parvum
QISILFQYNIELFDAFTNN

SEQ ID NO: 2302039 - protein, 19 aa, Cryptosporidium parvum
QISILKEKIEMAGSASERT

SEQ ID NO: 2302040 - protein, 21 aa, Cryptosporidium parvum
QISKFKFVFLGEQSVGKTSII

SEQ ID NO: 2302041 - protein, 24 aa, Cryptosporidium parvum
QISKWNWYYRMEQLYYDWQAINFP

SEQ ID NO: 2302042 - protein, 19 aa, Cryptosporidium parvum
QISNIEFLKVMSLSSKAKK

SEQ ID NO: 2302043 - protein, 17 aa, Cryptosporidium parvum
QISSFQIVDGMNISSSS

SEQ ID NO: 2302044 - protein, 30 aa, Cryptosporidium parvum; identical to SEQ ID NO: 2179678

SEQ ID NO: 2302045 - protein, 32 aa, Cryptosporidium parvum
QIYKLENFISIELFNKIKMEWTKSTVSIYSGQ

SEQ ID NO: 2302046 - protein, 22 aa, Cryptosporidium parvum
QKARILHAVAQWRERFKTIDDF

SEQ ID NO: 2302047 - protein, 25 aa, Cryptosporidium parvum
QKASKSSLFNQIDLNNISFLPKKEF

SEQ ID NO: 2302048 - protein, 30 aa, Cryptosporidium parvum; identical to SEQ ID NO: 2179683

SEQ ID NO: 2302049 - protein, 23 aa, Cryptosporidium parvum
QKEFMIDKRFIIQIIQKHNEDGS

SEQ ID NO: 2302050 - protein, 25 aa, Cryptosporidium parvum
QKELKRLKLVVIDPITSLLGSHNFI

SEQ ID NO: 2302051 - protein, 28 aa, Cryptosporidium parvum
QKFDLALGLGKFELCISILQEIQLKDQA

SEQ ID NO: 2302052 - protein, 22 aa, Cryptosporidium parvum
QKFRIPEKYGYSIYLKVPSSNT

SEQ ID NO: 2302053 - protein, 21 aa, Cryptosporidium parvum
QKFVKIMGHCIGIEFRDPSLI

SEQ ID NO: 2302054 - protein, 17 aa, Cryptosporidium parvum
QKGDMLCDYDDGHEGTS

SEQ ID NO: 2302055 - protein, 22 aa, Cryptosporidium parvum
QKGKWRVKLRNGIAQIANQEIP

SEQ ID NO: 2302056 - protein, 25 aa, Cryptosporidium parvum
QKGQKMSLNWSVLIIRSRNETPDLI

SEQ ID NO: 2302057 - protein, 22 aa, Cryptosporidium parvum
QKGVDFIKAFLLGFELQDAIAL

SEQ ID NO: 2302058 - protein, 21 aa, Cryptosporidium parvum
QKIFLSILFFTVYHLLSNGKY

SEQ ID NO: 2302059 - protein, 18 aa, Cryptosporidium parvum
QKIKFGIFGGYLYSIVEG

SEQ ID NO: 2302060 - protein, 29 aa, Cryptosporidium parvum
QKIQLLFRDCFRVGLQLLDLSGADFNQIN

SEQ ID NO: 2302061 - protein, 21 aa, Cryptosporidium parvum
QKKDKDCLISPKRTNELSDIS

SEQ ID NO: 2302062 - protein, 31 aa, Cryptosporidium parvum
QKKISYCAFCSRMKRGLLYSCMKKNGYNVLS

SEQ ID NO: 2302063 - protein, 25 aa, Cryptosporidium parvum
QKKRGIEIIEQVLLNYLPNEDFTLT

SEQ ID NO: 2302064 - protein, 29 aa, Cryptosporidium parvum
QKKRMLLRCHLTVPKLQYKIYSSAHQINS

SEQ ID NO: 2302065 - protein, 20 aa, Cryptosporidium parvum
QKLDIPIVIKLLHNKLIDLS

SEQ ID NO: 2302066 - protein, 19 aa, Cryptosporidium parvum
QKLEIKYNALVVAEKAKLR

SEQ ID NO: 2302067 - protein, 19 aa, Cryptosporidium parvum
QKLHAAGIASKLADKNIID

SEQ ID NO: 2302068 - protein, 29 aa, Cryptosporidium parvum
QKLHFFELRLARYLSYCVDGGLLGAKFII

SEQ ID NO: 2302069 - protein, 25 aa, Cryptosporidium parvum
QKLKLPIIYQCYGDFYYYHYNHDNF

SEQ ID NO: 2302070 - protein, 23 aa, Cryptosporidium parvum
QKLLEIIYFEIHFSESNTRNYQD

SEQ ID NO: 2302071 - protein, 25 aa, Cryptosporidium parvum
QKLMNKRLLIPKSTYLDKNYDKGVS

SEQ ID NO: 2302072 - protein, 24 aa, Cryptosporidium parvum
QKLNIKSGFPILGTQILCNNIEKK

SEQ ID NO: 2302073 - protein, 26 aa, Cryptosporidium parvum
QKMDLGGSVPLMLQRIVLATQLQSLN

SEQ ID NO: 2302074 - protein, 22 aa, Cryptosporidium parvum
QKMSSCNWNPFTSDHLIGNGEL

SEQ ID NO: 2302075 - protein, 20 aa, Cryptosporidium parvum
QKNKFLPKIAEWVKEHIDGV

SEQ ID NO: 2302076 - protein, 23 aa, Cryptosporidium parvum
QKQEIKEAFELFDTEKTGRIDYH

SEQ ID NO: 2302077 - protein, 25 aa, Cryptosporidium parvum
QKQYSCPLCMTSTYYKNDIKMYYGD

SEQ ID NO: 2302078 - protein, 24 aa, Cryptosporidium parvum
QKRFSFVRDNIRGVAEEIESWTKC

SEQ ID NO: 2302079 - protein, 19 aa, Cryptosporidium parvum
QKRKANCEYSASMRAPSTK

SEQ ID NO: 2302080 - protein, 27 aa, Cryptosporidium parvum
QKRLSWEEFKYILVHFSPNFPIKLNSC

SEQ ID NO: 2302081 - protein, 19 aa, Cryptosporidium parvum
QKSAEGLASPIGFSPLASP

SEQ ID NO: 2302082 - protein, 17 aa, Cryptosporidium parvum
QKSIPWISNNNINMNMN

SEQ ID NO: 2302083 - protein, 29 aa, Cryptosporidium parvum
QKSLVIPGFIREGRQLSRALSLSLDVEDL

SEQ ID NO: 2302084 - protein, 18 aa, Cryptosporidium parvum
QKSMRWQPISVIHNQLAL

SEQ ID NO: 2302085 - protein, 20 aa, Cryptosporidium parvum
QKSRVAIAIMAYLNPHLLIL

SEQ ID NO: 2302086 - protein, 24 aa, Cryptosporidium parvum
QKTDRFALVSSFENQHLLKSNQNI

SEQ ID NO: 2302087 - protein, 28 aa, Cryptosporidium parvum
QKTLKCCFEWFKTFKIMESDGVVCNDVF

SEQ ID NO: 2302088 - protein, 18 aa, Cryptosporidium parvum
QKVFKFSIITMYTTKNNM

SEQ ID NO: 2302089 - protein, 21 aa, Cryptosporidium parvum
QKWPDGAVFEGNFVNGTANGY

SEQ ID NO: 2302090 - protein, 19 aa, Cryptosporidium parvum
QKYFKRFSVDSGDQDTLFH

SEQ ID NO: 2302091 - protein, 25 aa, Cryptosporidium parvum
QKYPNRLEKLFGHYKVTLLEEGLPK

SEQ ID NO: 2302092 - protein, 19 aa, Cryptosporidium parvum
QLALKHRLNKNLRQRIVCF

SEQ ID NO: 2302093 - protein, 22 aa, Cryptosporidium parvum
QLCLECIEWCLEEKRTFLRHRI

SEQ ID NO: 2302094 - protein, 23 aa, Cryptosporidium parvum
QLCNLKRAEGFDAKKFESGFLGK

SEQ ID NO: 2302095 - protein, 19 aa, Cryptosporidium parvum
QLCSAYCAISELFMTDLCY

SEQ ID NO: 2302096 - protein, 25 aa, Cryptosporidium parvum
QLDLFAFNILEIFILTNNKAVIENI

SEQ ID NO: 2302097 - protein, 28 aa, Cryptosporidium parvum
QLDRMRNEFSYFYPLDCRVSGKDLIFNH

SEQ ID NO: 2302098 - protein, 18 aa, Cryptosporidium parvum
QLEQFLSRFSHISNPMTR

SEQ ID NO: 2302099 - protein, 24 aa, Cryptosporidium parvum
QLFLRPFMQCCAPRSRSEKKIKIN

SEQ ID NO: 2302100 - protein, 25 aa, Cryptosporidium parvum
QLFQALSRLSLELSNTNLALDQCLK

SEQ ID NO: 2302101 - protein, 23 aa, Cryptosporidium parvum
QLHEISSLMSFFSSKIQEQSEIC

SEQ ID NO: 2302102 - protein, 23 aa, Cryptosporidium parvum
QLIEFLFLDFLDYIHIDKGLIKD

SEQ ID NO: 2302103 - protein, 17 aa, Cryptosporidium parvum
QLIKQASGIITEEVANN

SEQ ID NO: 2302104 - protein, 19 aa, Cryptosporidium parvum
QLILIKALHEITRKYHKIT

SEQ ID NO: 2302105 - protein, 19 aa, Cryptosporidium parvum
QLIQRSGVVPASMDELKRQ

SEQ ID NO: 2302106 - protein, 17 aa, Cryptosporidium parvum
QLIRIAIEIYKETQHLG

SEQ ID NO: 2302107 - protein, 18 aa, Cryptosporidium parvum
QLIRKCLLKGENQCPFIE

SEQ ID NO: 2302108 - protein, 22 aa, Cryptosporidium parvum
QLKFSCLTLPPKGLNASSEDII

SEQ ID NO: 2302109 - protein, 22 aa, Cryptosporidium parvum
QLKKVLCLGVAIGNVNMTEEEI

SEQ ID NO: 2302110 - protein, 26 aa, Cryptosporidium parvum
QLKSIEKGDCSIIWIKDDGEQLSQIP

SEQ ID NO: 2302111 - protein, 23 aa, Cryptosporidium parvum
QLKTPPKRPFLRKGEGKSLVISN

SEQ ID NO: 2302112 - protein, 37 aa, Cryptosporidium parvum
QLLEPSWPHLLVIYEFFLRFVISPQFSTKVAKKYIDN

SEQ ID NO: 2302113 - protein, 19 aa, Cryptosporidium parvum
QLLETCLNIAMFIFSSQPF

SEQ ID NO: 2302114 - protein, 24 aa, Cryptosporidium parvum
QLLGERLFPIIAQFQPELAGKITG

SEQ ID NO: 2302115 - protein, 22 aa, Cryptosporidium parvum
QLLKFLCSFNIDDIIKLNELCN

SEQ ID NO: 2302116 - protein, 19 aa, Cryptosporidium parvum
QLMPSIPGVYFDRRQIGYR

SEQ ID NO: 2302117 - protein, 22 aa, Cryptosporidium parvum
QLMYWNRYGKFYSVINNSRRIM

SEQ ID NO: 2302118 - protein, 18 aa, Cryptosporidium parvum
QLNLKVCAVKAPGFGDHR

SEQ ID NO: 2302119 - protein, 30 aa, Cryptosporidium parvum
QLNMNLELYRWVFKPLLSNRRIRHEDNFDY

SEQ ID NO: 2302120 - protein, 31 aa, Cryptosporidium parvum; identical to SEQ ID NO: 2179755

SEQ ID NO: 2302121 - protein, 17 aa, Cryptosporidium parvum
QLPKGVAFVKFKNIESV

SEQ ID NO: 2302122 - protein, 18 aa, Cryptosporidium parvum
QLPLENVFFKQGSFVSRP

SEQ ID NO: 2302123 - protein, 20 aa, Cryptosporidium parvum
QLPPGIAGYVIIKIDEVREF

SEQ ID NO: 2302124 - protein, 26 aa, Cryptosporidium parvum
QLQKVDFLFGKSFRPPEAYETGSLYD

SEQ ID NO: 2302125 - protein, 27 aa, Cryptosporidium parvum
QLQYCRKTCPPNCTIPTHINGNMFRRK

SEQ ID NO: 2302126 - protein, 19 aa, Cryptosporidium parvum
QLRECEDNLLLALSNVKGN

SEQ ID NO: 2302127 - protein, 23 aa, Cryptosporidium parvum
QLRFKPKIIRDQIILLVDSIIQI

SEQ ID NO: 2302128 - protein, 19 aa, Cryptosporidium parvum
QLRRIHLHIMKKISDEVYK

SEQ ID NO: 2302129 - protein, 24 aa, Cryptosporidium parvum
QLSCSFGITSMDHWELGPDPLEGP

SEQ ID NO: 2302130 - protein, 19 aa, Cryptosporidium parvum
QLSELICQYCIGMRLELAR

SEQ ID NO: 2302131 - protein, 22 aa, Cryptosporidium parvum
QLSFRLWGDYYFNKENNSFETD

SEQ ID NO: 2302132 - protein, 24 aa, Cryptosporidium parvum
QLSKLCYEPIASISPEFDPQNGIG

SEQ ID NO: 2302133 - protein, 19 aa, Cryptosporidium parvum
QLSRLLIVLFSVYHNFEKN

SEQ ID NO: 2302134 - protein, 27 aa, Cryptosporidium parvum
QLTGIYRYKYRIMRQVRMCKDIKHIVY

SEQ ID NO: 2302135 - protein, 23 aa, Cryptosporidium parvum
QLTNKCILACSGMLADINALRKT

SEQ ID NO: 2302136 - protein, 24 aa, Cryptosporidium parvum
QLVAYSLYWLLKFTNSTNVPIYSI

SEQ ID NO: 2302137 - protein, 19 aa, Cryptosporidium parvum
QLVLNCLGITPDLEPAQYI

SEQ ID NO: 2302138 - protein, 23 aa, Cryptosporidium parvum
QLWSEGRNGILADEMGLGKTMQT

SEQ ID NO: 2302139 - protein, 20 aa, Cryptosporidium parvum
QLYFIKRRIENIKENIENTE

SEQ ID NO: 2302140 - protein, 17 aa, Cryptosporidium parvum
QMAWRRKQNYSFECEEL

SEQ ID NO: 2302141 - protein, 27 aa, Cryptosporidium parvum
QMCDRFIRDIPRGFFYAYFLNPLILLA

SEQ ID NO: 2302142 - protein, 32 aa, Cryptosporidium parvum
QMFMIPSSFSCRFIYMRIHFWINILSIPLSKM

SEQ ID NO: 2302143 - protein, 22 aa, Cryptosporidium parvum
QMKIGKLKAQLTLIKVEKHAAV

SEQ ID NO: 2302144 - protein, 24 aa, Cryptosporidium parvum
QMKSYKPDCIIGMGGGHCMDIAKV

SEQ ID NO: 2302145 - protein, 25 aa, Cryptosporidium parvum
QMMRFDMRESFPLLTTKKVAIRSIF

SEQ ID NO: 2302146 - protein, 20 aa, Cryptosporidium parvum
QMPAPMPMQMPIPAHLPTPM

SEQ ID NO: 2302147 - protein, 25 aa, Cryptosporidium parvum
QMQRAGGLHPGFQPVLHHLQQQLQL

SEQ ID NO: 2302148 - protein, 21 aa, Cryptosporidium parvum
QMTDLGFNIEVNWDPSNGLIF

SEQ ID NO: 2302149 - protein, 17 aa, Cryptosporidium parvum
QMVDIFSLLHLNRGFNY

SEQ ID NO: 2302150 - protein, 19 aa, Cryptosporidium parvum
QNALKLSGTSMNGREVTIE

SEQ ID NO: 2302151 - protein, 25 aa, Cryptosporidium parvum
QNDLQEVWALLNYLMPSIFNSSETF

SEQ ID NO: 2302152 - protein, 22 aa, Cryptosporidium parvum
QNDPHCWLWSYNIVNRQCSFHM

SEQ ID NO: 2302153 - protein, 28 aa, Cryptosporidium parvum
QNDQLWKSPDWMICLRDGISKGIKNKNN

SEQ ID NO: 2302154 - protein, 17 aa, Cryptosporidium parvum
QNEEVQYRIPLLNCHVG

SEQ ID NO: 2302155 - protein, 24 aa, Cryptosporidium parvum
QNESKFSATIPVASTIGENVSSDD

SEQ ID NO: 2302156 - protein, 23 aa, Cryptosporidium parvum
QNFCPHIPFPPWSGSTTNQNKEE

SEQ ID NO: 2302157 - protein, 21 aa, Cryptosporidium parvum
QNFRSLETFKSLISDNNGSIK

SEQ ID NO: 2302158 - protein, 24 aa, Cryptosporidium parvum
QNGLRFPPDFPKDAKLLVESLLKQ

SEQ ID NO: 2302159 - protein, 25 aa, Cryptosporidium parvum
QNGPVFPGAVPRMGVYSTPHSPNRS

SEQ ID NO: 2302160 - protein, 24 aa, Cryptosporidium parvum
QNILKEYLFSLLNLPENLQKENPF

SEQ ID NO: 2302161 - protein, 20 aa, Cryptosporidium parvum
QNILKILGLGIGQKYDNGPV

SEQ ID NO: 2302162 - protein, 18 aa, Cryptosporidium parvum
QNIMSFVGSSSFKSNNKA

SEQ ID NO: 2302163 - protein, 20 aa, Cryptosporidium parvum
QNISEYKKSVGVMEGSYVDR

SEQ ID NO: 2302164 - protein, 19 aa, Cryptosporidium parvum
QNKAVAVKPCPSCGQRFRG

SEQ ID NO: 2302165 - protein, 23 aa, Cryptosporidium parvum
QNKLLKKRYAVFDFENRLKELKG

SEQ ID NO: 2302166 - protein, 24 aa, Cryptosporidium parvum
QNKLPPWKRKPISLDNDILKRAKN

SEQ ID NO: 2302167 - protein, 24 aa, Cryptosporidium parvum
QNKRTILLAIEMRKIITPILQEFD

SEQ ID NO: 2302168 - protein, 18 aa, Cryptosporidium parvum
QNKVFKTKGNEWIYKARK

SEQ ID NO: 2302169 - protein, 24 aa, Cryptosporidium parvum
QNLCGLKPIIKCTGKIIIKMSVTS

SEQ ID NO: 2302170 - protein, 25 aa, Cryptosporidium parvum
QNLIKSASFQTHFGLKLIAEENDTL

SEQ ID NO: 2302171 - protein, 17 aa, Cryptosporidium parvum
QNLKVPFNKSIEYSLNL

SEQ ID NO: 2302172 - protein, 17 aa, Cryptosporidium parvum
QNLQEWELNAFKSSTFE

SEQ ID NO: 2302173 - protein, 28 aa, Cryptosporidium parvum
QNLYQAGSMPILLDMEFDDFINNEENED

SEQ ID NO: 2302174 - protein, 30 aa, Cryptosporidium parvum
QNNICHRGKILVCNACYLRVSKENKIRQKI

SEQ ID NO: 2302175 - protein, 24 aa, Cryptosporidium parvum
QNNSWKRRGLHKYSGNRVYNNQSI

SEQ ID NO: 2302176 - protein, 25 aa, Cryptosporidium parvum
QNPNCKFLFCSFIPYLTVQSQVCGI

SEQ ID NO: 2302177 - protein, 22 aa, Cryptosporidium parvum
QNQMNLPMGFNNNGGSNEFGVD

SEQ ID NO: 2302178 - protein, 18 aa, Cryptosporidium parvum
QNSHPVKTCAQIQSKKEI

SEQ ID NO: 2302179 - protein, 20 aa, Cryptosporidium parvum
QNSTLDWTRDERKMFRLESS

SEQ ID NO: 2302180 - protein, 22 aa, Cryptosporidium parvum
QNTRKGYVNKMYQYLADSSQFP

SEQ ID NO: 2302181 - protein, 30 aa, Cryptosporidium parvum
QNVRISAPILSRFDLFFVMIDDPEDVYDEV

SEQ ID NO: 2302182 - protein, 36 aa, Cryptosporidium parvum
QNVTFLKNVILRPSIDRWREEWTKRLEASKDDDNEL

SEQ ID NO: 2302183 - protein, 25 aa, Cryptosporidium parvum
QNYKNLRCLLLGGNKIKDFSELIVL

SEQ ID NO: 2302184 - protein, 23 aa, Cryptosporidium parvum
QPAEFASLLGLCYLPPQIDNRTK

SEQ ID NO: 2302185 - protein, 17 aa, Cryptosporidium parvum
QPCCVNLSKVFLGGNPI

SEQ ID NO: 2302186 - protein, 23 aa, Cryptosporidium parvum
QPDIPFNHGYIWGPLPITCFIDV

SEQ ID NO: 2302187 - protein, 17 aa, Cryptosporidium parvum
QPECLKGGQLREYQMKG

SEQ ID NO: 2302188 - protein, 24 aa, Cryptosporidium parvum
QPEIGESIVDAWGVGNTFDSFIKG

SEQ ID NO: 2302189 - protein, 28 aa, Cryptosporidium parvum
QPKTFVPVDCRVMPGYPFASLAGVPCVI

SEQ ID NO: 2302190 - protein, 21 aa, Cryptosporidium parvum
QPMRFGNKAFQTWYDKTNQTC

SEQ ID NO: 2302191 - protein, 20 aa, Cryptosporidium parvum
QPNECNIAFVLKTQDVSDLI

SEQ ID NO: 2302192 - protein, 17 aa, Cryptosporidium parvum
QPNRPHANMAFPTIEVW

SEQ ID NO: 2302193 - protein, 34 aa, Cryptosporidium parvum
QPPGDFKRLFIGGSVRLKYSYAITCKNAIIDTDT

SEQ ID NO: 2302194 - protein, 26 aa, Cryptosporidium parvum
QPQKLPKLRGFLSMNSLAHLGRQSFG

SEQ ID NO: 2302195 - protein, 19 aa, Cryptosporidium parvum
QPRIIFRQKGIYKVLLNSP

SEQ ID NO: 2302196 - protein, 21 aa, Cryptosporidium parvum
QPSPFGGVLNDGFWNHSHNSV

SEQ ID NO: 2302197 - protein, 25 aa, Cryptosporidium parvum
QPSYKEWRTAYATFKTWSCAQKVIQ

SEQ ID NO: 2302198 - protein, 20 aa, Cryptosporidium parvum
QPTFNFGVAKAFYEVTKASN

SEQ ID NO: 2302199 - protein, 23 aa, Cryptosporidium parvum
QQALKHPWLVDSFKYNPIGPIYK

SEQ ID NO: 2302200 - protein, 17 aa, Cryptosporidium parvum
QQALLIYKYWRMRRHKL

SEQ ID NO: 2302201 - protein, 19 aa, Cryptosporidium parvum
QQCMLRFQNESDLIDFTDK

SEQ ID NO: 2302202 - protein, 30 aa, Cryptosporidium parvum; identical to SEQ ID NO: 2179830

SEQ ID NO: 2302203 - protein, 19 aa, Cryptosporidium parvum
QQEILWLPCTHCFCRNCIT

SEQ ID NO: 2302204 - protein, 17 aa, Cryptosporidium parvum
QQEMHLRQIMTKNMEIN

SEQ ID NO: 2302205 - protein, 21 aa, Cryptosporidium parvum
QQFMMRMQINASKDQIPPGIA

SEQ ID NO: 2302206 - protein, 17 aa, Cryptosporidium parvum
QQIISGMEYCYINRICH

SEQ ID NO: 2302207 - protein, 17 aa, Cryptosporidium parvum
QQILAYYLFIVLKFIIP

SEQ ID NO: 2302208 - protein, 21 aa, Cryptosporidium parvum
QQIQLAMSFPMLSKENFELIK

SEQ ID NO: 2302209 - protein, 29 aa, Cryptosporidium parvum
QQKDFKSCTMWRVRVKELIKDVIQDCISN

SEQ ID NO: 2302210 - protein, 25 aa, Cryptosporidium parvum
QQKMEIKEAFELFDGDSIGYIDIKE

SEQ ID NO: 2302211 - protein, 18 aa, Cryptosporidium parvum
QQKPRFNLWASIKESITK

SEQ ID NO: 2302212 - protein, 20 aa, Cryptosporidium parvum
QQLLPMSRFLPKPSTQKTTK

SEQ ID NO: 2302213 - protein, 19 aa, Cryptosporidium parvum
QQNNYRWVRYVTQSNSYIY

SEQ ID NO: 2302214 - protein, 17 aa, Cryptosporidium parvum
QQQSISFRENRNIHPCA

SEQ ID NO: 2302215 - protein, 17 aa, Cryptosporidium parvum
QQQTFILDGVWETPVAS

SEQ ID NO: 2302216 - protein, 25 aa, Cryptosporidium parvum
QQSESSFKFGRIIDSTLSIPSTADY

SEQ ID NO: 2302217 - protein, 20 aa, Cryptosporidium parvum
QRALLLKWITEILKTSEASS

SEQ ID NO: 2302218 - protein, 26 aa, Cryptosporidium parvum
QRASEYARSLGIPRIFIAANSGARMG

SEQ ID NO: 2302219 - protein, 30 aa, Cryptosporidium parvum
QRCIHQCSCIMIWKLFIPFVDEKINSLKDR

SEQ ID NO: 2302220 - protein, 29 aa, Cryptosporidium parvum
QRDGPWFPTLRLLHKYPDMMPTMQVDKGA

SEQ ID NO: 2302221 - protein, 20 aa, Cryptosporidium parvum
QREIYKKELVASGIVVKKRP

SEQ ID NO: 2302222 - protein, 26 aa, Cryptosporidium parvum
QRELEVLEPYEILIIPKRDNTVTVRD

SEQ ID NO: 2302223 - protein, 25 aa, Cryptosporidium parvum
QRESSISFAPVRFGSMSISDTLALQ

SEQ ID NO: 2302224 - protein, 31 aa, Cryptosporidium parvum
QRFKKMTFITSLKFNSFFKEMKKKEFNLEQI

SEQ ID NO: 2302225 - protein, 20 aa, Cryptosporidium parvum
QRFPPVVQFHLKRFQFNIQS

SEQ ID NO: 2302226 - protein, 21 aa, Cryptosporidium parvum
QRGHLTLKYRRDNNETKKNES

SEQ ID NO: 2302227 - protein, 22 aa, Cryptosporidium parvum
QRHFDMLYSIIAREMNDTECML

SEQ ID NO: 2302228 - protein, 17 aa, Cryptosporidium parvum
QRIESNILYSNDIADIM

SEQ ID NO: 2302229 - protein, 17 aa, Cryptosporidium parvum
QRILFTWTRENPDLGYK

SEQ ID NO: 2302230 - protein, 18 aa, Cryptosporidium parvum
QRKICLIDIDIQGVEQIQ

SEQ ID NO: 2302231 - protein, 27 aa, Cryptosporidium parvum
QRKNLEAFECTECSKFYKAINNNRTSN

SEQ ID NO: 2302232 - protein, 23 aa, Cryptosporidium parvum
QRKREWRTSLSKGGFDVEGNEQD

SEQ ID NO: 2302233 - protein, 21 aa, Cryptosporidium parvum
QRKRMEGYKIFGLEQTSSSIS

SEQ ID NO: 2302234 - protein, 23 aa, Cryptosporidium parvum
QRKSSILLECIQGFVKMMKGLPN

SEQ ID NO: 2302235 - protein, 27 aa, Cryptosporidium parvum
QRLEQAEGWLKRMVELEQENSTLSQQI

SEQ ID NO: 2302236 - protein, 21 aa, Cryptosporidium parvum
QRLHDVFNFIRTGGIMLGDGK

SEQ ID NO: 2302237 - protein, 22 aa, Cryptosporidium parvum
QRLKETLRRNVDLMTELQKARG

SEQ ID NO: 2302238 - protein, 19 aa, Cryptosporidium parvum
QRLKEYLRNMSPFFKDNLE

SEQ ID NO: 2302239 - protein, 19 aa, Cryptosporidium parvum
QRLLQCGFDDVAIIPLPRW

SEQ ID NO: 2302240 - protein, 24 aa, Cryptosporidium parvum
QRLRSKYGAPFTWAQNKSRDKTEV

SEQ ID NO: 2302241 - protein, 26 aa, Cryptosporidium parvum
QRMARIGWDLGILFNHYSMRKEMEDL

SEQ ID NO: 2302242 - protein, 24 aa, Cryptosporidium parvum
QRMIHRDMILYISFQEEIMSQRNQ

SEQ ID NO: 2302243 - protein, 17 aa, Cryptosporidium parvum
QRNAFYWQPSGGESLAN

SEQ ID NO: 2302244 - protein, 20 aa, Cryptosporidium parvum
QRNGNIIGIGFEGSMSSVPY

SEQ ID NO: 2302245 - protein, 18 aa, Cryptosporidium parvum
QRNIAKLLFIHMLGYPSQ

SEQ ID NO: 2302246 - protein, 24 aa, Cryptosporidium parvum
QRQFACLLWGIKNEYGLVTTEKSI

SEQ ID NO: 2302247 - protein, 17 aa, Cryptosporidium parvum
QRQLCKDGLSAMLVTSG

SEQ ID NO: 2302248 - protein, 20 aa, Cryptosporidium parvum
QRQLFKEFIAKQILKDPKSQ

SEQ ID NO: 2302249 - protein, 22 aa, Cryptosporidium parvum
QRSRKITSFVLFNKVKKDKEEI

SEQ ID NO: 2302250 - protein, 23 aa, Cryptosporidium parvum
QRTFREIMILTELSGHENIVNLL

SEQ ID NO: 2302251 - protein, 22 aa, Cryptosporidium parvum
QRTRELIRLVSLLETNKLNSLE

SEQ ID NO: 2302252 - protein, 21 aa, Cryptosporidium parvum
QRVGLHLSLTRNHHISKKLSI

SEQ ID NO: 2302253 - protein, 25 aa, Cryptosporidium parvum
QRVTPSYYPNPMIKMPGQSMENFKA

SEQ ID NO: 2302254 - protein, 17 aa, Cryptosporidium parvum
QRVWLEYSLKRQQAQLQ

SEQ ID NO: 2302255 - protein, 17 aa, Cryptosporidium parvum
QSAFNFQASPAYFIIPN

SEQ ID NO: 2302256 - protein, 22 aa, Cryptosporidium parvum
QSAPRLYRAMCEIISKVQREVG

SEQ ID NO: 2302257 - protein, 17 aa, Cryptosporidium parvum
QSCGARIWSPREVVTLV

SEQ ID NO: 2302258 - protein, 26 aa, Cryptosporidium parvum
QSCSSCYIREAILSSIFSKVLETFNI

SEQ ID NO: 2302259 - protein, 23 aa, Cryptosporidium parvum
QSDIKRLIEFAIDRPSVQGENSP

SEQ ID NO: 2302260 - protein, 17 aa, Cryptosporidium parvum
QSDLCPVVKKFKAQLLL

SEQ ID NO: 2302261 - protein, 29 aa, Cryptosporidium parvum
QSDTRIYHWIRLSSLRLESQMILFYPRMF

SEQ ID NO: 2302262 - protein, 28 aa, Cryptosporidium parvum
QSEEKGLVLFIGKLIADTWLKSKVLDEA

SEQ ID NO: 2302263 - protein, 24 aa, Cryptosporidium parvum
QSEHSLQVSFCMGTMLGVIPDEHS

SEQ ID NO: 2302264 - protein, 25 aa, Cryptosporidium parvum
QSELEIVEGLKLDKGYISPYFITNQ

SEQ ID NO: 2302265 - protein, 23 aa, Cryptosporidium parvum
QSEYKLEISREGDLLKLIQEEIS

SEQ ID NO: 2302266 - protein, 20 aa, Cryptosporidium parvum
QSFIPIDILYSIWTEFIAEI

SEQ ID NO: 2302267 - protein, 25 aa, Cryptosporidium parvum
QSGLITRLSLFKNIHPLYESSDPSL

SEQ ID NO: 2302268 - protein, 25 aa, Cryptosporidium parvum
QSGWIPENMKLLLAIKSPFKGVHSI

SEQ ID NO: 2302269 - protein, 19 aa, Cryptosporidium parvum
QSHPHTGDKWVIYPMYDFA

SEQ ID NO: 2302270 - protein, 17 aa, Cryptosporidium parvum
QSIFGIVISNNYLVTIY

SEQ ID NO: 2302271 - protein, 24 aa, Cryptosporidium parvum
QSIKELLKTLSLTNFHKHPSFSSD

SEQ ID NO: 2302272 - protein, 18 aa, Cryptosporidium parvum
QSILPGAAFVDFMATVAL

SEQ ID NO: 2302273 - protein, 20 aa, Cryptosporidium parvum
QSIRILILVVHPLKSNQLRK

SEQ ID NO: 2302274 - protein, 17 aa, Cryptosporidium parvum
QSKKFLAAISLEVDTGL

SEQ ID NO: 2302275 - protein, 22 aa, Cryptosporidium parvum
QSKLKSVPCLALSSTGNTNTVE

SEQ ID NO: 2302276 - protein, 47 aa, Cryptosporidium parvum
QSLIRMRFVCILWRKILPYRQFICGLALLIHLAIPWVKTSTIFDKLE

SEQ ID NO: 2302277 - protein, 22 aa, Cryptosporidium parvum
QSLLLCDIAWIFQSMKNISSNL

SEQ ID NO: 2302278 - protein, 22 aa, Cryptosporidium parvum
QSLQKRLEVVHNFYTHESLVTS

SEQ ID NO: 2302279 - protein, 25 aa, Cryptosporidium parvum
QSLSLKELIEVAGYDKNTLLDILSE

SEQ ID NO: 2302280 - protein, 24 aa, Cryptosporidium parvum
QSLTRIRAASSFSIQARSKQKYLD

SEQ ID NO: 2302281 - protein, 17 aa, Cryptosporidium parvum
QSMQWKHIIVDEGHRLK

SEQ ID NO: 2302282 - protein, 31 aa, Cryptosporidium parvum; identical to SEQ ID NO: 2179898

SEQ ID NO: 2302283 - protein, 21 aa, Cryptosporidium parvum
QSNIYFLNFINSFLNTCNHKH

SEQ ID NO: 2302284 - protein, 26 aa, Cryptosporidium parvum
QSNLRIPIEFCNWIIDSFLSKYQTEN

SEQ ID NO: 2302285 - protein, 22 aa, Cryptosporidium parvum
QSPCNPCKGTGKTIPVTKQCKK

SEQ ID NO: 2302286 - protein, 19 aa, Cryptosporidium parvum
QSPNEFSSMILNRDIWNDS

SEQ ID NO: 2302287 - protein, 23 aa, Cryptosporidium parvum
QSPNFESHEPFTVEDNFDDNCSS

SEQ ID NO: 2302288 - protein, 19 aa, Cryptosporidium parvum
QSRKSWTTRIEKILKAAAF

SEQ ID NO: 2302289 - protein, 23 aa, Cryptosporidium parvum
QSSEFILSLMIERIVQKIEHIVI

SEQ ID NO: 2302290 - protein, 20 aa, Cryptosporidium parvum
QSSLLFRDYVEAMLQIGRNF

SEQ ID NO: 2302291 - protein, 21 aa, Cryptosporidium parvum
QSSSLLADCILGWDTIPEQKI

SEQ ID NO: 2302292 - protein, 17 aa, Cryptosporidium parvum
QSSTIINNWEIYDGNNG

SEQ ID NO: 2302293 - protein, 25 aa, Cryptosporidium parvum
QSVLRPLRGFRCMGSMGRSKTKKNN

SEQ ID NO: 2302294 - protein, 22 aa, Cryptosporidium parvum
QSVPKLFWLSIYYLVNSMKFIS

SEQ ID NO: 2302295 - protein, 26 aa, Cryptosporidium parvum
QSVSFPDIYLSSLLHYIIKLQSSILE

SEQ ID NO: 2302296 - protein, 24 aa, Cryptosporidium parvum
QSYCFNGRIGKKCDVCYSWWVFAS

SEQ ID NO: 2302297 - protein, 20 aa, Cryptosporidium parvum
QSYCGQVWRIFVASDGCLMG

SEQ ID NO: 2302298 - protein, 25 aa, Cryptosporidium parvum
QSYLKALRIARKEFETFINNAQQSW

SEQ ID NO: 2302299 - protein, 20 aa, Cryptosporidium parvum
QTAFKLLGLEVGASTKEIKS

SEQ ID NO: 2302300 - protein, 21 aa, Cryptosporidium parvum
QTCHLAHRMGLAPSKSDLEQL

SEQ ID NO: 2302301 - protein, 27 aa, Cryptosporidium parvum
QTCINFEKLRILICKLKKSLYSDTLSK

SEQ ID NO: 2302302 - protein, 22 aa, Cryptosporidium parvum
QTDRFLLDIGLRVQDQKMVGSE

SEQ ID NO: 2302303 - protein, 26 aa, Cryptosporidium parvum
QTDSGQRWCMLMGLCPVTNESTGSIS

SEQ ID NO: 2302304 - protein, 30 aa, Cryptosporidium parvum
QTEDEFNRWYYALCYGGFIESKKIENLKFD

SEQ ID NO: 2302305 - protein, 26 aa, Cryptosporidium parvum
QTENEFLVPLSLSFMSNWAENKNKDC

SEQ ID NO: 2302306 - protein, 19 aa, Cryptosporidium parvum
QTGCSRAKAVKALKSNNND

SEQ ID NO: 2302307 - protein, 19 aa, Cryptosporidium parvum
QTGWAFLGAMTVQEVMDLA

SEQ ID NO: 2302308 - protein, 26 aa, Cryptosporidium parvum
QTHAHGRIAYKHGYPPSLGSGPGSGT

SEQ ID NO: 2302309 - protein, 17 aa, Cryptosporidium parvum
QTHFIMVLLCKKYSMPK

SEQ ID NO: 2302310 - protein, 29 aa, Cryptosporidium parvum
QTHLYSSVIVREFSNMIASFGQDQTISLL

SEQ ID NO: 2302311 - protein, 27 aa, Cryptosporidium parvum
QTHSKIRVGPEYQAVVPDLIVPEKKTQ

SEQ ID NO: 2302312 - protein, 28 aa, Cryptosporidium parvum
QTIEYCKSCGLPTDYCEYGQCTKNKILG

SEQ ID NO: 2302313 - protein, 18 aa, Cryptosporidium parvum
QTILYARSKDILLYNSPI

SEQ ID NO: 2302314 - protein, 17 aa, Cryptosporidium parvum
QTKQCIQVLTGHTKAVR

SEQ ID NO: 2302315 - protein, 21 aa, Cryptosporidium parvum
QTLICILTLLTCRIQNSYVPS

SEQ ID NO: 2302316 - protein, 22 aa, Cryptosporidium parvum
QTMKIPKYVGGLVKNKLPHYGF

SEQ ID NO: 2302317 - protein, 25 aa, Cryptosporidium parvum
QTMRGVLGCPVCYVPLTIDFNKVSN

SEQ ID NO: 2302318 - protein, 25 aa, Cryptosporidium parvum
QTNCSRFEICLGTILNCIQVFGLDA

SEQ ID NO: 2302319 - protein, 27 aa, Cryptosporidium parvum
QTNIDILDLFPIFSWLENPNNFNHPMY

SEQ ID NO: 2302320 - protein, 27 aa, Cryptosporidium parvum
QTNQVRGTLRFVVKLVPNQQNPNYRFD

SEQ ID NO: 2302321 - protein, 34 aa, Cryptosporidium parvum
QTNYPTNCISWDIKGTEFITCTEYNITRFIQSNN

SEQ ID NO: 2302322 - protein, 21 aa, Cryptosporidium parvum
QTPESWLKYEGYIPKLTGDHD

SEQ ID NO: 2302323 - protein, 22 aa, Cryptosporidium parvum
QTPHGFSQFFFFSSSKVTCELL

SEQ ID NO: 2302324 - protein, 20 aa, Cryptosporidium parvum
QTQTRFPLINFQNSEEKGLK

SEQ ID NO: 2302325 - protein, 20 aa, Cryptosporidium parvum
QTRIKIGLNSKMPTRFPPVV

SEQ ID NO: 2302326 - protein, 18 aa, Cryptosporidium parvum
QTRITAMSLSHMCYCEGQ

SEQ ID NO: 2302327 - protein, 23 aa, Cryptosporidium parvum
QTRKRYRFDVVITTPSILNSQVD

SEQ ID NO: 2302328 - protein, 19 aa, Cryptosporidium parvum
QTRRPELGDKFSSRHGQKG

SEQ ID NO: 2302329 - protein, 25 aa, Cryptosporidium parvum
QTRSYCSLCGLSGRMHTRRSCPLLP

SEQ ID NO: 2302330 - protein, 21 aa, Cryptosporidium parvum
QTSKYPIKWVKSENNKDFIFK

SEQ ID NO: 2302331 - protein, 27 aa, Cryptosporidium parvum
QTTQWAVGLTRVFLKIEAFRDLEQLRV

SEQ ID NO: 2302332 - protein, 23 aa, Cryptosporidium parvum
QTVDDLILLFVFVLELIMIENPH

SEQ ID NO: 2302333 - protein, 18 aa, Cryptosporidium parvum
QTYHFTADIDFNYYNNND

SEQ ID NO: 2302334 - protein, 20 aa, Cryptosporidium parvum
QTYPGLVSFGNQILKQVNKD

SEQ ID NO: 2302335 - protein, 18 aa, Cryptosporidium parvum
QVAALCFQLKQVVSASWV

SEQ ID NO: 2302336 - protein, 17 aa, Cryptosporidium parvum
QVAEALFQMDLFTHYDK

SEQ ID NO: 2302337 - protein, 19 aa, Cryptosporidium parvum
QVDDDCCLCLDALNRDLVK

SEQ ID NO: 2302338 - protein, 23 aa, Cryptosporidium parvum
QVECLKLIASNKFCEKRIGYLAI

SEQ ID NO: 2302339 - protein, 45 aa, Cryptosporidium parvum
QVFKDINGIPWIGIWRWDLYEKKRGKLILIYSIINQTNYPTNCIS

SEQ ID NO: 2302340 - protein, 25 aa, Cryptosporidium parvum
QVFQDCSRMTTTTTVPSTFTTQTTA

SEQ ID NO: 2302341 - protein, 19 aa, Cryptosporidium parvum
QVGGFSCFNFKSRKIEIIK

SEQ ID NO: 2302342 - protein, 18 aa, Cryptosporidium parvum
QVIARISKIGSINVNQQV

SEQ ID NO: 2302343 - protein, 26 aa, Cryptosporidium parvum
QVIDCCNPAFPIREFEEHKKSNVESN

SEQ ID NO: 2302344 - protein, 23 aa, Cryptosporidium parvum
QVIKLGLPRPYLLKENIFSRIDQ

SEQ ID NO: 2302345 - protein, 24 aa, Cryptosporidium parvum
QVILPPKLLFKLPKHHVLKSLPLF

SEQ ID NO: 2302346 - protein, 19 aa, Cryptosporidium parvum
QVILWKWPSMQKIATLTGH

SEQ ID NO: 2302347 - protein, 23 aa, Cryptosporidium parvum
QVIPKEWPLLKMINFLKNSLVSS

SEQ ID NO: 2302348 - protein, 21 aa, Cryptosporidium parvum
QVIQKEWITSISIYNEKMYDS

SEQ ID NO: 2302349 - protein, 17 aa, Cryptosporidium parvum
QVISLFGKYTWSWISPR

SEQ ID NO: 2302350 - protein, 23 aa, Cryptosporidium parvum
QVKKAISTHGLFRATFEDKILLS

SEQ ID NO: 2302351 - protein, 20 aa, Cryptosporidium parvum
QVKPGITFEVFLHKTDNETF

SEQ ID NO: 2302352 - protein, 22 aa, Cryptosporidium parvum
QVKQSIEWNEIYFTALHSDAFC

SEQ ID NO: 2302353 - protein, 24 aa, Cryptosporidium parvum
QVKRIEGDIPYRVFIKGKMYPGLA

SEQ ID NO: 2302354 - protein, 23 aa, Cryptosporidium parvum
QVKSIETGILFGFVTFQTKNSQN

SEQ ID NO: 2302355 - protein, 26 aa, Cryptosporidium parvum
QVLDLWKLSILIGGGISQIGSSSNNI

SEQ ID NO: 2302356 - protein, 28 aa, Cryptosporidium parvum
QVLLPCAHIICIDCYKLISKKSSSNHKL

SEQ ID NO: 2302357 - protein, 18 aa, Cryptosporidium parvum
QVLMIINDMIQILLLNIN

SEQ ID NO: 2302358 - protein, 20 aa, Cryptosporidium parvum
QVLRRIIVFYSSFNEVFEIL

SEQ ID NO: 2302359 - protein, 25 aa, Cryptosporidium parvum
QVLVDLCAAPGGWLQVAKRNMGVSS

SEQ ID NO: 2302360 - protein, 18 aa, Cryptosporidium parvum
QVLWLIKNYLCGLEANKA

SEQ ID NO: 2302361 - protein, 18 aa, Cryptosporidium parvum
QVNISLCDQIQILEFKLK

SEQ ID NO: 2302362 - protein, 25 aa, Cryptosporidium parvum
QVPEARGYFSFTMCMENIYKELFMN

SEQ ID NO: 2302363 - protein, 20 aa, Cryptosporidium parvum
QVPFIYDVRVKPKVINTTTG

SEQ ID NO: 2302364 - protein, 32 aa, Cryptosporidium parvum
QVRTSFLEVINWLREWACSRSYGLGTYLPWDT

SEQ ID NO: 2302365 - protein, 29 aa, Cryptosporidium parvum
QVTFRNIYRLILFISEIKLSKNYNYFSLD

SEQ ID NO: 2302366 - protein, 23 aa, Cryptosporidium parvum
QVTGFSVGYPFKTDQWREQQQSI

SEQ ID NO: 2302367 - protein, 29 aa, Cryptosporidium parvum
QVTNKWLLKYKVVLFILVEALTLRDYYNE

SEQ ID NO: 2302368 - protein, 19 aa, Cryptosporidium parvum
QWAPSVVRGISKLAFFSSM

SEQ ID NO: 2302369 - protein, 19 aa, Cryptosporidium parvum
QWEPAGCPLTYMMNIELRK

SEQ ID NO: 2302370 - protein, 22 aa, Cryptosporidium parvum
QWETIIYNFDCELSDLELNFDF

SEQ ID NO: 2302371 - protein, 19 aa, Cryptosporidium parvum
QWLIGPKLYEANWMELQDR

SEQ ID NO: 2302372 - protein, 25 aa, Cryptosporidium parvum
QWNNYSIIWRQFILNKSNNNNNNNE

SEQ ID NO: 2302373 - protein, 25 aa, Cryptosporidium parvum
QYAGLMRPEGFPVYTTQWPSAFHGG

SEQ ID NO: 2302374 - protein, 22 aa, Cryptosporidium parvum
QYCPTIFWNIVRIFHGEIDLGI

SEQ ID NO: 2302375 - protein, 28 aa, Cryptosporidium parvum
QYDFERCIDDFIFLCFFIGNDFLPNLPV

SEQ ID NO: 2302376 - protein, 19 aa, Cryptosporidium parvum
QYDLEFFNRILYGVLERNK

SEQ ID NO: 2302377 - protein, 24 aa, Cryptosporidium parvum
QYEILIQLRDAWINALRSNAVDTK

SEQ ID NO: 2302378 - protein, 25 aa, Cryptosporidium parvum
QYFPPGWKNTLLLLLSNCIAIDSIQ

SEQ ID NO: 2302379 - protein, 20 aa, Cryptosporidium parvum
QYKGHFFVMKSQYNFSLYSE

SEQ ID NO: 2302380 - protein, 18 aa, Cryptosporidium parvum
QYKISTPKLLTFGNNKET

SEQ ID NO: 2302381 - protein, 25 aa, Cryptosporidium parvum
QYLCPTAYQHCLPWIQHILEGINDP

SEQ ID NO: 2302382 - protein, 24 aa, Cryptosporidium parvum
QYLGKIDTFLGIGGKYAKFQAKTR

SEQ ID NO: 2302383 - protein, 31 aa, Cryptosporidium parvum; identical to SEQ ID NO: 2179984

SEQ ID NO: 2302384 - protein, 22 aa, Cryptosporidium parvum
QYMCLKALVSRKAGKKAKKEYT

SEQ ID NO: 2302385 - protein, 17 aa, Cryptosporidium parvum
QYNEKWDIWSLGCVIQE

SEQ ID NO: 2302386 - protein, 18 aa, Cryptosporidium parvum
QYQKECRNKYQLLENYIN

SEQ ID NO: 2302387 - protein, 19 aa, Cryptosporidium parvum
QYRYQIRLIAQSIIRGGSR

SEQ ID NO: 2302388 - protein, 21 aa, Cryptosporidium parvum
QYSSPCNGGFYIHSNSDFNSD

SEQ ID NO: 2302389 - protein, 20 aa, Cryptosporidium parvum
QYTEACLQSLVAAAAEYPTD

SEQ ID NO: 2302390 - protein, 18 aa, Cryptosporidium parvum
QYTISWLKMGIFALNDIK

SEQ ID NO: 2302391 - protein, 23 aa, Cryptosporidium parvum
QYVKPCIMEEPIIDTVGENAVNT

SEQ ID NO: 2302392 - protein, 20 aa, Cryptosporidium parvum
QYYHCDLNFGNIIILKESIN

SEQ ID NO: 2302393 - protein, 17 aa, Cryptosporidium parvum
QYYPGKDMECINAPRDQ

SEQ ID NO: 2302394 - protein, 20 aa, Cryptosporidium parvum
RAAGLEGLCNFCNKDYVVLN

SEQ ID NO: 2302395 - protein, 26 aa, Cryptosporidium parvum
RADAQEFKPTFGITGSNVIPNSGIYY

SEQ ID NO: 2302396 - protein, 26 aa, Cryptosporidium parvum
RADFQLRPKLTIKDLEWLNSDKNDGF

SEQ ID NO: 2302397 - protein, 19 aa, Cryptosporidium parvum
RADLEYTLSRLIKGLESQR

SEQ ID NO: 2302398 - protein, 24 aa, Cryptosporidium parvum
RAFSTEIDYNWFLSPHNRILIENI

SEQ ID NO: 2302399 - protein, 20 aa, Cryptosporidium parvum
RAGLQFPVGRIQRMLKHRIP

SEQ ID NO: 2302400 - protein, 18 aa, Cryptosporidium parvum
RAGMKIGRIEDVTPIPTD

SEQ ID NO: 2302401 - protein, 17 aa, Cryptosporidium parvum
RAGNFGTSFTLLLPNEI

SEQ ID NO: 2302402 - protein, 17 aa, Cryptosporidium parvum
RAHFLAAHIPLYLYPFL

SEQ ID NO: 2302403 - protein, 21 aa, Cryptosporidium parvum
RAHTPRYLWEKIKLSNNFLVA

SEQ ID NO: 2302404 - protein, 21 aa, Cryptosporidium parvum
RAIANNFMSLFGYGDTVQSVN

SEQ ID NO: 2302405 - protein, 19 aa, Cryptosporidium parvum
RAIGITIALLLLRSFSKSI

SEQ ID NO: 2302406 - protein, 37 aa, Cryptosporidium parvum
RAIRMMFCKRRFPYSISEMLIRLSIGRVFIHALKWNY

SEQ ID NO: 2302407 - protein, 25 aa, Cryptosporidium parvum
RAITHLKIQILYRLGQFEECERLYS

SEQ ID NO: 2302408 - protein, 18 aa, Cryptosporidium parvum
RAKDWLNQIEELYKPLEY

SEQ ID NO: 2302409 - protein, 18 aa, Cryptosporidium parvum
RAKFRKSVEEYRDQMDDC

SEQ ID NO: 2302410 - protein, 28 aa, Cryptosporidium parvum
RAKGLEWKVVFIPKFVDKVFPLYRESEN

SEQ ID NO: 2302411 - protein, 17 aa, Cryptosporidium parvum
RAKKFGIAIDLNLEKMI

SEQ ID NO: 2302412 - protein, 20 aa, Cryptosporidium parvum
RALEFEVCRIRYESGIKGKF

SEQ ID NO: 2302413 - protein, 25 aa, Cryptosporidium parvum
RALGKYTGLGIHAFVGGLSLEKQER

SEQ ID NO: 2302414 - protein, 19 aa, Cryptosporidium parvum
RALMHLGDTSKLFGLDLEA

SEQ ID NO: 2302415 - protein, 24 aa, Cryptosporidium parvum
RALRIWKSCRIINNIFEIDNALSL

SEQ ID NO: 2302416 - protein, 20 aa, Cryptosporidium parvum
RALSLLRHLLIQGVVKSEYI

SEQ ID NO: 2302417 - protein, 23 aa, Cryptosporidium parvum
RANNIKVSASMFVEDLATGLKGM

SEQ ID NO: 2302418 - protein, 19 aa, Cryptosporidium parvum
RANVRYRIGPEDGITDVDI

SEQ ID NO: 2302419 - protein, 32 aa, Cryptosporidium parvum; identical to SEQ ID NO: 2180021

SEQ ID NO: 2302420 - protein, 17 aa, Cryptosporidium parvum
RAPEILLGIDKYSPSVD

SEQ ID NO: 2302421 - protein, 18 aa, Cryptosporidium parvum
RAPSIIFIDEIDSLCSSR

SEQ ID NO: 2302422 - protein, 28 aa, Cryptosporidium parvum
RAPVGVPQNLGYRLVRTVKNYVGPSKAP

SEQ ID NO: 2302423 - protein, 18 aa, Cryptosporidium parvum
RAPVVTWQDIPIFKPFTF

SEQ ID NO: 2302424 - protein, 18 aa, Cryptosporidium parvum
RAQFEAVAKFKRGLKHKD

SEQ ID NO: 2302425 - protein, 19 aa, Cryptosporidium parvum
RARNRIALLNTDYSNVMKE

SEQ ID NO: 2302426 - protein, 22 aa, Cryptosporidium parvum
RASEGLFTFSTEMNISLNLKSP

SEQ ID NO: 2302427 - protein, 22 aa, Cryptosporidium parvum
RASIPIFCLRDCQPFAKFACLR

SEQ ID NO: 2302428 - protein, 18 aa, Cryptosporidium parvum
RASKRLGSSFLDKDTLSG

SEQ ID NO: 2302429 - protein, 28 aa, Cryptosporidium parvum
RASLEICEKLKLHGLVVIGGDDSNTNAA

SEQ ID NO: 2302430 - protein, 17 aa, Cryptosporidium parvum
RATGIGLKQAVSGEITQ

SEQ ID NO: 2302431 - protein, 18 aa, Cryptosporidium parvum
RATMVPISINKCLITSKI

SEQ ID NO: 2302432 - protein, 26 aa, Cryptosporidium parvum
RATRLQEMWDRVVAGESIINGGKIPQ

SEQ ID NO: 2302433 - protein, 24 aa, Cryptosporidium parvum
RATYMLINCICEFRNFKLDKRNFI

SEQ ID NO: 2302434 - protein, 20 aa, Cryptosporidium parvum
RAVDLCAAPGSWSQVLSTKL

SEQ ID NO: 2302435 - protein, 18 aa, Cryptosporidium parvum
RAYDIMRYRNFRTLTADE

SEQ ID NO: 2302436 - protein, 21 aa, Cryptosporidium parvum
RAYNLKFWKILLSKDKTQFEL

SEQ ID NO: 2302437 - protein, 28 aa, Cryptosporidium parvum
RAYSPNNCWRMYCSECIMHNFSSIIKQK

SEQ ID NO: 2302438 - protein, 18 aa, Cryptosporidium parvum
RCFDMLQQSFVRRRKLDE

SEQ ID NO: 2302439 - protein, 25 aa, Cryptosporidium parvum
RCGHHFCLNCAGNLVQRKQKCPRCR

SEQ ID NO: 2302440 - protein, 22 aa, Cryptosporidium parvum
RCIIDLKVAKNNIYFIISEAKD

SEQ ID NO: 2302441 - protein, 26 aa, Cryptosporidium parvum
RCIISPRVPLLFIQKNLFRLGWFEPN

SEQ ID NO: 2302442 - protein, 22 aa, Cryptosporidium parvum
RCIKPNSRKAVHEFDSLDVLRQ

SEQ ID NO: 2302443 - protein, 21 aa, Cryptosporidium parvum
RCIQQLKILFWRHPGDPLLGK

SEQ ID NO: 2302444 - protein, 21 aa, Cryptosporidium parvum
RCKGLILLIGRIIRSIWDIPL

SEQ ID NO: 2302445 - protein, 22 aa, Cryptosporidium parvum
RCKIDQLVKFCVDFASCHVDVL

SEQ ID NO: 2302446 - protein, 21 aa, Cryptosporidium parvum
RCKIILGCRDLMFPPLNLQDR

SEQ ID NO: 2302447 - protein, 23 aa, Cryptosporidium parvum
RCLDLVQKYCIEFPEVSFNVRKF

SEQ ID NO: 2302448 - protein, 26 aa, Cryptosporidium parvum
RCLHRVLCCCPRIVGISRLVSTLINL

SEQ ID NO: 2302449 - protein, 23 aa, Cryptosporidium parvum
RCNKCSVEYLLDVTCEGGATRNV

SEQ ID NO: 2302450 - protein, 19 aa, Cryptosporidium parvum
RCQDLLKEELPEILNKTLS

SEQ ID NO: 2302451 - protein, 18 aa, Cryptosporidium parvum
RCQTFPAIGEVTMMKKDG

SEQ ID NO: 2302452 - protein, 23 aa, Cryptosporidium parvum
RCREFPIKYILKLLQTIEKPTEN

SEQ ID NO: 2302453 - protein, 18 aa, Cryptosporidium parvum
RCRICTEPPFSHFFNLRI

SEQ ID NO: 2302454 - protein, 19 aa, Cryptosporidium parvum
RCRQYIDGCCNRGGYCNFM

SEQ ID NO: 2302455 - protein, 24 aa, Cryptosporidium parvum
RCTDGQCGEACMHRAVNVDGTQGV

SEQ ID NO: 2302456 - protein, 19 aa, Cryptosporidium parvum
RCVAFWGNMNIMIEKILQL

SEQ ID NO: 2302457 - protein, 22 aa, Cryptosporidium parvum
RCVLKPRLGGNLKQNKDNIFDS

SEQ ID NO: 2302458 - protein, 21 aa, Cryptosporidium parvum
RCYNCSVDLWSVGCIMVEMIS

SEQ ID NO: 2302459 - protein, 23 aa, Cryptosporidium parvum
RDAEAGDILVFYFAGHGVQVDVL

SEQ ID NO: 2302460 - protein, 22 aa, Cryptosporidium parvum
RDAFSGWGCKVYLLTPEKLVTK

SEQ ID NO: 2302461 - protein, 21 aa, Cryptosporidium parvum
RDAPNRCPIPIVQSIDDLGKE

SEQ ID NO: 2302462 - protein, 20 aa, Cryptosporidium parvum
RDAYLPGCIITASNGKTIEV

SEQ ID NO: 2302463 - protein, 22 aa, Cryptosporidium parvum
RDCKRCYYLSLEFLLGRAMQNA

SEQ ID NO: 2302464 - protein, 18 aa, Cryptosporidium parvum
RDDLDSWLPYKGSTENAR

SEQ ID NO: 2302465 - protein, 18 aa, Cryptosporidium parvum
RDDVRNWLMGPRCREQFV

SEQ ID NO: 2302466 - protein, 18 aa, Cryptosporidium parvum
RDEEIPVLSRWFPKDSPP

SEQ ID NO: 2302467 - protein, 20 aa, Cryptosporidium parvum
RDEFTWRASQDLYKLEWKVG

SEQ ID NO: 2302468 - protein, 19 aa, Cryptosporidium parvum
RDEILDFGNEIDFSNIISK

SEQ ID NO: 2302469 - protein, 19 aa, Cryptosporidium parvum
RDELRRLRESDRFKYEKYI

SEQ ID NO: 2302470 - protein, 25 aa, Cryptosporidium parvum
RDEQPRGSINLKIVENVFADGPLGI

SEQ ID NO: 2302471 - protein, 20 aa, Cryptosporidium parvum
RDEYKIECIVAPYEADAQLS

SEQ ID NO: 2302472 - protein, 20 aa, Cryptosporidium parvum
RDFASEIKIVRSRSENSLKL

SEQ ID NO: 2302473 - protein, 17 aa, Cryptosporidium parvum
RDFFDFLKHIIKIYKEK

SEQ ID NO: 2302474 - protein, 18 aa, Cryptosporidium parvum
RDGNGFFKMVECYIRGNN

SEQ ID NO: 2302475 - protein, 19 aa, Cryptosporidium parvum
RDHCPEIFSQFLTPSMYAK

SEQ ID NO: 2302476 - protein, 19 aa, Cryptosporidium parvum
RDHKNWTALHIGVSKKFPE

SEQ ID NO: 2302477 - protein, 19 aa, Cryptosporidium parvum
RDIIGPKFARHLNQYFIIP

SEQ ID NO: 2302478 - protein, 23 aa, Cryptosporidium parvum
RDIKEKLCYIALDYEEEMKKSQE

SEQ ID NO: 2302479 - protein, 27 aa, Cryptosporidium parvum
RDINYIRDLLCILSRDIWSLLLSCHQN

SEQ ID NO: 2302480 - protein, 20 aa, Cryptosporidium parvum
RDIRLAFLRLVRKFHPDKNI

SEQ ID NO: 2302481 - protein, 27 aa, Cryptosporidium parvum
RDITCLKCIKRKSLQYLFMKSKQKAQQ

SEQ ID NO: 2302482 - protein, 18 aa, Cryptosporidium parvum
RDIVNIRYLHGYNIKNGF

SEQ ID NO: 2302483 - protein, 26 aa, Cryptosporidium parvum
RDIWSIGCVMYCILNGSPPFFGQDTR

SEQ ID NO: 2302484 - protein, 26 aa, Cryptosporidium parvum
RDKFLQLLLCIPYWNGNIPPPAILRP

SEQ ID NO: 2302485 - protein, 18 aa, Cryptosporidium parvum
RDKLCSLIRKYQTLIEAH

SEQ ID NO: 2302486 - protein, 27 aa, Cryptosporidium parvum
RDLAYRLCFLACHIEVVNAIASADDGR

SEQ ID NO: 2302487 - protein, 25 aa, Cryptosporidium parvum
RDLCKEIPIHINVGSVDALKASHNI

SEQ ID NO: 2302488 - protein, 24 aa, Cryptosporidium parvum
RDLFEMELRSKFGRILLKQLNSLE

SEQ ID NO: 2302489 - protein, 18 aa, Cryptosporidium parvum
RDLFPALWVPDLFMERVE

SEQ ID NO: 2302490 - protein, 17 aa, Cryptosporidium parvum
RDLFVYDPSLFVDDEDA

SEQ ID NO: 2302491 - protein, 23 aa, Cryptosporidium parvum
RDLKPSNILLHITFDKFLEQPIC

SEQ ID NO: 2302492 - protein, 33 aa, Cryptosporidium parvum; identical to SEQ ID NO: 2180083

SEQ ID NO: 2302493 - protein, 27 aa, Cryptosporidium parvum
RDLNFTWGCLPLRAIDHPDQLVPLPIG

SEQ ID NO: 2302494 - protein, 25 aa, Cryptosporidium parvum
RDLPPKRELYVYIGLSKLQKKIYSE

SEQ ID NO: 2302495 - protein, 22 aa, Cryptosporidium parvum
RDLRGICMACVGPESYNQLFNW

SEQ ID NO: 2302496 - protein, 27 aa, Cryptosporidium parvum
RDLVLRAGALPPILQLIALEIGPLDNN

SEQ ID NO: 2302497 - protein, 24 aa, Cryptosporidium parvum
RDMILKAINLFFLESIEQVSMINN

SEQ ID NO: 2302498 - protein, 22 aa, Cryptosporidium parvum
RDMNRMDAMYNRDINYIRDLLC

SEQ ID NO: 2302499 - protein, 22 aa, Cryptosporidium parvum
RDNGQHCIIVYDDLSKQANAYR

SEQ ID NO: 2302500 - protein, 22 aa, Cryptosporidium parvum
RDNQQIRKDLCIKVNSLQNDLE

SEQ ID NO: 2302501 - protein, 19 aa, Cryptosporidium parvum
RDNWMMWDSSLKIAIKRED

SEQ ID NO: 2302502 - protein, 24 aa, Cryptosporidium parvum
RDPEIFKIIINYLRDSAKCLPSPT

SEQ ID NO: 2302503 - protein, 21 aa, Cryptosporidium parvum
RDPRRSLLIRSLRFDTPTSLV

SEQ ID NO: 2302504 - protein, 24 aa, Cryptosporidium parvum
RDRATRSSTVWSIALPLFHSNLRL

SEQ ID NO: 2302505 - protein, 21 aa, Cryptosporidium parvum
RDRIVDLQFPISIPAMVESVP

SEQ ID NO: 2302506 - protein, 22 aa, Cryptosporidium parvum
RDRQRISSSLYYRDLNDGTGHG

SEQ ID NO: 2302507 - protein, 21 aa, Cryptosporidium parvum
RDRTRLCFTVDSFTTQRECLN

SEQ ID NO: 2302508 - protein, 20 aa, Cryptosporidium parvum
RDRVDLRNKLVFSVDPPGCK

SEQ ID NO: 2302509 - protein, 21 aa, Cryptosporidium parvum
RDSKFSKAMLFFSKRDITCLK

SEQ ID NO: 2302510 - protein, 19 aa, Cryptosporidium parvum
RDSKWVLYRHEHIGNVNQA

SEQ ID NO: 2302511 - protein, 28 aa, Cryptosporidium parvum
RDSLTCPICARLFRYAVLTPCCGETYCQ

SEQ ID NO: 2302512 - protein, 26 aa, Cryptosporidium parvum
RDSNGPKGCAFVRFSNIYEAQNAILC

SEQ ID NO: 2302513 - protein, 23 aa, Cryptosporidium parvum
RDSSPDFTIVRRMNPTKSDESNP

SEQ ID NO: 2302514 - protein, 17 aa, Cryptosporidium parvum
RDSYFSLLNFVRQYHLG

SEQ ID NO: 2302515 - protein, 19 aa, Cryptosporidium parvum
RDTLQIPICKFSLIKKIIV

SEQ ID NO: 2302516 - protein, 26 aa, Cryptosporidium parvum
RDVCIWKLVTEWSVEERMVFGREQKL

SEQ ID NO: 2302517 - protein, 22 aa, Cryptosporidium parvum
RDVKVYRLITARTYEAEMFERA

SEQ ID NO: 2302518 - protein, 25 aa, Cryptosporidium parvum
RDVLKEEIGPVILYFGCRYYDNDYL

SEQ ID NO: 2302519 - protein, 17 aa, Cryptosporidium parvum
RDVNCTFAHSINDLRTT

SEQ ID NO: 2302520 - protein, 18 aa, Cryptosporidium parvum
RDWHAIRLRLHLWGRFYD

SEQ ID NO: 2302521 - protein, 23 aa, Cryptosporidium parvum
RDYLNKEFCSYDDFFQLVNNGIL

SEQ ID NO: 2302522 - protein, 20 aa, Cryptosporidium parvum
RDYWSGKLLYCHTPPSNTKN

SEQ ID NO: 2302523 - protein, 27 aa, Cryptosporidium parvum
REAELAAMEICKTASTLFDTTDGTTPV

SEQ ID NO: 2302524 - protein, 19 aa, Cryptosporidium parvum
REAEWKLKILSRLLGHEKE

SEQ ID NO: 2302525 - protein, 17 aa, Cryptosporidium parvum
REAFREMADEAARGGAI

SEQ ID NO: 2302526 - protein, 27 aa, Cryptosporidium parvum
REAMRCLRHKKLKALIVAPDIEGDGVE

SEQ ID NO: 2302527 - protein, 17 aa, Cryptosporidium parvum
REAPFIAKVTNLDYSLQ

SEQ ID NO: 2302528 - protein, 20 aa, Cryptosporidium parvum
RECKTHDQIIRLTKKRQNSI

SEQ ID NO: 2302529 - protein, 36 aa, Cryptosporidium parvum
REDFAKEIIKSIGLKPIYFDCIKNLLKHIESKSEHV

SEQ ID NO: 2302530 - protein, 17 aa, Cryptosporidium parvum
REDIVLVGATIGSGQAS

SEQ ID NO: 2302531 - protein, 19 aa, Cryptosporidium parvum
REEILKAFKLFDDDNTGKI

SEQ ID NO: 2302532 - protein, 21 aa, Cryptosporidium parvum
REEKWWESIYNYYSQIYIPGY

SEQ ID NO: 2302533 - protein, 22 aa, Cryptosporidium parvum
REELELYLLVLRVVSKKADIVI

SEQ ID NO: 2302534 - protein, 21 aa, Cryptosporidium parvum
REENARLATIVEELSEKRKDF

SEQ ID NO: 2302535 - protein, 21 aa, Cryptosporidium parvum
REFFSRSNLELIYRAESPFGL

SEQ ID NO: 2302536 - protein, 24 aa, Cryptosporidium parvum
REFLSYMNRIFLRGMEELYSSCNL

SEQ ID NO: 2302537 - protein, 17 aa, Cryptosporidium parvum
REFPDLLRPKARYSEKV

SEQ ID NO: 2302538 - protein, 17 aa, Cryptosporidium parvum
REFTEVITPNIFSCDLW

SEQ ID NO: 2302539 - protein, 20 aa, Cryptosporidium parvum
REGKCFRLYTKEAFESELAD

SEQ ID NO: 2302540 - protein, 18 aa, Cryptosporidium parvum
REGLIPALINKKGDSSQS

SEQ ID NO: 2302541 - protein, 23 aa, Cryptosporidium parvum
REHFGGKCTYAIKQIPLGSKNLH

SEQ ID NO: 2302542 - protein, 18 aa, Cryptosporidium parvum
REIARLSTEITSFEKKKE

SEQ ID NO: 2302543 - protein, 21 aa, Cryptosporidium parvum
REIFWNSYFLTRLCRNTRLRR

SEQ ID NO: 2302544 - protein, 23 aa, Cryptosporidium parvum
REIKIILDIHGKKYRCRYISGKI

SEQ ID NO: 2302545 - protein, 25 aa, Cryptosporidium parvum
REIKRKIMSMFLLEFEVSNSKDYIK

SEQ ID NO: 2302546 - protein, 17 aa, Cryptosporidium parvum
REIKRMEHILNMRILEE

SEQ ID NO: 2302547 - protein, 25 aa, Cryptosporidium parvum
REIKSNMLLCRKCNIQLMDHNAFKQ

SEQ ID NO: 2302548 - protein, 19 aa, Cryptosporidium parvum
REILRCYINQRGIRGKFMS

SEQ ID NO: 2302549 - protein, 22 aa, Cryptosporidium parvum
REKELDGREALLNSQRAALSES

SEQ ID NO: 2302550 - protein, 20 aa, Cryptosporidium parvum
REKEVSFSKPHHGNITYIEV

SEQ ID NO: 2302551 - protein, 24 aa, Cryptosporidium parvum
REKKRKKALLGRLAVNATKQVVSI

SEQ ID NO: 2302552 - protein, 23 aa, Cryptosporidium parvum
REKMKNRRMMGGGTSIENSTAGT

SEQ ID NO: 2302553 - protein, 24 aa, Cryptosporidium parvum
REKNNCGLSHDFAQMNAKLSEINK

SEQ ID NO: 2302554 - protein, 21 aa, Cryptosporidium parvum
RELFKQYVVPIVDEVLLGFNC

SEQ ID NO: 2302555 - protein, 17 aa, Cryptosporidium parvum
RELFSPYGQINEIFIMR

SEQ ID NO: 2302556 - protein, 21 aa, Cryptosporidium parvum
RELIASIILCSRGTLSEKANL

SEQ ID NO: 2302557 - protein, 20 aa, Cryptosporidium parvum
RELKSSGISDGFTIELFDTD

SEQ ID NO: 2302558 - protein, 24 aa, Cryptosporidium parvum
RELLEILCDSFAYQIHIHGFFHGD

SEQ ID NO: 2302559 - protein, 18 aa, Cryptosporidium parvum
RELLMGIYEKGFERPSPI

SEQ ID NO: 2302560 - protein, 27 aa, Cryptosporidium parvum
RELLQFRCYKPVLTVYEFLKSKNCLDV

SEQ ID NO: 2302561 - protein, 19 aa, Cryptosporidium parvum
REMEELKGLNSQMEQKIEE

SEQ ID NO: 2302562 - protein, 17 aa, Cryptosporidium parvum
REMGITFSEKTENESLW

SEQ ID NO: 2302563 - protein, 27 aa, Cryptosporidium parvum
REMLTRLKNCFDIISFLNSVYDISPML

SEQ ID NO: 2302564 - protein, 39 aa, Cryptosporidium parvum
RENGKRKFRFSSLCPKLLNCLFPWIRSEQYFEDHDQPIF

SEQ ID NO: 2302565 - protein, 22 aa, Cryptosporidium parvum
RENISPPGFFNLFVRVESGNIA

SEQ ID NO: 2302566 - protein, 25 aa, Cryptosporidium parvum
RENKKRFTLGSTINRRGKIGFEASA

SEQ ID NO: 2302567 - protein, 25 aa, Cryptosporidium parvum
RENLISLLLTREVFSMVLKDGELDQ

SEQ ID NO: 2302568 - protein, 31 aa, Cryptosporidium parvum
RENYAKYGMFLFLKLLEGYKDHWVDSIRLTA

SEQ ID NO: 2302569 - protein, 17 aa, Cryptosporidium parvum
REPIRVATDLPQIKVTN

SEQ ID NO: 2302570 - protein, 31 aa, Cryptosporidium parvum
REPWEFGGEILKYIRKLVVTRYELLSFWYTI

SEQ ID NO: 2302571 - protein, 23 aa, Cryptosporidium parvum
REQKAKLSLYRPNGNSNKGENSS

SEQ ID NO: 2302572 - protein, 18 aa, Cryptosporidium parvum
RERIRKGLQLYCSEPTEP

SEQ ID NO: 2302573 - protein, 21 aa, Cryptosporidium parvum
RERLARLTGRVALIKIGGYSD

SEQ ID NO: 2302574 - protein, 18 aa, Cryptosporidium parvum
RESLNRHLESCIENFTRP

SEQ ID NO: 2302575 - protein, 17 aa, Cryptosporidium parvum
RETAILIATKRRALNLN

SEQ ID NO: 2302576 - protein, 18 aa, Cryptosporidium parvum
RETFPDLAPLMWHSFGCI

SEQ ID NO: 2302577 - protein, 17 aa, Cryptosporidium parvum
RETRILQILSFISQKCW

SEQ ID NO: 2302578 - protein, 18 aa, Cryptosporidium parvum
RETTSAFSNRFNSNNDQY

SEQ ID NO: 2302579 - protein, 20 aa, Cryptosporidium parvum
REVDLLYVLCGKGSSREDGV

SEQ ID NO: 2302580 - protein, 19 aa, Cryptosporidium parvum
REVGWREVENTDLLVRLND

SEQ ID NO: 2302581 - protein, 17 aa, Cryptosporidium parvum
REVPYFVYEDIIKPVPV

SEQ ID NO: 2302582 - protein, 27 aa, Cryptosporidium parvum
REVVEMPLLHPERFVQLGIDPPKGVLL

SEQ ID NO: 2302583 - protein, 23 aa, Cryptosporidium parvum
REWDGLMRICFSRKKKTIRANFN

SEQ ID NO: 2302584 - protein, 22 aa, Cryptosporidium parvum
REYCQSILRFLKNFKLSNQIQT

SEQ ID NO: 2302585 - protein, 17 aa, Cryptosporidium parvum
REYIKYISESVCVHKWN

SEQ ID NO: 2302586 - protein, 19 aa, Cryptosporidium parvum
REYRLNFSVGTKLKKLSFY

SEQ ID NO: 2302587 - protein, 18 aa, Cryptosporidium parvum
RFAERIIKVVERPKDPLE

SEQ ID NO: 2302588 - protein, 25 aa, Cryptosporidium parvum
RFAFYKGELPILITTERFLFFRRYL

SEQ ID NO: 2302589 - protein, 26 aa, Cryptosporidium parvum
RFAIGKSIFKRSDFTLRNRRFQALHC

SEQ ID NO: 2302590 - protein, 26 aa, Cryptosporidium parvum
RFAILKERILLPVTWIPPEYRWLHFL

SEQ ID NO: 2302591 - protein, 20 aa, Cryptosporidium parvum
RFDDFMEIMRHLKLNIKPGS

SEQ ID NO: 2302592 - protein, 31 aa, Cryptosporidium parvum; identical to SEQ ID NO: 2180176

SEQ ID NO: 2302593 - protein, 21 aa, Cryptosporidium parvum
RFEAVKLLLDKGAEPNLSDNV

SEQ ID NO: 2302594 - protein, 22 aa, Cryptosporidium parvum
RFEDNFEVIKILGYGGFGSVFM

SEQ ID NO: 2302595 - protein, 26 aa, Cryptosporidium parvum
RFEQCVDELKILHGFFPQISSSVDSI

SEQ ID NO: 2302596 - protein, 23 aa, Cryptosporidium parvum
RFERCLDLYLCPRAMKMRMNVDP

SEQ ID NO: 2302597 - protein, 25 aa, Cryptosporidium parvum
RFFILRSDGALIWCHHPNDTVYCET

SEQ ID NO: 2302598 - protein, 19 aa, Cryptosporidium parvum
RFFPLRTLTLYLLYKKSLE

SEQ ID NO: 2302599 - protein, 24 aa, Cryptosporidium parvum
RFFYIYKTWQWKNPVILCEIKEVP

SEQ ID NO: 2302600 - protein, 18 aa, Cryptosporidium parvum
RFGLETPSGVLLYGPPGC

SEQ ID NO: 2302601 - protein, 17 aa, Cryptosporidium parvum
RFGNAFHLCREVLRLTK

SEQ ID NO: 2302602 - protein, 19 aa, Cryptosporidium parvum
RFGNEYYNALILQIKAQRD

SEQ ID NO: 2302603 - protein, 19 aa, Cryptosporidium parvum
RFHELRSSIPSKLNILSQC

SEQ ID NO: 2302604 - protein, 19 aa, Cryptosporidium parvum
RFIDRFRCNASRASLVQSR

SEQ ID NO: 2302605 - protein, 18 aa, Cryptosporidium parvum
RFILEGQLIRKCLLKGEN

SEQ ID NO: 2302606 - protein, 18 aa, Cryptosporidium parvum
RFIPPEYNGFVLENEGSC

SEQ ID NO: 2302607 - protein, 19 aa, Cryptosporidium parvum
RFISESTKDMFIPRGVDVK

SEQ ID NO: 2302608 - protein, 20 aa, Cryptosporidium parvum
RFLCNLIISQIFKFPTVFRT

SEQ ID NO: 2302609 - protein, 17 aa, Cryptosporidium parvum
RFLEISNLLSIRNPNLL

SEQ ID NO: 2302610 - protein, 21 aa, Cryptosporidium parvum
RFLERVKKIFGGVLIIGIYDD

SEQ ID NO: 2302611 - protein, 19 aa, Cryptosporidium parvum
RFLNLGLLQIHRGINYNDN

SEQ ID NO: 2302612 - protein, 28 aa, Cryptosporidium parvum
RFLYDSLPLESCFGVSPLIEIFNAEVSS

SEQ ID NO: 2302613 - protein, 18 aa, Cryptosporidium parvum
RFNDWKFLFSNTLGLNVV

SEQ ID NO: 2302614 - protein, 19 aa, Cryptosporidium parvum
RFPEKSCRFLLDLLQNAES

SEQ ID NO: 2302615 - protein, 20 aa, Cryptosporidium parvum
RFPLNQANIVRECNFKEKLC

SEQ ID NO: 2302616 - protein, 25 aa, Cryptosporidium parvum
RFPSQILLKRINLLKTYIKTSNLNI

SEQ ID NO: 2302617 - protein, 24 aa, Cryptosporidium parvum
RFRAPELLFQPSLIGYEYPGIHEV

SEQ ID NO: 2302618 - protein, 18 aa, Cryptosporidium parvum
RFRCNASRASLVQSRIKY

SEQ ID NO: 2302619 - protein, 21 aa, Cryptosporidium parvum
RFSEYVDGYVLFFKIYDDMKI

SEQ ID NO: 2302620 - protein, 21 aa, Cryptosporidium parvum
RFSGGSIMTWSYIDISTFNPN

SEQ ID NO: 2302621 - protein, 20 aa, Cryptosporidium parvum
RFSSMFKDNINLIYLSTNFR

SEQ ID NO: 2302622 - protein, 24 aa, Cryptosporidium parvum
RFSVNCYMPVVIVSPVSQNIEAKF

SEQ ID NO: 2302623 - protein, 31 aa, Cryptosporidium parvum; identical to SEQ ID NO: 2180198

SEQ ID NO: 2302624 - protein, 26 aa, Cryptosporidium parvum
RFTKMYYPHYICVGISDRKSLELAGL

SEQ ID NO: 2302625 - protein, 20 aa, Cryptosporidium parvum
RFVHRSRLLAHKEVVPQAVW

SEQ ID NO: 2302626 - protein, 18 aa, Cryptosporidium parvum
RFVLKGRPIRVGRPTNAA

SEQ ID NO: 2302627 - protein, 23 aa, Cryptosporidium parvum
RFVNSGYCARLIPAGKETLYIEF

SEQ ID NO: 2302628 - protein, 19 aa, Cryptosporidium parvum
RFVPIVLDRLKSEWQNLMI

SEQ ID NO: 2302629 - protein, 19 aa, Cryptosporidium parvum
RFWDFRMINSPIYEHKTNG

SEQ ID NO: 2302630 - protein, 23 aa, Cryptosporidium parvum
RFYFSCFNEIFKLEFPQGDKERI

SEQ ID NO: 2302631 - protein, 24 aa, Cryptosporidium parvum
RFYGEAYGSMSYKEYIDYYQFDNI

SEQ ID NO: 2302632 - protein, 18 aa, Cryptosporidium parvum
RFYSEKSAEIIIKNLSRY

SEQ ID NO: 2302633 - protein, 17 aa, Cryptosporidium parvum
RFYSIKISKLPGNVKNL

SEQ ID NO: 2302634 - protein, 20 aa, Cryptosporidium parvum
RGDALRWIMMDRIRESSYKL

SEQ ID NO: 2302635 - protein, 30 aa, Cryptosporidium parvum; identical to SEQ ID NO: 2180209

SEQ ID NO: 2302636 - protein, 44 aa, Cryptosporidium parvum
RGEAKRFTLLFHISKMYLAIKTCKEWYRRIQSHFLNGLKNVRNN

SEQ ID NO: 2302637 - protein, 20 aa, Cryptosporidium parvum
RGECKKLKDKLKELSPSLAV

SEQ ID NO: 2302638 - protein, 20 aa, Cryptosporidium parvum
RGEECFSSKISLKVLKGSLI

SEQ ID NO: 2302639 - protein, 20 aa, Cryptosporidium parvum
RGEGCGAILLTKRSEIGGKK

SEQ ID NO: 2302640 - protein, 20 aa, Cryptosporidium parvum
RGESSFKGGGFNSSKASRSS

SEQ ID NO: 2302641 - protein, 17 aa, Cryptosporidium parvum
RGFLKGILSRKSSWRIR

SEQ ID NO: 2302642 - protein, 22 aa, Cryptosporidium parvum
RGGDKYEVFGVGGIKIQQILDL

SEQ ID NO: 2302643 - protein, 23 aa, Cryptosporidium parvum
RGGKDICNSCVDLKELLVSVCGE

SEQ ID NO: 2302644 - protein, 20 aa, Cryptosporidium parvum
RGGSGIGRLTGRGRLGSGTT

SEQ ID NO: 2302645 - protein, 22 aa, Cryptosporidium parvum
RGGSPYRGQAFILFQDLNCAIN

SEQ ID NO: 2302646 - protein, 23 aa, Cryptosporidium parvum
RGHSEIRESGLLSANKETYYNIE

SEQ ID NO: 2302647 - protein, 21 aa, Cryptosporidium parvum
RGHTGLNHLLFTSVGVLNDKN

SEQ ID NO: 2302648 - protein, 17 aa, Cryptosporidium parvum
RGIAMVRNITNVPADSN

SEQ ID NO: 2302649 - protein, 20 aa, Cryptosporidium parvum
RGIDIPDIEWIIQFDAPQDP

SEQ ID NO: 2302650 - protein, 20 aa, Cryptosporidium parvum
RGIDKLPPMHDWQFYDKKRI

SEQ ID NO: 2302651 - protein, 19 aa, Cryptosporidium parvum
RGIDTFGNVFIFNSSHETI

SEQ ID NO: 2302652 - protein, 26 aa, Cryptosporidium parvum
RGIHIPLSLAGKYFGLLKNERTKGDK

SEQ ID NO: 2302653 - protein, 22 aa, Cryptosporidium parvum
RGIIPILERWIGNLLSRQFTGR

SEQ ID NO: 2302654 - protein, 18 aa, Cryptosporidium parvum
RGILGKGCSSDFSVSQSL

SEQ ID NO: 2302655 - protein, 18 aa, Cryptosporidium parvum
RGIQASRMMRLSKEDFGM

SEQ ID NO: 2302656 - protein, 26 aa, Cryptosporidium parvum
RGISSSIRRKLSILLENLRKDPNFEL

SEQ ID NO: 2302657 - protein, 26 aa, Cryptosporidium parvum
RGKSCGFRFHSIELLKNVKSNNSKSN

SEQ ID NO: 2302658 - protein, 24 aa, Cryptosporidium parvum
RGKSEIDSGCLLSSRYISRLVPLD

SEQ ID NO: 2302659 - protein, 17 aa, Cryptosporidium parvum
RGKSSKYGSGAVGGGSS

SEQ ID NO: 2302660 - protein, 18 aa, Cryptosporidium parvum
RGKSTLDFVVDWSEKFIQ

SEQ ID NO: 2302661 - protein, 24 aa, Cryptosporidium parvum
RGKVNLKLIKFLILDEADRMLDMG

SEQ ID NO: 2302662 - protein, 21 aa, Cryptosporidium parvum
RGLDFPKIDWVIQLDIPENAD

SEQ ID NO: 2302663 - protein, 24 aa, Cryptosporidium parvum
RGLKCASCGVGSMFFKEDENGVTR

SEQ ID NO: 2302664 - protein, 24 aa, Cryptosporidium parvum
RGMEKFGDLLFDFEKRLDQITPIL

SEQ ID NO: 2302665 - protein, 20 aa, Cryptosporidium parvum
RGNFPKRLLNQGVFTKSHFS

SEQ ID NO: 2302666 - protein, 20 aa, Cryptosporidium parvum
RGNIRVFCRVRPPTISEQDF

SEQ ID NO: 2302667 - protein, 22 aa, Cryptosporidium parvum
RGNPILAHVCNVPYDFQNIVPD

SEQ ID NO: 2302668 - protein, 18 aa, Cryptosporidium parvum
RGNRELKGTLYAYDPHMN

SEQ ID NO: 2302669 - protein, 17 aa, Cryptosporidium parvum
RGPFLVVAPLSTLDHWK

SEQ ID NO: 2302670 - protein, 23 aa, Cryptosporidium parvum
RGPSRCPITLWFDQYNMKVVLED

SEQ ID NO: 2302671 - protein, 26 aa, Cryptosporidium parvum
RGQFCSICRKIWTSSWEGEWLQCDIC

SEQ ID NO: 2302672 - protein, 25 aa, Cryptosporidium parvum
RGQQEWSLRKPLEMRVQTDNVSNLQ

SEQ ID NO: 2302673 - protein, 23 aa, Cryptosporidium parvum
RGRKTMKAQKLWFLILQAQIETG

SEQ ID NO: 2302674 - protein, 17 aa, Cryptosporidium parvum
RGRYKIMTRLVDNEGNL

SEQ ID NO: 2302675 - protein, 24 aa, Cryptosporidium parvum
RGSHLRYVEGLSREFSVKVESVVD

SEQ ID NO: 2302676 - protein, 17 aa, Cryptosporidium parvum
RGSLMTMKNCVISDLVK

SEQ ID NO: 2302677 - protein, 27 aa, Cryptosporidium parvum
RGSNQICPVCHGFVKYIADFEYGETDF

SEQ ID NO: 2302678 - protein, 27 aa, Cryptosporidium parvum
RGSTLRLLCNLRFIKLIQPLIESILEN

SEQ ID NO: 2302679 - protein, 24 aa, Cryptosporidium parvum
RGTRRFLFDFSVTLKCDYTLDNNE

SEQ ID NO: 2302680 - protein, 18 aa, Cryptosporidium parvum
RGVMLLLPGMLTFIMHKD

SEQ ID NO: 2302681 - protein, 21 aa, Cryptosporidium parvum
RGYEDCPVCKAGVNSENVIPL

SEQ ID NO: 2302682 - protein, 26 aa, Cryptosporidium parvum
RGYENKRIYAIPVLEKVKCYVDTNYG

SEQ ID NO: 2302683 - protein, 18 aa, Cryptosporidium parvum
RGYLKSKNPRKMVTQWCE

SEQ ID NO: 2302684 - protein, 24 aa, Cryptosporidium parvum
RGYSCPKCKSIVCYLPTKCPVCLI

SEQ ID NO: 2302685 - protein, 25 aa, Cryptosporidium parvum
RGYSMLERICHRFSQFWSSKSPIIH

SEQ ID NO: 2302686 - protein, 18 aa, Cryptosporidium parvum
RHASALAKWGTRTKSVKK

SEQ ID NO: 2302687 - protein, 25 aa, Cryptosporidium parvum
RHDIIPKFIRFVLIIEVGKKSKKIY

SEQ ID NO: 2302688 - protein, 28 aa, Cryptosporidium parvum
RHFKNAPFHRLVACISPIPPPSVLSSSF

SEQ ID NO: 2302689 - protein, 23 aa, Cryptosporidium parvum
RHFNKIFAGITFLKFQDLMDENI

SEQ ID NO: 2302690 - protein, 18 aa, Cryptosporidium parvum
RHGCCTMLLYEIIRRLSI

SEQ ID NO: 2302691 - protein, 19 aa, Cryptosporidium parvum
RHIIISLITIYRCGFASSI

SEQ ID NO: 2302692 - protein, 24 aa, Cryptosporidium parvum
RHISGECFPVFKGIASKLNNLFSI

SEQ ID NO: 2302693 - protein, 19 aa, Cryptosporidium parvum
RHLTLHIGVGYGRTTILQV

SEQ ID NO: 2302694 - protein, 20 aa, Cryptosporidium parvum
RHLVKLTEYVILFWNKLSEE

SEQ ID NO: 2302695 - protein, 25 aa, Cryptosporidium parvum
RHNLEHPRWGSSWAGVQPSLIKNLQ

SEQ ID NO: 2302696 - protein, 22 aa, Cryptosporidium parvum
RHPYVIFGTGIFKKSLIETDIL

SEQ ID NO: 2302697 - protein, 24 aa, Cryptosporidium parvum
RHQEMPCIPRQKIIESIQHSMNTE

SEQ ID NO: 2302698 - protein, 17 aa, Cryptosporidium parvum
RHSKFALEKVTALKKTI

SEQ ID NO: 2302699 - protein, 18 aa, Cryptosporidium parvum
RIAETLCMEYYRNHGVDV

SEQ ID NO: 2302700 - protein, 17 aa, Cryptosporidium parvum
RIAKATGATICLTMAQL

SEQ ID NO: 2302701 - protein, 22 aa, Cryptosporidium parvum
RIARGGLLLGAIGTIPMSFMFN

SEQ ID NO: 2302702 - protein, 18 aa, Cryptosporidium parvum
RICMHCWISKSTLYCSTC

SEQ ID NO: 2302703 - protein, 21 aa, Cryptosporidium parvum
RIDGLELIFIFSKLLQVVATC

SEQ ID NO: 2302704 - protein, 29 aa, Cryptosporidium parvum
RIDNVTIQLAGLFCSLENELLELYHLCGS

SEQ ID NO: 2302705 - protein, 19 aa, Cryptosporidium parvum
RIDQLEFMLNDLISEVESS

SEQ ID NO: 2302706 - protein, 28 aa, Cryptosporidium parvum
RIDSVCMNCYISLCPHCILIGQHSSGDA

SEQ ID NO: 2302707 - protein, 18 aa, Cryptosporidium parvum
RIEDSFSQIEYVNQASQM

SEQ ID NO: 2302708 - protein, 24 aa, Cryptosporidium parvum
RIEKAKVHFDNKIEMIKKSIEKIS

SEQ ID NO: 2302709 - protein, 24 aa, Cryptosporidium parvum
RIEKSSNEILPWSKGIISIDGLAS

SEQ ID NO: 2302710 - protein, 20 aa, Cryptosporidium parvum
RIELDFGGLGKGYLWDMEIT

SEQ ID NO: 2302711 - protein, 20 aa, Cryptosporidium parvum
RIESDFETFQGRKSRTGYNR

SEQ ID NO: 2302712 - protein, 27 aa, Cryptosporidium parvum
RIFELSELWDMINLESFGVKWNPVINI

SEQ ID NO: 2302713 - protein, 21 aa, Cryptosporidium parvum
RIFSEICDFSILNEMKRKLLS

SEQ ID NO: 2302714 - protein, 18 aa, Cryptosporidium parvum
RIGAMDWCGPILATGGRD

SEQ ID NO: 2302715 - protein, 20 aa, Cryptosporidium parvum
RIGGKLSNSVLSRKCSDSRN

SEQ ID NO: 2302716 - protein, 18 aa, Cryptosporidium parvum
RIGQYVILEQNCIVRPCF

SEQ ID NO: 2302717 - protein, 23 aa, Cryptosporidium parvum
RIGRRRICSGNEGRERRRNQGLV

SEQ ID NO: 2302718 - protein, 19 aa, Cryptosporidium parvum
RIGTTGGSFSGSHDKPNQN

SEQ ID NO: 2302719 - protein, 25 aa, Cryptosporidium parvum
RIHEPRIDREKRFLGGVQSIITRKG

SEQ ID NO: 2302720 - protein, 25 aa, Cryptosporidium parvum
RIHVLPFDDCLEGITGNLFETYLKP

SEQ ID NO: 2302721 - protein, 28 aa, Cryptosporidium parvum
RIICGFLDRTIRVWFRTDQQLFLEEERE

SEQ ID NO: 2302722 - protein, 17 aa, Cryptosporidium parvum
RIICYFADESKKTGVKP

SEQ ID NO: 2302723 - protein, 24 aa, Cryptosporidium parvum
RIIDKELWYEKKINEKRKSKKRSI

SEQ ID NO: 2302724 - protein, 24 aa, Cryptosporidium parvum
RIIIGSLRVLARVASNPSNVDNLI

SEQ ID NO: 2302725 - protein, 21 aa, Cryptosporidium parvum
RIIILEEVYKVVDEFVSIHLE

SEQ ID NO: 2302726 - protein, 17 aa, Cryptosporidium parvum
RIIKEWYLYTLKQKILL

SEQ ID NO: 2302727 - protein, 17 aa, Cryptosporidium parvum
RIIRSIWDIPLFQQTSF

SEQ ID NO: 2302728 - protein, 26 aa, Cryptosporidium parvum
RIISDPMTINKIRIIKSMSNIPSQNR

SEQ ID NO: 2302729 - protein, 23 aa, Cryptosporidium parvum
RIIWKIKKIHGGTEIILKSKICL

SEQ ID NO: 2302730 - protein, 20 aa, Cryptosporidium parvum
RIKDEFLILVTKITFSSYYL

SEQ ID NO: 2302731 - protein, 36 aa, Cryptosporidium parvum
RIKEIIPKYKFCCCYSKNCLCDISVRYKSHDSNGIY

SEQ ID NO: 2302732 - protein, 19 aa, Cryptosporidium parvum
RIKIIDFFLYIFNKKEYYS

SEQ ID NO: 2302733 - protein, 29 aa, Cryptosporidium parvum
RIKSAKEALKHPFFKGMDFTKIRHQKPPI

SEQ ID NO: 2302734 - protein, 20 aa, Cryptosporidium parvum
RILDLGVQFLISTILLPEIL

SEQ ID NO: 2302735 - protein, 18 aa, Cryptosporidium parvum
RILEYLGFEVLRVNHVGD

SEQ ID NO: 2302736 - protein, 21 aa, Cryptosporidium parvum
RILKKGVSLNNEFLLEKEMIT

SEQ ID NO: 2302737 - protein, 20 aa, Cryptosporidium parvum
RILREIKLLRQLQHENILGI

SEQ ID NO: 2302738 - protein, 22 aa, Cryptosporidium parvum
RILREWKLLAKINHPNIIGFKG

SEQ ID NO: 2302739 - protein, 19 aa, Cryptosporidium parvum
RIMEEIRKFEGWENLEKVF

SEQ ID NO: 2302740 - protein, 20 aa, Cryptosporidium parvum
RIMGPEICNYIVPICSSFLA

SEQ ID NO: 2302741 - protein, 30 aa, Cryptosporidium parvum
RINEELKRKFGSFESHIRRLLDARDNEIIQ

SEQ ID NO: 2302742 - protein, 23 aa, Cryptosporidium parvum
RINLNLSACFLKINEFNMAMLHC

SEQ ID NO: 2302743 - protein, 19 aa, Cryptosporidium parvum
RINQPKGFFHELFKRQTKS

SEQ ID NO: 2302744 - protein, 18 aa, Cryptosporidium parvum
RIPFYNHNNGHDFTASFH

SEQ ID NO: 2302745 - protein, 28 aa, Cryptosporidium parvum
RIPNPHSLMPLRSCFSSRNGLWVASAAE

SEQ ID NO: 2302746 - protein, 21 aa, Cryptosporidium parvum
RIPPIAIQCLAAYTPKVKKMI

SEQ ID NO: 2302747 - protein, 25 aa, Cryptosporidium parvum
RIPRGKIPYEYLVKYHHQSYSQCKW

SEQ ID NO: 2302748 - protein, 25 aa, Cryptosporidium parvum
RIQKFLMENSGSFGFELSPEPVVDS

SEQ ID NO: 2302749 - protein, 27 aa, Cryptosporidium parvum
RIQKLLCFCLEFFLKYLQVAGRVENWN

SEQ ID NO: 2302750 - protein, 25 aa, Cryptosporidium parvum
RIQRMCLPVNISMILKSLESSPSVF

SEQ ID NO: 2302751 - protein, 24 aa, Cryptosporidium parvum
RIQSIYFKLEDIFGPNWEFESQGH

SEQ ID NO: 2302752 - protein, 19 aa, Cryptosporidium parvum
RIQSVPLVIGQFLEMIDSR

SEQ ID NO: 2302753 - protein, 23 aa, Cryptosporidium parvum
RIRDSNSKHCIGRQLSQKNSNYA

SEQ ID NO: 2302754 - protein, 17 aa, Cryptosporidium parvum
RIREILIGGRIGNIISS

SEQ ID NO: 2302755 - protein, 20 aa, Cryptosporidium parvum
RIRPDIRTNWIASALGNHFC

SEQ ID NO: 2302756 - protein, 19 aa, Cryptosporidium parvum
RIRPRKSEAVEHVREQLRI

SEQ ID NO: 2302757 - protein, 19 aa, Cryptosporidium parvum
RIRRDEIESLFSTFGKVNK

SEQ ID NO: 2302758 - protein, 18 aa, Cryptosporidium parvum
RIRRIPGVPIMYVTNHKY

SEQ ID NO: 2302759 - protein, 18 aa, Cryptosporidium parvum
RIRRKISRYVHRKPKGFR

SEQ ID NO: 2302760 - protein, 17 aa, Cryptosporidium parvum
RISALGVRRNLKSQQKF

SEQ ID NO: 2302761 - protein, 18 aa, Cryptosporidium parvum
RISEFLNKHLSFINKLSE

SEQ ID NO: 2302762 - protein, 19 aa, Cryptosporidium parvum
RISEWLPYRQGVIVPGPKL

SEQ ID NO: 2302763 - protein, 25 aa, Cryptosporidium parvum
RISMPICLNEPLSFIQRLSEDLEYH

SEQ ID NO: 2302764 - protein, 23 aa, Cryptosporidium parvum
RISPELVKNLSFQIVNGLAALHS

SEQ ID NO: 2302765 - protein, 18 aa, Cryptosporidium parvum
RISQEVCELIRENGEKEK

SEQ ID NO: 2302766 - protein, 23 aa, Cryptosporidium parvum
RISWAPECFGQLFVAGTTQKNIS

SEQ ID NO: 2302767 - protein, 19 aa, Cryptosporidium parvum
RITERPFLIVFRGEGSTDF

SEQ ID NO: 2302768 - protein, 21 aa, Cryptosporidium parvum
RIVELIPRKSIVFDLTCGAGA

SEQ ID NO: 2302769 - protein, 19 aa, Cryptosporidium parvum
RIVNACERISYLVSNKYIT

SEQ ID NO: 2302770 - protein, 31 aa, Cryptosporidium parvum
RIYDIKWICYSQALNEWRLYNNLDGAYQIFY

SEQ ID NO: 2302771 - protein, 22 aa, Cryptosporidium parvum
RIYEIYLNLVIYCEQSVLGKVY

SEQ ID NO: 2302772 - protein, 24 aa, Cryptosporidium parvum
RIYHRLKKHLLTFSKSSYQQNSKE

SEQ ID NO: 2302773 - protein, 18 aa, Cryptosporidium parvum
RIYIPLPDEESRVLLIKN

SEQ ID NO: 2302774 - protein, 24 aa, Cryptosporidium parvum
RIYLDDIAKYFGWDNSHDVEGVVS

SEQ ID NO: 2302775 - protein, 17 aa, Cryptosporidium parvum
RIYNSGLGWSLLKSLCF

SEQ ID NO: 2302776 - protein, 21 aa, Cryptosporidium parvum
RIYPHLNNMDGFFVAKLKKIS

SEQ ID NO: 2302777 - protein, 24 aa, Cryptosporidium parvum
RIYPKYPLDVTWRHDLFVKSNLDR

SEQ ID NO: 2302778 - protein, 22 aa, Cryptosporidium parvum
RIYPSFLLELWENIRDAVEIKY

SEQ ID NO: 2302779 - protein, 26 aa, Cryptosporidium parvum
RKACDIGRGAIFFSIARGKVAEGIDF

SEQ ID NO: 2302780 - protein, 20 aa, Cryptosporidium parvum
RKAELIKVLIALMENSYKTL

SEQ ID NO: 2302781 - protein, 18 aa, Cryptosporidium parvum
RKAHHSIQEKISLTPKLF

SEQ ID NO: 2302782 - protein, 26 aa, Cryptosporidium parvum
RKAKLTGDVKFRWYVNENCANLGLDP

SEQ ID NO: 2302783 - protein, 31 aa, Cryptosporidium parvum
RKAKNCKANRCFKCLLKGHQIKDCDTKYGYF

SEQ ID NO: 2302784 - protein, 18 aa, Cryptosporidium parvum
RKCYARLPPRATNCRKRK

SEQ ID NO: 2302785 - protein, 27 aa, Cryptosporidium parvum
RKDEINCLKLEMRLEKILELVTEQMRK

SEQ ID NO: 2302786 - protein, 19 aa, Cryptosporidium parvum
RKDEKFIFESNTTVNSKAD

SEQ ID NO: 2302787 - protein, 19 aa, Cryptosporidium parvum
RKDFNSSIVSTRKGTGTRL

SEQ ID NO: 2302788 - protein, 23 aa, Cryptosporidium parvum
RKDGKYTMDGCATFYKTNKFIAK

SEQ ID NO: 2302789 - protein, 20 aa, Cryptosporidium parvum
RKEEEFKRKVQQGIQETYLE

SEQ ID NO: 2302790 - protein, 37 aa, Cryptosporidium parvum
RKEIDLRVGSSFTRFLTLRYSRLFPIPERTLSYGTCQ

SEQ ID NO: 2302791 - protein, 25 aa, Cryptosporidium parvum
RKEIEPSGFCLVCASDVQQRSYGFF

SEQ ID NO: 2302792 - protein, 19 aa, Cryptosporidium parvum
RKEIGFVSSQFGDNVDKLD

SEQ ID NO: 2302793 - protein, 27 aa, Cryptosporidium parvum
RKEIVNCCPKDVFALGGSTSKTEYALN

SEQ ID NO: 2302794 - protein, 26 aa, Cryptosporidium parvum
RKEIYKLPDGFSWFDCNLWDIESQDF

SEQ ID NO: 2302795 - protein, 19 aa, Cryptosporidium parvum
RKEKLFVFGNDWPTRDGTG

SEQ ID NO: 2302796 - protein, 19 aa, Cryptosporidium parvum
RKESEALARKKRRYEKVME

SEQ ID NO: 2302797 - protein, 22 aa, Cryptosporidium parvum
RKETSLLYKNEYVKDFLENYHL

SEQ ID NO: 2302798 - protein, 24 aa, Cryptosporidium parvum
RKFCGKCGNATLDRVPIKVSSDGT

SEQ ID NO: 2302799 - protein, 20 aa, Cryptosporidium parvum
RKFDAHWLIVRINESAPIQP

SEQ ID NO: 2302800 - protein, 26 aa, Cryptosporidium parvum
RKFEFIKCKLINISYAFPSDTEHSIK

SEQ ID NO: 2302801 - protein, 17 aa, Cryptosporidium parvum
RKFPLLTPFGCKNEALF

SEQ ID NO: 2302802 - protein, 19 aa, Cryptosporidium parvum
RKFYDRNIGKEVVYETRVY

SEQ ID NO: 2302803 - protein, 20 aa, Cryptosporidium parvum
RKGFEGFKNVLKEFPVLLSN

SEQ ID NO: 2302804 - protein, 17 aa, Cryptosporidium parvum
RKGHIPNQYFIFTSPSL

SEQ ID NO: 2302805 - protein, 23 aa, Cryptosporidium parvum
RKGLPTQHKIVMAAEKQRTLNKK

SEQ ID NO: 2302806 - protein, 20 aa, Cryptosporidium parvum
RKGTGKKRTRGMPSDIVTEI

SEQ ID NO: 2302807 - protein, 17 aa, Cryptosporidium parvum
RKGYPPQSLWDFCDKIG

SEQ ID NO: 2302808 - protein, 29 aa, Cryptosporidium parvum
RKHALEAVSYSIACVFYTKTCFEKNEAHC

SEQ ID NO: 2302809 - protein, 20 aa, Cryptosporidium parvum
RKHFKRIRFPPFDDEEPPID

SEQ ID NO: 2302810 - protein, 34 aa, Cryptosporidium parvum
RKHFLKLIDIYYFFRIQIIFWKLAMYKTYHIPNA

SEQ ID NO: 2302811 - protein, 25 aa, Cryptosporidium parvum
RKHFPSVNWNTSFSKYSRVLEPYFD

SEQ ID NO: 2302812 - protein, 17 aa, Cryptosporidium parvum
RKHNCPRVLTQKRIFGS

SEQ ID NO: 2302813 - protein, 18 aa, Cryptosporidium parvum
RKHRGILFGYEPNSGGVI

SEQ ID NO: 2302814 - protein, 17 aa, Cryptosporidium parvum
RKIASAFKSKCPYCDRS

SEQ ID NO: 2302815 - protein, 23 aa, Cryptosporidium parvum
RKIENYLKLCLQLIFMSYQELLS

SEQ ID NO: 2302816 - protein, 17 aa, Cryptosporidium parvum
RKILKQICTLNKSNNVT

SEQ ID NO: 2302817 - protein, 21 aa, Cryptosporidium parvum
RKIQESELINMISMMNETTEK

SEQ ID NO: 2302818 - protein, 29 aa, Cryptosporidium parvum
RKIVLSYIRRPSCLILAITAANTDIANSD

SEQ ID NO: 2302819 - protein, 23 aa, Cryptosporidium parvum
RKIYLWPSYCEYKTNLTQKNDNQ

SEQ ID NO: 2302820 - protein, 26 aa, Cryptosporidium parvum
RKKDVVFKLCEYYNKINLGLISHDPL

SEQ ID NO: 2302821 - protein, 25 aa, Cryptosporidium parvum
RKKIKREIKILYNLHGGPNIVKLLD

SEQ ID NO: 2302822 - protein, 21 aa, Cryptosporidium parvum
RKKILASGIKIVYQKSDSQPS

SEQ ID NO: 2302823 - protein, 22 aa, Cryptosporidium parvum
RKKKKGFIRKKWSIEDERDVSD

SEQ ID NO: 2302824 - protein, 28 aa, Cryptosporidium parvum
RKKKLLNIRMLYPFTIRCNGCEVYHYVG

SEQ ID NO: 2302825 - protein, 17 aa, Cryptosporidium parvum
RKKQLSLDREKILSQGL

SEQ ID NO: 2302826 - protein, 20 aa, Cryptosporidium parvum
RKKQVMMFSATMTKEIRDVC

SEQ ID NO: 2302827 - protein, 23 aa, Cryptosporidium parvum
RKKRPNNPLSHVIRRLTEEIFAI

SEQ ID NO: 2302828 - protein, 27 aa, Cryptosporidium parvum
RKKRWTLCPSCDCIPKADKREKIVGQW

SEQ ID NO: 2302829 - protein, 18 aa, Cryptosporidium parvum
RKKSNVIFSNNEKILNNP

SEQ ID NO: 2302830 - protein, 18 aa, Cryptosporidium parvum
RKKVELLKFWLERQKSYR

SEQ ID NO: 2302831 - protein, 18 aa, Cryptosporidium parvum
RKKYNIYNCEKFHVGLPL

SEQ ID NO: 2302832 - protein, 24 aa, Cryptosporidium parvum
RKLAFDFYPALTMVGTPSPNITSA

SEQ ID NO: 2302833 - protein, 18 aa, Cryptosporidium parvum
RKLGVWADNIEVQALSDL

SEQ ID NO: 2302834 - protein, 18 aa, Cryptosporidium parvum
RKLHALNFAREIIMRDDP

SEQ ID NO: 2302835 - protein, 19 aa, Cryptosporidium parvum
RKLIFDELNGIPVDVVLHD

SEQ ID NO: 2302836 - protein, 17 aa, Cryptosporidium parvum
RKLKVLKTFVKLDHFDI

SEQ ID NO: 2302837 - protein, 21 aa, Cryptosporidium parvum
RKLKYANGRIEWRVIGDVSLV

SEQ ID NO: 2302838 - protein, 19 aa, Cryptosporidium parvum
RKLLKSEFWGTIVEHLETE

SEQ ID NO: 2302839 - protein, 23 aa, Cryptosporidium parvum
RKLLPGMYVTISGVFLPVVKEGF

SEQ ID NO: 2302840 - protein, 26 aa, Cryptosporidium parvum
RKLLSECGTILRWSRQEDPTTKKLSS

SEQ ID NO: 2302841 - protein, 23 aa, Cryptosporidium parvum
RKLSGLFKHIGARFVMNSTISEY

SEQ ID NO: 2302842 - protein, 19 aa, Cryptosporidium parvum
RKLSKKSKFCMNFIIESFI

SEQ ID NO: 2302843 - protein, 17 aa, Cryptosporidium parvum
RKLSLVLDLDNTLIHAS

SEQ ID NO: 2302844 - protein, 18 aa, Cryptosporidium parvum
RKLSSFPKITNCSMTNFK

SEQ ID NO: 2302845 - protein, 17 aa, Cryptosporidium parvum
RKLTISISKLKKMVMGK

SEQ ID NO: 2302846 - protein, 25 aa, Cryptosporidium parvum
RKMGPRKLLVCAPSNAAIDAIVRKL

SEQ ID NO: 2302847 - protein, 20 aa, Cryptosporidium parvum
RKMGVFRLSFDPRRLNEWIL

SEQ ID NO: 2302848 - protein, 29 aa, Cryptosporidium parvum
RKMLFICDNHPWYLGLGDQGYWTAEKINT

SEQ ID NO: 2302849 - protein, 17 aa, Cryptosporidium parvum
RKMLTFHPSLRITATQC

SEQ ID NO: 2302850 - protein, 33 aa, Cryptosporidium parvum
RKNGYLSYKIKDYRIGQTLGIGSFGKVKLAIHE

SEQ ID NO: 2302851 - protein, 19 aa, Cryptosporidium parvum
RKNIFKKYLYEASQTNCSR

SEQ ID NO: 2302852 - protein, 30 aa, Cryptosporidium parvum
RKNIPSIDIIKRLAGRLKNKDSDTISEFNF

SEQ ID NO: 2302853 - protein, 23 aa, Cryptosporidium parvum
RKNKPEQTCSVFVFDKTQNSGNE

SEQ ID NO: 2302854 - protein, 27 aa, Cryptosporidium parvum
RKNLFKVFLRYFIYPAYLDLYSYGNII

SEQ ID NO: 2302855 - protein, 18 aa, Cryptosporidium parvum
RKNLPIYPMRDSLVDAIR

SEQ ID NO: 2302856 - protein, 18 aa, Cryptosporidium parvum
RKNSEHSHGHFVMSPAQS

SEQ ID NO: 2302857 - protein, 17 aa, Cryptosporidium parvum
RKNSICIRCLKIHPKEH

SEQ ID NO: 2302858 - protein, 26 aa, Cryptosporidium parvum
RKNSLEFLKNIRFEQMAPHDLLKIRT

SEQ ID NO: 2302859 - protein, 21 aa, Cryptosporidium parvum
RKNVNKCAPYESFEGKISSKK

SEQ ID NO: 2302860 - protein, 17 aa, Cryptosporidium parvum
RKPGKHMASETNREHKG

SEQ ID NO: 2302861 - protein, 17 aa, Cryptosporidium parvum
RKPIFRKMEEDNSEPQT

SEQ ID NO: 2302862 - protein, 24 aa, Cryptosporidium parvum
RKPIILGTYAFMLSIAEQKKRGDN

SEQ ID NO: 2302863 - protein, 19 aa, Cryptosporidium parvum
RKPIPGHFYGTYRSQNLKI

SEQ ID NO: 2302864 - protein, 20 aa, Cryptosporidium parvum
RKQMKSCCYCVELIGDDFRA

SEQ ID NO: 2302865 - protein, 18 aa, Cryptosporidium parvum
RKQNIGCTIDLFLTNNFI

SEQ ID NO: 2302866 - protein, 19 aa, Cryptosporidium parvum
RKQNYSFECEELLSNVMSK

SEQ ID NO: 2302867 - protein, 25 aa, Cryptosporidium parvum
RKQSSNFQILWPSLQDWIYSSDKNI

SEQ ID NO: 2302868 - protein, 23 aa, Cryptosporidium parvum
RKREIPWGIEMALRKMLKGEKSN

SEQ ID NO: 2302869 - protein, 19 aa, Cryptosporidium parvum
RKRELALKRKRDRETIRRA

SEQ ID NO: 2302870 - protein, 20 aa, Cryptosporidium parvum
RKRFSEHDAARIIKQVFSGI

SEQ ID NO: 2302871 - protein, 20 aa, Cryptosporidium parvum
RKRMKRYFLNILRSNNEKFK

SEQ ID NO: 2302872 - protein, 19 aa, Cryptosporidium parvum
RKRNCKNYKDKSFIQNINV

SEQ ID NO: 2302873 - protein, 24 aa, Cryptosporidium parvum
RKRQSNSFPGARKSSGGDLYKSLF

SEQ ID NO: 2302874 - protein, 20 aa, Cryptosporidium parvum
RKRRGSAKSSYNFSPPPIPV

SEQ ID NO: 2302875 - protein, 24 aa, Cryptosporidium parvum
RKRTESFALYIYKVLKQVHPETGI

SEQ ID NO: 2302876 - protein, 19 aa, Cryptosporidium parvum
RKRYTPLGWTKFYDFSEAD

SEQ ID NO: 2302877 - protein, 26 aa, Cryptosporidium parvum
RKSATIMCLPIKWKTYINTIYSGENI

SEQ ID NO: 2302878 - protein, 18 aa, Cryptosporidium parvum
RKSDLYFKNELLRKDELI

SEQ ID NO: 2302879 - protein, 25 aa, Cryptosporidium parvum
RKSIKTQKSLDCYDIIKRPITTESA

SEQ ID NO: 2302880 - protein, 19 aa, Cryptosporidium parvum
RKSIVMLAFIIKLFGLKNM

SEQ ID NO: 2302881 - protein, 20 aa, Cryptosporidium parvum
RKSKFSFNPNAKEFLPRAIS

SEQ ID NO: 2302882 - protein, 20 aa, Cryptosporidium parvum
RKSPQCAFDGPPVLSKLEKN

SEQ ID NO: 2302883 - protein, 23 aa, Cryptosporidium parvum
RKSRELWEKISYEKARLEEYGNS

SEQ ID NO: 2302884 - protein, 17 aa, Cryptosporidium parvum
RKSVAPFKLANMHKDFE

SEQ ID NO: 2302885 - protein, 18 aa, Cryptosporidium parvum
RKTLEFSLIEYQKGGWFS

SEQ ID NO: 2302886 - protein, 17 aa, Cryptosporidium parvum
RKTLLSFLELVSEKDNE

SEQ ID NO: 2302887 - protein, 20 aa, Cryptosporidium parvum
RKTNEFGRFRGLSKLFKLPK

SEQ ID NO: 2302888 - protein, 20 aa, Cryptosporidium parvum
RKTSFDKIMRIHSSLIGSLS

SEQ ID NO: 2302889 - protein, 17 aa, Cryptosporidium parvum
RKVEKDCFEEEEEDGEG

SEQ ID NO: 2302890 - protein, 25 aa, Cryptosporidium parvum
RKVSRLYEILRLPSNGLERAIIHRN

SEQ ID NO: 2302891 - protein, 24 aa, Cryptosporidium parvum
RKWRTLWCWTHIYVHYKRAQIYTR

SEQ ID NO: 2302892 - protein, 18 aa, Cryptosporidium parvum
RKYQCILLSATLNKEVDS

SEQ ID NO: 2302893 - protein, 24 aa, Cryptosporidium parvum
RKYYPGEEIPILSIMGDGNMTNSR

SEQ ID NO: 2302894 - protein, 17 aa, Cryptosporidium parvum
RLCNTIFPLKPWEKRDY

SEQ ID NO: 2302895 - protein, 19 aa, Cryptosporidium parvum
RLDAIFCMGSDESSFNGID

SEQ ID NO: 2302896 - protein, 19 aa, Cryptosporidium parvum
RLDEMPEIDTNLFSMPIQI

SEQ ID NO: 2302897 - protein, 19 aa, Cryptosporidium parvum
RLDNFPLLENLKVLEIQDN

SEQ ID NO: 2302898 - protein, 20 aa, Cryptosporidium parvum
RLDNLGGVFSCFTALIDASE

SEQ ID NO: 2302899 - protein, 19 aa, Cryptosporidium parvum
RLDTLSSRLSRIPSPNVLI

SEQ ID NO: 2302900 - protein, 18 aa, Cryptosporidium parvum
RLEHACKGYMQLSHASAS

SEQ ID NO: 2302901 - protein, 20 aa, Cryptosporidium parvum
RLEHCFANVIFPSRRKIENY

SEQ ID NO: 2302902 - protein, 30 aa, Cryptosporidium parvum; identical to SEQ ID NO: 2180439

SEQ ID NO: 2302903 - protein, 22 aa, Cryptosporidium parvum
RLELQISNGIPLKALTPDNSIT

SEQ ID NO: 2302904 - protein, 22 aa, Cryptosporidium parvum
RLENFSKFKSGQVDILFASELA

SEQ ID NO: 2302905 - protein, 18 aa, Cryptosporidium parvum
RLEVKISNMIRNMKTPKH

SEQ ID NO: 2302906 - protein, 18 aa, Cryptosporidium parvum
RLEYRVSRIERTLESLIK

SEQ ID NO: 2302907 - protein, 24 aa, Cryptosporidium parvum
RLFKKNVNNMFMWYSYFRGNIYLE

SEQ ID NO: 2302908 - protein, 20 aa, Cryptosporidium parvum
RLFLLPRPGTSLVNLVVALE

SEQ ID NO: 2302909 - protein, 26 aa, Cryptosporidium parvum
RLFSTCKEFKFLLVRNEEKIELEKLV

SEQ ID NO: 2302910 - protein, 20 aa, Cryptosporidium parvum
RLGDVPPLSFSYLDKNRNEA

SEQ ID NO: 2302911 - protein, 25 aa, Cryptosporidium parvum
RLGRCIPANPIALVGLLSNFGQFKS

SEQ ID NO: 2302912 - protein, 18 aa, Cryptosporidium parvum
RLHEETIPLSAARALTHV

SEQ ID NO: 2302913 - protein, 23 aa, Cryptosporidium parvum
RLHVPNIDPSMFMERFAAQMKLG

SEQ ID NO: 2302914 - protein, 19 aa, Cryptosporidium parvum
RLIGESIERILFLILNNGF

SEQ ID NO: 2302915 - protein, 19 aa, Cryptosporidium parvum
RLIIKRMSEYWKLLKEHSL

SEQ ID NO: 2302916 - protein, 20 aa, Cryptosporidium parvum
RLIWDQRPFLTGSIDDDTQL

SEQ ID NO: 2302917 - protein, 17 aa, Cryptosporidium parvum
RLIWGVVGEEALKNSKI

SEQ ID NO: 2302918 - protein, 23 aa, Cryptosporidium parvum
RLKGNEELNGFVGISRVFNGNIK

SEQ ID NO: 2302919 - protein, 17 aa, Cryptosporidium parvum
RLKKNICESEHENDDKE

SEQ ID NO: 2302920 - protein, 17 aa, Cryptosporidium parvum
RLKQIAIGKSLPEYKNY

SEQ ID NO: 2302921 - protein, 17 aa, Cryptosporidium parvum
RLKYGIISLKARSKLWW

SEQ ID NO: 2302922 - protein, 22 aa, Cryptosporidium parvum
RLLEPELNKSASSWKKYHSKVF

SEQ ID NO: 2302923 - protein, 19 aa, Cryptosporidium parvum
RLLFKPCTEFLPRLHQNLG

SEQ ID NO: 2302924 - protein, 19 aa, Cryptosporidium parvum
RLLFYISVYGFEELGFKCI

SEQ ID NO: 2302925 - protein, 19 aa, Cryptosporidium parvum
RLLGPGLNKAGKFPTVITP

SEQ ID NO: 2302926 - protein, 19 aa, Cryptosporidium parvum
RLLKLCSYSRVYSTQVPVV

SEQ ID NO: 2302927 - protein, 24 aa, Cryptosporidium parvum
RLLKNLKTILCINGSPNVKITPIN

SEQ ID NO: 2302928 - protein, 20 aa, Cryptosporidium parvum
RLLPETPLAEVFFADEMANH

SEQ ID NO: 2302929 - protein, 21 aa, Cryptosporidium parvum
RLLREERLLIAKMIKQIAATG

SEQ ID NO: 2302930 - protein, 23 aa, Cryptosporidium parvum
RLLSELMAIITVGRKGNCPSSKG

SEQ ID NO: 2302931 - protein, 23 aa, Cryptosporidium parvum
RLLTLQYYFSLWRQESRKERNFK

SEQ ID NO: 2302932 - protein, 18 aa, Cryptosporidium parvum
RLLYKKYYIDILVVDENL

SEQ ID NO: 2302933 - protein, 17 aa, Cryptosporidium parvum
RLNEIYTSISRTIIKKC

SEQ ID NO: 2302934 - protein, 24 aa, Cryptosporidium parvum
RLNESISAMTLRISSIDEEIAKRE

SEQ ID NO: 2302935 - protein, 21 aa, Cryptosporidium parvum
RLNLIKTLPLHQQYVIMGIIL

SEQ ID NO: 2302936 - protein, 27 aa, Cryptosporidium parvum
RLNNRLRANGFLSIPFLPDLTSPARSL

SEQ ID NO: 2302937 - protein, 24 aa, Cryptosporidium parvum
RLNSCEVFDPFATVPLRSVSMDPA

SEQ ID NO: 2302938 - protein, 25 aa, Cryptosporidium parvum
RLNSRRSCELEFISLPPPEYSYNIL

SEQ ID NO: 2302939 - protein, 20 aa, Cryptosporidium parvum
RLPDEILKHQSWWIYKKIVI

SEQ ID NO: 2302940 - protein, 24 aa, Cryptosporidium parvum
RLPVPRPGQVLGLVGTNGIGKSTA

SEQ ID NO: 2302941 - protein, 21 aa, Cryptosporidium parvum
RLQQLQFEFGIYIRPSDIMID

SEQ ID NO: 2302942 - protein, 24 aa, Cryptosporidium parvum
RLQTLRPEEIIIVFDFPEHEVEAR

SEQ ID NO: 2302943 - protein, 18 aa, Cryptosporidium parvum
RLRRVAHNPLFFSKRNAY

SEQ ID NO: 2302944 - protein, 25 aa, Cryptosporidium parvum
RLRSGLKMKCGRSKFQKSYTECSDY

SEQ ID NO: 2302945 - protein, 20 aa, Cryptosporidium parvum
RLRTIRILLNTCIQESKQLR

SEQ ID NO: 2302946 - protein, 25 aa, Cryptosporidium parvum
RLRYLKATRVLNKWQTIYKVQNKDS

SEQ ID NO: 2302947 - protein, 19 aa, Cryptosporidium parvum
RLSHCYILLKSIYNDLDQL

SEQ ID NO: 2302948 - protein, 18 aa, Cryptosporidium parvum
RLSKISFLPIKVEEEHDF

SEQ ID NO: 2302949 - protein, 19 aa, Cryptosporidium parvum
RLSKRAFKFQRKCETKDSI

SEQ ID NO: 2302950 - protein, 18 aa, Cryptosporidium parvum
RLSLELLEEVVIDMFHPL

SEQ ID NO: 2302951 - protein, 19 aa, Cryptosporidium parvum
RLSSCPTFSSIATSWGTPV

SEQ ID NO: 2302952 - protein, 18 aa, Cryptosporidium parvum
RLSSCSLLGTLLNRLIKG

SEQ ID NO: 2302953 - protein, 21 aa, Cryptosporidium parvum
RLSTPPFLKLHLKPMPSDPTH

SEQ ID NO: 2302954 - protein, 22 aa, Cryptosporidium parvum
RLTDCHHLLAIFCEKNRIEYPK

SEQ ID NO: 2302955 - protein, 17 aa, Cryptosporidium parvum
RLTETLVNKEHELMIKE

SEQ ID NO: 2302956 - protein, 26 aa, Cryptosporidium parvum
RLTQKKSYKFAVLSPFNISHRLYNLD

SEQ ID NO: 2302957 - protein, 24 aa, Cryptosporidium parvum
RLVLLEFQGSLSISKLNTETGEMI

SEQ ID NO: 2302958 - protein, 19 aa, Cryptosporidium parvum
RLVSLLSCLQKTAPRVLIF

SEQ ID NO: 2302959 - protein, 19 aa, Cryptosporidium parvum
RLVSWCSYLRTALSDIEVD

SEQ ID NO: 2302960 - protein, 20 aa, Cryptosporidium parvum
RLWDLRFAQQPFLYMNSNLT

SEQ ID NO: 2302961 - protein, 25 aa, Cryptosporidium parvum
RLWENKTPKLSSIWRRNEESKNLIV

SEQ ID NO: 2302962 - protein, 18 aa, Cryptosporidium parvum
RLWGDNFFNPETKKFTKT

SEQ ID NO: 2302963 - protein, 32 aa, Cryptosporidium parvum; identical to SEQ ID NO: 2180490

SEQ ID NO: 2302964 - protein, 19 aa, Cryptosporidium parvum
RLYLNSVKMGVKFGNGNTM

SEQ ID NO: 2302965 - protein, 32 aa, Cryptosporidium parvum; identical to SEQ ID NO: 2180494

SEQ ID NO: 2302966 - protein, 23 aa, Cryptosporidium parvum
RLYRLKENLKRLKIDKNAIELKI

SEQ ID NO: 2302967 - protein, 21 aa, Cryptosporidium parvum
RLYYCKSLDFLWDWNSRIFID

SEQ ID NO: 2302968 - protein, 19 aa, Cryptosporidium parvum
RMDEQIGIGLSNEITSNCS

SEQ ID NO: 2302969 - protein, 18 aa, Cryptosporidium parvum
RMDLSIGSYMAIPIKTPF

SEQ ID NO: 2302970 - protein, 29 aa, Cryptosporidium parvum
RMDPRVVHVVVLTKVWTRFRGLRNTLNGF

SEQ ID NO: 2302971 - protein, 26 aa, Cryptosporidium parvum
RMELEPERFQSLMIVQSLNDKIVPTR

SEQ ID NO: 2302972 - protein, 24 aa, Cryptosporidium parvum
RMGDKGTGIIFLRPTEEGYLEILK

SEQ ID NO: 2302973 - protein, 27 aa, Cryptosporidium parvum
RMMFSNGRARSGIIVLPCGAGKTLTGI

SEQ ID NO: 2302974 - protein, 19 aa, Cryptosporidium parvum
RMPTLSAVRRKGYPPQSLW

SEQ ID NO: 2302975 - protein, 21 aa, Cryptosporidium parvum
RMQFPGSVGFICYSHNGNYVA

SEQ ID NO: 2302976 - protein, 20 aa, Cryptosporidium parvum
RMSESIFWQSYFNAIRNIII

SEQ ID NO: 2302977 - protein, 18 aa, Cryptosporidium parvum
RMSPPCRVFLSDNFKSSK

SEQ ID NO: 2302978 - protein, 18 aa, Cryptosporidium parvum
RMVIKWMGIICTSNEDKS

SEQ ID NO: 2302979 - protein, 25 aa, Cryptosporidium parvum
RMYINDRCLWYEKPLLESGTLGTKA

SEQ ID NO: 2302980 - protein, 37 aa, Cryptosporidium parvum
RMYLQRRYFIRLSGSVLKAQILWRGKLARRQFQKLKE

SEQ ID NO: 2302981 - protein, 22 aa, Cryptosporidium parvum
RNAMKVRFSRAYQANFYFSNKR

SEQ ID NO: 2302982 - protein, 18 aa, Cryptosporidium parvum
RNAPGQMGTKSFGGSRMG

SEQ ID NO: 2302983 - protein, 19 aa, Cryptosporidium parvum
RNCVALGLDVDFDFPEMQA

SEQ ID NO: 2302984 - protein, 19 aa, Cryptosporidium parvum
RNCVRRSFMNYDTFKYYQD

SEQ ID NO: 2302985 - protein, 24 aa, Cryptosporidium parvum
RNDKRVSIAYCNSSGSGLEEIHGF

SEQ ID NO: 2302986 - protein, 24 aa, Cryptosporidium parvum
RNDLFNLLCDAIGLSHDERSNLFI

SEQ ID NO: 2302987 - protein, 22 aa, Cryptosporidium parvum
RNEEFIRIGYYVHNVYTDPLLE

SEQ ID NO: 2302988 - protein, 22 aa, Cryptosporidium parvum
RNELRYRLVHGEDRIEIPDSAD

SEQ ID NO: 2302989 - protein, 17 aa, Cryptosporidium parvum
RNELSYKTILARVREYI

SEQ ID NO: 2302990 - protein, 22 aa, Cryptosporidium parvum
RNEMAWDKFIINWIKKIEIEIG

SEQ ID NO: 2302991 - protein, 25 aa, Cryptosporidium parvum
RNEPFGIVVLEGWTAGKPVVATTSG

SEQ ID NO: 2302992 - protein, 25 aa, Cryptosporidium parvum
RNFGSKELDRDGGHRGRGWSGNLSH

SEQ ID NO: 2302993 - protein, 19 aa, Cryptosporidium parvum
RNFLQRFVRSLFLQTGYGS

SEQ ID NO: 2302994 - protein, 20 aa, Cryptosporidium parvum
RNFPDIDIFCFFGCSEYFLS

SEQ ID NO: 2302995 - protein, 21 aa, Cryptosporidium parvum
RNFRLPVYFVPSSSDYFYVSE

SEQ ID NO: 2302996 - protein, 19 aa, Cryptosporidium parvum
RNFSLPSWVQLRNIRDSKG

SEQ ID NO: 2302997 - protein, 20 aa, Cryptosporidium parvum
RNFTQYEYWALSLESFTSLK

SEQ ID NO: 2302998 - protein, 23 aa, Cryptosporidium parvum
RNFWLCDDCKVCSKCHKLINFPV

SEQ ID NO: 2302999 - protein, 17 aa, Cryptosporidium parvum
RNGHINHRFSNRPRFVS

SEQ ID NO: 2303000 - protein, 20 aa, Cryptosporidium parvum
RNGIRLVRLKVGSFSRDNFE

SEQ ID NO: 2303001 - protein, 24 aa, Cryptosporidium parvum
RNGSLRTSYLYVIGVMNYGSSWSN

SEQ ID NO: 2303002 - protein, 22 aa, Cryptosporidium parvum
RNGYIKGGLRYCRSKRRSISSS

SEQ ID NO: 2303003 - protein, 29 aa, Cryptosporidium parvum
RNINSPKKCKLVFKRLINKVNIVRETSSK

SEQ ID NO: 2303004 - protein, 17 aa, Cryptosporidium parvum
RNIPIQIGQLLAKKSTS

SEQ ID NO: 2303005 - protein, 18 aa, Cryptosporidium parvum
RNIQVCYDMLKGSNNVTE

SEQ ID NO: 2303006 - protein, 18 aa, Cryptosporidium parvum
RNISVFAGCCSNDWTHVC

SEQ ID NO: 2303007 - protein, 20 aa, Cryptosporidium parvum
RNITGILGFIQKTWKESDES

SEQ ID NO: 2303008 - protein, 17 aa, Cryptosporidium parvum
RNIYVIDFGLAKRFRDP

SEQ ID NO: 2303009 - protein, 25 aa, Cryptosporidium parvum
RNKGMCGTSIQWGPWIEQGMAANLK

SEQ ID NO: 2303010 - protein, 25 aa, Cryptosporidium parvum
RNKGMCGTSIQWGPWIEQGMAMNIK

SEQ ID NO: 2303011 - protein, 23 aa, Cryptosporidium parvum
RNKSGKIGKRWFKDGVLNGAEEE

SEQ ID NO: 2303012 - protein, 26 aa, Cryptosporidium parvum
RNKVHNCLWSYVAKCTVFQPHDIEKI

SEQ ID NO: 2303013 - protein, 20 aa, Cryptosporidium parvum
RNKVMNWDKHFYLPSEHHKY

SEQ ID NO: 2303014 - protein, 18 aa, Cryptosporidium parvum
RNLEKKLLKKTGITTNGK

SEQ ID NO: 2303015 - protein, 23 aa, Cryptosporidium parvum
RNLELISYFSCCKLQPLHTSLVL

SEQ ID NO: 2303016 - protein, 27 aa, Cryptosporidium parvum
RNLHLKLLGFLGKRFPPHVTLERNLTK

SEQ ID NO: 2303017 - protein, 17 aa, Cryptosporidium parvum
RNLQTLYLERNPIQNQL

SEQ ID NO: 2303018 - protein, 20 aa, Cryptosporidium parvum
RNLRRLKKVVLEDEEDEDDE

SEQ ID NO: 2303019 - protein, 19 aa, Cryptosporidium parvum
RNMCINPRVSVHADRDKID

SEQ ID NO: 2303020 - protein, 19 aa, Cryptosporidium parvum
RNMEDWDIINSDKFLNDAN

SEQ ID NO: 2303021 - protein, 18 aa, Cryptosporidium parvum
RNNDCFINGFQDVYMPNK

SEQ ID NO: 2303022 - protein, 24 aa, Cryptosporidium parvum
RNNIKLYVRRVFIMDDCEELIPEF

SEQ ID NO: 2303023 - protein, 25 aa, Cryptosporidium parvum
RNNLVKVKVSIEWNMNDDIMDNPPI

SEQ ID NO: 2303024 - protein, 24 aa, Cryptosporidium parvum
RNNSAWCYRHFIFTNLKKMNALKE

SEQ ID NO: 2303025 - protein, 17 aa, Cryptosporidium parvum
RNPQLGLNNVFSASPVK

SEQ ID NO: 2303026 - protein, 24 aa, Cryptosporidium parvum
RNRAFLCKNVGLGGKRSGSNAPIP

SEQ ID NO: 2303027 - protein, 25 aa, Cryptosporidium parvum
RNRDLKYPLPRCVLKPRLGGNLKQN

SEQ ID NO: 2303028 - protein, 18 aa, Cryptosporidium parvum
RNREFKPKISFIKHLASY

SEQ ID NO: 2303029 - protein, 20 aa, Cryptosporidium parvum
RNRLAKKVCINKESQQNETR

SEQ ID NO: 2303030 - protein, 17 aa, Cryptosporidium parvum
RNRMIGIEFETSYPHRC

SEQ ID NO: 2303031 - protein, 20 aa, Cryptosporidium parvum
RNSDYLYIWDVRKPNNILFK

SEQ ID NO: 2303032 - protein, 20 aa, Cryptosporidium parvum
RNSIRFCDQIIFFLKKNWGI

SEQ ID NO: 2303033 - protein, 20 aa, Cryptosporidium parvum
RNSLAIAIHEYFQKNGFMYI

SEQ ID NO: 2303034 - protein, 20 aa, Cryptosporidium parvum
RNSLCPIIKPLINKPYLYSQ

SEQ ID NO: 2303035 - protein, 25 aa, Cryptosporidium parvum
RNSNIRKGYAVNFIAVGPESEIQQC

SEQ ID NO: 2303036 - protein, 17 aa, Cryptosporidium parvum
RNSPYLRAPRMYSISDL

SEQ ID NO: 2303037 - protein, 17 aa, Cryptosporidium parvum
RNSRWRGASEDNFNTIK

SEQ ID NO: 2303038 - protein, 20 aa, Cryptosporidium parvum
RNTKKIPIDRSKFHPSISNL

SEQ ID NO: 2303039 - protein, 22 aa, Cryptosporidium parvum
RNTLHPRSDLVMMSTLTESNSK

SEQ ID NO: 2303040 - protein, 17 aa, Cryptosporidium parvum
RNTNEWGGEVELVALSN

SEQ ID NO: 2303041 - protein, 28 aa, Cryptosporidium parvum
RNVNELNIEYDFCKMVSKKSKLDDSDSK

SEQ ID NO: 2303042 - protein, 19 aa, Cryptosporidium parvum
RNWGEYCGSLVPINSNDDR

SEQ ID NO: 2303043 - protein, 24 aa, Cryptosporidium parvum
RNYGERFLDVVLPGVCSRIACLIP

SEQ ID NO: 2303044 - protein, 26 aa, Cryptosporidium parvum
RNYHIFYCLAAGVSKGIFPESISEEL

SEQ ID NO: 2303045 - protein, 18 aa, Cryptosporidium parvum
RNYSCDDIFRKGECFSNS

SEQ ID NO: 2303046 - protein, 22 aa, Cryptosporidium parvum
RPAEPKVVFVIRLKGINKLSPK

SEQ ID NO: 2303047 - protein, 18 aa, Cryptosporidium parvum
RPALGIKARNGVVIATEK

SEQ ID NO: 2303048 - protein, 25 aa, Cryptosporidium parvum
RPCEACSSLKGVVLYPLTENVGIEE

SEQ ID NO: 2303049 - protein, 18 aa, Cryptosporidium parvum
RPDFLVPQPSRIPIESVY

SEQ ID NO: 2303050 - protein, 20 aa, Cryptosporidium parvum
RPDLHDALCFSTLCDEKKSR

SEQ ID NO: 2303051 - protein, 19 aa, Cryptosporidium parvum
RPDLHVGLHSAPRGILLFG

SEQ ID NO: 2303052 - protein, 19 aa, Cryptosporidium parvum
RPDLLLTLIKLHEHLRDVL

SEQ ID NO: 2303053 - protein, 19 aa, Cryptosporidium parvum
RPDSPVLSIAWRTDSEHIL

SEQ ID NO: 2303054 - protein, 24 aa, Cryptosporidium parvum
RPEHILKKSLDFVYNNYIKYSSSK

SEQ ID NO: 2303055 - protein, 17 aa, Cryptosporidium parvum
RPEMKLIDMCNILESKV

SEQ ID NO: 2303056 - protein, 26 aa, Cryptosporidium parvum
RPFFQRLTDSIYRRLIIGSSNQIKLV

SEQ ID NO: 2303057 - protein, 19 aa, Cryptosporidium parvum
RPFPQLKFKRKVENIEDFK

SEQ ID NO: 2303058 - protein, 21 aa, Cryptosporidium parvum
RPGFICLKPEPSSISSISKEM

SEQ ID NO: 2303059 - protein, 21 aa, Cryptosporidium parvum
RPGFTRISLHWSDNLETVDYI

SEQ ID NO: 2303060 - protein, 17 aa, Cryptosporidium parvum
RPGKPSNRFSVPTVDIS

SEQ ID NO: 2303061 - protein, 24 aa, Cryptosporidium parvum
RPGMLKIDSFVKMIIKNPTIPREN

SEQ ID NO: 2303062 - protein, 17 aa, Cryptosporidium parvum
RPIDGIILTKFDTVDDK

SEQ ID NO: 2303063 - protein, 18 aa, Cryptosporidium parvum
RPILKRYQSIVLTSGTLS

SEQ ID NO: 2303064 - protein, 21 aa, Cryptosporidium parvum
RPIPDCFSDFLKEGAIIERSE

SEQ ID NO: 2303065 - protein, 17 aa, Cryptosporidium parvum
RPIRLLYYNDLHYDSLF

SEQ ID NO: 2303066 - protein, 18 aa, Cryptosporidium parvum
RPIYVGKFQKKAERFSEK

SEQ ID NO: 2303067 - protein, 23 aa, Cryptosporidium parvum
RPKYMNCCVCGVATEINPSRMCI

SEQ ID NO: 2303068 - protein, 17 aa, Cryptosporidium parvum
RPLEKLANTSFFDKLAL

SEQ ID NO: 2303069 - protein, 17 aa, Cryptosporidium parvum
RPLGIGIQGLADCFMML

SEQ ID NO: 2303070 - protein, 24 aa, Cryptosporidium parvum
RPLPPIPFTICDWPLPIQSNERGE

SEQ ID NO: 2303071 - protein, 26 aa, Cryptosporidium parvum
RPLPQLGSYFTPRPWKGGDNSSNGPK

SEQ ID NO: 2303072 - protein, 29 aa, Cryptosporidium parvum
RPLTENIFTPGFKCSCFAYGQTGSGKTYT

SEQ ID NO: 2303073 - protein, 19 aa, Cryptosporidium parvum
RPLYNELKNSLKIEKSENY

SEQ ID NO: 2303074 - protein, 26 aa, Cryptosporidium parvum
RPMGRRFSVKVVDYIVERFGTERTLP

SEQ ID NO: 2303075 - protein, 25 aa, Cryptosporidium parvum
RPNDLKEIILSFANKPGCNLKIRET

SEQ ID NO: 2303076 - protein, 19 aa, Cryptosporidium parvum
RPNFSREVVGPPGANIFIF

SEQ ID NO: 2303077 - protein, 19 aa, Cryptosporidium parvum
RPNIGRFSVNPGNLNVNGT

SEQ ID NO: 2303078 - protein, 18 aa, Cryptosporidium parvum
RPNYSFYDGPPFATGLPH

SEQ ID NO: 2303079 - protein, 17 aa, Cryptosporidium parvum
RPPEAYETGSLYDPTKV

SEQ ID NO: 2303080 - protein, 18 aa, Cryptosporidium parvum
RPPLPYVPYPNRRPHKPY

SEQ ID NO: 2303081 - protein, 24 aa, Cryptosporidium parvum
RPPPNRSPAIPFSRLTDAELKESA

SEQ ID NO: 2303082 - protein, 24 aa, Cryptosporidium parvum
RPQLRVLKISLKKSLFNEVSKLVL

SEQ ID NO: 2303083 - protein, 18 aa, Cryptosporidium parvum
RPRGFGFVTFESVDAVNN

SEQ ID NO: 2303084 - protein, 17 aa, Cryptosporidium parvum
RPRGRPKREQVCVTKNE

SEQ ID NO: 2303085 - protein, 17 aa, Cryptosporidium parvum
RPSIKYQSSVRRKNNSR

SEQ ID NO: 2303086 - protein, 20 aa, Cryptosporidium parvum
RPSSRILHRNEFGNMSIEGR

SEQ ID NO: 2303087 - protein, 18 aa, Cryptosporidium parvum
RPSVIFNNSVSFLKSNYK

SEQ ID NO: 2303088 - protein, 25 aa, Cryptosporidium parvum
RPTVFPGDLKLQIENQGIRNDIDFQ

SEQ ID NO: 2303089 - protein, 20 aa, Cryptosporidium parvum
RPTYLRWVALYYDILSKMFL

SEQ ID NO: 2303090 - protein, 17 aa, Cryptosporidium parvum
RPVFSSDSQYVIHGLQD

SEQ ID NO: 2303091 - protein, 19 aa, Cryptosporidium parvum
RPVRPIIQFPIDKVVDLEF

SEQ ID NO: 2303092 - protein, 18 aa, Cryptosporidium parvum
RPWNVHWEILAQKEGKTG

SEQ ID NO: 2303093 - protein, 24 aa, Cryptosporidium parvum
RPWSAGYRLVEWLIHSVNLGRNVA

SEQ ID NO: 2303094 - protein, 20 aa, Cryptosporidium parvum
RQARSSIGLTTPRPITRRPD

SEQ ID NO: 2303095 - protein, 22 aa, Cryptosporidium parvum
RQEWLIPFWPLLMAVGSIYDSN

SEQ ID NO: 2303096 - protein, 25 aa, Cryptosporidium parvum
RQFGHALILICILIKKYSNIIRLKY

SEQ ID NO: 2303097 - protein, 22 aa, Cryptosporidium parvum
RQFKGETELFFAQKMDLGGSVP

SEQ ID NO: 2303098 - protein, 17 aa, Cryptosporidium parvum
RQFQGLMSIIGTLVGRI

SEQ ID NO: 2303099 - protein, 20 aa, Cryptosporidium parvum
RQGVTFIFECLMGLRDFDGN

SEQ ID NO: 2303100 - protein, 21 aa, Cryptosporidium parvum
RQIEFARLNMTYLVLSKRKLL

SEQ ID NO: 2303101 - protein, 27 aa, Cryptosporidium parvum
RQIFETICLINLTFLQICDSHLHTNIT

SEQ ID NO: 2303102 - protein, 18 aa, Cryptosporidium parvum
RQIGTLGLEAMGKLIKLR

SEQ ID NO: 2303103 - protein, 30 aa, Cryptosporidium parvum; identical to SEQ ID NO: 2180627

SEQ ID NO: 2303104 - protein, 22 aa, Cryptosporidium parvum
RQISAFGLSFMRLDIRQEASKH

SEQ ID NO: 2303105 - protein, 25 aa, Cryptosporidium parvum
RQIWYNRLMWVLKHEIIISLLSLSQ

SEQ ID NO: 2303106 - protein, 18 aa, Cryptosporidium parvum
RQKGDFSALHIIILDELD

SEQ ID NO: 2303107 - protein, 24 aa, Cryptosporidium parvum
RQKLERFGLRFISKVRDFVDSKST

SEQ ID NO: 2303108 - protein, 19 aa, Cryptosporidium parvum
RQKLYGIHMRKVCDLDQIA

SEQ ID NO: 2303109 - protein, 25 aa, Cryptosporidium parvum
RQLFKTEIKSECGIVARSSTNSNII

SEQ ID NO: 2303110 - protein, 19 aa, Cryptosporidium parvum
RQLLQRILFTWTRENPDLG

SEQ ID NO: 2303111 - protein, 40 aa, Cryptosporidium parvum
RQLNEGVQCLNRFIQQLIKSCNIMRDHMLRKQNNSVGYSG

SEQ ID NO: 2303112 - protein, 25 aa, Cryptosporidium parvum
RQLQMKEWALAAAYLTQQQQQQQQQ

SEQ ID NO: 2303113 - protein, 25 aa, Cryptosporidium parvum
RQMYLFLNHRVRLVYLHYILSNVHF

SEQ ID NO: 2303114 - protein, 23 aa, Cryptosporidium parvum
RQNPKPCLVMWEPIIDCPSDLSS

SEQ ID NO: 2303115 - protein, 24 aa, Cryptosporidium parvum
RQNPSAGRMGKRFTSLEGSNTLIL

SEQ ID NO: 2303116 - protein, 20 aa, Cryptosporidium parvum
RQNTGVLGYLAPYIDESFNI

SEQ ID NO: 2303117 - protein, 18 aa, Cryptosporidium parvum
RQNTRAGSLMDFSTGNNL

SEQ ID NO: 2303118 - protein, 20 aa, Cryptosporidium parvum
RQPLRKMDCIYFVTNEKRNL

SEQ ID NO: 2303119 - protein, 18 aa, Cryptosporidium parvum
RQRDEKKLLLAELDTCIF

SEQ ID NO: 2303120 - protein, 26 aa, Cryptosporidium parvum
RQRLGSSKLHWEWKANSLNPYFEGNN

SEQ ID NO: 2303121 - protein, 34 aa, Cryptosporidium parvum; identical to SEQ ID NO: 2180646

SEQ ID NO: 2303122 - protein, 19 aa, Cryptosporidium parvum
RQTVMFSATFPREIQQLAK

SEQ ID NO: 2303123 - protein, 17 aa, Cryptosporidium parvum
RQVEYIDSRICELRGEK

SEQ ID NO: 2303124 - protein, 19 aa, Cryptosporidium parvum
RQVLQLTLCCLSYDFMGTV

SEQ ID NO: 2303125 - protein, 17 aa, Cryptosporidium parvum
RQVPIPRVGVMGKPPGL

SEQ ID NO: 2303126 - protein, 24 aa, Cryptosporidium parvum
RQVYILGWLIHLRILNRIVDNIFI

SEQ ID NO: 2303127 - protein, 24 aa, Cryptosporidium parvum
RQYFKMLCSNSIIFNMFATSINLQ

SEQ ID NO: 2303128 - protein, 22 aa, Cryptosporidium parvum
RQYIDMFGCNIVVYFPKKCIEY

SEQ ID NO: 2303129 - protein, 26 aa, Cryptosporidium parvum
RQYRAPEVILDLGWDMSSDMWGFGCI

SEQ ID NO: 2303130 - protein, 21 aa, Cryptosporidium parvum
RRADLALDRMKSEKSQGKQTE

SEQ ID NO: 2303131 - protein, 28 aa, Cryptosporidium parvum
RRAKRYALEICQWLDGILKDESVDESIE

SEQ ID NO: 2303132 - protein, 26 aa, Cryptosporidium parvum
RRALLRELRTVISFDGSYVNYRHLAL

SEQ ID NO: 2303133 - protein, 21 aa, Cryptosporidium parvum
RRARACPGFEKNLLVYTPSPA

SEQ ID NO: 2303134 - protein, 17 aa, Cryptosporidium parvum
RRCMKEYEQQFGEIFLT

SEQ ID NO: 2303135 - protein, 33 aa, Cryptosporidium parvum; identical to SEQ ID NO: 2180657

SEQ ID NO: 2303136 - protein, 35 aa, Cryptosporidium parvum
RRDFLIKKILPWEIELEVVPWSLLFGDSLSNKLFQ

SEQ ID NO: 2303137 - protein, 21 aa, Cryptosporidium parvum
RRDLKLGTLLFGVIDHVSEKE

SEQ ID NO: 2303138 - protein, 24 aa, Cryptosporidium parvum
RRDQLKALVLRYAKENGKDTFNEV

SEQ ID NO: 2303139 - protein, 21 aa, Cryptosporidium parvum
RRDSVVKWIGRLSMNSSSEEK

SEQ ID NO: 2303140 - protein, 18 aa, Cryptosporidium parvum
RRDVNLYWDPRIQESSRE

SEQ ID NO: 2303141 - protein, 24 aa, Cryptosporidium parvum
RREGLKTILTFLSKRGYPNQINPK

SEQ ID NO: 2303142 - protein, 17 aa, Cryptosporidium parvum
RREKIEQTREDWRKTYT

SEQ ID NO: 2303143 - protein, 17 aa, Cryptosporidium parvum
RRGGSPGRHHTMDGTGM

SEQ ID NO: 2303144 - protein, 17 aa, Cryptosporidium parvum
RRGHLSSIIKTQFYNAL

SEQ ID NO: 2303145 - protein, 25 aa, Cryptosporidium parvum
RRGRGGRIWFDRHLLFQDNFEPYFT

SEQ ID NO: 2303146 - protein, 25 aa, Cryptosporidium parvum
RRGVRKVSCIGAWHPARVQFQVPRA

SEQ ID NO: 2303147 - protein, 18 aa, Cryptosporidium parvum
RRGYPGYMYTDLSTIYER

SEQ ID NO: 2303148 - protein, 30 aa, Cryptosporidium parvum
RRHKGKQQDGSNCSISEIIKKIKEILNVEH

SEQ ID NO: 2303149 - protein, 25 aa, Cryptosporidium parvum
RRHYERCGLSFYAIKSRGEAWDSSV

SEQ ID NO: 2303150 - protein, 18 aa, Cryptosporidium parvum
RRIAAISLAEYVAKLLKT

SEQ ID NO: 2303151 - protein, 25 aa, Cryptosporidium parvum
RRIAGFFIICSRLGAAINSHKIFNQ

SEQ ID NO: 2303152 - protein, 20 aa, Cryptosporidium parvum
RRIEVIKAKLKVLQSHSKPK

SEQ ID NO: 2303153 - protein, 17 aa, Cryptosporidium parvum
RRIFARLALNRTEIANI

SEQ ID NO: 2303154 - protein, 19 aa, Cryptosporidium parvum
RRIKASYSQRVEIKNVIEQ

SEQ ID NO: 2303155 - protein, 20 aa, Cryptosporidium parvum
RRILRCDKNNLSINRDKVNK

SEQ ID NO: 2303156 - protein, 21 aa, Cryptosporidium parvum
RRINDDLAFIYQQRINKFDTK

SEQ ID NO: 2303157 - protein, 23 aa, Cryptosporidium parvum
RRIPGNGEIHTWTGIRRYGSSSF

SEQ ID NO: 2303158 - protein, 18 aa, Cryptosporidium parvum
RRIRKILEDDAASDLNSD

SEQ ID NO: 2303159 - protein, 20 aa, Cryptosporidium parvum
RRIRWVGCGSDHSMAITADG

SEQ ID NO: 2303160 - protein, 18 aa, Cryptosporidium parvum
RRISTRNSIHSSSDNKID

SEQ ID NO: 2303161 - protein, 21 aa, Cryptosporidium parvum
RRITDAMILRPNLDDNQEKDN

SEQ ID NO: 2303162 - protein, 20 aa, Cryptosporidium parvum
RRITHGFSARVYGFEDAKQM

SEQ ID NO: 2303163 - protein, 19 aa, Cryptosporidium parvum
RRKGAGLGSLIAAEVNSRR

SEQ ID NO: 2303164 - protein, 28 aa, Cryptosporidium parvum
RRKHSRICLFCKGFKRPIQHISKDTLYL

SEQ ID NO: 2303165 - protein, 23 aa, Cryptosporidium parvum
RRKLFTVKGGGCFVLVSDVIDKK

SEQ ID NO: 2303166 - protein, 24 aa, Cryptosporidium parvum
RRKRWKISLYLSYAKWESLQNNIK

SEQ ID NO: 2303167 - protein, 19 aa, Cryptosporidium parvum
RRLAFETQLSRSWQSNMHT

SEQ ID NO: 2303168 - protein, 24 aa, Cryptosporidium parvum
RRLKKEVLDKVLLRRTKVQRQEDV

SEQ ID NO: 2303169 - protein, 21 aa, Cryptosporidium parvum
RRLNKSDILFDNQLRDSYSYK

SEQ ID NO: 2303170 - protein, 19 aa, Cryptosporidium parvum
RRLPSNISVGGYDITARSE

SEQ ID NO: 2303171 - protein, 17 aa, Cryptosporidium parvum
RRLWCKRCNTHFIPGIT

SEQ ID NO: 2303172 - protein, 22 aa, Cryptosporidium parvum
RRMIEHCLKESGAKFKVKNYYC

SEQ ID NO: 2303173 - protein, 30 aa, Cryptosporidium parvum; identical to SEQ ID NO: 2180697

SEQ ID NO: 2303174 - protein, 18 aa, Cryptosporidium parvum
RRNGEFTVNIGLCENGKP

SEQ ID NO: 2303175 - protein, 31 aa, Cryptosporidium parvum
RRNLVLKRIEVFSLKLKRGGFSTVNKTNNDV

SEQ ID NO: 2303176 - protein, 18 aa, Cryptosporidium parvum
RRPCPLCLEDLFYSIKTV

SEQ ID NO: 2303177 - protein, 21 aa, Cryptosporidium parvum
RRPFKCILDVGLTRTTSGNRV

SEQ ID NO: 2303178 - protein, 17 aa, Cryptosporidium parvum
RRPGTVGNDRNFYIVDF

SEQ ID NO: 2303179 - protein, 20 aa, Cryptosporidium parvum
RRPIYTIPRSVIVDRNKRMY

SEQ ID NO: 2303180 - protein, 21 aa, Cryptosporidium parvum
RRPQMKHKEKEGAEHDKAKNA

SEQ ID NO: 2303181 - protein, 19 aa, Cryptosporidium parvum
RRPTFPFVSILATSHLCKG

SEQ ID NO: 2303182 - protein, 23 aa, Cryptosporidium parvum
RRPVLSCFACGRTSGIVVDIGAS

SEQ ID NO: 2303183 - protein, 23 aa, Cryptosporidium parvum
RRQLYKTKMCAFYNVGKCTRGNL

SEQ ID NO: 2303184 - protein, 29 aa, Cryptosporidium parvum
RRQSYSIPILRERCLSPMKYVDYYIETLP

SEQ ID NO: 2303185 - protein, 21 aa, Cryptosporidium parvum
RRQYVKLRFSAQVVQCRAYTC

SEQ ID NO: 2303186 - protein, 18 aa, Cryptosporidium parvum
RRRAEGIVASSKWNESPN

SEQ ID NO: 2303187 - protein, 18 aa, Cryptosporidium parvum
RRRIKIRNSHIFNNSDEL

SEQ ID NO: 2303188 - protein, 19 aa, Cryptosporidium parvum
RRRKHELQDILKLPSQAEH

SEQ ID NO: 2303189 - protein, 18 aa, Cryptosporidium parvum
RRRTFCGTYDYLPPEITR

SEQ ID NO: 2303190 - protein, 21 aa, Cryptosporidium parvum
RRRVCAVGPLVVYAEDNGIVK

SEQ ID NO: 2303191 - protein, 20 aa, Cryptosporidium parvum
RRSNDWRVKLLNKRCSLQAT

SEQ ID NO: 2303192 - protein, 17 aa, Cryptosporidium parvum
RRSSWRIISSVEQKEHS

SEQ ID NO: 2303193 - protein, 19 aa, Cryptosporidium parvum
RRSYDISLLKEWYKYNNIS

SEQ ID NO: 2303194 - protein, 27 aa, Cryptosporidium parvum
RRTSVSGKYKWAWTIGDYRLVSDMIWQ

SEQ ID NO: 2303195 - protein, 19 aa, Cryptosporidium parvum
RRVALIESFSDRNTRKNAK

SEQ ID NO: 2303196 - protein, 27 aa, Cryptosporidium parvum
RRWISKRLAPHYIPKSSLDFLPLDILE

SEQ ID NO: 2303197 - protein, 30 aa, Cryptosporidium parvum; identical to SEQ ID NO: 2180718

SEQ ID NO: 2303198 - protein, 18 aa, Cryptosporidium parvum
RRYCCRRMILTHADLIEK

SEQ ID NO: 2303199 - protein, 22 aa, Cryptosporidium parvum
RRYIPPPVYRCLSSGYNVFLNE

SEQ ID NO: 2303200 - protein, 17 aa, Cryptosporidium parvum
RRYSMVGNDELLIDTPV

SEQ ID NO: 2303201 - protein, 19 aa, Cryptosporidium parvum
RRYVPCLYVHNKIDNLKLS

SEQ ID NO: 2303202 - protein, 17 aa, Cryptosporidium parvum
RSACFQAGRAGFVSNEE

SEQ ID NO: 2303203 - protein, 20 aa, Cryptosporidium parvum
RSAPTLFRHHFSFKDIGIGG

SEQ ID NO: 2303204 - protein, 22 aa, Cryptosporidium parvum
RSARFHTVPMAFLEKNKVDQRN

SEQ ID NO: 2303205 - protein, 27 aa, Cryptosporidium parvum
RSDFKSGWKLDKEWEIEQKKKRLKIES

SEQ ID NO: 2303206 - protein, 19 aa, Cryptosporidium parvum
RSDKSGWSKTLLNGEDLIC

SEQ ID NO: 2303207 - protein, 21 aa, Cryptosporidium parvum
RSDVDPSFFIEFLDARVGMPK

SEQ ID NO: 2303208 - protein, 19 aa, Cryptosporidium parvum
RSDYLKWNSINEEIEFIER

SEQ ID NO: 2303209 - protein, 23 aa, Cryptosporidium parvum
RSEFYIDCISPYLSKGVGSIRSN

SEQ ID NO: 2303210 - protein, 17 aa, Cryptosporidium parvum
RSERVYGEILIRRLSTL

SEQ ID NO: 2303211 - protein, 17 aa, Cryptosporidium parvum
RSESIKIVLGYFDSDYY

SEQ ID NO: 2303212 - protein, 17 aa, Cryptosporidium parvum
RSESVFDASYSLNNEYR

SEQ ID NO: 2303213 - protein, 19 aa, Cryptosporidium parvum
RSFDPESYRNFILNISNSR

SEQ ID NO: 2303214 - protein, 19 aa, Cryptosporidium parvum
RSFEFKKEISPFEKLLSYT

SEQ ID NO: 2303215 - protein, 17 aa, Cryptosporidium parvum
RSFKPYVPHMSTLLGSG

SEQ ID NO: 2303216 - protein, 19 aa, Cryptosporidium parvum
RSGEIPYETSIVLDVVNRE

SEQ ID NO: 2303217 - protein, 19 aa, Cryptosporidium parvum
RSGISMPIKVPSSIENIMS

SEQ ID NO: 2303218 - protein, 22 aa, Cryptosporidium parvum
RSGQDLVKFVFEFENMDLHILS

SEQ ID NO: 2303219 - protein, 24 aa, Cryptosporidium parvum
RSGSGGTCNNCFVCNSSRVNNRNV

SEQ ID NO: 2303220 - protein, 25 aa, Cryptosporidium parvum
RSHNLEFKTSFPYVSNGGVMQVVSN

SEQ ID NO: 2303221 - protein, 19 aa, Cryptosporidium parvum
RSIFCMGIKEYSLFFQPYK

SEQ ID NO: 2303222 - protein, 26 aa, Cryptosporidium parvum
RSIGTGLKRRKCWEMLVDELVKLKNN

SEQ ID NO: 2303223 - protein, 24 aa, Cryptosporidium parvum
RSIIEIHDPLTLYIKNIINYSDKT

SEQ ID NO: 2303224 - protein, 26 aa, Cryptosporidium parvum
RSIISKECAHIRALFKEDENQYRQRN

SEQ ID NO: 2303225 - protein, 17 aa, Cryptosporidium parvum
RSILPLHRSNILEPEVS

SEQ ID NO: 2303226 - protein, 17 aa, Cryptosporidium parvum
RSIPTKMPMHLFSGKRG

SEQ ID NO: 2303227 - protein, 19 aa, Cryptosporidium parvum
RSIPVSIKLPSDINNDGSE

SEQ ID NO: 2303228 - protein, 27 aa, Cryptosporidium parvum
RSITFLYKFISGICPKSYGMNVAQLAG

SEQ ID NO: 2303229 - protein, 17 aa, Cryptosporidium parvum
RSIVECNRRGRSPSLSY

SEQ ID NO: 2303230 - protein, 20 aa, Cryptosporidium parvum
RSIWTEMVLALKNVHDLRIV

SEQ ID NO: 2303231 - protein, 17 aa, Cryptosporidium parvum
RSKGIVLNMNIKMYLNR

SEQ ID NO: 2303232 - protein, 22 aa, Cryptosporidium parvum
RSKHSILEACDYIGQLKKYDFF

SEQ ID NO: 2303233 - protein, 24 aa, Cryptosporidium parvum
RSKIKRRLIVEWAKELCLGGYCKI

SEQ ID NO: 2303234 - protein, 37 aa, Cryptosporidium parvum
RSKPFSLGFTVLIGQCICSFLQEFKKKASLIDKQEDK

SEQ ID NO: 2303235 - protein, 17 aa, Cryptosporidium parvum
RSKVCILHGKTAAEMVK

SEQ ID NO: 2303236 - protein, 20 aa, Cryptosporidium parvum
RSKVGSSFVRRFDKTNSCKH

SEQ ID NO: 2303237 - protein, 25 aa, Cryptosporidium parvum
RSKVSRIGFAWVRSIIGTFFNDTFI

SEQ ID NO: 2303238 - protein, 18 aa, Cryptosporidium parvum
RSLCRAENSVCRVDNTRI

SEQ ID NO: 2303239 - protein, 20 aa, Cryptosporidium parvum
RSLNPLLLFSGDVFNPSIMS

SEQ ID NO: 2303240 - protein, 22 aa, Cryptosporidium parvum
RSLPKDCFKNLSLECPKIDYSF

SEQ ID NO: 2303241 - protein, 19 aa, Cryptosporidium parvum
RSLPVYKVRDSLIKLIGEH

SEQ ID NO: 2303242 - protein, 19 aa, Cryptosporidium parvum
RSLRTKFPWAMYTRSDFSF

SEQ ID NO: 2303243 - protein, 19 aa, Cryptosporidium parvum
RSMFPRFYFIGDEDLLEMI

SEQ ID NO: 2303244 - protein, 24 aa, Cryptosporidium parvum
RSNFIYKLKCVFLCHPSLSSTCTI

SEQ ID NO: 2303245 - protein, 21 aa, Cryptosporidium parvum
RSNGARGYCNRRVSSRMNNHH

SEQ ID NO: 2303246 - protein, 22 aa, Cryptosporidium parvum
RSNHKLLVLRKINLEKQIDNNY

SEQ ID NO: 2303247 - protein, 21 aa, Cryptosporidium parvum
RSNIDYARAFIGHDFKNGSKP

SEQ ID NO: 2303248 - protein, 26 aa, Cryptosporidium parvum
RSNILSYKMEGDWLIVPEFKEVVSRT

SEQ ID NO: 2303249 - protein, 19 aa, Cryptosporidium parvum
RSNIMLKCCETEFSFVSCW

SEQ ID NO: 2303250 - protein, 18 aa, Cryptosporidium parvum
RSNKFSGDGFIFGPTSTN

SEQ ID NO: 2303251 - protein, 22 aa, Cryptosporidium parvum
RSNLQKAISCNFYYNSKTKKVS

SEQ ID NO: 2303252 - protein, 18 aa, Cryptosporidium parvum
RSNSNCFLSINSCNHKLA

SEQ ID NO: 2303253 - protein, 17 aa, Cryptosporidium parvum
RSNTCYLVNKRIDMLPE

SEQ ID NO: 2303254 - protein, 20 aa, Cryptosporidium parvum
RSPAGFHLFTTCYWDQANDG

SEQ ID NO: 2303255 - protein, 27 aa, Cryptosporidium parvum
RSPSPRKDWAFDEAILYPLHPRTGLPK

SEQ ID NO: 2303256 - protein, 18 aa, Cryptosporidium parvum
RSQLRISILQQVLHATGD

SEQ ID NO: 2303257 - protein, 23 aa, Cryptosporidium parvum
RSQNSVLKRRELIISDEEENDED

SEQ ID NO: 2303258 - protein, 17 aa, Cryptosporidium parvum
RSQSCLQKIVFELLTSV

SEQ ID NO: 2303259 - protein, 25 aa, Cryptosporidium parvum
RSQTECIRLLVAFILNSLSMDELKC

SEQ ID NO: 2303260 - protein, 20 aa, Cryptosporidium parvum
RSRGICVFQGNIISIQIASM

SEQ ID NO: 2303261 - protein, 19 aa, Cryptosporidium parvum
RSRGRPRASDRPEVDEITS

SEQ ID NO: 2303262 - protein, 20 aa, Cryptosporidium parvum
RSRIKEVYKTGVAAYKEMCG

SEQ ID NO: 2303263 - protein, 27 aa, Cryptosporidium parvum
RSRILCLCQSFFKLGAPGILRKLLQII

SEQ ID NO: 2303264 - protein, 17 aa, Cryptosporidium parvum
RSRSFSPAGARVNGTLS

SEQ ID NO: 2303265 - protein, 18 aa, Cryptosporidium parvum
RSSADLKAGKSIKDALED

SEQ ID NO: 2303266 - protein, 19 aa, Cryptosporidium parvum
RSSEYEYKISHADNKGSIE

SEQ ID NO: 2303267 - protein, 18 aa, Cryptosporidium parvum
RSSFRSESRDSALNKKKI

SEQ ID NO: 2303268 - protein, 23 aa, Cryptosporidium parvum
RSSGLKLPFLRNDFVSINEVPTA

SEQ ID NO: 2303269 - protein, 20 aa, Cryptosporidium parvum
RSSIFNIPGIGIVNTDTIPE

SEQ ID NO: 2303270 - protein, 30 aa, Cryptosporidium parvum
RSSLIVSLISRVILEFCPGNDAPKLSEKMK

SEQ ID NO: 2303271 - protein, 20 aa, Cryptosporidium parvum
RSSLVPARIIPSLRTEYELP

SEQ ID NO: 2303272 - protein, 23 aa, Cryptosporidium parvum
RSSNDIYRRVDFLIKAFKKRDLN

SEQ ID NO: 2303273 - protein, 23 aa, Cryptosporidium parvum
RSSQPKSAFKRCIEDEMMITTIS

SEQ ID NO: 2303274 - protein, 29 aa, Cryptosporidium parvum
RSSRSHAILRIKIESHINSNDVCVGILNF

SEQ ID NO: 2303275 - protein, 17 aa, Cryptosporidium parvum
RSSSFNLLRTMIRKATE

SEQ ID NO: 2303276 - protein, 17 aa, Cryptosporidium parvum
RSSSGRSGRKLRNFLSS

SEQ ID NO: 2303277 - protein, 25 aa, Cryptosporidium parvum
RSSSIVIGYLMWKYNKSFNDASEYV

SEQ ID NO: 2303278 - protein, 22 aa, Cryptosporidium parvum
RSSSSGGCWIALGGSNGLITLI

SEQ ID NO: 2303279 - protein, 20 aa, Cryptosporidium parvum
RSSTQFLPRIKKINHEKNIK

SEQ ID NO: 2303280 - protein, 18 aa, Cryptosporidium parvum
RSSWEHISDLSGEELSIK

SEQ ID NO: 2303281 - protein, 25 aa, Cryptosporidium parvum
RSSWTREEIALFCLRSMNNNVKKAI

SEQ ID NO: 2303282 - protein, 20 aa, Cryptosporidium parvum
RSTFEWMKHYESMLWDTYED

SEQ ID NO: 2303283 - protein, 22 aa, Cryptosporidium parvum
RSTGIGVSLIFCKQFPQESVYL

SEQ ID NO: 2303284 - protein, 25 aa, Cryptosporidium parvum
RSTRLMISHLFIWRQRNSMFRVSKD

SEQ ID NO: 2303285 - protein, 27 aa, Cryptosporidium parvum
RSVELLKSLGICRNFRPSVLTKTMIHT

SEQ ID NO: 2303286 - protein, 20 aa, Cryptosporidium parvum
RSVLDFDYEKICSVTLREEH

SEQ ID NO: 2303287 - protein, 19 aa, Cryptosporidium parvum
RSVMKRAAIKGEKLTFIFE

SEQ ID NO: 2303288 - protein, 17 aa, Cryptosporidium parvum
RSVNSLKGYCLTPKQNV

SEQ ID NO: 2303289 - protein, 26 aa, Cryptosporidium parvum
RSYDPIYWWVDFVLPSVNPYISTYSD

SEQ ID NO: 2303290 - protein, 21 aa, Cryptosporidium parvum
RSYQFKVLRYEYSDNSWNPLL

SEQ ID NO: 2303291 - protein, 20 aa, Cryptosporidium parvum
RTDACFICVIGSELVQKYVG

SEQ ID NO: 2303292 - protein, 25 aa, Cryptosporidium parvum
RTDKIELLRAFLRLSKEDIILLYII

SEQ ID NO: 2303293 - protein, 23 aa, Cryptosporidium parvum
RTFDSFRCILDVISKDNNSKKFI

SEQ ID NO: 2303294 - protein, 17 aa, Cryptosporidium parvum
RTFGTKAGSGWDVESMF

SEQ ID NO: 2303295 - protein, 17 aa, Cryptosporidium parvum
RTFRSRKLPGIWHRILA

SEQ ID NO: 2303296 - protein, 18 aa, Cryptosporidium parvum
RTFSEFIYQFKYCDMSAA

SEQ ID NO: 2303297 - protein, 26 aa, Cryptosporidium parvum
RTGVNPPPIVSGIRINPHPTTPTPDM

SEQ ID NO: 2303298 - protein, 19 aa, Cryptosporidium parvum
RTIGISAMRGISWKNYISY

SEQ ID NO: 2303299 - protein, 19 aa, Cryptosporidium parvum
RTIGRVRIGKFILDTWYFS

SEQ ID NO: 2303300 - protein, 17 aa, Cryptosporidium parvum
RTIISKGHWNELIEVLK

SEQ ID NO: 2303301 - protein, 17 aa, Cryptosporidium parvum
RTIPIELFQELKKKSLE

SEQ ID NO: 2303302 - protein, 25 aa, Cryptosporidium parvum
RTIPKLKYYWVYMLTLDFPNLTFIL

SEQ ID NO: 2303303 - protein, 19 aa, Cryptosporidium parvum
RTKDNIKLRGDINVCIVGD

SEQ ID NO: 2303304 - protein, 19 aa, Cryptosporidium parvum
RTKIYCLIQRKMWNQALFL

SEQ ID NO: 2303305 - protein, 27 aa, Cryptosporidium parvum
RTKLCRRSLREGCDFGPLRCQYSHNVY

SEQ ID NO: 2303306 - protein, 28 aa, Cryptosporidium parvum
RTKPCRRSKQMGCDFGITRCQYSHNIYW

SEQ ID NO: 2303307 - protein, 18 aa, Cryptosporidium parvum
RTLCRVCGKHILKQKFAT

SEQ ID NO: 2303308 - protein, 23 aa, Cryptosporidium parvum
RTLEGFYSMEMIQKFRLKSNSDI

SEQ ID NO: 2303309 - protein, 17 aa, Cryptosporidium parvum
RTLELFQLSILKTNDTI

SEQ ID NO: 2303310 - protein, 24 aa, Cryptosporidium parvum
RTLIWEFQILIPLISKNVSYYNKI

SEQ ID NO: 2303311 - protein, 18 aa, Cryptosporidium parvum
RTLIYKILTLMIPYFSNI

SEQ ID NO: 2303312 - protein, 26 aa, Cryptosporidium parvum
RTLNLRLIELYLDYKKKNKMNNNILI

SEQ ID NO: 2303313 - protein, 17 aa, Cryptosporidium parvum
RTLPMKISTKFQISNKT

SEQ ID NO: 2303314 - protein, 25 aa, Cryptosporidium parvum
RTLTEWSIEPLSSWISVAEIPLSSL

SEQ ID NO: 2303315 - protein, 19 aa, Cryptosporidium parvum
RTLTFCEICGINQVTKVIF

SEQ ID NO: 2303316 - protein, 22 aa, Cryptosporidium parvum
RTNRKYVIFCLIAPVNKEIELQ

SEQ ID NO: 2303317 - protein, 36 aa, Cryptosporidium parvum
RTNSSCRILSAAEMKKVFCKSKKPIGSLKDFVHTIE

SEQ ID NO: 2303318 - protein, 20 aa, Cryptosporidium parvum
RTPETFRMGIVYRSPAQQHS

SEQ ID NO: 2303319 - protein, 18 aa, Cryptosporidium parvum
RTPGRRYGHIMVYSKPNL

SEQ ID NO: 2303320 - protein, 18 aa, Cryptosporidium parvum
RTPHKFDIGAIYNIPISE

SEQ ID NO: 2303321 - protein, 19 aa, Cryptosporidium parvum
RTPRIEVGKKVIISPLKLE

SEQ ID NO: 2303322 - protein, 17 aa, Cryptosporidium parvum
RTPRPFPQLKFKRKVEN

SEQ ID NO: 2303323 - protein, 29 aa, Cryptosporidium parvum
RTPVNLKKTKLCPFWLSSACSIGENCPFA

SEQ ID NO: 2303324 - protein, 22 aa, Cryptosporidium parvum
RTQDKLVLYCWVDTNELDQNNS

SEQ ID NO: 2303325 - protein, 23 aa, Cryptosporidium parvum
RTREKEIIDYIVLEEIKQFNHQG

SEQ ID NO: 2303326 - protein, 20 aa, Cryptosporidium parvum
RTRHVKLVPLGVEIGSNGIS

SEQ ID NO: 2303327 - protein, 21 aa, Cryptosporidium parvum
RTRRNYFKLLKNYTNIFNSEN

SEQ ID NO: 2303328 - protein, 19 aa, Cryptosporidium parvum
RTRSSWLLLLNNIGKSNVI

SEQ ID NO: 2303329 - protein, 19 aa, Cryptosporidium parvum
RTSCGRCGLTYFPSKGDEG

SEQ ID NO: 2303330 - protein, 17 aa, Cryptosporidium parvum
RTSESKASLRKFLESTI

SEQ ID NO: 2303331 - protein, 17 aa, Cryptosporidium parvum
RTTYCYVSFRKDLVETL

SEQ ID NO: 2303332 - protein, 20 aa, Cryptosporidium parvum
RTVCTKERFQFLHISILRDY

SEQ ID NO: 2303333 - protein, 27 aa, Cryptosporidium parvum
RTVGIGAYLARLGHRVIQKAHGAPIVL

SEQ ID NO: 2303334 - protein, 18 aa, Cryptosporidium parvum
RTVSELKSGNNNEFKEDK

SEQ ID NO: 2303335 - protein, 29 aa, Cryptosporidium parvum
RTWICPWHECCLCFRRATQAGGLLIHCSE

SEQ ID NO: 2303336 - protein, 17 aa, Cryptosporidium parvum
RTYLSWRQADCHINNLY

SEQ ID NO: 2303337 - protein, 23 aa, Cryptosporidium parvum
RTYSVECLDIFASENTEILFSII

SEQ ID NO: 2303338 - protein, 17 aa, Cryptosporidium parvum
RVAAMSVAARVAKEMGS

SEQ ID NO: 2303339 - protein, 17 aa, Cryptosporidium parvum
RVADCYSNLGLVYRLLG

SEQ ID NO: 2303340 - protein, 19 aa, Cryptosporidium parvum
RVADNEGRRDRDFDSERGR

SEQ ID NO: 2303341 - protein, 19 aa, Cryptosporidium parvum
RVAMLLKLPAFKLAVEQSI

SEQ ID NO: 2303342 - protein, 19 aa, Cryptosporidium parvum
RVCVFNLDDNASWRDLKDY

SEQ ID NO: 2303343 - protein, 22 aa, Cryptosporidium parvum
RVEIPLGCLFTPLKESSKLQLV

SEQ ID NO: 2303344 - protein, 29 aa, Cryptosporidium parvum
RVELPCKRWPELLPYLIRLVQNNSDNKMS

SEQ ID NO: 2303345 - protein, 21 aa, Cryptosporidium parvum
RVFLLKFSEIYIPRIHKKGIL

SEQ ID NO: 2303346 - protein, 28 aa, Cryptosporidium parvum
RVIELGCGCGLMSLAAAIYSRYFFDSQP

SEQ ID NO: 2303347 - protein, 20 aa, Cryptosporidium parvum
RVIGIFEINDYPTLIRQKIV

SEQ ID NO: 2303348 - protein, 24 aa, Cryptosporidium parvum
RVIKSLKFSFVFFYNQLLNIEGVS

SEQ ID NO: 2303349 - protein, 22 aa, Cryptosporidium parvum
RVKDCKFSVGSGSLYAYGVLDS

SEQ ID NO: 2303350 - protein, 17 aa, Cryptosporidium parvum
RVKGKLSKFGLEQQNSL

SEQ ID NO: 2303351 - protein, 20 aa, Cryptosporidium parvum
RVKSELDFAKGHYEGKIKIK

SEQ ID NO: 2303352 - protein, 20 aa, Cryptosporidium parvum
RVLHEISGTPILGVMLDSIW

SEQ ID NO: 2303353 - protein, 17 aa, Cryptosporidium parvum
RVLVGIILKKEYKLCDI

SEQ ID NO: 2303354 - protein, 20 aa, Cryptosporidium parvum
RVMLESNPQLKALREQNPEL

SEQ ID NO: 2303355 - protein, 21 aa, Cryptosporidium parvum
RVMPWMLNIDSFNLPNSNQQP

SEQ ID NO: 2303356 - protein, 19 aa, Cryptosporidium parvum
RVNDCRPLENLVHKKHIML

SEQ ID NO: 2303357 - protein, 24 aa, Cryptosporidium parvum
RVPRSREIIVSGDLVDYACPGEEI

SEQ ID NO: 2303358 - protein, 18 aa, Cryptosporidium parvum
RVPTLLKSTYISTSDSSS

SEQ ID NO: 2303359 - protein, 21 aa, Cryptosporidium parvum
RVQAAISLRNVFREFVLTPDN

SEQ ID NO: 2303360 - protein, 18 aa, Cryptosporidium parvum
RVRAALEPYSKYSALYDQ

SEQ ID NO: 2303361 - protein, 25 aa, Cryptosporidium parvum
RVRHKLCNSKGYWPRIKIEIPEKNE

SEQ ID NO: 2303362 - protein, 20 aa, Cryptosporidium parvum
RVRPGMVIPTGMGQQVQGQN

SEQ ID NO: 2303363 - protein, 17 aa, Cryptosporidium parvum
RVRRISLIIFGLIKEIY

SEQ ID NO: 2303364 - protein, 25 aa, Cryptosporidium parvum
RVSCKCNACGYIGALDNNHKITTYI

SEQ ID NO: 2303365 - protein, 17 aa, Cryptosporidium parvum
RVSDGTGGIDARFDIDS

SEQ ID NO: 2303366 - protein, 20 aa, Cryptosporidium parvum
RVSNVKPRIQVVNYTCEVCG

SEQ ID NO: 2303367 - protein, 19 aa, Cryptosporidium parvum
RVSRFYRQTIHYLSYTPLN

SEQ ID NO: 2303368 - protein, 41 aa, Cryptosporidium parvum; identical to SEQ ID NO: 2180869

SEQ ID NO: 2303369 - protein, 22 aa, Cryptosporidium parvum
RVVIQRIPWRELKEIHHDAQRS

SEQ ID NO: 2303370 - protein, 26 aa, Cryptosporidium parvum
RVWKKEHKSGRVLLRTEFIVPVAPLD

SEQ ID NO: 2303371 - protein, 18 aa, Cryptosporidium parvum
RVYSSFVIIGETNILLVF

SEQ ID NO: 2303372 - protein, 20 aa, Cryptosporidium parvum
RWEIVYSCDDFLSSINGVCW

SEQ ID NO: 2303373 - protein, 18 aa, Cryptosporidium parvum
RWKAIGVPIFIEGSQYLR

SEQ ID NO: 2303374 - protein, 24 aa, Cryptosporidium parvum
RWKHYEDFNTLFLQFEEFSTNKEV

SEQ ID NO: 2303375 - protein, 18 aa, Cryptosporidium parvum
RWNAEALHAIQCAAEAFL

SEQ ID NO: 2303376 - protein, 17 aa, Cryptosporidium parvum
RWQCIVLDEAHRIKNEG

SEQ ID NO: 2303377 - protein, 20 aa, Cryptosporidium parvum
RWSNGEVFEGEYVRGVKCGH

SEQ ID NO: 2303378 - protein, 18 aa, Cryptosporidium parvum
RWTEDTVFRNQNRVSQPK

SEQ ID NO: 2303379 - protein, 19 aa, Cryptosporidium parvum
RYAAVIMRQVFSAIAYCHS

SEQ ID NO: 2303380 - protein, 18 aa, Cryptosporidium parvum
RYADIIVHRLLSASIGLE

SEQ ID NO: 2303381 - protein, 22 aa, Cryptosporidium parvum
RYCKTIPLRGVILINKEFTKCV

SEQ ID NO: 2303382 - protein, 20 aa, Cryptosporidium parvum
RYCTEIFDYLSLASLIEDRI

SEQ ID NO: 2303383 - protein, 17 aa, Cryptosporidium parvum
RYDKSFQGAINFSLNPE

SEQ ID NO: 2303384 - protein, 17 aa, Cryptosporidium parvum
RYDSCYHSNLSPNTNFQ

SEQ ID NO: 2303385 - protein, 22 aa, Cryptosporidium parvum
RYESTFLKKLCQSIETDVVNGH

SEQ ID NO: 2303386 - protein, 18 aa, Cryptosporidium parvum
RYFNINLSDIIKQTRLNH

SEQ ID NO: 2303387 - protein, 26 aa, Cryptosporidium parvum
RYGVEKSYEMALRFYQVNIIGNFGND

SEQ ID NO: 2303388 - protein, 22 aa, Cryptosporidium parvum
RYIKGRYQRHLDKIKATKSRME

SEQ ID NO: 2303389 - protein, 18 aa, Cryptosporidium parvum
RYILGCSISPLEDKIATY

SEQ ID NO: 2303390 - protein, 20 aa, Cryptosporidium parvum
RYIPVLCPDIIIKEDESSIS

SEQ ID NO: 2303391 - protein, 18 aa, Cryptosporidium parvum
RYIQLRSKFIGYSCDEIQ

SEQ ID NO: 2303392 - protein, 19 aa, Cryptosporidium parvum
RYLANKCSIAARIDNFSTV

SEQ ID NO: 2303393 - protein, 19 aa, Cryptosporidium parvum
RYLDLPASVFPATHTKKTM

SEQ ID NO: 2303394 - protein, 18 aa, Cryptosporidium parvum
RYLELYCRTWGHERKCVQ

SEQ ID NO: 2303395 - protein, 27 aa, Cryptosporidium parvum
RYLFKDLNVYFGWETPLVIPIITEPDC

SEQ ID NO: 2303396 - protein, 26 aa, Cryptosporidium parvum
RYLNYKLLIRKIRWVSEQESQENWTE

SEQ ID NO: 2303397 - protein, 25 aa, Cryptosporidium parvum
RYLQGCDLGLLLLINQRISTVMELI

SEQ ID NO: 2303398 - protein, 23 aa, Cryptosporidium parvum
RYLYKSSGVDLFFIHLNNEIVQL

SEQ ID NO: 2303399 - protein, 20 aa, Cryptosporidium parvum
RYMAPECFYIGRSIDEKSDI

SEQ ID NO: 2303400 - protein, 18 aa, Cryptosporidium parvum
RYNSFSVISTPTISQKLI

SEQ ID NO: 2303401 - protein, 24 aa, Cryptosporidium parvum
RYPATELNGPFFFSFNQEPNLYNG

SEQ ID NO: 2303402 - protein, 30 aa, Cryptosporidium parvum; identical to SEQ ID NO: 2180899

SEQ ID NO: 2303403 - protein, 18 aa, Cryptosporidium parvum
RYPSKTCIFKQGELAKSF

SEQ ID NO: 2303404 - protein, 17 aa, Cryptosporidium parvum
RYRCDKNRTLGLNTQNV

SEQ ID NO: 2303405 - protein, 21 aa, Cryptosporidium parvum
RYSFPEQFFLNDFSEILRDDT

SEQ ID NO: 2303406 - protein, 28 aa, Cryptosporidium parvum
RYSSIEILRSRLLYAINNCVAIDLDAYV

SEQ ID NO: 2303407 - protein, 18 aa, Cryptosporidium parvum
RYSTSRVNTERKVRFSID

SEQ ID NO: 2303408 - protein, 26 aa, Cryptosporidium parvum
RYTILLECIEELIFKQVVYSKNSDFI

SEQ ID NO: 2303409 - protein, 23 aa, Cryptosporidium parvum
RYTQGVELLCWVRGSDQESETLR

SEQ ID NO: 2303410 - protein, 17 aa, Cryptosporidium parvum
RYVECLISDLNLPQELF

SEQ ID NO: 2303411 - protein, 20 aa, Cryptosporidium parvum
RYVIDCGLCKVKVYNPKIGM

SEQ ID NO: 2303412 - protein, 21 aa, Cryptosporidium parvum
RYVKLKADWWTNSAYFNRERI

SEQ ID NO: 2303413 - protein, 22 aa, Cryptosporidium parvum
RYYRSPEICLGLAYNEKIDIWS

SEQ ID NO: 2303414 - protein, 23 aa, Cryptosporidium parvum
SADFKASIVYRVSGYAGKVLFGW

SEQ ID NO: 2303415 - protein, 27 aa, Cryptosporidium parvum
SAEIIIKNLSRYGARLILPIITEGIEE

SEQ ID NO: 2303416 - protein, 35 aa, Cryptosporidium parvum; identical to SEQ ID NO: 2180915

SEQ ID NO: 2303417 - protein, 22 aa, Cryptosporidium parvum
SAEYFLKSGFSVIFFHRKGSHI

SEQ ID NO: 2303418 - protein, 20 aa, Cryptosporidium parvum
SAFNSFKFITLILSYILVIS

SEQ ID NO: 2303419 - protein, 28 aa, Cryptosporidium parvum
SAGCIFAELIKRSALFAGHDHLDQLKAI

SEQ ID NO: 2303420 - protein, 20 aa, Cryptosporidium parvum
SAGPIGDDMFHWQATIMGPD

SEQ ID NO: 2303421 - protein, 17 aa, Cryptosporidium parvum
SAHMAINEAILRTKVKK

SEQ ID NO: 2303422 - protein, 19 aa, Cryptosporidium parvum
SAICAKITPGDFVLDACSA

SEQ ID NO: 2303423 - protein, 23 aa, Cryptosporidium parvum
SAIELRNALISRFGIKISSTALF

SEQ ID NO: 2303424 - protein, 29 aa, Cryptosporidium parvum
SAIEPEWLNFYAPHIFKLNINDSNKEDLL

SEQ ID NO: 2303425 - protein, 25 aa, Cryptosporidium parvum
SAIHKSDENFTFWLSLTSDKDQSCQ

SEQ ID NO: 2303426 - protein, 27 aa, Cryptosporidium parvum
SAIPVPILIDRAVPVPMELQIIQDILC

SEQ ID NO: 2303427 - protein, 22 aa, Cryptosporidium parvum
SAKDFTGGTSWYESPEQKMLEY

SEQ ID NO: 2303428 - protein, 18 aa, Cryptosporidium parvum
SAKILLIIIICFDTMPNR

SEQ ID NO: 2303429 - protein, 25 aa, Cryptosporidium parvum
SAKLGRGLLLDVIRQISAFGLSFMR

SEQ ID NO: 2303430 - protein, 18 aa, Cryptosporidium parvum
SALKEERDILSADYKILE

SEQ ID NO: 2303431 - protein, 17 aa, Cryptosporidium parvum
SALKLATDSAVTILKID

SEQ ID NO: 2303432 - protein, 19 aa, Cryptosporidium parvum
SALNKFRFINSNKKPLENE

SEQ ID NO: 2303433 - protein, 43 aa, Cryptosporidium parvum
SALPLRSSEFFMISILGLNRFKIRAQCVLAMKAFEEEYQSCLE

SEQ ID NO: 2303434 - protein, 17 aa, Cryptosporidium parvum
SALRKAGVPPGKPSYVY

SEQ ID NO: 2303435 - protein, 17 aa, Cryptosporidium parvum
SALSWKLDGENNLNLNS

SEQ ID NO: 2303436 - protein, 19 aa, Cryptosporidium parvum
SALTKCVIIGKKPLYKIRN

SEQ ID NO: 2303437 - protein, 21 aa, Cryptosporidium parvum
SAMLDCVRDPAKHIIQGLWRK

SEQ ID NO: 2303438 - protein, 29 aa, Cryptosporidium parvum
SANELSSWTCPSCSLRSSTSIGRSNSIIN

SEQ ID NO: 2303439 - protein, 22 aa, Cryptosporidium parvum
SANLFFPNFRIVSIKDNSSGDR

SEQ ID NO: 2303440 - protein, 18 aa, Cryptosporidium parvum
SANSFLILVTEDRNIVIL

SEQ ID NO: 2303441 - protein, 33 aa, Cryptosporidium parvum
SARACHSLTRIFGRLYLFGGFDGIQCFNDLWVY

SEQ ID NO: 2303442 - protein, 26 aa, Cryptosporidium parvum
SARTRLSNWIISFSCLDDDIKGEVPF

SEQ ID NO: 2303443 - protein, 27 aa, Cryptosporidium parvum
SASAFCRRRLAVVLVQLKFCPNLKDSV

SEQ ID NO: 2303444 - protein, 17 aa, Cryptosporidium parvum
SASEPRISFKKDGELKM

SEQ ID NO: 2303445 - protein, 30 aa, Cryptosporidium parvum
SASESKMLISFPFFLKYYLSVLTTIRQKHF

SEQ ID NO: 2303446 - protein, 24 aa, Cryptosporidium parvum
SASIDCLKTLLGVDFKAEDIEVGV

SEQ ID NO: 2303447 - protein, 25 aa, Cryptosporidium parvum
SASPNLKAVIPLFGLLDLAFEIRKY

SEQ ID NO: 2303448 - protein, 17 aa, Cryptosporidium parvum
SASREFCGTLVIVFDLW

SEQ ID NO: 2303449 - protein, 25 aa, Cryptosporidium parvum
SASSWKKYHSKVFFESMDKKRRELL

SEQ ID NO: 2303450 - protein, 20 aa, Cryptosporidium parvum
SASTCKVTNLLNLQDQDTVT

SEQ ID NO: 2303451 - protein, 27 aa, Cryptosporidium parvum
SASTGNHFKPINGFVFDKTGKDLKEVS

SEQ ID NO: 2303452 - protein, 20 aa, Cryptosporidium parvum
SASVFSWLPVYHDMGLIGFF

SEQ ID NO: 2303453 - protein, 18 aa, Cryptosporidium parvum
SASWCPIYSSSLIAVCDY

SEQ ID NO: 2303454 - protein, 18 aa, Cryptosporidium parvum
SATFPFFGIEPAILDPDT

SEQ ID NO: 2303455 - protein, 18 aa, Cryptosporidium parvum
SATILVIEKGGLWGLGRS

SEQ ID NO: 2303456 - protein, 20 aa, Cryptosporidium parvum
SATTCKAGTAQSEAVTSQVC

SEQ ID NO: 2303457 - protein, 17 aa, Cryptosporidium parvum
SAVESLGGFDLIELNKR

SEQ ID NO: 2303458 - protein, 18 aa, Cryptosporidium parvum
SCAKSCLNLTNLSNIFHY

SEQ ID NO: 2303459 - protein, 21 aa, Cryptosporidium parvum
SCDLKPKISIRELDRRGEECF

SEQ ID NO: 2303460 - protein, 18 aa, Cryptosporidium parvum
SCDLVRCGRTDRGVHSAG

SEQ ID NO: 2303461 - protein, 22 aa, Cryptosporidium parvum
SCGAGYFFVSIVRFTKGKFDIL

SEQ ID NO: 2303462 - protein, 20 aa, Cryptosporidium parvum
SCGAIDIIMELGVKDLNGIL

SEQ ID NO: 2303463 - protein, 19 aa, Cryptosporidium parvum
SCGKLCFHQIFVIKHGQYL

SEQ ID NO: 2303464 - protein, 21 aa, Cryptosporidium parvum
SCGKLYRVSCMTVTDPGDSDI

SEQ ID NO: 2303465 - protein, 25 aa, Cryptosporidium parvum
SCGKSCIYSYYILRAGVVCGVSVAV

SEQ ID NO: 2303466 - protein, 33 aa, Cryptosporidium parvum; identical to SEQ ID NO: 2180956

SEQ ID NO: 2303467 - protein, 20 aa, Cryptosporidium parvum
SCILEALSEWDSFGQQSKPD

SEQ ID NO: 2303468 - protein, 28 aa, Cryptosporidium parvum
SCILRICPPVLYLDLWDYLLMTILFVLK

SEQ ID NO: 2303469 - protein, 30 aa, Cryptosporidium parvum
SCISDLKLRILWIKETIHCFEPFTDTLTPS

SEQ ID NO: 2303470 - protein, 25 aa, Cryptosporidium parvum
SCKCCGLTVHWSCYGLGEKMESIND

SEQ ID NO: 2303471 - protein, 19 aa, Cryptosporidium parvum
SCKEIRQSETLILKEQQQT

SEQ ID NO: 2303472 - protein, 25 aa, Cryptosporidium parvum
SCKIPLHYILTLYIRSRIRRIREKL

SEQ ID NO: 2303473 - protein, 17 aa, Cryptosporidium parvum
SCKLEFEFDTILMDKIA

SEQ ID NO: 2303474 - protein, 24 aa, Cryptosporidium parvum
SCKMKLDCGIVFSLVSPTMFRISS

SEQ ID NO: 2303475 - protein, 22 aa, Cryptosporidium parvum
SCKQWSCKKFGKEGAAKRAIQF

SEQ ID NO: 2303476 - protein, 29 aa, Cryptosporidium parvum
SCKYFYKDCVTGSYLPIPLFPDIIVVSSG

SEQ ID NO: 2303477 - protein, 32 aa, Cryptosporidium parvum
SCLAGLSIVGRDYFGVFPLRGKLLNVREASFK

SEQ ID NO: 2303478 - protein, 20 aa, Cryptosporidium parvum
SCLLLQFTDRRFRVDHDLTI

SEQ ID NO: 2303479 - protein, 24 aa, Cryptosporidium parvum
SCLNMKYFPPKKIDWNGLLGDNKD

SEQ ID NO: 2303480 - protein, 27 aa, Cryptosporidium parvum
SCLSNNWYQRLNWVWRDGYSIVNSKSD

SEQ ID NO: 2303481 - protein, 20 aa, Cryptosporidium parvum
SCLTPKICEIISVIKQNNNE

SEQ ID NO: 2303482 - protein, 17 aa, Cryptosporidium parvum
SCLYPFRDISDIKPFGW

SEQ ID NO: 2303483 - protein, 21 aa, Cryptosporidium parvum
SCLYSDILWSTRFSVCKNSII

SEQ ID NO: 2303484 - protein, 19 aa, Cryptosporidium parvum
SCMTAPCIPILAAKKLTIE

SEQ ID NO: 2303485 - protein, 17 aa, Cryptosporidium parvum
SCNNCISNATQNEFGDF

SEQ ID NO: 2303486 - protein, 20 aa, Cryptosporidium parvum
SCNYLKGKWLIGSSTGKIRL

SEQ ID NO: 2303487 - protein, 17 aa, Cryptosporidium parvum
SCQSDLYSLDGYLTQEW

SEQ ID NO: 2303488 - protein, 20 aa, Cryptosporidium parvum
SCRLFINEYVQLLGLLLNKF

SEQ ID NO: 2303489 - protein, 24 aa, Cryptosporidium parvum
SCSAVGKSSLKWNGGGTGSNNGGI

SEQ ID NO: 2303490 - protein, 25 aa, Cryptosporidium parvum
SCSEGYIYEENHLNLGFQAEQQQKP

SEQ ID NO: 2303491 - protein, 25 aa, Cryptosporidium parvum
SCTDCPLYMPKMCNCGTKGGENLYS

SEQ ID NO: 2303492 - protein, 26 aa, Cryptosporidium parvum
SCTFGQEFFLRIYGTGLLNEIQNHTT

SEQ ID NO: 2303493 - protein, 24 aa, Cryptosporidium parvum
SCVKCNWRLAHSIVEELFIGGYSP

SEQ ID NO: 2303494 - protein, 17 aa, Cryptosporidium parvum
SCVKDASKNMEATSYDL

SEQ ID NO: 2303495 - protein, 17 aa, Cryptosporidium parvum
SCVLCSHSGGAMKRTNK

SEQ ID NO: 2303496 - protein, 17 aa, Cryptosporidium parvum
SCVNAQFSTHFKNGKSI

SEQ ID NO: 2303497 - protein, 18 aa, Cryptosporidium parvum
SCYHELCRLLGKLNTANQ

SEQ ID NO: 2303498 - protein, 22 aa, Cryptosporidium parvum
SDAEFSLPISYLVDVNTKALEM

SEQ ID NO: 2303499 - protein, 27 aa, Cryptosporidium parvum
SDAEIIKRCEILLKWLFLPNEDTSDSG

SEQ ID NO: 2303500 - protein, 23 aa, Cryptosporidium parvum
SDCLMLRQMKNMFFLLCKQDSSW

SEQ ID NO: 2303501 - protein, 18 aa, Cryptosporidium parvum
SDCWSIGCLLLELCSLEK

SEQ ID NO: 2303502 - protein, 20 aa, Cryptosporidium parvum
SDDGSWVYWGTVWSTMSFGP

SEQ ID NO: 2303503 - protein, 20 aa, Cryptosporidium parvum
SDDMRCILTVLQHHSYWVVS

SEQ ID NO: 2303504 - protein, 27 aa, Cryptosporidium parvum
SDEFDFRFKAIIGHLTLKFISVFFKPS

SEQ ID NO: 2303505 - protein, 25 aa, Cryptosporidium parvum
SDEFIKCPICLDSDLLVPKISNCGH

SEQ ID NO: 2303506 - protein, 20 aa, Cryptosporidium parvum
SDEILGIGIVFAEDLTRCII

SEQ ID NO: 2303507 - protein, 22 aa, Cryptosporidium parvum
SDEKRIVNIFSPYSQDKFKRNR

SEQ ID NO: 2303508 - protein, 23 aa, Cryptosporidium parvum
SDELKKTCRLYFDSLNHVIVQST

SEQ ID NO: 2303509 - protein, 23 aa, Cryptosporidium parvum
SDELVLRLRIKNIEPTNNIRDNI

SEQ ID NO: 2303510 - protein, 27 aa, Cryptosporidium parvum
SDERILPVLEFCLFGVIFTQSLEDAKK

SEQ ID NO: 2303511 - protein, 19 aa, Cryptosporidium parvum
SDEVPLLIIKLFQESNDGL

SEQ ID NO: 2303512 - protein, 19 aa, Cryptosporidium parvum
SDFREIIGYEPCKKEDLDD

SEQ ID NO: 2303513 - protein, 24 aa, Cryptosporidium parvum
SDFYYLLNCVIMRNIQENPDYSNP

SEQ ID NO: 2303514 - protein, 17 aa, Cryptosporidium parvum
SDGFIYSFGKIYLGYNI

SEQ ID NO: 2303515 - protein, 22 aa, Cryptosporidium parvum
SDGPFCKPVFLSKEETNGLPML

SEQ ID NO: 2303516 - protein, 17 aa, Cryptosporidium parvum
SDHCPILLILKTGEFES

SEQ ID NO: 2303517 - protein, 25 aa, Cryptosporidium parvum
SDHLVDFFLGKVLRSSNSLFYIEKK

SEQ ID NO: 2303518 - protein, 21 aa, Cryptosporidium parvum
SDHPRSADAFHILSNAYNQIK

SEQ ID NO: 2303519 - protein, 19 aa, Cryptosporidium parvum
SDIICKSGITALYLGDFDP

SEQ ID NO: 2303520 - protein, 18 aa, Cryptosporidium parvum
SDIIKCLPHKEHVEPLIK

SEQ ID NO: 2303521 - protein, 18 aa, Cryptosporidium parvum
SDIKCSNKSLANSVTTFR

SEQ ID NO: 2303522 - protein, 17 aa, Cryptosporidium parvum
SDIPGVLEVGWVEKIID

SEQ ID NO: 2303523 - protein, 23 aa, Cryptosporidium parvum
SDISRYKLEFGLCSLEDSKKIHQ

SEQ ID NO: 2303524 - protein, 22 aa, Cryptosporidium parvum
SDKDILSAVSFQLKNSNEGFAI

SEQ ID NO: 2303525 - protein, 17 aa, Cryptosporidium parvum
SDKEHKESIFLAIGGPG

SEQ ID NO: 2303526 - protein, 19 aa, Cryptosporidium parvum
SDKILLRYIESIASVDLEA

SEQ ID NO: 2303527 - protein, 20 aa, Cryptosporidium parvum
SDKMFSCFKATPLNKISVVI

SEQ ID NO: 2303528 - protein, 18 aa, Cryptosporidium parvum
SDKSIIKIRGELFNDSIF

SEQ ID NO: 2303529 - protein, 25 aa, Cryptosporidium parvum
SDKSKCGWIQCQVGISGGSSNNLKS

SEQ ID NO: 2303530 - protein, 22 aa, Cryptosporidium parvum
SDLEFPDRVLIGGRTDSEIGKI

SEQ ID NO: 2303531 - protein, 25 aa, Cryptosporidium parvum
SDLEIYILDCLKIVSDIIEESIQDS

SEQ ID NO: 2303532 - protein, 36 aa, Cryptosporidium parvum
SDLEVIKQLRNCNLLYFNKEVVFNCIVDIEQSKLKY

SEQ ID NO: 2303533 - protein, 25 aa, Cryptosporidium parvum
SDLFIHGSLYHLALMKRREFPEVLL

SEQ ID NO: 2303534 - protein, 20 aa, Cryptosporidium parvum
SDLFSALYITGSDLNLLKNP

SEQ ID NO: 2303535 - protein, 24 aa, Cryptosporidium parvum
SDLHWSKRPKKVLPCREKEHEEIT

SEQ ID NO: 2303536 - protein, 23 aa, Cryptosporidium parvum
SDLIPYAALFARCYYPSKLEEIV

SEQ ID NO: 2303537 - protein, 24 aa, Cryptosporidium parvum
SDLNYLKYIGIKSLSKIALIDPSY

SEQ ID NO: 2303538 - protein, 22 aa, Cryptosporidium parvum
SDLPPRRYREFKSRNRRRRRSV

SEQ ID NO: 2303539 - protein, 21 aa, Cryptosporidium parvum
SDLQKAIPYFLKAVELYNKNG

SEQ ID NO: 2303540 - protein, 32 aa, Cryptosporidium parvum
SDLRKMCVNLVPFPRLHFFMIGFAPLTSRGSQ

SEQ ID NO: 2303541 - protein, 18 aa, Cryptosporidium parvum
SDLSLPFQALLKIEKFGD

SEQ ID NO: 2303542 - protein, 21 aa, Cryptosporidium parvum
SDLWSTGMAYKIVIITNAGLR

SEQ ID NO: 2303543 - protein, 20 aa, Cryptosporidium parvum
SDLYKYRLVGLGLDGRIIEW

SEQ ID NO: 2303544 - protein, 21 aa, Cryptosporidium parvum
SDLYLPILGQLYPLLSKAKSI

SEQ ID NO: 2303545 - protein, 20 aa, Cryptosporidium parvum
SDMASILMTLYFSKKDSEDL

SEQ ID NO: 2303546 - protein, 19 aa, Cryptosporidium parvum
SDMLFELKKLPLWNDHDNN

SEQ ID NO: 2303547 - protein, 23 aa, Cryptosporidium parvum
SDNGIPLIALWLHSENVGVRERA

SEQ ID NO: 2303548 - protein, 21 aa, Cryptosporidium parvum
SDNYFPFKLYSRLDRSGHLEL

SEQ ID NO: 2303549 - protein, 21 aa, Cryptosporidium parvum
SDPEKGIAIISAYRLYQNNKN

SEQ ID NO: 2303550 - protein, 21 aa, Cryptosporidium parvum
SDPQFRLVLEQLKQNPATLTQ

SEQ ID NO: 2303551 - protein, 24 aa, Cryptosporidium parvum
SDPRSKYLGNRGVNICRIMREDFG

SEQ ID NO: 2303552 - protein, 17 aa, Cryptosporidium parvum
SDQEWMHRSGIKNQSDN

SEQ ID NO: 2303553 - protein, 19 aa, Cryptosporidium parvum
SDQFDCKFFHTIFKTVKRY

SEQ ID NO: 2303554 - protein, 23 aa, Cryptosporidium parvum
SDRKSLELAGLWNNILKKVKRKD

SEQ ID NO: 2303555 - protein, 22 aa, Cryptosporidium parvum
SDRYVFECLWSEMIDQTSSDDS

SEQ ID NO: 2303556 - protein, 32 aa, Cryptosporidium parvum
SDSDYRIPFILLFDTWETFKFAKNLELVEKVT

SEQ ID NO: 2303557 - protein, 24 aa, Cryptosporidium parvum
SDSFKAKCPCYKFSKLEESRKFWG

SEQ ID NO: 2303558 - protein, 17 aa, Cryptosporidium parvum
SDSLPYALPLAGTKAQT

SEQ ID NO: 2303559 - protein, 23 aa, Cryptosporidium parvum
SDSPWINKLYYYWEDNHFYYMLM

SEQ ID NO: 2303560 - protein, 20 aa, Cryptosporidium parvum
SDSSELDWNIKDCKEDTRNI

SEQ ID NO: 2303561 - protein, 23 aa, Cryptosporidium parvum
SDSSIKLRALKVLFSVINENNIK

SEQ ID NO: 2303562 - protein, 18 aa, Cryptosporidium parvum
SDSSSCSCLCSCTEKSSS

SEQ ID NO: 2303563 - protein, 24 aa, Cryptosporidium parvum
SDSVKFGYSSPPSLNNDKNSSQSN

SEQ ID NO: 2303564 - protein, 19 aa, Cryptosporidium parvum
SDTALKFISKFQVKLSDFN

SEQ ID NO: 2303565 - protein, 27 aa, Cryptosporidium parvum
SDTQGCMEICITPPLSSELITSNNFYF

SEQ ID NO: 2303566 - protein, 17 aa, Cryptosporidium parvum
SDTRISQFDKLRLALLY

SEQ ID NO: 2303567 - protein, 17 aa, Cryptosporidium parvum
SDTYLLDIRKFSCSMHS

SEQ ID NO: 2303568 - protein, 24 aa, Cryptosporidium parvum
SDVCSPPIKLPWSIIFHTLDPTEF

SEQ ID NO: 2303569 - protein, 18 aa, Cryptosporidium parvum
SDVLKSRLLTPAVVVNQL

SEQ ID NO: 2303570 - protein, 27 aa, Cryptosporidium parvum
SDVNECADICWLKGSKVLVNGTISGHL

SEQ ID NO: 2303571 - protein, 17 aa, Cryptosporidium parvum
SDVPGVKFFSFIINGNK

SEQ ID NO: 2303572 - protein, 24 aa, Cryptosporidium parvum
SDWCCSLCRCIETAQWRYLRNTLE

SEQ ID NO: 2303573 - protein, 17 aa, Cryptosporidium parvum
SDYRGKYVVLFFYPLNF

SEQ ID NO: 2303574 - protein, 18 aa, Cryptosporidium parvum
SEAEAQCAELCKDGLVYG

SEQ ID NO: 2303575 - protein, 17 aa, Cryptosporidium parvum
SEAGMFAIRAERDYIIE

SEQ ID NO: 2303576 - protein, 23 aa, Cryptosporidium parvum
SEAIARLLPYHTFYVDEIKSNRI

SEQ ID NO: 2303577 - protein, 33 aa, Cryptosporidium parvum
SECGIEWSTIIKIWRLILDRLVDCKNLELKGLK

SEQ ID NO: 2303578 - protein, 17 aa, Cryptosporidium parvum
SECGILDWYCILNRIYI

SEQ ID NO: 2303579 - protein, 22 aa, Cryptosporidium parvum
SECLPSKCIQPICIFNEEPSIY

SEQ ID NO: 2303580 - protein, 27 aa, Cryptosporidium parvum
SECLRSMRVSVRWLRLASSMHLNLYQI

SEQ ID NO: 2303581 - protein, 27 aa, Cryptosporidium parvum
SEDEILKAAVMKYGLNNWSRVASLLIM

SEQ ID NO: 2303582 - protein, 26 aa, Cryptosporidium parvum
SEDLLPTSVCPLIIIGEITSDEQKNK

SEQ ID NO: 2303583 - protein, 33 aa, Cryptosporidium parvum; identical to SEQ ID NO: 2181073

SEQ ID NO: 2303584 - protein, 18 aa, Cryptosporidium parvum
SEDTRLSVIFVILDPLTI

SEQ ID NO: 2303585 - protein, 18 aa, Cryptosporidium parvum
SEDYIIKLYELFIELIEI

SEQ ID NO: 2303586 - protein, 22 aa, Cryptosporidium parvum
SEEIKVLIVGSGRGGLIKSAFN

SEQ ID NO: 2303587 - protein, 21 aa, Cryptosporidium parvum
SEEISCVIRAFINAEVPNSLL

SEQ ID NO: 2303588 - protein, 24 aa, Cryptosporidium parvum
SEENIEFCFNKKMNNIFGDNDTIK

SEQ ID NO: 2303589 - protein, 19 aa, Cryptosporidium parvum
SEEWGELYYGIGNESMGDG

SEQ ID NO: 2303590 - protein, 20 aa, Cryptosporidium parvum
SEFCDSRFNPFHDLKNIILE

SEQ ID NO: 2303591 - protein, 19 aa, Cryptosporidium parvum
SEFIKSRLTSVPLTSCNLL

SEQ ID NO: 2303592 - protein, 17 aa, Cryptosporidium parvum
SEFIPPALELYPLPFPK

SEQ ID NO: 2303593 - protein, 21 aa, Cryptosporidium parvum
SEFKQKGWCQFQSLDDISACV

SEQ ID NO: 2303594 - protein, 22 aa, Cryptosporidium parvum
SEFKTALLTGVTGFVGRILLVK

SEQ ID NO: 2303595 - protein, 17 aa, Cryptosporidium parvum
SEFLRYLLTNIDDNCSP

SEQ ID NO: 2303596 - protein, 17 aa, Cryptosporidium parvum
SEFSIKDDFAMEMNNSV

SEQ ID NO: 2303597 - protein, 22 aa, Cryptosporidium parvum
SEFSNRLENHFIQLEQLSEHLN

SEQ ID NO: 2303598 - protein, 22 aa, Cryptosporidium parvum
SEFTSRFSFFSSCEIELILESM

SEQ ID NO: 2303599 - protein, 25 aa, Cryptosporidium parvum
SEFTSSCFISIWSIPSLKEIYSFNC

SEQ ID NO: 2303600 - protein, 17 aa, Cryptosporidium parvum
SEFWGTIVEHLETEIFE

SEQ ID NO: 2303601 - protein, 18 aa, Cryptosporidium parvum
SEFWNIFNPNSIIIDPSI

SEQ ID NO: 2303602 - protein, 20 aa, Cryptosporidium parvum
SEGAWLYRWEYIPESIDNLF

SEQ ID NO: 2303603 - protein, 26 aa, Cryptosporidium parvum
SEGEKKVPVAFGLFKLQMGATIIDDL

SEQ ID NO: 2303604 - protein, 21 aa, Cryptosporidium parvum
SEGKYLWPFMYSYSNGYFILI

SEQ ID NO: 2303605 - protein, 22 aa, Cryptosporidium parvum
SEHISRLLSVLLEEFKSMGKEK

SEQ ID NO: 2303606 - protein, 18 aa, Cryptosporidium parvum
SEIGCCFAGMPADFRVIL

SEQ ID NO: 2303607 - protein, 19 aa, Cryptosporidium parvum
SEIGLGLNPDATLKMADSC

SEQ ID NO: 2303608 - protein, 22 aa, Cryptosporidium parvum
SEIGVGPSPKVDITVKRKELSE

SEQ ID NO: 2303609 - protein, 24 aa, Cryptosporidium parvum
SEIKKSYRKLALKWHPDKNPDNRE

SEQ ID NO: 2303610 - protein, 18 aa, Cryptosporidium parvum
SEILDFYSPLLINTIIIH

SEQ ID NO: 2303611 - protein, 17 aa, Cryptosporidium parvum
SEIRRRLHFSRQKSDIM

SEQ ID NO: 2303612 - protein, 19 aa, Cryptosporidium parvum
SEIRWLFDGYLSSDLSELR

SEQ ID NO: 2303613 - protein, 17 aa, Cryptosporidium parvum
SEISLSSLNSWVTFFES

SEQ ID NO: 2303614 - protein, 25 aa, Cryptosporidium parvum
SEIYFKLIEFCPINRELLCETKTID

SEQ ID NO: 2303615 - protein, 18 aa, Cryptosporidium parvum
SEIYRKTMLQQHAVDVLD

SEQ ID NO: 2303616 - protein, 27 aa, Cryptosporidium parvum
SEKAIKWRRIFKTLVLVEYLLKNGIDR

SEQ ID NO: 2303617 - protein, 24 aa, Cryptosporidium parvum
SEKARLRKGITILGGTPGRILDHI

SEQ ID NO: 2303618 - protein, 17 aa, Cryptosporidium parvum
SEKGGQIIISFTQLLPV

SEQ ID NO: 2303619 - protein, 21 aa, Cryptosporidium parvum
SEKKVVWSPIMFTIMQPSLNM

SEQ ID NO: 2303620 - protein, 26 aa, Cryptosporidium parvum
SEKQTDLLQNQHIFKKYTTTTTTPAN

SEQ ID NO: 2303621 - protein, 23 aa, Cryptosporidium parvum
SEKRLKKNRKYRIKKDAINTEFE

SEQ ID NO: 2303622 - protein, 17 aa, Cryptosporidium parvum
SEKSFMKKLKFILFQQQ

SEQ ID NO: 2303623 - protein, 17 aa, Cryptosporidium parvum
SELEAWATIGSFRKDPI

SEQ ID NO: 2303624 - protein, 27 aa, Cryptosporidium parvum
SELESIVRWSCRLLNISNFRNIPIQIG

SEQ ID NO: 2303625 - protein, 18 aa, Cryptosporidium parvum
SELFKKLLDEISIEANVR

SEQ ID NO: 2303626 - protein, 25 aa, Cryptosporidium parvum
SELHTRINTWTGYVEPLLQAQNSRP

SEQ ID NO: 2303627 - protein, 18 aa, Cryptosporidium parvum
SELIFICVKPHILSQILS

SEQ ID NO: 2303628 - protein, 25 aa, Cryptosporidium parvum
SELILPERVNFYFAALRILHQLKRK

SEQ ID NO: 2303629 - protein, 25 aa, Cryptosporidium parvum
SELIPRGKQVLGFDIGIGANCIFSL

SEQ ID NO: 2303630 - protein, 30 aa, Cryptosporidium parvum
SELKSTASICFNCLSLTLPSIIETTMGISN

SEQ ID NO: 2303631 - protein, 17 aa, Cryptosporidium parvum
SELLDMIYHPNYPDYSN

SEQ ID NO: 2303632 - protein, 19 aa, Cryptosporidium parvum
SELLVIGWEALKKGESVLV

SEQ ID NO: 2303633 - protein, 21 aa, Cryptosporidium parvum
SELQLQLVGIMDMFMATSPAS

SEQ ID NO: 2303634 - protein, 20 aa, Cryptosporidium parvum
SELQRGIGYVCRKGLKPESP

SEQ ID NO: 2303635 - protein, 17 aa, Cryptosporidium parvum
SELRLLLEDRMRTYPSG

SEQ ID NO: 2303636 - protein, 24 aa, Cryptosporidium parvum
SELRRRHSNELQRFETIIDDLKKK

SEQ ID NO: 2303637 - protein, 22 aa, Cryptosporidium parvum
SELSLPPGGPIIQKSELYGRSS

SEQ ID NO: 2303638 - protein, 23 aa, Cryptosporidium parvum
SELTMPIQVPMYIIGGGISTILL

SEQ ID NO: 2303639 - protein, 21 aa, Cryptosporidium parvum
SELVLIFGLLSLYSIWGKKQK

SEQ ID NO: 2303640 - protein, 21 aa, Cryptosporidium parvum
SENAVKYEVWKECVTSVEKYL

SEQ ID NO: 2303641 - protein, 20 aa, Cryptosporidium parvum
SENCKYCRANLTGKSGNASG

SEQ ID NO: 2303642 - protein, 18 aa, Cryptosporidium parvum
SENLREIVKSVPYNIKII

SEQ ID NO: 2303643 - protein, 24 aa, Cryptosporidium parvum
SENNFCFSHSFGIAENASINLDRF

SEQ ID NO: 2303644 - protein, 22 aa, Cryptosporidium parvum
SENPCTFRDLYFYKHSEESTIE

SEQ ID NO: 2303645 - protein, 25 aa, Cryptosporidium parvum
SENQLKISYILVRVLAQLRMIESIL

SEQ ID NO: 2303646 - protein, 22 aa, Cryptosporidium parvum
SENREIYSSYCMDHETKANSIE

SEQ ID NO: 2303647 - protein, 25 aa, Cryptosporidium parvum
SEPAFYRQHFSIFFPQILNIAKNIQ

SEQ ID NO: 2303648 - protein, 18 aa, Cryptosporidium parvum
SEPLTGIVPRHLISSKVF

SEQ ID NO: 2303649 - protein, 19 aa, Cryptosporidium parvum
SEPRTSSIITKSNMNHNNN

SEQ ID NO: 2303650 - protein, 17 aa, Cryptosporidium parvum
SEQCLVVLDSVYDKLIS

SEQ ID NO: 2303651 - protein, 21 aa, Cryptosporidium parvum
SEQQSGFILNFNFAPNPFFEG

SEQ ID NO: 2303652 - protein, 25 aa, Cryptosporidium parvum
SEQSRAESGLLLLTEKVIEYAKQSP

SEQ ID NO: 2303653 - protein, 26 aa, Cryptosporidium parvum
SEQYFSESLPIWGILETPEIIKLPRY

SEQ ID NO: 2303654 - protein, 28 aa, Cryptosporidium parvum
SERDKAMCFSPAFKLKFSHNAFVSLGSL

SEQ ID NO: 2303655 - protein, 20 aa, Cryptosporidium parvum
SERLHICLDKRYRPFIIQFV

SEQ ID NO: 2303656 - protein, 18 aa, Cryptosporidium parvum
SERNGISMYESWAESNRQ

SEQ ID NO: 2303657 - protein, 26 aa, Cryptosporidium parvum
SESFSIGGNCMMDWHIKKSVFENIFP

SEQ ID NO: 2303658 - protein, 27 aa, Cryptosporidium parvum
SESGFEPFGPWLVTPLFLGAKGGGGSQ

SEQ ID NO: 2303659 - protein, 24 aa, Cryptosporidium parvum
SESIKLAQELSLRLEISEPNSKSS

SEQ ID NO: 2303660 - protein, 18 aa, Cryptosporidium parvum
SESKLAKDNLEWSKQCND

SEQ ID NO: 2303661 - protein, 18 aa, Cryptosporidium parvum
SESLPCVIYLHGNCSSRR

SEQ ID NO: 2303662 - protein, 26 aa, Cryptosporidium parvum
SESNINIPLKWPYLLNITISKDISRS

SEQ ID NO: 2303663 - protein, 21 aa, Cryptosporidium parvum
SESPFCLLFGFKEEKSNNYGT

SEQ ID NO: 2303664 - protein, 23 aa, Cryptosporidium parvum
SESRACIFGSKTSRMLQITINYF

SEQ ID NO: 2303665 - protein, 25 aa, Cryptosporidium parvum
SESSARFILKQVVEALIYMHQKEII

SEQ ID NO: 2303666 - protein, 31 aa, Cryptosporidium parvum
SESSKYKWLFRWLPYYYKFGMGYQISKVISK

SEQ ID NO: 2303667 - protein, 31 aa, Cryptosporidium parvum; identical to SEQ ID NO: 2181153

SEQ ID NO: 2303668 - protein, 20 aa, Cryptosporidium parvum
SETFQGRLTRRFKEKANKKS

SEQ ID NO: 2303669 - protein, 20 aa, Cryptosporidium parvum
SETGWCPDLIMNPHGFPSRM

SEQ ID NO: 2303670 - protein, 27 aa, Cryptosporidium parvum
SETIMYPYFAKWIRSHRDLPLKINQWT

SEQ ID NO: 2303671 - protein, 37 aa, Cryptosporidium parvum
SETISSSSFLFWLVNNCLKFETRKIVVVTHSNSITQK

SEQ ID NO: 2303672 - protein, 20 aa, Cryptosporidium parvum
SETLKLTFLFVREDEKLASL

SEQ ID NO: 2303673 - protein, 20 aa, Cryptosporidium parvum
SETLPRYEVLETDKNFNNKT

SEQ ID NO: 2303674 - protein, 28 aa, Cryptosporidium parvum
SETLSEWRNELLLAILEKISESKMFQDT

SEQ ID NO: 2303675 - protein, 18 aa, Cryptosporidium parvum
SETNKIWTGDEVRRQFVK

SEQ ID NO: 2303676 - protein, 25 aa, Cryptosporidium parvum
SETYTYIRHTFSWMNNQFGMKLIAP

SEQ ID NO: 2303677 - protein, 22 aa, Cryptosporidium parvum
SEVCTRCKLPIVEEEVIYSCEL

SEQ ID NO: 2303678 - protein, 18 aa, Cryptosporidium parvum
SEVDPKFCNYDMVSRIMR

SEQ ID NO: 2303679 - protein, 20 aa, Cryptosporidium parvum
SEVGLHCGYSNISIDKPSID

SEQ ID NO: 2303680 - protein, 25 aa, Cryptosporidium parvum
SEVTRKRLVILLQTFGDKMTEDEIN

SEQ ID NO: 2303681 - protein, 18 aa, Cryptosporidium parvum
SEVYCLPDGTFAVLKDAK

SEQ ID NO: 2303682 - protein, 20 aa, Cryptosporidium parvum
SEWFSILLFHQNRKKGNFGG

SEQ ID NO: 2303683 - protein, 20 aa, Cryptosporidium parvum
SEWMGFYLLHEGMLDSVIFA

SEQ ID NO: 2303684 - protein, 23 aa, Cryptosporidium parvum
SEWMGYCLLYESMLYTILDARNR

SEQ ID NO: 2303685 - protein, 18 aa, Cryptosporidium parvum
SEYDCLSFESSEFQNKEN

SEQ ID NO: 2303686 - protein, 17 aa, Cryptosporidium parvum
SEYEVMEKTLIQRKEQL

SEQ ID NO: 2303687 - protein, 18 aa, Cryptosporidium parvum
SEYKIAFPHFYNSLPKFV

SEQ ID NO: 2303688 - protein, 28 aa, Cryptosporidium parvum
SEYLLERLKWKIALRIYYTLDPNDKGYI

SEQ ID NO: 2303689 - protein, 24 aa, Cryptosporidium parvum
SEYRNIPQGLTWIKVVNDRIFAGD

SEQ ID NO: 2303690 - protein, 20 aa, Cryptosporidium parvum
SFACKSDLPGFIKNTQKEGV

SEQ ID NO: 2303691 - protein, 34 aa, Cryptosporidium parvum
SFADFKLAAEAFWKMGALPPTFSGFGPQVPQNIN

SEQ ID NO: 2303692 - protein, 25 aa, Cryptosporidium parvum
SFALSCLYNRLNFVRNVLPDCTYTL

SEQ ID NO: 2303693 - protein, 19 aa, Cryptosporidium parvum
SFCISSWYFDVHYLTNSEE

SEQ ID NO: 2303694 - protein, 20 aa, Cryptosporidium parvum
SFCKDSCFAQAWSVGTILYF

SEQ ID NO: 2303695 - protein, 18 aa, Cryptosporidium parvum
SFCKGYRSIGERRVPFNF

SEQ ID NO: 2303696 - protein, 29 aa, Cryptosporidium parvum
SFDAAMPIWMIKRFVDLFNASRTTYCYVS

SEQ ID NO: 2303697 - protein, 28 aa, Cryptosporidium parvum
SFDKHIKWRKEFNMDNVVRPYVITNMVP

SEQ ID NO: 2303698 - protein, 27 aa, Cryptosporidium parvum
SFDKSLKVWSLKSRSHMNTYYGHTNKI

SEQ ID NO: 2303699 - protein, 26 aa, Cryptosporidium parvum
SFDPIFMKKCFQRLCGELEMTQNSQY

SEQ ID NO: 2303700 - protein, 25 aa, Cryptosporidium parvum
SFDPSKRISLGFSNLSKGGIKIQSS

SEQ ID NO: 2303701 - protein, 26 aa, Cryptosporidium parvum
SFDRSRLLTRFVIKLILELNDKNKSQ

SEQ ID NO: 2303702 - protein, 24 aa, Cryptosporidium parvum
SFELFKNYITICSIKYKSANQSKS

SEQ ID NO: 2303703 - protein, 19 aa, Cryptosporidium parvum
SFERACFILKIGENDKNHQ

SEQ ID NO: 2303704 - protein, 19 aa, Cryptosporidium parvum
SFESLKLPQFEDSSSSYAE

SEQ ID NO: 2303705 - protein, 22 aa, Cryptosporidium parvum
SFFQSCIIQNGLLGLVQALPHI

SEQ ID NO: 2303706 - protein, 20 aa, Cryptosporidium parvum
SFGDLRLIRRCEIDAVSKRH

SEQ ID NO: 2303707 - protein, 19 aa, Cryptosporidium parvum
SFGGDEVFVTGSFNFWRKQ

SEQ ID NO: 2303708 - protein, 18 aa, Cryptosporidium parvum
SFHPYSCSQSSKSTVSTN

SEQ ID NO: 2303709 - protein, 20 aa, Cryptosporidium parvum
SFIDLKWILDSSISVKLKRK

SEQ ID NO: 2303710 - protein, 17 aa, Cryptosporidium parvum
SFIEREGLIPALINKKG

SEQ ID NO: 2303711 - protein, 26 aa, Cryptosporidium parvum
SFIIKSSQCPIIFSCRMAIVNNSKKE

SEQ ID NO: 2303712 - protein, 28 aa, Cryptosporidium parvum
SFIKRSLVESFGMEWKAKINMNTDTKYK

SEQ ID NO: 2303713 - protein, 20 aa, Cryptosporidium parvum
SFINYRGYNYLRLDGSTKVD

SEQ ID NO: 2303714 - protein, 21 aa, Cryptosporidium parvum
SFKKFMEWFEQIYFNSVLFLY

SEQ ID NO: 2303715 - protein, 25 aa, Cryptosporidium parvum
SFKTNKRAGFSFKNFFSKYFGIKKH

SEQ ID NO: 2303716 - protein, 19 aa, Cryptosporidium parvum
SFLPISCEFPESLLPINGV

SEQ ID NO: 2303717 - protein, 17 aa, Cryptosporidium parvum
SFLPPVMLENLPWLHHI

SEQ ID NO: 2303718 - protein, 26 aa, Cryptosporidium parvum
SFLQLQICGVSSCAHSLIQKIHQLLD

SEQ ID NO: 2303719 - protein, 26 aa, Cryptosporidium parvum
SFLSDLYACMSIGQSIIFVNTRKTAF

SEQ ID NO: 2303720 - protein, 25 aa, Cryptosporidium parvum
SFLSTCKEWLHYYLFSYVSYIDSCM

SEQ ID NO: 2303721 - protein, 22 aa, Cryptosporidium parvum
SFMSMGGSIPGGFDFSTISKQL

SEQ ID NO: 2303722 - protein, 22 aa, Cryptosporidium parvum
SFNDSWVLYSLLWTSSIQHDAC

SEQ ID NO: 2303723 - protein, 26 aa, Cryptosporidium parvum
SFNEICNMFIYNGCWEGLIVYLTCKL

SEQ ID NO: 2303724 - protein, 17 aa, Cryptosporidium parvum
SFNFQIPDLRKFRKGLP

SEQ ID NO: 2303725 - protein, 23 aa, Cryptosporidium parvum
SFNKECRTIFVGDLYINRSKSNY

SEQ ID NO: 2303726 - protein, 18 aa, Cryptosporidium parvum
SFNKSWNLFFSKFLNGFR

SEQ ID NO: 2303727 - protein, 18 aa, Cryptosporidium parvum
SFNNCLRYNQFYFSEKNN

SEQ ID NO: 2303728 - protein, 20 aa, Cryptosporidium parvum
SFNNFFLIRETCGFSSNNEC

SEQ ID NO: 2303729 - protein, 26 aa, Cryptosporidium parvum
SFNNRKLYPAFVINIHLPQSLLDINV

SEQ ID NO: 2303730 - protein, 21 aa, Cryptosporidium parvum
SFNNTCSWVQYNVLTDSIDHV

SEQ ID NO: 2303731 - protein, 25 aa, Cryptosporidium parvum
SFPLPPRYAKILLLTTAYIRKNLIS

SEQ ID NO: 2303732 - protein, 18 aa, Cryptosporidium parvum
SFPPPPPYFRLFDHEDKV

SEQ ID NO: 2303733 - protein, 18 aa, Cryptosporidium parvum
SFPTDRSFIHILIGVIFT

SEQ ID NO: 2303734 - protein, 31 aa, Cryptosporidium parvum
SFRRKCLPIDLLCKGPLKIEVWNRSDTSSIL

SEQ ID NO: 2303735 - protein, 23 aa, Cryptosporidium parvum
SFRSNLDYAKWVIEKGADVNAKD

SEQ ID NO: 2303736 - protein, 19 aa, Cryptosporidium parvum
SFRYPEIKIGMGRGNPNSN

SEQ ID NO: 2303737 - protein, 27 aa, Cryptosporidium parvum
SFSECLPCKIPFLFNISKVIVPHFNSN

SEQ ID NO: 2303738 - protein, 17 aa, Cryptosporidium parvum
SFSEGGLYVNLKNFEAY

SEQ ID NO: 2303739 - protein, 24 aa, Cryptosporidium parvum
SFSFPRVSTAPVIKNMQVEQTYLM

SEQ ID NO: 2303740 - protein, 21 aa, Cryptosporidium parvum
SFSIKCFLCQKDIGIGRNYLE

SEQ ID NO: 2303741 - protein, 18 aa, Cryptosporidium parvum
SFSIKWWPLNEKFYKHEK

SEQ ID NO: 2303742 - protein, 24 aa, Cryptosporidium parvum
SFSLLKFGETFFRSENYDSDTVIT

SEQ ID NO: 2303743 - protein, 18 aa, Cryptosporidium parvum
SFSRYQIKEVHQIHVDLR

SEQ ID NO: 2303744 - protein, 18 aa, Cryptosporidium parvum
SFSSDKFKYIVINTKNNF

SEQ ID NO: 2303745 - protein, 19 aa, Cryptosporidium parvum
SFSSFKVYIQDVITYSNNS

SEQ ID NO: 2303746 - protein, 18 aa, Cryptosporidium parvum
SFSSLKVNLDPGYFSKQK

SEQ ID NO: 2303747 - protein, 19 aa, Cryptosporidium parvum
SFSTLPLFFGNFVPNIDFL

SEQ ID NO: 2303748 - protein, 24 aa, Cryptosporidium parvum
SFTENRIKRCLNFIQPIEFEKDDD

SEQ ID NO: 2303749 - protein, 19 aa, Cryptosporidium parvum
SFTHLFSIINYERIINNCG

SEQ ID NO: 2303750 - protein, 25 aa, Cryptosporidium parvum
SFTHVLGLCKPCVFVNKTNKKCRNG

SEQ ID NO: 2303751 - protein, 23 aa, Cryptosporidium parvum
SFTQRNRIGIITGDVSINPDAQC

SEQ ID NO: 2303752 - protein, 27 aa, Cryptosporidium parvum
SFTRLVLNYCKYEWATYKSFFCCQETL

SEQ ID NO: 2303753 - protein, 25 aa, Cryptosporidium parvum
SFTRRDIIRIYSRFKALDTNQNGEL

SEQ ID NO: 2303754 - protein, 26 aa, Cryptosporidium parvum
SFVACETCTKTGFIMVFGEITTKANV

SEQ ID NO: 2303755 - protein, 20 aa, Cryptosporidium parvum
SFVDCFRIEQDYSQEELDLL

SEQ ID NO: 2303756 - protein, 21 aa, Cryptosporidium parvum
SFVEWKDEDDFWSESEINSDN

SEQ ID NO: 2303757 - protein, 19 aa, Cryptosporidium parvum
SFVKGTLILPNRLRYLQKR

SEQ ID NO: 2303758 - protein, 18 aa, Cryptosporidium parvum
SFVTGCRDFFIIDKKHST

SEQ ID NO: 2303759 - protein, 19 aa, Cryptosporidium parvum
SGAFASVGMPGMYELDPNM

SEQ ID NO: 2303760 - protein, 22 aa, Cryptosporidium parvum
SGAKLIARGYFRHKCGHTYCNE

SEQ ID NO: 2303761 - protein, 18 aa, Cryptosporidium parvum
SGAYMARLVAKSIVFSGL

SEQ ID NO: 2303762 - protein, 19 aa, Cryptosporidium parvum
SGDCKRVMGAHGITIMGDK

SEQ ID NO: 2303763 - protein, 18 aa, Cryptosporidium parvum
SGDDFPKYPMYSFAGGIL

SEQ ID NO: 2303764 - protein, 25 aa, Cryptosporidium parvum
SGDDVIRLYKACDAVVVPSRNEPFG

SEQ ID NO: 2303765 - protein, 29 aa, Cryptosporidium parvum
SGDINGKVHFWDWKTTKNFRSFNAHEGVS

SEQ ID NO: 2303766 - protein, 26 aa, Cryptosporidium parvum
SGDRKGNICFWQPIQGGSWSVNPVHG

SEQ ID NO: 2303767 - protein, 18 aa, Cryptosporidium parvum
SGEGIPSIVHYVTAICGH

SEQ ID NO: 2303768 - protein, 22 aa, Cryptosporidium parvum
SGELPPPLPPSFGELPLPPPPP

SEQ ID NO: 2303769 - protein, 23 aa, Cryptosporidium parvum
SGENGRIYASVGYESCSGGITEG

SEQ ID NO: 2303770 - protein, 19 aa, Cryptosporidium parvum
SGESCSFGSSSNVSEDLNS

SEQ ID NO: 2303771 - protein, 19 aa, Cryptosporidium parvum
SGESKVLIATDVLSRGIDV

SEQ ID NO: 2303772 - protein, 23 aa, Cryptosporidium parvum
SGETPINVSNTFSLNNGSVKDYQ

SEQ ID NO: 2303773 - protein, 23 aa, Cryptosporidium parvum
SGETRLSDFLIYQVCHNTRIYFV

SEQ ID NO: 2303774 - protein, 25 aa, Cryptosporidium parvum
SGEVSKILLMEAFAYNKHKQGESIH

SEQ ID NO: 2303775 - protein, 21 aa, Cryptosporidium parvum
SGEWFCPRCIRGRRRRTNNRR

SEQ ID NO: 2303776 - protein, 19 aa, Cryptosporidium parvum
SGEYAWAKKMQKLYGASIA

SEQ ID NO: 2303777 - protein, 19 aa, Cryptosporidium parvum
SGFTGFCTGLIKGVTSSVV

SEQ ID NO: 2303778 - protein, 21 aa, Cryptosporidium parvum
SGGARLNYVFHNWFGNTLFNF

SEQ ID NO: 2303779 - protein, 25 aa, Cryptosporidium parvum
SGGESLANLCLRIERVLDNLSQNCG

SEQ ID NO: 2303780 - protein, 19 aa, Cryptosporidium parvum
SGGIQVYFDECLKDKKVFV

SEQ ID NO: 2303781 - protein, 18 aa, Cryptosporidium parvum
SGGQLLVKYQHGIDKEIA

SEQ ID NO: 2303782 - protein, 37 aa, Cryptosporidium parvum; identical to SEQ ID NO: 2181251

SEQ ID NO: 2303783 - protein, 17 aa, Cryptosporidium parvum
SGGRLCQCEYILNEILE

SEQ ID NO: 2303784 - protein, 21 aa, Cryptosporidium parvum
SGHFNSWLSIEFLSFKKFMEW

SEQ ID NO: 2303785 - protein, 18 aa, Cryptosporidium parvum
SGICSGINPSKWGGSVLP

SEQ ID NO: 2303786 - protein, 26 aa, Cryptosporidium parvum
SGIDPRLSEYYLIYADVLFEKEENST

SEQ ID NO: 2303787 - protein, 22 aa, Cryptosporidium parvum
SGIERLLFFQVLQLFHQIDLNN

SEQ ID NO: 2303788 - protein, 17 aa, Cryptosporidium parvum
SGIFVLFNFKLKFNKEI

SEQ ID NO: 2303789 - protein, 17 aa, Cryptosporidium parvum
SGIGYSFCRSLVRKTHN

SEQ ID NO: 2303790 - protein, 20 aa, Cryptosporidium parvum
SGIHNIHLYGPYLYNRKIYT

SEQ ID NO: 2303791 - protein, 25 aa, Cryptosporidium parvum
SGIHREIFLRNSILQIFRNFTDLIG

SEQ ID NO: 2303792 - protein, 18 aa, Cryptosporidium parvum
SGIITRRTDILTKFKSLY

SEQ ID NO: 2303793 - protein, 27 aa, Cryptosporidium parvum
SGILFYEFRLPIIYHIIYLLEILRICI

SEQ ID NO: 2303794 - protein, 18 aa, Cryptosporidium parvum
SGIPNLLVLGDYCEGALL

SEQ ID NO: 2303795 - protein, 17 aa, Cryptosporidium parvum
SGISCSINLDSGHLLHI

SEQ ID NO: 2303796 - protein, 19 aa, Cryptosporidium parvum
SGISSGLCNRDFNMDILED

SEQ ID NO: 2303797 - protein, 17 aa, Cryptosporidium parvum
SGISVDIVLDFLCEWKD

SEQ ID NO: 2303798 - protein, 27 aa, Cryptosporidium parvum
SGKAFPQCVFDHWELINGDPLEKGSKT

SEQ ID NO: 2303799 - protein, 17 aa, Cryptosporidium parvum
SGKELILALIQYYLENN

SEQ ID NO: 2303800 - protein, 19 aa, Cryptosporidium parvum
SGKLYLLSRLLFHIRSNTK

SEQ ID NO: 2303801 - protein, 20 aa, Cryptosporidium parvum
SGKQMDWLGLMEGRVYINEN

SEQ ID NO: 2303802 - protein, 19 aa, Cryptosporidium parvum
SGKQTIVFHMLPDCESNNS

SEQ ID NO: 2303803 - protein, 24 aa, Cryptosporidium parvum
SGKSSVACGIAISLGYDTHILARG

SEQ ID NO: 2303804 - protein, 21 aa, Cryptosporidium parvum
SGKYCIGGPIYTGKLYDDDFV

SEQ ID NO: 2303805 - protein, 24 aa, Cryptosporidium parvum
SGLDEKIRVIKYLWETKRDFNIHE

SEQ ID NO: 2303806 - protein, 23 aa, Cryptosporidium parvum
SGLGPRKAKSLAFYLDSHPGPIS

SEQ ID NO: 2303807 - protein, 23 aa, Cryptosporidium parvum
SGLKELNPYYVLQGDSFSSSKIC

SEQ ID NO: 2303808 - protein, 31 aa, Cryptosporidium parvum
SGLMCKSITPLRERICLACRKNSLLRHNNQK

SEQ ID NO: 2303809 - protein, 17 aa, Cryptosporidium parvum
SGLWVSNLIAMHSRMSQ

SEQ ID NO: 2303810 - protein, 25 aa, Cryptosporidium parvum
SGMGADILHALGFNKTSNSDNSDTA

SEQ ID NO: 2303811 - protein, 19 aa, Cryptosporidium parvum
SGNARLLFDDNLAKKVNEL

SEQ ID NO: 2303812 - protein, 18 aa, Cryptosporidium parvum
SGNEIFLGIKYTIIGLGS

SEQ ID NO: 2303813 - protein, 17 aa, Cryptosporidium parvum
SGNGNWSPTTLGVGGPN

SEQ ID NO: 2303814 - protein, 17 aa, Cryptosporidium parvum
SGNKFILTCPSKFRTAF

SEQ ID NO: 2303815 - protein, 25 aa, Cryptosporidium parvum
SGNKRPRHFFCFSCNQFKPRSTKAR

SEQ ID NO: 2303816 - protein, 21 aa, Cryptosporidium parvum
SGNPLVLCNNILKNMSAQLGD

SEQ ID NO: 2303817 - protein, 37 aa, Cryptosporidium parvum; identical to SEQ ID NO: 2181286

SEQ ID NO: 2303818 - protein, 22 aa, Cryptosporidium parvum
SGPLEDRKDVFFYLSDDSHYVP

SEQ ID NO: 2303819 - protein, 32 aa, Cryptosporidium parvum
SGRAGRVRPGKCFRLYTKLSFTTEMEVSNVPE

SEQ ID NO: 2303820 - protein, 22 aa, Cryptosporidium parvum
SGRFKHISNFIGIESPNLVLNK

SEQ ID NO: 2303821 - protein, 24 aa, Cryptosporidium parvum
SGRKCVLDTDISPVLEKRIRAKIV

SEQ ID NO: 2303822 - protein, 27 aa, Cryptosporidium parvum
SGRMKVLLFRFPDYFGSESLRFFDSED

SEQ ID NO: 2303823 - protein, 24 aa, Cryptosporidium parvum
SGRRQPPLNLFPFNFGVGNSTNNR

SEQ ID NO: 2303824 - protein, 19 aa, Cryptosporidium parvum
SGSDGPHMFGTSIKNNSDR

SEQ ID NO: 2303825 - protein, 30 aa, Cryptosporidium parvum
SGSNSICIIEFIFSCLKTIYPLNSKLLEAI

SEQ ID NO: 2303826 - protein, 23 aa, Cryptosporidium parvum
SGSSISTSIVNWAEKNNVSERAN

SEQ ID NO: 2303827 - protein, 18 aa, Cryptosporidium parvum
SGSSITYTIFLFVNPTSG

SEQ ID NO: 2303828 - protein, 31 aa, Cryptosporidium parvum; identical to SEQ ID NO: 2181301

SEQ ID NO: 2303829 - protein, 25 aa, Cryptosporidium parvum
SGTCFSLFVRWNLGIDDVLYPNIPK

SEQ ID NO: 2303830 - protein, 19 aa, Cryptosporidium parvum
SGTFDGIICIAVLHHLSTP

SEQ ID NO: 2303831 - protein, 24 aa, Cryptosporidium parvum
SGTGLFGPGSLVWIPCPKEVWRPG

SEQ ID NO: 2303832 - protein, 18 aa, Cryptosporidium parvum
SGTMPTLFNKSNLSENNM

SEQ ID NO: 2303833 - protein, 20 aa, Cryptosporidium parvum
SGTMPVPLAVGFGEACKIAS

SEQ ID NO: 2303834 - protein, 24 aa, Cryptosporidium parvum
SGVDYKGLLACLDDRMNIAMEDTE

SEQ ID NO: 2303835 - protein, 18 aa, Cryptosporidium parvum
SGVGTMFYMAPEQCKGNF

SEQ ID NO: 2303836 - protein, 20 aa, Cryptosporidium parvum
SGVSGLGRRVMISNRRLLTP

SEQ ID NO: 2303837 - protein, 18 aa, Cryptosporidium parvum
SGYDFRTLNNFGVVEDIS

SEQ ID NO: 2303838 - protein, 19 aa, Cryptosporidium parvum
SGYKEAWKKGENRYGDKWE

SEQ ID NO: 2303839 - protein, 26 aa, Cryptosporidium parvum
SGYLKKWSPVIGRGWQSRYFALLEQD

SEQ ID NO: 2303840 - protein, 24 aa, Cryptosporidium parvum
SHANSFPLGLSYNVSNRRYDLNPR

SEQ ID NO: 2303841 - protein, 25 aa, Cryptosporidium parvum
SHAQKYFLKKVRGIAPSTLTMDSKL

SEQ ID NO: 2303842 - protein, 19 aa, Cryptosporidium parvum
SHCQIPYSLSTYGNSCGVS

SEQ ID NO: 2303843 - protein, 24 aa, Cryptosporidium parvum
SHCTEFPGNFIFFLAAAVSDFYIP

SEQ ID NO: 2303844 - protein, 19 aa, Cryptosporidium parvum
SHDIMKYITLFIPDNYKGM

SEQ ID NO: 2303845 - protein, 26 aa, Cryptosporidium parvum
SHDPYKRLLVFFKWLFNSLNRGSRAV

SEQ ID NO: 2303846 - protein, 27 aa, Cryptosporidium parvum
SHDSNGIYPWVWCDLVTDQDTATPYNS

SEQ ID NO: 2303847 - protein, 23 aa, Cryptosporidium parvum
SHEKLLLQRGIEFLKKKLYTLKN

SEQ ID NO: 2303848 - protein, 18 aa, Cryptosporidium parvum
SHEPCISCSMALVHSRIS

SEQ ID NO: 2303849 - protein, 21 aa, Cryptosporidium parvum
SHERNIICLTFRGQPKRWVFC

SEQ ID NO: 2303850 - protein, 20 aa, Cryptosporidium parvum
SHEVVAWIKKILRCEKTGHS

SEQ ID NO: 2303851 - protein, 17 aa, Cryptosporidium parvum
SHFKTFGEECGKKAIRQ

SEQ ID NO: 2303852 - protein, 18 aa, Cryptosporidium parvum
SHFSECLTQFKWINTQGM

SEQ ID NO: 2303853 - protein, 19 aa, Cryptosporidium parvum
SHGEIRFSLLAVVPDKISV

SEQ ID NO: 2303854 - protein, 25 aa, Cryptosporidium parvum
SHGKEIKFILSMMLFHQSFLNFISI

SEQ ID NO: 2303855 - protein, 24 aa, Cryptosporidium parvum
SHGPKLPLMVTLGIQYAQGYCDIL

SEQ ID NO: 2303856 - protein, 32 aa, Cryptosporidium parvum; identical to SEQ ID NO: 2181326

SEQ ID NO: 2303857 - protein, 24 aa, Cryptosporidium parvum
SHICDKIRLIGCMDSEVLRTKIYC

SEQ ID NO: 2303858 - protein, 20 aa, Cryptosporidium parvum
SHIQGCLTAPVSVDNCEVSS

SEQ ID NO: 2303859 - protein, 23 aa, Cryptosporidium parvum
SHLKEKPKWIIFTDIIQTKKTYI

SEQ ID NO: 2303860 - protein, 21 aa, Cryptosporidium parvum
SHLKIPLKFIYIGYNISQILS

SEQ ID NO: 2303861 - protein, 17 aa, Cryptosporidium parvum
SHLNFDFSRGMRTLSAP

SEQ ID NO: 2303862 - protein, 20 aa, Cryptosporidium parvum
SHLRYRNALEIERSNHTSEL

SEQ ID NO: 2303863 - protein, 25 aa, Cryptosporidium parvum
SHNFIYHIIKLLGYGYYGTVFLAKM

SEQ ID NO: 2303864 - protein, 17 aa, Cryptosporidium parvum
SHNVAGCCLEWLGDSSN

SEQ ID NO: 2303865 - protein, 26 aa, Cryptosporidium parvum
SHNVYWPRRCPFYLSDRSALRYLPDI

SEQ ID NO: 2303866 - protein, 20 aa, Cryptosporidium parvum
SHPFKLHIHDLIKDVWHSSI

SEQ ID NO: 2303867 - protein, 20 aa, Cryptosporidium parvum
SHPGFGCWFSGTDVSTQQSF

SEQ ID NO: 2303868 - protein, 18 aa, Cryptosporidium parvum
SHPHPSKVHYGGEDAHFY

SEQ ID NO: 2303869 - protein, 23 aa, Cryptosporidium parvum
SHQRLRSRMLMVASHRQDQTKRI

SEQ ID NO: 2303870 - protein, 24 aa, Cryptosporidium parvum
SHQYKLQIFKFLNIKIPIKCDDQI

SEQ ID NO: 2303871 - protein, 17 aa, Cryptosporidium parvum
SHSDLVIHFGYSCYHNI

SEQ ID NO: 2303872 - protein, 18 aa, Cryptosporidium parvum
SHSFCISCVRGSHECPIC

SEQ ID NO: 2303873 - protein, 23 aa, Cryptosporidium parvum
SHSINKIFLAIGIHSHESPISQI

SEQ ID NO: 2303874 - protein, 31 aa, Cryptosporidium parvum; identical to SEQ ID NO: 2181345

SEQ ID NO: 2303875 - protein, 31 aa, Cryptosporidium parvum
SHSLETICLLFALKIRYPRQIHLIRGNHEDP

SEQ ID NO: 2303876 - protein, 25 aa, Cryptosporidium parvum
SHVGLKKKRRAIWLGSEVENNAIKE

SEQ ID NO: 2303877 - protein, 22 aa, Cryptosporidium parvum
SHVKRKKLGIGDFQQISKAENF

SEQ ID NO: 2303878 - protein, 17 aa, Cryptosporidium parvum
SHYKESRQCPINKSPSW

SEQ ID NO: 2303879 - protein, 25 aa, Cryptosporidium parvum
SIADRMTLSWSWKEMIDEDFSPITT

SEQ ID NO: 2303880 - protein, 24 aa, Cryptosporidium parvum
SIAKYSYHILICIINIIEDKSFQL

SEQ ID NO: 2303881 - protein, 17 aa, Cryptosporidium parvum
SIAPICKIFESKILSLV

SEQ ID NO: 2303882 - protein, 18 aa, Cryptosporidium parvum
SICTLEFELHRPLYDWLQ

SEQ ID NO: 2303883 - protein, 19 aa, Cryptosporidium parvum
SIDAWRKNQVPSFITSNNR

SEQ ID NO: 2303884 - protein, 25 aa, Cryptosporidium parvum
SIDEGLELLFLVGFREKQAEDQLRY

SEQ ID NO: 2303885 - protein, 24 aa, Cryptosporidium parvum
SIDELRPSVDLTRTKLCEIQLKEG

SEQ ID NO: 2303886 - protein, 17 aa, Cryptosporidium parvum
SIDLKVRHLRAKDLPKH

SEQ ID NO: 2303887 - protein, 24 aa, Cryptosporidium parvum
SIDSQCISYGFGILDEFETLEQAG

SEQ ID NO: 2303888 - protein, 21 aa, Cryptosporidium parvum
SIDVPRTFPELNIFRDQASQE

SEQ ID NO: 2303889 - protein, 25 aa, Cryptosporidium parvum
SIEDKLNELILLFNTKMKSLSNGNN

SEQ ID NO: 2303890 - protein, 25 aa, Cryptosporidium parvum
SIEEKRISLSIGILKSLIRVISAFK

SEQ ID NO: 2303891 - protein, 25 aa, Cryptosporidium parvum
SIEEYRWKFYQSDPGNWNNLHLETL

SEQ ID NO: 2303892 - protein, 23 aa, Cryptosporidium parvum
SIEGVLYDSIEWIDAKFKESNEN

SEQ ID NO: 2303893 - protein, 23 aa, Cryptosporidium parvum
SIEKIKIAFLLSIQKELGELHSI

SEQ ID NO: 2303894 - protein, 19 aa, Cryptosporidium parvum
SIENRVGIQPNIMNETINE

SEQ ID NO: 2303895 - protein, 32 aa, Cryptosporidium parvum
SIEYKLSYHKSIEFEFDRFFFTIEHKYNTSIV

SEQ ID NO: 2303896 - protein, 17 aa, Cryptosporidium parvum
SIFDDFGLMRALSDGDI

SEQ ID NO: 2303897 - protein, 21 aa, Cryptosporidium parvum
SIFFDMLIFKGGNFLRQRLAL

SEQ ID NO: 2303898 - protein, 17 aa, Cryptosporidium parvum
SIFKMLYLKINKNLIEK

SEQ ID NO: 2303899 - protein, 27 aa, Cryptosporidium parvum
SIGDYFISRIVKFVSLTPVDFCVMVIL

SEQ ID NO: 2303900 - protein, 22 aa, Cryptosporidium parvum
SIGEYTLRLELHHLSIDEVSCS

SEQ ID NO: 2303901 - protein, 22 aa, Cryptosporidium parvum
SIGPSRFSLHKSLNRGEDKPDF

SEQ ID NO: 2303902 - protein, 25 aa, Cryptosporidium parvum
SIGTNRWLLGFEVSGNLKRIIKIVL

SEQ ID NO: 2303903 - protein, 24 aa, Cryptosporidium parvum
SIGTRGRRGYGSGSCTTTTRSGRF

SEQ ID NO: 2303904 - protein, 23 aa, Cryptosporidium parvum
SIGVIALELFIIICNQYNNSQNQ

SEQ ID NO: 2303905 - protein, 28 aa, Cryptosporidium parvum
SIGYFTLSLSCLKWLLLSDPDNNISIEE

SEQ ID NO: 2303906 - protein, 19 aa, Cryptosporidium parvum
SIHLKIFIENSFGGVLSLK

SEQ ID NO: 2303907 - protein, 24 aa, Cryptosporidium parvum
SIIASDIDYCFNLSLKSMLKILSN

SEQ ID NO: 2303908 - protein, 25 aa, Cryptosporidium parvum
SIIDNWKKSVGFIFNDSYKNLKYTL

SEQ ID NO: 2303909 - protein, 17 aa, Cryptosporidium parvum
SIIFKNQPKIFGKPKNI

SEQ ID NO: 2303910 - protein, 21 aa, Cryptosporidium parvum
SIIFPKECVEYIMNRQGAKSS

SEQ ID NO: 2303911 - protein, 21 aa, Cryptosporidium parvum
  misc_feature (17)..(17): Xaa can be any naturally occurring amino acid
SIIHPHIIRLYEVIDTXSDIY

SEQ ID NO: 2303912 - protein, 26 aa, Cryptosporidium parvum
SIIHPLQCILLIIGILRRSLENPNHS

SEQ ID NO: 2303913 - protein, 19 aa, Cryptosporidium parvum
SIIKARRSLSHKLRLISQK

SEQ ID NO: 2303914 - protein, 18 aa, Cryptosporidium parvum
SIINVLLCYCGNSEWIKH

SEQ ID NO: 2303915 - protein, 17 aa, Cryptosporidium parvum
SIIPFGIPVWVKNRDDD

SEQ ID NO: 2303916 - protein, 22 aa, Cryptosporidium parvum
SIIPGPAFFSIDGYASSGKIQQ

SEQ ID NO: 2303917 - protein, 18 aa, Cryptosporidium parvum
SIIPLRAKISSIIEDLNK

SEQ ID NO: 2303918 - protein, 19 aa, Cryptosporidium parvum
SIIPTYFSCISINNLQKSY

SEQ ID NO: 2303919 - protein, 25 aa, Cryptosporidium parvum
SIIRLPYACKLLFQELQAMNVCPRI

SEQ ID NO: 2303920 - protein, 17 aa, Cryptosporidium parvum
SIISLQFRISSINNSTY

SEQ ID NO: 2303921 - protein, 26 aa, Cryptosporidium parvum
SIITGTDIPIVFKLIGRLINGIFPII

SEQ ID NO: 2303922 - protein, 19 aa, Cryptosporidium parvum
SIKCFKRAIQYDNRYVYAY

SEQ ID NO: 2303923 - protein, 23 aa, Cryptosporidium parvum
SIKEGWKKNSAALLNAFGGNSGS

SEQ ID NO: 2303924 - protein, 18 aa, Cryptosporidium parvum
SIKILKEFYEIGNPKAPE

SEQ ID NO: 2303925 - protein, 19 aa, Cryptosporidium parvum
SIKKLISVFYYRKIFADIM

SEQ ID NO: 2303926 - protein, 25 aa, Cryptosporidium parvum
SIKLFNVDPCFNFKSEFPTNITEPF

SEQ ID NO: 2303927 - protein, 18 aa, Cryptosporidium parvum
SIKYEFPKANSLNSPINE

SEQ ID NO: 2303928 - protein, 25 aa, Cryptosporidium parvum
SILAVLRFCRQILKIEIGYDSSLEL

SEQ ID NO: 2303929 - protein, 17 aa, Cryptosporidium parvum
SILCSSLSWISQQIYGP

SEQ ID NO: 2303930 - protein, 28 aa, Cryptosporidium parvum
SILELSCFTTQWALDIFDYYLGATTLET

SEQ ID NO: 2303931 - protein, 27 aa, Cryptosporidium parvum
SILEYLDLFPCFVLAIFKSLVLLDQGE

SEQ ID NO: 2303932 - protein, 24 aa, Cryptosporidium parvum
SILEYVVVLSLELLFCDPYEAKML

SEQ ID NO: 2303933 - protein, 20 aa, Cryptosporidium parvum
SILFEDLFKRFSVLTKKQID

SEQ ID NO: 2303934 - protein, 32 aa, Cryptosporidium parvum
SILGEIFTFEFLKEFYGVLDFGSVLKVNILAL

SEQ ID NO: 2303935 - protein, 23 aa, Cryptosporidium parvum
SILIKYLIPLALCDISEQVRISA

SEQ ID NO: 2303936 - protein, 20 aa, Cryptosporidium parvum
SILIMSGICGMRLNAERIST

SEQ ID NO: 2303937 - protein, 20 aa, Cryptosporidium parvum
SILKERKLKIAEFPEFEEDK

SEQ ID NO: 2303938 - protein, 18 aa, Cryptosporidium parvum
SILLKYWLSLEEKLASKN

SEQ ID NO: 2303939 - protein, 21 aa, Cryptosporidium parvum
SILNGFKWNYNALFSEKIPKT

SEQ ID NO: 2303940 - protein, 30 aa, Cryptosporidium parvum
SILNGIEWSGIFAINWLYNYLSNMSAPSIN

SEQ ID NO: 2303941 - protein, 24 aa, Cryptosporidium parvum
SILPKLRAAGHRVLIFSQMTKLLT

SEQ ID NO: 2303942 - protein, 23 aa, Cryptosporidium parvum
SILQRNSILYSFNKFPDLKIILI

SEQ ID NO: 2303943 - protein, 19 aa, Cryptosporidium parvum
SILQWLKEYLNNFSQTSIC

SEQ ID NO: 2303944 - protein, 37 aa, Cryptosporidium parvum
SILRRYAIECLIEINKTYPLIFCPLLEINFIPNQNIE

SEQ ID NO: 2303945 - protein, 26 aa, Cryptosporidium parvum
SILRYSEFLKEFILIINSFENCLRIK

SEQ ID NO: 2303946 - protein, 20 aa, Cryptosporidium parvum
SILSEDKFAIGTSISESQNG

SEQ ID NO: 2303947 - protein, 22 aa, Cryptosporidium parvum
SIMPELSAKVFRTFNASITLER

SEQ ID NO: 2303948 - protein, 23 aa, Cryptosporidium parvum
SINDGIINRCCICDKNKNNSNIG

SEQ ID NO: 2303949 - protein, 18 aa, Cryptosporidium parvum
SINDGSCAICFQKQTNLC

SEQ ID NO: 2303950 - protein, 23 aa, Cryptosporidium parvum
SINDLKVSVYLYLNQFMDNIMGE

SEQ ID NO: 2303951 - protein, 19 aa, Cryptosporidium parvum
SINGYKCPSELLFEVSSCI

SEQ ID NO: 2303952 - protein, 18 aa, Cryptosporidium parvum
SINILKQRLKSIQTKLSI

SEQ ID NO: 2303953 - protein, 20 aa, Cryptosporidium parvum
SINLIALIIMMDRENVLIGQ

SEQ ID NO: 2303954 - protein, 25 aa, Cryptosporidium parvum
SINLNLRVNFSIGKFFEKMETDLKT

SEQ ID NO: 2303955 - protein, 22 aa, Cryptosporidium parvum
SINPVQCLREATIPENDHEFTE

SEQ ID NO: 2303956 - protein, 23 aa, Cryptosporidium parvum
SIPDVGGVSPVYGFKDNKNEKDG

SEQ ID NO: 2303957 - protein, 27 aa, Cryptosporidium parvum
SIPESFLPDFLDLIIWGHEHECIVNPV

SEQ ID NO: 2303958 - protein, 25 aa, Cryptosporidium parvum
SIPIFADKCKFNSFYRINYNSDSNI

SEQ ID NO: 2303959 - protein, 33 aa, Cryptosporidium parvum; identical to SEQ ID NO: 2181411

SEQ ID NO: 2303960 - protein, 23 aa, Cryptosporidium parvum
SIPKNRQCVLVSATMPTALASFS

SEQ ID NO: 2303961 - protein, 33 aa, Cryptosporidium parvum; identical to SEQ ID NO: 2181412

SEQ ID NO: 2303962 - protein, 27 aa, Cryptosporidium parvum
SIPVSCLRPGLRWIQLFDANFIDIQCC

SEQ ID NO: 2303963 - protein, 26 aa, Cryptosporidium parvum
SIQCCHGSLIFWNYITINWIRISPSF

SEQ ID NO: 2303964 - protein, 34 aa, Cryptosporidium parvum; identical to SEQ ID NO: 2181417

SEQ ID NO: 2303965 - protein, 25 aa, Cryptosporidium parvum
SIQKNLRNAMKIKIRTVQNTEMEVE

SEQ ID NO: 2303966 - protein, 55 aa, Cryptosporidium parvum
SIQKSSCYLPSALMEVCIKRFLTCPDFDLQLILGELIWRVLKKTNYGRGYSQSDN

SEQ ID NO: 2303967 - protein, 20 aa, Cryptosporidium parvum
SIQNKLFCLSKIVNTVQQFS

SEQ ID NO: 2303968 - protein, 23 aa, Cryptosporidium parvum
SIQPLCIRLWEFLFKEGNIIKFF

SEQ ID NO: 2303969 - protein, 24 aa, Cryptosporidium parvum
SIQREILRYILIGANSLSSDEAFL

SEQ ID NO: 2303970 - protein, 18 aa, Cryptosporidium parvum
SIRLDFDQLLPIIILGND

SEQ ID NO: 2303971 - protein, 22 aa, Cryptosporidium parvum
SIRLFCFEQMKIISGGNLNKRV

SEQ ID NO: 2303972 - protein, 24 aa, Cryptosporidium parvum
SISEIVLTLFCDLENMGISSKELL

SEQ ID NO: 2303973 - protein, 23 aa, Cryptosporidium parvum
SISELRQLIVWELEKVIYSFSEI

SEQ ID NO: 2303974 - protein, 20 aa, Cryptosporidium parvum
SISLFPDRTGFAIGSIEGRC

SEQ ID NO: 2303975 - protein, 25 aa, Cryptosporidium parvum
SISLYCSWTGVLNSGDFTDLFEDLN

SEQ ID NO: 2303976 - protein, 17 aa, Cryptosporidium parvum
SISRHGGHYNMHAKEDI

SEQ ID NO: 2303977 - protein, 24 aa, Cryptosporidium parvum
SISRYLYEWIFNLIVELINIALKQ

SEQ ID NO: 2303978 - protein, 27 aa, Cryptosporidium parvum
SISSFPWNYIFKCSRDFSLSQFHSELE

SEQ ID NO: 2303979 - protein, 24 aa, Cryptosporidium parvum
SISSNCYTFIQSCEKLTSVELAQL

SEQ ID NO: 2303980 - protein, 27 aa, Cryptosporidium parvum
SISTRLNCLIQDVFDLRKHKWVKKVHK

SEQ ID NO: 2303981 - protein, 24 aa, Cryptosporidium parvum
SISVIKFLRTCLGTRDDFYYRLFT

SEQ ID NO: 2303982 - protein, 26 aa, Cryptosporidium parvum
SITMDSWTPKQMKAMELGGNTRLTEI

SEQ ID NO: 2303983 - protein, 18 aa, Cryptosporidium parvum
SITSVITGKSDFANINKK

SEQ ID NO: 2303984 - protein, 24 aa, Cryptosporidium parvum
SITVTSFIAALFITFKRNQEAFLD

SEQ ID NO: 2303985 - protein, 26 aa, Cryptosporidium parvum
SIVFGVLRPNAKWRPGRGNSSKSQAT

SEQ ID NO: 2303986 - protein, 32 aa, Cryptosporidium parvum; identical to SEQ ID NO: 2181443

SEQ ID NO: 2303987 - protein, 18 aa, Cryptosporidium parvum
SIVFTSIKKYDGRKNRIL

SEQ ID NO: 2303988 - protein, 20 aa, Cryptosporidium parvum
SIVHPRCIPLEIEANKETTI

SEQ ID NO: 2303989 - protein, 17 aa, Cryptosporidium parvum
SIVLGSGVESLTREIAE

SEQ ID NO: 2303990 - protein, 30 aa, Cryptosporidium parvum; identical to SEQ ID NO: 2181446

SEQ ID NO: 2303991 - protein, 20 aa, Cryptosporidium parvum
SIVSYLKICKILGYDFIGKD

SEQ ID NO: 2303992 - protein, 24 aa, Cryptosporidium parvum
SIYPFYDCQMVKRLVIKYLDLPEG

SEQ ID NO: 2303993 - protein, 24 aa, Cryptosporidium parvum
SIYTYEFHCSLWIYQNLQHTLDII

SEQ ID NO: 2303994 - protein, 20 aa, Cryptosporidium parvum
SKADYGLMIFADLRYNKKDK

SEQ ID NO: 2303995 - protein, 19 aa, Cryptosporidium parvum
SKAENFDSISILNKNEQES

SEQ ID NO: 2303996 - protein, 18 aa, Cryptosporidium parvum
SKAFPINMLFKSNDNNKP

SEQ ID NO: 2303997 - protein, 19 aa, Cryptosporidium parvum
SKALKEWMMRLDPELLSLQ

SEQ ID NO: 2303998 - protein, 25 aa, Cryptosporidium parvum
SKASLRKFLESTIMDSGEDSINNGT

SEQ ID NO: 2303999 - protein, 24 aa, Cryptosporidium parvum
SKCKELRSLMLISNHIRKIKNLDE

SEQ ID NO: 2304000 - protein, 25 aa, Cryptosporidium parvum
SKCLKRNHKSFGIAGLKDRRGITVQ

SEQ ID NO: 2304001 - protein, 24 aa, Cryptosporidium parvum
SKCSSKLSGLGMESFSLSKVSNNI

SEQ ID NO: 2304002 - protein, 21 aa, Cryptosporidium parvum
SKDAIPWNLLFIVKLSEKDTA

SEQ ID NO: 2304003 - protein, 18 aa, Cryptosporidium parvum
SKDKAFLCVVNMDKTEWL

SEQ ID NO: 2304004 - protein, 23 aa, Cryptosporidium parvum
SKDVYCCSWLRKNIFKKYLYEAS

SEQ ID NO: 2304005 - protein, 19 aa, Cryptosporidium parvum
SKDWLCIEIENLINEHNLK

SEQ ID NO: 2304006 - protein, 19 aa, Cryptosporidium parvum
SKEGLFFYILLENNAKKSS

SEQ ID NO: 2304007 - protein, 18 aa, Cryptosporidium parvum
SKEGYAMDWGNSTSNDYL

SEQ ID NO: 2304008 - protein, 25 aa, Cryptosporidium parvum
SKEKPCKEFYFLENLSKIKLQDSWN

SEQ ID NO: 2304009 - protein, 20 aa, Cryptosporidium parvum
SKEMLDRGLLQSIFGSDSAS

SEQ ID NO: 2304010 - protein, 25 aa, Cryptosporidium parvum
SKENEFIPCFALDFTKNSIPSSLIL

SEQ ID NO: 2304011 - protein, 20 aa, Cryptosporidium parvum
SKEQVCWAAFKVFDQDGNGK

SEQ ID NO: 2304012 - protein, 27 aa, Cryptosporidium parvum
SKETFTLPPLWHVAALCTLTMLEEEDK

SEQ ID NO: 2304013 - protein, 30 aa, Cryptosporidium parvum
SKEVLFRIAKLRSEILWDVPSNLNMDIKLL

SEQ ID NO: 2304014 - protein, 24 aa, Cryptosporidium parvum
SKEYLDYFFPLFLLECQQSIQRAK

SEQ ID NO: 2304015 - protein, 17 aa, Cryptosporidium parvum
SKEYLKECIKCELQNIN

SEQ ID NO: 2304016 - protein, 21 aa, Cryptosporidium parvum
SKFAKRYCHYCKAELNSDSNK

SEQ ID NO: 2304017 - protein, 29 aa, Cryptosporidium parvum
SKFDYLLCNGCNRAFHWYCVNRPEFRDLK

SEQ ID NO: 2304018 - protein, 18 aa, Cryptosporidium parvum
SKFFLKQSLDEWFKSQEI

SEQ ID NO: 2304019 - protein, 24 aa, Cryptosporidium parvum
SKFKFVQQNCRIFLLKDSNINRNT

SEQ ID NO: 2304020 - protein, 22 aa, Cryptosporidium parvum
SKFPNECKIGSRIGDCHKKLRN

SEQ ID NO: 2304021 - protein, 17 aa, Cryptosporidium parvum
SKFPRKMWQVSESVSKF

SEQ ID NO: 2304022 - protein, 21 aa, Cryptosporidium parvum
SKFPVILTEILNFYIKLLENF

SEQ ID NO: 2304023 - protein, 20 aa, Cryptosporidium parvum
SKFTCIKKLILIEYNDSQKP

SEQ ID NO: 2304024 - protein, 23 aa, Cryptosporidium parvum
SKGAECPKCGQNIGIYPLQGLVF

SEQ ID NO: 2304025 - protein, 23 aa, Cryptosporidium parvum
SKGDITSILGFLHHDACDGKLYR

SEQ ID NO: 2304026 - protein, 24 aa, Cryptosporidium parvum
SKGGKDWRAGRCAGNNIIPASTGA

SEQ ID NO: 2304027 - protein, 17 aa, Cryptosporidium parvum
SKGGYLAAVSPRAISPS

SEQ ID NO: 2304028 - protein, 23 aa, Cryptosporidium parvum
SKGLQNWIYRLFSTYRSNGTSKE

SEQ ID NO: 2304029 - protein, 17 aa, Cryptosporidium parvum
SKGLSSRSIQWGAWDED

SEQ ID NO: 2304030 - protein, 26 aa, Cryptosporidium parvum
SKGMKNQFCKLVDNFVEETSKALIDE

SEQ ID NO: 2304031 - protein, 21 aa, Cryptosporidium parvum
SKGRPFGFVNFENPDSAKAAV

SEQ ID NO: 2304032 - protein, 17 aa, Cryptosporidium parvum
SKGSVGIIVHFGDSSIR

SEQ ID NO: 2304033 - protein, 23 aa, Cryptosporidium parvum
SKGVPLRLQFPLNDKYEHGNMQF

SEQ ID NO: 2304034 - protein, 39 aa, Cryptosporidium parvum; identical to SEQ ID NO: 2181494

SEQ ID NO: 2304035 - protein, 21 aa, Cryptosporidium parvum
SKHQFVATFRRFSIGARPKTP

SEQ ID NO: 2304036 - protein, 20 aa, Cryptosporidium parvum
SKHRPPWRTSIDNIINAMQE

SEQ ID NO: 2304037 - protein, 19 aa, Cryptosporidium parvum
SKHSFSLQLSDYFRLLIDR

SEQ ID NO: 2304038 - protein, 18 aa, Cryptosporidium parvum
SKIDAGYDTKLDFTHENN

SEQ ID NO: 2304039 - protein, 25 aa, Cryptosporidium parvum
SKIDFSVFEEGFYRRYKSFFHDRQA

SEQ ID NO: 2304040 - protein, 17 aa, Cryptosporidium parvum
SKIEYFLTYADNFATGY

SEQ ID NO: 2304041 - protein, 19 aa, Cryptosporidium parvum
SKIFTYWYPYELDIPIKGY

SEQ ID NO: 2304042 - protein, 19 aa, Cryptosporidium parvum
SKIGKIHAIYDNWDGSYVV

SEQ ID NO: 2304043 - protein, 20 aa, Cryptosporidium parvum
SKIGRKEILSIHEIKPGLMV

SEQ ID NO: 2304044 - protein, 25 aa, Cryptosporidium parvum
SKILEIFRDGQICKLDSTLKYITTP

SEQ ID NO: 2304045 - protein, 28 aa, Cryptosporidium parvum
SKILKEKSCLFLANYVLMVFQRNSSNYA

SEQ ID NO: 2304046 - protein, 18 aa, Cryptosporidium parvum
SKILREWFELSMKQKLNT

SEQ ID NO: 2304047 - protein, 20 aa, Cryptosporidium parvum
SKILTYRSGSFIQANSQGYK

SEQ ID NO: 2304048 - protein, 22 aa, Cryptosporidium parvum
SKILYNRIIELADIIWNHMEGL

SEQ ID NO: 2304049 - protein, 22 aa, Cryptosporidium parvum
SKIMQRKGFIESLKLPYMNGDV

SEQ ID NO: 2304050 - protein, 23 aa, Cryptosporidium parvum
SKIPFSRSELRVIKYMDPDADAE

SEQ ID NO: 2304051 - protein, 18 aa, Cryptosporidium parvum
SKIRCLFFGRFHGDEESA

SEQ ID NO: 2304052 - protein, 21 aa, Cryptosporidium parvum
SKISFPREMGITFSEKTENES

SEQ ID NO: 2304053 - protein, 18 aa, Cryptosporidium parvum
SKISNLYLKIKIKDDNKT

SEQ ID NO: 2304054 - protein, 17 aa, Cryptosporidium parvum
SKIVPYITREMSIAQLQ

SEQ ID NO: 2304055 - protein, 25 aa, Cryptosporidium parvum
SKIVYNCYKLRNIVGNKFPRKSSKF

SEQ ID NO: 2304056 - protein, 26 aa, Cryptosporidium parvum
SKKALRFIRKGVFSRAEIELNDPDLV

SEQ ID NO: 2304057 - protein, 25 aa, Cryptosporidium parvum
SKKECTYCRIEFLQHRILKKAFKVF

SEQ ID NO: 2304058 - protein, 22 aa, Cryptosporidium parvum
SKKKICPIAGCNFLVVKKFLKR

SEQ ID NO: 2304059 - protein, 20 aa, Cryptosporidium parvum
SKKKRIVSLGGEKSSKLKYA

SEQ ID NO: 2304060 - protein, 20 aa, Cryptosporidium parvum
SKKRRIIMRLSKLKKGLRGE

SEQ ID NO: 2304061 - protein, 29 aa, Cryptosporidium parvum
SKKSFKSLSLLLSCFRSVTSINALTSEED

SEQ ID NO: 2304062 - protein, 21 aa, Cryptosporidium parvum
SKKTIHIEISFSPKNNIFVDA

SEQ ID NO: 2304063 - protein, 21 aa, Cryptosporidium parvum
SKLACACLMLAHKIEGVEESW

SEQ ID NO: 2304064 - protein, 23 aa, Cryptosporidium parvum
SKLCDLWSAGVILYILLCGYPPF

SEQ ID NO: 2304065 - protein, 20 aa, Cryptosporidium parvum
SKLDRLCARLEKASSKEKIS

SEQ ID NO: 2304066 - protein, 26 aa, Cryptosporidium parvum
SKLEKKHRKSSCKHNHMSKHKDKYKH

SEQ ID NO: 2304067 - protein, 19 aa, Cryptosporidium parvum
SKLELCGAVNVDTFFFLIS

SEQ ID NO: 2304068 - protein, 25 aa, Cryptosporidium parvum
SKLESYLSLCEDLYLGGISKTQTVS

SEQ ID NO: 2304069 - protein, 21 aa, Cryptosporidium parvum
SKLFATILWLSNFVNAHSHNI

SEQ ID NO: 2304070 - protein, 24 aa, Cryptosporidium parvum
SKLFLDVLNKFDWVESCNCFVNQY

SEQ ID NO: 2304071 - protein, 24 aa, Cryptosporidium parvum
SKLFPEEDYFSLAPNYLKETNFDL

SEQ ID NO: 2304072 - protein, 24 aa, Cryptosporidium parvum
SKLGRPLKDIIIIDNSPISYILQP

SEQ ID NO: 2304073 - protein, 18 aa, Cryptosporidium parvum
SKLILNWLEDGVFDALEK

SEQ ID NO: 2304074 - protein, 20 aa, Cryptosporidium parvum
SKLINAFDKAKCASENSQSG

SEQ ID NO: 2304075 - protein, 20 aa, Cryptosporidium parvum
SKLIVCGKSGHVQMINQLSK

SEQ ID NO: 2304076 - protein, 20 aa, Cryptosporidium parvum
SKLKDFWLSKVQEFNFEDAT

SEQ ID NO: 2304077 - protein, 18 aa, Cryptosporidium parvum
SKLKELHERITFLEKSNS

SEQ ID NO: 2304078 - protein, 24 aa, Cryptosporidium parvum
SKLKMIDEVCKRVSMNNLSNYFIS

SEQ ID NO: 2304079 - protein, 20 aa, Cryptosporidium parvum
SKLLMKRRDWHAIRLRLHLW

SEQ ID NO: 2304080 - protein, 19 aa, Cryptosporidium parvum
SKLLPLAVVELDVQNECNY

SEQ ID NO: 2304081 - protein, 18 aa, Cryptosporidium parvum
SKLLTCCSFSEDRTLMLT

SEQ ID NO: 2304082 - protein, 20 aa, Cryptosporidium parvum
SKLQFLQLLSSFNLLVYDSQ

SEQ ID NO: 2304083 - protein, 21 aa, Cryptosporidium parvum
SKLQLCAVPYMLYQINLASVT

SEQ ID NO: 2304084 - protein, 18 aa, Cryptosporidium parvum
SKLQVCQREIKYYEDELS

SEQ ID NO: 2304085 - protein, 31 aa, Cryptosporidium parvum
SKLRFLVRKLETFKGLQVRPWPKAIQEQDEA

SEQ ID NO: 2304086 - protein, 17 aa, Cryptosporidium parvum
SKLRFSNDTNLYGNISM

SEQ ID NO: 2304087 - protein, 25 aa, Cryptosporidium parvum
SKLSTFINMEISWRIKSTTEGIFGL

SEQ ID NO: 2304088 - protein, 19 aa, Cryptosporidium parvum
SKLVCIGKCKKVVQAFIED

SEQ ID NO: 2304089 - protein, 22 aa, Cryptosporidium parvum
SKLVNCKEVLDLKDFDAELKDI

SEQ ID NO: 2304090 - protein, 46 aa, Cryptosporidium parvum
SKLVPDILSSICGGEGLKMVAKEKLSFWMDLPCNMDRKKAKTGIGP

SEQ ID NO: 2304091 - protein, 17 aa, Cryptosporidium parvum
SKMELKELIKDYSNLYA

SEQ ID NO: 2304092 - protein, 17 aa, Cryptosporidium parvum
SKMIIFTKVVRLVDVQV

SEQ ID NO: 2304093 - protein, 21 aa, Cryptosporidium parvum
SKMKELRGSMEVIFNEKISSD

SEQ ID NO: 2304094 - protein, 22 aa, Cryptosporidium parvum
SKMLIYEILRDVFVEDENLVGI

SEQ ID NO: 2304095 - protein, 32 aa, Cryptosporidium parvum; identical to SEQ ID NO: 2181558

SEQ ID NO: 2304096 - protein, 17 aa, Cryptosporidium parvum
SKMYGAFEDELKRCDAL

SEQ ID NO: 2304097 - protein, 18 aa, Cryptosporidium parvum
SKNCKLYLITEYSRKMLK

SEQ ID NO: 2304098 - protein, 25 aa, Cryptosporidium parvum
SKNDGRLRFRANFNLPKKYAGEKIS

SEQ ID NO: 2304099 - protein, 20 aa, Cryptosporidium parvum
SKNDLEAIHFLMKPVIGNGH

SEQ ID NO: 2304100 - protein, 22 aa, Cryptosporidium parvum
SKNFPKLICESIINWQNEFRQR

SEQ ID NO: 2304101 - protein, 25 aa, Cryptosporidium parvum
SKNIELLYHKFGFKNFIIKDYSNSF

SEQ ID NO: 2304102 - protein, 23 aa, Cryptosporidium parvum
SKNNKFRLGITSLQYIARLTPNK

SEQ ID NO: 2304103 - protein, 18 aa, Cryptosporidium parvum
SKNRILIASKMLRGEIWF

SEQ ID NO: 2304104 - protein, 20 aa, Cryptosporidium parvum
SKNSIKKVLKKVSVNHSNTH

SEQ ID NO: 2304105 - protein, 28 aa, Cryptosporidium parvum
SKNYRSFASLIKRICTRLRIKNLPNPSI

SEQ ID NO: 2304106 - protein, 22 aa, Cryptosporidium parvum
SKPDCLIGFGGGSPMDASKLVR

SEQ ID NO: 2304107 - protein, 24 aa, Cryptosporidium parvum
SKPDKDGIKHVISYIKDSKGSTIK

SEQ ID NO: 2304108 - protein, 33 aa, Cryptosporidium parvum; identical to SEQ ID NO: 2181573

SEQ ID NO: 2304109 - protein, 18 aa, Cryptosporidium parvum
SKPMPLWVANAIRKSREN

SEQ ID NO: 2304110 - protein, 18 aa, Cryptosporidium parvum
SKPQDARVPTLLKSTYIS

SEQ ID NO: 2304111 - protein, 21 aa, Cryptosporidium parvum
SKPYLNKEILDILNSKYHNRE

SEQ ID NO: 2304112 - protein, 19 aa, Cryptosporidium parvum
SKQLPANWKYQAATASTLV

SEQ ID NO: 2304113 - protein, 18 aa, Cryptosporidium parvum
SKQRVVLKDVGIRPTIGQ

SEQ ID NO: 2304114 - protein, 24 aa, Cryptosporidium parvum
SKQSTAYNIMGWKFARVSRNPKSL

SEQ ID NO: 2304115 - protein, 27 aa, Cryptosporidium parvum
SKQTKCQETMRGAGYETSIQGQDQARK

SEQ ID NO: 2304116 - protein, 17 aa, Cryptosporidium parvum
SKRIKLSLRELFLEDFL

SEQ ID NO: 2304117 - protein, 26 aa, Cryptosporidium parvum
SKRKEEFPNDITIGSTRLIKVCSKYT

SEQ ID NO: 2304118 - protein, 19 aa, Cryptosporidium parvum
SKRKVHRSLWIPPKSYEHA

SEQ ID NO: 2304119 - protein, 27 aa, Cryptosporidium parvum
SKRLECEIKVLKECLSKESKSALIRGE

SEQ ID NO: 2304120 - protein, 30 aa, Cryptosporidium parvum
SKRNSSMVVWRSGFEHIPAVLTHAAVLCSK

SEQ ID NO: 2304121 - protein, 32 aa, Cryptosporidium parvum
SKRQIIYNFANSIWDYVKPVSLDELEERRKTN

SEQ ID NO: 2304122 - protein, 17 aa, Cryptosporidium parvum
SKRSISVPVQENQLSNF

SEQ ID NO: 2304123 - protein, 24 aa, Cryptosporidium parvum
SKRTGIDLQTRFPGASSQSIDLLK

SEQ ID NO: 2304124 - protein, 24 aa, Cryptosporidium parvum
SKRVKISKLLIEGKIKEAISSSYG

SEQ ID NO: 2304125 - protein, 26 aa, Cryptosporidium parvum
SKSAYSFDKSHYWFTPDFTLLSNGGG

SEQ ID NO: 2304126 - protein, 23 aa, Cryptosporidium parvum
SKSCIFCNECVNLTKNYGYINPV

SEQ ID NO: 2304127 - protein, 21 aa, Cryptosporidium parvum
SKSFIPPPLFSCMDQKPYIPD

SEQ ID NO: 2304128 - protein, 28 aa, Cryptosporidium parvum
SKSLIRATCIIDLFGLSISQVHSSHMIT

SEQ ID NO: 2304129 - protein, 38 aa, Cryptosporidium parvum
SKSPLRLAVPGGIFDAGFRGELRIPFDNIKDYDYELKI

SEQ ID NO: 2304130 - protein, 24 aa, Cryptosporidium parvum
SKSQLPLIRWVMLEILPILHKLNS

SEQ ID NO: 2304131 - protein, 22 aa, Cryptosporidium parvum
SKSQLREWIGILQSEFDLLKSI

SEQ ID NO: 2304132 - protein, 18 aa, Cryptosporidium parvum
SKSRIGSVNDVWLDDGTD

SEQ ID NO: 2304133 - protein, 19 aa, Cryptosporidium parvum
SKSSFGIRPEDSISKISAK

SEQ ID NO: 2304134 - protein, 20 aa, Cryptosporidium parvum
SKSSIKYSFIYATTNLAKFT

SEQ ID NO: 2304135 - protein, 22 aa, Cryptosporidium parvum
SKSTKPTSLWIALNSIKTIQDF

SEQ ID NO: 2304136 - protein, 31 aa, Cryptosporidium parvum; identical to SEQ ID NO: 2181590

SEQ ID NO: 2304137 - protein, 23 aa, Cryptosporidium parvum
SKTCAGVSAFGFGGTNAHAIFEK

SEQ ID NO: 2304138 - protein, 20 aa, Cryptosporidium parvum
SKTCPSFQRKGSLRPSPNTQ

SEQ ID NO: 2304139 - protein, 20 aa, Cryptosporidium parvum
SKTKVGCVQLNILDPRNSPD

SEQ ID NO: 2304140 - protein, 29 aa, Cryptosporidium parvum
SKTLFGKGIYCFNHFVIARGKMNKITQSF

SEQ ID NO: 2304141 - protein, 28 aa, Cryptosporidium parvum
SKVFDWTGKFLASFEFFGEATVNLIQCG

SEQ ID NO: 2304142 - protein, 23 aa, Cryptosporidium parvum
SKVFSSKLIFHWLTHHILTNFLY

SEQ ID NO: 2304143 - protein, 29 aa, Cryptosporidium parvum
SKVIRPEQWHPWKSFSRLMDEAILEMGWQ

SEQ ID NO: 2304144 - protein, 27 aa, Cryptosporidium parvum
SKVLDEAYKNGFTVAAVSPPGYGKSGK

SEQ ID NO: 2304145 - protein, 24 aa, Cryptosporidium parvum
SKVPLMHRVLGFPLSFNHANPKII

SEQ ID NO: 2304146 - protein, 19 aa, Cryptosporidium parvum
SKVVSCFNKNSGLPNGISL

SEQ ID NO: 2304147 - protein, 18 aa, Cryptosporidium parvum
SKWGEVKSVNIIRSPESG

SEQ ID NO: 2304148 - protein, 18 aa, Cryptosporidium parvum
SKYDISCISVPTFCNKAK

SEQ ID NO: 2304149 - protein, 17 aa, Cryptosporidium parvum
SKYLFERALNLVRNHFE

SEQ ID NO: 2304150 - protein, 19 aa, Cryptosporidium parvum
SKYSASRLEMLSWLRDIAI

SEQ ID NO: 2304151 - protein, 20 aa, Cryptosporidium parvum
SKYSIALEMIAGGRLYNLVV

SEQ ID NO: 2304152 - protein, 24 aa, Cryptosporidium parvum
SKYSNKLLERWIHKLAKKCINISA

SEQ ID NO: 2304153 - protein, 17 aa, Cryptosporidium parvum
SKYTLSDNIGFKEEIPN

SEQ ID NO: 2304154 - protein, 17 aa, Cryptosporidium parvum
SLANMLSTIDWDKFNYP

SEQ ID NO: 2304155 - protein, 18 aa, Cryptosporidium parvum
SLAPMYYRGAAAAIVVYD

SEQ ID NO: 2304156 - protein, 17 aa, Cryptosporidium parvum
SLARFQRDIGLSVTSEV

SEQ ID NO: 2304157 - protein, 23 aa, Cryptosporidium parvum
SLAVHICSLSYLLLNGSKNHPFS

SEQ ID NO: 2304158 - protein, 18 aa, Cryptosporidium parvum
SLAYKEIPNFLKVFHYIR

SEQ ID NO: 2304159 - protein, 20 aa, Cryptosporidium parvum
SLCEEKSALSKSWEEQYNRV

SEQ ID NO: 2304160 - protein, 17 aa, Cryptosporidium parvum
SLCFRVTRRDIEYFQDK

SEQ ID NO: 2304161 - protein, 19 aa, Cryptosporidium parvum
SLCKIQKANSLPIIQSRLG

SEQ ID NO: 2304162 - protein, 17 aa, Cryptosporidium parvum
SLCLLDYDTGIRPFMPY

SEQ ID NO: 2304163 - protein, 26 aa, Cryptosporidium parvum
SLCVDLWSVGIILFEMLFGGPPLSDP

SEQ ID NO: 2304164 - protein, 38 aa, Cryptosporidium parvum
SLDETFEWRGSYLHLERELFRIIAWRANSATVNELLGY

SEQ ID NO: 2304165 - protein, 18 aa, Cryptosporidium parvum
SLDLSFAFGQSISNNIMV

SEQ ID NO: 2304166 - protein, 24 aa, Cryptosporidium parvum
SLDLSNILSCISLSYTPILFDSIL

SEQ ID NO: 2304167 - protein, 19 aa, Cryptosporidium parvum
SLDYDFRKQPILPSLENRS

SEQ ID NO: 2304168 - protein, 18 aa, Cryptosporidium parvum
SLEAFKMIRKNYHASKYK

SEQ ID NO: 2304169 - protein, 29 aa, Cryptosporidium parvum
SLECPKIDYSFILCIIWISLLKSGYQVTS

SEQ ID NO: 2304170 - protein, 19 aa, Cryptosporidium parvum
SLEDIDWNRVSKIIENFEK

SEQ ID NO: 2304171 - protein, 19 aa, Cryptosporidium parvum
SLEGEKCFVVMIANISPSS

SEQ ID NO: 2304172 - protein, 19 aa, Cryptosporidium parvum
SLEGSRARYEQSIKNVEEY

SEQ ID NO: 2304173 - protein, 25 aa, Cryptosporidium parvum
SLEILYRPGIPRSYSKFICPSGTDT

SEQ ID NO: 2304174 - protein, 18 aa, Cryptosporidium parvum
SLEIRFIPDDIVDFQFEP

SEQ ID NO: 2304175 - protein, 18 aa, Cryptosporidium parvum
SLEKVFRKYSMQEMLIFS

SEQ ID NO: 2304176 - protein, 18 aa, Cryptosporidium parvum
SLESGINILRAMMPHANI

SEQ ID NO: 2304177 - protein, 24 aa, Cryptosporidium parvum
SLESHSFISLLYMKIGNYFKSYEH

SEQ ID NO: 2304178 - protein, 20 aa, Cryptosporidium parvum
SLESKLAWINSLIYSMNAKA

SEQ ID NO: 2304179 - protein, 24 aa, Cryptosporidium parvum
SLFDFCKTIEKFTFHTETQDYRLR

SEQ ID NO: 2304180 - protein, 34 aa, Cryptosporidium parvum
SLFEFWAHIVTLYISSLFKHPSFPEFLFGIIPNL

SEQ ID NO: 2304181 - protein, 17 aa, Cryptosporidium parvum
SLFGRPTQVLSIQHINI

SEQ ID NO: 2304182 - protein, 21 aa, Cryptosporidium parvum
SLFKFQKLYIEMTVFVLYVQA

SEQ ID NO: 2304183 - protein, 18 aa, Cryptosporidium parvum
SLFKSGGDIFGRIRSNKW

SEQ ID NO: 2304184 - protein, 25 aa, Cryptosporidium parvum
SLFPKEWLPDEFIEQCVTAATLFSK

SEQ ID NO: 2304185 - protein, 17 aa, Cryptosporidium parvum
SLFRIPITAPFRKLIRY

SEQ ID NO: 2304186 - protein, 24 aa, Cryptosporidium parvum
SLFSEAFSSLNSMVNLFTSLRFYH

SEQ ID NO: 2304187 - protein, 23 aa, Cryptosporidium parvum
SLFSPRIPSFLFNLMTYILESPC

SEQ ID NO: 2304188 - protein, 25 aa, Cryptosporidium parvum
SLGCVLAGLIFKRDPFFCGVDNNDQ

SEQ ID NO: 2304189 - protein, 22 aa, Cryptosporidium parvum
SLGEAVCGWNIKFPTFSLSTQN

SEQ ID NO: 2304190 - protein, 18 aa, Cryptosporidium parvum
SLGKRILLSNGRLLSHLP

SEQ ID NO: 2304191 - protein, 18 aa, Cryptosporidium parvum
SLGLSWNSLICERLILKR

SEQ ID NO: 2304192 - protein, 23 aa, Cryptosporidium parvum
SLGRISEKWLYTELASSLSEIPG

SEQ ID NO: 2304193 - protein, 20 aa, Cryptosporidium parvum
SLGSEDVFSFPFIDPPSSSS

SEQ ID NO: 2304194 - protein, 18 aa, Cryptosporidium parvum
SLGSVVFDCVKRIPDGIL

SEQ ID NO: 2304195 - protein, 33 aa, Cryptosporidium parvum; identical to SEQ ID NO: 2181652

SEQ ID NO: 2304196 - protein, 19 aa, Cryptosporidium parvum
SLHQLEVFGFIDLALQDPS

SEQ ID NO: 2304197 - protein, 22 aa, Cryptosporidium parvum
SLIARISLQYGNFPLVHSTLNT

SEQ ID NO: 2304198 - protein, 24 aa, Cryptosporidium parvum
SLIENKCRVVVCSDLLARGIDIRM

SEQ ID NO: 2304199 - protein, 26 aa, Cryptosporidium parvum
SLIGDELRAVLGLSASAIRGVKVSKQ

SEQ ID NO: 2304200 - protein, 20 aa, Cryptosporidium parvum
SLIHWKGDGSNKFSLNSNKI

SEQ ID NO: 2304201 - protein, 19 aa, Cryptosporidium parvum
SLIIPGWYLNKFPSAKNSL

SEQ ID NO: 2304202 - protein, 23 aa, Cryptosporidium parvum
SLIKRLAHNVIRSGLKTICSSYN

SEQ ID NO: 2304203 - protein, 20 aa, Cryptosporidium parvum
SLIKTWEIFRELSMDENEVY

SEQ ID NO: 2304204 - protein, 22 aa, Cryptosporidium parvum
SLIQKRRLSVDWNDSKKKKTGA

SEQ ID NO: 2304205 - protein, 25 aa, Cryptosporidium parvum
SLIRISESLARMELSEWVKKSHVDE

SEQ ID NO: 2304206 - protein, 17 aa, Cryptosporidium parvum
SLIRLGFDLEQISWASQ

SEQ ID NO: 2304207 - protein, 26 aa, Cryptosporidium parvum
SLISDVISVLLFRFGALKNTNILNQI

SEQ ID NO: 2304208 - protein, 23 aa, Cryptosporidium parvum
SLISENELDFSLNIESSSKNTLV

SEQ ID NO: 2304209 - protein, 23 aa, Cryptosporidium parvum
SLISEPFFPLSFSGNLNRYVTED

SEQ ID NO: 2304210 - protein, 20 aa, Cryptosporidium parvum
SLISIIPCFILWAKLETYII

SEQ ID NO: 2304211 - protein, 18 aa, Cryptosporidium parvum
SLISKLKAHFGLKKSDNE

SEQ ID NO: 2304212 - protein, 24 aa, Cryptosporidium parvum
SLISLKTRNCIVFSPHPRTARSSI

SEQ ID NO: 2304213 - protein, 24 aa, Cryptosporidium parvum
SLIYAIECCTSIPPKCQVYVHAEE

SEQ ID NO: 2304214 - protein, 18 aa, Cryptosporidium parvum
SLIYKRREEGIVENEIYN

SEQ ID NO: 2304215 - protein, 19 aa, Cryptosporidium parvum
SLKEKFYFDRILCDVPCSS

SEQ ID NO: 2304216 - protein, 18 aa, Cryptosporidium parvum
SLKESRTVLHKNFSNGKP

SEQ ID NO: 2304217 - protein, 19 aa, Cryptosporidium parvum
SLKFPIIIDQVVRSGNLFY

SEQ ID NO: 2304218 - protein, 17 aa, Cryptosporidium parvum
SLKGERVGVVDIGGSFL

SEQ ID NO: 2304219 - protein, 25 aa, Cryptosporidium parvum
SLKIPDFSAELYISGLGYNPKQNTL

SEQ ID NO: 2304220 - protein, 23 aa, Cryptosporidium parvum
SLKIPEYCFRRRNFKGEGELENS

SEQ ID NO: 2304221 - protein, 21 aa, Cryptosporidium parvum
SLKLEQLFHLLINCYPDMSNM

SEQ ID NO: 2304222 - protein, 24 aa, Cryptosporidium parvum
SLKLPMKLANEFSRFVNNDQFTKR

SEQ ID NO: 2304223 - protein, 26 aa, Cryptosporidium parvum
SLKNLLSIYCSLDIDKRFQLADWRER

SEQ ID NO: 2304224 - protein, 27 aa, Cryptosporidium parvum
SLKQFFSIRLDKIFPVDEVFINDGFKK

SEQ ID NO: 2304225 - protein, 25 aa, Cryptosporidium parvum
SLKRREYKLIVSLFSKYFELFSKDT

SEQ ID NO: 2304226 - protein, 20 aa, Cryptosporidium parvum
SLKSFGECTLAILVEAMSFP

SEQ ID NO: 2304227 - protein, 17 aa, Cryptosporidium parvum
SLKWDTFMRRYNTIPTF

SEQ ID NO: 2304228 - protein, 26 aa, Cryptosporidium parvum
SLLAYLACYMKNWGPHLIVVPTSVML

SEQ ID NO: 2304229 - protein, 18 aa, Cryptosporidium parvum
SLLEIRMIQFFKDRDSIT

SEQ ID NO: 2304230 - protein, 19 aa, Cryptosporidium parvum
SLLEVLYSCRKRKDVDFTV

SEQ ID NO: 2304231 - protein, 19 aa, Cryptosporidium parvum
SLLEYIHGINRLRIVYKDM

SEQ ID NO: 2304232 - protein, 18 aa, Cryptosporidium parvum
SLLGTLLNRLIKGQLDSS

SEQ ID NO: 2304233 - protein, 19 aa, Cryptosporidium parvum
SLLKQEWNEDLTLEQGLHL

SEQ ID NO: 2304234 - protein, 23 aa, Cryptosporidium parvum
SLLLKLRLKCIRKQTFTPQKLID

SEQ ID NO: 2304235 - protein, 20 aa, Cryptosporidium parvum
SLLLLFPSILFITIQKHKNS

SEQ ID NO: 2304236 - protein, 22 aa, Cryptosporidium parvum
SLLNKRVYDISGTSGVKVYLNG

SEQ ID NO: 2304237 - protein, 18 aa, Cryptosporidium parvum
SLLPTIYPYLSIQFIAQV

SEQ ID NO: 2304238 - protein, 18 aa, Cryptosporidium parvum
SLLQYVLQYHIFEDSNKI

SEQ ID NO: 2304239 - protein, 18 aa, Cryptosporidium parvum
SLLSKIFHDQICFNQYSI

SEQ ID NO: 2304240 - protein, 25 aa, Cryptosporidium parvum
SLLSKNWFNPFGMFAGGYKNDEIYK

SEQ ID NO: 2304241 - protein, 18 aa, Cryptosporidium parvum
SLLSLAWKISFQEIEPLP

SEQ ID NO: 2304242 - protein, 18 aa, Cryptosporidium parvum
SLLTALLTMHMVKTKEIK

SEQ ID NO: 2304243 - protein, 26 aa, Cryptosporidium parvum
SLLYYKKEIPSIITLINSQSEYIHHT

SEQ ID NO: 2304244 - protein, 20 aa, Cryptosporidium parvum
SLMHILKYYFDLMTLPPHSV

SEQ ID NO: 2304245 - protein, 19 aa, Cryptosporidium parvum
SLMKSCCYSIGGSSCTDPV

SEQ ID NO: 2304246 - protein, 17 aa, Cryptosporidium parvum
SLNDAIMIVRRAMKSSY

SEQ ID NO: 2304247 - protein, 21 aa, Cryptosporidium parvum
SLNDTFGIIFCESKQGWTKFL

SEQ ID NO: 2304248 - protein, 25 aa, Cryptosporidium parvum
SLNIKWCSINKSWISTDAIALTQSS

SEQ ID NO: 2304249 - protein, 31 aa, Cryptosporidium parvum; identical to SEQ ID NO: 2181702

SEQ ID NO: 2304250 - protein, 18 aa, Cryptosporidium parvum
SLPAERQNSLILKASKIG

SEQ ID NO: 2304251 - protein, 23 aa, Cryptosporidium parvum
SLPAWSERKTFCKLVKKNQVVIL

SEQ ID NO: 2304252 - protein, 23 aa, Cryptosporidium parvum
SLPIRKGDEVMVIRGSNHDYEGV

SEQ ID NO: 2304253 - protein, 18 aa, Cryptosporidium parvum
SLPLKVYDMRGSDENGID

SEQ ID NO: 2304254 - protein, 18 aa, Cryptosporidium parvum
SLPPFKYWEYFQADPSQN

SEQ ID NO: 2304255 - protein, 19 aa, Cryptosporidium parvum
SLPPLPFEISKLYKEYKIP

SEQ ID NO: 2304256 - protein, 30 aa, Cryptosporidium parvum
SLPSVCPTKGCGNRTAWQLRLENCDFGDWQ

SEQ ID NO: 2304257 - protein, 30 aa, Cryptosporidium parvum; identical to SEQ ID NO: 2181707

SEQ ID NO: 2304258 - protein, 22 aa, Cryptosporidium parvum
SLQNKYRCAVLMFQEEFALRLL

SEQ ID NO: 2304259 - protein, 22 aa, Cryptosporidium parvum
SLQRKCELLELSFNLKGQESEI

SEQ ID NO: 2304260 - protein, 25 aa, Cryptosporidium parvum
SLQSNRIVNWSINFSKNVNNVQELY

SEQ ID NO: 2304261 - protein, 25 aa, Cryptosporidium parvum
SLRARAPCVTIEWYPGGRRLVVGTV

SEQ ID NO: 2304262 - protein, 21 aa, Cryptosporidium parvum
SLRNMPFLRLDGTTLSEDRQE

SEQ ID NO: 2304263 - protein, 18 aa, Cryptosporidium parvum
SLSCLKPGIRLEDKLHEM

SEQ ID NO: 2304264 - protein, 20 aa, Cryptosporidium parvum
SLSCSWKRYCEQHTLRKKAD

SEQ ID NO: 2304265 - protein, 25 aa, Cryptosporidium parvum
SLSDLRITSIFQKYGQIVSIKRQDP

SEQ ID NO: 2304266 - protein, 23 aa, Cryptosporidium parvum
SLSIFVKDRMTILTFGYSENVEM

SEQ ID NO: 2304267 - protein, 20 aa, Cryptosporidium parvum
SLSKMWGYSIMEHFDSKQQD

SEQ ID NO: 2304268 - protein, 20 aa, Cryptosporidium parvum
SLSLWDLRTSCIDEPIMKNK

SEQ ID NO: 2304269 - protein, 23 aa, Cryptosporidium parvum
SLSNGESFVFLPVQLIPQLLQKT

SEQ ID NO: 2304270 - protein, 21 aa, Cryptosporidium parvum
SLSPPTPFKAVIELPTVDEGS

SEQ ID NO: 2304271 - protein, 25 aa, Cryptosporidium parvum
SLSRISLKRKYVLEVLDNIEKIIST

SEQ ID NO: 2304272 - protein, 25 aa, Cryptosporidium parvum
SLSSEKKWRMKIENIMKSNDKSSQN

SEQ ID NO: 2304273 - protein, 20 aa, Cryptosporidium parvum
SLSSGGLFGSGTSPLGLPSS

SEQ ID NO: 2304274 - protein, 20 aa, Cryptosporidium parvum
SLSSISWRYHLIKTKDDNFI

SEQ ID NO: 2304275 - protein, 20 aa, Cryptosporidium parvum
SLSSLNSWVTFFESKDINQI

SEQ ID NO: 2304276 - protein, 19 aa, Cryptosporidium parvum
SLSSPGILASASWDGTVRI

SEQ ID NO: 2304277 - protein, 21 aa, Cryptosporidium parvum
SLSTSHPVQFISFSPSNQQIL

SEQ ID NO: 2304278 - protein, 21 aa, Cryptosporidium parvum
SLSVFKLKFLYFAENISLFES

SEQ ID NO: 2304279 - protein, 18 aa, Cryptosporidium parvum
SLSVLRQSKKFLAAISLE

SEQ ID NO: 2304280 - protein, 24 aa, Cryptosporidium parvum
SLSYCLGDSLALYGQNPVNEAIKA

SEQ ID NO: 2304281 - protein, 29 aa, Cryptosporidium parvum
SLTEIENDCSLCLRQIGISNNIPGVVLQC

SEQ ID NO: 2304282 - protein, 23 aa, Cryptosporidium parvum
SLTINRYLSIFFKVLNNNETQDL

SEQ ID NO: 2304283 - protein, 21 aa, Cryptosporidium parvum
SLTTLKSGDYWDYDGDGKMSD

SEQ ID NO: 2304284 - protein, 20 aa, Cryptosporidium parvum
SLTVQCFHEIGSTFIKELSA

SEQ ID NO: 2304285 - protein, 19 aa, Cryptosporidium parvum
SLTYSLKFTRLTINLNPSF

SEQ ID NO: 2304286 - protein, 23 aa, Cryptosporidium parvum
SLVGGKWIISGFISSLDKGRPSP

SEQ ID NO: 2304287 - protein, 18 aa, Cryptosporidium parvum
SLVKRKIDRFSIKKLISV

SEQ ID NO: 2304288 - protein, 23 aa, Cryptosporidium parvum
SLVPVCRSMIRLSSTRDPTTAMK

SEQ ID NO: 2304289 - protein, 25 aa, Cryptosporidium parvum
SLVRKTHNLFGFKFLNIGIKNQINL

SEQ ID NO: 2304290 - protein, 20 aa, Cryptosporidium parvum
SLVSCLWFYEVEERKSIEAS

SEQ ID NO: 2304291 - protein, 25 aa, Cryptosporidium parvum
SLVSNRVSYSFGFRGPSQTIDTACS

SEQ ID NO: 2304292 - protein, 24 aa, Cryptosporidium parvum
SLYEDVRLQFAYFIYGNNSWIKIS

SEQ ID NO: 2304293 - protein, 19 aa, Cryptosporidium parvum
SLYHQFGFIGENSVTPHTL

SEQ ID NO: 2304294 - protein, 18 aa, Cryptosporidium parvum
SLYLASCIWVCYENFLSI

SEQ ID NO: 2304295 - protein, 18 aa, Cryptosporidium parvum
SLYMENFSPYVLLLQIDI

SEQ ID NO: 2304296 - protein, 25 aa, Cryptosporidium parvum
SLYNEWSTACSFVNTGDVIEIFGGY

SEQ ID NO: 2304297 - protein, 18 aa, Cryptosporidium parvum
SLYSSLFLSNGHSSKLGS

SEQ ID NO: 2304298 - protein, 21 aa, Cryptosporidium parvum
SMAIDWTFEDVQAMFEKEELT

SEQ ID NO: 2304299 - protein, 22 aa, Cryptosporidium parvum
SMCKHLKQSLLLQNSGRHRFKH

SEQ ID NO: 2304300 - protein, 22 aa, Cryptosporidium parvum
SMDKVCRWNDIHLLVPRGRYEI

SEQ ID NO: 2304301 - protein, 20 aa, Cryptosporidium parvum
SMDLKCMYKVLKMELLKNPF

SEQ ID NO: 2304302 - protein, 24 aa, Cryptosporidium parvum
SMDLPIIRLRVEYECDSQLINSKR

SEQ ID NO: 2304303 - protein, 25 aa, Cryptosporidium parvum
SMDRISPKLPMVLKDFGNMEFLQPT

SEQ ID NO: 2304304 - protein, 21 aa, Cryptosporidium parvum
SMERVCLFLNLANDPTIERIL

SEQ ID NO: 2304305 - protein, 17 aa, Cryptosporidium parvum
SMFDKYIFKNSIFDDEV

SEQ ID NO: 2304306 - protein, 20 aa, Cryptosporidium parvum
SMFIDEFRGLLYVLYLNSDI

SEQ ID NO: 2304307 - protein, 19 aa, Cryptosporidium parvum
SMFIPFDLITNLNVNKLVL

SEQ ID NO: 2304308 - protein, 17 aa, Cryptosporidium parvum
SMGYGFLEFKTSENAKE

SEQ ID NO: 2304309 - protein, 29 aa, Cryptosporidium parvum
SMKCKNVKPGECFFGLSPPYVGDDQLGHH

SEQ ID NO: 2304310 - protein, 25 aa, Cryptosporidium parvum
SMKEIGDKILMEFSKDELDCIWTDD

SEQ ID NO: 2304311 - protein, 25 aa, Cryptosporidium parvum
SMKKAIQIFSCLSVSTETRVRVACV

SEQ ID NO: 2304312 - protein, 28 aa, Cryptosporidium parvum
SMLARKLSCFDWFECESSIVSMKIRQKI

SEQ ID NO: 2304313 - protein, 17 aa, Cryptosporidium parvum
SMMKREIRWADIEEDDH

SEQ ID NO: 2304314 - protein, 25 aa, Cryptosporidium parvum
SMNGREVTIEIALGKNGGGGRGAGS

SEQ ID NO: 2304315 - protein, 28 aa, Cryptosporidium parvum
SMNHLISMFKWRVSTYPLSDMESNLRED

SEQ ID NO: 2304316 - protein, 19 aa, Cryptosporidium parvum
SMNLGEDFIPYAISVLQLF

SEQ ID NO: 2304317 - protein, 28 aa, Cryptosporidium parvum
SMPESKFLGPLMPWEYYEPWDPILRPTL

SEQ ID NO: 2304318 - protein, 19 aa, Cryptosporidium parvum
SMQLLIYKYHLMVAESCLD

SEQ ID NO: 2304319 - protein, 24 aa, Cryptosporidium parvum
SMTFKDTYLALAYSRDEYISKFNS

SEQ ID NO: 2304320 - protein, 26 aa, Cryptosporidium parvum
SMTRLQMLKIWKGLYYSMWLSDKVLI

SEQ ID NO: 2304321 - protein, 23 aa, Cryptosporidium parvum
SNADIPSNCDFCSNQTSEIINSE

SEQ ID NO: 2304322 - protein, 24 aa, Cryptosporidium parvum
SNAIMMITFLYKLIEILKDYFKVL

SEQ ID NO: 2304323 - protein, 20 aa, Cryptosporidium parvum
SNATLNLLLHLLKVSIADLN

SEQ ID NO: 2304324 - protein, 27 aa, Cryptosporidium parvum
SNCCSGCSFLNNIFEFHGLDPLISFSI

SEQ ID NO: 2304325 - protein, 26 aa, Cryptosporidium parvum
SNCDVPWPLTGGDQFLHFNESDNAIS

SEQ ID NO: 2304326 - protein, 28 aa, Cryptosporidium parvum
SNCIKQFRLVFGPLFLPRQFIKYPTESE

SEQ ID NO: 2304327 - protein, 20 aa, Cryptosporidium parvum
SNDDMLLWSRLMEDFIAIHK

SEQ ID NO: 2304328 - protein, 27 aa, Cryptosporidium parvum
SNDITEVFSVLGIEAVRRALLRELRTV

SEQ ID NO: 2304329 - protein, 20 aa, Cryptosporidium parvum
SNDRNPLCTLTMKSIDLNPP

SEQ ID NO: 2304330 - protein, 18 aa, Cryptosporidium parvum
SNDWSFLQSRKGMAPFTG

SEQ ID NO: 2304331 - protein, 38 aa, Cryptosporidium parvum
SNEADYDWRNECLRILNLLRKEQNSFLFENPVLESNDL

SEQ ID NO: 2304332 - protein, 25 aa, Cryptosporidium parvum
SNEDFPEYYHDLFPQFNDSSEEKDV

SEQ ID NO: 2304333 - protein, 18 aa, Cryptosporidium parvum
SNEECTILLLDRSFDTAP

SEQ ID NO: 2304334 - protein, 17 aa, Cryptosporidium parvum
SNEEFIESSALRTAKND

SEQ ID NO: 2304335 - protein, 24 aa, Cryptosporidium parvum
SNEFPLWKNACMYINHRDSMVRNT

SEQ ID NO: 2304336 - protein, 25 aa, Cryptosporidium parvum
SNEGLKLLGREVMLGRLYRRDKLLV

SEQ ID NO: 2304337 - protein, 18 aa, Cryptosporidium parvum
SNEGRGYVLRRILRRAIR

SEQ ID NO: 2304338 - protein, 19 aa, Cryptosporidium parvum
SNEILTWIRNGFFDGKGDL

SEQ ID NO: 2304339 - protein, 30 aa, Cryptosporidium parvum; identical to SEQ ID NO: 2181784

SEQ ID NO: 2304340 - protein, 18 aa, Cryptosporidium parvum
SNELKMDIVYERVSYDTL

SEQ ID NO: 2304341 - protein, 25 aa, Cryptosporidium parvum
SNERFKIIYWLSLHSNRLKFQSCTF

SEQ ID NO: 2304342 - protein, 25 aa, Cryptosporidium parvum
SNEWYSLDIPFRLKYGHIRRASIQV

SEQ ID NO: 2304343 - protein, 20 aa, Cryptosporidium parvum
SNFDRYCIELEKKKFKWSFL

SEQ ID NO: 2304344 - protein, 32 aa, Cryptosporidium parvum; identical to SEQ ID NO: 2181788

SEQ ID NO: 2304345 - protein, 17 aa, Cryptosporidium parvum
SNFEIIYQLFLDSASNK

SEQ ID NO: 2304346 - protein, 17 aa, Cryptosporidium parvum
SNFKIRNMLLPLINVIQ

SEQ ID NO: 2304347 - protein, 17 aa, Cryptosporidium parvum
SNFKTLIFKQLISTSIY

SEQ ID NO: 2304348 - protein, 27 aa, Cryptosporidium parvum
SNFKVIYKILCLILSMLETNQNTKKSL

SEQ ID NO: 2304349 - protein, 26 aa, Cryptosporidium parvum
SNFPKLLESSLRFGSSLLIQDVGSSL

SEQ ID NO: 2304350 - protein, 23 aa, Cryptosporidium parvum
SNFRAFHKYNRFMKVALTVIAQQ

SEQ ID NO: 2304351 - protein, 17 aa, Cryptosporidium parvum
SNFSANPFIPLKGEAIA

SEQ ID NO: 2304352 - protein, 22 aa, Cryptosporidium parvum
SNGCADELLIHASLDALDENTW

SEQ ID NO: 2304353 - protein, 22 aa, Cryptosporidium parvum
SNGDIDRCLFLLSSVFLNEYSY

SEQ ID NO: 2304354 - protein, 19 aa, Cryptosporidium parvum
SNGEFIMDLYYSFWNHLIS

SEQ ID NO: 2304355 - protein, 20 aa, Cryptosporidium parvum
SNGIEDLKLFIAFSQEQDNR

SEQ ID NO: 2304356 - protein, 18 aa, Cryptosporidium parvum
SNGMQIIDTWPYAFPRYK

SEQ ID NO: 2304357 - protein, 29 aa, Cryptosporidium parvum
SNGQPIRKSCAGRPRLDRSDWCCSLCRCI

SEQ ID NO: 2304358 - protein, 18 aa, Cryptosporidium parvum
SNHMRILLLDPKWKQQKD

SEQ ID NO: 2304359 - protein, 24 aa, Cryptosporidium parvum
SNIARRFGVEMVFFHGRGGSIGRG

SEQ ID NO: 2304360 - protein, 25 aa, Cryptosporidium parvum
SNIEKLKKMGLCLNTKILQLGNVEL

SEQ ID NO: 2304361 - protein, 22 aa, Cryptosporidium parvum
SNIKRRCLFLAESATTSFFRRL

SEQ ID NO: 2304362 - protein, 24 aa, Cryptosporidium parvum
SNILDSICFVLGITNLSQIRINKL

SEQ ID NO: 2304363 - protein, 19 aa, Cryptosporidium parvum
SNILKLSKYIVIGDEIPKL

SEQ ID NO: 2304364 - protein, 20 aa, Cryptosporidium parvum
SNIMCPGLTSPGGRMEQVEQ

SEQ ID NO: 2304365 - protein, 28 aa, Cryptosporidium parvum
SNIPCPLFRQLWSEFEWENKIPIHTSCD

SEQ ID NO: 2304366 - protein, 24 aa, Cryptosporidium parvum
SNIPKLSPIFKVNLSSGVTPLLLP

SEQ ID NO: 2304367 - protein, 24 aa, Cryptosporidium parvum
SNIQLPSNIPIIFDHKEYKDQESL

SEQ ID NO: 2304368 - protein, 30 aa, Cryptosporidium parvum
SNISKAFGIPPRFSESLIMNTNEGKKLLVS

SEQ ID NO: 2304369 - protein, 25 aa, Cryptosporidium parvum
SNISRCAVCGKTITKGTYRLGVPEY

SEQ ID NO: 2304370 - protein, 24 aa, Cryptosporidium parvum
SNIVKFFPRYLIYYPQITSQALNF

SEQ ID NO: 2304371 - protein, 17 aa, Cryptosporidium parvum
SNIYRRGLIEIPPANDA

SEQ ID NO: 2304372 - protein, 18 aa, Cryptosporidium parvum
SNKDKEICELRRMIEDLE

SEQ ID NO: 2304373 - protein, 25 aa, Cryptosporidium parvum
SNKDLKCLICFNTGILKRVLIPQKF

SEQ ID NO: 2304374 - protein, 25 aa, Cryptosporidium parvum
SNKITEISRAWVLEAEASKQILDNA

SEQ ID NO: 2304375 - protein, 18 aa, Cryptosporidium parvum
SNKIWVWTVHDFSEEQKL

SEQ ID NO: 2304376 - protein, 23 aa, Cryptosporidium parvum
SNKLEVCTVIGLVYPEEIINMLR

SEQ ID NO: 2304377 - protein, 22 aa, Cryptosporidium parvum
SNKLRFPSIYTELISSKVEYEK

SEQ ID NO: 2304378 - protein, 19 aa, Cryptosporidium parvum
SNKPIIWIQITYKKLLKGS

SEQ ID NO: 2304379 - protein, 17 aa, Cryptosporidium parvum
SNKSLANSVTTFRTNTK

SEQ ID NO: 2304380 - protein, 20 aa, Cryptosporidium parvum
SNKYRIPFHYLIKHPINALK

SEQ ID NO: 2304381 - protein, 29 aa, Cryptosporidium parvum
SNLAFKLQRLVLFIPPGWLQYLPGEIDLR

SEQ ID NO: 2304382 - protein, 21 aa, Cryptosporidium parvum
SNLGRKCYFGLEEDLLKEFQV

SEQ ID NO: 2304383 - protein, 17 aa, Cryptosporidium parvum
SNLIIPAQKKLLNTTSP

SEQ ID NO: 2304384 - protein, 18 aa, Cryptosporidium parvum
SNLISLKFQERLIDNHGR

SEQ ID NO: 2304385 - protein, 18 aa, Cryptosporidium parvum
SNLKIYIHHLLKNQMEIV

SEQ ID NO: 2304386 - protein, 30 aa, Cryptosporidium parvum; identical to SEQ ID NO: 2181830

SEQ ID NO: 2304387 - protein, 26 aa, Cryptosporidium parvum
SNLLAEVVWSLPLLYAEKLLILVESV

SEQ ID NO: 2304388 - protein, 17 aa, Cryptosporidium parvum
SNLLRIIAGRSFCKECG

SEQ ID NO: 2304389 - protein, 18 aa, Cryptosporidium parvum
SNLLRKTNFCLVDYIHKE

SEQ ID NO: 2304390 - protein, 18 aa, Cryptosporidium parvum
SNLMRYGKKELLNSSEII

SEQ ID NO: 2304391 - protein, 32 aa, Cryptosporidium parvum
SNLPNSFLERIFLRYNQLFEIFLCQVNDSDSS

SEQ ID NO: 2304392 - protein, 24 aa, Cryptosporidium parvum
SNLQELFDAWMLYINFEKDRMLSI

SEQ ID NO: 2304393 - protein, 31 aa, Cryptosporidium parvum
SNLQPEIRSSWKLNGKKCLERDIIALRKGLN

SEQ ID NO: 2304394 - protein, 27 aa, Cryptosporidium parvum
SNLRWAFRSLYKFAFGDIAYAKKIGED

SEQ ID NO: 2304395 - protein, 22 aa, Cryptosporidium parvum
SNLSARCIYNIKDLEVEELLEF

SEQ ID NO: 2304396 - protein, 24 aa, Cryptosporidium parvum
SNLSLKESLQILGDIVLEQFGPFS

SEQ ID NO: 2304397 - protein, 23 aa, Cryptosporidium parvum
SNMLKKYTARYEIQIPPDNQFQI

SEQ ID NO: 2304398 - protein, 20 aa, Cryptosporidium parvum
SNMPFPYKHEFFSGLIKLPF

SEQ ID NO: 2304399 - protein, 26 aa, Cryptosporidium parvum
SNMQMWRRRWEPCLPHILRSPLSIKE

SEQ ID NO: 2304400 - protein, 24 aa, Cryptosporidium parvum
SNNEFKEIIKILKSIVDELERNET

SEQ ID NO: 2304401 - protein, 30 aa, Cryptosporidium parvum; identical to SEQ ID NO: 2181847

SEQ ID NO: 2304402 - protein, 27 aa, Cryptosporidium parvum
SNNKSVPGWGNWCSSVSRIMDLNIREK

SEQ ID NO: 2304403 - protein, 20 aa, Cryptosporidium parvum
SNNRHGFAVNSDRGVGTGGI

SEQ ID NO: 2304404 - protein, 17 aa, Cryptosporidium parvum
SNNRLASGYARLIHSFI

SEQ ID NO: 2304405 - protein, 17 aa, Cryptosporidium parvum
SNPEYIRYFLSKMKEEF

SEQ ID NO: 2304406 - protein, 17 aa, Cryptosporidium parvum
SNPFIGNFFILKTDHNF

SEQ ID NO: 2304407 - protein, 24 aa, Cryptosporidium parvum
SNPIFRITLQIIFQEIYDFQLSLS

SEQ ID NO: 2304408 - protein, 24 aa, Cryptosporidium parvum
SNPIIVHFDFFKSYWKSQEIHITL

SEQ ID NO: 2304409 - protein, 17 aa, Cryptosporidium parvum
SNPKYEELMEWLIKEQN

SEQ ID NO: 2304410 - protein, 17 aa, Cryptosporidium parvum
SNPMNRLLAKFHKKRPS

SEQ ID NO: 2304411 - protein, 23 aa, Cryptosporidium parvum
SNPMTRLRFLKFEHILDASEFDI

SEQ ID NO: 2304412 - protein, 22 aa, Cryptosporidium parvum
SNPNVIPCVLQESIIDTENSSQ

SEQ ID NO: 2304413 - protein, 21 aa, Cryptosporidium parvum
SNQIINCVCDFWEEIQIYWSI

SEQ ID NO: 2304414 - protein, 23 aa, Cryptosporidium parvum
SNQKFILRWIDTQLKEWEKLLKC

SEQ ID NO: 2304415 - protein, 24 aa, Cryptosporidium parvum
SNQSLNFYSVFQWARIPKQLYEMI

SEQ ID NO: 2304416 - protein, 26 aa, Cryptosporidium parvum
SNRCFNFKKHLFNQLQVIGQFNKGFI

SEQ ID NO: 2304417 - protein, 18 aa, Cryptosporidium parvum
SNRDVCSDKSKPRAENTN

SEQ ID NO: 2304418 - protein, 21 aa, Cryptosporidium parvum
SNREEFLCYYIIYVTLQNMKA

SEQ ID NO: 2304419 - protein, 24 aa, Cryptosporidium parvum
SNRKPVENYSRFEGFEQRQENVIK

SEQ ID NO: 2304420 - protein, 25 aa, Cryptosporidium parvum
SNRLCNSFLTFLSFIYGFFEITSSD

SEQ ID NO: 2304421 - protein, 24 aa, Cryptosporidium parvum
SNRQSKCLFPDSLIYETWGKSKWK

SEQ ID NO: 2304422 - protein, 23 aa, Cryptosporidium parvum
SNRYKLLYGKTIKWLGSNTPLHI

SEQ ID NO: 2304423 - protein, 35 aa, Cryptosporidium parvum
SNSEKRKAFNWLVREIENYKSLYLQFLCVTLPSNI

SEQ ID NO: 2304424 - protein, 31 aa, Cryptosporidium parvum
SNSEYYLFLTWNNCILGYIPINTNKINKISL

SEQ ID NO: 2304425 - protein, 25 aa, Cryptosporidium parvum
SNSFFFKRVVINPAFYDPNVFQVEI

SEQ ID NO: 2304426 - protein, 32 aa, Cryptosporidium parvum; identical to SEQ ID NO: 2181865

SEQ ID NO: 2304427 - protein, 19 aa, Cryptosporidium parvum
SNSGGFCEYIIRSAIKELA

SEQ ID NO: 2304428 - protein, 18 aa, Cryptosporidium parvum
SNSGWGIVDVRRLDGARD

SEQ ID NO: 2304429 - protein, 17 aa, Cryptosporidium parvum
SNSISYCGNENLIKNNN

SEQ ID NO: 2304430 - protein, 19 aa, Cryptosporidium parvum
SNSLEEISTYLGVKTDKIL

SEQ ID NO: 2304431 - protein, 23 aa, Cryptosporidium parvum
SNSLKAAAAQMILHEINKNRNQL

SEQ ID NO: 2304432 - protein, 24 aa, Cryptosporidium parvum
SNSQCLPNSRFLSGSSQLEEQLVS

SEQ ID NO: 2304433 - protein, 30 aa, Cryptosporidium parvum; identical to SEQ ID NO: 2181873

SEQ ID NO: 2304434 - protein, 24 aa, Cryptosporidium parvum
SNSRLPSLLSVLGKHLLIANLASE

SEQ ID NO: 2304435 - protein, 17 aa, Cryptosporidium parvum
SNSRRSPKMSYSNAVSG

SEQ ID NO: 2304436 - protein, 24 aa, Cryptosporidium parvum
SNSRSCPRAGSRQVQRKSIERGRS

SEQ ID NO: 2304437 - protein, 20 aa, Cryptosporidium parvum
SNSYIKTWGKEKWTNDLIHK

SEQ ID NO: 2304438 - protein, 26 aa, Cryptosporidium parvum
SNTCSILPGLLAKYGNLTPVPVSIKS

SEQ ID NO: 2304439 - protein, 20 aa, Cryptosporidium parvum
SNTCSKIGVNNCYIDPISPG

SEQ ID NO: 2304440 - protein, 17 aa, Cryptosporidium parvum
SNTEWNKCLKIRQICSR

SEQ ID NO: 2304441 - protein, 18 aa, Cryptosporidium parvum
SNTLCDITSFLYKQLNNR

SEQ ID NO: 2304442 - protein, 17 aa, Cryptosporidium parvum
SNTSMAIDWTFEDVQAM

SEQ ID NO: 2304443 - protein, 27 aa, Cryptosporidium parvum
SNVCHCPLMRAHFMVFKWQEDPKKAAL

SEQ ID NO: 2304444 - protein, 20 aa, Cryptosporidium parvum
SNVELFPISNFVNITSSNII

SEQ ID NO: 2304445 - protein, 21 aa, Cryptosporidium parvum
SNVIDAMLFVFGKRAKHMRLN

SEQ ID NO: 2304446 - protein, 18 aa, Cryptosporidium parvum
SNVLLLLKVDGWDDILLE

SEQ ID NO: 2304447 - protein, 21 aa, Cryptosporidium parvum
SNVPVLAPPPVAEYMPVTTPI

SEQ ID NO: 2304448 - protein, 19 aa, Cryptosporidium parvum
SNVYMSIAIQRLMNAKYAF

SEQ ID NO: 2304449 - protein, 23 aa, Cryptosporidium parvum
SNWEFPIKKINSGSNHVLVLLSN

SEQ ID NO: 2304450 - protein, 20 aa, Cryptosporidium parvum
SNYHVNYYCGKSGGSEEVKR

SEQ ID NO: 2304451 - protein, 20 aa, Cryptosporidium parvum
SNYLKPGGFFIGSTISCDHI

SEQ ID NO: 2304452 - protein, 24 aa, Cryptosporidium parvum
SNYRNTCRYMKPLIGMLPNNVVET

SEQ ID NO: 2304453 - protein, 21 aa, Cryptosporidium parvum
SNYYATAFLRYLPGINAKNIK

SEQ ID NO: 2304454 - protein, 27 aa, Cryptosporidium parvum
SPACLHLKKFECELCKVYFPTQLRLID

SEQ ID NO: 2304455 - protein, 19 aa, Cryptosporidium parvum
SPADIFGSFGQDVSGRRQP

SEQ ID NO: 2304456 - protein, 24 aa, Cryptosporidium parvum
SPAEFKSHLEFGEMILKEGKDQFE

SEQ ID NO: 2304457 - protein, 20 aa, Cryptosporidium parvum
SPAIAFRLLGLRNKLVKKPK

SEQ ID NO: 2304458 - protein, 21 aa, Cryptosporidium parvum
SPCKIPITELCELLKEGESCS

SEQ ID NO: 2304459 - protein, 20 aa, Cryptosporidium parvum
SPDEAVSWGKIKAESTPVKV

SEQ ID NO: 2304460 - protein, 18 aa, Cryptosporidium parvum
SPDGRYIASASFDKTIRL

SEQ ID NO: 2304461 - protein, 25 aa, Cryptosporidium parvum
SPEAMDLICSLVCEPSQRIKSAKEA

SEQ ID NO: 2304462 - protein, 23 aa, Cryptosporidium parvum
SPEDKQIFCTQYLPHLLTSIKVH

SEQ ID NO: 2304463 - protein, 24 aa, Cryptosporidium parvum
SPEIIWQYYIELMINEKNIEFADI

SEQ ID NO: 2304464 - protein, 17 aa, Cryptosporidium parvum
SPESMRHREYESFHGNG

SEQ ID NO: 2304465 - protein, 19 aa, Cryptosporidium parvum
SPETMRRIQRDSGRGPRMG

SEQ ID NO: 2304466 - protein, 18 aa, Cryptosporidium parvum
SPFHFIWDSIIFNKTKKI

SEQ ID NO: 2304467 - protein, 28 aa, Cryptosporidium parvum
SPFQPEFWSYRILTSMSIKIKDANDNRI

SEQ ID NO: 2304468 - protein, 26 aa, Cryptosporidium parvum
SPFSSKELKRVFSIEFGVLSPELIRK

SEQ ID NO: 2304469 - protein, 22 aa, Cryptosporidium parvum
SPGEWSLKPFVVHKGNNNHVNA

SEQ ID NO: 2304470 - protein, 17 aa, Cryptosporidium parvum
SPGNSVLKIRMRQLEDY

SEQ ID NO: 2304471 - protein, 26 aa, Cryptosporidium parvum
SPGPYEWLYNPLLMNLYGNYSAASQA

SEQ ID NO: 2304472 - protein, 22 aa, Cryptosporidium parvum
SPGSCFWLPAGARLYNKLMDFI

SEQ ID NO: 2304473 - protein, 18 aa, Cryptosporidium parvum
SPHAENCVQLFSPDNYDG

SEQ ID NO: 2304474 - protein, 18 aa, Cryptosporidium parvum
SPHFKKLKTFNSLQNQEK

SEQ ID NO: 2304475 - protein, 25 aa, Cryptosporidium parvum
SPHLFVAFCRARMLSPDCRCKTFDA

SEQ ID NO: 2304476 - protein, 20 aa, Cryptosporidium parvum
SPHWKLPLFGDPLFAILKDL

SEQ ID NO: 2304477 - protein, 22 aa, Cryptosporidium parvum
SPIGVSCLDSALQDRLNIILQK

SEQ ID NO: 2304478 - protein, 25 aa, Cryptosporidium parvum
SPIKNSHIYDRFGLETPSGVLLYGP

SEQ ID NO: 2304479 - protein, 18 aa, Cryptosporidium parvum
SPINPYCRVHPREMIQTG

SEQ ID NO: 2304480 - protein, 18 aa, Cryptosporidium parvum
SPIRRAADILVHQMVYDI

SEQ ID NO: 2304481 - protein, 17 aa, Cryptosporidium parvum
SPIRRYADIIVHRLLSA

SEQ ID NO: 2304482 - protein, 22 aa, Cryptosporidium parvum
SPIVGFIRPLSYLERLEKEAKM

SEQ ID NO: 2304483 - protein, 22 aa, Cryptosporidium parvum
SPIYKACRRLDIGGYHLDLALK

SEQ ID NO: 2304484 - protein, 19 aa, Cryptosporidium parvum
SPKLCPEICFVKSNEKMNL

SEQ ID NO: 2304485 - protein, 18 aa, Cryptosporidium parvum
SPKLEIIGFYSGLPDEKC

SEQ ID NO: 2304486 - protein, 18 aa, Cryptosporidium parvum
SPKLSVLLSTPYVEIVPV

SEQ ID NO: 2304487 - protein, 25 aa, Cryptosporidium parvum
SPKSLSFPEPVIFMGDFIQGRKNRE

SEQ ID NO: 2304488 - protein, 24 aa, Cryptosporidium parvum
SPKVKVLLCNVIDLISPFHGITTR

SEQ ID NO: 2304489 - protein, 20 aa, Cryptosporidium parvum
SPLEVCLSNLIGIDISSINE

SEQ ID NO: 2304490 - protein, 21 aa, Cryptosporidium parvum
SPLLCTSTMRGQRKRYSIYYM

SEQ ID NO: 2304491 - protein, 18 aa, Cryptosporidium parvum
SPLLHFDEKLVFNVFSSA

SEQ ID NO: 2304492 - protein, 17 aa, Cryptosporidium parvum
SPLRMKVVLQKVKGASV

SEQ ID NO: 2304493 - protein, 18 aa, Cryptosporidium parvum
SPLVKNALRRLNKSDILF

SEQ ID NO: 2304494 - protein, 22 aa, Cryptosporidium parvum
SPLVSKCTLLYFSMPSNQLNEP

SEQ ID NO: 2304495 - protein, 27 aa, Cryptosporidium parvum
SPNFNRLRLQFIFFYYDSNRDGLLSID

SEQ ID NO: 2304496 - protein, 25 aa, Cryptosporidium parvum
SPNNRRSTESLAMNYRQSSVPPLDQ

SEQ ID NO: 2304497 - protein, 24 aa, Cryptosporidium parvum
SPNSLLKVIDWGFAAKCPKTHKFT

SEQ ID NO: 2304498 - protein, 24 aa, Cryptosporidium parvum
SPNVKTRFPSVITIFSAPNYCDVY

SEQ ID NO: 2304499 - protein, 17 aa, Cryptosporidium parvum
SPPEVFEYEALDPENFL

SEQ ID NO: 2304500 - protein, 19 aa, Cryptosporidium parvum
SPPPLPVSCNNNYSRSLNS

SEQ ID NO: 2304501 - protein, 23 aa, Cryptosporidium parvum
SPQKHYFGARMILQIFTQLKLSA

SEQ ID NO: 2304502 - protein, 18 aa, Cryptosporidium parvum
SPQQLKLRARIHVCCCGY

SEQ ID NO: 2304503 - protein, 20 aa, Cryptosporidium parvum
SPRCVFCRNDNTFGLVKCDH

SEQ ID NO: 2304504 - protein, 26 aa, Cryptosporidium parvum
SPRELTRWKISIYSGLHSSKGSGSKS

SEQ ID NO: 2304505 - protein, 19 aa, Cryptosporidium parvum
SPRLTRFNIGWDTKQEDQN

SEQ ID NO: 2304506 - protein, 18 aa, Cryptosporidium parvum
SPRMIIIRSFDVNKPGED

SEQ ID NO: 2304507 - protein, 24 aa, Cryptosporidium parvum
SPRNFRRACLEFQQSPPGVLLASD

SEQ ID NO: 2304508 - protein, 26 aa, Cryptosporidium parvum
SPRQIARLLVLISFFRYLPNPLPKIE

SEQ ID NO: 2304509 - protein, 25 aa, Cryptosporidium parvum
SPSHSALYVTLKFPLPNIVQQFLPS

SEQ ID NO: 2304510 - protein, 31 aa, Cryptosporidium parvum
SPSNYYAVPPAQYILDTSIYSSATPYVAVPA

SEQ ID NO: 2304511 - protein, 17 aa, Cryptosporidium parvum
SPTLLKRLAEFKHTSTA

SEQ ID NO: 2304512 - protein, 27 aa, Cryptosporidium parvum
SPTPRSGHRMVVWRHYFVVFGGFHDTI

SEQ ID NO: 2304513 - protein, 22 aa, Cryptosporidium parvum
SPYCSIVSLYLWEISNGDYKDK

SEQ ID NO: 2304514 - protein, 18 aa, Cryptosporidium parvum
SPYTYKFYIDPKSKEEYD

SEQ ID NO: 2304515 - protein, 25 aa, Cryptosporidium parvum
SQALKEARRTKGIMLHFPAPESDDE

SEQ ID NO: 2304516 - protein, 18 aa, Cryptosporidium parvum
SQAPRPLPQLGSYFTPRP

SEQ ID NO: 2304517 - protein, 17 aa, Cryptosporidium parvum
SQASYWMNDCYRPGDVV

SEQ ID NO: 2304518 - protein, 25 aa, Cryptosporidium parvum
SQDFKFPFIFSKEIRSSKNVGYHRK

SEQ ID NO: 2304519 - protein, 48 aa, Cryptosporidium parvum; identical to SEQ ID NO: 2181956

SEQ ID NO: 2304520 - protein, 24 aa, Cryptosporidium parvum
SQEVRIPNQFLWRTYNKKIVDRTN

SEQ ID NO: 2304521 - protein, 17 aa, Cryptosporidium parvum
SQFDISNKLLKLGDFFI

SEQ ID NO: 2304522 - protein, 21 aa, Cryptosporidium parvum
SQFGHIFAFGMNREEARKHLI

SEQ ID NO: 2304523 - protein, 35 aa, Cryptosporidium parvum
SQFLFKNYYSSILFGFGLIPETRFNDFDFQIFLTF

SEQ ID NO: 2304524 - protein, 22 aa, Cryptosporidium parvum
SQFNARVGFSGWFGRNHLTPRG

SEQ ID NO: 2304525 - protein, 27 aa, Cryptosporidium parvum
SQFSCLRDIPNIGGMLVWSHLLQERIQ

SEQ ID NO: 2304526 - protein, 17 aa, Cryptosporidium parvum
SQGGLVNPFLMMQRMSA

SEQ ID NO: 2304527 - protein, 20 aa, Cryptosporidium parvum
SQGGRHCRIRVPKQGRSMEY

SEQ ID NO: 2304528 - protein, 25 aa, Cryptosporidium parvum
SQGHFRPILTHSFQMEYCLCFDPAI

SEQ ID NO: 2304529 - protein, 23 aa, Cryptosporidium parvum
SQHIHEWIDLIFGFKQRGPQAYS

SEQ ID NO: 2304530 - protein, 17 aa, Cryptosporidium parvum
SQHSMALIWNGSYSNKF

SEQ ID NO: 2304531 - protein, 19 aa, Cryptosporidium parvum
SQIGFKSSSLIINKEEITL

SEQ ID NO: 2304532 - protein, 18 aa, Cryptosporidium parvum
SQIKEMFQQMSISLNNSE

SEQ ID NO: 2304533 - protein, 20 aa, Cryptosporidium parvum
SQILDSHWSILLKHQSSQLN

SEQ ID NO: 2304534 - protein, 18 aa, Cryptosporidium parvum
SQIMGIKPLFPVKPLLSI

SEQ ID NO: 2304535 - protein, 25 aa, Cryptosporidium parvum
SQIPSNSLQLFSFILNDIISSLVEN

SEQ ID NO: 2304536 - protein, 22 aa, Cryptosporidium parvum
SQIRRVKFQPTLSPIAQSPLSE

SEQ ID NO: 2304537 - protein, 27 aa, Cryptosporidium parvum
SQKCKRIDKIFPIICYDTVVNDEMENR

SEQ ID NO: 2304538 - protein, 22 aa, Cryptosporidium parvum
SQKICIYQSLLQRIINKLNDKC

SEQ ID NO: 2304539 - protein, 27 aa, Cryptosporidium parvum
SQKILAHYGFVFPIMIRLKILHHHLLF

SEQ ID NO: 2304540 - protein, 22 aa, Cryptosporidium parvum
SQKILFKLFNYWNLNIDFKQSS

SEQ ID NO: 2304541 - protein, 28 aa, Cryptosporidium parvum
SQKIVKHETPFWLACWIGNEQIVQYLLN

SEQ ID NO: 2304542 - protein, 24 aa, Cryptosporidium parvum
SQKNRFVGNEVKLKIDIKKFQFSI

SEQ ID NO: 2304543 - protein, 27 aa, Cryptosporidium parvum
SQKPQGWRVVYYTGKDREFEYFKVPAN

SEQ ID NO: 2304544 - protein, 18 aa, Cryptosporidium parvum
SQKQRIQAIESFKSSNSA

SEQ ID NO: 2304545 - protein, 27 aa, Cryptosporidium parvum
SQKRIQFKIQVCKIGAGKFPILNRSKD

SEQ ID NO: 2304546 - protein, 20 aa, Cryptosporidium parvum
SQKYLKKAIQGHEFNLDEIE

SEQ ID NO: 2304547 - protein, 18 aa, Cryptosporidium parvum
SQLCPKVKLWKRIEEPNS

SEQ ID NO: 2304548 - protein, 19 aa, Cryptosporidium parvum
SQLIELENLLPFLNQEIDI

SEQ ID NO: 2304549 - protein, 17 aa, Cryptosporidium parvum
SQLLKLVFERLLQLVGI

SEQ ID NO: 2304550 - protein, 25 aa, Cryptosporidium parvum
SQLQLLLIFILKIYGAMNVSELLNL

SEQ ID NO: 2304551 - protein, 17 aa, Cryptosporidium parvum
SQLVFDYRNRPSLDETI

SEQ ID NO: 2304552 - protein, 17 aa, Cryptosporidium parvum
SQMHKSGVLIGFPQNPK

SEQ ID NO: 2304553 - protein, 22 aa, Cryptosporidium parvum
SQMIRDVINWMKERQGEAIQWL

SEQ ID NO: 2304554 - protein, 25 aa, Cryptosporidium parvum
SQMSSRRLLVFNVEYNKEYGKDTLS

SEQ ID NO: 2304555 - protein, 34 aa, Cryptosporidium parvum; identical to SEQ ID NO: 2181978

SEQ ID NO: 2304556 - protein, 22 aa, Cryptosporidium parvum
SQNLKISKSMMGAELSSLKRTK

SEQ ID NO: 2304557 - protein, 20 aa, Cryptosporidium parvum
SQNLLFPMFLNRDFVDQASK

SEQ ID NO: 2304558 - protein, 20 aa, Cryptosporidium parvum
SQNLRLAAPATLSKVIEHSQ

SEQ ID NO: 2304559 - protein, 26 aa, Cryptosporidium parvum
SQNNPRRVCICIKWNSSHHLEDNERT

SEQ ID NO: 2304560 - protein, 19 aa, Cryptosporidium parvum
SQPDSAMWFNQLNSAQQLM

SEQ ID NO: 2304561 - protein, 20 aa, Cryptosporidium parvum
SQPPKISIPFYRDNKHSKKS

SEQ ID NO: 2304562 - protein, 20 aa, Cryptosporidium parvum
SQQHLLKFIRKCYNSDKDRV

SEQ ID NO: 2304563 - protein, 19 aa, Cryptosporidium parvum
SQQRLIYKGRILKDSDSLD

SEQ ID NO: 2304564 - protein, 18 aa, Cryptosporidium parvum
SQQWLNDELINFYFSMLQ

SEQ ID NO: 2304565 - protein, 24 aa, Cryptosporidium parvum
SQREYYKSIPIVGSIRYKKQKIDL

SEQ ID NO: 2304566 - protein, 25 aa, Cryptosporidium parvum
SQRGLPSIRWVGGVEIELLAIATGA

SEQ ID NO: 2304567 - protein, 23 aa, Cryptosporidium parvum
SQRLKPGNRWFFGETEIIDKQNS

SEQ ID NO: 2304568 - protein, 18 aa, Cryptosporidium parvum
SQRPSISSNGEWLITASN

SEQ ID NO: 2304569 - protein, 18 aa, Cryptosporidium parvum
SQSCIKDGMTVTVPQSVA

SEQ ID NO: 2304570 - protein, 25 aa, Cryptosporidium parvum
SQSENKGAMILNCFSKFSRKFQNMI

SEQ ID NO: 2304571 - protein, 20 aa, Cryptosporidium parvum
SQSHTLFYRFLKFIETHLWT

SEQ ID NO: 2304572 - protein, 22 aa, Cryptosporidium parvum
SQSKLKLGIPKLGIKSKSSSDL

SEQ ID NO: 2304573 - protein, 24 aa, Cryptosporidium parvum
SQSSSQAWYLSRITSFSTNYRELS

SEQ ID NO: 2304574 - protein, 22 aa, Cryptosporidium parvum
SQVCFKENWAIHKLKHQLGGSN

SEQ ID NO: 2304575 - protein, 17 aa, Cryptosporidium parvum
SQVKQPNWTGGKELSQQ

SEQ ID NO: 2304576 - protein, 19 aa, Cryptosporidium parvum
SQWDMFSISCGTILNESGV

SEQ ID NO: 2304577 - protein, 20 aa, Cryptosporidium parvum
SQYFMWEIFIGFTDPNPNTR

SEQ ID NO: 2304578 - protein, 19 aa, Cryptosporidium parvum
SQYNELWKAIIRPPRDRYS

SEQ ID NO: 2304579 - protein, 22 aa, Cryptosporidium parvum
SRAALYRIVLKDSLACQLMTIH

SEQ ID NO: 2304580 - protein, 26 aa, Cryptosporidium parvum
SRAETRHNICFGIPAISEITCVSNAC

SEQ ID NO: 2304581 - protein, 20 aa, Cryptosporidium parvum
SRAIQILKYLGLLDPSSENL

SEQ ID NO: 2304582 - protein, 26 aa, Cryptosporidium parvum
SRALMSVKLRKMFSKPLVSVFEGHSD

SEQ ID NO: 2304583 - protein, 20 aa, Cryptosporidium parvum
SRCAKFRFQPISANSQIERL

SEQ ID NO: 2304584 - protein, 24 aa, Cryptosporidium parvum
SRCGQCKRYLTYISNILPQRLYCS

SEQ ID NO: 2304585 - protein, 20 aa, Cryptosporidium parvum
SRCKGSLGFVLLRQTFYRLQ

SEQ ID NO: 2304586 - protein, 19 aa, Cryptosporidium parvum
SRCPEPIKLGNKGMNNENN

SEQ ID NO: 2304587 - protein, 29 aa, Cryptosporidium parvum
SRDLPYTIDLCLFLGLKMTTLTSKQTTDS

SEQ ID NO: 2304588 - protein, 27 aa, Cryptosporidium parvum
SREELCAFVSYKMRRATELFTFKCSLY

SEQ ID NO: 2304589 - protein, 24 aa, Cryptosporidium parvum
SRELHSMGLLSWGSLRSTPDLGNP

SEQ ID NO: 2304590 - protein, 23 aa, Cryptosporidium parvum
SRENCGWNTFSIVSDEKNWRAVF

SEQ ID NO: 2304591 - protein, 21 aa, Cryptosporidium parvum
SRESFPWNSFKHSILGEQKSI

SEQ ID NO: 2304592 - protein, 28 aa, Cryptosporidium parvum
SREVLELKLRIGWVSVSYGDGWLDSYKI

SEQ ID NO: 2304593 - protein, 18 aa, Cryptosporidium parvum
SRFGKFIEIYFDATGKLR

SEQ ID NO: 2304594 - protein, 20 aa, Cryptosporidium parvum
SRFGKYMKLGFDENGKIINA

SEQ ID NO: 2304595 - protein, 19 aa, Cryptosporidium parvum
SRFGYPLGTRVVYINTNDG

SEQ ID NO: 2304596 - protein, 26 aa, Cryptosporidium parvum
SRFPPDAWHLCCWLLRKNSNERASPI

SEQ ID NO: 2304597 - protein, 28 aa, Cryptosporidium parvum
SRFPSEKKCCIRPLIAPYDNQTTVQPHS

SEQ ID NO: 2304598 - protein, 33 aa, Cryptosporidium parvum; identical to SEQ ID NO: 2182013

SEQ ID NO: 2304599 - protein, 25 aa, Cryptosporidium parvum
SRGCTKTRGNFMLAIFAALKSTYAY

SEQ ID NO: 2304600 - protein, 31 aa, Cryptosporidium parvum
SRGGAYNIIHGVFTWSFCKAISDIATGILQQ

SEQ ID NO: 2304601 - protein, 19 aa, Cryptosporidium parvum
SRGLNFPKIDTVIQLDPPQ

SEQ ID NO: 2304602 - protein, 20 aa, Cryptosporidium parvum
SRGLNPLMFRPHCGEAGKIS

SEQ ID NO: 2304603 - protein, 22 aa, Cryptosporidium parvum
SRGPESPIFKFVPLMQYWRHYW

SEQ ID NO: 2304604 - protein, 18 aa, Cryptosporidium parvum
SRHIKGRSDSKCRERYMN

SEQ ID NO: 2304605 - protein, 17 aa, Cryptosporidium parvum
SRIESKRSISVPVQENQ

SEQ ID NO: 2304606 - protein, 34 aa, Cryptosporidium parvum; identical to SEQ ID NO: 2182020

SEQ ID NO: 2304607 - protein, 19 aa, Cryptosporidium parvum
SRIRISQVLIFPQYQGKGL

SEQ ID NO: 2304608 - protein, 26 aa, Cryptosporidium parvum
SRISQICLPYACKLLLQELMAMSIYP

SEQ ID NO: 2304609 - protein, 19 aa, Cryptosporidium parvum
SRITRAHWGMFDQNIISGH

SEQ ID NO: 2304610 - protein, 19 aa, Cryptosporidium parvum
SRITRLPFWSGDVKLNSSR

SEQ ID NO: 2304611 - protein, 19 aa, Cryptosporidium parvum
SRIVRYETELDILKEFIPI

SEQ ID NO: 2304612 - protein, 19 aa, Cryptosporidium parvum
SRKFKRILSQMGFEEMPTN

SEQ ID NO: 2304613 - protein, 23 aa, Cryptosporidium parvum
SRKGGDRLENWLIKNLCISVFQF

SEQ ID NO: 2304614 - protein, 18 aa, Cryptosporidium parvum
SRKILLPKVMDCEKSHDI

SEQ ID NO: 2304615 - protein, 30 aa, Cryptosporidium parvum
SRKIVRSLLMVWKAKLDQVSAEAWITSLCG

SEQ ID NO: 2304616 - protein, 19 aa, Cryptosporidium parvum
SRKLFENCLDRWRRNKVSL

SEQ ID NO: 2304617 - protein, 18 aa, Cryptosporidium parvum
SRKNYVLIDISIMIEDVD

SEQ ID NO: 2304618 - protein, 19 aa, Cryptosporidium parvum
SRKVVKYTDFDDEDDELDD

SEQ ID NO: 2304619 - protein, 29 aa, Cryptosporidium parvum
SRLAALKEYSCLKALYENGFNEGEIKVPE

SEQ ID NO: 2304620 - protein, 24 aa, Cryptosporidium parvum
SRLDFSTYRRPVCSNHNDKNNQDL

SEQ ID NO: 2304621 - protein, 25 aa, Cryptosporidium parvum
SRLDKLDIVDGFLFKDDDTEKKDGV

SEQ ID NO: 2304622 - protein, 20 aa, Cryptosporidium parvum
SRLKHILNIKKIFVGVGEGN

SEQ ID NO: 2304623 - protein, 18 aa, Cryptosporidium parvum
SRLKTKRVNSKKEIEIVT

SEQ ID NO: 2304624 - protein, 19 aa, Cryptosporidium parvum
SRLLLCFLTKQILLKGLDL

SEQ ID NO: 2304625 - protein, 19 aa, Cryptosporidium parvum
SRLLRFAIDEAHCVCQWGF

SEQ ID NO: 2304626 - protein, 31 aa, Cryptosporidium parvum; identical to SEQ ID NO: 2182033

SEQ ID NO: 2304627 - protein, 19 aa, Cryptosporidium parvum
SRLSMKTLMRNSSSSYYGT

SEQ ID NO: 2304628 - protein, 18 aa, Cryptosporidium parvum
SRLSMSFDARNGRHSFNR

SEQ ID NO: 2304629 - protein, 19 aa, Cryptosporidium parvum
SRLTLSLIEELKIDFINSL

SEQ ID NO: 2304630 - protein, 17 aa, Cryptosporidium parvum
SRLTSVPLTSCNLLNDF

SEQ ID NO: 2304631 - protein, 24 aa, Cryptosporidium parvum
SRLWKLSADSHLIFYPSNNNNNND

SEQ ID NO: 2304632 - protein, 19 aa, Cryptosporidium parvum
SRLWQERFFILRSDGALIW

SEQ ID NO: 2304633 - protein, 17 aa, Cryptosporidium parvum
SRMITSSLKCNRCKNET

SEQ ID NO: 2304634 - protein, 20 aa, Cryptosporidium parvum
SRNFRCINCHDCPKCMATIS

SEQ ID NO: 2304635 - protein, 26 aa, Cryptosporidium parvum
SRNKEAFSLIRWIAIADCIALHITGK

SEQ ID NO: 2304636 - protein, 22 aa, Cryptosporidium parvum
SRNLKISSIWRGMFYMNVPKNI

SEQ ID NO: 2304637 - protein, 22 aa, Cryptosporidium parvum
SRNLPKSIKWHFIGHLQSNKVK

SEQ ID NO: 2304638 - protein, 25 aa, Cryptosporidium parvum
SRNNWGVGFLESFERKKVCQYIRVD

SEQ ID NO: 2304639 - protein, 18 aa, Cryptosporidium parvum
SRNRKYLDVFIFESADIR

SEQ ID NO: 2304640 - protein, 20 aa, Cryptosporidium parvum
SRPFPKTKVRYVQRKFQKET

SEQ ID NO: 2304641 - protein, 21 aa, Cryptosporidium parvum
SRPFSISSFYFGLVDFSISPI

SEQ ID NO: 2304642 - protein, 19 aa, Cryptosporidium parvum
SRPIYPHPFKRSTAFLLGN

SEQ ID NO: 2304643 - protein, 18 aa, Cryptosporidium parvum
SRPLTLSMSEWYTKKTQK

SEQ ID NO: 2304644 - protein, 24 aa, Cryptosporidium parvum
SRPTGLPPPLPYNSINNRESGNSR

SEQ ID NO: 2304645 - protein, 20 aa, Cryptosporidium parvum
SRPYAAISVSAMPQNQNRPL

SEQ ID NO: 2304646 - protein, 21 aa, Cryptosporidium parvum
SRQGECVLFCTPKDVPAYSKH

SEQ ID NO: 2304647 - protein, 19 aa, Cryptosporidium parvum
SRQHFRTVLYLILPKLTSV

SEQ ID NO: 2304648 - protein, 18 aa, Cryptosporidium parvum
SRQIRLLSIMGIITILED

SEQ ID NO: 2304649 - protein, 24 aa, Cryptosporidium parvum
SRQKVGQCGIHFTVLREIKIMNEI

SEQ ID NO: 2304650 - protein, 26 aa, Cryptosporidium parvum
SRQLIWPTSLHFLLAQFFSNYSEVRE

SEQ ID NO: 2304651 - protein, 30 aa, Cryptosporidium parvum; identical to SEQ ID NO: 2182053

SEQ ID NO: 2304652 - protein, 24 aa, Cryptosporidium parvum
SRQSDPLRCEISKLGAQVESLKSL

SEQ ID NO: 2304653 - protein, 17 aa, Cryptosporidium parvum
SRQVVSIVSERTLIVDS

SEQ ID NO: 2304654 - protein, 22 aa, Cryptosporidium parvum
SRREIYLLVEHDFKHIFSNDFQ

SEQ ID NO: 2304655 - protein, 24 aa, Cryptosporidium parvum
SRRKEVFNILKYNSEFNSINSNMN

SEQ ID NO: 2304656 - protein, 21 aa, Cryptosporidium parvum
SRRKNVKSLKERKKEKTGKKK

SEQ ID NO: 2304657 - protein, 17 aa, Cryptosporidium parvum
SRRPRGFGFVEYVEEED

SEQ ID NO: 2304658 - protein, 21 aa, Cryptosporidium parvum
SRRSPKMSYSNAVSGGKPSGT

SEQ ID NO: 2304659 - protein, 20 aa, Cryptosporidium parvum
SRSGRVRKMRYSNFSNIDNE

SEQ ID NO: 2304660 - protein, 21 aa, Cryptosporidium parvum
SRSHAILQIEIRSRIFSTTKE

SEQ ID NO: 2304661 - protein, 22 aa, Cryptosporidium parvum
SRSLEPFFMWQISILGNCHTPT

SEQ ID NO: 2304662 - protein, 21 aa, Cryptosporidium parvum
SRSNGCLSNWFVKDVSTSGTF

SEQ ID NO: 2304663 - protein, 17 aa, Cryptosporidium parvum
SRSRSLLSKNWFNPFGM

SEQ ID NO: 2304664 - protein, 28 aa, Cryptosporidium parvum
SRTADIWSLGAILYRITYKRHLFQQPIS

SEQ ID NO: 2304665 - protein, 17 aa, Cryptosporidium parvum
SRTMGLVSMETYKRHIS

SEQ ID NO: 2304666 - protein, 19 aa, Cryptosporidium parvum
SRTRSISRSKSWDVTSPNM

SEQ ID NO: 2304667 - protein, 23 aa, Cryptosporidium parvum
SRVAIYTWHGCILQIRGLVQQEY

SEQ ID NO: 2304668 - protein, 18 aa, Cryptosporidium parvum
SRVNRLSVLSAITSTQQR

SEQ ID NO: 2304669 - protein, 20 aa, Cryptosporidium parvum
SRWASPYIIKDIVNIIDNQM

SEQ ID NO: 2304670 - protein, 21 aa, Cryptosporidium parvum
SRWISCPSSVSITFSTMKTPE

SEQ ID NO: 2304671 - protein, 18 aa, Cryptosporidium parvum
SRYHIIALFEDYLDVISP

SEQ ID NO: 2304672 - protein, 17 aa, Cryptosporidium parvum
SRYKYISPYSEYLLERL

SEQ ID NO: 2304673 - protein, 29 aa, Cryptosporidium parvum
SRYLVPLFMRCLYSSLLLLYDYSSYLLSF

SEQ ID NO: 2304674 - protein, 23 aa, Cryptosporidium parvum
SRYSREIFNIYSILNDINTKNSF

SEQ ID NO: 2304675 - protein, 17 aa, Cryptosporidium parvum
SSACPHLAFSAILCAGI

SEQ ID NO: 2304676 - protein, 25 aa, Cryptosporidium parvum
SSADPRGIFSIKVKGLSAFWDDESA

SEQ ID NO: 2304677 - protein, 17 aa, Cryptosporidium parvum
SSAFKNKESCVISSVSS

SEQ ID NO: 2304678 - protein, 19 aa, Cryptosporidium parvum
SSALASPWMQSILNDPEIF

SEQ ID NO: 2304679 - protein, 26 aa, Cryptosporidium parvum
SSAPFPPGYMSRSWQCQDSINVPSSR

SEQ ID NO: 2304680 - protein, 19 aa, Cryptosporidium parvum
SSASLGFQNGLPLVAGGGL

SEQ ID NO: 2304681 - protein, 18 aa, Cryptosporidium parvum
SSASTLYPSFGYLYPEGT

SEQ ID NO: 2304682 - protein, 25 aa, Cryptosporidium parvum
SSATKLFILELMAKINKQLNDSGSN

SEQ ID NO: 2304683 - protein, 23 aa, Cryptosporidium parvum
SSAVFRHECAFVLGQIQVISTAD

SEQ ID NO: 2304684 - protein, 20 aa, Cryptosporidium parvum
SSCDILKLGYIVRRTPNDRE

SEQ ID NO: 2304685 - protein, 26 aa, Cryptosporidium parvum
SSCDVLPDIWIYRIINDDFSCENKAK

SEQ ID NO: 2304686 - protein, 20 aa, Cryptosporidium parvum
SSCILFICEAVSLNIKKGQT

SEQ ID NO: 2304687 - protein, 21 aa, Cryptosporidium parvum
SSCIRCCKGFERGQFCSICRK

SEQ ID NO: 2304688 - protein, 19 aa, Cryptosporidium parvum
SSCLTESTFQLIIDSVSQK

SEQ ID NO: 2304689 - protein, 21 aa, Cryptosporidium parvum
SSCSKGFVGASVFHKIDHNSE

SEQ ID NO: 2304690 - protein, 21 aa, Cryptosporidium parvum
SSCSSSSSSSCSSCISSSCSS

SEQ ID NO: 2304691 - protein, 18 aa, Cryptosporidium parvum
SSDFEWNDSLSVINKEQF

SEQ ID NO: 2304692 - protein, 28 aa, Cryptosporidium parvum
SSDFIPHKWVRLAMCEGYDINCTDFDIG

SEQ ID NO: 2304693 - protein, 26 aa, Cryptosporidium parvum
SSDLKIAAFRLLRRCMSDPSNALDFL

SEQ ID NO: 2304694 - protein, 21 aa, Cryptosporidium parvum
SSDMWGFGCILMELYTGVLLF

SEQ ID NO: 2304695 - protein, 17 aa, Cryptosporidium parvum
SSDNRWIAVSTKNSELF

SEQ ID NO: 2304696 - protein, 21 aa, Cryptosporidium parvum
SSDSNSIYILFRVIPSDNDLI

SEQ ID NO: 2304697 - protein, 25 aa, Cryptosporidium parvum
SSDSRSDKLLNMWISEINGDTRDSL

SEQ ID NO: 2304698 - protein, 21 aa, Cryptosporidium parvum
SSEAFGLWIDQVYNFTIKSLE

SEQ ID NO: 2304699 - protein, 22 aa, Cryptosporidium parvum
SSECGKLVFIGGGNGIIYKIYY

SEQ ID NO: 2304700 - protein, 17 aa, Cryptosporidium parvum
SSEIMRKATRLVDQLLI

SEQ ID NO: 2304701 - protein, 20 aa, Cryptosporidium parvum
SSELKRMFDNCRFYNAKNTI

SEQ ID NO: 2304702 - protein, 25 aa, Cryptosporidium parvum
SSELKTNLWLERSWIIHFSGSNRLE

SEQ ID NO: 2304703 - protein, 25 aa, Cryptosporidium parvum
SSESCGEFLPDVGLAPVGETLPLTN

SEQ ID NO: 2304704 - protein, 17 aa, Cryptosporidium parvum
SSFACHLNCDLITIQRK

SEQ ID NO: 2304705 - protein, 17 aa, Cryptosporidium parvum
SSFDVIIELQKIFRQME

SEQ ID NO: 2304706 - protein, 20 aa, Cryptosporidium parvum
SSFILTIPMFVASITGMRAL

SEQ ID NO: 2304707 - protein, 22 aa, Cryptosporidium parvum
SSFKNSIKFIPPLPYETIRSIK

SEQ ID NO: 2304708 - protein, 22 aa, Cryptosporidium parvum
SSFLENFGNLILNNDWVLFEDN

SEQ ID NO: 2304709 - protein, 23 aa, Cryptosporidium parvum
SSFPLCMRHLFESLKKDHHLKHW

SEQ ID NO: 2304710 - protein, 17 aa, Cryptosporidium parvum
SSFPRVVASFIDSQEDL

SEQ ID NO: 2304711 - protein, 17 aa, Cryptosporidium parvum
SSGECLTLFQPWNLLYA

SEQ ID NO: 2304712 - protein, 26 aa, Cryptosporidium parvum
SSGEIIKRCDMFFRLVKYEFNEFQAI

SEQ ID NO: 2304713 - protein, 17 aa, Cryptosporidium parvum
SSGGGRGNESMGRDFVG

SEQ ID NO: 2304714 - protein, 19 aa, Cryptosporidium parvum
SSGICFKPLPNFSNKPYKR

SEQ ID NO: 2304715 - protein, 23 aa, Cryptosporidium parvum
SSGIPKYLLNRLIDQGIRIELKN

SEQ ID NO: 2304716 - protein, 22 aa, Cryptosporidium parvum
SSGITPALWFGFSKIISDYKPT

SEQ ID NO: 2304717 - protein, 21 aa, Cryptosporidium parvum
SSGRYDILAILLAYNSSYLRS

SEQ ID NO: 2304718 - protein, 23 aa, Cryptosporidium parvum
SSGYYRLEVDQAPLITVPVVQEI

SEQ ID NO: 2304719 - protein, 19 aa, Cryptosporidium parvum
SSIAALWAKAMSKTGGRTG

SEQ ID NO: 2304720 - protein, 18 aa, Cryptosporidium parvum
SSICGGYLNISAECSKGP

SEQ ID NO: 2304721 - protein, 24 aa, Cryptosporidium parvum
SSICKCMARIYLILLKKGIIHVHQ

SEQ ID NO: 2304722 - protein, 22 aa, Cryptosporidium parvum
SSIEGIIKIHGLKSVRTIKYFP

SEQ ID NO: 2304723 - protein, 17 aa, Cryptosporidium parvum
SSIELLQQVCILVSYLS

SEQ ID NO: 2304724 - protein, 19 aa, Cryptosporidium parvum
SSIFVCGDIDEIYCTSTIN

SEQ ID NO: 2304725 - protein, 25 aa, Cryptosporidium parvum
SSIGKSKPSLSLSKLKSFSKTQIIS

SEQ ID NO: 2304726 - protein, 21 aa, Cryptosporidium parvum
SSIHGFGLFAKELIKTGEPII

SEQ ID NO: 2304727 - protein, 20 aa, Cryptosporidium parvum
SSIHLLRLSFSMRNISESEL

SEQ ID NO: 2304728 - protein, 17 aa, Cryptosporidium parvum
SSIIEFILCGLKQQESN

SEQ ID NO: 2304729 - protein, 19 aa, Cryptosporidium parvum
SSIIPIVFIAGEDRNSRQF

SEQ ID NO: 2304730 - protein, 19 aa, Cryptosporidium parvum
SSIKAVLQNVFSRFSSNSN

SEQ ID NO: 2304731 - protein, 30 aa, Cryptosporidium parvum
SSIKSSELIARYAILSKLILDSGIEESEEQ

SEQ ID NO: 2304732 - protein, 21 aa, Cryptosporidium parvum
SSILMEYFLQFGVILDAVVMY

SEQ ID NO: 2304733 - protein, 23 aa, Cryptosporidium parvum
SSILPSPMSIFLSVKEVLIGVIF

SEQ ID NO: 2304734 - protein, 21 aa, Cryptosporidium parvum
SSINLPILINFSGVFEEKLIF

SEQ ID NO: 2304735 - protein, 22 aa, Cryptosporidium parvum
SSINRLGFRDILQKEVQYSNKE

SEQ ID NO: 2304736 - protein, 25 aa, Cryptosporidium parvum
SSINTRIVPFISNYYSLLGDSPNSL

SEQ ID NO: 2304737 - protein, 25 aa, Cryptosporidium parvum
SSIPRYSLKNKLVIVFVIGSITFPE

SEQ ID NO: 2304738 - protein, 19 aa, Cryptosporidium parvum
SSIQRPWVLQRLPKEQLAF

SEQ ID NO: 2304739 - protein, 24 aa, Cryptosporidium parvum
SSISGGMCNNCFICKSSQVNQKNI

SEQ ID NO: 2304740 - protein, 19 aa, Cryptosporidium parvum
SSISLLLPICSAYYIGQLL

SEQ ID NO: 2304741 - protein, 26 aa, Cryptosporidium parvum
SSKCLLARGIPDWDFISNDDKISTLQ

SEQ ID NO: 2304742 - protein, 19 aa, Cryptosporidium parvum
SSKFFTLFFGDFISPDQDH

SEQ ID NO: 2304743 - protein, 21 aa, Cryptosporidium parvum
SSKFLACGGLENKGIILGVSI

SEQ ID NO: 2304744 - protein, 18 aa, Cryptosporidium parvum
SSKGRRWSNNSTTSTISS

SEQ ID NO: 2304745 - protein, 27 aa, Cryptosporidium parvum
SSKIREVQTGFQFRLQVPMGSILASLR

SEQ ID NO: 2304746 - protein, 17 aa, Cryptosporidium parvum
SSKNCLKSTFDQNLEQV

SEQ ID NO: 2304747 - protein, 24 aa, Cryptosporidium parvum
SSKNWFCFQCLSLTLRILPSLIYR

SEQ ID NO: 2304748 - protein, 19 aa, Cryptosporidium parvum
SSKPKLLIYSQIISSTDKN

SEQ ID NO: 2304749 - protein, 21 aa, Cryptosporidium parvum
SSKRKRMRRIPSSSRNISSKI

SEQ ID NO: 2304750 - protein, 22 aa, Cryptosporidium parvum
SSKWYKYPWRFTFSDFTNKKMI

SEQ ID NO: 2304751 - protein, 18 aa, Cryptosporidium parvum
SSLARLLQDSVIMGELIV

SEQ ID NO: 2304752 - protein, 17 aa, Cryptosporidium parvum
SSLCKKAIAILHGKPIE

SEQ ID NO: 2304753 - protein, 20 aa, Cryptosporidium parvum
SSLCLDEKPAGLIEDTKMSK

SEQ ID NO: 2304754 - protein, 28 aa, Cryptosporidium parvum
SSLINSLKRGYCVKVGAVAGVTRHLQRI

SEQ ID NO: 2304755 - protein, 32 aa, Cryptosporidium parvum
SSLIPFSYSSRIHILFEICFFILDGISKESFS

SEQ ID NO: 2304756 - protein, 32 aa, Cryptosporidium parvum
SSLKELCGLLLSSFCGILDDFGLETQADEQML

SEQ ID NO: 2304757 - protein, 22 aa, Cryptosporidium parvum
SSLKKSWLEDFYRFCQTLNPTS

SEQ ID NO: 2304758 - protein, 29 aa, Cryptosporidium parvum
SSLKQDVWFEPKFVWEVKGADLSLSPVHT

SEQ ID NO: 2304759 - protein, 30 aa, Cryptosporidium parvum; identical to SEQ ID NO: 2182169

SEQ ID NO: 2304760 - protein, 23 aa, Cryptosporidium parvum
SSLKTIFIIFQLHFTDNHFDFLF

SEQ ID NO: 2304761 - protein, 21 aa, Cryptosporidium parvum
SSLLHPYLNIWSNIRSFFNIL

SEQ ID NO: 2304762 - protein, 18 aa, Cryptosporidium parvum
SSLLIGRKELINYVKTRQ

SEQ ID NO: 2304763 - protein, 19 aa, Cryptosporidium parvum
SSLPCIPPTMSRPFNQILS

SEQ ID NO: 2304764 - protein, 17 aa, Cryptosporidium parvum
SSLPIVNFIAISILLAR

SEQ ID NO: 2304765 - protein, 20 aa, Cryptosporidium parvum
SSLQLFKLVLMTLQKMITNW

SEQ ID NO: 2304766 - protein, 17 aa, Cryptosporidium parvum
SSLRGMLDLSVLPIEEV

SEQ ID NO: 2304767 - protein, 18 aa, Cryptosporidium parvum
SSLRRLDRTLLLIEENFE

SEQ ID NO: 2304768 - protein, 29 aa, Cryptosporidium parvum
SSLRVRCIYCKKIYFSVKGFISHRGRCIY

SEQ ID NO: 2304769 - protein, 27 aa, Cryptosporidium parvum
SSLSLYREWGFPIWAHGWSVHREFLLN

SEQ ID NO: 2304770 - protein, 21 aa, Cryptosporidium parvum
SSLSRLGRVWSIIDSEETGSI

SEQ ID NO: 2304771 - protein, 25 aa, Cryptosporidium parvum
SSLSSWTWCIPRHFQGENSKGSKGK

SEQ ID NO: 2304772 - protein, 18 aa, Cryptosporidium parvum
SSLSWISQQIYGPVSFAR

SEQ ID NO: 2304773 - protein, 24 aa, Cryptosporidium parvum
SSLVHKIELFPEVLPDTTMQSTDY

SEQ ID NO: 2304774 - protein, 26 aa, Cryptosporidium parvum
SSLVSAIALLCGWSGRKAGKDANLNK

SEQ ID NO: 2304775 - protein, 27 aa, Cryptosporidium parvum
SSNEFCPKVPWLFQLMEYCNSGSLDTL

SEQ ID NO: 2304776 - protein, 29 aa, Cryptosporidium parvum
SSNFLLGRSDLRFKNILMRITNKRVNSTL

SEQ ID NO: 2304777 - protein, 20 aa, Cryptosporidium parvum
SSNFRYAVLESDEIQDEMLV

SEQ ID NO: 2304778 - protein, 28 aa, Cryptosporidium parvum
SSNIGINLLQKMGWTEGKGLGKEEVGMQ

SEQ ID NO: 2304779 - protein, 19 aa, Cryptosporidium parvum
SSNILKKKIELIINDIESK

SEQ ID NO: 2304780 - protein, 24 aa, Cryptosporidium parvum
SSNIPENWPKLLPISKTLKSIEIE

SEQ ID NO: 2304781 - protein, 24 aa, Cryptosporidium parvum
SSNKGVIVPGIFDSATLNSVGAGA

SEQ ID NO: 2304782 - protein, 26 aa, Cryptosporidium parvum
SSNLNGWRFKYYKGLGTSTDLEFKEY

SEQ ID NO: 2304783 - protein, 23 aa, Cryptosporidium parvum
SSNMKRSFSLEFLSQALGDDSPE

SEQ ID NO: 2304784 - protein, 24 aa, Cryptosporidium parvum
SSNNKLLFVNKFVWIRSIPMGRFI

SEQ ID NO: 2304785 - protein, 26 aa, Cryptosporidium parvum
SSNNLKSKWALDKRSGNIIERSILSL

SEQ ID NO: 2304786 - protein, 20 aa, Cryptosporidium parvum
SSNPSYDCIEFFKDDNHKIR

SEQ ID NO: 2304787 - protein, 21 aa, Cryptosporidium parvum
SSNRLNLRYGDNEKINSLLDE

SEQ ID NO: 2304788 - protein, 18 aa, Cryptosporidium parvum
SSNSCSDWSMINEIDQNA

SEQ ID NO: 2304789 - protein, 24 aa, Cryptosporidium parvum
SSNSRLAMNLTILIRNLFSPEDQQ

SEQ ID NO: 2304790 - protein, 19 aa, Cryptosporidium parvum
SSNVPEWLSDLAGPGISLP

SEQ ID NO: 2304791 - protein, 18 aa, Cryptosporidium parvum
SSPCTIHSINIIGGENGK

SEQ ID NO: 2304792 - protein, 18 aa, Cryptosporidium parvum
SSPDVLVQKGMTFNLSIG

SEQ ID NO: 2304793 - protein, 17 aa, Cryptosporidium parvum
SSPNNIIIIFSGRERHL

SEQ ID NO: 2304794 - protein, 17 aa, Cryptosporidium parvum
SSPPLLFILICSSNTDS

SEQ ID NO: 2304795 - protein, 28 aa, Cryptosporidium parvum
SSQEYVPRIAWIRVRRNMNTWQYEDEKV

SEQ ID NO: 2304796 - protein, 18 aa, Cryptosporidium parvum
SSQGGIYLLFSIKDDPKF

SEQ ID NO: 2304797 - protein, 26 aa, Cryptosporidium parvum
SSQGTWYRLSIKFHLNILNEIYRGNT

SEQ ID NO: 2304798 - protein, 19 aa, Cryptosporidium parvum
SSQISRIYVGSLDYSLNEA

SEQ ID NO: 2304799 - protein, 25 aa, Cryptosporidium parvum
SSQKVWPNLLVNFGRYESTFLKKLC

SEQ ID NO: 2304800 - protein, 20 aa, Cryptosporidium parvum
SSQSFHWLQYMRMYWMSKDC

SEQ ID NO: 2304801 - protein, 23 aa, Cryptosporidium parvum
SSQSGTFPKFFGVNYPLEENESM

SEQ ID NO: 2304802 - protein, 19 aa, Cryptosporidium parvum
SSQTWVLCGYALHELGDIR

SEQ ID NO: 2304803 - protein, 30 aa, Cryptosporidium parvum
SSQVLNFNEPVWRVSWSVTGTVLAASSGED

SEQ ID NO: 2304804 - protein, 19 aa, Cryptosporidium parvum
SSRADYVICPSTYNEVMEK

SEQ ID NO: 2304805 - protein, 21 aa, Cryptosporidium parvum
SSRHLLEFLFRSEDELRNNEK

SEQ ID NO: 2304806 - protein, 21 aa, Cryptosporidium parvum
SSRIPLTLKEDVFSMNNLISG

SEQ ID NO: 2304807 - protein, 19 aa, Cryptosporidium parvum
SSRLEVLGIGMGQMNNFPE

SEQ ID NO: 2304808 - protein, 22 aa, Cryptosporidium parvum
SSRRFLLPVSECEYSLMNILDD

SEQ ID NO: 2304809 - protein, 20 aa, Cryptosporidium parvum
SSRSEKDLSRDSKITTFESS

SEQ ID NO: 2304810 - protein, 41 aa, Cryptosporidium parvum
SSRYLRIKKKEFCFTISDFIKEYWKQPVFTPEFSENTLMSN

SEQ ID NO: 2304811 - protein, 17 aa, Cryptosporidium parvum
SSSCCFYLFESNRSEIK

SEQ ID NO: 2304812 - protein, 20 aa, Cryptosporidium parvum
SSSCLKRLDNGGFPRFQDIS

SEQ ID NO: 2304813 - protein, 23 aa, Cryptosporidium parvum
SSSDSGYFCPFYATREIESVCNV

SEQ ID NO: 2304814 - protein, 17 aa, Cryptosporidium parvum
SSSDYFSEWSFTEGDVF

SEQ ID NO: 2304815 - protein, 22 aa, Cryptosporidium parvum
SSSFSSGMGFQGGVSKSVSTST

SEQ ID NO: 2304816 - protein, 21 aa, Cryptosporidium parvum
SSSHLLKRYIVISRFEDMDEF

SEQ ID NO: 2304817 - protein, 24 aa, Cryptosporidium parvum
SSSKKCLPSAISNSSLDEIVPHPI

SEQ ID NO: 2304818 - protein, 26 aa, Cryptosporidium parvum
SSSLDWNTWFCKSVDIAIMQSVEAYS

SEQ ID NO: 2304819 - protein, 19 aa, Cryptosporidium parvum
SSSLFSFGSTMASSNPSLS

SEQ ID NO: 2304820 - protein, 23 aa, Cryptosporidium parvum
SSSNPCPSCSSSAKSCSCSCPLV

SEQ ID NO: 2304821 - protein, 22 aa, Cryptosporidium parvum
SSSPCYSNFYLICSGFNDHSNT

SEQ ID NO: 2304822 - protein, 19 aa, Cryptosporidium parvum
SSSRLAMSLMTTGYNNNSE

SEQ ID NO: 2304823 - protein, 18 aa, Cryptosporidium parvum
SSSSRGLFNISLNELSEN

SEQ ID NO: 2304824 - protein, 21 aa, Cryptosporidium parvum
SSSSYAECYLEVDGVSHYETH

SEQ ID NO: 2304825 - protein, 26 aa, Cryptosporidium parvum
SSSVGRLSSFFGNRELSGIASSSSLT

SEQ ID NO: 2304826 - protein, 17 aa, Cryptosporidium parvum
SSSWKYMEYLFLKQAGK

SEQ ID NO: 2304827 - protein, 20 aa, Cryptosporidium parvum
SSTCALIKMCRWSQDGKYLA

SEQ ID NO: 2304828 - protein, 21 aa, Cryptosporidium parvum
SSTIRCPKKLISKVNLSNNFK

SEQ ID NO: 2304829 - protein, 26 aa, Cryptosporidium parvum
SSTIRIKLYFLLAFLHSVILERKRYT

SEQ ID NO: 2304830 - protein, 22 aa, Cryptosporidium parvum
SSTKEFLICLQITSLKKQNQNP

SEQ ID NO: 2304831 - protein, 23 aa, Cryptosporidium parvum
SSTLDGRCIIWSVDEAEQIKYSK

SEQ ID NO: 2304832 - protein, 25 aa, Cryptosporidium parvum
SSTLKSLFKVGGVFRRYGYLSNSSF

SEQ ID NO: 2304833 - protein, 18 aa, Cryptosporidium parvum
SSTLPLILLGGERGKIEL

SEQ ID NO: 2304834 - protein, 17 aa, Cryptosporidium parvum
SSTNLFWTLVNNNSSNN

SEQ ID NO: 2304835 - protein, 17 aa, Cryptosporidium parvum
SSTPSFQVIARISKIGS

SEQ ID NO: 2304836 - protein, 24 aa, Cryptosporidium parvum
SSTRSGGVGLNLTGADTVIFYDSD

SEQ ID NO: 2304837 - protein, 24 aa, Cryptosporidium parvum
SSTSLPLPIPLIAKNNQFQGTSGL

SEQ ID NO: 2304838 - protein, 39 aa, Cryptosporidium parvum
SSTTLKPKLSIGSCHDSNMSVCVNGKCGNPKNLWSSCHT

SEQ ID NO: 2304839 - protein, 19 aa, Cryptosporidium parvum
SSVCSSRLSFVVPDNYNHS

SEQ ID NO: 2304840 - protein, 19 aa, Cryptosporidium parvum
SSVDEFKKEIKLYNTKEKL

SEQ ID NO: 2304841 - protein, 21 aa, Cryptosporidium parvum
SSVKCGQYLIFLGGIKSSKRE

SEQ ID NO: 2304842 - protein, 25 aa, Cryptosporidium parvum
SSVLRRQLHDQSHFLPSNSLVNSNN

SEQ ID NO: 2304843 - protein, 32 aa, Cryptosporidium parvum
SSVPFNEYIPFEWIEKGHIFVPLKIHYIDPTS

SEQ ID NO: 2304844 - protein, 18 aa, Cryptosporidium parvum
SSVRLFWKMIGKLDSATK

SEQ ID NO: 2304845 - protein, 22 aa, Cryptosporidium parvum
SSVRRKNCIKNYLVSSDTEIED

SEQ ID NO: 2304846 - protein, 17 aa, Cryptosporidium parvum
SSVRSYIHHIGRTARGG

SEQ ID NO: 2304847 - protein, 21 aa, Cryptosporidium parvum
SSVRTFIRFCPSKKTIIEDSK

SEQ ID NO: 2304848 - protein, 26 aa, Cryptosporidium parvum
SSWRIRTILFFIIFKSMESYGKGDLV

SEQ ID NO: 2304849 - protein, 25 aa, Cryptosporidium parvum
SSYDRGMFHACVYKTKIISAAPPSA

SEQ ID NO: 2304850 - protein, 18 aa, Cryptosporidium parvum
SSYIAIALEDGNWSIRKK

SEQ ID NO: 2304851 - protein, 20 aa, Cryptosporidium parvum
SSYLKSPLILGVEPKNVENF

SEQ ID NO: 2304852 - protein, 18 aa, Cryptosporidium parvum
SSYLPHIYSATLGLKNGF

SEQ ID NO: 2304853 - protein, 25 aa, Cryptosporidium parvum
SSYMSMSGFIPQFIQASKYFTCFYG

SEQ ID NO: 2304854 - protein, 19 aa, Cryptosporidium parvum
STACATPLSNFECNLNYKD

SEQ ID NO: 2304855 - protein, 26 aa, Cryptosporidium parvum
STAKMEFEYYYKLGRILNNYNDLIYN

SEQ ID NO: 2304856 - protein, 18 aa, Cryptosporidium parvum
STALFFANCIKRQFCEGI

SEQ ID NO: 2304857 - protein, 22 aa, Cryptosporidium parvum
STCPTLLSSVSLVFLNIETFGG

SEQ ID NO: 2304858 - protein, 19 aa, Cryptosporidium parvum
STDIDICINWILTNIDSIN

SEQ ID NO: 2304859 - protein, 19 aa, Cryptosporidium parvum
STDSFDCMNSLNNENKLKG

SEQ ID NO: 2304860 - protein, 18 aa, Cryptosporidium parvum
STDYRIVDMLLFECTCPS

SEQ ID NO: 2304861 - protein, 23 aa, Cryptosporidium parvum
STEDARHSVRFENGLVLMTKRFI

SEQ ID NO: 2304862 - protein, 17 aa, Cryptosporidium parvum
STEFCRLLLSPNSTSLI

SEQ ID NO: 2304863 - protein, 24 aa, Cryptosporidium parvum
STEKTRIYVPLSIETKDDNAFFLN

SEQ ID NO: 2304864 - protein, 19 aa, Cryptosporidium parvum
STELHGFLPQEKRLENFSK

SEQ ID NO: 2304865 - protein, 19 aa, Cryptosporidium parvum
STELPRYGVPVGLANFSAA

SEQ ID NO: 2304866 - protein, 23 aa, Cryptosporidium parvum
STFGHPIGPEWNTTAIHNKLIQP

SEQ ID NO: 2304867 - protein, 30 aa, Cryptosporidium parvum
STFHRDPDLRCCSYLAYPESDESVYGDSEI

SEQ ID NO: 2304868 - protein, 24 aa, Cryptosporidium parvum
STFTFPGIYYEKLIKNISDRFECP

SEQ ID NO: 2304869 - protein, 17 aa, Cryptosporidium parvum
STFYFEIIINIFGPLYE

SEQ ID NO: 2304870 - protein, 24 aa, Cryptosporidium parvum
STGCCPPGYYIVYINKVMGKEETI

SEQ ID NO: 2304871 - protein, 22 aa, Cryptosporidium parvum
STGHIPNIYEIFLPSNNSSNYI

SEQ ID NO: 2304872 - protein, 23 aa, Cryptosporidium parvum
STGKSSQFIIVFGGLTKSLTEIS

SEQ ID NO: 2304873 - protein, 19 aa, Cryptosporidium parvum
STGLPFYLPLVDYAGKEEM

SEQ ID NO: 2304874 - protein, 23 aa, Cryptosporidium parvum
STIDFDYNWRSIFTDIKRDIQRN

SEQ ID NO: 2304875 - protein, 19 aa, Cryptosporidium parvum
STIEDIGWFGTLKSYNKSM

SEQ ID NO: 2304876 - protein, 24 aa, Cryptosporidium parvum
STILSRFDLIFLLKDEKNVERDKL

SEQ ID NO: 2304877 - protein, 17 aa, Cryptosporidium parvum
STINAWGVDLQARYFIS

SEQ ID NO: 2304878 - protein, 19 aa, Cryptosporidium parvum
STINCKYAALQNLEKKRFS

SEQ ID NO: 2304879 - protein, 17 aa, Cryptosporidium parvum
STINEHQIILAIVYQNA

SEQ ID NO: 2304880 - protein, 26 aa, Cryptosporidium parvum
STIYMAYYTICHFFHSDFEGRSKGLM

SEQ ID NO: 2304881 - protein, 27 aa, Cryptosporidium parvum
STKGIWRKNILKDWFGLEGENKSSYGF

SEQ ID NO: 2304882 - protein, 25 aa, Cryptosporidium parvum
STKLKVKCLKFLNEILLSSKNIFWN

SEQ ID NO: 2304883 - protein, 25 aa, Cryptosporidium parvum
STKNFPGRVFTVGVREAMRCLRHKK

SEQ ID NO: 2304884 - protein, 22 aa, Cryptosporidium parvum
STKQVHCTFNLKNIVYYPYIQT

SEQ ID NO: 2304885 - protein, 24 aa, Cryptosporidium parvum
STLGLRVSNILKHLFPKLKNASQR

SEQ ID NO: 2304886 - protein, 17 aa, Cryptosporidium parvum
STLKFLYRLEALNKSGN

SEQ ID NO: 2304887 - protein, 23 aa, Cryptosporidium parvum
STLKSSPYYNYKAYKNEFHEYKY

SEQ ID NO: 2304888 - protein, 19 aa, Cryptosporidium parvum
STLLPAFLYEDGFVQDKKM

SEQ ID NO: 2304889 - protein, 25 aa, Cryptosporidium parvum
STLMGHLFVSLGLISEGVMRKYKKE

SEQ ID NO: 2304890 - protein, 33 aa, Cryptosporidium parvum
STLQLGCPADMWALGVTIWCWFYGTLPFQGNSI

SEQ ID NO: 2304891 - protein, 17 aa, Cryptosporidium parvum
STLSILLKQEFEQKINF

SEQ ID NO: 2304892 - protein, 17 aa, Cryptosporidium parvum
STLTTKNNIVWINKLVF

SEQ ID NO: 2304893 - protein, 27 aa, Cryptosporidium parvum
STLYCKGSGVVDCIANLPVQDCCEDGC

SEQ ID NO: 2304894 - protein, 19 aa, Cryptosporidium parvum
STLYCLNILFRIYKLEFTE

SEQ ID NO: 2304895 - protein, 24 aa, Cryptosporidium parvum
STNDEFLLEWNINVPKDLLRFIPN

SEQ ID NO: 2304896 - protein, 23 aa, Cryptosporidium parvum
STNDIFCIPKPSINVNYPQTDSS

SEQ ID NO: 2304897 - protein, 25 aa, Cryptosporidium parvum
STNDIGTCCPIVFHISPSEEKDRES

SEQ ID NO: 2304898 - protein, 21 aa, Cryptosporidium parvum
STNDKVIWREVFLDYVKRSPR

SEQ ID NO: 2304899 - protein, 18 aa, Cryptosporidium parvum
STNKDSWVKKDLDSKRIS

SEQ ID NO: 2304900 - protein, 24 aa, Cryptosporidium parvum
STNSEIFLTCEVFDSHISDENQCV

SEQ ID NO: 2304901 - protein, 18 aa, Cryptosporidium parvum
STNWVLDVLLNKTSENQT

SEQ ID NO: 2304902 - protein, 27 aa, Cryptosporidium parvum
STPIISASLYFSFKLYCRNISFNDLLK

SEQ ID NO: 2304903 - protein, 19 aa, Cryptosporidium parvum
STPIKVRIIMSILYISDSL

SEQ ID NO: 2304904 - protein, 20 aa, Cryptosporidium parvum
STPSILGILLKYFDVSWPSH

SEQ ID NO: 2304905 - protein, 23 aa, Cryptosporidium parvum
STPTKLLLWYGQNRIIDLFVKND

SEQ ID NO: 2304906 - protein, 27 aa, Cryptosporidium parvum
STQFLNKLCETRHLFQQGKGAIPDWSK

SEQ ID NO: 2304907 - protein, 17 aa, Cryptosporidium parvum
STREGYIGLFVYLPQSF

SEQ ID NO: 2304908 - protein, 32 aa, Cryptosporidium parvum
STREMSRLFPPTRQGYPWSKWAAEQILETAHQ

SEQ ID NO: 2304909 - protein, 36 aa, Cryptosporidium parvum; identical to SEQ ID NO: 2182290

SEQ ID NO: 2304910 - protein, 27 aa, Cryptosporidium parvum
STRLIKVCSKYTMVPYFGSRSIVKIND

SEQ ID NO: 2304911 - protein, 24 aa, Cryptosporidium parvum
STRLKSPGGIFFRLIKNQISHEEY

SEQ ID NO: 2304912 - protein, 24 aa, Cryptosporidium parvum
STSCPSCYFSWLRLINSKNGDDNN

SEQ ID NO: 2304913 - protein, 24 aa, Cryptosporidium parvum
STSEIATLMAIIVNKSRYGNKNDE

SEQ ID NO: 2304914 - protein, 20 aa, Cryptosporidium parvum
STSSLSCFSIKSKRKYRQYM

SEQ ID NO: 2304915 - protein, 18 aa, Cryptosporidium parvum
STTFICLEEDLTIDLIDQ

SEQ ID NO: 2304916 - protein, 31 aa, Cryptosporidium parvum
STTLETMWDCLGRSALLHGFINVAEKCLQVT

SEQ ID NO: 2304917 - protein, 20 aa, Cryptosporidium parvum
STTPQGFCPTGTQPGMANFA

SEQ ID NO: 2304918 - protein, 26 aa, Cryptosporidium parvum
STVEYLSNFILELCIDDILTSLDTSI

SEQ ID NO: 2304919 - protein, 26 aa, Cryptosporidium parvum
STVNFPIELCIISLLIVVKDLVPGYK

SEQ ID NO: 2304920 - protein, 17 aa, Cryptosporidium parvum
STVVPNIELCIQKENDQ

SEQ ID NO: 2304921 - protein, 24 aa, Cryptosporidium parvum
STVYRKGAEVVRMYETILGREGFR

SEQ ID NO: 2304922 - protein, 19 aa, Cryptosporidium parvum
STWACTIFGPPNTTFENRI

SEQ ID NO: 2304923 - protein, 25 aa, Cryptosporidium parvum
STWGRGFVTLCRRLCGAIFETAPTK

SEQ ID NO: 2304924 - protein, 21 aa, Cryptosporidium parvum
STYGGGLWHTWFDRGLGIAGK

SEQ ID NO: 2304925 - protein, 19 aa, Cryptosporidium parvum
STYLKTRMSTIAPNLTYMV

SEQ ID NO: 2304926 - protein, 24 aa, Cryptosporidium parvum
STYVFLKIIKSFTFCLENINNNDY

SEQ ID NO: 2304927 - protein, 22 aa, Cryptosporidium parvum
SVAIIGVSCRLPGRVKSFNDLY

SEQ ID NO: 2304928 - protein, 18 aa, Cryptosporidium parvum
SVCEKLRNNAKNTELNFS

SEQ ID NO: 2304929 - protein, 18 aa, Cryptosporidium parvum
SVCIPPIPIRAYLIRLAQ

SEQ ID NO: 2304930 - protein, 17 aa, Cryptosporidium parvum
SVCQPISSFGLGIPIQV

SEQ ID NO: 2304931 - protein, 24 aa, Cryptosporidium parvum
SVDLRFVKEISNTFSFGKQHDASE

SEQ ID NO: 2304932 - protein, 25 aa, Cryptosporidium parvum
SVDNIRWPLLWNNSMRCKMNFLYLK

SEQ ID NO: 2304933 - protein, 28 aa, Cryptosporidium parvum
SVDVDFQRFCLGLGFDINSQNQVICDSQ

SEQ ID NO: 2304934 - protein, 19 aa, Cryptosporidium parvum
SVECSRYHIIALFEDYLDV

SEQ ID NO: 2304935 - protein, 18 aa, Cryptosporidium parvum
SVEEGVRIHSKWIQEQNQ

SEQ ID NO: 2304936 - protein, 24 aa, Cryptosporidium parvum
SVENTRILTPFNIRNGIHSIKSYK

SEQ ID NO: 2304937 - protein, 19 aa, Cryptosporidium parvum
SVFLRLETQLAIEDGSQSS

SEQ ID NO: 2304938 - protein, 18 aa, Cryptosporidium parvum
SVFTLCDLVNITIDETLV

SEQ ID NO: 2304939 - protein, 18 aa, Cryptosporidium parvum
SVGERWPLNIMSITALEE

SEQ ID NO: 2304940 - protein, 17 aa, Cryptosporidium parvum
SVGFICYSHNGNYVAAA

SEQ ID NO: 2304941 - protein, 34 aa, Cryptosporidium parvum
SVGGGLPLDLSCWLPQNLTAICNPGFQSSSSSTC

SEQ ID NO: 2304942 - protein, 24 aa, Cryptosporidium parvum
SVGIFKLLFHLQVLPLTRELTNLA

SEQ ID NO: 2304943 - protein, 17 aa, Cryptosporidium parvum
SVGQCKVPALFISGTND

SEQ ID NO: 2304944 - protein, 20 aa, Cryptosporidium parvum
SVGYRPYAIRTFLDEWGMDS

SEQ ID NO: 2304945 - protein, 26 aa, Cryptosporidium parvum
SVHEFIRCLRRIMSLVHSPIVKSFTY

SEQ ID NO: 2304946 - protein, 18 aa, Cryptosporidium parvum
SVHFPTSGLIKLAIENIN

SEQ ID NO: 2304947 - protein, 18 aa, Cryptosporidium parvum
SVHMRPVLHPSLIGGHTC

SEQ ID NO: 2304948 - protein, 28 aa, Cryptosporidium parvum
SVIKKGFLNTISYWSFLRAPPSPKKNVK

SEQ ID NO: 2304949 - protein, 17 aa, Cryptosporidium parvum
SVIKRMIRIWNIKKDYL

SEQ ID NO: 2304950 - protein, 22 aa, Cryptosporidium parvum
SVINKRRGNVFNEELKEGTSTF

SEQ ID NO: 2304951 - protein, 25 aa, Cryptosporidium parvum
SVISCFWKSMVASIEQIYSIESLPL

SEQ ID NO: 2304952 - protein, 19 aa, Cryptosporidium parvum
SVKAHWFWEVDIDITVDAV

SEQ ID NO: 2304953 - protein, 21 aa, Cryptosporidium parvum
SVKFIGWPGIHIEKEDEKEEI

SEQ ID NO: 2304954 - protein, 23 aa, Cryptosporidium parvum
SVKHELKHYFVIIERIAGIFSET

SEQ ID NO: 2304955 - protein, 22 aa, Cryptosporidium parvum
SVKINIGPNFAFFPHTELEPAL

SEQ ID NO: 2304956 - protein, 24 aa, Cryptosporidium parvum
SVKSSECIPLLPCIQNLKDENHLE

SEQ ID NO: 2304957 - protein, 17 aa, Cryptosporidium parvum
SVLEGIVARFKKSFTRL

SEQ ID NO: 2304958 - protein, 24 aa, Cryptosporidium parvum
SVLFPKLLTLFFHYPEDQNSKISF

SEQ ID NO: 2304959 - protein, 18 aa, Cryptosporidium parvum
SVLIHKYCINKFEAHNFS

SEQ ID NO: 2304960 - protein, 19 aa, Cryptosporidium parvum
SVLISRSSLIVSLISRVIL

SEQ ID NO: 2304961 - protein, 40 aa, Cryptosporidium parvum; identical to SEQ ID NO: 2182333

SEQ ID NO: 2304962 - protein, 17 aa, Cryptosporidium parvum
SVLNNRLTALYSKEGIT

SEQ ID NO: 2304963 - protein, 19 aa, Cryptosporidium parvum
SVLSPMHRFIRIMGPEICN

SEQ ID NO: 2304964 - protein, 27 aa, Cryptosporidium parvum
SVLTLDLRKAYIMEHFDEFNTMKSQLI

SEQ ID NO: 2304965 - protein, 17 aa, Cryptosporidium parvum
SVMRIRNSLAIAIHEYF

SEQ ID NO: 2304966 - protein, 26 aa, Cryptosporidium parvum
SVNFIKRKWFDIVFCLNSETHVLFDR

SEQ ID NO: 2304967 - protein, 23 aa, Cryptosporidium parvum
SVPKSPMTGIHFDRTKPAWAVSY

SEQ ID NO: 2304968 - protein, 17 aa, Cryptosporidium parvum
SVQDILASFGWEDDIIL

SEQ ID NO: 2304969 - protein, 18 aa, Cryptosporidium parvum
SVQFEYLRSWKSGQASIA

SEQ ID NO: 2304970 - protein, 20 aa, Cryptosporidium parvum
SVRMLYKLAQMYLYNENGLS

SEQ ID NO: 2304971 - protein, 18 aa, Cryptosporidium parvum
SVRSRGVLEAFNLAIKWI

SEQ ID NO: 2304972 - protein, 23 aa, Cryptosporidium parvum
SVSDSTALWGFVENLSRERHLSI

SEQ ID NO: 2304973 - protein, 25 aa, Cryptosporidium parvum
SVSDWSYYIWWLFSRRPEISKISPK

SEQ ID NO: 2304974 - protein, 23 aa, Cryptosporidium parvum
SVSFARRSISLFFGYHYFVLLSF

SEQ ID NO: 2304975 - protein, 25 aa, Cryptosporidium parvum
SVSGSIKSYSKVTFTAPETTTTGAA

SEQ ID NO: 2304976 - protein, 17 aa, Cryptosporidium parvum
SVSKRNSSMVVWRSGFE

SEQ ID NO: 2304977 - protein, 17 aa, Cryptosporidium parvum
SVSKSRFDNAYKGTNGI

SEQ ID NO: 2304978 - protein, 26 aa, Cryptosporidium parvum
SVSSSEFKASLYIEYGQLKVGQSYHV

SEQ ID NO: 2304979 - protein, 19 aa, Cryptosporidium parvum
SVSVTRLRNEINILKNQLD

SEQ ID NO: 2304980 - protein, 32 aa, Cryptosporidium parvum; identical to SEQ ID NO: 2182351

SEQ ID NO: 2304981 - protein, 17 aa, Cryptosporidium parvum
SVVKALIIPPKGYDGRV

SEQ ID NO: 2304982 - protein, 19 aa, Cryptosporidium parvum
SVVKENCKIILTEKKNPIK

SEQ ID NO: 2304983 - protein, 24 aa, Cryptosporidium parvum
SVVLTEFYAFVGLIGEESNVNVYC

SEQ ID NO: 2304984 - protein, 18 aa, Cryptosporidium parvum
SVVNLDFPKKKKTKKDFE

SEQ ID NO: 2304985 - protein, 17 aa, Cryptosporidium parvum
SVYCLHTAKYLYSLTPI

SEQ ID NO: 2304986 - protein, 19 aa, Cryptosporidium parvum
SVYFYGFVKGGIMRKNQSV

SEQ ID NO: 2304987 - protein, 17 aa, Cryptosporidium parvum
SVYRNCVRRSFMNYDTF

SEQ ID NO: 2304988 - protein, 35 aa, Cryptosporidium parvum; identical to SEQ ID NO: 2127822

SEQ ID NO: 2304989 - protein, 23 aa, Cryptosporidium parvum
SWESIKNEILFRILSTKLAQFYT

SEQ ID NO: 2304990 - protein, 19 aa, Cryptosporidium parvum
SWFGGWLGGQSEPTPPAPP

SEQ ID NO: 2304991 - protein, 18 aa, Cryptosporidium parvum
SWFSKTCISNFPEIQKLI

SEQ ID NO: 2304992 - protein, 24 aa, Cryptosporidium parvum
SWHPKTRRFVVALKSCESGKTIYK

SEQ ID NO: 2304993 - protein, 21 aa, Cryptosporidium parvum
SWHPYRQILAIACNSLESNNA

SEQ ID NO: 2304994 - protein, 18 aa, Cryptosporidium parvum
SWIKRKVQKISGFIHNDN

SEQ ID NO: 2304995 - protein, 24 aa, Cryptosporidium parvum
SWLKSHGLNKMALIISQERENERV

SEQ ID NO: 2304996 - protein, 24 aa, Cryptosporidium parvum
SWNKIKESYLASGSDDNVICLWDI

SEQ ID NO: 2304997 - protein, 23 aa, Cryptosporidium parvum
SWSKLALFSDFYKLASLHEDNTL

SEQ ID NO: 2304998 - protein, 17 aa, Cryptosporidium parvum
SWTHSLIAHSSRQNCQG

SEQ ID NO: 2304999 - protein, 18 aa, Cryptosporidium parvum
SWVGIKYEKAKYIQIWLH

SEQ ID NO: 2305000 - protein, 21 aa, Cryptosporidium parvum
SYASHALKDAFNVYSLDLQQI

SEQ ID NO: 2305001 - protein, 17 aa, Cryptosporidium parvum
SYCHLVPTFSLGQFEVE

SEQ ID NO: 2305002 - protein, 19 aa, Cryptosporidium parvum
SYCIDTIVIKLNYLKDVVK

SEQ ID NO: 2305003 - protein, 18 aa, Cryptosporidium parvum
SYDGHLDEGFSMDWNPNQ

SEQ ID NO: 2305004 - protein, 17 aa, Cryptosporidium parvum
SYDSYSFETIKNHYFDC

SEQ ID NO: 2305005 - protein, 26 aa, Cryptosporidium parvum
SYEIRFRVDPELGRDNFYYAMIAFQG

SEQ ID NO: 2305006 - protein, 17 aa, Cryptosporidium parvum
SYEKLKQLIEIGNELTI

SEQ ID NO: 2305007 - protein, 26 aa, Cryptosporidium parvum
SYFSESPGYLVLQWDNSWSLFSGKTV

SEQ ID NO: 2305008 - protein, 18 aa, Cryptosporidium parvum
SYFYKEENLLLLLTVKDI

SEQ ID NO: 2305009 - protein, 30 aa, Cryptosporidium parvum
SYGPFSENLICFICEPILKVLNILNNYNYR

SEQ ID NO: 2305010 - protein, 27 aa, Cryptosporidium parvum
SYGPKCDAWSAGVLLHLLLMGAVPFPG

SEQ ID NO: 2305011 - protein, 17 aa, Cryptosporidium parvum
SYHNFKFISSSNKKTFD

SEQ ID NO: 2305012 - protein, 18 aa, Cryptosporidium parvum
SYHPSWRDDQIFTGIFKK

SEQ ID NO: 2305013 - protein, 26 aa, Cryptosporidium parvum
SYIKRHKFILSRPLVKNDLIDILRFV

SEQ ID NO: 2305014 - protein, 18 aa, Cryptosporidium parvum
SYIPYKIIETNIPKTFKG

SEQ ID NO: 2305015 - protein, 19 aa, Cryptosporidium parvum
SYISYWGYILLELLMDGSQ

SEQ ID NO: 2305016 - protein, 23 aa, Cryptosporidium parvum
SYKERFPMWSLPNIINLLKSEKY

SEQ ID NO: 2305017 - protein, 31 aa, Cryptosporidium parvum; identical to SEQ ID NO: 2182381

SEQ ID NO: 2305018 - protein, 26 aa, Cryptosporidium parvum
SYKTAIRYLVALLVRYRKYELEEDVI

SEQ ID NO: 2305019 - protein, 18 aa, Cryptosporidium parvum
SYLAFLVFKISKKNQTTE

SEQ ID NO: 2305020 - protein, 22 aa, Cryptosporidium parvum
SYLGYDFLALRALNKRGIISSV

SEQ ID NO: 2305021 - protein, 23 aa, Cryptosporidium parvum
SYLKSSSFLKHYLISETTDSMGN

SEQ ID NO: 2305022 - protein, 22 aa, Cryptosporidium parvum
SYLPFLPSLFIVSSSKPLLRIV

SEQ ID NO: 2305023 - protein, 19 aa, Cryptosporidium parvum
SYLQSRGWTHSPIITNKNL

SEQ ID NO: 2305024 - protein, 24 aa, Cryptosporidium parvum
SYLRRLNTPLGREGKFAKPRQLHN

SEQ ID NO: 2305025 - protein, 17 aa, Cryptosporidium parvum
SYLSDKLLFFLSGLISH

SEQ ID NO: 2305026 - protein, 19 aa, Cryptosporidium parvum
SYLSGISFDHHIFRLRIIQ

SEQ ID NO: 2305027 - protein, 26 aa, Cryptosporidium parvum
SYLVRLMKRRLIFVSISLLDLLDDEN

SEQ ID NO: 2305028 - protein, 25 aa, Cryptosporidium parvum
SYMAIPIKTPFGIWSNVSMFNEASP

SEQ ID NO: 2305029 - protein, 18 aa, Cryptosporidium parvum
SYMSPRFMRKLEYADSIR

SEQ ID NO: 2305030 - protein, 21 aa, Cryptosporidium parvum
SYNRAHISFKEIPSLFHNISL

SEQ ID NO: 2305031 - protein, 19 aa, Cryptosporidium parvum
SYNSFLIKGIIEIGKHKLI

SEQ ID NO: 2305032 - protein, 18 aa, Cryptosporidium parvum
SYNSLGWQGINSNSSKAS

SEQ ID NO: 2305033 - protein, 28 aa, Cryptosporidium parvum
SYPFCWRSDTPLQYRAVPSWFINVESLK

SEQ ID NO: 2305034 - protein, 18 aa, Cryptosporidium parvum
SYPHCIKMLRLLQIEDFR

SEQ ID NO: 2305035 - protein, 23 aa, Cryptosporidium parvum
SYPMSGTCRFVEFNRKYDNQDKF

SEQ ID NO: 2305036 - protein, 22 aa, Cryptosporidium parvum
SYQETVEALKICEELDPKCELL

SEQ ID NO: 2305037 - protein, 25 aa, Cryptosporidium parvum
SYRHQFALQDYVVFCDHLQSVRLVW

SEQ ID NO: 2305038 - protein, 17 aa, Cryptosporidium parvum
SYRKFSSNILKMENKNS

SEQ ID NO: 2305039 - protein, 20 aa, Cryptosporidium parvum
SYRQLPIRLADFGVLHRNEF

SEQ ID NO: 2305040 - protein, 26 aa, Cryptosporidium parvum
SYSDLIYFDICINGIILLDDEFNESN

SEQ ID NO: 2305041 - protein, 20 aa, Cryptosporidium parvum
SYSFRNVYRFVPIPFENRLH

SEQ ID NO: 2305042 - protein, 23 aa, Cryptosporidium parvum
SYSIPLNIIGKFWDDFFQQGWVP

SEQ ID NO: 2305043 - protein, 19 aa, Cryptosporidium parvum
SYSQFCLVLSFLQQHSSSY

SEQ ID NO: 2305044 - protein, 20 aa, Cryptosporidium parvum
SYSRPSSLQINQIIKQLELL

SEQ ID NO: 2305045 - protein, 21 aa, Cryptosporidium parvum
SYSSRSHLIFMLQLQQKNVFD

SEQ ID NO: 2305046 - protein, 18 aa, Cryptosporidium parvum
SYSTYIYKVLKQVHPETG

SEQ ID NO: 2305047 - protein, 25 aa, Cryptosporidium parvum
SYTFRENFESLPLFSSINGIFEFDI

SEQ ID NO: 2305048 - protein, 18 aa, Cryptosporidium parvum
SYTLYKLDGGFSTGQVIK

SEQ ID NO: 2305049 - protein, 25 aa, Cryptosporidium parvum
SYVRGEIKFVGFLIRQFKGETELFF

SEQ ID NO: 2305050 - protein, 25 aa, Cryptosporidium parvum
SYVRRNAVMCIYSIIKTFGVDIIPN

SEQ ID NO: 2305051 - protein, 24 aa, Cryptosporidium parvum
SYWSRTGPFFSIFYQLAHGLILDS

SEQ ID NO: 2305052 - protein, 24 aa, Cryptosporidium parvum
SYYKKRDLSVIILASCSSSIQDSQ

SEQ ID NO: 2305053 - protein, 24 aa, Cryptosporidium parvum
SYYRSSRFQMMLKYLKDNIILQLI

SEQ ID NO: 2305054 - protein, 20 aa, Cryptosporidium parvum
SYYWILIIVWYRIMHDYSRM

SEQ ID NO: 2305055 - protein, 29 aa, Cryptosporidium parvum
SYYYFRGVPSWRWYYPYRYAPFACDIAII

SEQ ID NO: 2305056 - protein, 27 aa, Cryptosporidium parvum
TACGIWECKGCRKVLAGGAWQLSTAAA

SEQ ID NO: 2305057 - protein, 18 aa, Cryptosporidium parvum
TADRACLQLQSLVDQFND

SEQ ID NO: 2305058 - protein, 33 aa, Cryptosporidium parvum
TADRLICVSGVFAEEVCRLFGINRNKIKVIFNG

SEQ ID NO: 2305059 - protein, 18 aa, Cryptosporidium parvum
TAEWQVFDTDKWCKVPIS

SEQ ID NO: 2305060 - protein, 18 aa, Cryptosporidium parvum
TAFGGGRSSGFCVIYNNI

SEQ ID NO: 2305061 - protein, 26 aa, Cryptosporidium parvum
TAFKILRYLDELRMRENIDFRLKPPL

SEQ ID NO: 2305062 - protein, 19 aa, Cryptosporidium parvum
TAFWNGIDWTASSFAEKSS

SEQ ID NO: 2305063 - protein, 22 aa, Cryptosporidium parvum
TAFYGNCVGGLIASATSVALRE

SEQ ID NO: 2305064 - protein, 24 aa, Cryptosporidium parvum
TAIFKNKRIHPVLQKDHFKAGLLF

SEQ ID NO: 2305065 - protein, 23 aa, Cryptosporidium parvum
TAIGPRFSNIVLQTIMILIKNRA

SEQ ID NO: 2305066 - protein, 23 aa, Cryptosporidium parvum
TAIRYVLKNSFVRGGLLRGLNEV

SEQ ID NO: 2305067 - protein, 17 aa, Cryptosporidium parvum
TAKDVPAGILIEKFAQQ

SEQ ID NO: 2305068 - protein, 21 aa, Cryptosporidium parvum
TAKRAMRFARARLGTERRAKK

SEQ ID NO: 2305069 - protein, 22 aa, Cryptosporidium parvum
TAKRPRAETSFSDKLDSDTLEP

SEQ ID NO: 2305070 - protein, 24 aa, Cryptosporidium parvum
TALHYASACGWLPTMKLLLKYNCD

SEQ ID NO: 2305071 - protein, 17 aa, Cryptosporidium parvum
TALKFDGAMFRGRQIKV

SEQ ID NO: 2305072 - protein, 30 aa, Cryptosporidium parvum
TALKSVIVIKFWKRNGFERFIVMKECHYSI

SEQ ID NO: 2305073 - protein, 25 aa, Cryptosporidium parvum
TALYFKRMLNIHSIKSSFNRGTSCS

SEQ ID NO: 2305074 - protein, 20 aa, Cryptosporidium parvum
TAMRCIDDVILLSKSLSPIF

SEQ ID NO: 2305075 - protein, 18 aa, Cryptosporidium parvum
TANDRIRLASTFHGLCTI

SEQ ID NO: 2305076 - protein, 30 aa, Cryptosporidium parvum
TANFPYMVGNTAAFGFPHYNTKPNGHHHPT

SEQ ID NO: 2305077 - protein, 19 aa, Cryptosporidium parvum
TAPGTAQICCDFVQEIHAS

SEQ ID NO: 2305078 - protein, 17 aa, Cryptosporidium parvum
TAPLAVTLFHWQNSLAL

SEQ ID NO: 2305079 - protein, 25 aa, Cryptosporidium parvum
TAQSEAVTSQVCYFDTTDNTMTFVY

SEQ ID NO: 2305080 - protein, 19 aa, Cryptosporidium parvum
TARSSLCTFFDFCNCFGPR

SEQ ID NO: 2305081 - protein, 22 aa, Cryptosporidium parvum
TASCPWLDGVHTIFGKVVHGKE

SEQ ID NO: 2305082 - protein, 22 aa, Cryptosporidium parvum
TASFCTRLFIVTSLGTWGEIPP

SEQ ID NO: 2305083 - protein, 24 aa, Cryptosporidium parvum
TASPVSWKRFIPVNNFSGTNSGIS

SEQ ID NO: 2305084 - protein, 17 aa, Cryptosporidium parvum
TASRCPEPIKLGNKGMN

SEQ ID NO: 2305085 - protein, 27 aa, Cryptosporidium parvum
TATQFRFIVDLLRRFHVLDNYCGCTGY

SEQ ID NO: 2305086 - protein, 31 aa, Cryptosporidium parvum; identical to SEQ ID NO: 2182432

SEQ ID NO: 2305087 - protein, 30 aa, Cryptosporidium parvum
TCATLHPLLHKLCIITGRIRDILILLDLPT

SEQ ID NO: 2305088 - protein, 19 aa, Cryptosporidium parvum
TCCRDHCKINESDPNSGVE

SEQ ID NO: 2305089 - protein, 21 aa, Cryptosporidium parvum
TCDIRFGSTELWRIQRNSQKF

SEQ ID NO: 2305090 - protein, 25 aa, Cryptosporidium parvum
TCDLEFCVELFWLLISEISIQEYPK

SEQ ID NO: 2305091 - protein, 20 aa, Cryptosporidium parvum
TCEPNRYLKLNVEVNLTLEE

SEQ ID NO: 2305092 - protein, 22 aa, Cryptosporidium parvum
TCFKLWRFFIYYRKTRNSRFEK

SEQ ID NO: 2305093 - protein, 26 aa, Cryptosporidium parvum
TCFTEYCIRSSSKLILIHKYSKVYWQ

SEQ ID NO: 2305094 - protein, 18 aa, Cryptosporidium parvum
TCINCKRKIPSDNLDLHS

SEQ ID NO: 2305095 - protein, 20 aa, Cryptosporidium parvum
TCINDMRKELAILEVEKQKF

SEQ ID NO: 2305096 - protein, 30 aa, Cryptosporidium parvum
TCIQCGKLRIKISFLGRISCELEKDIIELN

SEQ ID NO: 2305097 - protein, 26 aa, Cryptosporidium parvum
TCIRGRPCRIMWCLRDPASRRNNDGN

SEQ ID NO: 2305098 - protein, 22 aa, Cryptosporidium parvum
TCLKVITLLLEFKLKYKLNTLK

SEQ ID NO: 2305099 - protein, 20 aa, Cryptosporidium parvum
TCLTILKIINGFILSTNRQW

SEQ ID NO: 2305100 - protein, 17 aa, Cryptosporidium parvum
TCMKCPFNSESKLCQRR

SEQ ID NO: 2305101 - protein, 22 aa, Cryptosporidium parvum
TCPQLLKWKPPHLNTADFAAIF

SEQ ID NO: 2305102 - protein, 27 aa, Cryptosporidium parvum
TCQCGKQDRLLPVLPQSSNSRMMRMIQ

SEQ ID NO: 2305103 - protein, 24 aa, Cryptosporidium parvum
TCSDRNCMQCFALLHAHAQTNTDK

SEQ ID NO: 2305104 - protein, 18 aa, Cryptosporidium parvum
TCVIKMALNQSKLNSSDI

SEQ ID NO: 2305105 - protein, 18 aa, Cryptosporidium parvum
TCVPGVFNYKGAKIQLLD

SEQ ID NO: 2305106 - protein, 22 aa, Cryptosporidium parvum
TCYEFLRPDTVMEMAWKHNCLD

SEQ ID NO: 2305107 - protein, 21 aa, Cryptosporidium parvum
TCYETWYKIIQHFSDKYPSSS

SEQ ID NO: 2305108 - protein, 21 aa, Cryptosporidium parvum
TDALFTYFWIERFVLDEERGI

SEQ ID NO: 2305109 - protein, 25 aa, Cryptosporidium parvum
TDDAYKLKSSFGWEHVKGSSKLFFL

SEQ ID NO: 2305110 - protein, 18 aa, Cryptosporidium parvum
TDDFLVFVKKNDKVPLSL

SEQ ID NO: 2305111 - protein, 25 aa, Cryptosporidium parvum
TDDLRHIFKTFGVILSCQLIPSIEK

SEQ ID NO: 2305112 - protein, 20 aa, Cryptosporidium parvum
TDDQFIWSSFMFPSGNDDLD

SEQ ID NO: 2305113 - protein, 25 aa, Cryptosporidium parvum
TDEFVHPQLLLKGHSKEGYAMDWGN

SEQ ID NO: 2305114 - protein, 18 aa, Cryptosporidium parvum
TDELDNWKNLLPKSSQGT

SEQ ID NO: 2305115 - protein, 25 aa, Cryptosporidium parvum
TDELIKNLILFLGIIPEYLFSTNEI

SEQ ID NO: 2305116 - protein, 18 aa, Cryptosporidium parvum
TDEPICLINNNVNNDDIN

SEQ ID NO: 2305117 - protein, 21 aa, Cryptosporidium parvum
TDEWNQWNSLILNMIFNSIEK

SEQ ID NO: 2305118 - protein, 19 aa, Cryptosporidium parvum
TDHCQRSILSFALSLMEGL

SEQ ID NO: 2305119 - protein, 23 aa, Cryptosporidium parvum
TDHKDLDFHLAFGTPVLDTQFGK

SEQ ID NO: 2305120 - protein, 17 aa, Cryptosporidium parvum
TDIGSMLPWFVNLSLKL

SEQ ID NO: 2305121 - protein, 20 aa, Cryptosporidium parvum
TDIKSCIMEFFLYSKKELIL

SEQ ID NO: 2305122 - protein, 24 aa, Cryptosporidium parvum
TDIKSQLNNLSWFLEISSQRNSSL

SEQ ID NO: 2305123 - protein, 18 aa, Cryptosporidium parvum
TDILTKFKSLYMECVKCG

SEQ ID NO: 2305124 - protein, 17 aa, Cryptosporidium parvum
TDINILSFLSFRFELED

SEQ ID NO: 2305125 - protein, 18 aa, Cryptosporidium parvum
TDIRHFAFILFKKNLNVL

SEQ ID NO: 2305126 - protein, 25 aa, Cryptosporidium parvum
TDIYIKYDVVKILSIIQKSGLGNFK

SEQ ID NO: 2305127 - protein, 25 aa, Cryptosporidium parvum
TDKDSKVTYKEEYMAQIDSSYTSTT

SEQ ID NO: 2305128 - protein, 24 aa, Cryptosporidium parvum
TDLEHNRFLILQGEVELIAQMKPK

SEQ ID NO: 2305129 - protein, 20 aa, Cryptosporidium parvum
TDNLKLYYLYESFENKKGTQ

SEQ ID NO: 2305130 - protein, 19 aa, Cryptosporidium parvum
TDNLLNCFDQLFKDEELKS

SEQ ID NO: 2305131 - protein, 18 aa, Cryptosporidium parvum
TDNNLLRAAGLEGLCNFC

SEQ ID NO: 2305132 - protein, 26 aa, Cryptosporidium parvum
TDNSAECCLSWNMYQVAYFVKCIGLS

SEQ ID NO: 2305133 - protein, 17 aa, Cryptosporidium parvum
TDPFYRCPIWDRLKNYK

SEQ ID NO: 2305134 - protein, 22 aa, Cryptosporidium parvum
TDPTCYSNFCGYLNSIDDVGIL

SEQ ID NO: 2305135 - protein, 18 aa, Cryptosporidium parvum
TDQWREQQQSISFRENRN

SEQ ID NO: 2305136 - protein, 19 aa, Cryptosporidium parvum
TDRILLILNQMERLNEIIS

SEQ ID NO: 2305137 - protein, 17 aa, Cryptosporidium parvum
TDRIPGGVRTYNEKYQE

SEQ ID NO: 2305138 - protein, 19 aa, Cryptosporidium parvum
TDRMLIPFVDGFENDNSVE

SEQ ID NO: 2305139 - protein, 29 aa, Cryptosporidium parvum
TDRREIIELVLEYLHPCRGLDLRLNSLYG

SEQ ID NO: 2305140 - protein, 21 aa, Cryptosporidium parvum
TDSLFQLLPYLLKLTKFQIIR

SEQ ID NO: 2305141 - protein, 22 aa, Cryptosporidium parvum
TDSWRIVGNILQLSSDYNTKFF

SEQ ID NO: 2305142 - protein, 18 aa, Cryptosporidium parvum
TDTLKPFVECVRCGVVSH

SEQ ID NO: 2305143 - protein, 19 aa, Cryptosporidium parvum
TDVRGDCFISSSFDDEYVF

SEQ ID NO: 2305144 - protein, 25 aa, Cryptosporidium parvum
TEAPRLGIIPKVMTFDGEKILKNGN

SEQ ID NO: 2305145 - protein, 27 aa, Cryptosporidium parvum
TEAYSVDGADAFEFLNILKASKPSDQV

SEQ ID NO: 2305146 - protein, 17 aa, Cryptosporidium parvum
TECRLHFLSSRIEESGV

SEQ ID NO: 2305147 - protein, 25 aa, Cryptosporidium parvum
TECRRRIIYTGDVSFLLKLHAYLEF

SEQ ID NO: 2305148 - protein, 24 aa, Cryptosporidium parvum
TECSFPSICIHAALSQQERISRYQ

SEQ ID NO: 2305149 - protein, 27 aa, Cryptosporidium parvum
TEDCFSDKLFSEWVFKLNGKKELYQDS

SEQ ID NO: 2305150 - protein, 21 aa, Cryptosporidium parvum
TEDNISLALWDRVYRASSGEL

SEQ ID NO: 2305151 - protein, 20 aa, Cryptosporidium parvum
TEDSIPVIISNSTRLAPQEI

SEQ ID NO: 2305152 - protein, 21 aa, Cryptosporidium parvum
TEECFNFLASISSWSTGTSDY

SEQ ID NO: 2305153 - protein, 25 aa, Cryptosporidium parvum
TEEEFPFKVIEILLGNILPIYTTSL

SEQ ID NO: 2305154 - protein, 19 aa, Cryptosporidium parvum
TEEKVCIFGSQSFQESVEI

SEQ ID NO: 2305155 - protein, 20 aa, Cryptosporidium parvum
TEELKTFLIQNLPKKVKKYN

SEQ ID NO: 2305156 - protein, 29 aa, Cryptosporidium parvum
TEFDFFYFRISQILKLKGFDLTETAQNSS

SEQ ID NO: 2305157 - protein, 19 aa, Cryptosporidium parvum
TEFKRKIVALNYPKVYVKN

SEQ ID NO: 2305158 - protein, 24 aa, Cryptosporidium parvum
TEFLREELRFVRGICERAPKCYQS

SEQ ID NO: 2305159 - protein, 23 aa, Cryptosporidium parvum
TEFVHGFIVWFDIEFPAHKSNAI

SEQ ID NO: 2305160 - protein, 28 aa, Cryptosporidium parvum
TEGFSGRQLFKLVLGMKSIVLGSGVESL

SEQ ID NO: 2305161 - protein, 19 aa, Cryptosporidium parvum
TEIIWRDKPELLSLAEPLA

SEQ ID NO: 2305162 - protein, 17 aa, Cryptosporidium parvum
TEIKSLIWRPRNNNNTG

SEQ ID NO: 2305163 - protein, 20 aa, Cryptosporidium parvum
TEILCILSGVCVWSVKCEIH

SEQ ID NO: 2305164 - protein, 21 aa, Cryptosporidium parvum
TEIQGKVIGLIFDKTTFYSES

SEQ ID NO: 2305165 - protein, 22 aa, Cryptosporidium parvum
TEKEIVNLPGFSPFKLESSQMS

SEQ ID NO: 2305166 - protein, 21 aa, Cryptosporidium parvum
TEKFLKVAVLIGDKDKFEDNE

SEQ ID NO: 2305167 - protein, 18 aa, Cryptosporidium parvum
TEKFWLENVMNFESDEFA

SEQ ID NO: 2305168 - protein, 20 aa, Cryptosporidium parvum
TEKNELCNILDALETQNRSR

SEQ ID NO: 2305169 - protein, 17 aa, Cryptosporidium parvum
TEKRLGKAKTFLEQTIS

SEQ ID NO: 2305170 - protein, 18 aa, Cryptosporidium parvum
TEKVSVVNLDFPKKKKTK

SEQ ID NO: 2305171 - protein, 17 aa, Cryptosporidium parvum
TELDILKEFIPIRLEMY

SEQ ID NO: 2305172 - protein, 20 aa, Cryptosporidium parvum
TELFLKLNINPILSNSGSTP

SEQ ID NO: 2305173 - protein, 24 aa, Cryptosporidium parvum
TELFWKNLKFHTSNYILKYLNLYL

SEQ ID NO: 2305174 - protein, 23 aa, Cryptosporidium parvum
TELILPCVYSMIKARYYWNQYNK

SEQ ID NO: 2305175 - protein, 17 aa, Cryptosporidium parvum
TELKPIISNKSKLVGGV

SEQ ID NO: 2305176 - protein, 18 aa, Cryptosporidium parvum
TELLEYINRSIIKNSVSH

SEQ ID NO: 2305177 - protein, 28 aa, Cryptosporidium parvum
TELLLIFDSLYWKDIISRLVELRSNPDN

SEQ ID NO: 2305178 - protein, 23 aa, Cryptosporidium parvum
TELLLKSGALLAEAMDSEGYTPI

SEQ ID NO: 2305179 - protein, 17 aa, Cryptosporidium parvum
TELLLKVQRHSFLQLPS

SEQ ID NO: 2305180 - protein, 20 aa, Cryptosporidium parvum
TELSPLDMLQMIGRGGRPQY

SEQ ID NO: 2305181 - protein, 23 aa, Cryptosporidium parvum
TELTFRMSNYFSVGVESRIGIGF

SEQ ID NO: 2305182 - protein, 25 aa, Cryptosporidium parvum
TELVNWRLVFYMNILNEDPNHIFWL

SEQ ID NO: 2305183 - protein, 24 aa, Cryptosporidium parvum
TENCEWRDLPGIERFRHSAWAIKS

SEQ ID NO: 2305184 - protein, 18 aa, Cryptosporidium parvum
TENFKKLDLNGIYYSLAK

SEQ ID NO: 2305185 - protein, 26 aa, Cryptosporidium parvum
TENPELFANILIEWSKKGYKSEKDIF

SEQ ID NO: 2305186 - protein, 20 aa, Cryptosporidium parvum
TEPRKCMEREVPKESEMELK

SEQ ID NO: 2305187 - protein, 27 aa, Cryptosporidium parvum
TEPSFLRKYWWLIAIGFITYSVLTTDQ

SEQ ID NO: 2305188 - protein, 28 aa, Cryptosporidium parvum
TEPVGFLFKKFEELREALQHGLAPISTN

SEQ ID NO: 2305189 - protein, 28 aa, Cryptosporidium parvum
TERELRYFFLKEIQRFSPDLVIPDSIKM

SEQ ID NO: 2305190 - protein, 25 aa, Cryptosporidium parvum
TERGVIYRLEFENESNFLFSSSNIS

SEQ ID NO: 2305191 - protein, 19 aa, Cryptosporidium parvum
TERKVRFSIDDLGVSSETK

SEQ ID NO: 2305192 - protein, 41 aa, Cryptosporidium parvum; identical to SEQ ID NO: 2182544

SEQ ID NO: 2305193 - protein, 23 aa, Cryptosporidium parvum
TESECNLRRAILILETAHTQSFS

SEQ ID NO: 2305194 - protein, 24 aa, Cryptosporidium parvum
TESKYSVSIPSEYIPYARSLDTHW

SEQ ID NO: 2305195 - protein, 18 aa, Cryptosporidium parvum
TESMASFSSGSQSTGIRK

SEQ ID NO: 2305196 - protein, 20 aa, Cryptosporidium parvum
TESTRFCGLNSLSNIDGSSG

SEQ ID NO: 2305197 - protein, 20 aa, Cryptosporidium parvum
TETFVTKADGSTVTTVDQVF

SEQ ID NO: 2305198 - protein, 28 aa, Cryptosporidium parvum
TEVDLRIPCGLFKTFALISSHSIFVQSR

SEQ ID NO: 2305199 - protein, 18 aa, Cryptosporidium parvum
TEVYSHIIAAYGAKRIIQ

SEQ ID NO: 2305200 - protein, 19 aa, Cryptosporidium parvum
TEYCNLHFILKKLLSEGLE

SEQ ID NO: 2305201 - protein, 23 aa, Cryptosporidium parvum
TEYSIPFDIRFSKLRKGFSSQNG

SEQ ID NO: 2305202 - protein, 18 aa, Cryptosporidium parvum
TFCQRLSNTIGRNVTKEE

SEQ ID NO: 2305203 - protein, 21 aa, Cryptosporidium parvum
TFDIEELLLYSGLEDSSLILL

SEQ ID NO: 2305204 - protein, 23 aa, Cryptosporidium parvum
TFDKKYKVCIERVDNKLTVRPRT

SEQ ID NO: 2305205 - protein, 25 aa, Cryptosporidium parvum
TFDLACRSYFKAYIIPLQIDAIKFL

SEQ ID NO: 2305206 - protein, 24 aa, Cryptosporidium parvum
TFDRKRTVFIGGLPKFCTEDELRR

SEQ ID NO: 2305207 - protein, 24 aa, Cryptosporidium parvum
TFEFECTTEWSLLRMLEVWLDHLF

SEQ ID NO: 2305208 - protein, 20 aa, Cryptosporidium parvum
TFEKTCRRPTFPFVSILATS

SEQ ID NO: 2305209 - protein, 17 aa, Cryptosporidium parvum
TFESGFYFHPAILDGAL

SEQ ID NO: 2305210 - protein, 17 aa, Cryptosporidium parvum
TFGRPCIEITRDESKNS

SEQ ID NO: 2305211 - protein, 23 aa, Cryptosporidium parvum
TFIECPNDMHGMIDVAKVADLVL

SEQ ID NO: 2305212 - protein, 22 aa, Cryptosporidium parvum
TFIKDLLNALLISTENEEIDFS

SEQ ID NO: 2305213 - protein, 29 aa, Cryptosporidium parvum
TFKSTHGWTDYQLRCNLAVAIGVSKDLFD

SEQ ID NO: 2305214 - protein, 29 aa, Cryptosporidium parvum
TFKVLRKRLLCFSASTAFWIPYTFSNEEH

SEQ ID NO: 2305215 - protein, 17 aa, Cryptosporidium parvum
TFLAKACATEMKGTFLS

SEQ ID NO: 2305216 - protein, 26 aa, Cryptosporidium parvum
TFLSNICVECGFILEGKSEFSNNNKS

SEQ ID NO: 2305217 - protein, 25 aa, Cryptosporidium parvum
TFLYLDIPTAWSFLRNGIRKSNIIQ

SEQ ID NO: 2305218 - protein, 19 aa, Cryptosporidium parvum
TFNSFIWEPAVNKLSAYSS

SEQ ID NO: 2305219 - protein, 17 aa, Cryptosporidium parvum
TFSCGVLSDTIRSETQN

SEQ ID NO: 2305220 - protein, 25 aa, Cryptosporidium parvum
TFSCKGGVSELVFSGSSARFTTPSI

SEQ ID NO: 2305221 - protein, 22 aa, Cryptosporidium parvum
TFSEMLENIFSPLIEALINPKD

SEQ ID NO: 2305222 - protein, 24 aa, Cryptosporidium parvum
TFSSLRISPKLILDEYKFYSFNTR

SEQ ID NO: 2305223 - protein, 18 aa, Cryptosporidium parvum
TFSSRKFGFNRAREKAIK

SEQ ID NO: 2305224 - protein, 18 aa, Cryptosporidium parvum
TFTSSLFSLICLKLDGLI

SEQ ID NO: 2305225 - protein, 18 aa, Cryptosporidium parvum
TFYLFNVWVNDFYRILKW

SEQ ID NO: 2305226 - protein, 18 aa, Cryptosporidium parvum
TGATICLTMAQLEDSEES

SEQ ID NO: 2305227 - protein, 17 aa, Cryptosporidium parvum
TGCNVVFTEKGVSDLAQ

SEQ ID NO: 2305228 - protein, 18 aa, Cryptosporidium parvum
TGDLFKLIHGNGSRSKAF

SEQ ID NO: 2305229 - protein, 18 aa, Cryptosporidium parvum
TGDPRIDAIRTIVIDYFN

SEQ ID NO: 2305230 - protein, 23 aa, Cryptosporidium parvum
TGDSSSCIWKFGQEKTEKSNISW

SEQ ID NO: 2305231 - protein, 23 aa, Cryptosporidium parvum
TGEAIEAYIFVGPIYYQKLKHMV

SEQ ID NO: 2305232 - protein, 22 aa, Cryptosporidium parvum
TGELLMRGPSSFSGYFRNEEET

SEQ ID NO: 2305233 - protein, 24 aa, Cryptosporidium parvum
TGESCIIALCKQWYIEYGEEKWRK

SEQ ID NO: 2305234 - protein, 18 aa, Cryptosporidium parvum
TGESIKDPFLSKSEGEDI

SEQ ID NO: 2305235 - protein, 27 aa, Cryptosporidium parvum
TGFHWEKNIRIKLPFNKEIQNNNVKLS

SEQ ID NO: 2305236 - protein, 17 aa, Cryptosporidium parvum
TGGELFDRLSHVGRFSE

SEQ ID NO: 2305237 - protein, 25 aa, Cryptosporidium parvum
TGGKLRLFTEFPFEKIYRDIYQTLY

SEQ ID NO: 2305238 - protein, 25 aa, Cryptosporidium parvum
TGHTLRLLSFPSLLEKGLSKLFSIK

SEQ ID NO: 2305239 - protein, 26 aa, Cryptosporidium parvum
TGIDHSYCYKIAWSYEKGKDDCKVMD

SEQ ID NO: 2305240 - protein, 18 aa, Cryptosporidium parvum
TGIFSWDLTYEEIKRIKC

SEQ ID NO: 2305241 - protein, 19 aa, Cryptosporidium parvum
TGIIWKELSRISAQLSQES

SEQ ID NO: 2305242 - protein, 18 aa, Cryptosporidium parvum
TGILCMFAAMAGAKHVYG

SEQ ID NO: 2305243 - protein, 17 aa, Cryptosporidium parvum
TGIRFDIIAGQAYYNHE

SEQ ID NO: 2305244 - protein, 24 aa, Cryptosporidium parvum
TGKELPRGVPYNHLTEVIISERRF

SEQ ID NO: 2305245 - protein, 25 aa, Cryptosporidium parvum
TGKMKFYQLEGLNWMFQLYKHNING

SEQ ID NO: 2305246 - protein, 28 aa, Cryptosporidium parvum
TGKMYLNMNKSCYIGGGHQGETGVGASI

SEQ ID NO: 2305247 - protein, 23 aa, Cryptosporidium parvum
TGKRQKKSWKRVVNKVCFVGNDF

SEQ ID NO: 2305248 - protein, 17 aa, Cryptosporidium parvum
TGKTMFARKLAKESGLD

SEQ ID NO: 2305249 - protein, 23 aa, Cryptosporidium parvum
TGKWKEALCEYNQISMEVKDNSP

SEQ ID NO: 2305250 - protein, 24 aa, Cryptosporidium parvum
TGLCNRTSCPLSNLLYATVIEHEG

SEQ ID NO: 2305251 - protein, 25 aa, Cryptosporidium parvum
TGLEVSNAFRFIYQVSDELWNSLFD

SEQ ID NO: 2305252 - protein, 26 aa, Cryptosporidium parvum
TGLIEKCLKLFLHPTITPVELSARFN

SEQ ID NO: 2305253 - protein, 20 aa, Cryptosporidium parvum
TGLKVAGIDVMFSEIGSAIE

SEQ ID NO: 2305254 - protein, 20 aa, Cryptosporidium parvum
TGLLPVDYAYWLTPYNTSIG

SEQ ID NO: 2305255 - protein, 24 aa, Cryptosporidium parvum
TGLRAVPCLYRLTTTSISSKVSDK

SEQ ID NO: 2305256 - protein, 20 aa, Cryptosporidium parvum
TGMPKGFAYLEFCEPEAVET

SEQ ID NO: 2305257 - protein, 21 aa, Cryptosporidium parvum
TGNASLSFLNLVKTGGVPGST

SEQ ID NO: 2305258 - protein, 17 aa, Cryptosporidium parvum
TGNCRVIYWKDLYKSGV

SEQ ID NO: 2305259 - protein, 18 aa, Cryptosporidium parvum
TGNFDRLFVVKASVLEIG

SEQ ID NO: 2305260 - protein, 23 aa, Cryptosporidium parvum
TGNFPISLSTFIIRSILTSSIQN

SEQ ID NO: 2305261 - protein, 24 aa, Cryptosporidium parvum
TGNKRLHTMTALNVCIKLLDLLIN

SEQ ID NO: 2305262 - protein, 21 aa, Cryptosporidium parvum
TGNSLCCLIEVLIKNNVKEKN

SEQ ID NO: 2305263 - protein, 30 aa, Cryptosporidium parvum
TGPVFDEELLRWIAEAEYLGVSRETAILIA

SEQ ID NO: 2305264 - protein, 25 aa, Cryptosporidium parvum
TGQDGVDFIGVFSLIDTEIRMPPVK

SEQ ID NO: 2305265 - protein, 25 aa, Cryptosporidium parvum
TGQDGVEFKGIFSLDQPELKLPTEH

SEQ ID NO: 2305266 - protein, 28 aa, Cryptosporidium parvum
TGQEVPRLLGYPACKEFFTHTVDIKPFY

SEQ ID NO: 2305267 - protein, 28 aa, Cryptosporidium parvum
TGQPFIPFALSFLMNLGDSYGISFFTTS

SEQ ID NO: 2305268 - protein, 22 aa, Cryptosporidium parvum
TGRSKGVCYVEFYSVESVLKAL

SEQ ID NO: 2305269 - protein, 22 aa, Cryptosporidium parvum
TGRSRGFGFITFASEESVDAVL

SEQ ID NO: 2305270 - protein, 17 aa, Cryptosporidium parvum
TGSFRLYKRDVFKSILG

SEQ ID NO: 2305271 - protein, 17 aa, Cryptosporidium parvum
TGSIFVWCLQPYSSKNT

SEQ ID NO: 2305272 - protein, 17 aa, Cryptosporidium parvum
TGSKIKPGIIVLVNNCD

SEQ ID NO: 2305273 - protein, 25 aa, Cryptosporidium parvum
TGSNPKLISMMGVRNEGSIRNNLNI

SEQ ID NO: 2305274 - protein, 26 aa, Cryptosporidium parvum
TGSVCAGGLCSIDGAFYAASADQGDA

SEQ ID NO: 2305275 - protein, 24 aa, Cryptosporidium parvum
TGTKLRPVVDFGDDRWVTLSTAEY

SEQ ID NO: 2305276 - protein, 19 aa, Cryptosporidium parvum
TGTSDYRSNYGFKAKYILD

SEQ ID NO: 2305277 - protein, 19 aa, Cryptosporidium parvum
TGVPMLGINNIRFNEKTDV

SEQ ID NO: 2305278 - protein, 17 aa, Cryptosporidium parvum
THACILHAILNCAGNRG

SEQ ID NO: 2305279 - protein, 18 aa, Cryptosporidium parvum
THDSILLKFNHLRTSFLL

SEQ ID NO: 2305280 - protein, 26 aa, Cryptosporidium parvum
THEGIFLINLAKTWEKIQIAARIIAT

SEQ ID NO: 2305281 - protein, 19 aa, Cryptosporidium parvum
THFFLPWFQVPFIYDVRVK

SEQ ID NO: 2305282 - protein, 29 aa, Cryptosporidium parvum
THFIPLWLRNCPKFGIVHILAFGLAPWLA

SEQ ID NO: 2305283 - protein, 23 aa, Cryptosporidium parvum
THNFFLSAPILKYNNRNDNSEES

SEQ ID NO: 2305284 - protein, 22 aa, Cryptosporidium parvum
THNIWSYRIFKEKNFAEVTEGS

SEQ ID NO: 2305285 - protein, 21 aa, Cryptosporidium parvum
THRGFKFIAEQVMHHPPVAAY

SEQ ID NO: 2305286 - protein, 24 aa, Cryptosporidium parvum
THSIPLLWRLAMFRIEDIPLFISN

SEQ ID NO: 2305287 - protein, 18 aa, Cryptosporidium parvum
THSSLRRVVYNCRQNSAL

SEQ ID NO: 2305288 - protein, 18 aa, Cryptosporidium parvum
THTLCIPFSGAIRDILRQ

SEQ ID NO: 2305289 - protein, 18 aa, Cryptosporidium parvum
THTLKAKLAKSVWGGATC

SEQ ID NO: 2305290 - protein, 19 aa, Cryptosporidium parvum
THVKLIIQDRIYDWKTPDS

SEQ ID NO: 2305291 - protein, 20 aa, Cryptosporidium parvum
THYDTLELKKDCSKEDICRA

SEQ ID NO: 2305292 - protein, 23 aa, Cryptosporidium parvum
TIADFCRRIHKQLLPQMKYALVW

SEQ ID NO: 2305293 - protein, 25 aa, Cryptosporidium parvum
TICKSKRPASVLMISFNSESSVQDK

SEQ ID NO: 2305294 - protein, 17 aa, Cryptosporidium parvum
TICYHKETNLICSGGED

SEQ ID NO: 2305295 - protein, 24 aa, Cryptosporidium parvum
TIDPNANDGLLFGSFGAVDISKIP

SEQ ID NO: 2305296 - protein, 18 aa, Cryptosporidium parvum
TIDPSFTALHYIIANLSL

SEQ ID NO: 2305297 - protein, 18 aa, Cryptosporidium parvum
TIEKSKLLRDSRSRAMMP

SEQ ID NO: 2305298 - protein, 26 aa, Cryptosporidium parvum
TIELELDYLLGWWLGAREAEFVRISE

SEQ ID NO: 2305299 - protein, 26 aa, Cryptosporidium parvum
TIEPIRCLRCRAYANPFTCVSQNGSQ

SEQ ID NO: 2305300 - protein, 18 aa, Cryptosporidium parvum
TIERGVKLTFNKSSQNNL

SEQ ID NO: 2305301 - protein, 18 aa, Cryptosporidium parvum
TIEWARDAFQGIFTSDPQ

SEQ ID NO: 2305302 - protein, 18 aa, Cryptosporidium parvum
TIFAHGFVTAPDGKKMSK

SEQ ID NO: 2305303 - protein, 20 aa, Cryptosporidium parvum
TIFRNCLNPIIVIINNDGYT

SEQ ID NO: 2305304 - protein, 33 aa, Cryptosporidium parvum
TIGGFKLELLFLGIRTGFFWNDLNLISKYIKRA

SEQ ID NO: 2305305 - protein, 27 aa, Cryptosporidium parvum
TIGLSEWSLILSLRIINLLKKLVAEYE

SEQ ID NO: 2305306 - protein, 28 aa, Cryptosporidium parvum
TIGRSRYFGEWAIIKGFDERTSNVISKG

SEQ ID NO: 2305307 - protein, 19 aa, Cryptosporidium parvum
TIGTLRFGIRAKMVKNAPK

SEQ ID NO: 2305308 - protein, 19 aa, Cryptosporidium parvum
TIIECLKASISGELPPSSK

SEQ ID NO: 2305309 - protein, 18 aa, Cryptosporidium parvum
TIIFEEFSPLVVENINKD

SEQ ID NO: 2305310 - protein, 19 aa, Cryptosporidium parvum
TIIQVKILGCLALIDDDEL

SEQ ID NO: 2305311 - protein, 24 aa, Cryptosporidium parvum
TIKGYCPHCSTVISIADLEPNNPI

SEQ ID NO: 2305312 - protein, 22 aa, Cryptosporidium parvum
TIKIWSFPDLKLQGTCKGHLSG

SEQ ID NO: 2305313 - protein, 18 aa, Cryptosporidium parvum
TIKIWSIQNQICLQTLTK

SEQ ID NO: 2305314 - protein, 23 aa, Cryptosporidium parvum
TIKVIHPLIRFSLSDEIKEKTYE

SEQ ID NO: 2305315 - protein, 23 aa, Cryptosporidium parvum
TIKVWDWDRDWIKAQTFQGNSHY

SEQ ID NO: 2305316 - protein, 24 aa, Cryptosporidium parvum
TILLPEILFFDSLLSMPIYQYIKE

SEQ ID NO: 2305317 - protein, 22 aa, Cryptosporidium parvum
TILLRMIILFLMSGNEEDLQTR

SEQ ID NO: 2305318 - protein, 17 aa, Cryptosporidium parvum
TILNCIQVFGLDAKMVI

SEQ ID NO: 2305319 - protein, 26 aa, Cryptosporidium parvum
TILNGLCSCPGFISVCNNKKKIHAIE

SEQ ID NO: 2305320 - protein, 19 aa, Cryptosporidium parvum
TILPFGKDDMEIFSSMKEL

SEQ ID NO: 2305321 - protein, 23 aa, Cryptosporidium parvum
TILRECAIIELMQNVMMVHNDNP

SEQ ID NO: 2305322 - protein, 17 aa, Cryptosporidium parvum
TILRIELAFSNGEEFLR

SEQ ID NO: 2305323 - protein, 18 aa, Cryptosporidium parvum
TILSCFESFISKIKTSKN

SEQ ID NO: 2305324 - protein, 17 aa, Cryptosporidium parvum
TIMSRSDISTCEDVISL

SEQ ID NO: 2305325 - protein, 23 aa, Cryptosporidium parvum
TINPARNCWEFQWPTEEKEQVGF

SEQ ID NO: 2305326 - protein, 41 aa, Cryptosporidium parvum; identical to SEQ ID NO: 2182664

SEQ ID NO: 2305327 - protein, 17 aa, Cryptosporidium parvum
TIPGICCDIRNPFPGPP

SEQ ID NO: 2305328 - protein, 19 aa, Cryptosporidium parvum
TIPLEGGFCSKEEFMERLK

SEQ ID NO: 2305329 - protein, 19 aa, Cryptosporidium parvum
TIPTHINGNMFRRKSGSGV

SEQ ID NO: 2305330 - protein, 27 aa, Cryptosporidium parvum
TIPVCNSLLLLRSGFLFASHEFGNHTN

SEQ ID NO: 2305331 - protein, 21 aa, Cryptosporidium parvum
TIRSICLPILETIKSARNFHI

SEQ ID NO: 2305332 - protein, 20 aa, Cryptosporidium parvum
TIRVACRLLIISVLLSSLEN

SEQ ID NO: 2305333 - protein, 22 aa, Cryptosporidium parvum
TISAYPMALKFVEDGNARDGRS

SEQ ID NO: 2305334 - protein, 24 aa, Cryptosporidium parvum
TISEGIPALIPRIEELASSKINSS

SEQ ID NO: 2305335 - protein, 18 aa, Cryptosporidium parvum
TISEKVINPEGKIDEKDS

SEQ ID NO: 2305336 - protein, 17 aa, Cryptosporidium parvum
TITCPGISISSSTIETN

SEQ ID NO: 2305337 - protein, 25 aa, Cryptosporidium parvum
TIVPPELVYSGGIQQMYRGNNTAAQ

SEQ ID NO: 2305338 - protein, 26 aa, Cryptosporidium parvum
TIVPPLWPPLVEWVFPKVSDRFHFVE

SEQ ID NO: 2305339 - protein, 18 aa, Cryptosporidium parvum
TIYESVRIVEFLGGTIDK

SEQ ID NO: 2305340 - protein, 24 aa, Cryptosporidium parvum
TIYLEFKESISLSFSNSIQEYRLG

SEQ ID NO: 2305341 - protein, 19 aa, Cryptosporidium parvum
TIYPYLSIQFIAQVENSKV

SEQ ID NO: 2305342 - protein, 18 aa, Cryptosporidium parvum
TKAAASIPAKKAMSDSSS

SEQ ID NO: 2305343 - protein, 20 aa, Cryptosporidium parvum
TKALERVSCTGGTDSDTTGD

SEQ ID NO: 2305344 - protein, 20 aa, Cryptosporidium parvum
TKALKLYKSIIYNILNYFNV

SEQ ID NO: 2305345 - protein, 17 aa, Cryptosporidium parvum
TKCGKVYTWGQGGRLGH

SEQ ID NO: 2305346 - protein, 21 aa, Cryptosporidium parvum
TKCKIEFPRQPTLSNECINAI

SEQ ID NO: 2305347 - protein, 17 aa, Cryptosporidium parvum
TKCVTTTSTTPVQTGTT

SEQ ID NO: 2305348 - protein, 18 aa, Cryptosporidium parvum
TKDEFLCDSKMIRGADIN

SEQ ID NO: 2305349 - protein, 20 aa, Cryptosporidium parvum
TKDSELIWLDSIHNHTKKKP

SEQ ID NO: 2305350 - protein, 20 aa, Cryptosporidium parvum
TKEFSGNALVVYKYEQSIEL

SEQ ID NO: 2305351 - protein, 17 aa, Cryptosporidium parvum
TKEGVILASEKRISSPL

SEQ ID NO: 2305352 - protein, 21 aa, Cryptosporidium parvum
TKEIKPPMKFNIKVKSIDKST

SEQ ID NO: 2305353 - protein, 25 aa, Cryptosporidium parvum
TKEKIRSAINLLDLSNCTTYVEVLE

SEQ ID NO: 2305354 - protein, 22 aa, Cryptosporidium parvum
TKELFLKYTFLRFMPRSFSIKK

SEQ ID NO: 2305355 - protein, 25 aa, Cryptosporidium parvum
TKELNIPNLWPFKEQMLNEMNDAKE

SEQ ID NO: 2305356 - protein, 25 aa, Cryptosporidium parvum
TKELRLDGWPALCIHGDKKQEERTW

SEQ ID NO: 2305357 - protein, 30 aa, Cryptosporidium parvum; identical to SEQ ID NO: 2182686

SEQ ID NO: 2305358 - protein, 27 aa, Cryptosporidium parvum
TKENLAIIGPISLEFDRYPASLYLGDL

SEQ ID NO: 2305359 - protein, 21 aa, Cryptosporidium parvum
TKERIKASLLLDDSASNDTIS

SEQ ID NO: 2305360 - protein, 18 aa, Cryptosporidium parvum
TKESFGIINGLSRPFINP

SEQ ID NO: 2305361 - protein, 20 aa, Cryptosporidium parvum
TKEYLAWLDPQFFFSGTPAI

SEQ ID NO: 2305362 - protein, 37 aa, Cryptosporidium parvum
TKFANYYQRRGWKTALVCADTFRAGAFDQLKQNATKV

SEQ ID NO: 2305363 - protein, 22 aa, Cryptosporidium parvum
TKFGQAVGYKFQIIKKLSDNKE

SEQ ID NO: 2305364 - protein, 26 aa, Cryptosporidium parvum
TKFKIRCSRYLYTLVMKDLEKAKKLE

SEQ ID NO: 2305365 - protein, 18 aa, Cryptosporidium parvum
TKFSASRKTGAFTGINFL

SEQ ID NO: 2305366 - protein, 22 aa, Cryptosporidium parvum
TKFSILRYFNPVGCHPSSLIGE

SEQ ID NO: 2305367 - protein, 20 aa, Cryptosporidium parvum
TKGRLPVCGEDSMDTWYDDL

SEQ ID NO: 2305368 - protein, 20 aa, Cryptosporidium parvum
TKHLYLYLSELLKLNGLGEE

SEQ ID NO: 2305369 - protein, 23 aa, Cryptosporidium parvum
TKHQLEMIFICFPDPHFKKRNWR

SEQ ID NO: 2305370 - protein, 20 aa, Cryptosporidium parvum
TKHYCPFAHGLDELRNPETI

SEQ ID NO: 2305371 - protein, 25 aa, Cryptosporidium parvum
TKIQSLWRMILCRNQYSKAIKAIIT

SEQ ID NO: 2305372 - protein, 24 aa, Cryptosporidium parvum
TKKIKEVRNIIKINKNVVNRRLIM

SEQ ID NO: 2305373 - protein, 22 aa, Cryptosporidium parvum
TKKIRFLLRQEKTLKIVANHYV

SEQ ID NO: 2305374 - protein, 22 aa, Cryptosporidium parvum
TKKNLREIENWKKSDHKNSASI

SEQ ID NO: 2305375 - protein, 24 aa, Cryptosporidium parvum
TKKNWIISIGICARIAQLESSFVE

SEQ ID NO: 2305376 - protein, 23 aa, Cryptosporidium parvum
TKKVPDGVVCFFSSYLYMEQMLS

SEQ ID NO: 2305377 - protein, 25 aa, Cryptosporidium parvum
TKLCKSQLYSYSWYCYNHLITTLDQ

SEQ ID NO: 2305378 - protein, 22 aa, Cryptosporidium parvum
TKLIRYGRRALMHLGDTSKLFG

SEQ ID NO: 2305379 - protein, 20 aa, Cryptosporidium parvum
TKLLPLLYRRQLSQIIEENY

SEQ ID NO: 2305380 - protein, 18 aa, Cryptosporidium parvum
TKLLRLGSLIGVDESYIR

SEQ ID NO: 2305381 - protein, 24 aa, Cryptosporidium parvum
TKLSSSFIPLRFGKDHTEGAGSSK

SEQ ID NO: 2305382 - protein, 32 aa, Cryptosporidium parvum
TKMLKLIQMYLLRPAEQWVYERSLYEQMLFLE

SEQ ID NO: 2305383 - protein, 19 aa, Cryptosporidium parvum
TKMSAIFFQNMNRYIQDEY

SEQ ID NO: 2305384 - protein, 19 aa, Cryptosporidium parvum
TKNAFSLGNTRSFVKSILA

SEQ ID NO: 2305385 - protein, 24 aa, Cryptosporidium parvum
TKNHLKNQIPILLASVGISTQDNI

SEQ ID NO: 2305386 - protein, 24 aa, Cryptosporidium parvum
TKNQSSSWFSSWFGNNSSANEIQE

SEQ ID NO: 2305387 - protein, 20 aa, Cryptosporidium parvum
TKPHPVVRPHPTEKPSNGEH

SEQ ID NO: 2305388 - protein, 29 aa, Cryptosporidium parvum
TKQLWQIAAMCGLEERFINLHAQSLAQSK

SEQ ID NO: 2305389 - protein, 28 aa, Cryptosporidium parvum
TKQWIPIRPKSRFLYYYKKKGNYSNAIM

SEQ ID NO: 2305390 - protein, 17 aa, Cryptosporidium parvum
TKRDFLLKNILQLYEIS

SEQ ID NO: 2305391 - protein, 24 aa, Cryptosporidium parvum
TKRIKIKRLIDGKCEEVSSDAVLN

SEQ ID NO: 2305392 - protein, 18 aa, Cryptosporidium parvum
TKRQYRFYLSTLLAITVK

SEQ ID NO: 2305393 - protein, 18 aa, Cryptosporidium parvum
TKRRLIIKGSKCKENIQN

SEQ ID NO: 2305394 - protein, 38 aa, Cryptosporidium parvum
TKSEIPKLDFVVDHLFLWGSPLPAMLVMMFPEYLRSGL

SEQ ID NO: 2305395 - protein, 26 aa, Cryptosporidium parvum
TKSGVPWNLGICVGGFPDRVAALRFE

SEQ ID NO: 2305396 - protein, 24 aa, Cryptosporidium parvum
TKSIIEIWIDWKIFPSEYIEGLSS

SEQ ID NO: 2305397 - protein, 27 aa, Cryptosporidium parvum
TKSRPFEYLRLTSLGVIGALVKVDDPE

SEQ ID NO: 2305398 - protein, 22 aa, Cryptosporidium parvum
TKTELFEKVFISPLIIPASVSK

SEQ ID NO: 2305399 - protein, 23 aa, Cryptosporidium parvum
TKTLFKYSSWVGGDRDGNPYVTA

SEQ ID NO: 2305400 - protein, 18 aa, Cryptosporidium parvum
TKTLRDLSGFGKINQTPE

SEQ ID NO: 2305401 - protein, 19 aa, Cryptosporidium parvum
TKVRYVLKFGQLSLSRPSV

SEQ ID NO: 2305402 - protein, 21 aa, Cryptosporidium parvum
TKYIECMEKLKKLLHSIHSAC

SEQ ID NO: 2305403 - protein, 20 aa, Cryptosporidium parvum
TKYPELRVSCVIGGEDSGKQ

SEQ ID NO: 2305404 - protein, 23 aa, Cryptosporidium parvum
TKYQPFETCRLITDNLNQNPVKN

SEQ ID NO: 2305405 - protein, 17 aa, Cryptosporidium parvum
TLAESWLGVEILSDKVN

SEQ ID NO: 2305406 - protein, 25 aa, Cryptosporidium parvum
TLAWGVNFPAHFAIIKGTEYFDAKL

SEQ ID NO: 2305407 - protein, 20 aa, Cryptosporidium parvum
TLCPDVYVYASWTFFLQHLR

SEQ ID NO: 2305408 - protein, 34 aa, Cryptosporidium parvum
TLDDCWCFNILKKDEWVCVLPLSVKSQEWVDSDS

SEQ ID NO: 2305409 - protein, 26 aa, Cryptosporidium parvum
TLDTIPWFCSYNKLQVLSNSEYEVME

SEQ ID NO: 2305410 - protein, 18 aa, Cryptosporidium parvum
TLDYLVTPMVRYRDIASN

SEQ ID NO: 2305411 - protein, 33 aa, Cryptosporidium parvum; identical to SEQ ID NO: 2182745

SEQ ID NO: 2305412 - protein, 19 aa, Cryptosporidium parvum
TLEEKVECIFEFFLEVFGI

SEQ ID NO: 2305413 - protein, 18 aa, Cryptosporidium parvum
TLEGFQKMKLATQNRINK

SEQ ID NO: 2305414 - protein, 17 aa, Cryptosporidium parvum
TLEKELERKECGQDLLY

SEQ ID NO: 2305415 - protein, 25 aa, Cryptosporidium parvum
TLEKVYRICFNLYFQEIYDFQLSLD

SEQ ID NO: 2305416 - protein, 23 aa, Cryptosporidium parvum
TLELKRLRYFTIKSIPTSISGIN

SEQ ID NO: 2305417 - protein, 24 aa, Cryptosporidium parvum
TLELSELRVPSYLNNSPLIDKHNN

SEQ ID NO: 2305418 - protein, 18 aa, Cryptosporidium parvum
TLEMKNLSIEWVHRPFFN

SEQ ID NO: 2305419 - protein, 25 aa, Cryptosporidium parvum
TLESYKMAGSICYGGVNNKQYIPLK

SEQ ID NO: 2305420 - protein, 23 aa, Cryptosporidium parvum
TLFDGCLCSEVLELERRGLIELI

SEQ ID NO: 2305421 - protein, 18 aa, Cryptosporidium parvum
TLFHVLRQYASLLSDKKH

SEQ ID NO: 2305422 - protein, 21 aa, Cryptosporidium parvum
TLFLKNYCDWGQLDKIVQQVL

SEQ ID NO: 2305423 - protein, 28 aa, Cryptosporidium parvum
TLFNKAFCLQKMNILEFVPSKKLSKEMT

SEQ ID NO: 2305424 - protein, 32 aa, Cryptosporidium parvum
TLFRDPECVPREILDIYLAMGVSSEADENIVI

SEQ ID NO: 2305425 - protein, 17 aa, Cryptosporidium parvum
TLFTLPLPGASQYTRTG

SEQ ID NO: 2305426 - protein, 27 aa, Cryptosporidium parvum
TLGHLLFDFLELFGIVFNYSSTGIRLK

SEQ ID NO: 2305427 - protein, 24 aa, Cryptosporidium parvum
TLGSLRVEDILSIDGKFIQKTTLS

SEQ ID NO: 2305428 - protein, 20 aa, Cryptosporidium parvum
TLHFCEYCLDFFCFEDELIR

SEQ ID NO: 2305429 - protein, 19 aa, Cryptosporidium parvum
TLIGFQMGVFIGCCSNDWS

SEQ ID NO: 2305430 - protein, 24 aa, Cryptosporidium parvum
TLIHEVSELKTLWQHETKKREIYE

SEQ ID NO: 2305431 - protein, 20 aa, Cryptosporidium parvum
TLIKESRQVVSIVSERTLIV

SEQ ID NO: 2305432 - protein, 23 aa, Cryptosporidium parvum
TLILKSGFLLPSILNPLTSILVL

SEQ ID NO: 2305433 - protein, 17 aa, Cryptosporidium parvum
TLIPLPYPDFSMIAKTR

SEQ ID NO: 2305434 - protein, 21 aa, Cryptosporidium parvum
TLKIMYPYHVHLARGNHETKN

SEQ ID NO: 2305435 - protein, 24 aa, Cryptosporidium parvum
TLKNCKPKRAIPSKDPQEIDEFNS

SEQ ID NO: 2305436 - protein, 18 aa, Cryptosporidium parvum
TLKRNCDKQEIIMHDYER

SEQ ID NO: 2305437 - protein, 24 aa, Cryptosporidium parvum
TLLADYNIKCTFFVTERNAKYIKN

SEQ ID NO: 2305438 - protein, 18 aa, Cryptosporidium parvum
TLLDEDLCLKRPKRIEII

SEQ ID NO: 2305439 - protein, 24 aa, Cryptosporidium parvum
TLLDHPWLRIRGVSSDYLENMLAR

SEQ ID NO: 2305440 - protein, 20 aa, Cryptosporidium parvum
TLLEFKLSLDPLYDPGPPDN

SEQ ID NO: 2305441 - protein, 26 aa, Cryptosporidium parvum
TLLETGSDILFFWVARMVMLSFACTD

SEQ ID NO: 2305442 - protein, 23 aa, Cryptosporidium parvum
TLLKDFRIAINLEHKENPIEVAN

SEQ ID NO: 2305443 - protein, 24 aa, Cryptosporidium parvum
TLLKKGPEELADWNRYFKRIQSSK

SEQ ID NO: 2305444 - protein, 20 aa, Cryptosporidium parvum
TLLLQFCFELYMISTQLASE

SEQ ID NO: 2305445 - protein, 24 aa, Cryptosporidium parvum
TLLNVKGGIPLKVVEKSSTSLLGK

SEQ ID NO: 2305446 - protein, 18 aa, Cryptosporidium parvum
TLMKACINEQILRKDFKS

SEQ ID NO: 2305447 - protein, 19 aa, Cryptosporidium parvum
TLMYCSGEYGALEAEKHIR

SEQ ID NO: 2305448 - protein, 25 aa, Cryptosporidium parvum
TLNDFLRYFVDIFIEESVSVQLQIL

SEQ ID NO: 2305449 - protein, 27 aa, Cryptosporidium parvum
TLNFRKRDWYSLIAVFLTGAEWQLQSF

SEQ ID NO: 2305450 - protein, 19 aa, Cryptosporidium parvum
TLNIPFKFTTLIEASGNSK

SEQ ID NO: 2305451 - protein, 24 aa, Cryptosporidium parvum
TLNIWKELEQIVGDFGTKDNTSML

SEQ ID NO: 2305452 - protein, 25 aa, Cryptosporidium parvum
TLNREICLFYLPLNLPCMYSVPFIE

SEQ ID NO: 2305453 - protein, 17 aa, Cryptosporidium parvum
TLPKIDFKIGIRVQFVY

SEQ ID NO: 2305454 - protein, 19 aa, Cryptosporidium parvum
TLPLKTVVIIWDYLLANGL

SEQ ID NO: 2305455 - protein, 25 aa, Cryptosporidium parvum
TLQPCGHQLCFYCEHRLVDSKCPWD

SEQ ID NO: 2305456 - protein, 19 aa, Cryptosporidium parvum
TLRDYQIYGLNWMISRFKK

SEQ ID NO: 2305457 - protein, 22 aa, Cryptosporidium parvum
TLRGPRSAIIFYRKDVESKIRV

SEQ ID NO: 2305458 - protein, 20 aa, Cryptosporidium parvum
TLRILPSLIYRIPNLTPGLI

SEQ ID NO: 2305459 - protein, 29 aa, Cryptosporidium parvum
TLRKNPNLFAKWSISFSLGLHRLQRNILL

SEQ ID NO: 2305460 - protein, 24 aa, Cryptosporidium parvum
TLRPEVKKCSAICSLLEQQFNEVE

SEQ ID NO: 2305461 - protein, 18 aa, Cryptosporidium parvum
TLSELKNDPWMKIKCENE

SEQ ID NO: 2305462 - protein, 19 aa, Cryptosporidium parvum
TLSNALAFDQFDAGLQSRE

SEQ ID NO: 2305463 - protein, 27 aa, Cryptosporidium parvum
TLSRCLPHTKIKKIIKCSGAVNHMIGS

SEQ ID NO: 2305464 - protein, 28 aa, Cryptosporidium parvum
TLSRYWTHISLIGECFNILKKNDITSIG

SEQ ID NO: 2305465 - protein, 29 aa, Cryptosporidium parvum
TLTHIKLLSCFVLNYISDWACVDSVIGII

SEQ ID NO: 2305466 - protein, 17 aa, Cryptosporidium parvum
TLVELLIVVMFQNSNIN

SEQ ID NO: 2305467 - protein, 26 aa, Cryptosporidium parvum
TLVRGRWYHKTCLELLNSESERESHS

SEQ ID NO: 2305468 - protein, 18 aa, Cryptosporidium parvum
TLVYQVIPFNGIKNILKR

SEQ ID NO: 2305469 - protein, 19 aa, Cryptosporidium parvum
TMAALALLFAMQSYHPSPF

SEQ ID NO: 2305470 - protein, 18 aa, Cryptosporidium parvum
TMDFWFAAIRFFFLEAGR

SEQ ID NO: 2305471 - protein, 17 aa, Cryptosporidium parvum
TMGLVSMETYKRHISDI

SEQ ID NO: 2305472 - protein, 24 aa, Cryptosporidium parvum
TMLLYEIIRRLSIESRDNLVNMMQ

SEQ ID NO: 2305473 - protein, 25 aa, Cryptosporidium parvum
TMLRLACIHPQLGIMGIHNKNKDDD

SEQ ID NO: 2305474 - protein, 23 aa, Cryptosporidium parvum
TMQFFNFRIVKRRHYSSSSNLLK

SEQ ID NO: 2305475 - protein, 19 aa, Cryptosporidium parvum
TMRLWNWQSRTCISVITGH

SEQ ID NO: 2305476 - protein, 26 aa, Cryptosporidium parvum
TMSHLRFGPKPIKSAYLLQRCDYVAV

SEQ ID NO: 2305477 - protein, 19 aa, Cryptosporidium parvum
TMYIAGDIRPFLKNKDCQE

SEQ ID NO: 2305478 - protein, 20 aa, Cryptosporidium parvum
TMYIIRFRLKNISSQINEKI

SEQ ID NO: 2305479 - protein, 29 aa, Cryptosporidium parvum
TNASCCITLEWSVCGRFLLASTTSPRLRV

SEQ ID NO: 2305480 - protein, 17 aa, Cryptosporidium parvum
TNCETNMTSEQTKKRPS

SEQ ID NO: 2305481 - protein, 27 aa, Cryptosporidium parvum
TNCSTQFCNECCKFIFNTLHQCPICCS

SEQ ID NO: 2305482 - protein, 19 aa, Cryptosporidium parvum
TNDCFKLMLNIIKEFNNRY

SEQ ID NO: 2305483 - protein, 24 aa, Cryptosporidium parvum
TNEETVLWKLSPKIWEIKLKNKIN

SEQ ID NO: 2305484 - protein, 25 aa, Cryptosporidium parvum
TNEQESSFWGWFGYSTTPENPKAKI

SEQ ID NO: 2305485 - protein, 23 aa, Cryptosporidium parvum
TNEYLMLYSFPFGGFSSCFQFNF

SEQ ID NO: 2305486 - protein, 40 aa, Cryptosporidium parvum
TNGSKGLINFTIKRNDFRNIPMLVSNLFGTTNLKKQMLLW

SEQ ID NO: 2305487 - protein, 37 aa, Cryptosporidium parvum; identical to SEQ ID NO: 2182811

SEQ ID NO: 2305488 - protein, 21 aa, Cryptosporidium parvum
TNHLFHIFLFLIIQELSDLNR

SEQ ID NO: 2305489 - protein, 24 aa, Cryptosporidium parvum
TNHLSSGFSINWVLDADWSFLNNH

SEQ ID NO: 2305490 - protein, 19 aa, Cryptosporidium parvum
TNHTCFIAFNRAYCIDTEI

SEQ ID NO: 2305491 - protein, 18 aa, Cryptosporidium parvum
TNIFKSLDIVSSIRTSPL

SEQ ID NO: 2305492 - protein, 18 aa, Cryptosporidium parvum
TNIICGGLSISHQLNKIR

SEQ ID NO: 2305493 - protein, 18 aa, Cryptosporidium parvum
TNILDLVRQFIKIRFPFV

SEQ ID NO: 2305494 - protein, 20 aa, Cryptosporidium parvum
TNINLVMKGRCSVGNISDLK

SEQ ID NO: 2305495 - protein, 23 aa, Cryptosporidium parvum
TNIPWEIDSGIRRRFERRIYIPL

SEQ ID NO: 2305496 - protein, 17 aa, Cryptosporidium parvum
TNIRWTYYSFYPLILSS

SEQ ID NO: 2305497 - protein, 26 aa, Cryptosporidium parvum
TNKEVPIRIRFLINDVIDSRKNNWKS

SEQ ID NO: 2305498 - protein, 20 aa, Cryptosporidium parvum
TNKIQWVILALISVHTIDSY

SEQ ID NO: 2305499 - protein, 25 aa, Cryptosporidium parvum
TNKKCRNGVHCCFCHFQHKERKRGK

SEQ ID NO: 2305500 - protein, 25 aa, Cryptosporidium parvum
TNLALWEVSDPIILNTFEKELFAFL

SEQ ID NO: 2305501 - protein, 23 aa, Cryptosporidium parvum
TNLDTVMEFYRFWSNFSSTRTFS

SEQ ID NO: 2305502 - protein, 23 aa, Cryptosporidium parvum
TNLILYCLKHIFTQLAQSSPESN

SEQ ID NO: 2305503 - protein, 26 aa, Cryptosporidium parvum
TNLNNERYISSSLILTNGTSQGKFAL

SEQ ID NO: 2305504 - protein, 18 aa, Cryptosporidium parvum
TNLPEYVSWHHRKYDRPL

SEQ ID NO: 2305505 - protein, 19 aa, Cryptosporidium parvum
TNLTNLRGNFMGNDGSDYI

SEQ ID NO: 2305506 - protein, 26 aa, Cryptosporidium parvum
TNLVPYPRIHFMLSSYAPIISAEKAF

SEQ ID NO: 2305507 - protein, 22 aa, Cryptosporidium parvum
TNNLECALCPNGTVHSSEDSQE

SEQ ID NO: 2305508 - protein, 19 aa, Cryptosporidium parvum
TNPCLFSINNVRVTGVSGQ

SEQ ID NO: 2305509 - protein, 22 aa, Cryptosporidium parvum
TNPKHSPGWIAAARFEEFVGRL

SEQ ID NO: 2305510 - protein, 24 aa, Cryptosporidium parvum
TNPNCPPPKCYRSYGSNKEDEPMC

SEQ ID NO: 2305511 - protein, 21 aa, Cryptosporidium parvum
TNSAFLACCYMMIRQGKTPGS

SEQ ID NO: 2305512 - protein, 27 aa, Cryptosporidium parvum
TNSATSLKAEYIVGAKEGLLCVYCTSK

SEQ ID NO: 2305513 - protein, 26 aa, Cryptosporidium parvum
TNSIEYWFNRCCLYLSNNDIDNAMTS

SEQ ID NO: 2305514 - protein, 21 aa, Cryptosporidium parvum
TNSIRILLDYFIDSNDLIASI

SEQ ID NO: 2305515 - protein, 23 aa, Cryptosporidium parvum
TNSKVIGIVICLQPQNPNILLLK

SEQ ID NO: 2305516 - protein, 17 aa, Cryptosporidium parvum
TNTKCKFCIKSPDRNIT

SEQ ID NO: 2305517 - protein, 19 aa, Cryptosporidium parvum
TNVCNQCGLFGYNNYCHYC

SEQ ID NO: 2305518 - protein, 24 aa, Cryptosporidium parvum
TNVDESYLTWGIMHVIREIKHSSL

SEQ ID NO: 2305519 - protein, 20 aa, Cryptosporidium parvum
TNWIMQTWRNIQCEMGNEGD

SEQ ID NO: 2305520 - protein, 26 aa, Cryptosporidium parvum
TNWNKFTFPLLEEFSMIQDQIQLVEN

SEQ ID NO: 2305521 - protein, 21 aa, Cryptosporidium parvum
TNYGLKPGYNIMLHSKNVNNN

SEQ ID NO: 2305522 - protein, 20 aa, Cryptosporidium parvum
TNYIPEKMMILGVGNIDHNS

SEQ ID NO: 2305523 - protein, 23 aa, Cryptosporidium parvum
TNYRELSGLFSLPDLLLKDELLC

SEQ ID NO: 2305524 - protein, 28 aa, Cryptosporidium parvum
TNYRKISVIFWRKVWINIYKIVHGKLEL

SEQ ID NO: 2305525 - protein, 22 aa, Cryptosporidium parvum
TPALQKRTYPFISYPSDSESGN

SEQ ID NO: 2305526 - protein, 20 aa, Cryptosporidium parvum
TPCDKSRYGVQEFHQELPTE

SEQ ID NO: 2305527 - protein, 18 aa, Cryptosporidium parvum
TPEFYIPIFKKLKVSTVI

SEQ ID NO: 2305528 - protein, 25 aa, Cryptosporidium parvum
TPEKVCFIKDLNMYAVAGVKERYKG

SEQ ID NO: 2305529 - protein, 18 aa, Cryptosporidium parvum
TPEKWESFTRRWWAKSRS

SEQ ID NO: 2305530 - protein, 20 aa, Cryptosporidium parvum
TPESLLLASLQIERRGAKEK

SEQ ID NO: 2305531 - protein, 20 aa, Cryptosporidium parvum
TPFEDFRIFDIYLLGQDYVG

SEQ ID NO: 2305532 - protein, 17 aa, Cryptosporidium parvum
TPFPIMLSVGKVMEQME

SEQ ID NO: 2305533 - protein, 18 aa, Cryptosporidium parvum
TPGIRRKTGELVREQSPF

SEQ ID NO: 2305534 - protein, 24 aa, Cryptosporidium parvum
TPGKSYPELCWAEGEGLKYYNIDE

SEQ ID NO: 2305535 - protein, 21 aa, Cryptosporidium parvum
TPGLFDAKLINFTGSTNSSTA

SEQ ID NO: 2305536 - protein, 25 aa, Cryptosporidium parvum
TPGPKPSKSIGCLEYVPESNNKNNN

SEQ ID NO: 2305537 - protein, 21 aa, Cryptosporidium parvum
TPGSWKAALHASGSVINAVDC

SEQ ID NO: 2305538 - protein, 17 aa, Cryptosporidium parvum
TPIHCIAYANFIYEEDE

SEQ ID NO: 2305539 - protein, 25 aa, Cryptosporidium parvum
TPIIECPNSNIIIPKCFILDIIYGI

SEQ ID NO: 2305540 - protein, 21 aa, Cryptosporidium parvum
TPIQAACLVPAIRDRKDIVGA

SEQ ID NO: 2305541 - protein, 20 aa, Cryptosporidium parvum
TPIRKSKRQIIYNFANSIWD

SEQ ID NO: 2305542 - protein, 17 aa, Cryptosporidium parvum
TPKEILNQLNLKHVFAI

SEQ ID NO: 2305543 - protein, 24 aa, Cryptosporidium parvum
TPKELKLKLIDFLDKKLNWTEIET

SEQ ID NO: 2305544 - protein, 31 aa, Cryptosporidium parvum
TPKQFKDWRAHDIGIGFLLYGESVCFVLARM

SEQ ID NO: 2305545 - protein, 21 aa, Cryptosporidium parvum
TPKRSYLPLITHISSPLSNPS

SEQ ID NO: 2305546 - protein, 20 aa, Cryptosporidium parvum
TPKYGELKCLDIFKYNNNTQ

SEQ ID NO: 2305547 - protein, 26 aa, Cryptosporidium parvum
TPLEESAKCLVEHGFHYSGKEYLTSG

SEQ ID NO: 2305548 - protein, 29 aa, Cryptosporidium parvum
TPLETRVSWLSKWLRISKSGGRREKDELV

SEQ ID NO: 2305549 - protein, 19 aa, Cryptosporidium parvum
TPLKIKYPYLTGTYTQLNY

SEQ ID NO: 2305550 - protein, 17 aa, Cryptosporidium parvum
TPLKVILDLETKMYYLG

SEQ ID NO: 2305551 - protein, 18 aa, Cryptosporidium parvum
TPLLLGIYGLKFETVRLL

SEQ ID NO: 2305552 - protein, 19 aa, Cryptosporidium parvum
TPLLYNMIIEIPKLTNKKF

SEQ ID NO: 2305553 - protein, 18 aa, Cryptosporidium parvum
TPLNWDLKIYENFLNLSK

SEQ ID NO: 2305554 - protein, 20 aa, Cryptosporidium parvum
TPLPPSRYLVPLFMRCLYSS

SEQ ID NO: 2305555 - protein, 23 aa, Cryptosporidium parvum
TPLQCKSPFLKEINHILRDWAVF

SEQ ID NO: 2305556 - protein, 17 aa, Cryptosporidium parvum
TPLQWACMTNNKELISY

SEQ ID NO: 2305557 - protein, 18 aa, Cryptosporidium parvum
TPLSTRFSLVKRFNQNQS

SEQ ID NO: 2305558 - protein, 23 aa, Cryptosporidium parvum
TPNKRIVMLPAKVETVLAENIQQ

SEQ ID NO: 2305559 - protein, 20 aa, Cryptosporidium parvum
TPNYLGCLDYVFYTDERLRL

SEQ ID NO: 2305560 - protein, 21 aa, Cryptosporidium parvum
TPPAFKSSPPLLFILICSSNT

SEQ ID NO: 2305561 - protein, 23 aa, Cryptosporidium parvum
TPPSVPVLPGINGFHATIITNSL

SEQ ID NO: 2305562 - protein, 19 aa, Cryptosporidium parvum
TPQTCRLGNASHILRIPKQ

SEQ ID NO: 2305563 - protein, 22 aa, Cryptosporidium parvum
TPQYCYSLLRCLHRVLCCCPRI

SEQ ID NO: 2305564 - protein, 23 aa, Cryptosporidium parvum
TPRNKLRLGGNIHEGIISGRCNT

SEQ ID NO: 2305565 - protein, 18 aa, Cryptosporidium parvum
TPRPNCYDYYNRDPYNRD

SEQ ID NO: 2305566 - protein, 23 aa, Cryptosporidium parvum
TPRPQMSSCFLLRIPEDSINGIF

SEQ ID NO: 2305567 - protein, 26 aa, Cryptosporidium parvum
TPRVSSFPGSLSWDSRDSYKIRDLSG

SEQ ID NO: 2305568 - protein, 17 aa, Cryptosporidium parvum
TPSLAIDLLEQILRYEP

SEQ ID NO: 2305569 - protein, 18 aa, Cryptosporidium parvum
TPSLSYLIQKNFENPANG

SEQ ID NO: 2305570 - protein, 19 aa, Cryptosporidium parvum
TPSLTLGCGSWGHTSTAEG

SEQ ID NO: 2305571 - protein, 25 aa, Cryptosporidium parvum
TPSLVFFKKSLKWYLESFHSVHLIP

SEQ ID NO: 2305572 - protein, 17 aa, Cryptosporidium parvum
TPSRLNEKLKFSNKSNS

SEQ ID NO: 2305573 - protein, 18 aa, Cryptosporidium parvum
TPTLRPKDKPKWSPPPPL

SEQ ID NO: 2305574 - protein, 17 aa, Cryptosporidium parvum
TPVFIKELMIRSEDGKT

SEQ ID NO: 2305575 - protein, 23 aa, Cryptosporidium parvum
TPYKNLFVIWDYMIKRSYQELGM

SEQ ID NO: 2305576 - protein, 17 aa, Cryptosporidium parvum
TPYSCIPVILNRLRQKD

SEQ ID NO: 2305577 - protein, 25 aa, Cryptosporidium parvum
TQDMICHVCSLKLGNKPCALYPNGS

SEQ ID NO: 2305578 - protein, 24 aa, Cryptosporidium parvum
TQDYRLRTVFNYKSIKSGMHSNMS

SEQ ID NO: 2305579 - protein, 25 aa, Cryptosporidium parvum
TQEVSQCILPLPIIHQGPTINASSR

SEQ ID NO: 2305580 - protein, 26 aa, Cryptosporidium parvum
TQEYLKPGGKLLIFTPFMTTELLQIH

SEQ ID NO: 2305581 - protein, 24 aa, Cryptosporidium parvum
TQFSSRINRMIKLGLSIDEEDIVD

SEQ ID NO: 2305582 - protein, 18 aa, Cryptosporidium parvum
TQGFLALFAGDTGEIKPE

SEQ ID NO: 2305583 - protein, 19 aa, Cryptosporidium parvum
TQGTLSRQHFRTVLYLILP

SEQ ID NO: 2305584 - protein, 17 aa, Cryptosporidium parvum
TQHGKPVIVPKMSEIQE

SEQ ID NO: 2305585 - protein, 20 aa, Cryptosporidium parvum
TQICPCPECNEEAINGSIHG

SEQ ID NO: 2305586 - protein, 21 aa, Cryptosporidium parvum
TQIFPCSELNSLIKSNSYIEP

SEQ ID NO: 2305587 - protein, 23 aa, Cryptosporidium parvum
TQKFRFYPKYILIGHEAIIWSID

SEQ ID NO: 2305588 - protein, 29 aa, Cryptosporidium parvum
TQKSIRGIYQWFRKYFKTYYLPNEYWIYK

SEQ ID NO: 2305589 - protein, 29 aa, Cryptosporidium parvum
TQKWVRGEVEGFLHIVKRDIEPIYQLIVL

SEQ ID NO: 2305590 - protein, 40 aa, Cryptosporidium parvum
TQKYVIPLIMSYPIAGIVFFNTNMGIKWFNAKNPIINDHL

SEQ ID NO: 2305591 - protein, 20 aa, Cryptosporidium parvum
TQLFPLNPIHIENKMAATSS

SEQ ID NO: 2305592 - protein, 25 aa, Cryptosporidium parvum
TQLIKVKVLTWIISDIFDIRNNSNK

SEQ ID NO: 2305593 - protein, 17 aa, Cryptosporidium parvum
TQLNVILDCNGGQTILD

SEQ ID NO: 2305594 - protein, 25 aa, Cryptosporidium parvum
TQMIPRSLFDMKFSTPNSNLLLPFE

SEQ ID NO: 2305595 - protein, 25 aa, Cryptosporidium parvum
TQMLICGIPSYLILQFFDKNNMEEY

SEQ ID NO: 2305596 - protein, 25 aa, Cryptosporidium parvum
TQNEELRDSLGMKAQEIEKLQTEKQ

SEQ ID NO: 2305597 - protein, 20 aa, Cryptosporidium parvum
TQNFNWRTPKYIGRNDLETM

SEQ ID NO: 2305598 - protein, 21 aa, Cryptosporidium parvum
TQNIRMSKVFYYDFSEKEFVS

SEQ ID NO: 2305599 - protein, 18 aa, Cryptosporidium parvum
TQNYSIFDLVLFDSEGSC

SEQ ID NO: 2305600 - protein, 21 aa, Cryptosporidium parvum
TQPFFMLLSFIPKLSYDILLA

SEQ ID NO: 2305601 - protein, 23 aa, Cryptosporidium parvum
TQPFFRLDWKVLYDNIKEMTILE

SEQ ID NO: 2305602 - protein, 17 aa, Cryptosporidium parvum
TQPRRIAAISLAEYVAK

SEQ ID NO: 2305603 - protein, 17 aa, Cryptosporidium parvum
TQPRRVAAMSVAARVAK

SEQ ID NO: 2305604 - protein, 25 aa, Cryptosporidium parvum
TQRECLNGFSILGVLIKYLFDQINF

SEQ ID NO: 2305605 - protein, 17 aa, Cryptosporidium parvum
TQRGLVSYIILDPNEED

SEQ ID NO: 2305606 - protein, 18 aa, Cryptosporidium parvum
TQRKCLSILHSLKDIHQL

SEQ ID NO: 2305607 - protein, 37 aa, Cryptosporidium parvum
TQRKLVLHAISFKRISNFSSIFCKEIEYYGFLGEFYS

SEQ ID NO: 2305608 - protein, 23 aa, Cryptosporidium parvum
TQSFHVDLMFHPPIQNIDKNVAN

SEQ ID NO: 2305609 - protein, 20 aa, Cryptosporidium parvum
TQSLKFVMQDVQEHFKRASQ

SEQ ID NO: 2305610 - protein, 22 aa, Cryptosporidium parvum
TQSLNCIYCYKEILQSLKEKYE

SEQ ID NO: 2305611 - protein, 30 aa, Cryptosporidium parvum
TQTFRSIAYLNRIQAIMSDYFRRSRYQNRM

SEQ ID NO: 2305612 - protein, 19 aa, Cryptosporidium parvum
TQVEARNGIQDHLDSATVS

SEQ ID NO: 2305613 - protein, 23 aa, Cryptosporidium parvum
TQVKVPINYSFRSLKDALEYPIC

SEQ ID NO: 2305614 - protein, 21 aa, Cryptosporidium parvum
TQYYLYISFKNCIIAKLNINS

SEQ ID NO: 2305615 - protein, 18 aa, Cryptosporidium parvum
TRAYQNFLKLKPRKEDRE

SEQ ID NO: 2305616 - protein, 18 aa, Cryptosporidium parvum
TRCTGFFNCFAARAKFYF

SEQ ID NO: 2305617 - protein, 19 aa, Cryptosporidium parvum
TRDILPYFIEYVKPERVIN

SEQ ID NO: 2305618 - protein, 17 aa, Cryptosporidium parvum
TREFWKTYGRNYYTRFD

SEQ ID NO: 2305619 - protein, 23 aa, Cryptosporidium parvum
TREKRASEHLIYYPYESSDKIYS

SEQ ID NO: 2305620 - protein, 22 aa, Cryptosporidium parvum
TRELCDPEKMISHTAQEDLPVY

SEQ ID NO: 2305621 - protein, 27 aa, Cryptosporidium parvum
TRELSNLCLNYFVRYPFSKGLLKKPKE

SEQ ID NO: 2305622 - protein, 26 aa, Cryptosporidium parvum
TRFHNECKWEYKVVCNKSGDKNKEFD

SEQ ID NO: 2305623 - protein, 19 aa, Cryptosporidium parvum
TRFIACPEGELQKKREVVH

SEQ ID NO: 2305624 - protein, 19 aa, Cryptosporidium parvum
TRFIFYLGDDVLQRPVIML

SEQ ID NO: 2305625 - protein, 21 aa, Cryptosporidium parvum
TRFSYIASLGIMTRVDSQFEK

SEQ ID NO: 2305626 - protein, 21 aa, Cryptosporidium parvum
TRFVSYGNFIKWGSRADLEYD

SEQ ID NO: 2305627 - protein, 19 aa, Cryptosporidium parvum
TRGIPWPKVKDFVSSFEPG

SEQ ID NO: 2305628 - protein, 24 aa, Cryptosporidium parvum
TRGRIWCPKGFNVIFPPKALEKYE

SEQ ID NO: 2305629 - protein, 27 aa, Cryptosporidium parvum
TRGTNLLTFKFDYIFSSVSTQHEVFEE

SEQ ID NO: 2305630 - protein, 23 aa, Cryptosporidium parvum
TRHMSSLWKSYTFTHETLFTMTS

SEQ ID NO: 2305631 - protein, 21 aa, Cryptosporidium parvum
TRIEGPLTFVKHIEASCYIQS

SEQ ID NO: 2305632 - protein, 20 aa, Cryptosporidium parvum
TRIFPSLVISVGSGVSIIRV

SEQ ID NO: 2305633 - protein, 18 aa, Cryptosporidium parvum
TRILNTWSDLKMETKQQD

SEQ ID NO: 2305634 - protein, 26 aa, Cryptosporidium parvum
TRIRCFSCSYCFEGYGMTELLAACMS

SEQ ID NO: 2305635 - protein, 29 aa, Cryptosporidium parvum
TRISQFDKLRLALLYSLKYEKEEIQINNF

SEQ ID NO: 2305636 - protein, 17 aa, Cryptosporidium parvum
TRIWLLWSNEVVLQLFN

SEQ ID NO: 2305637 - protein, 31 aa, Cryptosporidium parvum
TRKFPECGYIKYTTSEFMCVASRAGRSVVLR

SEQ ID NO: 2305638 - protein, 19 aa, Cryptosporidium parvum
TRKQRALALIELGSIFQSV

SEQ ID NO: 2305639 - protein, 19 aa, Cryptosporidium parvum
TRKTIPINRNSFYCDLEKI

SEQ ID NO: 2305640 - protein, 18 aa, Cryptosporidium parvum
TRLGRGFTLEELSACGIN

SEQ ID NO: 2305641 - protein, 26 aa, Cryptosporidium parvum
TRLKVSEGFRVTVFQGRVMWNTEFDM

SEQ ID NO: 2305642 - protein, 35 aa, Cryptosporidium parvum
TRLLGAVKVEELLLWYSYHMEYRSILLDKLSYESK

SEQ ID NO: 2305643 - protein, 20 aa, Cryptosporidium parvum
TRLSGSLLMLEFCDNQINLY

SEQ ID NO: 2305644 - protein, 21 aa, Cryptosporidium parvum
TRLSLITAFHGAWFCKEATIT

SEQ ID NO: 2305645 - protein, 19 aa, Cryptosporidium parvum
TRLSVIFVILDPLTILYEG

SEQ ID NO: 2305646 - protein, 24 aa, Cryptosporidium parvum
TRNKCYFPSISFVKLASSNNIDSF

SEQ ID NO: 2305647 - protein, 17 aa, Cryptosporidium parvum
TRNKFAALSLSDDEDDQ

SEQ ID NO: 2305648 - protein, 20 aa, Cryptosporidium parvum
TRNRCFRMLYSSKFGKKSIL

SEQ ID NO: 2305649 - protein, 20 aa, Cryptosporidium parvum
TRPGNVFWNNHMMRNNSILN

SEQ ID NO: 2305650 - protein, 26 aa, Cryptosporidium parvum
TRQFIPRLGAPIYNITSFRKEKVCMD

SEQ ID NO: 2305651 - protein, 33 aa, Cryptosporidium parvum
TRQKECEIDNELYIQNDCIYGDEDVKLYNNNNN

SEQ ID NO: 2305652 - protein, 23 aa, Cryptosporidium parvum
TRRFLLEFLSFFHRYIPIGILEQ

SEQ ID NO: 2305653 - protein, 21 aa, Cryptosporidium parvum
TRRGKVGEVRIIINLQTLSNF

SEQ ID NO: 2305654 - protein, 21 aa, Cryptosporidium parvum
TRRRLCASSGAIIEYVGNFAF

SEQ ID NO: 2305655 - protein, 19 aa, Cryptosporidium parvum
TRSGFGVEIYENISDQISV

SEQ ID NO: 2305656 - protein, 19 aa, Cryptosporidium parvum
TRSLIAFALSKGIEDRFLI

SEQ ID NO: 2305657 - protein, 18 aa, Cryptosporidium parvum
TRSYSCSDEEYISNSNTK

SEQ ID NO: 2305658 - protein, 18 aa, Cryptosporidium parvum
TRTAIGIKTVFKVLFSLE

SEQ ID NO: 2305659 - protein, 26 aa, Cryptosporidium parvum
TRTLHPFGCKFYFNLSLDINKNLGHN

SEQ ID NO: 2305660 - protein, 19 aa, Cryptosporidium parvum
TRVCSKAAYMLIKFVNKYL

SEQ ID NO: 2305661 - protein, 24 aa, Cryptosporidium parvum
TRVKKSPIAYGFKAEEIINDPNLA

SEQ ID NO: 2305662 - protein, 25 aa, Cryptosporidium parvum
TRVKQGTYVYGRLMVEAKLVTKPGV

SEQ ID NO: 2305663 - protein, 25 aa, Cryptosporidium parvum
TRVQPRAGRIVTFFIADMHEGEPLC

SEQ ID NO: 2305664 - protein, 20 aa, Cryptosporidium parvum
TRWDKIRIQKWYNVYKDHIT

SEQ ID NO: 2305665 - protein, 20 aa, Cryptosporidium parvum
TRYCNYCILRSNELKIRELF

SEQ ID NO: 2305666 - protein, 21 aa, Cryptosporidium parvum
TRYFFLVLKWNGLQQIVGASG

SEQ ID NO: 2305667 - protein, 17 aa, Cryptosporidium parvum
TRYGGSVIDCSRNGHIN

SEQ ID NO: 2305668 - protein, 21 aa, Cryptosporidium parvum
TRYINYINIWSIELTSENFYE

SEQ ID NO: 2305669 - protein, 19 aa, Cryptosporidium parvum
TRYSQVFLKEIRKRLDSYF

SEQ ID NO: 2305670 - protein, 27 aa, Cryptosporidium parvum
TSAHPWKYRYAAIMAIAQTIEYLPEDD

SEQ ID NO: 2305671 - protein, 25 aa, Cryptosporidium parvum
TSALRRNGWCLALSSGLNEMYSANL

SEQ ID NO: 2305672 - protein, 21 aa, Cryptosporidium parvum
TSARFVQLGFFGALRFGSNRI

SEQ ID NO: 2305673 - protein, 22 aa, Cryptosporidium parvum
TSASKLPCFSLFTNKEYFIQDI

SEQ ID NO: 2305674 - protein, 25 aa, Cryptosporidium parvum
TSCILCPRRGGALIEAQGIPQNHIG

SEQ ID NO: 2305675 - protein, 19 aa, Cryptosporidium parvum
TSCLYLLSIWDKIESIPST

SEQ ID NO: 2305676 - protein, 24 aa, Cryptosporidium parvum
TSCQLPNSMSFIWQNLVQQGSNPM

SEQ ID NO: 2305677 - protein, 29 aa, Cryptosporidium parvum
TSDFGIPVDHVFGFWDWVGGRFSVCSAVG

SEQ ID NO: 2305678 - protein, 25 aa, Cryptosporidium parvum
TSEFGWSANMERIMKAQALRDTSMT

SEQ ID NO: 2305679 - protein, 22 aa, Cryptosporidium parvum
TSELFAIQWFLTLFTYDIADTE

SEQ ID NO: 2305680 - protein, 23 aa, Cryptosporidium parvum
TSELLKFWSKLGFLPVYIRQQVS

SEQ ID NO: 2305681 - protein, 26 aa, Cryptosporidium parvum
TSEPPKYAVSLVMDLSKVPNIDQMKE

SEQ ID NO: 2305682 - protein, 25 aa, Cryptosporidium parvum
TSETKQCLFWGLGSDGTVSANKNAI

SEQ ID NO: 2305683 - protein, 19 aa, Cryptosporidium parvum
TSGILAFDMNFRYNQNNPY

SEQ ID NO: 2305684 - protein, 29 aa, Cryptosporidium parvum
TSGILCLKDAITLVARRAEIMASLPQNDG

SEQ ID NO: 2305685 - protein, 18 aa, Cryptosporidium parvum
TSGQTFMLSRQWKNQKEN

SEQ ID NO: 2305686 - protein, 22 aa, Cryptosporidium parvum
TSHIYKACVIVWLLSFNEETVP

SEQ ID NO: 2305687 - protein, 24 aa, Cryptosporidium parvum
TSHNMAVPFVKRSEYQLIDIHDNF

SEQ ID NO: 2305688 - protein, 26 aa, Cryptosporidium parvum
TSHWWLIVICHPRKIFNLMNSSSPRN

SEQ ID NO: 2305689 - protein, 17 aa, Cryptosporidium parvum
TSIDTCISRLVGESRSV

SEQ ID NO: 2305690 - protein, 17 aa, Cryptosporidium parvum
TSIFKKLDILENEVMKI

SEQ ID NO: 2305691 - protein, 24 aa, Cryptosporidium parvum
TSIGQLRLQFIFLYYDTDRNGLLN

SEQ ID NO: 2305692 - protein, 17 aa, Cryptosporidium parvum
TSIIKVLYDKVSPHETV

SEQ ID NO: 2305693 - protein, 19 aa, Cryptosporidium parvum
TSIIRLYLRFKNLISDRYG

SEQ ID NO: 2305694 - protein, 17 aa, Cryptosporidium parvum
TSIKLSIFYCCNSTPNE

SEQ ID NO: 2305695 - protein, 27 aa, Cryptosporidium parvum
TSIKPGTVIRLSWMKVIKNSTIRSLGC

SEQ ID NO: 2305696 - protein, 17 aa, Cryptosporidium parvum
TSIKVVGIGKIFCCHAR

SEQ ID NO: 2305697 - protein, 17 aa, Cryptosporidium parvum
TSIRFGLGRFTKHEDVD

SEQ ID NO: 2305698 - protein, 19 aa, Cryptosporidium parvum
TSIRIRYDFDQIIDSKNIQ

SEQ ID NO: 2305699 - protein, 17 aa, Cryptosporidium parvum
TSISQAIPVRKAQNHSR

SEQ ID NO: 2305700 - protein, 27 aa, Cryptosporidium parvum
TSKLKLSKLAPMTIQFMRDLKTFTNIE

SEQ ID NO: 2305701 - protein, 31 aa, Cryptosporidium parvum
TSKMNGYELCKLLSIYSSVLFQTPLSIVLFY

SEQ ID NO: 2305702 - protein, 19 aa, Cryptosporidium parvum
TSKNFSLETEEIISDFKDF

SEQ ID NO: 2305703 - protein, 19 aa, Cryptosporidium parvum
TSKTLKYLALRYSRNNVKK

SEQ ID NO: 2305704 - protein, 28 aa, Cryptosporidium parvum
TSLEVSDPFCYPTPIALSSASNHIEKNE

SEQ ID NO: 2305705 - protein, 21 aa, Cryptosporidium parvum
TSLEYRIRKDILISGDTDSTL

SEQ ID NO: 2305706 - protein, 17 aa, Cryptosporidium parvum
TSLKTGYLYVYRFSNGM

SEQ ID NO: 2305707 - protein, 18 aa, Cryptosporidium parvum
TSLKYAKILLGIHLIQKY

SEQ ID NO: 2305708 - protein, 19 aa, Cryptosporidium parvum
TSLRGANPYLILTVLHEAR

SEQ ID NO: 2305709 - protein, 22 aa, Cryptosporidium parvum
TSLRYLRIWRNSGISVSVTKLV

SEQ ID NO: 2305710 - protein, 17 aa, Cryptosporidium parvum
TSLSRVVPLSTNRTSES

SEQ ID NO: 2305711 - protein, 22 aa, Cryptosporidium parvum
TSMPGCIPTKVLNKGSGVCNLK

SEQ ID NO: 2305712 - protein, 17 aa, Cryptosporidium parvum
TSMVKILAKQCGYNVNE

SEQ ID NO: 2305713 - protein, 24 aa, Cryptosporidium parvum
TSNGFKPKVWLWNSFFYTKLTCDQ

SEQ ID NO: 2305714 - protein, 20 aa, Cryptosporidium parvum
TSNIDLGVCSFQVNVPNNIS

SEQ ID NO: 2305715 - protein, 19 aa, Cryptosporidium parvum
TSPFAIRYRAFRDLINNIN

SEQ ID NO: 2305716 - protein, 19 aa, Cryptosporidium parvum
TSPNLCKLDGGISNPPIAP

SEQ ID NO: 2305717 - protein, 21 aa, Cryptosporidium parvum
TSPQGKLCRSILDIMERRQNS

SEQ ID NO: 2305718 - protein, 21 aa, Cryptosporidium parvum
TSQLTALAMLCMDPYYRTIQG

SEQ ID NO: 2305719 - protein, 29 aa, Cryptosporidium parvum
TSRFLIYTCMIGVCVLDIQIGKRVLIIGK

SEQ ID NO: 2305720 - protein, 34 aa, Cryptosporidium parvum
TSRIVCSWKDIFDRLNCEPLKIEAYKVSTFGDQE

SEQ ID NO: 2305721 - protein, 17 aa, Cryptosporidium parvum
TSRVLKRLVARDASHCE

SEQ ID NO: 2305722 - protein, 30 aa, Cryptosporidium parvum
TSRYRILDIIGEGTFGRVFECEDLKRKRKV

SEQ ID NO: 2305723 - protein, 24 aa, Cryptosporidium parvum
TSSEIIWFGYMLKYGVTEALGNVI

SEQ ID NO: 2305724 - protein, 20 aa, Cryptosporidium parvum
TSSESVIFFHFISKDDKYSN

SEQ ID NO: 2305725 - protein, 20 aa, Cryptosporidium parvum
TSSLKCNRCKNETRENEVMV

SEQ ID NO: 2305726 - protein, 19 aa, Cryptosporidium parvum
TSSLPAYYSSFSSSLRTNG

SEQ ID NO: 2305727 - protein, 23 aa, Cryptosporidium parvum
TSSLRILAQSVINLMNKRGSKGR

SEQ ID NO: 2305728 - protein, 27 aa, Cryptosporidium parvum
TSSPAGLLRLEMIFMYYDKGNKGYWNM

SEQ ID NO: 2305729 - protein, 23 aa, Cryptosporidium parvum
TSTFKIEAYIPIIESLGISQELR

SEQ ID NO: 2305730 - protein, 17 aa, Cryptosporidium parvum
TSTIFKKKLFIRNLSES

SEQ ID NO: 2305731 - protein, 20 aa, Cryptosporidium parvum
TSTVPSIHHPDARWMETAET

SEQ ID NO: 2305732 - protein, 24 aa, Cryptosporidium parvum
TSVFTPRKLFGIVITGLGFNMSTC

SEQ ID NO: 2305733 - protein, 20 aa, Cryptosporidium parvum
TSVLFGLKLVEMLCGVEKSK

SEQ ID NO: 2305734 - protein, 33 aa, Cryptosporidium parvum; identical to SEQ ID NO: 2183025

SEQ ID NO: 2305735 - protein, 36 aa, Cryptosporidium parvum; identical to SEQ ID NO: 2183027

SEQ ID NO: 2305736 - protein, 28 aa, Cryptosporidium parvum
TSVTNLCYSRELILNGIGNLFPQEAIEY

SEQ ID NO: 2305737 - protein, 19 aa, Cryptosporidium parvum
TSWMSFKALANYIELSDLH

SEQ ID NO: 2305738 - protein, 21 aa, Cryptosporidium parvum
TSYDKVCRCYHGPREGETKGR

SEQ ID NO: 2305739 - protein, 25 aa, Cryptosporidium parvum
TSYFFPPSFLRRAIQTAINNNVKVS

SEQ ID NO: 2305740 - protein, 25 aa, Cryptosporidium parvum
TSYFNIPLLHLWCADHIRFRKGNQA

SEQ ID NO: 2305741 - protein, 17 aa, Cryptosporidium parvum
TSYLPIVLALRRWQLSF

SEQ ID NO: 2305742 - protein, 22 aa, Cryptosporidium parvum
TSYPHRCGIGYLGNESMKTLTP

SEQ ID NO: 2305743 - protein, 23 aa, Cryptosporidium parvum
TTAEEIFHLGIFQFDPLIGNSFT

SEQ ID NO: 2305744 - protein, 17 aa, Cryptosporidium parvum
TTALVCIIFGPDPIDNK

SEQ ID NO: 2305745 - protein, 25 aa, Cryptosporidium parvum
TTCGGDGYSCEKLVNAYNVLSYIDG

SEQ ID NO: 2305746 - protein, 22 aa, Cryptosporidium parvum
TTCLVSGIVAVPVYPPDPMRGQ

SEQ ID NO: 2305747 - protein, 23 aa, Cryptosporidium parvum
TTDVTRTLFLFGIGEERPTIEQI

SEQ ID NO: 2305748 - protein, 18 aa, Cryptosporidium parvum
TTDYSCYYDFSNAHEYYQ

SEQ ID NO: 2305749 - protein, 24 aa, Cryptosporidium parvum
TTEKSYKGTVTRETYSVDGKQTSK

SEQ ID NO: 2305750 - protein, 17 aa, Cryptosporidium parvum
TTERKKGRFELGGSSNI

SEQ ID NO: 2305751 - protein, 17 aa, Cryptosporidium parvum
TTFLITIDLNFNSLNTN

SEQ ID NO: 2305752 - protein, 21 aa, Cryptosporidium parvum
TTGFCAFPGAQLVEPLYEVVD

SEQ ID NO: 2305753 - protein, 22 aa, Cryptosporidium parvum
TTGIPSWLLKISGKLTKMENSL

SEQ ID NO: 2305754 - protein, 22 aa, Cryptosporidium parvum
TTGQLLNCWLPHYKPINKIKLV

SEQ ID NO: 2305755 - protein, 18 aa, Cryptosporidium parvum
TTGQPVVFVGTGQKYFNL

SEQ ID NO: 2305756 - protein, 28 aa, Cryptosporidium parvum
TTGRRPTGLCGAALLISARYHGIPVSSS

SEQ ID NO: 2305757 - protein, 17 aa, Cryptosporidium parvum
TTGRYVSDWSQVFQAQQ

SEQ ID NO: 2305758 - protein, 21 aa, Cryptosporidium parvum
TTGVCDSASSVSVSGSIKSYS

SEQ ID NO: 2305759 - protein, 26 aa, Cryptosporidium parvum
TTIDSFLRLSSMDSTTCTTIQNDTNS

SEQ ID NO: 2305760 - protein, 19 aa, Cryptosporidium parvum
TTIENLFCIGALDSTTAAS

SEQ ID NO: 2305761 - protein, 19 aa, Cryptosporidium parvum
TTIGEFLEKCRIKLKSEFK

SEQ ID NO: 2305762 - protein, 19 aa, Cryptosporidium parvum
TTIQLFKINPFKYLIDIQI

SEQ ID NO: 2305763 - protein, 26 aa, Cryptosporidium parvum
TTISILKNRVQYILNRVHKLTNLEIN

SEQ ID NO: 2305764 - protein, 25 aa, Cryptosporidium parvum
TTKLLEPYCRLFSYSQTENFFGTQN

SEQ ID NO: 2305765 - protein, 20 aa, Cryptosporidium parvum
TTKNNIVWINKLVFRVGIYE

SEQ ID NO: 2305766 - protein, 40 aa, Cryptosporidium parvum; identical to SEQ ID NO: 2183052

SEQ ID NO: 2305767 - protein, 25 aa, Cryptosporidium parvum
TTLCVIPNYILLLFGRNIENELREN

SEQ ID NO: 2305768 - protein, 17 aa, Cryptosporidium parvum
TTLKRNLFNLVIINRNP

SEQ ID NO: 2305769 - protein, 21 aa, Cryptosporidium parvum
TTLPPKFIVVPMNPLSHYFYE

SEQ ID NO: 2305770 - protein, 23 aa, Cryptosporidium parvum
TTMTETFSNGSITSRQIDIEVSK

SEQ ID NO: 2305771 - protein, 23 aa, Cryptosporidium parvum
TTNLKSREFFQNDEIGMLRRSSE

SEQ ID NO: 2305772 - protein, 25 aa, Cryptosporidium parvum
TTNNEIWRTPDLFLLSRQGTPFDHT

SEQ ID NO: 2305773 - protein, 22 aa, Cryptosporidium parvum
TTNNFPLFGVYSNIINFLNSTM

SEQ ID NO: 2305774 - protein, 23 aa, Cryptosporidium parvum
TTPEWKRQYLGKSLSFGKKNVTA

SEQ ID NO: 2305775 - protein, 20 aa, Cryptosporidium parvum
TTPQCIRGFLADFSFCTDPI

SEQ ID NO: 2305776 - protein, 17 aa, Cryptosporidium parvum
TTPRLKTPIKPVISDNN

SEQ ID NO: 2305777 - protein, 23 aa, Cryptosporidium parvum
TTTEANLFLNASNVGKIASVNRR

SEQ ID NO: 2305778 - protein, 21 aa, Cryptosporidium parvum
TTTTMRNSCIGMRNNNVAGTR

SEQ ID NO: 2305779 - protein, 23 aa, Cryptosporidium parvum
TTVIRKALNLSIHRLNNSISNKP

SEQ ID NO: 2305780 - protein, 22 aa, Cryptosporidium parvum
TTVVMFWEIVKKLDLKLQKKLL

SEQ ID NO: 2305781 - protein, 31 aa, Cryptosporidium parvum
TTYRLECTLNYMLDRCWCLSVSENILGIGYD

SEQ ID NO: 2305782 - protein, 27 aa, Cryptosporidium parvum
TVARGCALQAAMLSPVIKVREFNMTER

SEQ ID NO: 2305783 - protein, 17 aa, Cryptosporidium parvum
TVCEKASHEEELKNFDQ

SEQ ID NO: 2305784 - protein, 23 aa, Cryptosporidium parvum
TVCQKLVIVDGIFIILETILCRI

SEQ ID NO: 2305785 - protein, 26 aa, Cryptosporidium parvum
TVCSIWKIERLIGGGSFGDIYLAVNT

SEQ ID NO: 2305786 - protein, 25 aa, Cryptosporidium parvum
TVDDCPLQLIEKGIRESSTYSLGMN

SEQ ID NO: 2305787 - protein, 25 aa, Cryptosporidium parvum
TVEDAVNIFSCLDIKKTGTIDLEDL

SEQ ID NO: 2305788 - protein, 18 aa, Cryptosporidium parvum
TVEKLLSLEQWGTLIQTM

SEQ ID NO: 2305789 - protein, 22 aa, Cryptosporidium parvum
TVEVPSVCFLKNFEKEGNENKL

SEQ ID NO: 2305790 - protein, 28 aa, Cryptosporidium parvum
TVFTKLKIGCKVLELYGKQSLQKRLEVV

SEQ ID NO: 2305791 - protein, 30 aa, Cryptosporidium parvum; identical to SEQ ID NO: 2183082

SEQ ID NO: 2305792 - protein, 28 aa, Cryptosporidium parvum
TVHPRDNPWYKGCNKLILLGIPSSLRPN

SEQ ID NO: 2305793 - protein, 17 aa, Cryptosporidium parvum
TVIAEKLAVCIDEIKNV

SEQ ID NO: 2305794 - protein, 33 aa, Cryptosporidium parvum; identical to SEQ ID NO: 2183085

SEQ ID NO: 2305795 - protein, 18 aa, Cryptosporidium parvum
TVICFAKLMNVLPEQYHA

SEQ ID NO: 2305796 - protein, 22 aa, Cryptosporidium parvum
TVIEIRCLVLAPQHGNQNSINM

SEQ ID NO: 2305797 - protein, 18 aa, Cryptosporidium parvum
TVIFKAPNWYKIIKSTNE

SEQ ID NO: 2305798 - protein, 21 aa, Cryptosporidium parvum
TVKCLSWESSNRFAIVVVDDV

SEQ ID NO: 2305799 - protein, 24 aa, Cryptosporidium parvum
TVLLKFCFIVWPSLNNTKTEIDAL

SEQ ID NO: 2305800 - protein, 18 aa, Cryptosporidium parvum
TVLLPQIFVDGVCIGNDV

SEQ ID NO: 2305801 - protein, 18 aa, Cryptosporidium parvum
TVLRKSRYDYEQIYDEDS

SEQ ID NO: 2305802 - protein, 18 aa, Cryptosporidium parvum
TVMCIEWYQELYKNSSSS

SEQ ID NO: 2305803 - protein, 24 aa, Cryptosporidium parvum
TVNLPRRHPIHIYRESVKMGRTNY

SEQ ID NO: 2305804 - protein, 24 aa, Cryptosporidium parvum
TVPCPWLDGKHVVFGKVLEGMEVV

SEQ ID NO: 2305805 - protein, 22 aa, Cryptosporidium parvum
TVPRVFVKGRFIGGCDDTLKLL

SEQ ID NO: 2305806 - protein, 26 aa, Cryptosporidium parvum
TVQDYRFLPKPTFRIEDNNLYSNLNQ

SEQ ID NO: 2305807 - protein, 25 aa, Cryptosporidium parvum
TVSDFSRTVKVCAGGEYSENKDSEV

SEQ ID NO: 2305808 - protein, 25 aa, Cryptosporidium parvum
TVSFGSGLHGWAFTIEKFARIYAKK

SEQ ID NO: 2305809 - protein, 17 aa, Cryptosporidium parvum
TVSKRLEYITGEIESVN

SEQ ID NO: 2305810 - protein, 19 aa, Cryptosporidium parvum
TVSLIAMELFPCGKWPDLL

SEQ ID NO: 2305811 - protein, 21 aa, Cryptosporidium parvum
TVSQLYYLIGHMQKLVVQNPE

SEQ ID NO: 2305812 - protein, 18 aa, Cryptosporidium parvum
TVSREMEELKGLNSQMEQ

SEQ ID NO: 2305813 - protein, 25 aa, Cryptosporidium parvum
TVSSLCNCVTYFSGSTRSTGPNFHY

SEQ ID NO: 2305814 - protein, 23 aa, Cryptosporidium parvum
TVSSPLLPPIAFPTKVIDTNQQN

SEQ ID NO: 2305815 - protein, 26 aa, Cryptosporidium parvum
TVSVLECGDVPYGKRIHVLPFDDCLE

SEQ ID NO: 2305816 - protein, 17 aa, Cryptosporidium parvum
TVTFLVSFIERLDGESL

SEQ ID NO: 2305817 - protein, 17 aa, Cryptosporidium parvum
TVTKGRKLRSQKWEDED

SEQ ID NO: 2305818 - protein, 27 aa, Cryptosporidium parvum
TVTKTTTRFASGNVDGVTTRTETFVTK

SEQ ID NO: 2305819 - protein, 24 aa, Cryptosporidium parvum
TVVLMCMEELLQFHLPHHLEALCV

SEQ ID NO: 2305820 - protein, 25 aa, Cryptosporidium parvum
TVVMRPGPEFWKERRLDLIKDALKS

SEQ ID NO: 2305821 - protein, 23 aa, Cryptosporidium parvum
TVYKMCYNQVPFRVDTRNGLDPE

SEQ ID NO: 2305822 - protein, 18 aa, Cryptosporidium parvum
TVYREPAIFFATNSNMKF

SEQ ID NO: 2305823 - protein, 41 aa, Cryptosporidium parvum; identical to SEQ ID NO: 2183109

SEQ ID NO: 2305824 - protein, 18 aa, Cryptosporidium parvum
TWDGKLIIWLTLERSKKN

SEQ ID NO: 2305825 - protein, 18 aa, Cryptosporidium parvum
TWEAYKMILDIIRLTPKL

SEQ ID NO: 2305826 - protein, 23 aa, Cryptosporidium parvum
TWGSEIWHISSLFNIEKIFLNYS

SEQ ID NO: 2305827 - protein, 17 aa, Cryptosporidium parvum
TWLSLSFAVFICLNCSS

SEQ ID NO: 2305828 - protein, 23 aa, Cryptosporidium parvum
TWRNSALYMRTIYKLGDTQISAF

SEQ ID NO: 2305829 - protein, 18 aa, Cryptosporidium parvum
TWSCWEIFIKTSRMSIVC

SEQ ID NO: 2305830 - protein, 24 aa, Cryptosporidium parvum
TWVKTCIKAASSMGKFSTDRTIEE

SEQ ID NO: 2305831 - protein, 17 aa, Cryptosporidium parvum
TYCMSFGYDGSDYHGMQ

SEQ ID NO: 2305832 - protein, 19 aa, Cryptosporidium parvum
TYFCPSCLENVPSSEAFSR

SEQ ID NO: 2305833 - protein, 17 aa, Cryptosporidium parvum
TYFSRYYIRKLLQEFNV

SEQ ID NO: 2305834 - protein, 28 aa, Cryptosporidium parvum
TYHFGFLGICINPPLALENPLSQKKKQM

SEQ ID NO: 2305835 - protein, 18 aa, Cryptosporidium parvum
TYIFPSGYAINIRDFEHL

SEQ ID NO: 2305836 - protein, 24 aa, Cryptosporidium parvum
TYIIELLYRIIKLVRDFCGTVNED

SEQ ID NO: 2305837 - protein, 18 aa, Cryptosporidium parvum
TYISRTLYLCKLPYDMTE

SEQ ID NO: 2305838 - protein, 23 aa, Cryptosporidium parvum
TYKFPSGLVEIVFYDEQEDSVCP

SEQ ID NO: 2305839 - protein, 19 aa, Cryptosporidium parvum
TYKNVPNWHRDIVRVCENI

SEQ ID NO: 2305840 - protein, 19 aa, Cryptosporidium parvum
TYLADRVILFTGTPGVDCF

SEQ ID NO: 2305841 - protein, 19 aa, Cryptosporidium parvum
TYLIDEFMYLVSELGFLTK

SEQ ID NO: 2305842 - protein, 22 aa, Cryptosporidium parvum
TYLKPYFLEAYRPVKKGDAFLV

SEQ ID NO: 2305843 - protein, 21 aa, Cryptosporidium parvum
TYQACILLQFNDFISLSLLEL

SEQ ID NO: 2305844 - protein, 19 aa, Cryptosporidium parvum
TYSQLGFSYITFYLFLTKE

SEQ ID NO: 2305845 - protein, 24 aa, Cryptosporidium parvum
TYTRKDLLQTLGYIGYLLDNQTIF

SEQ ID NO: 2305846 - protein, 25 aa, Cryptosporidium parvum
TYYECFEKWASLLISKYNIIIQDDN

SEQ ID NO: 2305847 - protein, 19 aa, Cryptosporidium parvum
VACDCILEHGSSDYKFEEK

SEQ ID NO: 2305848 - protein, 21 aa, Cryptosporidium parvum
VADCQILLFDVDIPKSFIDEV

SEQ ID NO: 2305849 - protein, 20 aa, Cryptosporidium parvum
VADSWMSRGRRNIFDQVVSV

SEQ ID NO: 2305850 - protein, 25 aa, Cryptosporidium parvum
VADVICKRAEFGKNFGTVLIPDALL

SEQ ID NO: 2305851 - protein, 19 aa, Cryptosporidium parvum
VAEEFLRDCFLSCNLHKII

SEQ ID NO: 2305852 - protein, 25 aa, Cryptosporidium parvum
VAEKCGLNIAAILFCEGVVLDALDW

SEQ ID NO: 2305853 - protein, 20 aa, Cryptosporidium parvum
VAELLWEISCEDLQKKGTEY

SEQ ID NO: 2305854 - protein, 22 aa, Cryptosporidium parvum
VAELRIGQFAAVTMCSYPLPLV

SEQ ID NO: 2305855 - protein, 19 aa, Cryptosporidium parvum
VAGLLLKKELEYFSKALES

SEQ ID NO: 2305856 - protein, 18 aa, Cryptosporidium parvum
VAIDEFFSAIKSRGPESP

SEQ ID NO: 2305857 - protein, 26 aa, Cryptosporidium parvum
VAIIPLPRWDRVALVRHFDTSGGNSN

SEQ ID NO: 2305858 - protein, 24 aa, Cryptosporidium parvum
VAIKGIPGVTTFKCDITTERCRKL

SEQ ID NO: 2305859 - protein, 19 aa, Cryptosporidium parvum
VAIKKIHRVFEDLVDCKRI

SEQ ID NO: 2305860 - protein, 31 aa, Cryptosporidium parvum
VAIQSCPRQIFAISWFMEFILYGFSNEESVL

SEQ ID NO: 2305861 - protein, 17 aa, Cryptosporidium parvum
VAIVEFENFDDLSNSVN

SEQ ID NO: 2305862 - protein, 28 aa, Cryptosporidium parvum
VAKEMGSRLGGLVGYSIRFEDCTSEETV

SEQ ID NO: 2305863 - protein, 23 aa, Cryptosporidium parvum
VAKGSKSKANWWPFHGSTAGLVC

SEQ ID NO: 2305864 - protein, 21 aa, Cryptosporidium parvum
VAKNCKRRNFLKILQNTKFFQ

SEQ ID NO: 2305865 - protein, 26 aa, Cryptosporidium parvum
VALHKECVLWSLPFVLEPILNNLDMG

SEQ ID NO: 2305866 - protein, 26 aa, Cryptosporidium parvum
VALSCPDLEVSYALYKRLLNQCPKLK

SEQ ID NO: 2305867 - protein, 19 aa, Cryptosporidium parvum
VANKLLLNTIRLRVAKKVK

SEQ ID NO: 2305868 - protein, 32 aa, Cryptosporidium parvum; identical to SEQ ID NO: 2183157

SEQ ID NO: 2305869 - protein, 18 aa, Cryptosporidium parvum
VAPYNRFLILLKDKTCSD

SEQ ID NO: 2305870 - protein, 17 aa, Cryptosporidium parvum
VAQFDWVWFDWPHSKIP

SEQ ID NO: 2305871 - protein, 19 aa, Cryptosporidium parvum
VAQGLLHNDRIVFGLHLMR

SEQ ID NO: 2305872 - protein, 26 aa, Cryptosporidium parvum
VAQHFKFNLMRILKRIKQTEEVQVYI

SEQ ID NO: 2305873 - protein, 25 aa, Cryptosporidium parvum
VAQMKIGNSFFPFSITVLEESHVDF

SEQ ID NO: 2305874 - protein, 17 aa, Cryptosporidium parvum
VARYFGLAKGQVVKIIR

SEQ ID NO: 2305875 - protein, 19 aa, Cryptosporidium parvum
VASFGRLFSIKSLGSDQIE

SEQ ID NO: 2305876 - protein, 20 aa, Cryptosporidium parvum
VASFGRRIQFLYSVWLEENT

SEQ ID NO: 2305877 - protein, 20 aa, Cryptosporidium parvum
VASMKRLWENKTPKLSSIWR

SEQ ID NO: 2305878 - protein, 26 aa, Cryptosporidium parvum
VASSLHKLKGFFLILVQTELGDIYRI

SEQ ID NO: 2305879 - protein, 24 aa, Cryptosporidium parvum
VATMWNFRKSYIISEQSNTQLIDN

SEQ ID NO: 2305880 - protein, 24 aa, Cryptosporidium parvum
VATSGQAAIKCIRSMRHWAYVTFG

SEQ ID NO: 2305881 - protein, 21 aa, Cryptosporidium parvum
VAVKPCPSCGQRFRGSVPNKS

SEQ ID NO: 2305882 - protein, 19 aa, Cryptosporidium parvum
VAVRRACYGVLRHVMESGA

SEQ ID NO: 2305883 - protein, 30 aa, Cryptosporidium parvum; identical to SEQ ID NO: 2183167

SEQ ID NO: 2305884 - protein, 21 aa, Cryptosporidium parvum
VAYSNIIKVFGMEMNPKQATC

SEQ ID NO: 2305885 - protein, 21 aa, Cryptosporidium parvum
VCHFMACSARCILDSSNEYTL

SEQ ID NO: 2305886 - protein, 17 aa, Cryptosporidium parvum
VCIKHLHESLKLIHCDI

SEQ ID NO: 2305887 - protein, 22 aa, Cryptosporidium parvum
VCKDIPIGKILLEFQNPKTELD

SEQ ID NO: 2305888 - protein, 19 aa, Cryptosporidium parvum
VCKDLKLSVESAKSYSNEV

SEQ ID NO: 2305889 - protein, 25 aa, Cryptosporidium parvum
VCNGAKFSKSPFVGGLSAARRRPYS

SEQ ID NO: 2305890 - protein, 19 aa, Cryptosporidium parvum
VCNHPDLFEPRTIKTPIVE

SEQ ID NO: 2305891 - protein, 21 aa, Cryptosporidium parvum
VCQILELLGLILYEHQKKLTE

SEQ ID NO: 2305892 - protein, 20 aa, Cryptosporidium parvum
VCQVVSFRAKIKINDELELI

SEQ ID NO: 2305893 - protein, 17 aa, Cryptosporidium parvum
VCRDVNCTFAHSINDLR

SEQ ID NO: 2305894 - protein, 19 aa, Cryptosporidium parvum
VCSILTCIQSLLNDPNPNS

SEQ ID NO: 2305895 - protein, 26 aa, Cryptosporidium parvum
VCTASYRLLPEFGFPNGPISGSDALK

SEQ ID NO: 2305896 - protein, 18 aa, Cryptosporidium parvum
VCTFRGNYSYQVTPSGLF

SEQ ID NO: 2305897 - protein, 22 aa, Cryptosporidium parvum
VCWDKYRKGLLILGRQISNADT

SEQ ID NO: 2305898 - protein, 22 aa, Cryptosporidium parvum
VDDCNYFAATLCPQQTYCAKHS

SEQ ID NO: 2305899 - protein, 19 aa, Cryptosporidium parvum
VDDDAYGGGSIFGESVVRG

SEQ ID NO: 2305900 - protein, 27 aa, Cryptosporidium parvum
VDDGLKSSLLFGFNLDLIKLHALTPRT

SEQ ID NO: 2305901 - protein, 23 aa, Cryptosporidium parvum
VDDMCFLSFLLMNKVFTGFLESI

SEQ ID NO: 2305902 - protein, 18 aa, Cryptosporidium parvum
VDEAVARASYLKHRSIVL

SEQ ID NO: 2305903 - protein, 23 aa, Cryptosporidium parvum
VDEFVLRTPILVKCIIDPHNIMV

SEQ ID NO: 2305904 - protein, 22 aa, Cryptosporidium parvum
VDEVPAILNFSRRLPHPSDGII

SEQ ID NO: 2305905 - protein, 18 aa, Cryptosporidium parvum
VDEYEEFLLSSGRYDILA

SEQ ID NO: 2305906 - protein, 18 aa, Cryptosporidium parvum
VDFFSLSIHDCYKKIHEL

SEQ ID NO: 2305907 - protein, 19 aa, Cryptosporidium parvum
VDFPHILNLKEYCSGEHKS

SEQ ID NO: 2305908 - protein, 17 aa, Cryptosporidium parvum
VDGCGIAASTEFIAFPA

SEQ ID NO: 2305909 - protein, 24 aa, Cryptosporidium parvum
VDGPYKCFFIPASDKQNKLLKKRY

SEQ ID NO: 2305910 - protein, 22 aa, Cryptosporidium parvum
VDGYIPSTFVMKCLDKRNLNIS

SEQ ID NO: 2305911 - protein, 18 aa, Cryptosporidium parvum
VDHPYLIVYGKFNHKKDL

SEQ ID NO: 2305912 - protein, 18 aa, Cryptosporidium parvum
VDIACPYLPTKNSRRLIL

SEQ ID NO: 2305913 - protein, 19 aa, Cryptosporidium parvum
VDIGMPLLAHLKVYTRQSD

SEQ ID NO: 2305914 - protein, 19 aa, Cryptosporidium parvum
VDILCEFADFFVDLASNVA

SEQ ID NO: 2305915 - protein, 22 aa, Cryptosporidium parvum
VDILYICEFCLSFFAHSDEYTR

SEQ ID NO: 2305916 - protein, 33 aa, Cryptosporidium parvum
VDIREFRSSLPYQLFCKGVKIIPMSLEIGDYVI

SEQ ID NO: 2305917 - protein, 18 aa, Cryptosporidium parvum
VDIYSNWIDKCYEVNSME

SEQ ID NO: 2305918 - protein, 18 aa, Cryptosporidium parvum
VDKLVCAMFVLSKDPEVI

SEQ ID NO: 2305919 - protein, 17 aa, Cryptosporidium parvum
VDLHLKTTLSFGSISEL

SEQ ID NO: 2305920 - protein, 24 aa, Cryptosporidium parvum
VDLIPKWVATKWISFYGSIRPTIA

SEQ ID NO: 2305921 - protein, 23 aa, Cryptosporidium parvum
VDLLFRLLQYCPKKRITALEALQ

SEQ ID NO: 2305922 - protein, 17 aa, Cryptosporidium parvum
VDLLLAPNCHRDQAFSI

SEQ ID NO: 2305923 - protein, 22 aa, Cryptosporidium parvum
VDLMSLYLKFAHGLDYYSLSTS

SEQ ID NO: 2305924 - protein, 17 aa, Cryptosporidium parvum
VDLPCNIEVYKSLDCES

SEQ ID NO: 2305925 - protein, 18 aa, Cryptosporidium parvum
VDLQARYFISSTLVSFGL

SEQ ID NO: 2305926 - protein, 20 aa, Cryptosporidium parvum
VDLSMLREYLNFDFGEIRDQ

SEQ ID NO: 2305927 - protein, 32 aa, Cryptosporidium parvum; identical to SEQ ID NO: 2183206

SEQ ID NO: 2305928 - protein, 30 aa, Cryptosporidium parvum; identical to SEQ ID NO: 2183207

SEQ ID NO: 2305929 - protein, 17 aa, Cryptosporidium parvum
VDNRICVHDIKFNRTHV

SEQ ID NO: 2305930 - protein, 22 aa, Cryptosporidium parvum
VDNSFLFNEWVEGFSSNNIIIN

SEQ ID NO: 2305931 - protein, 25 aa, Cryptosporidium parvum
VDNSKFHPFIGIKLEETFIREHQII

SEQ ID NO: 2305932 - protein, 20 aa, Cryptosporidium parvum
VDPEEYCIVAPDTVIHCEGD

SEQ ID NO: 2305933 - protein, 18 aa, Cryptosporidium parvum
VDPEMIKLLPTIDPLRKL

SEQ ID NO: 2305934 - protein, 25 aa, Cryptosporidium parvum
VDPERFKYRLAFQEYLNLLLHVLKN

SEQ ID NO: 2305935 - protein, 27 aa, Cryptosporidium parvum
VDPERRCFRVIGGVMVERTVKTVKPAL

SEQ ID NO: 2305936 - protein, 26 aa, Cryptosporidium parvum
VDPFPKPCYLFAVVAGVLGRLEDKFI

SEQ ID NO: 2305937 - protein, 23 aa, Cryptosporidium parvum
VDPPNPLPVILVSKYVESQCNEI

SEQ ID NO: 2305938 - protein, 25 aa, Cryptosporidium parvum
VDPPYEVYNGWHWNSNKLEYCLKSN

SEQ ID NO: 2305939 - protein, 52 aa, Cryptosporidium parvum
VDPSKYFCFDKCILFNKFNLRFLVYNSAGGLCWSDRICDMNTQFLQDYFFLF

SEQ ID NO: 2305940 - protein, 17 aa, Cryptosporidium parvum
VDQLLIKTSNDFSNLEG

SEQ ID NO: 2305941 - protein, 31 aa, Cryptosporidium parvum
VDRLHKVLRPFLLRREKIQVANEVPPKLEEI

SEQ ID NO: 2305942 - protein, 18 aa, Cryptosporidium parvum
VDRLNRIVEWSGIGPSLK

SEQ ID NO: 2305943 - protein, 18 aa, Cryptosporidium parvum
VDSAKFSTEIDLKANDNS

SEQ ID NO: 2305944 - protein, 17 aa, Cryptosporidium parvum
VDSFLPISCEFPESLLP

SEQ ID NO: 2305945 - protein, 17 aa, Cryptosporidium parvum
VDSGVPFRSADSDPSTL

SEQ ID NO: 2305946 - protein, 21 aa, Cryptosporidium parvum
VDSNICLRLVQLSKEEIRLFE

SEQ ID NO: 2305947 - protein, 23 aa, Cryptosporidium parvum
VDSSRFKYTFPTLGYCAINLIET

SEQ ID NO: 2305948 - protein, 18 aa, Cryptosporidium parvum
VDTGMGLERLVSILQNKT

SEQ ID NO: 2305949 - protein, 22 aa, Cryptosporidium parvum
VDTLQRYNCRSIPLEFTPEKVC

SEQ ID NO: 2305950 - protein, 19 aa, Cryptosporidium parvum
VDTNMGLVPGMSLGGELGV

SEQ ID NO: 2305951 - protein, 24 aa, Cryptosporidium parvum
VDTVLKLAKLSILRIESEGGGTGA

SEQ ID NO: 2305952 - protein, 20 aa, Cryptosporidium parvum
VEAIKSEFERIFKNEDSAFN

SEQ ID NO: 2305953 - protein, 17 aa, Cryptosporidium parvum
VEALFTCINDMRKELAI

SEQ ID NO: 2305954 - protein, 18 aa, Cryptosporidium parvum
VEALSGAIAFDLKSVLEL

SEQ ID NO: 2305955 - protein, 21 aa, Cryptosporidium parvum
VEALYMIMKAGGFCDFQHICR

SEQ ID NO: 2305956 - protein, 22 aa, Cryptosporidium parvum
VEAPVFKYGGYKNSSLIINNNK

SEQ ID NO: 2305957 - protein, 17 aa, Cryptosporidium parvum
VECDCVETAIKLYDELD

SEQ ID NO: 2305958 - protein, 28 aa, Cryptosporidium parvum
VECKKCQVKFHFECCISDNIMNFNHLDN

SEQ ID NO: 2305959 - protein, 18 aa, Cryptosporidium parvum
VECSCSSIRIVIGSSSVS

SEQ ID NO: 2305960 - protein, 17 aa, Cryptosporidium parvum
VEENVDLTKSCLWSILE

SEQ ID NO: 2305961 - protein, 17 aa, Cryptosporidium parvum
VEFGDRPIDGIILTKFD

SEQ ID NO: 2305962 - protein, 19 aa, Cryptosporidium parvum
VEFHKEYPWILSCSDDQTM

SEQ ID NO: 2305963 - protein, 26 aa, Cryptosporidium parvum
VEFYFALLQSIRWPSKLLIKGGPNVK

SEQ ID NO: 2305964 - protein, 21 aa, Cryptosporidium parvum
VEGKKSLAIEAFANALRQIPT

SEQ ID NO: 2305965 - protein, 19 aa, Cryptosporidium parvum
VEGLIRYGLDKEGRPCIFM

SEQ ID NO: 2305966 - protein, 26 aa, Cryptosporidium parvum
VEGLPRKIAAFILQRHGNQIPYDRQF

SEQ ID NO: 2305967 - protein, 28 aa, Cryptosporidium parvum
VEIHRRYDIKGSWIGRSTPLILQEDKTI

SEQ ID NO: 2305968 - protein, 17 aa, Cryptosporidium parvum
VEIIPVVKKYEWGRKEK

SEQ ID NO: 2305969 - protein, 18 aa, Cryptosporidium parvum
VEILGLYPNIPVNIKKHS

SEQ ID NO: 2305970 - protein, 17 aa, Cryptosporidium parvum
VEIMSRITISFGSVLES

SEQ ID NO: 2305971 - protein, 17 aa, Cryptosporidium parvum
VEIRRRSIIDPELVEVD

SEQ ID NO: 2305972 - protein, 17 aa, Cryptosporidium parvum
VEISLYHALSFYNAIYS

SEQ ID NO: 2305973 - protein, 17 aa, Cryptosporidium parvum
VEITRRILIRSYTDRVK

SEQ ID NO: 2305974 - protein, 18 aa, Cryptosporidium parvum
VEITRSFCGISIVCNYHK

SEQ ID NO: 2305975 - protein, 19 aa, Cryptosporidium parvum
VEKFLKRRPQMKHKEKEGA

SEQ ID NO: 2305976 - protein, 42 aa, Cryptosporidium parvum; identical to SEQ ID NO: 2183261

SEQ ID NO: 2305977 - protein, 36 aa, Cryptosporidium parvum; identical to SEQ ID NO: 2183262

SEQ ID NO: 2305978 - protein, 18 aa, Cryptosporidium parvum
VEKYRPGNVLDISHHKDV

SEQ ID NO: 2305979 - protein, 26 aa, Cryptosporidium parvum
VELFRLNNFGSIKFSSFNWLIARALT

SEQ ID NO: 2305980 - protein, 17 aa, Cryptosporidium parvum
VELIFKGLAEFIIMCDK

SEQ ID NO: 2305981 - protein, 21 aa, Cryptosporidium parvum
VELIKSLYVYRHSKEFCYIES

SEQ ID NO: 2305982 - protein, 20 aa, Cryptosporidium parvum
VELITLLTCALRYHTINTGY

SEQ ID NO: 2305983 - protein, 17 aa, Cryptosporidium parvum
VELKGVLDQVLLDPNFS

SEQ ID NO: 2305984 - protein, 18 aa, Cryptosporidium parvum
VELLKKLDHPNIMKLFEI

SEQ ID NO: 2305985 - protein, 23 aa, Cryptosporidium parvum
VELNYCLAYGFRAIQSISRKLNL

SEQ ID NO: 2305986 - protein, 31 aa, Cryptosporidium parvum; identical to SEQ ID NO: 2183268

SEQ ID NO: 2305987 - protein, 25 aa, Cryptosporidium parvum
VELSARFNHMAAFSLTWPEVIQLCE

SEQ ID NO: 2305988 - protein, 28 aa, Cryptosporidium parvum
VELVLLRLGISFYFSLCQIMDHPFSTNR

SEQ ID NO: 2305989 - protein, 20 aa, Cryptosporidium parvum
VELWQNLYAHRKRDDKRLVG

SEQ ID NO: 2305990 - protein, 25 aa, Cryptosporidium parvum
VELYCIHPSGSCYKYCAMAVGKGRQ

SEQ ID NO: 2305991 - protein, 23 aa, Cryptosporidium parvum
VENIIRRLFKVFLQDFKLSSMYK

SEQ ID NO: 2305992 - protein, 26 aa, Cryptosporidium parvum
VENWLPKRLGGGLGKVRGQEKPESKS

SEQ ID NO: 2305993 - protein, 27 aa, Cryptosporidium parvum
VEPESRSAFVWIIGEVYEFVQVTKPST

SEQ ID NO: 2305994 - protein, 25 aa, Cryptosporidium parvum
VEPNLLGFGDNCFYIVNNGPFSQSN

SEQ ID NO: 2305995 - protein, 20 aa, Cryptosporidium parvum
VEPNMTFSIEKIKIGALNLY

SEQ ID NO: 2305996 - protein, 18 aa, Cryptosporidium parvum
VEPYFPGLFAQALSTTNV

SEQ ID NO: 2305997 - protein, 22 aa, Cryptosporidium parvum
VERFSFKGIRLVDCERNCNFDN

SEQ ID NO: 2305998 - protein, 19 aa, Cryptosporidium parvum
VERIYTCWITAKASESQKE

SEQ ID NO: 2305999 - protein, 24 aa, Cryptosporidium parvum
VERKEISHCIGSGTSVFLQDYDLP

SEQ ID NO: 2306000 - protein, 23 aa, Cryptosporidium parvum
VERSLRYILSIQENVTYMGDVIQ

SEQ ID NO: 2306001 - protein, 18 aa, Cryptosporidium parvum
VESCELQPIVILRDKMGK

SEQ ID NO: 2306002 - protein, 22 aa, Cryptosporidium parvum
VESFKFGSEQAILANLSSTNNK

SEQ ID NO: 2306003 - protein, 17 aa, Cryptosporidium parvum
VESFSVNILEAISYQDR

SEQ ID NO: 2306004 - protein, 18 aa, Cryptosporidium parvum
VESILLPLSTTSCGTSAE

SEQ ID NO: 2306005 - protein, 20 aa, Cryptosporidium parvum
VESKFKLIIDKIFGNLIKYL

SEQ ID NO: 2306006 - protein, 17 aa, Cryptosporidium parvum
VESLCSGVFRADIPEKF

SEQ ID NO: 2306007 - protein, 21 aa, Cryptosporidium parvum
VESRVPCCGSFMIMLEDHTLG

SEQ ID NO: 2306008 - protein, 18 aa, Cryptosporidium parvum
VETAKIAYLTAFEAQVNA

SEQ ID NO: 2306009 - protein, 23 aa, Cryptosporidium parvum
VETLLALEFFFPMDSGDLPYEVK

SEQ ID NO: 2306010 - protein, 18 aa, Cryptosporidium parvum
VETLPLSYKVFLASLILE

SEQ ID NO: 2306011 - protein, 18 aa, Cryptosporidium parvum
VETLYRMGYLCIIISTRT

SEQ ID NO: 2306012 - protein, 24 aa, Cryptosporidium parvum
VEVELRKCCNHPFQVVGVEEREVA

SEQ ID NO: 2306013 - protein, 17 aa, Cryptosporidium parvum
VEVKPMLASPTIVPESR

SEQ ID NO: 2306014 - protein, 25 aa, Cryptosporidium parvum
VEVLECSKSINNSLCITAKGRMYIG

SEQ ID NO: 2306015 - protein, 22 aa, Cryptosporidium parvum
VEVPEVRIVDKFVSKPVTKYVE

SEQ ID NO: 2306016 - protein, 19 aa, Cryptosporidium parvum
VEVPIAFYSAIPVPILIDR

SEQ ID NO: 2306017 - protein, 27 aa, Cryptosporidium parvum
VEVPVEVPIAYPPRIVPVPKPYIVERT

SEQ ID NO: 2306018 - protein, 18 aa, Cryptosporidium parvum
VEWSEGFLQYLQSILPPA

SEQ ID NO: 2306019 - protein, 17 aa, Cryptosporidium parvum
VEYAKKELDRWMNSENN

SEQ ID NO: 2306020 - protein, 21 aa, Cryptosporidium parvum
VEYIDSRICELRGEKIDLQSS

SEQ ID NO: 2306021 - protein, 23 aa, Cryptosporidium parvum
VEYRMPYIMGIKVVDSIIIESRK

SEQ ID NO: 2306022 - protein, 23 aa, Cryptosporidium parvum
VFAPEILQKVGLTFPTQQAIHAI

SEQ ID NO: 2306023 - protein, 18 aa, Cryptosporidium parvum
VFCYWISSRYLRIKKKEF

SEQ ID NO: 2306024 - protein, 18 aa, Cryptosporidium parvum
VFDAKRLIGRKFDDQAVQ

SEQ ID NO: 2306025 - protein, 25 aa, Cryptosporidium parvum
VFDGHGGSVISEWVSRHIESIFEQE

SEQ ID NO: 2306026 - protein, 23 aa, Cryptosporidium parvum
VFDMKTRGWKILDGCANTPRFLH

SEQ ID NO: 2306027 - protein, 24 aa, Cryptosporidium parvum
VFDSSIKVGKLFLVDLAGSEKISK

SEQ ID NO: 2306028 - protein, 19 aa, Cryptosporidium parvum
VFEAHGIKRFQSLGKQFNP

SEQ ID NO: 2306029 - protein, 19 aa, Cryptosporidium parvum
VFEEIRFQLNVIVNNLELI

SEQ ID NO: 2306030 - protein, 36 aa, Cryptosporidium parvum
VFEEYYLAWNCFRIDECIQIAMDLSRNINKFLTDHA

SEQ ID NO: 2306031 - protein, 21 aa, Cryptosporidium parvum
VFENPSLPLTFVLTSITKPSR

SEQ ID NO: 2306032 - protein, 19 aa, Cryptosporidium parvum
VFEQIQFQIIKFFFGDENS

SEQ ID NO: 2306033 - protein, 21 aa, Cryptosporidium parvum
VFERWDCNIILKEMGKEMATN

SEQ ID NO: 2306034 - protein, 19 aa, Cryptosporidium parvum
VFEVLPRSDNIVHYDNDTS

SEQ ID NO: 2306035 - protein, 22 aa, Cryptosporidium parvum
VFFEVYRVPALFISTQAVLSLY

SEQ ID NO: 2306036 - protein, 22 aa, Cryptosporidium parvum
VFFKHILFSTSIEHLNLSRNKI

SEQ ID NO: 2306037 - protein, 19 aa, Cryptosporidium parvum
VFIEPRNSFELGSVLDSYM

SEQ ID NO: 2306038 - protein, 17 aa, Cryptosporidium parvum
VFLILINYNIFPGVNGK

SEQ ID NO: 2306039 - protein, 19 aa, Cryptosporidium parvum
VFLLKERLLTCNKYIGLLQ

SEQ ID NO: 2306040 - protein, 24 aa, Cryptosporidium parvum
VFLNEVRRLTCIFVSVKGLDISTH

SEQ ID NO: 2306041 - protein, 23 aa, Cryptosporidium parvum
VFMNIDGSFCFLDKISTNIQFND

SEQ ID NO: 2306042 - protein, 24 aa, Cryptosporidium parvum
VFPSIVGRPKMPGVMVGMDQKDCY

SEQ ID NO: 2306043 - protein, 18 aa, Cryptosporidium parvum
VFRALRRIVSDDFVSALL

SEQ ID NO: 2306044 - protein, 17 aa, Cryptosporidium parvum
VFSESFGNLSTYFGNPD

SEQ ID NO: 2306045 - protein, 42 aa, Cryptosporidium parvum
VGEELPIKGLFFFPSRLLETAAFRPPKNVTWLDAGKTKSSEN

SEQ ID NO: 2306046 - protein, 18 aa, Cryptosporidium parvum
VGELKPRINQALKAELDT

SEQ ID NO: 2306047 - protein, 19 aa, Cryptosporidium parvum
VGERLKRRFGEYKTTNDSG

SEQ ID NO: 2306048 - protein, 19 aa, Cryptosporidium parvum
VGFNPKYVPTWEVREVPKL

SEQ ID NO: 2306049 - protein, 18 aa, Cryptosporidium parvum
VGGDFSHSVSRLIRVNIF

SEQ ID NO: 2306050 - protein, 35 aa, Cryptosporidium parvum
VGGGHGIGMGMGNRIIPGISPGVIHPKSTVSGGSS

SEQ ID NO: 2306051 - protein, 20 aa, Cryptosporidium parvum
VGGISPPHGIQIGGGIDYKS

SEQ ID NO: 2306052 - protein, 17 aa, Cryptosporidium parvum
VGGKRLLEKDCDQDNGN

SEQ ID NO: 2306053 - protein, 17 aa, Cryptosporidium parvum
VGGVVTWNKQNNFVEDM

SEQ ID NO: 2306054 - protein, 23 aa, Cryptosporidium parvum
VGIEILRNSFFPILISSIEEDLL

SEQ ID NO: 2306055 - protein, 25 aa, Cryptosporidium parvum
VGIICRKCNKMLCSEHIYESEHECM

SEQ ID NO: 2306056 - protein, 19 aa, Cryptosporidium parvum
VGILYRRFPNIKEFIENHL

SEQ ID NO: 2306057 - protein, 26 aa, Cryptosporidium parvum
VGIYGFNCRCGFNFCSTHRYADAHDC

SEQ ID NO: 2306058 - protein, 18 aa, Cryptosporidium parvum
VGKHCIPTLIEIISTPLN

SEQ ID NO: 2306059 - protein, 17 aa, Cryptosporidium parvum
VGKSCLVVRFSKDEFHE

SEQ ID NO: 2306060 - protein, 18 aa, Cryptosporidium parvum
VGLDESRIPKIGLESSVS

SEQ ID NO: 2306061 - protein, 26 aa, Cryptosporidium parvum
VGLGICGGGSGFSRHLGISKLGTPNS

SEQ ID NO: 2306062 - protein, 17 aa, Cryptosporidium parvum
VGLIRRGLSFGIKLSLE

SEQ ID NO: 2306063 - protein, 17 aa, Cryptosporidium parvum
VGLMPYNTFLSINHESA

SEQ ID NO: 2306064 - protein, 21 aa, Cryptosporidium parvum
VGLQITMPIITLIASETKYCG

SEQ ID NO: 2306065 - protein, 29 aa, Cryptosporidium parvum
VGLSGEFREFPLGDVLTGSTLSNLVESME

SEQ ID NO: 2306066 - protein, 25 aa, Cryptosporidium parvum
VGMIKVRLFRPWSIDAFVKKIPKTT

SEQ ID NO: 2306067 - protein, 24 aa, Cryptosporidium parvum
VGNLFRKIRHGAFSLPGHISDLAK

SEQ ID NO: 2306068 - protein, 29 aa, Cryptosporidium parvum
VGNLPFRRLCLKFGADVTVSEMVLCNEIL

SEQ ID NO: 2306069 - protein, 33 aa, Cryptosporidium parvum
VGNSGLFRPEMLRPLGFPSDIVVIAWGLSLERP

SEQ ID NO: 2306070 - protein, 25 aa, Cryptosporidium parvum
VGQKDSRIWGLWAVLDFLNNSRKQS

SEQ ID NO: 2306071 - protein, 23 aa, Cryptosporidium parvum
VGQVSLKRSIVYDSSLGCCVPLY

SEQ ID NO: 2306072 - protein, 18 aa, Cryptosporidium parvum
VGQYISRKNEISGLAWPM

SEQ ID NO: 2306073 - protein, 19 aa, Cryptosporidium parvum
VGRCHFVMLDGCATPLQLD

SEQ ID NO: 2306074 - protein, 24 aa, Cryptosporidium parvum
VGRPKYKRCMAGALEGDIFVGSKC

SEQ ID NO: 2306075 - protein, 21 aa, Cryptosporidium parvum
VGRSRGCGVVEYSFPEEAQRA

SEQ ID NO: 2306076 - protein, 36 aa, Cryptosporidium parvum
VGSDPRSGFIWQRMYKLRLMVYNTLISKNEASLSGN

SEQ ID NO: 2306077 - protein, 23 aa, Cryptosporidium parvum
VGSDSCTFVWLCMKLGTSKFNIN

SEQ ID NO: 2306078 - protein, 24 aa, Cryptosporidium parvum
VGSEFGRIFFSNWIKSIEEDSKKS

SEQ ID NO: 2306079 - protein, 22 aa, Cryptosporidium parvum
VGSGLISCFIFYSETDDQYVLF

SEQ ID NO: 2306080 - protein, 19 aa, Cryptosporidium parvum
VGSIIVISNLMWWINDIHV

SEQ ID NO: 2306081 - protein, 23 aa, Cryptosporidium parvum
VGTHPFKNLSLFDMVYILCEDNT

SEQ ID NO: 2306082 - protein, 27 aa, Cryptosporidium parvum
VGTNMRSKCLLIAIGQMLEDYYCPPYK

SEQ ID NO: 2306083 - protein, 23 aa, Cryptosporidium parvum
VGVESRIGIGFDRYRTKNAVLNK

SEQ ID NO: 2306084 - protein, 19 aa, Cryptosporidium parvum
VGVIDCSWNKIDQVPFHKI

SEQ ID NO: 2306085 - protein, 17 aa, Cryptosporidium parvum
VGYKMLYLDVVKGSKFQ

SEQ ID NO: 2306086 - protein, 21 aa, Cryptosporidium parvum
VGYLKHWESFTVLRDTLDADI

SEQ ID NO: 2306087 - protein, 17 aa, Cryptosporidium parvum
VGYRGTIFSVMDRNQDD

SEQ ID NO: 2306088 - protein, 17 aa, Cryptosporidium parvum
VGYSDGSVRVWNISLKS

SEQ ID NO: 2306089 - protein, 23 aa, Cryptosporidium parvum
VHDFRLKSILFINWRRYSKKQKI

SEQ ID NO: 2306090 - protein, 19 aa, Cryptosporidium parvum
VHDKYVIPILMVIQECFTR

SEQ ID NO: 2306091 - protein, 19 aa, Cryptosporidium parvum
VHLLDFPNIVIKGSDLSLP

SEQ ID NO: 2306092 - protein, 17 aa, Cryptosporidium parvum
VHLSFKCITLYAQYHLF

SEQ ID NO: 2306093 - protein, 18 aa, Cryptosporidium parvum
VHLSNVFSHPKYRSNMEY

SEQ ID NO: 2306094 - protein, 21 aa, Cryptosporidium parvum
VHNRLKYKKALKRLKGTQRSM

SEQ ID NO: 2306095 - protein, 17 aa, Cryptosporidium parvum
VHPKIELSFILRDGEKK

SEQ ID NO: 2306096 - protein, 17 aa, Cryptosporidium parvum
VHRIGILDICLFNLDRN

SEQ ID NO: 2306097 - protein, 21 aa, Cryptosporidium parvum
VHSAMIFNMEIFRNERRKELD

SEQ ID NO: 2306098 - protein, 17 aa, Cryptosporidium parvum
VHSGHYICYNKRKIDSS

SEQ ID NO: 2306099 - protein, 28 aa, Cryptosporidium parvum
VHVLPFPSLCKFFEILFEKGNLFLFQFG

SEQ ID NO: 2306100 - protein, 26 aa, Cryptosporidium parvum
VHVLRVRLSPAFINFLLPKAVDEVKE

SEQ ID NO: 2306101 - protein, 25 aa, Cryptosporidium parvum
VHVPNWKSIRPWALVNSNNSRMDDC

SEQ ID NO: 2306102 - protein, 22 aa, Cryptosporidium parvum
VIACVGFKMFLGITAETKDWNP

SEQ ID NO: 2306103 - protein, 20 aa, Cryptosporidium parvum
VIALLALPKICCILFLVNPG

SEQ ID NO: 2306104 - protein, 53 aa, Cryptosporidium parvum
VICGLLNGMEYCICKCDELDILLERWNPFLLYKFEQEYLKNGAILMDNNIGIL

SEQ ID NO: 2306105 - protein, 17 aa, Cryptosporidium parvum
VICKAWMVSRELKGNRA

SEQ ID NO: 2306106 - protein, 21 aa, Cryptosporidium parvum
VICNLNLKASRGSKCRVFSRM

SEQ ID NO: 2306107 - protein, 17 aa, Cryptosporidium parvum
VICQVKGIYIPPDSSNP

SEQ ID NO: 2306108 - protein, 25 aa, Cryptosporidium parvum
VICRKVFCGSNSDFGLILLQNGMLW

SEQ ID NO: 2306109 - protein, 25 aa, Cryptosporidium parvum
VIDCKKFGNYVLHIGILLQGKIEIS

SEQ ID NO: 2306110 - protein, 22 aa, Cryptosporidium parvum
VIDCRGSLLGRLASVIAKELLN

SEQ ID NO: 2306111 - protein, 20 aa, Cryptosporidium parvum
VIDGKLDYPAACNSLETLLI

SEQ ID NO: 2306112 - protein, 19 aa, Cryptosporidium parvum
VIDSNLIFTILFGSDSLEK

SEQ ID NO: 2306113 - protein, 23 aa, Cryptosporidium parvum
VIDVAWHPVHPGIFAAIDADSKL

SEQ ID NO: 2306114 - protein, 21 aa, Cryptosporidium parvum
VIEIPFPLLVSKFSYEEEQYS

SEQ ID NO: 2306115 - protein, 36 aa, Cryptosporidium parvum
VIEWLYNLLECCGKLAKLRSYIIWNSIAVIKVLKKR

SEQ ID NO: 2306116 - protein, 19 aa, Cryptosporidium parvum
VIFPSILMNLIIIDKKDIN

SEQ ID NO: 2306117 - protein, 21 aa, Cryptosporidium parvum
VIFRCSKWRDILMELISKSRK

SEQ ID NO: 2306118 - protein, 19 aa, Cryptosporidium parvum
VIFRPCIIGLLEIYNIHCQ

SEQ ID NO: 2306119 - protein, 26 aa, Cryptosporidium parvum
VIGAMPDWIQLKGIFFRNPFIMSSAK

SEQ ID NO: 2306120 - protein, 21 aa, Cryptosporidium parvum
VIGDNCIIKGCSILDNTVIEN

SEQ ID NO: 2306121 - protein, 20 aa, Cryptosporidium parvum
VIGTHPFIKLLTNFVNLVFG

SEQ ID NO: 2306122 - protein, 24 aa, Cryptosporidium parvum
VIHIKFSLPCLINSSTSSLSIESD

SEQ ID NO: 2306123 - protein, 18 aa, Cryptosporidium parvum
VIHKEFPGVFTMAEESTA

SEQ ID NO: 2306124 - protein, 34 aa, Cryptosporidium parvum
VIIECFDHHLINCFSVILGFRYANFMLLIDSVDE

SEQ ID NO: 2306125 - protein, 18 aa, Cryptosporidium parvum
VIIFFFLYHCAFKNESSF

SEQ ID NO: 2306126 - protein, 30 aa, Cryptosporidium parvum
VIKDVLLPWYHCYRFFVQEAIRYENTNHNI

SEQ ID NO: 2306127 - protein, 19 aa, Cryptosporidium parvum
VIKEFKMSQLLISIENSLI

SEQ ID NO: 2306128 - protein, 17 aa, Cryptosporidium parvum
VIKHCKELEGKVEELGC

SEQ ID NO: 2306129 - protein, 22 aa, Cryptosporidium parvum
VIKKEFSVWGPVDYIRVIPSKN

SEQ ID NO: 2306130 - protein, 27 aa, Cryptosporidium parvum
VIKKLQTWLSDWKSVVIEGKKKAPPKA

SEQ ID NO: 2306131 - protein, 20 aa, Cryptosporidium parvum
VIKLSKYVLDCEFRLKKTLL

SEQ ID NO: 2306132 - protein, 19 aa, Cryptosporidium parvum
VIKPDIFFMNGHPGDSICV

SEQ ID NO: 2306133 - protein, 24 aa, Cryptosporidium parvum
VIKSPSFSAPLMFDSEYNVIGHLG

SEQ ID NO: 2306134 - protein, 17 aa, Cryptosporidium parvum
VILFLDCVIGLTKQLER

SEQ ID NO: 2306135 - protein, 19 aa, Cryptosporidium parvum
VILFTGTPGVDCFAHRPEN

SEQ ID NO: 2306136 - protein, 24 aa, Cryptosporidium parvum
VILIPLRLLEEFMSLEEQRSRKIT

SEQ ID NO: 2306137 - protein, 20 aa, Cryptosporidium parvum
VILLKLGRRLNILTYKINQL

SEQ ID NO: 2306138 - protein, 23 aa, Cryptosporidium parvum
VINCPQVKYTMRLLDESIYSEQI

SEQ ID NO: 2306139 - protein, 17 aa, Cryptosporidium parvum
VINEVKGSQVFVMRAVN

SEQ ID NO: 2306140 - protein, 28 aa, Cryptosporidium parvum
VINHTKRLLFEFIRVVSCQIIDFDTLSE

SEQ ID NO: 2306141 - protein, 24 aa, Cryptosporidium parvum
VINLHGKKVFGLFDIKLVKNNNKN

SEQ ID NO: 2306142 - protein, 25 aa, Cryptosporidium parvum
VINLPIPRRPMILVGPNCKTKKAPN

SEQ ID NO: 2306143 - protein, 18 aa, Cryptosporidium parvum
VINMKPKELLSMVEEAAG

SEQ ID NO: 2306144 - protein, 18 aa, Cryptosporidium parvum
VINPFNIKDFFTLNINEI

SEQ ID NO: 2306145 - protein, 18 aa, Cryptosporidium parvum
VINYLKMRSQEYIAELCS

SEQ ID NO: 2306146 - protein, 18 aa, Cryptosporidium parvum
VIPELYGRNLFNLYRNGL

SEQ ID NO: 2306147 - protein, 24 aa, Cryptosporidium parvum
VIPSVDSLDHWMMLFLQPLGITCD

SEQ ID NO: 2306148 - protein, 18 aa, Cryptosporidium parvum
VIPVEMKKLNCNEMDEDP

SEQ ID NO: 2306149 - protein, 19 aa, Cryptosporidium parvum
VIQECFNKDVLGFSLDSVS

SEQ ID NO: 2306150 - protein, 23 aa, Cryptosporidium parvum
VIQKDSFCKLTPNSGSNKIWVWT

SEQ ID NO: 2306151 - protein, 24 aa, Cryptosporidium parvum
VIQRSTFHLCPRGFGRTSFRLYES

SEQ ID NO: 2306152 - protein, 25 aa, Cryptosporidium parvum
VIRAHSLGVQAIRFIPKTGHLLLSA

SEQ ID NO: 2306153 - protein, 22 aa, Cryptosporidium parvum
VIREFCKKFKTEYGNISHLNTS

SEQ ID NO: 2306154 - protein, 25 aa, Cryptosporidium parvum
VIRIWDHRVQKCIEKFHGHTNTITG

SEQ ID NO: 2306155 - protein, 19 aa, Cryptosporidium parvum
VISEIFGVTSINFENFTKL

SEQ ID NO: 2306156 - protein, 18 aa, Cryptosporidium parvum
VISRLCLLINKITPAQYT

SEQ ID NO: 2306157 - protein, 29 aa, Cryptosporidium parvum
VISRLHSILRPFLLRRVKSDVLQDLPEKK

SEQ ID NO: 2306158 - protein, 19 aa, Cryptosporidium parvum
VITCQSFNWNVYMRQLYYN

SEQ ID NO: 2306159 - protein, 21 aa, Cryptosporidium parvum
VITIRMALDYSLSVQQQVSAL

SEQ ID NO: 2306160 - protein, 19 aa, Cryptosporidium parvum
VIYFPCILLDEIDKKGKKQ

SEQ ID NO: 2306161 - protein, 24 aa, Cryptosporidium parvum
VIYWKDLYKSGVISQLMFSYETFV

SEQ ID NO: 2306162 - protein, 25 aa, Cryptosporidium parvum
VKAAYRGCRASMCMQLYRQALNFAL

SEQ ID NO: 2306163 - protein, 18 aa, Cryptosporidium parvum
VKAKCYLNGVKVEKLTIN

SEQ ID NO: 2306164 - protein, 25 aa, Cryptosporidium parvum
VKCSEELKTRFLLSQYSLFVKIVDS

SEQ ID NO: 2306165 - protein, 31 aa, Cryptosporidium parvum
VKDAFHLHDMFYLCFPLRLKHSCTHEDKDRI

SEQ ID NO: 2306166 - protein, 21 aa, Cryptosporidium parvum
VKDGMKFGVDYILYHKSPSLV

SEQ ID NO: 2306167 - protein, 20 aa, Cryptosporidium parvum
VKDISWKEISGIDILFNLDK

SEQ ID NO: 2306168 - protein, 23 aa, Cryptosporidium parvum
VKDKSRIGVCLDTCHLFAAGYDV

SEQ ID NO: 2306169 - protein, 17 aa, Cryptosporidium parvum
VKDVIKDVLLPWYHCYR

SEQ ID NO: 2306170 - protein, 20 aa, Cryptosporidium parvum
VKEGRNLICTEGNSEEEKVI

SEQ ID NO: 2306171 - protein, 17 aa, Cryptosporidium parvum
VKEIPKIEIQYVEKIVE

SEQ ID NO: 2306172 - protein, 23 aa, Cryptosporidium parvum
VKELKCVSEECTIVLDKLNVSIS

SEQ ID NO: 2306173 - protein, 21 aa, Cryptosporidium parvum
VKELPSILLFTCQSLKPYKVI

SEQ ID NO: 2306174 - protein, 18 aa, Cryptosporidium parvum
VKELVLDGVKLRELTQQD

SEQ ID NO: 2306175 - protein, 30 aa, Cryptosporidium parvum
VKEQLKECVEWPLIHSELFEYMKIKPPSGV

SEQ ID NO: 2306176 - protein, 27 aa, Cryptosporidium parvum
VKERSKPKCSVAFCETVEFRTVYVTKQ

SEQ ID NO: 2306177 - protein, 33 aa, Cryptosporidium parvum
VKFDKLKQRTLRVMKHLHSVMVIGKTARKKRKF

SEQ ID NO: 2306178 - protein, 23 aa, Cryptosporidium parvum
VKFDTRMMRHFSIEDITFNNTIR

SEQ ID NO: 2306179 - protein, 17 aa, Cryptosporidium parvum
VKFELNWNQILERFNEL

SEQ ID NO: 2306180 - protein, 18 aa, Cryptosporidium parvum
VKFIHQFYFLLGTENLKI

SEQ ID NO: 2306181 - protein, 28 aa, Cryptosporidium parvum
VKFKDPKFKIAWYFAMRDTLIVDDLDIA

SEQ ID NO: 2306182 - protein, 17 aa, Cryptosporidium parvum
VKGEIGYTLPTISPGLE

SEQ ID NO: 2306183 - protein, 19 aa, Cryptosporidium parvum
VKGEIRFGAVNDYYSNMNL

SEQ ID NO: 2306184 - protein, 18 aa, Cryptosporidium parvum
VKGELKCTGQYKKWKANT

SEQ ID NO: 2306185 - protein, 27 aa, Cryptosporidium parvum
VKGFISHRGRCIYYKAFQNTQYESISQ

SEQ ID NO: 2306186 - protein, 18 aa, Cryptosporidium parvum
VKGLEWVKLYTLNGHSST

SEQ ID NO: 2306187 - protein, 18 aa, Cryptosporidium parvum
VKGLNMLFVLCSGNNVLS

SEQ ID NO: 2306188 - protein, 17 aa, Cryptosporidium parvum
VKGLPSLESRLYISEGI

SEQ ID NO: 2306189 - protein, 22 aa, Cryptosporidium parvum
VKGNALVCFVVLKDSGNRTFDL

SEQ ID NO: 2306190 - protein, 25 aa, Cryptosporidium parvum
VKGSDASVVAPIFVQILHLKSKSMI

SEQ ID NO: 2306191 - protein, 17 aa, Cryptosporidium parvum
VKHDFQYLHNYKLLQQV

SEQ ID NO: 2306192 - protein, 18 aa, Cryptosporidium parvum
VKHIKSSYGVKVTFKLEN

SEQ ID NO: 2306193 - protein, 18 aa, Cryptosporidium parvum
VKIACIDFPLKQYRMQMG

SEQ ID NO: 2306194 - protein, 25 aa, Cryptosporidium parvum
VKIDNIRFGLDYNNIGSISSMLMNN

SEQ ID NO: 2306195 - protein, 38 aa, Cryptosporidium parvum; identical to SEQ ID NO: 2183458

SEQ ID NO: 2306196 - protein, 19 aa, Cryptosporidium parvum
VKIFGELTLMVSEPSVRAF

SEQ ID NO: 2306197 - protein, 21 aa, Cryptosporidium parvum
VKIGMPSIVFSLGLLISNIFG

SEQ ID NO: 2306198 - protein, 20 aa, Cryptosporidium parvum
VKILGCLALIDDDELDWKVV

SEQ ID NO: 2306199 - protein, 17 aa, Cryptosporidium parvum
VKIMNKVKMKAINMYEK

SEQ ID NO: 2306200 - protein, 25 aa, Cryptosporidium parvum
VKINNCQICIYKILKPNSEKYSTAH

SEQ ID NO: 2306201 - protein, 33 aa, Cryptosporidium parvum
VKIPNNFLDICFWKQLLEIVLSAPILDLSVLTG

SEQ ID NO: 2306202 - protein, 17 aa, Cryptosporidium parvum
VKIYLDEIAELRSQILQ

SEQ ID NO: 2306203 - protein, 21 aa, Cryptosporidium parvum
VKKAYRKAIILCHPDKNHNES

SEQ ID NO: 2306204 - protein, 19 aa, Cryptosporidium parvum
VKKFSKETGDFGFLSETDF

SEQ ID NO: 2306205 - protein, 29 aa, Cryptosporidium parvum
VKKGDAFLVRGGFRPIEFKVVGVDPEEYC

SEQ ID NO: 2306206 - protein, 25 aa, Cryptosporidium parvum
VKKGLQCMNCKTIIKEGPLCKDCSK

SEQ ID NO: 2306207 - protein, 19 aa, Cryptosporidium parvum
VKKNDKVPLSLVVYNTETE

SEQ ID NO: 2306208 - protein, 33 aa, Cryptosporidium parvum
VKKNFKNEVCSKCSKNAECYVHSIFETTHDLSK

SEQ ID NO: 2306209 - protein, 20 aa, Cryptosporidium parvum
VKKVVFSLHPSFLNPNRVVE

SEQ ID NO: 2306210 - protein, 24 aa, Cryptosporidium parvum
VKKWVEECIALKPTILNIGQSPFT

SEQ ID NO: 2306211 - protein, 17 aa, Cryptosporidium parvum
VKLALNINTEFFRKVLK

SEQ ID NO: 2306212 - protein, 23 aa, Cryptosporidium parvum
VKLDPNWTPGLYFVEVIMGDVSC

SEQ ID NO: 2306213 - protein, 18 aa, Cryptosporidium parvum
VKLEAFFSSLFEFFLKHL

SEQ ID NO: 2306214 - protein, 20 aa, Cryptosporidium parvum
VKLHECDIYSSLFSLINTEE

SEQ ID NO: 2306215 - protein, 19 aa, Cryptosporidium parvum
VKLKYGIQLILGLNGYVWI

SEQ ID NO: 2306216 - protein, 21 aa, Cryptosporidium parvum
VKLNCLDWDKSITEFIEDIII

SEQ ID NO: 2306217 - protein, 21 aa, Cryptosporidium parvum
VKLNWNGWFNDHFTINVFPIN

SEQ ID NO: 2306218 - protein, 19 aa, Cryptosporidium parvum
VKLPGYLDLPARLSKNLDK

SEQ ID NO: 2306219 - protein, 24 aa, Cryptosporidium parvum
VKMFFSSMPFDMGGGFDGRMGGRM

SEQ ID NO: 2306220 - protein, 19 aa, Cryptosporidium parvum
VKMRMGNKIWEFTLLCNLN

SEQ ID NO: 2306221 - protein, 26 aa, Cryptosporidium parvum
VKNILRRLFRVYSHIYCHHWTHVESI

SEQ ID NO: 2306222 - protein, 24 aa, Cryptosporidium parvum
VKNLKDKLFQLFKMRIYEKPDENI

SEQ ID NO: 2306223 - protein, 25 aa, Cryptosporidium parvum
VKNSIPLDWLQFVEMIVSARTIELN

SEQ ID NO: 2306224 - protein, 24 aa, Cryptosporidium parvum
VKNYCQRGRMCMFSHTKEEQMYHV

SEQ ID NO: 2306225 - protein, 17 aa, Cryptosporidium parvum
VKPNIVCPIINMDYYSR

SEQ ID NO: 2306226 - protein, 19 aa, Cryptosporidium parvum
VKPPLKPKPKFLAPPKNPP

SEQ ID NO: 2306227 - protein, 25 aa, Cryptosporidium parvum
VKRFRKALCPIVERLVCSLMMHGRN

SEQ ID NO: 2306228 - protein, 19 aa, Cryptosporidium parvum
VKRGCLTPLSLIFEKSGGI

SEQ ID NO: 2306229 - protein, 24 aa, Cryptosporidium parvum
VKRNCWPKVRGVSMNPVDHPHGGG

SEQ ID NO: 2306230 - protein, 20 aa, Cryptosporidium parvum
VKRSIKELAQHSLLQKELLK

SEQ ID NO: 2306231 - protein, 24 aa, Cryptosporidium parvum
VKSCQICLNYYFPSKAIKQMESNS

SEQ ID NO: 2306232 - protein, 20 aa, Cryptosporidium parvum
VKSGRKLKCEGAISHYNCID

SEQ ID NO: 2306233 - protein, 21 aa, Cryptosporidium parvum
VKSKVKSIVLFLRANLGINVA

SEQ ID NO: 2306234 - protein, 20 aa, Cryptosporidium parvum
VKSSGFINYFGLQRFGTSEI

SEQ ID NO: 2306235 - protein, 19 aa, Cryptosporidium parvum
VKSSITFSDELSKVYLDFQ

SEQ ID NO: 2306236 - protein, 22 aa, Cryptosporidium parvum
VKTKGFSVFQFGDEGARQKAIE

SEQ ID NO: 2306237 - protein, 19 aa, Cryptosporidium parvum
VKTLRILAIRLWDKRIMLK

SEQ ID NO: 2306238 - protein, 20 aa, Cryptosporidium parvum
VKTNSFLSLEDSFRSVSEYN

SEQ ID NO: 2306239 - protein, 18 aa, Cryptosporidium parvum
VKTTKTVTTQEVKPSSES

SEQ ID NO: 2306240 - protein, 22 aa, Cryptosporidium parvum
VKVADFGLSRSFVNIRRVTNNI

SEQ ID NO: 2306241 - protein, 18 aa, Cryptosporidium parvum
VKVAMRALGFDPKKEELK

SEQ ID NO: 2306242 - protein, 19 aa, Cryptosporidium parvum
VKVGSILSGYVCNSGKEGV

SEQ ID NO: 2306243 - protein, 17 aa, Cryptosporidium parvum
VKVKMRMGNKIWEFTLL

SEQ ID NO: 2306244 - protein, 18 aa, Cryptosporidium parvum
VKVPSSVELINFNNISMD

SEQ ID NO: 2306245 - protein, 19 aa, Cryptosporidium parvum
VKVQFVPGVLMFITSGKDN

SEQ ID NO: 2306246 - protein, 19 aa, Cryptosporidium parvum
VKYKMIISHQVYLKHIEIY

SEQ ID NO: 2306247 - protein, 18 aa, Cryptosporidium parvum
VLDELRGPLKVQYSTGEP

SEQ ID NO: 2306248 - protein, 23 aa, Cryptosporidium parvum
VLDYEGKEKLGFLNRDILLTDYR

SEQ ID NO: 2306249 - protein, 23 aa, Cryptosporidium parvum
VLEAFNLAIKWIKKQKSINEKNH

SEQ ID NO: 2306250 - protein, 22 aa, Cryptosporidium parvum
VLEALSKYFAYEICVGQNGIIW

SEQ ID NO: 2306251 - protein, 19 aa, Cryptosporidium parvum
VLEDWPYWNKSILSELKNN

SEQ ID NO: 2306252 - protein, 22 aa, Cryptosporidium parvum
VLEEIKQSIILINESLGSEKYD

SEQ ID NO: 2306253 - protein, 36 aa, Cryptosporidium parvum
VLEESHVDFLFGLDLLKRYQCCIDLHQNALIIGDEK

SEQ ID NO: 2306254 - protein, 24 aa, Cryptosporidium parvum
VLEKWEIPEPCITPEGKLLTQIEK

SEQ ID NO: 2306255 - protein, 18 aa, Cryptosporidium parvum
VLERRREEYLKKALPASI

SEQ ID NO: 2306256 - protein, 17 aa, Cryptosporidium parvum
VLESMGGSPAWRCNPEF

SEQ ID NO: 2306257 - protein, 22 aa, Cryptosporidium parvum
VLETIKISGFELDKVRDLLTKQ

SEQ ID NO: 2306258 - protein, 23 aa, Cryptosporidium parvum
VLETIPIFGNMGFDQINQSADTD

SEQ ID NO: 2306259 - protein, 21 aa, Cryptosporidium parvum
VLEYLCAELLELAGNAARDAK

SEQ ID NO: 2306260 - protein, 17 aa, Cryptosporidium parvum
VLEYLYIGHSFILSSRY

SEQ ID NO: 2306261 - protein, 23 aa, Cryptosporidium parvum
VLFESAAGYLLCIIDNWEEIGQV

SEQ ID NO: 2306262 - protein, 29 aa, Cryptosporidium parvum
VLFKILFERCFQEYLLLCCDPTESAANAI

SEQ ID NO: 2306263 - protein, 20 aa, Cryptosporidium parvum
VLFLQQIIAPFVLRRSKQDV

SEQ ID NO: 2306264 - protein, 34 aa, Cryptosporidium parvum
VLGFPEYWKRITVMRCMAPVISLSWSPDDCKVVV

SEQ ID NO: 2306265 - protein, 18 aa, Cryptosporidium parvum
VLGLELEDILPLNKFDNS

SEQ ID NO: 2306266 - protein, 18 aa, Cryptosporidium parvum
VLGLPSWFIEDENKHNKP

SEQ ID NO: 2306267 - protein, 19 aa, Cryptosporidium parvum
VLGTSLPLITRRSLFKSGG

SEQ ID NO: 2306268 - protein, 26 aa, Cryptosporidium parvum
VLIEIGPRFVLEPILILDGTFSGQVL

SEQ ID NO: 2306269 - protein, 19 aa, Cryptosporidium parvum
VLIEKCGKLQSLRPLIYGT

SEQ ID NO: 2306270 - protein, 17 aa, Cryptosporidium parvum
VLIGVIFEFDHVLNKRL

SEQ ID NO: 2306271 - protein, 17 aa, Cryptosporidium parvum
VLIKELPPISANDDELV

SEQ ID NO: 2306272 - protein, 22 aa, Cryptosporidium parvum
VLIKRRILLNIKNSSGQLANVI

SEQ ID NO: 2306273 - protein, 19 aa, Cryptosporidium parvum
VLIKYLFDQINFFSDLNID

SEQ ID NO: 2306274 - protein, 18 aa, Cryptosporidium parvum
VLKFLYKVEKGFTDKSLG

SEQ ID NO: 2306275 - protein, 23 aa, Cryptosporidium parvum
VLKNRIAPKILHFQKLNPHIDTE

SEQ ID NO: 2306276 - protein, 19 aa, Cryptosporidium parvum
VLKNWFIKLPLEYLEQAVS

SEQ ID NO: 2306277 - protein, 17 aa, Cryptosporidium parvum
VLLCGYPPFSAPTDSEV

SEQ ID NO: 2306278 - protein, 22 aa, Cryptosporidium parvum
VLLCSELKELLLCVPPETQLNV

SEQ ID NO: 2306279 - protein, 19 aa, Cryptosporidium parvum
VLLCSNCYSLQIKVIQIVL

SEQ ID NO: 2306280 - protein, 24 aa, Cryptosporidium parvum
VLLELIQFRCKIHLNQIEKDSIGS

SEQ ID NO: 2306281 - protein, 32 aa, Cryptosporidium parvum
VLLHYRYNINWDIPDKFLIPTIPSRANYVHFI

SEQ ID NO: 2306282 - protein, 22 aa, Cryptosporidium parvum
VLLPDLPVPLSYNKSSGQTTSN

SEQ ID NO: 2306283 - protein, 25 aa, Cryptosporidium parvum
VLLYPTDFYQLFLISSDSFAKNNSL

SEQ ID NO: 2306284 - protein, 17 aa, Cryptosporidium parvum
VLMKGLDSTGMLIEKKY

SEQ ID NO: 2306285 - protein, 25 aa, Cryptosporidium parvum
VLNDLNKFILLFAALCHDIDHPGVN

SEQ ID NO: 2306286 - protein, 17 aa, Cryptosporidium parvum
VLNEFSIVSWCTPNKYF

SEQ ID NO: 2306287 - protein, 30 aa, Cryptosporidium parvum; identical to SEQ ID NO: 2183529

SEQ ID NO: 2306288 - protein, 26 aa, Cryptosporidium parvum
VLPGVCSRIACLIPHPVSPGIVLSLT

SEQ ID NO: 2306289 - protein, 24 aa, Cryptosporidium parvum
VLPKESIHPYIFIRSKKKNSSESN

SEQ ID NO: 2306290 - protein, 22 aa, Cryptosporidium parvum
VLPNIFPSISHRPLPVNVCYIK

SEQ ID NO: 2306291 - protein, 22 aa, Cryptosporidium parvum
VLPTRYARFNSTLSFKRNDPDL

SEQ ID NO: 2306292 - protein, 17 aa, Cryptosporidium parvum
VLPTSRDPKLWLVKVDR

SEQ ID NO: 2306293 - protein, 17 aa, Cryptosporidium parvum
VLQFIISQYDPRIKISK

SEQ ID NO: 2306294 - protein, 17 aa, Cryptosporidium parvum
VLQMLCFYDEKRNSFIT

SEQ ID NO: 2306295 - protein, 23 aa, Cryptosporidium parvum
VLQQERLRMWARDNAKYTSSISN

SEQ ID NO: 2306296 - protein, 17 aa, Cryptosporidium parvum
VLQRKIIVLSLIVAHNA

SEQ ID NO: 2306297 - protein, 20 aa, Cryptosporidium parvum
VLRGYDRFEEEFGLPDNSSE

SEQ ID NO: 2306298 - protein, 20 aa, Cryptosporidium parvum
VLRKYELVKKLGKGAYGIVW

SEQ ID NO: 2306299 - protein, 23 aa, Cryptosporidium parvum
VLSLTRRLWQKGIRSEYRLTPVR

SEQ ID NO: 2306300 - protein, 19 aa, Cryptosporidium parvum
VLSNMGFTDTEACIKALTE

SEQ ID NO: 2306301 - protein, 22 aa, Cryptosporidium parvum
VLSRTFSGGACFDKVSLVYNKP

SEQ ID NO: 2306302 - protein, 22 aa, Cryptosporidium parvum
VLSTRAGGLGLNLQAADTVIIF

SEQ ID NO: 2306303 - protein, 25 aa, Cryptosporidium parvum
VLTLPIPNRRELFELENYPSDLNQN

SEQ ID NO: 2306304 - protein, 18 aa, Cryptosporidium parvum
VLTMWYRAPEILLGIDKY

SEQ ID NO: 2306305 - protein, 17 aa, Cryptosporidium parvum
VLTVSFHKFGEFFPGTG

SEQ ID NO: 2306306 - protein, 17 aa, Cryptosporidium parvum
VLVKPWNGNRFMFPRGK

SEQ ID NO: 2306307 - protein, 31 aa, Cryptosporidium parvum
VLVKVRDWCGSCLLDLIRRCQRLASQSSEMG

SEQ ID NO: 2306308 - protein, 33 aa, Cryptosporidium parvum; identical to SEQ ID NO: 2183549

SEQ ID NO: 2306309 - protein, 22 aa, Cryptosporidium parvum
VLYDRDHYKLALGHISGSKNII

SEQ ID NO: 2306310 - protein, 28 aa, Cryptosporidium parvum
VLYELTCLKPPFSGDSLLSLAWKISFQE

SEQ ID NO: 2306311 - protein, 17 aa, Cryptosporidium parvum
VLYKASYIYIQRVENPQ

SEQ ID NO: 2306312 - protein, 18 aa, Cryptosporidium parvum
VMACKRQAEEYGDASNTV

SEQ ID NO: 2306313 - protein, 23 aa, Cryptosporidium parvum
VMADPAGGMSFMPNVAKPVGGHV

SEQ ID NO: 2306314 - protein, 19 aa, Cryptosporidium parvum
VMENYRPGAIVLQCGADSL

SEQ ID NO: 2306315 - protein, 19 aa, Cryptosporidium parvum
VMGVSWDPKDEFIASQSSD

SEQ ID NO: 2306316 - protein, 18 aa, Cryptosporidium parvum
VMKCEIDRILRLESGGVI

SEQ ID NO: 2306317 - protein, 19 aa, Cryptosporidium parvum
VMKICKLYLKILKQAKPTK

SEQ ID NO: 2306318 - protein, 19 aa, Cryptosporidium parvum
VMLGGAFPFDERKGNLERL

SEQ ID NO: 2306319 - protein, 17 aa, Cryptosporidium parvum
VMLLACRKLEKQIEEQQ

SEQ ID NO: 2306320 - protein, 20 aa, Cryptosporidium parvum
VMMCDKKSGIGRGFGFVTFT

SEQ ID NO: 2306321 - protein, 17 aa, Cryptosporidium parvum
VMMFFIYADRWNMKPLS

SEQ ID NO: 2306322 - protein, 25 aa, Cryptosporidium parvum
VMMFPEYLRSGLTLPKGLAPIQPNE

SEQ ID NO: 2306323 - protein, 19 aa, Cryptosporidium parvum
VMNRWKKLAKYTIENDDDI

SEQ ID NO: 2306324 - protein, 17 aa, Cryptosporidium parvum
VMQDVQEHFKRASQTIL

SEQ ID NO: 2306325 - protein, 26 aa, Cryptosporidium parvum
VMSHVLKCEADFRLLAITLNSLNFNF

SEQ ID NO: 2306326 - protein, 21 aa, Cryptosporidium parvum
VMTRHRFGHVQFWEVTNKQRY

SEQ ID NO: 2306327 - protein, 18 aa, Cryptosporidium parvum
VNCISWNPFSENLLLSGS

SEQ ID NO: 2306328 - protein, 18 aa, Cryptosporidium parvum
VNCRELMRSFGWDASDAF

SEQ ID NO: 2306329 - protein, 21 aa, Cryptosporidium parvum
VNDAMKINNEMLALSKSNNVC

SEQ ID NO: 2306330 - protein, 20 aa, Cryptosporidium parvum
VNDLKGIWFKDSDKIIKQEL

SEQ ID NO: 2306331 - protein, 24 aa, Cryptosporidium parvum
VNDLKWHPSSLSVFGSVSDDGTFA

SEQ ID NO: 2306332 - protein, 19 aa, Cryptosporidium parvum
VNDQFRLSGQFDEEILLYL

SEQ ID NO: 2306333 - protein, 24 aa, Cryptosporidium parvum
VNELGKFTGITTWLVVAQGDKYDK

SEQ ID NO: 2306334 - protein, 22 aa, Cryptosporidium parvum
VNELKYTFVLFSLFLSNSNLTE

SEQ ID NO: 2306335 - protein, 19 aa, Cryptosporidium parvum
VNFFDGFRTSHELQKIDMI

SEQ ID NO: 2306336 - protein, 25 aa, Cryptosporidium parvum
VNFRKEVHGTWFITLKTEDLTTKVA

SEQ ID NO: 2306337 - protein, 23 aa, Cryptosporidium parvum
VNGEVVLPLLELNKVKERFKDDN

SEQ ID NO: 2306338 - protein, 18 aa, Cryptosporidium parvum
VNIGLFLHIPFPSFEIFR

SEQ ID NO: 2306339 - protein, 22 aa, Cryptosporidium parvum
VNIIKRLLCRVPEVRMGCSATG

SEQ ID NO: 2306340 - protein, 23 aa, Cryptosporidium parvum
VNIKELICKAFSFLRNSIRFCDQ

SEQ ID NO: 2306341 - protein, 27 aa, Cryptosporidium parvum
VNIKNEIIWGFPIVPNITFIKGESNNF

SEQ ID NO: 2306342 - protein, 35 aa, Cryptosporidium parvum; identical to SEQ ID NO: 2183578

SEQ ID NO: 2306343 - protein, 24 aa, Cryptosporidium parvum
VNIYRLVSEWTIEESIFKKQLQKR

SEQ ID NO: 2306344 - protein, 19 aa, Cryptosporidium parvum
VNKAIIIQRVFRMALCRRQ

SEQ ID NO: 2306345 - protein, 27 aa, Cryptosporidium parvum
VNKAVDLLGLIPIYPVKNIKTFTNNLH

SEQ ID NO: 2306346 - protein, 23 aa, Cryptosporidium parvum
VNKCKLNESFYLLIENENNEETD

SEQ ID NO: 2306347 - protein, 29 aa, Cryptosporidium parvum
VNKGCEILEKMNINWNRPDDMLAEMLKTD

SEQ ID NO: 2306348 - protein, 46 aa, Cryptosporidium parvum
VNKHFPLERFIRLIVFCMEWGMRYLMCPGKVETCLALIDMKGVSLT

SEQ ID NO: 2306349 - protein, 24 aa, Cryptosporidium parvum
VNKRLLYKGKVVKIIDYEKEGNEI

SEQ ID NO: 2306350 - protein, 22 aa, Cryptosporidium parvum
VNKRMIFLIDYCKLHPDDDISP

SEQ ID NO: 2306351 - protein, 19 aa, Cryptosporidium parvum
VNKTGIPLEICFINENNIP

SEQ ID NO: 2306352 - protein, 25 aa, Cryptosporidium parvum
VNKVFDFRPGILIKQLNLKSPIFKK

SEQ ID NO: 2306353 - protein, 17 aa, Cryptosporidium parvum
VNLGGFTEADWYKKIPN

SEQ ID NO: 2306354 - protein, 18 aa, Cryptosporidium parvum
VNLLRFLIWHIISEKEEA

SEQ ID NO: 2306355 - protein, 17 aa, Cryptosporidium parvum
VNLYIKNIPSFYQFQVV

SEQ ID NO: 2306356 - protein, 17 aa, Cryptosporidium parvum
VNNCLVSLSIDIDSNNS

SEQ ID NO: 2306357 - protein, 18 aa, Cryptosporidium parvum
VNNKLKRAFINSGELDYR

SEQ ID NO: 2306358 - protein, 23 aa, Cryptosporidium parvum
VNNLDGLCIGSRNIRVNAVIQKN

SEQ ID NO: 2306359 - protein, 25 aa, Cryptosporidium parvum
VNNNCRSLFLSHCFGQKGKFQEAFV

SEQ ID NO: 2306360 - protein, 23 aa, Cryptosporidium parvum
VNQKAKWIVRAPCSGTITSKKLT

SEQ ID NO: 2306361 - protein, 17 aa, Cryptosporidium parvum
VNQRVGLHLSLTRNHHI

SEQ ID NO: 2306362 - protein, 22 aa, Cryptosporidium parvum
VNQRYSSLFGYDITVLQLFVEC

SEQ ID NO: 2306363 - protein, 25 aa, Cryptosporidium parvum
VNRFEFRGPKSLNFIESFRLKRPLS

SEQ ID NO: 2306364 - protein, 20 aa, Cryptosporidium parvum
VNRFPNLIKLSWNSSPINYY

SEQ ID NO: 2306365 - protein, 27 aa, Cryptosporidium parvum
VNRNDLRVHPDFRLLYQSSAPFQETNN

SEQ ID NO: 2306366 - protein, 33 aa, Cryptosporidium parvum
VNSDEMLLELGIHYPIPLPKPWDELLLEDVCLT

SEQ ID NO: 2306367 - protein, 17 aa, Cryptosporidium parvum
VNSKIIIENMNKYLMLH

SEQ ID NO: 2306368 - protein, 24 aa, Cryptosporidium parvum
VNSLDWSRCDRFLLTASNDMTVRL

SEQ ID NO: 2306369 - protein, 29 aa, Cryptosporidium parvum
VNSRISKVPVIMFSPSIINFRRFTFSRME

SEQ ID NO: 2306370 - protein, 19 aa, Cryptosporidium parvum
VNSTLDLFSRFCKDDLDIL

SEQ ID NO: 2306371 - protein, 20 aa, Cryptosporidium parvum
VNSVGSLSSYGSRKHFSEEP

SEQ ID NO: 2306372 - protein, 21 aa, Cryptosporidium parvum
VNSYCRIFPKGLFINELLAEL

SEQ ID NO: 2306373 - protein, 25 aa, Cryptosporidium parvum
VNTETVFDSGMKIQKTVNKTSTEDV

SEQ ID NO: 2306374 - protein, 23 aa, Cryptosporidium parvum
VNTPFINKINCDYVSNNRKISND

SEQ ID NO: 2306375 - protein, 30 aa, Cryptosporidium parvum
VNTWKPRYFRLYPGILCYIKGSKIRKINIP

SEQ ID NO: 2306376 - protein, 25 aa, Cryptosporidium parvum
VNVADCLACSGCVTSAEAKLLEDQN

SEQ ID NO: 2306377 - protein, 18 aa, Cryptosporidium parvum
VNVFKRRNIEAVEFSAMG

SEQ ID NO: 2306378 - protein, 23 aa, Cryptosporidium parvum
VNVHKGAALLSTFSSDPTFKKNC

SEQ ID NO: 2306379 - protein, 18 aa, Cryptosporidium parvum
VNVLKLILQFLLESGLLE

SEQ ID NO: 2306380 - protein, 23 aa, Cryptosporidium parvum
VNVRSVLMMTRIVYSYMKKRDRG

SEQ ID NO: 2306381 - protein, 24 aa, Cryptosporidium parvum
VNWAKEFIMDLYIFSERKKNEMLH

SEQ ID NO: 2306382 - protein, 25 aa, Cryptosporidium parvum
VNYLKYLLYWCEFPYVKYISYPHCI

SEQ ID NO: 2306383 - protein, 17 aa, Cryptosporidium parvum
VNYSAVFHYQGQKVGVV

SEQ ID NO: 2306384 - protein, 22 aa, Cryptosporidium parvum
VNYTCWYEGVFNYLSNNLHSIL

SEQ ID NO: 2306385 - protein, 22 aa, Cryptosporidium parvum
VPAFSGKFAFLPQPPLDGSSST

SEQ ID NO: 2306386 - protein, 17 aa, Cryptosporidium parvum
VPAGILIEKFAQQLKKG

SEQ ID NO: 2306387 - protein, 25 aa, Cryptosporidium parvum
VPATGRSKVGFLRMFTEDIMDIAKH

SEQ ID NO: 2306388 - protein, 17 aa, Cryptosporidium parvum
VPCKLNMDLESLFYYFS

SEQ ID NO: 2306389 - protein, 18 aa, Cryptosporidium parvum
VPDSKIISSYEAFSDKDI

SEQ ID NO: 2306390 - protein, 19 aa, Cryptosporidium parvum
VPEELQRHFEIYDGIEGVL

SEQ ID NO: 2306391 - protein, 25 aa, Cryptosporidium parvum
VPESRLSSTRITYFGGRSKTGSDSD

SEQ ID NO: 2306392 - protein, 22 aa, Cryptosporidium parvum
VPIETSEILINWRESISQEAKS

SEQ ID NO: 2306393 - protein, 19 aa, Cryptosporidium parvum
VPIEYSHLISFKKIVNDLL

SEQ ID NO: 2306394 - protein, 26 aa, Cryptosporidium parvum
VPIFKEFTFFLSLRRSLLELRKKIWR

SEQ ID NO: 2306395 - protein, 17 aa, Cryptosporidium parvum
VPIIISNYFLQESSQIL

SEQ ID NO: 2306396 - protein, 17 aa, Cryptosporidium parvum
VPIIPMILVNGTDGIGT

SEQ ID NO: 2306397 - protein, 18 aa, Cryptosporidium parvum
VPIKENLDDFSIGNTDLR

SEQ ID NO: 2306398 - protein, 19 aa, Cryptosporidium parvum
VPIPGRIIPVPVEVEVEKI

SEQ ID NO: 2306399 - protein, 17 aa, Cryptosporidium parvum
VPKGPMVLFCYFLGKLY

SEQ ID NO: 2306400 - protein, 17 aa, Cryptosporidium parvum
VPKQEIQYVDKFVEVPE

SEQ ID NO: 2306401 - protein, 17 aa, Cryptosporidium parvum
VPLAVGFGEACKIASSE

SEQ ID NO: 2306402 - protein, 24 aa, Cryptosporidium parvum
VPLDLRGSVPIQIHQPPQIPLSQP

SEQ ID NO: 2306403 - protein, 20 aa, Cryptosporidium parvum
VPLGGPRAAIVVKKCKNAIQ

SEQ ID NO: 2306404 - protein, 18 aa, Cryptosporidium parvum
VPLKASVTKLALICNNEE

SEQ ID NO: 2306405 - protein, 21 aa, Cryptosporidium parvum
VPLTRRLNVVYIPSTTAVLVH

SEQ ID NO: 2306406 - protein, 23 aa, Cryptosporidium parvum
VPLYCLYCHKLLEGHTSGSIQNV

SEQ ID NO: 2306407 - protein, 17 aa, Cryptosporidium parvum
VPLYKYIAELAGNDTNN

SEQ ID NO: 2306408 - protein, 19 aa, Cryptosporidium parvum
VPMSYNWGPNYTNIQLIPL

SEQ ID NO: 2306409 - protein, 22 aa, Cryptosporidium parvum
VPNELRLLSKEALLDKIAVLLA

SEQ ID NO: 2306410 - protein, 22 aa, Cryptosporidium parvum
VPNPSTLVCYGFDGKYSIWELE

SEQ ID NO: 2306411 - protein, 24 aa, Cryptosporidium parvum
VPNREAFRPITIQDFNLSLKLVKP

SEQ ID NO: 2306412 - protein, 22 aa, Cryptosporidium parvum
VPNYYRPYIWMQLSGANDLKNS

SEQ ID NO: 2306413 - protein, 26 aa, Cryptosporidium parvum
VPPFNWSWKEIKDMLSSDFSLSHDTW

SEQ ID NO: 2306414 - protein, 26 aa, Cryptosporidium parvum
VPPNEFTECLQPCPLETPKLDFHEQN

SEQ ID NO: 2306415 - protein, 22 aa, Cryptosporidium parvum
VPPTLFASDNFLHWLKEFNNEV

SEQ ID NO: 2306416 - protein, 19 aa, Cryptosporidium parvum
VPQFKEIVLTEFITDAISK

SEQ ID NO: 2306417 - protein, 23 aa, Cryptosporidium parvum
VPQSLKRRFYMQIQFVKYMEKHI

SEQ ID NO: 2306418 - protein, 23 aa, Cryptosporidium parvum
VPREKCSYLLFILTPSENDKDLT

SEQ ID NO: 2306419 - protein, 19 aa, Cryptosporidium parvum
VPSTISLSLSYVYRNAVEA

SEQ ID NO: 2306420 - protein, 36 aa, Cryptosporidium parvum
VPTFCNKAKLISCCNARLIPQIPRCDLTRHEDENLM

SEQ ID NO: 2306421 - protein, 18 aa, Cryptosporidium parvum
VPTGEGKTLCYVIPIANY

SEQ ID NO: 2306422 - protein, 17 aa, Cryptosporidium parvum
VPTGVKHLHRKAEEYDI

SEQ ID NO: 2306423 - protein, 25 aa, Cryptosporidium parvum
VPTIKIKLLYSYSQVIQKEWITSIS

SEQ ID NO: 2306424 - protein, 37 aa, Cryptosporidium parvum; identical to SEQ ID NO: 2183635

SEQ ID NO: 2306425 - protein, 23 aa, Cryptosporidium parvum
VPVERLRCKNVYDLPSLPILDIT

SEQ ID NO: 2306426 - protein, 17 aa, Cryptosporidium parvum
VPVRRVNPAYIIATSTK

SEQ ID NO: 2306427 - protein, 25 aa, Cryptosporidium parvum
VPWPTFKCRGKPCVDGYFAVGRGEL

SEQ ID NO: 2306428 - protein, 20 aa, Cryptosporidium parvum
VPYMVPKPFVVPVHVPVLEF

SEQ ID NO: 2306429 - protein, 21 aa, Cryptosporidium parvum
VPYSIAMTLTYPEVVTPYNIE

SEQ ID NO: 2306430 - protein, 25 aa, Cryptosporidium parvum
VPYTFRPESILSYFKDIYEEYDYFI

SEQ ID NO: 2306431 - protein, 25 aa, Cryptosporidium parvum
VQDANCIVLFGFKTAFGGGRSSGFC

SEQ ID NO: 2306432 - protein, 31 aa, Cryptosporidium parvum; identical to SEQ ID NO: 2183647

SEQ ID NO: 2306433 - protein, 39 aa, Cryptosporidium parvum
VQDKDPFVGYGFLPYIVKMVWEKVRAALEGDLDIIETIK

SEQ ID NO: 2306434 - protein, 25 aa, Cryptosporidium parvum
VQDKFRIPALISLLLSRTGSGKRTV

SEQ ID NO: 2306435 - protein, 22 aa, Cryptosporidium parvum
VQDRINILPLKFKSLNDKLYSL

SEQ ID NO: 2306436 - protein, 23 aa, Cryptosporidium parvum
VQEEAKTCLWEYSAEVREVFLRM

SEQ ID NO: 2306437 - protein, 24 aa, Cryptosporidium parvum
VQELICSYAALVLSDGGVPVTSEN

SEQ ID NO: 2306438 - protein, 23 aa, Cryptosporidium parvum
VQEWCSLGIRTLEEVKRYEEEKK

SEQ ID NO: 2306439 - protein, 22 aa, Cryptosporidium parvum
VQFNACNNIESILECEEPKKYK

SEQ ID NO: 2306440 - protein, 25 aa, Cryptosporidium parvum
VQGGTCAIPGAFGCGKTCISQALSK

SEQ ID NO: 2306441 - protein, 23 aa, Cryptosporidium parvum
VQHIMVALDMLMRIYNNREFPLV

SEQ ID NO: 2306442 - protein, 22 aa, Cryptosporidium parvum
VQHLRYKLKMDDLRKIYSNLHI

SEQ ID NO: 2306443 - protein, 23 aa, Cryptosporidium parvum
VQIESRRGFRQCETYELELELKP

SEQ ID NO: 2306444 - protein, 19 aa, Cryptosporidium parvum
VQKRSGFSGCIMNTLTCSK

SEQ ID NO: 2306445 - protein, 30 aa, Cryptosporidium parvum
VQLFPTASCLVHLLEFPPFVLSLDEIEVVS

SEQ ID NO: 2306446 - protein, 20 aa, Cryptosporidium parvum
VQLQCIKSFCIIAETESGAK

SEQ ID NO: 2306447 - protein, 36 aa, Cryptosporidium parvum; identical to SEQ ID NO: 2183663

SEQ ID NO: 2306448 - protein, 18 aa, Cryptosporidium parvum
VQNLISFKIDGMVSKNEC

SEQ ID NO: 2306449 - protein, 20 aa, Cryptosporidium parvum
VQNLRIAVERALKSQVTGIV

SEQ ID NO: 2306450 - protein, 32 aa, Cryptosporidium parvum; identical to SEQ ID NO: 2183664

SEQ ID NO: 2306451 - protein, 23 aa, Cryptosporidium parvum
VQNSSFIPTWAWPASLRNNEDLK

SEQ ID NO: 2306452 - protein, 27 aa, Cryptosporidium parvum
VQQDPRILPELLVRIGQSNPEILQLIT

SEQ ID NO: 2306453 - protein, 37 aa, Cryptosporidium parvum; identical to SEQ ID NO: 2183668

SEQ ID NO: 2306454 - protein, 23 aa, Cryptosporidium parvum
VQRFTFPNDWIWVEQFEGEYDKS

SEQ ID NO: 2306455 - protein, 29 aa, Cryptosporidium parvum
VQRIRTPLRYRSSLLGALSNRTNSSCRIL

SEQ ID NO: 2306456 - protein, 22 aa, Cryptosporidium parvum
VQRKWKCHLSVEQEKVEKIASQ

SEQ ID NO: 2306457 - protein, 36 aa, Cryptosporidium parvum
VQSESYLGIPIWRFYGRCTQCGNEIVFKTDPKSGDY

SEQ ID NO: 2306458 - protein, 20 aa, Cryptosporidium parvum
VQSLAKWKRYALKKYELNGL

SEQ ID NO: 2306459 - protein, 23 aa, Cryptosporidium parvum
VQSQESFFYRLILETNQDKGFLT

SEQ ID NO: 2306460 - protein, 18 aa, Cryptosporidium parvum
VQTACIRSNIPLDNVGIY

SEQ ID NO: 2306461 - protein, 17 aa, Cryptosporidium parvum
VQYRMHPQISAFPSKHF

SEQ ID NO: 2306462 - protein, 25 aa, Cryptosporidium parvum
VRAICRDWWIFSLKYYRNIKYKDNK

SEQ ID NO: 2306463 - protein, 21 aa, Cryptosporidium parvum
VRAKASLHLVAHRGASYFVPE

SEQ ID NO: 2306464 - protein, 20 aa, Cryptosporidium parvum
VRAMPTFKFFLNGKEVKSVV

SEQ ID NO: 2306465 - protein, 23 aa, Cryptosporidium parvum
VRASVNCFCVPKGSVYNQLVDQF

SEQ ID NO: 2306466 - protein, 21 aa, Cryptosporidium parvum
VRDDFNFDKGYQFNRNQFEYY

SEQ ID NO: 2306467 - protein, 19 aa, Cryptosporidium parvum
VRDRALIYWRLLSTNPEET

SEQ ID NO: 2306468 - protein, 23 aa, Cryptosporidium parvum
VRDRLPSILLELWNGEEYLGEYL

SEQ ID NO: 2306469 - protein, 23 aa, Cryptosporidium parvum
VRDTCAWTIGRIVTFHPTIIFPL

SEQ ID NO: 2306470 - protein, 17 aa, Cryptosporidium parvum
VRDVFRLARENSPAIVF

SEQ ID NO: 2306471 - protein, 22 aa, Cryptosporidium parvum
VREEAKLITACKVYTNELESDK

SEQ ID NO: 2306472 - protein, 18 aa, Cryptosporidium parvum
VREQEHWCSRWLGHKQEV

SEQ ID NO: 2306473 - protein, 26 aa, Cryptosporidium parvum
VREWSGREIGSCICCHLIYEDEMNVY

SEQ ID NO: 2306474 - protein, 31 aa, Cryptosporidium parvum
VRFPTLKAKDWRKILPEGTPSLAIDLLEQIL

SEQ ID NO: 2306475 - protein, 17 aa, Cryptosporidium parvum
VRGDTIIFRDFRGEKSL

SEQ ID NO: 2306476 - protein, 23 aa, Cryptosporidium parvum
VRGISKLAFFSSMSSIAKKRPAY

SEQ ID NO: 2306477 - protein, 23 aa, Cryptosporidium parvum
VRGNTHWKSVVFNHLDDRCFVAW

SEQ ID NO: 2306478 - protein, 20 aa, Cryptosporidium parvum
VRGPNIICGILTRKGLLSAY

SEQ ID NO: 2306479 - protein, 27 aa, Cryptosporidium parvum
VRGSHECPICRSLLKEELWLSKSDQLV

SEQ ID NO: 2306480 - protein, 18 aa, Cryptosporidium parvum
VRHEAGEAIAAIGDDESL

SEQ ID NO: 2306481 - protein, 25 aa, Cryptosporidium parvum
VRIEPEERIRMGIFDDSLVESDVKF

SEQ ID NO: 2306482 - protein, 20 aa, Cryptosporidium parvum
VRIGKFILDTWYFSPLPDEY

SEQ ID NO: 2306483 - protein, 22 aa, Cryptosporidium parvum
VRIIKETLCYIAKDPAAENERP

SEQ ID NO: 2306484 - protein, 30 aa, Cryptosporidium parvum
VRIIRRCIEFYKIEAIIPLIIKFLSGQVKS

SEQ ID NO: 2306485 - protein, 27 aa, Cryptosporidium parvum
VRIKSLGMTPSRFESSIGNLSSNNNKL

SEQ ID NO: 2306486 - protein, 26 aa, Cryptosporidium parvum
VRISEAWKCKFCNVIEYCQVCPLSKE

SEQ ID NO: 2306487 - protein, 21 aa, Cryptosporidium parvum
VRISSDLSRVIWAPKKWESVG

SEQ ID NO: 2306488 - protein, 20 aa, Cryptosporidium parvum
VRIYLDFEWLTILRSVKANI

SEQ ID NO: 2306489 - protein, 26 aa, Cryptosporidium parvum
VRKGKKICVLDCSVFGRFNAIIPEGM

SEQ ID NO: 2306490 - protein, 22 aa, Cryptosporidium parvum
VRKGPFKTVFVSESIKDLDYTS

SEQ ID NO: 2306491 - protein, 23 aa, Cryptosporidium parvum
VRKKVCIFLSDLLAVYKNNVSLH

SEQ ID NO: 2306492 - protein, 18 aa, Cryptosporidium parvum
VRKLRDFGILEAIENALK

SEQ ID NO: 2306493 - protein, 22 aa, Cryptosporidium parvum
VRKRKDKKLSDEEYKNQIDNGE

SEQ ID NO: 2306494 - protein, 17 aa, Cryptosporidium parvum
VRLKKLIENGSLLKLSG

SEQ ID NO: 2306495 - protein, 20 aa, Cryptosporidium parvum
VRLLEPFGRIVAPNIGTLFQ

SEQ ID NO: 2306496 - protein, 19 aa, Cryptosporidium parvum
VRLPIAASMSLILATALSC

SEQ ID NO: 2306497 - protein, 22 aa, Cryptosporidium parvum
VRMCKDIKHIVYYRFNTGSVGK

SEQ ID NO: 2306498 - protein, 25 aa, Cryptosporidium parvum
VRMKEFKSNFNSIKSFQYSILKFEK

SEQ ID NO: 2306499 - protein, 24 aa, Cryptosporidium parvum
VRNSCLTVNFGEIFMDFTRQNLDE

SEQ ID NO: 2306500 - protein, 21 aa, Cryptosporidium parvum
VRPFGCSILLGGLDQDRGVEL

SEQ ID NO: 2306501 - protein, 19 aa, Cryptosporidium parvum
VRPKVPILPGTKIKRKKRS

SEQ ID NO: 2306502 - protein, 25 aa, Cryptosporidium parvum
VRQFIKIRFPFVLVLNKADIMSESS

SEQ ID NO: 2306503 - protein, 22 aa, Cryptosporidium parvum
VRQILCGNGFNIICTQNLFIWG

SEQ ID NO: 2306504 - protein, 19 aa, Cryptosporidium parvum
VRRDRVVFLGSPPELPERV

SEQ ID NO: 2306505 - protein, 20 aa, Cryptosporidium parvum
VRREIPGIPADVSIACVEQE

SEQ ID NO: 2306506 - protein, 30 aa, Cryptosporidium parvum
VRRNSMRGRRRYRRTLLRNYEQPLGQNSHG

SEQ ID NO: 2306507 - protein, 17 aa, Cryptosporidium parvum
VRRVFAWHPLTKSYSPC

SEQ ID NO: 2306508 - protein, 26 aa, Cryptosporidium parvum
VRRVRTRISPELVVGETCIEIIGEKE

SEQ ID NO: 2306509 - protein, 21 aa, Cryptosporidium parvum
VRSATSFAFQRHIDMGDMTKP

SEQ ID NO: 2306510 - protein, 18 aa, Cryptosporidium parvum
VRSIYKFKGQVHDENEVM

SEQ ID NO: 2306511 - protein, 18 aa, Cryptosporidium parvum
VRSSKPLQVKSHRNDLPI

SEQ ID NO: 2306512 - protein, 20 aa, Cryptosporidium parvum
VRTAESFNKVMVEFEAVIGL

SEQ ID NO: 2306513 - protein, 20 aa, Cryptosporidium parvum
VRTIKYFPKKSEFFVNKVSY

SEQ ID NO: 2306514 - protein, 18 aa, Cryptosporidium parvum
VRTNASKVVSCFNKNSGL

SEQ ID NO: 2306515 - protein, 25 aa, Cryptosporidium parvum
VRTSNELCCLIQCFKNAPLKYIPIC

SEQ ID NO: 2306516 - protein, 23 aa, Cryptosporidium parvum
VRVLRFVSISGVEELVLKRAQKK

SEQ ID NO: 2306517 - protein, 25 aa, Cryptosporidium parvum
VRYLPRSAKWFIIMKNRVWQWSGDE

SEQ ID NO: 2306518 - protein, 18 aa, Cryptosporidium parvum
VSCCPMEMIHRRRHSLSY

SEQ ID NO: 2306519 - protein, 17 aa, Cryptosporidium parvum
VSCSQGGCKENQDGWFV

SEQ ID NO: 2306520 - protein, 20 aa, Cryptosporidium parvum
VSDERRLSIQSSVNGVLGSS

SEQ ID NO: 2306521 - protein, 27 aa, Cryptosporidium parvum
VSDLLICPICEGFFRGATTIRECLHTF

SEQ ID NO: 2306522 - protein, 19 aa, Cryptosporidium parvum
VSDVEFSPFYSCLLVSASQ

SEQ ID NO: 2306523 - protein, 23 aa, Cryptosporidium parvum
VSECIRHNLLYSYPVITERQGEY

SEQ ID NO: 2306524 - protein, 24 aa, Cryptosporidium parvum
VSEFIIELMQKWDSKLCELQYHHL

SEQ ID NO: 2306525 - protein, 25 aa, Cryptosporidium parvum
VSEFIPEIIDFISTIISRGFAYESE

SEQ ID NO: 2306526 - protein, 22 aa, Cryptosporidium parvum
VSEKSILRYAYLKKQAVENKVK

SEQ ID NO: 2306527 - protein, 25 aa, Cryptosporidium parvum
VSEQGRLGKRFSILELSKEAKEILS

SEQ ID NO: 2306528 - protein, 23 aa, Cryptosporidium parvum
VSERLKVNMLLFDYPGYGKYEGR

SEQ ID NO: 2306529 - protein, 17 aa, Cryptosporidium parvum
VSEWENGLTKRGINISI

SEQ ID NO: 2306530 - protein, 17 aa, Cryptosporidium parvum
VSFDKWNLMEFVKGIIC

SEQ ID NO: 2306531 - protein, 40 aa, Cryptosporidium parvum
VSGKAYTGPEIDVWSCGVILYALLCGSLPFDDENVGNLFR

SEQ ID NO: 2306532 - protein, 20 aa, Cryptosporidium parvum
VSGKLVRWLIQNGGQGEKGQ

SEQ ID NO: 2306533 - protein, 19 aa, Cryptosporidium parvum
VSGKTGLVVYSHMIQEYLI

SEQ ID NO: 2306534 - protein, 23 aa, Cryptosporidium parvum
VSGLPGLRVKCLILNQLMEKELH

SEQ ID NO: 2306535 - protein, 22 aa, Cryptosporidium parvum
VSGLQLKVLRPFNQESKLILNW

SEQ ID NO: 2306536 - protein, 25 aa, Cryptosporidium parvum
VSGNLKRIIKIVLFTLKSSNYEWIF

SEQ ID NO: 2306537 - protein, 17 aa, Cryptosporidium parvum
VSGRFSRCFGNNIEGRI

SEQ ID NO: 2306538 - protein, 28 aa, Cryptosporidium parvum
VSGRNKMDFPFDMPSNYSSKYGMKPDGN

SEQ ID NO: 2306539 - protein, 19 aa, Cryptosporidium parvum
VSHGFKATSLHGGKMQEVR

SEQ ID NO: 2306540 - protein, 18 aa, Cryptosporidium parvum
VSHVACYGVNIPLNELLD

SEQ ID NO: 2306541 - protein, 25 aa, Cryptosporidium parvum
VSIESIIKLIFLLWSITKNEVEIYS

SEQ ID NO: 2306542 - protein, 17 aa, Cryptosporidium parvum
VSIGEYLLNIVVTLEST

SEQ ID NO: 2306543 - protein, 31 aa, Cryptosporidium parvum; identical to SEQ ID NO: 2183746

SEQ ID NO: 2306544 - protein, 18 aa, Cryptosporidium parvum
VSISMPIDSSITLNPNQH

SEQ ID NO: 2306545 - protein, 25 aa, Cryptosporidium parvum
VSIVPRTGGALGFAQMVPNELRLLS

SEQ ID NO: 2306546 - protein, 18 aa, Cryptosporidium parvum
VSIYIYKLIFSQIDKDQT

SEQ ID NO: 2306547 - protein, 24 aa, Cryptosporidium parvum
VSKKKCRETNEILAKYVNDLASEY

SEQ ID NO: 2306548 - protein, 23 aa, Cryptosporidium parvum
VSKKYLEGFARTFDPMRSLFREN

SEQ ID NO: 2306549 - protein, 20 aa, Cryptosporidium parvum
VSKNFICSFSSLKVNLDPGY

SEQ ID NO: 2306550 - protein, 18 aa, Cryptosporidium parvum
VSKNFLLVCSRIFCYQMI

SEQ ID NO: 2306551 - protein, 20 aa, Cryptosporidium parvum
VSKPSWDGGRLVKLLQGHGL

SEQ ID NO: 2306552 - protein, 19 aa, Cryptosporidium parvum
VSKSEVIRLFKAVNTDSID

SEQ ID NO: 2306553 - protein, 26 aa, Cryptosporidium parvum
VSLDHMKWMRGIWNLISFKIFGNSSS

SEQ ID NO: 2306554 - protein, 18 aa, Cryptosporidium parvum
VSLNNEFLLEKEMITDML

SEQ ID NO: 2306555 - protein, 18 aa, Cryptosporidium parvum
VSLNYICNNCNKLSNKIS

SEQ ID NO: 2306556 - protein, 20 aa, Cryptosporidium parvum
VSLRMKVMHLCRQKELNISQ

SEQ ID NO: 2306557 - protein, 21 aa, Cryptosporidium parvum
VSLRSRLTLYIPQENGDTLQT

SEQ ID NO: 2306558 - protein, 17 aa, Cryptosporidium parvum
VSLVFTLQFENNQEIVF

SEQ ID NO: 2306559 - protein, 28 aa, Cryptosporidium parvum
VSMLPCICLDPKPGHFVLDLCSAPGSKS

SEQ ID NO: 2306560 - protein, 19 aa, Cryptosporidium parvum
VSMPKERWFGYIKDYDGGT

SEQ ID NO: 2306561 - protein, 20 aa, Cryptosporidium parvum
VSNELVHWGKFDDDYCSRLS

SEQ ID NO: 2306562 - protein, 26 aa, Cryptosporidium parvum
VSNEVLPSWILEKFFVDGGFNVISRL

SEQ ID NO: 2306563 - protein, 25 aa, Cryptosporidium parvum
VSNSIKNLFSLVVLKYCFNRDDQVK

SEQ ID NO: 2306564 - protein, 18 aa, Cryptosporidium parvum
VSNSVWGITDFKRILIDL

SEQ ID NO: 2306565 - protein, 17 aa, Cryptosporidium parvum
VSPDLFSIFDFITQEFI

SEQ ID NO: 2306566 - protein, 22 aa, Cryptosporidium parvum
VSPEYVKRVFSLFDINNTGKVG

SEQ ID NO: 2306567 - protein, 20 aa, Cryptosporidium parvum
VSPNFVFKFENNFSDLDMKS

SEQ ID NO: 2306568 - protein, 19 aa, Cryptosporidium parvum
VSQFDCILSTFFKCKNICC

SEQ ID NO: 2306569 - protein, 32 aa, Cryptosporidium parvum; identical to SEQ ID NO: 2183767

SEQ ID NO: 2306570 - protein, 20 aa, Cryptosporidium parvum
VSRFGFVCSDSLSYAVVDCN

SEQ ID NO: 2306571 - protein, 34 aa, Cryptosporidium parvum
VSRTQKWLLRNVKLEDFKYLIRVDQLREENILRN

SEQ ID NO: 2306572 - protein, 33 aa, Cryptosporidium parvum
VSSDLVDWAQCELCKKWRKLPLGMNPNTLPEEW

SEQ ID NO: 2306573 - protein, 17 aa, Cryptosporidium parvum
VSSEAFADLRTNQQLAY

SEQ ID NO: 2306574 - protein, 22 aa, Cryptosporidium parvum
VSSKDFRLKRLLYASKSQLKNI

SEQ ID NO: 2306575 - protein, 26 aa, Cryptosporidium parvum
VSSKRYVCSGIRVLSGCLNNPYTRNY

SEQ ID NO: 2306576 - protein, 25 aa, Cryptosporidium parvum
VSSLESIPEFSARIERYKSLENTIL

SEQ ID NO: 2306577 - protein, 19 aa, Cryptosporidium parvum
VSSLICTYGSRILSKPDSS

SEQ ID NO: 2306578 - protein, 25 aa, Cryptosporidium parvum
VSSMTERGDLCWIMSGTDMLSGSQF

SEQ ID NO: 2306579 - protein, 30 aa, Cryptosporidium parvum
VSSRSHAIFQLSIFLERKKLFNISANNNPH

SEQ ID NO: 2306580 - protein, 26 aa, Cryptosporidium parvum
VSSSIKRTLKFLWAISKGLPIISPST

SEQ ID NO: 2306581 - protein, 34 aa, Cryptosporidium parvum; identical to SEQ ID NO: 2183773

SEQ ID NO: 2306582 - protein, 22 aa, Cryptosporidium parvum
VSSYFGVIFIITRGGILYIVEP

SEQ ID NO: 2306583 - protein, 23 aa, Cryptosporidium parvum
VSTGTSLFGSSLFQINKTSENSA

SEQ ID NO: 2306584 - protein, 17 aa, Cryptosporidium parvum
VSVDRDGRFTGIVSDEQ

SEQ ID NO: 2306585 - protein, 18 aa, Cryptosporidium parvum
VSVEPCEGNPDFKKLNSL

SEQ ID NO: 2306586 - protein, 26 aa, Cryptosporidium parvum
VSVLDFDVPFSLKFGAFDDLVKLVDD

SEQ ID NO: 2306587 - protein, 43 aa, Cryptosporidium parvum
VSVPVAIPAPGCIPIVGGCGTVGVGARQGGGIGDLQQLQQQQH

SEQ ID NO: 2306588 - protein, 27 aa, Cryptosporidium parvum
VSVVDPRTGRQLKVWDVAKSFSDSISA

SEQ ID NO: 2306589 - protein, 37 aa, Cryptosporidium parvum
VSYSFRNCLLYFSYHPEVWYEYFIFVWNSHPVQLTGM

SEQ ID NO: 2306590 - protein, 24 aa, Cryptosporidium parvum
VTAHKSCFIHYFIYNDINNRISNF

SEQ ID NO: 2306591 - protein, 18 aa, Cryptosporidium parvum
VTAHLIKQMLSAISYCHS

SEQ ID NO: 2306592 - protein, 20 aa, Cryptosporidium parvum
VTCEDWKNLSNWNVDRVKRS

SEQ ID NO: 2306593 - protein, 27 aa, Cryptosporidium parvum
VTCPNCTEIEYIKAHHIIDGPIIGLEW

SEQ ID NO: 2306594 - protein, 17 aa, Cryptosporidium parvum
VTDCSLCTYNISEETNE

SEQ ID NO: 2306595 - protein, 17 aa, Cryptosporidium parvum
VTDIICNSYEPYLSEVG

SEQ ID NO: 2306596 - protein, 25 aa, Cryptosporidium parvum
VTDNCLDFIWDVGISGPRGSESKIF

SEQ ID NO: 2306597 - protein, 21 aa, Cryptosporidium parvum
VTELHIKPGVDINVISTPTGP

SEQ ID NO: 2306598 - protein, 20 aa, Cryptosporidium parvum
VTELSYYIGVQVAFHSSFSK

SEQ ID NO: 2306599 - protein, 18 aa, Cryptosporidium parvum
VTEVGLQITMPIITLIAS

SEQ ID NO: 2306600 - protein, 21 aa, Cryptosporidium parvum
VTEVKERMQVLLNLVKTKEGS

SEQ ID NO: 2306601 - protein, 17 aa, Cryptosporidium parvum
VTEYIRTGDLFKLIHGN

SEQ ID NO: 2306602 - protein, 19 aa, Cryptosporidium parvum
VTGLLKFINKWYLPNNMCL

SEQ ID NO: 2306603 - protein, 17 aa, Cryptosporidium parvum
VTGSWDKTIKFWNGQSQ

SEQ ID NO: 2306604 - protein, 20 aa, Cryptosporidium parvum
VTHIYSFDAAMPIWMIKRFV

SEQ ID NO: 2306605 - protein, 24 aa, Cryptosporidium parvum
VTHPELKTTFYLDIVSIKKNPQSQ

SEQ ID NO: 2306606 - protein, 17 aa, Cryptosporidium parvum
VTINGELIDSSGTMTGG

SEQ ID NO: 2306607 - protein, 26 aa, Cryptosporidium parvum
VTIPIPRILQGLEVFNLTGRDLLQAS

SEQ ID NO: 2306608 - protein, 19 aa, Cryptosporidium parvum
VTIPLVRALTGFTCPVTTL

SEQ ID NO: 2306609 - protein, 19 aa, Cryptosporidium parvum
VTITPKFAASPPKPASGAA

SEQ ID NO: 2306610 - protein, 26 aa, Cryptosporidium parvum
VTLLEVFSKLSLRAKRNLFDFVEDKY

SEQ ID NO: 2306611 - protein, 17 aa, Cryptosporidium parvum
VTLPLKLFLNINSDEFD

SEQ ID NO: 2306612 - protein, 22 aa, Cryptosporidium parvum
VTLWYRCPELLFGSTKYTHAVD

SEQ ID NO: 2306613 - protein, 19 aa, Cryptosporidium parvum
VTPPEPKLLGTYINMVPIS

SEQ ID NO: 2306614 - protein, 19 aa, Cryptosporidium parvum
VTPSFHIKDLQVEFPENKD

SEQ ID NO: 2306615 - protein, 25 aa, Cryptosporidium parvum
VTQALYCTHWKNMYKQQIAVPNLEN

SEQ ID NO: 2306616 - protein, 29 aa, Cryptosporidium parvum
VTQVKSRVLWWVWPVKFLIFHLNNKYIVS

SEQ ID NO: 2306617 - protein, 21 aa, Cryptosporidium parvum
VTRKLSGPDFFDIIRSEHSSS

SEQ ID NO: 2306618 - protein, 22 aa, Cryptosporidium parvum
VTRLSVINMRLRACNLFLHKIE

SEQ ID NO: 2306619 - protein, 21 aa, Cryptosporidium parvum
VTRRMEARLSSSHSPWISKGS

SEQ ID NO: 2306620 - protein, 25 aa, Cryptosporidium parvum
VTSDILVRIARLFGFNTRFQTGTDE

SEQ ID NO: 2306621 - protein, 19 aa, Cryptosporidium parvum
VTSEVKFWSSYERSLQQIL

SEQ ID NO: 2306622 - protein, 25 aa, Cryptosporidium parvum
VTSPEEVFELMALGHKHRAVASTNM

SEQ ID NO: 2306623 - protein, 19 aa, Cryptosporidium parvum
VTTKPGLVTKMFKENQANV

SEQ ID NO: 2306624 - protein, 23 aa, Cryptosporidium parvum
VTTTPELPCYCFVIEASSMALQG

SEQ ID NO: 2306625 - protein, 23 aa, Cryptosporidium parvum
VTVEPCIMCIGFIDQMGIHNIFY

SEQ ID NO: 2306626 - protein, 18 aa, Cryptosporidium parvum
VTVGGWARTVRKQCSDTL

SEQ ID NO: 2306627 - protein, 25 aa, Cryptosporidium parvum
VTVIDICAFSIVFHSDIDEEECHSN

SEQ ID NO: 2306628 - protein, 18 aa, Cryptosporidium parvum
VVCSSHLQGKCKNSDSCP

SEQ ID NO: 2306629 - protein, 18 aa, Cryptosporidium parvum
VVELFSEDDMMNFSKLLE

SEQ ID NO: 2306630 - protein, 27 aa, Cryptosporidium parvum
VVETCGRSICNPCLQFSRVHDVSLFNS

SEQ ID NO: 2306631 - protein, 24 aa, Cryptosporidium parvum
VVETLNFLSAILLKGMPPKVKIQL

SEQ ID NO: 2306632 - protein, 21 aa, Cryptosporidium parvum
VVFVPVCLENSISHQMIETCI

SEQ ID NO: 2306633 - protein, 23 aa, Cryptosporidium parvum
VVGPWRRSLHGGQTVDSLETVRR

SEQ ID NO: 2306634 - protein, 36 aa, Cryptosporidium parvum
VVHGSNCNCTGCLKQGGRMGITTSMGLGMTPPGSIL

SEQ ID NO: 2306635 - protein, 18 aa, Cryptosporidium parvum
VVIIWDYLLANGLQSLIS

SEQ ID NO: 2306636 - protein, 31 aa, Cryptosporidium parvum
VVKEGFELLKKCSRSGCLLRKDTDIENKSLH

SEQ ID NO: 2306637 - protein, 17 aa, Cryptosporidium parvum
VVKETKETFVIISADNK

SEQ ID NO: 2306638 - protein, 24 aa, Cryptosporidium parvum
VVKKIKKAFCPPGIIEGNPCIEYI

SEQ ID NO: 2306639 - protein, 19 aa, Cryptosporidium parvum
VVKLADFGLARVFNTRNRM

SEQ ID NO: 2306640 - protein, 18 aa, Cryptosporidium parvum
VVKSRLKHILNIKKIFVG

SEQ ID NO: 2306641 - protein, 21 aa, Cryptosporidium parvum
VVKSYDCIRPKRSSIGDFDND

SEQ ID NO: 2306642 - protein, 22 aa, Cryptosporidium parvum
VVLDALDWSIEFPKPSDYIKRY

SEQ ID NO: 2306643 - protein, 18 aa, Cryptosporidium parvum
VVLFELLKRINFTDKSEF

SEQ ID NO: 2306644 - protein, 19 aa, Cryptosporidium parvum
VVMASSIGSNVYIGKNSII

SEQ ID NO: 2306645 - protein, 24 aa, Cryptosporidium parvum
VVQLFLEWFGMTYLENEEFKRSNK

SEQ ID NO: 2306646 - protein, 17 aa, Cryptosporidium parvum
VVRFSKDEFHEYQEPTI

SEQ ID NO: 2306647 - protein, 25 aa, Cryptosporidium parvum
VVSDKIGSLNIFWALPSAAKFSKEN

SEQ ID NO: 2306648 - protein, 18 aa, Cryptosporidium parvum
VVSGLCILGKSSIIDIDS

SEQ ID NO: 2306649 - protein, 18 aa, Cryptosporidium parvum
VVSKIEWKQGRDPTQEVV

SEQ ID NO: 2306650 - protein, 22 aa, Cryptosporidium parvum
VVSRKVLPKVCCLTRDVFKDPV

SEQ ID NO: 2306651 - protein, 18 aa, Cryptosporidium parvum
VVTPSGKQTIVFHMLPDC

SEQ ID NO: 2306652 - protein, 26 aa, Cryptosporidium parvum
VVTSFLMYEWDCIKDLARIERNFYSL

SEQ ID NO: 2306653 - protein, 21 aa, Cryptosporidium parvum
VVVGMSCSFPGGSSTPGEFWS

SEQ ID NO: 2306654 - protein, 27 aa, Cryptosporidium parvum
VVVIDEWDCSSFYPTGHIVGVLGKAGD

SEQ ID NO: 2306655 - protein, 27 aa, Cryptosporidium parvum
VVVMPWRTFRFNECACAPYNADFDGDE

SEQ ID NO: 2306656 - protein, 27 aa, Cryptosporidium parvum
VVVNSGVWPFGRIGLLNQSQDSSNSQV

SEQ ID NO: 2306657 - protein, 19 aa, Cryptosporidium parvum
VVVVPSLYLNQIIRMDYIM

SEQ ID NO: 2306658 - protein, 19 aa, Cryptosporidium parvum
VVWSSVIACDFSKQENDNE

SEQ ID NO: 2306659 - protein, 23 aa, Cryptosporidium parvum
VVYGGGCSEMLMSVSVDELSKRV

SEQ ID NO: 2306660 - protein, 19 aa, Cryptosporidium parvum
VWAPFLDWFASEKNFQVIL

SEQ ID NO: 2306661 - protein, 17 aa, Cryptosporidium parvum
VWDIRKASCGSAERACA

SEQ ID NO: 2306662 - protein, 19 aa, Cryptosporidium parvum
VWKHERRILHQGGNALELF

SEQ ID NO: 2306663 - protein, 24 aa, Cryptosporidium parvum
VWKSTKIFPKFKCLINNDRKSLSS

SEQ ID NO: 2306664 - protein, 19 aa, Cryptosporidium parvum
VWNMLGFASSRNISSIYKG

SEQ ID NO: 2306665 - protein, 24 aa, Cryptosporidium parvum
VWVKHPKLAWAPATILRREEQGFV

SEQ ID NO: 2306666 - protein, 27 aa, Cryptosporidium parvum
VWVNYKCTFWPAQIMEFSKEQFEVFIF

SEQ ID NO: 2306667 - protein, 20 aa, Cryptosporidium parvum
VWYQPPEILLRPGDSLDNPR

SEQ ID NO: 2306668 - protein, 18 aa, Cryptosporidium parvum
VYCTHGILINIIKSELMG

SEQ ID NO: 2306669 - protein, 30 aa, Cryptosporidium parvum; identical to SEQ ID NO: 2183850

SEQ ID NO: 2306670 - protein, 24 aa, Cryptosporidium parvum
VYELYCISLCKALYSENSGERIGA

SEQ ID NO: 2306671 - protein, 30 aa, Cryptosporidium parvum; identical to SEQ ID NO: 2183851

SEQ ID NO: 2306672 - protein, 34 aa, Cryptosporidium parvum
VYGCLVPCLKCCIYPCRAFFLTGRCISQKRRMKK

SEQ ID NO: 2306673 - protein, 28 aa, Cryptosporidium parvum
VYGIPLLCLRGSMPIWYYRKKKNMSLYA

SEQ ID NO: 2306674 - protein, 18 aa, Cryptosporidium parvum
VYHIKELMIKRELEKDER

SEQ ID NO: 2306675 - protein, 22 aa, Cryptosporidium parvum
VYIKRGNSLYFWDKLKYNNQSL

SEQ ID NO: 2306676 - protein, 34 aa, Cryptosporidium parvum; identical to SEQ ID NO: 2183857

SEQ ID NO: 2306677 - protein, 29 aa, Cryptosporidium parvum
VYKDELSSLTIIICWIEECLQNFVYPIQR

SEQ ID NO: 2306678 - protein, 17 aa, Cryptosporidium parvum
VYLKSYLSSLLIMNDNN

SEQ ID NO: 2306679 - protein, 24 aa, Cryptosporidium parvum
VYLLLKRYVDCVDDCRASLKENPK

SEQ ID NO: 2306680 - protein, 18 aa, Cryptosporidium parvum
VYLLNEFVHNVRGSHLRY

SEQ ID NO: 2306681 - protein, 18 aa, Cryptosporidium parvum
VYLTLPFMGSNTIIEKNQ

SEQ ID NO: 2306682 - protein, 25 aa, Cryptosporidium parvum
VYNFTIKSLEEWSVLPNSKHYLLGL

SEQ ID NO: 2306683 - protein, 27 aa, Cryptosporidium parvum
VYQIEEVRDSLGYQKKRLIPIDQDELF

SEQ ID NO: 2306684 - protein, 19 aa, Cryptosporidium parvum
VYRYFKAIKSITLLQQWWR

SEQ ID NO: 2306685 - protein, 22 aa, Cryptosporidium parvum
VYSFGIILWEMITKKIPHEDLN

SEQ ID NO: 2306686 - protein, 17 aa, Cryptosporidium parvum
VYVCVTHLLFASSKEKF

SEQ ID NO: 2306687 - protein, 25 aa, Cryptosporidium parvum
VYVLVAWTRRYMWVYCHDIKSFTEM

SEQ ID NO: 2306688 - protein, 17 aa, Cryptosporidium parvum
VYYLGFIDFFSTWSTIK

SEQ ID NO: 2306689 - protein, 18 aa, Cryptosporidium parvum
VYYPRAYMYNNIKHNLPD

SEQ ID NO: 2306690 - protein, 18 aa, Cryptosporidium parvum
WAASVLMVTKAFQVKQEY

SEQ ID NO: 2306691 - protein, 21 aa, Cryptosporidium parvum
WAHTLSSVWMLSRFYESFPIS

SEQ ID NO: 2306692 - protein, 18 aa, Cryptosporidium parvum
WAILTARICQLYPNAAPS

SEQ ID NO: 2306693 - protein, 19 aa, Cryptosporidium parvum
WAKSFGWSSYGNMKFMKDD

SEQ ID NO: 2306694 - protein, 30 aa, Cryptosporidium parvum; identical to SEQ ID NO: 2183877

SEQ ID NO: 2306695 - protein, 27 aa, Cryptosporidium parvum
WALWLEAILNLLKLIILTIQSFSSTGY

SEQ ID NO: 2306696 - protein, 18 aa, Cryptosporidium parvum
WCHLVELQIASLPASALP

SEQ ID NO: 2306697 - protein, 21 aa, Cryptosporidium parvum
WCKLYEILHYFRWHEYINEAE

SEQ ID NO: 2306698 - protein, 22 aa, Cryptosporidium parvum
WCPKIPKFIYHGNLNMRDEALK

SEQ ID NO: 2306699 - protein, 22 aa, Cryptosporidium parvum
WCQKIKNDFAFEYIHLDDTPIV

SEQ ID NO: 2306700 - protein, 30 aa, Cryptosporidium parvum
WCSDPLCRMWYDMTQFFGFLGEDIIDTDID

SEQ ID NO: 2306701 - protein, 25 aa, Cryptosporidium parvum
WCSVESYHGVYNCRMRCERSGQYLL

SEQ ID NO: 2306702 - protein, 19 aa, Cryptosporidium parvum
WDAILTCFFLDTAKNIITY

SEQ ID NO: 2306703 - protein, 23 aa, Cryptosporidium parvum
WDEDRFGLEYDLEIFNIVAVESF

SEQ ID NO: 2306704 - protein, 19 aa, Cryptosporidium parvum
WDFDISKFELSNCKSIEKI

SEQ ID NO: 2306705 - protein, 17 aa, Cryptosporidium parvum
WDGEKFDKVMGYFRKYA

SEQ ID NO: 2306706 - protein, 18 aa, Cryptosporidium parvum
WDHSWGCPGDFSDLPGLN

SEQ ID NO: 2306707 - protein, 27 aa, Cryptosporidium parvum
WDIAHSKIHICVVWKHERRILHQGGNA

SEQ ID NO: 2306708 - protein, 17 aa, Cryptosporidium parvum
WDIRKCSEYTPLYIYKS

SEQ ID NO: 2306709 - protein, 20 aa, Cryptosporidium parvum
WDIWSLGCVIQEFFGNSNPF

SEQ ID NO: 2306710 - protein, 18 aa, Cryptosporidium parvum
WDKEHPILLTSNYNLQDY

SEQ ID NO: 2306711 - protein, 21 aa, Cryptosporidium parvum
WDLNPRSGFKSYFENSTLYLN

SEQ ID NO: 2306712 - protein, 20 aa, Cryptosporidium parvum
WDNIGMIPFRGTIHELERNN

SEQ ID NO: 2306713 - protein, 19 aa, Cryptosporidium parvum
WDNKHIPSYLDFYKIYFQD

SEQ ID NO: 2306714 - protein, 18 aa, Cryptosporidium parvum
WDNSWSLFSGKTVHFVIK

SEQ ID NO: 2306715 - protein, 20 aa, Cryptosporidium parvum
WDPSNGLIFGGNIHNCGTWM

SEQ ID NO: 2306716 - protein, 24 aa, Cryptosporidium parvum
WDQFEENLNKFGIQGTFDENLYTT

SEQ ID NO: 2306717 - protein, 17 aa, Cryptosporidium parvum
WDSKLSKIYSIKKKIEE

SEQ ID NO: 2306718 - protein, 18 aa, Cryptosporidium parvum
WDSPRITPNFGDENDSLL

SEQ ID NO: 2306719 - protein, 17 aa, Cryptosporidium parvum
WDSSLKIAIKREDLSRI

SEQ ID NO: 2306720 - protein, 19 aa, Cryptosporidium parvum
WDTDDIDHWNVPKLTPEDN

SEQ ID NO: 2306721 - protein, 17 aa, Cryptosporidium parvum
WDVRKGPFKTVFVSESI

SEQ ID NO: 2306722 - protein, 20 aa, Cryptosporidium parvum
WDYMIKRSYQELGMDYDIKL

SEQ ID NO: 2306723 - protein, 19 aa, Cryptosporidium parvum
WDYSNSNFIFCVNAYESYI

SEQ ID NO: 2306724 - protein, 24 aa, Cryptosporidium parvum
WEALKKGESVLVFCPSKYSVESTA

SEQ ID NO: 2306725 - protein, 19 aa, Cryptosporidium parvum
WEALNKSGTRWAIRTFLRF

SEQ ID NO: 2306726 - protein, 19 aa, Cryptosporidium parvum
WEDIELIGYYPYPTIKMEM

SEQ ID NO: 2306727 - protein, 20 aa, Cryptosporidium parvum
WEDLDYLVLDFPPGTGDIQL

SEQ ID NO: 2306728 - protein, 18 aa, Cryptosporidium parvum
WEDLSGKSARVFSNSIMK

SEQ ID NO: 2306729 - protein, 21 aa, Cryptosporidium parvum
WEDLSNFYLRFNGNCKLLLEY

SEQ ID NO: 2306730 - protein, 19 aa, Cryptosporidium parvum
WEEAVKLHFQHIRKKAHEN

SEQ ID NO: 2306731 - protein, 17 aa, Cryptosporidium parvum
WEEISTKGIRVVNIQDS

SEQ ID NO: 2306732 - protein, 19 aa, Cryptosporidium parvum
WEELCKLVNYQAEKQMDDI

SEQ ID NO: 2306733 - protein, 23 aa, Cryptosporidium parvum
WEENGYKNGIKFYKKKENNNDSY

SEQ ID NO: 2306734 - protein, 18 aa, Cryptosporidium parvum
WEFDVGGCFLNFRRLILA

SEQ ID NO: 2306735 - protein, 17 aa, Cryptosporidium parvum
WEKCIEIFGLDVCINLV

SEQ ID NO: 2306736 - protein, 18 aa, Cryptosporidium parvum
WEKKPLIVDFDFQINEDS

SEQ ID NO: 2306737 - protein, 18 aa, Cryptosporidium parvum
WEKNFTRYFNLLLSSLNQ

SEQ ID NO: 2306738 - protein, 19 aa, Cryptosporidium parvum
WEKSDVLKFSKNISKESDF

SEQ ID NO: 2306739 - protein, 18 aa, Cryptosporidium parvum
WEKWYLTHHCTIYYEHRY

SEQ ID NO: 2306740 - protein, 23 aa, Cryptosporidium parvum
WELSTLCGVTGYVLYITYQSIID

SEQ ID NO: 2306741 - protein, 26 aa, Cryptosporidium parvum
WEMLMLEYHILKILNWDLSINYHEFK

SEQ ID NO: 2306742 - protein, 17 aa, Cryptosporidium parvum
WERDFAIDEMDPLKRGS

SEQ ID NO: 2306743 - protein, 20 aa, Cryptosporidium parvum
WESSNRFAIVVVDDVTRSQT

SEQ ID NO: 2306744 - protein, 23 aa, Cryptosporidium parvum
WESYPNLIEFIIIIDKVFQPLKE

SEQ ID NO: 2306745 - protein, 21 aa, Cryptosporidium parvum
WETAKSCICWLKQHRKQPMNF

SEQ ID NO: 2306746 - protein, 25 aa, Cryptosporidium parvum
WETMNIPLRLVDMIRKRIFSQVNEP

SEQ ID NO: 2306747 - protein, 24 aa, Cryptosporidium parvum
WEVGDANVSIPFFGIHGNHDDPGE

SEQ ID NO: 2306748 - protein, 18 aa, Cryptosporidium parvum
WEYYEPWDPILRPTLDLG

SEQ ID NO: 2306749 - protein, 21 aa, Cryptosporidium parvum
WFEDKSRIWLVIEIAPGGELY

SEQ ID NO: 2306750 - protein, 20 aa, Cryptosporidium parvum
WFLNNECGFDSNLNEGFIKK

SEQ ID NO: 2306751 - protein, 17 aa, Cryptosporidium parvum
WFPETHDSILLKFNHLR

SEQ ID NO: 2306752 - protein, 19 aa, Cryptosporidium parvum
WFREMKIYDLESLKAAEID

SEQ ID NO: 2306753 - protein, 20 aa, Cryptosporidium parvum
WFSRIRRISENNIKNELILF

SEQ ID NO: 2306754 - protein, 24 aa, Cryptosporidium parvum
WFVYYRPFLKFFLQNASKLGSICV

SEQ ID NO: 2306755 - protein, 18 aa, Cryptosporidium parvum
WGERLLSYFQFERNADCL

SEQ ID NO: 2306756 - protein, 18 aa, Cryptosporidium parvum
WGKISWKGKFSKYDKEIW

SEQ ID NO: 2306757 - protein, 20 aa, Cryptosporidium parvum
WGNEFSRLSKLYGANIIAEE

SEQ ID NO: 2306758 - protein, 27 aa, Cryptosporidium parvum
WGNYLGGTFIRYWKRASTHIFGLRFDL

SEQ ID NO: 2306759 - protein, 19 aa, Cryptosporidium parvum
WGQIYILNVVAEWKVSTEK

SEQ ID NO: 2306760 - protein, 17 aa, Cryptosporidium parvum
WGQRACYSHHIRSKIKR

SEQ ID NO: 2306761 - protein, 17 aa, Cryptosporidium parvum
WGQYLSLNIEEMENRDK

SEQ ID NO: 2306762 - protein, 26 aa, Cryptosporidium parvum
WGRFYDEYFEAFPLAISETLEINQLM

SEQ ID NO: 2306763 - protein, 62 aa, Cryptosporidium parvum; identical to SEQ ID NO: 2183947

SEQ ID NO: 2306764 - protein, 22 aa, Cryptosporidium parvum
WGSNTYRKAIFEKMKNYLVELS

SEQ ID NO: 2306765 - protein, 17 aa, Cryptosporidium parvum
WGTQFGMLIEYLKEEYP

SEQ ID NO: 2306766 - protein, 19 aa, Cryptosporidium parvum
WGVEHLIGSSFLKAYLHGY

SEQ ID NO: 2306767 - protein, 18 aa, Cryptosporidium parvum
WHDLKDHMRQAGNVIRAD

SEQ ID NO: 2306768 - protein, 17 aa, Cryptosporidium parvum
WHYSYRHQFALQDYVVF

SEQ ID NO: 2306769 - protein, 17 aa, Cryptosporidium parvum
WIAVHGIHTKQLLLKYI

SEQ ID NO: 2306770 - protein, 24 aa, Cryptosporidium parvum
WICKIPGKSGTLWENGEYTLNVTF

SEQ ID NO: 2306771 - protein, 18 aa, Cryptosporidium parvum
WIDTAILCQMYYVPKTLQ

SEQ ID NO: 2306772 - protein, 23 aa, Cryptosporidium parvum
WIEAPCRKGGPPAQRFQHVVLFV

SEQ ID NO: 2306773 - protein, 23 aa, Cryptosporidium parvum
WIEEKIRGLELILNHQRLPLLFK

SEQ ID NO: 2306774 - protein, 26 aa, Cryptosporidium parvum
WIGILDIYGFEVFKVNGFEQFLINFA

SEQ ID NO: 2306775 - protein, 19 aa, Cryptosporidium parvum
WIGTAVITKEDWIRSYTSG

SEQ ID NO: 2306776 - protein, 18 aa, Cryptosporidium parvum
WIIENVPFNLCNRYRNPT

SEQ ID NO: 2306777 - protein, 21 aa, Cryptosporidium parvum
WIKKQQCELVDPSVLFSDNNI

SEQ ID NO: 2306778 - protein, 17 aa, Cryptosporidium parvum
WIKRNTFFNEYLRYIVS

SEQ ID NO: 2306779 - protein, 18 aa, Cryptosporidium parvum
WILDSSISVKLKRKQINE

SEQ ID NO: 2306780 - protein, 18 aa, Cryptosporidium parvum
WIMMDRIRESSYKLMEPT

SEQ ID NO: 2306781 - protein, 18 aa, Cryptosporidium parvum
WIMSLPISGKIFLDKGAI

SEQ ID NO: 2306782 - protein, 18 aa, Cryptosporidium parvum
WINTQGMLQIIKNYTANK

SEQ ID NO: 2306783 - protein, 23 aa, Cryptosporidium parvum
WIPCPKEVWRPGVVSRVDDSQIS

SEQ ID NO: 2306784 - protein, 20 aa, Cryptosporidium parvum
WIPKKEFNVTLYGHGVDDGR

SEQ ID NO: 2306785 - protein, 17 aa, Cryptosporidium parvum
WIPPEYRWLHFLHLALI

SEQ ID NO: 2306786 - protein, 22 aa, Cryptosporidium parvum
WIPSEFKHRFKIQDRKDCYSNG

SEQ ID NO: 2306787 - protein, 20 aa, Cryptosporidium parvum
WIRQILEGILYLNNLDKNGD

SEQ ID NO: 2306788 - protein, 20 aa, Cryptosporidium parvum
WISKLNDLCLGVTKDEKSDR

SEQ ID NO: 2306789 - protein, 19 aa, Cryptosporidium parvum
WISQKRFGIVTSSFLTKLM

SEQ ID NO: 2306790 - protein, 17 aa, Cryptosporidium parvum
WITEFSVSMKMSLGLEY

SEQ ID NO: 2306791 - protein, 17 aa, Cryptosporidium parvum
WITSISIYNEKMYDSHQ

SEQ ID NO: 2306792 - protein, 19 aa, Cryptosporidium parvum
WKCQNCINNLVFCNICNSF

SEQ ID NO: 2306793 - protein, 21 aa, Cryptosporidium parvum
WKELDHLCGIQIKNDYLPIKF

SEQ ID NO: 2306794 - protein, 20 aa, Cryptosporidium parvum
WKELSRISAQLSQESLIDET

SEQ ID NO: 2306795 - protein, 20 aa, Cryptosporidium parvum
WKFETLCDLYDTLTVTQSII

SEQ ID NO: 2306796 - protein, 17 aa, Cryptosporidium parvum
WKFYLDGKFTMVSKKYI

SEQ ID NO: 2306797 - protein, 25 aa, Cryptosporidium parvum
WKGVLSRRRFKLLLKEKAALKIQTI

SEQ ID NO: 2306798 - protein, 20 aa, Cryptosporidium parvum
WKHNCLDATMPFFIQSLRDM

SEQ ID NO: 2306799 - protein, 20 aa, Cryptosporidium parvum
WKICQYCQMEMFPSLYFINV

SEQ ID NO: 2306800 - protein, 32 aa, Cryptosporidium parvum
WKIDKSYLDLMVWWQKNYMEFFSSIRNIQLSE

SEQ ID NO: 2306801 - protein, 19 aa, Cryptosporidium parvum
WKIIEDFEPVISYDDYRAA

SEQ ID NO: 2306802 - protein, 20 aa, Cryptosporidium parvum
WKKFPARRIGVVLSGGQASG

SEQ ID NO: 2306803 - protein, 19 aa, Cryptosporidium parvum
WKKMCPKTLEGKSQEKIKF

SEQ ID NO: 2306804 - protein, 19 aa, Cryptosporidium parvum
WKLHHTIKYEVLDNCSKQK

SEQ ID NO: 2306805 - protein, 18 aa, Cryptosporidium parvum
WKLKHKKRVKKYKDFIDD

SEQ ID NO: 2306806 - protein, 17 aa, Cryptosporidium parvum
WKLKILSRLLGHEKEVN

SEQ ID NO: 2306807 - protein, 21 aa, Cryptosporidium parvum
WKLRNCIMNIFPYLVSHISFQ

SEQ ID NO: 2306808 - protein, 28 aa, Cryptosporidium parvum
WKMKLINKRGRKSLSYNGSSINEQNSPS

SEQ ID NO: 2306809 - protein, 17 aa, Cryptosporidium parvum
WKNAYYIAEPKVKRPKW

SEQ ID NO: 2306810 - protein, 20 aa, Cryptosporidium parvum
WKNLSNWNVDRVKRSWTNKR

SEQ ID NO: 2306811 - protein, 18 aa, Cryptosporidium parvum
WKNMNLTVFVFKDELENT

SEQ ID NO: 2306812 - protein, 19 aa, Cryptosporidium parvum
WKPAKSVNISNEFDSAAIS

SEQ ID NO: 2306813 - protein, 19 aa, Cryptosporidium parvum
WKPPHLNTADFAAIFYAES

SEQ ID NO: 2306814 - protein, 20 aa, Cryptosporidium parvum
WKQTIVLFQDCLEAKAGLNL

SEQ ID NO: 2306815 - protein, 21 aa, Cryptosporidium parvum
WKRVVNKVCFVGNDFTRKPPK

SEQ ID NO: 2306816 - protein, 20 aa, Cryptosporidium parvum
WKSCHPNLIDSNAIKKYLNS

SEQ ID NO: 2306817 - protein, 20 aa, Cryptosporidium parvum
WKSYGRPIVKRDMKLKNPEG

SEQ ID NO: 2306818 - protein, 17 aa, Cryptosporidium parvum
WKTDRIPGGVRTYNEKY

SEQ ID NO: 2306819 - protein, 19 aa, Cryptosporidium parvum
WKTIIESLCSPNFPTEFIY

SEQ ID NO: 2306820 - protein, 20 aa, Cryptosporidium parvum
WKTLLRVCNEISASIEDSSL

SEQ ID NO: 2306821 - protein, 19 aa, Cryptosporidium parvum
WKVPGQPVQPTWEPEENLN

SEQ ID NO: 2306822 - protein, 25 aa, Cryptosporidium parvum
WKYHNFRLNTLDAMFEIKLNTCANS

SEQ ID NO: 2306823 - protein, 17 aa, Cryptosporidium parvum
WKYLCNWEKTNHNNILD

SEQ ID NO: 2306824 - protein, 21 aa, Cryptosporidium parvum
WKYNHWEVKGVCLRFEVGPRD

SEQ ID NO: 2306825 - protein, 27 aa, Cryptosporidium parvum
WLAICGPRLGFKPAYSPDFLIRDTPVV

SEQ ID NO: 2306826 - protein, 22 aa, Cryptosporidium parvum
WLCNRYPLIVKELKDAVDEETC

SEQ ID NO: 2306827 - protein, 22 aa, Cryptosporidium parvum
WLDGKNALIIRKLVNGDKDMQT

SEQ ID NO: 2306828 - protein, 19 aa, Cryptosporidium parvum
WLDICKNELYKLIRVKSPK

SEQ ID NO: 2306829 - protein, 18 aa, Cryptosporidium parvum
WLENFHAFNEKQSELEKK

SEQ ID NO: 2306830 - protein, 18 aa, Cryptosporidium parvum
WLFDGYLSSDLSELRTEN

SEQ ID NO: 2306831 - protein, 20 aa, Cryptosporidium parvum
WLGWTNGFLSSFRFPHCSRY

SEQ ID NO: 2306832 - protein, 18 aa, Cryptosporidium parvum
WLKVFKINHFNIIDNIKA

SEQ ID NO: 2306833 - protein, 17 aa, Cryptosporidium parvum
WLLKRIIASESHENTKY

SEQ ID NO: 2306834 - protein, 17 aa, Cryptosporidium parvum
WLLKYCEHLSEKINSLH

SEQ ID NO: 2306835 - protein, 18 aa, Cryptosporidium parvum
WLLTTGFSDKGERQIGVW

SEQ ID NO: 2306836 - protein, 19 aa, Cryptosporidium parvum
WLMGPRCREQFVIRYQSAT

SEQ ID NO: 2306837 - protein, 25 aa, Cryptosporidium parvum
WLNVTRFYCVFDHSKLQPDNKKSLN

SEQ ID NO: 2306838 - protein, 20 aa, Cryptosporidium parvum
WLPSSFCYPHSSSIGSVATV

SEQ ID NO: 2306839 - protein, 19 aa, Cryptosporidium parvum
WLPSYNRIEKNKGFFGTWN

SEQ ID NO: 2306840 - protein, 18 aa, Cryptosporidium parvum
WLPTEYEMSITPNWSQDI

SEQ ID NO: 2306841 - protein, 25 aa, Cryptosporidium parvum
WLPTMKLLLKYNCDINRRDHKNWTA

SEQ ID NO: 2306842 - protein, 20 aa, Cryptosporidium parvum
WLQYMRMYWMSKDCQKNLKD

SEQ ID NO: 2306843 - protein, 21 aa, Cryptosporidium parvum
WLRIEIEMWIFNNINSNWSSV

SEQ ID NO: 2306844 - protein, 21 aa, Cryptosporidium parvum
WLSNCISCLTSSLKDGIESKP

SEQ ID NO: 2306845 - protein, 21 aa, Cryptosporidium parvum
WLSRRASSLTSMVIDKSIGSV

SEQ ID NO: 2306846 - protein, 19 aa, Cryptosporidium parvum
WLTKMLRLISNFFENLDQG

SEQ ID NO: 2306847 - protein, 20 aa, Cryptosporidium parvum
WLYELCDVYLELIKSRFKNI

SEQ ID NO: 2306848 - protein, 23 aa, Cryptosporidium parvum
WLYIRAASILRHLYVRPNVGVGA

SEQ ID NO: 2306849 - protein, 28 aa, Cryptosporidium parvum
WLYKQSRFLKDWRRRWFVLTRNYLASFK

SEQ ID NO: 2306850 - protein, 22 aa, Cryptosporidium parvum
WMISRFKKNVNILLADEMGLGK

SEQ ID NO: 2306851 - protein, 19 aa, Cryptosporidium parvum
WMKNRFIVLIRKRRQLMNL

SEQ ID NO: 2306852 - protein, 20 aa, Cryptosporidium parvum
WMNDCYRPGDVVRCSILSVV

SEQ ID NO: 2306853 - protein, 27 aa, Cryptosporidium parvum
WMPDMFIRILCTFDKMIVSNIGLQSAE

SEQ ID NO: 2306854 - protein, 22 aa, Cryptosporidium parvum
WMQKQKIALALSELQNNTQTAS

SEQ ID NO: 2306855 - protein, 19 aa, Cryptosporidium parvum
WMQPLNCLFLSNGSTIEKN

SEQ ID NO: 2306856 - protein, 20 aa, Cryptosporidium parvum
WMRLMYELHEIILKYIEIEK

SEQ ID NO: 2306857 - protein, 17 aa, Cryptosporidium parvum
WNDFLSFLYSKGHSVDW

SEQ ID NO: 2306858 - protein, 18 aa, Cryptosporidium parvum
WNDIHLLVPRGRYEIEVL

SEQ ID NO: 2306859 - protein, 17 aa, Cryptosporidium parvum
WNEHLSLNGLILQSFKC

SEQ ID NO: 2306860 - protein, 19 aa, Cryptosporidium parvum
WNFDGDLLAAASSDTIIYI

SEQ ID NO: 2306861 - protein, 18 aa, Cryptosporidium parvum
WNFIPREHIAEACDTLKS

SEQ ID NO: 2306862 - protein, 17 aa, Cryptosporidium parvum
WNGLPLINLKFVHENLL

SEQ ID NO: 2306863 - protein, 20 aa, Cryptosporidium parvum
WNKEYCLLQSNIFLCHELKY

SEQ ID NO: 2306864 - protein, 17 aa, Cryptosporidium parvum
WNKLLFNPGYTFYKNRW

SEQ ID NO: 2306865 - protein, 33 aa, Cryptosporidium parvum
WNLIDTYPIFRWFPNNCCDFFFEEERSIKSRSI

SEQ ID NO: 2306866 - protein, 19 aa, Cryptosporidium parvum
WNLRLWKELLSYLKKVLAF

SEQ ID NO: 2306867 - protein, 21 aa, Cryptosporidium parvum
WNMKPLSHMYLANSLIEKIKD

SEQ ID NO: 2306868 - protein, 18 aa, Cryptosporidium parvum
WNNHLGLVSELRNYQKDA

SEQ ID NO: 2306869 - protein, 18 aa, Cryptosporidium parvum
WNNNIWLPNEIKKLEKLV

SEQ ID NO: 2306870 - protein, 21 aa, Cryptosporidium parvum
WNNVYLLGRYIKFSRRISQSK

SEQ ID NO: 2306871 - protein, 27 aa, Cryptosporidium parvum
WNPVLWKSFQKLVGLSCQYPHELVKIC

SEQ ID NO: 2306872 - protein, 17 aa, Cryptosporidium parvum
WNRPDDMLAEMLKTDQH

SEQ ID NO: 2306873 - protein, 31 aa, Cryptosporidium parvum
WNRYYPMNSLRVGLFMTLKISTVNLFKMNPG

SEQ ID NO: 2306874 - protein, 20 aa, Cryptosporidium parvum
WNSCGDFVPFIGRVKEGNVM

SEQ ID NO: 2306875 - protein, 24 aa, Cryptosporidium parvum
WNSFADRFGHDFISNNLLLKDKHI

SEQ ID NO: 2306876 - protein, 17 aa, Cryptosporidium parvum
WNSLFCILSHLPKLECL

SEQ ID NO: 2306877 - protein, 19 aa, Cryptosporidium parvum
WNSLICERLILKREKDLKA

SEQ ID NO: 2306878 - protein, 28 aa, Cryptosporidium parvum
WNSMKPCLKECITLLGLLILIRMYSVRA

SEQ ID NO: 2306879 - protein, 18 aa, Cryptosporidium parvum
WNSYSKLLPLAVVELDVQ

SEQ ID NO: 2306880 - protein, 17 aa, Cryptosporidium parvum
WNTICFQLFKNSEDLSL

SEQ ID NO: 2306881 - protein, 20 aa, Cryptosporidium parvum
WNVDLIPKFVMASGDLVKIL

SEQ ID NO: 2306882 - protein, 20 aa, Cryptosporidium parvum
WNVRNILDWEYYKNRLTNTI

SEQ ID NO: 2306883 - protein, 21 aa, Cryptosporidium parvum
WNWQYSLEVELSWFSPTESSI

SEQ ID NO: 2306884 - protein, 18 aa, Cryptosporidium parvum
WNYNALFSEKIPKTYTNY

SEQ ID NO: 2306885 - protein, 17 aa, Cryptosporidium parvum
WNYSLEWHPFFRPNGNF

SEQ ID NO: 2306886 - protein, 21 aa, Cryptosporidium parvum
WPENDFRLFCGDLGNDVTEEI

SEQ ID NO: 2306887 - protein, 26 aa, Cryptosporidium parvum
WPIKSRLPVWKVWREMNNLLINKSLH

SEQ ID NO: 2306888 - protein, 23 aa, Cryptosporidium parvum
WPITCKKMSHILTREIGFQDLIE

SEQ ID NO: 2306889 - protein, 18 aa, Cryptosporidium parvum
WPLPLLFTKKNMEHYYNL

SEQ ID NO: 2306890 - protein, 24 aa, Cryptosporidium parvum
WPPYRWSNNEIFVFKVQDTSVSIF

SEQ ID NO: 2306891 - protein, 18 aa, Cryptosporidium parvum
WPTLDKWASLSEKSFKLN

SEQ ID NO: 2306892 - protein, 20 aa, Cryptosporidium parvum
WPTLTIDWLPNSYKSADGSY

SEQ ID NO: 2306893 - protein, 18 aa, Cryptosporidium parvum
WPTPYKMYEEMSSEITFD

SEQ ID NO: 2306894 - protein, 22 aa, Cryptosporidium parvum
WPVRVPRPCLEKLQGNTPLLTG

SEQ ID NO: 2306895 - protein, 26 aa, Cryptosporidium parvum
WQESSQRWIAQWSDSISGRRITHGFS

SEQ ID NO: 2306896 - protein, 22 aa, Cryptosporidium parvum
WQLQSFPFKTIQDIFTMVKGYH

SEQ ID NO: 2306897 - protein, 27 aa, Cryptosporidium parvum
WQNLLIKWLTYVVKFSERNGISMYESW

SEQ ID NO: 2306898 - protein, 17 aa, Cryptosporidium parvum
WQSRTCISVITGHNHYV

SEQ ID NO: 2306899 - protein, 23 aa, Cryptosporidium parvum
WQVFDTDKWCKVPISDPPSSNLL

SEQ ID NO: 2306900 - protein, 17 aa, Cryptosporidium parvum
WQYEISRLLKMDPKMVF

SEQ ID NO: 2306901 - protein, 17 aa, Cryptosporidium parvum
WQYKPIRPVQELQKLAS

SEQ ID NO: 2306902 - protein, 26 aa, Cryptosporidium parvum
WRFDCSRCSISFSIKKNICERLSLGE

SEQ ID NO: 2306903 - protein, 21 aa, Cryptosporidium parvum
WRIEKPCINIDFVFNNTNVML

SEQ ID NO: 2306904 - protein, 19 aa, Cryptosporidium parvum
WRIQTRPSKRNLVETEEVK

SEQ ID NO: 2306905 - protein, 20 aa, Cryptosporidium parvum
WRKIETIFRTLSIDYSKLID

SEQ ID NO: 2306906 - protein, 20 aa, Cryptosporidium parvum
WRKKEVNIIINVGGIPFLLN

SEQ ID NO: 2306907 - protein, 28 aa, Cryptosporidium parvum
WRKSENTLRKLLNWWKTEGFFKRSKHLE

SEQ ID NO: 2306908 - protein, 17 aa, Cryptosporidium parvum
WRLLPKVRPDILNLFIS

SEQ ID NO: 2306909 - protein, 20 aa, Cryptosporidium parvum
WRLTSYCPLLVQFLGAFIKP

SEQ ID NO: 2306910 - protein, 18 aa, Cryptosporidium parvum
WRMPDNQAENLLFWIQQL

SEQ ID NO: 2306911 - protein, 20 aa, Cryptosporidium parvum
WRNLIPRIWSIFIEEPLDIN

SEQ ID NO: 2306912 - protein, 27 aa, Cryptosporidium parvum
WRRLENASYQRVDWSSRQFLGSEVDPK

SEQ ID NO: 2306913 - protein, 22 aa, Cryptosporidium parvum
WRRYHQMNMLWSSVITPIVSPE

SEQ ID NO: 2306914 - protein, 21 aa, Cryptosporidium parvum
WRSILEDLKHLPISFNKLELK

SEQ ID NO: 2306915 - protein, 17 aa, Cryptosporidium parvum
WRSSHPYIVSLRIEEIN

SEQ ID NO: 2306916 - protein, 20 aa, Cryptosporidium parvum
WRTPKYIGRNDLETMLASSN

SEQ ID NO: 2306917 - protein, 23 aa, Cryptosporidium parvum
WRTSEIPNFVSFVGCSLSTTIKY

SEQ ID NO: 2306918 - protein, 18 aa, Cryptosporidium parvum
WRTWGRSDKSGWSKTLLN

SEQ ID NO: 2306919 - protein, 17 aa, Cryptosporidium parvum
WRVPTCEMLYYSKPFDK

SEQ ID NO: 2306920 - protein, 17 aa, Cryptosporidium parvum
WRVRGITWHAERKAFIV

SEQ ID NO: 2306921 - protein, 19 aa, Cryptosporidium parvum
WRYFFNRLSSKSVYTNETN

SEQ ID NO: 2306922 - protein, 34 aa, Cryptosporidium parvum; identical to SEQ ID NO: 2184086

SEQ ID NO: 2306923 - protein, 25 aa, Cryptosporidium parvum
WSCPSCSSPSLPLFLLFDESYTSHT

SEQ ID NO: 2306924 - protein, 17 aa, Cryptosporidium parvum
WSCSNAKSQWETIIYNF

SEQ ID NO: 2306925 - protein, 20 aa, Cryptosporidium parvum
WSDRLIRLVVENALSHLSFT

SEQ ID NO: 2306926 - protein, 20 aa, Cryptosporidium parvum
WSFHFKGIYFFRNISKSNPC

SEQ ID NO: 2306927 - protein, 20 aa, Cryptosporidium parvum
WSIGCEIFRKIWGPDEKPIL

SEQ ID NO: 2306928 - protein, 18 aa, Cryptosporidium parvum
WSIGCVFGELILGKPLFS

SEQ ID NO: 2306929 - protein, 25 aa, Cryptosporidium parvum
WSIPSLKEIYSFNCGKSEQIINIRF

SEQ ID NO: 2306930 - protein, 17 aa, Cryptosporidium parvum
WSKCRFSYSKLFPEEDY

SEQ ID NO: 2306931 - protein, 31 aa, Cryptosporidium parvum
WSKGWYRAGKALYYLNIFDKAVIVFKAALKR

SEQ ID NO: 2306932 - protein, 21 aa, Cryptosporidium parvum
WSLCKNELFFGFYACHHDSNP

SEQ ID NO: 2306933 - protein, 27 aa, Cryptosporidium parvum
WSLCNDKFMLIAYKWSNKESLKEIMEF

SEQ ID NO: 2306934 - protein, 17 aa, Cryptosporidium parvum
WSLGVLCYELVKGEPPF

SEQ ID NO: 2306935 - protein, 21 aa, Cryptosporidium parvum
WSLKLKQFLNHDGLYICSEHI

SEQ ID NO: 2306936 - protein, 20 aa, Cryptosporidium parvum
WSMMCNPHLISRCDNIQVLD

SEQ ID NO: 2306937 - protein, 28 aa, Cryptosporidium parvum
WSNFSSTRTFSWKDLWNLNQAQNRQIRR

SEQ ID NO: 2306938 - protein, 32 aa, Cryptosporidium parvum
WSNSTKINLSLYWDESSSYLFDNTHSKIILFA

SEQ ID NO: 2306939 - protein, 25 aa, Cryptosporidium parvum
WSPELKILCFKGSRYERRSLIYEMR

SEQ ID NO: 2306940 - protein, 18 aa, Cryptosporidium parvum
WSPLGSYFVLGGSGGNLT

SEQ ID NO: 2306941 - protein, 18 aa, Cryptosporidium parvum
WSPLHSCCSSGYFEIARL

SEQ ID NO: 2306942 - protein, 19 aa, Cryptosporidium parvum
WSQFAHIFSIHGANSNQNP

SEQ ID NO: 2306943 - protein, 20 aa, Cryptosporidium parvum
WSRDSHELFDYEAQHINNKK

SEQ ID NO: 2306944 - protein, 27 aa, Cryptosporidium parvum
WSRSRLEWVQTPILYLFDAFIRNEEQF

SEQ ID NO: 2306945 - protein, 20 aa, Cryptosporidium parvum
WSSDGLRLSKISFLPIKVEE

SEQ ID NO: 2306946 - protein, 20 aa, Cryptosporidium parvum
WSSDRLEGFIRRFYDSVDTL

SEQ ID NO: 2306947 - protein, 19 aa, Cryptosporidium parvum
WSSFGSFNWDGFSANRNLE

SEQ ID NO: 2306948 - protein, 18 aa, Cryptosporidium parvum
WSSRLYDLYRRMKGESSQ

SEQ ID NO: 2306949 - protein, 22 aa, Cryptosporidium parvum
WSSRQFLGSEVDPKFCNYDMVS

SEQ ID NO: 2306950 - protein, 17 aa, Cryptosporidium parvum
WSVGCIFAELLNMLKEN

SEQ ID NO: 2306951 - protein, 25 aa, Cryptosporidium parvum
WSVGCVMAELVLRKPLFDHNSSTQQ

SEQ ID NO: 2306952 - protein, 21 aa, Cryptosporidium parvum
WSVPYDLLFDVYISLLDSSLA

SEQ ID NO: 2306953 - protein, 26 aa, Cryptosporidium parvum
WTDEEHNRFVLALKKFGRNWTLVQQE

SEQ ID NO: 2306954 - protein, 17 aa, Cryptosporidium parvum
WTDGVFTAILRKIINSS

SEQ ID NO: 2306955 - protein, 17 aa, Cryptosporidium parvum
WTEGKGLGKEEVGMQEC

SEQ ID NO: 2306956 - protein, 18 aa, Cryptosporidium parvum
WTEGSFWTANVKIVPNSK

SEQ ID NO: 2306957 - protein, 43 aa, Cryptosporidium parvum; identical to SEQ ID NO: 2184121

SEQ ID NO: 2306958 - protein, 21 aa, Cryptosporidium parvum
WTISAREAILLLPRNTILCPW

SEQ ID NO: 2306959 - protein, 17 aa, Cryptosporidium parvum
WTLEGGALVLADEGICL

SEQ ID NO: 2306960 - protein, 26 aa, Cryptosporidium parvum
WTNPDLKCTLWRSSQPKSAFKRCIED

SEQ ID NO: 2306961 - protein, 25 aa, Cryptosporidium parvum
WTQDYKEWLESTLLPAPNADNDNIE

SEQ ID NO: 2306962 - protein, 31 aa, Cryptosporidium parvum
WTSPLIPYIIKDFSCPNCFEIEDFDFTGNAI

SEQ ID NO: 2306963 - protein, 18 aa, Cryptosporidium parvum
WTSSDSKPHVGFPETALH

SEQ ID NO: 2306964 - protein, 20 aa, Cryptosporidium parvum
WTTRIEKILKAAAFMQQLKG

SEQ ID NO: 2306965 - protein, 18 aa, Cryptosporidium parvum
WTYFLPILLSSSVSDIEI

SEQ ID NO: 2306966 - protein, 18 aa, Cryptosporidium parvum
WVAVWRLRESLESSYFES

SEQ ID NO: 2306967 - protein, 22 aa, Cryptosporidium parvum
WVECKKALPREIMAGNSNQSNS

SEQ ID NO: 2306968 - protein, 17 aa, Cryptosporidium parvum
WVERDSYLPCGSRGLKS

SEQ ID NO: 2306969 - protein, 25 aa, Cryptosporidium parvum
WVGLLRPNGIFSRFDCCNKYPTIIE

SEQ ID NO: 2306970 - protein, 32 aa, Cryptosporidium parvum
WVIVGHSMGGLIGFELLKRIKFEQLKDFSAKF

SEQ ID NO: 2306971 - protein, 35 aa, Cryptosporidium parvum
WVLRSGFSGKSYVYFKIDFIKTIIIGYVPNLGLVL

SEQ ID NO: 2306972 - protein, 23 aa, Cryptosporidium parvum
WVNCSHISKFIGFNGFTGPLRPY

SEQ ID NO: 2306973 - protein, 19 aa, Cryptosporidium parvum
WVVTIGRYATYIQRSVGLF

SEQ ID NO: 2306974 - protein, 35 aa, Cryptosporidium parvum
WVYETSELYLPEILCFLRVIPICSARQFAQAGPND

SEQ ID NO: 2306975 - protein, 18 aa, Cryptosporidium parvum
WVYWGTVWSTMSFGPNSL

SEQ ID NO: 2306976 - protein, 18 aa, Cryptosporidium parvum
WWAKSISVGKRIEKESDN

SEQ ID NO: 2306977 - protein, 18 aa, Cryptosporidium parvum
WWKTEGFFKRSKHLEDYK

SEQ ID NO: 2306978 - protein, 25 aa, Cryptosporidium parvum
WWMNCKPFAEKACKAVKNHELQIEP

SEQ ID NO: 2306979 - protein, 20 aa, Cryptosporidium parvum
WWQCDGCLKEILPNKKKFDC

SEQ ID NO: 2306980 - protein, 20 aa, Cryptosporidium parvum
WWSDIEIVDLSMLREYLNFD

SEQ ID NO: 2306981 - protein, 18 aa, Cryptosporidium parvum
WWSVGILMYECLYGGVPF

SEQ ID NO: 2306982 - protein, 17 aa, Cryptosporidium parvum
WYAGLGVVPISLEKTYS

SEQ ID NO: 2306983 - protein, 19 aa, Cryptosporidium parvum
WYDEREGRSRVFLKATQDI

SEQ ID NO: 2306984 - protein, 17 aa, Cryptosporidium parvum
WYFNLFLLIENLIDSYA

SEQ ID NO: 2306985 - protein, 25 aa, Cryptosporidium parvum
WYHIRWLEIQKLLLIENIKSNFLGS

SEQ ID NO: 2306986 - protein, 17 aa, Cryptosporidium parvum
WYHSHPGFGCWFSGTDV

SEQ ID NO: 2306987 - protein, 19 aa, Cryptosporidium parvum
WYILVPYEYGIPIITETQR

SEQ ID NO: 2306988 - protein, 22 aa, Cryptosporidium parvum
WYKSVRGRLLYRSESGKLQGKI

SEQ ID NO: 2306989 - protein, 19 aa, Cryptosporidium parvum
WYPYELDIPIKGYFTISPE

SEQ ID NO: 2306990 - protein, 21 aa, Cryptosporidium parvum
WYRAPEIILCVNRYDKAVDIW

SEQ ID NO: 2306991 - protein, 17 aa, Cryptosporidium parvum
WYRRCMKEYEQQFGEIF

SEQ ID NO: 2306992 - protein, 17 aa, Cryptosporidium parvum
WYSPYGYTMPFMGSYTP

SEQ ID NO: 2306993 - protein, 17 aa, Cryptosporidium parvum
YAARDGRSQTCMLLLDN

SEQ ID NO: 2306994 - protein, 19 aa, Cryptosporidium parvum
YACSIALKKLEEISLKNGT

SEQ ID NO: 2306995 - protein, 19 aa, Cryptosporidium parvum
YADRWNMKPLSHMYLANSL

SEQ ID NO: 2306996 - protein, 17 aa, Cryptosporidium parvum
YAFKNIYNLDDFMNTTN

SEQ ID NO: 2306997 - protein, 26 aa, Cryptosporidium parvum
YAGIKIKPKKGFAVVWPNIDSQGKLD

SEQ ID NO: 2306998 - protein, 17 aa, Cryptosporidium parvum
YAIKNTTLWLSKYFFGR

SEQ ID NO: 2306999 - protein, 23 aa, Cryptosporidium parvum
YAIWKGAQLFSALRDYQENLWIS

SEQ ID NO: 2307000 - protein, 26 aa, Cryptosporidium parvum
YAKKFKCPICFSNVLLNELVSLRYQI

SEQ ID NO: 2307001 - protein, 46 aa, Cryptosporidium parvum
YANSGICKSRMIHFDIVKGRIMLEKKSRFSLILISDLKEWQVIDAK

SEQ ID NO: 2307002 - protein, 18 aa, Cryptosporidium parvum
YAPIWLLSLKYLIQISQQ

SEQ ID NO: 2307003 - protein, 21 aa, Cryptosporidium parvum
YAPSGALPYSVPGAVPTHGRL

SEQ ID NO: 2307004 - protein, 26 aa, Cryptosporidium parvum
YASDKKLICIIPRYSIIPKETLAFLK

SEQ ID NO: 2307005 - protein, 19 aa, Cryptosporidium parvum
YASIEPIINIYARMAAHHI

SEQ ID NO: 2307006 - protein, 17 aa, Cryptosporidium parvum
YATKVIIGSCAIFSNGY

SEQ ID NO: 2307007 - protein, 18 aa, Cryptosporidium parvum
YAVCSSSNVRLYPALSEQ

SEQ ID NO: 2307008 - protein, 17 aa, Cryptosporidium parvum
YCARLTPGGVIKRSKAA

SEQ ID NO: 2307009 - protein, 18 aa, Cryptosporidium parvum
YCEEMFKLGKAYVDDTCV

SEQ ID NO: 2307010 - protein, 17 aa, Cryptosporidium parvum
YCEHEFLHGNLFSCEPN

SEQ ID NO: 2307011 - protein, 19 aa, Cryptosporidium parvum
YCEHRLVDSKCPWDRSKYT

SEQ ID NO: 2307012 - protein, 24 aa, Cryptosporidium parvum
YCENLCFLSKLFLDHKTLYNSVHL

SEQ ID NO: 2307013 - protein, 25 aa, Cryptosporidium parvum
YCETIPIRFVRQIRVFNLATSKENE

SEQ ID NO: 2307014 - protein, 19 aa, Cryptosporidium parvum
YCHDYGASILCQGNRCNRQ

SEQ ID NO: 2307015 - protein, 17 aa, Cryptosporidium parvum
YCLRLDRMDLNHEFPRV

SEQ ID NO: 2307016 - protein, 24 aa, Cryptosporidium parvum
YCNISSYTSSPCQSFSTYDGPFLE

SEQ ID NO: 2307017 - protein, 17 aa, Cryptosporidium parvum
YCNRRVSSRMNNHHMMI

SEQ ID NO: 2307018 - protein, 23 aa, Cryptosporidium parvum
YCPDKIKIFIFRSKSEFFMGKYS

SEQ ID NO: 2307019 - protein, 18 aa, Cryptosporidium parvum
YCPTVNVEKLWTLVSKNT

SEQ ID NO: 2307020 - protein, 18 aa, Cryptosporidium parvum
YCSLCSRSQNNAVTGSNH

SEQ ID NO: 2307021 - protein, 21 aa, Cryptosporidium parvum
YCSRKLHRLRSGLKMKCGRSK

SEQ ID NO: 2307022 - protein, 23 aa, Cryptosporidium parvum
YCTNGSISFCCQILLNHYIIPRI

SEQ ID NO: 2307023 - protein, 23 aa, Cryptosporidium parvum
YDDKCDIWSIGVMAHILLCGVPP

SEQ ID NO: 2307024 - protein, 18 aa, Cryptosporidium parvum
YDDPEFMKFYSLKLPMKL

SEQ ID NO: 2307025 - protein, 23 aa, Cryptosporidium parvum
YDEIKRYREILSITKSQFNKDET

SEQ ID NO: 2307026 - protein, 24 aa, Cryptosporidium parvum
YDEKCDVWSAGVILYILLSGTPPF

SEQ ID NO: 2307027 - protein, 25 aa, Cryptosporidium parvum
YDERISGLGIGVHWEEISTKGIRVV

SEQ ID NO: 2307028 - protein, 18 aa, Cryptosporidium parvum
YDEYGIGATYDMPVIDSN

SEQ ID NO: 2307029 - protein, 19 aa, Cryptosporidium parvum
YDFGRFAWNGYFDRNKNLL

SEQ ID NO: 2307030 - protein, 17 aa, Cryptosporidium parvum
YDFILSFTCIIANNIDE

SEQ ID NO: 2307031 - protein, 24 aa, Cryptosporidium parvum
YDFKFRSLLELCFEKRNKKQQPSL

SEQ ID NO: 2307032 - protein, 19 aa, Cryptosporidium parvum
YDFQLSLSQFTLRNISNDN

SEQ ID NO: 2307033 - protein, 19 aa, Cryptosporidium parvum
YDFTCPIQKTLGMMKTIGN

SEQ ID NO: 2307034 - protein, 17 aa, Cryptosporidium parvum
YDGAVLFCTDIASRGLD

SEQ ID NO: 2307035 - protein, 17 aa, Cryptosporidium parvum
YDGIEGVLGRGAYSSVF

SEQ ID NO: 2307036 - protein, 18 aa, Cryptosporidium parvum
YDGNCWKSDTYLLDIRKF

SEQ ID NO: 2307037 - protein, 24 aa, Cryptosporidium parvum
YDGVRWMWNRFRRSEGGILADEMG

SEQ ID NO: 2307038 - protein, 18 aa, Cryptosporidium parvum
YDILELQPGSSIENIKKA

SEQ ID NO: 2307039 - protein, 24 aa, Cryptosporidium parvum
YDKCKSEIIEYILSQKEKVSTLTE

SEQ ID NO: 2307040 - protein, 22 aa, Cryptosporidium parvum
YDKELYRKTSLYDIPNNQLLPP

SEQ ID NO: 2307041 - protein, 23 aa, Cryptosporidium parvum
YDKLKDIAFRWRKLTFSDYHNEF

SEQ ID NO: 2307042 - protein, 21 aa, Cryptosporidium parvum
YDKLYLYMSIINKVLYKNTMS

SEQ ID NO: 2307043 - protein, 23 aa, Cryptosporidium parvum
YDKSYLLSLMIEFIKTSQNNNTN

SEQ ID NO: 2307044 - protein, 19 aa, Cryptosporidium parvum
YDLKVNFYIPTAFNHLSTK

SEQ ID NO: 2307045 - protein, 19 aa, Cryptosporidium parvum
YDLSGYIEGLKLEGRVIKV

SEQ ID NO: 2307046 - protein, 19 aa, Cryptosporidium parvum
YDLYILCILKSLNNENNSI

SEQ ID NO: 2307047 - protein, 18 aa, Cryptosporidium parvum
YDPGNLRSSFSPSASDNL

SEQ ID NO: 2307048 - protein, 24 aa, Cryptosporidium parvum
YDPIKRILYSISWDQILNSNRFDE

SEQ ID NO: 2307049 - protein, 21 aa, Cryptosporidium parvum
YDPNKIKVWILKRGMEKFGDL

SEQ ID NO: 2307050 - protein, 35 aa, Cryptosporidium parvum
YDPNVKKWGFKCCKNLKRSSVCSAYNKSKSQISNS

SEQ ID NO: 2307051 - protein, 29 aa, Cryptosporidium parvum
YDPTKVDVFCLGWMLLFTLTKYQPFETCR

SEQ ID NO: 2307052 - protein, 19 aa, Cryptosporidium parvum
YDQIVPKRSNLSLSSPIID

SEQ ID NO: 2307053 - protein, 22 aa, Cryptosporidium parvum
YDREFSDNVQFIIPNFYPNVRS

SEQ ID NO: 2307054 - protein, 25 aa, Cryptosporidium parvum
YDRFSKWSVSLGFSLPNLVEESEEL

SEQ ID NO: 2307055 - protein, 26 aa, Cryptosporidium parvum
YDSGFKQKLLDILSIRPNQYGERITS

SEQ ID NO: 2307056 - protein, 24 aa, Cryptosporidium parvum
YDSKQKIYLCEYIGEFRDEIEDAK

SEQ ID NO: 2307057 - protein, 17 aa, Cryptosporidium parvum
YDSLLEMILNIGNITNK

SEQ ID NO: 2307058 - protein, 22 aa, Cryptosporidium parvum
YDSWNKITLEWGDIFQKDNNKA

SEQ ID NO: 2307059 - protein, 24 aa, Cryptosporidium parvum
YDWYQRWENMREIIKEYLKFDDKI

SEQ ID NO: 2307060 - protein, 19 aa, Cryptosporidium parvum
YEAFEAFNIANDERALQSL

SEQ ID NO: 2307061 - protein, 26 aa, Cryptosporidium parvum
YEAKRLAEEWRLRYLYSNPNGPNGQQ

SEQ ID NO: 2307062 - protein, 25 aa, Cryptosporidium parvum
YECETRKYYFFFIPDLSEYTIEITL

SEQ ID NO: 2307063 - protein, 17 aa, Cryptosporidium parvum
YECFTGDIMFKGRTNND

SEQ ID NO: 2307064 - protein, 17 aa, Cryptosporidium parvum
YECTMGLNVQDTNFPLC

SEQ ID NO: 2307065 - protein, 27 aa, Cryptosporidium parvum
YEDYIRLLPFFKERKYIPLFSNTELDS

SEQ ID NO: 2307066 - protein, 19 aa, Cryptosporidium parvum
YEEKVSFTFNNKVLEIVQS

SEQ ID NO: 2307067 - protein, 25 aa, Cryptosporidium parvum
YEENQRLILKYGFVKDPSLFCDHFN

SEQ ID NO: 2307068 - protein, 26 aa, Cryptosporidium parvum
YEGIASGITHGWVAVWRLRESLESSY

SEQ ID NO: 2307069 - protein, 25 aa, Cryptosporidium parvum
YEGIDYSVAISRARFEELCADYFRA

SEQ ID NO: 2307070 - protein, 27 aa, Cryptosporidium parvum
YEGIFWHPINKVWIGVWLDSITHETCT

SEQ ID NO: 2307071 - protein, 28 aa, Cryptosporidium parvum
YEGLEFKVGFGGIWKKSLTELSGGQRSL

SEQ ID NO: 2307072 - protein, 22 aa, Cryptosporidium parvum
YEHTRLRLCRNTISIQIIYPKN

SEQ ID NO: 2307073 - protein, 30 aa, Cryptosporidium parvum
YEHYFKLNVESVKLIRSFFYYFQNLSELFV

SEQ ID NO: 2307074 - protein, 17 aa, Cryptosporidium parvum
YEIELERARSQEKKLQS

SEQ ID NO: 2307075 - protein, 18 aa, Cryptosporidium parvum
YEIGFPKDCISGLYEIIK

SEQ ID NO: 2307076 - protein, 28 aa, Cryptosporidium parvum
YEIMINCKEEARLTYSHAKEKEIQNQRR

SEQ ID NO: 2307077 - protein, 19 aa, Cryptosporidium parvum
YEIQLSQPLSREEREQLET

SEQ ID NO: 2307078 - protein, 23 aa, Cryptosporidium parvum
YEIVDQLIIHLSLIQFSRPLRTC

SEQ ID NO: 2307079 - protein, 24 aa, Cryptosporidium parvum
YEIYKRCILNSAFLHSTIPSLPVS

SEQ ID NO: 2307080 - protein, 18 aa, Cryptosporidium parvum
YEIYPVLIKALSCNGKKL

SEQ ID NO: 2307081 - protein, 17 aa, Cryptosporidium parvum
YEKCKFTGILDEKTLLA

SEQ ID NO: 2307082 - protein, 25 aa, Cryptosporidium parvum
YEKENKCLLNKSWGSKQINTQNSQL

SEQ ID NO: 2307083 - protein, 28 aa, Cryptosporidium parvum
YEKGDDFRMISAYDFFHAENPPLLLLKS

SEQ ID NO: 2307084 - protein, 22 aa, Cryptosporidium parvum
YEKKGSYFLNLWNRIKKPIQNG

SEQ ID NO: 2307085 - protein, 18 aa, Cryptosporidium parvum
YEKLCLLLGNLTDKLIEF

SEQ ID NO: 2307086 - protein, 19 aa, Cryptosporidium parvum
YELMQKFGINMDLNKEARL

SEQ ID NO: 2307087 - protein, 19 aa, Cryptosporidium parvum
YELNARVALENHDLGQFNQ

SEQ ID NO: 2307088 - protein, 28 aa, Cryptosporidium parvum
YELSCAEAISACLFFFGFPKQAEKLLGI

SEQ ID NO: 2307089 - protein, 17 aa, Cryptosporidium parvum
YELYRRILHHVRIRLIA

SEQ ID NO: 2307090 - protein, 17 aa, Cryptosporidium parvum
YEMEAKVGLDESRIPKI

SEQ ID NO: 2307091 - protein, 17 aa, Cryptosporidium parvum
YEMRYTIHSSLQSICAS

SEQ ID NO: 2307092 - protein, 24 aa, Cryptosporidium parvum
YENKDIRITFDISKNKFNQRETNF

SEQ ID NO: 2307093 - protein, 22 aa, Cryptosporidium parvum
YEPKIRVPIYFTSSALNKFNDW

SEQ ID NO: 2307094 - protein, 22 aa, Cryptosporidium parvum
YEPSKRSLNWLKIKKDYVDGLT

SEQ ID NO: 2307095 - protein, 21 aa, Cryptosporidium parvum
YEQSIKCAFSNLKEVTYSIED

SEQ ID NO: 2307096 - protein, 17 aa, Cryptosporidium parvum
YERNLWTAWLQDNKNNQ

SEQ ID NO: 2307097 - protein, 24 aa, Cryptosporidium parvum
YESSELYGPFLAVHLFDPLFYEGF

SEQ ID NO: 2307098 - protein, 18 aa, Cryptosporidium parvum
YETINIFGSDIWISLLID

SEQ ID NO: 2307099 - protein, 17 aa, Cryptosporidium parvum
YETIRSIKLLEMNSYTE

SEQ ID NO: 2307100 - protein, 17 aa, Cryptosporidium parvum
YEVEERKSIEASLKQIV

SEQ ID NO: 2307101 - protein, 22 aa, Cryptosporidium parvum
YEVISSLRISDGALLLVDVAEG

SEQ ID NO: 2307102 - protein, 19 aa, Cryptosporidium parvum
YEVSILLLIGKKVKEKNFV

SEQ ID NO: 2307103 - protein, 18 aa, Cryptosporidium parvum
YEYFYGGGIVCVRPEEIT

SEQ ID NO: 2307104 - protein, 25 aa, Cryptosporidium parvum
YFADLVEAYSLCLIPNKSYLRGMKN

SEQ ID NO: 2307105 - protein, 18 aa, Cryptosporidium parvum
YFCQICSATKTPQWRYIS

SEQ ID NO: 2307106 - protein, 23 aa, Cryptosporidium parvum
YFDKIRKLWRANWKENGRVKTKG

SEQ ID NO: 2307107 - protein, 35 aa, Cryptosporidium parvum
YFEREIVYREWFLKCCKIIDPFLKISLKSLVYPET

SEQ ID NO: 2307108 - protein, 17 aa, Cryptosporidium parvum
YFESLEFTRAFGVLNDE

SEQ ID NO: 2307109 - protein, 26 aa, Cryptosporidium parvum
YFFGSLGSVIIRWSNRMTLCAGKCTY

SEQ ID NO: 2307110 - protein, 17 aa, Cryptosporidium parvum
YFGHIVIDLLFFQAKKF

SEQ ID NO: 2307111 - protein, 21 aa, Cryptosporidium parvum
YFHCKVCCMCYPLSIKETHKC

SEQ ID NO: 2307112 - protein, 21 aa, Cryptosporidium parvum
YFISSTLVSFGLREYAQHISV

SEQ ID NO: 2307113 - protein, 21 aa, Cryptosporidium parvum
YFKEFDLTLSKKGEFHDEDSL

SEQ ID NO: 2307114 - protein, 27 aa, Cryptosporidium parvum
YFKHDFRFKVYHKFLDLLPECRNNDIS

SEQ ID NO: 2307115 - protein, 24 aa, Cryptosporidium parvum
YFKLLESLIFCIPFGNSLNSGIER

SEQ ID NO: 2307116 - protein, 18 aa, Cryptosporidium parvum
YFLEALHKSCLPKNLQTD

SEQ ID NO: 2307117 - protein, 24 aa, Cryptosporidium parvum
YFLKDYGVIMSMALSHYAMGFLLK

SEQ ID NO: 2307118 - protein, 17 aa, Cryptosporidium parvum
YFLVNSLVHKFGDKEDK

SEQ ID NO: 2307119 - protein, 23 aa, Cryptosporidium parvum
YFNDKLRYNFVIPGTGKKIDLIE

SEQ ID NO: 2307120 - protein, 26 aa, Cryptosporidium parvum
YFNLHCPMCGRIIPHKFFSNSFKQST

SEQ ID NO: 2307121 - protein, 18 aa, Cryptosporidium parvum
YFNNQGFCEHNFAEICDN

SEQ ID NO: 2307122 - protein, 18 aa, Cryptosporidium parvum
YFNRDVNCIIELFRKRFG

SEQ ID NO: 2307123 - protein, 19 aa, Cryptosporidium parvum
YFNRGSCDYNRYENIYRKV

SEQ ID NO: 2307124 - protein, 17 aa, Cryptosporidium parvum
YFNSVYFARIIKQTLQS

SEQ ID NO: 2307125 - protein, 22 aa, Cryptosporidium parvum
YFPQRTPRVVSDWFRTLNQKIK

SEQ ID NO: 2307126 - protein, 19 aa, Cryptosporidium parvum
YFRAYRGRKLFSFNKDSVG

SEQ ID NO: 2307127 - protein, 17 aa, Cryptosporidium parvum
YFSAKRYGVEKSYEMAL

SEQ ID NO: 2307128 - protein, 23 aa, Cryptosporidium parvum
YFSCFCRRCHKIINNAKLIPNNS

SEQ ID NO: 2307129 - protein, 19 aa, Cryptosporidium parvum
YFSEWSFTEGDVFRRDQIF

SEQ ID NO: 2307130 - protein, 43 aa, Cryptosporidium parvum
YFSGKICPKCFSVYLIGINCKLEVKPIKGIIRKRLKKKLLKLS

SEQ ID NO: 2307131 - protein, 17 aa, Cryptosporidium parvum
YFSSMFDHIVFKQAQEM

SEQ ID NO: 2307132 - protein, 22 aa, Cryptosporidium parvum
YFTDEDFEIIFGYSKFVHNKII

SEQ ID NO: 2307133 - protein, 19 aa, Cryptosporidium parvum
YFVDCCIENGLTISRDSKV

SEQ ID NO: 2307134 - protein, 23 aa, Cryptosporidium parvum
YFWEHLKRNLSFEANSRVYKPLI

SEQ ID NO: 2307135 - protein, 22 aa, Cryptosporidium parvum
YGADSLRLFLINSPVVRAETLR

SEQ ID NO: 2307136 - protein, 25 aa, Cryptosporidium parvum
YGAKLMIPGVLRFDNGIDVGTEVVM

SEQ ID NO: 2307137 - protein, 22 aa, Cryptosporidium parvum
YGCKKGKLIRVYVIKDKDDLTM

SEQ ID NO: 2307138 - protein, 22 aa, Cryptosporidium parvum
YGDKLIFEPSMKFIKSDPKDSE

SEQ ID NO: 2307139 - protein, 26 aa, Cryptosporidium parvum
YGDSEIQLKLCIMELYDFLYNRNDSI

SEQ ID NO: 2307140 - protein, 27 aa, Cryptosporidium parvum
YGEIKPTFFIGEKKLHITLGLVRAETP

SEQ ID NO: 2307141 - protein, 25 aa, Cryptosporidium parvum
YGEYKRLLEEVSLWEENGYKNGIKF

SEQ ID NO: 2307142 - protein, 25 aa, Cryptosporidium parvum
YGFDVARSEAIAFLKAKQSELQSIG

SEQ ID NO: 2307143 - protein, 25 aa, Cryptosporidium parvum
YGFEKSRYLAIQWRIKYNGEPSQLN

SEQ ID NO: 2307144 - protein, 19 aa, Cryptosporidium parvum
YGGNCLKLNVVSNAEESPI

SEQ ID NO: 2307145 - protein, 24 aa, Cryptosporidium parvum
YGGVKKALKHACIFQSQTEQCKFN

SEQ ID NO: 2307146 - protein, 19 aa, Cryptosporidium parvum
YGHLMKLGHCKHVCLMSVI

SEQ ID NO: 2307147 - protein, 18 aa, Cryptosporidium parvum
YGIQLGMKNVPFIETLAI

SEQ ID NO: 2307148 - protein, 21 aa, Cryptosporidium parvum
YGKILNLRIVKDFQGESRGYA

SEQ ID NO: 2307149 - protein, 24 aa, Cryptosporidium parvum
YGKIPRSLAILALNLKGHSFVSLN

SEQ ID NO: 2307150 - protein, 18 aa, Cryptosporidium parvum
YGKKELLNSSEIISLPKN

SEQ ID NO: 2307151 - protein, 18 aa, Cryptosporidium parvum
YGLLVPFHVRLLKNVVCT

SEQ ID NO: 2307152 - protein, 20 aa, Cryptosporidium parvum
YGLNKVVWCRIHIQESQQDI

SEQ ID NO: 2307153 - protein, 25 aa, Cryptosporidium parvum
YGNCESESTFLWKWMSDYCKSIANI

SEQ ID NO: 2307154 - protein, 33 aa, Cryptosporidium parvum; identical to SEQ ID NO: 2184306

SEQ ID NO: 2307155 - protein, 24 aa, Cryptosporidium parvum
YGPPGCGKTLLAKAIAKESGANFI

SEQ ID NO: 2307156 - protein, 20 aa, Cryptosporidium parvum
YGPTDIRLLTEFQPTANDYK

SEQ ID NO: 2307157 - protein, 26 aa, Cryptosporidium parvum
YGQPNYRLNYLKSMKEWEVTTIPIKK

SEQ ID NO: 2307158 - protein, 20 aa, Cryptosporidium parvum
YGRRIKIGIKKKVGMSDEFE

SEQ ID NO: 2307159 - protein, 20 aa, Cryptosporidium parvum
YGSIKLRIIYKENKYNRTGN

SEQ ID NO: 2307160 - protein, 18 aa, Cryptosporidium parvum
YGSLCITSIVSSYKSKVQ

SEQ ID NO: 2307161 - protein, 27 aa, Cryptosporidium parvum
YGTAEYERPEYLLKDDRSIVMNLMEKK

SEQ ID NO: 2307162 - protein, 29 aa, Cryptosporidium parvum
YGTCDLPQSFSRLAAVKGSLQRLGTTIST

SEQ ID NO: 2307163 - protein, 23 aa, Cryptosporidium parvum
YGTCQFPTLGFVVSRYKKIINFR

SEQ ID NO: 2307164 - protein, 22 aa, Cryptosporidium parvum
YGTKEIIFFLGSMRSVDNSFLF

SEQ ID NO: 2307165 - protein, 17 aa, Cryptosporidium parvum
YGVPVGLANFSAAYCTG

SEQ ID NO: 2307166 - protein, 17 aa, Cryptosporidium parvum
YHCAFKNESSFEFIPPP

SEQ ID NO: 2307167 - protein, 25 aa, Cryptosporidium parvum
YHEIPKFLMSYSDLYQNQAPKYEGI

SEQ ID NO: 2307168 - protein, 18 aa, Cryptosporidium parvum
YHEYYFKQLVNLIQNDDH

SEQ ID NO: 2307169 - protein, 25 aa, Cryptosporidium parvum
YHFQKGEWRAVYGPSKNRQQKSFSV

SEQ ID NO: 2307170 - protein, 17 aa, Cryptosporidium parvum
YHGDVCLMVRYGPTDIR

SEQ ID NO: 2307171 - protein, 27 aa, Cryptosporidium parvum
YHIILSIEIINRWAKFLILPNLFNSCK

SEQ ID NO: 2307172 - protein, 20 aa, Cryptosporidium parvum
YHITGSFCSTSIKSEQGFKI

SEQ ID NO: 2307173 - protein, 23 aa, Cryptosporidium parvum
YHKECTCCLEIDGEYLYQRCNSA

SEQ ID NO: 2307174 - protein, 21 aa, Cryptosporidium parvum
YHKFINHFGIEDVKNDDELYK

SEQ ID NO: 2307175 - protein, 19 aa, Cryptosporidium parvum
YHLIGKCIRNLAKLGKSEF

SEQ ID NO: 2307176 - protein, 24 aa, Cryptosporidium parvum
YHLKCLMTRNNFHTFGAKCSHVNV

SEQ ID NO: 2307177 - protein, 20 aa, Cryptosporidium parvum
YHLLPFKSLFRLGINENILQ

SEQ ID NO: 2307178 - protein, 27 aa, Cryptosporidium parvum
YHMIDDYFPRYSIIPNKECIDKWCRLR

SEQ ID NO: 2307179 - protein, 20 aa, Cryptosporidium parvum
YHMLTGFPTLTPRFGLGKHQ

SEQ ID NO: 2307180 - protein, 23 aa, Cryptosporidium parvum
YHNGQFCRFLEWIPQSEKPEKGS

SEQ ID NO: 2307181 - protein, 20 aa, Cryptosporidium parvum
YHNIFHALQVVQVCYIILRN

SEQ ID NO: 2307182 - protein, 17 aa, Cryptosporidium parvum
YHPSPFFVLDEVDAALD

SEQ ID NO: 2307183 - protein, 17 aa, Cryptosporidium parvum
YHTAWDIGKRGCVAVKL

SEQ ID NO: 2307184 - protein, 25 aa, Cryptosporidium parvum
YHTPKISSGTLQWMSPELIQSKDYD

SEQ ID NO: 2307185 - protein, 24 aa, Cryptosporidium parvum
YHYKYSKYCSFQFPDSKKSSENKP

SEQ ID NO: 2307186 - protein, 17 aa, Cryptosporidium parvum
YIADLKMIGEKINKEKE

SEQ ID NO: 2307187 - protein, 26 aa, Cryptosporidium parvum
YICKPWIKKLLHKWGTGTMKKNATDE

SEQ ID NO: 2307188 - protein, 23 aa, Cryptosporidium parvum
YICPESFADFGLLIFVLSAIHPK

SEQ ID NO: 2307189 - protein, 17 aa, Cryptosporidium parvum
YIDGALEERDNINQNKI

SEQ ID NO: 2307190 - protein, 17 aa, Cryptosporidium parvum
YIDILRDQMMGMGELEH

SEQ ID NO: 2307191 - protein, 18 aa, Cryptosporidium parvum
YIDSYCHLVPTFSLGQFE

SEQ ID NO: 2307192 - protein, 23 aa, Cryptosporidium parvum
YIEYRKSPKWRYPIPLEDVIASI

SEQ ID NO: 2307193 - protein, 17 aa, Cryptosporidium parvum
YIGKFKFIYVVKLKNQR

SEQ ID NO: 2307194 - protein, 18 aa, Cryptosporidium parvum
YIHSAGIYHRDLKPANCL

SEQ ID NO: 2307195 - protein, 20 aa, Cryptosporidium parvum
YIIHCSWGNISKSTIRFEEY

SEQ ID NO: 2307196 - protein, 18 aa, Cryptosporidium parvum
YIKDDFWINYNFLNDSSD

SEQ ID NO: 2307197 - protein, 20 aa, Cryptosporidium parvum
YILKKRWTEDTVFRNQNRVS

SEQ ID NO: 2307198 - protein, 21 aa, Cryptosporidium parvum
YILLMRRLQSIYLLEPAGSRG

SEQ ID NO: 2307199 - protein, 20 aa, Cryptosporidium parvum
YILNCFLSAIKMLWKEGREQ

SEQ ID NO: 2307200 - protein, 17 aa, Cryptosporidium parvum
YILRNALDYILTGDCRL

SEQ ID NO: 2307201 - protein, 20 aa, Cryptosporidium parvum
YILYRLMVCINCVKESFDNF

SEQ ID NO: 2307202 - protein, 17 aa, Cryptosporidium parvum
YINFSFLSLIQDDIEAQ

SEQ ID NO: 2307203 - protein, 25 aa, Cryptosporidium parvum
YINIIKGLKFIGSIFKMRKKNNLNI

SEQ ID NO: 2307204 - protein, 18 aa, Cryptosporidium parvum
YINQRGIRGKFMSSSNLQ

SEQ ID NO: 2307205 - protein, 24 aa, Cryptosporidium parvum
YINSFIVILCDEFGNRISTGGHQL

SEQ ID NO: 2307206 - protein, 18 aa, Cryptosporidium parvum
YIPASSMGLDMLLMPPTV

SEQ ID NO: 2307207 - protein, 24 aa, Cryptosporidium parvum
YIPIFKKLKVSTVIRLNKKQYESE

SEQ ID NO: 2307208 - protein, 27 aa, Cryptosporidium parvum
YIPPKGELRGGAWVVVDSNINPEFIEM

SEQ ID NO: 2307209 - protein, 17 aa, Cryptosporidium parvum
YIPPYKWEEDLRNESKK

SEQ ID NO: 2307210 - protein, 28 aa, Cryptosporidium parvum
YIPYARSLDTHWLKYLLDSGLTMISDDS

SEQ ID NO: 2307211 - protein, 19 aa, Cryptosporidium parvum
YIQEKRKLGVWADNIEVQA

SEQ ID NO: 2307212 - protein, 19 aa, Cryptosporidium parvum
YIQNFKNFIILKIDQDYNI

SEQ ID NO: 2307213 - protein, 18 aa, Cryptosporidium parvum
YIQPRCKYNKIFKFTSCS

SEQ ID NO: 2307214 - protein, 25 aa, Cryptosporidium parvum
YIQSRFRISPTIKTLGCLNKSNKEN

SEQ ID NO: 2307215 - protein, 26 aa, Cryptosporidium parvum
YIRNCISCSISGIIYISGSPGTGKTC

SEQ ID NO: 2307216 - protein, 28 aa, Cryptosporidium parvum
YIRNKLPLCFLVLFKLETEYEILFKKSD

SEQ ID NO: 2307217 - protein, 24 aa, Cryptosporidium parvum
YIRTDIPIAILFRALGVLSDKDIL

SEQ ID NO: 2307218 - protein, 25 aa, Cryptosporidium parvum
YIRTMCVHMGLLLGVGAHMQELRRV

SEQ ID NO: 2307219 - protein, 20 aa, Cryptosporidium parvum
YIRVLPRIGDYLTLEGNIIP

SEQ ID NO: 2307220 - protein, 18 aa, Cryptosporidium parvum
YIRYFLSKMKEEFGNMDA

SEQ ID NO: 2307221 - protein, 19 aa, Cryptosporidium parvum
YISCLKTSILAHLDQNPEL

SEQ ID NO: 2307222 - protein, 23 aa, Cryptosporidium parvum
YISKSVLLYYFFEKWMNEKFVGE

SEQ ID NO: 2307223 - protein, 23 aa, Cryptosporidium parvum
YISLITGQLLRWNPDEVTTNLIV

SEQ ID NO: 2307224 - protein, 24 aa, Cryptosporidium parvum
YISYVFKKEFNGWFKFDDDIVTLV

SEQ ID NO: 2307225 - protein, 47 aa, Cryptosporidium parvum
YITEQNKMGPFGWFDGKYTIPGWRTMQMAYESFDFDNFDSKRLSNGT

SEQ ID NO: 2307226 - protein, 25 aa, Cryptosporidium parvum
YITSIEWIFHTKLLVFTIYRILDTF

SEQ ID NO: 2307227 - protein, 26 aa, Cryptosporidium parvum
YIWHAPCISKGWQLILKRKHIIHNSK

SEQ ID NO: 2307228 - protein, 24 aa, Cryptosporidium parvum
YIYFANKSFKMFLLSERGKYTSNI

SEQ ID NO: 2307229 - protein, 17 aa, Cryptosporidium parvum
YIYNFKIEKEMKILQFL

SEQ ID NO: 2307230 - protein, 19 aa, Cryptosporidium parvum
YIYSIKGGNLLINNEKDPD

SEQ ID NO: 2307231 - protein, 17 aa, Cryptosporidium parvum
YIYSPRELTRWKISIYS

SEQ ID NO: 2307232 - protein, 25 aa, Cryptosporidium parvum
YKALFPYPKKRFYRVDVLEASIEGY

SEQ ID NO: 2307233 - protein, 18 aa, Cryptosporidium parvum
YKANELIPTLKIIEDRYA

SEQ ID NO: 2307234 - protein, 20 aa, Cryptosporidium parvum
YKCFTKHCENILEFDQESKL

SEQ ID NO: 2307235 - protein, 19 aa, Cryptosporidium parvum
YKCPSELLFEVSSCIIFPA

SEQ ID NO: 2307236 - protein, 22 aa, Cryptosporidium parvum
YKDDEAVLCIKNNKFSLGSNND

SEQ ID NO: 2307237 - protein, 26 aa, Cryptosporidium parvum
YKDDIKWGHGIYRWSNGEVFEGEYVR

SEQ ID NO: 2307238 - protein, 21 aa, Cryptosporidium parvum
YKDIKKASVVHFIKENVRKAK

SEQ ID NO: 2307239 - protein, 18 aa, Cryptosporidium parvum
YKDVIPFTDIQNRMMEWN

SEQ ID NO: 2307240 - protein, 17 aa, Cryptosporidium parvum
YKDWESISFLVLSKDFI

SEQ ID NO: 2307241 - protein, 19 aa, Cryptosporidium parvum
YKEICTLYPFTDAKQIVMA

SEQ ID NO: 2307242 - protein, 25 aa, Cryptosporidium parvum
YKEIPNFLKVFHYIRNEADPDSEKK

SEQ ID NO: 2307243 - protein, 21 aa, Cryptosporidium parvum
YKELGERGITVFETCSDNQFV

SEQ ID NO: 2307244 - protein, 19 aa, Cryptosporidium parvum
YKERSCLNLYFINKQGMTF

SEQ ID NO: 2307245 - protein, 21 aa, Cryptosporidium parvum
YKESRQCPINKSPSWNSFADR

SEQ ID NO: 2307246 - protein, 24 aa, Cryptosporidium parvum
YKEVKEKVFIVGRLIRYVSKALNI

SEQ ID NO: 2307247 - protein, 23 aa, Cryptosporidium parvum
YKEYQLPFIFPFKSLSIGEIAAS

SEQ ID NO: 2307248 - protein, 22 aa, Cryptosporidium parvum
YKEYVELEMKRIIGESDPNALN

SEQ ID NO: 2307249 - protein, 20 aa, Cryptosporidium parvum
YKFGGGYAEEDRRREEEDDD

SEQ ID NO: 2307250 - protein, 25 aa, Cryptosporidium parvum
YKFIKSCSIGKFSRKQYLRMLLRKK

SEQ ID NO: 2307251 - protein, 21 aa, Cryptosporidium parvum
YKFISNSNVILWYDFETNNKR

SEQ ID NO: 2307252 - protein, 21 aa, Cryptosporidium parvum
YKFSDPSLKFCSIQSSHEHKT

SEQ ID NO: 2307253 - protein, 17 aa, Cryptosporidium parvum
YKFVISPNIKVPSISEI

SEQ ID NO: 2307254 - protein, 17 aa, Cryptosporidium parvum
YKGKNLVEKKVLRKVPV

SEQ ID NO: 2307255 - protein, 19 aa, Cryptosporidium parvum
YKGLGAFPVTDGFRELLVQ

SEQ ID NO: 2307256 - protein, 33 aa, Cryptosporidium parvum; identical to SEQ ID NO: 2184395

SEQ ID NO: 2307257 - protein, 32 aa, Cryptosporidium parvum
YKHEFFSGLIKLPFLSSEPEYINFPISQASIQ

SEQ ID NO: 2307258 - protein, 26 aa, Cryptosporidium parvum
YKIFEYKMNIEIPKFNDSMDLGFLSK

SEQ ID NO: 2307259 - protein, 24 aa, Cryptosporidium parvum
YKIFGNAIKIIWLVQGSYNLSNAA

SEQ ID NO: 2307260 - protein, 18 aa, Cryptosporidium parvum
YKIGISLLKKEWKKAFYL

SEQ ID NO: 2307261 - protein, 17 aa, Cryptosporidium parvum
YKIKWMGYSHLHNTWES

SEQ ID NO: 2307262 - protein, 21 aa, Cryptosporidium parvum
YKISKAMFESIKLYTLESRAW

SEQ ID NO: 2307263 - protein, 17 aa, Cryptosporidium parvum
YKIWKENTSLLYENIMT

SEQ ID NO: 2307264 - protein, 22 aa, Cryptosporidium parvum
YKKIHRKSTNSVTWDESAIDNE

SEQ ID NO: 2307265 - protein, 17 aa, Cryptosporidium parvum
YKKIWKRGVHLKSPNKK

SEQ ID NO: 2307266 - protein, 25 aa, Cryptosporidium parvum
YKKLKLKVILIDGTWSQAKSINKSL

SEQ ID NO: 2307267 - protein, 34 aa, Cryptosporidium parvum; identical to SEQ ID NO: 2184403

SEQ ID NO: 2307268 - protein, 18 aa, Cryptosporidium parvum
YKKREIVQDITLYDLDLA

SEQ ID NO: 2307269 - protein, 23 aa, Cryptosporidium parvum
YKKRKCFFAHLTPEFEKGELIMS

SEQ ID NO: 2307270 - protein, 26 aa, Cryptosporidium parvum
YKKYPRYFFNDPWPEIDVSKPIPYVK

SEQ ID NO: 2307271 - protein, 23 aa, Cryptosporidium parvum
YKLALKECVRYISGSLSINETIS

SEQ ID NO: 2307272 - protein, 21 aa, Cryptosporidium parvum
YKLDCIESIIKKIFSLGPLEN

SEQ ID NO: 2307273 - protein, 18 aa, Cryptosporidium parvum
YKLEINFSSLYYKKISNR

SEQ ID NO: 2307274 - protein, 17 aa, Cryptosporidium parvum
YKLHTVFNKNFKIIIKV

SEQ ID NO: 2307275 - protein, 25 aa, Cryptosporidium parvum
YKLIPIDHGLCLPDVLDVAQFDWVW

SEQ ID NO: 2307276 - protein, 21 aa, Cryptosporidium parvum
YKLLVECAIKIQSLLEDEHEL

SEQ ID NO: 2307277 - protein, 20 aa, Cryptosporidium parvum
YKLLVICDSYIGCDQEFMFS

SEQ ID NO: 2307278 - protein, 22 aa, Cryptosporidium parvum
YKLNGLGIEFKCEICGNCSYWG

SEQ ID NO: 2307279 - protein, 19 aa, Cryptosporidium parvum
YKLPNKFSTSLPRSVIEYL

SEQ ID NO: 2307280 - protein, 18 aa, Cryptosporidium parvum
YKMELDIRRMLDKTSSSN

SEQ ID NO: 2307281 - protein, 22 aa, Cryptosporidium parvum
YKMSIQEWKDFLASIEPKDKRY

SEQ ID NO: 2307282 - protein, 20 aa, Cryptosporidium parvum
YKMSISFYLITQVLYRVSTR

SEQ ID NO: 2307283 - protein, 18 aa, Cryptosporidium parvum
YKNALIYVDYTFPENKNL

SEQ ID NO: 2307284 - protein, 22 aa, Cryptosporidium parvum
YKNDLYRLLARYLVERQDLDLW

SEQ ID NO: 2307285 - protein, 20 aa, Cryptosporidium parvum
YKNELDSFSGIGIVDNSLNM

SEQ ID NO: 2307286 - protein, 26 aa, Cryptosporidium parvum
YKNFAYRDALKYALFEFQLRRDQYRL

SEQ ID NO: 2307287 - protein, 18 aa, Cryptosporidium parvum
YKNFNFRIMILPKVKLTS

SEQ ID NO: 2307288 - protein, 23 aa, Cryptosporidium parvum
YKNRPRLNPNFPTISLEIATEGD

SEQ ID NO: 2307289 - protein, 19 aa, Cryptosporidium parvum
YKNTITLQEFVNLYLSKGY

SEQ ID NO: 2307290 - protein, 20 aa, Cryptosporidium parvum
YKNTSIIKDCLKKENISQRN

SEQ ID NO: 2307291 - protein, 26 aa, Cryptosporidium parvum
YKNYLKSRRKFFKSVEAILSNFSANP

SEQ ID NO: 2307292 - protein, 17 aa, Cryptosporidium parvum
YKPAWILSLLHLSPTEH

SEQ ID NO: 2307293 - protein, 21 aa, Cryptosporidium parvum
YKPDPTPAYNFSDEKLRDVQK

SEQ ID NO: 2307294 - protein, 41 aa, Cryptosporidium parvum; identical to SEQ ID NO: 2184421

SEQ ID NO: 2307295 - protein, 17 aa, Cryptosporidium parvum
YKQELLRRSDLEELKRT

SEQ ID NO: 2307296 - protein, 17 aa, Cryptosporidium parvum
YKQGFAQLRRFYEVRGM

SEQ ID NO: 2307297 - protein, 23 aa, Cryptosporidium parvum
YKQKAIYFLSIIILTRYLRDNAL

SEQ ID NO: 2307298 - protein, 23 aa, Cryptosporidium parvum
YKRFSRELIEKISYGVDKFELKS

SEQ ID NO: 2307299 - protein, 25 aa, Cryptosporidium parvum
YKRLEHLRESGLLKRSLGGIQNEAI

SEQ ID NO: 2307300 - protein, 18 aa, Cryptosporidium parvum
YKRMSGNLLLSLESCPQR

SEQ ID NO: 2307301 - protein, 33 aa, Cryptosporidium parvum
YKRNKKRITGIIKRASIEIEKPLILNEYQTNSF

SEQ ID NO: 2307302 - protein, 18 aa, Cryptosporidium parvum
YKRRKKFSQRNILSTTCN

SEQ ID NO: 2307303 - protein, 24 aa, Cryptosporidium parvum
YKSFFCCQETLNGKNENKIYEIQR

SEQ ID NO: 2307304 - protein, 21 aa, Cryptosporidium parvum
YKSMTLHYWLFGFEFSDTLIL

SEQ ID NO: 2307305 - protein, 18 aa, Cryptosporidium parvum
YKSPMVPRKASNHSYHIS

SEQ ID NO: 2307306 - protein, 19 aa, Cryptosporidium parvum
YKSPTLLRNIIKQGYSSSY

SEQ ID NO: 2307307 - protein, 20 aa, Cryptosporidium parvum
YKSQESFLRNKKEMDSLITM

SEQ ID NO: 2307308 - protein, 19 aa, Cryptosporidium parvum
YKSSLREKDTLIVKLNGSI

SEQ ID NO: 2307309 - protein, 18 aa, Cryptosporidium parvum
YKSYCPVQIFNSDTIFKK

SEQ ID NO: 2307310 - protein, 19 aa, Cryptosporidium parvum
YKTGASLVLSKFINEDHIT

SEQ ID NO: 2307311 - protein, 20 aa, Cryptosporidium parvum
YKTKICEQFQRGDCNTYYCH

SEQ ID NO: 2307312 - protein, 17 aa, Cryptosporidium parvum
YKTPRLISNLENIENHQ

SEQ ID NO: 2307313 - protein, 18 aa, Cryptosporidium parvum
YKTSSILFAPFFNKIKRL

SEQ ID NO: 2307314 - protein, 20 aa, Cryptosporidium parvum
YKTYVHRFIFALATIIPLSG

SEQ ID NO: 2307315 - protein, 17 aa, Cryptosporidium parvum
YKVPNFLIDHVNLDINI

SEQ ID NO: 2307316 - protein, 22 aa, Cryptosporidium parvum
YKVRILLCLVDIPPSGAIDAAI

SEQ ID NO: 2307317 - protein, 19 aa, Cryptosporidium parvum
YKVSPKKKVEFMRYEYNST

SEQ ID NO: 2307318 - protein, 21 aa, Cryptosporidium parvum
YKVSTSMLFDIQVKRIHEYKR

SEQ ID NO: 2307319 - protein, 17 aa, Cryptosporidium parvum
YKWDKEHPILLTSNYNL

SEQ ID NO: 2307320 - protein, 19 aa, Cryptosporidium parvum
YKYISPYSEYLLERLKWKI

SEQ ID NO: 2307321 - protein, 20 aa, Cryptosporidium parvum
YKYLIDYSCLLEFSPDGLYV

SEQ ID NO: 2307322 - protein, 18 aa, Cryptosporidium parvum
YKYLIFKERYHNGNYYDK

SEQ ID NO: 2307323 - protein, 23 aa, Cryptosporidium parvum
YKYNEAKSLLSILVEHNNYNSEF

SEQ ID NO: 2307324 - protein, 24 aa, Cryptosporidium parvum
YKYPEVTCSYPFVSSPPYVVHYMS

SEQ ID NO: 2307325 - protein, 21 aa, Cryptosporidium parvum
YKYPKSLSFPGYIETLSMCIA

SEQ ID NO: 2307326 - protein, 21 aa, Cryptosporidium parvum
YLAEMRKLRSKFEAQYNEIYS

SEQ ID NO: 2307327 - protein, 33 aa, Cryptosporidium parvum
YLCHNIQCGSIRIVILGVLYRISNILNILSDRY

SEQ ID NO: 2307328 - protein, 23 aa, Cryptosporidium parvum
YLCIRLRELGCDHIFGVPGDYAL

SEQ ID NO: 2307329 - protein, 18 aa, Cryptosporidium parvum
YLDEFDWKRLRSDILNLT

SEQ ID NO: 2307330 - protein, 18 aa, Cryptosporidium parvum
YLDFFGNKKVCLLGDEEY

SEQ ID NO: 2307331 - protein, 28 aa, Cryptosporidium parvum
YLDISFIPQFKCCIDCNPTTIKLNKKMA

SEQ ID NO: 2307332 - protein, 28 aa, Cryptosporidium parvum
YLDNFEFLLSIMRKMTCDIKHLSDQERR

SEQ ID NO: 2307333 - protein, 18 aa, Cryptosporidium parvum
YLEGCNSELILLIHRRIS

SEQ ID NO: 2307334 - protein, 18 aa, Cryptosporidium parvum
YLEKLMNYICEIVKLYWT

SEQ ID NO: 2307335 - protein, 17 aa, Cryptosporidium parvum
YLELGLLCNPEVLPKVI

SEQ ID NO: 2307336 - protein, 18 aa, Cryptosporidium parvum
YLELIKEANVDLVDSDKY

SEQ ID NO: 2307337 - protein, 21 aa, Cryptosporidium parvum
YLEMGQVLFIWDFELKENNIN

SEQ ID NO: 2307338 - protein, 18 aa, Cryptosporidium parvum
YLERVFYPVDERWISILD

SEQ ID NO: 2307339 - protein, 17 aa, Cryptosporidium parvum
YLEWQVIEGTYVYQFQK

SEQ ID NO: 2307340 - protein, 17 aa, Cryptosporidium parvum
YLFRKGYLEPIVMKKGY

SEQ ID NO: 2307341 - protein, 25 aa, Cryptosporidium parvum
YLGFTCLYITIKIERVVNFNFKEII

SEQ ID NO: 2307342 - protein, 25 aa, Cryptosporidium parvum
YLGISCKLKYFYDIEEFLKDYNTIS

SEQ ID NO: 2307343 - protein, 27 aa, Cryptosporidium parvum
YLHDCYRRQPVLPGLIICGDFNSTPDS

SEQ ID NO: 2307344 - protein, 27 aa, Cryptosporidium parvum
YLHGYNIKNGFKFMSWNDLSASAKINQ

SEQ ID NO: 2307345 - protein, 20 aa, Cryptosporidium parvum
YLHIVLRLLQPVKIEKVSEL

SEQ ID NO: 2307346 - protein, 20 aa, Cryptosporidium parvum
YLHLMCKEFHSELSSFMGIS

SEQ ID NO: 2307347 - protein, 17 aa, Cryptosporidium parvum
YLHVIRWKVRNTKLELE

SEQ ID NO: 2307348 - protein, 22 aa, Cryptosporidium parvum
YLICTRAGGLGINLVSANHVVM

SEQ ID NO: 2307349 - protein, 22 aa, Cryptosporidium parvum
YLILQFPNWFWRSASEEYIVRW

SEQ ID NO: 2307350 - protein, 20 aa, Cryptosporidium parvum
YLIQEFKKTQGIDLSRDKLA

SEQ ID NO: 2307351 - protein, 22 aa, Cryptosporidium parvum
YLITKLCLDFGIYDSNLFSNTI

SEQ ID NO: 2307352 - protein, 19 aa, Cryptosporidium parvum
YLKAMLRKYMNAGCHINKI

SEQ ID NO: 2307353 - protein, 17 aa, Cryptosporidium parvum
YLKEKLRSLSQALNTSD

SEQ ID NO: 2307354 - protein, 23 aa, Cryptosporidium parvum
YLKELRFLVENTILAVADRNSEN

SEQ ID NO: 2307355 - protein, 21 aa, Cryptosporidium parvum
YLKLVPSVIEIFKIVRDAPNR

SEQ ID NO: 2307356 - protein, 30 aa, Cryptosporidium parvum; identical to SEQ ID NO: 2184475

SEQ ID NO: 2307357 - protein, 21 aa, Cryptosporidium parvum
YLKSLLKRKVHSHSSIRVVFP

SEQ ID NO: 2307358 - protein, 23 aa, Cryptosporidium parvum
YLKWTKDCLEIYSGPQKCDPETL

SEQ ID NO: 2307359 - protein, 41 aa, Cryptosporidium parvum
YLLDNTILPFDWFPNLCRIPYRIYYSSGISVFGTESSNESI

SEQ ID NO: 2307360 - protein, 25 aa, Cryptosporidium parvum
YLLEFKDSFQAWQICSELLEVSVEP

SEQ ID NO: 2307361 - protein, 25 aa, Cryptosporidium parvum
YLLNKMGIYLIHFFQSLNDISNDKV

SEQ ID NO: 2307362 - protein, 17 aa, Cryptosporidium parvum
YLLYILEDFVPAFIETI

SEQ ID NO: 2307363 - protein, 23 aa, Cryptosporidium parvum
YLMDEIKLLESILEESKDDHTLE

SEQ ID NO: 2307364 - protein, 17 aa, Cryptosporidium parvum
YLMPEFLLKHVNINNDD

SEQ ID NO: 2307365 - protein, 17 aa, Cryptosporidium parvum
YLNFWKRSNGLPVPVDR

SEQ ID NO: 2307366 - protein, 22 aa, Cryptosporidium parvum
YLNNEYLSIGIIQMLYILNKQW

SEQ ID NO: 2307367 - protein, 19 aa, Cryptosporidium parvum
YLNPYCPRCKVDTVCNLKR

SEQ ID NO: 2307368 - protein, 20 aa, Cryptosporidium parvum
YLPNCSNNIFLVAGNNQDIT

SEQ ID NO: 2307369 - protein, 24 aa, Cryptosporidium parvum
YLPTKCPVCLIYLISPNHLAKSFA

SEQ ID NO: 2307370 - protein, 17 aa, Cryptosporidium parvum
YLQKKGIKYPRNNYGND

SEQ ID NO: 2307371 - protein, 23 aa, Cryptosporidium parvum
YLRCKICNYRFLKLHNHNSSDST

SEQ ID NO: 2307372 - protein, 22 aa, Cryptosporidium parvum
YLREKYGILSIIEEKKQDILDE

SEQ ID NO: 2307373 - protein, 17 aa, Cryptosporidium parvum
YLRKCINEGQSEYIKFT

SEQ ID NO: 2307374 - protein, 25 aa, Cryptosporidium parvum
YLSDLVCCLWGSPGVYGVVTTPFSV

SEQ ID NO: 2307375 - protein, 23 aa, Cryptosporidium parvum
YLSKRGGILITTFETFRNDVHKL

SEQ ID NO: 2307376 - protein, 20 aa, Cryptosporidium parvum
YLSNIRELLPTCLKKNDLSY

SEQ ID NO: 2307377 - protein, 19 aa, Cryptosporidium parvum
YLSRFSIELGKLINSNITN

SEQ ID NO: 2307378 - protein, 28 aa, Cryptosporidium parvum
YLSSEIIQRWVVICSKLIEQSSLLSETD

SEQ ID NO: 2307379 - protein, 18 aa, Cryptosporidium parvum
YLSSFCALIANYFNPLLF

SEQ ID NO: 2307380 - protein, 27 aa, Cryptosporidium parvum
YLSTGSFVIRGKKNFLPPLKLEMGCAL

SEQ ID NO: 2307381 - protein, 19 aa, Cryptosporidium parvum
YLSYIECARQCIPNNIEIV

SEQ ID NO: 2307382 - protein, 21 aa, Cryptosporidium parvum
YLTRRVKGVNIGLFLHIPFPS

SEQ ID NO: 2307383 - protein, 18 aa, Cryptosporidium parvum
YLTTILLCDRLIMTGTFT

SEQ ID NO: 2307384 - protein, 17 aa, Cryptosporidium parvum
YLTVLGIKSEKYVPTIK

SEQ ID NO: 2307385 - protein, 17 aa, Cryptosporidium parvum
YLVELSIDSHSSKMVEK

SEQ ID NO: 2307386 - protein, 24 aa, Cryptosporidium parvum
YLVFKRLNIKIIYYCTSNYSHKPC

SEQ ID NO: 2307387 - protein, 22 aa, Cryptosporidium parvum
YLVFRLFKCDNLAAADGVTGTS

SEQ ID NO: 2307388 - protein, 48 aa, Cryptosporidium parvum
YLVMIRCSIKFFSLYRHIKRKNACIQICKALRRYVCIKREERERIERE

SEQ ID NO: 2307389 - protein, 20 aa, Cryptosporidium parvum
YLVMRHFCTCHSYIDKVVLQ

SEQ ID NO: 2307390 - protein, 17 aa, Cryptosporidium parvum
YLVRKCLSIRLWPDESD

SEQ ID NO: 2307391 - protein, 21 aa, Cryptosporidium parvum
YLWDPCSLLFDSIRGSGLAYS

SEQ ID NO: 2307392 - protein, 21 aa, Cryptosporidium parvum
YLYDTMLSYTLEWPTLTIDWL

SEQ ID NO: 2307393 - protein, 18 aa, Cryptosporidium parvum
YMAPEVILGKGYNLSCDA

SEQ ID NO: 2307394 - protein, 21 aa, Cryptosporidium parvum
YMDSSCLNGFLTQGLNSIEML

SEQ ID NO: 2307395 - protein, 17 aa, Cryptosporidium parvum
YMEEVLGSLWCLDNVPG

SEQ ID NO: 2307396 - protein, 24 aa, Cryptosporidium parvum
YMFEYESFCKLRWRDRTLRDLFLN

SEQ ID NO: 2307397 - protein, 18 aa, Cryptosporidium parvum
YMKDLRIIQGANLKRTVL

SEQ ID NO: 2307398 - protein, 27 aa, Cryptosporidium parvum
YMKERHWKLLLSKVIWHEKTSNSGLES

SEQ ID NO: 2307399 - protein, 35 aa, Cryptosporidium parvum; identical to SEQ ID NO: 2184518

SEQ ID NO: 2307400 - protein, 20 aa, Cryptosporidium parvum
YMKLQLCDASNQIVKGNSIY

SEQ ID NO: 2307401 - protein, 18 aa, Cryptosporidium parvum
YMMVRAKASLHLVAHRGA

SEQ ID NO: 2307402 - protein, 20 aa, Cryptosporidium parvum
YMNAGLQFISAMGIFTEENF

SEQ ID NO: 2307403 - protein, 19 aa, Cryptosporidium parvum
YMNRKGRKNPYYSAKNINL

SEQ ID NO: 2307404 - protein, 17 aa, Cryptosporidium parvum
YMQSNWTGPPFKIDDGV

SEQ ID NO: 2307405 - protein, 26 aa, Cryptosporidium parvum
YNAKEYLFKAFLIILSLEDNVDAQIK

SEQ ID NO: 2307406 - protein, 17 aa, Cryptosporidium parvum
YNALVVAEKAKLRKIRQ

SEQ ID NO: 2307407 - protein, 23 aa, Cryptosporidium parvum
YNATCISISQNIRMRTQNYENSA

SEQ ID NO: 2307408 - protein, 22 aa, Cryptosporidium parvum
YNCVSEGRIAGTYHNEQSTGIA

SEQ ID NO: 2307409 - protein, 25 aa, Cryptosporidium parvum
YNDCNKMSLLFSWYTYVPNSELDTS

SEQ ID NO: 2307410 - protein, 20 aa, Cryptosporidium parvum
YNDLFPEFVNNHIFKNCYSF

SEQ ID NO: 2307411 - protein, 19 aa, Cryptosporidium parvum
YNEGIPFVQPMTADNLKHS

SEQ ID NO: 2307412 - protein, 27 aa, Cryptosporidium parvum
YNELMLSRMDLFKVWVFLGNLEMISKG

SEQ ID NO: 2307413 - protein, 24 aa, Cryptosporidium parvum
YNEMLTLLSCDSFPYISKLSFVDR

SEQ ID NO: 2307414 - protein, 17 aa, Cryptosporidium parvum
YNFREFYSVYTPSKEEI

SEQ ID NO: 2307415 - protein, 22 aa, Cryptosporidium parvum
YNGDLLKRVNFDTLYSAYWSPK

SEQ ID NO: 2307416 - protein, 30 aa, Cryptosporidium parvum; identical to SEQ ID NO: 2184538

SEQ ID NO: 2307417 - protein, 19 aa, Cryptosporidium parvum
YNIGVGDWFLIPDNTNYNF

SEQ ID NO: 2307418 - protein, 26 aa, Cryptosporidium parvum
YNISDGPWRACLCRLGYDPRKDPESR

SEQ ID NO: 2307419 - protein, 22 aa, Cryptosporidium parvum
YNISTCNFLKNAISNGINLTVF

SEQ ID NO: 2307420 - protein, 25 aa, Cryptosporidium parvum
YNKDKRILVSLSLQRELKVYILELR

SEQ ID NO: 2307421 - protein, 23 aa, Cryptosporidium parvum
YNKIKWNSIYAIGLLFENDNFYN

SEQ ID NO: 2307422 - protein, 25 aa, Cryptosporidium parvum
YNKPGSCGWDIFTLDFNIPERTNLS

SEQ ID NO: 2307423 - protein, 21 aa, Cryptosporidium parvum
YNKRRAWFSVRSRGVLEAFNL

SEQ ID NO: 2307424 - protein, 17 aa, Cryptosporidium parvum
YNKVCVEKKRSRSFDRS

SEQ ID NO: 2307425 - protein, 20 aa, Cryptosporidium parvum
YNKVKDLFCKKMNMVQNDGG

SEQ ID NO: 2307426 - protein, 17 aa, Cryptosporidium parvum
YNLDSMASIILFEKNAP

SEQ ID NO: 2307427 - protein, 23 aa, Cryptosporidium parvum
YNLEFKQPVLLASYLEGFVKPCN

SEQ ID NO: 2307428 - protein, 17 aa, Cryptosporidium parvum
YNLFDFYWLFFRTYNGL

SEQ ID NO: 2307429 - protein, 18 aa, Cryptosporidium parvum
YNLPKLLERIIGSSLSGL

SEQ ID NO: 2307430 - protein, 26 aa, Cryptosporidium parvum
YNLRKQVLCDLILPFVSSEAFADLRT

SEQ ID NO: 2307431 - protein, 24 aa, Cryptosporidium parvum
YNLRLESFEFWPLYLRNEKGINIL

SEQ ID NO: 2307432 - protein, 17 aa, Cryptosporidium parvum
YNLTGFSSITEIKWLME

SEQ ID NO: 2307433 - protein, 41 aa, Cryptosporidium parvum; identical to SEQ ID NO: 2184552

SEQ ID NO: 2307434 - protein, 22 aa, Cryptosporidium parvum
YNNKKCWPRECRMRLVKNDVII

SEQ ID NO: 2307435 - protein, 17 aa, Cryptosporidium parvum
YNNLRITTLCVIPNYIL

SEQ ID NO: 2307436 - protein, 20 aa, Cryptosporidium parvum
YNNLTKYKRLIIKKTNVEEN

SEQ ID NO: 2307437 - protein, 27 aa, Cryptosporidium parvum
YNNSVCYRGSSSFGCVQNHSLSNIAEG

SEQ ID NO: 2307438 - protein, 20 aa, Cryptosporidium parvum
YNPLIPWSYGAQIVALNYQA

SEQ ID NO: 2307439 - protein, 19 aa, Cryptosporidium parvum
YNPSSFKFTSLIDTNSEEF

SEQ ID NO: 2307440 - protein, 21 aa, Cryptosporidium parvum
YNPTWHCVVGRNFGSYVTHET

SEQ ID NO: 2307441 - protein, 24 aa, Cryptosporidium parvum
YNQDRRGRGYGYSGNRQHNHGSSS

SEQ ID NO: 2307442 - protein, 19 aa, Cryptosporidium parvum
YNREVPKNLLSLNVKSSID

SEQ ID NO: 2307443 - protein, 25 aa, Cryptosporidium parvum
YNRFNWKGWVDFHISSIKLNDTFHQ

SEQ ID NO: 2307444 - protein, 17 aa, Cryptosporidium parvum
YNRIPCLVITGKGFPDI

SEQ ID NO: 2307445 - protein, 24 aa, Cryptosporidium parvum
YNRTFMYRYYFNNIIFSLKAVTNN

SEQ ID NO: 2307446 - protein, 17 aa, Cryptosporidium parvum
YNSGLGWSLLKSLCFTD

SEQ ID NO: 2307447 - protein, 23 aa, Cryptosporidium parvum
YNSGSSCSCHICSKHNAHDKIID

SEQ ID NO: 2307448 - protein, 17 aa, Cryptosporidium parvum
YNSLCLLDYDTGIRPFM

SEQ ID NO: 2307449 - protein, 24 aa, Cryptosporidium parvum
YNSLLKFSIHNGIGFLYKNQSFKE

SEQ ID NO: 2307450 - protein, 26 aa, Cryptosporidium parvum
YNSLLYKTQCLIGWFEFKNLQFEKAF

SEQ ID NO: 2307451 - protein, 22 aa, Cryptosporidium parvum
YNSLWAELQWDGEKFDKVMGYF

SEQ ID NO: 2307452 - protein, 24 aa, Cryptosporidium parvum
YNSRKRVHFLLAIEIADLDDQDYE

SEQ ID NO: 2307453 - protein, 20 aa, Cryptosporidium parvum
YNSSLKFSKSSNHVDIDLIK

SEQ ID NO: 2307454 - protein, 19 aa, Cryptosporidium parvum
YNSSLTITTPVKFKKLYND

SEQ ID NO: 2307455 - protein, 30 aa, Cryptosporidium parvum; identical to SEQ ID NO: 2184569

SEQ ID NO: 2307456 - protein, 17 aa, Cryptosporidium parvum
YNSYKNFAYRDALKYAL

SEQ ID NO: 2307457 - protein, 17 aa, Cryptosporidium parvum
YNTIGIRIPNIELIKQR

SEQ ID NO: 2307458 - protein, 18 aa, Cryptosporidium parvum
YNTIPTFLSEVDYSSQGR

SEQ ID NO: 2307459 - protein, 20 aa, Cryptosporidium parvum
YNTSIVKMIIFETENRSYEI

SEQ ID NO: 2307460 - protein, 25 aa, Cryptosporidium parvum
YNVAKEIFESFILEIKSLWNHQVDI

SEQ ID NO: 2307461 - protein, 18 aa, Cryptosporidium parvum
YNWGVKFIINNSTPELLI

SEQ ID NO: 2307462 - protein, 21 aa, Cryptosporidium parvum
YNYGYPIYFLKGLYKENVLDF

SEQ ID NO: 2307463 - protein, 21 aa, Cryptosporidium parvum
YNYKKCTLWDLEFSHQINPLS

SEQ ID NO: 2307464 - protein, 17 aa, Cryptosporidium parvum
YPEIRFIIFMNDREYFR

SEQ ID NO: 2307465 - protein, 25 aa, Cryptosporidium parvum
YPEKKRFTIYGALVFENDVRNLLSY

SEQ ID NO: 2307466 - protein, 23 aa, Cryptosporidium parvum
YPEMIRYHFKEAFSVNEGVEARE

SEQ ID NO: 2307467 - protein, 23 aa, Cryptosporidium parvum
YPEMKLKIQLLIEKGFLNENLTI

SEQ ID NO: 2307468 - protein, 20 aa, Cryptosporidium parvum
YPEPRQLLIKKVGDPNMEGV

SEQ ID NO: 2307469 - protein, 28 aa, Cryptosporidium parvum
YPERQSWKVVGHTGISWCVRRKTWRVWF

SEQ ID NO: 2307470 - protein, 24 aa, Cryptosporidium parvum
YPFTFKLCIYFDFKTQIAYYSAFF

SEQ ID NO: 2307471 - protein, 26 aa, Cryptosporidium parvum
YPHQKEGVLWMWGLYCNNHGGILADE

SEQ ID NO: 2307472 - protein, 23 aa, Cryptosporidium parvum
YPICIKERNGIIYVLYDDGALMS

SEQ ID NO: 2307473 - protein, 25 aa, Cryptosporidium parvum
YPIDDRLYLWNGLYWIRILDQSKSG

SEQ ID NO: 2307474 - protein, 24 aa, Cryptosporidium parvum
YPKFSEKLRVLFSLDGENGNCKLF

SEQ ID NO: 2307475 - protein, 17 aa, Cryptosporidium parvum
YPKGFVIANDLDTRRAH

SEQ ID NO: 2307476 - protein, 17 aa, Cryptosporidium parvum
YPLDASIYMGHYAASNV

SEQ ID NO: 2307477 - protein, 17 aa, Cryptosporidium parvum
YPLEVVKVSVPSGVTQI

SEQ ID NO: 2307478 - protein, 26 aa, Cryptosporidium parvum
YPLLEFYKSNYFFSLYEDIDYQTRQT

SEQ ID NO: 2307479 - protein, 20 aa, Cryptosporidium parvum
YPMYSFAGGILIAVNPYKEY

SEQ ID NO: 2307480 - protein, 20 aa, Cryptosporidium parvum
YPMYVSLAVSVGRLVQNPLA

SEQ ID NO: 2307481 - protein, 26 aa, Cryptosporidium parvum
YPNCNRYYCPFSHGIEQIRAPEKVRE

SEQ ID NO: 2307482 - protein, 24 aa, Cryptosporidium parvum
YPNHVLCCRIFILVIQKVSERERK

SEQ ID NO: 2307483 - protein, 23 aa, Cryptosporidium parvum
YPNKRNILTAINWLTRDAEAGDI

SEQ ID NO: 2307484 - protein, 19 aa, Cryptosporidium parvum
YPPPIKILKLCLSSLKVIV

SEQ ID NO: 2307485 - protein, 21 aa, Cryptosporidium parvum
YPQRLRFYLDDGSGLILIDWL

SEQ ID NO: 2307486 - protein, 19 aa, Cryptosporidium parvum
YPRLYPLHHSLILSESNNE

SEQ ID NO: 2307487 - protein, 17 aa, Cryptosporidium parvum
YPSIGHFALLGSSNSQL

SEQ ID NO: 2307488 - protein, 23 aa, Cryptosporidium parvum
YPSIIQEFNICFTTREPTDLGPD

SEQ ID NO: 2307489 - protein, 20 aa, Cryptosporidium parvum
YPSIQRILRRICKRAIIEFF

SEQ ID NO: 2307490 - protein, 26 aa, Cryptosporidium parvum
YPSSPNLWLLYGFIYRKAFPDRINEA

SEQ ID NO: 2307491 - protein, 21 aa, Cryptosporidium parvum
YPTVIEIVDFVAAQISGKELH

SEQ ID NO: 2307492 - protein, 17 aa, Cryptosporidium parvum
YPTVPYPFSIDSDDGHL

SEQ ID NO: 2307493 - protein, 22 aa, Cryptosporidium parvum
YPTYDFACPIVDSIEGVTHALR

SEQ ID NO: 2307494 - protein, 18 aa, Cryptosporidium parvum
YPVAKSRYAKLVDILHFK

SEQ ID NO: 2307495 - protein, 24 aa, Cryptosporidium parvum
YPVRVLPGMVLKVGQCKMEILPYM

SEQ ID NO: 2307496 - protein, 21 aa, Cryptosporidium parvum
YPVVKNTLLALSFIDNLVPNS

SEQ ID NO: 2307497 - protein, 18 aa, Cryptosporidium parvum
YPYKIKRSISIASISKCE

SEQ ID NO: 2307498 - protein, 17 aa, Cryptosporidium parvum
YQEPEIIFYHPPSSFSI

SEQ ID NO: 2307499 - protein, 28 aa, Cryptosporidium parvum
YQGIRIINILSCLSELVILEESSTEQLI

SEQ ID NO: 2307500 - protein, 26 aa, Cryptosporidium parvum
YQHLLRCANLFLAKNILFTRVKIAKK

SEQ ID NO: 2307501 - protein, 17 aa, Cryptosporidium parvum
YQHPAAWRQSCGARIWS

SEQ ID NO: 2307502 - protein, 18 aa, Cryptosporidium parvum
YQHRVCYVDIDIHHGDGV

SEQ ID NO: 2307503 - protein, 24 aa, Cryptosporidium parvum
YQIKYYYYHSMTWPQLLDIATDSN

SEQ ID NO: 2307504 - protein, 17 aa, Cryptosporidium parvum
YQILSLRKVGINLPPYV

SEQ ID NO: 2307505 - protein, 19 aa, Cryptosporidium parvum
YQILTRIAMDTSLRYSLHL

SEQ ID NO: 2307506 - protein, 25 aa, Cryptosporidium parvum
YQIRCFNQDLPKCMDLLSDIIKNSK

SEQ ID NO: 2307507 - protein, 19 aa, Cryptosporidium parvum
YQIYRRLMVFSYNRYPMNY

SEQ ID NO: 2307508 - protein, 17 aa, Cryptosporidium parvum
YQKKGWGVFESKLKESC

SEQ ID NO: 2307509 - protein, 19 aa, Cryptosporidium parvum
YQLIPSIIRILSYAKNMFL

SEQ ID NO: 2307510 - protein, 19 aa, Cryptosporidium parvum
YQMKGLEWLVSLYNNNLNG

SEQ ID NO: 2307511 - protein, 19 aa, Cryptosporidium parvum
YQRCKCLFGNNSLNLRIEL

SEQ ID NO: 2307512 - protein, 20 aa, Cryptosporidium parvum
YQRCNSAPFLTWSIFLIEFL

SEQ ID NO: 2307513 - protein, 18 aa, Cryptosporidium parvum
YQSLELPYRVISIVSGAL

SEQ ID NO: 2307514 - protein, 18 aa, Cryptosporidium parvum
YQTDPSGIALEWKAQAVG

SEQ ID NO: 2307515 - protein, 29 aa, Cryptosporidium parvum
YQVDIKKLWKLNGTVYSRDLLLEYFSNIL

SEQ ID NO: 2307516 - protein, 19 aa, Cryptosporidium parvum
YQVEFCLSIAKSMKTKPSN

SEQ ID NO: 2307517 - protein, 22 aa, Cryptosporidium parvum
YQWDFLSKFYRVYISDQYKFVS

SEQ ID NO: 2307518 - protein, 28 aa, Cryptosporidium parvum
YQYPPCCPNSSLGGSMGYNFGGIDDSNS

SEQ ID NO: 2307519 - protein, 22 aa, Cryptosporidium parvum
YQYRCVPNTKKAGLLTEEVISS

SEQ ID NO: 2307520 - protein, 20 aa, Cryptosporidium parvum
YRDGLNFQNLMNLKNRLQGY

SEQ ID NO: 2307521 - protein, 18 aa, Cryptosporidium parvum
YRDLGFYGVPGRAGVSNV

SEQ ID NO: 2307522 - protein, 22 aa, Cryptosporidium parvum
YRDSKPLKGARITGSLHLTIET

SEQ ID NO: 2307523 - protein, 22 aa, Cryptosporidium parvum
YRELINIVEYIVRMEGSDIIEI

SEQ ID NO: 2307524 - protein, 18 aa, Cryptosporidium parvum
YRELLGYLQMVRRLKDSR

SEQ ID NO: 2307525 - protein, 23 aa, Cryptosporidium parvum
YRENLRKSQLIKMMVHSEKNRIV

SEQ ID NO: 2307526 - protein, 20 aa, Cryptosporidium parvum
YRETSHIPSCLFEQDNTNNL

SEQ ID NO: 2307527 - protein, 18 aa, Cryptosporidium parvum
YRFGELLKELEAKKEGLT

SEQ ID NO: 2307528 - protein, 22 aa, Cryptosporidium parvum
YRGEHLLEIVASILSKIFNMYL

SEQ ID NO: 2307529 - protein, 20 aa, Cryptosporidium parvum
YRGKYVVLFFYPLNFTFVCP

SEQ ID NO: 2307530 - protein, 20 aa, Cryptosporidium parvum
YRGSYIPRMSPYEFLRNVNN

SEQ ID NO: 2307531 - protein, 23 aa, Cryptosporidium parvum
YRHKELPLNICHFSTLPSTQIWA

SEQ ID NO: 2307532 - protein, 17 aa, Cryptosporidium parvum
YRHSIFGNFRWNNKRRR

SEQ ID NO: 2307533 - protein, 20 aa, Cryptosporidium parvum
YRINHLRSRFIYTKYYLDKE

SEQ ID NO: 2307534 - protein, 23 aa, Cryptosporidium parvum
YRKAHIELLKDYRVVTIRVACRL

SEQ ID NO: 2307535 - protein, 21 aa, Cryptosporidium parvum
YRKEFDACLDTLVISGSIRKI

SEQ ID NO: 2307536 - protein, 17 aa, Cryptosporidium parvum
YRKLFLNLIEECIQNID

SEQ ID NO: 2307537 - protein, 17 aa, Cryptosporidium parvum
YRKTMLQQHAVDVLDGI

SEQ ID NO: 2307538 - protein, 20 aa, Cryptosporidium parvum
YRKWIDWKPDPSIYIQYSKF

SEQ ID NO: 2307539 - protein, 30 aa, Cryptosporidium parvum; identical to SEQ ID NO: 2184651

SEQ ID NO: 2307540 - protein, 18 aa, Cryptosporidium parvum
YRLQRIESNILYSNDIAD

SEQ ID NO: 2307541 - protein, 23 aa, Cryptosporidium parvum
YRMALEEARKALSSNSFNNRENR

SEQ ID NO: 2307542 - protein, 27 aa, Cryptosporidium parvum
YRNKLGCDILYSFKFSPLKNIIIENQQ

SEQ ID NO: 2307543 - protein, 19 aa, Cryptosporidium parvum
YRNPYLPVHAGGVPSQQIY

SEQ ID NO: 2307544 - protein, 24 aa, Cryptosporidium parvum
YRPKRLKIAILDHIPCDLDSLSIE

SEQ ID NO: 2307545 - protein, 23 aa, Cryptosporidium parvum
YRPLEVVNFNPPIDAIRHGFGEN

SEQ ID NO: 2307546 - protein, 20 aa, Cryptosporidium parvum
YRPPLPLLLTHLKARCKPTT

SEQ ID NO: 2307547 - protein, 31 aa, Cryptosporidium parvum; identical to SEQ ID NO: 2184662

SEQ ID NO: 2307548 - protein, 27 aa, Cryptosporidium parvum
YRQICRTGIAIICRFCGSIIENEAVMQ

SEQ ID NO: 2307549 - protein, 25 aa, Cryptosporidium parvum
YRQKLHPCEICAAFLSETDNDQRLN

SEQ ID NO: 2307550 - protein, 25 aa, Cryptosporidium parvum
YRQNFRLLVFTTRLFLLFIQEMCGG

SEQ ID NO: 2307551 - protein, 22 aa, Cryptosporidium parvum
YRRKISTGVLDIWVSFTEKHQI

SEQ ID NO: 2307552 - protein, 20 aa, Cryptosporidium parvum
YRRTCPIGVILVIFEARPEV

SEQ ID NO: 2307553 - protein, 26 aa, Cryptosporidium parvum
YRSPEVIVGAGYDWSADIWSLGCTIF

SEQ ID NO: 2307554 - protein, 17 aa, Cryptosporidium parvum
YRSRRPRGFGFVEYVEE

SEQ ID NO: 2307555 - protein, 23 aa, Cryptosporidium parvum
YRSTAWYPKFLFDKKFIEENIEE

SEQ ID NO: 2307556 - protein, 17 aa, Cryptosporidium parvum
YRTRSSSYCTSTCSSSS

SEQ ID NO: 2307557 - protein, 19 aa, Cryptosporidium parvum
YRTTYRPPLPLLLTHLKAR

SEQ ID NO: 2307558 - protein, 17 aa, Cryptosporidium parvum
YRVLNEFSIVSWCTPNK

SEQ ID NO: 2307559 - protein, 20 aa, Cryptosporidium parvum
YRVLQKLILDNSWIICSSGL

SEQ ID NO: 2307560 - protein, 28 aa, Cryptosporidium parvum
YRVSGYAGKVLFGWDFPAGFTPSLSCKG

SEQ ID NO: 2307561 - protein, 22 aa, Cryptosporidium parvum
YRWGLYDLKSPIVFKPKLETFF

SEQ ID NO: 2307562 - protein, 37 aa, Cryptosporidium parvum
YSALLNCCGEVFIWGMKDCCGLEGQLIKNGNEKILKE

SEQ ID NO: 2307563 - protein, 20 aa, Cryptosporidium parvum
YSAPLFLNLLHYLRNNKSAL

SEQ ID NO: 2307564 - protein, 18 aa, Cryptosporidium parvum
YSAPTLGPYGVWVGYSVN

SEQ ID NO: 2307565 - protein, 19 aa, Cryptosporidium parvum
YSCEGRISPIFIEGLKRGI

SEQ ID NO: 2307566 - protein, 18 aa, Cryptosporidium parvum
YSDMVEFPSEISAFNGNS

SEQ ID NO: 2307567 - protein, 25 aa, Cryptosporidium parvum
YSEIIGKVCPFEFFSDRVYKIAPYR

SEQ ID NO: 2307568 - protein, 37 aa, Cryptosporidium parvum
YSEIRMFIEKYLMYPKDFRRIASFMEYKTIKDCIDFY

SEQ ID NO: 2307569 - protein, 18 aa, Cryptosporidium parvum
YSEKCLLANHRFEQELYR

SEQ ID NO: 2307570 - protein, 19 aa, Cryptosporidium parvum
YSELVPILILAYDLSTFLG

SEQ ID NO: 2307571 - protein, 32 aa, Cryptosporidium parvum; identical to SEQ ID NO: 2184681

SEQ ID NO: 2307572 - protein, 32 aa, Cryptosporidium parvum; identical to SEQ ID NO: 2184683

SEQ ID NO: 2307573 - protein, 29 aa, Cryptosporidium parvum
YSFPSCETIKLRIPFSVVPCSNCASKGYE

SEQ ID NO: 2307574 - protein, 21 aa, Cryptosporidium parvum
YSFSEGLSFDSFILVNDPRCK

SEQ ID NO: 2307575 - protein, 21 aa, Cryptosporidium parvum
YSGKSKFNFFPKFLKDNMKWF

SEQ ID NO: 2307576 - protein, 20 aa, Cryptosporidium parvum
YSGPEIKIEYDLSELYNSER

SEQ ID NO: 2307577 - protein, 22 aa, Cryptosporidium parvum
YSGRLGGAFSNGRLNGNNNINH

SEQ ID NO: 2307578 - protein, 17 aa, Cryptosporidium parvum
YSGRVGTKRMKVIEIAQ

SEQ ID NO: 2307579 - protein, 17 aa, Cryptosporidium parvum
YSGTSYLGSSAKFSNDM

SEQ ID NO: 2307580 - protein, 18 aa, Cryptosporidium parvum
YSHAAWRRTPLEQGGIGP

SEQ ID NO: 2307581 - protein, 25 aa, Cryptosporidium parvum
YSHKPCDIKRALNIANTLPRKPTIF

SEQ ID NO: 2307582 - protein, 20 aa, Cryptosporidium parvum
YSHLSGFKFNSLNFERLKYF

SEQ ID NO: 2307583 - protein, 27 aa, Cryptosporidium parvum
YSHNIYWPRRCPFYLSNQSTIRYIPVL

SEQ ID NO: 2307584 - protein, 22 aa, Cryptosporidium parvum
YSHPYNFPKASFLPPNTEPSSN

SEQ ID NO: 2307585 - protein, 24 aa, Cryptosporidium parvum
YSHVLPKLSLRVFGQFVAEDCPIL

SEQ ID NO: 2307586 - protein, 17 aa, Cryptosporidium parvum
YSIADYSYRNMVLDRRN

SEQ ID NO: 2307587 - protein, 18 aa, Cryptosporidium parvum
YSIDYSLSTYLSWLYLNK

SEQ ID NO: 2307588 - protein, 20 aa, Cryptosporidium parvum
YSIELPMIRFTPYRQDELYA

SEQ ID NO: 2307589 - protein, 17 aa, Cryptosporidium parvum
YSKEYLKYGYDDLQFEI

SEQ ID NO: 2307590 - protein, 24 aa, Cryptosporidium parvum
YSKKIEHLHSLVFDAFHLLSTGKS

SEQ ID NO: 2307591 - protein, 27 aa, Cryptosporidium parvum
YSKLICINFRLPVILTNFMAPTKKMGK

SEQ ID NO: 2307592 - protein, 18 aa, Cryptosporidium parvum
YSKSNIIYWECFFDNVLT

SEQ ID NO: 2307593 - protein, 21 aa, Cryptosporidium parvum
YSKVCIKIILNNADWKCVTQF

SEQ ID NO: 2307594 - protein, 20 aa, Cryptosporidium parvum
YSKYYIEVEDSVKIEYLKNY

SEQ ID NO: 2307595 - protein, 19 aa, Cryptosporidium parvum
YSLARKDFMMVLNLTQNDR

SEQ ID NO: 2307596 - protein, 21 aa, Cryptosporidium parvum
YSLCYYPYILTSDICLSICRG

SEQ ID NO: 2307597 - protein, 35 aa, Cryptosporidium parvum; identical to SEQ ID NO: 2184702

SEQ ID NO: 2307598 - protein, 19 aa, Cryptosporidium parvum
YSLIKHVYFLLDTVQEEAK

SEQ ID NO: 2307599 - protein, 17 aa, Cryptosporidium parvum
YSLIPSLKSLIQNNNNL

SEQ ID NO: 2307600 - protein, 18 aa, Cryptosporidium parvum
YSLKSVRSKKNLTISEDV

SEQ ID NO: 2307601 - protein, 17 aa, Cryptosporidium parvum
YSLNQVILWKWPSMQKI

SEQ ID NO: 2307602 - protein, 24 aa, Cryptosporidium parvum
YSLSCISFGIPMVFMGTENLQGKW

SEQ ID NO: 2307603 - protein, 30 aa, Cryptosporidium parvum; identical to SEQ ID NO: 2184710

SEQ ID NO: 2307604 - protein, 18 aa, Cryptosporidium parvum
YSMNKWFMKLHEKPFWEV

SEQ ID NO: 2307605 - protein, 25 aa, Cryptosporidium parvum
YSNFKIPVIACPIIDTRIQKDYNNN

SEQ ID NO: 2307606 - protein, 30 aa, Cryptosporidium parvum; identical to SEQ ID NO: 2184711

SEQ ID NO: 2307607 - protein, 18 aa, Cryptosporidium parvum
YSNHYLKGKWVECKRALP

SEQ ID NO: 2307608 - protein, 17 aa, Cryptosporidium parvum
YSNIGIWNSICDTGHGN

SEQ ID NO: 2307609 - protein, 25 aa, Cryptosporidium parvum
YSNLMLCIKCNGSGHIIKDKNVFLR

SEQ ID NO: 2307610 - protein, 17 aa, Cryptosporidium parvum
YSNLPFPPFQVKITQIF

SEQ ID NO: 2307611 - protein, 18 aa, Cryptosporidium parvum
YSNRAACYMQLLEYPSAL

SEQ ID NO: 2307612 - protein, 20 aa, Cryptosporidium parvum
YSNWLKNEWNIIPDDFPIND

SEQ ID NO: 2307613 - protein, 22 aa, Cryptosporidium parvum
YSPCLCLKDAFPSTTIDLSSEI

SEQ ID NO: 2307614 - protein, 24 aa, Cryptosporidium parvum
YSPFISRCIVFIGYMLENGIYVDE

SEQ ID NO: 2307615 - protein, 23 aa, Cryptosporidium parvum
YSPKYPTFGSISWPILRKPIHVD

SEQ ID NO: 2307616 - protein, 24 aa, Cryptosporidium parvum
YSPTEIKIQPSIFSFDVSLDTKRS

SEQ ID NO: 2307617 - protein, 18 aa, Cryptosporidium parvum
YSPYRKIQESELINMISM

SEQ ID NO: 2307618 - protein, 26 aa, Cryptosporidium parvum
YSQKCLDACVHYISYTLKYLLDNPEE

SEQ ID NO: 2307619 - protein, 21 aa, Cryptosporidium parvum
YSQLILKFVDFDSLLDQVVCD

SEQ ID NO: 2307620 - protein, 25 aa, Cryptosporidium parvum
YSQMIKLCSSFRRMLKLYVASCYYF

SEQ ID NO: 2307621 - protein, 18 aa, Cryptosporidium parvum
YSQSGAYIITLKEYKELS

SEQ ID NO: 2307622 - protein, 25 aa, Cryptosporidium parvum
YSRKNGYCYFHLDLSFGEVRNPHYW

SEQ ID NO: 2307623 - protein, 19 aa, Cryptosporidium parvum
YSRLRNIEIFKNTDFNALN

SEQ ID NO: 2307624 - protein, 17 aa, Cryptosporidium parvum
YSRLTSCYIQLGEYNNA

SEQ ID NO: 2307625 - protein, 20 aa, Cryptosporidium parvum
YSRSNSDLARFLENKDELET

SEQ ID NO: 2307626 - protein, 20 aa, Cryptosporidium parvum
YSSCNKINFYQGFANDPVDF

SEQ ID NO: 2307627 - protein, 22 aa, Cryptosporidium parvum
YSSKLYCDYVYNSLNSKINSEE

SEQ ID NO: 2307628 - protein, 25 aa, Cryptosporidium parvum
YSSKSSEMNLLFPGEEEGDWKELAI

SEQ ID NO: 2307629 - protein, 24 aa, Cryptosporidium parvum
YSSLWRKLPQQIPVRELAMSRYHI

SEQ ID NO: 2307630 - protein, 23 aa, Cryptosporidium parvum
YSSNFIWDLVRSIPIESLNRLYV

SEQ ID NO: 2307631 - protein, 21 aa, Cryptosporidium parvum
YSSNRLAVYGLYQPINLELLD

SEQ ID NO: 2307632 - protein, 18 aa, Cryptosporidium parvum
YSSPELYLPLSNTPLTFI

SEQ ID NO: 2307633 - protein, 17 aa, Cryptosporidium parvum
YSSSCLEDLSNNLIFNN

SEQ ID NO: 2307634 - protein, 20 aa, Cryptosporidium parvum
YSTILAFKVGEEFDLEDERS

SEQ ID NO: 2307635 - protein, 25 aa, Cryptosporidium parvum
YSTLDWMYKYYDSFKNKTSKHIMSI

SEQ ID NO: 2307636 - protein, 18 aa, Cryptosporidium parvum
YSTLSYESGVSLNWIESV

SEQ ID NO: 2307637 - protein, 20 aa, Cryptosporidium parvum
YSTQNSQDWMGIVSEKSILR

SEQ ID NO: 2307638 - protein, 17 aa, Cryptosporidium parvum
YSVPLFVLEKCLLSPTQ

SEQ ID NO: 2307639 - protein, 25 aa, Cryptosporidium parvum
YSVRTRSKFKLQYLFGQNIDSISHS

SEQ ID NO: 2307640 - protein, 18 aa, Cryptosporidium parvum
YSVSLFNLIAILKQNIPI

SEQ ID NO: 2307641 - protein, 18 aa, Cryptosporidium parvum
YSWHFPELAKIITDTEKF

SEQ ID NO: 2307642 - protein, 18 aa, Cryptosporidium parvum
YSWSDCGESIEIYISLQD

SEQ ID NO: 2307643 - protein, 19 aa, Cryptosporidium parvum
YSYKNLTSISARRTKAEPE

SEQ ID NO: 2307644 - protein, 18 aa, Cryptosporidium parvum
YTCLEVYRYFKAIKSITL

SEQ ID NO: 2307645 - protein, 26 aa, Cryptosporidium parvum
YTDERLRLGGVLELLDEEALIREAAA

SEQ ID NO: 2307646 - protein, 18 aa, Cryptosporidium parvum
YTDGSVYTGEWFDGKEHG

SEQ ID NO: 2307647 - protein, 29 aa, Cryptosporidium parvum
YTDLRIGTRLNEGPGLTCSSKFIAFANDG

SEQ ID NO: 2307648 - protein, 23 aa, Cryptosporidium parvum
YTECGEIIVSLCCEHYTHYIDLS

SEQ ID NO: 2307649 - protein, 26 aa, Cryptosporidium parvum
YTELNSSLNWIWRYNGVVIDTRNITG

SEQ ID NO: 2307650 - protein, 24 aa, Cryptosporidium parvum
YTESKGRCLYARKCFNPGDIIFAE

SEQ ID NO: 2307651 - protein, 23 aa, Cryptosporidium parvum
YTEYKTGKTLTFFEELNRSFPII

SEQ ID NO: 2307652 - protein, 29 aa, Cryptosporidium parvum
YTGRKALLISCNWKWNGILYMEHKYGDLN

SEQ ID NO: 2307653 - protein, 22 aa, Cryptosporidium parvum
YTHKGHLDLLALTNQDLIQRRE

SEQ ID NO: 2307654 - protein, 23 aa, Cryptosporidium parvum
YTKEADWSYIKYCSVLNSKLYSN

SEQ ID NO: 2307655 - protein, 19 aa, Cryptosporidium parvum
YTLKQEKFITGGIDNSDDE

SEQ ID NO: 2307656 - protein, 27 aa, Cryptosporidium parvum
YTLLKRVILVSIALRIGENCEFNQLRD

SEQ ID NO: 2307657 - protein, 26 aa, Cryptosporidium parvum
YTLLLCLSGDCIISFNEKITKDNCNN

SEQ ID NO: 2307658 - protein, 17 aa, Cryptosporidium parvum
YTLSDNIGFKEEIPNKN

SEQ ID NO: 2307659 - protein, 17 aa, Cryptosporidium parvum
YTLVYVMESCNEFVCIY

SEQ ID NO: 2307660 - protein, 28 aa, Cryptosporidium parvum
YTMVTDLIFSWLELRDGSENLVFSTENH

SEQ ID NO: 2307661 - protein, 17 aa, Cryptosporidium parvum
YTNWDWITEFSVSMKMS

SEQ ID NO: 2307662 - protein, 21 aa, Cryptosporidium parvum
YTPCDIRELALYCGEEQGKYV

SEQ ID NO: 2307663 - protein, 24 aa, Cryptosporidium parvum
YTPDLHVTRGWSLITKEQRERFNK

SEQ ID NO: 2307664 - protein, 18 aa, Cryptosporidium parvum
YTPGWKYNHWEVKGVCLR

SEQ ID NO: 2307665 - protein, 23 aa, Cryptosporidium parvum
YTPKELGGLGMLSMGHILIPQSD

SEQ ID NO: 2307666 - protein, 24 aa, Cryptosporidium parvum
YTPLRQFFFFDAFEQLDLISNEIH

SEQ ID NO: 2307667 - protein, 19 aa, Cryptosporidium parvum
YTQEWKSTVERVGRLIDFD

SEQ ID NO: 2307668 - protein, 27 aa, Cryptosporidium parvum
YTRKPGCSRMKLDIIGYGESENYGTQL

SEQ ID NO: 2307669 - protein, 37 aa, Cryptosporidium parvum
YTSDKRGTLKFTTNNYLKWDPSHLITDLRGIHIPLSL

SEQ ID NO: 2307670 - protein, 17 aa, Cryptosporidium parvum
YTSTALIHFLRGNWKSC

SEQ ID NO: 2307671 - protein, 18 aa, Cryptosporidium parvum
YTVFDCFNIPKSADALRS

SEQ ID NO: 2307672 - protein, 19 aa, Cryptosporidium parvum
YTVHFLKSIMHLFSGNDQR

SEQ ID NO: 2307673 - protein, 17 aa, Cryptosporidium parvum
YVAKSPFFLSVKNKYRD

SEQ ID NO: 2307674 - protein, 24 aa, Cryptosporidium parvum
YVASFKCTLLLLPNGSKRISGLQF

SEQ ID NO: 2307675 - protein, 17 aa, Cryptosporidium parvum
YVAVMCRDSRQKAGGPR

SEQ ID NO: 2307676 - protein, 25 aa, Cryptosporidium parvum
YVCRADPMLCSAAFLSYPGLVRHIK

SEQ ID NO: 2307677 - protein, 22 aa, Cryptosporidium parvum
YVDFIELVIFYFKKFNLKGVFV

SEQ ID NO: 2307678 - protein, 17 aa, Cryptosporidium parvum
YVDQFFSIINWDFVESN

SEQ ID NO: 2307679 - protein, 26 aa, Cryptosporidium parvum
YVEKLVEIPFHPGMMYDENMLNQSIP

SEQ ID NO: 2307680 - protein, 24 aa, Cryptosporidium parvum
YVEKQICCNACYMKYDRNRPRYRN

SEQ ID NO: 2307681 - protein, 23 aa, Cryptosporidium parvum
YVELYLDWFLNKSIESQFRAFYN

SEQ ID NO: 2307682 - protein, 26 aa, Cryptosporidium parvum
YVFEKLRNYDIMLIIIEYISEVNPEL

SEQ ID NO: 2307683 - protein, 20 aa, Cryptosporidium parvum
YVFHNWFGNTLFNFDPLDGL

SEQ ID NO: 2307684 - protein, 17 aa, Cryptosporidium parvum
YVFKDSSNVPEWLSDLA

SEQ ID NO: 2307685 - protein, 19 aa, Cryptosporidium parvum
YVHPLKVHLSNVFSHPKYR

SEQ ID NO: 2307686 - protein, 18 aa, Cryptosporidium parvum
YVIHPLISNLGMEKNQIA

SEQ ID NO: 2307687 - protein, 17 aa, Cryptosporidium parvum
YVIPIANYLYNRTYPNL

SEQ ID NO: 2307688 - protein, 41 aa, Cryptosporidium parvum
YVIPILMVIQECFTRRNELMRELDILLILEFLVDLRLSYES

SEQ ID NO: 2307689 - protein, 21 aa, Cryptosporidium parvum
YVKFMPLSMDFLDISNPKAVL

SEQ ID NO: 2307690 - protein, 26 aa, Cryptosporidium parvum
YVKITFKPDLSRFGNMKDFDDDIISL

SEQ ID NO: 2307691 - protein, 21 aa, Cryptosporidium parvum
YVKRIESVLPHLENLTKQWIP

SEQ ID NO: 2307692 - protein, 18 aa, Cryptosporidium parvum
YVKSYSESYADCITGVTV

SEQ ID NO: 2307693 - protein, 28 aa, Cryptosporidium parvum
YVLEINMSCSIIWSILYCEEIVCKSRVV

SEQ ID NO: 2307694 - protein, 25 aa, Cryptosporidium parvum
YVLERCNNGTFLPHIGEILEKYQSD

SEQ ID NO: 2307695 - protein, 25 aa, Cryptosporidium parvum
YVLRLRACLSCRIILSDQQFYEGGC

SEQ ID NO: 2307696 - protein, 24 aa, Cryptosporidium parvum
YVNCKPLYLDVERIVSTVLVKNPY

SEQ ID NO: 2307697 - protein, 18 aa, Cryptosporidium parvum
YVNECISIIIPLIQGYDE

SEQ ID NO: 2307698 - protein, 21 aa, Cryptosporidium parvum
YVPECVGGRLPIMVDPTDPIY

SEQ ID NO: 2307699 - protein, 17 aa, Cryptosporidium parvum
YVPPKKPMEMFSGSGNS

SEQ ID NO: 2307700 - protein, 25 aa, Cryptosporidium parvum
YVQGMNFLVGCILWHSSSEEQAFEL

SEQ ID NO: 2307701 - protein, 26 aa, Cryptosporidium parvum
YVRGVKCGHGIYTWPNGDRFEGEYKD

SEQ ID NO: 2307702 - protein, 27 aa, Cryptosporidium parvum
YVSLSCKGYCFSAAPWSQIAAEASLPL

SEQ ID NO: 2307703 - protein, 24 aa, Cryptosporidium parvum
YVTGAKGSFLRRVEDETGTFIFID

SEQ ID NO: 2307704 - protein, 22 aa, Cryptosporidium parvum
YVTLMPCISCTKNIIQCEIERV

SEQ ID NO: 2307705 - protein, 18 aa, Cryptosporidium parvum
YVTYKGVYALSINVPSKE

SEQ ID NO: 2307706 - protein, 23 aa, Cryptosporidium parvum
YVVAESRLEWVLSELKIKEYNII

SEQ ID NO: 2307707 - protein, 23 aa, Cryptosporidium parvum
YVVLRDGRQFTGIFRSFDQYGSL

SEQ ID NO: 2307708 - protein, 20 aa, Cryptosporidium parvum
YWDGSGHRRSVHVPRNTTIG

SEQ ID NO: 2307709 - protein, 21 aa, Cryptosporidium parvum
YWDYGRSKIIFTRRNKSGQTT

SEQ ID NO: 2307710 - protein, 28 aa, Cryptosporidium parvum
YWERIFQLIPCPYLCLSATIGNPLAFYN

SEQ ID NO: 2307711 - protein, 25 aa, Cryptosporidium parvum
YWKDKESRVYARFTWATRKYSKSFY

SEQ ID NO: 2307712 - protein, 29 aa, Cryptosporidium parvum
YWKFEQSLCILLRLSTCLNPYSDIRESIS

SEQ ID NO: 2307713 - protein, 17 aa, Cryptosporidium parvum
YWLDPYKPIKLTREVKD

SEQ ID NO: 2307714 - protein, 28 aa, Cryptosporidium parvum
YWLFGFEFSDTLILFSRKKKIVIVTSQK

SEQ ID NO: 2307715 - protein, 18 aa, Cryptosporidium parvum
YWPLYRYNPELVRTEVVD

SEQ ID NO: 2307716 - protein, 19 aa, Cryptosporidium parvum
YWQLIKRLLNLFVDESESE

SEQ ID NO: 2307717 - protein, 20 aa, Cryptosporidium parvum
YYDIFVSFPPIFEASSHLHI

SEQ ID NO: 2307718 - protein, 30 aa, Cryptosporidium parvum
YYDISGCYILRPWSYFIWETIQSVFDQKIK

SEQ ID NO: 2307719 - protein, 21 aa, Cryptosporidium parvum
YYDTWCYLSILTGPNHHFTVA

SEQ ID NO: 2307720 - protein, 20 aa, Cryptosporidium parvum
YYDYLKLILDSIVEHNILFS

SEQ ID NO: 2307721 - protein, 17 aa, Cryptosporidium parvum
YYELDILEIRKLRFKDF

SEQ ID NO: 2307722 - protein, 17 aa, Cryptosporidium parvum
YYFNPIIKLENGNNTKL

SEQ ID NO: 2307723 - protein, 25 aa, Cryptosporidium parvum
YYGELRFSTRIFKNALVFVLGEKEN

SEQ ID NO: 2307724 - protein, 17 aa, Cryptosporidium parvum
YYHPLIVELVYKSILIC

SEQ ID NO: 2307725 - protein, 21 aa, Cryptosporidium parvum
YYHSYKGAFGVQGRDFMLIGY

SEQ ID NO: 2307726 - protein, 28 aa, Cryptosporidium parvum
YYIEGYKKLRVRLCCIIKNIMKNILKDC

SEQ ID NO: 2307727 - protein, 26 aa, Cryptosporidium parvum
YYKASEMERSVIIPRSKFVSHSSNPP

SEQ ID NO: 2307728 - protein, 17 aa, Cryptosporidium parvum
YYKDSHSILGRTFGMCI

SEQ ID NO: 2307729 - protein, 17 aa, Cryptosporidium parvum
YYKGKVILAEFDINLTC

SEQ ID NO: 2307730 - protein, 17 aa, Cryptosporidium parvum
YYKSILMSLPNSPKNIV

SEQ ID NO: 2307731 - protein, 22 aa, Cryptosporidium parvum
YYLELCGEYALYIDSNWDQIDI

SEQ ID NO: 2307732 - protein, 19 aa, Cryptosporidium parvum
YYLKFFKACEYDETLENYK

SEQ ID NO: 2307733 - protein, 23 aa, Cryptosporidium parvum
YYLSVLKCLVEFIQWDIKKEREN

SEQ ID NO: 2307734 - protein, 29 aa, Cryptosporidium parvum
YYNRRRPILCITVGLGFDSFIVVRNTFTE

SEQ ID NO: 2307735 - protein, 19 aa, Cryptosporidium parvum
YYRKKKNMSLYAFGGTQGS

SEQ ID NO: 2307736 - protein, 31 aa, Cryptosporidium parvum
YYSEKGLRNLYDWQYECITQPGVLQGRNLVY

SEQ ID NO: 2307737 - protein, 26 aa, Cryptosporidium parvum
YYSQIYIPGYLFGMISTRLTVDDCPL

SEQ ID NO: 2307738 - protein, 22 aa, Cryptosporidium parvum
YYVSKFESIFGVNQIVSGLKGK

SEQ ID NO: 2307739 - protein, 21 aa, Cryptosporidium parvum
YYYCLSRMRLYSSILGVMTPP

SEQ ID NO: 2307740 - protein, 19 aa, Cryptosporidium parvum
YYYENFVRSLSFGDYSPYE

SEQ ID NO: 2307741 - protein, 23 aa, Cryptosporidium parvum
YYYHGVPSWDWYYPYHYAPYVMD

SEQ ID NO: 2307742 - protein, 18 aa, Cryptosporidium parvum
GRIIIKWMLEEGVRKIAI

SEQ ID NO: 2307743 - protein, 17 aa, Cryptosporidium parvum
MCGTSIQWGPWIEQGMA

SEQ ID NO: 2307744 - protein, 20 aa, Cryptosporidium parvum
TLHLVLRLRGGMQIFVKTLT

SEQ ID NO: 2307745 - protein, 19 aa, Cryptosporidium parvum
AAEISRPLSLQAYADVLTH

SEQ ID NO: 2307746 - protein, 21 aa, Cryptosporidium parvum
AALKEYSCLKALYENGFNEGE

SEQ ID NO: 2307747 - protein, 18 aa, Cryptosporidium parvum
AALRDIRNLFPIYRNPLY

SEQ ID NO: 2307748 - protein, 18 aa, Cryptosporidium parvum
AAMEICKTASTLFDTTDG

SEQ ID NO: 2307749 - protein, 18 aa, Cryptosporidium parvum
ACETCTKTGFIMVFGEIT

SEQ ID NO: 2307750 - protein, 18 aa, Cryptosporidium parvum
ACFRYRIEDCMRILTKGN

SEQ ID NO: 2307751 - protein, 19 aa, Cryptosporidium parvum
ACGVEEYLFILVLKLPSIC

SEQ ID NO: 2307752 - protein, 18 aa, Cryptosporidium parvum
ACKGIGKFHAKWIPVSVA

SEQ ID NO: 2307753 - protein, 19 aa, Cryptosporidium parvum
ACPICKKKVLFSTSYCEKC

SEQ ID NO: 2307754 - protein, 20 aa, Cryptosporidium parvum
ACVSIIPSVRSIYKFKGQVH

SEQ ID NO: 2307755 - protein, 20 aa, Cryptosporidium parvum
ADIWSLGAILYRITYKRHLF

SEQ ID NO: 2307756 - protein, 18 aa, Cryptosporidium parvum
ADRGWSDFFSLKTLLDPK

SEQ ID NO: 2307757 - protein, 24 aa, Cryptosporidium parvum
AEEKLYIRRVCLIQSTFRMYLQRR

SEQ ID NO: 2307758 - protein, 17 aa, Cryptosporidium parvum
AEHQSGVPGVYWQESSQ

SEQ ID NO: 2307759 - protein, 17 aa, Cryptosporidium parvum
AELSLKVVYDMLKRREA

SEQ ID NO: 2307760 - protein, 21 aa, Cryptosporidium parvum
AFKARTSLLLGQGIIEEPEDT

SEQ ID NO: 2307761 - protein, 22 aa, Cryptosporidium parvum
AFKRELIELFKIEVEILNGIQE

SEQ ID NO: 2307762 - protein, 18 aa, Cryptosporidium parvum
AFSLIRWIAIADCIALHI

SEQ ID NO: 2307763 - protein, 19 aa, Cryptosporidium parvum
AGIALRFISNIKKLYADNN

SEQ ID NO: 2307764 - protein, 25 aa, Cryptosporidium parvum
AGISRLKLVFSYYDWGWKGYLDEFD

SEQ ID NO: 2307765 - protein, 24 aa, Cryptosporidium parvum
AGRVRPGKCFRLYTKLSFTTEMEV

SEQ ID NO: 2307766 - protein, 17 aa, Cryptosporidium parvum
AHIICIDCYKLISKKSS

SEQ ID NO: 2307767 - protein, 18 aa, Cryptosporidium parvum
AHLLGFFKRLCKLLYYGI

SEQ ID NO: 2307768 - protein, 24 aa, Cryptosporidium parvum
AHPWKYRYAAIMAIAQTIEYLPED

SEQ ID NO: 2307769 - protein, 17 aa, Cryptosporidium parvum
AIAGWYLKHADPILKVS

SEQ ID NO: 2307770 - protein, 19 aa, Cryptosporidium parvum
AICCLTKLFQCCPDRLRAN

SEQ ID NO: 2307771 - protein, 20 aa, Cryptosporidium parvum
AICGPRLGFKPAYSPDFLIR

SEQ ID NO: 2307772 - protein, 20 aa, Cryptosporidium parvum
AICYPMIRFLLSNRTLSDTE

SEQ ID NO: 2307773 - protein, 24 aa, Cryptosporidium parvum
AIDEAHCVCQWGFDFRPDYIQLCK

SEQ ID NO: 2307774 - protein, 22 aa, Cryptosporidium parvum
AILPWFRLGSRPILSDESDEYS

SEQ ID NO: 2307775 - protein, 43 aa, Cryptosporidium parvum; identical to SEQ ID NO: 2184857

SEQ ID NO: 2307776 - protein, 20 aa, Cryptosporidium parvum
AIPPPHMYAPNMARPGPYAQ

SEQ ID NO: 2307777 - protein, 25 aa, Cryptosporidium parvum
AIQSCPRQIFAISWFMEFILYGFSN

SEQ ID NO: 2307778 - protein, 24 aa, Cryptosporidium parvum
AKCIYWKLGNNFLYTLYSLILKDD

SEQ ID NO: 2307779 - protein, 18 aa, Cryptosporidium parvum
AKCPTEWRVRGITWHAER

SEQ ID NO: 2307780 - protein, 17 aa, Cryptosporidium parvum
AKDWRKILPEGTPSLAI

SEQ ID NO: 2307781 - protein, 20 aa, Cryptosporidium parvum
AKHGWKFLPLYIFEESLGTW

SEQ ID NO: 2307782 - protein, 23 aa, Cryptosporidium parvum
AKKFKCPICFSNVLLNELVSLRY

SEQ ID NO: 2307783 - protein, 19 aa, Cryptosporidium parvum
AKLLEDWDVIGHFFQDCMS

SEQ ID NO: 2307784 - protein, 23 aa, Cryptosporidium parvum
AKLVCFYCDLLLKNSYSEIGNDF

SEQ ID NO: 2307785 - protein, 23 aa, Cryptosporidium parvum
AKPLKRLSCPAIFFDCTHDNETP

SEQ ID NO: 2307786 - protein, 19 aa, Cryptosporidium parvum
AKVTSCFFCQQGQNSQIED

SEQ ID NO: 2307787 - protein, 19 aa, Cryptosporidium parvum
ALAKQCYRGMMGVQGREFL

SEQ ID NO: 2307788 - protein, 20 aa, Cryptosporidium parvum
ALLASCCGKGQLLLTLVYGN

SEQ ID NO: 2307789 - protein, 25 aa, Cryptosporidium parvum
ALPACISYFYKCFYDDKSAIKNSID

SEQ ID NO: 2307790 - protein, 24 aa, Cryptosporidium parvum
ALPKRPIMYFAKWKHLSFADNTWE

SEQ ID NO: 2307791 - protein, 21 aa, Cryptosporidium parvum
ALRKLCCTFSRVIIQDYFTSW

SEQ ID NO: 2307792 - protein, 18 aa, Cryptosporidium parvum
ALSHCLLELTGINNDLKK

SEQ ID NO: 2307793 - protein, 19 aa, Cryptosporidium parvum
ALTIRCLNIRHTISLEAII

SEQ ID NO: 2307794 - protein, 22 aa, Cryptosporidium parvum
AMRLKEWYGWHFPELGKIISDR

SEQ ID NO: 2307795 - protein, 21 aa, Cryptosporidium parvum
AMSKSQLKALFSIFKISNYTQ

SEQ ID NO: 2307796 - protein, 21 aa, Cryptosporidium parvum
ANCSPRLKINITWPTTLKNYT

SEQ ID NO: 2307797 - protein, 22 aa, Cryptosporidium parvum
ANLMPRCIGMWKEYFTSDGKPY

SEQ ID NO: 2307798 - protein, 21 aa, Cryptosporidium parvum
ANSFPLGLSYNVSNRRYDLNP

SEQ ID NO: 2307799 - protein, 20 aa, Cryptosporidium parvum
APTSYFPVMGFLSERRRLDE

SEQ ID NO: 2307800 - protein, 19 aa, Cryptosporidium parvum
APWPMGVTMVGIHERAGRT

SEQ ID NO: 2307801 - protein, 20 aa, Cryptosporidium parvum
AQKYFLKKVRGIAPSTLTMD

SEQ ID NO: 2307802 - protein, 19 aa, Cryptosporidium parvum
AQSLLRFPPEWRSLNNEEV

SEQ ID NO: 2307803 - protein, 19 aa, Cryptosporidium parvum
ARAAAPCVLFFDELDSIGT

SEQ ID NO: 2307804 - protein, 20 aa, Cryptosporidium parvum
ARCSGRKLLRFNYAKKLQFS

SEQ ID NO: 2307805 - protein, 17 aa, Cryptosporidium parvum
ARCSILAAANPTFGSYD

SEQ ID NO: 2307806 - protein, 18 aa, Cryptosporidium parvum
ARFAKWRAVLTIDQAKGK

SEQ ID NO: 2307807 - protein, 17 aa, Cryptosporidium parvum
ARGIPDWDFISNDDKIS

SEQ ID NO: 2307808 - protein, 20 aa, Cryptosporidium parvum
ARGYFSFTMCMENIYKELFM

SEQ ID NO: 2307809 - protein, 19 aa, Cryptosporidium parvum
ARHALKGLVLILSDLIIKL

SEQ ID NO: 2307810 - protein, 23 aa, Cryptosporidium parvum
ARILKRSLPLVFSRYMSSKCEGK

SEQ ID NO: 2307811 - protein, 19 aa, Cryptosporidium parvum
ARKLLDWCDFIGYHAVIIS

SEQ ID NO: 2307812 - protein, 19 aa, Cryptosporidium parvum
ARLAFPLLIQRFKDLREEA

SEQ ID NO: 2307813 - protein, 24 aa, Cryptosporidium parvum
ARLWDLRMGRELVKYSSGLRSSCH

SEQ ID NO: 2307814 - protein, 17 aa, Cryptosporidium parvum
ARRLFRKPVNTLLPGTY

SEQ ID NO: 2307815 - protein, 26 aa, Cryptosporidium parvum
ARRYFPRSISCPGILLRNGLIVTDRY

SEQ ID NO: 2307816 - protein, 17 aa, Cryptosporidium parvum
ARVFFIHRIKRQLLLFS

SEQ ID NO: 2307817 - protein, 19 aa, Cryptosporidium parvum
ASCCITLEWSVCGRFLLAS

SEQ ID NO: 2307818 - protein, 22 aa, Cryptosporidium parvum
ASEFKTLCELLRTHYQLLVSNR

SEQ ID NO: 2307819 - protein, 20 aa, Cryptosporidium parvum
ASFKCTLLLLPNGSKRISGL

SEQ ID NO: 2307820 - protein, 19 aa, Cryptosporidium parvum
ASGNRRWNFGASKEKGRYK

SEQ ID NO: 2307821 - protein, 18 aa, Cryptosporidium parvum
ATKISYNGKQRWRVVTIN

SEQ ID NO: 2307822 - protein, 19 aa, Cryptosporidium parvum
ATMWNFRKSYIISEQSNTQ

SEQ ID NO: 2307823 - protein, 24 aa, Cryptosporidium parvum
AVINCSDWPTSVSFHPIQKNIIFI

SEQ ID NO: 2307824 - protein, 18 aa, Cryptosporidium parvum
AYESFDFDNFDSKRLSNG

SEQ ID NO: 2307825 - protein, 18 aa, Cryptosporidium parvum
AYLARLGHRVIQKAHGAP

SEQ ID NO: 2307826 - protein, 18 aa, Cryptosporidium parvum
AYPEMLEILLSCQSEDLR

SEQ ID NO: 2307827 - protein, 18 aa, Cryptosporidium parvum
CADICWLKGSKVLVNGTI

SEQ ID NO: 2307828 - protein, 21 aa, Cryptosporidium parvum
CAPEKSGIMTPEFPGSHDSNF

SEQ ID NO: 2307829 - protein, 17 aa, Cryptosporidium parvum
CAPYRFIHRDIKTINML

SEQ ID NO: 2307830 - protein, 17 aa, Cryptosporidium parvum
CCLSWNMYQVAYFVKCI

SEQ ID NO: 2307831 - protein, 18 aa, Cryptosporidium parvum
CDICKFWVHYDCDKDLNE

SEQ ID NO: 2307832 - protein, 17 aa, Cryptosporidium parvum
CDIGRGAIFFSIARGKV

SEQ ID NO: 2307833 - protein, 18 aa, Cryptosporidium parvum
CELFKFTLDYLKNNTIGG

SEQ ID NO: 2307834 - protein, 17 aa, Cryptosporidium parvum
CEYDPRLPIKYVSSKLG

SEQ ID NO: 2307835 - protein, 18 aa, Cryptosporidium parvum
CFLCGELGHTLKDCKKPR

SEQ ID NO: 2307836 - protein, 17 aa, Cryptosporidium parvum
CFNEIRFRRKLDFLKDS

SEQ ID NO: 2307837 - protein, 22 aa, Cryptosporidium parvum
CFRFSFLGLRSNEQWLGELFSL

SEQ ID NO: 2307838 - protein, 22 aa, Cryptosporidium parvum
CFSLKVPPVFCNNGNLLLIPKG

SEQ ID NO: 2307839 - protein, 17 aa, Cryptosporidium parvum
CGDVPYGKRIHVLPFDD

SEQ ID NO: 2307840 - protein, 21 aa, Cryptosporidium parvum
CGGFVPCFPGPYLNMHYDPHF

SEQ ID NO: 2307841 - protein, 23 aa, Cryptosporidium parvum
CGHIYCWPCIIKLMNIILENDEY

SEQ ID NO: 2307842 - protein, 19 aa, Cryptosporidium parvum
CGHLYCWSCICSWLDRGYE

SEQ ID NO: 2307843 - protein, 21 aa, Cryptosporidium parvum
CGHTFCRYCITHNRLLGKKCP

SEQ ID NO: 2307844 - protein, 18 aa, Cryptosporidium parvum
CGKLCLLDKLLSRLREKG

SEQ ID NO: 2307845 - protein, 17 aa, Cryptosporidium parvum
CGLPLPIHHYLKKKNII

SEQ ID NO: 2307846 - protein, 19 aa, Cryptosporidium parvum
CGLWNAAVRLHLEFIGEIP

SEQ ID NO: 2307847 - protein, 17 aa, Cryptosporidium parvum
CGVILYALLCGSLPFDD

SEQ ID NO: 2307848 - protein, 18 aa, Cryptosporidium parvum
CGVVKRVSIPRYSDTGKM

SEQ ID NO: 2307849 - protein, 19 aa, Cryptosporidium parvum
CHRAHWGIGYVWFKREEYY

SEQ ID NO: 2307850 - protein, 20 aa, Cryptosporidium parvum
CHSMGGILLKLIISNHPEIT

SEQ ID NO: 2307851 - protein, 20 aa, Cryptosporidium parvum
CHWVRIKLSYLFKEGEELPA

SEQ ID NO: 2307852 - protein, 19 aa, Cryptosporidium parvum
CICLDPKPGHFVLDLCSAP

SEQ ID NO: 2307853 - protein, 17 aa, Cryptosporidium parvum
CIEELIFKQVVYSKNSD

SEQ ID NO: 2307854 - protein, 25 aa, Cryptosporidium parvum
CIHQCSCIMIWKLFIPFVDEKINSL

SEQ ID NO: 2307855 - protein, 17 aa, Cryptosporidium parvum
CILPLPIIHQGPTINAS

SEQ ID NO: 2307856 - protein, 18 aa, Cryptosporidium parvum
CISWDIKGTEFITCTEYN

SEQ ID NO: 2307857 - protein, 17 aa, Cryptosporidium parvum
CIWVCYENFLSIKNLKS

SEQ ID NO: 2307858 - protein, 21 aa, Cryptosporidium parvum
CKCNACGYIGALDNNHKITTY

SEQ ID NO: 2307859 - protein, 18 aa, Cryptosporidium parvum
CKEEARLTYSHAKEKEIQ

SEQ ID NO: 2307860 - protein, 19 aa, Cryptosporidium parvum
CKGILFAIQVCKAIMEGNY

SEQ ID NO: 2307861 - protein, 18 aa, Cryptosporidium parvum
CKHIKSAISTPRDPVEQI

SEQ ID NO: 2307862 - protein, 19 aa, Cryptosporidium parvum
CKHLFSWIEYEMALLGNSI

SEQ ID NO: 2307863 - protein, 18 aa, Cryptosporidium parvum
CKHVRWIIQIPRLYNIFH

SEQ ID NO: 2307864 - protein, 24 aa, Cryptosporidium parvum
CKKCQVKFHFECCISDNIMNFNHL

SEQ ID NO: 2307865 - protein, 21 aa, Cryptosporidium parvum
CKSKRPASVLMISFNSESSVQ

SEQ ID NO: 2307866 - protein, 20 aa, Cryptosporidium parvum
CLEKICLLSMDFGVKIQYFR

SEQ ID NO: 2307867 - protein, 17 aa, Cryptosporidium parvum
CLICFRILQRTMVVKDC

SEQ ID NO: 2307868 - protein, 24 aa, Cryptosporidium parvum
CLKCCIYPCRAFFLTGRCISQKRR

SEQ ID NO: 2307869 - protein, 18 aa, Cryptosporidium parvum
CLLGLYYAMLLKWFDYET

SEQ ID NO: 2307870 - protein, 17 aa, Cryptosporidium parvum
CLLSMDFGVKIQYFRDF

SEQ ID NO: 2307871 - protein, 23 aa, Cryptosporidium parvum
CLRSMRVSVRWLRLASSMHLNLY

SEQ ID NO: 2307872 - protein, 17 aa, Cryptosporidium parvum
CMNCYISLCPHCILIGQ

SEQ ID NO: 2307873 - protein, 19 aa, Cryptosporidium parvum
CMQLYRQALNFALHGLKYE

SEQ ID NO: 2307874 - protein, 19 aa, Cryptosporidium parvum
CNALPKLVCKTVKIEENNP

SEQ ID NO: 2307875 - protein, 19 aa, Cryptosporidium parvum
CNCLLSFNLVEEFFFLFNR

SEQ ID NO: 2307876 - protein, 24 aa, Cryptosporidium parvum
CNHILCWKCIINVDEIFYLDSNTS

SEQ ID NO: 2307877 - protein, 17 aa, Cryptosporidium parvum
CNICGSVKHLARNCDQQ

SEQ ID NO: 2307878 - protein, 18 aa, Cryptosporidium parvum
CNLCKGCIYDSICYNSLN

SEQ ID NO: 2307879 - protein, 22 aa, Cryptosporidium parvum
CNPKCLICSQVLVKIKIVSFDK

SEQ ID NO: 2307880 - protein, 19 aa, Cryptosporidium parvum
CNVPKWIAQQVWFKCSFLS

SEQ ID NO: 2307881 - protein, 18 aa, Cryptosporidium parvum
CNYIKYSTQWYLWAKRRN

SEQ ID NO: 2307882 - protein, 17 aa, Cryptosporidium parvum
CPCCRKPDSCFCGIEKD

SEQ ID NO: 2307883 - protein, 18 aa, Cryptosporidium parvum
CPHLHPYLELGLLCNPEV

SEQ ID NO: 2307884 - protein, 24 aa, Cryptosporidium parvum
CPHLIRYLACFGIIMRRNKDILDN

SEQ ID NO: 2307885 - protein, 20 aa, Cryptosporidium parvum
CPLMRAHFMVFKWQEDPKKA

SEQ ID NO: 2307886 - protein, 22 aa, Cryptosporidium parvum
CPSYSELFLFSIIYDDSILIKE

SEQ ID NO: 2307887 - protein, 18 aa, Cryptosporidium parvum
CPTKGCGNRTAWQLRLEN

SEQ ID NO: 2307888 - protein, 19 aa, Cryptosporidium parvum
CPVCHGFVKYIADFEYGET

SEQ ID NO: 2307889 - protein, 20 aa, Cryptosporidium parvum
CPVWIPPWWTAFRIGGWNWQ

SEQ ID NO: 2307890 - protein, 26 aa, Cryptosporidium parvum
CPYGPGCFFIHPTVPCRYGLACYNSL

SEQ ID NO: 2307891 - protein, 19 aa, Cryptosporidium parvum
CQNYFLYKRIRSIIGKGEK

SEQ ID NO: 2307892 - protein, 18 aa, Cryptosporidium parvum
CQQLPCSALEFLTGEYEL

SEQ ID NO: 2307893 - protein, 17 aa, Cryptosporidium parvum
CQRGRMCMFSHTKEEQM

SEQ ID NO: 2307894 - protein, 19 aa, Cryptosporidium parvum
CRMWYDMTQFFGFLGEDII

SEQ ID NO: 2307895 - protein, 19 aa, Cryptosporidium parvum
CRRCNSMAGTFCYMAPEIL

SEQ ID NO: 2307896 - protein, 20 aa, Cryptosporidium parvum
CRRSCKRLNYSRCPSKLKPL

SEQ ID NO: 2307897 - protein, 18 aa, Cryptosporidium parvum
CSHSFHFGCMLLKYTSLM

SEQ ID NO: 2307898 - protein, 18 aa, Cryptosporidium parvum
CSILPGLLAKYGNLTPVP

SEQ ID NO: 2307899 - protein, 17 aa, Cryptosporidium parvum
CSIWKIERLIGGGSFGD

SEQ ID NO: 2307900 - protein, 17 aa, Cryptosporidium parvum
CSSKRPHTKRGRSTANT

SEQ ID NO: 2307901 - protein, 27 aa, Cryptosporidium parvum
CSWSSNPFLCRKCCKKSSIQPSITYDI

SEQ ID NO: 2307902 - protein, 17 aa, Cryptosporidium parvum
CSYLVLWLDCDREGENI

SEQ ID NO: 2307903 - protein, 18 aa, Cryptosporidium parvum
CTEFPGNFIFFLAAAVSD

SEQ ID NO: 2307904 - protein, 20 aa, Cryptosporidium parvum
CTKTRGNFMLAIFAALKSTY

SEQ ID NO: 2307905 - protein, 30 aa, Cryptosporidium parvum; identical to SEQ ID NO: 2184961

SEQ ID NO: 2307906 - protein, 17 aa, Cryptosporidium parvum
CTSEFCLACELVHLTFM

SEQ ID NO: 2307907 - protein, 18 aa, Cryptosporidium parvum
CVEWPLIHSELFEYMKIK

SEQ ID NO: 2307908 - protein, 17 aa, Cryptosporidium parvum
CVKKCPYSAITIINLPK

SEQ ID NO: 2307909 - protein, 17 aa, Cryptosporidium parvum
CYILRPWSYFIWETIQS

SEQ ID NO: 2307910 - protein, 19 aa, Cryptosporidium parvum
CYNYWKFPDINVFVNNDSH

SEQ ID NO: 2307911 - protein, 18 aa, Cryptosporidium parvum
CYSCESWSTLDLILNKTK

SEQ ID NO: 2307912 - protein, 20 aa, Cryptosporidium parvum
CYTLPIKGFGELVQREQQQR

SEQ ID NO: 2307913 - protein, 24 aa, Cryptosporidium parvum
DADILCTMPWQFVIIDEAHRLKNR

SEQ ID NO: 2307914 - protein, 17 aa, Cryptosporidium parvum
DALDWIKKTFLYIRIIR

SEQ ID NO: 2307915 - protein, 23 aa, Cryptosporidium parvum
DAQEFKPTFGITGSNVIPNSGIY

SEQ ID NO: 2307916 - protein, 17 aa, Cryptosporidium parvum
DAYKLKSSFGWEHVKGS

SEQ ID NO: 2307917 - protein, 23 aa, Cryptosporidium parvum
DCFSDKLFSEWVFKLNGKKELYQ

SEQ ID NO: 2307918 - protein, 17 aa, Cryptosporidium parvum
DCLCWRCYFNQRPFFEE

SEQ ID NO: 2307919 - protein, 22 aa, Cryptosporidium parvum
DCNKMSLLFSWYTYVPNSELDT

SEQ ID NO: 2307920 - protein, 25 aa, Cryptosporidium parvum
DCNVLWKWILRQGFVNRDNHSNYSS

SEQ ID NO: 2307921 - protein, 18 aa, Cryptosporidium parvum
DDPANWSWRQKSFLLEEL

SEQ ID NO: 2307922 - protein, 19 aa, Cryptosporidium parvum
DDPKLCWRCHKRDATPHMR

SEQ ID NO: 2307923 - protein, 18 aa, Cryptosporidium parvum
DDTIKIWNMKGFGCVRTM

SEQ ID NO: 2307924 - protein, 19 aa, Cryptosporidium parvum
DDYFPRYSIIPNKECIDKW

SEQ ID NO: 2307925 - protein, 17 aa, Cryptosporidium parvum
DEEFIYLLLDFKISMIP

SEQ ID NO: 2307926 - protein, 20 aa, Cryptosporidium parvum
DEELLRWIAEAEYLGVSRET

SEQ ID NO: 2307927 - protein, 18 aa, Cryptosporidium parvum
DEFTRWNIALQFGGFING

SEQ ID NO: 2307928 - protein, 18 aa, Cryptosporidium parvum
DEGFNWCGNTVSRITNNE

SEQ ID NO: 2307929 - protein, 18 aa, Cryptosporidium parvum
DEILKIYLSYLLDSGGIR

SEQ ID NO: 2307930 - protein, 17 aa, Cryptosporidium parvum
DEIRLICSLGNKKDFLT

SEQ ID NO: 2307931 - protein, 24 aa, Cryptosporidium parvum
DELEMRLVLYLLKYFAPIWDTKAG

SEQ ID NO: 2307932 - protein, 21 aa, Cryptosporidium parvum
DELSSLTIIICWIEECLQNFV

SEQ ID NO: 2307933 - protein, 18 aa, Cryptosporidium parvum
DEVDKFLLSFGLRKVGMH

SEQ ID NO: 2307934 - protein, 20 aa, Cryptosporidium parvum
DEVPLRLGYTGVKNRSSADL

SEQ ID NO: 2307935 - protein, 22 aa, Cryptosporidium parvum
DEYKFNYDLIKRIIKYENYINM

SEQ ID NO: 2307936 - protein, 20 aa, Cryptosporidium parvum
DFDVPFSLKFGAFDDLVKLV

SEQ ID NO: 2307937 - protein, 17 aa, Cryptosporidium parvum
DFEWLRSTLVIQFPGVF

SEQ ID NO: 2307938 - protein, 17 aa, Cryptosporidium parvum
DFGLCKFSPLIEGDENR

SEQ ID NO: 2307939 - protein, 24 aa, Cryptosporidium parvum
DFIPHKWVRLAMCEGYDINCTDFD

SEQ ID NO: 2307940 - protein, 24 aa, Cryptosporidium parvum
DFPSFPYKYGMAITSLLADGQSNS

SEQ ID NO: 2307941 - protein, 23 aa, Cryptosporidium parvum
DFQWPEILEYIGIITNDYQESSH

SEQ ID NO: 2307942 - protein, 18 aa, Cryptosporidium parvum
DFRIEYCTRIIQLLKKNF

SEQ ID NO: 2307943 - protein, 18 aa, Cryptosporidium parvum
DFRNIPMLVSNLFGTTNL

SEQ ID NO: 2307944 - protein, 18 aa, Cryptosporidium parvum
DFYYKYKYTLGFKRILRL

SEQ ID NO: 2307945 - protein, 24 aa, Cryptosporidium parvum
DGCKREVLELMKLLLKASEADLTN

SEQ ID NO: 2307946 - protein, 19 aa, Cryptosporidium parvum
DGEFLRLTWSFRFKDENKQ

SEQ ID NO: 2307947 - protein, 19 aa, Cryptosporidium parvum
DGESMYLWLGRAIPTTFIQ

SEQ ID NO: 2307948 - protein, 20 aa, Cryptosporidium parvum
DGIRLNGKIDLLRGIQIAQL

SEQ ID NO: 2307949 - protein, 23 aa, Cryptosporidium parvum
DGKNSFKILFSWLNEELKLPSIE

SEQ ID NO: 2307950 - protein, 20 aa, Cryptosporidium parvum
DGNCSRGFFLADIQNISEQF

SEQ ID NO: 2307951 - protein, 17 aa, Cryptosporidium parvum
DGVDFIGVFSLIDTEIR

SEQ ID NO: 2307952 - protein, 17 aa, Cryptosporidium parvum
DGVEFKGIFSLDQPELK

SEQ ID NO: 2307953 - protein, 24 aa, Cryptosporidium parvum
DHFMFKICLLFSIQIVPISNDHTE

SEQ ID NO: 2307954 - protein, 18 aa, Cryptosporidium parvum
DHLKRYQIGKVYRRDEPQ

SEQ ID NO: 2307955 - protein, 24 aa, Cryptosporidium parvum
DIELKYSGLFAFGGDIATVKGQKG

SEQ ID NO: 2307956 - protein, 25 aa, Cryptosporidium parvum
DILLERWNPFLLYKFEQEYLKNGAI

SEQ ID NO: 2307957 - protein, 20 aa, Cryptosporidium parvum
DINGIPWIGIWRWDLYEKKR

SEQ ID NO: 2307958 - protein, 21 aa, Cryptosporidium parvum
DIQYIWRRNCPYLYDTMLSYT

SEQ ID NO: 2307959 - protein, 22 aa, Cryptosporidium parvum
DITEVFSVLGIEAVRRALLREL

SEQ ID NO: 2307960 - protein, 23 aa, Cryptosporidium parvum
DITSRLGTWLLRIQLNNKLVTDK

SEQ ID NO: 2307961 - protein, 23 aa, Cryptosporidium parvum
DKCRAECPFCHISLDWTKMKPYI

SEQ ID NO: 2307962 - protein, 18 aa, Cryptosporidium parvum
DKERVAICGEKGVHIWSF

SEQ ID NO: 2307963 - protein, 17 aa, Cryptosporidium parvum
DKICCLNNYFLKDEEHK

SEQ ID NO: 2307964 - protein, 17 aa, Cryptosporidium parvum
DKKIPCFFFAPRSNSKI

SEQ ID NO: 2307965 - protein, 21 aa, Cryptosporidium parvum
DKKMICSMLYDIPNFVKQLSN

SEQ ID NO: 2307966 - protein, 18 aa, Cryptosporidium parvum
DKLCNQCLNLLRQNKISS

SEQ ID NO: 2307967 - protein, 17 aa, Cryptosporidium parvum
DKSHYWFTPDFTLLSNG

SEQ ID NO: 2307968 - protein, 18 aa, Cryptosporidium parvum
DLALGLGKFELCISILQE

SEQ ID NO: 2307969 - protein, 23 aa, Cryptosporidium parvum
DLFRRICIFEGIFVGDTPANILK

SEQ ID NO: 2307970 - protein, 19 aa, Cryptosporidium parvum
DLKELWSLIDFVYPGKLGT

SEQ ID NO: 2307971 - protein, 27 aa, Cryptosporidium parvum
DLKPGNIILHRGCCKIADFGLSKQSDQ

SEQ ID NO: 2307972 - protein, 21 aa, Cryptosporidium parvum
DLLKRYQCCIDLHQNALIIGD

SEQ ID NO: 2307973 - protein, 20 aa, Cryptosporidium parvum
DLLLSYILHRLFDTPFTDED

SEQ ID NO: 2307974 - protein, 22 aa, Cryptosporidium parvum
DLLPTSVCPLIIIGEITSDEQK

SEQ ID NO: 2307975 - protein, 23 aa, Cryptosporidium parvum
DLLSSCFAFHFSLMKTRKIFYDL

SEQ ID NO: 2307976 - protein, 19 aa, Cryptosporidium parvum
DLSSLKVLFRWFSISDQTN

SEQ ID NO: 2307977 - protein, 21 aa, Cryptosporidium parvum
DLTSFSWNFTRRAKRRTVQVQ

SEQ ID NO: 2307978 - protein, 18 aa, Cryptosporidium parvum
DLVCCLWGSPGVYGVVTT

SEQ ID NO: 2307979 - protein, 27 aa, Cryptosporidium parvum
DLYEKKRGKLILIYSIINQTNYPTNCI

SEQ ID NO: 2307980 - protein, 17 aa, Cryptosporidium parvum
DMFNRSGSPSFQGLDPA

SEQ ID NO: 2307981 - protein, 25 aa, Cryptosporidium parvum
DNCKYRHCLPVGYVIKEQESDDGGD

SEQ ID NO: 2307982 - protein, 20 aa, Cryptosporidium parvum
DNELLRLLVLLNRIQLLNDV

SEQ ID NO: 2307983 - protein, 22 aa, Cryptosporidium parvum
DNKEVFSFLPIRSYGLKFILQA

SEQ ID NO: 2307984 - protein, 24 aa, Cryptosporidium parvum
DNLFKWYLKYGMRDSVSQLVGQLT

SEQ ID NO: 2307985 - protein, 27 aa, Cryptosporidium parvum
DNLYRALRFGGLLVRIPPYNQKSYEHF

SEQ ID NO: 2307986 - protein, 17 aa, Cryptosporidium parvum
DNNWSCCNSCLRFIWTL

SEQ ID NO: 2307987 - protein, 17 aa, Cryptosporidium parvum
DNPFRWVLFPIKYSRLW

SEQ ID NO: 2307988 - protein, 20 aa, Cryptosporidium parvum
DPFVGYGFLPYIVKMVWEKV

SEQ ID NO: 2307989 - protein, 23 aa, Cryptosporidium parvum
DPKVKFKALRLIKHLCENGNPTF

SEQ ID NO: 2307990 - protein, 23 aa, Cryptosporidium parvum
DPPYEVYNGWHWNSNKLEYCLKS

SEQ ID NO: 2307991 - protein, 17 aa, Cryptosporidium parvum
DQLKALVLRYAKENGKD

SEQ ID NO: 2307992 - protein, 22 aa, Cryptosporidium parvum
DQNKEFIVHIGLLEENKSKCEF

SEQ ID NO: 2307993 - protein, 19 aa, Cryptosporidium parvum
DRLYLWNGLYWIRILDQSK

SEQ ID NO: 2307994 - protein, 21 aa, Cryptosporidium parvum
DRMIIGGGMAFTFKKVMDNMQ

SEQ ID NO: 2307995 - protein, 19 aa, Cryptosporidium parvum
DSEWKCYICKVPRNGKESM

SEQ ID NO: 2307996 - protein, 18 aa, Cryptosporidium parvum
DSFRFERGLSLFLEIPKE

SEQ ID NO: 2307997 - protein, 18 aa, Cryptosporidium parvum
DSIAWGCCEILKNFDHSR

SEQ ID NO: 2307998 - protein, 24 aa, Cryptosporidium parvum
DSICYCVSCILSLYESKVNFDGEN

SEQ ID NO: 2307999 - protein, 25 aa, Cryptosporidium parvum
DSIHWMIIIALRFIALSSLQLGNYA

SEQ ID NO: 2308000 - protein, 17 aa, Cryptosporidium parvum
DSIKLFPLNGFDPLDIP

SEQ ID NO: 2308001 - protein, 18 aa, Cryptosporidium parvum
DSNMSVCVNGKCGNPKNL

SEQ ID NO: 2308002 - protein, 22 aa, Cryptosporidium parvum
DSRCLRDTWGLRQHRDGRWDWI

SEQ ID NO: 2308003 - protein, 22 aa, Cryptosporidium parvum
DSREVYCGNLPYSCTEEEIRGL

SEQ ID NO: 2308004 - protein, 30 aa, Cryptosporidium parvum
DSTRGSSIARCFKKGLGGSILSSCMGVSDT

SEQ ID NO: 2308005 - protein, 18 aa, Cryptosporidium parvum
DTYLLFDLCKEFDLRFIV

SEQ ID NO: 2308006 - protein, 19 aa, Cryptosporidium parvum
DVCIWKLVTEWSVEERMVF

SEQ ID NO: 2308007 - protein, 25 aa, Cryptosporidium parvum
DVDFQRFCLGLGFDINSQNQVICDS

SEQ ID NO: 2308008 - protein, 17 aa, Cryptosporidium parvum
DVIFAFDEIVSFGYRES

SEQ ID NO: 2308009 - protein, 17 aa, Cryptosporidium parvum
DVLNCIYNSLSIIIPGQ

SEQ ID NO: 2308010 - protein, 19 aa, Cryptosporidium parvum
DVRLWICIGDCYLAKNEVA

SEQ ID NO: 2308011 - protein, 21 aa, Cryptosporidium parvum
DYASWEMIKDLAICELKHIVY

SEQ ID NO: 2308012 - protein, 20 aa, Cryptosporidium parvum
DYLKLLLLDLRILKKGVSLN

SEQ ID NO: 2308013 - protein, 18 aa, Cryptosporidium parvum
DYLRYGVRYIGNKAINGN

SEQ ID NO: 2308014 - protein, 19 aa, Cryptosporidium parvum
EAISACLFFFGFPKQAEKL

SEQ ID NO: 2308015 - protein, 19 aa, Cryptosporidium parvum
EAKELFSYSGIWLDTHSIP

SEQ ID NO: 2308016 - protein, 19 aa, Cryptosporidium parvum
EALPYIPLLLPIGITVMAV

SEQ ID NO: 2308017 - protein, 20 aa, Cryptosporidium parvum
EARNSFVFMIRVLKRKFENY

SEQ ID NO: 2308018 - protein, 23 aa, Cryptosporidium parvum
EAYCLRLRFLIFRRRNIIEWEKM

SEQ ID NO: 2308019 - protein, 17 aa, Cryptosporidium parvum
ECIPLLPCIQNLKDENH

SEQ ID NO: 2308020 - protein, 19 aa, Cryptosporidium parvum
ECIRLLVAFILNSLSMDEL

SEQ ID NO: 2308021 - protein, 19 aa, Cryptosporidium parvum
ECPICRSLLKEELWLSKSD

SEQ ID NO: 2308022 - protein, 19 aa, Cryptosporidium parvum
ECVICKRDKFGVATGLGTE

SEQ ID NO: 2308023 - protein, 17 aa, Cryptosporidium parvum
EDAWPCAELIGYYLDKK

SEQ ID NO: 2308024 - protein, 21 aa, Cryptosporidium parvum
EDIELRFTLNLEEDLSKFKEA

SEQ ID NO: 2308025 - protein, 24 aa, Cryptosporidium parvum
EDISLLPGWILRNLSLMREIDKKS

SEQ ID NO: 2308026 - protein, 18 aa, Cryptosporidium parvum
EDLLEWKAMIKEFYSNDP

SEQ ID NO: 2308027 - protein, 24 aa, Cryptosporidium parvum
EDLQAIFRRCYKNSLWRKKEVETN

SEQ ID NO: 2308028 - protein, 17 aa, Cryptosporidium parvum
EDVIKSWESRLAKQVKL

SEQ ID NO: 2308029 - protein, 21 aa, Cryptosporidium parvum
EDYYRRINVQPAIVDTPMSPR

SEQ ID NO: 2308030 - protein, 24 aa, Cryptosporidium parvum
EEDRVNCPFYWKIGACRHGDQCSR

SEQ ID NO: 2308031 - protein, 18 aa, Cryptosporidium parvum
EEEKEVWNIFSFSPVEDK

SEQ ID NO: 2308032 - protein, 22 aa, Cryptosporidium parvum
EEFYYKNIESIPRCYDELIDMS

SEQ ID NO: 2308033 - protein, 19 aa, Cryptosporidium parvum
EEHNRFVLALKKFGRNWTL

SEQ ID NO: 2308034 - protein, 17 aa, Cryptosporidium parvum
EEICIPPAFYGNTYLSL

SEQ ID NO: 2308035 - protein, 25 aa, Cryptosporidium parvum
EELKNGLRWGLKYLKLEDYRKGQKD

SEQ ID NO: 2308036 - protein, 23 aa, Cryptosporidium parvum
EELKYIYCIILKFIYQSKTKYCQ

SEQ ID NO: 2308037 - protein, 25 aa, Cryptosporidium parvum
EELPIKGLFFFPSRLLETAAFRPPK

SEQ ID NO: 2308038 - protein, 26 aa, Cryptosporidium parvum
EENIRYFLYWRRMRMQLKREERRQLN

SEQ ID NO: 2308039 - protein, 23 aa, Cryptosporidium parvum
EEYKLEWWLGIIEKFCDKNKSLL

SEQ ID NO: 2308040 - protein, 17 aa, Cryptosporidium parvum
EFIKCPICLDSDLLVPK

SEQ ID NO: 2308041 - protein, 21 aa, Cryptosporidium parvum
EFMRFSVLLAVLFGLKDPIDP

SEQ ID NO: 2308042 - protein, 18 aa, Cryptosporidium parvum
EFRRRYLEEFLRRVFNRG

SEQ ID NO: 2308043 - protein, 17 aa, Cryptosporidium parvum
EFSKILFDYCRRSTSQT

SEQ ID NO: 2308044 - protein, 17 aa, Cryptosporidium parvum
EGIPQVYILLRWDCLVF

SEQ ID NO: 2308045 - protein, 19 aa, Cryptosporidium parvum
EGLELLFLVGFREKQAEDQ

SEQ ID NO: 2308046 - protein, 25 aa, Cryptosporidium parvum
EGLKMVAKEKLSFWMDLPCNMDRKK

SEQ ID NO: 2308047 - protein, 23 aa, Cryptosporidium parvum
EGLPRKIAAFILQRHGNQIPYDR

SEQ ID NO: 2308048 - protein, 19 aa, Cryptosporidium parvum
EGNNGFCFLQFSSPLTSYR

SEQ ID NO: 2308049 - protein, 24 aa, Cryptosporidium parvum
EGVRPSRIFFRWKIYYCHSKEDAY

SEQ ID NO: 2308050 - protein, 23 aa, Cryptosporidium parvum
EGYKKLRVRLCCIIKNIMKNILK

SEQ ID NO: 2308051 - protein, 26 aa, Cryptosporidium parvum
EHIQAIELLKYFWGLSLSPKDNDERR

SEQ ID NO: 2308052 - protein, 17 aa, Cryptosporidium parvum
EHLEILLGLSFLGNDVK

SEQ ID NO: 2308053 - protein, 23 aa, Cryptosporidium parvum
EICHYIFTFRIYKDFNEIESGKN

SEQ ID NO: 2308054 - protein, 18 aa, Cryptosporidium parvum
EIIAKVTSCFFCQQGQNS

SEQ ID NO: 2308055 - protein, 26 aa, Cryptosporidium parvum
EIIFKVQCLWPVFLLPLVSGELFFTI

SEQ ID NO: 2308056 - protein, 17 aa, Cryptosporidium parvum
EIIGKVCPFEFFSDRVY

SEQ ID NO: 2308057 - protein, 19 aa, Cryptosporidium parvum
EILDILSYCRLMIDETADD

SEQ ID NO: 2308058 - protein, 17 aa, Cryptosporidium parvum
EILHEWSPSINLLTTVD

SEQ ID NO: 2308059 - protein, 18 aa, Cryptosporidium parvum
EILWYLPQLCEISLNRFE

SEQ ID NO: 2308060 - protein, 25 aa, Cryptosporidium parvum
EIPHFKLFRKGNCSNGIREVQFSKR

SEQ ID NO: 2308061 - protein, 19 aa, Cryptosporidium parvum
EIPNFLKVFHYIRNEADPD

SEQ ID NO: 2308062 - protein, 37 aa, Cryptosporidium parvum
EIQYAKDFEFFFGVPYRPYIRLSRYRFGKNMKYPRDL

SEQ ID NO: 2308063 - protein, 17 aa, Cryptosporidium parvum
EIRQCYRLQFKGSDGKW

SEQ ID NO: 2308064 - protein, 32 aa, Cryptosporidium parvum
EISGEIFWSLLFWKMPELFFLSVSKSTQISKE

SEQ ID NO: 2308065 - protein, 23 aa, Cryptosporidium parvum
EIVRICILHGILIGINYLNKSED

SEQ ID NO: 2308066 - protein, 21 aa, Cryptosporidium parvum
EKCWYCSSNIYPGHGVTFVRN

SEQ ID NO: 2308067 - protein, 25 aa, Cryptosporidium parvum
EKEECFQILLGVVIRLFNKRLELDL

SEQ ID NO: 2308068 - protein, 17 aa, Cryptosporidium parvum
EKGLVLFIGKLIADTWL

SEQ ID NO: 2308069 - protein, 24 aa, Cryptosporidium parvum
EKKKKCWWDSCFLGESKLDLSQVQ

SEQ ID NO: 2308070 - protein, 20 aa, Cryptosporidium parvum
EKKRFTIYGALVFENDVRNL

SEQ ID NO: 2308071 - protein, 23 aa, Cryptosporidium parvum
EKKRIFEGLTFFISREVPLLPLA

SEQ ID NO: 2308072 - protein, 20 aa, Cryptosporidium parvum
EKKSRFSLILISDLKEWQVI

SEQ ID NO: 2308073 - protein, 17 aa, Cryptosporidium parvum
EKQEQFYILAILLGCDY

SEQ ID NO: 2308074 - protein, 18 aa, Cryptosporidium parvum
EKQILIWNGIPINKLSGK

SEQ ID NO: 2308075 - protein, 18 aa, Cryptosporidium parvum
EKVVWDYLHFLYRQNTGV

SEQ ID NO: 2308076 - protein, 17 aa, Cryptosporidium parvum
EKVWKPKVDEINSKCED

SEQ ID NO: 2308077 - protein, 19 aa, Cryptosporidium parvum
EKWFRRGRKLFVRKFVQQL

SEQ ID NO: 2308078 - protein, 17 aa, Cryptosporidium parvum
ELDWKVVCIRVCDPHAS

SEQ ID NO: 2308079 - protein, 19 aa, Cryptosporidium parvum
ELDYELICIDFFLRYISNL

SEQ ID NO: 2308080 - protein, 24 aa, Cryptosporidium parvum
ELEILDRISFIWGYNNDNIYKINI

SEQ ID NO: 2308081 - protein, 22 aa, Cryptosporidium parvum
ELEPERFQSLMIVQSLNDKIVP

SEQ ID NO: 2308082 - protein, 21 aa, Cryptosporidium parvum
ELFKTAGRVVKVFLAKNKNNS

SEQ ID NO: 2308083 - protein, 22 aa, Cryptosporidium parvum
ELFRRNIDICLPKDSKFSSIID

SEQ ID NO: 2308084 - protein, 19 aa, Cryptosporidium parvum
ELFSNLIIYSGFYLPPNSN

SEQ ID NO: 2308085 - protein, 22 aa, Cryptosporidium parvum
ELILYKRSWDWLARTRLDEACK

SEQ ID NO: 2308086 - protein, 22 aa, Cryptosporidium parvum
ELKATSMGLLYGRKEKEQEREI

SEQ ID NO: 2308087 - protein, 24 aa, Cryptosporidium parvum
ELKLKILICFRENYFINNYSKKWK

SEQ ID NO: 2308088 - protein, 19 aa, Cryptosporidium parvum
ELKPSHFIPLLKSYIEDTN

SEQ ID NO: 2308089 - protein, 23 aa, Cryptosporidium parvum
ELLHCLKCGVNIHSKCSEVVNGS

SEQ ID NO: 2308090 - protein, 18 aa, Cryptosporidium parvum
ELMHAIGISTGMSEVLNL

SEQ ID NO: 2308091 - protein, 22 aa, Cryptosporidium parvum
ELMQLLKWRFLVLKDIKANSIG

SEQ ID NO: 2308092 - protein, 24 aa, Cryptosporidium parvum
ELPCKRWPELLPYLIRLVQNNSDN

SEQ ID NO: 2308093 - protein, 19 aa, Cryptosporidium parvum
ELRLRLCSQLAALLNPIIL

SEQ ID NO: 2308094 - protein, 18 aa, Cryptosporidium parvum
ELSIPVMVIPVEMKKLNC

SEQ ID NO: 2308095 - protein, 21 aa, Cryptosporidium parvum
ELWSLLNFLLPQVFHSVEDFQ

SEQ ID NO: 2308096 - protein, 19 aa, Cryptosporidium parvum
ELWSLLNFLYPEIFSSSEE

SEQ ID NO: 2308097 - protein, 18 aa, Cryptosporidium parvum
EMAVPFGISPGVCQSNNA

SEQ ID NO: 2308098 - protein, 17 aa, Cryptosporidium parvum
EMTEILFTRGLIKVLFA

SEQ ID NO: 2308099 - protein, 28 aa, Cryptosporidium parvum
EMYADLCQILKWRSPVLVNKDGKSTIAF

SEQ ID NO: 2308100 - protein, 22 aa, Cryptosporidium parvum
ENEARWLFSQIFNAVINLHNKN

SEQ ID NO: 2308101 - protein, 24 aa, Cryptosporidium parvum
ENEFKFVLLILNWAASVLMVTKAF

SEQ ID NO: 2308102 - protein, 23 aa, Cryptosporidium parvum
ENFPETFDIFGISLEFIKKTINE

SEQ ID NO: 2308103 - protein, 21 aa, Cryptosporidium parvum
ENFPRILAIFIDIYGTSMSND

SEQ ID NO: 2308104 - protein, 20 aa, Cryptosporidium parvum
ENGLKIVLCIGESLSERETG

SEQ ID NO: 2308105 - protein, 23 aa, Cryptosporidium parvum
ENIRLSTGVSEIFGFFETSEDKQ

SEQ ID NO: 2308106 - protein, 22 aa, Cryptosporidium parvum
ENLRKDPNFELFIYPIDPVRDG

SEQ ID NO: 2308107 - protein, 17 aa, Cryptosporidium parvum
ENMGIDIWGEFLVPDIK

SEQ ID NO: 2308108 - protein, 18 aa, Cryptosporidium parvum
ENPHEFERLVKLIFSNCM

SEQ ID NO: 2308109 - protein, 20 aa, Cryptosporidium parvum
ENPRKVCLMDAVLKEGELEE

SEQ ID NO: 2308110 - protein, 17 aa, Cryptosporidium parvum
ENQRLILKYGFVKDPSL

SEQ ID NO: 2308111 - protein, 24 aa, Cryptosporidium parvum
ENRIAFDFIIDEVFLRGTIYDYMR

SEQ ID NO: 2308112 - protein, 23 aa, Cryptosporidium parvum
ENRNRLKLLLSWLEERVQEGYQD

SEQ ID NO: 2308113 - protein, 25 aa, Cryptosporidium parvum
EPEWLNFYAPHIFKLNINDSNKEDL

SEQ ID NO: 2308114 - protein, 19 aa, Cryptosporidium parvum
EPFGPWLVTPLFLGAKGGG

SEQ ID NO: 2308115 - protein, 23 aa, Cryptosporidium parvum
EPPKYAVSLVMDLSKVPNIDQMK

SEQ ID NO: 2308116 - protein, 18 aa, Cryptosporidium parvum
EPQLIFLRWIRLLFSREF

SEQ ID NO: 2308117 - protein, 32 aa, Cryptosporidium parvum
EPSWPHLLVIYEFFLRFVISPQFSTKVAKKYI

SEQ ID NO: 2308118 - protein, 21 aa, Cryptosporidium parvum
EPSWRIWIFFLRGIIPILERW

SEQ ID NO: 2308119 - protein, 21 aa, Cryptosporidium parvum
EQAEGWLKRMVELEQENSTLS

SEQ ID NO: 2308120 - protein, 22 aa, Cryptosporidium parvum
EQGRLGKRFSILELSKEAKEIL

SEQ ID NO: 2308121 - protein, 23 aa, Cryptosporidium parvum
ERGKSLWLWKPLPQFISRSNRYQ

SEQ ID NO: 2308122 - protein, 23 aa, Cryptosporidium parvum
ERKRAKEYLAWLIAQRTSTVSVD

SEQ ID NO: 2308123 - protein, 17 aa, Cryptosporidium parvum
ERLKIILVLNKMDRLIL

SEQ ID NO: 2308124 - protein, 17 aa, Cryptosporidium parvum
ERLRLGGVLELLDEEAL

SEQ ID NO: 2308125 - protein, 18 aa, Cryptosporidium parvum
ERRCFRVIGGVMVERTVK

SEQ ID NO: 2308126 - protein, 21 aa, Cryptosporidium parvum
ESAFKRLAFKRFKSVPLYIEW

SEQ ID NO: 2308127 - protein, 23 aa, Cryptosporidium parvum
ESCLPLRILIKFERKTLKDKDRE

SEQ ID NO: 2308128 - protein, 27 aa, Cryptosporidium parvum
ESEYLFRLLWHFSHCCIYHGNLLNSST

SEQ ID NO: 2308129 - protein, 20 aa, Cryptosporidium parvum
ESFLPDFLDLIIWGHEHECI

SEQ ID NO: 2308130 - protein, 18 aa, Cryptosporidium parvum
ESGKRFALKKVLQDPRYK

SEQ ID NO: 2308131 - protein, 25 aa, Cryptosporidium parvum
ESIKFIKIKVAFLINQGYPEKSPPE

SEQ ID NO: 2308132 - protein, 17 aa, Cryptosporidium parvum
ESIVSLELWNLYKEMGP

SEQ ID NO: 2308133 - protein, 19 aa, Cryptosporidium parvum
ESKELKRSLGLIMLRGENI

SEQ ID NO: 2308134 - protein, 21 aa, Cryptosporidium parvum
ESLHWEWPAGLLPASRGVRSR

SEQ ID NO: 2308135 - protein, 19 aa, Cryptosporidium parvum
ESLSSKSGWNKKQLFGNEV

SEQ ID NO: 2308136 - protein, 19 aa, Cryptosporidium parvum
ESPFVYALVDWIKEKVGNF

SEQ ID NO: 2308137 - protein, 24 aa, Cryptosporidium parvum
ESSILELISFFGFKYDEKSQKLLD

SEQ ID NO: 2308138 - protein, 23 aa, Cryptosporidium parvum
ESSQRWIAQWSDSISGRRITHGF

SEQ ID NO: 2308139 - protein, 18 aa, Cryptosporidium parvum
ESYIGRVCLFDIIENLQV

SEQ ID NO: 2308140 - protein, 19 aa, Cryptosporidium parvum
ETCIKRPKFRLIVTSATLE

SEQ ID NO: 2308141 - protein, 23 aa, Cryptosporidium parvum
ETDFKLSIPILIELIKKDNLDEI

SEQ ID NO: 2308142 - protein, 17 aa, Cryptosporidium parvum
ETIPIRFVRQIRVFNLA

SEQ ID NO: 2308143 - protein, 22 aa, Cryptosporidium parvum
ETLNEILPLIAQRIAFSNIINS

SEQ ID NO: 2308144 - protein, 25 aa, Cryptosporidium parvum
ETLSEWRNELLLAILEKISESKMFQ

SEQ ID NO: 2308145 - protein, 25 aa, Cryptosporidium parvum
ETTCTANLIKCCIDKSAWRCLHTLL

SEQ ID NO: 2308146 - protein, 20 aa, Cryptosporidium parvum
ETVFDSGMKIQKTVNKTSTE

SEQ ID NO: 2308147 - protein, 24 aa, Cryptosporidium parvum
EVFKPMVYETIVFPPGYFEYKKQL

SEQ ID NO: 2308148 - protein, 19 aa, Cryptosporidium parvum
EVIELISFTIYRQANGPAA

SEQ ID NO: 2308149 - protein, 20 aa, Cryptosporidium parvum
EVLPSWILEKFFVDGGFNVI

SEQ ID NO: 2308150 - protein, 20 aa, Cryptosporidium parvum
EVQTGFQFRLQVPMGSILAS

SEQ ID NO: 2308151 - protein, 18 aa, Cryptosporidium parvum
EVRRRIDLGSSLILQNYS

SEQ ID NO: 2308152 - protein, 21 aa, Cryptosporidium parvum
EVVGLLEWLVSIVIYRQNRYM

SEQ ID NO: 2308153 - protein, 20 aa, Cryptosporidium parvum
EVYCVPGTKSYIVFGDAKLE

SEQ ID NO: 2308154 - protein, 22 aa, Cryptosporidium parvum
EWKKLRWSNKLNLVINIDDYNK

SEQ ID NO: 2308155 - protein, 20 aa, Cryptosporidium parvum
EWYKNCNWYHIYPIGLCGVE

SEQ ID NO: 2308156 - protein, 19 aa, Cryptosporidium parvum
EYFEAFPLAISETLEINQL

SEQ ID NO: 2308157 - protein, 23 aa, Cryptosporidium parvum
EYWTEFWNLIALDLGNRCERTGR

SEQ ID NO: 2308158 - protein, 28 aa, Cryptosporidium parvum
EYYMAELLWRIGTVLGHSSFVNIPLVPL

SEQ ID NO: 2308159 - protein, 17 aa, Cryptosporidium parvum
EYYYKLGRILNNYNDLI

SEQ ID NO: 2308160 - protein, 21 aa, Cryptosporidium parvum
FACGYPGCHASFKRRSHLERH

SEQ ID NO: 2308161 - protein, 17 aa, Cryptosporidium parvum
FAFKVLKSFRGKLRLGV

SEQ ID NO: 2308162 - protein, 23 aa, Cryptosporidium parvum
FAHLRLALLPSDFLVYSHRHDLV

SEQ ID NO: 2308163 - protein, 18 aa, Cryptosporidium parvum
FAIAEWTYRRMLKDNRSQ

SEQ ID NO: 2308164 - protein, 23 aa, Cryptosporidium parvum
FAKEIIKSIGLKPIYFDCIKNLL

SEQ ID NO: 2308165 - protein, 17 aa, Cryptosporidium parvum
FASGNVDGVTTRTETFV

SEQ ID NO: 2308166 - protein, 19 aa, Cryptosporidium parvum
FCRRRLAVVLVQLKFCPNL

SEQ ID NO: 2308167 - protein, 17 aa, Cryptosporidium parvum
FCVNCGILALDEPTTNL

SEQ ID NO: 2308168 - protein, 21 aa, Cryptosporidium parvum
FCWRSDTPLQYRAVPSWFINV

SEQ ID NO: 2308169 - protein, 20 aa, Cryptosporidium parvum
FDASWRYKLCNKFKIVPYTN

SEQ ID NO: 2308170 - protein, 21 aa, Cryptosporidium parvum
FDFRFKAIIGHLTLKFISVFF

SEQ ID NO: 2308171 - protein, 18 aa, Cryptosporidium parvum
FDGHGGSVISEWVSRHIE

SEQ ID NO: 2308172 - protein, 17 aa, Cryptosporidium parvum
FDIPPVRVCIQILSAHQ

SEQ ID NO: 2308173 - protein, 17 aa, Cryptosporidium parvum
FDLCKEFDLRFIVIHDR

SEQ ID NO: 2308174 - protein, 23 aa, Cryptosporidium parvum
FDLQLILGELIWRVLKKTNYGRG

SEQ ID NO: 2308175 - protein, 18 aa, Cryptosporidium parvum
FDLRFIVIHDRYIPPSGK

SEQ ID NO: 2308176 - protein, 21 aa, Cryptosporidium parvum
FDLSLFIKMILILRFEVKLIR

SEQ ID NO: 2308177 - protein, 20 aa, Cryptosporidium parvum
FDYALSIHCEFGRPRHRDSS

SEQ ID NO: 2308178 - protein, 22 aa, Cryptosporidium parvum
FEEMKYFFGRGGIIKIDPTTLS

SEQ ID NO: 2308179 - protein, 17 aa, Cryptosporidium parvum
FEFKVLLLTSMGSKVFV

SEQ ID NO: 2308180 - protein, 19 aa, Cryptosporidium parvum
FEFLKEFYGVLDFGSVLKV

SEQ ID NO: 2308181 - protein, 19 aa, Cryptosporidium parvum
FEGSWKLGGFENAISLSDT

SEQ ID NO: 2308182 - protein, 17 aa, Cryptosporidium parvum
FEICLGTILNCIQVFGL

SEQ ID NO: 2308183 - protein, 20 aa, Cryptosporidium parvum
FEILRICAGILHLCNFDFIQ

SEQ ID NO: 2308184 - protein, 17 aa, Cryptosporidium parvum
FEKVVVRGARGLSFQIV

SEQ ID NO: 2308185 - protein, 19 aa, Cryptosporidium parvum
FELKNRIALIDAQNLLSRY

SEQ ID NO: 2308186 - protein, 22 aa, Cryptosporidium parvum
FENELWKANVINVLKRFDQSWV

SEQ ID NO: 2308187 - protein, 17 aa, Cryptosporidium parvum
FEVARKFIQTRFGCKFS

SEQ ID NO: 2308188 - protein, 22 aa, Cryptosporidium parvum
FEVTECGWGEFDIMAKVYFVDS

SEQ ID NO: 2308189 - protein, 17 aa, Cryptosporidium parvum
FFFKRVVINPAFYDPNV

SEQ ID NO: 2308190 - protein, 19 aa, Cryptosporidium parvum
FFPERSIEFSSYFNKAKFL

SEQ ID NO: 2308191 - protein, 17 aa, Cryptosporidium parvum
FFRERYIMFASRLFSQI

SEQ ID NO: 2308192 - protein, 18 aa, Cryptosporidium parvum
FFSIDTWAPLSLTIGIDS

SEQ ID NO: 2308193 - protein, 18 aa, Cryptosporidium parvum
FGDLCCITFTPSGEHIFA

SEQ ID NO: 2308194 - protein, 19 aa, Cryptosporidium parvum
FGIPPRFSESLIMNTNEGK

SEQ ID NO: 2308195 - protein, 25 aa, Cryptosporidium parvum
FGITPWMPFWFRFTPINAKTVSNPL

SEQ ID NO: 2308196 - protein, 22 aa, Cryptosporidium parvum
FGMGGAEAFGGLRTMNYGGGKL

SEQ ID NO: 2308197 - protein, 19 aa, Cryptosporidium parvum
FGMLSCRPYSSSISTITSS

SEQ ID NO: 2308198 - protein, 22 aa, Cryptosporidium parvum
FGRIGRLVLRACMERNDITVVA

SEQ ID NO: 2308199 - protein, 18 aa, Cryptosporidium parvum
FGVLRPNAKWRPGRGNSS

SEQ ID NO: 2308200 - protein, 17 aa, Cryptosporidium parvum
FHPKIPFVCKIEMKSET

SEQ ID NO: 2308201 - protein, 17 aa, Cryptosporidium parvum
FIDKEVVDWSQYTTMDS

SEQ ID NO: 2308202 - protein, 19 aa, Cryptosporidium parvum
FIDRGWRDCFECFKHENRY

SEQ ID NO: 2308203 - protein, 17 aa, Cryptosporidium parvum
FIDRLKNLFAILNNKKI

SEQ ID NO: 2308204 - protein, 18 aa, Cryptosporidium parvum
FIEFWRLYEEMLKHSGVY

SEQ ID NO: 2308205 - protein, 17 aa, Cryptosporidium parvum
FIHGWKLAFLTVSPMSK

SEQ ID NO: 2308206 - protein, 24 aa, Cryptosporidium parvum
FIIKSSQCPIIFSCRMAIVNNSKK

SEQ ID NO: 2308207 - protein, 19 aa, Cryptosporidium parvum
FIKCKLINISYAFPSDTEH

SEQ ID NO: 2308208 - protein, 24 aa, Cryptosporidium parvum
FIPFKYKWSYFIGMLQNLGQYTGI

SEQ ID NO: 2308209 - protein, 17 aa, Cryptosporidium parvum
FIPQFKCCIDCNPTTIK

SEQ ID NO: 2308210 - protein, 18 aa, Cryptosporidium parvum
FIQNNVRFFFTRNIHCHA

SEQ ID NO: 2308211 - protein, 17 aa, Cryptosporidium parvum
FIRCLRRIMSLVHSPIV

SEQ ID NO: 2308212 - protein, 18 aa, Cryptosporidium parvum
FISFCFWFPITEFQRLYN

SEQ ID NO: 2308213 - protein, 19 aa, Cryptosporidium parvum
FKAILFIPRRAPFDLFETR

SEQ ID NO: 2308214 - protein, 17 aa, Cryptosporidium parvum
FKCCKNLKRSSVCSAYN

SEQ ID NO: 2308215 - protein, 19 aa, Cryptosporidium parvum
FKENLCIDGLFIGNLDRAE

SEQ ID NO: 2308216 - protein, 21 aa, Cryptosporidium parvum
FKESFSFLPSFFVDEIFGGQL

SEQ ID NO: 2308217 - protein, 18 aa, Cryptosporidium parvum
FKEYRLGQILPVSIHQFF

SEQ ID NO: 2308218 - protein, 21 aa, Cryptosporidium parvum
FKGRCVIAGSLIRKDDFVLEY

SEQ ID NO: 2308219 - protein, 19 aa, Cryptosporidium parvum
FKIAIALAENCQLPVFITL

SEQ ID NO: 2308220 - protein, 22 aa, Cryptosporidium parvum
FKIRCSRYLYTLVMKDLEKAKK

SEQ ID NO: 2308221 - protein, 19 aa, Cryptosporidium parvum
FKRLCKLLYYGILPVIVFD

SEQ ID NO: 2308222 - protein, 23 aa, Cryptosporidium parvum
FKRPDIKCSICGDKGHITKDCKQ

SEQ ID NO: 2308223 - protein, 25 aa, Cryptosporidium parvum
FKRSVWLKSHFIRKRIIDNINDFNL

SEQ ID NO: 2308224 - protein, 19 aa, Cryptosporidium parvum
FKSGWKLDKEWEIEQKKKR

SEQ ID NO: 2308225 - protein, 19 aa, Cryptosporidium parvum
FKTHILKRSKSIGVSKVKR

SEQ ID NO: 2308226 - protein, 19 aa, Cryptosporidium parvum
FKVFLRYFIYPAYLDLYSY

SEQ ID NO: 2308227 - protein, 20 aa, Cryptosporidium parvum
FKYRRGGIVVAPEICIPKQH

SEQ ID NO: 2308228 - protein, 20 aa, Cryptosporidium parvum
FLHELKLKLIEIFRINSEKF

SEQ ID NO: 2308229 - protein, 22 aa, Cryptosporidium parvum
FLICEFCSGGTLFNLLHGDSKK

SEQ ID NO: 2308230 - protein, 18 aa, Cryptosporidium parvum
FLIGEGIPSYILDLPNEV

SEQ ID NO: 2308231 - protein, 20 aa, Cryptosporidium parvum
FLKRLKGIGRHQVKINIYNS

SEQ ID NO: 2308232 - protein, 20 aa, Cryptosporidium parvum
FLLNLLIKFGILRSDASDLH

SEQ ID NO: 2308233 - protein, 31 aa, Cryptosporidium parvum; identical to SEQ ID NO: 2185248

SEQ ID NO: 2308234 - protein, 22 aa, Cryptosporidium parvum
FLNKLCETRHLFQQGKGAIPDW

SEQ ID NO: 2308235 - protein, 18 aa, Cryptosporidium parvum
FLQLLLCIPYWNGNIPPP

SEQ ID NO: 2308236 - protein, 27 aa, Cryptosporidium parvum
FLRLLQLLGEWAEFGLIVIFCNRQTDV

SEQ ID NO: 2308237 - protein, 22 aa, Cryptosporidium parvum
FLSFVFKLPFYLKMDINLTPVT

SEQ ID NO: 2308238 - protein, 20 aa, Cryptosporidium parvum
FLTLRYSRLFPIPERTLSYG

SEQ ID NO: 2308239 - protein, 27 aa, Cryptosporidium parvum
FLVEDIPLPKVCVFQIEAKLELLLLYR

SEQ ID NO: 2308240 - protein, 19 aa, Cryptosporidium parvum
FLVPLSLSFMSNWAENKNK

SEQ ID NO: 2308241 - protein, 20 aa, Cryptosporidium parvum
FLVYNSAGGLCWSDRICDMN

SEQ ID NO: 2308242 - protein, 17 aa, Cryptosporidium parvum
FLYKFISGICPKSYGMN

SEQ ID NO: 2308243 - protein, 24 aa, Cryptosporidium parvum
FMNIQELFLFLSLFYHNYQREWIL

SEQ ID NO: 2308244 - protein, 26 aa, Cryptosporidium parvum
FNEYIPFEWIEKGHIFVPLKIHYIDP

SEQ ID NO: 2308245 - protein, 18 aa, Cryptosporidium parvum
FNGPSYFCSYSFASVFSR

SEQ ID NO: 2308246 - protein, 17 aa, Cryptosporidium parvum
FNICHCHDWLAAPVLTS

SEQ ID NO: 2308247 - protein, 20 aa, Cryptosporidium parvum
FNKPRLVSPITFNTIGMPER

SEQ ID NO: 2308248 - protein, 17 aa, Cryptosporidium parvum
FNLKGGMMFGTSKKDGS

SEQ ID NO: 2308249 - protein, 17 aa, Cryptosporidium parvum
FNMLLCFSKLPDIQSEM

SEQ ID NO: 2308250 - protein, 20 aa, Cryptosporidium parvum
FNPRSGIRWLCFILGEYGKL

SEQ ID NO: 2308251 - protein, 19 aa, Cryptosporidium parvum
FNVPYEWDKKSLVGLFCRF

SEQ ID NO: 2308252 - protein, 21 aa, Cryptosporidium parvum
FNWLLEYDVPLFITNDLINSE

SEQ ID NO: 2308253 - protein, 19 aa, Cryptosporidium parvum
FNWSWKEIKDMLSSDFSLS

SEQ ID NO: 2308254 - protein, 18 aa, Cryptosporidium parvum
FNYWMLAKKFEFEKIVTR

SEQ ID NO: 2308255 - protein, 17 aa, Cryptosporidium parvum
FPCGKWPDLLPFLFRLI

SEQ ID NO: 2308256 - protein, 19 aa, Cryptosporidium parvum
FPHFEFLLDYMILFSPCGQ

SEQ ID NO: 2308257 - protein, 19 aa, Cryptosporidium parvum
FPICAKWSSLIVEEFNYQS

SEQ ID NO: 2308258 - protein, 25 aa, Cryptosporidium parvum
FPIDANCILSAWKYQEVSLYYIFNE

SEQ ID NO: 2308259 - protein, 18 aa, Cryptosporidium parvum
FPIYCMELLGSKGSQSII

SEQ ID NO: 2308260 - protein, 22 aa, Cryptosporidium parvum
FPLDYYQKWVLEYNQIINNLYN

SEQ ID NO: 2308261 - protein, 17 aa, Cryptosporidium parvum
FPLKPGVPFTDDFQLIV

SEQ ID NO: 2308262 - protein, 21 aa, Cryptosporidium parvum
FPNCKRFYCPFIHDSETNLIN

SEQ ID NO: 2308263 - protein, 20 aa, Cryptosporidium parvum
FPVMMSRFIATFTRAEKRNS

SEQ ID NO: 2308264 - protein, 17 aa, Cryptosporidium parvum
FQEIELIFSNCREYNTS

SEQ ID NO: 2308265 - protein, 20 aa, Cryptosporidium parvum
FQKGEWRAVYGPSKNRQQKS

SEQ ID NO: 2308266 - protein, 21 aa, Cryptosporidium parvum
FQLRPKLTIKDLEWLNSDKND

SEQ ID NO: 2308267 - protein, 19 aa, Cryptosporidium parvum
FRCSGCPYKGMPAFKPGEK

SEQ ID NO: 2308268 - protein, 19 aa, Cryptosporidium parvum
FRDGILLVNLLKQWSSLYG

SEQ ID NO: 2308269 - protein, 20 aa, Cryptosporidium parvum
FRDVILMSFECPHCGFKNNE

SEQ ID NO: 2308270 - protein, 19 aa, Cryptosporidium parvum
FRFKVRVGNTYAWMDPLND

SEQ ID NO: 2308271 - protein, 18 aa, Cryptosporidium parvum
FRIPFLVNYGTRCQPNKF

SEQ ID NO: 2308272 - protein, 17 aa, Cryptosporidium parvum
FRISQILKLKGFDLTET

SEQ ID NO: 2308273 - protein, 18 aa, Cryptosporidium parvum
FRKRDWYSLIAVFLTGAE

SEQ ID NO: 2308274 - protein, 17 aa, Cryptosporidium parvum
FRLECFETLTGLRFFLI

SEQ ID NO: 2308275 - protein, 21 aa, Cryptosporidium parvum
FRNIYRLILFISEIKLSKNYN

SEQ ID NO: 2308276 - protein, 23 aa, Cryptosporidium parvum
FRNKEVIDLWGPHEVILFECGVC

SEQ ID NO: 2308277 - protein, 19 aa, Cryptosporidium parvum
FRPASKWRRPMNAIGDGIY

SEQ ID NO: 2308278 - protein, 18 aa, Cryptosporidium parvum
FRPVPLLQTFIGIKAKKG

SEQ ID NO: 2308279 - protein, 18 aa, Cryptosporidium parvum
FRRSRYQNRMVILNLIKK

SEQ ID NO: 2308280 - protein, 20 aa, Cryptosporidium parvum
FRSLYKFAFGDIAYAKKIGE

SEQ ID NO: 2308281 - protein, 18 aa, Cryptosporidium parvum
FSCSYCFEGYGMTELLAA

SEQ ID NO: 2308282 - protein, 17 aa, Cryptosporidium parvum
FSELIVLKELPKLETLS

SEQ ID NO: 2308283 - protein, 24 aa, Cryptosporidium parvum
FSENLICFICEPILKVLNILNNYN

SEQ ID NO: 2308284 - protein, 17 aa, Cryptosporidium parvum
FSEVFKLGSCISQSLKV

SEQ ID NO: 2308285 - protein, 17 aa, Cryptosporidium parvum
FSIESGYRWDGVIRGNG

SEQ ID NO: 2308286 - protein, 19 aa, Cryptosporidium parvum
FSINFGINVFNLFENNLFG

SEQ ID NO: 2308287 - protein, 18 aa, Cryptosporidium parvum
FSKIFSIKKLHLGHVASS

SEQ ID NO: 2308288 - protein, 17 aa, Cryptosporidium parvum
FSKYGLKYSQLRNATIH

SEQ ID NO: 2308289 - protein, 19 aa, Cryptosporidium parvum
FSPKSQWKFICRFRSCFNK

SEQ ID NO: 2308290 - protein, 29 aa, Cryptosporidium parvum
FSSCVACGRFFCHLCILYIRSSNPCSPIA

SEQ ID NO: 2308291 - protein, 22 aa, Cryptosporidium parvum
FSSKELKRVFSIEFGVLSPELI

SEQ ID NO: 2308292 - protein, 18 aa, Cryptosporidium parvum
FSVYLIGINCKLEVKPIK

SEQ ID NO: 2308293 - protein, 24 aa, Cryptosporidium parvum
FTDHGWRMAVEFILFGSIPNMPYY

SEQ ID NO: 2308294 - protein, 17 aa, Cryptosporidium parvum
FTFPLLEEFSMIQDQIQ

SEQ ID NO: 2308295 - protein, 21 aa, Cryptosporidium parvum
FTFPPVCLARRYFPRSISCPG

SEQ ID NO: 2308296 - protein, 18 aa, Cryptosporidium parvum
FTLCKSCCRNTNHEHPLE

SEQ ID NO: 2308297 - protein, 24 aa, Cryptosporidium parvum
FTSHLKLWIKLLFGYSIDKKDIIY

SEQ ID NO: 2308298 - protein, 22 aa, Cryptosporidium parvum
FTSKLAIVPLIFGIQGSNKSSV

SEQ ID NO: 2308299 - protein, 18 aa, Cryptosporidium parvum
FVCRGCRIGKVLLNNSSE

SEQ ID NO: 2308300 - protein, 25 aa, Cryptosporidium parvum
FVHLLIWNYIKCCISFYQLDDQEQK

SEQ ID NO: 2308301 - protein, 25 aa, Cryptosporidium parvum
FVIPSKRIIIEWPLHLLKNLKALDF

SEQ ID NO: 2308302 - protein, 17 aa, Cryptosporidium parvum
FVKHWSKARGIYSNVLG

SEQ ID NO: 2308303 - protein, 17 aa, Cryptosporidium parvum
FVMDLLFAMVDISSSNG

SEQ ID NO: 2308304 - protein, 18 aa, Cryptosporidium parvum
FVNFCLRYIADLDIPIKR

SEQ ID NO: 2308305 - protein, 24 aa, Cryptosporidium parvum
FVNYRAAAALGVWDLCRGMGKGLK

SEQ ID NO: 2308306 - protein, 18 aa, Cryptosporidium parvum
FVQPRFADYASYYFPDGT

SEQ ID NO: 2308307 - protein, 18 aa, Cryptosporidium parvum
FWHFLSLGAIFLKYSKKN

SEQ ID NO: 2308308 - protein, 18 aa, Cryptosporidium parvum
FWRCRAEASSKEQGKVLI

SEQ ID NO: 2308309 - protein, 17 aa, Cryptosporidium parvum
FWRFCYNACNSLFTKLQ

SEQ ID NO: 2308310 - protein, 21 aa, Cryptosporidium parvum
FYELRLQLLINRMEEKGDSED

SEQ ID NO: 2308311 - protein, 19 aa, Cryptosporidium parvum
FYFHWKRIIGACNFKDLHA

SEQ ID NO: 2308312 - protein, 18 aa, Cryptosporidium parvum
FYKDLKFVGVSSFLGTGM

SEQ ID NO: 2308313 - protein, 25 aa, Cryptosporidium parvum
FYLHSRCLITIPFLQWELINDQVYT

SEQ ID NO: 2308314 - protein, 19 aa, Cryptosporidium parvum
FYLRGSCRFGDNCRDYHPN

SEQ ID NO: 2308315 - protein, 19 aa, Cryptosporidium parvum
GAGAFEFRAYNALKEARKS

SEQ ID NO: 2308316 - protein, 21 aa, Cryptosporidium parvum
GALRSPLPWDLGRHSKSTIQV

SEQ ID NO: 2308317 - protein, 21 aa, Cryptosporidium parvum
GASFYRFIFNSVFFSKSNLNE

SEQ ID NO: 2308318 - protein, 19 aa, Cryptosporidium parvum
GAYHKWKFNAFLEIQKKLD

SEQ ID NO: 2308319 - protein, 22 aa, Cryptosporidium parvum
GCFGIGFKSVFLITNTPFIFSN

SEQ ID NO: 2308320 - protein, 18 aa, Cryptosporidium parvum
GDCLLSAAFICFAGGLDQ

SEQ ID NO: 2308321 - protein, 22 aa, Cryptosporidium parvum
GDDFRMISAYDFFHAENPPLLL

SEQ ID NO: 2308322 - protein, 17 aa, Cryptosporidium parvum
GDLIPWTLCNHLARDDF

SEQ ID NO: 2308323 - protein, 21 aa, Cryptosporidium parvum
GDLRPSWSLYYLLKKIICKEM

SEQ ID NO: 2308324 - protein, 21 aa, Cryptosporidium parvum
GDNATHSWTCFLRSPDNEDIS

SEQ ID NO: 2308325 - protein, 18 aa, Cryptosporidium parvum
GDRLGCFNLSLKGHGHAV

SEQ ID NO: 2308326 - protein, 21 aa, Cryptosporidium parvum
GEEFWAWIMIWMRFNSLGVLD

SEQ ID NO: 2308327 - protein, 19 aa, Cryptosporidium parvum
GEHPVQCMIFSGPFTTDKE

SEQ ID NO: 2308328 - protein, 21 aa, Cryptosporidium parvum
GEIYYYPGYFFQRIICSLSQF

SEQ ID NO: 2308329 - protein, 18 aa, Cryptosporidium parvum
GELWPCVFHVTARAIATS

SEQ ID NO: 2308330 - protein, 22 aa, Cryptosporidium parvum
GELYALKCVRVFTKNHDHSNAH

SEQ ID NO: 2308331 - protein, 17 aa, Cryptosporidium parvum
GEMMVPMTPWYKSFKGK

SEQ ID NO: 2308332 - protein, 18 aa, Cryptosporidium parvum
GFCHFSLNVNLEMDAGNE

SEQ ID NO: 2308333 - protein, 26 aa, Cryptosporidium parvum
GFELLKKCSRSGCLLRKDTDIENKSL

SEQ ID NO: 2308334 - protein, 18 aa, Cryptosporidium parvum
GFGGIWKKSLTELSGGQR

SEQ ID NO: 2308335 - protein, 18 aa, Cryptosporidium parvum
GFHLKPLLFRISKLLNSS

SEQ ID NO: 2308336 - protein, 22 aa, Cryptosporidium parvum
GFKLWTRREFNLLLRCLETNGV

SEQ ID NO: 2308337 - protein, 18 aa, Cryptosporidium parvum
GFLKGIVIDSSFCSLRQL

SEQ ID NO: 2308338 - protein, 18 aa, Cryptosporidium parvum
GFLPEIYDSINITLYRMR

SEQ ID NO: 2308339 - protein, 18 aa, Cryptosporidium parvum
GFMFSMVVSYTWNNVYLL

SEQ ID NO: 2308340 - protein, 17 aa, Cryptosporidium parvum
GFMLYKNKMELFWNSDK

SEQ ID NO: 2308341 - protein, 17 aa, Cryptosporidium parvum
GFRGEALSSISFVSQLS

SEQ ID NO: 2308342 - protein, 19 aa, Cryptosporidium parvum
GFSSLHWASLKGHSQVVEE

SEQ ID NO: 2308343 - protein, 20 aa, Cryptosporidium parvum
GGAIALRLAEYIGQICQEDN

SEQ ID NO: 2308344 - protein, 17 aa, Cryptosporidium parvum
GGHPFGGSMAYRGGELG

SEQ ID NO: 2308345 - protein, 25 aa, Cryptosporidium parvum
GGISYKSGIPGVYWKTRDQEWVAEW

SEQ ID NO: 2308346 - protein, 17 aa, Cryptosporidium parvum
GGLCSIDGAFYAASADQ

SEQ ID NO: 2308347 - protein, 17 aa, Cryptosporidium parvum
GGMGMMDKCYFTGKSDL

SEQ ID NO: 2308348 - protein, 17 aa, Cryptosporidium parvum
GGMGRGGFRGGYSRGGM

SEQ ID NO: 2308349 - protein, 19 aa, Cryptosporidium parvum
GGSVPLMLQRIVLATQLQS

SEQ ID NO: 2308350 - protein, 17 aa, Cryptosporidium parvum
GHFRPILTHSFQMEYCL

SEQ ID NO: 2308351 - protein, 18 aa, Cryptosporidium parvum
GHHFCLNCAGNLVQRKQK

SEQ ID NO: 2308352 - protein, 21 aa, Cryptosporidium parvum
GHLLFDFLELFGIVFNYSSTG

SEQ ID NO: 2308353 - protein, 23 aa, Cryptosporidium parvum
GHPFVKCRLCFLVKKDHCICMDL

SEQ ID NO: 2308354 - protein, 18 aa, Cryptosporidium parvum
GHTLRLLSFPSLLEKGLS

SEQ ID NO: 2308355 - protein, 24 aa, Cryptosporidium parvum
GIDISRLKAIEWRVKLINEKKLRD

SEQ ID NO: 2308356 - protein, 24 aa, Cryptosporidium parvum
GIDPRLSEYYLIYADVLFEKEENS

SEQ ID NO: 2308357 - protein, 21 aa, Cryptosporidium parvum
GIEHLLRLLIILPKLIGDHIS

SEQ ID NO: 2308358 - protein, 23 aa, Cryptosporidium parvum
GIFKASKELFGWKNRRTNATYHY

SEQ ID NO: 2308359 - protein, 18 aa, Cryptosporidium parvum
GIGVWSAEMAMIFCMNRK

SEQ ID NO: 2308360 - protein, 18 aa, Cryptosporidium parvum
GIIGRFFIFSSFNHRGNE

SEQ ID NO: 2308361 - protein, 19 aa, Cryptosporidium parvum
GIINLCIYFSFASFLDILG

SEQ ID NO: 2308362 - protein, 18 aa, Cryptosporidium parvum
GILCLKDAITLVARRAEI

SEQ ID NO: 2308363 - protein, 18 aa, Cryptosporidium parvum
GIMTPEFPGSHDSNFSFS

SEQ ID NO: 2308364 - protein, 23 aa, Cryptosporidium parvum
GINKVRYWAMCFIGSERSTEPEF

SEQ ID NO: 2308365 - protein, 25 aa, Cryptosporidium parvum
GIPLLCLRGSMPIWYYRKKKNMSLY

SEQ ID NO: 2308366 - protein, 21 aa, Cryptosporidium parvum
GIPVDHVFGFWDWVGGRFSVC

SEQ ID NO: 2308367 - protein, 19 aa, Cryptosporidium parvum
GIRTGFFWNDLNLISKYIK

SEQ ID NO: 2308368 - protein, 24 aa, Cryptosporidium parvum
GISGICWFCQIMVLKVLDSKIRGF

SEQ ID NO: 2308369 - protein, 18 aa, Cryptosporidium parvum
GIVFFNTNMGIKWFNAKN

SEQ ID NO: 2308370 - protein, 22 aa, Cryptosporidium parvum
GIWRKNILKDWFGLEGENKSSY

SEQ ID NO: 2308371 - protein, 18 aa, Cryptosporidium parvum
GKCGVKYETTQSGKTQIK

SEQ ID NO: 2308372 - protein, 21 aa, Cryptosporidium parvum
GKEIKFILSMMLFHQSFLNFI

SEQ ID NO: 2308373 - protein, 18 aa, Cryptosporidium parvum
GKFSPRWFIFKGTNLAVF

SEQ ID NO: 2308374 - protein, 18 aa, Cryptosporidium parvum
GKICLPKEFYNMMIDKDN

SEQ ID NO: 2308375 - protein, 20 aa, Cryptosporidium parvum
GKICPKCFSVYLIGINCKLE

SEQ ID NO: 2308376 - protein, 20 aa, Cryptosporidium parvum
GKIPQGAHLLGFFKRLCKLL

SEQ ID NO: 2308377 - protein, 25 aa, Cryptosporidium parvum
GKLHYKYFGPRSWTVMGLKEALRKA

SEQ ID NO: 2308378 - protein, 20 aa, Cryptosporidium parvum
GKLKPWKGILLYGPPGTGKT

SEQ ID NO: 2308379 - protein, 17 aa, Cryptosporidium parvum
GKRQGCWRRRKDGKRKH

SEQ ID NO: 2308380 - protein, 19 aa, Cryptosporidium parvum
GKSIKFQCCLFRITQNSLG

SEQ ID NO: 2308381 - protein, 22 aa, Cryptosporidium parvum
GKWRECRDYVFSLSIWDYNQED

SEQ ID NO: 2308382 - protein, 20 aa, Cryptosporidium parvum
GKYTIPGWRTMQMAYESFDF

SEQ ID NO: 2308383 - protein, 17 aa, Cryptosporidium parvum
GLCKPCVFVNKTNKKCR

SEQ ID NO: 2308384 - protein, 20 aa, Cryptosporidium parvum
GLEFKVGFGGIWKKSLTELS

SEQ ID NO: 2308385 - protein, 23 aa, Cryptosporidium parvum
GLEWKVVFIPKFVDKVFPLYRES

SEQ ID NO: 2308386 - protein, 22 aa, Cryptosporidium parvum
GLFRPEMLRPLGFPSDIVVIAW

SEQ ID NO: 2308387 - protein, 19 aa, Cryptosporidium parvum
GLMRPEGFPVYTTQWPSAF

SEQ ID NO: 2308388 - protein, 24 aa, Cryptosporidium parvum
GLNALLRWLFRYVPDLSLSIRNLY

SEQ ID NO: 2308389 - protein, 24 aa, Cryptosporidium parvum
GLSRKSVNVLLHFLTLYSQVIKLV

SEQ ID NO: 2308390 - protein, 23 aa, Cryptosporidium parvum
GMGADILHALGFNKTSNSDNSDT

SEQ ID NO: 2308391 - protein, 19 aa, Cryptosporidium parvum
GMSCLRSVLSMNDLVNNVS

SEQ ID NO: 2308392 - protein, 17 aa, Cryptosporidium parvum
GNCGIKFKSRRDSIENM

SEQ ID NO: 2308393 - protein, 19 aa, Cryptosporidium parvum
GNFIKLRFSQSLKVEISVK

SEQ ID NO: 2308394 - protein, 20 aa, Cryptosporidium parvum
GNFWPIEKFVSVFEPIERAK

SEQ ID NO: 2308395 - protein, 21 aa, Cryptosporidium parvum
GNLKRIIKIVLFTLKSSNYEW

SEQ ID NO: 2308396 - protein, 23 aa, Cryptosporidium parvum
GNLRFLRYCKILWVMIGIDDFSM

SEQ ID NO: 2308397 - protein, 17 aa, Cryptosporidium parvum
GPITRGALKFIFKAPSP

SEQ ID NO: 2308398 - protein, 19 aa, Cryptosporidium parvum
GPKDIKSILPFWGNNKKDT

SEQ ID NO: 2308399 - protein, 21 aa, Cryptosporidium parvum
GPVNLRYGSLMLMTDQDHDGS

SEQ ID NO: 2308400 - protein, 18 aa, Cryptosporidium parvum
GPWRACLCRLGYDPRKDP

SEQ ID NO: 2308401 - protein, 17 aa, Cryptosporidium parvum
GQCKRYLTYISNILPQR

SEQ ID NO: 2308402 - protein, 18 aa, Cryptosporidium parvum
GQDLVKFVFEFENMDLHI

SEQ ID NO: 2308403 - protein, 19 aa, Cryptosporidium parvum
GQLEFKAILFIPRRAPFDL

SEQ ID NO: 2308404 - protein, 22 aa, Cryptosporidium parvum
GRCNCGYPIFIINGEVIAGSSG

SEQ ID NO: 2308405 - protein, 19 aa, Cryptosporidium parvum
GRFTFLLLRALERYSPVWE

SEQ ID NO: 2308406 - protein, 17 aa, Cryptosporidium parvum
GRLRVGAAIGVNEIERA

SEQ ID NO: 2308407 - protein, 23 aa, Cryptosporidium parvum
GRNRLDILLSQWVSYFSGRQSID

SEQ ID NO: 2308408 - protein, 20 aa, Cryptosporidium parvum
GRNWIRRMVYQISSSFVTIP

SEQ ID NO: 2308409 - protein, 20 aa, Cryptosporidium parvum
GRRFSVKVVDYIVERFGTER

SEQ ID NO: 2308410 - protein, 19 aa, Cryptosporidium parvum
GRSICNPCLQFSRVHDVSL

SEQ ID NO: 2308411 - protein, 18 aa, Cryptosporidium parvum
GSAYPFWDLKIINVISSS

SEQ ID NO: 2308412 - protein, 18 aa, Cryptosporidium parvum
GSCNFQWILSNVYDAYTG

SEQ ID NO: 2308413 - protein, 18 aa, Cryptosporidium parvum
GSFGVVFKGRIRSGIWSN

SEQ ID NO: 2308414 - protein, 17 aa, Cryptosporidium parvum
GSIGARGADIWMGGGGS

SEQ ID NO: 2308415 - protein, 17 aa, Cryptosporidium parvum
GSINLKIVENVFADGPL

SEQ ID NO: 2308416 - protein, 18 aa, Cryptosporidium parvum
GSIRIVILGVLYRISNIL

SEQ ID NO: 2308417 - protein, 19 aa, Cryptosporidium parvum
GSKLKVVIMSATFQSSSFE

SEQ ID NO: 2308418 - protein, 18 aa, Cryptosporidium parvum
GSLNFALSVQKFAIVVQM

SEQ ID NO: 2308419 - protein, 22 aa, Cryptosporidium parvum
GSRMKYWWSKYIRRQKKKKEDS

SEQ ID NO: 2308420 - protein, 19 aa, Cryptosporidium parvum
GSTWLEWLGDVNVTSKNHG

SEQ ID NO: 2308421 - protein, 23 aa, Cryptosporidium parvum
GTDRRLDCWLTWESLRVIPNEYL

SEQ ID NO: 2308422 - protein, 23 aa, Cryptosporidium parvum
GTFGLKMMFDWNFEFNWYEDFTD

SEQ ID NO: 2308423 - protein, 20 aa, Cryptosporidium parvum
GTGRLRYYVFNWKIPQISPS

SEQ ID NO: 2308424 - protein, 21 aa, Cryptosporidium parvum
GTHYEFKFLDGLFVFDPSIKG

SEQ ID NO: 2308425 - protein, 24 aa, Cryptosporidium parvum
GTIDFPEFLSLMARKMKDTDTEDE

SEQ ID NO: 2308426 - protein, 18 aa, Cryptosporidium parvum
GTLKFTTNNYLKWDPSHL

SEQ ID NO: 2308427 - protein, 23 aa, Cryptosporidium parvum
GTNLLTFKFDYIFSSVSTQHEVF

SEQ ID NO: 2308428 - protein, 21 aa, Cryptosporidium parvum
GTPSWFPPLYVEALKHLKDLI

SEQ ID NO: 2308429 - protein, 19 aa, Cryptosporidium parvum
GTVSRIGSPMIIKGNEMNY

SEQ ID NO: 2308430 - protein, 22 aa, Cryptosporidium parvum
GVCWCPWDFGLQFACAISDGSV

SEQ ID NO: 2308431 - protein, 18 aa, Cryptosporidium parvum
GVFAEEVCRLFGINRNKI

SEQ ID NO: 2308432 - protein, 17 aa, Cryptosporidium parvum
GWDSYKWWQTETQKNEK

SEQ ID NO: 2308433 - protein, 18 aa, Cryptosporidium parvum
GYCFIEFLGKLEAISALE

SEQ ID NO: 2308434 - protein, 19 aa, Cryptosporidium parvum
GYDYCLLYFELLRDGLINA

SEQ ID NO: 2308435 - protein, 23 aa, Cryptosporidium parvum
GYFFQRIICSLSQFFTSSFYVSI

SEQ ID NO: 2308436 - protein, 22 aa, Cryptosporidium parvum
GYLYCWPWPGTISGRSEIKINP

SEQ ID NO: 2308437 - protein, 17 aa, Cryptosporidium parvum
GYQYDFIFDWSFLQPEK

SEQ ID NO: 2308438 - protein, 24 aa, Cryptosporidium parvum
GYYFPGVLCGRTLCYYRDVVRLLR

SEQ ID NO: 2308439 - protein, 18 aa, Cryptosporidium parvum
GYYKLRPGVINMLRTLSK

SEQ ID NO: 2308440 - protein, 22 aa, Cryptosporidium parvum
HAHGRIAYKHGYPPSLGSGPGS

SEQ ID NO: 2308441 - protein, 17 aa, Cryptosporidium parvum
HAILRIKIESHINSNDV

SEQ ID NO: 2308442 - protein, 25 aa, Cryptosporidium parvum
HCSECPTTFCIDCFPPEYARHQVLD

SEQ ID NO: 2308443 - protein, 17 aa, Cryptosporidium parvum
HCSLCKPTFDYKNSILM

SEQ ID NO: 2308444 - protein, 18 aa, Cryptosporidium parvum
HCSLPNPIIYKWPSNSVC

SEQ ID NO: 2308445 - protein, 17 aa, Cryptosporidium parvum
HDFFLKRLKGIGRHQVK

SEQ ID NO: 2308446 - protein, 17 aa, Cryptosporidium parvum
HDFRFKVYHKFLDLLPE

SEQ ID NO: 2308447 - protein, 22 aa, Cryptosporidium parvum
HEFERLVKLIFSNCMIFNPNSG

SEQ ID NO: 2308448 - protein, 17 aa, Cryptosporidium parvum
HGGSVISEWVSRHIESI

SEQ ID NO: 2308449 - protein, 17 aa, Cryptosporidium parvum
HGIGMGMGNRIIPGISP

SEQ ID NO: 2308450 - protein, 19 aa, Cryptosporidium parvum
HGILFKRLGIIIVDELHLL

SEQ ID NO: 2308451 - protein, 20 aa, Cryptosporidium parvum
HGLPVHYIWLLSPRTILKTS

SEQ ID NO: 2308452 - protein, 17 aa, Cryptosporidium parvum
HGLRMGAVIKRFYIDSI

SEQ ID NO: 2308453 - protein, 23 aa, Cryptosporidium parvum
HGSNCNCTGCLKQGGRMGITTSM

SEQ ID NO: 2308454 - protein, 22 aa, Cryptosporidium parvum
HHKMCIKVIRFLHTSNLLVEGL

SEQ ID NO: 2308455 - protein, 25 aa, Cryptosporidium parvum
HIACYDCVRLALMIQQRYNVKAHCP

SEQ ID NO: 2308456 - protein, 18 aa, Cryptosporidium parvum
HKEMIKFSGISLQGRESL

SEQ ID NO: 2308457 - protein, 17 aa, Cryptosporidium parvum
HKPRLLVKLLLEQGEGL

SEQ ID NO: 2308458 - protein, 24 aa, Cryptosporidium parvum
HLCREVLRLTKLVVDCHVQYRLGN

SEQ ID NO: 2308459 - protein, 23 aa, Cryptosporidium parvum
HLERELFRIIAWRANSATVNELL

SEQ ID NO: 2308460 - protein, 21 aa, Cryptosporidium parvum
HLISMFKWRVSTYPLSDMESN

SEQ ID NO: 2308461 - protein, 19 aa, Cryptosporidium parvum
HLKWQIPSFIIGGNPRLQG

SEQ ID NO: 2308462 - protein, 18 aa, Cryptosporidium parvum
HLLALLWRCYKICEERGY

SEQ ID NO: 2308463 - protein, 18 aa, Cryptosporidium parvum
HMRGFPYCRIDGNTSGDD

SEQ ID NO: 2308464 - protein, 17 aa, Cryptosporidium parvum
HMRVIRELLGFDIEELN

SEQ ID NO: 2308465 - protein, 26 aa, Cryptosporidium parvum
HMVKARLAVCMTFRLAIETFNQYYSY

SEQ ID NO: 2308466 - protein, 17 aa, Cryptosporidium parvum
HNFGIPIPFCLDNKATT

SEQ ID NO: 2308467 - protein, 24 aa, Cryptosporidium parvum
HNIYWPRRCPFYLSNQSTIRYIPV

SEQ ID NO: 2308468 - protein, 17 aa, Cryptosporidium parvum
HNLEFKTSFPYVSNGGV

SEQ ID NO: 2308469 - protein, 17 aa, Cryptosporidium parvum
HPGCTRTAHPLCLKLYG

SEQ ID NO: 2308470 - protein, 17 aa, Cryptosporidium parvum
HPIASLLSVLSMNKGIQ

SEQ ID NO: 2308471 - protein, 18 aa, Cryptosporidium parvum
HPLPSVCCYIPNTNNSCI

SEQ ID NO: 2308472 - protein, 21 aa, Cryptosporidium parvum
HPLQCILLIIGILRRSLENPN

SEQ ID NO: 2308473 - protein, 21 aa, Cryptosporidium parvum
HPNTCPFVFCRWECMVKYSRR

SEQ ID NO: 2308474 - protein, 21 aa, Cryptosporidium parvum
HQKFKLSFLLFSYNKNIEKNK

SEQ ID NO: 2308475 - protein, 19 aa, Cryptosporidium parvum
HQYCHLCFSRFMSLRPFLL

SEQ ID NO: 2308476 - protein, 18 aa, Cryptosporidium parvum
HRIPMGLLLGGRDALENE

SEQ ID NO: 2308477 - protein, 18 aa, Cryptosporidium parvum
HRRIEWFLHWYIESASSI

SEQ ID NO: 2308478 - protein, 19 aa, Cryptosporidium parvum
HVKRFSIIYNQGIGITGTQ

SEQ ID NO: 2308479 - protein, 26 aa, Cryptosporidium parvum
HVSCYHCLRKALHVEYWAAKNDIWDK

SEQ ID NO: 2308480 - protein, 22 aa, Cryptosporidium parvum
HWSRLQLWLFLKGCGMKLEEQL

SEQ ID NO: 2308481 - protein, 18 aa, Cryptosporidium parvum
HYERCGLSFYAIKSRGEA

SEQ ID NO: 2308482 - protein, 22 aa, Cryptosporidium parvum
HYFEFPDLITIIYRFPFYINPM

SEQ ID NO: 2308483 - protein, 19 aa, Cryptosporidium parvum
HYKLILKRRIFLFWRELLR

SEQ ID NO: 2308484 - protein, 24 aa, Cryptosporidium parvum
HYYWPSLIHFRGFLKQFVTPIVKA

SEQ ID NO: 2308485 - protein, 22 aa, Cryptosporidium parvum
IADRMTLSWSWKEMIDEDFSPI

SEQ ID NO: 2308486 - protein, 21 aa, Cryptosporidium parvum
IAHSKIHICVVWKHERRILHQ

SEQ ID NO: 2308487 - protein, 17 aa, Cryptosporidium parvum
IALLCGWSGRKAGKDAN

SEQ ID NO: 2308488 - protein, 24 aa, Cryptosporidium parvum
IAMIKRLWIKLCEILIKYGVNLTI

SEQ ID NO: 2308489 - protein, 23 aa, Cryptosporidium parvum
IAMKRVLLALQWLHANNVVHRDL

SEQ ID NO: 2308490 - protein, 20 aa, Cryptosporidium parvum
IARRFGVEMVFFHGRGGSIG

SEQ ID NO: 2308491 - protein, 24 aa, Cryptosporidium parvum
IASEWRPSCDYPHLLDESVQIFHS

SEQ ID NO: 2308492 - protein, 18 aa, Cryptosporidium parvum
IASIAIKFCARIPDKDEL

SEQ ID NO: 2308493 - protein, 20 aa, Cryptosporidium parvum
IASVNRRLRENTNSSQKASK

SEQ ID NO: 2308494 - protein, 24 aa, Cryptosporidium parvum
IAVCRVCKSPCRIITLPYIFRYLS

SEQ ID NO: 2308495 - protein, 17 aa, Cryptosporidium parvum
IAYEIAEVCYIRRKALL

SEQ ID NO: 2308496 - protein, 17 aa, Cryptosporidium parvum
IAYNVIRRLGSMLRILY

SEQ ID NO: 2308497 - protein, 18 aa, Cryptosporidium parvum
ICAFSIVFHSDIDEEECH

SEQ ID NO: 2308498 - protein, 18 aa, Cryptosporidium parvum
ICEKLKLHGLVVIGGDDS

SEQ ID NO: 2308499 - protein, 20 aa, Cryptosporidium parvum
ICFNCLSLTLPSIIETTMGI

SEQ ID NO: 2308500 - protein, 20 aa, Cryptosporidium parvum
ICGFLDRTIRVWFRTDQQLF

SEQ ID NO: 2308501 - protein, 25 aa, Cryptosporidium parvum
ICHRGKILVCNACYLRVSKENKIRQ

SEQ ID NO: 2308502 - protein, 20 aa, Cryptosporidium parvum
ICINFRLPVILTNFMAPTKK

SEQ ID NO: 2308503 - protein, 17 aa, Cryptosporidium parvum
ICLNEPLSFIQRLSEDL

SEQ ID NO: 2308504 - protein, 19 aa, Cryptosporidium parvum
ICLPYACKLLLQELMAMSI

SEQ ID NO: 2308505 - protein, 20 aa, Cryptosporidium parvum
ICNRPCTMFRWKLHNSKKYN

SEQ ID NO: 2308506 - protein, 25 aa, Cryptosporidium parvum
ICSIPVFEIRLVWKDKILSNNALLS

SEQ ID NO: 2308507 - protein, 18 aa, Cryptosporidium parvum
ICVLDCSVFGRFNAIIPE

SEQ ID NO: 2308508 - protein, 19 aa, Cryptosporidium parvum
ICYIYKYRRESILKENLFK

SEQ ID NO: 2308509 - protein, 21 aa, Cryptosporidium parvum
IDANGILFVWGMNLTGQIGIK

SEQ ID NO: 2308510 - protein, 22 aa, Cryptosporidium parvum
IDHSYCYKIAWSYEKGKDDCKV

SEQ ID NO: 2308511 - protein, 20 aa, Cryptosporidium parvum
IDIQFVWNIVLCRKYKYLSE

SEQ ID NO: 2308512 - protein, 17 aa, Cryptosporidium parvum
IDLFPCLVHKPKNSKVA

SEQ ID NO: 2308513 - protein, 18 aa, Cryptosporidium parvum
IDNIRFGLDYNNIGSISS

SEQ ID NO: 2308514 - protein, 24 aa, Cryptosporidium parvum
IDNPLCKICDPFFIGYSDLLNLQV

SEQ ID NO: 2308515 - protein, 18 aa, Cryptosporidium parvum
IDPRCHRAHWGIGYVWFK

SEQ ID NO: 2308516 - protein, 17 aa, Cryptosporidium parvum
IDRFEPFNSLIKQLATQ

SEQ ID NO: 2308517 - protein, 17 aa, Cryptosporidium parvum
IDRLPPYLHVCLQRYCY

SEQ ID NO: 2308518 - protein, 17 aa, Cryptosporidium parvum
IDVSKEWGIRMEIDHSS

SEQ ID NO: 2308519 - protein, 23 aa, Cryptosporidium parvum
IDYKSHGIGVFLPEGRTIDPNAN

SEQ ID NO: 2308520 - protein, 26 aa, Cryptosporidium parvum
IEAKLELLLLYRGCSSKRPHTKRGRS

SEQ ID NO: 2308521 - protein, 17 aa, Cryptosporidium parvum
IEAYIFVGPIYYQKLKH

SEQ ID NO: 2308522 - protein, 18 aa, Cryptosporidium parvum
IECLIEINKTYPLIFCPL

SEQ ID NO: 2308523 - protein, 20 aa, Cryptosporidium parvum
IEFLIRFLLNMKRELESGKQ

SEQ ID NO: 2308524 - protein, 18 aa, Cryptosporidium parvum
IEGDIPYRVFIKGKMYPG

SEQ ID NO: 2308525 - protein, 19 aa, Cryptosporidium parvum
IEIINRWAKFLILPNLFNS

SEQ ID NO: 2308526 - protein, 18 aa, Cryptosporidium parvum
IEKKEEWGLYDDLIYKFL

SEQ ID NO: 2308527 - protein, 17 aa, Cryptosporidium parvum
IELLRAFLRLSKEDIIL

SEQ ID NO: 2308528 - protein, 22 aa, Cryptosporidium parvum
IENDCSLCLRQIGISNNIPGVV

SEQ ID NO: 2308529 - protein, 18 aa, Cryptosporidium parvum
IETPWEWERDFAIDEMDP

SEQ ID NO: 2308530 - protein, 17 aa, Cryptosporidium parvum
IEWKGPFPLHNSIIQHV

SEQ ID NO: 2308531 - protein, 17 aa, Cryptosporidium parvum
IEYCFKSSVVPAKKVIT

SEQ ID NO: 2308532 - protein, 22 aa, Cryptosporidium parvum
IEYWFNRCCLYLSNNDIDNAMT

SEQ ID NO: 2308533 - protein, 22 aa, Cryptosporidium parvum
IFDLPGSIIIKLDMKKFGGNKP

SEQ ID NO: 2308534 - protein, 20 aa, Cryptosporidium parvum
IFHANCLLPWLNQHNSCPVC

SEQ ID NO: 2308535 - protein, 21 aa, Cryptosporidium parvum
IFHYRLFRCIQILQILILNGL

SEQ ID NO: 2308536 - protein, 23 aa, Cryptosporidium parvum
IFLFWRELLRIILLKDKNFKQEN

SEQ ID NO: 2308537 - protein, 18 aa, Cryptosporidium parvum
IFLRNSILQIFRNFTDLI

SEQ ID NO: 2308538 - protein, 18 aa, Cryptosporidium parvum
IFLRQGYTHLVDWWSVGI

SEQ ID NO: 2308539 - protein, 19 aa, Cryptosporidium parvum
IFLTKNCRYTEDIDNRLSK

SEQ ID NO: 2308540 - protein, 18 aa, Cryptosporidium parvum
IFPLKIYSSNMIKSNHNI

SEQ ID NO: 2308541 - protein, 22 aa, Cryptosporidium parvum
IFRWFPNNCCDFFFEEERSIKS

SEQ ID NO: 2308542 - protein, 21 aa, Cryptosporidium parvum
IFWHPINKVWIGVWLDSITHE

SEQ ID NO: 2308543 - protein, 19 aa, Cryptosporidium parvum
IGARGADIWMGGGGSSMGI

SEQ ID NO: 2308544 - protein, 17 aa, Cryptosporidium parvum
IGDYRLVSDMIWQVQVC

SEQ ID NO: 2308545 - protein, 17 aa, Cryptosporidium parvum
IGFNMLLCFSKLPDIQS

SEQ ID NO: 2308546 - protein, 17 aa, Cryptosporidium parvum
IGITIGIKIAHLINNYV

SEQ ID NO: 2308547 - protein, 20 aa, Cryptosporidium parvum
IGKVCPFEFFSDRVYKIAPY

SEQ ID NO: 2308548 - protein, 17 aa, Cryptosporidium parvum
IGLLKLVFDKATTQHHF

SEQ ID NO: 2308549 - protein, 24 aa, Cryptosporidium parvum
IGLSEWSLILSLRIINLLKKLVAE

SEQ ID NO: 2308550 - protein, 17 aa, Cryptosporidium parvum
IGQTLGIGSFGKVKLAI

SEQ ID NO: 2308551 - protein, 31 aa, Cryptosporidium parvum; identical to SEQ ID NO: 2185529

SEQ ID NO: 2308552 - protein, 17 aa, Cryptosporidium parvum
IGTCCPIVFHISPSEEK

SEQ ID NO: 2308553 - protein, 24 aa, Cryptosporidium parvum
IGYNSKIPLSFDERTVFESKPVAN

SEQ ID NO: 2308554 - protein, 17 aa, Cryptosporidium parvum
IHFILKFVVDIDRQIQD

SEQ ID NO: 2308555 - protein, 22 aa, Cryptosporidium parvum
IHPFFERFSSINLFEFFLIGAK

SEQ ID NO: 2308556 - protein, 23 aa, Cryptosporidium parvum
IHTRNKFLWCIEILHQFYYLNLD

SEQ ID NO: 2308557 - protein, 19 aa, Cryptosporidium parvum
IIDNWKKSVGFIFNDSYKN

SEQ ID NO: 2308558 - protein, 20 aa, Cryptosporidium parvum
IIHGVFTWSFCKAISDIATG

SEQ ID NO: 2308559 - protein, 19 aa, Cryptosporidium parvum
IIIPPRLAIEANILIHQKK

SEQ ID NO: 2308560 - protein, 21 aa, Cryptosporidium parvum
IIKQKCSFIKFIVNSIQSNIV

SEQ ID NO: 2308561 - protein, 17 aa, Cryptosporidium parvum
IIKRLGILNSSNNFEVN

SEQ ID NO: 2308562 - protein, 21 aa, Cryptosporidium parvum
IIPKYKFCCCYSKNCLCDISV

SEQ ID NO: 2308563 - protein, 17 aa, Cryptosporidium parvum
IIPVGGDILCFLPGQQE

SEQ ID NO: 2308564 - protein, 25 aa, Cryptosporidium parvum
IIRIPIYPNRCVFLSSIGGGLSSSS

SEQ ID NO: 2308565 - protein, 25 aa, Cryptosporidium parvum
IISPVEWKPDVSFLRYGFISPISSN

SEQ ID NO: 2308566 - protein, 21 aa, Cryptosporidium parvum
IKCIIFFLTCRSVEFYFKYLS

SEQ ID NO: 2308567 - protein, 19 aa, Cryptosporidium parvum
IKCPICLDSDLLVPKISNC

SEQ ID NO: 2308568 - protein, 25 aa, Cryptosporidium parvum
IKDSFPLPGIYYFRFKVRVGNTYAW

SEQ ID NO: 2308569 - protein, 19 aa, Cryptosporidium parvum
IKFCVKRLGFSITYNKRRA

SEQ ID NO: 2308570 - protein, 21 aa, Cryptosporidium parvum
IKFKIPWKYPKIIHEHVIQQL

SEQ ID NO: 2308571 - protein, 19 aa, Cryptosporidium parvum
IKFKIVFIAPMKSLVSEIT

SEQ ID NO: 2308572 - protein, 19 aa, Cryptosporidium parvum
IKFKTCRQLFNKAGEILTG

SEQ ID NO: 2308573 - protein, 17 aa, Cryptosporidium parvum
IKFVGFLIRQFKGETEL

SEQ ID NO: 2308574 - protein, 18 aa, Cryptosporidium parvum
IKGIREFAGKVMKTEDVR

SEQ ID NO: 2308575 - protein, 20 aa, Cryptosporidium parvum
IKISIPFGYPLEASSFCISS

SEQ ID NO: 2308576 - protein, 22 aa, Cryptosporidium parvum
IKKAYHKLAIKWHPDKNMGNDR

SEQ ID NO: 2308577 - protein, 20 aa, Cryptosporidium parvum
IKKILPWEIELEVVPWSLLF

SEQ ID NO: 2308578 - protein, 18 aa, Cryptosporidium parvum
IKKIRCVSFWVKEWGILF

SEQ ID NO: 2308579 - protein, 23 aa, Cryptosporidium parvum
IKLFTSIGMWKSLFLTLNYSTYI

SEQ ID NO: 2308580 - protein, 20 aa, Cryptosporidium parvum
IKLIDWGSCLSIYQASNTRN

SEQ ID NO: 2308581 - protein, 17 aa, Cryptosporidium parvum
IKLILVGGIVFERQLSE

SEQ ID NO: 2308582 - protein, 17 aa, Cryptosporidium parvum
IKLLTNFVNLVFGITLF

SEQ ID NO: 2308583 - protein, 25 aa, Cryptosporidium parvum
IKLPEFIKPLILRVLMFNKRRHPNT

SEQ ID NO: 2308584 - protein, 19 aa, Cryptosporidium parvum
IKLRCMSRVFSISVMNCEK

SEQ ID NO: 2308585 - protein, 19 aa, Cryptosporidium parvum
IKLSLGIHCSFRFVNIVRY

SEQ ID NO: 2308586 - protein, 17 aa, Cryptosporidium parvum
IKMGINFGTIRGSSKPS

SEQ ID NO: 2308587 - protein, 23 aa, Cryptosporidium parvum
IKMRCLFSGRVLLTPVPGSEPDI

SEQ ID NO: 2308588 - protein, 22 aa, Cryptosporidium parvum
IKNEIIWGFPIVPNITFIKGES

SEQ ID NO: 2308589 - protein, 23 aa, Cryptosporidium parvum
IKNRPFKNCPICHTKWSRNPESL

SEQ ID NO: 2308590 - protein, 17 aa, Cryptosporidium parvum
IKREIKILYNLHGGPNI

SEQ ID NO: 2308591 - protein, 17 aa, Cryptosporidium parvum
IKRRNRYGITRGRKHLA

SEQ ID NO: 2308592 - protein, 17 aa, Cryptosporidium parvum
IKSECGIVARSSTNSNI

SEQ ID NO: 2308593 - protein, 18 aa, Cryptosporidium parvum
IKSLEEWSVLPNSKHYLL

SEQ ID NO: 2308594 - protein, 18 aa, Cryptosporidium parvum
IKSLRIGIDYPVYDDDEE

SEQ ID NO: 2308595 - protein, 25 aa, Cryptosporidium parvum
IKSWESRLAKQVKLFNKASSDVLEV

SEQ ID NO: 2308596 - protein, 19 aa, Cryptosporidium parvum
IKTCKEWYRRIQSHFLNGL

SEQ ID NO: 2308597 - protein, 19 aa, Cryptosporidium parvum
IKVLKDWNEHLSLNGLILQ

SEQ ID NO: 2308598 - protein, 19 aa, Cryptosporidium parvum
IKYLACLSPGFVGSEIRNL

SEQ ID NO: 2308599 - protein, 18 aa, Cryptosporidium parvum
IKYSRLWSLYKKYEVSFW

SEQ ID NO: 2308600 - protein, 26 aa, Cryptosporidium parvum
ILCEICRVCGFVIVFAVESEYNEDVI

SEQ ID NO: 2308601 - protein, 19 aa, Cryptosporidium parvum
ILEEKLCLIHENIARDIIF

SEQ ID NO: 2308602 - protein, 19 aa, Cryptosporidium parvum
ILEWFKFRVLCENVAEFTA

SEQ ID NO: 2308603 - protein, 23 aa, Cryptosporidium parvum
ILFERCFQEYLLLCCDPTESAAN

SEQ ID NO: 2308604 - protein, 23 aa, Cryptosporidium parvum
ILFYEFRLPIIYHIIYLLEILRI

SEQ ID NO: 2308605 - protein, 24 aa, Cryptosporidium parvum
ILFYPRMFCLSSWNLQQQETDQSL

SEQ ID NO: 2308606 - protein, 17 aa, Cryptosporidium parvum
ILIDRAVPVPMELQIIQ

SEQ ID NO: 2308607 - protein, 23 aa, Cryptosporidium parvum
ILKKDEWVCVLPLSVKSQEWVDS

SEQ ID NO: 2308608 - protein, 19 aa, Cryptosporidium parvum
ILMKLRINYLINNNQVTEY

SEQ ID NO: 2308609 - protein, 19 aa, Cryptosporidium parvum
ILNGFKLQWLSDDSFNIYT

SEQ ID NO: 2308610 - protein, 18 aa, Cryptosporidium parvum
ILNILLGRCHKAIEMYCC

SEQ ID NO: 2308611 - protein, 19 aa, Cryptosporidium parvum
ILNLQCMWRHYNLKIQLKA

SEQ ID NO: 2308612 - protein, 18 aa, Cryptosporidium parvum
ILPFDWFPNLCRIPYRIY

SEQ ID NO: 2308613 - protein, 20 aa, Cryptosporidium parvum
ILPKVEWILCFPVNQCSTNT

SEQ ID NO: 2308614 - protein, 20 aa, Cryptosporidium parvum
ILRKEMKNLLLLTKKEAYQF

SEQ ID NO: 2308615 - protein, 22 aa, Cryptosporidium parvum
ILSMLRFKPAPVYILDEIDSAL

SEQ ID NO: 2308616 - protein, 17 aa, Cryptosporidium parvum
ILSPSFKMIFHDDGVTT

SEQ ID NO: 2308617 - protein, 20 aa, Cryptosporidium parvum
ILSRFDLIFLLKDEKNVERD

SEQ ID NO: 2308618 - protein, 17 aa, Cryptosporidium parvum
ILSSICGGEGLKMVAKE

SEQ ID NO: 2308619 - protein, 17 aa, Cryptosporidium parvum
ILSVFGFEELYRMNILE

SEQ ID NO: 2308620 - protein, 18 aa, Cryptosporidium parvum
ILYNLGIWVIGEYGSCVE

SEQ ID NO: 2308621 - protein, 17 aa, Cryptosporidium parvum
ILYSFKFSPLKNIIIEN

SEQ ID NO: 2308622 - protein, 17 aa, Cryptosporidium parvum
IMIKLLREWILNANRGE

SEQ ID NO: 2308623 - protein, 19 aa, Cryptosporidium parvum
IMVRLNGFIYFKSKMILIK

SEQ ID NO: 2308624 - protein, 19 aa, Cryptosporidium parvum
INGFRECYSWIGSNGDIKK

SEQ ID NO: 2308625 - protein, 17 aa, Cryptosporidium parvum
INGVCWCPWDFGLQFAC

SEQ ID NO: 2308626 - protein, 18 aa, Cryptosporidium parvum
INILSCLSELVILEESST

SEQ ID NO: 2308627 - protein, 18 aa, Cryptosporidium parvum
INITEGFPSVGFQFETYL

SEQ ID NO: 2308628 - protein, 24 aa, Cryptosporidium parvum
INKNNGSCPFCFFKGNNKGQKLSI

SEQ ID NO: 2308629 - protein, 19 aa, Cryptosporidium parvum
INLPICGLLIYFISSLIHR

SEQ ID NO: 2308630 - protein, 18 aa, Cryptosporidium parvum
INLSLYWDESSSYLFDNT

SEQ ID NO: 2308631 - protein, 17 aa, Cryptosporidium parvum
INLSSVIAIHIEDALNF

SEQ ID NO: 2308632 - protein, 19 aa, Cryptosporidium parvum
INNCQICIYKILKPNSEKY

SEQ ID NO: 2308633 - protein, 23 aa, Cryptosporidium parvum
INNSKLCICLNCNQTGHVNCGRQ

SEQ ID NO: 2308634 - protein, 18 aa, Cryptosporidium parvum
INNWKIKIELGIEEEKKT

SEQ ID NO: 2308635 - protein, 18 aa, Cryptosporidium parvum
INQWTSIVRWEFKHPTPF

SEQ ID NO: 2308636 - protein, 19 aa, Cryptosporidium parvum
INSPKKCKLVFKRLINKVN

SEQ ID NO: 2308637 - protein, 24 aa, Cryptosporidium parvum
INVLEKFACCLRIEIFMDNDIILE

SEQ ID NO: 2308638 - protein, 21 aa, Cryptosporidium parvum
INYIRDLLCILSRDIWSLLLS

SEQ ID NO: 2308639 - protein, 17 aa, Cryptosporidium parvum
IPCGHTFCRYCITHNRL

SEQ ID NO: 2308640 - protein, 18 aa, Cryptosporidium parvum
IPCVLDFLKQRYLVNQIY

SEQ ID NO: 2308641 - protein, 17 aa, Cryptosporidium parvum
IPDPLLFSIIESIQKIY

SEQ ID NO: 2308642 - protein, 17 aa, Cryptosporidium parvum
IPFSWSQPILKLKILEE

SEQ ID NO: 2308643 - protein, 19 aa, Cryptosporidium parvum
IPIEFCNWIIDSFLSKYQT

SEQ ID NO: 2308644 - protein, 18 aa, Cryptosporidium parvum
IPIGLKLRDMIGIAETGS

SEQ ID NO: 2308645 - protein, 17 aa, Cryptosporidium parvum
IPIPFCLDNKATTVRLA

SEQ ID NO: 2308646 - protein, 21 aa, Cryptosporidium parvum
IPKERSCIFLDSIDEQDSSVN

SEQ ID NO: 2308647 - protein, 22 aa, Cryptosporidium parvum
IPKLKYYWVYMLTLDFPNLTFI

SEQ ID NO: 2308648 - protein, 23 aa, Cryptosporidium parvum
IPLIMSYPIAGIVFFNTNMGIKW

SEQ ID NO: 2308649 - protein, 22 aa, Cryptosporidium parvum
IPLWLRNCPKFGIVHILAFGLA

SEQ ID NO: 2308650 - protein, 17 aa, Cryptosporidium parvum
IPLYRHWNLMDSVYHSE

SEQ ID NO: 2308651 - protein, 26 aa, Cryptosporidium parvum
IPNLSKRLECMILRSSFEQLYLESLK

SEQ ID NO: 2308652 - protein, 18 aa, Cryptosporidium parvum
IPNLWPFKEQMLNEMNDA

SEQ ID NO: 2308653 - protein, 17 aa, Cryptosporidium parvum
IPNYILLLFGRNIENEL

SEQ ID NO: 2308654 - protein, 17 aa, Cryptosporidium parvum
IPPEYISGISIEIPPRF

SEQ ID NO: 2308655 - protein, 17 aa, Cryptosporidium parvum
IPPFTEWGGTPGVMLRR

SEQ ID NO: 2308656 - protein, 25 aa, Cryptosporidium parvum
IPPKGELRGGAWVVVDSNINPEFIE

SEQ ID NO: 2308657 - protein, 21 aa, Cryptosporidium parvum
IPRLIKTLFLPGAISYMKKES

SEQ ID NO: 2308658 - protein, 18 aa, Cryptosporidium parvum
IPSWLVNQVFPFVTNKNK

SEQ ID NO: 2308659 - protein, 26 aa, Cryptosporidium parvum
IPTCISWSMDGTRLFIGYMNGNVIMC

SEQ ID NO: 2308660 - protein, 23 aa, Cryptosporidium parvum
IPVSCLRPGLRWIQLFDANFIDI

SEQ ID NO: 2308661 - protein, 17 aa, Cryptosporidium parvum
IQAEFDWMILVFLSEEQ

SEQ ID NO: 2308662 - protein, 18 aa, Cryptosporidium parvum
IQEKLRLKMEGWTIHGSG

SEQ ID NO: 2308663 - protein, 17 aa, Cryptosporidium parvum
IQGLIGRYNSMCMDDQI

SEQ ID NO: 2308664 - protein, 17 aa, Cryptosporidium parvum
IQIFSCLSVSTETRVRV

SEQ ID NO: 2308665 - protein, 18 aa, Cryptosporidium parvum
IQIYWSINIHEIIKKPSF

SEQ ID NO: 2308666 - protein, 17 aa, Cryptosporidium parvum
IQKGASITPRFSLEESL

SEQ ID NO: 2308667 - protein, 22 aa, Cryptosporidium parvum
IQKTRWPIICICNDRMSEKVRN

SEQ ID NO: 2308668 - protein, 18 aa, Cryptosporidium parvum
IQLPPIFYILSKRILIQE

SEQ ID NO: 2308669 - protein, 17 aa, Cryptosporidium parvum
IQLPSNIPIIFDHKEYK

SEQ ID NO: 2308670 - protein, 17 aa, Cryptosporidium parvum
IQRIPWRELKEIHHDAQ

SEQ ID NO: 2308671 - protein, 20 aa, Cryptosporidium parvum
IQSICLMDTFSLVRSISNLR

SEQ ID NO: 2308672 - protein, 18 aa, Cryptosporidium parvum
IQSIIRYHFENIINKDNN

SEQ ID NO: 2308673 - protein, 21 aa, Cryptosporidium parvum
IQYLFYRWIRSIKCHSGSIAA

SEQ ID NO: 2308674 - protein, 18 aa, Cryptosporidium parvum
IRAQCVLAMKAFEEEYQS

SEQ ID NO: 2308675 - protein, 22 aa, Cryptosporidium parvum
IRCSIKFFSLYRHIKRKNACIQ

SEQ ID NO: 2308676 - protein, 18 aa, Cryptosporidium parvum
IRDTRFNYILGIVLYSVR

SEQ ID NO: 2308677 - protein, 17 aa, Cryptosporidium parvum
IRIKLPFNKEIQNNNVK

SEQ ID NO: 2308678 - protein, 17 aa, Cryptosporidium parvum
IRKRLDSYFSIVVRNIR

SEQ ID NO: 2308679 - protein, 23 aa, Cryptosporidium parvum
IRKTEIFWKFFLENLKVDMMNKT

SEQ ID NO: 2308680 - protein, 19 aa, Cryptosporidium parvum
IRLCDSCSGGNYYLNSRLD

SEQ ID NO: 2308681 - protein, 18 aa, Cryptosporidium parvum
IRLDKIFPVDEVFINDGF

SEQ ID NO: 2308682 - protein, 19 aa, Cryptosporidium parvum
IRMKKRLVGTFGYLAPEVL

SEQ ID NO: 2308683 - protein, 25 aa, Cryptosporidium parvum
IRNEFSLNYGWRPICNVPTPIQESI

SEQ ID NO: 2308684 - protein, 19 aa, Cryptosporidium parvum
IRNLFPIYRNPLYAGFGNR

SEQ ID NO: 2308685 - protein, 18 aa, Cryptosporidium parvum
IRPVPCTVYISGFQEKNY

SEQ ID NO: 2308686 - protein, 17 aa, Cryptosporidium parvum
IRRILKVMISYKLRSCF

SEQ ID NO: 2308687 - protein, 18 aa, Cryptosporidium parvum
IRSTAWIPKGEYIPEDII

SEQ ID NO: 2308688 - protein, 18 aa, Cryptosporidium parvum
IRWPLLWNNSMRCKMNFL

SEQ ID NO: 2308689 - protein, 18 aa, Cryptosporidium parvum
IRYIPCFCFPDGNYKFAS

SEQ ID NO: 2308690 - protein, 23 aa, Cryptosporidium parvum
ISCCNARLIPQIPRCDLTRHEDE

SEQ ID NO: 2308691 - protein, 27 aa, Cryptosporidium parvum
ISELRYIVLICIRWRLQNSSELSSNVS

SEQ ID NO: 2308692 - protein, 17 aa, Cryptosporidium parvum
ISFKEAFLSEKWNLNSN

SEQ ID NO: 2308693 - protein, 19 aa, Cryptosporidium parvum
ISFPVIIRINPEYITGNKP

SEQ ID NO: 2308694 - protein, 17 aa, Cryptosporidium parvum
ISGISIEIPPRFDLTKL

SEQ ID NO: 2308695 - protein, 18 aa, Cryptosporidium parvum
ISKGFGILTYKLFKHIFE

SEQ ID NO: 2308696 - protein, 19 aa, Cryptosporidium parvum
ISKRAICMANFGNLKNKNL

SEQ ID NO: 2308697 - protein, 18 aa, Cryptosporidium parvum
ISKVPVIMFSPSIINFRR

SEQ ID NO: 2308698 - protein, 21 aa, Cryptosporidium parvum
ISLGFCILNGFKLQWLSDDSF

SEQ ID NO: 2308699 - protein, 23 aa, Cryptosporidium parvum
ISNILGWRIEIIYVEGGLTAYKL

SEQ ID NO: 2308700 - protein, 18 aa, Cryptosporidium parvum
ISPLRSGLMINEESEEKF

SEQ ID NO: 2308701 - protein, 19 aa, Cryptosporidium parvum
ISPNFISFIEFWRLYEEML

SEQ ID NO: 2308702 - protein, 17 aa, Cryptosporidium parvum
ISQKLFPGWLSSDMLNC

SEQ ID NO: 2308703 - protein, 21 aa, Cryptosporidium parvum
ISRLRFPLYMAHIEKLLGETC

SEQ ID NO: 2308704 - protein, 27 aa, Cryptosporidium parvum
ISRYFLEVMKAIILSGGYGSRLRPLTL

SEQ ID NO: 2308705 - protein, 19 aa, Cryptosporidium parvum
ISSGTLQWMSPELIQSKDY

SEQ ID NO: 2308706 - protein, 17 aa, Cryptosporidium parvum
ITCKREIKCWIYKNQIK

SEQ ID NO: 2308707 - protein, 17 aa, Cryptosporidium parvum
ITFLYKFISGICPKSYG

SEQ ID NO: 2308708 - protein, 22 aa, Cryptosporidium parvum
ITFPSTFCFPSLSDGRSFTAEI

SEQ ID NO: 2308709 - protein, 18 aa, Cryptosporidium parvum
ITRLYGLKPIRTLTLGTT

SEQ ID NO: 2308710 - protein, 18 aa, Cryptosporidium parvum
IVEGLKLDKGYISPYFIT

SEQ ID NO: 2308711 - protein, 23 aa, Cryptosporidium parvum
IVFSCKYLPFKFFKVRNLDLFLD

SEQ ID NO: 2308712 - protein, 22 aa, Cryptosporidium parvum
IVFSGLCSRCLVQVSYGIGIAR

SEQ ID NO: 2308713 - protein, 18 aa, Cryptosporidium parvum
IVICHPRKIFNLMNSSSP

SEQ ID NO: 2308714 - protein, 17 aa, Cryptosporidium parvum
IVKRSGRPGITLIDKNF

SEQ ID NO: 2308715 - protein, 17 aa, Cryptosporidium parvum
IVLCIGESLSERETGKT

SEQ ID NO: 2308716 - protein, 17 aa, Cryptosporidium parvum
IVLFGFKTAFGGGRSSG

SEQ ID NO: 2308717 - protein, 18 aa, Cryptosporidium parvum
IVNCCPKDVFALGGSTSK

SEQ ID NO: 2308718 - protein, 21 aa, Cryptosporidium parvum
IVRVCGKFVMLDSILPKLRAA

SEQ ID NO: 2308719 - protein, 17 aa, Cryptosporidium parvum
IVRWEFKHPTPFIRTRE

SEQ ID NO: 2308720 - protein, 25 aa, Cryptosporidium parvum
IVYREWFLKCCKIIDPFLKISLKSL

SEQ ID NO: 2308721 - protein, 21 aa, Cryptosporidium parvum
IWIKFLNRFGIWLRKNDESVF

SEQ ID NO: 2308722 - protein, 20 aa, Cryptosporidium parvum
IWKQEIFSFVGYKKNKRYNY

SEQ ID NO: 2308723 - protein, 17 aa, Cryptosporidium parvum
IYCVLRVKIEWINEYLK

SEQ ID NO: 2308724 - protein, 18 aa, Cryptosporidium parvum
IYFDICINGIILLDDEFN

SEQ ID NO: 2308725 - protein, 18 aa, Cryptosporidium parvum
IYGGLSLYKRNKKRITGI

SEQ ID NO: 2308726 - protein, 17 aa, Cryptosporidium parvum
IYGKCLLVPELCSKGDE

SEQ ID NO: 2308727 - protein, 32 aa, Cryptosporidium parvum
IYGKIMPRRSCIRKAMKHIFLRVIIDGEPYNG

SEQ ID NO: 2308728 - protein, 17 aa, Cryptosporidium parvum
IYKGYGIKNETDGSVTE

SEQ ID NO: 2308729 - protein, 18 aa, Cryptosporidium parvum
IYKTEIDPECTFQPNLRK

SEQ ID NO: 2308730 - protein, 18 aa, Cryptosporidium parvum
IYNFLRDRLRAVWQDLTV

SEQ ID NO: 2308731 - protein, 21 aa, Cryptosporidium parvum
IYSLIEWKNVFGLVCSFKSFI

SEQ ID NO: 2308732 - protein, 19 aa, Cryptosporidium parvum
KAAEFVIKFLDRMQSKKYA

SEQ ID NO: 2308733 - protein, 19 aa, Cryptosporidium parvum
KAGGCGINLIGANRLVMFD

SEQ ID NO: 2308734 - protein, 18 aa, Cryptosporidium parvum
KAGLLFYKKKYHEVVTPS

SEQ ID NO: 2308735 - protein, 17 aa, Cryptosporidium parvum
KAGLNLKCLSKLERCVN

SEQ ID NO: 2308736 - protein, 25 aa, Cryptosporidium parvum
KAICMKFAIKLCVACGIASKESIDH

SEQ ID NO: 2308737 - protein, 18 aa, Cryptosporidium parvum
KAIEMYCCYNLFQCAWLI

SEQ ID NO: 2308738 - protein, 19 aa, Cryptosporidium parvum
KAIIDWKEKVIFPLKNSII

SEQ ID NO: 2308739 - protein, 23 aa, Cryptosporidium parvum
KAKLTGDVKFRWYVNENCANLGL

SEQ ID NO: 2308740 - protein, 26 aa, Cryptosporidium parvum
KAKRSFKISKIYLIFYSCNKTVLNIE

SEQ ID NO: 2308741 - protein, 21 aa, Cryptosporidium parvum
KALRLPVLYLLQFKKNLTNFL

SEQ ID NO: 2308742 - protein, 20 aa, Cryptosporidium parvum
KALYRRGLARLGFGMYEESK

SEQ ID NO: 2308743 - protein, 18 aa, Cryptosporidium parvum
KAPWKSRYLFEIFRNRQL

SEQ ID NO: 2308744 - protein, 23 aa, Cryptosporidium parvum
KARSKLWWFCRMAEHCGLVGREG

SEQ ID NO: 2308745 - protein, 17 aa, Cryptosporidium parvum
KAVIIGINYVETEGISL

SEQ ID NO: 2308746 - protein, 17 aa, Cryptosporidium parvum
KCGFLLSEYYENWVTAP

SEQ ID NO: 2308747 - protein, 24 aa, Cryptosporidium parvum
KCKNVKPGECFFGLSPPYVGDDQL

SEQ ID NO: 2308748 - protein, 17 aa, Cryptosporidium parvum
KCLPIDLLCKGPLKIEV

SEQ ID NO: 2308749 - protein, 23 aa, Cryptosporidium parvum
KCRYQICLWCFYHVRDQLDNKCP

SEQ ID NO: 2308750 - protein, 22 aa, Cryptosporidium parvum
KCSNVNFPRRFRCFKCGEYRDE

SEQ ID NO: 2308751 - protein, 21 aa, Cryptosporidium parvum
KDAQMAWGFVSNVCHCPLMRA

SEQ ID NO: 2308752 - protein, 18 aa, Cryptosporidium parvum
KDFRRIASFMEYKTIKDC

SEQ ID NO: 2308753 - protein, 18 aa, Cryptosporidium parvum
KDFRYICEFDYFSRDAKL

SEQ ID NO: 2308754 - protein, 18 aa, Cryptosporidium parvum
KDHFKAGLLFYKKKYHEV

SEQ ID NO: 2308755 - protein, 17 aa, Cryptosporidium parvum
KDIFDRLNCEPLKIEAY

SEQ ID NO: 2308756 - protein, 24 aa, Cryptosporidium parvum
KDIVCSGLIPKFFSRISLLNDPKA

SEQ ID NO: 2308757 - protein, 21 aa, Cryptosporidium parvum
KDKESRVYARFTWATRKYSKS

SEQ ID NO: 2308758 - protein, 20 aa, Cryptosporidium parvum
KDKWRLLPYFLKTEGLVKHH

SEQ ID NO: 2308759 - protein, 20 aa, Cryptosporidium parvum
KDLNVYFGWETPLVIPIITE

SEQ ID NO: 2308760 - protein, 17 aa, Cryptosporidium parvum
KDNMKWFKNRIPSNNTN

SEQ ID NO: 2308761 - protein, 24 aa, Cryptosporidium parvum
KDPKFKIAWYFAMRDTLIVDDLDI

SEQ ID NO: 2308762 - protein, 19 aa, Cryptosporidium parvum
KDPTLIIALHLKDTGNCIP

SEQ ID NO: 2308763 - protein, 21 aa, Cryptosporidium parvum
KDPVQRLLILLAHVYLTKPMT

SEQ ID NO: 2308764 - protein, 19 aa, Cryptosporidium parvum
KDQSLCYVRRQLIIGNEAN

SEQ ID NO: 2308765 - protein, 17 aa, Cryptosporidium parvum
KDRCTGLIANLHRMGIN

SEQ ID NO: 2308766 - protein, 24 aa, Cryptosporidium parvum
KDSILPLRLMKHLKLFPNIIEMAR

SEQ ID NO: 2308767 - protein, 19 aa, Cryptosporidium parvum
KDYILKLIIIREINNLTML

SEQ ID NO: 2308768 - protein, 19 aa, Cryptosporidium parvum
KEALKHPFFKGMDFTKIRH

SEQ ID NO: 2308769 - protein, 22 aa, Cryptosporidium parvum
KEFKELRRQLGWEKNTEKNFKN

SEQ ID NO: 2308770 - protein, 21 aa, Cryptosporidium parvum
KEFKMNLCLISLNRMDFELNM

SEQ ID NO: 2308771 - protein, 20 aa, Cryptosporidium parvum
KEGILGRGTISWLNLKPKIP

SEQ ID NO: 2308772 - protein, 23 aa, Cryptosporidium parvum
KEIDLRVGSSFTRFLTLRYSRLF

SEQ ID NO: 2308773 - protein, 17 aa, Cryptosporidium parvum
KEIQAEFDWMILVFLSE

SEQ ID NO: 2308774 - protein, 24 aa, Cryptosporidium parvum
KELMWKCLVCNQVFESRNKLFAHV

SEQ ID NO: 2308775 - protein, 23 aa, Cryptosporidium parvum
KEMGSRLGGLVGYSIRFEDCTSE

SEQ ID NO: 2308776 - protein, 24 aa, Cryptosporidium parvum
KEMRRLCSILTFLFDSKNSGCLEF

SEQ ID NO: 2308777 - protein, 22 aa, Cryptosporidium parvum
KENEFIPCFALDFTKNSIPSSL

SEQ ID NO: 2308778 - protein, 23 aa, Cryptosporidium parvum
KERHWKLLLSKVIWHEKTSNSGL

SEQ ID NO: 2308779 - protein, 20 aa, Cryptosporidium parvum
KERNLRLVSIDDWEEAPDVD

SEQ ID NO: 2308780 - protein, 19 aa, Cryptosporidium parvum
KEVFKCFLCGELGHTLKDC

SEQ ID NO: 2308781 - protein, 19 aa, Cryptosporidium parvum
KEWRLCTGIELILTAKVPI

SEQ ID NO: 2308782 - protein, 20 aa, Cryptosporidium parvum
KEYLFKAFLIILSLEDNVDA

SEQ ID NO: 2308783 - protein, 20 aa, Cryptosporidium parvum
KEYWRFLVGYNYELLISLLH

SEQ ID NO: 2308784 - protein, 19 aa, Cryptosporidium parvum
KFDCLRRVPAYDKLITERF

SEQ ID NO: 2308785 - protein, 20 aa, Cryptosporidium parvum
KFKCCLRKFCSLECFQIHSR

SEQ ID NO: 2308786 - protein, 32 aa, Cryptosporidium parvum
KFKHLEFFNTLLIRLEKFLSWIAKNNIQDYGV

SEQ ID NO: 2308787 - protein, 19 aa, Cryptosporidium parvum
KFPHSIWIQALRFLASSRF

SEQ ID NO: 2308788 - protein, 22 aa, Cryptosporidium parvum
KFPRKSSKFVLSFKKSSDDIVK

SEQ ID NO: 2308789 - protein, 28 aa, Cryptosporidium parvum
KFRTAFECFRFGSIYPNSSWTEFYLFDG

SEQ ID NO: 2308790 - protein, 17 aa, Cryptosporidium parvum
KFVEFFFDSSIPIFFPS

SEQ ID NO: 2308791 - protein, 23 aa, Cryptosporidium parvum
KFYCNLVPYMIKNLWRRLENASY

SEQ ID NO: 2308792 - protein, 24 aa, Cryptosporidium parvum
KFYLCGLCPHELFENTKLYMGPCK

SEQ ID NO: 2308793 - protein, 22 aa, Cryptosporidium parvum
KGDLILEFDICFPKSLTPEQKK

SEQ ID NO: 2308794 - protein, 24 aa, Cryptosporidium parvum
KGHWNELIEVLKYIKIPANLQIIL

SEQ ID NO: 2308795 - protein, 25 aa, Cryptosporidium parvum
KGKCCAFWKKWCCCCLSDKGPTKSG

SEQ ID NO: 2308796 - protein, 19 aa, Cryptosporidium parvum
KGNRCLFRYCKKSENINKI

SEQ ID NO: 2308797 - protein, 20 aa, Cryptosporidium parvum
KGSFKYAWVLDKLKAERERG

SEQ ID NO: 2308798 - protein, 19 aa, Cryptosporidium parvum
KGSVIRFISTVFHHYLIPY

SEQ ID NO: 2308799 - protein, 26 aa, Cryptosporidium parvum
KHFPLERFIRLIVFCMEWGMRYLMCP

SEQ ID NO: 2308800 - protein, 24 aa, Cryptosporidium parvum
KHNLIRLSVFFKRESPITFFKLQI

SEQ ID NO: 2308801 - protein, 18 aa, Cryptosporidium parvum
KIAKMIARIAMIRRKRKV

SEQ ID NO: 2308802 - protein, 18 aa, Cryptosporidium parvum
KIDYSFILCIIWISLLKS

SEQ ID NO: 2308803 - protein, 19 aa, Cryptosporidium parvum
KIKDYRIGQTLGIGSFGKV

SEQ ID NO: 2308804 - protein, 21 aa, Cryptosporidium parvum
KILKSRCSIPFIANGGISNYE

SEQ ID NO: 2308805 - protein, 21 aa, Cryptosporidium parvum
KILLFELFIQFGLIDKITIRG

SEQ ID NO: 2308806 - protein, 18 aa, Cryptosporidium parvum
KIPMFWLQVKLIEILELF

SEQ ID NO: 2308807 - protein, 22 aa, Cryptosporidium parvum
KIQEHWLWKKNVPFIYDYLFIT

SEQ ID NO: 2308808 - protein, 21 aa, Cryptosporidium parvum
KITEISRAWVLEAEASKQILD

SEQ ID NO: 2308809 - protein, 22 aa, Cryptosporidium parvum
KKAMFKPAAWFKGILLPLAEDE

SEQ ID NO: 2308810 - protein, 20 aa, Cryptosporidium parvum
KKCRNGVHCCFCHFQHKERK

SEQ ID NO: 2308811 - protein, 21 aa, Cryptosporidium parvum
KKDLLDLILIYGFLIGNKLEN

SEQ ID NO: 2308812 - protein, 19 aa, Cryptosporidium parvum
KKEDLEFVSPFYLKAARKD

SEQ ID NO: 2308813 - protein, 18 aa, Cryptosporidium parvum
KKEFCFTISDFIKEYWKQ

SEQ ID NO: 2308814 - protein, 17 aa, Cryptosporidium parvum
KKELLAWGSSLLGEELN

SEQ ID NO: 2308815 - protein, 18 aa, Cryptosporidium parvum
KKFEELREALQHGLAPIS

SEQ ID NO: 2308816 - protein, 17 aa, Cryptosporidium parvum
KKFPFNWIECISNPEDL

SEQ ID NO: 2308817 - protein, 19 aa, Cryptosporidium parvum
KKFVPRCCFFGGKAAPGYA

SEQ ID NO: 2308818 - protein, 21 aa, Cryptosporidium parvum
KKGLICFSCGSILRSNFGSKI

SEQ ID NO: 2308819 - protein, 25 aa, Cryptosporidium parvum
KKGSSRISLQWGCLAEEYPKFDVSV

SEQ ID NO: 2308820 - protein, 25 aa, Cryptosporidium parvum
KKIKELKSSLSLFFKSGFNLTDESE

SEQ ID NO: 2308821 - protein, 25 aa, Cryptosporidium parvum
KKIRPATGIPRSFLRAINFDEEGRL

SEQ ID NO: 2308822 - protein, 21 aa, Cryptosporidium parvum
KKISRFLICLVITDRPMECFK

SEQ ID NO: 2308823 - protein, 21 aa, Cryptosporidium parvum
KKKAPILRRIFGKKGSSNTDE

SEQ ID NO: 2308824 - protein, 20 aa, Cryptosporidium parvum
KKKSKKCCIFHKKRNFGESS

SEQ ID NO: 2308825 - protein, 20 aa, Cryptosporidium parvum
KKKWKLAFCNAQECVNALDY

SEQ ID NO: 2308826 - protein, 19 aa, Cryptosporidium parvum
KKLGSFIAERTDLFKVENN

SEQ ID NO: 2308827 - protein, 24 aa, Cryptosporidium parvum
KKLLNIRMLYPFTIRCNGCEVYHY

SEQ ID NO: 2308828 - protein, 19 aa, Cryptosporidium parvum
KKLLVFLIWQIVNNPEIHY

SEQ ID NO: 2308829 - protein, 19 aa, Cryptosporidium parvum
KKLRCCTKEGLTLEETAEE

SEQ ID NO: 2308830 - protein, 20 aa, Cryptosporidium parvum
KKLRGCPHVIQLIDSEIALS

SEQ ID NO: 2308831 - protein, 23 aa, Cryptosporidium parvum
KKQYGWFWVCPEGGDNCKYRHCL

SEQ ID NO: 2308832 - protein, 18 aa, Cryptosporidium parvum
KKRFSLQFHCEVNDTPCG

SEQ ID NO: 2308833 - protein, 19 aa, Cryptosporidium parvum
KKRIEDFKNGVSIDNSGPT

SEQ ID NO: 2308834 - protein, 19 aa, Cryptosporidium parvum
KKVPVAFGLFKLQMGATII

SEQ ID NO: 2308835 - protein, 22 aa, Cryptosporidium parvum
KLARRAAGIIVRMVKQGKIAGR

SEQ ID NO: 2308836 - protein, 19 aa, Cryptosporidium parvum
KLASFYVRDILKFILNEES

SEQ ID NO: 2308837 - protein, 19 aa, Cryptosporidium parvum
KLDLIMYSAIGWARHGEIN

SEQ ID NO: 2308838 - protein, 17 aa, Cryptosporidium parvum
KLFGFKGVKVIQFLDST

SEQ ID NO: 2308839 - protein, 23 aa, Cryptosporidium parvum
KLGWFNCVENFFSVCNDEQIVED

SEQ ID NO: 2308840 - protein, 23 aa, Cryptosporidium parvum
KLINKRGRKSLSYNGSSINEQNS

SEQ ID NO: 2308841 - protein, 23 aa, Cryptosporidium parvum
KLKAEQFLVFLIKLIIKLREDED

SEQ ID NO: 2308842 - protein, 22 aa, Cryptosporidium parvum
KLKIGCKVLELYGKQSLQKRLE

SEQ ID NO: 2308843 - protein, 17 aa, Cryptosporidium parvum
KLLERWIHKLAKKCINI

SEQ ID NO: 2308844 - protein, 17 aa, Cryptosporidium parvum
KLLGSYFIKANKMPIAI

SEQ ID NO: 2308845 - protein, 25 aa, Cryptosporidium parvum
KLLLLKRRCINYFSFGEESRVGITF

SEQ ID NO: 2308846 - protein, 24 aa, Cryptosporidium parvum
KLLSECGTILRWSRQEDPTTKKLS

SEQ ID NO: 2308847 - protein, 17 aa, Cryptosporidium parvum
KLLWTHLGWCILVYPNG

SEQ ID NO: 2308848 - protein, 20 aa, Cryptosporidium parvum
KLNFCCFTGYYYCDYCYGSN

SEQ ID NO: 2308849 - protein, 22 aa, Cryptosporidium parvum
KLNNSVNCWLIFVYINELLIQI

SEQ ID NO: 2308850 - protein, 23 aa, Cryptosporidium parvum
KLREYSAIFGRSWNRIILDEAHR

SEQ ID NO: 2308851 - protein, 18 aa, Cryptosporidium parvum
KLRIKISFLGRISCELEK

SEQ ID NO: 2308852 - protein, 19 aa, Cryptosporidium parvum
KLRPLCLFVITFLTFGVIQ

SEQ ID NO: 2308853 - protein, 22 aa, Cryptosporidium parvum
KLSRPWVFCPNIKCIKRAKSSG

SEQ ID NO: 2308854 - protein, 19 aa, Cryptosporidium parvum
KLVCLKRLMGSLSDDQYLR

SEQ ID NO: 2308855 - protein, 19 aa, Cryptosporidium parvum
KLWLLCWPSPISLCSIDER

SEQ ID NO: 2308856 - protein, 21 aa, Cryptosporidium parvum
KLYPNWKWSQRWHGIREKFYL

SEQ ID NO: 2308857 - protein, 18 aa, Cryptosporidium parvum
KMYLAIKTCKEWYRRIQS

SEQ ID NO: 2308858 - protein, 21 aa, Cryptosporidium parvum
KNEIIGGLGLESSVISMNNGF

SEQ ID NO: 2308859 - protein, 19 aa, Cryptosporidium parvum
KNFRPSINTLQEWLSITWN

SEQ ID NO: 2308860 - protein, 18 aa, Cryptosporidium parvum
KNHMFGYGKFDWTDHRCY

SEQ ID NO: 2308861 - protein, 23 aa, Cryptosporidium parvum
KNILCKAFWKILRSYEISASISL

SEQ ID NO: 2308862 - protein, 17 aa, Cryptosporidium parvum
KNLRCLLLGGNKIKDFS

SEQ ID NO: 2308863 - protein, 17 aa, Cryptosporidium parvum
KNLRKETNFELANDEEK

SEQ ID NO: 2308864 - protein, 23 aa, Cryptosporidium parvum
KNNRYLLKIARFEEAFITIIPTL

SEQ ID NO: 2308865 - protein, 18 aa, Cryptosporidium parvum
KNPFRWRGMLKDLYGVSE

SEQ ID NO: 2308866 - protein, 20 aa, Cryptosporidium parvum
KNRWSIYFCTILGQAPSDSE

SEQ ID NO: 2308867 - protein, 20 aa, Cryptosporidium parvum
KPCTRFRGFVFDIVHSDIPT

SEQ ID NO: 2308868 - protein, 23 aa, Cryptosporidium parvum
KPDTSSMVKFRFETYPIKNNSIT

SEQ ID NO: 2308869 - protein, 18 aa, Cryptosporidium parvum
KPFPGLISKVSVPWKRVK

SEQ ID NO: 2308870 - protein, 18 aa, Cryptosporidium parvum
KPFVCGSVDTLERIKILQ

SEQ ID NO: 2308871 - protein, 20 aa, Cryptosporidium parvum
KPGSCGWDIFTLDFNIPERT

SEQ ID NO: 2308872 - protein, 20 aa, Cryptosporidium parvum
KPGTVIRLSWMKVIKNSTIR

SEQ ID NO: 2308873 - protein, 20 aa, Cryptosporidium parvum
KPKCSVAFCETVEFRTVYVT

SEQ ID NO: 2308874 - protein, 17 aa, Cryptosporidium parvum
KPLFPVKPLLSISSPDF

SEQ ID NO: 2308875 - protein, 20 aa, Cryptosporidium parvum
KPMICDFILFSILFDDISLI

SEQ ID NO: 2308876 - protein, 21 aa, Cryptosporidium parvum
KPQGWRVVYYTGKDREFEYFK

SEQ ID NO: 2308877 - protein, 20 aa, Cryptosporidium parvum
KPSVLWCYKKELGFSSHKKV

SEQ ID NO: 2308878 - protein, 17 aa, Cryptosporidium parvum
KPWIKKLLHKWGTGTMK

SEQ ID NO: 2308879 - protein, 20 aa, Cryptosporidium parvum
KQFFSIRLDKIFPVDEVFIN

SEQ ID NO: 2308880 - protein, 17 aa, Cryptosporidium parvum
KQIPCRFHLISVPPNSR

SEQ ID NO: 2308881 - protein, 21 aa, Cryptosporidium parvum
KQKIDVCFYIGFVPFYSKVIL

SEQ ID NO: 2308882 - protein, 21 aa, Cryptosporidium parvum
KQKIIPRIVPNIFYLSKNTSE

SEQ ID NO: 2308883 - protein, 18 aa, Cryptosporidium parvum
KQKLKFILNHAISKSTSS

SEQ ID NO: 2308884 - protein, 19 aa, Cryptosporidium parvum
KQRARLAAMVSRRRVTLQH

SEQ ID NO: 2308885 - protein, 20 aa, Cryptosporidium parvum
KQRYSVPWCYENFLQSRALK

SEQ ID NO: 2308886 - protein, 22 aa, Cryptosporidium parvum
KQTKEFNIEFGLEKNTGIKQSN

SEQ ID NO: 2308887 - protein, 21 aa, Cryptosporidium parvum
KRAKNFLSLCETIGNEKVTQS

SEQ ID NO: 2308888 - protein, 24 aa, Cryptosporidium parvum
KRDFKRILLLIGDYAIHRFQDYGL

SEQ ID NO: 2308889 - protein, 20 aa, Cryptosporidium parvum
KRDLIVWSDCVKLKYGNCES

SEQ ID NO: 2308890 - protein, 19 aa, Cryptosporidium parvum
KRFKSVPLYIEWAPVNLFV

SEQ ID NO: 2308891 - protein, 18 aa, Cryptosporidium parvum
KRFLSLLKRPSFTSIDLN

SEQ ID NO: 2308892 - protein, 21 aa, Cryptosporidium parvum
KRFLTCPDFDLQLILGELIWR

SEQ ID NO: 2308893 - protein, 20 aa, Cryptosporidium parvum
KRFTLLFHISKMYLAIKTCK

SEQ ID NO: 2308894 - protein, 18 aa, Cryptosporidium parvum
KRGIEIIEQVLLNYLPNE

SEQ ID NO: 2308895 - protein, 21 aa, Cryptosporidium parvum
KRIDKIFPIICYDTVVNDEME

SEQ ID NO: 2308896 - protein, 17 aa, Cryptosporidium parvum
KRIGFPVMIKASSGGGG

SEQ ID NO: 2308897 - protein, 21 aa, Cryptosporidium parvum
KRIQFKIQVCKIGAGKFPILN

SEQ ID NO: 2308898 - protein, 19 aa, Cryptosporidium parvum
KRISLSIGILKSLIRVISA

SEQ ID NO: 2308899 - protein, 22 aa, Cryptosporidium parvum
KRLAEEWRLRYLYSNPNGPNGQ

SEQ ID NO: 2308900 - protein, 17 aa, Cryptosporidium parvum
KRLCGVKNIPCQISIQK

SEQ ID NO: 2308901 - protein, 21 aa, Cryptosporidium parvum
KRLDSYFSIVVRNIRDSVPKI

SEQ ID NO: 2308902 - protein, 20 aa, Cryptosporidium parvum
KRLEVLESYLIEYLSTDQED

SEQ ID NO: 2308903 - protein, 19 aa, Cryptosporidium parvum
KRLFRLFLLASYLKRGDKL

SEQ ID NO: 2308904 - protein, 19 aa, Cryptosporidium parvum
KRLNYSRCPSKLKPLNLGI

SEQ ID NO: 2308905 - protein, 19 aa, Cryptosporidium parvum
KRLPDWAKRFHRILKVISQ

SEQ ID NO: 2308906 - protein, 17 aa, Cryptosporidium parvum
KRLSWQQILALGKSTEK

SEQ ID NO: 2308907 - protein, 17 aa, Cryptosporidium parvum
KRSDCFNFLVKLSETHS

SEQ ID NO: 2308908 - protein, 22 aa, Cryptosporidium parvum
KRSFPRFEFEDHFQVSLLDSQQ

SEQ ID NO: 2308909 - protein, 17 aa, Cryptosporidium parvum
KRSLDSFAFPITSEKGK

SEQ ID NO: 2308910 - protein, 17 aa, Cryptosporidium parvum
KRVRCMFMIVGDNSRYQ

SEQ ID NO: 2308911 - protein, 17 aa, Cryptosporidium parvum
KRWKISLYLSYAKWESL

SEQ ID NO: 2308912 - protein, 20 aa, Cryptosporidium parvum
KRWLPCFKVITYFGTPKERQ

SEQ ID NO: 2308913 - protein, 17 aa, Cryptosporidium parvum
KRYILFEKSNPLGLDKS

SEQ ID NO: 2308914 - protein, 19 aa, Cryptosporidium parvum
KSASVSIISPVEWKPDVSF

SEQ ID NO: 2308915 - protein, 24 aa, Cryptosporidium parvum
KSAYNGICFRSGMYIGSNSFVVVP

SEQ ID NO: 2308916 - protein, 21 aa, Cryptosporidium parvum
KSDCLKLLKLIALLQIKTTNK

SEQ ID NO: 2308917 - protein, 21 aa, Cryptosporidium parvum
KSDFCMLQFSRFISHYFEFPD

SEQ ID NO: 2308918 - protein, 20 aa, Cryptosporidium parvum
KSDQAVKCLIQDANLNMPKV

SEQ ID NO: 2308919 - protein, 24 aa, Cryptosporidium parvum
KSEYRFLQEWTKLGFSDKSTKKKL

SEQ ID NO: 2308920 - protein, 25 aa, Cryptosporidium parvum
KSFPENIHIIFDYSLPLTFSDDLIN

SEQ ID NO: 2308921 - protein, 17 aa, Cryptosporidium parvum
KSGSFFSAFSMKDQAKS

SEQ ID NO: 2308922 - protein, 18 aa, Cryptosporidium parvum
KSKMIWSEIGHIVHSNRK

SEQ ID NO: 2308923 - protein, 26 aa, Cryptosporidium parvum
KSLIRATCIIDLFGLSISQVHSSHMI

SEQ ID NO: 2308924 - protein, 19 aa, Cryptosporidium parvum
KSPAWLRFIDICLNEIFQK

SEQ ID NO: 2308925 - protein, 18 aa, Cryptosporidium parvum
KSPFFFRPYFYLEAQKAV

SEQ ID NO: 2308926 - protein, 18 aa, Cryptosporidium parvum
KSPGGIFFRLIKNQISHE

SEQ ID NO: 2308927 - protein, 19 aa, Cryptosporidium parvum
KSQCCINTPGGFECKDSKD

SEQ ID NO: 2308928 - protein, 20 aa, Cryptosporidium parvum
KSQMIVDQWFGRLRELQNTS

SEQ ID NO: 2308929 - protein, 20 aa, Cryptosporidium parvum
KSQRFLLIFIRTSLLDFKRI

SEQ ID NO: 2308930 - protein, 19 aa, Cryptosporidium parvum
KSSNWKEICHYIFTFRIYK

SEQ ID NO: 2308931 - protein, 20 aa, Cryptosporidium parvum
KSYVYFKIDFIKTIIIGYVP

SEQ ID NO: 2308932 - protein, 25 aa, Cryptosporidium parvum
KTFKEYIIRQLGIRWERIKKQNIET

SEQ ID NO: 2308933 - protein, 18 aa, Cryptosporidium parvum
KTKFSGRWGSLISSMALK

SEQ ID NO: 2308934 - protein, 25 aa, Cryptosporidium parvum
KTLKCCFEWFKTFKIMESDGVVCND

SEQ ID NO: 2308935 - protein, 22 aa, Cryptosporidium parvum
KTLPIRLSDGFLMSFISNEGHR

SEQ ID NO: 2308936 - protein, 17 aa, Cryptosporidium parvum
KTNSCKHLFSWIEYEMA

SEQ ID NO: 2308937 - protein, 25 aa, Cryptosporidium parvum
KTPPASPVEFEWLLHLVLHSALSQL

SEQ ID NO: 2308938 - protein, 23 aa, Cryptosporidium parvum
KTPPKLRIGWLLKQLGRVRLIHA

SEQ ID NO: 2308939 - protein, 17 aa, Cryptosporidium parvum
KTTTRFASGNVDGVTTR

SEQ ID NO: 2308940 - protein, 22 aa, Cryptosporidium parvum
KTVLRFPISISMYSLLLFASDS

SEQ ID NO: 2308941 - protein, 19 aa, Cryptosporidium parvum
KVFDFRPGILIKQLNLKSP

SEQ ID NO: 2308942 - protein, 19 aa, Cryptosporidium parvum
KVHHPHIVHFIASFEEEDH

SEQ ID NO: 2308943 - protein, 18 aa, Cryptosporidium parvum
KVHNCLWSYVAKCTVFQP

SEQ ID NO: 2308944 - protein, 24 aa, Cryptosporidium parvum
KVLLKRRKIVYITAGFNGCTSVKT

SEQ ID NO: 2308945 - protein, 22 aa, Cryptosporidium parvum
KVPLTFSLRGKKMFLRAKGIQR

SEQ ID NO: 2308946 - protein, 19 aa, Cryptosporidium parvum
KVVIDCFRLISPHSVIAGQ

SEQ ID NO: 2308947 - protein, 22 aa, Cryptosporidium parvum
KWNSDWIKRCMKIGNYISNKYY

SEQ ID NO: 2308948 - protein, 18 aa, Cryptosporidium parvum
KWPDLLPFLFRLISNLQN

SEQ ID NO: 2308949 - protein, 18 aa, Cryptosporidium parvum
KWRLQKISWKYCILDEAH

SEQ ID NO: 2308950 - protein, 18 aa, Cryptosporidium parvum
KYAGEVIIVRFERSQIFP

SEQ ID NO: 2308951 - protein, 21 aa, Cryptosporidium parvum
KYKDSICWATIKAVKEVYEPQ

SEQ ID NO: 2308952 - protein, 21 aa, Cryptosporidium parvum
KYKLPWKHITSLLGEESSIKS

SEQ ID NO: 2308953 - protein, 23 aa, Cryptosporidium parvum
KYPNRLEKLFGHYKVTLLEEGLP

SEQ ID NO: 2308954 - protein, 17 aa, Cryptosporidium parvum
KYRICTYVDKTLWYEYN

SEQ ID NO: 2308955 - protein, 20 aa, Cryptosporidium parvum
KYRKGACTNCGSMTHQARDC

SEQ ID NO: 2308956 - protein, 20 aa, Cryptosporidium parvum
KYSLSYNWFIYWNDNFPKST

SEQ ID NO: 2308957 - protein, 21 aa, Cryptosporidium parvum
KYWLKYSIEIIRQIRWILGNS

SEQ ID NO: 2308958 - protein, 19 aa, Cryptosporidium parvum
LAESFCVNCGILALDEPTT

SEQ ID NO: 2308959 - protein, 18 aa, Cryptosporidium parvum
LAPLLSLVLVCKDTHEKE

SEQ ID NO: 2308960 - protein, 24 aa, Cryptosporidium parvum
LARMKKLYVCLGRHSIYLLKRNLR

SEQ ID NO: 2308961 - protein, 23 aa, Cryptosporidium parvum
LAYRLCFLACHIEVVNAIASADD

SEQ ID NO: 2308962 - protein, 21 aa, Cryptosporidium parvum
LCLYHCKRLDISVHVCDNTVN

SEQ ID NO: 2308963 - protein, 18 aa, Cryptosporidium parvum
LCNLWFRSIKIIQEIQNY

SEQ ID NO: 2308964 - protein, 18 aa, Cryptosporidium parvum
LCRCAICYDPGKARFNET

SEQ ID NO: 2308965 - protein, 25 aa, Cryptosporidium parvum
LCRHWMRGYCWLEADCKFAHGEAEL

SEQ ID NO: 2308966 - protein, 20 aa, Cryptosporidium parvum
LCRRSLREGCDFGPLRCQYS

SEQ ID NO: 2308967 - protein, 18 aa, Cryptosporidium parvum
LCSCPGFISVCNNKKKIH

SEQ ID NO: 2308968 - protein, 18 aa, Cryptosporidium parvum
LCSGYDLFLSDDRIIEKM

SEQ ID NO: 2308969 - protein, 22 aa, Cryptosporidium parvum
LCSKGNIYLPAWARIYNDRTKL

SEQ ID NO: 2308970 - protein, 18 aa, Cryptosporidium parvum
LCWRCHKRDATPHMRSCE

SEQ ID NO: 2308971 - protein, 18 aa, Cryptosporidium parvum
LDALKTLPGWGARQKLER

SEQ ID NO: 2308972 - protein, 22 aa, Cryptosporidium parvum
LDDGSGLILIDWLVDNTGTKYK

SEQ ID NO: 2308973 - protein, 25 aa, Cryptosporidium parvum
LDELRWVQLHVRPEFGFILSPTAPK

SEQ ID NO: 2308974 - protein, 23 aa, Cryptosporidium parvum
LDLFAFNILEIFILTNNKAVIEN

SEQ ID NO: 2308975 - protein, 17 aa, Cryptosporidium parvum
LDLRGSVPIQIHQPPQI

SEQ ID NO: 2308976 - protein, 17 aa, Cryptosporidium parvum
LDLSCWLPQNLTAICNP

SEQ ID NO: 2308977 - protein, 20 aa, Cryptosporidium parvum
LDLWNLGCLIYWSYQVSSNL

SEQ ID NO: 2308978 - protein, 23 aa, Cryptosporidium parvum
LDPRIVMRILFNFRKLYPVSYKT

SEQ ID NO: 2308979 - protein, 19 aa, Cryptosporidium parvum
LDSCVKRFVEVDIVRLGNA

SEQ ID NO: 2308980 - protein, 22 aa, Cryptosporidium parvum
LDSIGALLFDWIRRIPKSQVLE

SEQ ID NO: 2308981 - protein, 24 aa, Cryptosporidium parvum
LDVYWKGDITFRISIFHPTELEQI

SEQ ID NO: 2308982 - protein, 17 aa, Cryptosporidium parvum
LDYAKWVIEKGADVNAK

SEQ ID NO: 2308983 - protein, 19 aa, Cryptosporidium parvum
LDYLLGWWLGAREAEFVRI

SEQ ID NO: 2308984 - protein, 18 aa, Cryptosporidium parvum
LDYSEYILSIDIFTGSLV

SEQ ID NO: 2308985 - protein, 17 aa, Cryptosporidium parvum
LEAESGTQISIRGKGTT

SEQ ID NO: 2308986 - protein, 20 aa, Cryptosporidium parvum
LEAFECTECSKFYKAINNNR

SEQ ID NO: 2308987 - protein, 17 aa, Cryptosporidium parvum
LEAVSYSIACVFYTKTC

SEQ ID NO: 2308988 - protein, 24 aa, Cryptosporidium parvum
LECTFKPEILWPIGKFINKNNKSW

SEQ ID NO: 2308989 - protein, 18 aa, Cryptosporidium parvum
LEDGDCCWIHGFVVDVEI

SEQ ID NO: 2308990 - protein, 22 aa, Cryptosporidium parvum
LEFLNELPLEFGNFMISDPNQV

SEQ ID NO: 2308991 - protein, 18 aa, Cryptosporidium parvum
LEFRCSSCEIYLRRMHGL

SEQ ID NO: 2308992 - protein, 26 aa, Cryptosporidium parvum
LEGIRCPFCIIGFLVPSPIFKKSEVV

SEQ ID NO: 2308993 - protein, 19 aa, Cryptosporidium parvum
LEHYNNFFLPYISRTGNEH

SEQ ID NO: 2308994 - protein, 20 aa, Cryptosporidium parvum
LEIFPDLPISLAVPPDLSHI

SEQ ID NO: 2308995 - protein, 18 aa, Cryptosporidium parvum
LEILGLWEWAVFIIMHTN

SEQ ID NO: 2308996 - protein, 19 aa, Cryptosporidium parvum
LEIQKPYFLLFKLPRTLSL

SEQ ID NO: 2308997 - protein, 22 aa, Cryptosporidium parvum
LEKKHRKSSCKHNHMSKHKDKY

SEQ ID NO: 2308998 - protein, 17 aa, Cryptosporidium parvum
LELKIGFTKEMLKPQIK

SEQ ID NO: 2308999 - protein, 17 aa, Cryptosporidium parvum
LELYRWVFKPLLSNRRI

SEQ ID NO: 2309000 - protein, 17 aa, Cryptosporidium parvum
LEMGCALYFIKSKQNFN

SEQ ID NO: 2309001 - protein, 24 aa, Cryptosporidium parvum
LENFLKEWDKICVIVSHSRDLLNQ

SEQ ID NO: 2309002 - protein, 18 aa, Cryptosporidium parvum
LENLKFLIFFKINNDINP

SEQ ID NO: 2309003 - protein, 20 aa, Cryptosporidium parvum
LEPAIKFCFGHTIICEDENI

SEQ ID NO: 2309004 - protein, 20 aa, Cryptosporidium parvum
LEPFLAQWLIWIDKNSSSIS

SEQ ID NO: 2309005 - protein, 19 aa, Cryptosporidium parvum
LEPVYLRRLIRLMSNKLYE

SEQ ID NO: 2309006 - protein, 17 aa, Cryptosporidium parvum
LEPYEILIIPKRDNTVT

SEQ ID NO: 2309007 - protein, 24 aa, Cryptosporidium parvum
LESSDRTQLMWAMITDYCEMIKNT

SEQ ID NO: 2309008 - protein, 18 aa, Cryptosporidium parvum
LETICLLFALKIRYPRQI

SEQ ID NO: 2309009 - protein, 21 aa, Cryptosporidium parvum
LEVIDCIYLICSMLLEVPYLA

SEQ ID NO: 2309010 - protein, 19 aa, Cryptosporidium parvum
LEVPLKFVLDVAFSDFSNY

SEQ ID NO: 2309011 - protein, 18 aa, Cryptosporidium parvum
LEYLAGSCNFQWILSNVY

SEQ ID NO: 2309012 - protein, 19 aa, Cryptosporidium parvum
LEYMRFSTLFLKKLIIGPI

SEQ ID NO: 2309013 - protein, 21 aa, Cryptosporidium parvum
LEYRFNHIIGHGISIGDNNYS

SEQ ID NO: 2309014 - protein, 18 aa, Cryptosporidium parvum
LFGFEFSDTLILFSRKKK

SEQ ID NO: 2309015 - protein, 23 aa, Cryptosporidium parvum
LFGKGIYCFNHFVIARGKMNKIT

SEQ ID NO: 2309016 - protein, 17 aa, Cryptosporidium parvum
LFHPDCIQQLLFCFHNN

SEQ ID NO: 2309017 - protein, 18 aa, Cryptosporidium parvum
LFILKIIKDFSIGNKWDG

SEQ ID NO: 2309018 - protein, 23 aa, Cryptosporidium parvum
LFKDLRIIQSYAYRVPYSVKVLA

SEQ ID NO: 2309019 - protein, 17 aa, Cryptosporidium parvum
LFLDFPIDLQKSVLKEL

SEQ ID NO: 2309020 - protein, 18 aa, Cryptosporidium parvum
LFMRCLYSSLLLLYDYSS

SEQ ID NO: 2309021 - protein, 23 aa, Cryptosporidium parvum
LFSSCIGCSIIPTKIREEKKLFI

SEQ ID NO: 2309022 - protein, 18 aa, Cryptosporidium parvum
LFVSLGLISEGVMRKYKK

SEQ ID NO: 2309023 - protein, 18 aa, Cryptosporidium parvum
LFVSLLLEYMGYKDKIDY

SEQ ID NO: 2309024 - protein, 17 aa, Cryptosporidium parvum
LFYEISKGFGILTYKLF

SEQ ID NO: 2309025 - protein, 17 aa, Cryptosporidium parvum
LGCLIYWSYQVSSNLNP

SEQ ID NO: 2309026 - protein, 20 aa, Cryptosporidium parvum
LGETCKYIFMEVIKHGRIST

SEQ ID NO: 2309027 - protein, 23 aa, Cryptosporidium parvum
LGFKLFVDKCCDYYRYIRRKSWL

SEQ ID NO: 2309028 - protein, 17 aa, Cryptosporidium parvum
LGFNDSHSWIRHLNSQS

SEQ ID NO: 2309029 - protein, 25 aa, Cryptosporidium parvum
LGFPEYWKRITVMRCMAPVISLSWS

SEQ ID NO: 2309030 - protein, 17 aa, Cryptosporidium parvum
LGHLSCRVCGVEYTSRI

SEQ ID NO: 2309031 - protein, 17 aa, Cryptosporidium parvum
LGICINPPLALENPLSQ

SEQ ID NO: 2309032 - protein, 22 aa, Cryptosporidium parvum
LGIHCSFRFVNIVRYFRYFRKC

SEQ ID NO: 2309033 - protein, 17 aa, Cryptosporidium parvum
LGIKCFITISGSGLKFI

SEQ ID NO: 2309034 - protein, 22 aa, Cryptosporidium parvum
LGIPLNWLLEAIIYKLESSGNI

SEQ ID NO: 2309035 - protein, 17 aa, Cryptosporidium parvum
LGISKRAICMANFGNLK

SEQ ID NO: 2309036 - protein, 24 aa, Cryptosporidium parvum
LGKGWKIFLSRSVDLGRWTIIQKL

SEQ ID NO: 2309037 - protein, 24 aa, Cryptosporidium parvum
LGLMLKGPLFMRSCKDTINERSQG

SEQ ID NO: 2309038 - protein, 17 aa, Cryptosporidium parvum
LGMKLTLSGNVSSVKPI

SEQ ID NO: 2309039 - protein, 26 aa, Cryptosporidium parvum
LGNLRPSSMPIFILRPIIKQLDEYRK

SEQ ID NO: 2309040 - protein, 19 aa, Cryptosporidium parvum
LGSFSSILGYIPYNILLAS

SEQ ID NO: 2309041 - protein, 18 aa, Cryptosporidium parvum
LHFAYRWALVDLFDTSEL

SEQ ID NO: 2309042 - protein, 24 aa, Cryptosporidium parvum
LHFFELRLARYLSYCVDGGLLGAK

SEQ ID NO: 2309043 - protein, 18 aa, Cryptosporidium parvum
LHKECVLWSLPFVLEPIL

SEQ ID NO: 2309044 - protein, 17 aa, Cryptosporidium parvum
LHLRSTFYNNIKDLSTL

SEQ ID NO: 2309045 - protein, 18 aa, Cryptosporidium parvum
LHYHFPLDIGIISPILLN

SEQ ID NO: 2309046 - protein, 18 aa, Cryptosporidium parvum
LIAIPLYASMSFDEQKKA

SEQ ID NO: 2309047 - protein, 19 aa, Cryptosporidium parvum
LICIDFFLRYISNLYPLWG

SEQ ID NO: 2309048 - protein, 17 aa, Cryptosporidium parvum
LICNFGYRPNCITWNEV

SEQ ID NO: 2309049 - protein, 17 aa, Cryptosporidium parvum
LICSLVCEPSQRIKSAK

SEQ ID NO: 2309050 - protein, 21 aa, Cryptosporidium parvum
LIDILRFVMDLLFAMVDISSS

SEQ ID NO: 2309051 - protein, 17 aa, Cryptosporidium parvum
LIEEYYIRMIILYRKRI

SEQ ID NO: 2309052 - protein, 17 aa, Cryptosporidium parvum
LIEFCPINRELLCETKT

SEQ ID NO: 2309053 - protein, 17 aa, Cryptosporidium parvum
LIELCFELKHSLATKYI

SEQ ID NO: 2309054 - protein, 24 aa, Cryptosporidium parvum
LIGDELRAVLGLSASAIRGVKVSK

SEQ ID NO: 2309055 - protein, 23 aa, Cryptosporidium parvum
LIGEVIIEIMLYFGKYYQNDEEI

SEQ ID NO: 2309056 - protein, 18 aa, Cryptosporidium parvum
LIGFCFLFLEYSFYNSEM

SEQ ID NO: 2309057 - protein, 24 aa, Cryptosporidium parvum
LIGFFCTPLFFGCNIFQMSPIDFI

SEQ ID NO: 2309058 - protein, 18 aa, Cryptosporidium parvum
LIGLDYLHRICGVIHTDI

SEQ ID NO: 2309059 - protein, 22 aa, Cryptosporidium parvum
LIKSASFQTHFGLKLIAEENDT

SEQ ID NO: 2309060 - protein, 17 aa, Cryptosporidium parvum
LILPWLDYLDDVPIVRM

SEQ ID NO: 2309061 - protein, 19 aa, Cryptosporidium parvum
LIMRVECYFGSIANGIVSN

SEQ ID NO: 2309062 - protein, 24 aa, Cryptosporidium parvum
LINFICPFCRFFVIDPYNKIIKPL

SEQ ID NO: 2309063 - protein, 17 aa, Cryptosporidium parvum
LIQLRYIGIENFDFSFR

SEQ ID NO: 2309064 - protein, 17 aa, Cryptosporidium parvum
LIRQLFKDFVRIITQGR

SEQ ID NO: 2309065 - protein, 17 aa, Cryptosporidium parvum
LISMMGVRNEGSIRNNL

SEQ ID NO: 2309066 - protein, 20 aa, Cryptosporidium parvum
LITMCLRPNPDLRASSKEVF

SEQ ID NO: 2309067 - protein, 19 aa, Cryptosporidium parvum
LKALVLRYAKENGKDTFNE

SEQ ID NO: 2309068 - protein, 17 aa, Cryptosporidium parvum
LKARCSILAAANPTFGS

SEQ ID NO: 2309069 - protein, 18 aa, Cryptosporidium parvum
LKAVIPLFGLLDLAFEIR

SEQ ID NO: 2309070 - protein, 17 aa, Cryptosporidium parvum
LKCIGLCESEIFEILRI

SEQ ID NO: 2309071 - protein, 19 aa, Cryptosporidium parvum
LKCIKRKSLQYLFMKSKQK

SEQ ID NO: 2309072 - protein, 19 aa, Cryptosporidium parvum
LKCLICFNTGILKRVLIPQ

SEQ ID NO: 2309073 - protein, 17 aa, Cryptosporidium parvum
LKEERWFVCESGLDYIT

SEQ ID NO: 2309074 - protein, 19 aa, Cryptosporidium parvum
LKEIEGFTGFFPIQQKVIP

SEQ ID NO: 2309075 - protein, 23 aa, Cryptosporidium parvum
LKEKSCLFLANYVLMVFQRNSSN

SEQ ID NO: 2309076 - protein, 25 aa, Cryptosporidium parvum
LKELCGLLLSSFCGILDDFGLETQA

SEQ ID NO: 2309077 - protein, 18 aa, Cryptosporidium parvum
LKFISVFFKPSWRESNFQ

SEQ ID NO: 2309078 - protein, 17 aa, Cryptosporidium parvum
LKFPRIIHTKIFPNFLS

SEQ ID NO: 2309079 - protein, 17 aa, Cryptosporidium parvum
LKGAVPLRGEIQNFNNI

SEQ ID NO: 2309080 - protein, 17 aa, Cryptosporidium parvum
LKGGMMFGTSKKDGSTL

SEQ ID NO: 2309081 - protein, 17 aa, Cryptosporidium parvum
LKIGITIGIKIAHLINN

SEQ ID NO: 2309082 - protein, 21 aa, Cryptosporidium parvum
LKIIEFLKTFILFTSDFVIDN

SEQ ID NO: 2309083 - protein, 17 aa, Cryptosporidium parvum
LKILCFKGSRYERRSLI

SEQ ID NO: 2309084 - protein, 17 aa, Cryptosporidium parvum
LKINITWPTTLKNYTMY

SEQ ID NO: 2309085 - protein, 17 aa, Cryptosporidium parvum
LKIYWKKWFEYINSIRI

SEQ ID NO: 2309086 - protein, 23 aa, Cryptosporidium parvum
LKKEWKKAFYLILGFDEEKMISY

SEQ ID NO: 2309087 - protein, 18 aa, Cryptosporidium parvum
LKKQVCKRLTISLDKSNP

SEQ ID NO: 2309088 - protein, 19 aa, Cryptosporidium parvum
LKKRFLFWIINNYENQRIP

SEQ ID NO: 2309089 - protein, 20 aa, Cryptosporidium parvum
LKKRRKKVSINRHIKNPLDA

SEQ ID NO: 2309090 - protein, 18 aa, Cryptosporidium parvum
LKLKVILIDGTWSQAKSI

SEQ ID NO: 2309091 - protein, 22 aa, Cryptosporidium parvum
LKLPWQKVCIDIATSIVKNPHP

SEQ ID NO: 2309092 - protein, 22 aa, Cryptosporidium parvum
LKLSFGYGWNLLHIFSYLEHIE

SEQ ID NO: 2309093 - protein, 24 aa, Cryptosporidium parvum
LKMVRGRCLGFYGVKGFLQGKHIT

SEQ ID NO: 2309094 - protein, 17 aa, Cryptosporidium parvum
LKNDPEWLVLDQYREIG

SEQ ID NO: 2309095 - protein, 17 aa, Cryptosporidium parvum
LKPGVPFTDDFQLIVKN

SEQ ID NO: 2309096 - protein, 23 aa, Cryptosporidium parvum
LKQDVWFEPKFVWEVKGADLSLS

SEQ ID NO: 2309097 - protein, 20 aa, Cryptosporidium parvum
LKRLPLFLTEEGRYIEPIDT

SEQ ID NO: 2309098 - protein, 20 aa, Cryptosporidium parvum
LKRPRFATFDSFGSEYAVLM

SEQ ID NO: 2309099 - protein, 19 aa, Cryptosporidium parvum
LKRSLGLIMLRGENIVTFV

SEQ ID NO: 2309100 - protein, 25 aa, Cryptosporidium parvum
LKSCLGSVRIPHHWNSKRRYLQGKK

SEQ ID NO: 2309101 - protein, 21 aa, Cryptosporidium parvum
LKSIEKGDCSIIWIKDDGEQL

SEQ ID NO: 2309102 - protein, 17 aa, Cryptosporidium parvum
LKSSILPLVKIKEIDKE

SEQ ID NO: 2309103 - protein, 18 aa, Cryptosporidium parvum
LKTNLWLERSWIIHFSGS

SEQ ID NO: 2309104 - protein, 17 aa, Cryptosporidium parvum
LKVCGNELCEFLVNAVE

SEQ ID NO: 2309105 - protein, 17 aa, Cryptosporidium parvum
LKVLFRWFSISDQTNLA

SEQ ID NO: 2309106 - protein, 20 aa, Cryptosporidium parvum
LKYHAGIVLLELERYEEALT

SEQ ID NO: 2309107 - protein, 17 aa, Cryptosporidium parvum
LLAEVVWSLPLLYAEKL

SEQ ID NO: 2309108 - protein, 18 aa, Cryptosporidium parvum
LLAFEICQSIIPRLAYEI

SEQ ID NO: 2309109 - protein, 18 aa, Cryptosporidium parvum
LLCFCLEFFLKYLQVAGR

SEQ ID NO: 2309110 - protein, 24 aa, Cryptosporidium parvum
LLCIECKRGLFSFEGFRYQCKQVK

SEQ ID NO: 2309111 - protein, 18 aa, Cryptosporidium parvum
LLCKGVSSVSIWKDSFNI

SEQ ID NO: 2309112 - protein, 22 aa, Cryptosporidium parvum
LLDKFLRFCVKFHIEWLYKHQN

SEQ ID NO: 2309113 - protein, 17 aa, Cryptosporidium parvum
LLEPYCRLFSYSQTENF

SEQ ID NO: 2309114 - protein, 23 aa, Cryptosporidium parvum
LLERLKWKIALRIYYTLDPNDKG

SEQ ID NO: 2309115 - protein, 17 aa, Cryptosporidium parvum
LLFALKIRYPRQIHLIR

SEQ ID NO: 2309116 - protein, 17 aa, Cryptosporidium parvum
LLFCFHNNFPILWHPQV

SEQ ID NO: 2309117 - protein, 19 aa, Cryptosporidium parvum
LLGFNCTIFAYGQTGTGKT

SEQ ID NO: 2309118 - protein, 19 aa, Cryptosporidium parvum
LLHLIRWFREMKIYDLESL

SEQ ID NO: 2309119 - protein, 17 aa, Cryptosporidium parvum
LLHPERFVQLGIDPPKG

SEQ ID NO: 2309120 - protein, 20 aa, Cryptosporidium parvum
LLIKWLTYVVKFSERNGISM

SEQ ID NO: 2309121 - protein, 17 aa, Cryptosporidium parvum
LLINSPLHRRSHLKHFR

SEQ ID NO: 2309122 - protein, 17 aa, Cryptosporidium parvum
LLKFCFIVWPSLNNTKT

SEQ ID NO: 2309123 - protein, 17 aa, Cryptosporidium parvum
LLKTLSLTNFHKHPSFS

SEQ ID NO: 2309124 - protein, 19 aa, Cryptosporidium parvum
LLLCLSGDCIISFNEKITK

SEQ ID NO: 2309125 - protein, 17 aa, Cryptosporidium parvum
LLNCHVGDWQPVDSDRV

SEQ ID NO: 2309126 - protein, 18 aa, Cryptosporidium parvum
LLNFLSFVQDLFKNYCSP

SEQ ID NO: 2309127 - protein, 17 aa, Cryptosporidium parvum
LLNLRLDDLLIMLHNTG

SEQ ID NO: 2309128 - protein, 17 aa, Cryptosporidium parvum
LLQEVYHSLNFGSILLG

SEQ ID NO: 2309129 - protein, 19 aa, Cryptosporidium parvum
LLRKVCTDINLSLNYPIQS

SEQ ID NO: 2309130 - protein, 18 aa, Cryptosporidium parvum
LLSCFVLNYISDWACVDS

SEQ ID NO: 2309131 - protein, 17 aa, Cryptosporidium parvum
LLSFPSLLEKGLSKLFS

SEQ ID NO: 2309132 - protein, 17 aa, Cryptosporidium parvum
LLSPRVFIHDNIVLDKD

SEQ ID NO: 2309133 - protein, 23 aa, Cryptosporidium parvum
LLSRWPVDLSIGILFIYGLIFDC

SEQ ID NO: 2309134 - protein, 17 aa, Cryptosporidium parvum
LLTGVVKLFCHKVEYLD

SEQ ID NO: 2309135 - protein, 23 aa, Cryptosporidium parvum
LLTKWMGCPPLPFKLDDKETGNL

SEQ ID NO: 2309136 - protein, 17 aa, Cryptosporidium parvum
LLVFLKMRWLSNNVCSI

SEQ ID NO: 2309137 - protein, 17 aa, Cryptosporidium parvum
LLVIDSINFWNADLSSL

SEQ ID NO: 2309138 - protein, 18 aa, Cryptosporidium parvum
LLVKLLLEQGEGLTVVFV

SEQ ID NO: 2309139 - protein, 17 aa, Cryptosporidium parvum
LLVYRYLIENGFVHTAF

SEQ ID NO: 2309140 - protein, 19 aa, Cryptosporidium parvum
LLWENLEKLVFSYSNFVYK

SEQ ID NO: 2309141 - protein, 20 aa, Cryptosporidium parvum
LLWRCYKICEERGYYDLVSS

SEQ ID NO: 2309142 - protein, 24 aa, Cryptosporidium parvum
LMSRYRCYTEWKLLYRCNRHPNIL

SEQ ID NO: 2309143 - protein, 17 aa, Cryptosporidium parvum
LMTELGCGYECEDSQIT

SEQ ID NO: 2309144 - protein, 17 aa, Cryptosporidium parvum
LMYEWDCIKDLARIERN

SEQ ID NO: 2309145 - protein, 17 aa, Cryptosporidium parvum
LNFKIMVHKNIEKDSKI

SEQ ID NO: 2309146 - protein, 19 aa, Cryptosporidium parvum
LNGFIYFKSKMILIKQYLV

SEQ ID NO: 2309147 - protein, 18 aa, Cryptosporidium parvum
LNGWRFKYYKGLGTSTDL

SEQ ID NO: 2309148 - protein, 21 aa, Cryptosporidium parvum
LNICCAYSWTAELEMASKKYL

SEQ ID NO: 2309149 - protein, 20 aa, Cryptosporidium parvum
LNIISEFLVLRGFRHQRLDG

SEQ ID NO: 2309150 - protein, 20 aa, Cryptosporidium parvum
LNIKSGFPILGTQILCNNIE

SEQ ID NO: 2309151 - protein, 21 aa, Cryptosporidium parvum
LNIYISWSSYRLMESEKNNSD

SEQ ID NO: 2309152 - protein, 18 aa, Cryptosporidium parvum
LNLRLIELYLDYKKKNKM

SEQ ID NO: 2309153 - protein, 17 aa, Cryptosporidium parvum
LNNERYISSSLILTNGT

SEQ ID NO: 2309154 - protein, 18 aa, Cryptosporidium parvum
LNNLLSFKGNLLRIGKPK

SEQ ID NO: 2309155 - protein, 27 aa, Cryptosporidium parvum
LNPKEAFKRLCWKFHGQKVNKNKIEKM

SEQ ID NO: 2309156 - protein, 19 aa, Cryptosporidium parvum
LNRSFPIICLLLFERRVRS

SEQ ID NO: 2309157 - protein, 18 aa, Cryptosporidium parvum
LNSDFGDSPLCFISLIDC

SEQ ID NO: 2309158 - protein, 18 aa, Cryptosporidium parvum
LNSHEFYKSITLDYLNKN

SEQ ID NO: 2309159 - protein, 17 aa, Cryptosporidium parvum
LNVLKSVGFVIVKLKPS

SEQ ID NO: 2309160 - protein, 19 aa, Cryptosporidium parvum
LNVREIYGGLSLYKRNKKR

SEQ ID NO: 2309161 - protein, 19 aa, Cryptosporidium parvum
LNWKGRELVALSVLQAYLG

SEQ ID NO: 2309162 - protein, 18 aa, Cryptosporidium parvum
LNYESEYLFRLLWHFSHC

SEQ ID NO: 2309163 - protein, 18 aa, Cryptosporidium parvum
LNYKLLIRKIRWVSEQES

SEQ ID NO: 2309164 - protein, 18 aa, Cryptosporidium parvum
LPDGFSWFDCNLWDIESQ

SEQ ID NO: 2309165 - protein, 19 aa, Cryptosporidium parvum
LPEEVPIKWTGRLQRTAAQ

SEQ ID NO: 2309166 - protein, 18 aa, Cryptosporidium parvum
LPHGLTIVKARTIPRQTD

SEQ ID NO: 2309167 - protein, 23 aa, Cryptosporidium parvum
LPIATTCGFRLSLPRYSSIEILR

SEQ ID NO: 2309168 - protein, 17 aa, Cryptosporidium parvum
LPIIYQCYGDFYYYHYN

SEQ ID NO: 2309169 - protein, 17 aa, Cryptosporidium parvum
LPITWKQISSIFNGILK

SEQ ID NO: 2309170 - protein, 20 aa, Cryptosporidium parvum
LPIWLEQSILYCFLGGKYTI

SEQ ID NO: 2309171 - protein, 19 aa, Cryptosporidium parvum
LPKKEFFKPYYTTTTTTTT

SEQ ID NO: 2309172 - protein, 20 aa, Cryptosporidium parvum
LPLESCFGVSPLIEIFNAEV

SEQ ID NO: 2309173 - protein, 18 aa, Cryptosporidium parvum
LPLGDLGRKMLLKKLREI

SEQ ID NO: 2309174 - protein, 18 aa, Cryptosporidium parvum
LPLLCFSEVFKLGSCISQ

SEQ ID NO: 2309175 - protein, 18 aa, Cryptosporidium parvum
LPLNFCIPPLFGSCNPPF

SEQ ID NO: 2309176 - protein, 23 aa, Cryptosporidium parvum
LPNCVFPKSFYLWLLNENNNKYF

SEQ ID NO: 2309177 - protein, 21 aa, Cryptosporidium parvum
LPNIRTPVVITRCGHHFCLNC

SEQ ID NO: 2309178 - protein, 19 aa, Cryptosporidium parvum
LPNSMSFIWQNLVQQGSNP

SEQ ID NO: 2309179 - protein, 22 aa, Cryptosporidium parvum
LPPKRELYVYIGLSKLQKKIYS

SEQ ID NO: 2309180 - protein, 19 aa, Cryptosporidium parvum
LPPYLHVCLQRYCYDSISR

SEQ ID NO: 2309181 - protein, 19 aa, Cryptosporidium parvum
LPSNIPIIFDHKEYKDQES

SEQ ID NO: 2309182 - protein, 17 aa, Cryptosporidium parvum
LPVNISMILKSLESSPS

SEQ ID NO: 2309183 - protein, 20 aa, Cryptosporidium parvum
LPYRQFICGLALLIHLAIPW

SEQ ID NO: 2309184 - protein, 19 aa, Cryptosporidium parvum
LPYYLFIHFSRFSKANLNL

SEQ ID NO: 2309185 - protein, 20 aa, Cryptosporidium parvum
LQCELCKSPLPSSASIKGSR

SEQ ID NO: 2309186 - protein, 18 aa, Cryptosporidium parvum
LQEFKWNHEIVYYSFQTI

SEQ ID NO: 2309187 - protein, 24 aa, Cryptosporidium parvum
LQFILRLLFRYNILSASQYMSAIP

SEQ ID NO: 2309188 - protein, 24 aa, Cryptosporidium parvum
LQLKMFCGLIIKPGQKVKLDSTQG

SEQ ID NO: 2309189 - protein, 19 aa, Cryptosporidium parvum
LQMKEWALAAAYLTQQQQQ

SEQ ID NO: 2309190 - protein, 18 aa, Cryptosporidium parvum
LQPDFGRSIFGIQYNKNN

SEQ ID NO: 2309191 - protein, 23 aa, Cryptosporidium parvum
LQPEIRSSWKLNGKKCLERDIIA

SEQ ID NO: 2309192 - protein, 17 aa, Cryptosporidium parvum
LQSLFWYVDIMKQFLSG

SEQ ID NO: 2309193 - protein, 17 aa, Cryptosporidium parvum
LQSLKCTMYLINRLQEN

SEQ ID NO: 2309194 - protein, 19 aa, Cryptosporidium parvum
LQVSLADFRRLCILKGVYP

SEQ ID NO: 2309195 - protein, 18 aa, Cryptosporidium parvum
LRACLSCRIILSDQQFYE

SEQ ID NO: 2309196 - protein, 18 aa, Cryptosporidium parvum
LRCANLFLAKNILFTRVK

SEQ ID NO: 2309197 - protein, 18 aa, Cryptosporidium parvum
LRCNICLNLQETLNLLDH

SEQ ID NO: 2309198 - protein, 19 aa, Cryptosporidium parvum
LRDEVKFWRCRAEASSKEQ

SEQ ID NO: 2309199 - protein, 19 aa, Cryptosporidium parvum
LREFKKWLPDANVVLYHGN

SEQ ID NO: 2309200 - protein, 19 aa, Cryptosporidium parvum
LRELISWWMKIVINDIPVI

SEQ ID NO: 2309201 - protein, 18 aa, Cryptosporidium parvum
LREQLFMMGFELQNQNIE

SEQ ID NO: 2309202 - protein, 18 aa, Cryptosporidium parvum
LRFFGNMVLSLWDCGGQD

SEQ ID NO: 2309203 - protein, 19 aa, Cryptosporidium parvum
LRFIFELIQLSTFGVSERA

SEQ ID NO: 2309204 - protein, 17 aa, Cryptosporidium parvum
LRFSWLAPCHLVQIECI

SEQ ID NO: 2309205 - protein, 20 aa, Cryptosporidium parvum
LRGAAKLSLWNECFTTAEEI

SEQ ID NO: 2309206 - protein, 17 aa, Cryptosporidium parvum
LRGSVPIQIHQPPQIPL

SEQ ID NO: 2309207 - protein, 25 aa, Cryptosporidium parvum
LRIKEEFAGFTWDLFTINKFQTIII

SEQ ID NO: 2309208 - protein, 23 aa, Cryptosporidium parvum
LRIMLKFRRHLICPNHIIVEEIK

SEQ ID NO: 2309209 - protein, 17 aa, Cryptosporidium parvum
LRINGIFTYVESNFSLT

SEQ ID NO: 2309210 - protein, 21 aa, Cryptosporidium parvum
LRINNCLIWFDFGIENESKFD

SEQ ID NO: 2309211 - protein, 22 aa, Cryptosporidium parvum
LRIPCGLFKTFALISSHSIFVQ

SEQ ID NO: 2309212 - protein, 19 aa, Cryptosporidium parvum
LRKCDVWNLGVLLHCLLVG

SEQ ID NO: 2309213 - protein, 26 aa, Cryptosporidium parvum
LRKRFARKCLRRCILVTDLVSWMKNR

SEQ ID NO: 2309214 - protein, 26 aa, Cryptosporidium parvum
LRKYLPKLNCLFNFALNLGRKPDLIY

SEQ ID NO: 2309215 - protein, 19 aa, Cryptosporidium parvum
LRLACIHPQLGIMGIHNKN

SEQ ID NO: 2309216 - protein, 21 aa, Cryptosporidium parvum
LRLLCNLRFIKLIQPLIESIL

SEQ ID NO: 2309217 - protein, 17 aa, Cryptosporidium parvum
LRLLYRDHVTTFVDTRI

SEQ ID NO: 2309218 - protein, 17 aa, Cryptosporidium parvum
LRLTWSFRFKDENKQVM

SEQ ID NO: 2309219 - protein, 19 aa, Cryptosporidium parvum
LRLWLGEDLEIWIFDFHRP

SEQ ID NO: 2309220 - protein, 19 aa, Cryptosporidium parvum
LRMGLKLLGKWEMSDPYTR

SEQ ID NO: 2309221 - protein, 17 aa, Cryptosporidium parvum
LRMLKCEFEVFGKVQGV

SEQ ID NO: 2309222 - protein, 17 aa, Cryptosporidium parvum
LRNLELFSNLIIYSGFY

SEQ ID NO: 2309223 - protein, 17 aa, Cryptosporidium parvum
LRNPLSFFFGHLNVTDD

SEQ ID NO: 2309224 - protein, 17 aa, Cryptosporidium parvum
LRPAEQWVYERSLYEQM

SEQ ID NO: 2309225 - protein, 18 aa, Cryptosporidium parvum
LRPLPDLRFTRLCELTKR

SEQ ID NO: 2309226 - protein, 17 aa, Cryptosporidium parvum
LRPNAKWRPGRGNSSKS

SEQ ID NO: 2309227 - protein, 18 aa, Cryptosporidium parvum
LRQSSCLIRSLIITLNTI

SEQ ID NO: 2309228 - protein, 21 aa, Cryptosporidium parvum
LRSILMADLIGFHFFPYAKQF

SEQ ID NO: 2309229 - protein, 17 aa, Cryptosporidium parvum
LRSLMLISNHIRKIKNL

SEQ ID NO: 2309230 - protein, 17 aa, Cryptosporidium parvum
LRSYEISASISLIESKT

SEQ ID NO: 2309231 - protein, 17 aa, Cryptosporidium parvum
LRVGAAIGVNEIERAKL

SEQ ID NO: 2309232 - protein, 19 aa, Cryptosporidium parvum
LRVGIKSEHPIASLLSVLS

SEQ ID NO: 2309233 - protein, 18 aa, Cryptosporidium parvum
LRVNKMCLLQLESDLLEH

SEQ ID NO: 2309234 - protein, 22 aa, Cryptosporidium parvum
LRVSFIKSICLLKMYGKKLPIY

SEQ ID NO: 2309235 - protein, 21 aa, Cryptosporidium parvum
LRYSEFLKEFILIINSFENCL

SEQ ID NO: 2309236 - protein, 17 aa, Cryptosporidium parvum
LSAIKWNFSRFLIDKNG

SEQ ID NO: 2309237 - protein, 18 aa, Cryptosporidium parvum
LSALSFLIPIDFFCQLKL

SEQ ID NO: 2309238 - protein, 17 aa, Cryptosporidium parvum
LSCFDWFECESSIVSMK

SEQ ID NO: 2309239 - protein, 20 aa, Cryptosporidium parvum
LSDRGICCIDEFDKMDDSSR

SEQ ID NO: 2309240 - protein, 19 aa, Cryptosporidium parvum
LSFKPKFMYSIPFKCNENK

SEQ ID NO: 2309241 - protein, 18 aa, Cryptosporidium parvum
LSFLSCLLLPFLIFTKSK

SEQ ID NO: 2309242 - protein, 21 aa, Cryptosporidium parvum
LSFPSKEVFTFLFGDFNTLAI

SEQ ID NO: 2309243 - protein, 18 aa, Cryptosporidium parvum
LSGDCLTCLYSVGQEEPL

SEQ ID NO: 2309244 - protein, 20 aa, Cryptosporidium parvum
LSIIYRRLFSYFIQSIIRYH

SEQ ID NO: 2309245 - protein, 23 aa, Cryptosporidium parvum
LSKYLMRCLCSFCSKTTLIKLVN

SEQ ID NO: 2309246 - protein, 20 aa, Cryptosporidium parvum
LSLYCVIYLLSMNVAMDEYG

SEQ ID NO: 2309247 - protein, 18 aa, Cryptosporidium parvum
LSNFILELCIDDILTSLD

SEQ ID NO: 2309248 - protein, 28 aa, Cryptosporidium parvum
LSPLNGTEVAPLFSKFVPNEDTSDSVKF

SEQ ID NO: 2309249 - protein, 20 aa, Cryptosporidium parvum
LSQALARLRFSNIVERADFE

SEQ ID NO: 2309250 - protein, 20 aa, Cryptosporidium parvum
LSSRAVFILVEMIGQNFQQK

SEQ ID NO: 2309251 - protein, 17 aa, Cryptosporidium parvum
LSSVIAIHIEDALNFVI

SEQ ID NO: 2309252 - protein, 18 aa, Cryptosporidium parvum
LSTRAGGIGINLATADVV

SEQ ID NO: 2309253 - protein, 24 aa, Cryptosporidium parvum
LSYHKSIEFEFDRFFFTIEHKYNT

SEQ ID NO: 2309254 - protein, 22 aa, Cryptosporidium parvum
LSYTRIRFASVQQLFKISYVCD

SEQ ID NO: 2309255 - protein, 18 aa, Cryptosporidium parvum
LTCPICARLFRYAVLTPC

SEQ ID NO: 2309256 - protein, 19 aa, Cryptosporidium parvum
LTDNALLYWREEPTFPDQQ

SEQ ID NO: 2309257 - protein, 24 aa, Cryptosporidium parvum
LTEFFSRWLIWSLIWGFSSSMNLS

SEQ ID NO: 2309258 - protein, 22 aa, Cryptosporidium parvum
LTLDLRKAYIMEHFDEFNTMKS

SEQ ID NO: 2309259 - protein, 17 aa, Cryptosporidium parvum
LTLSIDISRDFSSNEEE

SEQ ID NO: 2309260 - protein, 17 aa, Cryptosporidium parvum
LTNIAKCYSRICEITTP

SEQ ID NO: 2309261 - protein, 18 aa, Cryptosporidium parvum
LTNPELFKRVGIKTPKGV

SEQ ID NO: 2309262 - protein, 19 aa, Cryptosporidium parvum
LTNVCSICFNWETDTLKPF

SEQ ID NO: 2309263 - protein, 17 aa, Cryptosporidium parvum
LTPRFGLGKHQSRWFNC

SEQ ID NO: 2309264 - protein, 18 aa, Cryptosporidium parvum
LTQFKWINTQGMLQIIKN

SEQ ID NO: 2309265 - protein, 17 aa, Cryptosporidium parvum
LTSAISIYGHHHSNHQP

SEQ ID NO: 2309266 - protein, 17 aa, Cryptosporidium parvum
LTSQISDKEWISLCKQT

SEQ ID NO: 2309267 - protein, 25 aa, Cryptosporidium parvum
LVCFDRKGVKYGIPFLRPVDPNMDG

SEQ ID NO: 2309268 - protein, 18 aa, Cryptosporidium parvum
LVCPELYQQIGIDPPTGV

SEQ ID NO: 2309269 - protein, 23 aa, Cryptosporidium parvum
LVDCKRILREIAILSRLNHDHIV

SEQ ID NO: 2309270 - protein, 26 aa, Cryptosporidium parvum
LVLEFLGGGELFEWIAQKGAYSEDQA

SEQ ID NO: 2309271 - protein, 19 aa, Cryptosporidium parvum
LVNKFCRLFSGMPFELPPL

SEQ ID NO: 2309272 - protein, 24 aa, Cryptosporidium parvum
LVNNCLKFETRKIVVVTHSNSITQ

SEQ ID NO: 2309273 - protein, 18 aa, Cryptosporidium parvum
LVRLMKRRLIFVSISLLD

SEQ ID NO: 2309274 - protein, 18 aa, Cryptosporidium parvum
LVRPRYVPCVQIGNTQNL

SEQ ID NO: 2309275 - protein, 18 aa, Cryptosporidium parvum
LVSDMIWQVQVCKTYMGR

SEQ ID NO: 2309276 - protein, 17 aa, Cryptosporidium parvum
LVSEWTIEESIFKKQLQ

SEQ ID NO: 2309277 - protein, 23 aa, Cryptosporidium parvum
LVSNRVSYSFGFRGPSQTIDTAC

SEQ ID NO: 2309278 - protein, 18 aa, Cryptosporidium parvum
LVTEWSVEERMVFGREQK

SEQ ID NO: 2309279 - protein, 23 aa, Cryptosporidium parvum
LVYKRLYDCLGPVMFPIAPLKGI

SEQ ID NO: 2309280 - protein, 18 aa, Cryptosporidium parvum
LWIVEEILYDEEILDGSQ

SEQ ID NO: 2309281 - protein, 18 aa, Cryptosporidium parvum
LWPECLKSPFSYKFETNI

SEQ ID NO: 2309282 - protein, 18 aa, Cryptosporidium parvum
LWPLLNYIEPIKFASIEA

SEQ ID NO: 2309283 - protein, 18 aa, Cryptosporidium parvum
LWSLLNFLMPNLFSSSED

SEQ ID NO: 2309284 - protein, 17 aa, Cryptosporidium parvum
LWSYVAKCTVFQPHDIE

SEQ ID NO: 2309285 - protein, 20 aa, Cryptosporidium parvum
LWTHLGWCILVYPNGDIKAI

SEQ ID NO: 2309286 - protein, 17 aa, Cryptosporidium parvum
LWVCNPNKLRVCEFLIH

SEQ ID NO: 2309287 - protein, 18 aa, Cryptosporidium parvum
LWYYEYINLLTIRNELEI

SEQ ID NO: 2309288 - protein, 17 aa, Cryptosporidium parvum
LYFSRKELRSFLITLYS

SEQ ID NO: 2309289 - protein, 17 aa, Cryptosporidium parvum
LYHFCIENNLPPTEETF

SEQ ID NO: 2309290 - protein, 18 aa, Cryptosporidium parvum
LYLFGGFDGIQCFNDLWV

SEQ ID NO: 2309291 - protein, 18 aa, Cryptosporidium parvum
LYLKACKFVSVSQTNNKV

SEQ ID NO: 2309292 - protein, 18 aa, Cryptosporidium parvum
LYLYLCRLLSGAISLRSQ

SEQ ID NO: 2309293 - protein, 24 aa, Cryptosporidium parvum
LYSKRFFPYYSFCLLSGLDEQGKG

SEQ ID NO: 2309294 - protein, 23 aa, Cryptosporidium parvum
LYYKKEIPSIITLINSQSEYIHH

SEQ ID NO: 2309295 - protein, 18 aa, Cryptosporidium parvum
LYYWCYKNNIPVFCPGIT

SEQ ID NO: 2309296 - protein, 17 aa, Cryptosporidium parvum
MASRPVITITFNITNSL

SEQ ID NO: 2309297 - protein, 18 aa, Cryptosporidium parvum
MCPQRIALELSEDRVAAL

SEQ ID NO: 2309298 - protein, 21 aa, Cryptosporidium parvum
MEASRLKLIFAGRILNDSQTV

SEQ ID NO: 2309299 - protein, 20 aa, Cryptosporidium parvum
MEIKEAFELFDGDSIGYIDI

SEQ ID NO: 2309300 - protein, 20 aa, Cryptosporidium parvum
MGAVIKRFYIDSIYTQDNLI

SEQ ID NO: 2309301 - protein, 20 aa, Cryptosporidium parvum
MGGLIGFELLKRIKFEQLKD

SEQ ID NO: 2309302 - protein, 17 aa, Cryptosporidium parvum
MGIDIWGEFLVPDIKID

SEQ ID NO: 2309303 - protein, 17 aa, Cryptosporidium parvum
MHLTNVCSICFNWETDT

SEQ ID NO: 2309304 - protein, 18 aa, Cryptosporidium parvum
MIKDLAICELKHIVYSDA

SEQ ID NO: 2309305 - protein, 20 aa, Cryptosporidium parvum
MITSLWSCIYKSLRYNMNRY

SEQ ID NO: 2309306 - protein, 18 aa, Cryptosporidium parvum
MKDCCGLEGQLIKNGNEK

SEQ ID NO: 2309307 - protein, 19 aa, Cryptosporidium parvum
MKKVFCKSKKPIGSLKDFV

SEQ ID NO: 2309308 - protein, 19 aa, Cryptosporidium parvum
MKNQFCKLVDNFVEETSKA

SEQ ID NO: 2309309 - protein, 18 aa, Cryptosporidium parvum
MLAKKFEFEKIVTRWTSN

SEQ ID NO: 2309310 - protein, 18 aa, Cryptosporidium parvum
MLEILLSCQSEDLRPNNS

SEQ ID NO: 2309311 - protein, 17 aa, Cryptosporidium parvum
MLIAYKWSNKESLKEIM

SEQ ID NO: 2309312 - protein, 27 aa, Cryptosporidium parvum
MLNPLRLLRFLIGFNFNITNAFNSFDK

SEQ ID NO: 2309313 - protein, 18 aa, Cryptosporidium parvum
MLQRRWKVVIWDLSIENL

SEQ ID NO: 2309314 - protein, 19 aa, Cryptosporidium parvum
MLRERIIVLSTNIEDKSSP

SEQ ID NO: 2309315 - protein, 21 aa, Cryptosporidium parvum
MLSRMDLFKVWVFLGNLEMIS

SEQ ID NO: 2309316 - protein, 17 aa, Cryptosporidium parvum
MLTFYAIEICFKKIDSK

SEQ ID NO: 2309317 - protein, 17 aa, Cryptosporidium parvum
MLVSNLFGTTNLKKQML

SEQ ID NO: 2309318 - protein, 17 aa, Cryptosporidium parvum
MMDKCYFTGKSDLLNWL

SEQ ID NO: 2309319 - protein, 17 aa, Cryptosporidium parvum
MMIEIINGIQICNNNNN

SEQ ID NO: 2309320 - protein, 22 aa, Cryptosporidium parvum
MMKQRVGWMYGYYREDSTYPMG

SEQ ID NO: 2309321 - protein, 19 aa, Cryptosporidium parvum
MMYRQKLSLIISGFISKPS

SEQ ID NO: 2309322 - protein, 18 aa, Cryptosporidium parvum
MNIEMIKGYCLVDAYRHY

SEQ ID NO: 2309323 - protein, 22 aa, Cryptosporidium parvum
MNVCKSNVVLIPYYGGLTKGNY

SEQ ID NO: 2309324 - protein, 20 aa, Cryptosporidium parvum
MPIWMIKRFVDLFNASRTTY

SEQ ID NO: 2309325 - protein, 18 aa, Cryptosporidium parvum
MQLIYSLLCKSEFQSLTQ

SEQ ID NO: 2309326 - protein, 22 aa, Cryptosporidium parvum
MQMWRRRWEPCLPHILRSPLSI

SEQ ID NO: 2309327 - protein, 17 aa, Cryptosporidium parvum
MQPNWPPPWLVRMQKYG

SEQ ID NO: 2309328 - protein, 22 aa, Cryptosporidium parvum
MRNEFSYFYPLDCRVSGKDLIF

SEQ ID NO: 2309329 - protein, 20 aa, Cryptosporidium parvum
MSAEIYKEFAMLREKNFRPS

SEQ ID NO: 2309330 - protein, 21 aa, Cryptosporidium parvum
MSKFIPWKRYILFEKSNPLGL

SEQ ID NO: 2309331 - protein, 18 aa, Cryptosporidium parvum
MSKNISIHPCIKKGYEES

SEQ ID NO: 2309332 - protein, 17 aa, Cryptosporidium parvum
MSLNWSVLIIRSRNETP

SEQ ID NO: 2309333 - protein, 21 aa, Cryptosporidium parvum
MSPRTAKWVRELTPVLEPYNF

SEQ ID NO: 2309334 - protein, 21 aa, Cryptosporidium parvum
MTERFAYEVLLFWQNSAGSSD

SEQ ID NO: 2309335 - protein, 17 aa, Cryptosporidium parvum
MTSCPDLKGAVPLRGEI

SEQ ID NO: 2309336 - protein, 18 aa, Cryptosporidium parvum
MVVSYTWNNVYLLGRYIK

SEQ ID NO: 2309337 - protein, 23 aa, Cryptosporidium parvum
MVYRMGLILEETWDKSLEGSRAR

SEQ ID NO: 2309338 - protein, 24 aa, Cryptosporidium parvum
MWYIKGIVTKGIWPFLSATNKVKR

SEQ ID NO: 2309339 - protein, 17 aa, Cryptosporidium parvum
NAFPVSFPTPVNRSISN

SEQ ID NO: 2309340 - protein, 19 aa, Cryptosporidium parvum
NAIKVVLYKNGFIIDDEEF

SEQ ID NO: 2309341 - protein, 18 aa, Cryptosporidium parvum
NALELFPYRCVKINGLPE

SEQ ID NO: 2309342 - protein, 17 aa, Cryptosporidium parvum
NCAIPFFSLPRKRLNPS

SEQ ID NO: 2309343 - protein, 19 aa, Cryptosporidium parvum
NCIVRPCFKKIKGKYGSVP

SEQ ID NO: 2309344 - protein, 25 aa, Cryptosporidium parvum
NCKANRCFKCLLKGHQIKDCDTKYG

SEQ ID NO: 2309345 - protein, 25 aa, Cryptosporidium parvum
NCLILVKLQLCFSLLYFVNGNFQEC

SEQ ID NO: 2309346 - protein, 21 aa, Cryptosporidium parvum
NCNRYYCPFSHGIEQIRAPEK

SEQ ID NO: 2309347 - protein, 19 aa, Cryptosporidium parvum
NCPESLKIIDFGLAASLGS

SEQ ID NO: 2309348 - protein, 18 aa, Cryptosporidium parvum
NCPYKYKICEEAAKYVFN

SEQ ID NO: 2309349 - protein, 19 aa, Cryptosporidium parvum
NCVRIMFGISEFMKESQDA

SEQ ID NO: 2309350 - protein, 17 aa, Cryptosporidium parvum
NDFLRYFVDIFIEESVS

SEQ ID NO: 2309351 - protein, 20 aa, Cryptosporidium parvum
NDHVCCFMRYYQIIYERLKK

SEQ ID NO: 2309352 - protein, 17 aa, Cryptosporidium parvum
NDIGTCCPIVFHISPSE

SEQ ID NO: 2309353 - protein, 26 aa, Cryptosporidium parvum
NDKELFKNCILCRDYSSPICKECSKH

SEQ ID NO: 2309354 - protein, 17 aa, Cryptosporidium parvum
NDKFMLIAYKWSNKESL

SEQ ID NO: 2309355 - protein, 17 aa, Cryptosporidium parvum
NDLDWDTIIHIIDTDVI

SEQ ID NO: 2309356 - protein, 20 aa, Cryptosporidium parvum
NDLKLLIGFLIKYPLNCLRT

SEQ ID NO: 2309357 - protein, 19 aa, Cryptosporidium parvum
NDLSIPLYRHWNLMDSVYH

SEQ ID NO: 2309358 - protein, 22 aa, Cryptosporidium parvum
NEFCPKVPWLFQLMEYCNSGSL

SEQ ID NO: 2309359 - protein, 23 aa, Cryptosporidium parvum
NEFCQLFLWPLFHNVLNPEELSN

SEQ ID NO: 2309360 - protein, 17 aa, Cryptosporidium parvum
NEFKSFASSFGFISFLA

SEQ ID NO: 2309361 - protein, 17 aa, Cryptosporidium parvum
NEFWHFLSLGAIFLKYS

SEQ ID NO: 2309362 - protein, 21 aa, Cryptosporidium parvum
NEIMSRLGFYDSVKGAELAGH

SEQ ID NO: 2309363 - protein, 20 aa, Cryptosporidium parvum
NEIWRTPDLFLLSRQGTPFD

SEQ ID NO: 2309364 - protein, 17 aa, Cryptosporidium parvum
NELFKVWSPHIVSPYVL

SEQ ID NO: 2309365 - protein, 18 aa, Cryptosporidium parvum
NELLWRIDWDEVIESITN

SEQ ID NO: 2309366 - protein, 23 aa, Cryptosporidium parvum
NEMSFRLIFKWFKETFKSLKLKS

SEQ ID NO: 2309367 - protein, 24 aa, Cryptosporidium parvum
NEVFGLYCVFAFKKIENSNINLDE

SEQ ID NO: 2309368 - protein, 17 aa, Cryptosporidium parvum
NFAYRDALKYALFEFQL

SEQ ID NO: 2309369 - protein, 19 aa, Cryptosporidium parvum
NFFWRAQITYIYLEISSLK

SEQ ID NO: 2309370 - protein, 24 aa, Cryptosporidium parvum
NFHCWRHRSFVLCCLRYISVIISW

SEQ ID NO: 2309371 - protein, 22 aa, Cryptosporidium parvum
NFIAKLFIRFGMKPEQTQIHDQ

SEQ ID NO: 2309372 - protein, 19 aa, Cryptosporidium parvum
NFIKRKWFDIVFCLNSETH

SEQ ID NO: 2309373 - protein, 20 aa, Cryptosporidium parvum
NFIYHIIKLLGYGYYGTVFL

SEQ ID NO: 2309374 - protein, 24 aa, Cryptosporidium parvum
NFKNEVCSKCSKNAECYVHSIFET

SEQ ID NO: 2309375 - protein, 20 aa, Cryptosporidium parvum
NFLMDILEAFDCHTDFPPTI

SEQ ID NO: 2309376 - protein, 21 aa, Cryptosporidium parvum
NFTSCWKLPTFLFYSDKKGNL

SEQ ID NO: 2309377 - protein, 18 aa, Cryptosporidium parvum
NGACGGFVPCFPGPYLNM

SEQ ID NO: 2309378 - protein, 17 aa, Cryptosporidium parvum
NGFLSIPFLPDLTSPAR

SEQ ID NO: 2309379 - protein, 23 aa, Cryptosporidium parvum
NGIEWSGIFAINWLYNYLSNMSA

SEQ ID NO: 2309380 - protein, 17 aa, Cryptosporidium parvum
NGKEIYLYFGPQVDSKV

SEQ ID NO: 2309381 - protein, 34 aa, Cryptosporidium parvum
NGKRKFRFSSLCPKLLNCLFPWIRSEQYFEDHDQ

SEQ ID NO: 2309382 - protein, 20 aa, Cryptosporidium parvum
NGNFKYNILKGFQIYIIGYS

SEQ ID NO: 2309383 - protein, 19 aa, Cryptosporidium parvum
NGYRFNICHCHDWLAAPVL

SEQ ID NO: 2309384 - protein, 18 aa, Cryptosporidium parvum
NHEKIVRYYHAWVQESVD

SEQ ID NO: 2309385 - protein, 17 aa, Cryptosporidium parvum
NHFWNYIFYCRWVLQVT

SEQ ID NO: 2309386 - protein, 24 aa, Cryptosporidium parvum
NHIKSRFPLLHWIVQIVRGSFGDN

SEQ ID NO: 2309387 - protein, 23 aa, Cryptosporidium parvum
NHTKRLLFEFIRVVSCQIIDFDT

SEQ ID NO: 2309388 - protein, 24 aa, Cryptosporidium parvum
NIDILDLFPIFSWLENPNNFNHPM

SEQ ID NO: 2309389 - protein, 20 aa, Cryptosporidium parvum
NIIKGLKFIGSIFKMRKKNN

SEQ ID NO: 2309390 - protein, 20 aa, Cryptosporidium parvum
NIILRMDILWIGDLNGKLPE

SEQ ID NO: 2309391 - protein, 23 aa, Cryptosporidium parvum
NIIRCSFGTNKYCNSFIRNSVCN

SEQ ID NO: 2309392 - protein, 20 aa, Cryptosporidium parvum
NILPEILYNLGIWVIGEYGS

SEQ ID NO: 2309393 - protein, 22 aa, Cryptosporidium parvum
NILRRLFRVYSHIYCHHWTHVE

SEQ ID NO: 2309394 - protein, 20 aa, Cryptosporidium parvum
NILSCYKLACIVQHNHISAI

SEQ ID NO: 2309395 - protein, 19 aa, Cryptosporidium parvum
NINIPLKWPYLLNITISKD

SEQ ID NO: 2309396 - protein, 20 aa, Cryptosporidium parvum
NISKEWKLVNTISLVISNNA

SEQ ID NO: 2309397 - protein, 25 aa, Cryptosporidium parvum
NISLSRRILICLSYFIITESYREIN

SEQ ID NO: 2309398 - protein, 18 aa, Cryptosporidium parvum
NIWQSICCLINILNSSED

SEQ ID NO: 2309399 - protein, 19 aa, Cryptosporidium parvum
NKCKTRYGAILNFLIANSS

SEQ ID NO: 2309400 - protein, 20 aa, Cryptosporidium parvum
NKCPYRLFRENCTVEGNSYI

SEQ ID NO: 2309401 - protein, 17 aa, Cryptosporidium parvum
NKFTFPLLEEFSMIQDQ

SEQ ID NO: 2309402 - protein, 24 aa, Cryptosporidium parvum
NKILNWRSGVEWDLDEVLQIRTIF

SEQ ID NO: 2309403 - protein, 22 aa, Cryptosporidium parvum
NKKRITGIIKRASIEIEKPLIL

SEQ ID NO: 2309404 - protein, 23 aa, Cryptosporidium parvum
NKLKSHKIFAVFLRYLQKKGIKY

SEQ ID NO: 2309405 - protein, 17 aa, Cryptosporidium parvum
NKMDFPFDMPSNYSSKY

SEQ ID NO: 2309406 - protein, 18 aa, Cryptosporidium parvum
NKMGIYLIHFFQSLNDIS

SEQ ID NO: 2309407 - protein, 21 aa, Cryptosporidium parvum
NKQRWKWVALLPFIDQKVLLE

SEQ ID NO: 2309408 - protein, 21 aa, Cryptosporidium parvum
NKSFKLSICNANELIIECKHS

SEQ ID NO: 2309409 - protein, 20 aa, Cryptosporidium parvum
NKSNFRWVWPAHVFVTHTGT

SEQ ID NO: 2309410 - protein, 17 aa, Cryptosporidium parvum
NKWYLPNNMCLFIVGDI

SEQ ID NO: 2309411 - protein, 19 aa, Cryptosporidium parvum
NLFLKLLHRFSQFKFRSIG

SEQ ID NO: 2309412 - protein, 25 aa, Cryptosporidium parvum
NLLECCGKLAKLRSYIIWNSIAVIK

SEQ ID NO: 2309413 - protein, 19 aa, Cryptosporidium parvum
NLLQKMGWTEGKGLGKEEV

SEQ ID NO: 2309414 - protein, 21 aa, Cryptosporidium parvum
NLLRRKGCLTDKSFTKYYAER

SEQ ID NO: 2309415 - protein, 17 aa, Cryptosporidium parvum
NLLSIYCSLDIDKRFQL

SEQ ID NO: 2309416 - protein, 20 aa, Cryptosporidium parvum
NLNHLFCLANLTGVKINLRS

SEQ ID NO: 2309417 - protein, 21 aa, Cryptosporidium parvum
NLPESIWLSGFLDQVNLKDVM

SEQ ID NO: 2309418 - protein, 18 aa, Cryptosporidium parvum
NLSRYGARLILPIITEGI

SEQ ID NO: 2309419 - protein, 23 aa, Cryptosporidium parvum
NMFCSCCTCPMQQQFPSCQCGTN

SEQ ID NO: 2309420 - protein, 19 aa, Cryptosporidium parvum
NMIAAKLLEDWDVIGHFFQ

SEQ ID NO: 2309421 - protein, 23 aa, Cryptosporidium parvum
NMIFKAFKFDSSWIDTELNKVTS

SEQ ID NO: 2309422 - protein, 19 aa, Cryptosporidium parvum
NMRSKCLLIAIGQMLEDYY

SEQ ID NO: 2309423 - protein, 18 aa, Cryptosporidium parvum
NNAIKYIVCEQIKKNKLK

SEQ ID NO: 2309424 - protein, 17 aa, Cryptosporidium parvum
NNCRSLFLSHCFGQKGK

SEQ ID NO: 2309425 - protein, 17 aa, Cryptosporidium parvum
NNFCFSHSFGIAENASI

SEQ ID NO: 2309426 - protein, 20 aa, Cryptosporidium parvum
NNFELLLCHPFNLSLNKYNA

SEQ ID NO: 2309427 - protein, 20 aa, Cryptosporidium parvum
NNGNKWKGWGIKSGESTNAD

SEQ ID NO: 2309428 - protein, 17 aa, Cryptosporidium parvum
NNGPLCFTIPEFSNNPT

SEQ ID NO: 2309429 - protein, 17 aa, Cryptosporidium parvum
NNGYSWRKNKPITDNNV

SEQ ID NO: 2309430 - protein, 18 aa, Cryptosporidium parvum
NNILPCIIEYTELNKLGD

SEQ ID NO: 2309431 - protein, 25 aa, Cryptosporidium parvum
NNISFLPKKEFFKPYYTTSTTTTTT

SEQ ID NO: 2309432 - protein, 20 aa, Cryptosporidium parvum
NNKIEMLKILAANFGATQED

SEQ ID NO: 2309433 - protein, 24 aa, Cryptosporidium parvum
NNKLPFDFSDPWKMKLINKRGRKS

SEQ ID NO: 2309434 - protein, 18 aa, Cryptosporidium parvum
NNLKSKWALDKRSGNIIE

SEQ ID NO: 2309435 - protein, 22 aa, Cryptosporidium parvum
NNLVKVKVSIEWNMNDDIMDNP

SEQ ID NO: 2309436 - protein, 22 aa, Cryptosporidium parvum
NNQHCLPCGRFISPEYLVPGTP

SEQ ID NO: 2309437 - protein, 20 aa, Cryptosporidium parvum
NNSRILLCAITWMREVSSGN

SEQ ID NO: 2309438 - protein, 24 aa, Cryptosporidium parvum
NPDDGLFLCRFCNEKLKSVDSASF

SEQ ID NO: 2309439 - protein, 18 aa, Cryptosporidium parvum
NPECCGWLYVLNLKGNQY

SEQ ID NO: 2309440 - protein, 22 aa, Cryptosporidium parvum
NPELFANILIEWSKKGYKSEKD

SEQ ID NO: 2309441 - protein, 20 aa, Cryptosporidium parvum
NPHSLMPLRSCFSSRNGLWV

SEQ ID NO: 2309442 - protein, 18 aa, Cryptosporidium parvum
NPIIYKWPSNSVCIEDYK

SEQ ID NO: 2309443 - protein, 17 aa, Cryptosporidium parvum
NPINEFFILNKSFPENI

SEQ ID NO: 2309444 - protein, 25 aa, Cryptosporidium parvum
NPKVKWISFHGCYDFAYLVKILSSQ

SEQ ID NO: 2309445 - protein, 22 aa, Cryptosporidium parvum
NPNSGECKWIYDSAKQSLNKFN

SEQ ID NO: 2309446 - protein, 21 aa, Cryptosporidium parvum
NPRRVCICIKWNSSHHLEDNE

SEQ ID NO: 2309447 - protein, 24 aa, Cryptosporidium parvum
NQFIKEWMDSIIIPPRLAIEANIL

SEQ ID NO: 2309448 - protein, 23 aa, Cryptosporidium parvum
NQKLEEFFLFFAQFLEKIVHISE

SEQ ID NO: 2309449 - protein, 17 aa, Cryptosporidium parvum
NQLEWVRRYSPQVYEAM

SEQ ID NO: 2309450 - protein, 23 aa, Cryptosporidium parvum
NQYSFRLYRMFILHDSLFIQTVW

SEQ ID NO: 2309451 - protein, 21 aa, Cryptosporidium parvum
NRCGHLFCRDCIDRNLSSRNR

SEQ ID NO: 2309452 - protein, 17 aa, Cryptosporidium parvum
NRFSIESGYRWDGVIRG

SEQ ID NO: 2309453 - protein, 18 aa, Cryptosporidium parvum
NRVKSLILCNAFVSTLNL

SEQ ID NO: 2309454 - protein, 17 aa, Cryptosporidium parvum
NRVQYILNRVHKLTNLE

SEQ ID NO: 2309455 - protein, 23 aa, Cryptosporidium parvum
NSAIFGLCWCNNDSFLLSGCLDR

SEQ ID NO: 2309456 - protein, 17 aa, Cryptosporidium parvum
NSALYMRTIYKLGDTQI

SEQ ID NO: 2309457 - protein, 17 aa, Cryptosporidium parvum
NSCKHLFSWIEYEMALL

SEQ ID NO: 2309458 - protein, 17 aa, Cryptosporidium parvum
NSIFRFPAEIEFNVYDQ

SEQ ID NO: 2309459 - protein, 23 aa, Cryptosporidium parvum
NSLKNPLLFWFKGLFRQNEPTHI

SEQ ID NO: 2309460 - protein, 24 aa, Cryptosporidium parvum
NSLLYKTQCLIGWFEFKNLQFEKA

SEQ ID NO: 2309461 - protein, 20 aa, Cryptosporidium parvum
NSLSILICRLIIYRHTEFEN

SEQ ID NO: 2309462 - protein, 18 aa, Cryptosporidium parvum
NSMLRPALNIGKRTKSTG

SEQ ID NO: 2309463 - protein, 22 aa, Cryptosporidium parvum
NSNIRKGYAVNFIAVGPESEIQ

SEQ ID NO: 2309464 - protein, 19 aa, Cryptosporidium parvum
NSQNYWKLLLRQPAINILK

SEQ ID NO: 2309465 - protein, 18 aa, Cryptosporidium parvum
NSTLKWNICSSQMETKMD

SEQ ID NO: 2309466 - protein, 23 aa, Cryptosporidium parvum
NSVCYRGSSSFGCVQNHSLSNIA

SEQ ID NO: 2309467 - protein, 17 aa, Cryptosporidium parvum
NSYFIKPYYVIKQLEGI

SEQ ID NO: 2309468 - protein, 19 aa, Cryptosporidium parvum
NTEFKLLLNETIPATYQES

SEQ ID NO: 2309469 - protein, 24 aa, Cryptosporidium parvum
NTIECAICLMTLQDLLNCKNKGEE

SEQ ID NO: 2309470 - protein, 24 aa, Cryptosporidium parvum
NTIKIKCYLIWSIKFEIIKKKKRL

SEQ ID NO: 2309471 - protein, 17 aa, Cryptosporidium parvum
NTLFPWKYIQNTLNYIS

SEQ ID NO: 2309472 - protein, 18 aa, Cryptosporidium parvum
NTLLRLNNLLSFKGNLLR

SEQ ID NO: 2309473 - protein, 23 aa, Cryptosporidium parvum
NTPFAVKIARIFGNKFGQLNGNV

SEQ ID NO: 2309474 - protein, 24 aa, Cryptosporidium parvum
NTRWKCPLCYQIIRPGMLKIDSFV

SEQ ID NO: 2309475 - protein, 19 aa, Cryptosporidium parvum
NTSRFPLRFTNVNQNFELC

SEQ ID NO: 2309476 - protein, 23 aa, Cryptosporidium parvum
NVILRLVPRLDVPALIRKSQNSQ

SEQ ID NO: 2309477 - protein, 24 aa, Cryptosporidium parvum
NVLKLRFKILIQCYRMLSRGLIPG

SEQ ID NO: 2309478 - protein, 23 aa, Cryptosporidium parvum
NVYWPRRCPFYLSDRSALRYLPD

SEQ ID NO: 2309479 - protein, 21 aa, Cryptosporidium parvum
NWLKGRVSICLGRNLENNIEE

SEQ ID NO: 2309480 - protein, 27 aa, Cryptosporidium parvum
NWSCCNSCLRFIWTLIQYKSLRYNDID

SEQ ID NO: 2309481 - protein, 23 aa, Cryptosporidium parvum
NYIPEWFRIGLRILTVSNALELR

SEQ ID NO: 2309482 - protein, 18 aa, Cryptosporidium parvum
NYLGGTFIRYWKRASTHI

SEQ ID NO: 2309483 - protein, 18 aa, Cryptosporidium parvum
NYSFKYRRGGIVVAPEIC

SEQ ID NO: 2309484 - protein, 17 aa, Cryptosporidium parvum
PAEQWVYERSLYEQMLF

SEQ ID NO: 2309485 - protein, 19 aa, Cryptosporidium parvum
PAGLLRLEMIFMYYDKGNK

SEQ ID NO: 2309486 - protein, 17 aa, Cryptosporidium parvum
PALKFAQHTGAHAMVGR

SEQ ID NO: 2309487 - protein, 18 aa, Cryptosporidium parvum
PARNCWEFQWPTEEKEQV

SEQ ID NO: 2309488 - protein, 19 aa, Cryptosporidium parvum
PCFLLAVKCSIDLTLPIYV

SEQ ID NO: 2309489 - protein, 20 aa, Cryptosporidium parvum
PCGHQLCFYCEHRLVDSKCP

SEQ ID NO: 2309490 - protein, 18 aa, Cryptosporidium parvum
PDEYAVECLCQLIMTTGY

SEQ ID NO: 2309491 - protein, 17 aa, Cryptosporidium parvum
PDIHFKPTLGYAVVPVE

SEQ ID NO: 2309492 - protein, 17 aa, Cryptosporidium parvum
PDLKGAVPLRGEIQNFN

SEQ ID NO: 2309493 - protein, 18 aa, Cryptosporidium parvum
PDNYKGMLIWKSTNFIRH

SEQ ID NO: 2309494 - protein, 24 aa, Cryptosporidium parvum
PDVILKEYLYLMALVDDSKFIDVD

SEQ ID NO: 2309495 - protein, 21 aa, Cryptosporidium parvum
PEFWSYRILTSMSIKIKDAND

SEQ ID NO: 2309496 - protein, 21 aa, Cryptosporidium parvum
PEHYIRFPVHKEFVSGIRLED

SEQ ID NO: 2309497 - protein, 19 aa, Cryptosporidium parvum
PEIDVWSCGVILYALLCGS

SEQ ID NO: 2309498 - protein, 18 aa, Cryptosporidium parvum
PEIEWKPANLSGELVLPL

SEQ ID NO: 2309499 - protein, 29 aa, Cryptosporidium parvum
PEIFKITYKIPFYWASLIANIYVFEKLRN

SEQ ID NO: 2309500 - protein, 20 aa, Cryptosporidium parvum
PEIIWQYYIELMINEKNIEF

SEQ ID NO: 2309501 - protein, 20 aa, Cryptosporidium parvum
PEIPEYNLSFGIHTQSAIKI

SEQ ID NO: 2309502 - protein, 19 aa, Cryptosporidium parvum
PELFPGLVYRYHPDNSPTK

SEQ ID NO: 2309503 - protein, 17 aa, Cryptosporidium parvum
PELGRNFTIKRYSSNDR

SEQ ID NO: 2309504 - protein, 20 aa, Cryptosporidium parvum
PELKFPLGYVLTEKEQNRVK

SEQ ID NO: 2309505 - protein, 17 aa, Cryptosporidium parvum
PELKILCFKGSRYERRS

SEQ ID NO: 2309506 - protein, 24 aa, Cryptosporidium parvum
PETHGWWLYCCHNGWLTIKRSVLI

SEQ ID NO: 2309507 - protein, 17 aa, Cryptosporidium parvum
PFCNGACNCERCLRNQQ

SEQ ID NO: 2309508 - protein, 21 aa, Cryptosporidium parvum
PFDMKSIRSLQTFSNQHSISH

SEQ ID NO: 2309509 - protein, 18 aa, Cryptosporidium parvum
PFGWQLDMRLVFYNALKY

SEQ ID NO: 2309510 - protein, 17 aa, Cryptosporidium parvum
PFIPFALSFLMNLGDSY

SEQ ID NO: 2309511 - protein, 19 aa, Cryptosporidium parvum
PFPSLCKFFEILFEKGNLF

SEQ ID NO: 2309512 - protein, 20 aa, Cryptosporidium parvum
PFRRLCLKFGADVTVSEMVL

SEQ ID NO: 2309513 - protein, 18 aa, Cryptosporidium parvum
PGCIPIVGGCGTVGVGAR

SEQ ID NO: 2309514 - protein, 20 aa, Cryptosporidium parvum
PGDFKRLFIGGSVRLKYSYA

SEQ ID NO: 2309515 - protein, 19 aa, Cryptosporidium parvum
PGGYAWTICVIYFFQKIGI

SEQ ID NO: 2309516 - protein, 18 aa, Cryptosporidium parvum
PGPEFWKERRLDLIKDAL

SEQ ID NO: 2309517 - protein, 18 aa, Cryptosporidium parvum
PGVCSRIACLIPHPVSPG

SEQ ID NO: 2309518 - protein, 17 aa, Cryptosporidium parvum
PGYLVLQWDNSWSLFSG

SEQ ID NO: 2309519 - protein, 17 aa, Cryptosporidium parvum
PGYVMRYPRSFKEQETF

SEQ ID NO: 2309520 - protein, 20 aa, Cryptosporidium parvum
PHANMAFPTIEVWCPGLNEH

SEQ ID NO: 2309521 - protein, 17 aa, Cryptosporidium parvum
PHIRLGPSVSQVLTTLT

SEQ ID NO: 2309522 - protein, 20 aa, Cryptosporidium parvum
PIDLCASTSISVCKVRIMKD

SEQ ID NO: 2309523 - protein, 23 aa, Cryptosporidium parvum
PIFKEFTFFLSLRRSLLELRKKI

SEQ ID NO: 2309524 - protein, 21 aa, Cryptosporidium parvum
PIIPCNFGILAIRSSERTSNF

SEQ ID NO: 2309525 - protein, 21 aa, Cryptosporidium parvum
PIKHPEIFESLGIAQPKGVLL

SEQ ID NO: 2309526 - protein, 17 aa, Cryptosporidium parvum
PIKSDFCMLQFSRFISH

SEQ ID NO: 2309527 - protein, 20 aa, Cryptosporidium parvum
PIRPKSRFLYYYKKKGNYSN

SEQ ID NO: 2309528 - protein, 19 aa, Cryptosporidium parvum
PITRYLIMFGYIIRTQKKY

SEQ ID NO: 2309529 - protein, 22 aa, Cryptosporidium parvum
PKCDAWSAGVLLHLLLMGAVPF

SEQ ID NO: 2309530 - protein, 18 aa, Cryptosporidium parvum
PKDSRLVIYGKFKDNPLV

SEQ ID NO: 2309531 - protein, 18 aa, Cryptosporidium parvum
PKILRFIRVGNQLRRSIT

SEQ ID NO: 2309532 - protein, 19 aa, Cryptosporidium parvum
PKKEYRGIPELELSDKSED

SEQ ID NO: 2309533 - protein, 21 aa, Cryptosporidium parvum
PKKKLECSVHWMYRSERGWMP

SEQ ID NO: 2309534 - protein, 18 aa, Cryptosporidium parvum
PKLYTGMHKYRFDKDGNG

SEQ ID NO: 2309535 - protein, 19 aa, Cryptosporidium parvum
PKNRQCVLVSATMPTALAS

SEQ ID NO: 2309536 - protein, 17 aa, Cryptosporidium parvum
PKPCYLFAVVAGVLGRL

SEQ ID NO: 2309537 - protein, 20 aa, Cryptosporidium parvum
PKPSKSIGCLEYVPESNNKN

SEQ ID NO: 2309538 - protein, 18 aa, Cryptosporidium parvum
PKQSLRLLLFINEQEKQS

SEQ ID NO: 2309539 - protein, 29 aa, Cryptosporidium parvum
PKSGCKGVSWSNRQMAWLAFWKEDNQRRS

SEQ ID NO: 2309540 - protein, 17 aa, Cryptosporidium parvum
PLCHYCRRSCKRLNYSR

SEQ ID NO: 2309541 - protein, 21 aa, Cryptosporidium parvum
PLHRRSHLKHFRFSESDEEGE

SEQ ID NO: 2309542 - protein, 17 aa, Cryptosporidium parvum
PLLCWAADIPSAKAFNF

SEQ ID NO: 2309543 - protein, 18 aa, Cryptosporidium parvum
PLLRLGAGLPHNSSGTPC

SEQ ID NO: 2309544 - protein, 19 aa, Cryptosporidium parvum
PLPCDMCRKSCAFDRGEEA

SEQ ID NO: 2309545 - protein, 20 aa, Cryptosporidium parvum
PLPERHEIVLFKSMEDANNT

SEQ ID NO: 2309546 - protein, 20 aa, Cryptosporidium parvum
PLPPRYAKILLLTTAYIRKN

SEQ ID NO: 2309547 - protein, 19 aa, Cryptosporidium parvum
PLVCFPDFVRSGANMEHLM

SEQ ID NO: 2309548 - protein, 21 aa, Cryptosporidium parvum
PMNSLRVGLFMTLKISTVNLF

SEQ ID NO: 2309549 - protein, 19 aa, Cryptosporidium parvum
PMPRFGHSMAWISEKTFLI

SEQ ID NO: 2309550 - protein, 25 aa, Cryptosporidium parvum
PNFNRLRLQFIFFYYDSNRDGLLSI

SEQ ID NO: 2309551 - protein, 26 aa, Cryptosporidium parvum
PNGDIKCILWPFSLLFIHKNELSDDV

SEQ ID NO: 2309552 - protein, 20 aa, Cryptosporidium parvum
PNIDVLPWIGSVGVGGVVTW

SEQ ID NO: 2309553 - protein, 24 aa, Cryptosporidium parvum
PNIEFLRFGFLFSKDTLAPFEMTI

SEQ ID NO: 2309554 - protein, 17 aa, Cryptosporidium parvum
PNKLRVCEFLIHWHEQR

SEQ ID NO: 2309555 - protein, 17 aa, Cryptosporidium parvum
PNLKAVIPLFGLLDLAF

SEQ ID NO: 2309556 - protein, 18 aa, Cryptosporidium parvum
PNPMCFHRTVTPIQRRRK

SEQ ID NO: 2309557 - protein, 22 aa, Cryptosporidium parvum
PNVKKWGFKCCKNLKRSSVCSA

SEQ ID NO: 2309558 - protein, 17 aa, Cryptosporidium parvum
PNWKSIRPWALVNSNNS

SEQ ID NO: 2309559 - protein, 22 aa, Cryptosporidium parvum
PNWPPPWLVRMQKYGPPPSYPY

SEQ ID NO: 2309560 - protein, 18 aa, Cryptosporidium parvum
PPCLFEWKKQAKISRVTI

SEQ ID NO: 2309561 - protein, 22 aa, Cryptosporidium parvum
PPDAWHLCCWLLRKNSNERASP

SEQ ID NO: 2309562 - protein, 17 aa, Cryptosporidium parvum
PPLLFDIAYEFEKLKLS

SEQ ID NO: 2309563 - protein, 17 aa, Cryptosporidium parvum
PPMYLLITHKGRHCKGN

SEQ ID NO: 2309564 - protein, 19 aa, Cryptosporidium parvum
PPSSPTCFSFKASVPVNIL

SEQ ID NO: 2309565 - protein, 23 aa, Cryptosporidium parvum
PQFKSGYKGVSWNSRMEAWLAFF

SEQ ID NO: 2309566 - protein, 18 aa, Cryptosporidium parvum
PQINLAISRGIFFELDIS

SEQ ID NO: 2309567 - protein, 20 aa, Cryptosporidium parvum
PQVYILLRWDCLVFHINEKG

SEQ ID NO: 2309568 - protein, 17 aa, Cryptosporidium parvum
PRALKLIFDNIDRNCEK

SEQ ID NO: 2309569 - protein, 21 aa, Cryptosporidium parvum
PRGKIPYEYLVKYHHQSYSQC

SEQ ID NO: 2309570 - protein, 22 aa, Cryptosporidium parvum
PRGWICRPMVPNKWLVVFCDEC

SEQ ID NO: 2309571 - protein, 20 aa, Cryptosporidium parvum
PRILPELLVRIGQSNPEILQ

SEQ ID NO: 2309572 - protein, 19 aa, Cryptosporidium parvum
PRLAYEIAEEIVVNLDNGS

SEQ ID NO: 2309573 - protein, 17 aa, Cryptosporidium parvum
PRLLVKLLLEQGEGLTV

SEQ ID NO: 2309574 - protein, 21 aa, Cryptosporidium parvum
PRPYLVWLLHDFNFLLYDTAN

SEQ ID NO: 2309575 - protein, 20 aa, Cryptosporidium parvum
PRTGGALGFAQMVPNELRLL

SEQ ID NO: 2309576 - protein, 24 aa, Cryptosporidium parvum
PRVLHPKRRFKLFRSILKFGDPYR

SEQ ID NO: 2309577 - protein, 18 aa, Cryptosporidium parvum
PRVLIILFWKDLIPIEWD

SEQ ID NO: 2309578 - protein, 17 aa, Cryptosporidium parvum
PRVPLLFIQKNLFRLGW

SEQ ID NO: 2309579 - protein, 23 aa, Cryptosporidium parvum
PRVSSFPGSLSWDSRDSYKIRDL

SEQ ID NO: 2309580 - protein, 22 aa, Cryptosporidium parvum
PSCRSLRTSIRINRSSTLSHLG

SEQ ID NO: 2309581 - protein, 19 aa, Cryptosporidium parvum
PSFEIFRCLPVREELLRSI

SEQ ID NO: 2309582 - protein, 23 aa, Cryptosporidium parvum
PSFLRKYWWLIAIGFITYSVLTT

SEQ ID NO: 2309583 - protein, 19 aa, Cryptosporidium parvum
PSQCFKLDLIMYSAIGWAR

SEQ ID NO: 2309584 - protein, 24 aa, Cryptosporidium parvum
PSSFSCRFIYMRIHFWINILSIPL

SEQ ID NO: 2309585 - protein, 23 aa, Cryptosporidium parvum
PSSPNLWLLYGFIYRKAFPDRIN

SEQ ID NO: 2309586 - protein, 17 aa, Cryptosporidium parvum
PSYFPAMYVPRAYVNNV

SEQ ID NO: 2309587 - protein, 20 aa, Cryptosporidium parvum
PTEFIYFWKKCCRKINEKLG

SEQ ID NO: 2309588 - protein, 21 aa, Cryptosporidium parvum
PTIKCPRDFEIIFPTYPTEDT

SEQ ID NO: 2309589 - protein, 19 aa, Cryptosporidium parvum
PVFGNIIDKDCCIYESDKY

SEQ ID NO: 2309590 - protein, 19 aa, Cryptosporidium parvum
PVGFLFKKFEELREALQHG

SEQ ID NO: 2309591 - protein, 20 aa, Cryptosporidium parvum
PVGGDILCFLPGQQEIEEAQ

SEQ ID NO: 2309592 - protein, 22 aa, Cryptosporidium parvum
PVLSEAFLLDWITSDVLQSTID

SEQ ID NO: 2309593 - protein, 18 aa, Cryptosporidium parvum
PVPKRGFIPSKWEAKKIT

SEQ ID NO: 2309594 - protein, 19 aa, Cryptosporidium parvum
PWGKGRPGWHIECSVMASN

SEQ ID NO: 2309595 - protein, 18 aa, Cryptosporidium parvum
PWLFFSIRILDGYDTFCS

SEQ ID NO: 2309596 - protein, 17 aa, Cryptosporidium parvum
PWYKGCNKLILLGIPSS

SEQ ID NO: 2309597 - protein, 18 aa, Cryptosporidium parvum
PYCRLFSYSQTENFFGTQ

SEQ ID NO: 2309598 - protein, 28 aa, Cryptosporidium parvum
PYDRQFWSYAYKTGRLHPAEEQVQRQLN

SEQ ID NO: 2309599 - protein, 26 aa, Cryptosporidium parvum
PYFDRFSLRLPIIMLFESLLKVDLHR

SEQ ID NO: 2309600 - protein, 24 aa, Cryptosporidium parvum
PYFEEWKFLYKRLCFIEKEVDSML

SEQ ID NO: 2309601 - protein, 22 aa, Cryptosporidium parvum
PYTFRPESILSYFKDIYEEYDY

SEQ ID NO: 2309602 - protein, 17 aa, Cryptosporidium parvum
PYTSIPCVLDFLKQRYL

SEQ ID NO: 2309603 - protein, 22 aa, Cryptosporidium parvum
QAIKMAYSVGLTYEAGLGERKL

SEQ ID NO: 2309604 - protein, 23 aa, Cryptosporidium parvum
QAIVCLFLDYKRLLFNTLQLNMN

SEQ ID NO: 2309605 - protein, 20 aa, Cryptosporidium parvum
QATCCEICLPPLTEKGLDES

SEQ ID NO: 2309606 - protein, 22 aa, Cryptosporidium parvum
QCELCKKWRKLPLGMNPNTLPE

SEQ ID NO: 2309607 - protein, 17 aa, Cryptosporidium parvum
QCGKVFHFDCLRNCNLI

SEQ ID NO: 2309608 - protein, 17 aa, Cryptosporidium parvum
QCLCNFCGHTFDIPMDY

SEQ ID NO: 2309609 - protein, 17 aa, Cryptosporidium parvum
QDLSYFIHGKWASIKKL

SEQ ID NO: 2309610 - protein, 21 aa, Cryptosporidium parvum
QECPKRIILCRYCNNFVQAGT

SEQ ID NO: 2309611 - protein, 17 aa, Cryptosporidium parvum
QEEGAKSAIQWNQTEYK

SEQ ID NO: 2309612 - protein, 19 aa, Cryptosporidium parvum
QFKCCIDCNPTTIKLNKKM

SEQ ID NO: 2309613 - protein, 18 aa, Cryptosporidium parvum
QFKISRYFLEVMKAIILS

SEQ ID NO: 2309614 - protein, 24 aa, Cryptosporidium parvum
QFLNDLCKIYHIYQVNLVKRSQET

SEQ ID NO: 2309615 - protein, 21 aa, Cryptosporidium parvum
QFRFIVDLLRRFHVLDNYCGC

SEQ ID NO: 2309616 - protein, 18 aa, Cryptosporidium parvum
QFYILAILLGCDYTVGVN

SEQ ID NO: 2309617 - protein, 20 aa, Cryptosporidium parvum
QGCMEICITPPLSSELITSN

SEQ ID NO: 2309618 - protein, 17 aa, Cryptosporidium parvum
QGGRMGITTSMGLGMTP

SEQ ID NO: 2309619 - protein, 18 aa, Cryptosporidium parvum
QGKFALSPLNGTEVAPLF

SEQ ID NO: 2309620 - protein, 18 aa, Cryptosporidium parvum
QHFKFNLMRILKRIKQTE

SEQ ID NO: 2309621 - protein, 19 aa, Cryptosporidium parvum
QIACLRQRLLGISKNHAIS

SEQ ID NO: 2309622 - protein, 26 aa, Cryptosporidium parvum
QILVAAILCRWWHALPDWPPPDTDYQ

SEQ ID NO: 2309623 - protein, 17 aa, Cryptosporidium parvum
QITSFCWITNQIFLVGF

SEQ ID NO: 2309624 - protein, 20 aa, Cryptosporidium parvum
QKEGVLWMWGLYCNNHGGIL

SEQ ID NO: 2309625 - protein, 18 aa, Cryptosporidium parvum
QKLCSYNFHDQEEYKLEW

SEQ ID NO: 2309626 - protein, 17 aa, Cryptosporidium parvum
QKLFPGWLSSDMLNCNS

SEQ ID NO: 2309627 - protein, 21 aa, Cryptosporidium parvum
QKLHPCEICAAFLSETDNDQR

SEQ ID NO: 2309628 - protein, 24 aa, Cryptosporidium parvum
QKLIWKRFRIGMMHDAQEFLRYFL

SEQ ID NO: 2309629 - protein, 21 aa, Cryptosporidium parvum
QKLPKLRGFLSMNSLAHLGRQ

SEQ ID NO: 2309630 - protein, 17 aa, Cryptosporidium parvum
QKLSLIISGFISKPSDK

SEQ ID NO: 2309631 - protein, 18 aa, Cryptosporidium parvum
QKYKICWLIDPLDGTKEF

SEQ ID NO: 2309632 - protein, 24 aa, Cryptosporidium parvum
QLFWEVDSAYPLREFQFGVMNEQT

SEQ ID NO: 2309633 - protein, 24 aa, Cryptosporidium parvum
QLIWKRPLEKFAPRLLNAVQISKL

SEQ ID NO: 2309634 - protein, 25 aa, Cryptosporidium parvum
QLLFRDCFRVGLQLLDLSGADFNQI

SEQ ID NO: 2309635 - protein, 18 aa, Cryptosporidium parvum
QLNIPVFFRHSLPKDSEW

SEQ ID NO: 2309636 - protein, 18 aa, Cryptosporidium parvum
QLNNLSWFLEISSQRNSS

SEQ ID NO: 2309637 - protein, 18 aa, Cryptosporidium parvum
QLVYGCGKLCLLDKLLSR

SEQ ID NO: 2309638 - protein, 19 aa, Cryptosporidium parvum
QMYLLRPAEQWVYERSLYE

SEQ ID NO: 2309639 - protein, 22 aa, Cryptosporidium parvum
QNYKLKYFEAMRKLQRLETEMV

SEQ ID NO: 2309640 - protein, 17 aa, Cryptosporidium parvum
QPCLELLTFILIDIIMD

SEQ ID NO: 2309641 - protein, 17 aa, Cryptosporidium parvum
QPFKIELSDEFSFFTSL

SEQ ID NO: 2309642 - protein, 17 aa, Cryptosporidium parvum
QPLLMRVYEDFFSMRGA

SEQ ID NO: 2309643 - protein, 25 aa, Cryptosporidium parvum
QPLRFPLPIFEFFCENMAKKCKGIE

SEQ ID NO: 2309644 - protein, 20 aa, Cryptosporidium parvum
QPLVYWRVYKGLSPSISFPS

SEQ ID NO: 2309645 - protein, 23 aa, Cryptosporidium parvum
QPVLQFVYRKCVELRFTVNNENL

SEQ ID NO: 2309646 - protein, 18 aa, Cryptosporidium parvum
QQEWSLRKPLEMRVQTDN

SEQ ID NO: 2309647 - protein, 22 aa, Cryptosporidium parvum
QQLIKSCNIMRDHMLRKQNNSV

SEQ ID NO: 2309648 - protein, 20 aa, Cryptosporidium parvum
QRLKDALGMQPNWPPPWLVR

SEQ ID NO: 2309649 - protein, 19 aa, Cryptosporidium parvum
QRMCLPVNISMILKSLESS

SEQ ID NO: 2309650 - protein, 25 aa, Cryptosporidium parvum
QRSLARLWFDYVFSVKCLSPSTSPY

SEQ ID NO: 2309651 - protein, 22 aa, Cryptosporidium parvum
QRWFYELFHDFPFFSISPYTKT

SEQ ID NO: 2309652 - protein, 17 aa, Cryptosporidium parvum
QSICCLINILNSSEDKF

SEQ ID NO: 2309653 - protein, 17 aa, Cryptosporidium parvum
QSLQLNLAMIYVKIQEW

SEQ ID NO: 2309654 - protein, 21 aa, Cryptosporidium parvum
QTGPKLQEWLGLRDWKNNQSK

SEQ ID NO: 2309655 - protein, 17 aa, Cryptosporidium parvum
QTLLCLIYQLLLNKKQR

SEQ ID NO: 2309656 - protein, 20 aa, Cryptosporidium parvum
QVQISYRWFCIHLLPKYYLI

SEQ ID NO: 2309657 - protein, 20 aa, Cryptosporidium parvum
QVTCLKFLPNLGIIISGDIS

SEQ ID NO: 2309658 - protein, 17 aa, Cryptosporidium parvum
QVYILGWLIHLRILNRI

SEQ ID NO: 2309659 - protein, 17 aa, Cryptosporidium parvum
QWSCKKFGKEGAAKRAI

SEQ ID NO: 2309660 - protein, 22 aa, Cryptosporidium parvum
QYWKTKLCLMFSKGACKNGDNC

SEQ ID NO: 2309661 - protein, 20 aa, Cryptosporidium parvum
RAIFHFVRCIPFINTSFREP

SEQ ID NO: 2309662 - protein, 21 aa, Cryptosporidium parvum
RANVFLRWNLAPTKQQIAEFL

SEQ ID NO: 2309663 - protein, 17 aa, Cryptosporidium parvum
RAPEVILDLGWDMSSDM

SEQ ID NO: 2309664 - protein, 20 aa, Cryptosporidium parvum
RAPRAIKGIREFAGKVMKTE

SEQ ID NO: 2309665 - protein, 19 aa, Cryptosporidium parvum
RATFFDVLEIFLLTIYKFR

SEQ ID NO: 2309666 - protein, 24 aa, Cryptosporidium parvum
RCENEVWLTLPLFFPSATLHNVTH

SEQ ID NO: 2309667 - protein, 17 aa, Cryptosporidium parvum
RCHLTVPKLQYKIYSSA

SEQ ID NO: 2309668 - protein, 19 aa, Cryptosporidium parvum
RCIYCKKIYFSVKGFISHR

SEQ ID NO: 2309669 - protein, 19 aa, Cryptosporidium parvum
RDERLFVSLLLEYMGYKDK

SEQ ID NO: 2309670 - protein, 17 aa, Cryptosporidium parvum
RDFSVYIVNMFDTGQAA

SEQ ID NO: 2309671 - protein, 18 aa, Cryptosporidium parvum
RDGKCLPLQIGMNNNLNC

SEQ ID NO: 2309672 - protein, 17 aa, Cryptosporidium parvum
RDIKGLHLVLSPKSTLG

SEQ ID NO: 2309673 - protein, 23 aa, Cryptosporidium parvum
RDLFLKMHAFEWKYESNSGNYRL

SEQ ID NO: 2309674 - protein, 17 aa, Cryptosporidium parvum
RDLIEIVRICILHGILI

SEQ ID NO: 2309675 - protein, 25 aa, Cryptosporidium parvum
RDPDLRCCSYLAYPESDESVYGDSE

SEQ ID NO: 2309676 - protein, 17 aa, Cryptosporidium parvum
RDSLGMKAQEIEKLQTE

SEQ ID NO: 2309677 - protein, 17 aa, Cryptosporidium parvum
RDWCGSCLLDLIRRCQR

SEQ ID NO: 2309678 - protein, 21 aa, Cryptosporidium parvum
RDYCLRPILTIRLSKVNKHFP

SEQ ID NO: 2309679 - protein, 17 aa, Cryptosporidium parvum
REFKIAIALAENCQLPV

SEQ ID NO: 2309680 - protein, 17 aa, Cryptosporidium parvum
REIYKGYGIKNETDGSV

SEQ ID NO: 2309681 - protein, 17 aa, Cryptosporidium parvum
RELLALCLKKIKGLNTV

SEQ ID NO: 2309682 - protein, 18 aa, Cryptosporidium parvum
RELTRWKISIYSGLHSSK

SEQ ID NO: 2309683 - protein, 23 aa, Cryptosporidium parvum
RFDCSRCSISFSIKKNICERLSL

SEQ ID NO: 2309684 - protein, 18 aa, Cryptosporidium parvum
RFFFTRNIHCHAKYITID

SEQ ID NO: 2309685 - protein, 18 aa, Cryptosporidium parvum
RFKLTWPLQKSFEIADEE

SEQ ID NO: 2309686 - protein, 18 aa, Cryptosporidium parvum
RFLLPKLLQFRPNIIFIS

SEQ ID NO: 2309687 - protein, 22 aa, Cryptosporidium parvum
RFRTGKIWILICTDLMARGVDF

SEQ ID NO: 2309688 - protein, 18 aa, Cryptosporidium parvum
RFTWYCSHCNFSIDNEIL

SEQ ID NO: 2309689 - protein, 18 aa, Cryptosporidium parvum
RFYDEYFEAFPLAISETL

SEQ ID NO: 2309690 - protein, 20 aa, Cryptosporidium parvum
RGCVAVKLVGNWDSHISPNK

SEQ ID NO: 2309691 - protein, 17 aa, Cryptosporidium parvum
RGEIKFVGFLIRQFKGE

SEQ ID NO: 2309692 - protein, 18 aa, Cryptosporidium parvum
RGEVEGFLHIVKRDIEPI

SEQ ID NO: 2309693 - protein, 20 aa, Cryptosporidium parvum
RGGAVPPVLRPGAIPPGPPG

SEQ ID NO: 2309694 - protein, 19 aa, Cryptosporidium parvum
RGGIVAPIQIEWPKTPPAS

SEQ ID NO: 2309695 - protein, 18 aa, Cryptosporidium parvum
RGGRIWFDRHLLFQDNFE

SEQ ID NO: 2309696 - protein, 24 aa, Cryptosporidium parvum
RGHEGPVWQVCWAHPTFGSVLASC

SEQ ID NO: 2309697 - protein, 22 aa, Cryptosporidium parvum
RGIGLRFPRFIRIRDDKSPEQA

SEQ ID NO: 2309698 - protein, 19 aa, Cryptosporidium parvum
RHDCFRRRLAEFIIYPPPV

SEQ ID NO: 2309699 - protein, 17 aa, Cryptosporidium parvum
RHIKRKNACIQICKALR

SEQ ID NO: 2309700 - protein, 17 aa, Cryptosporidium parvum
RHVPSFCSFADSMNISF

SEQ ID NO: 2309701 - protein, 20 aa, Cryptosporidium parvum
RIDEFWIKYIQMELILKNYI

SEQ ID NO: 2309702 - protein, 23 aa, Cryptosporidium parvum
RIEPEERIRMGIFDDSLVESDVK

SEQ ID NO: 2309703 - protein, 17 aa, Cryptosporidium parvum
RIFGRLYLFGGFDGIQC

SEQ ID NO: 2309704 - protein, 19 aa, Cryptosporidium parvum
RIGFAWVRSIIGTFFNDTF

SEQ ID NO: 2309705 - protein, 20 aa, Cryptosporidium parvum
RINPYLPAVVEWQYNTIIRE

SEQ ID NO: 2309706 - protein, 18 aa, Cryptosporidium parvum
RIRVCPQLPNLVSTWSEL

SEQ ID NO: 2309707 - protein, 18 aa, Cryptosporidium parvum
RISCGLLTGVVKLFCHKV

SEQ ID NO: 2309708 - protein, 17 aa, Cryptosporidium parvum
RISGLGIGVHWEEISTK

SEQ ID NO: 2309709 - protein, 19 aa, Cryptosporidium parvum
RISICLRELFSYFANTRWK

SEQ ID NO: 2309710 - protein, 18 aa, Cryptosporidium parvum
RIVPNIFYLSKNTSEETV

SEQ ID NO: 2309711 - protein, 17 aa, Cryptosporidium parvum
RIYNLKSRILNYWRKIW

SEQ ID NO: 2309712 - protein, 23 aa, Cryptosporidium parvum
RIYPSPLNEIVKILNMHQLTLQS

SEQ ID NO: 2309713 - protein, 17 aa, Cryptosporidium parvum
RKDWAFDEAILYPLHPR

SEQ ID NO: 2309714 - protein, 17 aa, Cryptosporidium parvum
RKDWPFDEAILYPPHPR

SEQ ID NO: 2309715 - protein, 20 aa, Cryptosporidium parvum
RKEIMDSLFACQVGDNGNNS

SEQ ID NO: 2309716 - protein, 18 aa, Cryptosporidium parvum
RKIFLGQWQSAYIILTKD

SEQ ID NO: 2309717 - protein, 19 aa, Cryptosporidium parvum
RKIMSMFLLEFEVSNSKDY

SEQ ID NO: 2309718 - protein, 18 aa, Cryptosporidium parvum
RKKCLEATSSISLSPKSD

SEQ ID NO: 2309719 - protein, 20 aa, Cryptosporidium parvum
RKKLHKVPGVPLIYLNNQVP

SEQ ID NO: 2309720 - protein, 17 aa, Cryptosporidium parvum
RKLYAILSICFNINLLN

SEQ ID NO: 2309721 - protein, 26 aa, Cryptosporidium parvum
RKMLYNFANSVWDYVKPVSLDELERK

SEQ ID NO: 2309722 - protein, 18 aa, Cryptosporidium parvum
RKNACIQICKALRRYVCI

SEQ ID NO: 2309723 - protein, 22 aa, Cryptosporidium parvum
RKPGCSRMKLDIIGYGESENYG

SEQ ID NO: 2309724 - protein, 19 aa, Cryptosporidium parvum
RKRKVAIKVIRDVQRYTSA

SEQ ID NO: 2309725 - protein, 19 aa, Cryptosporidium parvum
RKRLLCFSASTAFWIPYTF

SEQ ID NO: 2309726 - protein, 19 aa, Cryptosporidium parvum
RKSLYWDTVFNWSTSDDDE

SEQ ID NO: 2309727 - protein, 23 aa, Cryptosporidium parvum
RKVFPSYWFNLSWVYIEDRKANK

SEQ ID NO: 2309728 - protein, 22 aa, Cryptosporidium parvum
RKWRTLWCWTHIYVHYKRAQIY

SEQ ID NO: 2309729 - protein, 17 aa, Cryptosporidium parvum
RLALLGLDWDNITADDI

SEQ ID NO: 2309730 - protein, 19 aa, Cryptosporidium parvum
RLDGWPALCIHGDKKQEER

SEQ ID NO: 2309731 - protein, 23 aa, Cryptosporidium parvum
RLDKLDIVDGFLFKDDDTEKKDG

SEQ ID NO: 2309732 - protein, 23 aa, Cryptosporidium parvum
RLECEIKVLKECLSKESKSALIR

SEQ ID NO: 2309733 - protein, 18 aa, Cryptosporidium parvum
RLGAPIYNITSFRKEKVC

SEQ ID NO: 2309734 - protein, 20 aa, Cryptosporidium parvum
RLGSLPYNWKIMSDAPELFN

SEQ ID NO: 2309735 - protein, 17 aa, Cryptosporidium parvum
RLKEIQAEFDWMILVFL

SEQ ID NO: 2309736 - protein, 25 aa, Cryptosporidium parvum
RLLFTLVRLKLWIVEEILYDEEILD

SEQ ID NO: 2309737 - protein, 18 aa, Cryptosporidium parvum
RLLICLLENSIFTDFDYI

SEQ ID NO: 2309738 - protein, 18 aa, Cryptosporidium parvum
RLRFSNIVERADFEEATR

SEQ ID NO: 2309739 - protein, 21 aa, Cryptosporidium parvum
RLRLVFSVNYPNIWEAKKELG

SEQ ID NO: 2309740 - protein, 19 aa, Cryptosporidium parvum
RLRTVFNYKSIKSGMHSNM

SEQ ID NO: 2309741 - protein, 17 aa, Cryptosporidium parvum
RLSSTRITYFGGRSKTG

SEQ ID NO: 2309742 - protein, 20 aa, Cryptosporidium parvum
RLSWEEFKYILVHFSPNFPI

SEQ ID NO: 2309743 - protein, 19 aa, Cryptosporidium parvum
RLYEEMLKHSGVYNFLHNF

SEQ ID NO: 2309744 - protein, 23 aa, Cryptosporidium parvum
RMARIGWDLGILFNHYSMRKEME

SEQ ID NO: 2309745 - protein, 23 aa, Cryptosporidium parvum
RMIGEILKWYFGMSHVSLNDITP

SEQ ID NO: 2309746 - protein, 19 aa, Cryptosporidium parvum
RMIQKIDQFRVGSINQSSD

SEQ ID NO: 2309747 - protein, 19 aa, Cryptosporidium parvum
RMLLRCHLTVPKLQYKIYS

SEQ ID NO: 2309748 - protein, 19 aa, Cryptosporidium parvum
RNDYKFGFMMQFFPNEKDD

SEQ ID NO: 2309749 - protein, 23 aa, Cryptosporidium parvum
RNEEIKTYWSIRVAYDTLTQERD

SEQ ID NO: 2309750 - protein, 20 aa, Cryptosporidium parvum
RNIFLKKAIIDWKEKVIFPL

SEQ ID NO: 2309751 - protein, 23 aa, Cryptosporidium parvum
RNKLPLCFLVLFKLETEYEILFK

SEQ ID NO: 2309752 - protein, 22 aa, Cryptosporidium parvum
RNLTKIRLKNCIPVESIMELRY

SEQ ID NO: 2309753 - protein, 17 aa, Cryptosporidium parvum
RNNLFLKRDEIIIRKIS

SEQ ID NO: 2309754 - protein, 20 aa, Cryptosporidium parvum
RNNLGLAFCNTFLKESNEKI

SEQ ID NO: 2309755 - protein, 20 aa, Cryptosporidium parvum
RNPHYWRYIGIIKLYKKVQG

SEQ ID NO: 2309756 - protein, 20 aa, Cryptosporidium parvum
RNSIKIIALISIKFKETASN

SEQ ID NO: 2309757 - protein, 18 aa, Cryptosporidium parvum
RPAFNLGLSISRIGSSTQ

SEQ ID NO: 2309758 - protein, 17 aa, Cryptosporidium parvum
RPEEITRLYGLKPIRTL

SEQ ID NO: 2309759 - protein, 23 aa, Cryptosporidium parvum
RPEKAPDVCYSWWIFSLLYFLGR

SEQ ID NO: 2309760 - protein, 20 aa, Cryptosporidium parvum
RPERIVKIAERFGVQGDVAL

SEQ ID NO: 2309761 - protein, 18 aa, Cryptosporidium parvum
RPFLPRLLICLLENSIFT

SEQ ID NO: 2309762 - protein, 20 aa, Cryptosporidium parvum
RPGLYCLPRSCIKGGGNLLG

SEQ ID NO: 2309763 - protein, 19 aa, Cryptosporidium parvum
RPGVREFLNTIAPYYIMGI

SEQ ID NO: 2309764 - protein, 18 aa, Cryptosporidium parvum
RPHMNIVFIGHVDAGKST

SEQ ID NO: 2309765 - protein, 20 aa, Cryptosporidium parvum
RPTGLCGAALLISARYHGIP

SEQ ID NO: 2309766 - protein, 26 aa, Cryptosporidium parvum
RPTYKQVIWCCFGLLSGELELSLFED

SEQ ID NO: 2309767 - protein, 20 aa, Cryptosporidium parvum
RQIARLLVLISFFRYLPNPL

SEQ ID NO: 2309768 - protein, 19 aa, Cryptosporidium parvum
RQIIRYCFGGTPLYSESPK

SEQ ID NO: 2309769 - protein, 24 aa, Cryptosporidium parvum
RQLLTELLLIEWMEAFFAHLRLAL

SEQ ID NO: 2309770 - protein, 18 aa, Cryptosporidium parvum
RRELCSGYDLFLSDDRII

SEQ ID NO: 2309771 - protein, 18 aa, Cryptosporidium parvum
RRFRCFKCGEYRDEIGDK

SEQ ID NO: 2309772 - protein, 18 aa, Cryptosporidium parvum
RRHQRLFASQIMKSILNG

SEQ ID NO: 2309773 - protein, 17 aa, Cryptosporidium parvum
RRKAILPKVEWILCFPV

SEQ ID NO: 2309774 - protein, 20 aa, Cryptosporidium parvum
RRLASFPAIRAKIFEYFLSN

SEQ ID NO: 2309775 - protein, 24 aa, Cryptosporidium parvum
RRLFKDLFFREGYQYDFIFDWSFL

SEQ ID NO: 2309776 - protein, 22 aa, Cryptosporidium parvum
RRLISAWFRLYFEIIGNKTSNN

SEQ ID NO: 2309777 - protein, 18 aa, Cryptosporidium parvum
RRNGTLLIYVWAFEQKKG

SEQ ID NO: 2309778 - protein, 22 aa, Cryptosporidium parvum
RRNPYEYAYRPNLCPNVVFQNE

SEQ ID NO: 2309779 - protein, 21 aa, Cryptosporidium parvum
RRPILCITVGLGFDSFIVVRN

SEQ ID NO: 2309780 - protein, 21 aa, Cryptosporidium parvum
RRYDIKGSWIGRSTPLILQED

SEQ ID NO: 2309781 - protein, 19 aa, Cryptosporidium parvum
RRYLEEFLRRVFNRGYLIS

SEQ ID NO: 2309782 - protein, 22 aa, Cryptosporidium parvum
RRYWRRTHIYSRLTVYYNEKYP

SEQ ID NO: 2309783 - protein, 24 aa, Cryptosporidium parvum
RSEILENCIVCFTGFLKADEKPIV

SEQ ID NO: 2309784 - protein, 23 aa, Cryptosporidium parvum
RSGLYAGAFYRFQIELALEREYV

SEQ ID NO: 2309785 - protein, 17 aa, Cryptosporidium parvum
RSIDDPANWSWRQKSFL

SEQ ID NO: 2309786 - protein, 21 aa, Cryptosporidium parvum
RSKILFDICKEFIKLKYVNYS

SEQ ID NO: 2309787 - protein, 20 aa, Cryptosporidium parvum
RSQIFFGFREEFIYSLVKRK

SEQ ID NO: 2309788 - protein, 18 aa, Cryptosporidium parvum
RSRCLSHLDVDLKFKGIS

SEQ ID NO: 2309789 - protein, 18 aa, Cryptosporidium parvum
RSRLEWVQTPILYLFDAF

SEQ ID NO: 2309790 - protein, 19 aa, Cryptosporidium parvum
RSRLLLKERIFSMNPFEVN

SEQ ID NO: 2309791 - protein, 19 aa, Cryptosporidium parvum
RSRVIYCHVCCQYKPRSTR

SEQ ID NO: 2309792 - protein, 18 aa, Cryptosporidium parvum
RSSLPYQLFCKGVKIIPM

SEQ ID NO: 2309793 - protein, 25 aa, Cryptosporidium parvum
RSTRARFQVCQHIACYDCVRLALMI

SEQ ID NO: 2309794 - protein, 17 aa, Cryptosporidium parvum
RSVHILMGKTFSRDNNI

SEQ ID NO: 2309795 - protein, 22 aa, Cryptosporidium parvum
RSVPCGSFIWWDRRVWEYNFVY

SEQ ID NO: 2309796 - protein, 17 aa, Cryptosporidium parvum
RTALRFVKHWSKARGIY

SEQ ID NO: 2309797 - protein, 17 aa, Cryptosporidium parvum
RTLKCFIKKLIIENFKS

SEQ ID NO: 2309798 - protein, 19 aa, Cryptosporidium parvum
RTMCVHMGLLLGVGAHMQE

SEQ ID NO: 2309799 - protein, 24 aa, Cryptosporidium parvum
RTQKWLLRNVKLEDFKYLIRVDQL

SEQ ID NO: 2309800 - protein, 19 aa, Cryptosporidium parvum
RTSMKDCFTEFAVSEYRLA

SEQ ID NO: 2309801 - protein, 17 aa, Cryptosporidium parvum
RTYPGPIPWNYGAFPQT

SEQ ID NO: 2309802 - protein, 17 aa, Cryptosporidium parvum
RVCKIVDKVKCRRKLDE

SEQ ID NO: 2309803 - protein, 20 aa, Cryptosporidium parvum
RVLFLLEWIELIISEDQQNQ

SEQ ID NO: 2309804 - protein, 20 aa, Cryptosporidium parvum
RVPECLESVFGIGSCEPSAM

SEQ ID NO: 2309805 - protein, 22 aa, Cryptosporidium parvum
RVQPRAGRIVTFFIADMHEGEP

SEQ ID NO: 2309806 - protein, 19 aa, Cryptosporidium parvum
RVRILLLIFQWIKKQQCEL

SEQ ID NO: 2309807 - protein, 18 aa, Cryptosporidium parvum
RVRTRISPELVVGETCIE

SEQ ID NO: 2309808 - protein, 19 aa, Cryptosporidium parvum
RVSGRHWGIIELDSEFSCK

SEQ ID NO: 2309809 - protein, 22 aa, Cryptosporidium parvum
RVSPKFRVPRSFKVFSKVFSEF

SEQ ID NO: 2309810 - protein, 20 aa, Cryptosporidium parvum
RVSRGWKISNWYGNFYFSGV

SEQ ID NO: 2309811 - protein, 19 aa, Cryptosporidium parvum
RVTKSFNPRHYGGLEQALQ

SEQ ID NO: 2309812 - protein, 18 aa, Cryptosporidium parvum
RVTRIIRLLTFINRSIEG

SEQ ID NO: 2309813 - protein, 18 aa, Cryptosporidium parvum
RWAFRSLYKFAFGDIAYA

SEQ ID NO: 2309814 - protein, 21 aa, Cryptosporidium parvum
RWPAIKTWIYVCNQIKVDPRS

SEQ ID NO: 2309815 - protein, 22 aa, Cryptosporidium parvum
RWRKFFPCLKKNINYDVNTINN

SEQ ID NO: 2309816 - protein, 21 aa, Cryptosporidium parvum
RYALEICQWLDGILKDESVDE

SEQ ID NO: 2309817 - protein, 20 aa, Cryptosporidium parvum
RYDLIFKDILLRDMNRMDAM

SEQ ID NO: 2309818 - protein, 24 aa, Cryptosporidium parvum
RYGVHWLLCAFSIKGGAILADEMG

SEQ ID NO: 2309819 - protein, 19 aa, Cryptosporidium parvum
RYIPVVSIVLVLKSGKESK

SEQ ID NO: 2309820 - protein, 17 aa, Cryptosporidium parvum
RYISLKFLAKFVLNKNI

SEQ ID NO: 2309821 - protein, 18 aa, Cryptosporidium parvum
RYRIEGIPVNYNLTNKAQ

SEQ ID NO: 2309822 - protein, 22 aa, Cryptosporidium parvum
RYRLAMYFYEFLKSIKMLTEKG

SEQ ID NO: 2309823 - protein, 17 aa, Cryptosporidium parvum
SAFVWIIGEVYEFVQVT

SEQ ID NO: 2309824 - protein, 19 aa, Cryptosporidium parvum
SAGGLCWSDRICDMNTQFL

SEQ ID NO: 2309825 - protein, 26 aa, Cryptosporidium parvum
SAGQRVLACIIIRLALAESFCVNCGI

SEQ ID NO: 2309826 - protein, 19 aa, Cryptosporidium parvum
SALFKALILYSLKNKEYMN

SEQ ID NO: 2309827 - protein, 22 aa, Cryptosporidium parvum
SAPILSRFDLFFVMIDDPEDVY

SEQ ID NO: 2309828 - protein, 19 aa, Cryptosporidium parvum
SAVSLKFKYEEEIKLEVED

SEQ ID NO: 2309829 - protein, 21 aa, Cryptosporidium parvum
SCDAWAIGICLYEFLCGCLPF

SEQ ID NO: 2309830 - protein, 21 aa, Cryptosporidium parvum
SCGASACRDCVKNYLEQNKAV

SEQ ID NO: 2309831 - protein, 18 aa, Cryptosporidium parvum
SCLKRNWRIEFWSNFMTN

SEQ ID NO: 2309832 - protein, 19 aa, Cryptosporidium parvum
SCLMKRFGIPEVPIITLFA

SEQ ID NO: 2309833 - protein, 18 aa, Cryptosporidium parvum
SCNWKWNGILYMEHKYGD

SEQ ID NO: 2309834 - protein, 18 aa, Cryptosporidium parvum
SCNYMLICETCIIIDGHG

SEQ ID NO: 2309835 - protein, 17 aa, Cryptosporidium parvum
SCPDLKGAVPLRGEIQN

SEQ ID NO: 2309836 - protein, 20 aa, Cryptosporidium parvum
SCSCSCPLVTFSSSNSFLIQ

SEQ ID NO: 2309837 - protein, 18 aa, Cryptosporidium parvum
SCSSELDIEIVLMKQDQS

SEQ ID NO: 2309838 - protein, 19 aa, Cryptosporidium parvum
SCTLYVCRLSLKTKEDDLR

SEQ ID NO: 2309839 - protein, 18 aa, Cryptosporidium parvum
SCTMWRVRVKELIKDVIQ

SEQ ID NO: 2309840 - protein, 20 aa, Cryptosporidium parvum
SCWCISRFTPWLALQQGQPI

SEQ ID NO: 2309841 - protein, 20 aa, Cryptosporidium parvum
SDDVLTFSIGWRRFQSIPLY

SEQ ID NO: 2309842 - protein, 20 aa, Cryptosporidium parvum
SDEIPLCIVLKAMGIETEQE

SEQ ID NO: 2309843 - protein, 19 aa, Cryptosporidium parvum
SDENFTFWLSLTSDKDQSC

SEQ ID NO: 2309844 - protein, 18 aa, Cryptosporidium parvum
SDGALIWCHHPNDTVYCE

SEQ ID NO: 2309845 - protein, 18 aa, Cryptosporidium parvum
SDIDYCFNLSLKSMLKIL

SEQ ID NO: 2309846 - protein, 17 aa, Cryptosporidium parvum
SDILFFWVARMVMLSFA

SEQ ID NO: 2309847 - protein, 22 aa, Cryptosporidium parvum
SDKKLICIIPRYSIIPKETLAF

SEQ ID NO: 2309848 - protein, 17 aa, Cryptosporidium parvum
SDKPCTRFRGFVFDIVH

SEQ ID NO: 2309849 - protein, 18 aa, Cryptosporidium parvum
SDLCRRYHRAGLWDSSCP

SEQ ID NO: 2309850 - protein, 17 aa, Cryptosporidium parvum
SDLRFKNILMRITNKRV

SEQ ID NO: 2309851 - protein, 19 aa, Cryptosporidium parvum
SDLWIRYHVISSIARNGHP

SEQ ID NO: 2309852 - protein, 22 aa, Cryptosporidium parvum
SDPRSGFIWQRMYKLRLMVYNT

SEQ ID NO: 2309853 - protein, 19 aa, Cryptosporidium parvum
SDRNCMQCFALLHAHAQTN

SEQ ID NO: 2309854 - protein, 22 aa, Cryptosporidium parvum
SDSLRFPVPIKKLLFALELVQH

SEQ ID NO: 2309855 - protein, 23 aa, Cryptosporidium parvum
SDSRSDKLLNMWISEINGDTRDS

SEQ ID NO: 2309856 - protein, 24 aa, Cryptosporidium parvum
SDYRIPFILLFDTWETFKFAKNLE

SEQ ID NO: 2309857 - protein, 18 aa, Cryptosporidium parvum
SEACPRLVELLGHPSPLV

SEQ ID NO: 2309858 - protein, 17 aa, Cryptosporidium parvum
SEAFQLYSTYGFPMDLT

SEQ ID NO: 2309859 - protein, 23 aa, Cryptosporidium parvum
SECLPCKIPFLFNISKVIVPHFN

SEQ ID NO: 2309860 - protein, 24 aa, Cryptosporidium parvum
SEENCFFRRLLLLIPFSLSLLKSV

SEQ ID NO: 2309861 - protein, 19 aa, Cryptosporidium parvum
SEFILSLMIERIVQKIEHI

SEQ ID NO: 2309862 - protein, 21 aa, Cryptosporidium parvum
SEFRYWFKIYIKFSLDSLDLE

SEQ ID NO: 2309863 - protein, 19 aa, Cryptosporidium parvum
SEIDSGCLLSSRYISRLVP

SEQ ID NO: 2309864 - protein, 21 aa, Cryptosporidium parvum
SEIIQRWVVICSKLIEQSSLL

SEQ ID NO: 2309865 - protein, 18 aa, Cryptosporidium parvum
SEIIWKYHLNEEILFLTV

SEQ ID NO: 2309866 - protein, 17 aa, Cryptosporidium parvum
SEIYRGLVRLNFGLDQR

SEQ ID NO: 2309867 - protein, 18 aa, Cryptosporidium parvum
SEKGFPFLNFQYNNIEET

SEQ ID NO: 2309868 - protein, 20 aa, Cryptosporidium parvum
SEKKCCIRPLIAPYDNQTTV

SEQ ID NO: 2309869 - protein, 19 aa, Cryptosporidium parvum
SELIARYAILSKLILDSGI

SEQ ID NO: 2309870 - protein, 17 aa, Cryptosporidium parvum
SELLKHIFIEGSPDHIP

SEQ ID NO: 2309871 - protein, 22 aa, Cryptosporidium parvum
SELRKSNDLVIINSLNFSELSS

SEQ ID NO: 2309872 - protein, 21 aa, Cryptosporidium parvum
SELRYGISMWSGCTAAVCVRI

SEQ ID NO: 2309873 - protein, 19 aa, Cryptosporidium parvum
SELWKIRFGIEVDIIQLFK

SEQ ID NO: 2309874 - protein, 18 aa, Cryptosporidium parvum
SEMNLLFPGEEEGDWKEL

SEQ ID NO: 2309875 - protein, 19 aa, Cryptosporidium parvum
SEMTFAFKVLKSFRGKLRL

SEQ ID NO: 2309876 - protein, 17 aa, Cryptosporidium parvum
SENEFWHFLSLGAIFLK

SEQ ID NO: 2309877 - protein, 21 aa, Cryptosporidium parvum
SENKGAMILNCFSKFSRKFQN

SEQ ID NO: 2309878 - protein, 25 aa, Cryptosporidium parvum
SERLHLSYKLKFLIEKNAHLNCSIN

SEQ ID NO: 2309879 - protein, 17 aa, Cryptosporidium parvum
SESLARMELSEWVKKSH

SEQ ID NO: 2309880 - protein, 21 aa, Cryptosporidium parvum
SESSFKFGRIIDSTLSIPSTA

SEQ ID NO: 2309881 - protein, 22 aa, Cryptosporidium parvum
SEVPALLAIACELFVRDLTSFS

SEQ ID NO: 2309882 - protein, 25 aa, Cryptosporidium parvum
SEYICKLCGFPLLNPVLIKCAGSCG

SEQ ID NO: 2309883 - protein, 18 aa, Cryptosporidium parvum
SFCLPNWFSSSKISKESY

SEQ ID NO: 2309884 - protein, 18 aa, Cryptosporidium parvum
SFEILRFFLLDLFQISKK

SEQ ID NO: 2309885 - protein, 18 aa, Cryptosporidium parvum
SFFNGCGVVKRVSIPRYS

SEQ ID NO: 2309886 - protein, 19 aa, Cryptosporidium parvum
SFFYIKCCTISKMNKFLNY

SEQ ID NO: 2309887 - protein, 17 aa, Cryptosporidium parvum
SFLDIIYSFAIKDEDIM

SEQ ID NO: 2309888 - protein, 18 aa, Cryptosporidium parvum
SFLRLSSMDSTTCTTIQN

SEQ ID NO: 2309889 - protein, 25 aa, Cryptosporidium parvum
SFLRYEGWLYIRLAQLVMIYDFKFR

SEQ ID NO: 2309890 - protein, 17 aa, Cryptosporidium parvum
SGFEHIPAVLTHAAVLC

SEQ ID NO: 2309891 - protein, 19 aa, Cryptosporidium parvum
SGITHGWVAVWRLRESLES

SEQ ID NO: 2309892 - protein, 20 aa, Cryptosporidium parvum
SGKYKWAWTIGDYRLVSDMI

SEQ ID NO: 2309893 - protein, 18 aa, Cryptosporidium parvum
SGLHGWAFTIEKFARIYA

SEQ ID NO: 2309894 - protein, 24 aa, Cryptosporidium parvum
SGNVLKCLICIGGGNINKTFDYIK

SEQ ID NO: 2309895 - protein, 19 aa, Cryptosporidium parvum
SGRQLFKLVLGMKSIVLGS

SEQ ID NO: 2309896 - protein, 23 aa, Cryptosporidium parvum
SGSVLKAQILWRGKLARRQFQKL

SEQ ID NO: 2309897 - protein, 25 aa, Cryptosporidium parvum
SGVSFNFKSFCFMKFVTSIVGDSSS

SEQ ID NO: 2309898 - protein, 19 aa, Cryptosporidium parvum
SGVWPFGRIGLLNQSQDSS

SEQ ID NO: 2309899 - protein, 23 aa, Cryptosporidium parvum
SHGCLMCLTCSGVHRGLGVHISF

SEQ ID NO: 2309900 - protein, 25 aa, Cryptosporidium parvum
SHISKWIRDEYRFNNPMFLIPKKVK

SEQ ID NO: 2309901 - protein, 19 aa, Cryptosporidium parvum
SHSKGVCSKALLLFQQNYQ

SEQ ID NO: 2309902 - protein, 17 aa, Cryptosporidium parvum
SICCIEFWNTIADLEIE

SEQ ID NO: 2309903 - protein, 17 aa, Cryptosporidium parvum
SIDGWKVLVDVERGRTV

SEQ ID NO: 2309904 - protein, 20 aa, Cryptosporidium parvum
SIHFEMFFIPPFPADVVIPA

SEQ ID NO: 2309905 - protein, 20 aa, Cryptosporidium parvum
SIHYRWSRGPSRAVCTFHPS

SEQ ID NO: 2309906 - protein, 17 aa, Cryptosporidium parvum
SIISRFIPRFILSLSSC

SEQ ID NO: 2309907 - protein, 23 aa, Cryptosporidium parvum
SINKKRKIAFCLDNDLDTKELKL

SEQ ID NO: 2309908 - protein, 18 aa, Cryptosporidium parvum
SINTRIVPFISNYYSLLG

SEQ ID NO: 2309909 - protein, 20 aa, Cryptosporidium parvum
SISTIGYWSIIDGFSSSLIK

SEQ ID NO: 2309910 - protein, 18 aa, Cryptosporidium parvum
SITPRFSLEESLNYRRSS

SEQ ID NO: 2309911 - protein, 23 aa, Cryptosporidium parvum
SIVGTRCVVVWIGIRDCLSQESL

SEQ ID NO: 2309912 - protein, 18 aa, Cryptosporidium parvum
SIVPRTGGALGFAQMVPN

SEQ ID NO: 2309913 - protein, 19 aa, Cryptosporidium parvum
SIVRWSCRLLNISNFRNIP

SEQ ID NO: 2309914 - protein, 22 aa, Cryptosporidium parvum
SIYLKLLFKISILFGVNQHISD

SEQ ID NO: 2309915 - protein, 25 aa, Cryptosporidium parvum
SKEMIKWLGCLPIESMIDVYGTIVV

SEQ ID NO: 2309916 - protein, 17 aa, Cryptosporidium parvum
SKFSATIPVASTIGENV

SEQ ID NO: 2309917 - protein, 18 aa, Cryptosporidium parvum
SKGKYCVFSSLFYTILSM

SEQ ID NO: 2309918 - protein, 19 aa, Cryptosporidium parvum
SKLSRLSFRGDKESKGLDK

SEQ ID NO: 2309919 - protein, 20 aa, Cryptosporidium parvum
SKMLISFPFFLKYYLSVLTT

SEQ ID NO: 2309920 - protein, 17 aa, Cryptosporidium parvum
SKMSIIICLLKNSKIAI

SEQ ID NO: 2309921 - protein, 17 aa, Cryptosporidium parvum
SKRSSFENVERWLKELR

SEQ ID NO: 2309922 - protein, 22 aa, Cryptosporidium parvum
SKRYVCSGIRVLSGCLNNPYTR

SEQ ID NO: 2309923 - protein, 19 aa, Cryptosporidium parvum
SKSAFSVAIRFRPAVCSEI

SEQ ID NO: 2309924 - protein, 24 aa, Cryptosporidium parvum
SKSMCLKCVESLYGILNISLKQSR

SEQ ID NO: 2309925 - protein, 23 aa, Cryptosporidium parvum
SKVFPYPICFVSKSLPTPPKDYN

SEQ ID NO: 2309926 - protein, 25 aa, Cryptosporidium parvum
SKYCLLKNKYLFLGIEFLHETLGKI

SEQ ID NO: 2309927 - protein, 21 aa, Cryptosporidium parvum
SKYLGCSIIRKSLYKVRKQIK

SEQ ID NO: 2309928 - protein, 20 aa, Cryptosporidium parvum
SLCNDFRKANNFQNVGNNNF

SEQ ID NO: 2309929 - protein, 17 aa, Cryptosporidium parvum
SLDSFAFPITSEKGKKQ

SEQ ID NO: 2309930 - protein, 17 aa, Cryptosporidium parvum
SLFCFECITTLKKTQFK

SEQ ID NO: 2309931 - protein, 18 aa, Cryptosporidium parvum
SLINWKFSDGCIVSITDF

SEQ ID NO: 2309932 - protein, 17 aa, Cryptosporidium parvum
SLIPSYIRDSSVAVVVY

SEQ ID NO: 2309933 - protein, 18 aa, Cryptosporidium parvum
SLKNCLRNLLLSQITSDE

SEQ ID NO: 2309934 - protein, 17 aa, Cryptosporidium parvum
SLLKLSFGYGWNLLHIF

SEQ ID NO: 2309935 - protein, 23 aa, Cryptosporidium parvum
SLLRISSPFLWHFFQNGGNVHDL

SEQ ID NO: 2309936 - protein, 19 aa, Cryptosporidium parvum
SLQRFCAGLNFILQGKVII

SEQ ID NO: 2309937 - protein, 17 aa, Cryptosporidium parvum
SLQSFLIKYLDPIAIIS

SEQ ID NO: 2309938 - protein, 22 aa, Cryptosporidium parvum
SLTPYVLGLRVFKLINSNKKQV

SEQ ID NO: 2309939 - protein, 27 aa, Cryptosporidium parvum
SLWFDALRHLLKWTLQWDPSNRPNVNQ

SEQ ID NO: 2309940 - protein, 17 aa, Cryptosporidium parvum
SLYKFLLPREEFSQEFK

SEQ ID NO: 2309941 - protein, 23 aa, Cryptosporidium parvum
SMLEKRIGPVFSRNINGEKSDGT

SEQ ID NO: 2309942 - protein, 18 aa, Cryptosporidium parvum
SMPICLNEPLSFIQRLSE

SEQ ID NO: 2309943 - protein, 17 aa, Cryptosporidium parvum
SNASFSYFSFQLNNSGY

SEQ ID NO: 2309944 - protein, 17 aa, Cryptosporidium parvum
SNEGFAIAINRNNDEAI

SEQ ID NO: 2309945 - protein, 17 aa, Cryptosporidium parvum
SNEILPWSKGIISIDGL

SEQ ID NO: 2309946 - protein, 21 aa, Cryptosporidium parvum
SNGIYPWVWCDLVTDQDTATP

SEQ ID NO: 2309947 - protein, 22 aa, Cryptosporidium parvum
SNGPKGCAFVRFSNIYEAQNAI

SEQ ID NO: 2309948 - protein, 17 aa, Cryptosporidium parvum
SNICVECGFILEGKSEF

SEQ ID NO: 2309949 - protein, 22 aa, Cryptosporidium parvum
SNIFCPYPFRFGDSSEYGTMIV

SEQ ID NO: 2309950 - protein, 19 aa, Cryptosporidium parvum
SNLLRWTQRYGYQGTDEFS

SEQ ID NO: 2309951 - protein, 19 aa, Cryptosporidium parvum
SNNVFMFPIPIWKSPTQKK

SEQ ID NO: 2309952 - protein, 17 aa, Cryptosporidium parvum
SNPKLISMMGVRNEGSI

SEQ ID NO: 2309953 - protein, 25 aa, Cryptosporidium parvum
SNQKRISNAFAMVGGIDFHEFNNNL

SEQ ID NO: 2309954 - protein, 18 aa, Cryptosporidium parvum
SNSLVGLYAEWVDKNTIW

SEQ ID NO: 2309955 - protein, 22 aa, Cryptosporidium parvum
SNYTPRLAFRGSVAPNSYYTVN

SEQ ID NO: 2309956 - protein, 18 aa, Cryptosporidium parvum
SPELLALVVRHIYSQDQQ

SEQ ID NO: 2309957 - protein, 24 aa, Cryptosporidium parvum
SPLILEKFHPIWIRKIIDERRNLV

SEQ ID NO: 2309958 - protein, 18 aa, Cryptosporidium parvum
SPNNCWRMYCSECIMHNF

SEQ ID NO: 2309959 - protein, 17 aa, Cryptosporidium parvum
SPPICTIMTDCSGVIKT

SEQ ID NO: 2309960 - protein, 19 aa, Cryptosporidium parvum
SQEKIKFECCFTDHIFSKM

SEQ ID NO: 2309961 - protein, 24 aa, Cryptosporidium parvum
SQFDKLRLALLYSLKYEKEEIQIN

SEQ ID NO: 2309962 - protein, 18 aa, Cryptosporidium parvum
SQFRRLGCSLDWSREFFT

SEQ ID NO: 2309963 - protein, 21 aa, Cryptosporidium parvum
SQKCWKYLFGHTGDLLKGQES

SEQ ID NO: 2309964 - protein, 19 aa, Cryptosporidium parvum
SQKLPSFGFENRFQDNIKG

SEQ ID NO: 2309965 - protein, 19 aa, Cryptosporidium parvum
SQLCDSCTFIFLYDKNTKQ

SEQ ID NO: 2309966 - protein, 21 aa, Cryptosporidium parvum
SQSFPLCIFKSNIITSKNHPL

SEQ ID NO: 2309967 - protein, 17 aa, Cryptosporidium parvum
SREVLFFTSGFKNVQTQ

SEQ ID NO: 2309968 - protein, 17 aa, Cryptosporidium parvum
SRFLSWRSKDYTEKEKE

SEQ ID NO: 2309969 - protein, 19 aa, Cryptosporidium parvum
SRICLFCKGFKRPIQHISK

SEQ ID NO: 2309970 - protein, 23 aa, Cryptosporidium parvum
SRISKRFSNLLGRRPSKTYSDVQ

SEQ ID NO: 2309971 - protein, 19 aa, Cryptosporidium parvum
SRKAYFIGYMVHKLCLGAL

SEQ ID NO: 2309972 - protein, 24 aa, Cryptosporidium parvum
SRKILARVRELWLSNIVEGLPRKI

SEQ ID NO: 2309973 - protein, 18 aa, Cryptosporidium parvum
SRLFPPTRQGYPWSKWAA

SEQ ID NO: 2309974 - protein, 18 aa, Cryptosporidium parvum
SRLRIAIVEADRCKPKNC

SEQ ID NO: 2309975 - protein, 21 aa, Cryptosporidium parvum
SRPFEYLRLTSLGVIGALVKV

SEQ ID NO: 2309976 - protein, 21 aa, Cryptosporidium parvum
SRSNLRLPPKVPGISSNNAFK

SEQ ID NO: 2309977 - protein, 19 aa, Cryptosporidium parvum
SRTIIICNCSPDRVNYYET

SEQ ID NO: 2309978 - protein, 21 aa, Cryptosporidium parvum
SRTSLALPEFLVEDIPLPKVC

SEQ ID NO: 2309979 - protein, 20 aa, Cryptosporidium parvum
SRVYSSICIDQFLKNICPND

SEQ ID NO: 2309980 - protein, 20 aa, Cryptosporidium parvum
SRYFGEWAIIKGFDERTSNV

SEQ ID NO: 2309981 - protein, 19 aa, Cryptosporidium parvum
SSCEIYLRRMHGLENELQI

SEQ ID NO: 2309982 - protein, 20 aa, Cryptosporidium parvum
SSDESLFCFIWKNILIIWNT

SEQ ID NO: 2309983 - protein, 23 aa, Cryptosporidium parvum
SSEFKGVIFAGGSGRMLGPLAKN

SEQ ID NO: 2309984 - protein, 17 aa, Cryptosporidium parvum
SSFSILNILLSRWSGIP

SEQ ID NO: 2309985 - protein, 17 aa, Cryptosporidium parvum
SSFWGWFGYSTTPENPK

SEQ ID NO: 2309986 - protein, 17 aa, Cryptosporidium parvum
SSGGCWIALGGSNGLIT

SEQ ID NO: 2309987 - protein, 19 aa, Cryptosporidium parvum
SSHCFYCKHLIYVMRAGAI

SEQ ID NO: 2309988 - protein, 17 aa, Cryptosporidium parvum
SSIKVGKLFLVDLAGSE

SEQ ID NO: 2309989 - protein, 17 aa, Cryptosporidium parvum
SSISFAPVRFGSMSISD

SEQ ID NO: 2309990 - protein, 19 aa, Cryptosporidium parvum
SSIYLSLETEFCRKIDNSS

SEQ ID NO: 2309991 - protein, 27 aa, Cryptosporidium parvum
SSKYKWLFRWLPYYYKFGMGYQISKVI

SEQ ID NO: 2309992 - protein, 22 aa, Cryptosporidium parvum
SSLHKLKGFFLILVQTELGDIY

SEQ ID NO: 2309993 - protein, 17 aa, Cryptosporidium parvum
SSLWKSLAIYLIGALEI

SEQ ID NO: 2309994 - protein, 21 aa, Cryptosporidium parvum
SSRRLLVFNVEYNKEYGKDTL

SEQ ID NO: 2309995 - protein, 23 aa, Cryptosporidium parvum
SSSEFKASLYIEYGQLKVGQSYH

SEQ ID NO: 2309996 - protein, 18 aa, Cryptosporidium parvum
SSWPEGLIQLRYIGIENF

SEQ ID NO: 2309997 - protein, 24 aa, Cryptosporidium parvum
STCTSLRVSSCFKRMELIVWNYND

SEQ ID NO: 2309998 - protein, 18 aa, Cryptosporidium parvum
STGNHFKPINGFVFDKTG

SEQ ID NO: 2309999 - protein, 24 aa, Cryptosporidium parvum
STNPQLWCKISFIDLAGSERASAT

SEQ ID NO: 2310000 - protein, 19 aa, Cryptosporidium parvum
STQFCNECCKFIFNTLHQC

SEQ ID NO: 2310001 - protein, 18 aa, Cryptosporidium parvum
STWSRIFSPLSFGFDKRE

SEQ ID NO: 2310002 - protein, 19 aa, Cryptosporidium parvum
SVCAINCWGLFASNLISFQ

SEQ ID NO: 2310003 - protein, 19 aa, Cryptosporidium parvum
SVEVCIRSDINLIQNESDS

SEQ ID NO: 2310004 - protein, 18 aa, Cryptosporidium parvum
SVHLTKDRIEFMLEHPKF

SEQ ID NO: 2310005 - protein, 19 aa, Cryptosporidium parvum
SVIFRRFLEDLARNSHLGG

SEQ ID NO: 2310006 - protein, 17 aa, Cryptosporidium parvum
SVIIRWSNRMTLCAGKC

SEQ ID NO: 2310007 - protein, 18 aa, Cryptosporidium parvum
SVILGFRYANFMLLIDSV

SEQ ID NO: 2310008 - protein, 25 aa, Cryptosporidium parvum
SVLSDKGCAFITFEQEEGAKSAIQW

SEQ ID NO: 2310009 - protein, 19 aa, Cryptosporidium parvum
SVRRKNCIKNYLVSSDTEI

SEQ ID NO: 2310010 - protein, 25 aa, Cryptosporidium parvum
SVVDPRTGRQLKVWDVAKSFSDSIS

SEQ ID NO: 2310011 - protein, 19 aa, Cryptosporidium parvum
SWAPECFGQLFVAGTTQKN

SEQ ID NO: 2310012 - protein, 27 aa, Cryptosporidium parvum
SWGHKLRWVKIFKCEMHYFLSPKESNI

SEQ ID NO: 2310013 - protein, 22 aa, Cryptosporidium parvum
SWKYRLQRHSILLNDTRRKLFN

SEQ ID NO: 2310014 - protein, 25 aa, Cryptosporidium parvum
SWNSRMEAWLAFFVENGVRKSKTFS

SEQ ID NO: 2310015 - protein, 19 aa, Cryptosporidium parvum
SWPEFSKLLAHLVESPHYS

SEQ ID NO: 2310016 - protein, 18 aa, Cryptosporidium parvum
SWPLCPYGPGCFFIHPTV

SEQ ID NO: 2310017 - protein, 19 aa, Cryptosporidium parvum
SWRCWKANLPWKVHGMPPA

SEQ ID NO: 2310018 - protein, 21 aa, Cryptosporidium parvum
SWRFKLLKRRQISWSDISHPI

SEQ ID NO: 2310019 - protein, 17 aa, Cryptosporidium parvum
SYDYPLLLVPIISSMSN

SEQ ID NO: 2310020 - protein, 17 aa, Cryptosporidium parvum
SYIYKLWAVVCHSGNTL

SEQ ID NO: 2310021 - protein, 19 aa, Cryptosporidium parvum
SYLGIPIWRFYGRCTQCGN

SEQ ID NO: 2310022 - protein, 18 aa, Cryptosporidium parvum
SYLTWGIMHVIREIKHSS

SEQ ID NO: 2310023 - protein, 20 aa, Cryptosporidium parvum
SYQAYECWLCVREFANVLIH

SEQ ID NO: 2310024 - protein, 18 aa, Cryptosporidium parvum
SYRFPNNGPLCFTIPEFS

SEQ ID NO: 2310025 - protein, 17 aa, Cryptosporidium parvum
TAAVCVRIFNEAHIAWV

SEQ ID NO: 2310026 - protein, 19 aa, Cryptosporidium parvum
TAFGKFYFSITIKYHNLHN

SEQ ID NO: 2310027 - protein, 17 aa, Cryptosporidium parvum
TAFKGFQKRFFKLNLTD

SEQ ID NO: 2310028 - protein, 22 aa, Cryptosporidium parvum
TALQRWDFRICGVYCLDVGFLT

SEQ ID NO: 2310029 - protein, 22 aa, Cryptosporidium parvum
TARIPINTGYNFKVIPQNDNSS

SEQ ID NO: 2310030 - protein, 23 aa, Cryptosporidium parvum
TASYRLLPEFGFPNGPISGSDAL

SEQ ID NO: 2310031 - protein, 17 aa, Cryptosporidium parvum
TCCPIVFHISPSEEKDR

SEQ ID NO: 2310032 - protein, 17 aa, Cryptosporidium parvum
TCFSHAFNKLFLASSKG

SEQ ID NO: 2310033 - protein, 19 aa, Cryptosporidium parvum
TCKEFKFLLVRNEEKIELE

SEQ ID NO: 2310034 - protein, 22 aa, Cryptosporidium parvum
TCPLCRVPCSVFTLCDLVNITI

SEQ ID NO: 2310035 - protein, 18 aa, Cryptosporidium parvum
TDALIEIQKWLGLYQNEE

SEQ ID NO: 2310036 - protein, 22 aa, Cryptosporidium parvum
TDEYKHSIGFRMDVSKHLNTDI

SEQ ID NO: 2310037 - protein, 17 aa, Cryptosporidium parvum
TDIPFIWMNVVQRYQIV

SEQ ID NO: 2310038 - protein, 19 aa, Cryptosporidium parvum
TDIPIVFKLIGRLINGIFP

SEQ ID NO: 2310039 - protein, 18 aa, Cryptosporidium parvum
TDLIFSWLELRDGSENLV

SEQ ID NO: 2310040 - protein, 17 aa, Cryptosporidium parvum
TDPLWKHLEVVLSGADV

SEQ ID NO: 2310041 - protein, 17 aa, Cryptosporidium parvum
TDQRIQGLIGRYNSMCM

SEQ ID NO: 2310042 - protein, 17 aa, Cryptosporidium parvum
TEFMKLMVIDEADEMID

SEQ ID NO: 2310043 - protein, 19 aa, Cryptosporidium parvum
TEGNWLFSLFCSINNKLVE

SEQ ID NO: 2310044 - protein, 17 aa, Cryptosporidium parvum
TELFTFKCSLYQRELKL

SEQ ID NO: 2310045 - protein, 17 aa, Cryptosporidium parvum
TELSRFRTRICERKALH

SEQ ID NO: 2310046 - protein, 22 aa, Cryptosporidium parvum
TEQNKMGPFGWFDGKYTIPGWR

SEQ ID NO: 2310047 - protein, 18 aa, Cryptosporidium parvum
TERWDKERVAICGEKGVH

SEQ ID NO: 2310048 - protein, 23 aa, Cryptosporidium parvum
TEVLKRLTILGVLDDAIFDIPNS

SEQ ID NO: 2310049 - protein, 20 aa, Cryptosporidium parvum
TEYLCGSYVKVPIINPSTNS

SEQ ID NO: 2310050 - protein, 23 aa, Cryptosporidium parvum
TFIKEAFCAPSFAPPKSDIFSIN

SEQ ID NO: 2310051 - protein, 23 aa, Cryptosporidium parvum
TFKSMECKKCGYEWKKINVENDY

SEQ ID NO: 2310052 - protein, 22 aa, Cryptosporidium parvum
TFYKNRWEIVLSNIQYLSLFSP

SEQ ID NO: 2310053 - protein, 17 aa, Cryptosporidium parvum
TGPFFSIFYQLAHGLIL

SEQ ID NO: 2310054 - protein, 17 aa, Cryptosporidium parvum
TGYAITFFTLRDIPKIK

SEQ ID NO: 2310055 - protein, 17 aa, Cryptosporidium parvum
TGYYYCDYCYGSNTCSI

SEQ ID NO: 2310056 - protein, 21 aa, Cryptosporidium parvum
THCNKCIKFGLSLDQIQIHDK

SEQ ID NO: 2310057 - protein, 18 aa, Cryptosporidium parvum
THGWTDYQLRCNLAVAIG

SEQ ID NO: 2310058 - protein, 23 aa, Cryptosporidium parvum
TIDYKIWLAKCIDLSQMDEDDKK

SEQ ID NO: 2310059 - protein, 18 aa, Cryptosporidium parvum
TIEITLAAAIGCRQNVVA

SEQ ID NO: 2310060 - protein, 24 aa, Cryptosporidium parvum
TIEYRDGMKLSLGVDGRKLLLKRI

SEQ ID NO: 2310061 - protein, 26 aa, Cryptosporidium parvum
TIGEWYRQANIMKRCNSYSCENFSVT

SEQ ID NO: 2310062 - protein, 18 aa, Cryptosporidium parvum
TIKCKACPTVNYMIDIEA

SEQ ID NO: 2310063 - protein, 17 aa, Cryptosporidium parvum
TIPSVILSPSFKMIFHD

SEQ ID NO: 2310064 - protein, 23 aa, Cryptosporidium parvum
TISSSSFLFWLVNNCLKFETRKI

SEQ ID NO: 2310065 - protein, 24 aa, Cryptosporidium parvum
TIVKRFSVSWMYKSGFLHIPIHSI

SEQ ID NO: 2310066 - protein, 24 aa, Cryptosporidium parvum
TIYMAYYTICHFFHSDFEGRSKGL

SEQ ID NO: 2310067 - protein, 24 aa, Cryptosporidium parvum
TKARFKVCKHVSCYHCLRKALHVE

SEQ ID NO: 2310068 - protein, 18 aa, Cryptosporidium parvum
TKCPVCLIYLISPNHLAK

SEQ ID NO: 2310069 - protein, 20 aa, Cryptosporidium parvum
TKCQETMRGAGYETSIQGQD

SEQ ID NO: 2310070 - protein, 21 aa, Cryptosporidium parvum
TKFKACRVFKDAITPISNMDW

SEQ ID NO: 2310071 - protein, 26 aa, Cryptosporidium parvum
TKGNYLRFGFNVPRTDLLPISISFFD

SEQ ID NO: 2310072 - protein, 23 aa, Cryptosporidium parvum
TKKKSKVCGINWTCDGNKLVYSA

SEQ ID NO: 2310073 - protein, 20 aa, Cryptosporidium parvum
TKLFILELMAKINKQLNDSG

SEQ ID NO: 2310074 - protein, 18 aa, Cryptosporidium parvum
TKLKPCYLCYSSSTISNQ

SEQ ID NO: 2310075 - protein, 17 aa, Cryptosporidium parvum
TKLKSFCILLDYDSVII

SEQ ID NO: 2310076 - protein, 22 aa, Cryptosporidium parvum
TKPIEVFLIFSLNAIKSVIADL

SEQ ID NO: 2310077 - protein, 22 aa, Cryptosporidium parvum
TKVDVFCLGWMLLFTLTKYQPF

SEQ ID NO: 2310078 - protein, 24 aa, Cryptosporidium parvum
TLAFCRRWLDQLGFNKHALALKSL

SEQ ID NO: 2310079 - protein, 18 aa, Cryptosporidium parvum
TLFKYSSWVGGDRDGNPY

SEQ ID NO: 2310080 - protein, 21 aa, Cryptosporidium parvum
TLHPFGCKFYFNLSLDINKNL

SEQ ID NO: 2310081 - protein, 24 aa, Cryptosporidium parvum
TLRAIPWVFAWTQIRSHLPVWLGL

SEQ ID NO: 2310082 - protein, 21 aa, Cryptosporidium parvum
TLSLSCLKWLLLSDPDNNISI

SEQ ID NO: 2310083 - protein, 19 aa, Cryptosporidium parvum
TLVNLWLTAYFEKRIKKKQ

SEQ ID NO: 2310084 - protein, 23 aa, Cryptosporidium parvum
TNDFKGNMFKLGYDKIVSTISSA

SEQ ID NO: 2310085 - protein, 24 aa, Cryptosporidium parvum
TNGFSKWQVCRSFLATLMLSNNRE

SEQ ID NO: 2310086 - protein, 18 aa, Cryptosporidium parvum
TNMLKMYLKQRIMKISEF

SEQ ID NO: 2310087 - protein, 19 aa, Cryptosporidium parvum
TNPDLKCTLWRSSQPKSAF

SEQ ID NO: 2310088 - protein, 21 aa, Cryptosporidium parvum
TNRFSTLLSRIWTMNKYILLK

SEQ ID NO: 2310089 - protein, 17 aa, Cryptosporidium parvum
TNRLALLGLDWDNITAD

SEQ ID NO: 2310090 - protein, 22 aa, Cryptosporidium parvum
TNVNACMDISGYVSDLSLKNVT

SEQ ID NO: 2310091 - protein, 18 aa, Cryptosporidium parvum
TQCSICLENMKLTSLSSS

SEQ ID NO: 2310092 - protein, 18 aa, Cryptosporidium parvum
TQDYKEWLESTLLPAPNA

SEQ ID NO: 2310093 - protein, 23 aa, Cryptosporidium parvum
TQVEFLTGMLIFRPYNIKEKNSP

SEQ ID NO: 2310094 - protein, 17 aa, Cryptosporidium parvum
TRFDCLKELLLVCKNSS

SEQ ID NO: 2310095 - protein, 17 aa, Cryptosporidium parvum
TRFLPILPTSPRKEMYE

SEQ ID NO: 2310096 - protein, 18 aa, Cryptosporidium parvum
TRIYRWYLFYKHIILPLR

SEQ ID NO: 2310097 - protein, 21 aa, Cryptosporidium parvum
TRKGKCLLPVFAIGRAQELLL

SEQ ID NO: 2310098 - protein, 20 aa, Cryptosporidium parvum
TRKRLVILLQTFGDKMTEDE

SEQ ID NO: 2310099 - protein, 18 aa, Cryptosporidium parvum
TRLMISHLFIWRQRNSMF

SEQ ID NO: 2310100 - protein, 17 aa, Cryptosporidium parvum
TRLNCLIQDVFDLRKHK

SEQ ID NO: 2310101 - protein, 22 aa, Cryptosporidium parvum
TRLQEMWDRVVAGESIINGGKI

SEQ ID NO: 2310102 - protein, 20 aa, Cryptosporidium parvum
TRLSLITAFHGAWFCKEATI

SEQ ID NO: 2310103 - protein, 22 aa, Cryptosporidium parvum
TRLTEIFSEYGLNGCDIKKKYN

SEQ ID NO: 2310104 - protein, 17 aa, Cryptosporidium parvum
TRTFSWKDLWNLNQAQN

SEQ ID NO: 2310105 - protein, 17 aa, Cryptosporidium parvum
TSCSLIWEGVRPSRIFF

SEQ ID NO: 2310106 - protein, 18 aa, Cryptosporidium parvum
TSEIPNFVSFVGCSLSTT

SEQ ID NO: 2310107 - protein, 17 aa, Cryptosporidium parvum
TSICSYGNYFILIDFKE

SEQ ID NO: 2310108 - protein, 17 aa, Cryptosporidium parvum
TSIPCVLDFLKQRYLVN

SEQ ID NO: 2310109 - protein, 18 aa, Cryptosporidium parvum
TSKFCFCKQPVLDNMIRC

SEQ ID NO: 2310110 - protein, 17 aa, Cryptosporidium parvum
TSKHVWGPINLFYPDVK

SEQ ID NO: 2310111 - protein, 19 aa, Cryptosporidium parvum
TSLPLPIPLIAKNNQFQGT

SEQ ID NO: 2310112 - protein, 24 aa, Cryptosporidium parvum
TSPDYPVRCAFSLLNEYLKTYIDS

SEQ ID NO: 2310113 - protein, 17 aa, Cryptosporidium parvum
TSSGRCQFCGSSKCDRK

SEQ ID NO: 2310114 - protein, 24 aa, Cryptosporidium parvum
TTISNRVSYVFGMRGPSMTVDTAC

SEQ ID NO: 2310115 - protein, 17 aa, Cryptosporidium parvum
TTPELPCYCFVIEASSM

SEQ ID NO: 2310116 - protein, 18 aa, Cryptosporidium parvum
TTPIPLLSPRVFIHDNIV

SEQ ID NO: 2310117 - protein, 24 aa, Cryptosporidium parvum
TTQWAVGLTRVFLKIEAFRDLEQL

SEQ ID NO: 2310118 - protein, 18 aa, Cryptosporidium parvum
TTRSGRFVSLKYGYDDIL

SEQ ID NO: 2310119 - protein, 18 aa, Cryptosporidium parvum
TVGVGARQGGGIGDLQQL

SEQ ID NO: 2310120 - protein, 25 aa, Cryptosporidium parvum
TVVSKPGWGAVRWADLSISDASNSW

SEQ ID NO: 2310121 - protein, 17 aa, Cryptosporidium parvum
TWHDVWSPFLFFEKHKH

SEQ ID NO: 2310122 - protein, 19 aa, Cryptosporidium parvum
TWYRLSIKFHLNILNEIYR

SEQ ID NO: 2310123 - protein, 24 aa, Cryptosporidium parvum
VAAEGLKCGWGFPTGCSLNHCAAH

SEQ ID NO: 2310124 - protein, 18 aa, Cryptosporidium parvum
VAIRFRPAVCSEINEIEN

SEQ ID NO: 2310125 - protein, 17 aa, Cryptosporidium parvum
VAVLDRCVWCIRCYSEG

SEQ ID NO: 2310126 - protein, 23 aa, Cryptosporidium parvum
VCCTTCLKKSFNIIFGINKKFDY

SEQ ID NO: 2310127 - protein, 19 aa, Cryptosporidium parvum
VCENFTLCKSCCRNTNHEH

SEQ ID NO: 2310128 - protein, 18 aa, Cryptosporidium parvum
VCGNELCEFLVNAVEPLK

SEQ ID NO: 2310129 - protein, 18 aa, Cryptosporidium parvum
VCLSWNYKYLISCGEDKV

SEQ ID NO: 2310130 - protein, 18 aa, Cryptosporidium parvum
VCRLRYYQSFNIQLLHND

SEQ ID NO: 2310131 - protein, 22 aa, Cryptosporidium parvum
VCSEGYTGDGFTCRDIDECKVG

SEQ ID NO: 2310132 - protein, 18 aa, Cryptosporidium parvum
VDAALDFRNVSIIATFIK

SEQ ID NO: 2310133 - protein, 24 aa, Cryptosporidium parvum
VDDELRQALLLSIQDFSGNDSTNN

SEQ ID NO: 2310134 - protein, 17 aa, Cryptosporidium parvum
VDFSYKRIQGILATSIL

SEQ ID NO: 2310135 - protein, 17 aa, Cryptosporidium parvum
VDLRWPAIKTWIYVCNQ

SEQ ID NO: 2310136 - protein, 18 aa, Cryptosporidium parvum
VDSLDHWMMLFLQPLGIT

SEQ ID NO: 2310137 - protein, 20 aa, Cryptosporidium parvum
VDSWCLGWSTFYLLFGTELF

SEQ ID NO: 2310138 - protein, 19 aa, Cryptosporidium parvum
VECLCQLIMTTGYYLDSNE

SEQ ID NO: 2310139 - protein, 18 aa, Cryptosporidium parvum
VEECKKRHQSIIHQLVHI

SEQ ID NO: 2310140 - protein, 21 aa, Cryptosporidium parvum
VEELLLWYSYHMEYRSILLDK

SEQ ID NO: 2310141 - protein, 18 aa, Cryptosporidium parvum
VEHIWKSTCFIKLPSKLD

SEQ ID NO: 2310142 - protein, 19 aa, Cryptosporidium parvum
VELLFRYIFHFERNEIRIR

SEQ ID NO: 2310143 - protein, 24 aa, Cryptosporidium parvum
VFCPCRSCLFKGKAHDKLMGHFKI

SEQ ID NO: 2310144 - protein, 18 aa, Cryptosporidium parvum
VFELMALGHKHRAVASTN

SEQ ID NO: 2310145 - protein, 18 aa, Cryptosporidium parvum
VFGRKGDCSIRLKDQSIS

SEQ ID NO: 2310146 - protein, 20 aa, Cryptosporidium parvum
VFWRWLTPRILAIVGDKGIY

SEQ ID NO: 2310147 - protein, 20 aa, Cryptosporidium parvum
VGGCGTVGVGARQGGGIGDL

SEQ ID NO: 2310148 - protein, 18 aa, Cryptosporidium parvum
VGHAFAFAFLQQVVVEPS

SEQ ID NO: 2310149 - protein, 19 aa, Cryptosporidium parvum
VGLIWKYRFYLFRFKAGIP

SEQ ID NO: 2310150 - protein, 17 aa, Cryptosporidium parvum
VGRDYFGVFPLRGKLLN

SEQ ID NO: 2310151 - protein, 21 aa, Cryptosporidium parvum
VGRGRIGGIPVGFILVETRVT

SEQ ID NO: 2310152 - protein, 17 aa, Cryptosporidium parvum
VICLLEISSIGYANSKS

SEQ ID NO: 2310153 - protein, 20 aa, Cryptosporidium parvum
VIFCGPPIYPSIYLDCIQSI

SEQ ID NO: 2310154 - protein, 18 aa, Cryptosporidium parvum
VIHPRILVNVKRVMTGII

SEQ ID NO: 2310155 - protein, 18 aa, Cryptosporidium parvum
VIKKRWAKELSFYENEVN

SEQ ID NO: 2310156 - protein, 19 aa, Cryptosporidium parvum
VIQECFTRRNELMRELDIL

SEQ ID NO: 2310157 - protein, 17 aa, Cryptosporidium parvum
VISCLKEMVELIKLENF

SEQ ID NO: 2310158 - protein, 19 aa, Cryptosporidium parvum
VISVLLFRFGALKNTNILN

SEQ ID NO: 2310159 - protein, 17 aa, Cryptosporidium parvum
VIVGAGYDWSADIWSLG

SEQ ID NO: 2310160 - protein, 17 aa, Cryptosporidium parvum
VIVPGIFDSATLNSVGA

SEQ ID NO: 2310161 - protein, 25 aa, Cryptosporidium parvum
VKAHCPFCQIELDWNRVKPFIVLFK

SEQ ID NO: 2310162 - protein, 20 aa, Cryptosporidium parvum
VKCSIDLTLPIYVYKRNLES

SEQ ID NO: 2310163 - protein, 18 aa, Cryptosporidium parvum
VKDKLNGIVHSFKNCTDY

SEQ ID NO: 2310164 - protein, 19 aa, Cryptosporidium parvum
VKEKVFIVGRLIRYVSKAL

SEQ ID NO: 2310165 - protein, 17 aa, Cryptosporidium parvum
VKICPWLAISNFVDEFV

SEQ ID NO: 2310166 - protein, 19 aa, Cryptosporidium parvum
VKIKLPMRNGNNEGVAIVE

SEQ ID NO: 2310167 - protein, 17 aa, Cryptosporidium parvum
VKIPVCDPLAWGETLGC

SEQ ID NO: 2310168 - protein, 23 aa, Cryptosporidium parvum
VKKLKLLVIDGIEFINSNNSNGS

SEQ ID NO: 2310169 - protein, 19 aa, Cryptosporidium parvum
VKKLLGFLGMPCIDAPSEA

SEQ ID NO: 2310170 - protein, 23 aa, Cryptosporidium parvum
VKNQEIDCGFDFAPVDEYSNIGI

SEQ ID NO: 2310171 - protein, 19 aa, Cryptosporidium parvum
VKPKHFWKLIEPTVVSPAH

SEQ ID NO: 2310172 - protein, 18 aa, Cryptosporidium parvum
VKQWKKGHFFKLFEDSES

SEQ ID NO: 2310173 - protein, 20 aa, Cryptosporidium parvum
VKRIPDGILLFFGSYSLMDQ

SEQ ID NO: 2310174 - protein, 19 aa, Cryptosporidium parvum
VKSLWLRRFHQEITKITNL

SEQ ID NO: 2310175 - protein, 22 aa, Cryptosporidium parvum
VKSRVLWWVWPVKFLIFHLNNK

SEQ ID NO: 2310176 - protein, 22 aa, Cryptosporidium parvum
VKWPIRIIDGFNHILECVSSVN

SEQ ID NO: 2310177 - protein, 17 aa, Cryptosporidium parvum
VLESFTFELFCSIRQHF

SEQ ID NO: 2310178 - protein, 22 aa, Cryptosporidium parvum
VLKGEIKDLLLLDVTPLSLGIE

SEQ ID NO: 2310179 - protein, 20 aa, Cryptosporidium parvum
VLRYYCPFCNGACNCERCLR

SEQ ID NO: 2310180 - protein, 19 aa, Cryptosporidium parvum
VLSGIKWLTSVVNEIDELE

SEQ ID NO: 2310181 - protein, 22 aa, Cryptosporidium parvum
VLSKFGAPVVRRADGEETIEYR

SEQ ID NO: 2310182 - protein, 20 aa, Cryptosporidium parvum
VLSWIYKFLNDFGRLPVNKE

SEQ ID NO: 2310183 - protein, 17 aa, Cryptosporidium parvum
VLWSLPFVLEPILNNLD

SEQ ID NO: 2310184 - protein, 17 aa, Cryptosporidium parvum
VLYLCKILRSMFENKER

SEQ ID NO: 2310185 - protein, 18 aa, Cryptosporidium parvum
VMFWEIVKKLDLKLQKKL

SEQ ID NO: 2310186 - protein, 25 aa, Cryptosporidium parvum
VMHYWKEIPLPFSFTSIINRIRNNY

SEQ ID NO: 2310187 - protein, 23 aa, Cryptosporidium parvum
VMKIQCLIKRYWILAHLDRLFWV

SEQ ID NO: 2310188 - protein, 22 aa, Cryptosporidium parvum
VNFPIELCIISLLIVVKDLVPG

SEQ ID NO: 2310189 - protein, 19 aa, Cryptosporidium parvum
VNLLKQWSSLYGYNNTEGD

SEQ ID NO: 2310190 - protein, 17 aa, Cryptosporidium parvum
VNLLRCRNDIFLQKKNQ

SEQ ID NO: 2310191 - protein, 18 aa, Cryptosporidium parvum
VNNFRFGNSIWKTNKDSK

SEQ ID NO: 2310192 - protein, 22 aa, Cryptosporidium parvum
VNYKCTFWPAQIMEFSKEQFEV

SEQ ID NO: 2310193 - protein, 17 aa, Cryptosporidium parvum
VPCRYGLACYNSLCNYS

SEQ ID NO: 2310194 - protein, 17 aa, Cryptosporidium parvum
VPDSGLIELLPFYSFHI

SEQ ID NO: 2310195 - protein, 25 aa, Cryptosporidium parvum
VPEFIWRKIIHEFAFPINETATVWK

SEQ ID NO: 2310196 - protein, 19 aa, Cryptosporidium parvum
VPESISLPISETVSTTLSA

SEQ ID NO: 2310197 - protein, 17 aa, Cryptosporidium parvum
VPGWGNWCSSVSRIMDL

SEQ ID NO: 2310198 - protein, 19 aa, Cryptosporidium parvum
VPIRIRFLINDVIDSRKNN

SEQ ID NO: 2310199 - protein, 21 aa, Cryptosporidium parvum
VPKNTPGLMGFRVWNPNLNPQ

SEQ ID NO: 2310200 - protein, 28 aa, Cryptosporidium parvum
VPKSGIRLRLEWDRRRYCFKFTVYQIEE

SEQ ID NO: 2310201 - protein, 24 aa, Cryptosporidium parvum
VPLKNGFCSFILEITRLIIVLNPS

SEQ ID NO: 2310202 - protein, 18 aa, Cryptosporidium parvum
VPPAQYILDTSIYSSATP

SEQ ID NO: 2310203 - protein, 21 aa, Cryptosporidium parvum
VPPLWPPLVEWVFPKVSDRFH

SEQ ID NO: 2310204 - protein, 20 aa, Cryptosporidium parvum
VPRLLGYPACKEFFTHTVDI

SEQ ID NO: 2310205 - protein, 22 aa, Cryptosporidium parvum
VPRPRFPYLVLVPLEGDFSSKI

SEQ ID NO: 2310206 - protein, 20 aa, Cryptosporidium parvum
VQAFKIFLTKNCRYTEDIDN

SEQ ID NO: 2310207 - protein, 18 aa, Cryptosporidium parvum
VQDLDSLLLIYSCIGDIQ

SEQ ID NO: 2310208 - protein, 24 aa, Cryptosporidium parvum
VQDYRFLPKPTFRIEDNNLYSNLN

SEQ ID NO: 2310209 - protein, 21 aa, Cryptosporidium parvum
VQLRTDCWVYYSPKNAQQNKE

SEQ ID NO: 2310210 - protein, 22 aa, Cryptosporidium parvum
VQMLIRLSRLFYFAGKYRESQN

SEQ ID NO: 2310211 - protein, 17 aa, Cryptosporidium parvum
VQTPILYLFDAFIRNEE

SEQ ID NO: 2310212 - protein, 21 aa, Cryptosporidium parvum
VQYRIPLLNCHVGDWQPVDSD

SEQ ID NO: 2310213 - protein, 19 aa, Cryptosporidium parvum
VRDSLGYQKKRLIPIDQDE

SEQ ID NO: 2310214 - protein, 19 aa, Cryptosporidium parvum
VRGTLRFVVKLVPNQQNPN

SEQ ID NO: 2310215 - protein, 27 aa, Cryptosporidium parvum
VRKFSCKRWGKGKAYSHAMNFLASLTS

SEQ ID NO: 2310216 - protein, 18 aa, Cryptosporidium parvum
VRKLSRLMIPYVQKGVLD

SEQ ID NO: 2310217 - protein, 19 aa, Cryptosporidium parvum
VRLGIKLYPNWKWSQRWHG

SEQ ID NO: 2310218 - protein, 19 aa, Cryptosporidium parvum
VRVSLKFYFKCEFERRLFN

SEQ ID NO: 2310219 - protein, 20 aa, Cryptosporidium parvum
VSDPFCYPTPIALSSASNHI

SEQ ID NO: 2310220 - protein, 22 aa, Cryptosporidium parvum
VSEYPIRCAIFVSRKQWIITCG

SEQ ID NO: 2310221 - protein, 25 aa, Cryptosporidium parvum
VSFGKSRRNTIRWNPSGKWFAYGGF

SEQ ID NO: 2310222 - protein, 20 aa, Cryptosporidium parvum
VSGMQGWRVSMEDAHIALPR

SEQ ID NO: 2310223 - protein, 24 aa, Cryptosporidium parvum
VSGYAGKVLFGWDFPAGFTPSLSC

SEQ ID NO: 2310224 - protein, 18 aa, Cryptosporidium parvum
VSIGCQWHPVFPSRIASC

SEQ ID NO: 2310225 - protein, 22 aa, Cryptosporidium parvum
VSIRRMAYCIGVALSRLHELGI

SEQ ID NO: 2310226 - protein, 17 aa, Cryptosporidium parvum
VSKKLGSFIAERTDLFK

SEQ ID NO: 2310227 - protein, 22 aa, Cryptosporidium parvum
VSLPNKLFCIFSAPMDMDVLRL

SEQ ID NO: 2310228 - protein, 18 aa, Cryptosporidium parvum
VSNAFRFIYQVSDELWNS

SEQ ID NO: 2310229 - protein, 18 aa, Cryptosporidium parvum
VSSGICINGKYELIGNEI

SEQ ID NO: 2310230 - protein, 21 aa, Cryptosporidium parvum
VSSLCNCVTYFSGSTRSTGPN

SEQ ID NO: 2310231 - protein, 18 aa, Cryptosporidium parvum
VTCCTFFKLFKLHLNSQV

SEQ ID NO: 2310232 - protein, 28 aa, Cryptosporidium parvum
VTCFSPRMLPDWQLNWLRDVTRSLSSVP

SEQ ID NO: 2310233 - protein, 19 aa, Cryptosporidium parvum
VTFEFLRRFYIATNVQIQI

SEQ ID NO: 2310234 - protein, 17 aa, Cryptosporidium parvum
VTIEIALGKNGGGGRGA

SEQ ID NO: 2310235 - protein, 20 aa, Cryptosporidium parvum
VTNLCYSRELILNGIGNLFP

SEQ ID NO: 2310236 - protein, 18 aa, Cryptosporidium parvum
VVEFFKYPIPFFSKKNIS

SEQ ID NO: 2310237 - protein, 19 aa, Cryptosporidium parvum
VVKKLCKKYDLFLASQVLL

SEQ ID NO: 2310238 - protein, 17 aa, Cryptosporidium parvum
VVPQCCWIWSTYVFLKI

SEQ ID NO: 2310239 - protein, 19 aa, Cryptosporidium parvum
VVWSLPLLYAEKLLILVES

SEQ ID NO: 2310240 - protein, 18 aa, Cryptosporidium parvum
VVYYTGKDREFEYFKVPA

SEQ ID NO: 2310241 - protein, 20 aa, Cryptosporidium parvum
VWHVLSGRLLRCFSTPTMTL

SEQ ID NO: 2310242 - protein, 17 aa, Cryptosporidium parvum
VWNIFSFSPVEDKSVYD

SEQ ID NO: 2310243 - protein, 23 aa, Cryptosporidium parvum
VYKLPRFKKIDAFTCNYKFFPER

SEQ ID NO: 2310244 - protein, 20 aa, Cryptosporidium parvum
VYTGYWLKNHMFGYGKFDWT

SEQ ID NO: 2310245 - protein, 18 aa, Cryptosporidium parvum
WACCKCSNVNFPRRFRCF

SEQ ID NO: 2310246 - protein, 23 aa, Cryptosporidium parvum
WCDIMQFYLFFCPKCIYLKQSNV

SEQ ID NO: 2310247 - protein, 21 aa, Cryptosporidium parvum
WCEVCNLGFNDSHSWIRHLNS

SEQ ID NO: 2310248 - protein, 20 aa, Cryptosporidium parvum
WCNNDSFLLSGCLDRQITVL

SEQ ID NO: 2310249 - protein, 21 aa, Cryptosporidium parvum
WDKKSLVGLFCRFGNILSAHL

SEQ ID NO: 2310250 - protein, 17 aa, Cryptosporidium parvum
WDPINYNRFFTCSIDNT

SEQ ID NO: 2310251 - protein, 19 aa, Cryptosporidium parvum
WEIELEVVPWSLLFGDSLS

SEQ ID NO: 2310252 - protein, 17 aa, Cryptosporidium parvum
WFCIKYLEYYGSGRKHE

SEQ ID NO: 2310253 - protein, 22 aa, Cryptosporidium parvum
WGCTYRSLQMVFSWYLINNYTN

SEQ ID NO: 2310254 - protein, 18 aa, Cryptosporidium parvum
WGLYDLKSPIVFKPKLET

SEQ ID NO: 2310255 - protein, 20 aa, Cryptosporidium parvum
WGVNFPAHFAIIKGTEYFDA

SEQ ID NO: 2310256 - protein, 18 aa, Cryptosporidium parvum
WHFLSLFIQFIFRTIYSF

SEQ ID NO: 2310257 - protein, 24 aa, Cryptosporidium parvum
WICPWHECCLCFRRATQAGGLLIH

SEQ ID NO: 2310258 - protein, 19 aa, Cryptosporidium parvum
WIGIWRWDLYEKKRGKLIL

SEQ ID NO: 2310259 - protein, 19 aa, Cryptosporidium parvum
WIGSVGVGGVVTWNKQNNF

SEQ ID NO: 2310260 - protein, 18 aa, Cryptosporidium parvum
WIPENMKLLLAIKSPFKG

SEQ ID NO: 2310261 - protein, 23 aa, Cryptosporidium parvum
WISKRLAPHYIPKSSLDFLPLDI

SEQ ID NO: 2310262 - protein, 17 aa, Cryptosporidium parvum
WKANLPWKVHGMPPAVE

SEQ ID NO: 2310263 - protein, 19 aa, Cryptosporidium parvum
WKIKIELGIEEEKKTKIKI

SEQ ID NO: 2310264 - protein, 17 aa, Cryptosporidium parvum
WKISLYLSYAKWESLQN

SEQ ID NO: 2310265 - protein, 18 aa, Cryptosporidium parvum
WKKCCRKINEKLGINLQP

SEQ ID NO: 2310266 - protein, 19 aa, Cryptosporidium parvum
WKKSVGFIFNDSYKNLKYT

SEQ ID NO: 2310267 - protein, 18 aa, Cryptosporidium parvum
WKLDKEWEIEQKKKRLKI

SEQ ID NO: 2310268 - protein, 18 aa, Cryptosporidium parvum
WKLRLHLWGNLDDLEYSN

SEQ ID NO: 2310269 - protein, 18 aa, Cryptosporidium parvum
WKPISLNAICELLSSKDF

SEQ ID NO: 2310270 - protein, 19 aa, Cryptosporidium parvum
WKPLMEWDLKCFVKILKQC

SEQ ID NO: 2310271 - protein, 19 aa, Cryptosporidium parvum
WKSFVMVLKCCFSLLQRGN

SEQ ID NO: 2310272 - protein, 19 aa, Cryptosporidium parvum
WKSTCFIKLPSKLDDGGYF

SEQ ID NO: 2310273 - protein, 17 aa, Cryptosporidium parvum
WLCDRCEFEKKFLGTQY

SEQ ID NO: 2310274 - protein, 20 aa, Cryptosporidium parvum
WLCNRYPLIVKELKDAVDEE

SEQ ID NO: 2310275 - protein, 17 aa, Cryptosporidium parvum
WLDKYVCCDSIEILHVN

SEQ ID NO: 2310276 - protein, 19 aa, Cryptosporidium parvum
WLLKYKVVLFILVEALTLR

SEQ ID NO: 2310277 - protein, 18 aa, Cryptosporidium parvum
WLLSQLFVWASIDISIVL

SEQ ID NO: 2310278 - protein, 21 aa, Cryptosporidium parvum
WLPKRLGGGLGKVRGQEKPES

SEQ ID NO: 2310279 - protein, 18 aa, Cryptosporidium parvum
WLTLEFWGILILLFKHKS

SEQ ID NO: 2310280 - protein, 20 aa, Cryptosporidium parvum
WLYCILKYLVFFNSKFGFYN

SEQ ID NO: 2310281 - protein, 21 aa, Cryptosporidium parvum
WLYLDHWLFWLSLTNENNNSS

SEQ ID NO: 2310282 - protein, 25 aa, Cryptosporidium parvum
WLYSGRRGVHCWVCDTKARLLPSEA

SEQ ID NO: 2310283 - protein, 17 aa, Cryptosporidium parvum
WNIALQFGGFINGVTKS

SEQ ID NO: 2310284 - protein, 22 aa, Cryptosporidium parvum
WNIRTGKCLKRLSAHINAKSVS

SEQ ID NO: 2310285 - protein, 17 aa, Cryptosporidium parvum
WNISIPIYSCFPDGTFL

SEQ ID NO: 2310286 - protein, 17 aa, Cryptosporidium parvum
WNIWIAYINMEIVYGKN

SEQ ID NO: 2310287 - protein, 18 aa, Cryptosporidium parvum
WNKLKFFLVNGYKDLYPA

SEQ ID NO: 2310288 - protein, 17 aa, Cryptosporidium parvum
WNMYDWELLMRDIQYPA

SEQ ID NO: 2310289 - protein, 17 aa, Cryptosporidium parvum
WNSFELILRPELKKLNF

SEQ ID NO: 2310290 - protein, 17 aa, Cryptosporidium parvum
WNYIFKCSRDFSLSQFH

SEQ ID NO: 2310291 - protein, 18 aa, Cryptosporidium parvum
WPSPISLCSIDERFRQTV

SEQ ID NO: 2310292 - protein, 17 aa, Cryptosporidium parvum
WQLCFCKPIISVTLFAR

SEQ ID NO: 2310293 - protein, 17 aa, Cryptosporidium parvum
WRICYAPEPGKRVTKSF

SEQ ID NO: 2310294 - protein, 19 aa, Cryptosporidium parvum
WRPICNVPTPIQESILKER

SEQ ID NO: 2310295 - protein, 18 aa, Cryptosporidium parvum
WRTMQMAYESFDFDNFDS

SEQ ID NO: 2310296 - protein, 20 aa, Cryptosporidium parvum
WSAEMAMIFCMNRKNVFSFS

SEQ ID NO: 2310297 - protein, 24 aa, Cryptosporidium parvum
WSIGVLCYVCLCGGLPFHDNRAFD

SEQ ID NO: 2310298 - protein, 17 aa, Cryptosporidium parvum
WSPVIGRGWQSRYFALL

SEQ ID NO: 2310299 - protein, 18 aa, Cryptosporidium parvum
WSQRWHGIREKFYLWVTN

SEQ ID NO: 2310300 - protein, 17 aa, Cryptosporidium parvum
WSRECFRCVSVSYLNEI

SEQ ID NO: 2310301 - protein, 17 aa, Cryptosporidium parvum
WSSPFVYNSRNCRLYII

SEQ ID NO: 2310302 - protein, 18 aa, Cryptosporidium parvum
WSTACSFVNTGDVIEIFG

SEQ ID NO: 2310303 - protein, 21 aa, Cryptosporidium parvum
WSTCISKLCSWEFSIAETSIS

SEQ ID NO: 2310304 - protein, 18 aa, Cryptosporidium parvum
WTKDCLEIYSGPQKCDPE

SEQ ID NO: 2310305 - protein, 18 aa, Cryptosporidium parvum
WTLICTRIENGLKLGDQL

SEQ ID NO: 2310306 - protein, 19 aa, Cryptosporidium parvum
WTQRYGYQGTDEFSIRMFN

SEQ ID NO: 2310307 - protein, 19 aa, Cryptosporidium parvum
WTREEIALFCLRSMNNNVK

SEQ ID NO: 2310308 - protein, 20 aa, Cryptosporidium parvum
WVHLVCAIWHLPLVTCEDWK

SEQ ID NO: 2310309 - protein, 20 aa, Cryptosporidium parvum
WVLFPIKYSRLWSLYKKYEV

SEQ ID NO: 2310310 - protein, 21 aa, Cryptosporidium parvum
WWKKPRGWKVTYFKQGQKLSQ

SEQ ID NO: 2310311 - protein, 19 aa, Cryptosporidium parvum
WYHCYRFFVQEAIRYENTN

SEQ ID NO: 2310312 - protein, 18 aa, Cryptosporidium parvum
WYHKTCLELLNSESERES

SEQ ID NO: 2310313 - protein, 17 aa, Cryptosporidium parvum
YAFPRYKYDIDDQLEIS

SEQ ID NO: 2310314 - protein, 17 aa, Cryptosporidium parvum
YAKYFAVIRRYKISKAM

SEQ ID NO: 2310315 - protein, 21 aa, Cryptosporidium parvum
YARSLDTHWLKYLLDSGLTMI

SEQ ID NO: 2310316 - protein, 17 aa, Cryptosporidium parvum
YAYRLLRHPNICSYIGV

SEQ ID NO: 2310317 - protein, 22 aa, Cryptosporidium parvum
YCAFCSRMKRGLLYSCMKKNGY

SEQ ID NO: 2310318 - protein, 21 aa, Cryptosporidium parvum
YCKSCGLPTDYCEYGQCTKNK

SEQ ID NO: 2310319 - protein, 18 aa, Cryptosporidium parvum
YCLWRGWQYMRLDGSTNK

SEQ ID NO: 2310320 - protein, 24 aa, Cryptosporidium parvum
YDCTFKLRCSRGIAVSKIYAPWTA

SEQ ID NO: 2310321 - protein, 21 aa, Cryptosporidium parvum
YDCYKALYFLLIAKRLIGESI

SEQ ID NO: 2310322 - protein, 17 aa, Cryptosporidium parvum
YDLLRFSIRNEKILENE

SEQ ID NO: 2310323 - protein, 21 aa, Cryptosporidium parvum
YDWRNECLRILNLLRKEQNSF

SEQ ID NO: 2310324 - protein, 17 aa, Cryptosporidium parvum
YECFEKWASLLISKYNI

SEQ ID NO: 2310325 - protein, 23 aa, Cryptosporidium parvum
YEDCMNCLYLLLPFTLTHGTSQN

SEQ ID NO: 2310326 - protein, 20 aa, Cryptosporidium parvum
YEFGRALAIMISDNFDEKAR

SEQ ID NO: 2310327 - protein, 18 aa, Cryptosporidium parvum
YEFLKHILCRSCSNCASY

SEQ ID NO: 2310328 - protein, 22 aa, Cryptosporidium parvum
YELCKLLSIYSSVLFQTPLSIV

SEQ ID NO: 2310329 - protein, 20 aa, Cryptosporidium parvum
YELMKILLLDAKEVSLIVEN

SEQ ID NO: 2310330 - protein, 18 aa, Cryptosporidium parvum
YEMALRFYQVNIIGNFGN

SEQ ID NO: 2310331 - protein, 19 aa, Cryptosporidium parvum
YEPVSICCIEFWNTIADLE

SEQ ID NO: 2310332 - protein, 18 aa, Cryptosporidium parvum
YEYLFKTARIQGMIDTCG

SEQ ID NO: 2310333 - protein, 17 aa, Cryptosporidium parvum
YFAATFCPQQNYSSHKV

SEQ ID NO: 2310334 - protein, 18 aa, Cryptosporidium parvum
YFCSYSFASVFSRMGPNS

SEQ ID NO: 2310335 - protein, 17 aa, Cryptosporidium parvum
YFPEIRAFVALDLSSSF

SEQ ID NO: 2310336 - protein, 23 aa, Cryptosporidium parvum
YFWDLRFGQSIVCDDAPKICNIL

SEQ ID NO: 2310337 - protein, 17 aa, Cryptosporidium parvum
YGLLKLMGINGIIGTTT

SEQ ID NO: 2310338 - protein, 17 aa, Cryptosporidium parvum
YGRFCGFFNNGIFHSFY

SEQ ID NO: 2310339 - protein, 18 aa, Cryptosporidium parvum
YGVEKSYEMALRFYQVNI

SEQ ID NO: 2310340 - protein, 25 aa, Cryptosporidium parvum
YGVLCCICKSCGAFLLKGEEKRQHL

SEQ ID NO: 2310341 - protein, 21 aa, Cryptosporidium parvum
YGVRFGVSGMQGWRVSMEDAH

SEQ ID NO: 2310342 - protein, 24 aa, Cryptosporidium parvum
YHGLIKYCFRFGILTLYNSLENKG

SEQ ID NO: 2310343 - protein, 22 aa, Cryptosporidium parvum
YHPEVWYEYFIFVWNSHPVQLT

SEQ ID NO: 2310344 - protein, 18 aa, Cryptosporidium parvum
YHPKCWCNLFGFAMKKDS

SEQ ID NO: 2310345 - protein, 17 aa, Cryptosporidium parvum
YHRYKRYVAYNEMLNSE

SEQ ID NO: 2310346 - protein, 19 aa, Cryptosporidium parvum
YICLWDLQPDFGRSIFGIQ

SEQ ID NO: 2310347 - protein, 17 aa, Cryptosporidium parvum
YILSPAIEQIIKVEPCR

SEQ ID NO: 2310348 - protein, 24 aa, Cryptosporidium parvum
YIQNYRVGLKILKKRAALNNEEKI

SEQ ID NO: 2310349 - protein, 20 aa, Cryptosporidium parvum
YIRRPSCLILAITAANTDIA

SEQ ID NO: 2310350 - protein, 19 aa, Cryptosporidium parvum
YKAIFTWKRFNQIKYVLDT

SEQ ID NO: 2310351 - protein, 22 aa, Cryptosporidium parvum
YKERKCLFTLLGHLDYIRTVEF

SEQ ID NO: 2310352 - protein, 18 aa, Cryptosporidium parvum
YKFISGICPKSYGMNVAQ

SEQ ID NO: 2310353 - protein, 20 aa, Cryptosporidium parvum
YKHWLRKKCNNYLVMIRCSI

SEQ ID NO: 2310354 - protein, 17 aa, Cryptosporidium parvum
YKILCLILSMLETNQNT

SEQ ID NO: 2310355 - protein, 21 aa, Cryptosporidium parvum
YKILIGKCLPFFTARDNYMNL

SEQ ID NO: 2310356 - protein, 23 aa, Cryptosporidium parvum
YKKNLIWDGPRWDLAHFDPTMSA

SEQ ID NO: 2310357 - protein, 20 aa, Cryptosporidium parvum
YKLKSSFGWEHVKGSSKLFF

SEQ ID NO: 2310358 - protein, 19 aa, Cryptosporidium parvum
YKLRSCFISSIANSFIEMK

SEQ ID NO: 2310359 - protein, 25 aa, Cryptosporidium parvum
YKRIPLKNIWFIFKRIYSMKPNSVE

SEQ ID NO: 2310360 - protein, 32 aa, Cryptosporidium parvum
YKSGYKGVSWNKRMQSWLAFWTEGQRRRSKTF

SEQ ID NO: 2310361 - protein, 17 aa, Cryptosporidium parvum
YKSIPIVGSIRYKKQKI

SEQ ID NO: 2310362 - protein, 17 aa, Cryptosporidium parvum
YKTRSILRGSLQGITLL

SEQ ID NO: 2310363 - protein, 20 aa, Cryptosporidium parvum
YKYPRSCIGSRRFSRYNFEI

SEQ ID NO: 2310364 - protein, 17 aa, Cryptosporidium parvum
YKYRIMRQVRMCKDIKH

SEQ ID NO: 2310365 - protein, 19 aa, Cryptosporidium parvum
YKYTLGFKRILRLVYYFKG

SEQ ID NO: 2310366 - protein, 22 aa, Cryptosporidium parvum
YLESVLRKKVNLIHMENLQLKE

SEQ ID NO: 2310367 - protein, 21 aa, Cryptosporidium parvum
YLKHRSIVLGEQMKAYTLGHP

SEQ ID NO: 2310368 - protein, 19 aa, Cryptosporidium parvum
YLKKWSPVIGRGWQSRYFA

SEQ ID NO: 2310369 - protein, 21 aa, Cryptosporidium parvum
YLLYKACRIFKQLGVEYVTIF

SEQ ID NO: 2310370 - protein, 18 aa, Cryptosporidium parvum
YLPSALMEVCIKRFLTCP

SEQ ID NO: 2310371 - protein, 17 aa, Cryptosporidium parvum
YLYRLIIVIAEISLVLC

SEQ ID NO: 2310372 - protein, 17 aa, Cryptosporidium parvum
YMGRIRIGVCCRGSSEA

SEQ ID NO: 2310373 - protein, 22 aa, Cryptosporidium parvum
YMIFCGLKILYLLLNTTDISFF

SEQ ID NO: 2310374 - protein, 17 aa, Cryptosporidium parvum
YMKRSLDSFAFPITSEK

SEQ ID NO: 2310375 - protein, 20 aa, Cryptosporidium parvum
YNGKQRWRVVTINGELIDSS

SEQ ID NO: 2310376 - protein, 17 aa, Cryptosporidium parvum
YNGLYLQQWFEWLKQTG

SEQ ID NO: 2310377 - protein, 20 aa, Cryptosporidium parvum
YNLWSNRAWLLEFIVNLKDA

SEQ ID NO: 2310378 - protein, 19 aa, Cryptosporidium parvum
YNPLFFRPRIRSAVEEYQS

SEQ ID NO: 2310379 - protein, 20 aa, Cryptosporidium parvum
YPTDFYQLFLISSDSFAKNN

SEQ ID NO: 2310380 - protein, 17 aa, Cryptosporidium parvum
YQALPWVRYITQNGNYE

SEQ ID NO: 2310381 - protein, 17 aa, Cryptosporidium parvum
YQDREMYLQHELELKEN

SEQ ID NO: 2310382 - protein, 18 aa, Cryptosporidium parvum
YQIVNSWNKLKFFLVNGY

SEQ ID NO: 2310383 - protein, 18 aa, Cryptosporidium parvum
YRAEILDILSYCRLMIDE

SEQ ID NO: 2310384 - protein, 19 aa, Cryptosporidium parvum
YRFKTLYGHLAEYDTVSSN

SEQ ID NO: 2310385 - protein, 17 aa, Cryptosporidium parvum
YRHSWVFPPDFPCFDAI

SEQ ID NO: 2310386 - protein, 18 aa, Cryptosporidium parvum
YRLSVSLYNLFGCGDVFS

SEQ ID NO: 2310387 - protein, 19 aa, Cryptosporidium parvum
YRNPISFNYQCYNSLVYPI

SEQ ID NO: 2310388 - protein, 24 aa, Cryptosporidium parvum
YRYMPELDEFISFWCKYTEHIEKN

SEQ ID NO: 2310389 - protein, 18 aa, Cryptosporidium parvum
YRYQCLRCFQMFGRQTKI

SEQ ID NO: 2310390 - protein, 24 aa, Cryptosporidium parvum
YSDTGKMRGFAMVEFENDEQIQNA

SEQ ID NO: 2310391 - protein, 24 aa, Cryptosporidium parvum
YSEIKYKIEWCFSSDSNLTIYAKE

SEQ ID NO: 2310392 - protein, 22 aa, Cryptosporidium parvum
YSEKFGLWSFELYKNSNACITK

SEQ ID NO: 2310393 - protein, 17 aa, Cryptosporidium parvum
YSLRPSEVASMFPQQHI

SEQ ID NO: 2310394 - protein, 19 aa, Cryptosporidium parvum
YSRCCISPMAAFLGGIAAQ

SEQ ID NO: 2310395 - protein, 21 aa, Cryptosporidium parvum
YSVDGADAFEFLNILKASKPS

SEQ ID NO: 2310396 - protein, 17 aa, Cryptosporidium parvum
YSVECLDIFASENTEIL

SEQ ID NO: 2310397 - protein, 19 aa, Cryptosporidium parvum
YTIDLCLFLGLKMTTLTSK

SEQ ID NO: 2310398 - protein, 19 aa, Cryptosporidium parvum
YTNFFWKIRENLLKNSRLI

SEQ ID NO: 2310399 - protein, 17 aa, Cryptosporidium parvum
YTSRFFIDSGLFKKIGG

SEQ ID NO: 2310400 - protein, 24 aa, Cryptosporidium parvum
YVDMMPKVLFCRGHLVEMILSCNI

SEQ ID NO: 2310401 - protein, 18 aa, Cryptosporidium parvum
YVPDLSLSIRNLYIRYED

SEQ ID NO: 2310402 - protein, 20 aa, Cryptosporidium parvum
YVPRIAWIRVRRNMNTWQYE

SEQ ID NO: 2310403 - protein, 20 aa, Cryptosporidium parvum
YVRDILKFILNEESISNDKL

SEQ ID NO: 2310404 - protein, 28 aa, Cryptosporidium parvum
YVRNEILCGLNFCTLCYGKYSGISNQKA

SEQ ID NO: 2310405 - protein, 19 aa, Cryptosporidium parvum
YVVGSLFYRREMKQVKEEI

SEQ ID NO: 2310406 - protein, 17 aa, Cryptosporidium parvum
YYEGFKLPLGDLGRKML

SEQ ID NO: 2310407 - protein, 21 aa, Cryptosporidium parvum
YYFFRIQIIFWKLAMYKTYHI

SEQ ID NO: 2310408 - protein, 17 aa, Cryptosporidium parvum
YYFNLKGGMMFGTSKKD

SEQ ID NO: 2310409 - protein, 17 aa, Cryptosporidium parvum
YYIRMIILYRKRIQIKE

SEQ ID NO: 2310410 - protein, 18 aa, Cryptosporidium parvum
YYLFLTWNNCILGYIPIN

SEQ ID NO: 2310411 - protein, 18 aa, Cryptosporidium parvum
YYLSAGIALRFISNIKKL

SEQ ID NO: 2310412 - protein, 23 aa, Cryptosporidium parvum
YYNKELKSWVVRGEEHLVEQKQN

SEQ ID NO: 2310413 - protein, 17 aa, Cryptosporidium parvum
YYQFKWFHSWKKMLRNS

SEQ ID NO: 2310414 - protein, 27 aa, Cryptosporidium parvum
QPPAEESSWFSGWFGASETTPAPPPTP

SEQ ID NO: 2310415 - protein, 24 aa, Cryptosporidium parvum
VINSLIEDFIPNSLNLLKKGGCFV

SEQ ID NO: 2310416 - protein, 24 aa, Cryptosporidium parvum
HIGKVIIKIPTPFKYLELDTENHK

SEQ ID NO: 2310417 - protein, 18 aa, Cryptosporidium parvum
LNKNLKHFVMFSSVASLL

SEQ ID NO: 2310418 - protein, 17 aa, Cryptosporidium parvum
NLKHFVMFSSVASLLGN

SEQ ID NO: 2310419 - protein, 25 aa, Cryptosporidium parvum
QKESTLHLVLRLRGGMQIFVKTLTG

SEQ ID NO: 2310420 - protein, 29 aa, Cryptosporidium parvum
AAAAITANLMPRCIGMWKEYFTSDGKPYY

SEQ ID NO: 2310421 - protein, 18 aa, Cryptosporidium parvum
AAALGRLIQKTRWPIICI

SEQ ID NO: 2310422 - protein, 46 aa, Cryptosporidium parvum
AAANPYNYAYLNYAGYTANFPYMVGNTAAFGFPHYNTKPNGHHHPT

SEQ ID NO: 2310423 - protein, 18 aa, Cryptosporidium parvum
AAAPMKKSISNSSSSSSS

SEQ ID NO: 2310424 - protein, 24 aa, Cryptosporidium parvum
AACKKFVSFVKLLVNVLKAKNTFL

SEQ ID NO: 2310425 - protein, 20 aa, Cryptosporidium parvum
AAEFIIFNTLVKVSIERNIS

SEQ ID NO: 2310426 - protein, 26 aa, Cryptosporidium parvum
AAHQMGLPFHLAALSSIAGGIPIDPS

SEQ ID NO: 2310427 - protein, 21 aa, Cryptosporidium parvum
AAHVFSDIYSVWICGFRSVEP

SEQ ID NO: 2310428 - protein, 26 aa, Cryptosporidium parvum
AAIPLPIVKKFLGNHLFIFSSTINGY

SEQ ID NO: 2310429 - protein, 23 aa, Cryptosporidium parvum
AAKQLPLYILGVLKCPAFRDYKE

SEQ ID NO: 2310430 - protein, 17 aa, Cryptosporidium parvum
AALKVAIEFLEHKRAEK

SEQ ID NO: 2310431 - protein, 19 aa, Cryptosporidium parvum
AALLNYYYANKYEGKLLLR

SEQ ID NO: 2310432 - protein, 25 aa, Cryptosporidium parvum
AALPLPATVYIKSLFLWVDSQISDT

SEQ ID NO: 2310433 - protein, 27 aa, Cryptosporidium parvum
AALRDIRNLFPIYRNPLYAGFGNRDTD

SEQ ID NO: 2310434 - protein, 19 aa, Cryptosporidium parvum
AAMIGIPMFGARLNAQLFI

SEQ ID NO: 2310435 - protein, 27 aa, Cryptosporidium parvum
AAPSYSGLPAPVLPPHHAPPLIATHQL

SEQ ID NO: 2310436 - protein, 20 aa, Cryptosporidium parvum
AAPTNLTDALMASPIVLGEG

SEQ ID NO: 2310437 - protein, 17 aa, Cryptosporidium parvum
AAPTVGILCKEGVILGA

SEQ ID NO: 2310438 - protein, 33 aa, Cryptosporidium parvum
AAQLYKFPVTKTLNLAYKKPILPGQTIVIISRV

SEQ ID NO: 2310439 - protein, 17 aa, Cryptosporidium parvum
AARRALLEVIRGELLLV

SEQ ID NO: 2310440 - protein, 23 aa, Cryptosporidium parvum
AASMIFYNSFLQVLETHVKLIIQ

SEQ ID NO: 2310441 - protein, 27 aa, Cryptosporidium parvum
AASSDTIIYIWSFKHKKLINKLVGHKG

SEQ ID NO: 2310442 - protein, 32 aa, Cryptosporidium parvum; identical to SEQ ID NO: 2187148

SEQ ID NO: 2310443 - protein, 24 aa, Cryptosporidium parvum
AATKSFYYALYFARSNFSNEMERN

SEQ ID NO: 2310444 - protein, 28 aa, Cryptosporidium parvum
ACAPAIFNYQIPYFQPYSLRSYEISTLN

SEQ ID NO: 2310445 - protein, 17 aa, Cryptosporidium parvum
ACGTLLNRDPYSWAVTI

SEQ ID NO: 2310446 - protein, 18 aa, Cryptosporidium parvum
ACKYYLKDLYDKGGRELE

SEQ ID NO: 2310447 - protein, 17 aa, Cryptosporidium parvum
ACLSCRIILSDQQFYEG

SEQ ID NO: 2310448 - protein, 18 aa, Cryptosporidium parvum
ACNSGGPFLFIRIDGKTP

SEQ ID NO: 2310449 - protein, 25 aa, Cryptosporidium parvum
ACREKAYLYLKYLVQQKHGPVTIDV

SEQ ID NO: 2310450 - protein, 28 aa, Cryptosporidium parvum
ADADILCTMPWQFVIIDEAHRLKNRGAK

SEQ ID NO: 2310451 - protein, 24 aa, Cryptosporidium parvum
ADALQRFCSFILPMLDEKGTHTGE

SEQ ID NO: 2310452 - protein, 26 aa, Cryptosporidium parvum
ADARNSVFKLKWKFATMPDKNKIKIA

SEQ ID NO: 2310453 - protein, 26 aa, Cryptosporidium parvum
ADCISIEFWRIFRDFCKTKFGENFAL

SEQ ID NO: 2310454 - protein, 25 aa, Cryptosporidium parvum
ADCNEFCFLQLFNLPGNILTLYIES

SEQ ID NO: 2310455 - protein, 24 aa, Cryptosporidium parvum
ADDLLPLLIFCIIQSNPTKIKAHV

SEQ ID NO: 2310456 - protein, 26 aa, Cryptosporidium parvum
ADDVGTIIIIEIYPKGEANDPLNITY

SEQ ID NO: 2310457 - protein, 35 aa, Cryptosporidium parvum; identical to SEQ ID NO: 2187163

SEQ ID NO: 2310458 - protein, 23 aa, Cryptosporidium parvum
ADGSTVLIKKRGLLGSLKEENVK

SEQ ID NO: 2310459 - protein, 20 aa, Cryptosporidium parvum
ADIKAICTEAGLLALRERRM

SEQ ID NO: 2310460 - protein, 29 aa, Cryptosporidium parvum
ADIKKNKLCFVPIKRVYPIMRLNLNRNTK

SEQ ID NO: 2310461 - protein, 23 aa, Cryptosporidium parvum
ADINALRKTLLAKVKLYEFEHNK

SEQ ID NO: 2310462 - protein, 24 aa, Cryptosporidium parvum
ADKLLPNQILFIDDDIRNCKQALQ

SEQ ID NO: 2310463 - protein, 21 aa, Cryptosporidium parvum
ADLLNELAAMHYEWALDNYAK

SEQ ID NO: 2310464 - protein, 23 aa, Cryptosporidium parvum
ADLSQLIREATLKALDKLRTNDS

SEQ ID NO: 2310465 - protein, 25 aa, Cryptosporidium parvum
ADNARQILVFELKSLQKLFIEDKKE

SEQ ID NO: 2310466 - protein, 36 aa, Cryptosporidium parvum
ADNITTIQLFKINPFKYLIDIQIYDGPLITNAFQAF

SEQ ID NO: 2310467 - protein, 23 aa, Cryptosporidium parvum
ADNLYAIDLRFPNSKQLPIPIMK

SEQ ID NO: 2310468 - protein, 25 aa, Cryptosporidium parvum
ADRGWSDFFSLKTLLDPKTGFIDSE

SEQ ID NO: 2310469 - protein, 22 aa, Cryptosporidium parvum
ADSRNFLTKKLLARAQSQIDNP

SEQ ID NO: 2310470 - protein, 18 aa, Cryptosporidium parvum
ADVSNIIFAVNKLDLCNW

SEQ ID NO: 2310471 - protein, 35 aa, Cryptosporidium parvum
ADVSVYPPPILIQKSLVIPGFIREGRQLSRALSLS

SEQ ID NO: 2310472 - protein, 19 aa, Cryptosporidium parvum
ADWSYIKYCSVLNSKLYSN

SEQ ID NO: 2310473 - protein, 26 aa, Cryptosporidium parvum
AEDRTQLYYFVKWLSCPYDQCTWESY

SEQ ID NO: 2310474 - protein, 23 aa, Cryptosporidium parvum
AEEGIIESLPLKVFDMRGSDENG

SEQ ID NO: 2310475 - protein, 17 aa, Cryptosporidium parvum
AEEIFHLGIFQFDPLIG

SEQ ID NO: 2310476 - protein, 24 aa, Cryptosporidium parvum
AEFSRLGFGFDIGLGLGPGPGHGS

SEQ ID NO: 2310477 - protein, 19 aa, Cryptosporidium parvum
AEFYMRKQFPQLKPTLLGS

SEQ ID NO: 2310478 - protein, 26 aa, Cryptosporidium parvum
AEGHRVLIFSQFIQTLTLLEELVEHH

SEQ ID NO: 2310479 - protein, 22 aa, Cryptosporidium parvum
AEGILENPWLFQGFKTPEAINN

SEQ ID NO: 2310480 - protein, 27 aa, Cryptosporidium parvum
AEIPPKYILNFPIKNPLFITSNIKSDL

SEQ ID NO: 2310481 - protein, 23 aa, Cryptosporidium parvum
AEIRRECLKSYFFGTPEFPLKPH

SEQ ID NO: 2310482 - protein, 24 aa, Cryptosporidium parvum
AEISQFLFKNYYSSILFGFGLIPE

SEQ ID NO: 2310483 - protein, 34 aa, Cryptosporidium parvum; identical to SEQ ID NO: 2187185

SEQ ID NO: 2310484 - protein, 25 aa, Cryptosporidium parvum
AEKFFGSMEFGEIESLTLVLACKLN

SEQ ID NO: 2310485 - protein, 22 aa, Cryptosporidium parvum
AEKKFKTHILKRSKSIGVSKVK

SEQ ID NO: 2310486 - protein, 17 aa, Cryptosporidium parvum
AEKLAREAWRRWIQEEG

SEQ ID NO: 2310487 - protein, 25 aa, Cryptosporidium parvum
AELDTFVCIPLLDKLSNKLVNDINR

SEQ ID NO: 2310488 - protein, 18 aa, Cryptosporidium parvum
AELRVMCYIEQKINGHFT

SEQ ID NO: 2310489 - protein, 20 aa, Cryptosporidium parvum
AEMPADSGYPAYLGARLASF

SEQ ID NO: 2310490 - protein, 25 aa, Cryptosporidium parvum
AEMRKYKSLQTKRRLSKRISVLSKF

SEQ ID NO: 2310491 - protein, 22 aa, Cryptosporidium parvum
AENALNHRWLRTSFAKQGIQTS

SEQ ID NO: 2310492 - protein, 26 aa, Cryptosporidium parvum
AENCQLPVFITLRAPGSPLIISIGQR

SEQ ID NO: 2310493 - protein, 24 aa, Cryptosporidium parvum
AENIISPLQLLTHPFRNKEVIDLW

SEQ ID NO: 2310494 - protein, 23 aa, Cryptosporidium parvum
AENLTLERLLYEYLINNGDVIVW

SEQ ID NO: 2310495 - protein, 26 aa, Cryptosporidium parvum
AEQFTSMFRRKAFLHWYTGEGMDEME

SEQ ID NO: 2310496 - protein, 17 aa, Cryptosporidium parvum
AEQILRFFSSNAHPIIL

SEQ ID NO: 2310497 - protein, 31 aa, Cryptosporidium parvum
AEQYCAMRCDLLILLSTRKKLQRLNSFKHAW

SEQ ID NO: 2310498 - protein, 27 aa, Cryptosporidium parvum
AESATTSFFRRLDWSPKGEMLVVPTGQ

SEQ ID NO: 2310499 - protein, 26 aa, Cryptosporidium parvum
AESNYSPYYFILSTIYLLDDFQETHS

SEQ ID NO: 2310500 - protein, 26 aa, Cryptosporidium parvum
AESSIIYYLGHLALAKQCYRGMMGVQ

SEQ ID NO: 2310501 - protein, 24 aa, Cryptosporidium parvum
AESTKPFGGRFGATGFGSRGGRGG

SEQ ID NO: 2310502 - protein, 30 aa, Cryptosporidium parvum
AESVLGSQFLLSKLPFPNYGTFLGKETAEY

SEQ ID NO: 2310503 - protein, 24 aa, Cryptosporidium parvum
AETSIPGQWFKAIPSSLNPFQMIC

SEQ ID NO: 2310504 - protein, 21 aa, Cryptosporidium parvum
AETYEFMRILAEDPTGAQYVA

SEQ ID NO: 2310505 - protein, 18 aa, Cryptosporidium parvum
AEWLIFPFEDEQSLSLCL

SEQ ID NO: 2310506 - protein, 24 aa, Cryptosporidium parvum
AEWNPMNPSLIWRKNKENDDASTI

SEQ ID NO: 2310507 - protein, 34 aa, Cryptosporidium parvum; identical to SEQ ID NO: 2187201

SEQ ID NO: 2310508 - protein, 18 aa, Cryptosporidium parvum
AEYESRKKDIFSRGVVSG

SEQ ID NO: 2310509 - protein, 18 aa, Cryptosporidium parvum
AEYILPALISLFNDVQKS

SEQ ID NO: 2310510 - protein, 24 aa, Cryptosporidium parvum
AFAYQIMFEFDPIKWCSKGIATGM

SEQ ID NO: 2310511 - protein, 22 aa, Cryptosporidium parvum
AFDCRGINLTKWNPSFGYNVIS

SEQ ID NO: 2310512 - protein, 17 aa, Cryptosporidium parvum
AFDCYFSSDLYIQEESE

SEQ ID NO: 2310513 - protein, 26 aa, Cryptosporidium parvum
AFFETEMKLFYCKYNDPAYIKIEKLN

SEQ ID NO: 2310514 - protein, 24 aa, Cryptosporidium parvum
AFGIKSPWRIVRSRFYVTSASHIQ

SEQ ID NO: 2310515 - protein, 25 aa, Cryptosporidium parvum
AFITKLQNILIYWTNLIHEYETEKK

SEQ ID NO: 2310516 - protein, 17 aa, Cryptosporidium parvum
AFITYYDELSATKAIKN

SEQ ID NO: 2310517 - protein, 30 aa, Cryptosporidium parvum
AFKGFQKRFFKLNLTDNALLYWREEPTFPD

SEQ ID NO: 2310518 - protein, 33 aa, Cryptosporidium parvum; identical to SEQ ID NO: 2187211

SEQ ID NO: 2310519 - protein, 26 aa, Cryptosporidium parvum
AFLDNCIFGLVYIKRSNPIIPSLQSN

SEQ ID NO: 2310520 - protein, 22 aa, Cryptosporidium parvum
AFLFACVISYDSKQKIYLCEYI

SEQ ID NO: 2310521 - protein, 28 aa, Cryptosporidium parvum
AFNKEEILFVYIFSLLTGTCLCGENQIN

SEQ ID NO: 2310522 - protein, 28 aa, Cryptosporidium parvum
AFNQIRKTEIFWKFFLENLKVDMMNKTN

SEQ ID NO: 2310523 - protein, 38 aa, Cryptosporidium parvum
AFNWVEGIIKFWDPKFKLFFIHFLLSPSINSFRNINNT

SEQ ID NO: 2310524 - protein, 26 aa, Cryptosporidium parvum
AFPHCDAYMLSWSYRKTRIIVEILSH

SEQ ID NO: 2310525 - protein, 26 aa, Cryptosporidium parvum
AFQRRKLLAFITWRLTTNRSSHQISD

SEQ ID NO: 2310526 - protein, 25 aa, Cryptosporidium parvum
AFSDKFNIFLNNFLPYIDEAALSPI

SEQ ID NO: 2310527 - protein, 33 aa, Cryptosporidium parvum; identical to SEQ ID NO: 2187221

SEQ ID NO: 2310528 - protein, 29 aa, Cryptosporidium parvum
AGALLFIKRDLTVVPKILLPSASKDPRMI

SEQ ID NO: 2310529 - protein, 24 aa, Cryptosporidium parvum
AGDFVNDIGIFESLPKSTSDADYK

SEQ ID NO: 2310530 - protein, 19 aa, Cryptosporidium parvum
AGDGLYEGLDWLARNLEKA

SEQ ID NO: 2310531 - protein, 25 aa, Cryptosporidium parvum
AGESKLFATILWLSNFVNAHSHNIN

SEQ ID NO: 2310532 - protein, 32 aa, Cryptosporidium parvum
AGETKIWQYIHLTHRIYLIDCPGIVPPENASS

SEQ ID NO: 2310533 - protein, 25 aa, Cryptosporidium parvum
AGGLHPGFQPVLHHLQQQLQLQQIQ

SEQ ID NO: 2310534 - protein, 32 aa, Cryptosporidium parvum; identical to SEQ ID NO: 2187228

SEQ ID NO: 2310535 - protein, 26 aa, Cryptosporidium parvum
AGGSVEPYFPGLFAQALSTTNVSDIV

SEQ ID NO: 2310536 - protein, 29 aa, Cryptosporidium parvum
AGIELLRLITWYLSWNRILEYPNASFSIQ

SEQ ID NO: 2310537 - protein, 22 aa, Cryptosporidium parvum
AGIKHKPVILSHKMLPGLLEGQ

SEQ ID NO: 2310538 - protein, 27 aa, Cryptosporidium parvum
AGINWSQYLVFKRLNIKIIYYCTSNYS

SEQ ID NO: 2310539 - protein, 32 aa, Cryptosporidium parvum
AGIPLGLYYMLSISYLWSKIIHIPEKKMFLGL

SEQ ID NO: 2310540 - protein, 29 aa, Cryptosporidium parvum
AGKETLYIEFLMNLLTLPIKNNFGQRSQL

SEQ ID NO: 2310541 - protein, 24 aa, Cryptosporidium parvum
AGKPYSVALSFISSQATCCEICLP

SEQ ID NO: 2310542 - protein, 17 aa, Cryptosporidium parvum
AGKTILEFLNKKSNQKN

SEQ ID NO: 2310543 - protein, 25 aa, Cryptosporidium parvum
AGMAFSMFLKPSRGWNAPPLKQQTI

SEQ ID NO: 2310544 - protein, 25 aa, Cryptosporidium parvum
AGMDERLRGWDSYKWWQTETQKNEK

SEQ ID NO: 2310545 - protein, 20 aa, Cryptosporidium parvum
AGNAILSYWFIKECGKPQNK

SEQ ID NO: 2310546 - protein, 17 aa, Cryptosporidium parvum
AGQERFRTITSAYYRGA

SEQ ID NO: 2310547 - protein, 29 aa, Cryptosporidium parvum
AGQQILAYYLFIVLKFIIPINEIKKLINN

SEQ ID NO: 2310548 - protein, 26 aa, Cryptosporidium parvum
AGRKVCEMFKLSFLKSLLLTNIGVIL

SEQ ID NO: 2310549 - protein, 24 aa, Cryptosporidium parvum
AGSKARNFLQRFVRSLFLQTGYGS

SEQ ID NO: 2310550 - protein, 27 aa, Cryptosporidium parvum
AGSNDYNFLLRGIFDSILGVKTVKEVL

SEQ ID NO: 2310551 - protein, 29 aa, Cryptosporidium parvum
AGTTAGCFNPLLRQMYLGWQGNNNALTGQ

SEQ ID NO: 2310552 - protein, 24 aa, Cryptosporidium parvum
AGVDLLFRLLQYCPKKRITALEAL

SEQ ID NO: 2310553 - protein, 31 aa, Cryptosporidium parvum; identical to SEQ ID NO: 2187239

SEQ ID NO: 2310554 - protein, 28 aa, Cryptosporidium parvum
AGYPVRFPHFEFLLDYMILFSPCGQLSI

SEQ ID NO: 2310555 - protein, 22 aa, Cryptosporidium parvum
AHDWMPDMFIRILCTFDKMIVS

SEQ ID NO: 2310556 - protein, 18 aa, Cryptosporidium parvum
AHFILNDSFIYSYNEFTT

SEQ ID NO: 2310557 - protein, 18 aa, Cryptosporidium parvum
AHGEPYNYKRALCRHWMR

SEQ ID NO: 2310558 - protein, 18 aa, Cryptosporidium parvum
AHISLLLKTGLVHISTDQ

SEQ ID NO: 2310559 - protein, 32 aa, Cryptosporidium parvum; identical to SEQ ID NO: 2187245

SEQ ID NO: 2310560 - protein, 40 aa, Cryptosporidium parvum
AHLPTPMPMPVPMPMPMSMPIPMPMPMPMVAPGPIQIPNM

SEQ ID NO: 2310561 - protein, 40 aa, Cryptosporidium parvum; identical to SEQ ID NO: 2187246

SEQ ID NO: 2310562 - protein, 23 aa, Cryptosporidium parvum
AHNDVIRCILPLENKLFNYPNHD

SEQ ID NO: 2310563 - protein, 17 aa, Cryptosporidium parvum
AHQLILDGYQWSHNKNV

SEQ ID NO: 2310564 - protein, 35 aa, Cryptosporidium parvum; identical to SEQ ID NO: 2187250

SEQ ID NO: 2310565 - protein, 25 aa, Cryptosporidium parvum
AHTPRYLWEKIKLSNNFLVAISQIN

SEQ ID NO: 2310566 - protein, 20 aa, Cryptosporidium parvum
AHYYGKIPRSLAILALNLKG

SEQ ID NO: 2310567 - protein, 17 aa, Cryptosporidium parvum
AICKKQMRLLFEPQRLT

SEQ ID NO: 2310568 - protein, 20 aa, Cryptosporidium parvum
AIDHGLYSHAFQIYKKFSFN

SEQ ID NO: 2310569 - protein, 17 aa, Cryptosporidium parvum
AIDRGWFDPNPITMKLY

SEQ ID NO: 2310570 - protein, 19 aa, Cryptosporidium parvum
AIEAFANALRQIPTILLDN

SEQ ID NO: 2310571 - protein, 25 aa, Cryptosporidium parvum
AIEAYIFVGPIYYQKLKHMVLDKMH

SEQ ID NO: 2310572 - protein, 18 aa, Cryptosporidium parvum
AIEIAYKYGFQNFNLNVG

SEQ ID NO: 2310573 - protein, 21 aa, Cryptosporidium parvum
AIEPSIAPPIPPIPTISSISS

SEQ ID NO: 2310574 - protein, 21 aa, Cryptosporidium parvum
AIERKYDISLFQRLQMSGQQV

SEQ ID NO: 2310575 - protein, 17 aa, Cryptosporidium parvum
AIFDLDDTLIPTDWIRD

SEQ ID NO: 2310576 - protein, 22 aa, Cryptosporidium parvum
AIGQPLLMRVYEDFFSMRGAKV

SEQ ID NO: 2310577 - protein, 19 aa, Cryptosporidium parvum
AIGVVNRVLPRKGVEVRLL

SEQ ID NO: 2310578 - protein, 18 aa, Cryptosporidium parvum
AIHQIHQENILLGGGGMI

SEQ ID NO: 2310579 - protein, 34 aa, Cryptosporidium parvum
AIIDKGTHYEFKFLDGLFVFDPSIKGKNESNSDV

SEQ ID NO: 2310580 - protein, 28 aa, Cryptosporidium parvum
AIIELCRPFINFSFFKKTPVPLSSAILS

SEQ ID NO: 2310581 - protein, 26 aa, Cryptosporidium parvum
AIIGHLTLKFISVFFKPSWRESNFQE

SEQ ID NO: 2310582 - protein, 34 aa, Cryptosporidium parvum
AIIKTLHEYIQNFKNFIILKIDQDYNIIESLHSE

SEQ ID NO: 2310583 - protein, 23 aa, Cryptosporidium parvum
AIKAIEMFGYNPYSLLRLSINEE

SEQ ID NO: 2310584 - protein, 29 aa, Cryptosporidium parvum
AIKLKAEQFLVFLIKLIIKLREDEDQHMI

SEQ ID NO: 2310585 - protein, 25 aa, Cryptosporidium parvum
AILFRPKMIIAGASGYPRMINFKRF

SEQ ID NO: 2310586 - protein, 27 aa, Cryptosporidium parvum
AILHNIKLILLFSKVTLLSGYLRSHKL

SEQ ID NO: 2310587 - protein, 24 aa, Cryptosporidium parvum
AILPNYLDPVWQLNFDPIKHYTQN

SEQ ID NO: 2310588 - protein, 19 aa, Cryptosporidium parvum
AILWEISQPSPFNPVEMDK

SEQ ID NO: 2310589 - protein, 23 aa, Cryptosporidium parvum
AILYKSPSFAFFLSSSCLTESTF

SEQ ID NO: 2310590 - protein, 18 aa, Cryptosporidium parvum
AIMFNRFGGGVSPKAISE

SEQ ID NO: 2310591 - protein, 25 aa, Cryptosporidium parvum
AINAKLKSMILKKAPPKMMSRADFV

SEQ ID NO: 2310592 - protein, 20 aa, Cryptosporidium parvum
AIPSHLRLDSLSLSCISTGL

SEQ ID NO: 2310593 - protein, 38 aa, Cryptosporidium parvum; identical to SEQ ID NO: 2187280

SEQ ID NO: 2310594 - protein, 21 aa, Cryptosporidium parvum
AIRAKIFEYFLSNACITTVTT

SEQ ID NO: 2310595 - protein, 27 aa, Cryptosporidium parvum
AIRANPFLFSQYGLAPFTGLESNKSEE

SEQ ID NO: 2310596 - protein, 17 aa, Cryptosporidium parvum
AIRPFLLDEAEFKNAPE

SEQ ID NO: 2310597 - protein, 35 aa, Cryptosporidium parvum
AIRPTSETIMYPYFAKWIRSHRDLPLKINQWTSIV

SEQ ID NO: 2310598 - protein, 25 aa, Cryptosporidium parvum
AIRQYLKYYGIPISVSMDTLLRRSD

SEQ ID NO: 2310599 - protein, 29 aa, Cryptosporidium parvum
AISAAKKLFYAPLLPNTLIEISALTKCVI

SEQ ID NO: 2310600 - protein, 20 aa, Cryptosporidium parvum
AISADWLILATDVDALFTKN

SEQ ID NO: 2310601 - protein, 26 aa, Cryptosporidium parvum
AISHSRFKVFSWNVLAEIYASQEAFP

SEQ ID NO: 2310602 - protein, 17 aa, Cryptosporidium parvum
AISPFQGVSYKFEFRSS

SEQ ID NO: 2310603 - protein, 17 aa, Cryptosporidium parvum
AISPRVLPIPVKPIMFD

SEQ ID NO: 2310604 - protein, 20 aa, Cryptosporidium parvum
AISSFLLGRTSLYSPTSVLS

SEQ ID NO: 2310605 - protein, 22 aa, Cryptosporidium parvum
AISYNRTNYGLLGILNVIRMTD

SEQ ID NO: 2310606 - protein, 24 aa, Cryptosporidium parvum
AITEAWFCRNLGLAGTLPSISDNQ

SEQ ID NO: 2310607 - protein, 17 aa, Cryptosporidium parvum
AITIANELLLRENKDKA

SEQ ID NO: 2310608 - protein, 27 aa, Cryptosporidium parvum
AIVDANFVLSMPRFLAAATGLDALTHA

SEQ ID NO: 2310609 - protein, 17 aa, Cryptosporidium parvum
AIWDLERSLKIFSYQEN

SEQ ID NO: 2310610 - protein, 31 aa, Cryptosporidium parvum
AIYRGKFIMEYIKLSILYLRVLSKSIALRVV

SEQ ID NO: 2310611 - protein, 36 aa, Cryptosporidium parvum; identical to SEQ ID NO: 2187296

SEQ ID NO: 2310612 - protein, 25 aa, Cryptosporidium parvum
AKDLIRKMLTFHPSLRITATQCLEH

SEQ ID NO: 2310613 - protein, 26 aa, Cryptosporidium parvum
AKEIIKSIGLKPIYFDCIKNLLKHIE

SEQ ID NO: 2310614 - protein, 24 aa, Cryptosporidium parvum
AKELPLYCEFSPRSPLNFKDIFPN

SEQ ID NO: 2310615 - protein, 21 aa, Cryptosporidium parvum
AKELYKGFRNGLRSNCNIQNH

SEQ ID NO: 2310616 - protein, 28 aa, Cryptosporidium parvum
AKESILVPIYGLLVPFHVRLLKNVVCTQ

SEQ ID NO: 2310617 - protein, 31 aa, Cryptosporidium parvum
AKGIQRSLARLWFDYVFSVKCLSPSTSPYLS

SEQ ID NO: 2310618 - protein, 26 aa, Cryptosporidium parvum
AKGSQRRFFALSLLGLEPYFSTAHDE

SEQ ID NO: 2310619 - protein, 22 aa, Cryptosporidium parvum
AKHGNMPNLLLSGPPGTGKTTS

SEQ ID NO: 2310620 - protein, 25 aa, Cryptosporidium parvum
AKICNFKLRSLLLCDNWITRSKSRR

SEQ ID NO: 2310621 - protein, 17 aa, Cryptosporidium parvum
AKIFLAISEFEYIYNFK

SEQ ID NO: 2310622 - protein, 32 aa, Cryptosporidium parvum
AKIQNNVLALLFFIKNIFYLPELITYKLDDQE

SEQ ID NO: 2310623 - protein, 24 aa, Cryptosporidium parvum
AKIQRELGILNERLKRVSESLQRK

SEQ ID NO: 2310624 - protein, 21 aa, Cryptosporidium parvum
AKKMREMYLDISKNVGLSKSH

SEQ ID NO: 2310625 - protein, 26 aa, Cryptosporidium parvum
AKLGRGLLLDVIRQISAFGLSFMRLD

SEQ ID NO: 2310626 - protein, 28 aa, Cryptosporidium parvum
AKLISGILKVFPYLFHQGANYSQEIYEK

SEQ ID NO: 2310627 - protein, 20 aa, Cryptosporidium parvum
AKLVCFYCDLLLKNSYSEIG

SEQ ID NO: 2310628 - protein, 17 aa, Cryptosporidium parvum
AKLYFYYSAMNAGKSTV

SEQ ID NO: 2310629 - protein, 25 aa, Cryptosporidium parvum
AKNLDINLILFKNLQEKVSKKDKEI

SEQ ID NO: 2310630 - protein, 24 aa, Cryptosporidium parvum
AKNNKLYLYFGDELSQALFRHMEM

SEQ ID NO: 2310631 - protein, 31 aa, Cryptosporidium parvum
AKPPKCIFQPPLFHPNIYPSGTVCLSILNED

SEQ ID NO: 2310632 - protein, 17 aa, Cryptosporidium parvum
AKRKYELLYKNKRSPSN

SEQ ID NO: 2310633 - protein, 28 aa, Cryptosporidium parvum
AKRTQMIVPLLHKARRAILLSGTPALNN

SEQ ID NO: 2310634 - protein, 32 aa, Cryptosporidium parvum
AKSFLPPVMLENLPWLHHIDIFGIASTIHCLI

SEQ ID NO: 2310635 - protein, 19 aa, Cryptosporidium parvum
AKSPIWDGGNFKQPPLSVL

SEQ ID NO: 2310636 - protein, 33 aa, Cryptosporidium parvum
AKTCLWEYSAEVREVFLRMLAIGSLSRIVEDIN

SEQ ID NO: 2310637 - protein, 17 aa, Cryptosporidium parvum
AKTPFLCTAIIVNNAEL

SEQ ID NO: 2310638 - protein, 18 aa, Cryptosporidium parvum
AKYFCLTCEHNCFCEVCA

SEQ ID NO: 2310639 - protein, 19 aa, Cryptosporidium parvum
ALACSFSIIFDYDNLPQTA

SEQ ID NO: 2310640 - protein, 19 aa, Cryptosporidium parvum
ALAHIHSCILYFVDISEEC

SEQ ID NO: 2310641 - protein, 26 aa, Cryptosporidium parvum
ALAPQEFMIFPVGAPNFKEALRYGAE

SEQ ID NO: 2310642 - protein, 24 aa, Cryptosporidium parvum
ALATMNRFVLKGRPIRVGRPTNAA

SEQ ID NO: 2310643 - protein, 17 aa, Cryptosporidium parvum
ALCLKKIKGLNTVRLVD

SEQ ID NO: 2310644 - protein, 25 aa, Cryptosporidium parvum
ALDADSFIPIFYQFVTIYMQETSAH

SEQ ID NO: 2310645 - protein, 32 aa, Cryptosporidium parvum; identical to SEQ ID NO: 2187331

SEQ ID NO: 2310646 - protein, 28 aa, Cryptosporidium parvum
ALDKNYVIWYFYTELLREVNTQGSIIID

SEQ ID NO: 2310647 - protein, 23 aa, Cryptosporidium parvum
ALDLLKNLLCHPSKRFDGEQIKK

SEQ ID NO: 2310648 - protein, 28 aa, Cryptosporidium parvum
ALDYGIQLGMKNVPFIETLAIVDKVGNE

SEQ ID NO: 2310649 - protein, 22 aa, Cryptosporidium parvum
ALEFFPTSPIVWKRYIEYLQSQ

SEQ ID NO: 2310650 - protein, 17 aa, Cryptosporidium parvum
ALFALNCRNYPVKVYNF

SEQ ID NO: 2310651 - protein, 21 aa, Cryptosporidium parvum
ALFPIKKFKRFLRLQGFQSQD

SEQ ID NO: 2310652 - protein, 21 aa, Cryptosporidium parvum
ALFVGEMLCLVRFAGDFSIYI

SEQ ID NO: 2310653 - protein, 18 aa, Cryptosporidium parvum
ALGAYVFIADNCKELLDV

SEQ ID NO: 2310654 - protein, 26 aa, Cryptosporidium parvum
ALHKECVLWSLPFVLEPILNNLDMGY

SEQ ID NO: 2310655 - protein, 31 aa, Cryptosporidium parvum; identical to SEQ ID NO: 2187338

SEQ ID NO: 2310656 - protein, 19 aa, Cryptosporidium parvum
ALIINSKNWFKECLDQREA

SEQ ID NO: 2310657 - protein, 17 aa, Cryptosporidium parvum
ALILKLLHSGRNIETAS

SEQ ID NO: 2310658 - protein, 47 aa, Cryptosporidium parvum
ALIQEGFVSIFIDYWHRILRFLHKSLETIYMAYYSKPNYLRNAGNEM

SEQ ID NO: 2310659 - protein, 25 aa, Cryptosporidium parvum
ALISCNWMELDKNLGLHSSKFAFYK

SEQ ID NO: 2310660 - protein, 30 aa, Cryptosporidium parvum
ALISYYIQHGILFKRLGIIIVDELHLLGDE

SEQ ID NO: 2310661 - protein, 26 aa, Cryptosporidium parvum
ALKEYFTEDILLKLVSMKLLEDLGEY

SEQ ID NO: 2310662 - protein, 26 aa, Cryptosporidium parvum
ALKHLKDLIPPSRLQNRPAATASTKH

SEQ ID NO: 2310663 - protein, 21 aa, Cryptosporidium parvum
ALKINFLYRNNNFLNQLITLH

SEQ ID NO: 2310664 - protein, 17 aa, Cryptosporidium parvum
ALKKIMDIETALLEIDP

SEQ ID NO: 2310665 - protein, 21 aa, Cryptosporidium parvum
ALKKNLLLIGSHRANALELVE

SEQ ID NO: 2310666 - protein, 19 aa, Cryptosporidium parvum
ALLALRHLEGSRPLYKLFP

SEQ ID NO: 2310667 - protein, 26 aa, Cryptosporidium parvum
ALLIKKILPLFIKLKVKYISMFVFSM

SEQ ID NO: 2310668 - protein, 18 aa, Cryptosporidium parvum
ALLPFSFGKQQWGDYGGY

SEQ ID NO: 2310669 - protein, 17 aa, Cryptosporidium parvum
ALLTMHMVKTKEIKPPM

SEQ ID NO: 2310670 - protein, 43 aa, Cryptosporidium parvum
ALMEVCIKRFLTCPDFDLQLILGELIWRVLKKTNYGRGYSQSD

SEQ ID NO: 2310671 - protein, 20 aa, Cryptosporidium parvum
ALMKLRNARQRKIKGMRLTP

SEQ ID NO: 2310672 - protein, 22 aa, Cryptosporidium parvum
ALMSVKLRKMFSKPLVSVFEGH

SEQ ID NO: 2310673 - protein, 21 aa, Cryptosporidium parvum
ALNFPIPMDTQFLISSFGYPS

SEQ ID NO: 2310674 - protein, 18 aa, Cryptosporidium parvum
ALNLIKFGGNIIISLKTA

SEQ ID NO: 2310675 - protein, 18 aa, Cryptosporidium parvum
ALNLIKLSRPYVAPNPGF

SEQ ID NO: 2310676 - protein, 17 aa, Cryptosporidium parvum
ALNLNKSGGSLVVDTQS

SEQ ID NO: 2310677 - protein, 31 aa, Cryptosporidium parvum
ALNNPYFEEWKFLYKRLCFIEKEVDSMLLKL

SEQ ID NO: 2310678 - protein, 31 aa, Cryptosporidium parvum
ALNYLSICNISIGFILVLKKLAQLSSEYIEN

SEQ ID NO: 2310679 - protein, 22 aa, Cryptosporidium parvum
ALPKLYNKMCYCVSCAIHSRTV

SEQ ID NO: 2310680 - protein, 17 aa, Cryptosporidium parvum
ALPTMRSMYPGKLEIST

SEQ ID NO: 2310681 - protein, 17 aa, Cryptosporidium parvum
ALQFTYDIITINSLSQL

SEQ ID NO: 2310682 - protein, 22 aa, Cryptosporidium parvum
ALQPYPTGIKWINETHSWKVVY

SEQ ID NO: 2310683 - protein, 23 aa, Cryptosporidium parvum
ALQTYRVVRKLACKTNLVVCALT

SEQ ID NO: 2310684 - protein, 24 aa, Cryptosporidium parvum
ALRPQLRVLKISLKKSLFNEVSKL

SEQ ID NO: 2310685 - protein, 21 aa, Cryptosporidium parvum
ALSIITYFRQEWPVLVICPSS

SEQ ID NO: 2310686 - protein, 24 aa, Cryptosporidium parvum
ALSKFSAYTFQQLRDAILDLDKKI

SEQ ID NO: 2310687 - protein, 18 aa, Cryptosporidium parvum
ALSLSHSLGRFKLKFSPE

SEQ ID NO: 2310688 - protein, 17 aa, Cryptosporidium parvum
ALSLTTLKSGDYWDYDG

SEQ ID NO: 2310689 - protein, 21 aa, Cryptosporidium parvum
ALTKCVIIGKKPLYKIRNYFD

SEQ ID NO: 2310690 - protein, 19 aa, Cryptosporidium parvum
ALTKIWRNLFGKKDMRILM

SEQ ID NO: 2310691 - protein, 19 aa, Cryptosporidium parvum
ALTRRSLGYAYVNYNSVAD

SEQ ID NO: 2310692 - protein, 25 aa, Cryptosporidium parvum
ALVARMLSMLWSKPLIGVNHCVAHI

SEQ ID NO: 2310693 - protein, 51 aa, Cryptosporidium parvum
ALVQDILSFIDRLKNLFAILNNKKIQFPLDYYQKWVLEYNQIINNLYNTNK

SEQ ID NO: 2310694 - protein, 25 aa, Cryptosporidium parvum
AMCFSPAFKLKFSHNAFVSLGSLLE

SEQ ID NO: 2310695 - protein, 21 aa, Cryptosporidium parvum
AMDGYKWWFEQNLVTVWSAPN

SEQ ID NO: 2310696 - protein, 20 aa, Cryptosporidium parvum
AMDRYGLLSDLQLGHSMRLR

SEQ ID NO: 2310697 - protein, 24 aa, Cryptosporidium parvum
AMGKLIKLRVLIVGLRGLGVEIAK

SEQ ID NO: 2310698 - protein, 18 aa, Cryptosporidium parvum
AMILKCLIYLQKVGKYSS

SEQ ID NO: 2310699 - protein, 21 aa, Cryptosporidium parvum
AMIVLTDWFNGKISYYNFPPQ

SEQ ID NO: 2310700 - protein, 23 aa, Cryptosporidium parvum
AMKSILTFYLEMGQVLFIWDFEL

SEQ ID NO: 2310701 - protein, 17 aa, Cryptosporidium parvum
AMLFKKIAEALKELCHD

SEQ ID NO: 2310702 - protein, 28 aa, Cryptosporidium parvum
AMLNDLKLLIGFLIKYPLNCLRTAESDS

SEQ ID NO: 2310703 - protein, 28 aa, Cryptosporidium parvum
AMNINLNPLIWKKFSGLPLSLKDLVDAD

SEQ ID NO: 2310704 - protein, 33 aa, Cryptosporidium parvum; identical to SEQ ID NO: 2187364

SEQ ID NO: 2310705 - protein, 20 aa, Cryptosporidium parvum
AMYESNSQPFIYYDIKSDQM

SEQ ID NO: 2310706 - protein, 20 aa, Cryptosporidium parvum
AMYSPILAGGYGIAGTTAGC

SEQ ID NO: 2310707 - protein, 18 aa, Cryptosporidium parvum
ANATGHFGSGWIWVVIDP

SEQ ID NO: 2310708 - protein, 20 aa, Cryptosporidium parvum
ANEIQKILSIPVFVNPDLCE

SEQ ID NO: 2310709 - protein, 18 aa, Cryptosporidium parvum
ANELNLKCRIGEGGYGKV

SEQ ID NO: 2310710 - protein, 23 aa, Cryptosporidium parvum
ANEQNFLIIPRKKCLEATSSISL

SEQ ID NO: 2310711 - protein, 25 aa, Cryptosporidium parvum
ANETGAFFFLINGPEVMSKMAGEAE

SEQ ID NO: 2310712 - protein, 25 aa, Cryptosporidium parvum
ANETWNFVVVLFRKVKKTTKPKRKR

SEQ ID NO: 2310713 - protein, 18 aa, Cryptosporidium parvum
ANHRFEQELYRQKLQEEK

SEQ ID NO: 2310714 - protein, 34 aa, Cryptosporidium parvum; identical to SEQ ID NO: 2187372

SEQ ID NO: 2310715 - protein, 24 aa, Cryptosporidium parvum
ANIHHIPVMIVSESYKLCEKNYFE

SEQ ID NO: 2310716 - protein, 21 aa, Cryptosporidium parvum
ANIHILSLFEIIRELKLSECN

SEQ ID NO: 2310717 - protein, 24 aa, Cryptosporidium parvum
ANIHSLRSSFYRKLSDRLSLASEL

SEQ ID NO: 2310718 - protein, 24 aa, Cryptosporidium parvum
ANIPEMVPFVIYYCTNLGETDLLL

SEQ ID NO: 2310719 - protein, 26 aa, Cryptosporidium parvum
ANIQNPILCFLISSLLPSLSTPIHWL

SEQ ID NO: 2310720 - protein, 32 aa, Cryptosporidium parvum
ANISSNDFLQKAKVIWLYKNGDKYDKGTIYYV

SEQ ID NO: 2310721 - protein, 39 aa, Cryptosporidium parvum; identical to SEQ ID NO: 2187378

SEQ ID NO: 2310722 - protein, 30 aa, Cryptosporidium parvum
ANKFLLEHYNNFFLPYISRTGNEHILSNPC

SEQ ID NO: 2310723 - protein, 20 aa, Cryptosporidium parvum
ANLNIKWPPSLPNYTQKNLL

SEQ ID NO: 2310724 - protein, 30 aa, Cryptosporidium parvum
ANLPYQISSPFVFKLLSLQNKYRCAVLMFQ

SEQ ID NO: 2310725 - protein, 29 aa, Cryptosporidium parvum
ANMFTLSKWILIPFTKYAPWHRIEESRSE

SEQ ID NO: 2310726 - protein, 25 aa, Cryptosporidium parvum
ANNFFMKKKILFGILKGIDYIHSLK

SEQ ID NO: 2310727 - protein, 21 aa, Cryptosporidium parvum
ANQPCWLYFDIEYNKSQYNLD

SEQ ID NO: 2310728 - protein, 29 aa, Cryptosporidium parvum
ANQSQKILFKLFNYWNLNIDFKQSSFFQG

SEQ ID NO: 2310729 - protein, 24 aa, Cryptosporidium parvum
ANSELLKHIFIEGSPDHIPNSVDI

SEQ ID NO: 2310730 - protein, 23 aa, Cryptosporidium parvum
ANSLYIGILDIYGFEKLEINSFE

SEQ ID NO: 2310731 - protein, 20 aa, Cryptosporidium parvum
ANTFYKFKLISPDTIKVLDN

SEQ ID NO: 2310732 - protein, 20 aa, Cryptosporidium parvum
ANTVLLLKALGVNDLLNFDF

SEQ ID NO: 2310733 - protein, 37 aa, Cryptosporidium parvum
APAPPPTSAPPPPAPPLPPPSFPPYAASSQSKLKLGI

SEQ ID NO: 2310734 - protein, 36 aa, Cryptosporidium parvum
APEIFLRQGYTHLVDWWSVGILMYECLYGGVPFNDD

SEQ ID NO: 2310735 - protein, 17 aa, Cryptosporidium parvum
APFNRRRTFRAHGRITP

SEQ ID NO: 2310736 - protein, 20 aa, Cryptosporidium parvum
APGAHPPRPAIPPPHMYAPN

SEQ ID NO: 2310737 - protein, 18 aa, Cryptosporidium parvum
APHEILMFLQNDQSKISF

SEQ ID NO: 2310738 - protein, 26 aa, Cryptosporidium parvum
APIEFDAFIKIFRAKYKIPFDEDTII

SEQ ID NO: 2310739 - protein, 20 aa, Cryptosporidium parvum
APKITWRRLLILKVVKIFQE

SEQ ID NO: 2310740 - protein, 24 aa, Cryptosporidium parvum
APKSQIPLYMTLNDAKFGNEEVAT

SEQ ID NO: 2310741 - protein, 27 aa, Cryptosporidium parvum
APLNSLRVYQFLSYDERISGLGIGVHW

SEQ ID NO: 2310742 - protein, 28 aa, Cryptosporidium parvum
APNGGIIAPIIVVPGATIPGGMATSPLP

SEQ ID NO: 2310743 - protein, 22 aa, Cryptosporidium parvum
APNYKILVSYFKQFPCSYLLIN

SEQ ID NO: 2310744 - protein, 26 aa, Cryptosporidium parvum
APPPVAEYMPVTTPIIMARQPINALN

SEQ ID NO: 2310745 - protein, 26 aa, Cryptosporidium parvum
APSEFLVFCRVFQNGLRFPPDFPKDA

SEQ ID NO: 2310746 - protein, 21 aa, Cryptosporidium parvum
APSHLGMRFIGGRYVPKTVAS

SEQ ID NO: 2310747 - protein, 23 aa, Cryptosporidium parvum
APTSYFPVMGFLSERRRLDEMPE

SEQ ID NO: 2310748 - protein, 21 aa, Cryptosporidium parvum
AQFYKTKKCPWFAVGRCRMDK

SEQ ID NO: 2310749 - protein, 25 aa, Cryptosporidium parvum
AQGDVLTHFPLFLNEPFTSNENNKS

SEQ ID NO: 2310750 - protein, 30 aa, Cryptosporidium parvum
AQHAALIQGGLLPGLGIPMTQPGVPGVPGV

SEQ ID NO: 2310751 - protein, 20 aa, Cryptosporidium parvum
AQHFLVKAGISVIRRVRKSD

SEQ ID NO: 2310752 - protein, 18 aa, Cryptosporidium parvum
AQHSLLQKELLKAAVDMV

SEQ ID NO: 2310753 - protein, 19 aa, Cryptosporidium parvum
AQIPIYWEDFENCCYTKDL

SEQ ID NO: 2310754 - protein, 23 aa, Cryptosporidium parvum
AQKCKEFGIHALHIKLRAVGGVK

SEQ ID NO: 2310755 - protein, 17 aa, Cryptosporidium parvum
AQKMDLGGSVPLMLQRI

SEQ ID NO: 2310756 - protein, 19 aa, Cryptosporidium parvum
AQKTIFREILYTSLSSHPQ

SEQ ID NO: 2310757 - protein, 26 aa, Cryptosporidium parvum
AQLIYGDGFPILKMMERALTLLSMRV

SEQ ID NO: 2310758 - protein, 23 aa, Cryptosporidium parvum
AQLVMIYDFKFRSLLELCFEKRN

SEQ ID NO: 2310759 - protein, 27 aa, Cryptosporidium parvum
AQNDFPSITLIKIWLTLLTDINIQSRS

SEQ ID NO: 2310760 - protein, 19 aa, Cryptosporidium parvum
AQPFKNCKGILFAIQVCKA

SEQ ID NO: 2310761 - protein, 27 aa, Cryptosporidium parvum
AQSAPRIFRAIFNLAIKRRWSTLARRS

SEQ ID NO: 2310762 - protein, 35 aa, Cryptosporidium parvum
AQTVPPQPTLALTPLGLIPILPKVVGNHQFQGLNP

SEQ ID NO: 2310763 - protein, 20 aa, Cryptosporidium parvum
AQVLWLIRASGRVGLVSLDI

SEQ ID NO: 2310764 - protein, 21 aa, Cryptosporidium parvum
ARAGTGGNGFFRRCRSRSSKQ

SEQ ID NO: 2310765 - protein, 21 aa, Cryptosporidium parvum
ARDWCVSRNRFWGTPIPIWVS

SEQ ID NO: 2310766 - protein, 22 aa, Cryptosporidium parvum
AREARRFTPGLTLTKICGSRWE

SEQ ID NO: 2310767 - protein, 39 aa, Cryptosporidium parvum
ARENDIGSIWLIREIYLSLTPQILKLSMSIDGEWLILGS

SEQ ID NO: 2310768 - protein, 21 aa, Cryptosporidium parvum
ARFEELCADYFRATLAPVEKV

SEQ ID NO: 2310769 - protein, 18 aa, Cryptosporidium parvum
ARGIHFLHSANPPIIHRD

SEQ ID NO: 2310770 - protein, 24 aa, Cryptosporidium parvum
ARGIYSNVLGYLGGISWAILTARI

SEQ ID NO: 2310771 - protein, 24 aa, Cryptosporidium parvum
ARGPPLIPPPMIPPGQFPLINPSI

SEQ ID NO: 2310772 - protein, 32 aa, Cryptosporidium parvum
ARGVDIPMIKYVINFDFPLSPKLFVHRTGRTA

SEQ ID NO: 2310773 - protein, 28 aa, Cryptosporidium parvum
ARIIEEYIFPYQQYTIIYYKLQNDKFSN

SEQ ID NO: 2310774 - protein, 27 aa, Cryptosporidium parvum
ARIKINKLRMIGYWNWLCGDDLCSICS

SEQ ID NO: 2310775 - protein, 20 aa, Cryptosporidium parvum
ARILRFIFELIQLSTFGVSE

SEQ ID NO: 2310776 - protein, 31 aa, Cryptosporidium parvum; identical to SEQ ID NO: 2187417

SEQ ID NO: 2310777 - protein, 27 aa, Cryptosporidium parvum
ARKDFVHAFIVWFDIIFGCGHKPVTFT

SEQ ID NO: 2310778 - protein, 17 aa, Cryptosporidium parvum
ARKHLIMGLKGLTIRGE

SEQ ID NO: 2310779 - protein, 29 aa, Cryptosporidium parvum
ARKKLDGRLFCFLCTFKYKKLKHEEVKKT

SEQ ID NO: 2310780 - protein, 17 aa, Cryptosporidium parvum
ARKMALTVRPKLVPIKK

SEQ ID NO: 2310781 - protein, 20 aa, Cryptosporidium parvum
ARKVLPTFPGIWVEAAKLEE

SEQ ID NO: 2310782 - protein, 21 aa, Cryptosporidium parvum
ARLLRDLFPVMMSRFIATFTR

SEQ ID NO: 2310783 - protein, 20 aa, Cryptosporidium parvum
ARLNAQLFILSFDNSFNELM

SEQ ID NO: 2310784 - protein, 18 aa, Cryptosporidium parvum
ARLTGRVALIKIGGYSDT

SEQ ID NO: 2310785 - protein, 18 aa, Cryptosporidium parvum
ARLYFRIQDPIQLSSSGQ

SEQ ID NO: 2310786 - protein, 18 aa, Cryptosporidium parvum
ARNGHPLRKFGTGSIETL

SEQ ID NO: 2310787 - protein, 24 aa, Cryptosporidium parvum
ARNNPVLFVFGFQGFQHVNMGKYY

SEQ ID NO: 2310788 - protein, 29 aa, Cryptosporidium parvum
ARNNRGTRYLNYKLLIRKIRWVSEQESQE

SEQ ID NO: 2310789 - protein, 28 aa, Cryptosporidium parvum
ARNNSPVCVPPIYDSFWNPSEFNAISKN

SEQ ID NO: 2310790 - protein, 30 aa, Cryptosporidium parvum
ARNTFNEDFRFCRMNKLYKYALRTKMSDLE

SEQ ID NO: 2310791 - protein, 27 aa, Cryptosporidium parvum
ARPGPYAQGRYAPSGALPYSVPGAVPT

SEQ ID NO: 2310792 - protein, 38 aa, Cryptosporidium parvum
ARQNKKVVNLPREAPFIAKVTNLDYSLQLKDIQDFFKN

SEQ ID NO: 2310793 - protein, 23 aa, Cryptosporidium parvum
ARRKGIILTTPPPLSPSKGIYDR

SEQ ID NO: 2310794 - protein, 22 aa, Cryptosporidium parvum
ARRLEQWLRQPLIDEKQIISRQ

SEQ ID NO: 2310795 - protein, 19 aa, Cryptosporidium parvum
ARSLGIPRIFIAANSGARM

SEQ ID NO: 2310796 - protein, 30 aa, Cryptosporidium parvum; identical to SEQ ID NO: 2187437

SEQ ID NO: 2310797 - protein, 17 aa, Cryptosporidium parvum
ARSQLMGAELRLTSVKS

SEQ ID NO: 2310798 - protein, 17 aa, Cryptosporidium parvum
ARSTLKRILLEGDGRHF

SEQ ID NO: 2310799 - protein, 30 aa, Cryptosporidium parvum
ARTQQQFEETLPLILDTMLQITIMDIEDTI

SEQ ID NO: 2310800 - protein, 25 aa, Cryptosporidium parvum
ARVRPFILCAILRDLSFNEDVYKSF

SEQ ID NO: 2310801 - protein, 23 aa, Cryptosporidium parvum
ARVYCENLCFLSKLFLDHKTLYN

SEQ ID NO: 2310802 - protein, 33 aa, Cryptosporidium parvum
ASAARYIFTKLSKWTRYIFPEADDPLLTYLYDD

SEQ ID NO: 2310803 - protein, 21 aa, Cryptosporidium parvum
ASALVLLLNNLASQIQRLFEC

SEQ ID NO: 2310804 - protein, 23 aa, Cryptosporidium parvum
ASCCYDLAYGLILLDNIIKDQMS

SEQ ID NO: 2310805 - protein, 22 aa, Cryptosporidium parvum
ASCLNPAKTLMYCSGEYGALEA

SEQ ID NO: 2310806 - protein, 19 aa, Cryptosporidium parvum
ASDYRWFYSSVVSHSVNYQ

SEQ ID NO: 2310807 - protein, 30 aa, Cryptosporidium parvum
ASENEFWHFLSLGAIFLKYSKKNSIAVELF

SEQ ID NO: 2310808 - protein, 36 aa, Cryptosporidium parvum
ASETYDEFIFYEPTEKFYEKLISGPIQPMAQHRLQP

SEQ ID NO: 2310809 - protein, 27 aa, Cryptosporidium parvum
ASFDKTIRLWDGHSGKFIAVLRGHVGP

SEQ ID NO: 2310810 - protein, 40 aa, Cryptosporidium parvum; identical to SEQ ID NO: 2187451

SEQ ID NO: 2310811 - protein, 23 aa, Cryptosporidium parvum
ASGEEFLVYHGKKYYFGPVIEGI

SEQ ID NO: 2310812 - protein, 24 aa, Cryptosporidium parvum
ASGRYNFFFTLNSFARKYLKHNGI

SEQ ID NO: 2310813 - protein, 21 aa, Cryptosporidium parvum
ASGVRATPPTAPGIGVHPPTI

SEQ ID NO: 2310814 - protein, 20 aa, Cryptosporidium parvum
ASHHFHPGYPGAPFPQTGPT

SEQ ID NO: 2310815 - protein, 24 aa, Cryptosporidium parvum
ASIANALRRILLVEIPTVAIETVQ

SEQ ID NO: 2310816 - protein, 26 aa, Cryptosporidium parvum
ASIIQPFFETMNIFILQFSSCCKEIR

SEQ ID NO: 2310817 - protein, 21 aa, Cryptosporidium parvum
ASIPIFCLRDCQPFAKFACLR

SEQ ID NO: 2310818 - protein, 22 aa, Cryptosporidium parvum
ASISYLISLKDKKLFKLLDEVF

SEQ ID NO: 2310819 - protein, 19 aa, Cryptosporidium parvum
ASIYKKYLRYKCSNKLLPC

SEQ ID NO: 2310820 - protein, 24 aa, Cryptosporidium parvum
ASKDFTLKIWNITTGTIINTLSSH

SEQ ID NO: 2310821 - protein, 24 aa, Cryptosporidium parvum
ASKEILLFLENSLVALNEQLTNYK

SEQ ID NO: 2310822 - protein, 21 aa, Cryptosporidium parvum
ASKMLRGEIWFHNIGIEEICD

SEQ ID NO: 2310823 - protein, 25 aa, Cryptosporidium parvum
ASKVNPKIFIIPNALNQDECDEIIS

SEQ ID NO: 2310824 - protein, 23 aa, Cryptosporidium parvum
ASLPTPYSILLLQLAKITGENYL

SEQ ID NO: 2310825 - protein, 24 aa, Cryptosporidium parvum
ASMPKYWHFIRLMGRQPSNEVLEC

SEQ ID NO: 2310826 - protein, 21 aa, Cryptosporidium parvum
ASNLLIERLMLNSDVFETNVC

SEQ ID NO: 2310827 - protein, 17 aa, Cryptosporidium parvum
ASPIGELFNLSLSSSEY

SEQ ID NO: 2310828 - protein, 35 aa, Cryptosporidium parvum
ASPSKKMHISPSRPTGLPPPLPYNSINNRESGNSR

SEQ ID NO: 2310829 - protein, 29 aa, Cryptosporidium parvum
ASQAVLLQKLNIKPFSYGLKVNNIYDHGS

SEQ ID NO: 2310830 - protein, 38 aa, Cryptosporidium parvum; identical to SEQ ID NO: 2187466

SEQ ID NO: 2310831 - protein, 25 aa, Cryptosporidium parvum
ASQMMHWIHLIDSLDLSNILSCISL

SEQ ID NO: 2310832 - protein, 27 aa, Cryptosporidium parvum
ASQSLQIPVFLKYLPSIVLDSELHPHL

SEQ ID NO: 2310833 - protein, 24 aa, Cryptosporidium parvum
ASRWLKYTFLVTRVKKSPIAYGFK

SEQ ID NO: 2310834 - protein, 31 aa, Cryptosporidium parvum; identical to SEQ ID NO: 2187469

SEQ ID NO: 2310835 - protein, 22 aa, Cryptosporidium parvum
ASSFTLLYTFESSENYVIDVAW

SEQ ID NO: 2310836 - protein, 24 aa, Cryptosporidium parvum
ASSMGLDMLLMPPTVEMEQNDSNH

SEQ ID NO: 2310837 - protein, 19 aa, Cryptosporidium parvum
ASSSLFSFGSTMASSNPSL

SEQ ID NO: 2310838 - protein, 24 aa, Cryptosporidium parvum
ASTDFSLQTALFFACRDGNVKTAE

SEQ ID NO: 2310839 - protein, 29 aa, Cryptosporidium parvum
ASTGNHFKPINGFVFDKTGKDLKEVSELH

SEQ ID NO: 2310840 - protein, 19 aa, Cryptosporidium parvum
ASTHIFGLRFDLIRVLTDK

SEQ ID NO: 2310841 - protein, 25 aa, Cryptosporidium parvum
ASTLYPSFGYLYPEGTEQIRKAWND

SEQ ID NO: 2310842 - protein, 20 aa, Cryptosporidium parvum
ASTNLWLNLSDGFIGCGRRL

SEQ ID NO: 2310843 - protein, 35 aa, Cryptosporidium parvum
ASTQDFPLMIYGINLVRPIRKLSGFKLGFHLKPLL

SEQ ID NO: 2310844 - protein, 31 aa, Cryptosporidium parvum
ASVIVSYLRKMQITATLIFTLNQIGLDNNII

SEQ ID NO: 2310845 - protein, 21 aa, Cryptosporidium parvum
ASVLWSLRSILINNVNKYHKE

SEQ ID NO: 2310846 - protein, 27 aa, Cryptosporidium parvum
ASYKERFPMWSLPNIINLLKSEKYAHE

SEQ ID NO: 2310847 - protein, 26 aa, Cryptosporidium parvum
ATCDLEFCVELFWLLISEISIQEYPK

SEQ ID NO: 2310848 - protein, 19 aa, Cryptosporidium parvum
ATCLLIKELKEPIRDRKKV

SEQ ID NO: 2310849 - protein, 33 aa, Cryptosporidium parvum
ATCYMGSYLQYLFMNLDFRSTFLRINCSQIAGL

SEQ ID NO: 2310850 - protein, 24 aa, Cryptosporidium parvum
ATEFAVLLLSLLEAKLESLSKLSN

SEQ ID NO: 2310851 - protein, 24 aa, Cryptosporidium parvum
ATELVNWRLVFYMNILNEDPNHIF

SEQ ID NO: 2310852 - protein, 26 aa, Cryptosporidium parvum
ATETLKVAILLFLTEFKRKIVALNYP

SEQ ID NO: 2310853 - protein, 20 aa, Cryptosporidium parvum
ATFFSTHPVYRNLSPELVGT

SEQ ID NO: 2310854 - protein, 25 aa, Cryptosporidium parvum
ATGLQRLDNFPLLENLKVLEIQDNH

SEQ ID NO: 2310855 - protein, 23 aa, Cryptosporidium parvum
ATKNLILKYPTKHKNILSFLATN

SEQ ID NO: 2310856 - protein, 22 aa, Cryptosporidium parvum
ATKYLIKRFIQNNVRFFFTRNI

SEQ ID NO: 2310857 - protein, 18 aa, Cryptosporidium parvum
ATLALMDLAFRKNKNERV

SEQ ID NO: 2310858 - protein, 26 aa, Cryptosporidium parvum
ATLHPLLHKLCIITGRIRDILILLDL

SEQ ID NO: 2310859 - protein, 19 aa, Cryptosporidium parvum
ATLQVYLYSIEDGSFYVHH

SEQ ID NO: 2310860 - protein, 24 aa, Cryptosporidium parvum
ATPGRLFHHIIEAGLSLIAVKIIV

SEQ ID NO: 2310861 - protein, 26 aa, Cryptosporidium parvum
ATPILFSRIVLSLKNKLSLLTLSTLV

SEQ ID NO: 2310862 - protein, 24 aa, Cryptosporidium parvum
ATQDFLLGMYVLTGRDIFLTRDQF

SEQ ID NO: 2310863 - protein, 23 aa, Cryptosporidium parvum
ATQKIIEMLYKMPIKSVYSDCLM

SEQ ID NO: 2310864 - protein, 18 aa, Cryptosporidium parvum
ATQPHYLANLPSFSKITY

SEQ ID NO: 2310865 - protein, 30 aa, Cryptosporidium parvum; identical to SEQ ID NO: 2187500

SEQ ID NO: 2310866 - protein, 17 aa, Cryptosporidium parvum
ATSPSLLYSLRKQSRFL

SEQ ID NO: 2310867 - protein, 32 aa, Cryptosporidium parvum
ATSSIPLPTVFVSPLRHDLVRYVFTNMSKNKR

SEQ ID NO: 2310868 - protein, 24 aa, Cryptosporidium parvum
ATSVNLFATPPPNRKGRYSVVSSY

SEQ ID NO: 2310869 - protein, 23 aa, Cryptosporidium parvum
ATVGQIPMINPIQNVIPSQMPSM

SEQ ID NO: 2310870 - protein, 34 aa, Cryptosporidium parvum
AVATYFLYKTYVHRFIFALATIIPLSGEDLLRKG

SEQ ID NO: 2310871 - protein, 26 aa, Cryptosporidium parvum
AVAVFVPYAIFMAYVRKIQGRIIAEL

SEQ ID NO: 2310872 - protein, 24 aa, Cryptosporidium parvum
AVCGWNIKFPTFSLSTQNSMVGNV

SEQ ID NO: 2310873 - protein, 17 aa, Cryptosporidium parvum
AVDMWSIGCIFAELLTG

SEQ ID NO: 2310874 - protein, 25 aa, Cryptosporidium parvum
AVFELFKAIINFPNSGFVLIVASNT

SEQ ID NO: 2310875 - protein, 22 aa, Cryptosporidium parvum
AVFLVLDWILNERLDVPYISLH

SEQ ID NO: 2310876 - protein, 25 aa, Cryptosporidium parvum
AVHDAILRFQIMEAELICPICNHRY

SEQ ID NO: 2310877 - protein, 19 aa, Cryptosporidium parvum
AVISTLLRKFPDAKLISPT

SEQ ID NO: 2310878 - protein, 17 aa, Cryptosporidium parvum
AVIVQIFMKWLKDDIMI

SEQ ID NO: 2310879 - protein, 25 aa, Cryptosporidium parvum
AVKSTQLLLTLQNQTPLIGLQNTPI

SEQ ID NO: 2310880 - protein, 32 aa, Cryptosporidium parvum; identical to SEQ ID NO: 2187512

SEQ ID NO: 2310881 - protein, 28 aa, Cryptosporidium parvum
AVLALIDLGIPMEFFPLAVSIAESSHFY

SEQ ID NO: 2310882 - protein, 18 aa, Cryptosporidium parvum
AVLGAYKKAIKRHPKMVE

SEQ ID NO: 2310883 - protein, 18 aa, Cryptosporidium parvum
AVMKYGLNNWSRVASLLI

SEQ ID NO: 2310884 - protein, 18 aa, Cryptosporidium parvum
AVNLQGTTGLPIHCFSKV

SEQ ID NO: 2310885 - protein, 24 aa, Cryptosporidium parvum
AVNVDTFFFLISALVFARNKKYVN

SEQ ID NO: 2310886 - protein, 26 aa, Cryptosporidium parvum
AVPWSNIREIFTTKSELRMVNTRAAI

SEQ ID NO: 2310887 - protein, 21 aa, Cryptosporidium parvum
AVQNSPFLEKLRKLDYEVIYM

SEQ ID NO: 2310888 - protein, 23 aa, Cryptosporidium parvum
AVQNVQIELYPYGNLRVIEKPQN

SEQ ID NO: 2310889 - protein, 23 aa, Cryptosporidium parvum
AVRLFHVSNMVIKLLLGSAKETY

SEQ ID NO: 2310890 - protein, 26 aa, Cryptosporidium parvum
AVRNSWMHIFSFDSAIPRSNQRETIG

SEQ ID NO: 2310891 - protein, 28 aa, Cryptosporidium parvum
AVSFLKKFNVPLLILGGGGYTLRNVPKC

SEQ ID NO: 2310892 - protein, 23 aa, Cryptosporidium parvum
AVSMDLRSPFKQSSSLLADCILG

SEQ ID NO: 2310893 - protein, 19 aa, Cryptosporidium parvum
AVVDFRPPMIKNANTVRNG

SEQ ID NO: 2310894 - protein, 26 aa, Cryptosporidium parvum
AVVPCGLLYPIVFIGNIPPNVPYEYL

SEQ ID NO: 2310895 - protein, 20 aa, Cryptosporidium parvum
AWCYRHFIFTNLKKMNALKE

SEQ ID NO: 2310896 - protein, 21 aa, Cryptosporidium parvum
AWFDLDLGNTPYKLLRYSESA

SEQ ID NO: 2310897 - protein, 19 aa, Cryptosporidium parvum
AWISKSLLSLLYKSEQEEP

SEQ ID NO: 2310898 - protein, 21 aa, Cryptosporidium parvum
AWKYQEVSLYYIFNEIIENNN

SEQ ID NO: 2310899 - protein, 17 aa, Cryptosporidium parvum
AYCRYTYSNLGISKIAI

SEQ ID NO: 2310900 - protein, 23 aa, Cryptosporidium parvum
AYDNIFYCNFRKKKEKCTEDFRD

SEQ ID NO: 2310901 - protein, 18 aa, Cryptosporidium parvum
AYKNLFSQNIKLIRNLYF

SEQ ID NO: 2310902 - protein, 21 aa, Cryptosporidium parvum
AYLEKKFILAIEILEEIVVKA

SEQ ID NO: 2310903 - protein, 29 aa, Cryptosporidium parvum
AYRDALKYALFEFQLRRDQYRLLCDSNDL

SEQ ID NO: 2310904 - protein, 19 aa, Cryptosporidium parvum
AYRQISLLLRRPPGRESYP

SEQ ID NO: 2310905 - protein, 21 aa, Cryptosporidium parvum
AYRVPYSVKVLADELKLLYPY

SEQ ID NO: 2310906 - protein, 29 aa, Cryptosporidium parvum
AYSHIKYISKPILLGYLPLEEMLNKNKMN

SEQ ID NO: 2310907 - protein, 20 aa, Cryptosporidium parvum
CALTLSMYFIKTCGRACNVN

SEQ ID NO: 2310908 - protein, 25 aa, Cryptosporidium parvum
CAQLQKLLYDLPRIKQKELKRLKLV

SEQ ID NO: 2310909 - protein, 21 aa, Cryptosporidium parvum
CAQYFLGFCKYGPKCKRRHEP

SEQ ID NO: 2310910 - protein, 27 aa, Cryptosporidium parvum
CATESNSLYIWIFSHESIKSNELNQKT

SEQ ID NO: 2310911 - protein, 18 aa, Cryptosporidium parvum
CCCYSKNCLCDISVRYKS

SEQ ID NO: 2310912 - protein, 23 aa, Cryptosporidium parvum
CCFSVPFFQGSPIYKACRRLDIG

SEQ ID NO: 2310913 - protein, 30 aa, Cryptosporidium parvum
CCGKLAKLRSYIIWNSIAVIKVLKKRRKKV

SEQ ID NO: 2310914 - protein, 19 aa, Cryptosporidium parvum
CCTAVTWQYAPPEIVGCTD

SEQ ID NO: 2310915 - protein, 26 aa, Cryptosporidium parvum
CDPIDLIVKFLDNPSKYKDSICWATI

SEQ ID NO: 2310916 - protein, 25 aa, Cryptosporidium parvum
CDTRSIFLAILMNISQIYSFSRQIY

SEQ ID NO: 2310917 - protein, 22 aa, Cryptosporidium parvum
CDTWYFDQIYRHNINKFIQAQT

SEQ ID NO: 2310918 - protein, 24 aa, Cryptosporidium parvum
CDVCYSWWVFASLKIVKNITINRN

SEQ ID NO: 2310919 - protein, 29 aa, Cryptosporidium parvum
CDVWSAGVILYILLSGTPPFYGKNEYDIL

SEQ ID NO: 2310920 - protein, 24 aa, Cryptosporidium parvum
CEDRDPYLAYIAYRKAWGQCDDEI

SEQ ID NO: 2310921 - protein, 22 aa, Cryptosporidium parvum
CEDRHITKKQFFFNFNNQTPST

SEQ ID NO: 2310922 - protein, 25 aa, Cryptosporidium parvum
CEEMLEFLTKKLEFYRGLEAEILAL

SEQ ID NO: 2310923 - protein, 27 aa, Cryptosporidium parvum
CEEPFSIFKRHECWCRPLEQIGSNTEG

SEQ ID NO: 2310924 - protein, 20 aa, Cryptosporidium parvum
CEERGYYDLVSSLSVHLINQ

SEQ ID NO: 2310925 - protein, 18 aa, Cryptosporidium parvum
CEHCSIGGYPYYCNCYKM

SEQ ID NO: 2310926 - protein, 25 aa, Cryptosporidium parvum
CEIIPFELPIDFITSIYNSGTISSG

SEQ ID NO: 2310927 - protein, 23 aa, Cryptosporidium parvum
CEIYLRRMHGLENELQILTNNIY

SEQ ID NO: 2310928 - protein, 25 aa, Cryptosporidium parvum
CEKDIYIKPIFKAERTTLILRDLEN

SEQ ID NO: 2310929 - protein, 17 aa, Cryptosporidium parvum
CEKLAYNTPLMDFLKNL

SEQ ID NO: 2310930 - protein, 21 aa, Cryptosporidium parvum
CEKNLILKKLSVLNLRKQNVT

SEQ ID NO: 2310931 - protein, 30 aa, Cryptosporidium parvum; identical to SEQ ID NO: 2187569

SEQ ID NO: 2310932 - protein, 20 aa, Cryptosporidium parvum
CENCAISQIVLYDHNIRQYE

SEQ ID NO: 2310933 - protein, 23 aa, Cryptosporidium parvum
CEPLWRNFELVCLINEFKISKKA

SEQ ID NO: 2310934 - protein, 23 aa, Cryptosporidium parvum
CERRDVVLILPTGGGKSLTYQLP

SEQ ID NO: 2310935 - protein, 18 aa, Cryptosporidium parvum
CESDTLRVYTISSGDIFR

SEQ ID NO: 2310936 - protein, 35 aa, Cryptosporidium parvum; identical to SEQ ID NO: 2187575

SEQ ID NO: 2310937 - protein, 24 aa, Cryptosporidium parvum
CESTRLWIRLQNHGTPKDKLRRER

SEQ ID NO: 2310938 - protein, 26 aa, Cryptosporidium parvum
CEYPKTLLGCTWYYNPNRSNLQDIRN

SEQ ID NO: 2310939 - protein, 22 aa, Cryptosporidium parvum
CFEYMRIKYSFVIPDKEYLVDY

SEQ ID NO: 2310940 - protein, 20 aa, Cryptosporidium parvum
CFHDLYKWNIDKDEWRQVVI

SEQ ID NO: 2310941 - protein, 20 aa, Cryptosporidium parvum
CFIDFYYYQIANIYFQLRND

SEQ ID NO: 2310942 - protein, 19 aa, Cryptosporidium parvum
CFISQITWCVYMHGALIGG

SEQ ID NO: 2310943 - protein, 17 aa, Cryptosporidium parvum
CFQMKIPPNYFWIQGDN

SEQ ID NO: 2310944 - protein, 23 aa, Cryptosporidium parvum
CFRRRLAEFIIYPPPVMDHRRKA

SEQ ID NO: 2310945 - protein, 18 aa, Cryptosporidium parvum
CFSLKVPPVFCNNGNLLL

SEQ ID NO: 2310946 - protein, 27 aa, Cryptosporidium parvum
CFTISDFIKEYWKQPVFTPEFSENTLM

SEQ ID NO: 2310947 - protein, 17 aa, Cryptosporidium parvum
CFVQYYSHADALTAVTF

SEQ ID NO: 2310948 - protein, 20 aa, Cryptosporidium parvum
CGEWGYNPRLLLSINSHLGS

SEQ ID NO: 2310949 - protein, 22 aa, Cryptosporidium parvum
CGGEQSGWFWDGELNVCLKLRT

SEQ ID NO: 2310950 - protein, 23 aa, Cryptosporidium parvum
CGHIYCWPCIIKLMNIILENDEY

SEQ ID NO: 2310951 - protein, 18 aa, Cryptosporidium parvum
CGILYYYCTYTENLPNLL

SEQ ID NO: 2310952 - protein, 24 aa, Cryptosporidium parvum
CGINDLCWINPTLTPNIFSTVNHQ

SEQ ID NO: 2310953 - protein, 42 aa, Cryptosporidium parvum
CGIYDSKFKYLILNFSSLYMKKLVQPYYSKIFKSIHNTCFLG

SEQ ID NO: 2310954 - protein, 17 aa, Cryptosporidium parvum
CGKSQCCINTPGGFECK

SEQ ID NO: 2310955 - protein, 24 aa, Cryptosporidium parvum
CGKTVYEKFWQLPLDPEFQEMVKS

SEQ ID NO: 2310956 - protein, 17 aa, Cryptosporidium parvum
CGLKPIIKCTGKIIIKM

SEQ ID NO: 2310957 - protein, 50 aa, Cryptosporidium parvum
CGNLPYSCTEEEIRGLFEECGSIERVSVLSDKGCAFITFEQEEGAKSAIQ

SEQ ID NO: 2310958 - protein, 26 aa, Cryptosporidium parvum
CGNMPFKTFIFKILEDSGLSSKRGFN

SEQ ID NO: 2310959 - protein, 20 aa, Cryptosporidium parvum
CGNRKLVAIEKLLSSDFSSI

SEQ ID NO: 2310960 - protein, 24 aa, Cryptosporidium parvum
CGPIKAIYLGLNHQTMQPCGFCFV

SEQ ID NO: 2310961 - protein, 17 aa, Cryptosporidium parvum
CGYGGLLVWLSEHFKDK

SEQ ID NO: 2310962 - protein, 24 aa, Cryptosporidium parvum
CHCHDWLAAPVLTSLRRIGNNNRT

SEQ ID NO: 2310963 - protein, 30 aa, Cryptosporidium parvum
CHGSLIFWNYITINWIRISPSFLRKIIESD

SEQ ID NO: 2310964 - protein, 21 aa, Cryptosporidium parvum
CHIKKFYFSHLIKQVLQLWYS

SEQ ID NO: 2310965 - protein, 19 aa, Cryptosporidium parvum
CHINGLSIRYIPSLKRMRF

SEQ ID NO: 2310966 - protein, 27 aa, Cryptosporidium parvum
CHLCFSRFMSLRPFLLKAVQRKWKCHL

SEQ ID NO: 2310967 - protein, 19 aa, Cryptosporidium parvum
CHNPKWNSYFEFDCLSNLN

SEQ ID NO: 2310968 - protein, 28 aa, Cryptosporidium parvum
CHRLRLQSFCFMWMLPEHALLNSIIESG

SEQ ID NO: 2310969 - protein, 27 aa, Cryptosporidium parvum
CHSLTRIFGRLYLFGGFDGIQCFNDLW

SEQ ID NO: 2310970 - protein, 27 aa, Cryptosporidium parvum
CICDGNLLYLDFRLIGKINLLCKGVSS

SEQ ID NO: 2310971 - protein, 48 aa, Cryptosporidium parvum
CICKSFNLIDFFSCILRICPPVLYLDLWDYLLMTILFVLKVERDEFVK

SEQ ID NO: 2310972 - protein, 24 aa, Cryptosporidium parvum
CIEFYKIEAIIPLIIKFLSGQVKS

SEQ ID NO: 2310973 - protein, 38 aa, Cryptosporidium parvum
CIGNLILISINPYKVIPELYGRNLFNLYRNGLESVNSM

SEQ ID NO: 2310974 - protein, 19 aa, Cryptosporidium parvum
CIGNVFLIKTIPITIYNEF

SEQ ID NO: 2310975 - protein, 28 aa, Cryptosporidium parvum
CIHQCSCIMIWKLFIPFVDEKINSLKDR

SEQ ID NO: 2310976 - protein, 17 aa, Cryptosporidium parvum
CIITWDPVKTKLLLNLD

SEQ ID NO: 2310977 - protein, 19 aa, Cryptosporidium parvum
CIKNSWPGMFRGIFGAHYL

SEQ ID NO: 2310978 - protein, 17 aa, Cryptosporidium parvum
CIKVIRFLHTSNLLVEG

SEQ ID NO: 2310979 - protein, 18 aa, Cryptosporidium parvum
CILVFDDIETLGAFTKKD

SEQ ID NO: 2310980 - protein, 31 aa, Cryptosporidium parvum; identical to SEQ ID NO: 2187609

SEQ ID NO: 2310981 - protein, 23 aa, Cryptosporidium parvum
CIPADLILVTLTKQLLSIVSASA

SEQ ID NO: 2310982 - protein, 29 aa, Cryptosporidium parvum
CIPCIYCKEPLLRIPVILKPNELPNRSLV

SEQ ID NO: 2310983 - protein, 17 aa, Cryptosporidium parvum
CIPSLLEDKHHGVLLGT

SEQ ID NO: 2310984 - protein, 28 aa, Cryptosporidium parvum
CIQNIDSLILYIFKMYCIKTISCTFGQE

SEQ ID NO: 2310985 - protein, 25 aa, Cryptosporidium parvum
CIQNLHALFRLFLTPPKTSSSSHDQ

SEQ ID NO: 2310986 - protein, 17 aa, Cryptosporidium parvum
CISFCIYGQGIIDWNNP

SEQ ID NO: 2310987 - protein, 23 aa, Cryptosporidium parvum
CISNVPFLFEKISSLKKRLVNLE

SEQ ID NO: 2310988 - protein, 23 aa, Cryptosporidium parvum
CISSYLIHFLKDVSPLPFNDNSE

SEQ ID NO: 2310989 - protein, 25 aa, Cryptosporidium parvum
CISTPPPFTGLPQNNPFFSSNGINE

SEQ ID NO: 2310990 - protein, 27 aa, Cryptosporidium parvum
CITIGKWNSYNWSNLLEYFANQFDEST

SEQ ID NO: 2310991 - protein, 18 aa, Cryptosporidium parvum
CITPPLSSELITSNNFYF

SEQ ID NO: 2310992 - protein, 34 aa, Cryptosporidium parvum; identical to SEQ ID NO: 2187615

SEQ ID NO: 2310993 - protein, 32 aa, Cryptosporidium parvum; identical to SEQ ID NO: 2187616

SEQ ID NO: 2310994 - protein, 34 aa, Cryptosporidium parvum
CKCDELDILLERWNPFLLYKFEQEYLKNGAILMD

SEQ ID NO: 2310995 - protein, 18 aa, Cryptosporidium parvum
CKDELFKVNKKTLDLLLP

SEQ ID NO: 2310996 - protein, 29 aa, Cryptosporidium parvum
CKDNIFVDNIFLFWLSRSSSIIKIGGVKY

SEQ ID NO: 2310997 - protein, 26 aa, Cryptosporidium parvum
CKGTRNINIPIWRQGTMLPRVCNTTP

SEQ ID NO: 2310998 - protein, 31 aa, Cryptosporidium parvum; identical to SEQ ID NO: 2187618

SEQ ID NO: 2310999 - protein, 23 aa, Cryptosporidium parvum
CKHLKQSLLLQNSGRHRFKHPPT

SEQ ID NO: 2311000 - protein, 29 aa, Cryptosporidium parvum
CKHPLLLLKPEFQSWRILLKNKSNHDLKQ

SEQ ID NO: 2311001 - protein, 30 aa, Cryptosporidium parvum
CKICNRPCTMFRWKLHNSKKYNQTTICYSC

SEQ ID NO: 2311002 - protein, 26 aa, Cryptosporidium parvum
CKKRLLTLRKSLVPPVTRSALEVVNL

SEQ ID NO: 2311003 - protein, 17 aa, Cryptosporidium parvum
CKLLLLDSNVKTLDKNS

SEQ ID NO: 2311004 - protein, 19 aa, Cryptosporidium parvum
CKNDFLRQKLYGIHMRKVC

SEQ ID NO: 2311005 - protein, 23 aa, Cryptosporidium parvum
CKNEKYPERLIYSYLRELNKSTL

SEQ ID NO: 2311006 - protein, 18 aa, Cryptosporidium parvum
CKQFASMLHLSKLYHKSK

SEQ ID NO: 2311007 - protein, 22 aa, Cryptosporidium parvum
CKQKNCFAFLKLESLVSEFLKK

SEQ ID NO: 2311008 - protein, 23 aa, Cryptosporidium parvum
CKQLVYMGIIGLLLDVLKQNDLR

SEQ ID NO: 2311009 - protein, 24 aa, Cryptosporidium parvum
CKQRRFLAIKRCKHFQLGGDKKRK

SEQ ID NO: 2311010 - protein, 23 aa, Cryptosporidium parvum
CKRDGVKMILSNQIRLLEEKQRN

SEQ ID NO: 2311011 - protein, 19 aa, Cryptosporidium parvum
CKRLLGLDHYFKPGGLIGI

SEQ ID NO: 2311012 - protein, 18 aa, Cryptosporidium parvum
CKRRNFLKILQNTKFFQS

SEQ ID NO: 2311013 - protein, 26 aa, Cryptosporidium parvum
CLACELVHLTFMLYSCKFNLKNGKGR

SEQ ID NO: 2311014 - protein, 25 aa, Cryptosporidium parvum
CLCEKKFLDLDFPYIHKRAVLVKQG

SEQ ID NO: 2311015 - protein, 23 aa, Cryptosporidium parvum
CLCENNNLYYWFLNNECGFDSNL

SEQ ID NO: 2311016 - protein, 24 aa, Cryptosporidium parvum
CLDHDKLWEFTPNANLRVGDIITG

SEQ ID NO: 2311017 - protein, 21 aa, Cryptosporidium parvum
CLERDIIALRKGLNIQLDNMV

SEQ ID NO: 2311018 - protein, 18 aa, Cryptosporidium parvum
CLFLANYVLMVFQRNSSN

SEQ ID NO: 2311019 - protein, 18 aa, Cryptosporidium parvum
CLGAFVDPCTLSCSHSFC

SEQ ID NO: 2311020 - protein, 18 aa, Cryptosporidium parvum
CLGFIHPETHLAFDDPIN

SEQ ID NO: 2311021 - protein, 27 aa, Cryptosporidium parvum
CLGGQLKFSCLTLPPKGLNASSEDIIV

SEQ ID NO: 2311022 - protein, 26 aa, Cryptosporidium parvum
CLGLDKVPPRTWICPWHECCLCFRRA

SEQ ID NO: 2311023 - protein, 18 aa, Cryptosporidium parvum
CLHAYIRRKFETDESWRS

SEQ ID NO: 2311024 - protein, 33 aa, Cryptosporidium parvum; identical to SEQ ID NO: 2187639

SEQ ID NO: 2311025 - protein, 22 aa, Cryptosporidium parvum
CLITIPFLQWELINDQVYTNLF

SEQ ID NO: 2311026 - protein, 29 aa, Cryptosporidium parvum
CLKECITLLGLLILIRMYSVRAENYIAKK

SEQ ID NO: 2311027 - protein, 21 aa, Cryptosporidium parvum
CLLHVSLLLKQKIQAFVCIGT

SEQ ID NO: 2311028 - protein, 29 aa, Cryptosporidium parvum
CLLPGFHPITAWLLPPSYFEKGGQLKKSA

SEQ ID NO: 2311029 - protein, 17 aa, Cryptosporidium parvum
CLLYYQNNIIWTFNNSC

SEQ ID NO: 2311030 - protein, 17 aa, Cryptosporidium parvum
CLMDTFSLVRSISNLRL

SEQ ID NO: 2311031 - protein, 19 aa, Cryptosporidium parvum
CLNFILNPPEKSTLPEYLN

SEQ ID NO: 2311032 - protein, 22 aa, Cryptosporidium parvum
CLPCKIPFLFNISKVIVPHFNS

SEQ ID NO: 2311033 - protein, 19 aa, Cryptosporidium parvum
CLPIGIRDEFLDLCTKEII

SEQ ID NO: 2311034 - protein, 18 aa, Cryptosporidium parvum
CLPNLKKGLFSRLVNNYN

SEQ ID NO: 2311035 - protein, 23 aa, Cryptosporidium parvum
CLPTNAIRTVKVCPLPSAGSSMK

SEQ ID NO: 2311036 - protein, 22 aa, Cryptosporidium parvum
CLQKMNILEFVPSKKLSKEMTK

SEQ ID NO: 2311037 - protein, 25 aa, Cryptosporidium parvum
CLQPQNPNILLLKSLITEIQAIVCL

SEQ ID NO: 2311038 - protein, 26 aa, Cryptosporidium parvum
CLQSLQCEYIYLACKFKNDSTIFFGG

SEQ ID NO: 2311039 - protein, 27 aa, Cryptosporidium parvum
CLRQFDVRFIYSTLLVYYLSNYPDLKQ

SEQ ID NO: 2311040 - protein, 24 aa, Cryptosporidium parvum
CLRRCILVTDLVSWMKNRFIVLIR

SEQ ID NO: 2311041 - protein, 22 aa, Cryptosporidium parvum
CLSDILILNLDGKLIRVSPKFR

SEQ ID NO: 2311042 - protein, 37 aa, Cryptosporidium parvum
CLSEKAIKWRRIFKTLVLVEYLLKNGIDRFVDDFKEY

SEQ ID NO: 2311043 - protein, 17 aa, Cryptosporidium parvum
CLSHLDVDLKFKGISSI

SEQ ID NO: 2311044 - protein, 26 aa, Cryptosporidium parvum
CLSWHRRNPYEYAYRPNLCPNVVFQN

SEQ ID NO: 2311045 - protein, 23 aa, Cryptosporidium parvum
CLTLAMSIYLKHPLLISDVKLAL

SEQ ID NO: 2311046 - protein, 23 aa, Cryptosporidium parvum
CLTSGCIILSIGSKYREYCANIT

SEQ ID NO: 2311047 - protein, 17 aa, Cryptosporidium parvum
CLWIDTEGTFRPERIVQ

SEQ ID NO: 2311048 - protein, 18 aa, Cryptosporidium parvum
CMSQYGYKFPVTKSLLPT

SEQ ID NO: 2311049 - protein, 17 aa, Cryptosporidium parvum
CMTLLKKGDGAVFDVPL

SEQ ID NO: 2311050 - protein, 42 aa, Cryptosporidium parvum; identical to SEQ ID NO: 2187656

SEQ ID NO: 2311051 - protein, 26 aa, Cryptosporidium parvum
CNDKSILWKIFVKRRLRRLDLVHLTS

SEQ ID NO: 2311052 - protein, 39 aa, Cryptosporidium parvum; identical to SEQ ID NO: 2187658

SEQ ID NO: 2311053 - protein, 23 aa, Cryptosporidium parvum
CNHILCWKCIINVDEIFYLDSNT

SEQ ID NO: 2311054 - protein, 42 aa, Cryptosporidium parvum
CNHKLAITPRCKGLILLIGRIIRSIWDIPLFQQTSFELISKN

SEQ ID NO: 2311055 - protein, 30 aa, Cryptosporidium parvum
CNINQDIYLNLKLPIWVSNMAKQFYNAYNQ

SEQ ID NO: 2311056 - protein, 17 aa, Cryptosporidium parvum
CNKAFGSHLFLLETNPE

SEQ ID NO: 2311057 - protein, 27 aa, Cryptosporidium parvum
CNLLNDFHLLLYLAKLFDEATAISICE

SEQ ID NO: 2311058 - protein, 24 aa, Cryptosporidium parvum
CNNEIPFKNAIKKAYCALCGNPGH

SEQ ID NO: 2311059 - protein, 32 aa, Cryptosporidium parvum
CNQDSSSLLLLFPSILFITIQKHKNSSSINND

SEQ ID NO: 2311060 - protein, 25 aa, Cryptosporidium parvum
CNQFNYEFIILVLDTNDIIKQDDLL

SEQ ID NO: 2311061 - protein, 18 aa, Cryptosporidium parvum
CNSDIICNFPLREMLDLY

SEQ ID NO: 2311062 - protein, 36 aa, Cryptosporidium parvum; identical to SEQ ID NO: 2187668

SEQ ID NO: 2311063 - protein, 26 aa, Cryptosporidium parvum
CNSLLLLRSGFLFASHEFGNHTNYQI

SEQ ID NO: 2311064 - protein, 22 aa, Cryptosporidium parvum
CNSLSILICRLIIYRHTEFENN

SEQ ID NO: 2311065 - protein, 17 aa, Cryptosporidium parvum
CNTFPNCKRFYCPFIHD

SEQ ID NO: 2311066 - protein, 26 aa, Cryptosporidium parvum
CNYENELLFLKYYREKIIPTMNMYDL

SEQ ID NO: 2311067 - protein, 22 aa, Cryptosporidium parvum
CNYTNVYIFKLLDENYLGNGEF

SEQ ID NO: 2311068 - protein, 18 aa, Cryptosporidium parvum
CNYYPIYGSSTPPSHLSP

SEQ ID NO: 2311069 - protein, 17 aa, Cryptosporidium parvum
CPDLTLIDLPGITRVPL

SEQ ID NO: 2311070 - protein, 31 aa, Cryptosporidium parvum
CPDVYVYASWTFFLQHLRNYFFCKESMIGIV

SEQ ID NO: 2311071 - protein, 31 aa, Cryptosporidium parvum; identical to SEQ ID NO: 2187675

SEQ ID NO: 2311072 - protein, 35 aa, Cryptosporidium parvum; identical to SEQ ID NO: 2187676

SEQ ID NO: 2311073 - protein, 26 aa, Cryptosporidium parvum
CPIKEIDPIWLIELHPKIAKFSENSK

SEQ ID NO: 2311074 - protein, 24 aa, Cryptosporidium parvum
CPKTCENFLKLCKLKFYNNCEFYK

SEQ ID NO: 2311075 - protein, 26 aa, Cryptosporidium parvum
CPLTFGKVVIPKLNFAFKGGDKSLED

SEQ ID NO: 2311076 - protein, 17 aa, Cryptosporidium parvum
CPPLLQADIDLQSGIIL

SEQ ID NO: 2311077 - protein, 20 aa, Cryptosporidium parvum
CPQLLKWKPPHLNTADFAAI

SEQ ID NO: 2311078 - protein, 22 aa, Cryptosporidium parvum
CPRDFEIIFPTYPTEDTIKGNF

SEQ ID NO: 2311079 - protein, 17 aa, Cryptosporidium parvum
CPRGFGRTSFRLYESVQ

SEQ ID NO: 2311080 - protein, 18 aa, Cryptosporidium parvum
CPSFQRKGSLRPSPNTQV

SEQ ID NO: 2311081 - protein, 23 aa, Cryptosporidium parvum
CPSIRYFEKILFNNIKSPNFENF

SEQ ID NO: 2311082 - protein, 18 aa, Cryptosporidium parvum
CPSNFYINPFSPNELCFL

SEQ ID NO: 2311083 - protein, 21 aa, Cryptosporidium parvum
CPVCRQLIGYNFRINMTIHNV

SEQ ID NO: 2311084 - protein, 20 aa, Cryptosporidium parvum
CQIINRLLSETIAKEYGKIK

SEQ ID NO: 2311085 - protein, 17 aa, Cryptosporidium parvum
CQKMLAKYIFKEYPRFL

SEQ ID NO: 2311086 - protein, 20 aa, Cryptosporidium parvum
CQLPNSMSFIWQNLVQQGSN

SEQ ID NO: 2311087 - protein, 21 aa, Cryptosporidium parvum
CQRRFACIQPLKVVIINWDEC

SEQ ID NO: 2311088 - protein, 20 aa, Cryptosporidium parvum
CQTPTLFFTVQRRDSINSFI

SEQ ID NO: 2311089 - protein, 17 aa, Cryptosporidium parvum
CQVQPKEIAYLPGNIPL

SEQ ID NO: 2311090 - protein, 18 aa, Cryptosporidium parvum
CQYCIGMRLELARIDLLN

SEQ ID NO: 2311091 - protein, 28 aa, Cryptosporidium parvum
CQYCQMEMFPSLYFINVKRPKFVEFFFD

SEQ ID NO: 2311092 - protein, 17 aa, Cryptosporidium parvum
CRDALTRRSLGYAYVNY

SEQ ID NO: 2311093 - protein, 23 aa, Cryptosporidium parvum
CRELKFLLLIIRELANNSHPCVV

SEQ ID NO: 2311094 - protein, 28 aa, Cryptosporidium parvum
CRHIFPLQHVFIRKVKVLSKPSFDVSRL

SEQ ID NO: 2311095 - protein, 47 aa, Cryptosporidium parvum
CRIIGALKFEISILKLYISLNSQNYWKLLLRQPAINILKMASIDEIS

SEQ ID NO: 2311096 - protein, 20 aa, Cryptosporidium parvum
CRIVFSYTELIYYLIVVCKA

SEQ ID NO: 2311097 - protein, 18 aa, Cryptosporidium parvum
CRRSMESAYLLYLKTRTP

SEQ ID NO: 2311098 - protein, 26 aa, Cryptosporidium parvum
CSDLAKDLLYKLLSYSFYQSESLTMD

SEQ ID NO: 2311099 - protein, 25 aa, Cryptosporidium parvum
CSDYKIRLFLIQTGKCYKIFDENIS

SEQ ID NO: 2311100 - protein, 17 aa, Cryptosporidium parvum
CSEPVLGLWVGCPCCRH

SEQ ID NO: 2311101 - protein, 32 aa, Cryptosporidium parvum
CSETTYKLLLSIFFIFINIELKFRNGQQILNT

SEQ ID NO: 2311102 - protein, 17 aa, Cryptosporidium parvum
CSEWFDMDSVHPIELEM

SEQ ID NO: 2311103 - protein, 24 aa, Cryptosporidium parvum
CSGGELFDRIISQGSFDEIYAANL

SEQ ID NO: 2311104 - protein, 19 aa, Cryptosporidium parvum
CSGGTLFNLLHGDSKKCLG

SEQ ID NO: 2311105 - protein, 22 aa, Cryptosporidium parvum
CSGVHRGLGVHISFIRSITMDS

SEQ ID NO: 2311106 - protein, 23 aa, Cryptosporidium parvum
CSKGKYCVFSSLFYTILSMCGDY

SEQ ID NO: 2311107 - protein, 28 aa, Cryptosporidium parvum
CSKKELFKFMLKNIGPRPIWTNSGAIGD

SEQ ID NO: 2311108 - protein, 28 aa, Cryptosporidium parvum
CSLSTTIKYLAFLGLLDDLLQLKNALNV

SEQ ID NO: 2311109 - protein, 18 aa, Cryptosporidium parvum
CSLYPYTGIIWKELSRIS

SEQ ID NO: 2311110 - protein, 18 aa, Cryptosporidium parvum
CSNCSNFLRIREFFVGKQ

SEQ ID NO: 2311111 - protein, 26 aa, Cryptosporidium parvum
CSNECFVLAIIYVGRIIKFNKNFTIT

SEQ ID NO: 2311112 - protein, 24 aa, Cryptosporidium parvum
CSNFKTLIFKQLISTSIYACDCYK

SEQ ID NO: 2311113 - protein, 35 aa, Cryptosporidium parvum
CSNNGIGLSIIYRRLFSYFIQSIIRYHFENIINKD

SEQ ID NO: 2311114 - protein, 32 aa, Cryptosporidium parvum
CSNYILIPESMYRSVESWLLSNAYNQWDKLSI

SEQ ID NO: 2311115 - protein, 27 aa, Cryptosporidium parvum
CSSNKVIYIIKICNFSFQLIGRFIHSK

SEQ ID NO: 2311116 - protein, 18 aa, Cryptosporidium parvum
CSSPNNIIIIFSGRERHL

SEQ ID NO: 2311117 - protein, 31 aa, Cryptosporidium parvum; identical to SEQ ID NO: 2187709

SEQ ID NO: 2311118 - protein, 17 aa, Cryptosporidium parvum
CSVFTLCDLVNITIDET

SEQ ID NO: 2311119 - protein, 20 aa, Cryptosporidium parvum
CSYDDFFQLVNNGILNGTVN

SEQ ID NO: 2311120 - protein, 24 aa, Cryptosporidium parvum
CSYGNYFILIDFKEKQQDFVKGNF

SEQ ID NO: 2311121 - protein, 20 aa, Cryptosporidium parvum
CSYPLPLVICPQVFDYRESL

SEQ ID NO: 2311122 - protein, 27 aa, Cryptosporidium parvum
CTDLDDSFHNYLMKGLLGENVEGGSGS

SEQ ID NO: 2311123 - protein, 27 aa, Cryptosporidium parvum
CTEPPFSHFFNLRIFNGYFSDERSKKT

SEQ ID NO: 2311124 - protein, 20 aa, Cryptosporidium parvum
CTFVWLCMKLGTSKFNINSY

SEQ ID NO: 2311125 - protein, 18 aa, Cryptosporidium parvum
CTIWLSFTSNMISSGLRE

SEQ ID NO: 2311126 - protein, 18 aa, Cryptosporidium parvum
CTNYDIEFFRILNLTCTN

SEQ ID NO: 2311127 - protein, 18 aa, Cryptosporidium parvum
CTPGKMQDFLKKRSFPTE

SEQ ID NO: 2311128 - protein, 28 aa, Cryptosporidium parvum
CTTIEEFSPYQVILAPFETNNLNLIAIE

SEQ ID NO: 2311129 - protein, 19 aa, Cryptosporidium parvum
CVEAFTDYPPLGRFAVRDM

SEQ ID NO: 2311130 - protein, 17 aa, Cryptosporidium parvum
CVELYIGQVKLDPNWTP

SEQ ID NO: 2311131 - protein, 30 aa, Cryptosporidium parvum
CVEWPLIHSELFEYMKIKPPSGVLLYGPPG

SEQ ID NO: 2311132 - protein, 20 aa, Cryptosporidium parvum
CVEYVHQRLLTNIYTVFSQN

SEQ ID NO: 2311133 - protein, 17 aa, Cryptosporidium parvum
CVHVFQKEYFSTISADS

SEQ ID NO: 2311134 - protein, 27 aa, Cryptosporidium parvum
CVIDGNSYYYENFVRSLSFGDYSPYES

SEQ ID NO: 2311135 - protein, 21 aa, Cryptosporidium parvum
CVIKTVHPWFKSTATVECYNS

SEQ ID NO: 2311136 - protein, 23 aa, Cryptosporidium parvum
CVKRIPDGILLFFGSYSLMDQAV

SEQ ID NO: 2311137 - protein, 33 aa, Cryptosporidium parvum
CVNGSIIHPFYQPMVLIATLFQKSSQKQGKTQA

SEQ ID NO: 2311138 - protein, 21 aa, Cryptosporidium parvum
CVYCKFYFQEILEDHIPGYRI

SEQ ID NO: 2311139 - protein, 19 aa, Cryptosporidium parvum
CWCISRFTPWLALQQGQPI

SEQ ID NO: 2311140 - protein, 27 aa, Cryptosporidium parvum
CWEAIYNFLQVIPPNQLRILQFNVIPS

SEQ ID NO: 2311141 - protein, 20 aa, Cryptosporidium parvum
CWPGKVKYPDFLNPKVREIY

SEQ ID NO: 2311142 - protein, 25 aa, Cryptosporidium parvum
  misc_feature (2)..(2): Xaa can be any naturally occurring amino acid
CXVRIILNPAYYLNNWRTHMNGKLH

SEQ ID NO: 2311143 - protein, 17 aa, Cryptosporidium parvum
CYHEKVHLFLNLADIIY

SEQ ID NO: 2311144 - protein, 27 aa, Cryptosporidium parvum
CYIYKYRRESILKENLFKYIPTSVKMR

SEQ ID NO: 2311145 - protein, 27 aa, Cryptosporidium parvum
CYKDSTLIMQLLRDNLTLWTADLGASG

SEQ ID NO: 2311146 - protein, 27 aa, Cryptosporidium parvum
CYLNSIIHMLRSIPSFLQILRNSNLSS

SEQ ID NO: 2311147 - protein, 25 aa, Cryptosporidium parvum
CYNNNTFIPVFLNYAVDNPEIISYK

SEQ ID NO: 2311148 - protein, 17 aa, Cryptosporidium parvum
CYSLAVEGYGLLKLMGI

SEQ ID NO: 2311149 - protein, 24 aa, Cryptosporidium parvum
CYSSNLFKLIQSLLSRDPILRPDP

SEQ ID NO: 2311150 - protein, 19 aa, Cryptosporidium parvum
CYSTLIPPLNLKNVPEDLR

SEQ ID NO: 2311151 - protein, 26 aa, Cryptosporidium parvum
CYTFSGNLLIFILPRVEKIPRLMEAY

SEQ ID NO: 2311152 - protein, 23 aa, Cryptosporidium parvum
DADHYLFRKLKVLKTFVKLDHFD

SEQ ID NO: 2311153 - protein, 19 aa, Cryptosporidium parvum
DADKLSFLSDLYACMSIGQ

SEQ ID NO: 2311154 - protein, 21 aa, Cryptosporidium parvum
DAFFFSQALRPTPLEKTIIGV

SEQ ID NO: 2311155 - protein, 19 aa, Cryptosporidium parvum
DAFKGGLIYGISNSYPLDA

SEQ ID NO: 2311156 - protein, 20 aa, Cryptosporidium parvum
DAIQILTSLLLLLSDKTDVD

SEQ ID NO: 2311157 - protein, 25 aa, Cryptosporidium parvum
DAISHVWQPTLWYISERKTINKFAQ

SEQ ID NO: 2311158 - protein, 18 aa, Cryptosporidium parvum
DAIVIPMHCNQTSHWWLI

SEQ ID NO: 2311159 - protein, 25 aa, Cryptosporidium parvum
DALAVARNILLDPALLPGGGGTEMA

SEQ ID NO: 2311160 - protein, 35 aa, Cryptosporidium parvum; identical to SEQ ID NO: 2187756

SEQ ID NO: 2311161 - protein, 25 aa, Cryptosporidium parvum
DALRVIFSIVYFEISFLLCDSKSSI

SEQ ID NO: 2311162 - protein, 19 aa, Cryptosporidium parvum
DAMVYYFKEKSGIPANKVC

SEQ ID NO: 2311163 - protein, 22 aa, Cryptosporidium parvum
DANALSTILLQMKSYKPDCIIG

SEQ ID NO: 2311164 - protein, 21 aa, Cryptosporidium parvum
DANPPLIMQILSNNEPDKSDN

SEQ ID NO: 2311165 - protein, 39 aa, Cryptosporidium parvum; identical to SEQ ID NO: 2187760

SEQ ID NO: 2311166 - protein, 21 aa, Cryptosporidium parvum
DAPIISRYWLNHSIACSGERI

SEQ ID NO: 2311167 - protein, 30 aa, Cryptosporidium parvum; identical to SEQ ID NO: 2187761

SEQ ID NO: 2311168 - protein, 30 aa, Cryptosporidium parvum
DAQGLDKIMKLPWEKIPRYLYKSSGVDLFF

SEQ ID NO: 2311169 - protein, 27 aa, Cryptosporidium parvum
DARTPQKYRMLVPMVDVIFSDVAQPDQ

SEQ ID NO: 2311170 - protein, 27 aa, Cryptosporidium parvum
DASERDIRLAFLRLVRKFHPDKNISEL

SEQ ID NO: 2311171 - protein, 23 aa, Cryptosporidium parvum
DASIWLKQFLMGLKDKEGKIPQG

SEQ ID NO: 2311172 - protein, 26 aa, Cryptosporidium parvum
DASKQLLIEKLPPLLTIQLKRFSYVG

SEQ ID NO: 2311173 - protein, 22 aa, Cryptosporidium parvum
DASLNLTLKHKYGLIGRNGIGK

SEQ ID NO: 2311174 - protein, 23 aa, Cryptosporidium parvum
DATIWLFRCLLSIDSPSFHQLMA

SEQ ID NO: 2311175 - protein, 21 aa, Cryptosporidium parvum
DAVLEKLPYKNGEDKVIVICA

SEQ ID NO: 2311176 - protein, 26 aa, Cryptosporidium parvum
DAVSKALYSLVFDYILHLVNTQISRA

SEQ ID NO: 2311177 - protein, 28 aa, Cryptosporidium parvum
DAWSAGVLLHLLLMGAVPFPGVNDADTI

SEQ ID NO: 2311178 - protein, 24 aa, Cryptosporidium parvum
DAYEYAKQLWLKARNKSKLNKCQT

SEQ ID NO: 2311179 - protein, 24 aa, Cryptosporidium parvum
DAYGRLTYWFIPPSSSKEGIQMWK

SEQ ID NO: 2311180 - protein, 29 aa, Cryptosporidium parvum
DCAQIITSLFIKKLFKKNKIIPMIKFEKK

SEQ ID NO: 2311181 - protein, 26 aa, Cryptosporidium parvum
DCDARSQIFFGFREEFIYSLVKRKID

SEQ ID NO: 2311182 - protein, 22 aa, Cryptosporidium parvum
DCDFPGKMVPNKNLLRLSRNHA

SEQ ID NO: 2311183 - protein, 26 aa, Cryptosporidium parvum
DCESRNPTWLSLSFAVFICLNCSSDH

SEQ ID NO: 2311184 - protein, 22 aa, Cryptosporidium parvum
DCEYPVITIRILGFLGKNIPKT

SEQ ID NO: 2311185 - protein, 19 aa, Cryptosporidium parvum
DCFNIWRGLSLRLRNQKKK

SEQ ID NO: 2311186 - protein, 34 aa, Cryptosporidium parvum; identical to SEQ ID NO: 2187785

SEQ ID NO: 2311187 - protein, 18 aa, Cryptosporidium parvum
DCIRFRAKKAFMISTTDL

SEQ ID NO: 2311188 - protein, 22 aa, Cryptosporidium parvum
DCKLQYIGLIDPQNYPKKEVYK

SEQ ID NO: 2311189 - protein, 18 aa, Cryptosporidium parvum
DCLLWALDRETFNHIVKG

SEQ ID NO: 2311190 - protein, 24 aa, Cryptosporidium parvum
DCNTYYCHLIHGLAERRESKVYLL

SEQ ID NO: 2311191 - protein, 19 aa, Cryptosporidium parvum
DCQELLLHPFFSSINGTEG

SEQ ID NO: 2311192 - protein, 29 aa, Cryptosporidium parvum
DCQIDFNVINWNHLILLYGSPGTGKTSIS

SEQ ID NO: 2311193 - protein, 18 aa, Cryptosporidium parvum
DCQITWYHFIDPNINRKP

SEQ ID NO: 2311194 - protein, 26 aa, Cryptosporidium parvum
DCQPFKQIFKMIALSSTYSLPSFSEG

SEQ ID NO: 2311195 - protein, 25 aa, Cryptosporidium parvum
DCRSIPDFLILLLRDCFENKMFEDP

SEQ ID NO: 2311196 - protein, 22 aa, Cryptosporidium parvum
DCSYWERVLSKLCRLYELRNGE

SEQ ID NO: 2311197 - protein, 28 aa, Cryptosporidium parvum
DCVTGSYLPIPLFPDIIVVSSGTKLRVM

SEQ ID NO: 2311198 - protein, 29 aa, Cryptosporidium parvum
DDAEIGMQNFQRLLAKKAFDTIEEDEQQH

SEQ ID NO: 2311199 - protein, 24 aa, Cryptosporidium parvum
DDCYARFFTNLPVNLLEDAIHLYF

SEQ ID NO: 2311200 - protein, 23 aa, Cryptosporidium parvum
DDDIKEMWKSLISKKGMNLEDII

SEQ ID NO: 2311201 - protein, 25 aa, Cryptosporidium parvum
DDDPELIIFVRFSSPCTIHSINIIG

SEQ ID NO: 2311202 - protein, 22 aa, Cryptosporidium parvum
DDDVILLLKLVKVPSSVELINF

SEQ ID NO: 2311203 - protein, 18 aa, Cryptosporidium parvum
DDEFLNLTEIEMALRKCV

SEQ ID NO: 2311204 - protein, 18 aa, Cryptosporidium parvum
DDEFVDLLIRIRNSFDNC

SEQ ID NO: 2311205 - protein, 22 aa, Cryptosporidium parvum
DDEKLIYYYPSSDSIIIKRQQM

SEQ ID NO: 2311206 - protein, 27 aa, Cryptosporidium parvum
DDENKLYLIIKIIRIDNLILNIYEVNN

SEQ ID NO: 2311207 - protein, 17 aa, Cryptosporidium parvum
DDEYTPYVFLQFSPYQQ

SEQ ID NO: 2311208 - protein, 19 aa, Cryptosporidium parvum
DDFKEYMYKVRHLQDFYYT

SEQ ID NO: 2311209 - protein, 17 aa, Cryptosporidium parvum
DDFLKEFALPKVRVFDN

SEQ ID NO: 2311210 - protein, 24 aa, Cryptosporidium parvum
DDGKPVSYLLFARSSISKSPIRLC

SEQ ID NO: 2311211 - protein, 23 aa, Cryptosporidium parvum
DDGMIRLWNTFTGSLLASVRKHT

SEQ ID NO: 2311212 - protein, 24 aa, Cryptosporidium parvum
DDGNLFDACLMATLSGLKHYRYNE

SEQ ID NO: 2311213 - protein, 24 aa, Cryptosporidium parvum
DDIKLQMTGIVPTISLDKSNKVNI

SEQ ID NO: 2311214 - protein, 29 aa, Cryptosporidium parvum
DDIKPNTLFPWKYIQNTLNYISPKSMLLS

SEQ ID NO: 2311215 - protein, 23 aa, Cryptosporidium parvum
DDITVIVAFVAYSDRLSTRMSNI

SEQ ID NO: 2311216 - protein, 31 aa, Cryptosporidium parvum; identical to SEQ ID NO: 2187818

SEQ ID NO: 2311217 - protein, 32 aa, Cryptosporidium parvum; identical to SEQ ID NO: 2187819

SEQ ID NO: 2311218 - protein, 21 aa, Cryptosporidium parvum
DDKKALTWGLGLQGRLGHGDT

SEQ ID NO: 2311219 - protein, 23 aa, Cryptosporidium parvum
DDLCSKCFYIVRKSPDGIEEFED

SEQ ID NO: 2311220 - protein, 25 aa, Cryptosporidium parvum
DDLDKPIKLLWSFQIKDKPSCMDWC

SEQ ID NO: 2311221 - protein, 19 aa, Cryptosporidium parvum
DDLFNSLFKRKPGKHMASE

SEQ ID NO: 2311222 - protein, 20 aa, Cryptosporidium parvum
DDLFYSFRISMGIFDSLISK

SEQ ID NO: 2311223 - protein, 24 aa, Cryptosporidium parvum
DDLGPLMPKILPILLSRLGDESDS

SEQ ID NO: 2311224 - protein, 20 aa, Cryptosporidium parvum
DDLHSQIFSNFGLSGSGFGN

SEQ ID NO: 2311225 - protein, 21 aa, Cryptosporidium parvum
DDLLHFDFMDPPPPETLIRAL

SEQ ID NO: 2311226 - protein, 26 aa, Cryptosporidium parvum
DDLLTVYIILFMLNGSPSIYYGSEFR

SEQ ID NO: 2311227 - protein, 18 aa, Cryptosporidium parvum
DDLLVENPNRIEKELRIE

SEQ ID NO: 2311228 - protein, 32 aa, Cryptosporidium parvum; identical to SEQ ID NO: 2187825

SEQ ID NO: 2311229 - protein, 22 aa, Cryptosporidium parvum
DDLQVIWLHNYYMIYFNELHIP

SEQ ID NO: 2311230 - protein, 26 aa, Cryptosporidium parvum
DDLRSFPVLLSVLRLQTLRPEEIIIV

SEQ ID NO: 2311231 - protein, 20 aa, Cryptosporidium parvum
DDLSELVLKVLPNKLINGIS

SEQ ID NO: 2311232 - protein, 20 aa, Cryptosporidium parvum
DDMLPILSILPKSCTGRQTL

SEQ ID NO: 2311233 - protein, 26 aa, Cryptosporidium parvum
DDQYKKEILSLLLESRPAIVESAEST

SEQ ID NO: 2311234 - protein, 25 aa, Cryptosporidium parvum
DDRIPKKTFNFVPISEIRGYSKGQS

SEQ ID NO: 2311235 - protein, 24 aa, Cryptosporidium parvum
DDSELVLIFGLLSLYSIWGKKQKE

SEQ ID NO: 2311236 - protein, 18 aa, Cryptosporidium parvum
DDSFVLPWIIERKTGSDM

SEQ ID NO: 2311237 - protein, 48 aa, Cryptosporidium parvum
DDTKMLKLIQMYLLRPAEQWVYERSLYEQMLFLEPLTDLIEKQNMTRW

SEQ ID NO: 2311238 - protein, 18 aa, Cryptosporidium parvum
DDTPLCAQYFLGFCKYGP

SEQ ID NO: 2311239 - protein, 30 aa, Cryptosporidium parvum; identical to SEQ ID NO: 2187835

SEQ ID NO: 2311240 - protein, 17 aa, Cryptosporidium parvum
DDTRGYGLFSKLNNIFK

SEQ ID NO: 2311241 - protein, 26 aa, Cryptosporidium parvum
DDVIPPFIFVRAIADKWLHSETSISV

SEQ ID NO: 2311242 - protein, 25 aa, Cryptosporidium parvum
DDVLIFTREYELILLRAHLLNSDSE

SEQ ID NO: 2311243 - protein, 17 aa, Cryptosporidium parvum
DDVSSLLMDRIPPNLPI

SEQ ID NO: 2311244 - protein, 30 aa, Cryptosporidium parvum; identical to SEQ ID NO: 2187839

SEQ ID NO: 2311245 - protein, 22 aa, Cryptosporidium parvum
DEAAELVARIFTELRAKCMNQS

SEQ ID NO: 2311246 - protein, 24 aa, Cryptosporidium parvum
DEADRLFEMGLASQIEKILESIPK

SEQ ID NO: 2311247 - protein, 24 aa, Cryptosporidium parvum
DECSPPCSLPAPPGSDPFTISGFG

SEQ ID NO: 2311248 - protein, 20 aa, Cryptosporidium parvum
DECTPFLERGIHAGTSVIPS

SEQ ID NO: 2311249 - protein, 23 aa, Cryptosporidium parvum
DEDEYWMVVFSGNKQLISKHVDL

SEQ ID NO: 2311250 - protein, 18 aa, Cryptosporidium parvum
DEDKLPDLIIRRGEKRGE

SEQ ID NO: 2311251 - protein, 23 aa, Cryptosporidium parvum
DEDLLLIASIGVSLIKLLCFSNN

SEQ ID NO: 2311252 - protein, 31 aa, Cryptosporidium parvum; identical to SEQ ID NO: 2187849

SEQ ID NO: 2311253 - protein, 23 aa, Cryptosporidium parvum
DEDSFYLESVLRKKVNLIHMENL

SEQ ID NO: 2311254 - protein, 18 aa, Cryptosporidium parvum
DEDTVAGFLLTGIGARDP

SEQ ID NO: 2311255 - protein, 25 aa, Cryptosporidium parvum
DEDVDLLRRYIPPPVYRCLSSGYNV

SEQ ID NO: 2311256 - protein, 25 aa, Cryptosporidium parvum
DEEAKRIWLKYLPEDRILSCGSKEN

SEQ ID NO: 2311257 - protein, 23 aa, Cryptosporidium parvum
DEEIPVLSRWFPKDSPPASQLIK

SEQ ID NO: 2311258 - protein, 27 aa, Cryptosporidium parvum
DEERDIDILFFLDYRTPHYSLSPQLEE

SEQ ID NO: 2311259 - protein, 34 aa, Cryptosporidium parvum
DEEYLYHSKRQLILKLRWYGAKTLDYYSSRADYV

SEQ ID NO: 2311260 - protein, 26 aa, Cryptosporidium parvum
DEGGLLFCVTFKMISFRPYVGEVIEG

SEQ ID NO: 2311261 - protein, 27 aa, Cryptosporidium parvum
DEGSIRGILRWIKSWDNFVFKSESSNK

SEQ ID NO: 2311262 - protein, 26 aa, Cryptosporidium parvum
DEIENFFIQFPIFPSNMSRYRQRWLE

SEQ ID NO: 2311263 - protein, 31 aa, Cryptosporidium parvum
DEIFKYYMISIIHDRILLRLKAQIVPQNSET

SEQ ID NO: 2311264 - protein, 19 aa, Cryptosporidium parvum
DEILGLFNLLPTMASNRLT

SEQ ID NO: 2311265 - protein, 26 aa, Cryptosporidium parvum
DEIPRFFKDIGYPITINKTTIIAPGA

SEQ ID NO: 2311266 - protein, 19 aa, Cryptosporidium parvum
DEITSAVTLFFQQLRKIKG

SEQ ID NO: 2311267 - protein, 34 aa, Cryptosporidium parvum; identical to SEQ ID NO: 2187866

SEQ ID NO: 2311268 - protein, 20 aa, Cryptosporidium parvum
DEITTRIKDEIRKGLVDCST

SEQ ID NO: 2311269 - protein, 25 aa, Cryptosporidium parvum
DEKEAFPDDKLLPIYSRVVIQRIPW

SEQ ID NO: 2311270 - protein, 17 aa, Cryptosporidium parvum
DEKIFMDYLQDLRTQLI

SEQ ID NO: 2311271 - protein, 17 aa, Cryptosporidium parvum
DEKLLNYLSERVIKTAK

SEQ ID NO: 2311272 - protein, 22 aa, Cryptosporidium parvum
DEKLREHFGKYGTIKNLSVMVD

SEQ ID NO: 2311273 - protein, 23 aa, Cryptosporidium parvum
DEKRDRWRGFRPEDYKPIIEQFE

SEQ ID NO: 2311274 - protein, 26 aa, Cryptosporidium parvum
DEKVIPHIKTFLKYKIFGNAIKIIWL

SEQ ID NO: 2311275 - protein, 18 aa, Cryptosporidium parvum
DELDLPCLVLGTVYGMKL

SEQ ID NO: 2311276 - protein, 22 aa, Cryptosporidium parvum
DELKLLYPYISHLNSLCINWMR

SEQ ID NO: 2311277 - protein, 27 aa, Cryptosporidium parvum
DELKRKYIPAILDWGMVKIFDKSKQIA

SEQ ID NO: 2311278 - protein, 17 aa, Cryptosporidium parvum
DELLILSTKFNDYLVQN

SEQ ID NO: 2311279 - protein, 26 aa, Cryptosporidium parvum
DELMIKAISGIHKYFLNKAFEHESEK

SEQ ID NO: 2311280 - protein, 23 aa, Cryptosporidium parvum
DELPLIPVVYWMIENWNKYDMFL

SEQ ID NO: 2311281 - protein, 23 aa, Cryptosporidium parvum
DELQLEISKVWKGIESPFSPKKI

SEQ ID NO: 2311282 - protein, 23 aa, Cryptosporidium parvum
DENEIIEWKVLKKALRKEIVLKS

SEQ ID NO: 2311283 - protein, 25 aa, Cryptosporidium parvum
DENEKFLRNYILNQEWKESNSQKRI

SEQ ID NO: 2311284 - protein, 27 aa, Cryptosporidium parvum
DENENKLCFDIFKTEELPISSQKSPRI

SEQ ID NO: 2311285 - protein, 30 aa, Cryptosporidium parvum
DENFQLNIPVFFRHSLPKDSEWKCYICKVP

SEQ ID NO: 2311286 - protein, 25 aa, Cryptosporidium parvum
DENIAKMITFNPGILARTVTLNGDI

SEQ ID NO: 2311287 - protein, 29 aa, Cryptosporidium parvum
DENNKHLDTLFWLFKYVSNKSLFEIKYRT

SEQ ID NO: 2311288 - protein, 18 aa, Cryptosporidium parvum
DENNYGVLFSFLEPFQRS

SEQ ID NO: 2311289 - protein, 50 aa, Cryptosporidium parvum
DEPEFRSWIHRQLHIIYSNLAFKLQRLVLFIPPGWLQYLPGEIDLRDMLD

SEQ ID NO: 2311290 - protein, 19 aa, Cryptosporidium parvum
DEQIQNALKLSGTSMNGRE

SEQ ID NO: 2311291 - protein, 25 aa, Cryptosporidium parvum
DEQRYTHLLPLTQWNKSYVGGSELL

SEQ ID NO: 2311292 - protein, 17 aa, Cryptosporidium parvum
DEQVIQLLLNKSLGINE

SEQ ID NO: 2311293 - protein, 23 aa, Cryptosporidium parvum
DERENFTVYLQMPEGLLVFSQSI

SEQ ID NO: 2311294 - protein, 25 aa, Cryptosporidium parvum
DERFEPIFKFFRSKIYLDSFSNDKD

SEQ ID NO: 2311295 - protein, 21 aa, Cryptosporidium parvum
DERLQDILDLYSPGNLRGEAK

SEQ ID NO: 2311296 - protein, 27 aa, Cryptosporidium parvum
DERTQIWGFAALRFLIRSSLNACNEFL

SEQ ID NO: 2311297 - protein, 23 aa, Cryptosporidium parvum
DESFSISFPIYKASLIATDNESK

SEQ ID NO: 2311298 - protein, 17 aa, Cryptosporidium parvum
DESIYSEQIFTLSTALG

SEQ ID NO: 2311299 - protein, 24 aa, Cryptosporidium parvum
DESRKFFLIGYEQFLLTAAPIISR

SEQ ID NO: 2311300 - protein, 25 aa, Cryptosporidium parvum
DESTGLPFYLPLVDYAGKEEMKAYF

SEQ ID NO: 2311301 - protein, 26 aa, Cryptosporidium parvum
DETIILKFVVLSIWLVELNSFVSFSQ

SEQ ID NO: 2311302 - protein, 24 aa, Cryptosporidium parvum
DETKLTLHGLLQYYVKLGESEKNR

SEQ ID NO: 2311303 - protein, 18 aa, Cryptosporidium parvum
DETLMCSFQILKPVEKKK

SEQ ID NO: 2311304 - protein, 24 aa, Cryptosporidium parvum
DETSRFLIYTCMIGVCVLDIQIGK

SEQ ID NO: 2311305 - protein, 23 aa, Cryptosporidium parvum
DEVDGYIFDFSKRSTRLSNDTMD

SEQ ID NO: 2311306 - protein, 26 aa, Cryptosporidium parvum
DEVDRMLDMGFLNDIKIILDGIPSSS

SEQ ID NO: 2311307 - protein, 25 aa, Cryptosporidium parvum
DEVEEEIFSIPKHPTFFATANSNIS

SEQ ID NO: 2311308 - protein, 23 aa, Cryptosporidium parvum
DEVFNFLIDNFQIETTFIFMNDH

SEQ ID NO: 2311309 - protein, 18 aa, Cryptosporidium parvum
DEVLQIRTIFANVSKGQL

SEQ ID NO: 2311310 - protein, 30 aa, Cryptosporidium parvum
DEYAVECLCQLIMTTGYYLDSNEKSQMIVD

SEQ ID NO: 2311311 - protein, 17 aa, Cryptosporidium parvum
DEYLFINQNLCGLKPII

SEQ ID NO: 2311312 - protein, 21 aa, Cryptosporidium parvum
DFAIQFLSFHIKDCHFVKEME

SEQ ID NO: 2311313 - protein, 17 aa, Cryptosporidium parvum
DFALLKDEKEMLKNKYT

SEQ ID NO: 2311314 - protein, 18 aa, Cryptosporidium parvum
DFAPFNQNLSVDGSFLLG

SEQ ID NO: 2311315 - protein, 23 aa, Cryptosporidium parvum
DFAPLSHIFPGCIVSITATELAE

SEQ ID NO: 2311316 - protein, 24 aa, Cryptosporidium parvum
DFASRMFIRLWKTSALTGKNIRHV

SEQ ID NO: 2311317 - protein, 27 aa, Cryptosporidium parvum
DFCSSMNQLWYINDRFLYMYDVKSKNV

SEQ ID NO: 2311318 - protein, 17 aa, Cryptosporidium parvum
DFDIGIFDSCLCTCNSG

SEQ ID NO: 2311319 - protein, 20 aa, Cryptosporidium parvum
DFDSYISFVIFIINYGNYFK

SEQ ID NO: 2311320 - protein, 33 aa, Cryptosporidium parvum
DFEDLHHNVTIIYLLFLIFKSQYKTGLEDGQED

SEQ ID NO: 2311321 - protein, 27 aa, Cryptosporidium parvum
DFEEEWFEEFLKSRKFPLLTPFGCKNE

SEQ ID NO: 2311322 - protein, 17 aa, Cryptosporidium parvum
DFEGVELVYLVMGDISS

SEQ ID NO: 2311323 - protein, 19 aa, Cryptosporidium parvum
DFELSYTRYTQGVELLCWV

SEQ ID NO: 2311324 - protein, 25 aa, Cryptosporidium parvum
DFEPFKPINTSLYLCDNKFHVDALK

SEQ ID NO: 2311325 - protein, 33 aa, Cryptosporidium parvum
DFESSIIHPLQCILLIIGILRRSLENPNHSDLK

SEQ ID NO: 2311326 - protein, 22 aa, Cryptosporidium parvum
DFFQELISFFRFDFNIESNGNP

SEQ ID NO: 2311327 - protein, 25 aa, Cryptosporidium parvum
DFFRERYIMFASRLFSQIVKEIEGL

SEQ ID NO: 2311328 - protein, 21 aa, Cryptosporidium parvum
DFFTRYWQVIGILAKQESRQI

SEQ ID NO: 2311329 - protein, 21 aa, Cryptosporidium parvum
DFGVAKFLRQGYTQARTLVGT

SEQ ID NO: 2311330 - protein, 25 aa, Cryptosporidium parvum
DFHKFALFFIYKSNNSLKLLQLTPT

SEQ ID NO: 2311331 - protein, 31 aa, Cryptosporidium parvum; identical to SEQ ID NO: 2187922

SEQ ID NO: 2311332 - protein, 26 aa, Cryptosporidium parvum
DFHSITPSLSYLIQKNFENPANGCHT

SEQ ID NO: 2311333 - protein, 18 aa, Cryptosporidium parvum
DFIHAYIHQTSNAMIGGL

SEQ ID NO: 2311334 - protein, 22 aa, Cryptosporidium parvum
DFIKAFLLGFELQDAIALLRLD

SEQ ID NO: 2311335 - protein, 30 aa, Cryptosporidium parvum; identical to SEQ ID NO: 2187926

SEQ ID NO: 2311336 - protein, 30 aa, Cryptosporidium parvum; identical to SEQ ID NO: 2187927

SEQ ID NO: 2311337 - protein, 20 aa, Cryptosporidium parvum
DFKIINIYVPPFQIIDTVEI

SEQ ID NO: 2311338 - protein, 17 aa, Cryptosporidium parvum
DFKSLFPTFNDNDIRFY

SEQ ID NO: 2311339 - protein, 30 aa, Cryptosporidium parvum
DFKSNKPIIWIQITYKKLLKGSFASFEILN

SEQ ID NO: 2311340 - protein, 30 aa, Cryptosporidium parvum; identical to SEQ ID NO: 2187931

SEQ ID NO: 2311341 - protein, 24 aa, Cryptosporidium parvum
DFLKLRNEALLNQGLWYSSLSEED

SEQ ID NO: 2311342 - protein, 21 aa, Cryptosporidium parvum
DFLNLSFYIQVIEGGACINGL

SEQ ID NO: 2311343 - protein, 18 aa, Cryptosporidium parvum
DFLRYFVDIFIEESVSVQ

SEQ ID NO: 2311344 - protein, 28 aa, Cryptosporidium parvum
DFLSSINGVCWCPWDFGLQFACAISDGS

SEQ ID NO: 2311345 - protein, 24 aa, Cryptosporidium parvum
DFLWDWNSRIFIDCQSKSLFEFDP

SEQ ID NO: 2311346 - protein, 21 aa, Cryptosporidium parvum
DFMKPLEKVFTLIWDEIILGN

SEQ ID NO: 2311347 - protein, 22 aa, Cryptosporidium parvum
DFNCLICFRILQRTMVVKDCLH

SEQ ID NO: 2311348 - protein, 25 aa, Cryptosporidium parvum
DFNDTQMLALLRPSLEETFEFFSQD

SEQ ID NO: 2311349 - protein, 19 aa, Cryptosporidium parvum
DFNNFWELKYQGHMLAELF

SEQ ID NO: 2311350 - protein, 35 aa, Cryptosporidium parvum; identical to SEQ ID NO: 2187937

SEQ ID NO: 2311351 - protein, 17 aa, Cryptosporidium parvum
DFQEELKFKVQERENLM

SEQ ID NO: 2311352 - protein, 19 aa, Cryptosporidium parvum
DFQVWFSKPFSDLPSNEAS

SEQ ID NO: 2311353 - protein, 18 aa, Cryptosporidium parvum
DFRDNSLILLLAGSLRNR

SEQ ID NO: 2311354 - protein, 24 aa, Cryptosporidium parvum
DFRTYKFPAILIYDNYSLSNGFFN

SEQ ID NO: 2311355 - protein, 22 aa, Cryptosporidium parvum
DFSAPLLNYLNDGLSSDSWGSF

SEQ ID NO: 2311356 - protein, 25 aa, Cryptosporidium parvum
DFSKNHILFVFTGQGSQYINMCKGI

SEQ ID NO: 2311357 - protein, 25 aa, Cryptosporidium parvum
DFSRALNWMTILDNPFDNGLHRFRQ

SEQ ID NO: 2311358 - protein, 21 aa, Cryptosporidium parvum
DFSTELLLKVQRHSFLQLPST

SEQ ID NO: 2311359 - protein, 30 aa, Cryptosporidium parvum
DFSVSSVLFPKLLTLFFHYPEDQNSKISFI

SEQ ID NO: 2311360 - protein, 20 aa, Cryptosporidium parvum
DFTCLEFWDFLSNTLQKSSD

SEQ ID NO: 2311361 - protein, 24 aa, Cryptosporidium parvum
DFTFKKDLLLIKRRIILFKIEQGS

SEQ ID NO: 2311362 - protein, 38 aa, Cryptosporidium parvum
DFTNIFETLIPEIFLYILKLWLLCWPSPISLCSIDERF

SEQ ID NO: 2311363 - protein, 28 aa, Cryptosporidium parvum
DFTSMITYLCRSCFLPEIFSTNSKLNNF

SEQ ID NO: 2311364 - protein, 29 aa, Cryptosporidium parvum
DFTSRILEPILIPLSVNLRHFITSSFTDN

SEQ ID NO: 2311365 - protein, 19 aa, Cryptosporidium parvum
DFVAWFMYTQTDLQIHPIK

SEQ ID NO: 2311366 - protein, 24 aa, Cryptosporidium parvum
DFVCQILELLGLILYEHQKKLTEN

SEQ ID NO: 2311367 - protein, 34 aa, Cryptosporidium parvum; identical to SEQ ID NO: 2187947

SEQ ID NO: 2311368 - protein, 17 aa, Cryptosporidium parvum
DFVLLSGFGFSAAVPVD

SEQ ID NO: 2311369 - protein, 17 aa, Cryptosporidium parvum
DFYGWLCDRCEFEKKFL

SEQ ID NO: 2311370 - protein, 26 aa, Cryptosporidium parvum
DGADPLMILPIYSQLPSDLQAKIFKP

SEQ ID NO: 2311371 - protein, 32 aa, Cryptosporidium parvum
DGATGQPFIPFALSFLMNLGDSYGISFFTTSI

SEQ ID NO: 2311372 - protein, 35 aa, Cryptosporidium parvum
DGAVEFEWLYCILKYLVFFNSKFGFYNENLALLNS

SEQ ID NO: 2311373 - protein, 24 aa, Cryptosporidium parvum
DGCLDYFEVIKTPMDLITVSNKLL

SEQ ID NO: 2311374 - protein, 24 aa, Cryptosporidium parvum
DGDKPLATLIITVAPKPGNSMLPA

SEQ ID NO: 2311375 - protein, 23 aa, Cryptosporidium parvum
DGDMLSIYLFSYSEQIRIAQFEI

SEQ ID NO: 2311376 - protein, 24 aa, Cryptosporidium parvum
DGDSWRLYDLITRHFFATISNDIK

SEQ ID NO: 2311377 - protein, 26 aa, Cryptosporidium parvum
DGEELPQRFVLTPIVEKFLKRRPQMK

SEQ ID NO: 2311378 - protein, 24 aa, Cryptosporidium parvum
DGEFLIAYHPLYFDVSHSRKIKVL

SEQ ID NO: 2311379 - protein, 25 aa, Cryptosporidium parvum
DGFERKRIEYEHEIDLIRNNFTEKL

SEQ ID NO: 2311380 - protein, 21 aa, Cryptosporidium parvum
DGGLNSHIYRRAPVGVPQNLG

SEQ ID NO: 2311381 - protein, 25 aa, Cryptosporidium parvum
DGGTSTYMTLLKKLLEAQLTIEGEN

SEQ ID NO: 2311382 - protein, 31 aa, Cryptosporidium parvum; identical to SEQ ID NO: 2187965

SEQ ID NO: 2311383 - protein, 25 aa, Cryptosporidium parvum
DGINSLLYEFWIKKFYSITNVEISR

SEQ ID NO: 2311384 - protein, 25 aa, Cryptosporidium parvum
DGKNSFKILFSWLNEELKLPSIENY

SEQ ID NO: 2311385 - protein, 19 aa, Cryptosporidium parvum
DGLIISHFPYGPTAYFAIS

SEQ ID NO: 2311386 - protein, 35 aa, Cryptosporidium parvum
DGLREYLVEKIWPRQPKLRLLYRDHVTTFVDTRIR

SEQ ID NO: 2311387 - protein, 22 aa, Cryptosporidium parvum
DGNPGFCIYYHSYKGAFGVQGR

SEQ ID NO: 2311388 - protein, 17 aa, Cryptosporidium parvum
DGNVLWYSSIGISWCYI

SEQ ID NO: 2311389 - protein, 30 aa, Cryptosporidium parvum
DGQINLPICGLLIYFISSLIHRSPIFNLSE

SEQ ID NO: 2311390 - protein, 36 aa, Cryptosporidium parvum; identical to SEQ ID NO: 2187973

SEQ ID NO: 2311391 - protein, 17 aa, Cryptosporidium parvum
DGQLFITSGWDGNIKIW

SEQ ID NO: 2311392 - protein, 30 aa, Cryptosporidium parvum
DGQQIEPLYYVPIIPMILVNGTDGIGTGWS

SEQ ID NO: 2311393 - protein, 26 aa, Cryptosporidium parvum
DGQYEYYVVRAWVRNARRIQIKAIDY

SEQ ID NO: 2311394 - protein, 23 aa, Cryptosporidium parvum
DGRKRYKYFSIGAYGFEGSRQLA

SEQ ID NO: 2311395 - protein, 21 aa, Cryptosporidium parvum
DGRLRFRANFNLPKKYAGEKI

SEQ ID NO: 2311396 - protein, 25 aa, Cryptosporidium parvum
DGRTCNCMINENLLIYYNEKGMQSK

SEQ ID NO: 2311397 - protein, 33 aa, Cryptosporidium parvum; identical to SEQ ID NO: 2187977

SEQ ID NO: 2311398 - protein, 17 aa, Cryptosporidium parvum
DGSFLLGVGDNHIKVAL

SEQ ID NO: 2311399 - protein, 40 aa, Cryptosporidium parvum
DGSHIKGLIINLIHYYWPSLIHFRGFLKQFVTPIVKAKKG

SEQ ID NO: 2311400 - protein, 22 aa, Cryptosporidium parvum
DGSPPLYVIELDNIQLSSKIRE

SEQ ID NO: 2311401 - protein, 20 aa, Cryptosporidium parvum
DGTIRYWNLAGSRRCEYMIR

SEQ ID NO: 2311402 - protein, 24 aa, Cryptosporidium parvum
DGTNKGYCFIEFLGKLEAISALEQ

SEQ ID NO: 2311403 - protein, 23 aa, Cryptosporidium parvum
DGTRIYPKYPLDVTWRHDLFVKS

SEQ ID NO: 2311404 - protein, 27 aa, Cryptosporidium parvum
DGTVLLKFCFIVWPSLNNTKTEIDALS

SEQ ID NO: 2311405 - protein, 22 aa, Cryptosporidium parvum
DGTYIYEKFLPTFGTDIKVYTV

SEQ ID NO: 2311406 - protein, 22 aa, Cryptosporidium parvum
DGVFSHEFILNYIKLKRDEVVL

SEQ ID NO: 2311407 - protein, 32 aa, Cryptosporidium parvum
DGVIYKSMTLHYWLFGFEFSDTLILFSRKKKI

SEQ ID NO: 2311408 - protein, 22 aa, Cryptosporidium parvum
DGVRWMWNRFRRSEGGILADEM

SEQ ID NO: 2311409 - protein, 17 aa, Cryptosporidium parvum
DGWFLSEDLQSMGVADG

SEQ ID NO: 2311410 - protein, 17 aa, Cryptosporidium parvum
DGWIAVERFFRSVTKSL

SEQ ID NO: 2311411 - protein, 22 aa, Cryptosporidium parvum
DGYEPYIKYLQALSLSWSSCQA

SEQ ID NO: 2311412 - protein, 21 aa, Cryptosporidium parvum
DGYITIIFFEDGELGEVLIPS

SEQ ID NO: 2311413 - protein, 24 aa, Cryptosporidium parvum
DHCKFPLTFLLNMNSKSPKQGTII

SEQ ID NO: 2311414 - protein, 27 aa, Cryptosporidium parvum
DHCRSDFWSLVFPKTYMQILKKSNHHF

SEQ ID NO: 2311415 - protein, 23 aa, Cryptosporidium parvum
DHEPSWLIYPLKNYGIRVQDNSD

SEQ ID NO: 2311416 - protein, 22 aa, Cryptosporidium parvum
DHEYLFQLNNFLNIECIYKSKL

SEQ ID NO: 2311417 - protein, 19 aa, Cryptosporidium parvum
DHFNGKIHVGYLKIRKQAK

SEQ ID NO: 2311418 - protein, 22 aa, Cryptosporidium parvum
DHFNVKWDILQTLDLSYYQFKY

SEQ ID NO: 2311419 - protein, 20 aa, Cryptosporidium parvum
DHFVSFIFTTLEKEKIVLPN

SEQ ID NO: 2311420 - protein, 17 aa, Cryptosporidium parvum
DHHLKHWSRLQLWLFLK

SEQ ID NO: 2311421 - protein, 26 aa, Cryptosporidium parvum
DHHNKTYILPCLYPGIYSTNIPCLAP

SEQ ID NO: 2311422 - protein, 21 aa, Cryptosporidium parvum
DHKFTPGFLFVSMDVSRALVR

SEQ ID NO: 2311423 - protein, 21 aa, Cryptosporidium parvum
DHLLPWYHYKNTISNLRVIVL

SEQ ID NO: 2311424 - protein, 29 aa, Cryptosporidium parvum
DHLQQVTLFNLFSPQFILLIQNRINNIEY

SEQ ID NO: 2311425 - protein, 18 aa, Cryptosporidium parvum
DHLQSVRLVWKLQVSKDH

SEQ ID NO: 2311426 - protein, 21 aa, Cryptosporidium parvum
DHLVDFFLGKVLRSSNSLFYI

SEQ ID NO: 2311427 - protein, 23 aa, Cryptosporidium parvum
DHSIPVILPKRLEGKIKDVLENE

SEQ ID NO: 2311428 - protein, 41 aa, Cryptosporidium parvum
DHSRQYHYVLQSLTMWREVLFNMIRLWRLAEDDLLDGNNGY

SEQ ID NO: 2311429 - protein, 23 aa, Cryptosporidium parvum
DHSVSILLNTLRAIDDRVRWMST

SEQ ID NO: 2311430 - protein, 25 aa, Cryptosporidium parvum
DHVDFETPFTRKHAYMRNELVFCNK

SEQ ID NO: 2311431 - protein, 17 aa, Cryptosporidium parvum
DHVLMFCSCLLGIGFDA

SEQ ID NO: 2311432 - protein, 24 aa, Cryptosporidium parvum
DHYKLKALDFRMVDFIKAAINPDT

SEQ ID NO: 2311433 - protein, 27 aa, Cryptosporidium parvum
DHYKNVIKSPSFSAPLMFDSEYNVIGH

SEQ ID NO: 2311434 - protein, 31 aa, Cryptosporidium parvum; identical to SEQ ID NO: 2188005

SEQ ID NO: 2311435 - protein, 27 aa, Cryptosporidium parvum
DIAFDDFPSFPYKYGMAITSLLADGQS

SEQ ID NO: 2311436 - protein, 26 aa, Cryptosporidium parvum
DIAKHHGFPGIFFNGAVLIGPNGIDD

SEQ ID NO: 2311437 - protein, 32 aa, Cryptosporidium parvum; identical to SEQ ID NO: 2188007

SEQ ID NO: 2311438 - protein, 26 aa, Cryptosporidium parvum
DIASRNVFILDPILGNGFGVFSAIKY

SEQ ID NO: 2311439 - protein, 24 aa, Cryptosporidium parvum
DIAYNYYIDLLKYNLAINEIKKED

SEQ ID NO: 2311440 - protein, 26 aa, Cryptosporidium parvum
DICPIDRLFTLKPVDKFPLTIDEILG

SEQ ID NO: 2311441 - protein, 23 aa, Cryptosporidium parvum
DICRFKLTWPLQKSFEIADEEMK

SEQ ID NO: 2311442 - protein, 17 aa, Cryptosporidium parvum
DIDEILKEFGLGDSLRK

SEQ ID NO: 2311443 - protein, 17 aa, Cryptosporidium parvum
DIDKIIRFSICSSSLQM

SEQ ID NO: 2311444 - protein, 28 aa, Cryptosporidium parvum
DIDMLNNQLEWVRRYSPQVYEAMLENTY

SEQ ID NO: 2311445 - protein, 23 aa, Cryptosporidium parvum
DIDVRNKHFFTAKSNFQKFVIEF

SEQ ID NO: 2311446 - protein, 25 aa, Cryptosporidium parvum
DIDYKPPFFPKIRSSLQLSTFLIVF

SEQ ID NO: 2311447 - protein, 27 aa, Cryptosporidium parvum
DIDYQVLHDAFFIYSTKPHLTQFGDLY

SEQ ID NO: 2311448 - protein, 24 aa, Cryptosporidium parvum
DIECFTFLNRTLESSLAPIVIFGT

SEQ ID NO: 2311449 - protein, 24 aa, Cryptosporidium parvum
DIEIRNIHIKSEKGFPFLNFQYNN

SEQ ID NO: 2311450 - protein, 25 aa, Cryptosporidium parvum
DIESFNMIFKAFKFDSSWIDTELNK

SEQ ID NO: 2311451 - protein, 19 aa, Cryptosporidium parvum
DIETPFPCFVKEGCIIPYQ

SEQ ID NO: 2311452 - protein, 19 aa, Cryptosporidium parvum
DIFHIGHLRFLERVKKIFG

SEQ ID NO: 2311453 - protein, 17 aa, Cryptosporidium parvum
DIFQDYLKPFLSRYTFH

SEQ ID NO: 2311454 - protein, 30 aa, Cryptosporidium parvum
DIFSNTFFVSLAIDLPLISKLSLLETNYEN

SEQ ID NO: 2311455 - protein, 18 aa, Cryptosporidium parvum
DIFTLDFNIPERTNLSLI

SEQ ID NO: 2311456 - protein, 17 aa, Cryptosporidium parvum
DIGQLMIEYIAVWGIIN

SEQ ID NO: 2311457 - protein, 17 aa, Cryptosporidium parvum
DIHGIIKTGMKSRRVAE

SEQ ID NO: 2311458 - protein, 26 aa, Cryptosporidium parvum
DIHGQYYDLLRLFEYGGFPPDTNYLF

SEQ ID NO: 2311459 - protein, 24 aa, Cryptosporidium parvum
DIHGQYYDLMRLFHNYKAPISEEL

SEQ ID NO: 2311460 - protein, 23 aa, Cryptosporidium parvum
DIHTLTNLIKFKTNLYHLREERE

SEQ ID NO: 2311461 - protein, 26 aa, Cryptosporidium parvum
DIIDENKLILNIPILVGINGKNDIEI

SEQ ID NO: 2311462 - protein, 17 aa, Cryptosporidium parvum
DIIEDEIRYIYLNQILS

SEQ ID NO: 2311463 - protein, 26 aa, Cryptosporidium parvum
DIIISEWMGYLLLYESMLDTVLFCRD

SEQ ID NO: 2311464 - protein, 19 aa, Cryptosporidium parvum
DIIMNLKRMLKGEMMVPMT

SEQ ID NO: 2311465 - protein, 20 aa, Cryptosporidium parvum
DIITFKRFGFSDNAWFDMED

SEQ ID NO: 2311466 - protein, 17 aa, Cryptosporidium parvum
DIIVLRPSNDYIYSLRN

SEQ ID NO: 2311467 - protein, 19 aa, Cryptosporidium parvum
DIKLYGWKEYYSLKQASEV

SEQ ID NO: 2311468 - protein, 24 aa, Cryptosporidium parvum
DIKNDRIILLELNLENLKFLIFFK

SEQ ID NO: 2311469 - protein, 19 aa, Cryptosporidium parvum
DIKPDNFLIGRGKKLNVVY

SEQ ID NO: 2311470 - protein, 18 aa, Cryptosporidium parvum
DIKPDNILLYPNPSFCEE

SEQ ID NO: 2311471 - protein, 24 aa, Cryptosporidium parvum
DIKTKNILTLLAYGLHIQTDSSVW

SEQ ID NO: 2311472 - protein, 17 aa, Cryptosporidium parvum
DIKVIIRQLLSSLEYCH

SEQ ID NO: 2311473 - protein, 18 aa, Cryptosporidium parvum
DIKWNYFGNILATTNKDR

SEQ ID NO: 2311474 - protein, 28 aa, Cryptosporidium parvum
DIKYDKLYLYMSIINKVLYKNTMSSASV

SEQ ID NO: 2311475 - protein, 23 aa, Cryptosporidium parvum
DIKYLLYSYIKAETTRYVRDHNV

SEQ ID NO: 2311476 - protein, 39 aa, Cryptosporidium parvum; identical to SEQ ID NO: 2188040

SEQ ID NO: 2311477 - protein, 32 aa, Cryptosporidium parvum; identical to SEQ ID NO: 2188041

SEQ ID NO: 2311478 - protein, 19 aa, Cryptosporidium parvum
DILEWFKFRVLCENVAEFT

SEQ ID NO: 2311479 - protein, 17 aa, Cryptosporidium parvum
DILGKLNAILDKCKEMN

SEQ ID NO: 2311480 - protein, 19 aa, Cryptosporidium parvum
DILKDAWSPALTLRTVMLS

SEQ ID NO: 2311481 - protein, 17 aa, Cryptosporidium parvum
DILLIKGNFIQSLLLCD

SEQ ID NO: 2311482 - protein, 21 aa, Cryptosporidium parvum
DILLLSSYKWVATNPSLLLDK

SEQ ID NO: 2311483 - protein, 20 aa, Cryptosporidium parvum
DILSDWRNSTLLKTHSDMVI

SEQ ID NO: 2311484 - protein, 18 aa, Cryptosporidium parvum
DILVRIARLFGFNTRFQT

SEQ ID NO: 2311485 - protein, 18 aa, Cryptosporidium parvum
DILYKSMTFYLQEHPELL

SEQ ID NO: 2311486 - protein, 20 aa, Cryptosporidium parvum
DIMSKYKCFLHELKLKLIEI

SEQ ID NO: 2311487 - protein, 23 aa, Cryptosporidium parvum
DINCKLLNLLTILNEVELSNMWV

SEQ ID NO: 2311488 - protein, 17 aa, Cryptosporidium parvum
DINFDLQKLKRLPLFLT

SEQ ID NO: 2311489 - protein, 21 aa, Cryptosporidium parvum
DINGMIKKIISQENGILVPRS

SEQ ID NO: 2311490 - protein, 20 aa, Cryptosporidium parvum
DINNILIDLIPNKNKQTLSK

SEQ ID NO: 2311491 - protein, 23 aa, Cryptosporidium parvum
DINSLLKEKYKWECRIVELGGPN

SEQ ID NO: 2311492 - protein, 27 aa, Cryptosporidium parvum
DIPIYKINISPWGGLSLPIIQRIIRLV

SEQ ID NO: 2311493 - protein, 41 aa, Cryptosporidium parvum
DIPLPKVCVFQIEAKLELLLLYRGCSSKRPHTKRGRSTANT

SEQ ID NO: 2311494 - protein, 25 aa, Cryptosporidium parvum
DIPPHVQIPKYYEGIKISLGEAGRE

SEQ ID NO: 2311495 - protein, 19 aa, Cryptosporidium parvum
DIPSYISYLDITKFFNSDF

SEQ ID NO: 2311496 - protein, 18 aa, Cryptosporidium parvum
DIQFVWNIVLCRKYKYLS

SEQ ID NO: 2311497 - protein, 25 aa, Cryptosporidium parvum
DIQLFRQTILYARSKDILLYNSPIE

SEQ ID NO: 2311498 - protein, 23 aa, Cryptosporidium parvum
DIQQIFSNCYLYNKPDSSVSILC

SEQ ID NO: 2311499 - protein, 23 aa, Cryptosporidium parvum
DIQRTMLELLNQLDGFEARGDVK

SEQ ID NO: 2311500 - protein, 30 aa, Cryptosporidium parvum
DIRELQPMETLSWLKSHGLNKMALIISQER

SEQ ID NO: 2311501 - protein, 21 aa, Cryptosporidium parvum
DIRLNILNRYSPFSRIVNLGD

SEQ ID NO: 2311502 - protein, 29 aa, Cryptosporidium parvum
DISIPIIKFVPILLRREVYSKWLEIILNY

SEQ ID NO: 2311503 - protein, 20 aa, Cryptosporidium parvum
DISLIKRLIKKEGNEKENSQ

SEQ ID NO: 2311504 - protein, 21 aa, Cryptosporidium parvum
DISLIVIKSFLALRRKNLSEK

SEQ ID NO: 2311505 - protein, 18 aa, Cryptosporidium parvum
DISMLTCFLIILVNVINY

SEQ ID NO: 2311506 - protein, 34 aa, Cryptosporidium parvum; identical to SEQ ID NO: 2188068

SEQ ID NO: 2311507 - protein, 23 aa, Cryptosporidium parvum
DIVDNFFDPLFQFSKKESNPTIQ

SEQ ID NO: 2311508 - protein, 24 aa, Cryptosporidium parvum
DIVEEYFWGDFPIFDYERDRVNPP

SEQ ID NO: 2311509 - protein, 34 aa, Cryptosporidium parvum
DIVHAFLKDKPARVLFSHPLILEILHIDCSKGNA

SEQ ID NO: 2311510 - protein, 17 aa, Cryptosporidium parvum
DIVLGILELLKYHARVM

SEQ ID NO: 2311511 - protein, 18 aa, Cryptosporidium parvum
DIWELYNLILSGDSVRSV

SEQ ID NO: 2311512 - protein, 19 aa, Cryptosporidium parvum
DIWGLLPKSIRSSLLQETQ

SEQ ID NO: 2311513 - protein, 20 aa, Cryptosporidium parvum
DIWLSDLIRKLSQNCLLISS

SEQ ID NO: 2311514 - protein, 21 aa, Cryptosporidium parvum
DIWSFGCVLYELTCLKPPFSG

SEQ ID NO: 2311515 - protein, 17 aa, Cryptosporidium parvum
DIYKLETFFSGSETQFK

SEQ ID NO: 2311516 - protein, 20 aa, Cryptosporidium parvum
DIYRRVDFLIKAFKKRDLNN

SEQ ID NO: 2311517 - protein, 19 aa, Cryptosporidium parvum
DKAIYYVKLFVPMGMPEEG

SEQ ID NO: 2311518 - protein, 24 aa, Cryptosporidium parvum
DKAVKVWHVLSGRLLRCFSTPTMT

SEQ ID NO: 2311519 - protein, 31 aa, Cryptosporidium parvum
DKCCDYYRYIRRKSWLILNVLLLMVDSSIKD

SEQ ID NO: 2311520 - protein, 18 aa, Cryptosporidium parvum
DKCIGNRIYVVMKGDKEF

SEQ ID NO: 2311521 - protein, 21 aa, Cryptosporidium parvum
DKDLEVLVVSQFTLFGNVKNG

SEQ ID NO: 2311522 - protein, 23 aa, Cryptosporidium parvum
DKEPILFKRIYLWREEAKIQVSK

SEQ ID NO: 2311523 - protein, 20 aa, Cryptosporidium parvum
DKFIINWIKKIEIEIGIKID

SEQ ID NO: 2311524 - protein, 27 aa, Cryptosporidium parvum
DKFSGIVLAGNILRLTPASKGNQFSTF

SEQ ID NO: 2311525 - protein, 26 aa, Cryptosporidium parvum
DKFVNYLIGFYFKHLQYLYNPDVRQY

SEQ ID NO: 2311526 - protein, 24 aa, Cryptosporidium parvum
DKGRYICISYGQPNYRLNYLKSMK

SEQ ID NO: 2311527 - protein, 23 aa, Cryptosporidium parvum
DKGTIYYVKPYIRNMTQLLNEIN

SEQ ID NO: 2311528 - protein, 18 aa, Cryptosporidium parvum
DKICVICGVNIGKYKFKC

SEQ ID NO: 2311529 - protein, 30 aa, Cryptosporidium parvum
DKIFKDFISFCFWFPITEFQRLYNKSVFLR

SEQ ID NO: 2311530 - protein, 23 aa, Cryptosporidium parvum
DKIYNAYIKVIERTLNLRLIELY

SEQ ID NO: 2311531 - protein, 23 aa, Cryptosporidium parvum
DKKIPCFFFAPRSNSKILVIYAH

SEQ ID NO: 2311532 - protein, 26 aa, Cryptosporidium parvum
DKKLKPILPKLAGKKEYFVCRNKPRK

SEQ ID NO: 2311533 - protein, 29 aa, Cryptosporidium parvum
DKKNFKLVKPPFSIIHLKAISRIYGDNGP

SEQ ID NO: 2311534 - protein, 24 aa, Cryptosporidium parvum
DKKNWSPLVPLIPSILETLQNLIS

SEQ ID NO: 2311535 - protein, 21 aa, Cryptosporidium parvum
DKLCSLIRKYQTLIEAHCNVK

SEQ ID NO: 2311536 - protein, 23 aa, Cryptosporidium parvum
DKLGARPIIKCRELALMGVKEVF

SEQ ID NO: 2311537 - protein, 23 aa, Cryptosporidium parvum
DKLKLLMDAFVKPSMRVTNFRTK

SEQ ID NO: 2311538 - protein, 50 aa, Cryptosporidium parvum; identical to SEQ ID NO: 2188093

SEQ ID NO: 2311539 - protein, 18 aa, Cryptosporidium parvum
DKLPPMHDWQFYDKKRIM

SEQ ID NO: 2311540 - protein, 26 aa, Cryptosporidium parvum
DKLQKKIFFLWYYEYINLLTIRNELE

SEQ ID NO: 2311541 - protein, 20 aa, Cryptosporidium parvum
DKMFSCFKATPLNKISVVIL

SEQ ID NO: 2311542 - protein, 36 aa, Cryptosporidium parvum; identical to SEQ ID NO: 2188098

SEQ ID NO: 2311543 - protein, 25 aa, Cryptosporidium parvum
DKNDGFLVLIKFISQIRGHPIIGKI

SEQ ID NO: 2311544 - protein, 22 aa, Cryptosporidium parvum
DKNGCWMLSFFLGEYNLRKQVL

SEQ ID NO: 2311545 - protein, 28 aa, Cryptosporidium parvum
DKNIQVFLNQGYYFDSLNNWNGYIHDSI

SEQ ID NO: 2311546 - protein, 23 aa, Cryptosporidium parvum
DKNLLINQYIKNQRKRFISESIY

SEQ ID NO: 2311547 - protein, 23 aa, Cryptosporidium parvum
DKNRKITIKSILKLFVQNNVIKN

SEQ ID NO: 2311548 - protein, 24 aa, Cryptosporidium parvum
DKPDMLMNLMRLGAASIMASYYGQ

SEQ ID NO: 2311549 - protein, 33 aa, Cryptosporidium parvum; identical to SEQ ID NO: 2188102

SEQ ID NO: 2311550 - protein, 32 aa, Cryptosporidium parvum
DKQEFKLPKLSFFVLIYSFILSKLSKIDDNFS

SEQ ID NO: 2311551 - protein, 27 aa, Cryptosporidium parvum
DKQIFCTQYLPHLLTSIKVHGDSSTNI

SEQ ID NO: 2311552 - protein, 25 aa, Cryptosporidium parvum
DKQKRLELAILGMNPLDYEGGIRNP

SEQ ID NO: 2311553 - protein, 19 aa, Cryptosporidium parvum
DKRILIKKCVPICQRLFYS

SEQ ID NO: 2311554 - protein, 25 aa, Cryptosporidium parvum
DKRQRLLRVLTISIPVTTSITTAFR

SEQ ID NO: 2311555 - protein, 25 aa, Cryptosporidium parvum
DKRRNLNEYYNGRQVLGFIGDICEK

SEQ ID NO: 2311556 - protein, 25 aa, Cryptosporidium parvum
DKRTGMPKGFAYLEFCEPEAVETAL

SEQ ID NO: 2311557 - protein, 23 aa, Cryptosporidium parvum
DKSKLTMLVGGLTAMAFGIYGAK

SEQ ID NO: 2311558 - protein, 18 aa, Cryptosporidium parvum
DKSNLIFIGTVLDSNKLF

SEQ ID NO: 2311559 - protein, 23 aa, Cryptosporidium parvum
DKSTNYLIYDKLIKDAVKSCLSG

SEQ ID NO: 2311560 - protein, 24 aa, Cryptosporidium parvum
DKTGFLINITLWGELAEVSDEKFL

SEQ ID NO: 2311561 - protein, 27 aa, Cryptosporidium parvum
DKTGNCRVIYWKDLYKSGVISQLMFSY

SEQ ID NO: 2311562 - protein, 18 aa, Cryptosporidium parvum
DKTLQLFEIQKLNHGIML

SEQ ID NO: 2311563 - protein, 26 aa, Cryptosporidium parvum
DKVLELWPHYVYSLVSSLGASHAGSR

SEQ ID NO: 2311564 - protein, 27 aa, Cryptosporidium parvum
DKVLTTSFLRKYIHYCKYVRNTPKLTD

SEQ ID NO: 2311565 - protein, 23 aa, Cryptosporidium parvum
DKVNSNLFIDINLTLNSNDDFNN

SEQ ID NO: 2311566 - protein, 18 aa, Cryptosporidium parvum
DKWNISIPIYSCFPDGTF

SEQ ID NO: 2311567 - protein, 21 aa, Cryptosporidium parvum
DKYANLFDRNIGSKGFGGILD

SEQ ID NO: 2311568 - protein, 20 aa, Cryptosporidium parvum
DKYIKLLEIASRYLNPLHFA

SEQ ID NO: 2311569 - protein, 21 aa, Cryptosporidium parvum
DKYKFFGLDLINGTVRDNVQA

SEQ ID NO: 2311570 - protein, 17 aa, Cryptosporidium parvum
DKYLRKFQIKFIPDIDK

SEQ ID NO: 2311571 - protein, 25 aa, Cryptosporidium parvum
DKYLSEIPHFKLFRKGNCSNGIREV

SEQ ID NO: 2311572 - protein, 26 aa, Cryptosporidium parvum
DLAKEYWRFLVGYNYELLISLLHSAP

SEQ ID NO: 2311573 - protein, 26 aa, Cryptosporidium parvum
DLAMNPVDYILLLRLISTTDDTKILN

SEQ ID NO: 2311574 - protein, 17 aa, Cryptosporidium parvum
DLAQHFLVKAGISVIRR

SEQ ID NO: 2311575 - protein, 24 aa, Cryptosporidium parvum
DLATLTGANYRLFEGRYASVLGNN

SEQ ID NO: 2311576 - protein, 27 aa, Cryptosporidium parvum
DLCNKSEYRFLQEWTKLGFSDKSTKKK

SEQ ID NO: 2311577 - protein, 24 aa, Cryptosporidium parvum
DLCNLIIKPLIYTFPFKPHNSNRE

SEQ ID NO: 2311578 - protein, 23 aa, Cryptosporidium parvum
DLCSYSEYRIYPGRGRKFVARDG

SEQ ID NO: 2311579 - protein, 26 aa, Cryptosporidium parvum
DLDEKIISKWRFYRLESKSLQGIKDN

SEQ ID NO: 2311580 - protein, 22 aa, Cryptosporidium parvum
DLDSIFPGDLLQRSFKKRISSL

SEQ ID NO: 2311581 - protein, 17 aa, Cryptosporidium parvum
DLDYLVLDFPPGTGDIQ

SEQ ID NO: 2311582 - protein, 23 aa, Cryptosporidium parvum
DLEIWIFDFHRPAIDELMLTIGG

SEQ ID NO: 2311583 - protein, 24 aa, Cryptosporidium parvum
DLEQDISYYKIWRDELDAENIFFS

SEQ ID NO: 2311584 - protein, 22 aa, Cryptosporidium parvum
DLETLSWRYNIQKNIGICKQEI

SEQ ID NO: 2311585 - protein, 19 aa, Cryptosporidium parvum
DLFDVIFGGGRRAGSRGGG

SEQ ID NO: 2311586 - protein, 17 aa, Cryptosporidium parvum
DLFFLASKLSDSLLLYS

SEQ ID NO: 2311587 - protein, 18 aa, Cryptosporidium parvum
DLFKMRFLGRNMKISYYC

SEQ ID NO: 2311588 - protein, 18 aa, Cryptosporidium parvum
DLFKPCMDVIWEFNKHVM

SEQ ID NO: 2311589 - protein, 28 aa, Cryptosporidium parvum
DLGDKSLWWLKYTLNKRPILGPTTMDNE

SEQ ID NO: 2311590 - protein, 20 aa, Cryptosporidium parvum
DLGIIEIFSSIPPALLKRRR

SEQ ID NO: 2311591 - protein, 18 aa, Cryptosporidium parvum
DLGKLLDICLEKILKRTN

SEQ ID NO: 2311592 - protein, 27 aa, Cryptosporidium parvum
DLGKYVGLGGAIRFFMLCKQIKHSFVN

SEQ ID NO: 2311593 - protein, 33 aa, Cryptosporidium parvum; identical to SEQ ID NO: 2188143

SEQ ID NO: 2311594 - protein, 17 aa, Cryptosporidium parvum
DLHRKYTFLQSNNAINN

SEQ ID NO: 2311595 - protein, 30 aa, Cryptosporidium parvum
DLHVGLHSAPRGILLFGPPGTGKTMLAKWI

SEQ ID NO: 2311596 - protein, 19 aa, Cryptosporidium parvum
DLIKIFCWMTTQNGQNNPL

SEQ ID NO: 2311597 - protein, 17 aa, Cryptosporidium parvum
DLIKRWLNEMEIVYYEG

SEQ ID NO: 2311598 - protein, 23 aa, Cryptosporidium parvum
DLILEFDICFPKSLTPEQKKLIK

SEQ ID NO: 2311599 - protein, 19 aa, Cryptosporidium parvum
DLILVPLESTLNRFKDYIR

SEQ ID NO: 2311600 - protein, 22 aa, Cryptosporidium parvum
DLIYIDSYCHLVPTFSLGQFEV

SEQ ID NO: 2311601 - protein, 35 aa, Cryptosporidium parvum
DLKFLVSIHNLFFFKNIILETSSKFFTLFFGDFIS

SEQ ID NO: 2311602 - protein, 27 aa, Cryptosporidium parvum
DLKGRIHDRYILFINDSKVIQMAWRRK

SEQ ID NO: 2311603 - protein, 17 aa, Cryptosporidium parvum
DLKILRFHDGISGKTYK

SEQ ID NO: 2311604 - protein, 17 aa, Cryptosporidium parvum
DLKLENILFTDNNYIWV

SEQ ID NO: 2311605 - protein, 22 aa, Cryptosporidium parvum
DLKLIKIQQARERYLLRKQNKN

SEQ ID NO: 2311606 - protein, 19 aa, Cryptosporidium parvum
DLKLQKKLLFFVTGSDRVP

SEQ ID NO: 2311607 - protein, 20 aa, Cryptosporidium parvum
DLKNIRILKFSDIIQYIMVK

SEQ ID NO: 2311608 - protein, 24 aa, Cryptosporidium parvum
DLKVSVYLYLNQFMDNIMGELGGV

SEQ ID NO: 2311609 - protein, 20 aa, Cryptosporidium parvum
DLKVWKFFIGYEQTNIEDDK

SEQ ID NO: 2311610 - protein, 17 aa, Cryptosporidium parvum
DLLEEFVLFIPELSGKT

SEQ ID NO: 2311611 - protein, 17 aa, Cryptosporidium parvum
DLLIRIRNSFDNCNETS

SEQ ID NO: 2311612 - protein, 19 aa, Cryptosporidium parvum
DLLIYKRPLNRSQALNNIN

SEQ ID NO: 2311613 - protein, 32 aa, Cryptosporidium parvum; identical to SEQ ID NO: 2188160

SEQ ID NO: 2311614 - protein, 29 aa, Cryptosporidium parvum
DLLKSDCLKLLKLIALLQIKTTNKVMNSE

SEQ ID NO: 2311615 - protein, 18 aa, Cryptosporidium parvum
DLLKYHKEFTHRATSCYI

SEQ ID NO: 2311616 - protein, 27 aa, Cryptosporidium parvum
DLLNFDFMDPPPTTTLLIALETLFELG

SEQ ID NO: 2311617 - protein, 21 aa, Cryptosporidium parvum
DLLNKELPSSYLKYIKVIRLD

SEQ ID NO: 2311618 - protein, 18 aa, Cryptosporidium parvum
DLLNWLNSYFNLNVSRIE

SEQ ID NO: 2311619 - protein, 24 aa, Cryptosporidium parvum
DLLPKPFRKLFTNPNSPLLSFYPA

SEQ ID NO: 2311620 - protein, 22 aa, Cryptosporidium parvum
DLLQGFAAVELCNRGWLYYPDS

SEQ ID NO: 2311621 - protein, 20 aa, Cryptosporidium parvum
DLLTTLGEHLALPPINRKVV

SEQ ID NO: 2311622 - protein, 28 aa, Cryptosporidium parvum
DLLYNSLLYKTQCLIGWFEFKNLQFEKA

SEQ ID NO: 2311623 - protein, 19 aa, Cryptosporidium parvum
DLNAQIYEILFPQENKFQD

SEQ ID NO: 2311624 - protein, 26 aa, Cryptosporidium parvum
DLNLPQELFSELLYSALKQVFDEITN

SEQ ID NO: 2311625 - protein, 26 aa, Cryptosporidium parvum
DLNNLLVMVVKSYDCIRPKRSSIGDF

SEQ ID NO: 2311626 - protein, 21 aa, Cryptosporidium parvum
DLNQDLLVHWKNKSQLSHVEI

SEQ ID NO: 2311627 - protein, 20 aa, Cryptosporidium parvum
DLPCLVLGTVYGMKLNRGYN

SEQ ID NO: 2311628 - protein, 17 aa, Cryptosporidium parvum
DLPEFYLVLSNISKRQN

SEQ ID NO: 2311629 - protein, 21 aa, Cryptosporidium parvum
DLPEPVDFSMLSKLVLESSLD

SEQ ID NO: 2311630 - protein, 18 aa, Cryptosporidium parvum
DLPLKINQWTSIVRWEFK

SEQ ID NO: 2311631 - protein, 25 aa, Cryptosporidium parvum
DLQEVWALLNYLMPSIFNSSETFQQ

SEQ ID NO: 2311632 - protein, 35 aa, Cryptosporidium parvum
DLQKSKIEWWKKPRGWKVTYFKQGQKLSQIFRVSL

SEQ ID NO: 2311633 - protein, 25 aa, Cryptosporidium parvum
DLRIPCGLFKTFALISSHSIFVQSR

SEQ ID NO: 2311634 - protein, 35 aa, Cryptosporidium parvum
DLRKMCVNLVPFPRLHFFMIGFAPLTSRGSQQYRS

SEQ ID NO: 2311635 - protein, 37 aa, Cryptosporidium parvum; identical to SEQ ID NO: 2188177

SEQ ID NO: 2311636 - protein, 30 aa, Cryptosporidium parvum; identical to SEQ ID NO: 2188179

SEQ ID NO: 2311637 - protein, 17 aa, Cryptosporidium parvum
DLRRLGYLMPTKDLNNS

SEQ ID NO: 2311638 - protein, 23 aa, Cryptosporidium parvum
DLRSIIISILPNIKTFNKSIINK

SEQ ID NO: 2311639 - protein, 22 aa, Cryptosporidium parvum
DLRTITYKFPSGLVEIVFYDEQ

SEQ ID NO: 2311640 - protein, 25 aa, Cryptosporidium parvum
DLRTPVNLKKTKLCPFWLSSACSIG

SEQ ID NO: 2311641 - protein, 19 aa, Cryptosporidium parvum
DLSGEGFAIVKKPTSYGKN

SEQ ID NO: 2311642 - protein, 34 aa, Cryptosporidium parvum
DLSIYIQSFDHLFYSLFHFEINFLSNIPIDTILI

SEQ ID NO: 2311643 - protein, 23 aa, Cryptosporidium parvum
DLSNLVIAYEPIWAIGTGVVATP

SEQ ID NO: 2311644 - protein, 22 aa, Cryptosporidium parvum
DLSPKNLLKRSSTLLKATKSLT

SEQ ID NO: 2311645 - protein, 24 aa, Cryptosporidium parvum
DLSQIPASLLKRLSFKPTSEVQVI

SEQ ID NO: 2311646 - protein, 27 aa, Cryptosporidium parvum
DLSSLLELHAAFLAFTLTLYPDNTNYV

SEQ ID NO: 2311647 - protein, 27 aa, Cryptosporidium parvum
DLSTNQIISWLNFPFRLSSIVEEWTNM

SEQ ID NO: 2311648 - protein, 21 aa, Cryptosporidium parvum
DLSYLICLISSNYKYENIVFC

SEQ ID NO: 2311649 - protein, 21 aa, Cryptosporidium parvum
DLTEIVYFLDIIHNVETVLSH

SEQ ID NO: 2311650 - protein, 24 aa, Cryptosporidium parvum
DLTNEKILRRWDANGLPISCLGLS

SEQ ID NO: 2311651 - protein, 17 aa, Cryptosporidium parvum
DLTWIRLSAIPGSPSMS

SEQ ID NO: 2311652 - protein, 25 aa, Cryptosporidium parvum
DLVEAYSLCLIPNKSYLRGMKNESE

SEQ ID NO: 2311653 - protein, 30 aa, Cryptosporidium parvum
DLVLRAGALPPILQLIALEIGPLDNNEQMM

SEQ ID NO: 2311654 - protein, 24 aa, Cryptosporidium parvum
DLVMDPLHFLFKDFGDPQVETEDK

SEQ ID NO: 2311655 - protein, 50 aa, Cryptosporidium parvum
DLVSWMKNRFIVLIRKRRQLMNLISTRIYRWYLFYKHIILPLRRQVEYRM

SEQ ID NO: 2311656 - protein, 19 aa, Cryptosporidium parvum
DLWALDCELLVDWGDGVLT

SEQ ID NO: 2311657 - protein, 27 aa, Cryptosporidium parvum
DLWSIGIILYILMTGIPPLRIDLMCDY

SEQ ID NO: 2311658 - protein, 21 aa, Cryptosporidium parvum
DLYHYIYVCTVVNKNVPEIGN

SEQ ID NO: 2311659 - protein, 17 aa, Cryptosporidium parvum
DLYKIMTKSKELGTWNK

SEQ ID NO: 2311660 - protein, 21 aa, Cryptosporidium parvum
DLYLLIFRINEEISILCISVV

SEQ ID NO: 2311661 - protein, 19 aa, Cryptosporidium parvum
DLYSEILYYKENIDRILAQ

SEQ ID NO: 2311662 - protein, 17 aa, Cryptosporidium parvum
DLYSHLIPVYEIDPLEK

SEQ ID NO: 2311663 - protein, 19 aa, Cryptosporidium parvum
DMDALISPFYNINIQNKQG

SEQ ID NO: 2311664 - protein, 18 aa, Cryptosporidium parvum
DMEISERIEFPLLVIVKH

SEQ ID NO: 2311665 - protein, 22 aa, Cryptosporidium parvum
DMFRYLEYFQNNFPLCPKEIDN

SEQ ID NO: 2311666 - protein, 21 aa, Cryptosporidium parvum
DMGGELNCIFRKIKFDIPTEC

SEQ ID NO: 2311667 - protein, 18 aa, Cryptosporidium parvum
DMIDLFSIPPNKNKIYYL

SEQ ID NO: 2311668 - protein, 23 aa, Cryptosporidium parvum
DMIKGLYLLYLLSCDKISDFHIA

SEQ ID NO: 2311669 - protein, 20 aa, Cryptosporidium parvum
DMKFSPFYNNFLATSSDDRS

SEQ ID NO: 2311670 - protein, 22 aa, Cryptosporidium parvum
DMKNLEQLTWAFGLLEDYSDSI

SEQ ID NO: 2311671 - protein, 17 aa, Cryptosporidium parvum
DMLLKYKDKIQIINFNK

SEQ ID NO: 2311672 - protein, 25 aa, Cryptosporidium parvum
DMLSDMASILMTLYFSKKDSEDLTY

SEQ ID NO: 2311673 - protein, 17 aa, Cryptosporidium parvum
DMLYTQLDTLIQAFAGI

SEQ ID NO: 2311674 - protein, 17 aa, Cryptosporidium parvum
DMMKWICKIPGKSGTLW

SEQ ID NO: 2311675 - protein, 31 aa, Cryptosporidium parvum; identical to SEQ ID NO: 2188205

SEQ ID NO: 2311676 - protein, 30 aa, Cryptosporidium parvum
DMNTQFLQDYFFLFKFDNPKRKLIFNIISS

SEQ ID NO: 2311677 - protein, 26 aa, Cryptosporidium parvum
DMNYKVIHLPIYNYSEKWKKIIYKYC

SEQ ID NO: 2311678 - protein, 26 aa, Cryptosporidium parvum
DMPKELKNCFILTLNVSLEYENSEVT

SEQ ID NO: 2311679 - protein, 17 aa, Cryptosporidium parvum
DMRGIRFNLLDVTLHAD

SEQ ID NO: 2311680 - protein, 20 aa, Cryptosporidium parvum
DMVKLLSRSVPFHQAVRILG

SEQ ID NO: 2311681 - protein, 23 aa, Cryptosporidium parvum
DMVKLNDYFTFPEKLDLSSFVNH

SEQ ID NO: 2311682 - protein, 18 aa, Cryptosporidium parvum
DMVTKVFASLMQCTASNI

SEQ ID NO: 2311683 - protein, 22 aa, Cryptosporidium parvum
DMVWRIFRYFGTPTEESWPEIG

SEQ ID NO: 2311684 - protein, 20 aa, Cryptosporidium parvum
DMYIYDPDFPNFSRLKIEAW

SEQ ID NO: 2311685 - protein, 19 aa, Cryptosporidium parvum
DNCIILPDTTIAPNTLIPP

SEQ ID NO: 2311686 - protein, 23 aa, Cryptosporidium parvum
DNCKYRHCLPVGYVIKEQESDDG

SEQ ID NO: 2311687 - protein, 17 aa, Cryptosporidium parvum
DNCNELIKCADIDGFLV

SEQ ID NO: 2311688 - protein, 18 aa, Cryptosporidium parvum
DNDILKRAKNFLSLCETI

SEQ ID NO: 2311689 - protein, 24 aa, Cryptosporidium parvum
DNEAFLPTIDLLMALKATYGNELT

SEQ ID NO: 2311690 - protein, 22 aa, Cryptosporidium parvum
DNELNIMLLQGMNPYSGPEIKI

SEQ ID NO: 2311691 - protein, 23 aa, Cryptosporidium parvum
DNENFKLAYPFYSNIFNIENHTC

SEQ ID NO: 2311692 - protein, 24 aa, Cryptosporidium parvum
DNERDLPDVVKLLDREYKDVIPFT

SEQ ID NO: 2311693 - protein, 21 aa, Cryptosporidium parvum
DNFDFPFLYERAKKYDIDVSK

SEQ ID NO: 2311694 - protein, 25 aa, Cryptosporidium parvum
DNFDSFYYNYHMLTGFPTLTPRFGL

SEQ ID NO: 2311695 - protein, 24 aa, Cryptosporidium parvum
DNFFDYEILLPTRNQLEDDSILSL

SEQ ID NO: 2311696 - protein, 28 aa, Cryptosporidium parvum
DNFHLRIRVHPFHVLRINKMLSCAGADR

SEQ ID NO: 2311697 - protein, 25 aa, Cryptosporidium parvum
DNFKLLTVFGKGDGNFRVFKFDNEE

SEQ ID NO: 2311698 - protein, 26 aa, Cryptosporidium parvum
DNFNFSYVFIVFYSISDDLNYSNDEI

SEQ ID NO: 2311699 - protein, 21 aa, Cryptosporidium parvum
DNGFMDYASWDSTFSSCIRCC

SEQ ID NO: 2311700 - protein, 26 aa, Cryptosporidium parvum
DNGKDILIQSKLLLPFDEDKISDTDI

SEQ ID NO: 2311701 - protein, 23 aa, Cryptosporidium parvum
DNGKNIMNPKKLFNVKFGTLTED

SEQ ID NO: 2311702 - protein, 25 aa, Cryptosporidium parvum
DNGPEILELLKRTPYSCIPVILNRL

SEQ ID NO: 2311703 - protein, 27 aa, Cryptosporidium parvum
DNIAFHAVFKLVFSSKNPGLVEDEPLV

SEQ ID NO: 2311704 - protein, 24 aa, Cryptosporidium parvum
DNIEVFPVLLEKGSTRLAIYGIGN

SEQ ID NO: 2311705 - protein, 20 aa, Cryptosporidium parvum
DNINILLDLVLLNNKDKRVY

SEQ ID NO: 2311706 - protein, 21 aa, Cryptosporidium parvum
DNIRFGLDYNNIGSISSMLMN

SEQ ID NO: 2311707 - protein, 36 aa, Cryptosporidium parvum
DNKGLVLPPKVAPVQVIIIPIIFKTVITEEQKKICN

SEQ ID NO: 2311708 - protein, 24 aa, Cryptosporidium parvum
DNKHGYGIQKWPDGAVFEGNFVNG

SEQ ID NO: 2311709 - protein, 23 aa, Cryptosporidium parvum
DNKIIDRYYNRSVLRLRGLPWST

SEQ ID NO: 2311710 - protein, 17 aa, Cryptosporidium parvum
DNKIRFWKITDENYLGK

SEQ ID NO: 2311711 - protein, 26 aa, Cryptosporidium parvum
DNKLLGQFEMMGIPPAPRGVPQIEVT

SEQ ID NO: 2311712 - protein, 39 aa, Cryptosporidium parvum
DNKRNWMRIMVRLNGFIYFKSKMILIKQYLVDEEVQLLE

SEQ ID NO: 2311713 - protein, 25 aa, Cryptosporidium parvum
DNLSNGYILPKDMDALISPFYNINI

SEQ ID NO: 2311714 - protein, 18 aa, Cryptosporidium parvum
DNMNPFITLKWSCSNAKS

SEQ ID NO: 2311715 - protein, 23 aa, Cryptosporidium parvum
DNNNLLDFYEFGRALAIMISDNF

SEQ ID NO: 2311716 - protein, 18 aa, Cryptosporidium parvum
DNNRKIVICQIPKDIKEI

SEQ ID NO: 2311717 - protein, 37 aa, Cryptosporidium parvum
DNNSGIFKSNDYLKLLLLDLRILKKGVSLNNEFLLEK

SEQ ID NO: 2311718 - protein, 24 aa, Cryptosporidium parvum
DNNYIWVNAPRHPGALIRRPVRPE

SEQ ID NO: 2311719 - protein, 20 aa, Cryptosporidium parvum
DNPMEFKPLKLDRVYTLVTK

SEQ ID NO: 2311720 - protein, 26 aa, Cryptosporidium parvum
DNPPYSYWGFYLYSNIRVLNQLLYSR

SEQ ID NO: 2311721 - protein, 26 aa, Cryptosporidium parvum
DNQNLINPFYFWDLRFGQSIVCDDAP

SEQ ID NO: 2311722 - protein, 29 aa, Cryptosporidium parvum
DNRDLIYDMIYTILLLGNIEFNPVENKDE

SEQ ID NO: 2311723 - protein, 37 aa, Cryptosporidium parvum
DNREYLIMELFHGGTIRQLLRFKYKNGLPINSVRNLM

SEQ ID NO: 2311724 - protein, 17 aa, Cryptosporidium parvum
DNRFLIKLPIVVQTYSP

SEQ ID NO: 2311725 - protein, 24 aa, Cryptosporidium parvum
DNRIELDLKIPKNISLEEICETEQ

SEQ ID NO: 2311726 - protein, 35 aa, Cryptosporidium parvum; identical to SEQ ID NO: 2188245

SEQ ID NO: 2311727 - protein, 20 aa, Cryptosporidium parvum
DNSVLPFASCFRCGKTGHIV

SEQ ID NO: 2311728 - protein, 26 aa, Cryptosporidium parvum
DNTKNFIPYRDSKLTRILQNSLGGNS

SEQ ID NO: 2311729 - protein, 26 aa, Cryptosporidium parvum
DNTLVGPGLFLLLSRNILSTIQDQDE

SEQ ID NO: 2311730 - protein, 24 aa, Cryptosporidium parvum
DNTSRLWKLSADSHLIFYPSNNNN

SEQ ID NO: 2311731 - protein, 20 aa, Cryptosporidium parvum
DNTVLVLYADTLKQFLVLYG

SEQ ID NO: 2311732 - protein, 40 aa, Cryptosporidium parvum; identical to SEQ ID NO: 2188249

SEQ ID NO: 2311733 - protein, 25 aa, Cryptosporidium parvum
DNVLTWLSRPVLSDLIISLANCTQE

SEQ ID NO: 2311734 - protein, 17 aa, Cryptosporidium parvum
DNWVYNEEFASRFSPDI

SEQ ID NO: 2311735 - protein, 38 aa, Cryptosporidium parvum; identical to SEQ ID NO: 2188253

SEQ ID NO: 2311736 - protein, 17 aa, Cryptosporidium parvum
DNYKGMLIWKSTNFIRH

SEQ ID NO: 2311737 - protein, 25 aa, Cryptosporidium parvum
DPAKHIIQGLWRKLTGKASRKRNRL

SEQ ID NO: 2311738 - protein, 24 aa, Cryptosporidium parvum
DPAVRPKVPILPGTKIKRKKRSAV

SEQ ID NO: 2311739 - protein, 20 aa, Cryptosporidium parvum
DPCYDPSTIWVPSSNSREAK

SEQ ID NO: 2311740 - protein, 23 aa, Cryptosporidium parvum
DPEAKIYQIFPKKTFLNDIMESV

SEQ ID NO: 2311741 - protein, 23 aa, Cryptosporidium parvum
DPEGFWSQMARKELRWLRDFTKV

SEQ ID NO: 2311742 - protein, 36 aa, Cryptosporidium parvum; identical to SEQ ID NO: 2188261

SEQ ID NO: 2311743 - protein, 20 aa, Cryptosporidium parvum
DPFMLIFNRIKALESPIFKF

SEQ ID NO: 2311744 - protein, 28 aa, Cryptosporidium parvum
DPFSDGIIFSVRPPKKSWRPIHNLSGGE

SEQ ID NO: 2311745 - protein, 26 aa, Cryptosporidium parvum
DPGFSEHVDKWINLKDIKLEIDKISI

SEQ ID NO: 2311746 - protein, 35 aa, Cryptosporidium parvum
DPISAFQIIIRKYIIPLILMIYQPNNFEKCEDVVL

SEQ ID NO: 2311747 - protein, 22 aa, Cryptosporidium parvum
DPKEEIIKAFKLFDDDETGKIT

SEQ ID NO: 2311748 - protein, 17 aa, Cryptosporidium parvum
DPKSYNLWSNRAWLLEF

SEQ ID NO: 2311749 - protein, 24 aa, Cryptosporidium parvum
DPKVRIKYLRYIQRLEQRGVEGID

SEQ ID NO: 2311750 - protein, 21 aa, Cryptosporidium parvum
DPLDSKYLSRSMLEITRDVCY

SEQ ID NO: 2311751 - protein, 20 aa, Cryptosporidium parvum
DPLLRKKLHKVPGVPLIYLN

SEQ ID NO: 2311752 - protein, 26 aa, Cryptosporidium parvum
DPNDLSPIVINFPHPIQLQNISIPYE

SEQ ID NO: 2311753 - protein, 25 aa, Cryptosporidium parvum
DPNKKSYWQLIKRLLNLFVDESESE

SEQ ID NO: 2311754 - protein, 19 aa, Cryptosporidium parvum
DPNNWLLAQGTLYPDIIES

SEQ ID NO: 2311755 - protein, 18 aa, Cryptosporidium parvum
DPNPNTRWSIKKALFHPD

SEQ ID NO: 2311756 - protein, 17 aa, Cryptosporidium parvum
DPNSINALVLPYGSEKE

SEQ ID NO: 2311757 - protein, 23 aa, Cryptosporidium parvum
DPNTKSYFCLYFAKGACVNGSKC

SEQ ID NO: 2311758 - protein, 18 aa, Cryptosporidium parvum
DPQRCIMWYGQVSAIDGC

SEQ ID NO: 2311759 - protein, 24 aa, Cryptosporidium parvum
DPQSLLIKLPSFYNSTRLVHFSKL

SEQ ID NO: 2311760 - protein, 20 aa, Cryptosporidium parvum
DPRLMKIIELPIDLRKWSYN

SEQ ID NO: 2311761 - protein, 34 aa, Cryptosporidium parvum
DPRVLHPKRRFKLFRSILKFGDPYRRLDDIIIDS

SEQ ID NO: 2311762 - protein, 22 aa, Cryptosporidium parvum
DPSLKGFFQSLIQRGEKKGSLS

SEQ ID NO: 2311763 - protein, 23 aa, Cryptosporidium parvum
DPSNTRLFFIGFGVIQGEDGKKF

SEQ ID NO: 2311764 - protein, 35 aa, Cryptosporidium parvum
DPSVIITFPLLEDPNIQFLAWTTTPWTLPSNVAIA

SEQ ID NO: 2311765 - protein, 21 aa, Cryptosporidium parvum
DPTLIIALHLKDTGNCIPLKF

SEQ ID NO: 2311766 - protein, 17 aa, Cryptosporidium parvum
DPWSPVPNSIFLYRDAN

SEQ ID NO: 2311767 - protein, 17 aa, Cryptosporidium parvum
DPYLGYLGPAISLSYEY

SEQ ID NO: 2311768 - protein, 30 aa, Cryptosporidium parvum; identical to SEQ ID NO: 2188292

SEQ ID NO: 2311769 - protein, 26 aa, Cryptosporidium parvum
DQEEYKLEWWLGIIEKFCDKNKSLLI

SEQ ID NO: 2311770 - protein, 24 aa, Cryptosporidium parvum
DQEHVMYVWFDALTNYITGLKWAD

SEQ ID NO: 2311771 - protein, 24 aa, Cryptosporidium parvum
DQESPFVYALVDWIKEKVGNFRIE

SEQ ID NO: 2311772 - protein, 40 aa, Cryptosporidium parvum
DQHNLFKSFHWLLNHLCAVFLDDTIWFRDRNMIYGEMNDI

SEQ ID NO: 2311773 - protein, 21 aa, Cryptosporidium parvum
DQIMEMAPLIRLCLYHCKRLD

SEQ ID NO: 2311774 - protein, 24 aa, Cryptosporidium parvum
DQKKKFWQTIDYKLVRPAVSKINS

SEQ ID NO: 2311775 - protein, 24 aa, Cryptosporidium parvum
DQKKVYYLGFIDFFSTWSTIKKFE

SEQ ID NO: 2311776 - protein, 20 aa, Cryptosporidium parvum
DQKSIIEQKLFVAVLTPSNI

SEQ ID NO: 2311777 - protein, 19 aa, Cryptosporidium parvum
DQLDYLPYNCKLHSNLENS

SEQ ID NO: 2311778 - protein, 21 aa, Cryptosporidium parvum
DQLISLFSAILLMGNFELGEH

SEQ ID NO: 2311779 - protein, 22 aa, Cryptosporidium parvum
DQLNHEFNNFIFSISCSSIPSY

SEQ ID NO: 2311780 - protein, 24 aa, Cryptosporidium parvum
DQNDVIVMLLACRKLEKQIEEQQT

SEQ ID NO: 2311781 - protein, 32 aa, Cryptosporidium parvum
DQNMDIFSKLELLRNYLLKVKKNESDFLEYSK

SEQ ID NO: 2311782 - protein, 29 aa, Cryptosporidium parvum
DQPILTDYVATRWYRAPEILLGSTKYTKG

SEQ ID NO: 2311783 - protein, 18 aa, Cryptosporidium parvum
DQQRDLFIKCKIKCFKES

SEQ ID NO: 2311784 - protein, 30 aa, Cryptosporidium parvum
DQRELEVLEPYEILIIPKRDNTVTVRDVSH

SEQ ID NO: 2311785 - protein, 25 aa, Cryptosporidium parvum
DQRKGIWDTFLGFIGLLKEDQKDNI

SEQ ID NO: 2311786 - protein, 29 aa, Cryptosporidium parvum
DQSRIGMYYAPMLGIAPSWCSFLDSITEE

SEQ ID NO: 2311787 - protein, 24 aa, Cryptosporidium parvum
DQTNQILYKVPYSNNININNGNKW

SEQ ID NO: 2311788 - protein, 26 aa, Cryptosporidium parvum
DQTRGWFYTLMVLSTALFDQPAFKNI

SEQ ID NO: 2311789 - protein, 21 aa, Cryptosporidium parvum
DQVKLFVGALPRNIIEDEIRE

SEQ ID NO: 2311790 - protein, 26 aa, Cryptosporidium parvum
DQVKSIQIVAKLDSIPTPTAQQKAGL

SEQ ID NO: 2311791 - protein, 21 aa, Cryptosporidium parvum
DQVNYTIFNKHLVATESWNCD

SEQ ID NO: 2311792 - protein, 25 aa, Cryptosporidium parvum
DQWNQAGSLYWARKIIIKAIELGFL

SEQ ID NO: 2311793 - protein, 18 aa, Cryptosporidium parvum
DQYINFETLKKLVDTRRL

SEQ ID NO: 2311794 - protein, 21 aa, Cryptosporidium parvum
DRAVEYLTSGLPIPENPVAPN

SEQ ID NO: 2311795 - protein, 19 aa, Cryptosporidium parvum
DRDDAHISLLLKTGLVHIS

SEQ ID NO: 2311796 - protein, 37 aa, Cryptosporidium parvum; identical to SEQ ID NO: 2188318

SEQ ID NO: 2311797 - protein, 24 aa, Cryptosporidium parvum
DREFSKIFSIKKLHLGHVASSFGI

SEQ ID NO: 2311798 - protein, 18 aa, Cryptosporidium parvum
DREFVILDYDFLNNHLLI

SEQ ID NO: 2311799 - protein, 23 aa, Cryptosporidium parvum
DRELIFELFMEFKTHIEVFTSHD

SEQ ID NO: 2311800 - protein, 25 aa, Cryptosporidium parvum
DRFVTGILQVPLLRNLIVINETSLE

SEQ ID NO: 2311801 - protein, 21 aa, Cryptosporidium parvum
DRFWTIVSHPTNSLFAAGHDS

SEQ ID NO: 2311802 - protein, 35 aa, Cryptosporidium parvum; identical to SEQ ID NO: 2188323

SEQ ID NO: 2311803 - protein, 25 aa, Cryptosporidium parvum
DRIEQYNWVINALGLRPVEIYEFSR

SEQ ID NO: 2311804 - protein, 19 aa, Cryptosporidium parvum
DRIINLWDFNKNTNGILNS

SEQ ID NO: 2311805 - protein, 22 aa, Cryptosporidium parvum
DRISILYERLKNKLLKCQVLDS

SEQ ID NO: 2311806 - protein, 23 aa, Cryptosporidium parvum
DRLENWLIKNLCISVFQFSEHSI

SEQ ID NO: 2311807 - protein, 17 aa, Cryptosporidium parvum
DRLIENTTLYPCFDEVL

SEQ ID NO: 2311808 - protein, 23 aa, Cryptosporidium parvum
DRLKNEFCRFIDFKYHASTIGNT

SEQ ID NO: 2311809 - protein, 43 aa, Cryptosporidium parvum; identical to SEQ ID NO: 2188332

SEQ ID NO: 2311810 - protein, 23 aa, Cryptosporidium parvum
DRLPPYLHVCLQRYCYDSISRAR

SEQ ID NO: 2311811 - protein, 25 aa, Cryptosporidium parvum
DRMRQLVFTSLLQSFCRPQWCNSLL

SEQ ID NO: 2311812 - protein, 23 aa, Cryptosporidium parvum
DRNFYIVDFICEIPVNIKTLFMK

SEQ ID NO: 2311813 - protein, 21 aa, Cryptosporidium parvum
DRQRWSRRRNLSKIISGKNVN

SEQ ID NO: 2311814 - protein, 21 aa, Cryptosporidium parvum
DRQTLLWSATWPKEVQKLARD

SEQ ID NO: 2311815 - protein, 23 aa, Cryptosporidium parvum
DRRNVIVVLFLIREYPLAFKTSN

SEQ ID NO: 2311816 - protein, 30 aa, Cryptosporidium parvum; identical to SEQ ID NO: 2188337

SEQ ID NO: 2311817 - protein, 29 aa, Cryptosporidium parvum
DRSGKGKFSAYFLLIRKQIQQGSSKCGLY

SEQ ID NO: 2311818 - protein, 19 aa, Cryptosporidium parvum
DRVFIFDSIVFTVILGSKR

SEQ ID NO: 2311819 - protein, 25 aa, Cryptosporidium parvum
DRVLRQPFGHLLLIGPPGCGKTLLA

SEQ ID NO: 2311820 - protein, 17 aa, Cryptosporidium parvum
DRVLYCINIHYLIQRKL

SEQ ID NO: 2311821 - protein, 17 aa, Cryptosporidium parvum
DRWVAVWTENGIRRSRI

SEQ ID NO: 2311822 - protein, 21 aa, Cryptosporidium parvum
DRYYHLAKEQGYRARSAFKLI

SEQ ID NO: 2311823 - protein, 34 aa, Cryptosporidium parvum; identical to SEQ ID NO: 2209225

SEQ ID NO: 2311824 - protein, 23 aa, Cryptosporidium parvum
DSCNQLLMLLNGFIKLVELESNI

SEQ ID NO: 2311825 - protein, 24 aa, Cryptosporidium parvum
DSDFKKLFRTPVYLSELHVKTLLY

SEQ ID NO: 2311826 - protein, 22 aa, Cryptosporidium parvum
DSDLYKWCRYFGSSILDNNTKN

SEQ ID NO: 2311827 - protein, 28 aa, Cryptosporidium parvum
DSDVLDTWFSSGLIPFSPLGWPDEVNQK

SEQ ID NO: 2311828 - protein, 26 aa, Cryptosporidium parvum
DSDYRIPFILLFDTWETFKFAKNLEL

SEQ ID NO: 2311829 - protein, 23 aa, Cryptosporidium parvum
DSEKFVFVLSTRAGGLGLNLQAA

SEQ ID NO: 2311830 - protein, 18 aa, Cryptosporidium parvum
DSEKILCMSILDKVSLYR

SEQ ID NO: 2311831 - protein, 21 aa, Cryptosporidium parvum
DSELPPFFKVEKLMFERHERE

SEQ ID NO: 2311832 - protein, 32 aa, Cryptosporidium parvum
DSENGELLPIPTAPYIIGLFLTKTISCDNILD

SEQ ID NO: 2311833 - protein, 20 aa, Cryptosporidium parvum
DSFCKLTPNSGSNKIWVWTV

SEQ ID NO: 2311834 - protein, 21 aa, Cryptosporidium parvum
DSFELFKNYITICSIKYKSAN

SEQ ID NO: 2311835 - protein, 18 aa, Cryptosporidium parvum
DSFPLPGIYYFRFKVRVG

SEQ ID NO: 2311836 - protein, 22 aa, Cryptosporidium parvum
DSFSMPSYIRIPSNNFPNSNNR

SEQ ID NO: 2311837 - protein, 24 aa, Cryptosporidium parvum
DSFVKNFIFGIQKMVDLSLSIFVK

SEQ ID NO: 2311838 - protein, 26 aa, Cryptosporidium parvum
DSGDYLILQFPNWFWRSASEEYIVRW

SEQ ID NO: 2311839 - protein, 25 aa, Cryptosporidium parvum
DSGGYIGFPNFQLMSGSLVGYKQYN

SEQ ID NO: 2311840 - protein, 20 aa, Cryptosporidium parvum
DSHWSILLKHQSSQLNVDVI

SEQ ID NO: 2311841 - protein, 30 aa, Cryptosporidium parvum
DSIAKLKAKVPVKPSPLLKSKSEKEKEKEE

SEQ ID NO: 2311842 - protein, 17 aa, Cryptosporidium parvum
DSICFVLGITNLSQIRI

SEQ ID NO: 2311843 - protein, 21 aa, Cryptosporidium parvum
DSICNPFLLRTIETPKLIGKI

SEQ ID NO: 2311844 - protein, 35 aa, Cryptosporidium parvum
DSIEERLLVLPNLSSYWMLESQILHILIRTLMSVN

SEQ ID NO: 2311845 - protein, 24 aa, Cryptosporidium parvum
DSIKAKWEKLFKRILNNKNGNSGI

SEQ ID NO: 2311846 - protein, 27 aa, Cryptosporidium parvum
DSILETIILELYKFSILYYNRFRQNDL

SEQ ID NO: 2311847 - protein, 23 aa, Cryptosporidium parvum
DSKKLIQDFFLKSHKHSITDVNW

SEQ ID NO: 2311848 - protein, 28 aa, Cryptosporidium parvum
DSKRVKLFHHLLQKLLLRRTKDLVIKLP

SEQ ID NO: 2311849 - protein, 35 aa, Cryptosporidium parvum
DSKSLLPHPLNHLLYRCYKLLTFWNVIVKDWNSVN

SEQ ID NO: 2311850 - protein, 23 aa, Cryptosporidium parvum
DSKTQLFPLNPIHIENKMAATSS

SEQ ID NO: 2311851 - protein, 26 aa, Cryptosporidium parvum
DSLFAELHFIIWKMDINEIQAPINDY

SEQ ID NO: 2311852 - protein, 22 aa, Cryptosporidium parvum
DSLFEFWAHIVTLYISSLFKHP

SEQ ID NO: 2311853 - protein, 26 aa, Cryptosporidium parvum
DSLIKFISMIIILLTKKLEGAIPASV

SEQ ID NO: 2311854 - protein, 43 aa, Cryptosporidium parvum
DSLKVYKQLQIGGILQILNIMIYGYPCRVPYSQIYNYFKQIIE

SEQ ID NO: 2311855 - protein, 17 aa, Cryptosporidium parvum
DSLLSMPIYQYIKENYS

SEQ ID NO: 2311856 - protein, 50 aa, Cryptosporidium parvum
DSLNHILIDDWILLQCPGQIQSILWYFRYVVRDFIQFLSQKLLESKSLTP

SEQ ID NO: 2311857 - protein, 26 aa, Cryptosporidium parvum
DSLPVKFFALFEFLKCITFEPAYISN

SEQ ID NO: 2311858 - protein, 26 aa, Cryptosporidium parvum
DSLTCPICARLFRYAVLTPCCGETYC

SEQ ID NO: 2311859 - protein, 20 aa, Cryptosporidium parvum
DSLYNLITMCLRPNPDLRAS

SEQ ID NO: 2311860 - protein, 26 aa, Cryptosporidium parvum
DSNDAKSLFVLNPDGSGILKNISTKF

SEQ ID NO: 2311861 - protein, 33 aa, Cryptosporidium parvum; identical to SEQ ID NO: 2188371

SEQ ID NO: 2311862 - protein, 29 aa, Cryptosporidium parvum
DSNERGKSLWLWKPLPQFISRSNRYQLDN

SEQ ID NO: 2311863 - protein, 21 aa, Cryptosporidium parvum
DSNGIYPWVWCDLVTDQDTAT

SEQ ID NO: 2311864 - protein, 21 aa, Cryptosporidium parvum
DSNICLRLVQLSKEEIRLFEK

SEQ ID NO: 2311865 - protein, 27 aa, Cryptosporidium parvum
DSNKKHYLLTIYELYVFRTVVCSSHLQ

SEQ ID NO: 2311866 - protein, 26 aa, Cryptosporidium parvum
DSNLTIIGTLSRFPSEKKCCIRPLIA

SEQ ID NO: 2311867 - protein, 25 aa, Cryptosporidium parvum
DSNRIMATLVLTILLKIAQENNLDK

SEQ ID NO: 2311868 - protein, 25 aa, Cryptosporidium parvum
DSNSLTLFNIINQSVSFLNSNLWNI

SEQ ID NO: 2311869 - protein, 24 aa, Cryptosporidium parvum
DSNTRQLLQRILFTWTRENPDLGY

SEQ ID NO: 2311870 - protein, 38 aa, Cryptosporidium parvum
DSPILKSTILLQLKLTLSLISLLRKLGLFCLSSQLIKS

SEQ ID NO: 2311871 - protein, 18 aa, Cryptosporidium parvum
DSPPHLILPSVSTPLHIP

SEQ ID NO: 2311872 - protein, 23 aa, Cryptosporidium parvum
DSPQLLEIIPPNSPPEETDPLVQ

SEQ ID NO: 2311873 - protein, 26 aa, Cryptosporidium parvum
DSPRKITFFISLLRTTAIAFSSGYSD

SEQ ID NO: 2311874 - protein, 17 aa, Cryptosporidium parvum
DSQIIIFDLNIVLSNPD

SEQ ID NO: 2311875 - protein, 25 aa, Cryptosporidium parvum
DSQITYFENLKLYLRSYYTMKECHT

SEQ ID NO: 2311876 - protein, 22 aa, Cryptosporidium parvum
DSQSFPLCIFKSNIITSKNHPL

SEQ ID NO: 2311877 - protein, 19 aa, Cryptosporidium parvum
DSQWKQFYSARMRTNAFNS

SEQ ID NO: 2311878 - protein, 25 aa, Cryptosporidium parvum
DSRFHPLISMIQLLSKFTHQMEWYL

SEQ ID NO: 2311879 - protein, 23 aa, Cryptosporidium parvum
DSRPFWFQDWGERAISYYSSQID

SEQ ID NO: 2311880 - protein, 17 aa, Cryptosporidium parvum
DSRTKFWSVSPQLNVPR

SEQ ID NO: 2311881 - protein, 21 aa, Cryptosporidium parvum
DSRVRLFNLSDLSTFVKFKGH

SEQ ID NO: 2311882 - protein, 24 aa, Cryptosporidium parvum
DSSCPTLYMCLYLDDVSSLLMDRI

SEQ ID NO: 2311883 - protein, 25 aa, Cryptosporidium parvum
DSSESFLFPFSKTKYHLFVNLRHVF

SEQ ID NO: 2311884 - protein, 25 aa, Cryptosporidium parvum
DSSGIFVLFNFKLKFNKEIGNSLCE

SEQ ID NO: 2311885 - protein, 27 aa, Cryptosporidium parvum
DSSILEISFLLVKYLIKLSKNYININF

SEQ ID NO: 2311886 - protein, 26 aa, Cryptosporidium parvum
DSSIQRPWVLQRLPKEQLAFDNANSK

SEQ ID NO: 2311887 - protein, 25 aa, Cryptosporidium parvum
DSSKILQFHRFVRVPEYITTAHNGP

SEQ ID NO: 2311888 - protein, 26 aa, Cryptosporidium parvum
DSSLSLYREWGFPIWAHGWSVHREFL

SEQ ID NO: 2311889 - protein, 28 aa, Cryptosporidium parvum
DSSNKLLFQYFTTVFKFHTLNQFESTEF

SEQ ID NO: 2311890 - protein, 25 aa, Cryptosporidium parvum
DSSPSFVQSVYDLILVPLESTLNRF

SEQ ID NO: 2311891 - protein, 36 aa, Cryptosporidium parvum; identical to SEQ ID NO: 2188396

SEQ ID NO: 2311892 - protein, 30 aa, Cryptosporidium parvum; identical to SEQ ID NO: 2188397

SEQ ID NO: 2311893 - protein, 22 aa, Cryptosporidium parvum
DSSWFGGWLGGQSEPTPPAPPP

SEQ ID NO: 2311894 - protein, 23 aa, Cryptosporidium parvum
DSTALICQYISFLSKYALDLVPG

SEQ ID NO: 2311895 - protein, 24 aa, Cryptosporidium parvum
DSTFYFEIIINIFGPLYEESIKDK

SEQ ID NO: 2311896 - protein, 39 aa, Cryptosporidium parvum
DSTTFLLKSLAYITNFLLQLFRFLTLFDSSPPELKDFTF

SEQ ID NO: 2311897 - protein, 25 aa, Cryptosporidium parvum
DSVGIYMPMIPETIYTMLACARIGA

SEQ ID NO: 2311898 - protein, 25 aa, Cryptosporidium parvum
DSVHNMPNWLLKNITFRLKEEFPGR

SEQ ID NO: 2311899 - protein, 22 aa, Cryptosporidium parvum
DSVIMAYRRALDDLGSIRIDLW

SEQ ID NO: 2311900 - protein, 26 aa, Cryptosporidium parvum
DSVPKIIGHFLVRQIMDKLQFQLYNE

SEQ ID NO: 2311901 - protein, 25 aa, Cryptosporidium parvum
DSWRKIETIFRTLSIDYSKLIDEEG

SEQ ID NO: 2311902 - protein, 19 aa, Cryptosporidium parvum
DSWRVRLSSCSLLGTLLNR

SEQ ID NO: 2311903 - protein, 37 aa, Cryptosporidium parvum
DSYEFSFHLFINRFMKSLIPIPIEKFVKFTGIRQYPR

SEQ ID NO: 2311904 - protein, 23 aa, Cryptosporidium parvum
DSYLIYSPEVKLLDLQPTNYIEA

SEQ ID NO: 2311905 - protein, 22 aa, Cryptosporidium parvum
DSYNLSMYFDPKSNIVFVNGDI

SEQ ID NO: 2311906 - protein, 24 aa, Cryptosporidium parvum
DSYNVDIEGLPPLIVEYSSLNAKA

SEQ ID NO: 2311907 - protein, 18 aa, Cryptosporidium parvum
DTAKNIITYIRTITNLLP

SEQ ID NO: 2311908 - protein, 23 aa, Cryptosporidium parvum
DTAKYLRNLDLNSAFYDPKSRSM

SEQ ID NO: 2311909 - protein, 18 aa, Cryptosporidium parvum
DTAYFKSVLSKNISMIPK

SEQ ID NO: 2311910 - protein, 19 aa, Cryptosporidium parvum
DTCIIMALDLLGKNSKEFL

SEQ ID NO: 2311911 - protein, 33 aa, Cryptosporidium parvum
DTCRINVQYAFPPGSDLLPRPWSKYSIGSSQYN

SEQ ID NO: 2311912 - protein, 26 aa, Cryptosporidium parvum
DTEFVHGFIVWFDIEFPAHKSNAIIL

SEQ ID NO: 2311913 - protein, 23 aa, Cryptosporidium parvum
DTEKNTCLPLFPSSLYTSNITCN

SEQ ID NO: 2311914 - protein, 20 aa, Cryptosporidium parvum
DTGLAPPSQWDLAADRQNMQ

SEQ ID NO: 2311915 - protein, 18 aa, Cryptosporidium parvum
DTKDSVIMAYRRALDDLG

SEQ ID NO: 2311916 - protein, 29 aa, Cryptosporidium parvum
DTKLNYIIGLINLVIKYISVIRNVFCNTF

SEQ ID NO: 2311917 - protein, 25 aa, Cryptosporidium parvum
DTLDPALLRPGRLDRKVEFGLPDLE

SEQ ID NO: 2311918 - protein, 27 aa, Cryptosporidium parvum
DTLFSEKLIYYVIIKKIFSSSIHLLRL

SEQ ID NO: 2311919 - protein, 24 aa, Cryptosporidium parvum
DTLNDQFWRIFGISLTTSSRSERV

SEQ ID NO: 2311920 - protein, 17 aa, Cryptosporidium parvum
DTNLFSMPIQISSSQKI

SEQ ID NO: 2311921 - protein, 17 aa, Cryptosporidium parvum
DTPFIHYRNIGFNKDLK

SEQ ID NO: 2311922 - protein, 43 aa, Cryptosporidium parvum
DTQKSIRGIYQWFRKYFKTYYLPNEYWIYKLHNFEAKTNNAFS

SEQ ID NO: 2311923 - protein, 24 aa, Cryptosporidium parvum
DTQVWAYKAFAQALEIIPKTLAQN

SEQ ID NO: 2311924 - protein, 17 aa, Cryptosporidium parvum
DTRIIFKKYKKIFMITG

SEQ ID NO: 2311925 - protein, 27 aa, Cryptosporidium parvum
DTRLFVLLDKLLAIFPEKIVRKSFIIF

SEQ ID NO: 2311926 - protein, 27 aa, Cryptosporidium parvum
DTSDLLASSFRIPPEKKCDEKIGVIPN

SEQ ID NO: 2311927 - protein, 28 aa, Cryptosporidium parvum
DTSEDWLKLMKKIFDFQKIQNLLNRKDF

SEQ ID NO: 2311928 - protein, 23 aa, Cryptosporidium parvum
DTSFDFLQLRRLSIVFDNPDCVP

SEQ ID NO: 2311929 - protein, 24 aa, Cryptosporidium parvum
DTSKIFKSYKLPFIKVKINNCNYV

SEQ ID NO: 2311930 - protein, 23 aa, Cryptosporidium parvum
DTSQFAIWELNQASTSPVSPTSS

SEQ ID NO: 2311931 - protein, 25 aa, Cryptosporidium parvum
DTSVVDFVFWSDRLIRLVVENALSH

SEQ ID NO: 2311932 - protein, 24 aa, Cryptosporidium parvum
DTTTIKLIWLNSLNESFLPFDFIL

SEQ ID NO: 2311933 - protein, 20 aa, Cryptosporidium parvum
DTVILITPNQQIAALEILAG

SEQ ID NO: 2311934 - protein, 17 aa, Cryptosporidium parvum
DTVYKYYRGMGSVGAMK

SEQ ID NO: 2311935 - protein, 19 aa, Cryptosporidium parvum
DTYLDQYLWYESDNRKLFP

SEQ ID NO: 2311936 - protein, 20 aa, Cryptosporidium parvum
DTYNCINLRLWKATPSREFD

SEQ ID NO: 2311937 - protein, 31 aa, Cryptosporidium parvum
DVCEIDIPGFRRCLIMAFVCNFCGIKTNELK

SEQ ID NO: 2311938 - protein, 25 aa, Cryptosporidium parvum
DVDELFAKLIPFGYNCLTLHSGQDH

SEQ ID NO: 2311939 - protein, 22 aa, Cryptosporidium parvum
DVDFQRFCLGLGFDINSQNQVI

SEQ ID NO: 2311940 - protein, 23 aa, Cryptosporidium parvum
DVDVFWSMLARKLSCFDWFECES

SEQ ID NO: 2311941 - protein, 23 aa, Cryptosporidium parvum
DVDVLLELIQFRCKIHLNQIEKD

SEQ ID NO: 2311942 - protein, 31 aa, Cryptosporidium parvum
DVENFKMYLYAAISCLPKYIVAKILKRRNPG

SEQ ID NO: 2311943 - protein, 32 aa, Cryptosporidium parvum; identical to SEQ ID NO: 2188437

SEQ ID NO: 2311944 - protein, 20 aa, Cryptosporidium parvum
DVEVVCPAPVIVPYVQPEIK

SEQ ID NO: 2311945 - protein, 19 aa, Cryptosporidium parvum
DVFKLSFAYHPSSIIYYKI

SEQ ID NO: 2311946 - protein, 17 aa, Cryptosporidium parvum
DVFLIPIGNFLIKKISD

SEQ ID NO: 2311947 - protein, 24 aa, Cryptosporidium parvum
DVFSILEYLSNDNFFILLSSQAIE

SEQ ID NO: 2311948 - protein, 18 aa, Cryptosporidium parvum
DVGLTWKNAYYIAEPKVK

SEQ ID NO: 2311949 - protein, 21 aa, Cryptosporidium parvum
DVIVWTLPFLVRSCENFINIS

SEQ ID NO: 2311950 - protein, 17 aa, Cryptosporidium parvum
DVIYIKRRPGSESSFHV

SEQ ID NO: 2311951 - protein, 21 aa, Cryptosporidium parvum
DVKELPSILLFTCQSLKPYKV

SEQ ID NO: 2311952 - protein, 23 aa, Cryptosporidium parvum
DVKPAVIKPKIATAAPVINIKKP

SEQ ID NO: 2311953 - protein, 23 aa, Cryptosporidium parvum
DVKVLIWKIYKIQKNESLEYIFV

SEQ ID NO: 2311954 - protein, 26 aa, Cryptosporidium parvum
DVLKEEIGPVILYFGCRYYDNDYLYR

SEQ ID NO: 2311955 - protein, 24 aa, Cryptosporidium parvum
DVLLSFSMTSLCAQIPFVRPKMVN

SEQ ID NO: 2311956 - protein, 18 aa, Cryptosporidium parvum
DVLNQIEFNYKALSVTLE

SEQ ID NO: 2311957 - protein, 22 aa, Cryptosporidium parvum
DVLNRFENFLFTAEYKYDGERA

SEQ ID NO: 2311958 - protein, 23 aa, Cryptosporidium parvum
DVLPDIWIYRIINDDFSCENKAK

SEQ ID NO: 2311959 - protein, 25 aa, Cryptosporidium parvum
DVLTFSIGWRRFQSIPLYSIEDRNE

SEQ ID NO: 2311960 - protein, 23 aa, Cryptosporidium parvum
DVNEYGMIPRALKLIFDNIDRNC

SEQ ID NO: 2311961 - protein, 30 aa, Cryptosporidium parvum; identical to SEQ ID NO: 2188452

SEQ ID NO: 2311962 - protein, 32 aa, Cryptosporidium parvum; identical to SEQ ID NO: 2188453

SEQ ID NO: 2311963 - protein, 24 aa, Cryptosporidium parvum
DVPDLLKQHLLPPKPIKIRHRLAL

SEQ ID NO: 2311964 - protein, 18 aa, Cryptosporidium parvum
DVPEAPLDNLWLNQNFQI

SEQ ID NO: 2311965 - protein, 24 aa, Cryptosporidium parvum
DVQEPYLEICNYISDILQVRLNSD

SEQ ID NO: 2311966 - protein, 24 aa, Cryptosporidium parvum
DVRDRALIYWRLLSTNPEETRKVV

SEQ ID NO: 2311967 - protein, 17 aa, Cryptosporidium parvum
DVRIIPINKSTNAKILP

SEQ ID NO: 2311968 - protein, 24 aa, Cryptosporidium parvum
DVRKQLINIFDKYKLDIISAENDH

SEQ ID NO: 2311969 - protein, 28 aa, Cryptosporidium parvum
DVSGRRQPPLNLFPFNFGVGNSTNNRND

SEQ ID NO: 2311970 - protein, 32 aa, Cryptosporidium parvum; identical to SEQ ID NO: 2188457

SEQ ID NO: 2311971 - protein, 32 aa, Cryptosporidium parvum
DVVSWEKYLHSYLLLIYFFEINQDVNSPNIYK

SEQ ID NO: 2311972 - protein, 25 aa, Cryptosporidium parvum
DVYCCSWLRKNIFKKYLYEASQTNC

SEQ ID NO: 2311973 - protein, 19 aa, Cryptosporidium parvum
DVYGELQPRRSKDLPLSYD

SEQ ID NO: 2311974 - protein, 26 aa, Cryptosporidium parvum
DWCTDACLLRYLRGYNLKVIKSFEAL

SEQ ID NO: 2311975 - protein, 18 aa, Cryptosporidium parvum
DWGTQFGMLIEYLKEEYP

SEQ ID NO: 2311976 - protein, 19 aa, Cryptosporidium parvum
DWMYKYYDSFKNKTSKHIM

SEQ ID NO: 2311977 - protein, 30 aa, Cryptosporidium parvum; identical to SEQ ID NO: 2188468

SEQ ID NO: 2311978 - protein, 31 aa, Cryptosporidium parvum; identical to SEQ ID NO: 2188469

SEQ ID NO: 2311979 - protein, 17 aa, Cryptosporidium parvum
DYAWLTQQLISIANLCC

SEQ ID NO: 2311980 - protein, 25 aa, Cryptosporidium parvum
DYELFNHILVLLGDLLRIFNSTIIF

SEQ ID NO: 2311981 - protein, 30 aa, Cryptosporidium parvum; identical to SEQ ID NO: 2188472

SEQ ID NO: 2311982 - protein, 20 aa, Cryptosporidium parvum
DYENHKLCYLIDSTIRFKVS

SEQ ID NO: 2311983 - protein, 22 aa, Cryptosporidium parvum
DYESLIKMYNKWKKPLEILSND

SEQ ID NO: 2311984 - protein, 19 aa, Cryptosporidium parvum
DYFFTNILSIVGHEYFHNY

SEQ ID NO: 2311985 - protein, 17 aa, Cryptosporidium parvum
DYFLNPVKIPVCDPLAW

SEQ ID NO: 2311986 - protein, 23 aa, Cryptosporidium parvum
DYGLQLYHFSPKHSKRFNSPIRV

SEQ ID NO: 2311987 - protein, 25 aa, Cryptosporidium parvum
DYHSLNIVALFLIELGYKPSEVIQF

SEQ ID NO: 2311988 - protein, 28 aa, Cryptosporidium parvum
DYIDRLYAMVKPRRLIYMAIDGVAPRAK

SEQ ID NO: 2311989 - protein, 21 aa, Cryptosporidium parvum
DYIGLNQLLQPVQHPHLNPPP

SEQ ID NO: 2311990 - protein, 19 aa, Cryptosporidium parvum
DYIIPKIQNLIIPQSPTLY

SEQ ID NO: 2311991 - protein, 20 aa, Cryptosporidium parvum
DYIKGQLPTFYSLKIRINNT

SEQ ID NO: 2311992 - protein, 27 aa, Cryptosporidium parvum
DYITQVEFLTGMLIFRPYNIKEKNSPN

SEQ ID NO: 2311993 - protein, 37 aa, Cryptosporidium parvum
DYIVASSTLMRPFYSTDDFLVFVKKNDKVPLSLVVYN

SEQ ID NO: 2311994 - protein, 30 aa, Cryptosporidium parvum
DYKPLKKTKKLIIPLDKYPDYNFMGLIIGP

SEQ ID NO: 2311995 - protein, 25 aa, Cryptosporidium parvum
DYKTKLINIVPISNLPQFLGGLTTD

SEQ ID NO: 2311996 - protein, 23 aa, Cryptosporidium parvum
DYLESYNIFPTYNFLLENKEKVV

SEQ ID NO: 2311997 - protein, 17 aa, Cryptosporidium parvum
DYLIRVFKELHTRFFQN

SEQ ID NO: 2311998 - protein, 21 aa, Cryptosporidium parvum
DYLLCNGCNRAFHWYCVNRPE

SEQ ID NO: 2311999 - protein, 23 aa, Cryptosporidium parvum
DYLSDLVCCLWGSPGVYGVVTTP

SEQ ID NO: 2312000 - protein, 17 aa, Cryptosporidium parvum
DYLVLDFPPGTGDIQLS

SEQ ID NO: 2312001 - protein, 17 aa, Cryptosporidium parvum
DYLYKIVLIGDSGVGKS

SEQ ID NO: 2312002 - protein, 24 aa, Cryptosporidium parvum
DYMFNRIFIIINSIELKYYSSEKQ

SEQ ID NO: 2312003 - protein, 19 aa, Cryptosporidium parvum
DYNIWRTWGRSDKSGWSKT

SEQ ID NO: 2312004 - protein, 21 aa, Cryptosporidium parvum
DYPPKYYPPLHFSIYKPKVTK

SEQ ID NO: 2312005 - protein, 35 aa, Cryptosporidium parvum; identical to SEQ ID NO: 2188497

SEQ ID NO: 2312006 - protein, 23 aa, Cryptosporidium parvum
DYQSITNIIWIVKSSLPISDQIH

SEQ ID NO: 2312007 - protein, 24 aa, Cryptosporidium parvum
DYQYQYKYYLAKLSRYEALEHSIT

SEQ ID NO: 2312008 - protein, 34 aa, Cryptosporidium parvum
DYSGFRIVVRPLPPIPFTICDWPLPIQSNERGEI

SEQ ID NO: 2312009 - protein, 27 aa, Cryptosporidium parvum
DYSKQFELAFMRLMKTRYSKSKVLANT

SEQ ID NO: 2312010 - protein, 18 aa, Cryptosporidium parvum
DYSKTCPSFQRKGSLRPS

SEQ ID NO: 2312011 - protein, 21 aa, Cryptosporidium parvum
DYSLIMKKTIFVIGVGGVGSV

SEQ ID NO: 2312012 - protein, 26 aa, Cryptosporidium parvum
DYSLSTYLSWLYLNKTQKIFCQGRLI

SEQ ID NO: 2312013 - protein, 28 aa, Cryptosporidium parvum
DYTNHKHLLLLILLIERNLSSGADLGCG

SEQ ID NO: 2312014 - protein, 25 aa, Cryptosporidium parvum
DYTRKKNILLILDRDFHKSLRNEPG

SEQ ID NO: 2312015 - protein, 20 aa, Cryptosporidium parvum
DYVCIGFSNGSVRLYNFPKS

SEQ ID NO: 2312016 - protein, 23 aa, Cryptosporidium parvum
DYVKRSPRIYDIKWICYSQALNE

SEQ ID NO: 2312017 - protein, 20 aa, Cryptosporidium parvum
DYWEFKEILLYCGEASSCGN

SEQ ID NO: 2312018 - protein, 24 aa, Cryptosporidium parvum
EAAALQLPDWSLPNPQRPSDHLPL

SEQ ID NO: 2312019 - protein, 26 aa, Cryptosporidium parvum
EAALSIYLEDFARTLGSREQLAIAEF

SEQ ID NO: 2312020 - protein, 38 aa, Cryptosporidium parvum; identical to SEQ ID NO: 2188510

SEQ ID NO: 2312021 - protein, 22 aa, Cryptosporidium parvum
EACAIRIQTAFRKYIKRRYLNV

SEQ ID NO: 2312022 - protein, 23 aa, Cryptosporidium parvum
EACIRFRVSRGWKISNWYGNFYF

SEQ ID NO: 2312023 - protein, 23 aa, Cryptosporidium parvum
EACPRLVELLGHPSPLVQTPALR

SEQ ID NO: 2312024 - protein, 23 aa, Cryptosporidium parvum
EADDPLLTYLYDDGQQIEPLYYV

SEQ ID NO: 2312025 - protein, 26 aa, Cryptosporidium parvum
EADKGNYLIIPYFTPELEKLSEEKNR

SEQ ID NO: 2312026 - protein, 27 aa, Cryptosporidium parvum
EADLWSLGVLFYVMLGGAFPFDERKGN

SEQ ID NO: 2312027 - protein, 20 aa, Cryptosporidium parvum
EAEARILQYIYPTESKDLVN

SEQ ID NO: 2312028 - protein, 32 aa, Cryptosporidium parvum
EAEGSKFLDPFLFWEGRVKLFPPELLSALVEC

SEQ ID NO: 2312029 - protein, 22 aa, Cryptosporidium parvum
EAEIPYRDLGFYGVPGRAGVSN

SEQ ID NO: 2312030 - protein, 25 aa, Cryptosporidium parvum
EAEKLKLMKLLPKDDFNINHLDVME

SEQ ID NO: 2312031 - protein, 23 aa, Cryptosporidium parvum
EAGREILRCYINQRGIRGKFMSS

SEQ ID NO: 2312032 - protein, 24 aa, Cryptosporidium parvum
EAGTKRIILIFLDSFTDVLEKINP

SEQ ID NO: 2312033 - protein, 24 aa, Cryptosporidium parvum
EAHKSHMVCFALVAMDVGFDNPMF

SEQ ID NO: 2312034 - protein, 17 aa, Cryptosporidium parvum
EAILRQNIGKDVHLIIL

SEQ ID NO: 2312035 - protein, 28 aa, Cryptosporidium parvum
EAIRDTRFNYILGIVLYSVRTRSKFKLQ

SEQ ID NO: 2312036 - protein, 23 aa, Cryptosporidium parvum
EAKKDFRYICEFDYFSRDAKLQS

SEQ ID NO: 2312037 - protein, 28 aa, Cryptosporidium parvum
EAKRLLWDEITKDTLPPSWLRKINKESM

SEQ ID NO: 2312038 - protein, 24 aa, Cryptosporidium parvum
EALDLLDKLLQFNPNKRISANDAL

SEQ ID NO: 2312039 - protein, 36 aa, Cryptosporidium parvum; identical to SEQ ID NO: 2188530

SEQ ID NO: 2312040 - protein, 22 aa, Cryptosporidium parvum
EALFQMDLFTHYDKHAIAALCE

SEQ ID NO: 2312041 - protein, 21 aa, Cryptosporidium parvum
EALGYVLMYFNRGTLPWQGLK

SEQ ID NO: 2312042 - protein, 21 aa, Cryptosporidium parvum
EALKHPFFKGMDFTKIRHQKP

SEQ ID NO: 2312043 - protein, 27 aa, Cryptosporidium parvum
EALNGELIILLKNIVFENIKIPLISGE

SEQ ID NO: 2312044 - protein, 24 aa, Cryptosporidium parvum
EALTGFKFIITHLDGRKLLVKSNP

SEQ ID NO: 2312045 - protein, 23 aa, Cryptosporidium parvum
EALYDICFRTLKLTNPSYGDLNH

SEQ ID NO: 2312046 - protein, 38 aa, Cryptosporidium parvum
EALYNSGIDLFPKKPIRLYYCKSLDFLWDWNSRIFIDC

SEQ ID NO: 2312047 - protein, 19 aa, Cryptosporidium parvum
EANHMLSQRGLPSIRWVGG

SEQ ID NO: 2312048 - protein, 24 aa, Cryptosporidium parvum
EANLRKYLALPADVSYRASLNEKL

SEQ ID NO: 2312049 - protein, 22 aa, Cryptosporidium parvum
EANRPLFDIVTQYFSSFDNVLS

SEQ ID NO: 2312050 - protein, 27 aa, Cryptosporidium parvum
EANSEVLFLQQIIAPFVLRRSKQDVLS

SEQ ID NO: 2312051 - protein, 27 aa, Cryptosporidium parvum
EAQKVFTQHWIMYELDTMLFEAYKESQ

SEQ ID NO: 2312052 - protein, 32 aa, Cryptosporidium parvum
EASQLASFNILIQPLLNLVLNAPGDDPDIKRL

SEQ ID NO: 2312053 - protein, 28 aa, Cryptosporidium parvum
EASSNIMFSNCNSPIKLVTSIVATPKPN

SEQ ID NO: 2312054 - protein, 35 aa, Cryptosporidium parvum; identical to SEQ ID NO: 2188544

SEQ ID NO: 2312055 - protein, 28 aa, Cryptosporidium parvum
EATLLLGKCSFLLDLDYWKDINSIEDWK

SEQ ID NO: 2312056 - protein, 25 aa, Cryptosporidium parvum
EAVDIYSNWIDKCYEVNSMEQSTSS

SEQ ID NO: 2312057 - protein, 17 aa, Cryptosporidium parvum
EAVSRYGLGNWSEISKY

SEQ ID NO: 2312058 - protein, 25 aa, Cryptosporidium parvum
EAVSYSIACVFYTKTCFEKNEAHCL

SEQ ID NO: 2312059 - protein, 34 aa, Cryptosporidium parvum
EAVYKKYPRYFFNDPWPEIDVSKPIPYVKQKQPP

SEQ ID NO: 2312060 - protein, 17 aa, Cryptosporidium parvum
ECELWRLHPAEKYQVPI

SEQ ID NO: 2312061 - protein, 18 aa, Cryptosporidium parvum
ECERNIMISLSLGLGLLS

SEQ ID NO: 2312062 - protein, 24 aa, Cryptosporidium parvum
ECFETLTGLRFFLIASKDAQGLNE

SEQ ID NO: 2312063 - protein, 31 aa, Cryptosporidium parvum
ECGIEWSTIIKIWRLILDRLVDCKNLELKGL

SEQ ID NO: 2312064 - protein, 25 aa, Cryptosporidium parvum
ECGSFLPMNKLFKKGDLLTALVGLE

SEQ ID NO: 2312065 - protein, 23 aa, Cryptosporidium parvum
ECGWGEFDIMAKVYFVDSTEKPV

SEQ ID NO: 2312066 - protein, 19 aa, Cryptosporidium parvum
ECIKTLHSLPLTQTNKKYL

SEQ ID NO: 2312067 - protein, 20 aa, Cryptosporidium parvum
ECIMYFMKQISNKRAKFIVF

SEQ ID NO: 2312068 - protein, 26 aa, Cryptosporidium parvum
ECINNFFTPLIQIIHYWGGDVIKFSG

SEQ ID NO: 2312069 - protein, 21 aa, Cryptosporidium parvum
ECIRLLVAFILNSLSMDELKC

SEQ ID NO: 2312070 - protein, 32 aa, Cryptosporidium parvum; identical to SEQ ID NO: 2188557

SEQ ID NO: 2312071 - protein, 19 aa, Cryptosporidium parvum
ECKYPIIALKYVNDIYHLC

SEQ ID NO: 2312072 - protein, 17 aa, Cryptosporidium parvum
ECLIFAQRFLKPSGIMI

SEQ ID NO: 2312073 - protein, 17 aa, Cryptosporidium parvum
ECLMLNGNRLKEISFIN

SEQ ID NO: 2312074 - protein, 21 aa, Cryptosporidium parvum
ECLNYPFGYVNSVLEGSPAFQ

SEQ ID NO: 2312075 - protein, 18 aa, Cryptosporidium parvum
ECLYLNFDSPWSSSKPAQ

SEQ ID NO: 2312076 - protein, 32 aa, Cryptosporidium parvum; identical to SEQ ID NO: 2188561

SEQ ID NO: 2312077 - protein, 25 aa, Cryptosporidium parvum
ECNKYLTNIKFLPKNTLKRVEFLSV

SEQ ID NO: 2312078 - protein, 24 aa, Cryptosporidium parvum
ECNNSGILLIPTQNNEFGQLSNSE

SEQ ID NO: 2312079 - protein, 18 aa, Cryptosporidium parvum
ECNPGVEKPWKLPTGPLA

SEQ ID NO: 2312080 - protein, 23 aa, Cryptosporidium parvum
ECNRPLFIPDFKSINITNEYCQF

SEQ ID NO: 2312081 - protein, 28 aa, Cryptosporidium parvum
ECPFCHISLDWTKMKPYIVLSLEAKQFP

SEQ ID NO: 2312082 - protein, 28 aa, Cryptosporidium parvum
ECSNPNFTIDNLLLYVRFIQGNICLNAS

SEQ ID NO: 2312083 - protein, 23 aa, Cryptosporidium parvum
ECSRYHIIALFEDYLDVISPITA

SEQ ID NO: 2312084 - protein, 31 aa, Cryptosporidium parvum; identical to SEQ ID NO: 2188564

SEQ ID NO: 2312085 - protein, 31 aa, Cryptosporidium parvum; identical to SEQ ID NO: 2188566

SEQ ID NO: 2312086 - protein, 22 aa, Cryptosporidium parvum
EDAWPCAELIGYYLDKKNPGNS

SEQ ID NO: 2312087 - protein, 29 aa, Cryptosporidium parvum
EDCGRINYVNLLRFLIWHIISEKEEAEKR

SEQ ID NO: 2312088 - protein, 30 aa, Cryptosporidium parvum
EDCIRMAIHLFHDYFYCQIKQLLTNFPPDH

SEQ ID NO: 2312089 - protein, 25 aa, Cryptosporidium parvum
EDDDDKFCICVQSIIGEIFELRTQL

SEQ ID NO: 2312090 - protein, 17 aa, Cryptosporidium parvum
EDDGCIHGIRFYKDSNL

SEQ ID NO: 2312091 - protein, 26 aa, Cryptosporidium parvum
EDDKKLYRIFVYYSGPNSDRLSYRQF

SEQ ID NO: 2312092 - protein, 43 aa, Cryptosporidium parvum
EDDLILPLRSNKFNENSRFLFQVPPPPPLVYSSSGQPVSSLGK

SEQ ID NO: 2312093 - protein, 22 aa, Cryptosporidium parvum
EDDPLLCPCQCRGSIKFVHLEC

SEQ ID NO: 2312094 - protein, 25 aa, Cryptosporidium parvum
EDDTMKNILYQISAQFFTCVIIDNP

SEQ ID NO: 2312095 - protein, 30 aa, Cryptosporidium parvum
EDEFNRWYYALCYGGFIESKKIENLKFDQG

SEQ ID NO: 2312096 - protein, 27 aa, Cryptosporidium parvum
EDEKLASLLYLLRNTIPSHERAIIFCA

SEQ ID NO: 2312097 - protein, 26 aa, Cryptosporidium parvum
EDELIEAFKVFDRDGNGFISAAELRH

SEQ ID NO: 2312098 - protein, 27 aa, Cryptosporidium parvum
EDELLSYYIVLLRTLAFRLNGETLRLF

SEQ ID NO: 2312099 - protein, 28 aa, Cryptosporidium parvum
EDENRYPYRRMIISNIYTLLGELASQAQ

SEQ ID NO: 2312100 - protein, 20 aa, Cryptosporidium parvum
EDERACEILKKLMKIEPKFN

SEQ ID NO: 2312101 - protein, 24 aa, Cryptosporidium parvum
EDESLNHVVIPYSILDYLNETDRT

SEQ ID NO: 2312102 - protein, 33 aa, Cryptosporidium parvum
EDEVGLIWKYRFYLFRFKAGIPMLFHFINLSDK

SEQ ID NO: 2312103 - protein, 24 aa, Cryptosporidium parvum
EDFTYLNRFYKINSFIIQIQGRKT

SEQ ID NO: 2312104 - protein, 23 aa, Cryptosporidium parvum
EDGDLFIWNLKEVKSKSYVNING

SEQ ID NO: 2312105 - protein, 28 aa, Cryptosporidium parvum
EDGLDVLRWLDRKLIRLVSRFADYQKDD

SEQ ID NO: 2312106 - protein, 36 aa, Cryptosporidium parvum
EDGNYPPICSVYGVPAKYLDPLTNKYYSSLEAFKMI

SEQ ID NO: 2312107 - protein, 23 aa, Cryptosporidium parvum
EDGRIIFWKIFNLPMNQTVNVST

SEQ ID NO: 2312108 - protein, 22 aa, Cryptosporidium parvum
EDHFYELRLQLLINRMEEKGDS

SEQ ID NO: 2312109 - protein, 26 aa, Cryptosporidium parvum
EDHKPRLLVKLLLEQGEGLTVVFVEM

SEQ ID NO: 2312110 - protein, 25 aa, Cryptosporidium parvum
EDIHGMAVVLILGSYRNEEFIRIGY

SEQ ID NO: 2312111 - protein, 17 aa, Cryptosporidium parvum
EDILYFISVFPVNKVIG

SEQ ID NO: 2312112 - protein, 25 aa, Cryptosporidium parvum
EDISVYDWFYLDSKQQFKYFHKKGN

SEQ ID NO: 2312113 - protein, 25 aa, Cryptosporidium parvum
EDIYPSIGHFALLGSSNSQLLGVMN

SEQ ID NO: 2312114 - protein, 20 aa, Cryptosporidium parvum
EDKILKWECLAAIPISYTTS

SEQ ID NO: 2312115 - protein, 25 aa, Cryptosporidium parvum
EDKILLSDIVFCKTWVSMTPREFYN

SEQ ID NO: 2312116 - protein, 31 aa, Cryptosporidium parvum
EDKNEVINSPWLFFSIRILDGYDTFCSDFIA

SEQ ID NO: 2312117 - protein, 27 aa, Cryptosporidium parvum
EDKQIQFSQFRGVLNRLCEIFGSTNQE

SEQ ID NO: 2312118 - protein, 22 aa, Cryptosporidium parvum
EDKSTFLSSLVSSLSPLSSTSS

SEQ ID NO: 2312119 - protein, 31 aa, Cryptosporidium parvum
EDLDPKSQLFQALSRLSLELSNTNLALDQCL

SEQ ID NO: 2312120 - protein, 31 aa, Cryptosporidium parvum
EDLELPQFCLFLILKYILNDYKQFINQFFQA

SEQ ID NO: 2312121 - protein, 26 aa, Cryptosporidium parvum
EDLINYIRTNYIPEKMMILGVGNIDH

SEQ ID NO: 2312122 - protein, 29 aa, Cryptosporidium parvum
EDLIQSDLIPYAALFARCYYPSKLEEIVI

SEQ ID NO: 2312123 - protein, 17 aa, Cryptosporidium parvum
EDLLNACKDIDFWKQQC

SEQ ID NO: 2312124 - protein, 24 aa, Cryptosporidium parvum
EDMEKIWHHTFYNELRVAPEEHPV

SEQ ID NO: 2312125 - protein, 17 aa, Cryptosporidium parvum
EDMLLETGEYFYSELER

SEQ ID NO: 2312126 - protein, 23 aa, Cryptosporidium parvum
EDNGIIRIPLLDGYRDNGVIAMG

SEQ ID NO: 2312127 - protein, 25 aa, Cryptosporidium parvum
EDNKTPLHYASFRSNLDYAKWVIEK

SEQ ID NO: 2312128 - protein, 26 aa, Cryptosporidium parvum
EDNPPDIPILDKLQRIILSESPRLTR

SEQ ID NO: 2312129 - protein, 18 aa, Cryptosporidium parvum
EDNWEQYYFNLKGGMMFG

SEQ ID NO: 2312130 - protein, 20 aa, Cryptosporidium parvum
EDPFFTIKKDLFINMLNSKT

SEQ ID NO: 2312131 - protein, 19 aa, Cryptosporidium parvum
EDPFSVFGLVLVPSRELSY

SEQ ID NO: 2312132 - protein, 32 aa, Cryptosporidium parvum
EDPRNCPHLHPYLELGLLCNPEVLPKVINDPN

SEQ ID NO: 2312133 - protein, 31 aa, Cryptosporidium parvum
EDQAKIAMKRVLLALQWLHANNVVHRDLKTE

SEQ ID NO: 2312134 - protein, 22 aa, Cryptosporidium parvum
EDQSLKSVYYSKSSKYRDSIDK

SEQ ID NO: 2312135 - protein, 24 aa, Cryptosporidium parvum
EDQVNKIVIHPFSKHLFSASSDET

SEQ ID NO: 2312136 - protein, 27 aa, Cryptosporidium parvum
EDRPDYTYLRKLFRDLMQREGYVDDGD

SEQ ID NO: 2312137 - protein, 24 aa, Cryptosporidium parvum
EDRRPFKCILDVGLTRTTSGNRVF

SEQ ID NO: 2312138 - protein, 23 aa, Cryptosporidium parvum
EDRVNCPFYWKIGACRHGDQCSR

SEQ ID NO: 2312139 - protein, 25 aa, Cryptosporidium parvum
EDSDKFVFLLSTRAGGLGINLTSAD

SEQ ID NO: 2312140 - protein, 24 aa, Cryptosporidium parvum
EDTGDYRIFRVSGEFSRALQQARV

SEQ ID NO: 2312141 - protein, 22 aa, Cryptosporidium parvum
EDTLLRIQKGASITPRFSLEES

SEQ ID NO: 2312142 - protein, 27 aa, Cryptosporidium parvum
EDTRLSVIFVILDPLTILYEGLPFSTR

SEQ ID NO: 2312143 - protein, 20 aa, Cryptosporidium parvum
EDVKKLLGFLGMPCIDAPSE

SEQ ID NO: 2312144 - protein, 23 aa, Cryptosporidium parvum
EDVMSYFDVFPQKYSISNLENTD

SEQ ID NO: 2312145 - protein, 24 aa, Cryptosporidium parvum
EDVRKKVCIFLSDLLAVYKNNVSL

SEQ ID NO: 2312146 - protein, 26 aa, Cryptosporidium parvum
EDVRLQFAYFIYGNNSWIKISRHIKG

SEQ ID NO: 2312147 - protein, 29 aa, Cryptosporidium parvum
EDWNNIAVMMFFIYADRWNMKPLSHMYLA

SEQ ID NO: 2312148 - protein, 28 aa, Cryptosporidium parvum
EDYFNDKLRYNFVIPGTGKKIDLIEKGS

SEQ ID NO: 2312149 - protein, 17 aa, Cryptosporidium parvum
EDYFVFFDQAIDELYVI

SEQ ID NO: 2312150 - protein, 33 aa, Cryptosporidium parvum
EEAPPAPPAPLPLPEELPPPPPSEELPPPPPPS

SEQ ID NO: 2312151 - protein, 30 aa, Cryptosporidium parvum; identical to SEQ ID NO: 2188613

SEQ ID NO: 2312152 - protein, 24 aa, Cryptosporidium parvum
EECFQILLGVVIRLFNKRLELDLP

SEQ ID NO: 2312153 - protein, 26 aa, Cryptosporidium parvum
EECKKYVFKIKYILANKYNLSVEFND

SEQ ID NO: 2312154 - protein, 25 aa, Cryptosporidium parvum
EECTILLLDRSFDTAPLYIHDYHYQ

SEQ ID NO: 2312155 - protein, 21 aa, Cryptosporidium parvum
EEDDFDGLPSEEEELDDIDDE

SEQ ID NO: 2312156 - protein, 32 aa, Cryptosporidium parvum; identical to SEQ ID NO: 2188616

SEQ ID NO: 2312157 - protein, 24 aa, Cryptosporidium parvum
EEDELLYQLVQRLGPSSWSETARL

SEQ ID NO: 2312158 - protein, 24 aa, Cryptosporidium parvum
EEDHVCLVLEFLGGGELFEWIAQK

SEQ ID NO: 2312159 - protein, 24 aa, Cryptosporidium parvum
EEDKFIRDLFLKMHAFEWKYESNS

SEQ ID NO: 2312160 - protein, 36 aa, Cryptosporidium parvum
EEDSNWALQLTATQSYPAFMAYTCLEEFHNTNIENI

SEQ ID NO: 2312161 - protein, 25 aa, Cryptosporidium parvum
EEDWQIWYLLSWCSLVSEDVSGAIE

SEQ ID NO: 2312162 - protein, 26 aa, Cryptosporidium parvum
EEEDAFEFWVALSTGLFQCYGSVLTA

SEQ ID NO: 2312163 - protein, 25 aa, Cryptosporidium parvum
EEEFRKLTLIRQETIMKDFIGDISR

SEQ ID NO: 2312164 - protein, 18 aa, Cryptosporidium parvum
EEEIMLLCNLAASCLNKW

SEQ ID NO: 2312165 - protein, 32 aa, Cryptosporidium parvum; identical to SEQ ID NO: 2188622

SEQ ID NO: 2312166 - protein, 34 aa, Cryptosporidium parvum
EEERLFVISRLHSILRPFLLRRVKSDVLQDLPEK

SEQ ID NO: 2312167 - protein, 22 aa, Cryptosporidium parvum
EEFPDRILQTFSVFPSPKVSDT

SEQ ID NO: 2312168 - protein, 24 aa, Cryptosporidium parvum
EEFTKFIFKLITYMKLISNKTKLE

SEQ ID NO: 2312169 - protein, 24 aa, Cryptosporidium parvum
EEFYESQVHFTGTLMGACIYTKKE

SEQ ID NO: 2312170 - protein, 29 aa, Cryptosporidium parvum
EEFYQHLKELLVVASLYENYRNFQNQCNE

SEQ ID NO: 2312171 - protein, 19 aa, Cryptosporidium parvum
EEIAHYFQALERRDRLLEY

SEQ ID NO: 2312172 - protein, 24 aa, Cryptosporidium parvum
EEIDRILTILYSKISAFSSSNNAC

SEQ ID NO: 2312173 - protein, 26 aa, Cryptosporidium parvum
EEIFFLKFSDLISELLIIGSKFIDSG

SEQ ID NO: 2312174 - protein, 22 aa, Cryptosporidium parvum
EEILEYWRKINILKLTLEKTKG

SEQ ID NO: 2312175 - protein, 25 aa, Cryptosporidium parvum
EEILGAFNLLNWLKGRVSICLGRNL

SEQ ID NO: 2312176 - protein, 20 aa, Cryptosporidium parvum
EEIPSLCELQDKYYRDKNLS

SEQ ID NO: 2312177 - protein, 24 aa, Cryptosporidium parvum
EEISNHMRILLLDPKWKQQKDQLV

SEQ ID NO: 2312178 - protein, 25 aa, Cryptosporidium parvum
EEKANFWYNNLTKYKRLIIKKTNVE

SEQ ID NO: 2312179 - protein, 17 aa, Cryptosporidium parvum
EEKEECFQILLGVVIRL

SEQ ID NO: 2312180 - protein, 34 aa, Cryptosporidium parvum; identical to SEQ ID NO: 2188637

SEQ ID NO: 2312181 - protein, 23 aa, Cryptosporidium parvum
EEKKPQLFSITRSLGDSDGRVVG

SEQ ID NO: 2312182 - protein, 25 aa, Cryptosporidium parvum
EEKLETVVFILKEYYPRANAHSIDA

SEQ ID NO: 2312183 - protein, 31 aa, Cryptosporidium parvum
EEKLRGILLEHFLIQISQIRIVRDPKGKPKG

SEQ ID NO: 2312184 - protein, 20 aa, Cryptosporidium parvum
EEKNQRFPAKYKGQKKDTPS

SEQ ID NO: 2312185 - protein, 25 aa, Cryptosporidium parvum
EEKRAKIRLMRRQTARQKWAKMALR

SEQ ID NO: 2312186 - protein, 24 aa, Cryptosporidium parvum
EELELYVEDILNILIYSIQLTCYS

SEQ ID NO: 2312187 - protein, 26 aa, Cryptosporidium parvum
EELERLIDITSLDSLVFLSPVELALS

SEQ ID NO: 2312188 - protein, 18 aa, Cryptosporidium parvum
EELINVLTLLPSVSLKQS

SEQ ID NO: 2312189 - protein, 17 aa, Cryptosporidium parvum
EELKFDPGEIPLIDYQE

SEQ ID NO: 2312190 - protein, 22 aa, Cryptosporidium parvum
EELKLHIPARLTNSIVALCIFN

SEQ ID NO: 2312191 - protein, 27 aa, Cryptosporidium parvum
EELKNGLRWGLKYLKLEDYRKGQKDAI

SEQ ID NO: 2312192 - protein, 27 aa, Cryptosporidium parvum
EELKRKFGSFESHIRRLLDARDNEIIQ

SEQ ID NO: 2312193 - protein, 24 aa, Cryptosporidium parvum
EELKTFLIQNLPKKVKKYNLGVGD

SEQ ID NO: 2312194 - protein, 17 aa, Cryptosporidium parvum
EELLKIFNKYGLVVECN

SEQ ID NO: 2312195 - protein, 20 aa, Cryptosporidium parvum
EELLNDMLLKYKDKIQIINF

SEQ ID NO: 2312196 - protein, 37 aa, Cryptosporidium parvum
EELNLFERIQILISKNLYDWALILAKNGNVSNSIYSQ

SEQ ID NO: 2312197 - protein, 17 aa, Cryptosporidium parvum
EELQLTKQQMEQLRKVY

SEQ ID NO: 2312198 - protein, 25 aa, Cryptosporidium parvum
EELSEKLIWPLHRKYGHALDALKEA

SEQ ID NO: 2312199 - protein, 24 aa, Cryptosporidium parvum
EELVPYGVFVWASGASPNSLTKQI

SEQ ID NO: 2312200 - protein, 31 aa, Cryptosporidium parvum; identical to SEQ ID NO: 2188653

SEQ ID NO: 2312201 - protein, 25 aa, Cryptosporidium parvum
EEMKRALEEIPNLPFLGKSIRVEED

SEQ ID NO: 2312202 - protein, 26 aa, Cryptosporidium parvum
EEMSQICHLFYKFKVYMNDLVNSFTS

SEQ ID NO: 2312203 - protein, 25 aa, Cryptosporidium parvum
EENILKYYKSILMSLPNSPKNIVSS

SEQ ID NO: 2312204 - protein, 25 aa, Cryptosporidium parvum
EENLLSLLEWGGIKLPLKSETVKSI

SEQ ID NO: 2312205 - protein, 26 aa, Cryptosporidium parvum
EENNFELLLCHPFNLSLNKYNAINKL

SEQ ID NO: 2312206 - protein, 23 aa, Cryptosporidium parvum
EENQRLILKYGFVKDPSLFCDHF

SEQ ID NO: 2312207 - protein, 17 aa, Cryptosporidium parvum
EENRLLDKLNLLRQHDI

SEQ ID NO: 2312208 - protein, 28 aa, Cryptosporidium parvum
EENSSLFLENILIPKVRLKKLIENGSLL

SEQ ID NO: 2312209 - protein, 25 aa, Cryptosporidium parvum
EEPNNLLPYIQLVSIGRKEKLFVFG

SEQ ID NO: 2312210 - protein, 28 aa, Cryptosporidium parvum
EEQKVLSYLEFLDLPTLELIGIDPAVLG

SEQ ID NO: 2312211 - protein, 25 aa, Cryptosporidium parvum
EEQNAVLVSLLDVSVRKLEILRKEN

SEQ ID NO: 2312212 - protein, 26 aa, Cryptosporidium parvum
EEQRMLISRLLKGLDQLGFTRSDATC

SEQ ID NO: 2312213 - protein, 18 aa, Cryptosporidium parvum
EERKFRAFSTLRKQFIEA

SEQ ID NO: 2312214 - protein, 24 aa, Cryptosporidium parvum
EERLRLVFSVNYPNIWEAKKELGI

SEQ ID NO: 2312215 - protein, 22 aa, Cryptosporidium parvum
EERPFAILDARPKLNAFANKAT

SEQ ID NO: 2312216 - protein, 36 aa, Cryptosporidium parvum
EERSLHIKLYDIKKTLNYLALQLMFGKEHQISNKGR

SEQ ID NO: 2312217 - protein, 27 aa, Cryptosporidium parvum
EESKRSWYHIRWLEIQKLLLIENIKSN

SEQ ID NO: 2312218 - protein, 17 aa, Cryptosporidium parvum
EESLPIQTSIGLYFESI

SEQ ID NO: 2312219 - protein, 30 aa, Cryptosporidium parvum; identical to SEQ ID NO: 2188665

SEQ ID NO: 2312220 - protein, 29 aa, Cryptosporidium parvum
EESQKVEWIFLKEKNLVLYVGFNSPGNLT

SEQ ID NO: 2312221 - protein, 27 aa, Cryptosporidium parvum
EESSIPIFQCFAWERGKFSMGGTLKLP

SEQ ID NO: 2312222 - protein, 28 aa, Cryptosporidium parvum
EETAKFYIAELLLALDYLNNIQGHIHRD

SEQ ID NO: 2312223 - protein, 28 aa, Cryptosporidium parvum
EETKSQRFLLIFIRTSLLDFKRIILEIM

SEQ ID NO: 2312224 - protein, 26 aa, Cryptosporidium parvum
EETKTFLLNYLYKCGPDMLRSAPYLV

SEQ ID NO: 2312225 - protein, 25 aa, Cryptosporidium parvum
EEVCRSLISILIQLGKPSRITDAIS

SEQ ID NO: 2312226 - protein, 30 aa, Cryptosporidium parvum; identical to SEQ ID NO: 2188672

SEQ ID NO: 2312227 - protein, 22 aa, Cryptosporidium parvum
EEVPVILLRKLTKNETILSLEF

SEQ ID NO: 2312228 - protein, 31 aa, Cryptosporidium parvum; identical to SEQ ID NO: 2188674

SEQ ID NO: 2312229 - protein, 23 aa, Cryptosporidium parvum
EEWELFMEYLKQDLPSTFRVVGV

SEQ ID NO: 2312230 - protein, 19 aa, Cryptosporidium parvum
EEWKPISLNAICELLSSKD

SEQ ID NO: 2312231 - protein, 26 aa, Cryptosporidium parvum
EEYAICYPMIRFLLSNRTLSDTEKEK

SEQ ID NO: 2312232 - protein, 24 aa, Cryptosporidium parvum
EEYIKTNVIWIPKSPSRPEVFEVE

SEQ ID NO: 2312233 - protein, 28 aa, Cryptosporidium parvum
EFACSKWMEFFVKNLKYLETPQYLRKTL

SEQ ID NO: 2312234 - protein, 23 aa, Cryptosporidium parvum
EFAEALLVIPKTLAINSAKDATD

SEQ ID NO: 2312235 - protein, 28 aa, Cryptosporidium parvum
EFCIDSLEIRFIPDDIVDFQFEPISEST

SEQ ID NO: 2312236 - protein, 26 aa, Cryptosporidium parvum
EFCKYRKMFWDIIWSDILSGKISPIT

SEQ ID NO: 2312237 - protein, 26 aa, Cryptosporidium parvum
EFCRTNIIPLLLKRHSISKKLAVIKP

SEQ ID NO: 2312238 - protein, 26 aa, Cryptosporidium parvum
EFCTRSWRDAKAWRYSLLVARKSKMA

SEQ ID NO: 2312239 - protein, 22 aa, Cryptosporidium parvum
EFDELLPYSKIAKILKLVTDKK

SEQ ID NO: 2312240 - protein, 28 aa, Cryptosporidium parvum
EFDGNYLKFELPPVLVKSLRTPSWGIPW

SEQ ID NO: 2312241 - protein, 22 aa, Cryptosporidium parvum
EFDKFMSQLKSMGIIEKIDGSK

SEQ ID NO: 2312242 - protein, 23 aa, Cryptosporidium parvum
EFEIYVKFLKQGLNLPCIYPTVY

SEQ ID NO: 2312243 - protein, 18 aa, Cryptosporidium parvum
EFELLKTYYHPLIVELVY

SEQ ID NO: 2312244 - protein, 18 aa, Cryptosporidium parvum
EFFAKRQLVTLFSAPNYC

SEQ ID NO: 2312245 - protein, 17 aa, Cryptosporidium parvum
EFFLKYLQVAGRVENWN

SEQ ID NO: 2312246 - protein, 28 aa, Cryptosporidium parvum
EFGLPDNYVLVYLICTRAGGLGINLVSA

SEQ ID NO: 2312247 - protein, 21 aa, Cryptosporidium parvum
EFIEKIASPIASLHGHEKRVT

SEQ ID NO: 2312248 - protein, 19 aa, Cryptosporidium parvum
EFIKFWSYENLYCKHSVVE

SEQ ID NO: 2312249 - protein, 26 aa, Cryptosporidium parvum
EFIMDLYYSFWNHLISRFTNTNNQIM

SEQ ID NO: 2312250 - protein, 22 aa, Cryptosporidium parvum
EFINTREWCDELDNFKSENFFE

SEQ ID NO: 2312251 - protein, 20 aa, Cryptosporidium parvum
EFIPIRLEMYEKRKNYLLSK

SEQ ID NO: 2312252 - protein, 17 aa, Cryptosporidium parvum
EFISRYKAKSDLPMIIS

SEQ ID NO: 2312253 - protein, 22 aa, Cryptosporidium parvum
EFKMNLCLISLNRMDFELNMEF

SEQ ID NO: 2312254 - protein, 26 aa, Cryptosporidium parvum
EFKNLDIEFIIRVLAVYKSYNLAQNV

SEQ ID NO: 2312255 - protein, 20 aa, Cryptosporidium parvum
EFKQWELPTFPKPVPEELPK

SEQ ID NO: 2312256 - protein, 17 aa, Cryptosporidium parvum
EFKTGLDSLIRRKILQG

SEQ ID NO: 2312257 - protein, 20 aa, Cryptosporidium parvum
EFKYILVHFSPNFPIKLNSC

SEQ ID NO: 2312258 - protein, 17 aa, Cryptosporidium parvum
EFKYLRSNVKNHSRITT

SEQ ID NO: 2312259 - protein, 23 aa, Cryptosporidium parvum
EFLDELLILDYIVTKLNELLEST

SEQ ID NO: 2312260 - protein, 18 aa, Cryptosporidium parvum
EFLHELIDRIPSLIAPHS

SEQ ID NO: 2312261 - protein, 31 aa, Cryptosporidium parvum
EFLQVKQFFSIFFDMLIFKGGNFLRQRLALS

SEQ ID NO: 2312262 - protein, 25 aa, Cryptosporidium parvum
EFLRKFRSYLKSKLKSRITALKSLI

SEQ ID NO: 2312263 - protein, 17 aa, Cryptosporidium parvum
EFLRNISNYLKPGGFFI

SEQ ID NO: 2312264 - protein, 34 aa, Cryptosporidium parvum; identical to SEQ ID NO: 2188715

SEQ ID NO: 2312265 - protein, 20 aa, Cryptosporidium parvum
EFMVPPFNWSWKEIKDMLSS

SEQ ID NO: 2312266 - protein, 19 aa, Cryptosporidium parvum
EFNFMRKLILQLYGNHRNC

SEQ ID NO: 2312267 - protein, 24 aa, Cryptosporidium parvum
EFNNYKIVFRRYASLYFIMGLENS

SEQ ID NO: 2312268 - protein, 19 aa, Cryptosporidium parvum
EFPDLLRPKARYSEKVVKT

SEQ ID NO: 2312269 - protein, 25 aa, Cryptosporidium parvum
EFPFKVIEILLGNILPIYTTSLDVF

SEQ ID NO: 2312270 - protein, 33 aa, Cryptosporidium parvum; identical to SEQ ID NO: 2188719

SEQ ID NO: 2312271 - protein, 30 aa, Cryptosporidium parvum
EFQLYKVRIIHLLLYKILGKCLIRVFHNSS

SEQ ID NO: 2312272 - protein, 18 aa, Cryptosporidium parvum
EFRDLKTSSKNWFCFQCL

SEQ ID NO: 2312273 - protein, 24 aa, Cryptosporidium parvum
EFRENLKKCLNILELLSMDIEEQV

SEQ ID NO: 2312274 - protein, 18 aa, Cryptosporidium parvum
EFSMQRESRIMRYIESTS

SEQ ID NO: 2312275 - protein, 26 aa, Cryptosporidium parvum
EFSVIFRRAFASRVIPPKLLKELGIQ

SEQ ID NO: 2312276 - protein, 20 aa, Cryptosporidium parvum
EFSYFYPLDCRVSGKDLIFN

SEQ ID NO: 2312277 - protein, 17 aa, Cryptosporidium parvum
EFTCMISPELLDLFDNH

SEQ ID NO: 2312278 - protein, 25 aa, Cryptosporidium parvum
EFVGSEFGRIFFSNWIKSIEEDSKK

SEQ ID NO: 2312279 - protein, 28 aa, Cryptosporidium parvum
EFVIMTANLILPLLIIQSHSIQNIIIGG

SEQ ID NO: 2312280 - protein, 19 aa, Cryptosporidium parvum
EFVIYTTQALRSKCFGKAI

SEQ ID NO: 2312281 - protein, 18 aa, Cryptosporidium parvum
EFWKERRLDLIKDALKSL

SEQ ID NO: 2312282 - protein, 32 aa, Cryptosporidium parvum; identical to SEQ ID NO: 2188733

SEQ ID NO: 2312283 - protein, 25 aa, Cryptosporidium parvum
EFYKKLKLKVILIDGTWSQAKSINK

SEQ ID NO: 2312284 - protein, 18 aa, Cryptosporidium parvum
EFYVHFRGLNRRLDRWVK

SEQ ID NO: 2312285 - protein, 20 aa, Cryptosporidium parvum
EGCDFGPLRCQYSHNVYWPR

SEQ ID NO: 2312286 - protein, 26 aa, Cryptosporidium parvum
EGCKQYLHCLPFFKTYSKLSKLGIQF

SEQ ID NO: 2312287 - protein, 25 aa, Cryptosporidium parvum
EGDRRKEGMSINRSLLALSQVISQL

SEQ ID NO: 2312288 - protein, 17 aa, Cryptosporidium parvum
EGDWLIVPEFKEVVSRT

SEQ ID NO: 2312289 - protein, 25 aa, Cryptosporidium parvum
EGEALTALILNKLQLNLKVCAVKAP

SEQ ID NO: 2312290 - protein, 21 aa, Cryptosporidium parvum
EGEKCFVVMIANISPSSKAFE

SEQ ID NO: 2312291 - protein, 20 aa, Cryptosporidium parvum
EGESLMMKLYSLALSSGSAC

SEQ ID NO: 2312292 - protein, 19 aa, Cryptosporidium parvum
EGFELLIKLAAESNLMEKI

SEQ ID NO: 2312293 - protein, 26 aa, Cryptosporidium parvum
EGFNQDSFIYMRGNSIPGVVCGMNSI

SEQ ID NO: 2312294 - protein, 26 aa, Cryptosporidium parvum
EGGELYNIWYGKYQFDYDKRGKVASK

SEQ ID NO: 2312295 - protein, 24 aa, Cryptosporidium parvum
EGGSNPNIYFTPNSLIHGSCKEGN

SEQ ID NO: 2312296 - protein, 30 aa, Cryptosporidium parvum; identical to SEQ ID NO: 2188751

SEQ ID NO: 2312297 - protein, 17 aa, Cryptosporidium parvum
EGIKLKRKGLIMEGEKE

SEQ ID NO: 2312298 - protein, 23 aa, Cryptosporidium parvum
EGIKRKISALDYGIQLGMKNVPF

SEQ ID NO: 2312299 - protein, 24 aa, Cryptosporidium parvum
EGIPQVYILLRWDCLVFHINEKGM

SEQ ID NO: 2312300 - protein, 20 aa, Cryptosporidium parvum
EGKINFLPGIAGRKDKRYWN

SEQ ID NO: 2312301 - protein, 22 aa, Cryptosporidium parvum
EGKSGAFFYYTTDGRFLIKTVG

SEQ ID NO: 2312302 - protein, 25 aa, Cryptosporidium parvum
EGKSYLSKILLIYSLMDIDVGYVQG

SEQ ID NO: 2312303 - protein, 26 aa, Cryptosporidium parvum
EGKTLCYVIPIANYLYNRTYPNLSVL

SEQ ID NO: 2312304 - protein, 22 aa, Cryptosporidium parvum
EGKVGEWRDGSRLRWIKSSLEN

SEQ ID NO: 2312305 - protein, 25 aa, Cryptosporidium parvum
EGLIEFIPEMKILIQELNEILDKLK

SEQ ID NO: 2312306 - protein, 18 aa, Cryptosporidium parvum
EGLLKKLLAFKEVNLDFI

SEQ ID NO: 2312307 - protein, 17 aa, Cryptosporidium parvum
EGLLKLPYSLIHIPLNR

SEQ ID NO: 2312308 - protein, 31 aa, Cryptosporidium parvum
EGLLLSLKLILPWLDYLDDVPIVRMTIPIMS

SEQ ID NO: 2312309 - protein, 24 aa, Cryptosporidium parvum
EGLNLHLKTLRTFKSFILENEEDF

SEQ ID NO: 2312310 - protein, 25 aa, Cryptosporidium parvum
EGNIEMLKLEFYRISSRLSDSLKEK

SEQ ID NO: 2312311 - protein, 25 aa, Cryptosporidium parvum
EGNMYLLSKFIWERIKNIFNYHEFE

SEQ ID NO: 2312312 - protein, 24 aa, Cryptosporidium parvum
EGNNGFCFLQFSSPLTSYRALKWE

SEQ ID NO: 2312313 - protein, 25 aa, Cryptosporidium parvum
EGNNIFLNIWTPLHLNQIMDRKTLE

SEQ ID NO: 2312314 - protein, 26 aa, Cryptosporidium parvum
EGNRIYLPCIYILNKIDQITIEELDV

SEQ ID NO: 2312315 - protein, 21 aa, Cryptosporidium parvum
EGNSMIKYYVLDKSRKKTSNS

SEQ ID NO: 2312316 - protein, 38 aa, Cryptosporidium parvum
EGPLEKKNSWSWGHKLRWVKIFKCEMHYFLSPKESNIK

SEQ ID NO: 2312317 - protein, 25 aa, Cryptosporidium parvum
EGSCNYLEDYLIKKLKRNDPKVKFK

SEQ ID NO: 2312318 - protein, 25 aa, Cryptosporidium parvum
EGSDTIFPLISEPLKTFVTVNPATL

SEQ ID NO: 2312319 - protein, 18 aa, Cryptosporidium parvum
EGSKKNIIGLKSFLDDFV

SEQ ID NO: 2312320 - protein, 25 aa, Cryptosporidium parvum
EGVEYLRRYLDLPASVFPATHTKKT

SEQ ID NO: 2312321 - protein, 42 aa, Cryptosporidium parvum
EGVLDVLSQWLSPFKDGTLPNLSIRNKILKLISNIPLGEEDI

SEQ ID NO: 2312322 - protein, 25 aa, Cryptosporidium parvum
EHADRVVVYLYLDKDLFIQFGSYMD

SEQ ID NO: 2312323 - protein, 23 aa, Cryptosporidium parvum
EHDFIMATYLADRVILFTGTPGV

SEQ ID NO: 2312324 - protein, 28 aa, Cryptosporidium parvum
EHDKFLLNWKRYCKTIPLRGVILINKEF

SEQ ID NO: 2312325 - protein, 21 aa, Cryptosporidium parvum
EHIWKSTCFIKLPSKLDDGGY

SEQ ID NO: 2312326 - protein, 27 aa, Cryptosporidium parvum
EHLDISWCPMLTSKTLKYLALRYSRNN

SEQ ID NO: 2312327 - protein, 18 aa, Cryptosporidium parvum
EHLIPHYIDLNKSIEDQG

SEQ ID NO: 2312328 - protein, 17 aa, Cryptosporidium parvum
EHLSLNGLILQSFKCLI

SEQ ID NO: 2312329 - protein, 26 aa, Cryptosporidium parvum
EHNGYVFLILEYVDTNLFNILHRKKK

SEQ ID NO: 2312330 - protein, 27 aa, Cryptosporidium parvum
EHNYHAWSLVNWLIYELIPTIISSDDS

SEQ ID NO: 2312331 - protein, 25 aa, Cryptosporidium parvum
EHPIASLLSVLSMNKGIQSIHNRMS

SEQ ID NO: 2312332 - protein, 24 aa, Cryptosporidium parvum
EHPKFTEYLCGSYVKVPIINPSTN

SEQ ID NO: 2312333 - protein, 27 aa, Cryptosporidium parvum
EHPVNHFWNYIFYCRWVLQVTIGEYYS

SEQ ID NO: 2312334 - protein, 25 aa, Cryptosporidium parvum
EHSKSLSISYPFLDDIIIRPKSTAR

SEQ ID NO: 2312335 - protein, 25 aa, Cryptosporidium parvum
EHSSYVPYRDSKLTRLLQDSLGGRT

SEQ ID NO: 2312336 - protein, 30 aa, Cryptosporidium parvum
EHVENIIRRLFKVFLQDFKLSSMYKTISNG

SEQ ID NO: 2312337 - protein, 17 aa, Cryptosporidium parvum
EIACGTNYGLLRRYKHI

SEQ ID NO: 2312338 - protein, 17 aa, Cryptosporidium parvum
EIALGKNGGGGRGAGSG

SEQ ID NO: 2312339 - protein, 26 aa, Cryptosporidium parvum
EIANTKLYQLITYLRKHGLKHIFEDN

SEQ ID NO: 2312340 - protein, 19 aa, Cryptosporidium parvum
EICLYDIEILKYSPLSQAV

SEQ ID NO: 2312341 - protein, 27 aa, Cryptosporidium parvum
EIDKKTQRCLGFAHILFEKAIEGHDAI

SEQ ID NO: 2312342 - protein, 17 aa, Cryptosporidium parvum
EIDKLIGEKVFFSSALQ

SEQ ID NO: 2312343 - protein, 26 aa, Cryptosporidium parvum
EIDPLKKVVLLFNKADFLTLELRKQW

SEQ ID NO: 2312344 - protein, 21 aa, Cryptosporidium parvum
EIDQLDCKLLLLDSNVKTLDK

SEQ ID NO: 2312345 - protein, 32 aa, Cryptosporidium parvum
EIDRLFLNAGQFFKYIERCSPIKPISLNCIIS

SEQ ID NO: 2312346 - protein, 23 aa, Cryptosporidium parvum
EIDTLFYIFRLLGTANESNWPGV

SEQ ID NO: 2312347 - protein, 32 aa, Cryptosporidium parvum
EIDTNWDILLKRFLKCDLGKLCNCLLSFNLVE

SEQ ID NO: 2312348 - protein, 23 aa, Cryptosporidium parvum
EIEDFVKILGGKLTSAVSGRTSY

SEQ ID NO: 2312349 - protein, 25 aa, Cryptosporidium parvum
EIEHFQWYVGQYLTSRYRILDIIGE

SEQ ID NO: 2312350 - protein, 17 aa, Cryptosporidium parvum
EIELEMGMGSLGSLFTT

SEQ ID NO: 2312351 - protein, 22 aa, Cryptosporidium parvum
EIELFRKYFPDNMDLDSIFPGD

SEQ ID NO: 2312352 - protein, 19 aa, Cryptosporidium parvum
EIELLDFYVKSWKDDPYYL

SEQ ID NO: 2312353 - protein, 22 aa, Cryptosporidium parvum
EIEQEFKFISKLKLHDSFGPKK

SEQ ID NO: 2312354 - protein, 28 aa, Cryptosporidium parvum
EIERIQKLLCFCLEFFLKYLQVAGRVEN

SEQ ID NO: 2312355 - protein, 23 aa, Cryptosporidium parvum
EIESLKKLLIERNQLEMQKEYNR

SEQ ID NO: 2312356 - protein, 30 aa, Cryptosporidium parvum
EIFGIEHLLRLLIILPKLIGDHISFGEYNL

SEQ ID NO: 2312357 - protein, 20 aa, Cryptosporidium parvum
EIFITPNSGWGGKGLLGCDI

SEQ ID NO: 2312358 - protein, 21 aa, Cryptosporidium parvum
EIFLTKWELQTILTEKFFTYT

SEQ ID NO: 2312359 - protein, 26 aa, Cryptosporidium parvum
EIFMSSSFFDNLFGLGEYFMREKQIL

SEQ ID NO: 2312360 - protein, 17 aa, Cryptosporidium parvum
EIFRFRQEMQLLSILDH

SEQ ID NO: 2312361 - protein, 37 aa, Cryptosporidium parvum
EIFSENTSFILNLLSEKFYSQINSVLSFEIGLINQHD

SEQ ID NO: 2312362 - protein, 26 aa, Cryptosporidium parvum
EIGFLILDLGSFIMSIRDFSKYKSSK

SEQ ID NO: 2312363 - protein, 25 aa, Cryptosporidium parvum
EIGKNNKMIVLDLPVICRKVFCGSN

SEQ ID NO: 2312364 - protein, 25 aa, Cryptosporidium parvum
EIGPRFTLKLMWIQEGTFNTKKGIY

SEQ ID NO: 2312365 - protein, 45 aa, Cryptosporidium parvum; identical to SEQ ID NO: 2188811

SEQ ID NO: 2312366 - protein, 27 aa, Cryptosporidium parvum
EIGTFTYSCFLPPFIPPTFTGKLISFN

SEQ ID NO: 2312367 - protein, 20 aa, Cryptosporidium parvum
EIGVFANLTNRYCLLAHGSS

SEQ ID NO: 2312368 - protein, 33 aa, Cryptosporidium parvum; identical to SEQ ID NO: 2188817

SEQ ID NO: 2312369 - protein, 24 aa, Cryptosporidium parvum
EIIDLILCQIQFRATLLWIHRISV

SEQ ID NO: 2312370 - protein, 18 aa, Cryptosporidium parvum
EIIELIESRFKQLNREDL

SEQ ID NO: 2312371 - protein, 30 aa, Cryptosporidium parvum; identical to SEQ ID NO: 2188819

SEQ ID NO: 2312372 - protein, 17 aa, Cryptosporidium parvum
EIIGVSPNAGAAEIKKE

SEQ ID NO: 2312373 - protein, 18 aa, Cryptosporidium parvum
EIIIKTLCALLAKNDVDR

SEQ ID NO: 2312374 - protein, 27 aa, Cryptosporidium parvum
EIIKRCEILLKWLFLPNEDTSDSGNVF

SEQ ID NO: 2312375 - protein, 21 aa, Cryptosporidium parvum
EIINKYISSVFLLINEFLKNT

SEQ ID NO: 2312376 - protein, 21 aa, Cryptosporidium parvum
EIIPVVKKYEWGRKEKLALTK

SEQ ID NO: 2312377 - protein, 23 aa, Cryptosporidium parvum
EIIRRDIYHAPLLYYREDDSISD

SEQ ID NO: 2312378 - protein, 27 aa, Cryptosporidium parvum
EIITHTPILIPNPEAILLIFSKIDLNQ

SEQ ID NO: 2312379 - protein, 24 aa, Cryptosporidium parvum
EIIVTGIYRTFRDQKLNIKSGFPI

SEQ ID NO: 2312380 - protein, 22 aa, Cryptosporidium parvum
EIKDYVNPLLSECSCINIFAFG

SEQ ID NO: 2312381 - protein, 30 aa, Cryptosporidium parvum
EIKEWNIPPSISNWKNPMGYTVPLDKRVQA

SEQ ID NO: 2312382 - protein, 26 aa, Cryptosporidium parvum
EIKFVGFLIRQFKGETELFFAQKMDL

SEQ ID NO: 2312383 - protein, 22 aa, Cryptosporidium parvum
EIKKAYSLFIDVKRSTQYLIDY

SEQ ID NO: 2312384 - protein, 19 aa, Cryptosporidium parvum
EIKLLCEDLKVLGKKELMQ

SEQ ID NO: 2312385 - protein, 43 aa, Cryptosporidium parvum
EIKNQLLDFTLENQKFKKLIKQTIIPLIPDAEYNSTIGHILMV

SEQ ID NO: 2312386 - protein, 19 aa, Cryptosporidium parvum
EILARLSQCRVINSKTIKL

SEQ ID NO: 2312387 - protein, 22 aa, Cryptosporidium parvum
EILDRISFIWGYNNDNIYKINI

SEQ ID NO: 2312388 - protein, 20 aa, Cryptosporidium parvum
EILGPINTYFFSIKMNNGVK

SEQ ID NO: 2312389 - protein, 17 aa, Cryptosporidium parvum
EILIRNGEKSISEIVLT

SEQ ID NO: 2312390 - protein, 24 aa, Cryptosporidium parvum
EILKDSLFFIIFDEADRLLEDCFI

SEQ ID NO: 2312391 - protein, 26 aa, Cryptosporidium parvum
EILKKLMKIEPKFNYDPPGKIVYTDQ

SEQ ID NO: 2312392 - protein, 17 aa, Cryptosporidium parvum
EILMFLQNDQSKISFPR

SEQ ID NO: 2312393 - protein, 22 aa, Cryptosporidium parvum
EILMSDLCRRYHRAGLWDSSCP

SEQ ID NO: 2312394 - protein, 24 aa, Cryptosporidium parvum
EILNLIKPFYEDFLMTLFNKSRNK

SEQ ID NO: 2312395 - protein, 28 aa, Cryptosporidium parvum
EILNTIRFSAIEILAWTQSRLSEIFIKE

SEQ ID NO: 2312396 - protein, 21 aa, Cryptosporidium parvum
EILPLIAQRIAFSNIINSNNT

SEQ ID NO: 2312397 - protein, 24 aa, Cryptosporidium parvum
EILSIRELIRPLKSYGRRAPEPYI

SEQ ID NO: 2312398 - protein, 19 aa, Cryptosporidium parvum
EILVDYYLFGIEDNELLFQ

SEQ ID NO: 2312399 - protein, 17 aa, Cryptosporidium parvum
EILVRIYSLLVDSKEEI

SEQ ID NO: 2312400 - protein, 17 aa, Cryptosporidium parvum
EILYYKENIDRILAQNI

SEQ ID NO: 2312401 - protein, 19 aa, Cryptosporidium parvum
EIMELYLQFFNNTLEIRNT

SEQ ID NO: 2312402 - protein, 22 aa, Cryptosporidium parvum
EIMGSFDIILGSDLVYNSDMEI

SEQ ID NO: 2312403 - protein, 29 aa, Cryptosporidium parvum
EINDSKIVFFPLLARLLGIEIEDLRTNIV

SEQ ID NO: 2312404 - protein, 23 aa, Cryptosporidium parvum
EINKLSFTLFSLQDQLDNSIINL

SEQ ID NO: 2312405 - protein, 27 aa, Cryptosporidium parvum
EINLLVYRYLIENGFVHTAFSFNSEAN

SEQ ID NO: 2312406 - protein, 22 aa, Cryptosporidium parvum
EINPPEVLTFKGPLTEKIDNYA

SEQ ID NO: 2312407 - protein, 26 aa, Cryptosporidium parvum
EINQKIIRTKLFTDKWWTKKNGEKWG

SEQ ID NO: 2312408 - protein, 17 aa, Cryptosporidium parvum
EINSLHQNPLLSASQQT

SEQ ID NO: 2312409 - protein, 23 aa, Cryptosporidium parvum
EINSMLFWGKYGNNKDFKKIQNS

SEQ ID NO: 2312410 - protein, 18 aa, Cryptosporidium parvum
EIPIWWRSDSSSKGNNSE

SEQ ID NO: 2312411 - protein, 31 aa, Cryptosporidium parvum; identical to SEQ ID NO: 2188854

SEQ ID NO: 2312412 - protein, 38 aa, Cryptosporidium parvum
EIPTYKIGISLLKKEWKKAFYLILGFDEEKMISYSTEK

SEQ ID NO: 2312413 - protein, 23 aa, Cryptosporidium parvum
EIPVIKPDIFFMNGHPGDSICVE

SEQ ID NO: 2312414 - protein, 19 aa, Cryptosporidium parvum
EIQEILKNKSMDLPIIRLR

SEQ ID NO: 2312415 - protein, 22 aa, Cryptosporidium parvum
EIQGFIVTKFDPLLSIVKELND

SEQ ID NO: 2312416 - protein, 22 aa, Cryptosporidium parvum
EIQRTLMELLNQLDGFDELGAV

SEQ ID NO: 2312417 - protein, 34 aa, Cryptosporidium parvum; identical to SEQ ID NO: 2188860

SEQ ID NO: 2312418 - protein, 28 aa, Cryptosporidium parvum
EIRDTCTYFPLRKLLIKSLLEKGEITHH

SEQ ID NO: 2312419 - protein, 24 aa, Cryptosporidium parvum
EIRNLSRFIAVQKFENLSWRSSHP

SEQ ID NO: 2312420 - protein, 23 aa, Cryptosporidium parvum
EIRNNACQLTKWATQALLSSCDI

SEQ ID NO: 2312421 - protein, 27 aa, Cryptosporidium parvum
EIRSDCFVLGWYQLIRLDDFQDYGVVS

SEQ ID NO: 2312422 - protein, 21 aa, Cryptosporidium parvum
EIRSTAWIPKGEYIPEDIIMG

SEQ ID NO: 2312423 - protein, 24 aa, Cryptosporidium parvum
EISCILIESCLLIYYIMEDCNSSY

SEQ ID NO: 2312424 - protein, 29 aa, Cryptosporidium parvum
EISGEIFWSLLFWKMPELFFLSVSKSTQI

SEQ ID NO: 2312425 - protein, 18 aa, Cryptosporidium parvum
EISHLRYRNALEIERSNH

SEQ ID NO: 2312426 - protein, 17 aa, Cryptosporidium parvum
EISKFYRGFKNIWENIH

SEQ ID NO: 2312427 - protein, 32 aa, Cryptosporidium parvum; identical to SEQ ID NO: 2188872

SEQ ID NO: 2312428 - protein, 30 aa, Cryptosporidium parvum
EISSYPKHYIAWLCIMWLSIHLKENDLPQL

SEQ ID NO: 2312429 - protein, 27 aa, Cryptosporidium parvum
EITSELFAIQWFLTLFTYDIADTEYAI

SEQ ID NO: 2312430 - protein, 31 aa, Cryptosporidium parvum
EIVDQLIIHLSLIQFSRPLRTCLWILSECEY

SEQ ID NO: 2312431 - protein, 19 aa, Cryptosporidium parvum
EIVIEIILKLIINLDKNNI

SEQ ID NO: 2312432 - protein, 24 aa, Cryptosporidium parvum
EIVSKILNISLLDIIYPIDGNKDA

SEQ ID NO: 2312433 - protein, 23 aa, Cryptosporidium parvum
EIVTILHPVTYLNKVLVVTSKGC

SEQ ID NO: 2312434 - protein, 19 aa, Cryptosporidium parvum
EIVYALIPNVGLLEKNLKI

SEQ ID NO: 2312435 - protein, 20 aa, Cryptosporidium parvum
EIYFKLIEFCPINRELLCET

SEQ ID NO: 2312436 - protein, 30 aa, Cryptosporidium parvum
EIYHASISIFLFWAIWKTPSIVKNINFDLL

SEQ ID NO: 2312437 - protein, 18 aa, Cryptosporidium parvum
EIYIWDINTGRCRERIVD

SEQ ID NO: 2312438 - protein, 18 aa, Cryptosporidium parvum
EIYLLAYSHKDLLMDHIE

SEQ ID NO: 2312439 - protein, 25 aa, Cryptosporidium parvum
EIYMKVLRDLVKLASLQTAFFSLDE

SEQ ID NO: 2312440 - protein, 21 aa, Cryptosporidium parvum
EIYPLRNIRLLNKSVIKLALE

SEQ ID NO: 2312441 - protein, 26 aa, Cryptosporidium parvum
EIYSNLVELIFPYSLLNFTVCSTETT

SEQ ID NO: 2312442 - protein, 20 aa, Cryptosporidium parvum
EIYTQIYDIFRNELLCFMVT

SEQ ID NO: 2312443 - protein, 21 aa, Cryptosporidium parvum
EKAFFLSLSNHLHILESRKNS

SEQ ID NO: 2312444 - protein, 18 aa, Cryptosporidium parvum
EKAIKYLDARRKGIILTT

SEQ ID NO: 2312445 - protein, 24 aa, Cryptosporidium parvum
EKAKYLLVSIPPYGTKEIIFFLGS

SEQ ID NO: 2312446 - protein, 23 aa, Cryptosporidium parvum
EKANLLFDLFGYDDANRLSVAFH

SEQ ID NO: 2312447 - protein, 25 aa, Cryptosporidium parvum
EKARNFFGRFGITGSLALEPLYVLS

SEQ ID NO: 2312448 - protein, 25 aa, Cryptosporidium parvum
EKASSLLSWLFKTLSMEVGQTLKSG

SEQ ID NO: 2312449 - protein, 30 aa, Cryptosporidium parvum; identical to SEQ ID NO: 2188892

SEQ ID NO: 2312450 - protein, 21 aa, Cryptosporidium parvum
EKDAFILICSDGVWEFISSQE

SEQ ID NO: 2312451 - protein, 22 aa, Cryptosporidium parvum
EKDIFLLRAVLVLLSLNKTQFA

SEQ ID NO: 2312452 - protein, 17 aa, Cryptosporidium parvum
EKDIIACQGGCSDNFLS

SEQ ID NO: 2312453 - protein, 17 aa, Cryptosporidium parvum
EKDKKVDSIFRNEIYKI

SEQ ID NO: 2312454 - protein, 27 aa, Cryptosporidium parvum
EKDKWMDAIILWTLKSRKYRSKAEDSK

SEQ ID NO: 2312455 - protein, 31 aa, Cryptosporidium parvum
EKDLKPFVSTAEIPYWTIQSIIYDDDTNNLH

SEQ ID NO: 2312456 - protein, 33 aa, Cryptosporidium parvum
EKEDPIAKLKAKVPVKPSPLLKSKSEKEKEKED

SEQ ID NO: 2312457 - protein, 33 aa, Cryptosporidium parvum
EKEDPIAKLKAKVPVKPSPLLKSKSEKEKEKEE

SEQ ID NO: 2312458 - protein, 18 aa, Cryptosporidium parvum
EKEISVEYLLKLIDDKKK

SEQ ID NO: 2312459 - protein, 26 aa, Cryptosporidium parvum
EKELELHDIMSWIPEVKYNEDKYQTV

SEQ ID NO: 2312460 - protein, 21 aa, Cryptosporidium parvum
EKELHIIWDHIIRQGGTIDML

SEQ ID NO: 2312461 - protein, 31 aa, Cryptosporidium parvum; identical to SEQ ID NO: 2188900

SEQ ID NO: 2312462 - protein, 27 aa, Cryptosporidium parvum
EKFALLIVDSIIALFRTEFSGRGELAE

SEQ ID NO: 2312463 - protein, 21 aa, Cryptosporidium parvum
EKFDKVMGYFRKYAGLEEGLS

SEQ ID NO: 2312464 - protein, 21 aa, Cryptosporidium parvum
EKFKMMDCYFITGTSFEEILE

SEQ ID NO: 2312465 - protein, 18 aa, Cryptosporidium parvum
EKFPNIAVWSKESPVASL

SEQ ID NO: 2312466 - protein, 26 aa, Cryptosporidium parvum
EKFSAFIQTLICILTLLTCRIQNSYV

SEQ ID NO: 2312467 - protein, 29 aa, Cryptosporidium parvum
EKFSRYRGLFFSLIANMFVLCEDDKSAQI

SEQ ID NO: 2312468 - protein, 17 aa, Cryptosporidium parvum
EKGEFLFKVLITEDLYN

SEQ ID NO: 2312469 - protein, 26 aa, Cryptosporidium parvum
EKGLKSFYRVLKPGGRFLCLEFSKVN

SEQ ID NO: 2312470 - protein, 22 aa, Cryptosporidium parvum
EKGSSMKVILATDGFLKFSDEA

SEQ ID NO: 2312471 - protein, 23 aa, Cryptosporidium parvum
EKHLIPIIEKKLLNQNFYFQLIE

SEQ ID NO: 2312472 - protein, 23 aa, Cryptosporidium parvum
EKICLLSMDFGVKIQYFRDFYDS

SEQ ID NO: 2312473 - protein, 22 aa, Cryptosporidium parvum
EKIFYAIFKVEDLYKILLCFIY

SEQ ID NO: 2312474 - protein, 19 aa, Cryptosporidium parvum
EKIINLKRLLFNSVGRPGN

SEQ ID NO: 2312475 - protein, 32 aa, Cryptosporidium parvum
EKILDGKVINLPIPRRPMILVGPNCKTKKAPN

SEQ ID NO: 2312476 - protein, 21 aa, Cryptosporidium parvum
EKILQLIRHLIATGAQWQDIW

SEQ ID NO: 2312477 - protein, 22 aa, Cryptosporidium parvum
EKINIFIDHLAGFFSYTKSIFN

SEQ ID NO: 2312478 - protein, 33 aa, Cryptosporidium parvum
EKINYAYLFEKIMFAHELALYSGLNLLVPGSRI

SEQ ID NO: 2312479 - protein, 35 aa, Cryptosporidium parvum; identical to SEQ ID NO: 2188919

SEQ ID NO: 2312480 - protein, 26 aa, Cryptosporidium parvum
EKIVKLITFIFTRFNELLFSDEVFEV

SEQ ID NO: 2312481 - protein, 26 aa, Cryptosporidium parvum
EKIVQKIMINLLDALKFIHKNGIIHR

SEQ ID NO: 2312482 - protein, 17 aa, Cryptosporidium parvum
EKKAQFFKEPACSLVVA

SEQ ID NO: 2312483 - protein, 33 aa, Cryptosporidium parvum
EKKKLQERLLTLQYYFSLWRQESRKERNFKESK

SEQ ID NO: 2312484 - protein, 34 aa, Cryptosporidium parvum
EKKNRKLVQKLGLKPLPDFEKVVVRGARGLSFQI

SEQ ID NO: 2312485 - protein, 18 aa, Cryptosporidium parvum
EKKPNGIFPLLDSECLMP

SEQ ID NO: 2312486 - protein, 19 aa, Cryptosporidium parvum
EKKRIYITGIRKSLCFGTN

SEQ ID NO: 2312487 - protein, 25 aa, Cryptosporidium parvum
EKKVPVAFGLFKLQMGATIIDDLVN

SEQ ID NO: 2312488 - protein, 17 aa, Cryptosporidium parvum
EKLDEMILFPPVKAVEI

SEQ ID NO: 2312489 - protein, 34 aa, Cryptosporidium parvum; identical to SEQ ID NO: 2188931

SEQ ID NO: 2312490 - protein, 18 aa, Cryptosporidium parvum
EKLGKVLKKNNVSIDIIS

SEQ ID NO: 2312491 - protein, 17 aa, Cryptosporidium parvum
EKLKYLELILQVESKFK

SEQ ID NO: 2312492 - protein, 24 aa, Cryptosporidium parvum
EKLLFDLQNLEKEWWIDCLIEIGL

SEQ ID NO: 2312493 - protein, 20 aa, Cryptosporidium parvum
EKLNKLKSALSELGDFNKKL

SEQ ID NO: 2312494 - protein, 26 aa, Cryptosporidium parvum
EKLNNYGRYLLSCDSSLNLEFMNSNQ

SEQ ID NO: 2312495 - protein, 18 aa, Cryptosporidium parvum
EKLPASTITLYPDLIGKV

SEQ ID NO: 2312496 - protein, 20 aa, Cryptosporidium parvum
EKLVINLLILIKSKENKVEN

SEQ ID NO: 2312497 - protein, 27 aa, Cryptosporidium parvum
EKMKNILFGFFSLIGNFSLYSCGDANQ

SEQ ID NO: 2312498 - protein, 19 aa, Cryptosporidium parvum
EKMYIPPNEKLFLKNKTSN

SEQ ID NO: 2312499 - protein, 24 aa, Cryptosporidium parvum
EKNDIIIYLAREIFDDTRGYGLFS

SEQ ID NO: 2312500 - protein, 23 aa, Cryptosporidium parvum
EKNDQLPVILFGFSRRKVEQLAT

SEQ ID NO: 2312501 - protein, 25 aa, Cryptosporidium parvum
EKNIKMRCLFSGRVLLTPVPGSEPD

SEQ ID NO: 2312502 - protein, 29 aa, Cryptosporidium parvum
EKNKPMICDFILFSILFDDISLIEFNEGE

SEQ ID NO: 2312503 - protein, 21 aa, Cryptosporidium parvum
EKNLRRIILSRVWIEMINNIE

SEQ ID NO: 2312504 - protein, 23 aa, Cryptosporidium parvum
EKNLSHDLLLDEYSIHEKCFTDN

SEQ ID NO: 2312505 - protein, 23 aa, Cryptosporidium parvum
EKNSLILLLTSYCNWDEQIADVS

SEQ ID NO: 2312506 - protein, 27 aa, Cryptosporidium parvum
EKNYKDYILKLIIIREINNLTMLLLKN

SEQ ID NO: 2312507 - protein, 20 aa, Cryptosporidium parvum
EKPLLLLLDGINQKFHTDKA

SEQ ID NO: 2312508 - protein, 27 aa, Cryptosporidium parvum
EKQEQFYILAILLGCDYTVGVNGIGPV

SEQ ID NO: 2312509 - protein, 24 aa, Cryptosporidium parvum
EKQRSMFPRFYFIGDEDLLEMIGN

SEQ ID NO: 2312510 - protein, 27 aa, Cryptosporidium parvum
EKQTKYWVPSFLSFKPKFMYSIPFKCN

SEQ ID NO: 2312511 - protein, 24 aa, Cryptosporidium parvum
EKRFLRRIRNVLPGINTPIYEKYG

SEQ ID NO: 2312512 - protein, 41 aa, Cryptosporidium parvum
EKRKAFNWLVREIENYKSLYLQFLCVTLPSNIRPGNDSLLI

SEQ ID NO: 2312513 - protein, 19 aa, Cryptosporidium parvum
EKRRLLPYHMHLSLEVIDC

SEQ ID NO: 2312514 - protein, 23 aa, Cryptosporidium parvum
EKRTQMELKLLSTCLHDMALRYH

SEQ ID NO: 2312515 - protein, 26 aa, Cryptosporidium parvum
EKSERLHLSYKLKFLIEKNAHLNCSI

SEQ ID NO: 2312516 - protein, 28 aa, Cryptosporidium parvum
EKSGSRMKYWWSKYIRRQKKKKEDSKEK

SEQ ID NO: 2312517 - protein, 25 aa, Cryptosporidium parvum
EKSHDIMKYITLFIPDNYKGMLIWK

SEQ ID NO: 2312518 - protein, 23 aa, Cryptosporidium parvum
EKSISEIVLTLFCDLENMGISSK

SEQ ID NO: 2312519 - protein, 24 aa, Cryptosporidium parvum
EKSKCILNLINDPMLLKSERKKAR

SEQ ID NO: 2312520 - protein, 24 aa, Cryptosporidium parvum
EKSKLLKDFSSLKLDFDKLKEQHN

SEQ ID NO: 2312521 - protein, 37 aa, Cryptosporidium parvum; identical to SEQ ID NO: 2188963

SEQ ID NO: 2312522 - protein, 26 aa, Cryptosporidium parvum
EKSNTLSAIKWNFSRFLIDKNGKVVA

SEQ ID NO: 2312523 - protein, 30 aa, Cryptosporidium parvum; identical to SEQ ID NO: 2188965

SEQ ID NO: 2312524 - protein, 25 aa, Cryptosporidium parvum
EKTFKEYIIRQLGIRWERIKKQNIE

SEQ ID NO: 2312525 - protein, 19 aa, Cryptosporidium parvum
EKTFLWTQKVISNFCILPL

SEQ ID NO: 2312526 - protein, 22 aa, Cryptosporidium parvum
EKTLTVLVQCSYVILDEADRMI

SEQ ID NO: 2312527 - protein, 20 aa, Cryptosporidium parvum
EKVFGWQFCSLILGEYREIT

SEQ ID NO: 2312528 - protein, 21 aa, Cryptosporidium parvum
EKVLVLIKDLPFTLLQHNTQV

SEQ ID NO: 2312529 - protein, 20 aa, Cryptosporidium parvum
EKVNIYWRKIQWVHNIMLEF

SEQ ID NO: 2312530 - protein, 66 aa, Cryptosporidium parvum; identical to SEQ ID NO: 2188972

SEQ ID NO: 2312531 - protein, 17 aa, Cryptosporidium parvum
EKYKIWKENTSLLYENI

SEQ ID NO: 2312532 - protein, 36 aa, Cryptosporidium parvum; identical to SEQ ID NO: 2188975

SEQ ID NO: 2312533 - protein, 34 aa, Cryptosporidium parvum
EKYNSDFYMMLKYPLKVRPFYTMPDFDEPEKWSN

SEQ ID NO: 2312534 - protein, 19 aa, Cryptosporidium parvum
EKYSKFFPVTIIGEAESGG

SEQ ID NO: 2312535 - protein, 23 aa, Cryptosporidium parvum
ELAKSFILIFEGSVSLIVDEDLT

SEQ ID NO: 2312536 - protein, 26 aa, Cryptosporidium parvum
ELAQLQALELTWKYPIENSSNFPNDK

SEQ ID NO: 2312537 - protein, 18 aa, Cryptosporidium parvum
ELAVPPIIVFLNQKKMVD

SEQ ID NO: 2312538 - protein, 26 aa, Cryptosporidium parvum
ELCKVYFPTQLRLIDNYASSSTLIPL

SEQ ID NO: 2312539 - protein, 21 aa, Cryptosporidium parvum
ELCSGFESFPELLVVSKYQSE

SEQ ID NO: 2312540 - protein, 24 aa, Cryptosporidium parvum
ELDIDYHYFSFPTSLQIFNNASEE

SEQ ID NO: 2312541 - protein, 26 aa, Cryptosporidium parvum
ELEAFQHFIQLIQSVLYFQDKGVVHR

SEQ ID NO: 2312542 - protein, 33 aa, Cryptosporidium parvum
ELEISLERKKKNLTWLLWKRKKRKTMNPKPKLS

SEQ ID NO: 2312543 - protein, 18 aa, Cryptosporidium parvum
ELEKALGLPLDSLKPKKN

SEQ ID NO: 2312544 - protein, 25 aa, Cryptosporidium parvum
ELEKLIELVRLNVGLIFCIDEPSEV

SEQ ID NO: 2312545 - protein, 40 aa, Cryptosporidium parvum
ELELDYELICIDFFLRYISNLYPLWGEYGDNLMFHIAQIY

SEQ ID NO: 2312546 - protein, 22 aa, Cryptosporidium parvum
ELELLESDAVIYKLVGSVMVKQ

SEQ ID NO: 2312547 - protein, 21 aa, Cryptosporidium parvum
ELENPYILISQGKISSLKSIL

SEQ ID NO: 2312548 - protein, 20 aa, Cryptosporidium parvum
ELENWRATSVKLTFNYFLVK

SEQ ID NO: 2312549 - protein, 17 aa, Cryptosporidium parvum
ELERSFDYIVGIDGVPL

SEQ ID NO: 2312550 - protein, 29 aa, Cryptosporidium parvum
ELESELIRHSLLNLIRHFQLVQSKENNSQ

SEQ ID NO: 2312551 - protein, 19 aa, Cryptosporidium parvum
ELFFYLAKENVTSTPILLL

SEQ ID NO: 2312552 - protein, 32 aa, Cryptosporidium parvum; identical to SEQ ID NO: 2188994

SEQ ID NO: 2312553 - protein, 28 aa, Cryptosporidium parvum
ELFKVNKKTLDLLLPNPNENFGKDISNI

SEQ ID NO: 2312554 - protein, 24 aa, Cryptosporidium parvum
ELFLKFIYCVLRVKIEWINEYLKY

SEQ ID NO: 2312555 - protein, 19 aa, Cryptosporidium parvum
ELFPGLVYRYHPDNSPTKA

SEQ ID NO: 2312556 - protein, 27 aa, Cryptosporidium parvum
ELFTVFKRLLLYDSKAVRKCAVKVIIG

SEQ ID NO: 2312557 - protein, 48 aa, Cryptosporidium parvum; identical to SEQ ID NO: 2188999

SEQ ID NO: 2312558 - protein, 17 aa, Cryptosporidium parvum
ELHKELFPIVYDKQFYE

SEQ ID NO: 2312559 - protein, 24 aa, Cryptosporidium parvum
ELHMFGLVTSHWRSSRKYILHGNK

SEQ ID NO: 2312560 - protein, 24 aa, Cryptosporidium parvum
ELIDNLFKWYLKYGMRDSVSQLVG

SEQ ID NO: 2312561 - protein, 23 aa, Cryptosporidium parvum
ELIEMVSSIKLWVQLNIPQIQDG

SEQ ID NO: 2312562 - protein, 25 aa, Cryptosporidium parvum
ELIISKLKYAIKPYILRRTKQIISQ

SEQ ID NO: 2312563 - protein, 22 aa, Cryptosporidium parvum
ELIKDYSNLYAEYIVSKNLSKI

SEQ ID NO: 2312564 - protein, 25 aa, Cryptosporidium parvum
ELILPCVYSMIKARYYWNQYNKNYY

SEQ ID NO: 2312565 - protein, 18 aa, Cryptosporidium parvum
ELILYLRSISEVTISPHV

SEQ ID NO: 2312566 - protein, 26 aa, Cryptosporidium parvum
ELINEETYFEEIYYGVSDRVIGECRA

SEQ ID NO: 2312567 - protein, 27 aa, Cryptosporidium parvum
ELINKYIELKIKIPKSINNFIIPIVNE

SEQ ID NO: 2312568 - protein, 17 aa, Cryptosporidium parvum
ELIPEFLGFVRGVVDSE

SEQ ID NO: 2312569 - protein, 17 aa, Cryptosporidium parvum
ELIPWVIVGHSMGGLIG

SEQ ID NO: 2312570 - protein, 18 aa, Cryptosporidium parvum
ELIRFITDNIARQGLISS

SEQ ID NO: 2312571 - protein, 20 aa, Cryptosporidium parvum
ELISLFKNNNVFLEPSLIYI

SEQ ID NO: 2312572 - protein, 19 aa, Cryptosporidium parvum
ELKAALRALGFDVKKKDIE

SEQ ID NO: 2312573 - protein, 26 aa, Cryptosporidium parvum
ELKDLNHFIILFQYDDHKGIRGLYSF

SEQ ID NO: 2312574 - protein, 32 aa, Cryptosporidium parvum; identical to SEQ ID NO: 2189014

SEQ ID NO: 2312575 - protein, 28 aa, Cryptosporidium parvum
ELKEPNIYLLERIVYFIPNELVYKTFNE

SEQ ID NO: 2312576 - protein, 18 aa, Cryptosporidium parvum
ELKFPLGYVLTEKEQNRV

SEQ ID NO: 2312577 - protein, 18 aa, Cryptosporidium parvum
ELKGIKKRKRSRMVYDPI

SEQ ID NO: 2312578 - protein, 17 aa, Cryptosporidium parvum
ELKGWSSFFNIENCVEI

SEQ ID NO: 2312579 - protein, 24 aa, Cryptosporidium parvum
ELKILNRRVLISHKYYDILELQPG

SEQ ID NO: 2312580 - protein, 25 aa, Cryptosporidium parvum
ELKKLDFSAFALSLGLAIPPKIKIN

SEQ ID NO: 2312581 - protein, 31 aa, Cryptosporidium parvum
ELKKRILRNLELFSNLIIYSGFYLPPNSNIS

SEQ ID NO: 2312582 - protein, 22 aa, Cryptosporidium parvum
ELKLQILEIYNSKLDERTYRKR

SEQ ID NO: 2312583 - protein, 17 aa, Cryptosporidium parvum
ELKQASWAITQKAYKPG

SEQ ID NO: 2312584 - protein, 24 aa, Cryptosporidium parvum
ELKRRIRRIPGVPIMYVTNHKYSI

SEQ ID NO: 2312585 - protein, 18 aa, Cryptosporidium parvum
ELKSNIRKKYFKSSNLKG

SEQ ID NO: 2312586 - protein, 17 aa, Cryptosporidium parvum
ELKTFRALNPVEMVNRS

SEQ ID NO: 2312587 - protein, 22 aa, Cryptosporidium parvum
ELLARLDPLGYFPEIRAFVALD

SEQ ID NO: 2312588 - protein, 24 aa, Cryptosporidium parvum
ELLASELFDVPRDSGVAYLQIGTS

SEQ ID NO: 2312589 - protein, 18 aa, Cryptosporidium parvum
ELLDLLTTLGEHLALPPI

SEQ ID NO: 2312590 - protein, 21 aa, Cryptosporidium parvum
ELLEEFCLPMFLHIRGDQDCY

SEQ ID NO: 2312591 - protein, 18 aa, Cryptosporidium parvum
ELLGPSLEDLFNLCHRRF

SEQ ID NO: 2312592 - protein, 20 aa, Cryptosporidium parvum
ELLKFWLERQKSYRFIATSI

SEQ ID NO: 2312593 - protein, 19 aa, Cryptosporidium parvum
ELLKNLRNLQTLYLERNPI

SEQ ID NO: 2312594 - protein, 26 aa, Cryptosporidium parvum
ELLKPFPTGISWYCKKRRFYTSNGLD

SEQ ID NO: 2312595 - protein, 19 aa, Cryptosporidium parvum
ELLLSYITPLLSKAKMEGS

SEQ ID NO: 2312596 - protein, 18 aa, Cryptosporidium parvum
ELLNEHQFLTAKPVVYLV

SEQ ID NO: 2312597 - protein, 28 aa, Cryptosporidium parvum
ELLSESNLRWFITPKYIQNIIHLLRKNN

SEQ ID NO: 2312598 - protein, 17 aa, Cryptosporidium parvum
ELLVLLVNTLQRDLNSR

SEQ ID NO: 2312599 - protein, 23 aa, Cryptosporidium parvum
ELMPRFCHYLQLSHEIVGIAEYV

SEQ ID NO: 2312600 - protein, 30 aa, Cryptosporidium parvum; identical to SEQ ID NO: 2189038

SEQ ID NO: 2312601 - protein, 18 aa, Cryptosporidium parvum
ELMSNLKRPNNLDLRRRI

SEQ ID NO: 2312602 - protein, 23 aa, Cryptosporidium parvum
ELNKLIKSILNPDRKMRPSFELI

SEQ ID NO: 2312603 - protein, 27 aa, Cryptosporidium parvum
ELNLENLKFLIFFKINNDINPCKEDIV

SEQ ID NO: 2312604 - protein, 25 aa, Cryptosporidium parvum
ELNSIQAVILPKLGYKSPSPWELHC

SEQ ID NO: 2312605 - protein, 21 aa, Cryptosporidium parvum
ELNVPILLGNAYHLGSRPGDE

SEQ ID NO: 2312606 - protein, 23 aa, Cryptosporidium parvum
ELPCHIFMGVIYYQRLRHMVADK

SEQ ID NO: 2312607 - protein, 26 aa, Cryptosporidium parvum
ELPEPILKYYIGLKILSYPSILEKVV

SEQ ID NO: 2312608 - protein, 18 aa, Cryptosporidium parvum
ELPIAYISRLTDCHHLLA

SEQ ID NO: 2312609 - protein, 33 aa, Cryptosporidium parvum; identical to SEQ ID NO: 2189053

SEQ ID NO: 2312610 - protein, 24 aa, Cryptosporidium parvum
ELPKALLRARRKIIWIGPSAESME

SEQ ID NO: 2312611 - protein, 20 aa, Cryptosporidium parvum
ELPLNICHFSTLPSTQIWAY

SEQ ID NO: 2312612 - protein, 25 aa, Cryptosporidium parvum
ELPPPPPPSEELPPPPPPSSGELPP

SEQ ID NO: 2312613 - protein, 23 aa, Cryptosporidium parvum
ELQIHNLQLLSVLMRILHYTREN

SEQ ID NO: 2312614 - protein, 22 aa, Cryptosporidium parvum
ELQQDLLLRNYDILWDVDLGGS

SEQ ID NO: 2312615 - protein, 22 aa, Cryptosporidium parvum
ELQRVALILALGKKADIYLIDE

SEQ ID NO: 2312616 - protein, 21 aa, Cryptosporidium parvum
ELQSIGQLPSKKSVQYIRSNM

SEQ ID NO: 2312617 - protein, 24 aa, Cryptosporidium parvum
ELRKHLLNIGSIIKLTPEEVNCIL

SEQ ID NO: 2312618 - protein, 20 aa, Cryptosporidium parvum
ELRKKYLLDTNPNAFYQMKQ

SEQ ID NO: 2312619 - protein, 17 aa, Cryptosporidium parvum
ELRLKQQYFFVCATIQD

SEQ ID NO: 2312620 - protein, 22 aa, Cryptosporidium parvum
ELRMRENIDFRLKPPLESIHMC

SEQ ID NO: 2312621 - protein, 31 aa, Cryptosporidium parvum
ELSKALRLPVLYLLQFKKNLTNFLYDIIYSR

SEQ ID NO: 2312622 - protein, 24 aa, Cryptosporidium parvum
ELSKLQLFWHPNVSLRTDLVDLHV

SEQ ID NO: 2312623 - protein, 17 aa, Cryptosporidium parvum
ELSLPFKGMEGPHSLVL

SEQ ID NO: 2312624 - protein, 24 aa, Cryptosporidium parvum
ELSNEFEGIYNFRYEEPGANQQIM

SEQ ID NO: 2312625 - protein, 28 aa, Cryptosporidium parvum
ELSRQIAFPDSLLSRFDLIFIVKDSRNS

SEQ ID NO: 2312626 - protein, 37 aa, Cryptosporidium parvum; identical to SEQ ID NO: 2189073

SEQ ID NO: 2312627 - protein, 19 aa, Cryptosporidium parvum
ELTLTQLIRLVLYEGERIF

SEQ ID NO: 2312628 - protein, 22 aa, Cryptosporidium parvum
ELVIPRLSLTEKRRSISKKRSE

SEQ ID NO: 2312629 - protein, 21 aa, Cryptosporidium parvum
ELVPGVLFIDEVHMLDIECFT

SEQ ID NO: 2312630 - protein, 20 aa, Cryptosporidium parvum
ELYCNQKRPPPPPPGVSRHY

SEQ ID NO: 2312631 - protein, 24 aa, Cryptosporidium parvum
ELYDPVSVMFFFRNKHIMVDLGTG

SEQ ID NO: 2312632 - protein, 31 aa, Cryptosporidium parvum; identical to SEQ ID NO: 2189078

SEQ ID NO: 2312633 - protein, 20 aa, Cryptosporidium parvum
ELYIGQVKLDPNWTPGLYFV

SEQ ID NO: 2312634 - protein, 19 aa, Cryptosporidium parvum
ELYLDWFLNKSIESQFRAF

SEQ ID NO: 2312635 - protein, 20 aa, Cryptosporidium parvum
ELYNSLIMELNDWKVKKDSL

SEQ ID NO: 2312636 - protein, 24 aa, Cryptosporidium parvum
ELYTKKIPFVIRRYLPNGNYEDWK

SEQ ID NO: 2312637 - protein, 35 aa, Cryptosporidium parvum; identical to SEQ ID NO: 2189082

SEQ ID NO: 2312638 - protein, 31 aa, Cryptosporidium parvum
EMDILDIHGIKFKIPWKYPKIIHEHVIQQLE

SEQ ID NO: 2312639 - protein, 23 aa, Cryptosporidium parvum
EMDNLIKEIKWYPKGLAFQITKS

SEQ ID NO: 2312640 - protein, 31 aa, Cryptosporidium parvum
EMERLAVEGKFICKEYGKQKVYLVDQSDCKE

SEQ ID NO: 2312641 - protein, 25 aa, Cryptosporidium parvum
EMIASNGLFILKIIKDFSIGNKWDG

SEQ ID NO: 2312642 - protein, 40 aa, Cryptosporidium parvum
EMIELPLRHPGLFKALGVKPPRGVLLYGPPGSGKTLIAKA

SEQ ID NO: 2312643 - protein, 17 aa, Cryptosporidium parvum
EMINFGKIWKSCHPNLI

SEQ ID NO: 2312644 - protein, 26 aa, Cryptosporidium parvum
EMKKKVVVKLRKKLMEFHNKLLNKEN

SEQ ID NO: 2312645 - protein, 30 aa, Cryptosporidium parvum; identical to SEQ ID NO: 2189091

SEQ ID NO: 2312646 - protein, 29 aa, Cryptosporidium parvum
EMKQKEELLYTILHLHKQINSIGSSLGCG

SEQ ID NO: 2312647 - protein, 19 aa, Cryptosporidium parvum
EMKRSIYIGNVDYGTKLTE

SEQ ID NO: 2312648 - protein, 22 aa, Cryptosporidium parvum
EMKSGSMLIIIMSPCCHHRCLI

SEQ ID NO: 2312649 - protein, 17 aa, Cryptosporidium parvum
EMKTVTQNPLRIAMFSW

SEQ ID NO: 2312650 - protein, 21 aa, Cryptosporidium parvum
EMLHIVTPAWILDSCSKRTKI

SEQ ID NO: 2312651 - protein, 25 aa, Cryptosporidium parvum
EMLLKKLYHMGVIPTYKSLEAINEL

SEQ ID NO: 2312652 - protein, 19 aa, Cryptosporidium parvum
EMNRLLPETPLAEVFFADE

SEQ ID NO: 2312653 - protein, 25 aa, Cryptosporidium parvum
EMPQYRYQIRLIAQSIIRGGSRGQE

SEQ ID NO: 2312654 - protein, 17 aa, Cryptosporidium parvum
EMQMYIFNNGPIEWLEN

SEQ ID NO: 2312655 - protein, 25 aa, Cryptosporidium parvum
EMRCRDLFPALWVPDLFMERVEKDQ

SEQ ID NO: 2312656 - protein, 29 aa, Cryptosporidium parvum
EMRQEIDMLNIPIWLYKESGSLTVNGPFS

SEQ ID NO: 2312657 - protein, 40 aa, Cryptosporidium parvum
EMVIVSRTQKWLLRNVKLEDFKYLIRVDQLREENILRNSA

SEQ ID NO: 2312658 - protein, 28 aa, Cryptosporidium parvum
EMVRIYHRLKKHLLTFSKSSYQQNSKED

SEQ ID NO: 2312659 - protein, 28 aa, Cryptosporidium parvum
EMVSHSLPVLCRLLYFSDLEVMTDACWA

SEQ ID NO: 2312660 - protein, 18 aa, Cryptosporidium parvum
EMWLNITGNLLLNPSIRF

SEQ ID NO: 2312661 - protein, 26 aa, Cryptosporidium parvum
ENATKPIEVFLIFSLNAIKSVIADLS

SEQ ID NO: 2312662 - protein, 31 aa, Cryptosporidium parvum
ENCQDYYQDFLKLIHLYTRGVLTVVETLLAL

SEQ ID NO: 2312663 - protein, 19 aa, Cryptosporidium parvum
ENDFRLFCGDLGNDVTEEI

SEQ ID NO: 2312664 - protein, 20 aa, Cryptosporidium parvum
ENDIPLIMLCGLGSSGKTSI

SEQ ID NO: 2312665 - protein, 33 aa, Cryptosporidium parvum
ENDISLYDLAFKDYNFVPKLLKNYAKNVDTQTE

SEQ ID NO: 2312666 - protein, 24 aa, Cryptosporidium parvum
ENDKFIRFRAIYSQIQPVLQFVYR

SEQ ID NO: 2312667 - protein, 25 aa, Cryptosporidium parvum
ENDLIVILHLHLKHSIWLGKKKTQD

SEQ ID NO: 2312668 - protein, 25 aa, Cryptosporidium parvum
ENDLLNVYYQFLNIFKDSKDCKLRL

SEQ ID NO: 2312669 - protein, 24 aa, Cryptosporidium parvum
ENDSQIFEKNKWGRYIRLKNRHVK

SEQ ID NO: 2312670 - protein, 25 aa, Cryptosporidium parvum
ENEFERMSIIDYFNIIVKNGCPVQG

SEQ ID NO: 2312671 - protein, 26 aa, Cryptosporidium parvum
ENEFKFVLLILNWAASVLMVTKAFQV

SEQ ID NO: 2312672 - protein, 26 aa, Cryptosporidium parvum
ENEFVFFKQLLLYSSIYLIDQIIYLN

SEQ ID NO: 2312673 - protein, 24 aa, Cryptosporidium parvum
ENEIFNWLLEYDVPLFITNDLINS

SEQ ID NO: 2312674 - protein, 25 aa, Cryptosporidium parvum
ENELKATSMGLLYGRKEKEQEREIA

SEQ ID NO: 2312675 - protein, 26 aa, Cryptosporidium parvum
ENENTLAALQRNWIALQQNNGNVGGT

SEQ ID NO: 2312676 - protein, 18 aa, Cryptosporidium parvum
ENEYLNLQKKYIADLKMI

SEQ ID NO: 2312677 - protein, 22 aa, Cryptosporidium parvum
ENEYWMVVEFPKNSSLYRKHNC

SEQ ID NO: 2312678 - protein, 18 aa, Cryptosporidium parvum
ENFFLLRGNHECASINRI

SEQ ID NO: 2312679 - protein, 36 aa, Cryptosporidium parvum; identical to SEQ ID NO: 2189124

SEQ ID NO: 2312680 - protein, 27 aa, Cryptosporidium parvum
ENFPEREFFFDLFYNEKAQLYEGICCN

SEQ ID NO: 2312681 - protein, 30 aa, Cryptosporidium parvum; identical to SEQ ID NO: 2189126

SEQ ID NO: 2312682 - protein, 35 aa, Cryptosporidium parvum; identical to SEQ ID NO: 2189127

SEQ ID NO: 2312683 - protein, 25 aa, Cryptosporidium parvum
ENGVLYLLYKACRIFKQLGVEYVTI

SEQ ID NO: 2312684 - protein, 23 aa, Cryptosporidium parvum
ENGYICLWDLQPDFGRSIFGIQY

SEQ ID NO: 2312685 - protein, 21 aa, Cryptosporidium parvum
ENHHCNYIFSLLDKCQDLDIR

SEQ ID NO: 2312686 - protein, 19 aa, Cryptosporidium parvum
ENHKEEILPFGNSGLSSSF

SEQ ID NO: 2312687 - protein, 22 aa, Cryptosporidium parvum
ENIAFIHVCYLPYVGNQLKKKP

SEQ ID NO: 2312688 - protein, 25 aa, Cryptosporidium parvum
ENIERRKLLYACRNCEYFSYADPTN

SEQ ID NO: 2312689 - protein, 20 aa, Cryptosporidium parvum
ENIIPLISKLGSKVGYSIPS

SEQ ID NO: 2312690 - protein, 23 aa, Cryptosporidium parvum
ENIKIQLIAIPLYASMSFDEQKK

SEQ ID NO: 2312691 - protein, 32 aa, Cryptosporidium parvum; identical to SEQ ID NO: 2189139

SEQ ID NO: 2312692 - protein, 19 aa, Cryptosporidium parvum
ENILQYFQKLNEYSAFENY

SEQ ID NO: 2312693 - protein, 19 aa, Cryptosporidium parvum
ENINWWSCVIKGDQEIDTT

SEQ ID NO: 2312694 - protein, 25 aa, Cryptosporidium parvum
ENIQKNFLVAKFIHAVLTVLKQNPM

SEQ ID NO: 2312695 - protein, 30 aa, Cryptosporidium parvum
ENIQKRWALWLEAILNLLKLIILTIQSFSS

SEQ ID NO: 2312696 - protein, 25 aa, Cryptosporidium parvum
ENISKIRFSINFFTAIGLGALTHKL

SEQ ID NO: 2312697 - protein, 25 aa, Cryptosporidium parvum
ENISLFESLFRLGFTNITASCSRIS

SEQ ID NO: 2312698 - protein, 22 aa, Cryptosporidium parvum
ENIYFLLQVSPIVQVHTLRANV

SEQ ID NO: 2312699 - protein, 17 aa, Cryptosporidium parvum
ENIYRDNYCSIDGLLSL

SEQ ID NO: 2312700 - protein, 23 aa, Cryptosporidium parvum
ENKALINHKSLFSSYGGGLGGGD

SEQ ID NO: 2312701 - protein, 25 aa, Cryptosporidium parvum
ENKEKCLIFCHHTMLLDIIEEYIKI

SEQ ID NO: 2312702 - protein, 25 aa, Cryptosporidium parvum
ENKGNVLERVLIFSRSAFGRQKARD

SEQ ID NO: 2312703 - protein, 23 aa, Cryptosporidium parvum
ENKLVKNILIKEISGIEGNIEML

SEQ ID NO: 2312704 - protein, 24 aa, Cryptosporidium parvum
ENKPIRLITDKLSYPVWRTSEPIR

SEQ ID NO: 2312705 - protein, 17 aa, Cryptosporidium parvum
ENLELFPFHQESLKLES

SEQ ID NO: 2312706 - protein, 18 aa, Cryptosporidium parvum
ENLFDEILDDKIKKEKEL

SEQ ID NO: 2312707 - protein, 18 aa, Cryptosporidium parvum
ENLFKYIPTSVKMRNWEA

SEQ ID NO: 2312708 - protein, 19 aa, Cryptosporidium parvum
ENLKYIPLNNIGISNSSNN

SEQ ID NO: 2312709 - protein, 35 aa, Cryptosporidium parvum; identical to SEQ ID NO: 2189162

SEQ ID NO: 2312710 - protein, 19 aa, Cryptosporidium parvum
ENLLSSILILPDQSGKKGG

SEQ ID NO: 2312711 - protein, 25 aa, Cryptosporidium parvum
ENLNKRGWNISRDSMILFLCSKCKA

SEQ ID NO: 2312712 - protein, 30 aa, Cryptosporidium parvum; identical to SEQ ID NO: 2189164

SEQ ID NO: 2312713 - protein, 22 aa, Cryptosporidium parvum
ENNIIFQILNPNENLPNIAGPI

SEQ ID NO: 2312714 - protein, 17 aa, Cryptosporidium parvum
ENNIIPIQWGDKHFEHV

SEQ ID NO: 2312715 - protein, 28 aa, Cryptosporidium parvum
ENNITNEEFLNREWKTMQKYIYEHFKNQ

SEQ ID NO: 2312716 - protein, 41 aa, Cryptosporidium parvum
ENNKKYHYLVPIYNDYNVFCYWISSRYLRIKKKEFCFTISD

SEQ ID NO: 2312717 - protein, 26 aa, Cryptosporidium parvum
ENNPRGFVCGLFNPSIPTDGVALVHQ

SEQ ID NO: 2312718 - protein, 23 aa, Cryptosporidium parvum
ENNRKMKLFQFEQTKLLESQKNE

SEQ ID NO: 2312719 - protein, 20 aa, Cryptosporidium parvum
ENNSRVLKVWFEDSEFIFDS

SEQ ID NO: 2312720 - protein, 35 aa, Cryptosporidium parvum
ENNTIHVNLPPKYPFKYLMLISFGENKKTSPVFFN

SEQ ID NO: 2312721 - protein, 27 aa, Cryptosporidium parvum
ENNTLLSLMFFFDIISRSNKWMHSEIM

SEQ ID NO: 2312722 - protein, 24 aa, Cryptosporidium parvum
ENNYNSWKLFLKRDSPAGRKVCEM

SEQ ID NO: 2312723 - protein, 25 aa, Cryptosporidium parvum
ENPSPTLMPCASLIFINIPSFASGN

SEQ ID NO: 2312724 - protein, 23 aa, Cryptosporidium parvum
ENPSSLIYPKNEVTPNAPASALD

SEQ ID NO: 2312725 - protein, 24 aa, Cryptosporidium parvum
ENQDRPRLLPYLNRMLRELKKPYD

SEQ ID NO: 2312726 - protein, 18 aa, Cryptosporidium parvum
ENQIIQQNFGLISSLRGR

SEQ ID NO: 2312727 - protein, 26 aa, Cryptosporidium parvum
ENQKLKQDLFLMKRINNRTKDHAKIK

SEQ ID NO: 2312728 - protein, 24 aa, Cryptosporidium parvum
ENQKSLELFIKKLKEDEIDSCLGE

SEQ ID NO: 2312729 - protein, 23 aa, Cryptosporidium parvum
ENQLPSNLENMLDMAMVSSSLTD

SEQ ID NO: 2312730 - protein, 23 aa, Cryptosporidium parvum
ENQVVRWLTQALLGLAHLHNKRI

SEQ ID NO: 2312731 - protein, 23 aa, Cryptosporidium parvum
ENRDMILKAINLFFLESIEQVSM

SEQ ID NO: 2312732 - protein, 28 aa, Cryptosporidium parvum
ENRFPAILRRFYLGFFSFCCEDDFGKVN

SEQ ID NO: 2312733 - protein, 25 aa, Cryptosporidium parvum
ENRYWTPICYWYSDTMKPLIPKGSS

SEQ ID NO: 2312734 - protein, 25 aa, Cryptosporidium parvum
ENSEIIKYSCGALAIDCPFMGKFVD

SEQ ID NO: 2312735 - protein, 36 aa, Cryptosporidium parvum
ENSIKLFTSIGMWKSLFLTLNYSTYIRRKREMLYSK

SEQ ID NO: 2312736 - protein, 37 aa, Cryptosporidium parvum
ENSSIRNIIPPQGPWPLWGWNVYIIDSIKQRLSENLR

SEQ ID NO: 2312737 - protein, 25 aa, Cryptosporidium parvum
ENSWFKVRYITPNMFFNLWAQSKNS

SEQ ID NO: 2312738 - protein, 24 aa, Cryptosporidium parvum
ENTDYIRKIYLWPSYCEYKTNLTQ

SEQ ID NO: 2312739 - protein, 28 aa, Cryptosporidium parvum
ENTFIASSPVLTISFDPYCQYKYIGTSY

SEQ ID NO: 2312740 - protein, 23 aa, Cryptosporidium parvum
ENTKDFEIIGVLLKPIEGNIEQF

SEQ ID NO: 2312741 - protein, 26 aa, Cryptosporidium parvum
ENTKISIYLVLLLSSYDIYIQEIRAL

SEQ ID NO: 2312742 - protein, 31 aa, Cryptosporidium parvum; identical to SEQ ID NO: 2189187

SEQ ID NO: 2312743 - protein, 26 aa, Cryptosporidium parvum
ENTNVTLWCPSGIVPRPRRIWSILAS

SEQ ID NO: 2312744 - protein, 27 aa, Cryptosporidium parvum
ENTTNNFPLFGVYSNIINFLNSTMNPC

SEQ ID NO: 2312745 - protein, 18 aa, Cryptosporidium parvum
ENTVKTLLKNGADPRYKN

SEQ ID NO: 2312746 - protein, 24 aa, Cryptosporidium parvum
ENVDWKIIAQERTILYEKAKQHLA

SEQ ID NO: 2312747 - protein, 23 aa, Cryptosporidium parvum
ENVKLLFSFPFKTNSAKVLSTWP

SEQ ID NO: 2312748 - protein, 17 aa, Cryptosporidium parvum
ENVSWILDGFHTMLKSR

SEQ ID NO: 2312749 - protein, 25 aa, Cryptosporidium parvum
ENYHRFPSQILLKRINLLKTYIKTS

SEQ ID NO: 2312750 - protein, 22 aa, Cryptosporidium parvum
ENYLFILKIIKMLKYNIQFERM

SEQ ID NO: 2312751 - protein, 25 aa, Cryptosporidium parvum
EPAFDVVRMFNFPKSFQIALEQAEK

SEQ ID NO: 2312752 - protein, 26 aa, Cryptosporidium parvum
EPAFYRQHFSIFFPQILNIAKNIQLS

SEQ ID NO: 2312753 - protein, 20 aa, Cryptosporidium parvum
EPAQLKPPPGLKVQVAKTGD

SEQ ID NO: 2312754 - protein, 21 aa, Cryptosporidium parvum
EPDPRPHMNIVFIGHVDAGKS

SEQ ID NO: 2312755 - protein, 23 aa, Cryptosporidium parvum
EPEQRAQILRELDSLLISTLKCT

SEQ ID NO: 2312756 - protein, 25 aa, Cryptosporidium parvum
EPGKLLADWFNIIDLSILTDKLHRG

SEQ ID NO: 2312757 - protein, 23 aa, Cryptosporidium parvum
EPGKTLNFKPILGAVIELVDDNE

SEQ ID NO: 2312758 - protein, 17 aa, Cryptosporidium parvum
EPIDINLIRDKKLGISK

SEQ ID NO: 2312759 - protein, 17 aa, Cryptosporidium parvum
EPKLGISLFDVNSGLIS

SEQ ID NO: 2312760 - protein, 18 aa, Cryptosporidium parvum
EPKRKLLTPFKNESISDF

SEQ ID NO: 2312761 - protein, 22 aa, Cryptosporidium parvum
EPLLKIKYNIKKISPRLINRLK

SEQ ID NO: 2312762 - protein, 20 aa, Cryptosporidium parvum
EPLNPLICPCDCKGSMQFVH

SEQ ID NO: 2312763 - protein, 31 aa, Cryptosporidium parvum; identical to SEQ ID NO: 2189203

SEQ ID NO: 2312764 - protein, 32 aa, Cryptosporidium parvum
EPNDQSIWQYYFWLMGDFLPKILFKNEQFKVT

SEQ ID NO: 2312765 - protein, 28 aa, Cryptosporidium parvum
EPPIGICLHSLLYILPPSVPTEKYLIFK

SEQ ID NO: 2312766 - protein, 33 aa, Cryptosporidium parvum; identical to SEQ ID NO: 2189208

SEQ ID NO: 2312767 - protein, 18 aa, Cryptosporidium parvum
EPSKRSLNWLKIKKDYVD

SEQ ID NO: 2312768 - protein, 22 aa, Cryptosporidium parvum
EPSVIFRRFLEDLARNSHLGGE

SEQ ID NO: 2312769 - protein, 25 aa, Cryptosporidium parvum
EPTIPTLKRYGFANYILIFCQDESY

SEQ ID NO: 2312770 - protein, 23 aa, Cryptosporidium parvum
EPTPVFYDGFQWVAKTGSTASMD

SEQ ID NO: 2312771 - protein, 19 aa, Cryptosporidium parvum
EPVGFLFKKFEELREALQH

SEQ ID NO: 2312772 - protein, 20 aa, Cryptosporidium parvum
EPYVYNLSRENLRLGVLSGN

SEQ ID NO: 2312773 - protein, 33 aa, Cryptosporidium parvum
EQAFHKWIGWIESKLRFLVRKLETFKGLQVRPW

SEQ ID NO: 2312774 - protein, 22 aa, Cryptosporidium parvum
EQAYQIMGIFKASKIENIQGMK

SEQ ID NO: 2312775 - protein, 26 aa, Cryptosporidium parvum
EQDEDLLLIHRISKLLNFQHFIRNQI

SEQ ID NO: 2312776 - protein, 39 aa, Cryptosporidium parvum
EQEEGAKSAIQWNQTEYKGRMLRINMSADKPQPGSLSSG

SEQ ID NO: 2312777 - protein, 27 aa, Cryptosporidium parvum
EQEEPLSFLMLSYGITSTHWQNFIPEE

SEQ ID NO: 2312778 - protein, 35 aa, Cryptosporidium parvum
EQEKAKYQALILSSQKLLEIIYFEIHFSESNTRNY

SEQ ID NO: 2312779 - protein, 25 aa, Cryptosporidium parvum
EQEKPRLIIHKIVLENFKSYGGSKV

SEQ ID NO: 2312780 - protein, 29 aa, Cryptosporidium parvum
EQEKSFIFELLYIKRKLSLVLDLDNTLIH

SEQ ID NO: 2312781 - protein, 20 aa, Cryptosporidium parvum
EQESIFTYIWNIIKAIFTRR

SEQ ID NO: 2312782 - protein, 24 aa, Cryptosporidium parvum
EQFGELVIIPLYSSLPPYKQQKIF

SEQ ID NO: 2312783 - protein, 25 aa, Cryptosporidium parvum
EQFKAVTSLLWPFKLSSPNGGFVRK

SEQ ID NO: 2312784 - protein, 25 aa, Cryptosporidium parvum
EQGASGFYFFVISTGSFGVEINGNR

SEQ ID NO: 2312785 - protein, 31 aa, Cryptosporidium parvum
EQGKYVSQLLKLVFERLLQLVGINDIFLHNN

SEQ ID NO: 2312786 - protein, 18 aa, Cryptosporidium parvum
EQGVFLLNSLLSVEEGKP

SEQ ID NO: 2312787 - protein, 24 aa, Cryptosporidium parvum
EQIGGIIPAIGFNSSNANATLFGP

SEQ ID NO: 2312788 - protein, 33 aa, Cryptosporidium parvum
EQIKKFISVQFPNLKTFFYSPGSCIYINGNDVL

SEQ ID NO: 2312789 - protein, 21 aa, Cryptosporidium parvum
EQIKNLIISAIQKLKSGGNLH

SEQ ID NO: 2312790 - protein, 20 aa, Cryptosporidium parvum
EQILFVLNRGFTYAHDSVIN

SEQ ID NO: 2312791 - protein, 21 aa, Cryptosporidium parvum
EQIPREFLLQVANKGPSRTLS

SEQ ID NO: 2312792 - protein, 24 aa, Cryptosporidium parvum
EQKEFMIDKRFIIQIIQKHNEDGS

SEQ ID NO: 2312793 - protein, 27 aa, Cryptosporidium parvum
EQKLTPKAFCWLLCDSCNQLLMLLNGF

SEQ ID NO: 2312794 - protein, 18 aa, Cryptosporidium parvum
EQLNISRTMLASMGSPSS

SEQ ID NO: 2312795 - protein, 26 aa, Cryptosporidium parvum
EQLRTYKWFRPPFGRLTKQQYELVVS

SEQ ID NO: 2312796 - protein, 21 aa, Cryptosporidium parvum
EQMDYLVSAGIYRVIISIVEG

SEQ ID NO: 2312797 - protein, 19 aa, Cryptosporidium parvum
EQNIFNKNYRLFYNKNLPL

SEQ ID NO: 2312798 - protein, 18 aa, Cryptosporidium parvum
EQNILLSGNILDFNNGKS

SEQ ID NO: 2312799 - protein, 28 aa, Cryptosporidium parvum
EQNKMGPFGWFDGKYTIPGWRTMQMAYE

SEQ ID NO: 2312800 - protein, 28 aa, Cryptosporidium parvum
EQNKRTILLAIEMRKIITPILQEFDAEK

SEQ ID NO: 2312801 - protein, 18 aa, Cryptosporidium parvum
EQNWRFSSWEEGVYSKVV

SEQ ID NO: 2312802 - protein, 24 aa, Cryptosporidium parvum
EQPSLIPFWDEGTGLFYLAGKGDT

SEQ ID NO: 2312803 - protein, 25 aa, Cryptosporidium parvum
EQPVVLIQYIFPTNTLTLEKRDRLI

SEQ ID NO: 2312804 - protein, 30 aa, Cryptosporidium parvum
EQQQQMPVRYLVPPPPPPPSKTSGALQIFQ

SEQ ID NO: 2312805 - protein, 25 aa, Cryptosporidium parvum
EQQSGFILNFNFAPNPFFEGTNIKK

SEQ ID NO: 2312806 - protein, 23 aa, Cryptosporidium parvum
EQRKLKYNILKESLIKEASGSIN

SEQ ID NO: 2312807 - protein, 17 aa, Cryptosporidium parvum
EQTKEMVIVSRTQKWLL

SEQ ID NO: 2312808 - protein, 30 aa, Cryptosporidium parvum
EQTNIDILDLFPIFSWLENPNNFNHPMYPK

SEQ ID NO: 2312809 - protein, 24 aa, Cryptosporidium parvum
EQTPESWLKYEGYIPKLTGDHDDQ

SEQ ID NO: 2312810 - protein, 28 aa, Cryptosporidium parvum
EQVIEYFKSIKMSDLRPLIWVCDLHHRV

SEQ ID NO: 2312811 - protein, 29 aa, Cryptosporidium parvum
EQYINARKLVERLLLKIYQEYDDFLLSNN

SEQ ID NO: 2312812 - protein, 24 aa, Cryptosporidium parvum
EQYKGHFFVMKSQYNFSLYSEIKS

SEQ ID NO: 2312813 - protein, 19 aa, Cryptosporidium parvum
EQYSLRSLFFLKKSNSDLG

SEQ ID NO: 2312814 - protein, 22 aa, Cryptosporidium parvum
EQYYPSILMITNSKLILFSLKE

SEQ ID NO: 2312815 - protein, 21 aa, Cryptosporidium parvum
ERAFSAYIKSLFILTPNDKRE

SEQ ID NO: 2312816 - protein, 20 aa, Cryptosporidium parvum
ERAIIFCATKHHVDYIVKIL

SEQ ID NO: 2312817 - protein, 25 aa, Cryptosporidium parvum
ERALSLLRHLLIQGVVKSEYIIGNN

SEQ ID NO: 2312818 - protein, 21 aa, Cryptosporidium parvum
ERCPFSHCLSWHRRNPYEYAY

SEQ ID NO: 2312819 - protein, 25 aa, Cryptosporidium parvum
ERDELISKIGLLNLNINRLNKALEE

SEQ ID NO: 2312820 - protein, 26 aa, Cryptosporidium parvum
ERDLNFTWGCLPLRAIDHPDQLVPLP

SEQ ID NO: 2312821 - protein, 24 aa, Cryptosporidium parvum
ERDTLLEKAPSWSSKLLPSIGTKL

SEQ ID NO: 2312822 - protein, 26 aa, Cryptosporidium parvum
EREAIFNRLILNNPSIISVDKALLPG

SEQ ID NO: 2312823 - protein, 23 aa, Cryptosporidium parvum
EREAQTVGFLERKLRQVELEHKT

SEQ ID NO: 2312824 - protein, 18 aa, Cryptosporidium parvum
EREEFFRLKKIQEKKKEW

SEQ ID NO: 2312825 - protein, 30 aa, Cryptosporidium parvum
EREGALFYILNKIFTKRVIVFFQTKKEAHR

SEQ ID NO: 2312826 - protein, 19 aa, Cryptosporidium parvum
EREHYLGHSLHYNRSRGRG

SEQ ID NO: 2312827 - protein, 23 aa, Cryptosporidium parvum
EREKLLSSSLLLEQQLLNLETAK

SEQ ID NO: 2312828 - protein, 25 aa, Cryptosporidium parvum
ERELDYIDILFKDEIYLWQKDLVIN

SEQ ID NO: 2312829 - protein, 18 aa, Cryptosporidium parvum
EREQILNNFYLLIGEPVE

SEQ ID NO: 2312830 - protein, 31 aa, Cryptosporidium parvum
EREYYNGLYLQQWFEWLKQTGQVKYVETHAN

SEQ ID NO: 2312831 - protein, 32 aa, Cryptosporidium parvum; identical to SEQ ID NO: 2189254

SEQ ID NO: 2312832 - protein, 29 aa, Cryptosporidium parvum
ERIIKPIAEKFPYLIYPMNADELNISSIN

SEQ ID NO: 2312833 - protein, 22 aa, Cryptosporidium parvum
ERINELILNKYIYSSSNFESNS

SEQ ID NO: 2312834 - protein, 34 aa, Cryptosporidium parvum; identical to SEQ ID NO: 2189257

SEQ ID NO: 2312835 - protein, 18 aa, Cryptosporidium parvum
ERISPIKMLPINITEGFP

SEQ ID NO: 2312836 - protein, 29 aa, Cryptosporidium parvum
ERKELRILRKEMKNLLLLTKKEAYQFSKN

SEQ ID NO: 2312837 - protein, 25 aa, Cryptosporidium parvum
ERKIYELETFYWNQTTDIGNMLRGW

SEQ ID NO: 2312838 - protein, 18 aa, Cryptosporidium parvum
ERKKLVYYEALFNKLEND

SEQ ID NO: 2312839 - protein, 22 aa, Cryptosporidium parvum
ERLKLPYCKMLLNNELPETIGG

SEQ ID NO: 2312840 - protein, 27 aa, Cryptosporidium parvum
ERLQALGFPRNAVIEAYLICEKNEELA

SEQ ID NO: 2312841 - protein, 27 aa, Cryptosporidium parvum
ERLQNNYWLFHILGVNLNAPNLSLNDI

SEQ ID NO: 2312842 - protein, 26 aa, Cryptosporidium parvum
ERLRYLGFTCLYITIKIERVVNFNFK

SEQ ID NO: 2312843 - protein, 17 aa, Cryptosporidium parvum
ERLSLARSQLMGAELRL

SEQ ID NO: 2312844 - protein, 18 aa, Cryptosporidium parvum
ERMANNFVYLFQKNQPSK

SEQ ID NO: 2312845 - protein, 32 aa, Cryptosporidium parvum
ERMNKKFIELYRDLIFLPLNDVSGFRSAGLNL

SEQ ID NO: 2312846 - protein, 18 aa, Cryptosporidium parvum
ERNERREGVSSKKGDIFT

SEQ ID NO: 2312847 - protein, 24 aa, Cryptosporidium parvum
ERNSLLISLFDTLDEYWSTCATLH

SEQ ID NO: 2312848 - protein, 24 aa, Cryptosporidium parvum
ERNYHIFYCLAAGVSKGIFPESIS

SEQ ID NO: 2312849 - protein, 24 aa, Cryptosporidium parvum
ERPEMVEIMLYLTELLDSEILSVE

SEQ ID NO: 2312850 - protein, 28 aa, Cryptosporidium parvum
ERPNCIIHNIIFGSTWLEWLGDVNVTSK

SEQ ID NO: 2312851 - protein, 22 aa, Cryptosporidium parvum
ERQGEAIQWLKENGKYPQEEYV

SEQ ID NO: 2312852 - protein, 25 aa, Cryptosporidium parvum
ERQLQLERKPLLDELIRIEERDKQL

SEQ ID NO: 2312853 - protein, 25 aa, Cryptosporidium parvum
ERRESKVYLLPYTQNVQVPNFPGVV

SEQ ID NO: 2312854 - protein, 17 aa, Cryptosporidium parvum
ERRISSVTLVGWITHRE

SEQ ID NO: 2312855 - protein, 24 aa, Cryptosporidium parvum
ERRKVIIAAILEEAKRRKLAEKNK

SEQ ID NO: 2312856 - protein, 21 aa, Cryptosporidium parvum
ERRLIIEVIKSLLMLCERKRG

SEQ ID NO: 2312857 - protein, 25 aa, Cryptosporidium parvum
ERRMSPPCRVFLSDNFKSSKLSPEN

SEQ ID NO: 2312858 - protein, 28 aa, Cryptosporidium parvum
ERRRHDFLPFVLTLLRHASKKGLLMKKL

SEQ ID NO: 2312859 - protein, 26 aa, Cryptosporidium parvum
ERSIRYIPCFCFPDGNYKFASLKTFK

SEQ ID NO: 2312860 - protein, 17 aa, Cryptosporidium parvum
ERSNLVGNSAYYNYMTS

SEQ ID NO: 2312861 - protein, 29 aa, Cryptosporidium parvum
ERSNSPFHFIWDSIIFNKTKKILGGNVKA

SEQ ID NO: 2312862 - protein, 25 aa, Cryptosporidium parvum
ERSTNLYYFNAKVPYSIFTTPYTLG

SEQ ID NO: 2312863 - protein, 26 aa, Cryptosporidium parvum
ERVDITQDRIVFEVLPRSDNIVHYDN

SEQ ID NO: 2312864 - protein, 25 aa, Cryptosporidium parvum
ERYIKGRYQRHLDKIKATKSRMEQE

SEQ ID NO: 2312865 - protein, 24 aa, Cryptosporidium parvum
ESAPGHFETLYPPPTLFSRDDVRN

SEQ ID NO: 2312866 - protein, 23 aa, Cryptosporidium parvum
ESAQRVFLMAVQRSFTIGRNNMH

SEQ ID NO: 2312867 - protein, 21 aa, Cryptosporidium parvum
ESCCLVIKETWRSLYVYPRES

SEQ ID NO: 2312868 - protein, 22 aa, Cryptosporidium parvum
ESCCRDLILVLLQRDENAGLNR

SEQ ID NO: 2312869 - protein, 18 aa, Cryptosporidium parvum
ESCKLLVISSFTHSIILL

SEQ ID NO: 2312870 - protein, 22 aa, Cryptosporidium parvum
ESCTIIETNPYFSPKKKSNADT

SEQ ID NO: 2312871 - protein, 31 aa, Cryptosporidium parvum
ESDELEMRLVLYLLKYFAPIWDTKAGNQQCS

SEQ ID NO: 2312872 - protein, 24 aa, Cryptosporidium parvum
ESDPQLAQLFASAQIRIEDINNQK

SEQ ID NO: 2312873 - protein, 23 aa, Cryptosporidium parvum
ESDWDHSWGCPGDFSDLPGLNQD

SEQ ID NO: 2312874 - protein, 25 aa, Cryptosporidium parvum
ESENRKILDLLKETKKRYLNDVKAL

SEQ ID NO: 2312875 - protein, 21 aa, Cryptosporidium parvum
ESFEFGIWDALKASTYITIDK

SEQ ID NO: 2312876 - protein, 19 aa, Cryptosporidium parvum
ESFFDIYKDDLFKNQLITI

SEQ ID NO: 2312877 - protein, 18 aa, Cryptosporidium parvum
ESFINCIPSLLEDKHHGV

SEQ ID NO: 2312878 - protein, 26 aa, Cryptosporidium parvum
ESFLLERPFEFRLIQNRIGRRRICSG

SEQ ID NO: 2312879 - protein, 23 aa, Cryptosporidium parvum
ESFTKFIHLLVSDLNYLLEEGLS

SEQ ID NO: 2312880 - protein, 18 aa, Cryptosporidium parvum
ESGGILVVILPPSIINYG

SEQ ID NO: 2312881 - protein, 24 aa, Cryptosporidium parvum
ESGKFINLPSLYNSIKIHPSLDQT

SEQ ID NO: 2312882 - protein, 17 aa, Cryptosporidium parvum
ESGKQIKCIIFFLTCRS

SEQ ID NO: 2312883 - protein, 25 aa, Cryptosporidium parvum
ESHELPIFMSIIDFGRSLDIGEIYK

SEQ ID NO: 2312884 - protein, 24 aa, Cryptosporidium parvum
ESHNKLYNLLLELSKTYASINNSV

SEQ ID NO: 2312885 - protein, 25 aa, Cryptosporidium parvum
ESIDLPLPRINCGMFLRGNVIYIYG

SEQ ID NO: 2312886 - protein, 26 aa, Cryptosporidium parvum
ESIINHIFNLKLDFLKKLFQEPGIFT

SEQ ID NO: 2312887 - protein, 20 aa, Cryptosporidium parvum
ESIKLAQELSLRLEISEPNS

SEQ ID NO: 2312888 - protein, 24 aa, Cryptosporidium parvum
ESIKRRLLREYDIIYQFGRYEYFS

SEQ ID NO: 2312889 - protein, 21 aa, Cryptosporidium parvum
ESILKICECQSFLLGDTFLIY

SEQ ID NO: 2312890 - protein, 32 aa, Cryptosporidium parvum
ESINSEFFQLEKPYLIVPPQITIFHLQNYIMH

SEQ ID NO: 2312891 - protein, 19 aa, Cryptosporidium parvum
ESIPLFPILTHFCVLTCDI

SEQ ID NO: 2312892 - protein, 39 aa, Cryptosporidium parvum
ESITVGIKMQLIYSLLCKSEFQSLTQLIFQLLSEKSVGL

SEQ ID NO: 2312893 - protein, 30 aa, Cryptosporidium parvum; identical to SEQ ID NO: 2189309

SEQ ID NO: 2312894 - protein, 27 aa, Cryptosporidium parvum
ESKDIPPHLIYGKFQLVTAPCSGILRN

SEQ ID NO: 2312895 - protein, 17 aa, Cryptosporidium parvum
ESKLILNWLEDGVFDAL

SEQ ID NO: 2312896 - protein, 25 aa, Cryptosporidium parvum
ESKLKYKLHIMKTSLQGLISETGKL

SEQ ID NO: 2312897 - protein, 25 aa, Cryptosporidium parvum
ESKRKRKSLYWDTVFNWSTSDDDEG

SEQ ID NO: 2312898 - protein, 27 aa, Cryptosporidium parvum
ESKVPLMHRVLGFPLSFNHANPKIIAE

SEQ ID NO: 2312899 - protein, 22 aa, Cryptosporidium parvum
ESLDMILLVTINGNIKIFQIHG

SEQ ID NO: 2312900 - protein, 19 aa, Cryptosporidium parvum
ESLDPALIRPGRIDRKIEL

SEQ ID NO: 2312901 - protein, 37 aa, Cryptosporidium parvum
ESLTGFRRLIYSLIEWKNVFGLVCSFKSFIESDNFQG

SEQ ID NO: 2312902 - protein, 21 aa, Cryptosporidium parvum
ESLVGGKWIISGFISSLDKGR

SEQ ID NO: 2312903 - protein, 23 aa, Cryptosporidium parvum
ESLYGILNISLKQSRIIYEIMRT

SEQ ID NO: 2312904 - protein, 25 aa, Cryptosporidium parvum
ESMLSLLERFYSIKISKLPGNVKNL

SEQ ID NO: 2312905 - protein, 32 aa, Cryptosporidium parvum; identical to SEQ ID NO: 2189324

SEQ ID NO: 2312906 - protein, 17 aa, Cryptosporidium parvum
ESNKYIKQLVYLKSYLS

SEQ ID NO: 2312907 - protein, 24 aa, Cryptosporidium parvum
ESNKYRIPFHYLIKHPINALKYEI

SEQ ID NO: 2312908 - protein, 17 aa, Cryptosporidium parvum
ESNLSSLFSKRTSALKA

SEQ ID NO: 2312909 - protein, 27 aa, Cryptosporidium parvum
ESNNKGLILVILLEKKKKCWWDSCFLG

SEQ ID NO: 2312910 - protein, 24 aa, Cryptosporidium parvum
ESNNPQFDFLKPGHALFGYFADLV

SEQ ID NO: 2312911 - protein, 26 aa, Cryptosporidium parvum
ESNPSIDLYYLTGWIPETISIKSHYE

SEQ ID NO: 2312912 - protein, 24 aa, Cryptosporidium parvum
ESNSVSRRPSWSQFAHIFSIHGAN

SEQ ID NO: 2312913 - protein, 27 aa, Cryptosporidium parvum
ESNWKNLILLKNSLTLLSSIFGNVKLP

SEQ ID NO: 2312914 - protein, 25 aa, Cryptosporidium parvum
ESPNQDDFFILKTENWGLFGVFDGH

SEQ ID NO: 2312915 - protein, 20 aa, Cryptosporidium parvum
ESPQSINWFWNILDLNETGY

SEQ ID NO: 2312916 - protein, 17 aa, Cryptosporidium parvum
ESQEFRFGEGTFTGGLT

SEQ ID NO: 2312917 - protein, 19 aa, Cryptosporidium parvum
ESQLAACPSIYYLGIHFED

SEQ ID NO: 2312918 - protein, 18 aa, Cryptosporidium parvum
ESQVFKKSLFQKSKKLKD

SEQ ID NO: 2312919 - protein, 25 aa, Cryptosporidium parvum
ESRAWIHILVYITQFYDCIMSFLRT

SEQ ID NO: 2312920 - protein, 24 aa, Cryptosporidium parvum
ESRKLYLFRLPQINKENPYFQSTI

SEQ ID NO: 2312921 - protein, 20 aa, Cryptosporidium parvum
ESRLIWDQRPFLTGSIDDDT

SEQ ID NO: 2312922 - protein, 28 aa, Cryptosporidium parvum
ESRLKNTPLLIIPFKDTEYYGDAKKRQI

SEQ ID NO: 2312923 - protein, 29 aa, Cryptosporidium parvum
ESRLWQERFFILRSDGALIWCHHPNDTVY

SEQ ID NO: 2312924 - protein, 29 aa, Cryptosporidium parvum
ESRQKEFEEFWFELDKRQKNISTREKELD

SEQ ID NO: 2312925 - protein, 24 aa, Cryptosporidium parvum
ESRSAFVWIIGEVYEFVQVTKPST

SEQ ID NO: 2312926 - protein, 24 aa, Cryptosporidium parvum
ESRTKLLHQLKQLELLRFNNIQDQ

SEQ ID NO: 2312927 - protein, 20 aa, Cryptosporidium parvum
ESRVLLIKNGLKSINHSLID

SEQ ID NO: 2312928 - protein, 28 aa, Cryptosporidium parvum
ESSEWGNGNFWPIEKFVSVFEPIERAKM

SEQ ID NO: 2312929 - protein, 25 aa, Cryptosporidium parvum
ESSFAVLFPKYREKYLRDIWPDIRN

SEQ ID NO: 2312930 - protein, 26 aa, Cryptosporidium parvum
ESSIKSLIYPPFNKLARFPFTCVDSN

SEQ ID NO: 2312931 - protein, 21 aa, Cryptosporidium parvum
ESSLPIVNFIAISILLARRSA

SEQ ID NO: 2312932 - protein, 17 aa, Cryptosporidium parvum
ESSLTTSLIPYNRLFDS

SEQ ID NO: 2312933 - protein, 22 aa, Cryptosporidium parvum
ESSMDYIWKNYLSSGDVGIFNT

SEQ ID NO: 2312934 - protein, 27 aa, Cryptosporidium parvum
ESSNNCIWNDLLYNQVFDHVDFETPFT

SEQ ID NO: 2312935 - protein, 23 aa, Cryptosporidium parvum
ESTEFFIHIDTKDPGFSKNLGGI

SEQ ID NO: 2312936 - protein, 26 aa, Cryptosporidium parvum
ESTLHLVLRLRGGVIEPSLANLARQY

SEQ ID NO: 2312937 - protein, 30 aa, Cryptosporidium parvum
ESTLQERYKSINLLYLVGQKKLIREIINTQ

SEQ ID NO: 2312938 - protein, 27 aa, Cryptosporidium parvum
ESTPSSYLLYLHVNKEPVRLGFEASQA

SEQ ID NO: 2312939 - protein, 21 aa, Cryptosporidium parvum
ESTSSWYQLAIQSGSRNISGE

SEQ ID NO: 2312940 - protein, 17 aa, Cryptosporidium parvum
ESVLFRHEVLYVLGQMG

SEQ ID NO: 2312941 - protein, 23 aa, Cryptosporidium parvum
ESVTLIVALKVRYRNRVFLIRGN

SEQ ID NO: 2312942 - protein, 18 aa, Cryptosporidium parvum
ESWVARYNKLLPNIVPGC

SEQ ID NO: 2312943 - protein, 23 aa, Cryptosporidium parvum
ESYNEFYPNYYLLTKIGDIFKTK

SEQ ID NO: 2312944 - protein, 17 aa, Cryptosporidium parvum
ESYPLVKTIIKRITIDI

SEQ ID NO: 2312945 - protein, 20 aa, Cryptosporidium parvum
ETARNYAKEKGILSFETSAK

SEQ ID NO: 2312946 - protein, 35 aa, Cryptosporidium parvum; identical to SEQ ID NO: 2189353

SEQ ID NO: 2312947 - protein, 28 aa, Cryptosporidium parvum
ETDKRLKIYFPLPPLDKYNDSCAPAYIA

SEQ ID NO: 2312948 - protein, 28 aa, Cryptosporidium parvum
ETDPKECLIIFTYFTFEICHTTFPSVYH

SEQ ID NO: 2312949 - protein, 28 aa, Cryptosporidium parvum
ETEDNISLALWDRVYRASSGELIYCNLN

SEQ ID NO: 2312950 - protein, 26 aa, Cryptosporidium parvum
ETEFSFVSCWIIIRNWAIVKMKTGEP

SEQ ID NO: 2312951 - protein, 19 aa, Cryptosporidium parvum
ETELFFAQKMDLGGSVPLM

SEQ ID NO: 2312952 - protein, 20 aa, Cryptosporidium parvum
ETEVFAFDGDKWKCPVCRGE

SEQ ID NO: 2312953 - protein, 26 aa, Cryptosporidium parvum
ETFEFLNILQVHGFPRVLGVLTHLDK

SEQ ID NO: 2312954 - protein, 23 aa, Cryptosporidium parvum
ETGKRFLNLGLLQIHRGINYNDN

SEQ ID NO: 2312955 - protein, 22 aa, Cryptosporidium parvum
ETHKLSFEFLYRTCYRLTINNY

SEQ ID NO: 2312956 - protein, 22 aa, Cryptosporidium parvum
ETIALAPDARRAVRKQFNIEFI

SEQ ID NO: 2312957 - protein, 25 aa, Cryptosporidium parvum
ETIETKYSLLKEKYLFLVQKNEYLL

SEQ ID NO: 2312958 - protein, 23 aa, Cryptosporidium parvum
ETKDDNAFFLNRSKSLKDSKNQT

SEQ ID NO: 2312959 - protein, 23 aa, Cryptosporidium parvum
ETKETFVIISADNKVRTILKSQS

SEQ ID NO: 2312960 - protein, 17 aa, Cryptosporidium parvum
ETKGFVSRLLGLGDISG

SEQ ID NO: 2312961 - protein, 29 aa, Cryptosporidium parvum
ETKLLLTSIPQFRDVILMSFECPHCGFKN

SEQ ID NO: 2312962 - protein, 24 aa, Cryptosporidium parvum
ETKLTKNVSLKIPLISSAMDTVTE

SEQ ID NO: 2312963 - protein, 23 aa, Cryptosporidium parvum
ETKSLIDIYLLRSVANEKTNKQR

SEQ ID NO: 2312964 - protein, 17 aa, Cryptosporidium parvum
ETLAFLKTIQLINILIF

SEQ ID NO: 2312965 - protein, 20 aa, Cryptosporidium parvum
ETLLIFSLSDEKWSLLPNIS

SEQ ID NO: 2312966 - protein, 20 aa, Cryptosporidium parvum
ETLLLNILRGDFNRLRRCIN

SEQ ID NO: 2312967 - protein, 18 aa, Cryptosporidium parvum
ETLPSVVLSFIVDKCNEQ

SEQ ID NO: 2312968 - protein, 21 aa, Cryptosporidium parvum
ETLSEWRNELLLAILEKISES

SEQ ID NO: 2312969 - protein, 18 aa, Cryptosporidium parvum
ETLYYLLKQHRYNYFNRV

SEQ ID NO: 2312970 - protein, 24 aa, Cryptosporidium parvum
ETMKLLSEFLKLSPNLIRLTRKKV

SEQ ID NO: 2312971 - protein, 26 aa, Cryptosporidium parvum
ETMLRCFVNRLRYLKATRVLNKWQTI

SEQ ID NO: 2312972 - protein, 25 aa, Cryptosporidium parvum
ETMPRIDWKPNPLCWDNLRKAFCSG

SEQ ID NO: 2312973 - protein, 21 aa, Cryptosporidium parvum
ETNEILAKYVNDLASEYCHRN

SEQ ID NO: 2312974 - protein, 24 aa, Cryptosporidium parvum
ETNNIGKIFFGKPIRDFSSFSNVI

SEQ ID NO: 2312975 - protein, 19 aa, Cryptosporidium parvum
ETNNNIIFEVFARAILNGQ

SEQ ID NO: 2312976 - protein, 42 aa, Cryptosporidium parvum; identical to SEQ ID NO: 2189378

SEQ ID NO: 2312977 - protein, 29 aa, Cryptosporidium parvum
ETNTDFEPLLPYLVYYFNYNTRIICIQFE

SEQ ID NO: 2312978 - protein, 33 aa, Cryptosporidium parvum
ETPPPPPPAEESSWFSGWFGTSAPEEPPKEDPA

SEQ ID NO: 2312979 - protein, 28 aa, Cryptosporidium parvum
ETQEVFISKLFGYLLALGLSDGRVILYD

SEQ ID NO: 2312980 - protein, 21 aa, Cryptosporidium parvum
ETQINPIFKKKSQIFQHRGNI

SEQ ID NO: 2312981 - protein, 28 aa, Cryptosporidium parvum
ETQLDRQLSAYPLFVSTISHASMGLSNT

SEQ ID NO: 2312982 - protein, 27 aa, Cryptosporidium parvum
ETRILQILSFISQKCWKYLFGHTGDLL

SEQ ID NO: 2312983 - protein, 41 aa, Cryptosporidium parvum
ETRKRIAIYCLKDSILPLRLMKHLKLFPNIIEMARVTGTTI

SEQ ID NO: 2312984 - protein, 18 aa, Cryptosporidium parvum
ETRRYIWNLIDTYPIFRW

SEQ ID NO: 2312985 - protein, 23 aa, Cryptosporidium parvum
ETSMTIFENLPIKKENIDIDNEF

SEQ ID NO: 2312986 - protein, 22 aa, Cryptosporidium parvum
ETSPFAIRYRAFRDLINNINSG

SEQ ID NO: 2312987 - protein, 31 aa, Cryptosporidium parvum
ETVINMILESKGIPGIFRGQSIHLVENMMIG

SEQ ID NO: 2312988 - protein, 25 aa, Cryptosporidium parvum
ETVYSRLPLAKIPIMLRSEYCWTHN

SEQ ID NO: 2312989 - protein, 28 aa, Cryptosporidium parvum
ETVYTPVAPLLIPNYPVVPSGVGSPGVI

SEQ ID NO: 2312990 - protein, 17 aa, Cryptosporidium parvum
ETYHKFYLTEMKHIIGI

SEQ ID NO: 2312991 - protein, 33 aa, Cryptosporidium parvum; identical to SEQ ID NO: 2189388

SEQ ID NO: 2312992 - protein, 26 aa, Cryptosporidium parvum
EVDDELRQALLLSIQDFSGNDSTNNT

SEQ ID NO: 2312993 - protein, 18 aa, Cryptosporidium parvum
EVDLILISNPYGLIGIPF

SEQ ID NO: 2312994 - protein, 25 aa, Cryptosporidium parvum
EVDNYIYYNLNDEGIIKNLNDAKKL

SEQ ID NO: 2312995 - protein, 23 aa, Cryptosporidium parvum
EVEIPIHSEVYIRYGILSSSECL

SEQ ID NO: 2312996 - protein, 19 aa, Cryptosporidium parvum
EVFCYVKRPISDFDLTELR

SEQ ID NO: 2312997 - protein, 17 aa, Cryptosporidium parvum
EVFGLCGPIKAIYLGLN

SEQ ID NO: 2312998 - protein, 19 aa, Cryptosporidium parvum
EVFKCFLCGELGHTLKDCK

SEQ ID NO: 2312999 - protein, 23 aa, Cryptosporidium parvum
EVGYKIMKNLIWKEPESSGEDFP

SEQ ID NO: 2313000 - protein, 27 aa, Cryptosporidium parvum
EVHQIHVDLRWPAIKTWIYVCNQIKVD

SEQ ID NO: 2313001 - protein, 29 aa, Cryptosporidium parvum
EVIKIIGLLRPTILQRLIWFVASQVAAGT

SEQ ID NO: 2313002 - protein, 26 aa, Cryptosporidium parvum
EVINLLEYILNFLSFSTQELISRYNK

SEQ ID NO: 2313003 - protein, 17 aa, Cryptosporidium parvum
EVISRLCLLINKITPAQ

SEQ ID NO: 2313004 - protein, 17 aa, Cryptosporidium parvum
EVISSLRISDGALLLVD

SEQ ID NO: 2313005 - protein, 23 aa, Cryptosporidium parvum
EVKDQIWVLISGGDKNKTISFSE

SEQ ID NO: 2313006 - protein, 24 aa, Cryptosporidium parvum
EVKEKVFIVGRLIRYVSKALNISS

SEQ ID NO: 2313007 - protein, 17 aa, Cryptosporidium parvum
EVKKDWWRLIPTESTNS

SEQ ID NO: 2313008 - protein, 29 aa, Cryptosporidium parvum
EVKLRNFPDIDIFCFFGCSEYFLSHIIKN

SEQ ID NO: 2313009 - protein, 28 aa, Cryptosporidium parvum
EVKPIKGIIRKRLKKKLLKLSKISGQNF

SEQ ID NO: 2313010 - protein, 19 aa, Cryptosporidium parvum
EVLLGFNCTIFAYGQTGTG

SEQ ID NO: 2313011 - protein, 24 aa, Cryptosporidium parvum
EVLPSWILEKFFVDGGFNVISRLG

SEQ ID NO: 2313012 - protein, 26 aa, Cryptosporidium parvum
EVMKNLLMLVLSYILERSINKIILKV

SEQ ID NO: 2313013 - protein, 18 aa, Cryptosporidium parvum
EVNFKNLMRSHFSSKLRS

SEQ ID NO: 2313014 - protein, 18 aa, Cryptosporidium parvum
EVNKHCILQFFGILDLNN

SEQ ID NO: 2313015 - protein, 23 aa, Cryptosporidium parvum
EVNKRMIFLIDYCKLHPDDDISP

SEQ ID NO: 2313016 - protein, 24 aa, Cryptosporidium parvum
EVNPELIFEFQKYSKSSIQSNNNN

SEQ ID NO: 2313017 - protein, 24 aa, Cryptosporidium parvum
EVPATLTIFDIAGLVPGAHKGEGL

SEQ ID NO: 2313018 - protein, 26 aa, Cryptosporidium parvum
EVPIAFYSAIPVPILIDRAVPVPMEL

SEQ ID NO: 2313019 - protein, 25 aa, Cryptosporidium parvum
EVPLNIVLSLLYYKKEIPSIITLIN

SEQ ID NO: 2313020 - protein, 26 aa, Cryptosporidium parvum
EVPQVTCYIILIINGQICPDEMIAIA

SEQ ID NO: 2313021 - protein, 26 aa, Cryptosporidium parvum
EVQGELQVLNLLSLVKIEQPESDETL

SEQ ID NO: 2313022 - protein, 26 aa, Cryptosporidium parvum
EVQNSSFIPTWAWPASLRNNEDLKLI

SEQ ID NO: 2313023 - protein, 22 aa, Cryptosporidium parvum
EVQVYIRSLYQQLKSEMICHIE

SEQ ID NO: 2313024 - protein, 27 aa, Cryptosporidium parvum
EVRNPHYWRYIGIIKLYKKVQGLLSDH

SEQ ID NO: 2313025 - protein, 23 aa, Cryptosporidium parvum
EVRSGSIAFASFGKVCIWGGIDE

SEQ ID NO: 2313026 - protein, 19 aa, Cryptosporidium parvum
EVRVLRFVSISGVEELVLK

SEQ ID NO: 2313027 - protein, 21 aa, Cryptosporidium parvum
EVSELHILRLKQIETAQRLKE

SEQ ID NO: 2313028 - protein, 18 aa, Cryptosporidium parvum
EVSELKTLWQHETKKREI

SEQ ID NO: 2313029 - protein, 24 aa, Cryptosporidium parvum
EVSELLLVGNPFIKKRALLASVHI

SEQ ID NO: 2313030 - protein, 31 aa, Cryptosporidium parvum
EVSYALYKRLLNQCPKLKLWDLPGWRIFSCI

SEQ ID NO: 2313031 - protein, 27 aa, Cryptosporidium parvum
EVTDKKIYFEYILEFYLHILNNYPNQF

SEQ ID NO: 2313032 - protein, 26 aa, Cryptosporidium parvum
EVTQSWDLLNKNKPIWMRKPEEVTFE

SEQ ID NO: 2313033 - protein, 24 aa, Cryptosporidium parvum
EVVGLLEWLVSIVIYRQNRYMEAL

SEQ ID NO: 2313034 - protein, 22 aa, Cryptosporidium parvum
EVVKFLKFVNKGNLAMALDIEK

SEQ ID NO: 2313035 - protein, 17 aa, Cryptosporidium parvum
EVYFQIDGEYYLAKEPK

SEQ ID NO: 2313036 - protein, 25 aa, Cryptosporidium parvum
EVYNEKLFDLLAPQSNLNNSSNDFN

SEQ ID NO: 2313037 - protein, 24 aa, Cryptosporidium parvum
EVYSKWLEIILNYFVCNEFSTDEL

SEQ ID NO: 2313038 - protein, 19 aa, Cryptosporidium parvum
EVYVTEPCFTPSPNPLANG

SEQ ID NO: 2313039 - protein, 30 aa, Cryptosporidium parvum; identical to SEQ ID NO: 2189426

SEQ ID NO: 2313040 - protein, 17 aa, Cryptosporidium parvum
EWEEVFSINDLRFLLKQ

SEQ ID NO: 2313041 - protein, 21 aa, Cryptosporidium parvum
EWEKIGWLTASRLLLEIDSQS

SEQ ID NO: 2313042 - protein, 19 aa, Cryptosporidium parvum
EWFKSLFCFECITTLKKTQ

SEQ ID NO: 2313043 - protein, 25 aa, Cryptosporidium parvum
EWGIKYDFWLIEHINQYEYVVPWES

SEQ ID NO: 2313044 - protein, 21 aa, Cryptosporidium parvum
EWKIIFEKLDLIANSGVNVVL

SEQ ID NO: 2313045 - protein, 19 aa, Cryptosporidium parvum
EWLNLYNISKLPHVSVVDP

SEQ ID NO: 2313046 - protein, 20 aa, Cryptosporidium parvum
EWMKHYESMLWDTYEDVKLD

SEQ ID NO: 2313047 - protein, 27 aa, Cryptosporidium parvum
EWNAKLECLILMFIKLIKLQLNEIREE

SEQ ID NO: 2313048 - protein, 27 aa, Cryptosporidium parvum
EWNYSLEWHPFFRPNGNFKYNILKGFQ

SEQ ID NO: 2313049 - protein, 27 aa, Cryptosporidium parvum
EWRNELLSFPHIFNQVFLSLNRFNDYI

SEQ ID NO: 2313050 - protein, 21 aa, Cryptosporidium parvum
EWRRYHQMNMLWSSVITPIVS

SEQ ID NO: 2313051 - protein, 33 aa, Cryptosporidium parvum; identical to SEQ ID NO: 2189437

SEQ ID NO: 2313052 - protein, 25 aa, Cryptosporidium parvum
EWSGIFAINWLYNYLSNMSAPSINV

SEQ ID NO: 2313053 - protein, 20 aa, Cryptosporidium parvum
EWSKMLEMRIFYTQSVLRHF

SEQ ID NO: 2313054 - protein, 31 aa, Cryptosporidium parvum; identical to SEQ ID NO: 2189439

SEQ ID NO: 2313055 - protein, 19 aa, Cryptosporidium parvum
EWTDGVFTAILRKIINSSD

SEQ ID NO: 2313056 - protein, 19 aa, Cryptosporidium parvum
EYCKFCIPHGSYLINLGNP

SEQ ID NO: 2313057 - protein, 19 aa, Cryptosporidium parvum
EYCTASQKNWFIWRDKQNK

SEQ ID NO: 2313058 - protein, 18 aa, Cryptosporidium parvum
EYDIPILSYLKNITSEWT

SEQ ID NO: 2313059 - protein, 25 aa, Cryptosporidium parvum
EYDPNKIKVWILKRGMEKFGDLLFD

SEQ ID NO: 2313060 - protein, 26 aa, Cryptosporidium parvum
EYEALDPENFLYDNNYHEINFNVKGQ

SEQ ID NO: 2313061 - protein, 23 aa, Cryptosporidium parvum
EYEWDFTHEYWNYKNSQNFSNLN

SEQ ID NO: 2313062 - protein, 28 aa, Cryptosporidium parvum
EYFDNAPIIYIPGRRFPVNIYYTKSPEA

SEQ ID NO: 2313063 - protein, 25 aa, Cryptosporidium parvum
EYFEDFLKFIGFHLSIRKDQKVILA

SEQ ID NO: 2313064 - protein, 20 aa, Cryptosporidium parvum
EYGILNSHKRFRKIESSQES

SEQ ID NO: 2313065 - protein, 25 aa, Cryptosporidium parvum
EYIDDLFQGLFYIIIGQQVSQKAQV

SEQ ID NO: 2313066 - protein, 21 aa, Cryptosporidium parvum
EYIRKAITAGFFLQSARINKG

SEQ ID NO: 2313067 - protein, 33 aa, Cryptosporidium parvum
EYKGLTIVPPLWPPLVEWVFPKVSDRFHFVEIS

SEQ ID NO: 2313068 - protein, 21 aa, Cryptosporidium parvum
EYKIAFPHFYNSLPKFVSTSV

SEQ ID NO: 2313069 - protein, 19 aa, Cryptosporidium parvum
EYKIKWMGYSHLHNTWESA

SEQ ID NO: 2313070 - protein, 29 aa, Cryptosporidium parvum
EYKQAISKLLIYISPTLISYKLLVECAIK

SEQ ID NO: 2313071 - protein, 31 aa, Cryptosporidium parvum
EYKVKQRSALFKALILYSLKNKEYMNGESAK

SEQ ID NO: 2313072 - protein, 17 aa, Cryptosporidium parvum
EYLFEWQVLSRRSSIIY

SEQ ID NO: 2313073 - protein, 26 aa, Cryptosporidium parvum
EYLHDCYRRQPVLPGLIICGDFNSTP

SEQ ID NO: 2313074 - protein, 22 aa, Cryptosporidium parvum
EYLKIHRLIPFDDLISLCLGVS

SEQ ID NO: 2313075 - protein, 19 aa, Cryptosporidium parvum
EYMDSSCLNGFLTQGLNSI

SEQ ID NO: 2313076 - protein, 28 aa, Cryptosporidium parvum
EYMKSLELLWLSHIFELSLSKTGSQSFY

SEQ ID NO: 2313077 - protein, 25 aa, Cryptosporidium parvum
EYNGDLIYWSNILNGPIELSSMGVR

SEQ ID NO: 2313078 - protein, 22 aa, Cryptosporidium parvum
EYNSIFPLEKIASHLNISLKFL

SEQ ID NO: 2313079 - protein, 17 aa, Cryptosporidium parvum
EYPIRCAIFVSRKQWII

SEQ ID NO: 2313080 - protein, 43 aa, Cryptosporidium parvum
EYQNKHILFVLNKVDLIPKWVATKWISFYGSIRPTIAFHSSIT

SEQ ID NO: 2313081 - protein, 21 aa, Cryptosporidium parvum
EYRMPYIMGIKVVDSIIIESR

SEQ ID NO: 2313082 - protein, 32 aa, Cryptosporidium parvum
EYSDNSWNPLLLLTAKHLLINDQLPLVRSIDK

SEQ ID NO: 2313083 - protein, 26 aa, Cryptosporidium parvum
EYSPHWSPILVGFIHSALQKLPQNRI

SEQ ID NO: 2313084 - protein, 20 aa, Cryptosporidium parvum
EYSPPILEPIKSISWHNSDV

SEQ ID NO: 2313085 - protein, 27 aa, Cryptosporidium parvum
EYSRNLHLKLLGFLGKRFPPHVTLERN

SEQ ID NO: 2313086 - protein, 19 aa, Cryptosporidium parvum
EYTCHDYYNKDNFLPSLIN

SEQ ID NO: 2313087 - protein, 23 aa, Cryptosporidium parvum
EYVILKFAEFLNLLNYNISKYHN

SEQ ID NO: 2313088 - protein, 24 aa, Cryptosporidium parvum
EYVPRIAWIRVRRNMNTWQYEDEK

SEQ ID NO: 2313089 - protein, 22 aa, Cryptosporidium parvum
EYYFRLILDYRSGDAFQGCILY

SEQ ID NO: 2313090 - protein, 20 aa, Cryptosporidium parvum
EYYNKINLGLISHDPLTAPK

SEQ ID NO: 2313091 - protein, 22 aa, Cryptosporidium parvum
FADFGLLIFVLSAIHPKHHQDV

SEQ ID NO: 2313092 - protein, 30 aa, Cryptosporidium parvum; identical to SEQ ID NO: 2189478

SEQ ID NO: 2313093 - protein, 23 aa, Cryptosporidium parvum
FAEALDVFPRLLAENSGLNSTDL

SEQ ID NO: 2313094 - protein, 27 aa, Cryptosporidium parvum
FAGASIIKHIVLKRIKYGFSQLSKNAI

SEQ ID NO: 2313095 - protein, 17 aa, Cryptosporidium parvum
FAIIKLPEISGGELKIS

SEQ ID NO: 2313096 - protein, 28 aa, Cryptosporidium parvum
FAKDSLELSLLLNFRSLSTKLQTEILHA

SEQ ID NO: 2313097 - protein, 30 aa, Cryptosporidium parvum
FAKLSSMHFYGWKKGLKTGIYYLRTQSATR

SEQ ID NO: 2313098 - protein, 31 aa, Cryptosporidium parvum
FAKYGKIESIKMFNSYFRKGQAWITFSNAVS

SEQ ID NO: 2313099 - protein, 24 aa, Cryptosporidium parvum
FALKVIKDILRPINGDFYHPINLL

SEQ ID NO: 2313100 - protein, 24 aa, Cryptosporidium parvum
FALSILEKCIQFQWKILPFDQKTG

SEQ ID NO: 2313101 - protein, 21 aa, Cryptosporidium parvum
FANALRQIPTILLDNGGYDSA

SEQ ID NO: 2313102 - protein, 20 aa, Cryptosporidium parvum
FAPEEKKYFLKEFHDIILFT

SEQ ID NO: 2313103 - protein, 22 aa, Cryptosporidium parvum
FAPFLDVYWKGDITFRISIFHP

SEQ ID NO: 2313104 - protein, 17 aa, Cryptosporidium parvum
FAQEYLSPVAFSLLLDP

SEQ ID NO: 2313105 - protein, 27 aa, Cryptosporidium parvum
FARLNMTYLVLSKRKLLLLVNEKHVAG

SEQ ID NO: 2313106 - protein, 30 aa, Cryptosporidium parvum; identical to SEQ ID NO: 2189490

SEQ ID NO: 2313107 - protein, 34 aa, Cryptosporidium parvum; identical to SEQ ID NO: 2130496

SEQ ID NO: 2313108 - protein, 30 aa, Cryptosporidium parvum; identical to SEQ ID NO: 2189491

SEQ ID NO: 2313109 - protein, 24 aa, Cryptosporidium parvum
FAVEYSLAQLWISKGIKPDSVLGH

SEQ ID NO: 2313110 - protein, 20 aa, Cryptosporidium parvum
FAVLKQWQRNFYIENVLIAL

SEQ ID NO: 2313111 - protein, 19 aa, Cryptosporidium parvum
FAYRFFSEKKVVWSPIMFT

SEQ ID NO: 2313112 - protein, 22 aa, Cryptosporidium parvum
FCDFKKVSLLPLLFGETTCNQQ

SEQ ID NO: 2313113 - protein, 18 aa, Cryptosporidium parvum
FCGRFILSNFIYAHQHIE

SEQ ID NO: 2313114 - protein, 17 aa, Cryptosporidium parvum
FCIGALDSTTAASCLGK

SEQ ID NO: 2313115 - protein, 18 aa, Cryptosporidium parvum
FCIICNYVNKITPALQSR

SEQ ID NO: 2313116 - protein, 18 aa, Cryptosporidium parvum
FCIKQLCNSSWIVQLRVG

SEQ ID NO: 2313117 - protein, 25 aa, Cryptosporidium parvum
FCKKFNIPLLILGGGGYTIRNVART

SEQ ID NO: 2313118 - protein, 19 aa, Cryptosporidium parvum
FCKTWVSMTPREFYNPVID

SEQ ID NO: 2313119 - protein, 26 aa, Cryptosporidium parvum
FCLLLDSFMKYFTSITLRHIGDLLRR

SEQ ID NO: 2313120 - protein, 17 aa, Cryptosporidium parvum
FCLTILSSGKLINTLSN

SEQ ID NO: 2313121 - protein, 24 aa, Cryptosporidium parvum
FCNKAKLISCCNARLIPQIPRCDL

SEQ ID NO: 2313122 - protein, 29 aa, Cryptosporidium parvum
FCNLTPIQNYLYRRFLRSSACKKLLDSDS

SEQ ID NO: 2313123 - protein, 32 aa, Cryptosporidium parvum; identical to SEQ ID NO: 2189498

SEQ ID NO: 2313124 - protein, 18 aa, Cryptosporidium parvum
FCNPMTPHRVYEVSILLL

SEQ ID NO: 2313125 - protein, 17 aa, Cryptosporidium parvum
FCPIIDDENAFFSKNKN

SEQ ID NO: 2313126 - protein, 17 aa, Cryptosporidium parvum
FCPSIKAVKFLGNGQER

SEQ ID NO: 2313127 - protein, 24 aa, Cryptosporidium parvum
FCRGHLVEMILSCNISGYLEFQGI

SEQ ID NO: 2313128 - protein, 18 aa, Cryptosporidium parvum
FCRGILSKGIVEIFDIRK

SEQ ID NO: 2313129 - protein, 19 aa, Cryptosporidium parvum
FCRGVPDPKIRIYDVGRKK

SEQ ID NO: 2313130 - protein, 17 aa, Cryptosporidium parvum
FCYGYFPDQVILFILKN

SEQ ID NO: 2313131 - protein, 17 aa, Cryptosporidium parvum
FDAICKLCDGFNGADMR

SEQ ID NO: 2313132 - protein, 19 aa, Cryptosporidium parvum
FDAPPLPDFPLAQDLCIRL

SEQ ID NO: 2313133 - protein, 26 aa, Cryptosporidium parvum
FDCEYRLYKYFFPLNHERTKISKFPK

SEQ ID NO: 2313134 - protein, 23 aa, Cryptosporidium parvum
FDCKFFHTIFKTVKRYLNQTDQK

SEQ ID NO: 2313135 - protein, 31 aa, Cryptosporidium parvum; identical to SEQ ID NO: 2189510

SEQ ID NO: 2313136 - protein, 25 aa, Cryptosporidium parvum
FDFEVHDFIFLSEDYKKLAFLMTDR

SEQ ID NO: 2313137 - protein, 34 aa, Cryptosporidium parvum; identical to SEQ ID NO: 2189512

SEQ ID NO: 2313138 - protein, 21 aa, Cryptosporidium parvum
FDGRNFLQHYQLFEIGFNVYP

SEQ ID NO: 2313139 - protein, 31 aa, Cryptosporidium parvum
FDHHIFRLRIIQKFDWPLPLLFTKKNMEHYY

SEQ ID NO: 2313140 - protein, 33 aa, Cryptosporidium parvum; identical to SEQ ID NO: 2189515

SEQ ID NO: 2313141 - protein, 20 aa, Cryptosporidium parvum
FDHRASWYSMEKPTLFDILD

SEQ ID NO: 2313142 - protein, 26 aa, Cryptosporidium parvum
FDKGILSFVFLIDTVYNIIPGTNETL

SEQ ID NO: 2313143 - protein, 28 aa, Cryptosporidium parvum
FDKTKNDLPLFIRLLQDGSSEAVLSSGC

SEQ ID NO: 2313144 - protein, 19 aa, Cryptosporidium parvum
FDKYGVRFGVSGMQGWRVS

SEQ ID NO: 2313145 - protein, 37 aa, Cryptosporidium parvum
FDLACRSYFKAYIIPLQIDAIKFLTELYFKLEDSPQS

SEQ ID NO: 2313146 - protein, 17 aa, Cryptosporidium parvum
FDLILNKMEIKLSELNI

SEQ ID NO: 2313147 - protein, 27 aa, Cryptosporidium parvum
FDNLSEAIARLLPYHTFYVDEIKSNRI

SEQ ID NO: 2313148 - protein, 24 aa, Cryptosporidium parvum
FDNPRSFRPIFRAVLRVLSAGFSS

SEQ ID NO: 2313149 - protein, 32 aa, Cryptosporidium parvum; identical to SEQ ID NO: 2189524

SEQ ID NO: 2313150 - protein, 25 aa, Cryptosporidium parvum
FDQNYTVAIIYPLNGAQPIRCPTNF

SEQ ID NO: 2313151 - protein, 23 aa, Cryptosporidium parvum
FDQPAFKNIIVNGLVLASDGKKM

SEQ ID NO: 2313152 - protein, 25 aa, Cryptosporidium parvum
FDRIELIISIFSLLLEIINRGILPK

SEQ ID NO: 2313153 - protein, 34 aa, Cryptosporidium parvum
FDRKFKRRCKPDYYQFFFGYLDYEKEKKDKISGL

SEQ ID NO: 2313154 - protein, 23 aa, Cryptosporidium parvum
FDRKRTVFIGGLPKFCTEDELRR

SEQ ID NO: 2313155 - protein, 19 aa, Cryptosporidium parvum
FDRLFVVKASVLEIGEDSS

SEQ ID NO: 2313156 - protein, 19 aa, Cryptosporidium parvum
FDSIYIPYSLVKSNSLEEI

SEQ ID NO: 2313157 - protein, 25 aa, Cryptosporidium parvum
FDSPDIISDWYFKKSKNIVLMNKPW

SEQ ID NO: 2313158 - protein, 34 aa, Cryptosporidium parvum
FDSVIEYVKLFRNKISSILLLNNISRDFRTDIDI

SEQ ID NO: 2313159 - protein, 25 aa, Cryptosporidium parvum
FDTSKSKWMVVLKLSPELISISLNH

SEQ ID NO: 2313160 - protein, 18 aa, Cryptosporidium parvum
FDVAIIELLFSYVNPVDL

SEQ ID NO: 2313161 - protein, 22 aa, Cryptosporidium parvum
FDVDRKHILSFNKKWEKPSKYH

SEQ ID NO: 2313162 - protein, 27 aa, Cryptosporidium parvum
FDVPSVVKALIIPPKGYDGRVSKEYIT

SEQ ID NO: 2313163 - protein, 23 aa, Cryptosporidium parvum
FEASAFFPNLFGTLSTSKFSIAT

SEQ ID NO: 2313164 - protein, 20 aa, Cryptosporidium parvum
FEAYIDILRDQMMGMGELEH

SEQ ID NO: 2313165 - protein, 30 aa, Cryptosporidium parvum; identical to SEQ ID NO: 2189535

SEQ ID NO: 2313166 - protein, 23 aa, Cryptosporidium parvum
FEDINSLLFRHSPPQMNGDELAN

SEQ ID NO: 2313167 - protein, 17 aa, Cryptosporidium parvum
FEDNSYDALYEKMVWLH

SEQ ID NO: 2313168 - protein, 26 aa, Cryptosporidium parvum
FEEFCQILVYLMTSQNLFGVGAFYGT

SEQ ID NO: 2313169 - protein, 28 aa, Cryptosporidium parvum
FEEFDSCLNMKYFPPKKIDWNGLLGDNK

SEQ ID NO: 2313170 - protein, 19 aa, Cryptosporidium parvum
FEELFDWLIQILDDEESSI

SEQ ID NO: 2313171 - protein, 17 aa, Cryptosporidium parvum
FEESVLLIKSGLENPVH

SEQ ID NO: 2313172 - protein, 29 aa, Cryptosporidium parvum
FEFENMDLHILSFLSYNITLSLRSLCSIK

SEQ ID NO: 2313173 - protein, 18 aa, Cryptosporidium parvum
FEGLKNVIKGKYVINPII

SEQ ID NO: 2313174 - protein, 26 aa, Cryptosporidium parvum
FEGSVRDLFLMKIRDSFMDVQFTSEV

SEQ ID NO: 2313175 - protein, 19 aa, Cryptosporidium parvum
FEHLAAAVHLFPEKETHPT

SEQ ID NO: 2313176 - protein, 17 aa, Cryptosporidium parvum
FEIIFGYSKFVHNKIIK

SEQ ID NO: 2313177 - protein, 21 aa, Cryptosporidium parvum
FEILRFFLLDLFQISKKAQAI

SEQ ID NO: 2313178 - protein, 29 aa, Cryptosporidium parvum
FEITIYVLEKIPYLFWYHSSGKMQKEELN

SEQ ID NO: 2313179 - protein, 28 aa, Cryptosporidium parvum
FEKYPTQVLLVAWMSWWTKLTEESFSSG

SEQ ID NO: 2313180 - protein, 27 aa, Cryptosporidium parvum
FELCSLSLFMQILSYNPIDLNLILLKS

SEQ ID NO: 2313181 - protein, 21 aa, Cryptosporidium parvum
FELKTEPYINLSKEQLYKIIY

SEQ ID NO: 2313182 - protein, 17 aa, Cryptosporidium parvum
FELLLNMNIRRTFSLDH

SEQ ID NO: 2313183 - protein, 19 aa, Cryptosporidium parvum
FELLRLETTIFPFLESNKA

SEQ ID NO: 2313184 - protein, 17 aa, Cryptosporidium parvum
FELPPLPYDKKALEPVI

SEQ ID NO: 2313185 - protein, 19 aa, Cryptosporidium parvum
FELRAYLVGQIARIISVFG

SEQ ID NO: 2313186 - protein, 22 aa, Cryptosporidium parvum
FEMAIKEKWRLQKISWKYCILD

SEQ ID NO: 2313187 - protein, 28 aa, Cryptosporidium parvum
FEMANEAFFRDYILRHLNNYFDLSNRQQ

SEQ ID NO: 2313188 - protein, 26 aa, Cryptosporidium parvum
FEMPNIQLIFSFLYNPSSFNFISKGQ

SEQ ID NO: 2313189 - protein, 17 aa, Cryptosporidium parvum
FENKFVIALPPPNVTGR

SEQ ID NO: 2313190 - protein, 26 aa, Cryptosporidium parvum
FENLRDLNIELLYTTPFSLLIGSEGL

SEQ ID NO: 2313191 - protein, 18 aa, Cryptosporidium parvum
FENPSLPLTFVLTSITKP

SEQ ID NO: 2313192 - protein, 24 aa, Cryptosporidium parvum
FENSPFPYINTKSGAFFLNNSSFQ

SEQ ID NO: 2313193 - protein, 18 aa, Cryptosporidium parvum
FENYLPKKKVIGPIGSYI

SEQ ID NO: 2313194 - protein, 17 aa, Cryptosporidium parvum
FEQQGIWEGIYYVVGSN

SEQ ID NO: 2313195 - protein, 29 aa, Cryptosporidium parvum
FERFGAIRDVYLPLDYRSRRPRGFGFVEY

SEQ ID NO: 2313196 - protein, 19 aa, Cryptosporidium parvum
FERISGRFTEPKILRFIRV

SEQ ID NO: 2313197 - protein, 21 aa, Cryptosporidium parvum
FERIVHMVITYLGGKIGFYSG

SEQ ID NO: 2313198 - protein, 17 aa, Cryptosporidium parvum
FERLIVLDHKSYKFYII

SEQ ID NO: 2313199 - protein, 24 aa, Cryptosporidium parvum
FERPGFICLKPEPSSISSISKEMR

SEQ ID NO: 2313200 - protein, 25 aa, Cryptosporidium parvum
FESKFFIRKTKLIDLIFPIIHGIER

SEQ ID NO: 2313201 - protein, 24 aa, Cryptosporidium parvum
FESSLRLLKDVLLVQPNKLVSSNG

SEQ ID NO: 2313202 - protein, 20 aa, Cryptosporidium parvum
FESSLVQKLLFLIKLDNSIS

SEQ ID NO: 2313203 - protein, 18 aa, Cryptosporidium parvum
FETLFEFISKYNVALKQE

SEQ ID NO: 2313204 - protein, 26 aa, Cryptosporidium parvum
FETLIKELNLILLKTNDRKQIIDSLS

SEQ ID NO: 2313205 - protein, 26 aa, Cryptosporidium parvum
FEVACYKNKILNWRSGVEWDLDEVLQ

SEQ ID NO: 2313206 - protein, 25 aa, Cryptosporidium parvum
FEVDGPYKCFFIPASDKQNKLLKKR

SEQ ID NO: 2313207 - protein, 17 aa, Cryptosporidium parvum
FEVIISPLLRRSCSSYG

SEQ ID NO: 2313208 - protein, 19 aa, Cryptosporidium parvum
FEVSFIKIIELLGHIFNYE

SEQ ID NO: 2313209 - protein, 19 aa, Cryptosporidium parvum
FEVYIYIYIYIYIQTNKGF

SEQ ID NO: 2313210 - protein, 19 aa, Cryptosporidium parvum
FEWTNIFSSFSRPSDLALD

SEQ ID NO: 2313211 - protein, 17 aa, Cryptosporidium parvum
FEYEFKDNKLDVEALIE

SEQ ID NO: 2313212 - protein, 18 aa, Cryptosporidium parvum
FEYILKSTNILLNELEST

SEQ ID NO: 2313213 - protein, 21 aa, Cryptosporidium parvum
FEYTELNSSLNWIWRYNGVVI

SEQ ID NO: 2313214 - protein, 19 aa, Cryptosporidium parvum
FFDFILKSHVSDPKLNLSH

SEQ ID NO: 2313215 - protein, 21 aa, Cryptosporidium parvum
FFESGFFFYIFSGETSSDQNN

SEQ ID NO: 2313216 - protein, 21 aa, Cryptosporidium parvum
FFFESPILFEVDIADLLRLCE

SEQ ID NO: 2313217 - protein, 20 aa, Cryptosporidium parvum
FFIMSNLEKLVICGVRSFSP

SEQ ID NO: 2313218 - protein, 17 aa, Cryptosporidium parvum
FFKPYKIGIESPSICEA

SEQ ID NO: 2313219 - protein, 20 aa, Cryptosporidium parvum
FFLASKLSDSLLLYSKNNNF

SEQ ID NO: 2313220 - protein, 28 aa, Cryptosporidium parvum
FFLHENRYYLSLEYFPQTLLQYLEKSPK

SEQ ID NO: 2313221 - protein, 26 aa, Cryptosporidium parvum
FFLKKVPIFVSFSYLNDSIWVCDPNY

SEQ ID NO: 2313222 - protein, 18 aa, Cryptosporidium parvum
FFLMKRKDKNEIINTNYI

SEQ ID NO: 2313223 - protein, 42 aa, Cryptosporidium parvum
FFNSQIKLFSSLIFNIYRYPLIFVYNYKKRKCFFAHLTPEFE

SEQ ID NO: 2313224 - protein, 20 aa, Cryptosporidium parvum
FFPNEFQLPMPIEEAKRRLR

SEQ ID NO: 2313225 - protein, 17 aa, Cryptosporidium parvum
FFQNNIKIPFGSSIKFI

SEQ ID NO: 2313226 - protein, 26 aa, Cryptosporidium parvum
FFSDLWSTGMAYKIVIITNAGLRTVE

SEQ ID NO: 2313227 - protein, 28 aa, Cryptosporidium parvum
FFSNLKSYLNFISIYNQISKQGSINYTL

SEQ ID NO: 2313228 - protein, 20 aa, Cryptosporidium parvum
FFSRSNLELIYRAESPFGLE

SEQ ID NO: 2313229 - protein, 17 aa, Cryptosporidium parvum
FFTLYEYEQWRKNNSSN

SEQ ID NO: 2313230 - protein, 28 aa, Cryptosporidium parvum
FFVTCPPISPFIRSYYGAALMLQHEKIN

SEQ ID NO: 2313231 - protein, 31 aa, Cryptosporidium parvum; identical to SEQ ID NO: 2189599

SEQ ID NO: 2313232 - protein, 24 aa, Cryptosporidium parvum
FGALFLSLLDLKPEIVCEFMEMII

SEQ ID NO: 2313233 - protein, 19 aa, Cryptosporidium parvum
FGCDVPYNNYLINRGQQLR

SEQ ID NO: 2313234 - protein, 22 aa, Cryptosporidium parvum
FGCPLKVYIKNSGKFEYIYIYI

SEQ ID NO: 2313235 - protein, 20 aa, Cryptosporidium parvum
FGDDFVFHPKIPFVCKIEMK

SEQ ID NO: 2313236 - protein, 35 aa, Cryptosporidium parvum
FGDIFKDFCLFLLSFRANFVLKIINELFLAIKNLF

SEQ ID NO: 2313237 - protein, 17 aa, Cryptosporidium parvum
FGDLRPSWSLYYLLKKI

SEQ ID NO: 2313238 - protein, 23 aa, Cryptosporidium parvum
FGDNNLSLPFIWEKKFEQEKKGS

SEQ ID NO: 2313239 - protein, 23 aa, Cryptosporidium parvum
FGDSSIRILPIASGYLLSDYIGI

SEQ ID NO: 2313240 - protein, 29 aa, Cryptosporidium parvum
FGDYTDTLINYLNIWRDVKQSRNIKSYSN

SEQ ID NO: 2313241 - protein, 53 aa, Cryptosporidium parvum
FGDYTQLTLIPLENYIIFFISIIDYSLRFFLENDLIYLLNPIQSSVRTETLNL

SEQ ID NO: 2313242 - protein, 29 aa, Cryptosporidium parvum
FGETVNWRWILINYCLPLSLKRLNIKNLS

SEQ ID NO: 2313243 - protein, 18 aa, Cryptosporidium parvum
FGFSPKLLESIKIIGYSL

SEQ ID NO: 2313244 - protein, 31 aa, Cryptosporidium parvum; identical to SEQ ID NO: 2189611

SEQ ID NO: 2313245 - protein, 30 aa, Cryptosporidium parvum; identical to SEQ ID NO: 2189613

SEQ ID NO: 2313246 - protein, 31 aa, Cryptosporidium parvum; identical to SEQ ID NO: 2189614

SEQ ID NO: 2313247 - protein, 21 aa, Cryptosporidium parvum
FGGLMCSNSDFRRISPLLGVL

SEQ ID NO: 2313248 - protein, 23 aa, Cryptosporidium parvum
FGIAAVCLFTIFNLPETTDERRY

SEQ ID NO: 2313249 - protein, 26 aa, Cryptosporidium parvum
FGIDFRNYLRILQKNKIYGSYKFSTI

SEQ ID NO: 2313250 - protein, 19 aa, Cryptosporidium parvum
FGIIHKPKIILLNINNIFS

SEQ ID NO: 2313251 - protein, 27 aa, Cryptosporidium parvum
FGIKILKIVFLILINYNIFPGVNGKSA

SEQ ID NO: 2313252 - protein, 21 aa, Cryptosporidium parvum
FGISRFLNFGFTTTPQLHFMV

SEQ ID NO: 2313253 - protein, 19 aa, Cryptosporidium parvum
FGISSTLELLKKRGNISSS

SEQ ID NO: 2313254 - protein, 32 aa, Cryptosporidium parvum; identical to SEQ ID NO: 2189621

SEQ ID NO: 2313255 - protein, 24 aa, Cryptosporidium parvum
FGKRTLFHVLRQYASLLSDKKHVS

SEQ ID NO: 2313256 - protein, 27 aa, Cryptosporidium parvum
FGKSRRNTIRWNPSGKWFAYGGFGNLA

SEQ ID NO: 2313257 - protein, 29 aa, Cryptosporidium parvum
FGLDEFSHLWIIFIFDDVPQDITINSKIR

SEQ ID NO: 2313258 - protein, 27 aa, Cryptosporidium parvum
FGLKMMFDWNFEFNWYEDFTDVIPIAS

SEQ ID NO: 2313259 - protein, 24 aa, Cryptosporidium parvum
FGLSYEEYLEYYTLKRNCDKQEII

SEQ ID NO: 2313260 - protein, 19 aa, Cryptosporidium parvum
FGMEGIFIVKSDPSTIMLD

SEQ ID NO: 2313261 - protein, 19 aa, Cryptosporidium parvum
FGMSCGVLTPIIPAATRRM

SEQ ID NO: 2313262 - protein, 24 aa, Cryptosporidium parvum
FGNWIPFGWCEFFVKLFETNSKHY

SEQ ID NO: 2313263 - protein, 25 aa, Cryptosporidium parvum
FGNYVLHIGILLQGKIEISPELKSL

SEQ ID NO: 2313264 - protein, 18 aa, Cryptosporidium parvum
FGPKCYNYWKFPDINVFV

SEQ ID NO: 2313265 - protein, 33 aa, Cryptosporidium parvum; identical to SEQ ID NO: 2189628

SEQ ID NO: 2313266 - protein, 24 aa, Cryptosporidium parvum
FGQPFYKHIIFENIPLFGCNIVQF

SEQ ID NO: 2313267 - protein, 26 aa, Cryptosporidium parvum
FGRSEGAWLYRWEYIPESIDNLFMEN

SEQ ID NO: 2313268 - protein, 26 aa, Cryptosporidium parvum
FGSSLYNKLLPIFYQNLGGSLSEDGT

SEQ ID NO: 2313269 - protein, 26 aa, Cryptosporidium parvum
FGTSHDIEELSKWFSKMVGKFETFGL

SEQ ID NO: 2313270 - protein, 24 aa, Cryptosporidium parvum
FGTSTILRFLARGSPYTNLYGRTD

SEQ ID NO: 2313271 - protein, 28 aa, Cryptosporidium parvum
FGTTNLKKQMLLWLNDNEVSLFDNDSTI

SEQ ID NO: 2313272 - protein, 25 aa, Cryptosporidium parvum
FGTVLIPDALLSHLPDMKILISEIN

SEQ ID NO: 2313273 - protein, 17 aa, Cryptosporidium parvum
FGVFILYGDFFGVDTYS

SEQ ID NO: 2313274 - protein, 21 aa, Cryptosporidium parvum
FHASEPWILSGLYNGTITVHD

SEQ ID NO: 2313275 - protein, 19 aa, Cryptosporidium parvum
FHDEDSLVYIIYRDAPNIS

SEQ ID NO: 2313276 - protein, 18 aa, Cryptosporidium parvum
FHDWFLSFKDSNNYDSKQ

SEQ ID NO: 2313277 - protein, 27 aa, Cryptosporidium parvum
FHKFQRARIYYKNKSLFKLMGNCNDHN

SEQ ID NO: 2313278 - protein, 18 aa, Cryptosporidium parvum
FHLSCRIFDTFLIETHVQ

SEQ ID NO: 2313279 - protein, 31 aa, Cryptosporidium parvum; identical to SEQ ID NO: 2189639

SEQ ID NO: 2313280 - protein, 18 aa, Cryptosporidium parvum
FHLYYKKRIEDFKNGVSI

SEQ ID NO: 2313281 - protein, 17 aa, Cryptosporidium parvum
FHNIMKLFYSEKYSQMI

SEQ ID NO: 2313282 - protein, 18 aa, Cryptosporidium parvum
FHNKYYSSNNMFLTLVSN

SEQ ID NO: 2313283 - protein, 24 aa, Cryptosporidium parvum
FHRGDILSMKYVFLGDYVDGGKFS

SEQ ID NO: 2313284 - protein, 17 aa, Cryptosporidium parvum
FHRLKHLTIFIEENQDL

SEQ ID NO: 2313285 - protein, 23 aa, Cryptosporidium parvum
FHSSFSKIIWKKVKTKLPTESEI

SEQ ID NO: 2313286 - protein, 17 aa, Cryptosporidium parvum
FHSSNKFALKPLRELKQ

SEQ ID NO: 2313287 - protein, 19 aa, Cryptosporidium parvum
FHTTKLIGEGSFAKVYKGK

SEQ ID NO: 2313288 - protein, 17 aa, Cryptosporidium parvum
FIAVNRNGQIRIFMNIP

SEQ ID NO: 2313289 - protein, 20 aa, Cryptosporidium parvum
FICCTIAPCKSIQGGDPIPN

SEQ ID NO: 2313290 - protein, 22 aa, Cryptosporidium parvum
FICEIPVNIKTLFMKIVKESAE

SEQ ID NO: 2313291 - protein, 26 aa, Cryptosporidium parvum
FICRNNIQLILKYLLENYIVVICNLN

SEQ ID NO: 2313292 - protein, 17 aa, Cryptosporidium parvum
FIDDSKILTYRSGSFIQ

SEQ ID NO: 2313293 - protein, 27 aa, Cryptosporidium parvum
FIDEFRGLLYVLYLNSDIDVFLIPIGN

SEQ ID NO: 2313294 - protein, 33 aa, Cryptosporidium parvum
FIDSFTIIFNTFGFLQYMRQLLNYLKNVFQQIL

SEQ ID NO: 2313295 - protein, 23 aa, Cryptosporidium parvum
FIEARDWCVLIGPKECIFPKTCY

SEQ ID NO: 2313296 - protein, 17 aa, Cryptosporidium parvum
FIECELWRLHPAEKYQV

SEQ ID NO: 2313297 - protein, 36 aa, Cryptosporidium parvum
FIEEPFIRNIPSTLLSTLELKRLRYFTIKSIPTSIS

SEQ ID NO: 2313298 - protein, 26 aa, Cryptosporidium parvum
FIELVKALFPTLYDLKFILKQLSSLS

SEQ ID NO: 2313299 - protein, 23 aa, Cryptosporidium parvum
FIESYFQSFPPENFEGATLLVAG

SEQ ID NO: 2313300 - protein, 20 aa, Cryptosporidium parvum
FIFDSINIYSNPNKLSWKLV

SEQ ID NO: 2313301 - protein, 21 aa, Cryptosporidium parvum
FIFPNSILQYSNSRLFLTLLS

SEQ ID NO: 2313302 - protein, 18 aa, Cryptosporidium parvum
FIFSNGYCFKFNLNSKHG

SEQ ID NO: 2313303 - protein, 18 aa, Cryptosporidium parvum
FIGCGRRLYGVGGGCFDG

SEQ ID NO: 2313304 - protein, 17 aa, Cryptosporidium parvum
FIGMLQNLGQYTGIIFC

SEQ ID NO: 2313305 - protein, 26 aa, Cryptosporidium parvum
FIGSHLVEYLLSKGYYVLALDNFFSG

SEQ ID NO: 2313306 - protein, 20 aa, Cryptosporidium parvum
FIHGPRFRLRNNNPPRILIC

SEQ ID NO: 2313307 - protein, 17 aa, Cryptosporidium parvum
FIHPYMMNDFVDHKDFN

SEQ ID NO: 2313308 - protein, 17 aa, Cryptosporidium parvum
FIININFSLIFIDNYGI

SEQ ID NO: 2313309 - protein, 23 aa, Cryptosporidium parvum
FIKDWKLSKVWSKELIEYTWLSK

SEQ ID NO: 2313310 - protein, 26 aa, Cryptosporidium parvum
FIKESINLILIEEFGLDLDLLGLSLE

SEQ ID NO: 2313311 - protein, 29 aa, Cryptosporidium parvum
FIKEWMDSIIIPPRLAIEANILIHQKKYK

SEQ ID NO: 2313312 - protein, 19 aa, Cryptosporidium parvum
FIKHIIFEILKGIFHLHMH

SEQ ID NO: 2313313 - protein, 46 aa, Cryptosporidium parvum
FIKNEELLLNFWPITNLYCYLFDQYYQFFQIILQKLKQGEFSFIKN

SEQ ID NO: 2313314 - protein, 18 aa, Cryptosporidium parvum
FIKVVNKKQKAPDGTVIH

SEQ ID NO: 2313315 - protein, 19 aa, Cryptosporidium parvum
FILDKFDICPIDRLFTLKP

SEQ ID NO: 2313316 - protein, 28 aa, Cryptosporidium parvum
FIMDGTDPIAFLSYYTKSDLKVSRGEKS

SEQ ID NO: 2313317 - protein, 18 aa, Cryptosporidium parvum
FIMNHEIIEFIFLENSEI

SEQ ID NO: 2313318 - protein, 45 aa, Cryptosporidium parvum
FIMSIKRQLLTELLLIEWMEAFFAHLRLALLPSDFLVYSHRHDLV

SEQ ID NO: 2313319 - protein, 18 aa, Cryptosporidium parvum
FINAFRFLEDTFISETIT

SEQ ID NO: 2313320 - protein, 21 aa, Cryptosporidium parvum
FINAGIYILSKRILDLIKPNQ

SEQ ID NO: 2313321 - protein, 25 aa, Cryptosporidium parvum
FINDSKVIQMAWRRKQNYSFECEEL

SEQ ID NO: 2313322 - protein, 18 aa, Cryptosporidium parvum
FINFEKCELWGLVKDEET

SEQ ID NO: 2313323 - protein, 27 aa, Cryptosporidium parvum
FINLMEGDLFAYRLRILFKQSNISIYM

SEQ ID NO: 2313324 - protein, 18 aa, Cryptosporidium parvum
FINYFGLQRFGTSEIPTY

SEQ ID NO: 2313325 - protein, 17 aa, Cryptosporidium parvum
FIPCYDVIPPKFINAIV

SEQ ID NO: 2313326 - protein, 18 aa, Cryptosporidium parvum
FIPIFNKNDNINILIQLI

SEQ ID NO: 2313327 - protein, 23 aa, Cryptosporidium parvum
FISDNGIPLIALWLHSENVGVRE

SEQ ID NO: 2313328 - protein, 21 aa, Cryptosporidium parvum
FISHILPNRKPVSPTLTGLQG

SEQ ID NO: 2313329 - protein, 18 aa, Cryptosporidium parvum
FITADARGPKHLQIKLSR

SEQ ID NO: 2313330 - protein, 20 aa, Cryptosporidium parvum
FITDIDLFDNTFFGLSSTEA

SEQ ID NO: 2313331 - protein, 29 aa, Cryptosporidium parvum
FITNSNIPCPLFRQLWSEFEWENKIPIHT

SEQ ID NO: 2313332 - protein, 17 aa, Cryptosporidium parvum
FIVDNKYMSLFLPENFS

SEQ ID NO: 2313333 - protein, 20 aa, Cryptosporidium parvum
FIVLACDGIWDVVDNQLCVD

SEQ ID NO: 2313334 - protein, 17 aa, Cryptosporidium parvum
FIWGYNNDNIYKINIIN

SEQ ID NO: 2313335 - protein, 17 aa, Cryptosporidium parvum
FIYKLKCVFLCHPSLSS

SEQ ID NO: 2313336 - protein, 18 aa, Cryptosporidium parvum
FIYTKYYLDKEISRDLYE

SEQ ID NO: 2313337 - protein, 23 aa, Cryptosporidium parvum
FKADIIGVCSISIDMSSIGIPSQ

SEQ ID NO: 2313338 - protein, 25 aa, Cryptosporidium parvum
FKDLDYKAIFTWKRFNQIKYVLDTR

SEQ ID NO: 2313339 - protein, 26 aa, Cryptosporidium parvum
FKDLNNWMINLYDRILFSKKDSFQTE

SEQ ID NO: 2313340 - protein, 19 aa, Cryptosporidium parvum
FKDSFFIKQSISSNCYTFI

SEQ ID NO: 2313341 - protein, 19 aa, Cryptosporidium parvum
FKEILQAQIYYMFNCREDQ

SEQ ID NO: 2313342 - protein, 25 aa, Cryptosporidium parvum
FKELESKIFIIMADSLNKLKEIKLE

SEQ ID NO: 2313343 - protein, 26 aa, Cryptosporidium parvum
FKEMLSITVLLHYLCIGNDSPLMKEL

SEQ ID NO: 2313344 - protein, 17 aa, Cryptosporidium parvum
FKGGGFNSSKASRSSSN

SEQ ID NO: 2313345 - protein, 23 aa, Cryptosporidium parvum
FKGILKVDLFGDGIIRLLAIKTR

SEQ ID NO: 2313346 - protein, 40 aa, Cryptosporidium parvum
FKIAECIKPALAKSPAWLRFIDICLNEIFQKLDLKDLKTL

SEQ ID NO: 2313347 - protein, 31 aa, Cryptosporidium parvum
FKIKASIGSLLIFLSSLWRSSISKDPRAVFE

SEQ ID NO: 2313348 - protein, 22 aa, Cryptosporidium parvum
FKIMSLYDRAITVFSPDGHLLQ

SEQ ID NO: 2313349 - protein, 17 aa, Cryptosporidium parvum
FKKDVLCLAYLFDHFNL

SEQ ID NO: 2313350 - protein, 30 aa, Cryptosporidium parvum
FKLLKQVRDIWKFQDLYRAPGPLQFEGPCS

SEQ ID NO: 2313351 - protein, 19 aa, Cryptosporidium parvum
FKLLLIGDSGVGKSCLLLR

SEQ ID NO: 2313352 - protein, 17 aa, Cryptosporidium parvum
FKLLSQKSSSLLKLSPT

SEQ ID NO: 2313353 - protein, 17 aa, Cryptosporidium parvum
FKMVECYIRGNNIKLIR

SEQ ID NO: 2313354 - protein, 29 aa, Cryptosporidium parvum
FKNDKNILEIFPDLPISLAVPPDLSHITP

SEQ ID NO: 2313355 - protein, 19 aa, Cryptosporidium parvum
FKNLPKIKYKFIKSCSIGK

SEQ ID NO: 2313356 - protein, 17 aa, Cryptosporidium parvum
FKNLSLFDMVYILCEDN

SEQ ID NO: 2313357 - protein, 26 aa, Cryptosporidium parvum
FKNQSYNFFLITSKYFKLLDQYNISD

SEQ ID NO: 2313358 - protein, 25 aa, Cryptosporidium parvum
FKNSIKFIPPLPYETIRSIKLLEMN

SEQ ID NO: 2313359 - protein, 17 aa, Cryptosporidium parvum
FKPKCVLPLLIGDFTLY

SEQ ID NO: 2313360 - protein, 17 aa, Cryptosporidium parvum
FKQLNREDLINESKLEI

SEQ ID NO: 2313361 - protein, 26 aa, Cryptosporidium parvum
FKQRKLAFDFYPALTMVGTPSPNITS

SEQ ID NO: 2313362 - protein, 17 aa, Cryptosporidium parvum
FKRFLRLQGFQSQDQYK

SEQ ID NO: 2313363 - protein, 17 aa, Cryptosporidium parvum
FKRLINKVNIVRETSSK

SEQ ID NO: 2313364 - protein, 30 aa, Cryptosporidium parvum; identical to SEQ ID NO: 2189725

SEQ ID NO: 2313365 - protein, 20 aa, Cryptosporidium parvum
FKSHLYYSRFLLEQLVNSNW

SEQ ID NO: 2313366 - protein, 19 aa, Cryptosporidium parvum
FKSKGWFDPIGVKLSVFSQ

SEQ ID NO: 2313367 - protein, 18 aa, Cryptosporidium parvum
FKSLAVHICSLSYLLLNG

SEQ ID NO: 2313368 - protein, 34 aa, Cryptosporidium parvum
FKSYQNFAFIKFYDLNILCDCPLICKNDLNYNIN

SEQ ID NO: 2313369 - protein, 24 aa, Cryptosporidium parvum
FKTIPERLLMERRMIMSRSSDSNS

SEQ ID NO: 2313370 - protein, 22 aa, Cryptosporidium parvum
FKTKRDFLLKNILQLYEISVHN

SEQ ID NO: 2313371 - protein, 25 aa, Cryptosporidium parvum
FKVCVDFWLHFTQQLVYDVLDNSKK

SEQ ID NO: 2313372 - protein, 26 aa, Cryptosporidium parvum
FKVLRKRLLCFSASTAFWIPYTFSNE

SEQ ID NO: 2313373 - protein, 30 aa, Cryptosporidium parvum
FKVWSPHIVSPYVLSLYLKSFTSPQFHCST

SEQ ID NO: 2313374 - protein, 18 aa, Cryptosporidium parvum
FKYIIIGDTAVGKSCLLL

SEQ ID NO: 2313375 - protein, 21 aa, Cryptosporidium parvum
FLARPEFPKWLGKNSTTNKNK

SEQ ID NO: 2313376 - protein, 19 aa, Cryptosporidium parvum
FLDDGSLFSFDYFFYDTKS

SEQ ID NO: 2313377 - protein, 21 aa, Cryptosporidium parvum
FLDFKFLARPVVSLDMKILCK

SEQ ID NO: 2313378 - protein, 23 aa, Cryptosporidium parvum
FLDGKIWFRHYQIAPTTERDHNN

SEQ ID NO: 2313379 - protein, 24 aa, Cryptosporidium parvum
FLDRTIRVWFRTDQQLFLEEEREK

SEQ ID NO: 2313380 - protein, 18 aa, Cryptosporidium parvum
FLEKVRVIWKHDNEFKHE

SEQ ID NO: 2313381 - protein, 36 aa, Cryptosporidium parvum
FLESMQSYLKLPNGKKFPIPIRFDKKGIPKDCKGED

SEQ ID NO: 2313382 - protein, 19 aa, Cryptosporidium parvum
FLFKVLITEDLYNNILNCI

SEQ ID NO: 2313383 - protein, 24 aa, Cryptosporidium parvum
FLGEGSYFRAYRGRKLFSFNKDSV

SEQ ID NO: 2313384 - protein, 25 aa, Cryptosporidium parvum
FLGERAIEFVSELWEYISKFSGNPI

SEQ ID NO: 2313385 - protein, 24 aa, Cryptosporidium parvum
FLGGGELFEWIAQKGAYSEDQAKI

SEQ ID NO: 2313386 - protein, 19 aa, Cryptosporidium parvum
FLIVFLKSLEHKLKNDIYL

SEQ ID NO: 2313387 - protein, 25 aa, Cryptosporidium parvum
FLKEFYGVLDFGSVLKVNILALDSI

SEQ ID NO: 2313388 - protein, 20 aa, Cryptosporidium parvum
FLKFIIKLETEMSIASSLIS

SEQ ID NO: 2313389 - protein, 17 aa, Cryptosporidium parvum
FLKILQNTKFFQSTEMD

SEQ ID NO: 2313390 - protein, 26 aa, Cryptosporidium parvum
FLKNRRKAILPKVEWILCFPVNQCST

SEQ ID NO: 2313391 - protein, 20 aa, Cryptosporidium parvum
FLKRENRFLQLIRSNPELAS

SEQ ID NO: 2313392 - protein, 20 aa, Cryptosporidium parvum
FLKWRESFLSTVPTKYRMKY

SEQ ID NO: 2313393 - protein, 28 aa, Cryptosporidium parvum
FLLFRVHKLIIYLYYFECLDWITPEQEK

SEQ ID NO: 2313394 - protein, 17 aa, Cryptosporidium parvum
FLLHQIRKMVALAIEIF

SEQ ID NO: 2313395 - protein, 26 aa, Cryptosporidium parvum
FLLKQDPLYIHLQLATYQVYSYVPSS

SEQ ID NO: 2313396 - protein, 18 aa, Cryptosporidium parvum
FLLLTKNGKVSPILYVRT

SEQ ID NO: 2313397 - protein, 21 aa, Cryptosporidium parvum
FLLPSILNPLTSILVLTGEWS

SEQ ID NO: 2313398 - protein, 34 aa, Cryptosporidium parvum
FLLSRQGTPFDHTLLQVCLLLGLNRIAFLACGTL

SEQ ID NO: 2313399 - protein, 17 aa, Cryptosporidium parvum
FLLVRNEEKIELEKLVD

SEQ ID NO: 2313400 - protein, 17 aa, Cryptosporidium parvum
FLNLVKTGGVPGSTNYS

SEQ ID NO: 2313401 - protein, 33 aa, Cryptosporidium parvum; identical to SEQ ID NO: 2189755

SEQ ID NO: 2313402 - protein, 32 aa, Cryptosporidium parvum; identical to SEQ ID NO: 2189756

SEQ ID NO: 2313403 - protein, 19 aa, Cryptosporidium parvum
FLNQLYNYQLFLTSAKVCQ

SEQ ID NO: 2313404 - protein, 25 aa, Cryptosporidium parvum
FLPKLDRVLLDAPCTGLGIIARDPS

SEQ ID NO: 2313405 - protein, 18 aa, Cryptosporidium parvum
FLQQLHTPGIDILNVNGA

SEQ ID NO: 2313406 - protein, 18 aa, Cryptosporidium parvum
FLRKKFTPEELLNNDFDA

SEQ ID NO: 2313407 - protein, 25 aa, Cryptosporidium parvum
FLRTNEETVLWKLSPKIWEIKLKNK

SEQ ID NO: 2313408 - protein, 17 aa, Cryptosporidium parvum
FLSCNLHKIITPSGTAY

SEQ ID NO: 2313409 - protein, 30 aa, Cryptosporidium parvum
FLSFKKFMEWFEQIYFNSVLFLYAIQTNHH

SEQ ID NO: 2313410 - protein, 26 aa, Cryptosporidium parvum
FLSFRNSMMYLVHHYCIIYYEISDPN

SEQ ID NO: 2313411 - protein, 25 aa, Cryptosporidium parvum
FLSKGYIDTLFTNKFKIWYQRDEGS

SEQ ID NO: 2313412 - protein, 37 aa, Cryptosporidium parvum; identical to SEQ ID NO: 2189769

SEQ ID NO: 2313413 - protein, 18 aa, Cryptosporidium parvum
FLSKYALDLVPGIVNDDF

SEQ ID NO: 2313414 - protein, 26 aa, Cryptosporidium parvum
FLSNSFFFKRVVINPAFYDPNVFQVE

SEQ ID NO: 2313415 - protein, 32 aa, Cryptosporidium parvum
FLSSGADWTIKLWIPNPLASSFTLLYTFESSE

SEQ ID NO: 2313416 - protein, 17 aa, Cryptosporidium parvum
FLSSKQLFDELVQLAAV

SEQ ID NO: 2313417 - protein, 18 aa, Cryptosporidium parvum
FLVADISEIALLISFDRY

SEQ ID NO: 2313418 - protein, 19 aa, Cryptosporidium parvum
FLYNPNGPISLLSFNILIE

SEQ ID NO: 2313419 - protein, 45 aa, Cryptosporidium parvum
FMDEVPIFKEFTFFLSLRRSLLELRKKIWRLYSIIETKSSVIKLW

SEQ ID NO: 2313420 - protein, 25 aa, Cryptosporidium parvum
FMDKSCVAVLPYCQALCKFPAHVQQ

SEQ ID NO: 2313421 - protein, 20 aa, Cryptosporidium parvum
FMDPPPPETLIRALELLYSL

SEQ ID NO: 2313422 - protein, 25 aa, Cryptosporidium parvum
FMDVEYMAYLLKYDSVHGNFNGTVE

SEQ ID NO: 2313423 - protein, 18 aa, Cryptosporidium parvum
FMECAPVDGEYQLVSGFP

SEQ ID NO: 2313424 - protein, 19 aa, Cryptosporidium parvum
FMEIFSHLRKNSQTEPLIY

SEQ ID NO: 2313425 - protein, 25 aa, Cryptosporidium parvum
FMGSYTPIMPSIIPNPNVLGNQFQN

SEQ ID NO: 2313426 - protein, 25 aa, Cryptosporidium parvum
FMHGKLPTLKISLIQIFRAHLWQKI

SEQ ID NO: 2313427 - protein, 17 aa, Cryptosporidium parvum
FMILDYIAFLSENKQDE

SEQ ID NO: 2313428 - protein, 17 aa, Cryptosporidium parvum
FMLKKRLGKKMKQNRAV

SEQ ID NO: 2313429 - protein, 18 aa, Cryptosporidium parvum
FMLLFTEDYCNFKGGFQK

SEQ ID NO: 2313430 - protein, 18 aa, Cryptosporidium parvum
FMQNWDHILDVFKVMNKL

SEQ ID NO: 2313431 - protein, 17 aa, Cryptosporidium parvum
FMVFKWQEDPKKAALPL

SEQ ID NO: 2313432 - protein, 19 aa, Cryptosporidium parvum
FNALLTFPEDFPNSPPKMC

SEQ ID NO: 2313433 - protein, 18 aa, Cryptosporidium parvum
FNCISYSLDLNYIEYQSC

SEQ ID NO: 2313434 - protein, 30 aa, Cryptosporidium parvum
FNDEKRAYNLKFWKILLSKDKTQFELVSNY

SEQ ID NO: 2313435 - protein, 25 aa, Cryptosporidium parvum
FNDFDFQIFLTFNASMKILEYFEKL

SEQ ID NO: 2313436 - protein, 22 aa, Cryptosporidium parvum
FNDGIRAFGLRIPKFPVPKITL

SEQ ID NO: 2313437 - protein, 26 aa, Cryptosporidium parvum
FNDHFTINVFPINNIKFNTLQGLLSQ

SEQ ID NO: 2313438 - protein, 29 aa, Cryptosporidium parvum
FNDRILTKKILLNQIGIMIPKLKNRQNTT

SEQ ID NO: 2313439 - protein, 25 aa, Cryptosporidium parvum
FNDSFFGDFIGYNKLINEASEMNNW

SEQ ID NO: 2313440 - protein, 24 aa, Cryptosporidium parvum
FNDSMDLGFLSKRFGEKETNQNKP

SEQ ID NO: 2313441 - protein, 22 aa, Cryptosporidium parvum
FNDSWVLYSLLWTSSIQHDACN

SEQ ID NO: 2313442 - protein, 19 aa, Cryptosporidium parvum
FNELNNGYTGVLINTSGSL

SEQ ID NO: 2313443 - protein, 36 aa, Cryptosporidium parvum
FNEVSKLVLEYIIRVYIESLLLFALSYSVIQSEILD

SEQ ID NO: 2313444 - protein, 25 aa, Cryptosporidium parvum
FNEYIPFEWIEKGHIFVPLKIHYID

SEQ ID NO: 2313445 - protein, 17 aa, Cryptosporidium parvum
FNFRINVQWHSVYVDGW

SEQ ID NO: 2313446 - protein, 23 aa, Cryptosporidium parvum
FNHMAAFSLTWPEVIQLCEMAFS

SEQ ID NO: 2313447 - protein, 24 aa, Cryptosporidium parvum
FNHTSYALLRKKAIKKFPVNYGSS

SEQ ID NO: 2313448 - protein, 21 aa, Cryptosporidium parvum
FNIIQMLKIELLKHSGDKNNE

SEQ ID NO: 2313449 - protein, 18 aa, Cryptosporidium parvum
FNIKLSATTLFDYPTIRG

SEQ ID NO: 2313450 - protein, 22 aa, Cryptosporidium parvum
FNKECRTIFVGDLYINRSKSNY

SEQ ID NO: 2313451 - protein, 18 aa, Cryptosporidium parvum
FNKSLKKRLIYPSEMNQV

SEQ ID NO: 2313452 - protein, 24 aa, Cryptosporidium parvum
FNKSPEWILYHELVFTSKEYIRDC

SEQ ID NO: 2313453 - protein, 17 aa, Cryptosporidium parvum
FNLAIKWIKKQKSINEK

SEQ ID NO: 2313454 - protein, 19 aa, Cryptosporidium parvum
FNLKNIVYYPYIQTEIKLP

SEQ ID NO: 2313455 - protein, 19 aa, Cryptosporidium parvum
FNLLQDDLSALIWTDIRHF

SEQ ID NO: 2313456 - protein, 20 aa, Cryptosporidium parvum
FNLNSLPFQLPGQSKDWLCI

SEQ ID NO: 2313457 - protein, 27 aa, Cryptosporidium parvum
FNLSFNKSWNLFFSKFLNGFRLEMSDG

SEQ ID NO: 2313458 - protein, 33 aa, Cryptosporidium parvum
FNMDILEDSPIQRYFLFPIYEQPNINTNDNNNN

SEQ ID NO: 2313459 - protein, 18 aa, Cryptosporidium parvum
FNNFPHHIPHHSHIPPPI

SEQ ID NO: 2313460 - protein, 24 aa, Cryptosporidium parvum
FNNKFFYNFVDSDLYKWCRYFGSS

SEQ ID NO: 2313461 - protein, 18 aa, Cryptosporidium parvum
FNNLTIFCRNKDKMENVF

SEQ ID NO: 2313462 - protein, 17 aa, Cryptosporidium parvum
FNNNFNFRINVQWHSVY

SEQ ID NO: 2313463 - protein, 24 aa, Cryptosporidium parvum
FNPQLIFQIFEWFEYRTKSINTEQ

SEQ ID NO: 2313464 - protein, 19 aa, Cryptosporidium parvum
FNQFDYRKEFDACLDTLVI

SEQ ID NO: 2313465 - protein, 19 aa, Cryptosporidium parvum
FNQKGIISDILFPPEVPQV

SEQ ID NO: 2313466 - protein, 18 aa, Cryptosporidium parvum
FNRAKLCKQSLPHRSPSN

SEQ ID NO: 2313467 - protein, 21 aa, Cryptosporidium parvum
FNRCRVLILCPFKGVAKKLVD

SEQ ID NO: 2313468 - protein, 28 aa, Cryptosporidium parvum
FNSCDIYLKLILLTRHFPNIKFIWSCNS

SEQ ID NO: 2313469 - protein, 25 aa, Cryptosporidium parvum
FNSMKSLILLSFSQPLKTLFSSCFN

SEQ ID NO: 2313470 - protein, 26 aa, Cryptosporidium parvum
FNSYIGYWDVINSLGVLIVNLGYKKD

SEQ ID NO: 2313471 - protein, 27 aa, Cryptosporidium parvum
FNTEQMNLIINLSLRLIIKLGNMSFLL

SEQ ID NO: 2313472 - protein, 25 aa, Cryptosporidium parvum
FNTFTTILNGLCSCPGFISVCNNKK

SEQ ID NO: 2313473 - protein, 18 aa, Cryptosporidium parvum
FNTFYGRIPSVFRIVYIL

SEQ ID NO: 2313474 - protein, 19 aa, Cryptosporidium parvum
FNTLLPKGIVDFVALLPPS

SEQ ID NO: 2313475 - protein, 18 aa, Cryptosporidium parvum
FNTLPLNKVRRWISSKTE

SEQ ID NO: 2313476 - protein, 25 aa, Cryptosporidium parvum
FNTLQKEFMLQNLTEWYREIVKQYK

SEQ ID NO: 2313477 - protein, 21 aa, Cryptosporidium parvum
FPDCYNNTKSFLYALDKVCLT

SEQ ID NO: 2313478 - protein, 30 aa, Cryptosporidium parvum
FPENRTLIYKILTLMIPYFSNITSNLISNS

SEQ ID NO: 2313479 - protein, 18 aa, Cryptosporidium parvum
FPGNTCIKNILLYPSFSL

SEQ ID NO: 2313480 - protein, 25 aa, Cryptosporidium parvum
FPNCKRFYCPFIHDSETNLINFNEK

SEQ ID NO: 2313481 - protein, 30 aa, Cryptosporidium parvum; identical to SEQ ID NO: 2130669

SEQ ID NO: 2313482 - protein, 28 aa, Cryptosporidium parvum
FPPTIQRICELLLFPDCYNNTKSFLYAL

SEQ ID NO: 2313483 - protein, 24 aa, Cryptosporidium parvum
FPQDIGHCHIYISNNGLGICCITS

SEQ ID NO: 2313484 - protein, 17 aa, Cryptosporidium parvum
FPQVKYLKYTLARTQRL

SEQ ID NO: 2313485 - protein, 25 aa, Cryptosporidium parvum
FPSEKKCCIRPLIAPYDNQTTVQPH

SEQ ID NO: 2313486 - protein, 29 aa, Cryptosporidium parvum
FPTDRSFIHILIGVIFTIFEKEVGIKILI

SEQ ID NO: 2313487 - protein, 18 aa, Cryptosporidium parvum
FPTELKPIISNKSKLVGG

SEQ ID NO: 2313488 - protein, 22 aa, Cryptosporidium parvum
FPVHSLSFSLSQKYLISSGGDG

SEQ ID NO: 2313489 - protein, 17 aa, Cryptosporidium parvum
FPVLDFHHWYENFQNSL

SEQ ID NO: 2313490 - protein, 20 aa, Cryptosporidium parvum
FPVQSGYFYDYYNALPQMQL

SEQ ID NO: 2313491 - protein, 18 aa, Cryptosporidium parvum
FQALERRDRLLEYAKNST

SEQ ID NO: 2313492 - protein, 27 aa, Cryptosporidium parvum
FQASPAYFIIPNYNYAFQSFYPSQSGL

SEQ ID NO: 2313493 - protein, 20 aa, Cryptosporidium parvum
FQCYGSVLTAIPDPSGKRIL

SEQ ID NO: 2313494 - protein, 19 aa, Cryptosporidium parvum
FQFGLLYLTKLIFHIKKNS

SEQ ID NO: 2313495 - protein, 20 aa, Cryptosporidium parvum
FQGFDPTEWCNLGSGINTMV

SEQ ID NO: 2313496 - protein, 27 aa, Cryptosporidium parvum
FQGNHGFMPPMYPYGSSYAPYIPGAKN

SEQ ID NO: 2313497 - protein, 34 aa, Cryptosporidium parvum; identical to SEQ ID NO: 2189837

SEQ ID NO: 2313498 - protein, 28 aa, Cryptosporidium parvum
FQILHRRIEWFLHWYIESASSIDQEDRW

SEQ ID NO: 2313499 - protein, 23 aa, Cryptosporidium parvum
FQINTFLRKLGFFVSSRLNEKLY

SEQ ID NO: 2313500 - protein, 24 aa, Cryptosporidium parvum
FQISRIRSFYMRKVKFCQQAIHDR

SEQ ID NO: 2313501 - protein, 24 aa, Cryptosporidium parvum
FQKGGLLFNPKFIHKVPATEMEAL

SEQ ID NO: 2313502 - protein, 18 aa, Cryptosporidium parvum
FQKINQNILIKEKDIYEL

SEQ ID NO: 2313503 - protein, 20 aa, Cryptosporidium parvum
FQNFVLEEIAHIKNDIAKES

SEQ ID NO: 2313504 - protein, 17 aa, Cryptosporidium parvum
FQNIAHLVIDEADLLFA

SEQ ID NO: 2313505 - protein, 34 aa, Cryptosporidium parvum; identical to SEQ ID NO: 2189845

SEQ ID NO: 2313506 - protein, 26 aa, Cryptosporidium parvum
FQQFQNYQLILIKALHEITRKYHKIT

SEQ ID NO: 2313507 - protein, 32 aa, Cryptosporidium parvum; identical to SEQ ID NO: 2189846

SEQ ID NO: 2313508 - protein, 32 aa, Cryptosporidium parvum; identical to SEQ ID NO: 2189847

SEQ ID NO: 2313509 - protein, 20 aa, Cryptosporidium parvum
FQSCTFHLSCRIFDTFLIET

SEQ ID NO: 2313510 - protein, 18 aa, Cryptosporidium parvum
FQSISTMSADLAKNGIVF

SEQ ID NO: 2313511 - protein, 22 aa, Cryptosporidium parvum
FQTLIMHMIYGTELGAIKGHFG

SEQ ID NO: 2313512 - protein, 56 aa, Cryptosporidium parvum
FQTSIETLMSLYTWLKSHLLNPKSPFFDLDYGKFYYTRALELLSNIEYIIRVSGGT

SEQ ID NO: 2313513 - protein, 18 aa, Cryptosporidium parvum
FQVILAMESLLMSTPISL

SEQ ID NO: 2313514 - protein, 19 aa, Cryptosporidium parvum
FQVIQSFFPKGVPSYIIYG

SEQ ID NO: 2313515 - protein, 18 aa, Cryptosporidium parvum
FRCRYPEAFLNKLIELRR

SEQ ID NO: 2313516 - protein, 18 aa, Cryptosporidium parvum
FRDYILYCTLEILKDNDK

SEQ ID NO: 2313517 - protein, 17 aa, Cryptosporidium parvum
FRETIGKLFDLSYEEVF

SEQ ID NO: 2313518 - protein, 18 aa, Cryptosporidium parvum
FRFGSIGIHLFKLQFIQE

SEQ ID NO: 2313519 - protein, 19 aa, Cryptosporidium parvum
FRHVLRNISTQVLRTKKPI

SEQ ID NO: 2313520 - protein, 20 aa, Cryptosporidium parvum
FRIPFLVNYGTRCQPNKFER

SEQ ID NO: 2313521 - protein, 22 aa, Cryptosporidium parvum
FRKYNHVKICPWLAISNFVDEF

SEQ ID NO: 2313522 - protein, 37 aa, Cryptosporidium parvum
FRLEPLLYPNLVSLPDPVLLPYWRNLSKRTYHQWDKE

SEQ ID NO: 2313523 - protein, 17 aa, Cryptosporidium parvum
FRLGFIPNISLLKKYNL

SEQ ID NO: 2313524 - protein, 18 aa, Cryptosporidium parvum
FRLTYQMILQLSCRHSLK

SEQ ID NO: 2313525 - protein, 34 aa, Cryptosporidium parvum
FRMISAYDFFHAENPPLLLLKSNTINLNPKKVDE

SEQ ID NO: 2313526 - protein, 18 aa, Cryptosporidium parvum
FRNFESELVTYCILTYIF

SEQ ID NO: 2313527 - protein, 18 aa, Cryptosporidium parvum
FRPIFDRVLVQRIHPKAV

SEQ ID NO: 2313528 - protein, 17 aa, Cryptosporidium parvum
FRPVGMLRPIVHPPTQR

SEQ ID NO: 2313529 - protein, 22 aa, Cryptosporidium parvum
FRRDSSLLWLSYDPSNERQSEI

SEQ ID NO: 2313530 - protein, 25 aa, Cryptosporidium parvum
FRRFDILFDSNLFGYCDYDETDNVL

SEQ ID NO: 2313531 - protein, 18 aa, Cryptosporidium parvum
FRSPYTYKFYIDPKSKEE

SEQ ID NO: 2313532 - protein, 29 aa, Cryptosporidium parvum
FRSRILCLCQSFFKLGAPGILRKLLQIIS

SEQ ID NO: 2313533 - protein, 29 aa, Cryptosporidium parvum
FRSTDYNSVLWVLSQLFNTVKATKPQSSR

SEQ ID NO: 2313534 - protein, 25 aa, Cryptosporidium parvum
FRYEAPPLIIDSNTGALVPLNEKKK

SEQ ID NO: 2313535 - protein, 17 aa, Cryptosporidium parvum
FSAILLMGNFELGEHES

SEQ ID NO: 2313536 - protein, 17 aa, Cryptosporidium parvum
FSCDLNANIFLWNNSQV

SEQ ID NO: 2313537 - protein, 20 aa, Cryptosporidium parvum
FSDIIQYIMVKHVVGIKFRE

SEQ ID NO: 2313538 - protein, 17 aa, Cryptosporidium parvum
FSDRRKLFTVKGGGCFV

SEQ ID NO: 2313539 - protein, 25 aa, Cryptosporidium parvum
FSDSDKFIIIATDSIWQVFQEEELN

SEQ ID NO: 2313540 - protein, 31 aa, Cryptosporidium parvum; identical to SEQ ID NO: 2189868

SEQ ID NO: 2313541 - protein, 17 aa, Cryptosporidium parvum
FSDVFLIENSEDVFIDN

SEQ ID NO: 2313542 - protein, 22 aa, Cryptosporidium parvum
FSEHIVFWDLFSKKFNNYECYL

SEQ ID NO: 2313543 - protein, 24 aa, Cryptosporidium parvum
FSENLICFICEPILKVLNILNNYN

SEQ ID NO: 2313544 - protein, 28 aa, Cryptosporidium parvum
FSEYVDGYVLFFKIYDDMKIELSSYSIN

SEQ ID NO: 2313545 - protein, 19 aa, Cryptosporidium parvum
FSFDRMLDPKGNTAVYLLY

SEQ ID NO: 2313546 - protein, 18 aa, Cryptosporidium parvum
FSGDSLLSLAWKISFQEI

SEQ ID NO: 2313547 - protein, 23 aa, Cryptosporidium parvum
FSGKICPKCFSVYLIGINCKLEV

SEQ ID NO: 2313548 - protein, 24 aa, Cryptosporidium parvum
FSGKIPQIGFWYIRHRHDKLDHNV

SEQ ID NO: 2313549 - protein, 28 aa, Cryptosporidium parvum
FSHDKMIFDWRNVGLIELIYFDSDEFIK

SEQ ID NO: 2313550 - protein, 18 aa, Cryptosporidium parvum
FSHTRGIPWPKVKDFVSS

SEQ ID NO: 2313551 - protein, 24 aa, Cryptosporidium parvum
FSINYLHIVLRLLQPVKIEKVSEL

SEQ ID NO: 2313552 - protein, 17 aa, Cryptosporidium parvum
FSIVSILGQKFIEECLK

SEQ ID NO: 2313553 - protein, 23 aa, Cryptosporidium parvum
FSKAMLFFSKRDITCLKCIKRKS

SEQ ID NO: 2313554 - protein, 22 aa, Cryptosporidium parvum
FSKFGVSILPFYFEKVEFNNLN

SEQ ID NO: 2313555 - protein, 24 aa, Cryptosporidium parvum
FSKGFRQKGVPMLSRYLKPIKVGD

SEQ ID NO: 2313556 - protein, 29 aa, Cryptosporidium parvum
FSKVTNCHLLFNKFNVLGKLYYNGNKHNK

SEQ ID NO: 2313557 - protein, 33 aa, Cryptosporidium parvum; identical to SEQ ID NO: 2189887

SEQ ID NO: 2313558 - protein, 26 aa, Cryptosporidium parvum
FSLTPEFYIPIFKKLKVSTVIRLNKK

SEQ ID NO: 2313559 - protein, 17 aa, Cryptosporidium parvum
FSLTTFSPSGKLVQIEY

SEQ ID NO: 2313560 - protein, 19 aa, Cryptosporidium parvum
FSLYDDWLKTISPFTAFSR

SEQ ID NO: 2313561 - protein, 25 aa, Cryptosporidium parvum
FSMTVSQLALYLGISSSLKSFGECT

SEQ ID NO: 2313562 - protein, 19 aa, Cryptosporidium parvum
FSNFVSGVLFALLNALKKP

SEQ ID NO: 2313563 - protein, 30 aa, Cryptosporidium parvum; identical to SEQ ID NO: 2189892

SEQ ID NO: 2313564 - protein, 27 aa, Cryptosporidium parvum
FSNIVLQTIMILIKNRAPKGRKLLILA

SEQ ID NO: 2313565 - protein, 30 aa, Cryptosporidium parvum
FSNLDSISGIKTFLLGKIGHGNIGSKLNTS

SEQ ID NO: 2313566 - protein, 26 aa, Cryptosporidium parvum
FSNSQYPFNYFTPYSKYGTLEEFKDL

SEQ ID NO: 2313567 - protein, 17 aa, Cryptosporidium parvum
FSPIESKLFYNCLDYTT

SEQ ID NO: 2313568 - protein, 18 aa, Cryptosporidium parvum
FSQISCISDLKLRILWIK

SEQ ID NO: 2313569 - protein, 25 aa, Cryptosporidium parvum
FSQKDMYIYLILINQIMQEFHQQLL

SEQ ID NO: 2313570 - protein, 26 aa, Cryptosporidium parvum
FSQNIKLIRNLYFLGYSDIFLQLDNS

SEQ ID NO: 2313571 - protein, 18 aa, Cryptosporidium parvum
FSQVFNLMPSGNGGFMIF

SEQ ID NO: 2313572 - protein, 19 aa, Cryptosporidium parvum
FSRHLGISKLGTPNSRCSI

SEQ ID NO: 2313573 - protein, 25 aa, Cryptosporidium parvum
FSRQKIKFGIFGGYLYSIVEGRKPN

SEQ ID NO: 2313574 - protein, 31 aa, Cryptosporidium parvum; identical to SEQ ID NO: 2189902

SEQ ID NO: 2313575 - protein, 17 aa, Cryptosporidium parvum
FSSKSGTRIRVIGLFLP

SEQ ID NO: 2313576 - protein, 18 aa, Cryptosporidium parvum
FSSLLFPGSKVSAGTLYC

SEQ ID NO: 2313577 - protein, 25 aa, Cryptosporidium parvum
FSSLNSMVNLFTSLRFYHYSVEVRN

SEQ ID NO: 2313578 - protein, 36 aa, Cryptosporidium parvum; identical to SEQ ID NO: 2189904

SEQ ID NO: 2313579 - protein, 20 aa, Cryptosporidium parvum
FSSMMNFTFFDQAKKILQSE

SEQ ID NO: 2313580 - protein, 25 aa, Cryptosporidium parvum
FSSNKYLIESFLILTTKHISSLIRS

SEQ ID NO: 2313581 - protein, 23 aa, Cryptosporidium parvum
FSSNYARKWPGIILSPRAKKKVS

SEQ ID NO: 2313582 - protein, 20 aa, Cryptosporidium parvum
FSSRINRMIKLGLSIDEEDI

SEQ ID NO: 2313583 - protein, 23 aa, Cryptosporidium parvum
FSSSLYYPFTNKVNRFSGQLDYI

SEQ ID NO: 2313584 - protein, 45 aa, Cryptosporidium parvum
FSTLPLFFGNFVPNIDFLPELFEHVIFACWNFHIAHACKQKLLNT

SEQ ID NO: 2313585 - protein, 26 aa, Cryptosporidium parvum
FSTLRPLLIVIKLFLRQRGLDETYLG

SEQ ID NO: 2313586 - protein, 30 aa, Cryptosporidium parvum; identical to SEQ ID NO: 2189910

SEQ ID NO: 2313587 - protein, 25 aa, Cryptosporidium parvum
FSVKLITYLLVPQVSLRNFTQYEYW

SEQ ID NO: 2313588 - protein, 19 aa, Cryptosporidium parvum
FSVSIGTRIFLFFNNNTIT

SEQ ID NO: 2313589 - protein, 18 aa, Cryptosporidium parvum
FSVTKYVPIKLTSFLIKR

SEQ ID NO: 2313590 - protein, 22 aa, Cryptosporidium parvum
FSYLGRPIPNLRHQEMPCIPRQ

SEQ ID NO: 2313591 - protein, 24 aa, Cryptosporidium parvum
FTAFSRLVLILRSMHINPERTKVI

SEQ ID NO: 2313592 - protein, 27 aa, Cryptosporidium parvum
FTDAKQIVMAFLYTKIRIFKELSKQIS

SEQ ID NO: 2313593 - protein, 18 aa, Cryptosporidium parvum
FTEIPKQPSIYPLELERN

SEQ ID NO: 2313594 - protein, 18 aa, Cryptosporidium parvum
FTGFFPIQQKVIPYILDG

SEQ ID NO: 2313595 - protein, 20 aa, Cryptosporidium parvum
FTGIFRSFDQYGSLCLERSF

SEQ ID NO: 2313596 - protein, 22 aa, Cryptosporidium parvum
FTGNLICDLLVRTYKPGTTNLN

SEQ ID NO: 2313597 - protein, 25 aa, Cryptosporidium parvum
FTGPLRPYPISIKRKVPSHILRPDY

SEQ ID NO: 2313598 - protein, 24 aa, Cryptosporidium parvum
FTHVQQVYYHFQKGEWRAVYGPSK

SEQ ID NO: 2313599 - protein, 26 aa, Cryptosporidium parvum
FTIGTYWHRIINVKKLLEAGFIGIPR

SEQ ID NO: 2313600 - protein, 18 aa, Cryptosporidium parvum
FTISEGIPALIPRIEELA

SEQ ID NO: 2313601 - protein, 25 aa, Cryptosporidium parvum
FTKVNVLLQLYITGSRWINAKLTLL

SEQ ID NO: 2313602 - protein, 27 aa, Cryptosporidium parvum
FTMVSKKYIYFFFSNATPNSIFCFIEK

SEQ ID NO: 2313603 - protein, 26 aa, Cryptosporidium parvum
FTNGLKPYLGVLRYSLHDPFILWVLR

SEQ ID NO: 2313604 - protein, 30 aa, Cryptosporidium parvum; identical to SEQ ID NO: 2189932

SEQ ID NO: 2313605 - protein, 18 aa, Cryptosporidium parvum
FTRVFELGAFHAGIEIYG

SEQ ID NO: 2313606 - protein, 27 aa, Cryptosporidium parvum
FTSCWKLPTFLFYSDKKGNLLNYLFNK

SEQ ID NO: 2313607 - protein, 25 aa, Cryptosporidium parvum
FTSFTIWDTIFSIKGAKRPTSERYY

SEQ ID NO: 2313608 - protein, 24 aa, Cryptosporidium parvum
FTSRFSFFSSCEIELILESMFAEN

SEQ ID NO: 2313609 - protein, 19 aa, Cryptosporidium parvum
FTSRRPVLSCFACGRTSGI

SEQ ID NO: 2313610 - protein, 37 aa, Cryptosporidium parvum
FTTDDLRHIFKTFGVILSCQLIPSIEKPGTHRGYGFI

SEQ ID NO: 2313611 - protein, 24 aa, Cryptosporidium parvum
FTTILYVSFRLIDEFYPILICKKN

SEQ ID NO: 2313612 - protein, 24 aa, Cryptosporidium parvum
FTTLPGIPEDVGRPWCDIEKPYKV

SEQ ID NO: 2313613 - protein, 25 aa, Cryptosporidium parvum
FTTQWALDIFDYYLGATTLETASCC

SEQ ID NO: 2313614 - protein, 26 aa, Cryptosporidium parvum
FTTTPQLHFMVAFANGLIIDRVPIDI

SEQ ID NO: 2313615 - protein, 24 aa, Cryptosporidium parvum
FTVTFEFLRRFYIATNVQIQIMDN

SEQ ID NO: 2313616 - protein, 23 aa, Cryptosporidium parvum
FTWENLLTLSLLLEIFIASKFQQ

SEQ ID NO: 2313617 - protein, 18 aa, Cryptosporidium parvum
FTYCKNDFNLSFNKSWNL

SEQ ID NO: 2313618 - protein, 23 aa, Cryptosporidium parvum
FTYIPDLEVILQRLTDSSIQNDK

SEQ ID NO: 2313619 - protein, 25 aa, Cryptosporidium parvum
FTYTRKDLLQTLGYIGYLLDNQTIF

SEQ ID NO: 2313620 - protein, 19 aa, Cryptosporidium parvum
FVATFRRFSIGARPKTPPV

SEQ ID NO: 2313621 - protein, 27 aa, Cryptosporidium parvum
FVDVLENLLLQLFSDKIQKIKLRNWDE

SEQ ID NO: 2313622 - protein, 17 aa, Cryptosporidium parvum
FVDWCPTGFKCGINYQP

SEQ ID NO: 2313623 - protein, 17 aa, Cryptosporidium parvum
FVEVCFQAILKSAQYIH

SEQ ID NO: 2313624 - protein, 18 aa, Cryptosporidium parvum
FVFIKKAMLRLYNQRISF

SEQ ID NO: 2313625 - protein, 24 aa, Cryptosporidium parvum
FVFNLHNILIDKYSFVTKFCDFTL

SEQ ID NO: 2313626 - protein, 25 aa, Cryptosporidium parvum
FVFSWFRDILSWFGLSNKSAKILFL

SEQ ID NO: 2313627 - protein, 24 aa, Cryptosporidium parvum
FVGPPGSGFLPRETAEFHRNNILH

SEQ ID NO: 2313628 - protein, 18 aa, Cryptosporidium parvum
FVIAFTTCLVSGIVAVPV

SEQ ID NO: 2313629 - protein, 20 aa, Cryptosporidium parvum
FVIFIINYGNYFKNPHIRCQ

SEQ ID NO: 2313630 - protein, 17 aa, Cryptosporidium parvum
FVILNRLREYTASFCTR

SEQ ID NO: 2313631 - protein, 32 aa, Cryptosporidium parvum; identical to SEQ ID NO: 2189949

SEQ ID NO: 2313632 - protein, 19 aa, Cryptosporidium parvum
FVKDILRVLLCSNCYSLQI

SEQ ID NO: 2313633 - protein, 20 aa, Cryptosporidium parvum
FVKLNWNGWFNDHFTINVFP

SEQ ID NO: 2313634 - protein, 20 aa, Cryptosporidium parvum
FVKRLVLMKKWIDESKILTI

SEQ ID NO: 2313635 - protein, 27 aa, Cryptosporidium parvum
FVKVQKFFQYYSKKNILLIKHGRGGVL

SEQ ID NO: 2313636 - protein, 19 aa, Cryptosporidium parvum
FVLKSKRISSSGSLLIAVC

SEQ ID NO: 2313637 - protein, 17 aa, Cryptosporidium parvum
FVLSFKKSSDDIVKKTM

SEQ ID NO: 2313638 - protein, 18 aa, Cryptosporidium parvum
FVLTCDVIGPLDLLGLAN

SEQ ID NO: 2313639 - protein, 26 aa, Cryptosporidium parvum
FVLTEILPIKLFRSMITFLNTRTFSK

SEQ ID NO: 2313640 - protein, 17 aa, Cryptosporidium parvum
FVLVLNKADIMSESSDS

SEQ ID NO: 2313641 - protein, 18 aa, Cryptosporidium parvum
FVMLDGCATPLQLDKLLG

SEQ ID NO: 2313642 - protein, 20 aa, Cryptosporidium parvum
FVMVSRWYGGIQLGPDRFKH

SEQ ID NO: 2313643 - protein, 19 aa, Cryptosporidium parvum
FVNITASSVFRKATHRLFI

SEQ ID NO: 2313644 - protein, 26 aa, Cryptosporidium parvum
FVNLYKDLLEWYQFWREIFSKGAMAS

SEQ ID NO: 2313645 - protein, 25 aa, Cryptosporidium parvum
FVPIEYSHLISFKKIVNDLLPRAIG

SEQ ID NO: 2313646 - protein, 17 aa, Cryptosporidium parvum
FVSIPKFQDLINKLKVK

SEQ ID NO: 2313647 - protein, 18 aa, Cryptosporidium parvum
FVSLLSSYHHGIPLDIQV

SEQ ID NO: 2313648 - protein, 25 aa, Cryptosporidium parvum
FVTVEPCIMCIGFIDQMGIHNIFYG

SEQ ID NO: 2313649 - protein, 17 aa, Cryptosporidium parvum
FVVLPKRIREVGSEPAF

SEQ ID NO: 2313650 - protein, 20 aa, Cryptosporidium parvum
FVYEELTSPKYWGWQLNNKL

SEQ ID NO: 2313651 - protein, 61 aa, Cryptosporidium parvum
FWENVRYIMRALIVFSLRKKYNIYNCEKFHVGLPLQYAFGLLSLTIELLMNFGGVCLTPED

SEQ ID NO: 2313652 - protein, 17 aa, Cryptosporidium parvum
FWKDVFNTFYGRIPSVF

SEQ ID NO: 2313653 - protein, 17 aa, Cryptosporidium parvum
FWNFDALFQPQKHPARD

SEQ ID NO: 2313654 - protein, 21 aa, Cryptosporidium parvum
FWRSLEFIRTDKYLYKMKPDI

SEQ ID NO: 2313655 - protein, 32 aa, Cryptosporidium parvum
FWSKCYVLFCRNIIIIFLVNFTLRSELDEENC

SEQ ID NO: 2313656 - protein, 18 aa, Cryptosporidium parvum
FYCVSAVASMLQIVTEEL

SEQ ID NO: 2313657 - protein, 17 aa, Cryptosporidium parvum
FYDLIGLKYTYYTTSFF

SEQ ID NO: 2313658 - protein, 19 aa, Cryptosporidium parvum
FYDLVETKILQRDPKEEII

SEQ ID NO: 2313659 - protein, 19 aa, Cryptosporidium parvum
FYEKIGISDLKFKPAFNPY

SEQ ID NO: 2313660 - protein, 19 aa, Cryptosporidium parvum
FYESLYNENPYSIIALKYC

SEQ ID NO: 2313661 - protein, 17 aa, Cryptosporidium parvum
FYFQLIELDINLNINRE

SEQ ID NO: 2313662 - protein, 18 aa, Cryptosporidium parvum
FYHPINLLGYSSKIQRVR

SEQ ID NO: 2313663 - protein, 18 aa, Cryptosporidium parvum
FYILSFVGISFNQATVSK

SEQ ID NO: 2313664 - protein, 18 aa, Cryptosporidium parvum
FYKRALLMDSRSSQTWVL

SEQ ID NO: 2313665 - protein, 21 aa, Cryptosporidium parvum
FYLHSRCLITIPFLQWELIND

SEQ ID NO: 2313666 - protein, 17 aa, Cryptosporidium parvum
FYLRGSCRFGDNCRDYH

SEQ ID NO: 2313667 - protein, 28 aa, Cryptosporidium parvum
FYLSNQSTIRYIPVLCPDIIIKEDESSI

SEQ ID NO: 2313668 - protein, 20 aa, Cryptosporidium parvum
FYMMVRAKASLHLVAHRGAS

SEQ ID NO: 2313669 - protein, 18 aa, Cryptosporidium parvum
FYNIIPKYIYGINQYISK

SEQ ID NO: 2313670 - protein, 18 aa, Cryptosporidium parvum
FYNNLIPHCNLYPKFEYE

SEQ ID NO: 2313671 - protein, 20 aa, Cryptosporidium parvum
FYNNPVMLQSFIKKMDNQIS

SEQ ID NO: 2313672 - protein, 27 aa, Cryptosporidium parvum
FYPVDERWISILDLSARPRNLEPSETC

SEQ ID NO: 2313673 - protein, 27 aa, Cryptosporidium parvum
FYQLEGLNWMFQLYKHNINGILADEMG

SEQ ID NO: 2313674 - protein, 19 aa, Cryptosporidium parvum
FYQSLELPYRVISIVSGAL

SEQ ID NO: 2313675 - protein, 32 aa, Cryptosporidium parvum
FYSNNTLLNKQLLFSSLFPPSSYLNTHFSSYY

SEQ ID NO: 2313676 - protein, 18 aa, Cryptosporidium parvum
FYSTGFPLNKAISYAKLK

SEQ ID NO: 2313677 - protein, 26 aa, Cryptosporidium parvum
FYTDRICRIVLEHALNLLPYDYKEIK

SEQ ID NO: 2313678 - protein, 25 aa, Cryptosporidium parvum
FYTELPILLLRFQPTTLRISTLGIL

SEQ ID NO: 2313679 - protein, 47 aa, Cryptosporidium parvum; identical to SEQ ID NO: 2189987

SEQ ID NO: 2313680 - protein, 30 aa, Cryptosporidium parvum; identical to SEQ ID NO: 2189988

SEQ ID NO: 2313681 - protein, 23 aa, Cryptosporidium parvum
GAGYFFVSIVRFTKGKFDILATV

SEQ ID NO: 2313682 - protein, 22 aa, Cryptosporidium parvum
GAIELLIVWENLETKRMVVKNP

SEQ ID NO: 2313683 - protein, 29 aa, Cryptosporidium parvum
GAISPYEAIRLLKDPKLYSSPHNISKALA

SEQ ID NO: 2313684 - protein, 24 aa, Cryptosporidium parvum
GAKTPRWASINLGILICIDCSGVH

SEQ ID NO: 2313685 - protein, 19 aa, Cryptosporidium parvum
GALERLMKMIIRLADCGLI

SEQ ID NO: 2313686 - protein, 26 aa, Cryptosporidium parvum
GALGGAAMMSIFSSPKSFVCTLSSTR

SEQ ID NO: 2313687 - protein, 25 aa, Cryptosporidium parvum
GALQYYGKWIILGNMKRSLEKNSHL

SEQ ID NO: 2313688 - protein, 19 aa, Cryptosporidium parvum
GALVLRRLQFDTGKLEIVR

SEQ ID NO: 2313689 - protein, 25 aa, Cryptosporidium parvum
GANRVILYDPWWNPMTDVQAKERCW

SEQ ID NO: 2313690 - protein, 27 aa, Cryptosporidium parvum
GAPVDQMLIPPFPQVSGIPMFEDGTPD

SEQ ID NO: 2313691 - protein, 20 aa, Cryptosporidium parvum
GARGADIWMGGGGSSMGIGG

SEQ ID NO: 2313692 - protein, 19 aa, Cryptosporidium parvum
GARYRLGVLEIPECFLSKY

SEQ ID NO: 2313693 - protein, 20 aa, Cryptosporidium parvum
GASYNSSLTLKLKKTLKKRD

SEQ ID NO: 2313694 - protein, 31 aa, Cryptosporidium parvum
GAVADLILKKVLSVDLSLPPTVTHLAKIGKI

SEQ ID NO: 2313695 - protein, 21 aa, Cryptosporidium parvum
GAVRKSGVPGVYWSQKPQGWR

SEQ ID NO: 2313696 - protein, 37 aa, Cryptosporidium parvum; identical to SEQ ID NO: 2190004

SEQ ID NO: 2313697 - protein, 27 aa, Cryptosporidium parvum
GCAFVKYAFKEQGLFAIKSLHGALTLA

SEQ ID NO: 2313698 - protein, 25 aa, Cryptosporidium parvum
GCDEKNQILTLHRKLGFALDVNQQL

SEQ ID NO: 2313699 - protein, 23 aa, Cryptosporidium parvum
GCDNMTFMIVQLGPNIRKKSSDC

SEQ ID NO: 2313700 - protein, 17 aa, Cryptosporidium parvum
GCFERSEFYIDCISPYL

SEQ ID NO: 2313701 - protein, 28 aa, Cryptosporidium parvum
GCIELKKLVYLYIINYAKVQPELAILAV

SEQ ID NO: 2313702 - protein, 21 aa, Cryptosporidium parvum
GCILILNPCNGKLFMKVIHTS

SEQ ID NO: 2313703 - protein, 17 aa, Cryptosporidium parvum
GCILYVIKSIKFLVNYL

SEQ ID NO: 2313704 - protein, 22 aa, Cryptosporidium parvum
GCKRLILVGDPKQLPATVLSRR

SEQ ID NO: 2313705 - protein, 33 aa, Cryptosporidium parvum
GCLEFTEEQFRWHWINILKCTTIEEFSPYQVIL

SEQ ID NO: 2313706 - protein, 20 aa, Cryptosporidium parvum
GCLETFINAFRFLEDTFISE

SEQ ID NO: 2313707 - protein, 17 aa, Cryptosporidium parvum
GCLILPISKRRVSLHCS

SEQ ID NO: 2313708 - protein, 17 aa, Cryptosporidium parvum
GCLLALTCWNKSVKFYD

SEQ ID NO: 2313709 - protein, 20 aa, Cryptosporidium parvum
GCLMAELKEKMVLFRNRLNK

SEQ ID NO: 2313710 - protein, 20 aa, Cryptosporidium parvum
GCSFFGCNIPFDACSYQMCN

SEQ ID NO: 2313711 - protein, 20 aa, Cryptosporidium parvum
GCSKAPHAPPLVNRTRNIYI

SEQ ID NO: 2313712 - protein, 24 aa, Cryptosporidium parvum
GDAFGELALLYNCPRAASVVAKTD

SEQ ID NO: 2313713 - protein, 24 aa, Cryptosporidium parvum
GDAFHYICYIPFGKNVYELDGLTT

SEQ ID NO: 2313714 - protein, 26 aa, Cryptosporidium parvum
GDDFPKYPMYSFAGGILIAVNPYKEY

SEQ ID NO: 2313715 - protein, 35 aa, Cryptosporidium parvum; identical to SEQ ID NO: 2190021

SEQ ID NO: 2313716 - protein, 26 aa, Cryptosporidium parvum
GDEKNSLFGFLKHTITPGGTRLLKRW

SEQ ID NO: 2313717 - protein, 26 aa, Cryptosporidium parvum
GDETLRFWQIFPTGRPKGPKNLAALS

SEQ ID NO: 2313718 - protein, 22 aa, Cryptosporidium parvum
GDFIEKLNIFLSFAESKEFYGK

SEQ ID NO: 2313719 - protein, 33 aa, Cryptosporidium parvum
GDFSDMIVVPDFEKVWIDPFFDRKTLHVACFVL

SEQ ID NO: 2313720 - protein, 24 aa, Cryptosporidium parvum
GDGFLDFEDFYRVFQYCHSSTQND

SEQ ID NO: 2313721 - protein, 25 aa, Cryptosporidium parvum
GDGTLLWLSHLFQTSVPPVISIAMG

SEQ ID NO: 2313722 - protein, 22 aa, Cryptosporidium parvum
GDGWLDSYKIGLPILCDQNKLN

SEQ ID NO: 2313723 - protein, 21 aa, Cryptosporidium parvum
GDHFNLLINERFKKVIEASQN

SEQ ID NO: 2313724 - protein, 28 aa, Cryptosporidium parvum
GDHIPFLISTFNYLMDEIKLLESILEES

SEQ ID NO: 2313725 - protein, 21 aa, Cryptosporidium parvum
GDHPLFLKYKGFQSELVDLVE

SEQ ID NO: 2313726 - protein, 28 aa, Cryptosporidium parvum
GDIEDAYRLIFRSFVELSLNNISQEQRI

SEQ ID NO: 2313727 - protein, 20 aa, Cryptosporidium parvum
GDIIFAESPLLVVTPELAPE

SEQ ID NO: 2313728 - protein, 23 aa, Cryptosporidium parvum
GDISWVIPNKFIAFSGPSGTSVD

SEQ ID NO: 2313729 - protein, 23 aa, Cryptosporidium parvum
GDKKGSFAIFYGIGFRIIQSEER

SEQ ID NO: 2313730 - protein, 30 aa, Cryptosporidium parvum
GDKSKNILCKAFWKILRSYEISASISLIES

SEQ ID NO: 2313731 - protein, 21 aa, Cryptosporidium parvum
GDLFIKVNIKPNTKFKWIKDN

SEQ ID NO: 2313732 - protein, 23 aa, Cryptosporidium parvum
GDLINCFVTHFDFNRVKIFSQRR

SEQ ID NO: 2313733 - protein, 25 aa, Cryptosporidium parvum
GDLTQYPIFPWTIVSFNSVLNSRHD

SEQ ID NO: 2313734 - protein, 17 aa, Cryptosporidium parvum
GDLTYMSYLVTPFPPNE

SEQ ID NO: 2313735 - protein, 24 aa, Cryptosporidium parvum
GDNDTIKWLLFKNESFEILLEEIK

SEQ ID NO: 2313736 - protein, 28 aa, Cryptosporidium parvum
GDNSRYQICNLYYILSNIHSKKPSVLWC

SEQ ID NO: 2313737 - protein, 28 aa, Cryptosporidium parvum
GDQNHTRIFLFIQRLSYLPTHSIPIFAD

SEQ ID NO: 2313738 - protein, 24 aa, Cryptosporidium parvum
GDSQLFNIHLSRQLFPQLKFEDIP

SEQ ID NO: 2313739 - protein, 25 aa, Cryptosporidium parvum
GDTDYMMFLGCKTHRAASIVLRGAN

SEQ ID NO: 2313740 - protein, 30 aa, Cryptosporidium parvum; identical to SEQ ID NO: 2190045

SEQ ID NO: 2313741 - protein, 22 aa, Cryptosporidium parvum
GDYNVMILDLLGPSLEDLFTIC

SEQ ID NO: 2313742 - protein, 22 aa, Cryptosporidium parvum
GDYYDVYVLKRPGVDKFLNIVS

SEQ ID NO: 2313743 - protein, 25 aa, Cryptosporidium parvum
GEATAKLYILIEIQRMASVIGNPKV

SEQ ID NO: 2313744 - protein, 30 aa, Cryptosporidium parvum
GECLTLFQPWNLLYASWKHGLSLNRLVSLI

SEQ ID NO: 2313745 - protein, 24 aa, Cryptosporidium parvum
GECPSKLIKFPLNGLKKLNQSDTP

SEQ ID NO: 2313746 - protein, 33 aa, Cryptosporidium parvum
GECTLAILVEAMSFPLCFLAHLSSISSGGLAET

SEQ ID NO: 2313747 - protein, 25 aa, Cryptosporidium parvum
GEDCPVFDGLWEFCQLSAGGSLGGA

SEQ ID NO: 2313748 - protein, 22 aa, Cryptosporidium parvum
GEDFIPYAISVLQLFQQASITQ

SEQ ID NO: 2313749 - protein, 23 aa, Cryptosporidium parvum
GEDQVKIWRRSFDVPPPVLEKSD

SEQ ID NO: 2313750 - protein, 24 aa, Cryptosporidium parvum
GEEAVLVLWRQTFSSDSYLIHTRN

SEQ ID NO: 2313751 - protein, 26 aa, Cryptosporidium parvum
GEEEKILMKYFRKYQALSADKRREEK

SEQ ID NO: 2313752 - protein, 25 aa, Cryptosporidium parvum
GEEKNILPLVLKLSSQVYPLLDSII

SEQ ID NO: 2313753 - protein, 17 aa, Cryptosporidium parvum
GEFGIKEPKIKWVNDIY

SEQ ID NO: 2313754 - protein, 24 aa, Cryptosporidium parvum
GEFREFPLGDVLTGSTLSNLVESM

SEQ ID NO: 2313755 - protein, 24 aa, Cryptosporidium parvum
GEFRFRRGYLKSKNPRKMVTQWCE

SEQ ID NO: 2313756 - protein, 22 aa, Cryptosporidium parvum
GEGVNFIRRGLIDSAIESRSQK

SEQ ID NO: 2313757 - protein, 26 aa, Cryptosporidium parvum
GEIAPRYIFSVITLAGTINIYDTQHF

SEQ ID NO: 2313758 - protein, 26 aa, Cryptosporidium parvum
GEIIKRCDMFFRLVKYEFNEFQAIEK

SEQ ID NO: 2313759 - protein, 17 aa, Cryptosporidium parvum
GEIILRIYDRKNRLNIY

SEQ ID NO: 2313760 - protein, 25 aa, Cryptosporidium parvum
GEIQGVYFDKIRKLWRANWKENGRV

SEQ ID NO: 2313761 - protein, 26 aa, Cryptosporidium parvum
GEIRYDDIFLIFSKILGDQVLHHLIA

SEQ ID NO: 2313762 - protein, 24 aa, Cryptosporidium parvum
GEISLFEIILRIHELYKYGEIKYL

SEQ ID NO: 2313763 - protein, 17 aa, Cryptosporidium parvum
GEITGIIQWVCNLTIEI

SEQ ID NO: 2313764 - protein, 30 aa, Cryptosporidium parvum
GEIYPPDDNFILLIIDLIRELVQEWRDDTS

SEQ ID NO: 2313765 - protein, 29 aa, Cryptosporidium parvum
GEKINSLIDLFHRIYRIMFQDLRNEVERN

SEQ ID NO: 2313766 - protein, 31 aa, Cryptosporidium parvum; identical to SEQ ID NO: 2190067

SEQ ID NO: 2313767 - protein, 33 aa, Cryptosporidium parvum
GELDFPYAGIKIKPKKGFAVVWPNIDSQGKLDY

SEQ ID NO: 2313768 - protein, 28 aa, Cryptosporidium parvum
GELLDRPFVHLLIWNYIKCCISFYQLDD

SEQ ID NO: 2313769 - protein, 24 aa, Cryptosporidium parvum
GELNMYLKPVFGIFHGFSGTKFWR

SEQ ID NO: 2313770 - protein, 38 aa, Cryptosporidium parvum
GEPHFLTMNWNLFPKLMEFVFPPFPLENGILPEQQLYG

SEQ ID NO: 2313771 - protein, 20 aa, Cryptosporidium parvum
GEQLLSLPRSLLDEICREIN

SEQ ID NO: 2313772 - protein, 25 aa, Cryptosporidium parvum
GESFVFLPVQLIPQLLQKTGKPATQ

SEQ ID NO: 2313773 - protein, 19 aa, Cryptosporidium parvum
GESIAKWISSLRSCVSKSA

SEQ ID NO: 2313774 - protein, 25 aa, Cryptosporidium parvum
GESIERILFLILNNGFLALQHNKLD

SEQ ID NO: 2313775 - protein, 20 aa, Cryptosporidium parvum
GESLLKKSLFERRQYLRKCI

SEQ ID NO: 2313776 - protein, 26 aa, Cryptosporidium parvum
GESNKKLLVFLKMRWLSNNVCSIECL

SEQ ID NO: 2313777 - protein, 25 aa, Cryptosporidium parvum
GESNQKFILRWIDTQLKEWEKLLKC

SEQ ID NO: 2313778 - protein, 23 aa, Cryptosporidium parvum
GESVCFVLARMIELTYGRVANNG

SEQ ID NO: 2313779 - protein, 29 aa, Cryptosporidium parvum
GETEEFVHFLFREGFLVKGSRMESYDFHS

SEQ ID NO: 2313780 - protein, 26 aa, Cryptosporidium parvum
GETENIIKALFMISEYSSPSIIFIDE

SEQ ID NO: 2313781 - protein, 25 aa, Cryptosporidium parvum
GETTKLHFSKFFSLGQLQCVDPETR

SEQ ID NO: 2313782 - protein, 22 aa, Cryptosporidium parvum
GEVRIIINLQTLSNFDIINKDL

SEQ ID NO: 2313783 - protein, 17 aa, Cryptosporidium parvum
GEWFCPRCIRGRRRRTN

SEQ ID NO: 2313784 - protein, 18 aa, Cryptosporidium parvum
GEWIVLPFDHITGVELQS

SEQ ID NO: 2313785 - protein, 25 aa, Cryptosporidium parvum
GEYNLRNYVLLELLSKYLDSNCYLE

SEQ ID NO: 2313786 - protein, 24 aa, Cryptosporidium parvum
GEYSYCVMLYNAFLFNNSNMCLVF

SEQ ID NO: 2313787 - protein, 24 aa, Cryptosporidium parvum
GFDSFYIWLLMEQLLGFVCIENYY

SEQ ID NO: 2313788 - protein, 19 aa, Cryptosporidium parvum
GFEHCFEFKVLLLTSMGSK

SEQ ID NO: 2313789 - protein, 24 aa, Cryptosporidium parvum
GFESLTELIFYICYKMQFEPEFNL

SEQ ID NO: 2313790 - protein, 19 aa, Cryptosporidium parvum
GFEYACSIALKKLEEISLK

SEQ ID NO: 2313791 - protein, 20 aa, Cryptosporidium parvum
GFFGHLINKIIIYNIKNNNN

SEQ ID NO: 2313792 - protein, 19 aa, Cryptosporidium parvum
GFFKDDFFKYLFDSDNQKN

SEQ ID NO: 2313793 - protein, 17 aa, Cryptosporidium parvum
GFFKGMGAGLVAAVALP

SEQ ID NO: 2313794 - protein, 18 aa, Cryptosporidium parvum
GFFLIPEDGVWSYNSMVV

SEQ ID NO: 2313795 - protein, 27 aa, Cryptosporidium parvum
GFGASESLIWSLSIHFRSITLQDPATV

SEQ ID NO: 2313796 - protein, 17 aa, Cryptosporidium parvum
GFKIVELISIRDKAHQK

SEQ ID NO: 2313797 - protein, 18 aa, Cryptosporidium parvum
GFLDYVEHLLMLSRSDEG

SEQ ID NO: 2313798 - protein, 21 aa, Cryptosporidium parvum
GFLHIVKRDIEPIYQLIVLNQ

SEQ ID NO: 2313799 - protein, 23 aa, Cryptosporidium parvum
GFPSDIVVIAWGLSLERPTMISY

SEQ ID NO: 2313800 - protein, 17 aa, Cryptosporidium parvum
GFQDSLNFILDQIPPEI

SEQ ID NO: 2313801 - protein, 24 aa, Cryptosporidium parvum
GFQLEEIFYGCLTSIFAGSLPSST

SEQ ID NO: 2313802 - protein, 35 aa, Cryptosporidium parvum; identical to SEQ ID NO: 2190105

SEQ ID NO: 2313803 - protein, 19 aa, Cryptosporidium parvum
GFRGGYSRGGMMSGGHGPN

SEQ ID NO: 2313804 - protein, 17 aa, Cryptosporidium parvum
GFRLKLGSSSSIEWNPS

SEQ ID NO: 2313805 - protein, 23 aa, Cryptosporidium parvum
GFRYDLCSEKIYKIFQASNWKND

SEQ ID NO: 2313806 - protein, 25 aa, Cryptosporidium parvum
GFSALKRMYHTVQEPMWDAAMYNPN

SEQ ID NO: 2313807 - protein, 28 aa, Cryptosporidium parvum
GFSGRQLFKLVLGMKSIVLGSGVESLTR

SEQ ID NO: 2313808 - protein, 33 aa, Cryptosporidium parvum
GFSYPLIIHNNKFHLFGTVPTLRYIAKKIGEYG

SEQ ID NO: 2313809 - protein, 20 aa, Cryptosporidium parvum
GFVLPMIERLGCSHSQIVGI

SEQ ID NO: 2313810 - protein, 19 aa, Cryptosporidium parvum
GFYELNIEGLFLPNSMYVI

SEQ ID NO: 2313811 - protein, 21 aa, Cryptosporidium parvum
GFYNENLALLNSFQLSEELSF

SEQ ID NO: 2313812 - protein, 19 aa, Cryptosporidium parvum
GGALIFSLVTHHPNFLTCA

SEQ ID NO: 2313813 - protein, 32 aa, Cryptosporidium parvum
GGARLNYVFHNWFGNTLFNFDPLDGLSDTEIR

SEQ ID NO: 2313814 - protein, 17 aa, Cryptosporidium parvum
GGCFVLNCPWSTLEELN

SEQ ID NO: 2313815 - protein, 17 aa, Cryptosporidium parvum
GGDLKVWKFFIGYEQTN

SEQ ID NO: 2313816 - protein, 20 aa, Cryptosporidium parvum
GGEILNHKIIKSKGSEAKAI

SEQ ID NO: 2313817 - protein, 22 aa, Cryptosporidium parvum
GGEYIYREMLINNISIGEYTLR

SEQ ID NO: 2313818 - protein, 18 aa, Cryptosporidium parvum
GGFQLFRSDRRGGGNCFS

SEQ ID NO: 2313819 - protein, 25 aa, Cryptosporidium parvum
GGHGRFTFLLLRALERYSPVWEDLG

SEQ ID NO: 2313820 - protein, 40 aa, Cryptosporidium parvum; identical to SEQ ID NO: 2190119

SEQ ID NO: 2313821 - protein, 17 aa, Cryptosporidium parvum
GGIFIRSGLYAGAFYRF

SEQ ID NO: 2313822 - protein, 22 aa, Cryptosporidium parvum
GGIIPNLPKNLNPAVIRRLQNA

SEQ ID NO: 2313823 - protein, 39 aa, Cryptosporidium parvum
GGISKLVLSPCKNLLMGLTCYGWIYIWNIEQLGNNTNND

SEQ ID NO: 2313824 - protein, 18 aa, Cryptosporidium parvum
GGKRKGAIAIYLEPWHVD

SEQ ID NO: 2313825 - protein, 26 aa, Cryptosporidium parvum
GGLIKSFLPEFWPAYEPSSSLELFSI

SEQ ID NO: 2313826 - protein, 25 aa, Cryptosporidium parvum
GGLRKSPWMRPPGEWLRLCDNCLLP

SEQ ID NO: 2313827 - protein, 31 aa, Cryptosporidium parvum
GGLSFLVQVIVIHIFPICYKEMIETLQDDNK

SEQ ID NO: 2313828 - protein, 19 aa, Cryptosporidium parvum
GGNQVFCSLYNTERYYSSF

SEQ ID NO: 2313829 - protein, 17 aa, Cryptosporidium parvum
GGNTRLTEIFSEYGLNG

SEQ ID NO: 2313830 - protein, 25 aa, Cryptosporidium parvum
GGPPLSSLPLFVRVKFNANERRGQP

SEQ ID NO: 2313831 - protein, 25 aa, Cryptosporidium parvum
GGQNCSPLLTLIFVRVCNSICNANN

SEQ ID NO: 2313832 - protein, 26 aa, Cryptosporidium parvum
GGQYYSALLNCCGEVFIWGMKDCCGL

SEQ ID NO: 2313833 - protein, 22 aa, Cryptosporidium parvum
GGRHNYNLRKLLKSENYRELQK

SEQ ID NO: 2313834 - protein, 28 aa, Cryptosporidium parvum
GGRLCQCEYILNEILEAVSYKLETYEKH

SEQ ID NO: 2313835 - protein, 28 aa, Cryptosporidium parvum
GGSNGLITLIYLPFATISKFEKLYETIN

SEQ ID NO: 2313836 - protein, 26 aa, Cryptosporidium parvum
GGSYKLELFLPEHYPMEPPKVRFLTK

SEQ ID NO: 2313837 - protein, 23 aa, Cryptosporidium parvum
GGTHMYLKALIWKSIIDSETCSS

SEQ ID NO: 2313838 - protein, 24 aa, Cryptosporidium parvum
GGVCFRPYFEQRFAEIAFLAVTST

SEQ ID NO: 2313839 - protein, 23 aa, Cryptosporidium parvum
GGVRPFGISLLVAGFDSTRGPQL

SEQ ID NO: 2313840 - protein, 30 aa, Cryptosporidium parvum; identical to SEQ ID NO: 2190139

SEQ ID NO: 2313841 - protein, 36 aa, Cryptosporidium parvum
GHASRIFEEFFGTNNIFDIFSSFGEFPGFNEPSRSS

SEQ ID NO: 2313842 - protein, 24 aa, Cryptosporidium parvum
GHEFIDISLLPGVNLITGGNGSGK

SEQ ID NO: 2313843 - protein, 24 aa, Cryptosporidium parvum
GHELNFILFLMCIHRLGAFQKNDL

SEQ ID NO: 2313844 - protein, 17 aa, Cryptosporidium parvum
GHHIDWRALEFEVCRIR

SEQ ID NO: 2313845 - protein, 26 aa, Cryptosporidium parvum
GHIFVPLKIHYIDPTSYQYLGILWHV

SEQ ID NO: 2313846 - protein, 18 aa, Cryptosporidium parvum
GHIHPLIGNNDLMSSLEN

SEQ ID NO: 2313847 - protein, 23 aa, Cryptosporidium parvum
GHLKLLDFGLCKFSPLIEGDENR

SEQ ID NO: 2313848 - protein, 31 aa, Cryptosporidium parvum; identical to SEQ ID NO: 2190151

SEQ ID NO: 2313849 - protein, 25 aa, Cryptosporidium parvum
GHMHLSRCALLPTPDYRILNLGGIP

SEQ ID NO: 2313850 - protein, 18 aa, Cryptosporidium parvum
GHNFALTPNLITLENVQR

SEQ ID NO: 2313851 - protein, 17 aa, Cryptosporidium parvum
GHNFITEIDPLLSLTKL

SEQ ID NO: 2313852 - protein, 30 aa, Cryptosporidium parvum
GHPCKCLFINWHKLSIWMPFYRVHSHIDSP

SEQ ID NO: 2313853 - protein, 25 aa, Cryptosporidium parvum
GHQLKLEVFLVFKSGLDPNSELFEK

SEQ ID NO: 2313854 - protein, 24 aa, Cryptosporidium parvum
GHSDPLHTFLSISALSLIFNSDSK

SEQ ID NO: 2313855 - protein, 19 aa, Cryptosporidium parvum
GHSFPIYCMELLGSKGSQS

SEQ ID NO: 2313856 - protein, 19 aa, Cryptosporidium parvum
GHTCMHFLCTRPLQMLQVL

SEQ ID NO: 2313857 - protein, 45 aa, Cryptosporidium parvum
GHTHMIVSCKWDPINYNRFFTCSIDNTIRLFDLNSDPFGVDGYIP

SEQ ID NO: 2313858 - protein, 17 aa, Cryptosporidium parvum
GHVFTIEPMINAGRFED

SEQ ID NO: 2313859 - protein, 19 aa, Cryptosporidium parvum
GHVGPVYMISWSVDSRLIA

SEQ ID NO: 2313860 - protein, 26 aa, Cryptosporidium parvum
GIADNLTYFSKISSYLILWLDCDREG

SEQ ID NO: 2313861 - protein, 19 aa, Cryptosporidium parvum
GIAIMAFKLVPSKTNLILS

SEQ ID NO: 2313862 - protein, 24 aa, Cryptosporidium parvum
GIANTPSLGLGLSSGIPAQTLGAT

SEQ ID NO: 2313863 - protein, 24 aa, Cryptosporidium parvum
GIAVSKIYAPWTAGGPTPDLSAFQ

SEQ ID NO: 2313864 - protein, 25 aa, Cryptosporidium parvum
GICDTFNSFIWEPAVNKLSAYSSAT

SEQ ID NO: 2313865 - protein, 26 aa, Cryptosporidium parvum
GIDDDSFLSLFKPIISKCIEVYRPGA

SEQ ID NO: 2313866 - protein, 26 aa, Cryptosporidium parvum
GIDPRLSEYYLIYADVLFEKEENSTN

SEQ ID NO: 2313867 - protein, 33 aa, Cryptosporidium parvum
GIEKKEEWGLYDDLIYKFLFRKHDDSHLNTNKR

SEQ ID NO: 2313868 - protein, 24 aa, Cryptosporidium parvum
GIELPLLNITNLSDLLLLPIDVNR

SEQ ID NO: 2313869 - protein, 25 aa, Cryptosporidium parvum
GIENKLISSLFFDDFPIYESRFTSS

SEQ ID NO: 2313870 - protein, 26 aa, Cryptosporidium parvum
GIESIRLELLPFLAKNQHVPGSELWG

SEQ ID NO: 2313871 - protein, 18 aa, Cryptosporidium parvum
GIEVWWSFEGSVSSLPNE

SEQ ID NO: 2313872 - protein, 20 aa, Cryptosporidium parvum
GIFKVILSLINDTVPPNLHF

SEQ ID NO: 2313873 - protein, 17 aa, Cryptosporidium parvum
GIGFKSVFLITNTPFIF

SEQ ID NO: 2313874 - protein, 18 aa, Cryptosporidium parvum
GIGKFHAKWIPVSVATFT

SEQ ID NO: 2313875 - protein, 25 aa, Cryptosporidium parvum
GIGLERVIMLFLNLGNIRKSSMFPR

SEQ ID NO: 2313876 - protein, 18 aa, Cryptosporidium parvum
GIGLLKNLNVWKSTKIFP

SEQ ID NO: 2313877 - protein, 26 aa, Cryptosporidium parvum
GIGRFQNFLYCIMGEISIELIINQVC

SEQ ID NO: 2313878 - protein, 17 aa, Cryptosporidium parvum
GIHFIKRDFISQLKEFF

SEQ ID NO: 2313879 - protein, 25 aa, Cryptosporidium parvum
GIHNIHLYGPYLYNRKIYTRFPLNQ

SEQ ID NO: 2313880 - protein, 27 aa, Cryptosporidium parvum
GIIFTPVHLPYVPGTCPQLLKWKPPHL

SEQ ID NO: 2313881 - protein, 17 aa, Cryptosporidium parvum
GIKGMRIAKYGTAEYER

SEQ ID NO: 2313882 - protein, 27 aa, Cryptosporidium parvum
GIKHPRGELKLWPTSYDRVISQNSSKR

SEQ ID NO: 2313883 - protein, 19 aa, Cryptosporidium parvum
GIKNFPFAPSMKIDRLGAV

SEQ ID NO: 2313884 - protein, 17 aa, Cryptosporidium parvum
GILGVLMKYYPNVYWER

SEQ ID NO: 2313885 - protein, 19 aa, Cryptosporidium parvum
GILNDFFPNRLADYCYELS

SEQ ID NO: 2313886 - protein, 23 aa, Cryptosporidium parvum
GILNKFIPDVWIYFDKPKKDSLQ

SEQ ID NO: 2313887 - protein, 20 aa, Cryptosporidium parvum
GILSMKIVEFGFQGTNVLRM

SEQ ID NO: 2313888 - protein, 33 aa, Cryptosporidium parvum
GILSRKSSWRIRTILFFIIFKSMESYGKGDLVT

SEQ ID NO: 2313889 - protein, 28 aa, Cryptosporidium parvum
GINELNPGFPLILPNQLYQVNNTLGAVR

SEQ ID NO: 2313890 - protein, 19 aa, Cryptosporidium parvum
GINMLAKYVAPHVYGYSQL

SEQ ID NO: 2313891 - protein, 23 aa, Cryptosporidium parvum
GINRFLELIPSETIFLIQEMSNY

SEQ ID NO: 2313892 - protein, 26 aa, Cryptosporidium parvum
GINSNNILAYKLNFCGIRYLKENLMN

SEQ ID NO: 2313893 - protein, 30 aa, Cryptosporidium parvum
GIPCINILWLETIIYTWISPLKININNPLF

SEQ ID NO: 2313894 - protein, 45 aa, Cryptosporidium parvum
GIPHQMVLPSMMQMPNVAPPPLPIYQQPPGYPLSNGPAPYQIPGA

SEQ ID NO: 2313895 - protein, 21 aa, Cryptosporidium parvum
GIPIFEKFMQFLERPKVDSYL

SEQ ID NO: 2313896 - protein, 23 aa, Cryptosporidium parvum
GIPISHLVLCKAIFPERYEDCMN

SEQ ID NO: 2313897 - protein, 18 aa, Cryptosporidium parvum
GIPMFPFDFIETLSNQKL

SEQ ID NO: 2313898 - protein, 18 aa, Cryptosporidium parvum
GIPRSFLRAINFDEEGRL

SEQ ID NO: 2313899 - protein, 27 aa, Cryptosporidium parvum
GIPVDLLDRLLIIRTIPYNIEEMIRIV

SEQ ID NO: 2313900 - protein, 22 aa, Cryptosporidium parvum
GIQPISVPILRMNTIDTRKNVL

SEQ ID NO: 2313901 - protein, 26 aa, Cryptosporidium parvum
GIRCPFCIIGFLVPSPIFKKSEVVEP

SEQ ID NO: 2313902 - protein, 17 aa, Cryptosporidium parvum
GIRIELKNLPIGDIIWV

SEQ ID NO: 2313903 - protein, 22 aa, Cryptosporidium parvum
GIRSEYRLTPVRSLAIFLEKLK

SEQ ID NO: 2313904 - protein, 19 aa, Cryptosporidium parvum
GISDLKFKPAFNPYTEPSM

SEQ ID NO: 2313905 - protein, 20 aa, Cryptosporidium parvum
GISHLILVLGYSIETVELLN

SEQ ID NO: 2313906 - protein, 37 aa, Cryptosporidium parvum; identical to SEQ ID NO: 2190209

SEQ ID NO: 2313907 - protein, 26 aa, Cryptosporidium parvum
GISRVKLLNFLQKITLISLAEFVNSY

SEQ ID NO: 2313908 - protein, 24 aa, Cryptosporidium parvum
GISTDLLVDILLVKQLKVGNNQTP

SEQ ID NO: 2313909 - protein, 27 aa, Cryptosporidium parvum
GISTEDVLKIVYYPMTPFKILPATRCT

SEQ ID NO: 2313910 - protein, 25 aa, Cryptosporidium parvum
GITAIDLGIKVGGISPPHGIQIGGG

SEQ ID NO: 2313911 - protein, 23 aa, Cryptosporidium parvum
GITRLILEILAVLFEFDQNISVN

SEQ ID NO: 2313912 - protein, 18 aa, Cryptosporidium parvum
GITTSMGLGMTPPGSILS

SEQ ID NO: 2313913 - protein, 29 aa, Cryptosporidium parvum
GIVKEMRIYYYDTIPVCNSLLLLRSGFLF

SEQ ID NO: 2313914 - protein, 18 aa, Cryptosporidium parvum
GIYAPRLESINFPVFGAI

SEQ ID NO: 2313915 - protein, 30 aa, Cryptosporidium parvum; identical to SEQ ID NO: 2190221

SEQ ID NO: 2313916 - protein, 23 aa, Cryptosporidium parvum
GKCLFYGALFNLSNRIFFKSITY

SEQ ID NO: 2313917 - protein, 17 aa, Cryptosporidium parvum
GKCLWIDTEGTFRPERI

SEQ ID NO: 2313918 - protein, 28 aa, Cryptosporidium parvum
GKCNFDDLIKFLHRLGLSPTEDQCNELK

SEQ ID NO: 2313919 - protein, 26 aa, Cryptosporidium parvum
GKDDKIHSMLFGRLTLEQKKAVFTNH

SEQ ID NO: 2313920 - protein, 23 aa, Cryptosporidium parvum
GKDGWLIEPQEWIEFAKMALGFD

SEQ ID NO: 2313921 - protein, 27 aa, Cryptosporidium parvum
GKDLHESWICLVTLIFQMKDLIEERIK

SEQ ID NO: 2313922 - protein, 28 aa, Cryptosporidium parvum
GKEIKFILSMMLFHQSFLNFISIENNVD

SEQ ID NO: 2313923 - protein, 19 aa, Cryptosporidium parvum
GKEIYLYFGPQVDSKVISE

SEQ ID NO: 2313924 - protein, 24 aa, Cryptosporidium parvum
GKEKGACNALLLKVNQIGTVTEAI

SEQ ID NO: 2313925 - protein, 31 aa, Cryptosporidium parvum
GKEKLGFLNRDILLTDYRLIFLKDAEYSTQN

SEQ ID NO: 2313926 - protein, 27 aa, Cryptosporidium parvum
GKESIALMYYLLAREVNFLRGKTDKWD

SEQ ID NO: 2313927 - protein, 26 aa, Cryptosporidium parvum
GKESKDLFLSKFRFRILPSIPESSKL

SEQ ID NO: 2313928 - protein, 24 aa, Cryptosporidium parvum
GKEVFAYFCRCGGLIFLEKKHIEE

SEQ ID NO: 2313929 - protein, 25 aa, Cryptosporidium parvum
GKFGTAIMFCNMSDYPFLSSIEKAS

SEQ ID NO: 2313930 - protein, 20 aa, Cryptosporidium parvum
GKFLASIFRVSIGHLLDTLK

SEQ ID NO: 2313931 - protein, 25 aa, Cryptosporidium parvum
GKFSGRFICIEGMYTFLDISRMIKH

SEQ ID NO: 2313932 - protein, 28 aa, Cryptosporidium parvum
GKGLTFEDILLVPNYSEVLPREVSLETK

SEQ ID NO: 2313933 - protein, 21 aa, Cryptosporidium parvum
GKGRQPFLINLIDSPGHVDFS

SEQ ID NO: 2313934 - protein, 18 aa, Cryptosporidium parvum
GKGYYQYLINEIYLCTEC

SEQ ID NO: 2313935 - protein, 18 aa, Cryptosporidium parvum
GKICIELLGRLNKCGVIS

SEQ ID NO: 2313936 - protein, 28 aa, Cryptosporidium parvum
GKIGMEILKMIYLNWVPEEKILMMNVWS

SEQ ID NO: 2313937 - protein, 24 aa, Cryptosporidium parvum
GKIQQLLYYRMKDASLGPTITWES

SEQ ID NO: 2313938 - protein, 29 aa, Cryptosporidium parvum
GKIYKRWVFPFTYYLTYDNKFNLLENEPL

SEQ ID NO: 2313939 - protein, 20 aa, Cryptosporidium parvum
GKKHGIVLLPEGLIEFIPEF

SEQ ID NO: 2313940 - protein, 24 aa, Cryptosporidium parvum
GKKKAPPKASFSPGSRFPQVENIN

SEQ ID NO: 2313941 - protein, 24 aa, Cryptosporidium parvum
GKKSKLNFCTWPSPQLSTAVVEPY

SEQ ID NO: 2313942 - protein, 35 aa, Cryptosporidium parvum
GKLDNLFRDVIKRNQLYAFRLLQYQARIELKGRIG

SEQ ID NO: 2313943 - protein, 17 aa, Cryptosporidium parvum
GKLIRVSPKFRVPRSFK

SEQ ID NO: 2313944 - protein, 24 aa, Cryptosporidium parvum
GKLQSLRPLIYGTAGFRMNYEENP

SEQ ID NO: 2313945 - protein, 17 aa, Cryptosporidium parvum
GKLSLYITLGGIDPSKV

SEQ ID NO: 2313946 - protein, 20 aa, Cryptosporidium parvum
GKMIFHRFHKRKWKMYIDSS

SEQ ID NO: 2313947 - protein, 23 aa, Cryptosporidium parvum
GKMVLMGKLLPKLKAEGHRVLIF

SEQ ID NO: 2313948 - protein, 18 aa, Cryptosporidium parvum
GKNESILKICECQSFLLG

SEQ ID NO: 2313949 - protein, 32 aa, Cryptosporidium parvum
GKPKGFGFVLFNDRKFVISSVKMLSGAQFKDS

SEQ ID NO: 2313950 - protein, 21 aa, Cryptosporidium parvum
GKPNRKFFQEFYRYCSNPEEK

SEQ ID NO: 2313951 - protein, 25 aa, Cryptosporidium parvum
GKQDRLLPVLPQSSNSRMMRMIQQQ

SEQ ID NO: 2313952 - protein, 35 aa, Cryptosporidium parvum
GKQIKCIIFFLTCRSVEFYFKYLSKLFHNHSKNKQ

SEQ ID NO: 2313953 - protein, 24 aa, Cryptosporidium parvum
GKRIPFGFRDRSLPHFLKYDYGPE

SEQ ID NO: 2313954 - protein, 34 aa, Cryptosporidium parvum
GKSFDYTILFQSISRLFLLPRPGTSLVNLVVALE

SEQ ID NO: 2313955 - protein, 26 aa, Cryptosporidium parvum
GKSKWKDFIFWDQAKNSWVGLLRPNG

SEQ ID NO: 2313956 - protein, 27 aa, Cryptosporidium parvum
GKSNVIDAMLFVFGKRAKHMRLNKVSE

SEQ ID NO: 2313957 - protein, 49 aa, Cryptosporidium parvum; identical to SEQ ID NO: 2190248

SEQ ID NO: 2313958 - protein, 23 aa, Cryptosporidium parvum
GKSSLWKSLAIYLIGALEIETTD

SEQ ID NO: 2313959 - protein, 24 aa, Cryptosporidium parvum
GKSTLMGHLFVSLGLISEGVMRKY

SEQ ID NO: 2313960 - protein, 32 aa, Cryptosporidium parvum; identical to SEQ ID NO: 2190250

SEQ ID NO: 2313961 - protein, 27 aa, Cryptosporidium parvum
GKTIQTISLLAYLACYMKNWGPHLIVV

SEQ ID NO: 2313962 - protein, 23 aa, Cryptosporidium parvum
GKTLSFLVPAIQRSLLNDIGRTT

SEQ ID NO: 2313963 - protein, 27 aa, Cryptosporidium parvum
GKTQWCLTLITSVLLRNLDFSKVMGEL

SEQ ID NO: 2313964 - protein, 23 aa, Cryptosporidium parvum
GKVGVIVFVGRNKNLRLLTSTGE

SEQ ID NO: 2313965 - protein, 23 aa, Cryptosporidium parvum
GKVIGNLWQPWLVLLQNNVPEGE

SEQ ID NO: 2313966 - protein, 31 aa, Cryptosporidium parvum; identical to SEQ ID NO: 2190255

SEQ ID NO: 2313967 - protein, 29 aa, Cryptosporidium parvum
GKWEVEYFQVFHFITLKKSLNCLLNLSKS

SEQ ID NO: 2313968 - protein, 25 aa, Cryptosporidium parvum
GKYQALMSILKLWRDKKEHRVLIFT

SEQ ID NO: 2313969 - protein, 26 aa, Cryptosporidium parvum
GKYQDNLEFLQWMKGLFDESGAIDRD

SEQ ID NO: 2313970 - protein, 17 aa, Cryptosporidium parvum
GKYTGLGIHAFVGGLSL

SEQ ID NO: 2313971 - protein, 33 aa, Cryptosporidium parvum
GLCESEIFEILRICAGILHLCNFDFIQESASDA

SEQ ID NO: 2313972 - protein, 17 aa, Cryptosporidium parvum
GLDQLDYLPYNCKLHSN

SEQ ID NO: 2313973 - protein, 26 aa, Cryptosporidium parvum
GLEAVQMLMKYLYRNDLIVAPIDTNV

SEQ ID NO: 2313974 - protein, 25 aa, Cryptosporidium parvum
GLEDSSLILLLQENYIPFIGNCADI

SEQ ID NO: 2313975 - protein, 25 aa, Cryptosporidium parvum
GLEFKVGFGGIWKKSLTELSGGQRS

SEQ ID NO: 2313976 - protein, 21 aa, Cryptosporidium parvum
GLEGLLTYKYTLRGQGQTITQ

SEQ ID NO: 2313977 - protein, 18 aa, Cryptosporidium parvum
GLEIQYNYITKVNLQLLK

SEQ ID NO: 2313978 - protein, 23 aa, Cryptosporidium parvum
GLEPNFNFPLFSNLSKCKFHSNS

SEQ ID NO: 2313979 - protein, 25 aa, Cryptosporidium parvum
GLERIDIPIILGKIEKPRNSLFVAD

SEQ ID NO: 2313980 - protein, 28 aa, Cryptosporidium parvum
GLEYQLRVRKLIQSILWKIIKSAHKSNI

SEQ ID NO: 2313981 - protein, 36 aa, Cryptosporidium parvum
GLFLPNSMYVILNGFKLLFPDIFTCNVSIESFAEPP

SEQ ID NO: 2313982 - protein, 23 aa, Cryptosporidium parvum
GLGFVVAFFLLQLTPEDTVRLAL

SEQ ID NO: 2313983 - protein, 17 aa, Cryptosporidium parvum
GLGKYTVYLVSGVTPDG

SEQ ID NO: 2313984 - protein, 17 aa, Cryptosporidium parvum
GLGLGLGSGSSGLSSSG

SEQ ID NO: 2313985 - protein, 24 aa, Cryptosporidium parvum
GLGSSLYEYSFNSAALKLDKLISS

SEQ ID NO: 2313986 - protein, 34 aa, Cryptosporidium parvum; identical to SEQ ID NO: 2190273

SEQ ID NO: 2313987 - protein, 18 aa, Cryptosporidium parvum
GLHPAEGPVIWSEYRRFL

SEQ ID NO: 2313988 - protein, 25 aa, Cryptosporidium parvum
GLIEKCLKLFLHPTITPVELSARFN

SEQ ID NO: 2313989 - protein, 27 aa, Cryptosporidium parvum
GLIMDPTLPPCLFEWKKQAKISRVTIE

SEQ ID NO: 2313990 - protein, 18 aa, Cryptosporidium parvum
GLINRYYNRRRPILCITV

SEQ ID NO: 2313991 - protein, 18 aa, Cryptosporidium parvum
GLIPGEKLLGELFGMMDD

SEQ ID NO: 2313992 - protein, 35 aa, Cryptosporidium parvum
GLIQDKFYRNIWIKFLNRFGIWLRKNDESVFLECF

SEQ ID NO: 2313993 - protein, 18 aa, Cryptosporidium parvum
GLISAARLLVHLYESNTL

SEQ ID NO: 2313994 - protein, 17 aa, Cryptosporidium parvum
GLKIKRKYKKYIRKIIE

SEQ ID NO: 2313995 - protein, 20 aa, Cryptosporidium parvum
GLKLETTFVLPCGIPGSGKS

SEQ ID NO: 2313996 - protein, 23 aa, Cryptosporidium parvum
GLKPDFLFGRCEVPIDDICREQL

SEQ ID NO: 2313997 - protein, 22 aa, Cryptosporidium parvum
GLKSSLLFGFNLDLIKLHALTP

SEQ ID NO: 2313998 - protein, 28 aa, Cryptosporidium parvum
GLKTSFFCSQVCFKENWAIHKLKHQLGG

SEQ ID NO: 2313999 - protein, 19 aa, Cryptosporidium parvum
GLLCDLLWSDPEKDVRGWG

SEQ ID NO: 2314000 - protein, 24 aa, Cryptosporidium parvum
GLLCDPREYYFNPMTMTGASGANR

SEQ ID NO: 2314001 - protein, 18 aa, Cryptosporidium parvum
GLLKSPINGLSRSSQDLR

SEQ ID NO: 2314002 - protein, 21 aa, Cryptosporidium parvum
GLLSLILTPTRELASQVFDVI

SEQ ID NO: 2314003 - protein, 31 aa, Cryptosporidium parvum
GLLTRYQAQFYIGSIILALEYLHERSIVYRD

SEQ ID NO: 2314004 - protein, 20 aa, Cryptosporidium parvum
GLNFRNTAIGKSKTISNCEY

SEQ ID NO: 2314005 - protein, 17 aa, Cryptosporidium parvum
GLNIMKNSKEQIGGIIP

SEQ ID NO: 2314006 - protein, 28 aa, Cryptosporidium parvum
GLNLLSNFRAFHKYNRFMKVALTVIAQQ

SEQ ID NO: 2314007 - protein, 32 aa, Cryptosporidium parvum
GLNLQVANYVFLLDPWWNPAVELQAFQRAHRI

SEQ ID NO: 2314008 - protein, 18 aa, Cryptosporidium parvum
GLNPMDLLRGIKLGVEHV

SEQ ID NO: 2314009 - protein, 21 aa, Cryptosporidium parvum
GLPNALWNTDIYLRERDRGVL

SEQ ID NO: 2314010 - protein, 24 aa, Cryptosporidium parvum
GLQDNIFGFIKLLSSFIELCKFNK

SEQ ID NO: 2314011 - protein, 17 aa, Cryptosporidium parvum
GLQFPVGRIQRMLKHRI

SEQ ID NO: 2314012 - protein, 20 aa, Cryptosporidium parvum
GLQGFLMFNAVGGGTGAGLG

SEQ ID NO: 2314013 - protein, 17 aa, Cryptosporidium parvum
GLQPVFVQRSNSNSGFI

SEQ ID NO: 2314014 - protein, 28 aa, Cryptosporidium parvum
GLQVKEISNLLLLFKKLQENVDASIQFK

SEQ ID NO: 2314015 - protein, 26 aa, Cryptosporidium parvum
GLRTVELFYLKYCLPKLGDILKKYNV

SEQ ID NO: 2314016 - protein, 24 aa, Cryptosporidium parvum
GLRVIIVCHGGVIKSFRALLESER

SEQ ID NO: 2314017 - protein, 22 aa, Cryptosporidium parvum
GLSDRMIVEFFLSAYSIPSNTY

SEQ ID NO: 2314018 - protein, 24 aa, Cryptosporidium parvum
GLSELPLTCLAWSNSSKFLACGGL

SEQ ID NO: 2314019 - protein, 18 aa, Cryptosporidium parvum
GLSFYRSIQKATLGCIKE

SEQ ID NO: 2314020 - protein, 22 aa, Cryptosporidium parvum
GLSHKLNYLISIMFEKLYHGTE

SEQ ID NO: 2314021 - protein, 26 aa, Cryptosporidium parvum
GLSILYNIMLKFKRLTESKLKVFVNA

SEQ ID NO: 2314022 - protein, 27 aa, Cryptosporidium parvum
GLSVCKHIFCFVCIKQWSDVATQCPLC

SEQ ID NO: 2314023 - protein, 18 aa, Cryptosporidium parvum
GLSWNSLICERLILKREK

SEQ ID NO: 2314024 - protein, 24 aa, Cryptosporidium parvum
GLTKLITRLQYLKTSSQELLIENR

SEQ ID NO: 2314025 - protein, 17 aa, Cryptosporidium parvum
GLVKLNRFEKKGNIAFI

SEQ ID NO: 2314026 - protein, 27 aa, Cryptosporidium parvum
GLVKNKLPHYGFTDILIAFETNLNWKG

SEQ ID NO: 2314027 - protein, 26 aa, Cryptosporidium parvum
GLVLVLVLELVFKLKLGVVSLNIKCL

SEQ ID NO: 2314028 - protein, 20 aa, Cryptosporidium parvum
GLYELLYASVSFTTATLYPR

SEQ ID NO: 2314029 - protein, 18 aa, Cryptosporidium parvum
GMCGTSIQWGPWIEQGMA

SEQ ID NO: 2314030 - protein, 24 aa, Cryptosporidium parvum
GMECFKFIMNDSRFNDIPLILETP

SEQ ID NO: 2314031 - protein, 22 aa, Cryptosporidium parvum
GMFIYYEDTRLFWFNMASLESN

SEQ ID NO: 2314032 - protein, 17 aa, Cryptosporidium parvum
GMFLRGNVIYIYGGLFE

SEQ ID NO: 2314033 - protein, 21 aa, Cryptosporidium parvum
GMGADILHALGFNKTSNSDNS

SEQ ID NO: 2314034 - protein, 19 aa, Cryptosporidium parvum
GMGFDYIWNTSICSSLQDI

SEQ ID NO: 2314035 - protein, 18 aa, Cryptosporidium parvum
GMGGIMDVGYNQKLFYYQ

SEQ ID NO: 2314036 - protein, 19 aa, Cryptosporidium parvum
GMGPISRKIPKGPFKILDA

SEQ ID NO: 2314037 - protein, 19 aa, Cryptosporidium parvum
GMHINISLWKNEKNIFFDP

SEQ ID NO: 2314038 - protein, 26 aa, Cryptosporidium parvum
GMHTELSLYEELLKYLFSKRDLNEET

SEQ ID NO: 2314039 - protein, 18 aa, Cryptosporidium parvum
GMIIGKEENIVFGRLSDM

SEQ ID NO: 2314040 - protein, 21 aa, Cryptosporidium parvum
GMLIWKSTNFIRHCDIILTAH

SEQ ID NO: 2314041 - protein, 31 aa, Cryptosporidium parvum
GMLPIIKEMTEILFTRGLIKVLFATETISMG

SEQ ID NO: 2314042 - protein, 21 aa, Cryptosporidium parvum
GMNGLKFSYYSKIKFVLVVEK

SEQ ID NO: 2314043 - protein, 21 aa, Cryptosporidium parvum
GMRYCHRYKNIYLLEISAHSL

SEQ ID NO: 2314044 - protein, 17 aa, Cryptosporidium parvum
GMRYIFGDLPLDEFEEG

SEQ ID NO: 2314045 - protein, 29 aa, Cryptosporidium parvum
GMSIRLDFDQLLPIIILGNDRLYLEELKA

SEQ ID NO: 2314046 - protein, 22 aa, Cryptosporidium parvum
GMTACYCCAPPLVNFESNFSED

SEQ ID NO: 2314047 - protein, 19 aa, Cryptosporidium parvum
GMYLLDARQYLLDVIAKKR

SEQ ID NO: 2314048 - protein, 24 aa, Cryptosporidium parvum
GNCKLFNELALIWCILKTFAISTK

SEQ ID NO: 2314049 - protein, 23 aa, Cryptosporidium parvum
GNDLRQILNELQLLSLSNINVRF

SEQ ID NO: 2314050 - protein, 26 aa, Cryptosporidium parvum
GNEDFTTMLMLPFSKILSSEQDELLR

SEQ ID NO: 2314051 - protein, 22 aa, Cryptosporidium parvum
GNEIFLGIKYTIIGLGSSLYEY

SEQ ID NO: 2314052 - protein, 23 aa, Cryptosporidium parvum
GNFAAIPNAFLSQPGISGLGAPN

SEQ ID NO: 2314053 - protein, 19 aa, Cryptosporidium parvum
GNFMLAIFAALKSTYAYLT

SEQ ID NO: 2314054 - protein, 17 aa, Cryptosporidium parvum
GNFPFICNDLNLTQIES

SEQ ID NO: 2314055 - protein, 22 aa, Cryptosporidium parvum
GNFQPFTHFFGYQGRSAMPSQF

SEQ ID NO: 2314056 - protein, 25 aa, Cryptosporidium parvum
GNFTFPPVCLARRYFPRSISCPGIL

SEQ ID NO: 2314057 - protein, 33 aa, Cryptosporidium parvum; identical to SEQ ID NO: 2190333

SEQ ID NO: 2314058 - protein, 18 aa, Cryptosporidium parvum
GNGFFRRCRSRSSKQTRK

SEQ ID NO: 2314059 - protein, 21 aa, Cryptosporidium parvum
GNGKVVRIEVWFGTPRHQSAI

SEQ ID NO: 2314060 - protein, 26 aa, Cryptosporidium parvum
GNHEYNLFFNNFYKDYELGILEEFNT

SEQ ID NO: 2314061 - protein, 31 aa, Cryptosporidium parvum
GNHSSVWGSYYDPNVKKWGFKCCKNLKRSSV

SEQ ID NO: 2314062 - protein, 27 aa, Cryptosporidium parvum
GNINIRIKKHRWYPKILKSDDVLTFSI

SEQ ID NO: 2314063 - protein, 22 aa, Cryptosporidium parvum
GNIVPRLFLLITAGACYIRSLE

SEQ ID NO: 2314064 - protein, 20 aa, Cryptosporidium parvum
GNKILLPPSALNQLARRNIT

SEQ ID NO: 2314065 - protein, 32 aa, Cryptosporidium parvum
GNKKIYETILKLYETYIISYQESLWFSKKQNS

SEQ ID NO: 2314066 - protein, 21 aa, Cryptosporidium parvum
GNKLISTIHNLLYELESRGEH

SEQ ID NO: 2314067 - protein, 28 aa, Cryptosporidium parvum
GNLFETYLKPYFLEAYRPVKKGDAFLVR

SEQ ID NO: 2314068 - protein, 17 aa, Cryptosporidium parvum
GNLLNYLFNKYPCLEFQ

SEQ ID NO: 2314069 - protein, 29 aa, Cryptosporidium parvum
GNLNGMWYIKGIVTKGIWPFLSATNKVKR

SEQ ID NO: 2314070 - protein, 23 aa, Cryptosporidium parvum
GNLYKYPAIIKTIPDFLESSIQT

SEQ ID NO: 2314071 - protein, 25 aa, Cryptosporidium parvum
GNNESFKCDILKIGPLAFAPNSEEI

SEQ ID NO: 2314072 - protein, 32 aa, Cryptosporidium parvum
GNNNIIYNLLQFLLDHFWGNPSFRLESIKCLT

SEQ ID NO: 2314073 - protein, 18 aa, Cryptosporidium parvum
GNNQFGLNLKFKDKSHLK

SEQ ID NO: 2314074 - protein, 18 aa, Cryptosporidium parvum
GNNVGIPGICRNNPMNVG

SEQ ID NO: 2314075 - protein, 22 aa, Cryptosporidium parvum
GNNYPFILGDEQIEKITYGQQN

SEQ ID NO: 2314076 - protein, 24 aa, Cryptosporidium parvum
GNPINEFFILNKSFPENIHIIFDY

SEQ ID NO: 2314077 - protein, 28 aa, Cryptosporidium parvum
GNQYHKRLFRLFLLASYLKRGDKLVNLK

SEQ ID NO: 2314078 - protein, 26 aa, Cryptosporidium parvum
GNRIIKPFQIRFILVLLQGNILEHGF

SEQ ID NO: 2314079 - protein, 25 aa, Cryptosporidium parvum
GNRRCILNRLQAWNGAPLSGAGHPD

SEQ ID NO: 2314080 - protein, 30 aa, Cryptosporidium parvum
GNRSSISLLLPICSAYYIGQLLALYEHRTA

SEQ ID NO: 2314081 - protein, 26 aa, Cryptosporidium parvum
GNSGLFRPEMLRPLGFPSDIVVIAWG

SEQ ID NO: 2314082 - protein, 21 aa, Cryptosporidium parvum
GNSHYKPIIPPNSVLLPVIEN

SEQ ID NO: 2314083 - protein, 26 aa, Cryptosporidium parvum
GNSIFFYKPWIPIMRISFKHNNEKYN

SEQ ID NO: 2314084 - protein, 19 aa, Cryptosporidium parvum
GNSNLLNAVSIFDSKMGDE

SEQ ID NO: 2314085 - protein, 26 aa, Cryptosporidium parvum
GNSNMLTGYPILYQNNHHNHPAGDLL

SEQ ID NO: 2314086 - protein, 42 aa, Cryptosporidium parvum; identical to SEQ ID NO: 2190371

SEQ ID NO: 2314087 - protein, 26 aa, Cryptosporidium parvum
GNTLEMFRILGRYNPLFFRPRIRSAV

SEQ ID NO: 2314088 - protein, 17 aa, Cryptosporidium parvum
GNTPKYGLLFQSTYIGK

SEQ ID NO: 2314089 - protein, 34 aa, Cryptosporidium parvum
GNTRKFLNGLLPLINNLIISLSNKLYILGQFTKL

SEQ ID NO: 2314090 - protein, 20 aa, Cryptosporidium parvum
GNVFLWCLENERRQLPSKNI

SEQ ID NO: 2314091 - protein, 29 aa, Cryptosporidium parvum
GNVPEELAIIWIRQILEGILYLNNLDKNG

SEQ ID NO: 2314092 - protein, 25 aa, Cryptosporidium parvum
GNVPWIISTLLEQKIWMHDSSGKQI

SEQ ID NO: 2314093 - protein, 22 aa, Cryptosporidium parvum
GNVSYIDAVLHKNDSNSGGVTT

SEQ ID NO: 2314094 - protein, 17 aa, Cryptosporidium parvum
GNWLAICGPRLGFKPAY

SEQ ID NO: 2314095 - protein, 18 aa, Cryptosporidium parvum
GNYFLFSRDILQSDKDDD

SEQ ID NO: 2314096 - protein, 20 aa, Cryptosporidium parvum
GPFLFIRIDGKTPGNKREEY

SEQ ID NO: 2314097 - protein, 25 aa, Cryptosporidium parvum
GPFSTRHMSSLWKSYTFTHETLFTM

SEQ ID NO: 2314098 - protein, 19 aa, Cryptosporidium parvum
GPGNRRKYYPGEEIPILSI

SEQ ID NO: 2314099 - protein, 40 aa, Cryptosporidium parvum; identical to SEQ ID NO: 2190383

SEQ ID NO: 2314100 - protein, 21 aa, Cryptosporidium parvum
GPHQFILISELIEHILHESNI

SEQ ID NO: 2314101 - protein, 23 aa, Cryptosporidium parvum
GPKAMLKMLLDPLGGIVLTNDGN

SEQ ID NO: 2314102 - protein, 25 aa, Cryptosporidium parvum
GPKDIMYEIIHRLYKRDKQQIFAEP

SEQ ID NO: 2314103 - protein, 23 aa, Cryptosporidium parvum
GPKLQEWLGLRDWKNNQSKKQNV

SEQ ID NO: 2314104 - protein, 20 aa, Cryptosporidium parvum
GPNFAFFPHTELEPALKLLR

SEQ ID NO: 2314105 - protein, 23 aa, Cryptosporidium parvum
GPNIICGILTRKGLLSAYSMGVS

SEQ ID NO: 2314106 - protein, 27 aa, Cryptosporidium parvum
GPSLDCEGIIIYGYYEDGDLAPRFIYF

SEQ ID NO: 2314107 - protein, 18 aa, Cryptosporidium parvum
GPTHPYGYVIQPPNMINP

SEQ ID NO: 2314108 - protein, 28 aa, Cryptosporidium parvum
GPTRSQLQQLFFFSAPSLLPYVDEIVES

SEQ ID NO: 2314109 - protein, 20 aa, Cryptosporidium parvum
GPTTGSIFGSSPFGGSISGS

SEQ ID NO: 2314110 - protein, 23 aa, Cryptosporidium parvum
GPYNSIVMMSWIVKGYFGENSKL

SEQ ID NO: 2314111 - protein, 22 aa, Cryptosporidium parvum
GQAIHLFCMKGSSLFYSRDETK

SEQ ID NO: 2314112 - protein, 22 aa, Cryptosporidium parvum
GQAKVVLKVSFKELLESERRAK

SEQ ID NO: 2314113 - protein, 22 aa, Cryptosporidium parvum
GQFFDLLELFRIGGMPPDVNYL

SEQ ID NO: 2314114 - protein, 18 aa, Cryptosporidium parvum
GQFMIKINHRQLLDGILE

SEQ ID NO: 2314115 - protein, 19 aa, Cryptosporidium parvum
GQFPAFFAVFTREFENAVV

SEQ ID NO: 2314116 - protein, 30 aa, Cryptosporidium parvum
GQGNGLELWIILNTFRYIPVAGVLLESQKR

SEQ ID NO: 2314117 - protein, 39 aa, Cryptosporidium parvum
GQIAEIPLDLTDEYLAKWLDGKNALIIRKLVNGDKDMQT

SEQ ID NO: 2314118 - protein, 17 aa, Cryptosporidium parvum
GQIAPPIHHATAPGPQS

SEQ ID NO: 2314119 - protein, 18 aa, Cryptosporidium parvum
GQIIISFTQLLPVPKAHF

SEQ ID NO: 2314120 - protein, 20 aa, Cryptosporidium parvum
GQIIPIPPNPVNQVVGRSCS

SEQ ID NO: 2314121 - protein, 23 aa, Cryptosporidium parvum
GQIRLRYVSSLYPKLKYIQDEQA

SEQ ID NO: 2314122 - protein, 25 aa, Cryptosporidium parvum
GQKALNLVKLRRLFTSKSIELPFFV

SEQ ID NO: 2314123 - protein, 27 aa, Cryptosporidium parvum
GQKDSRIWGLWAVLDFLNNSRKQSETF

SEQ ID NO: 2314124 - protein, 33 aa, Cryptosporidium parvum
GQKKKKWHQKFKLSFLLFSYNKNIEKNKVKSIK

SEQ ID NO: 2314125 - protein, 25 aa, Cryptosporidium parvum
GQKKNCYIYRLFSTGTIEEKIYQRQ

SEQ ID NO: 2314126 - protein, 26 aa, Cryptosporidium parvum
GQKLDLRAKQKFEYNRRFSREKTGNF

SEQ ID NO: 2314127 - protein, 26 aa, Cryptosporidium parvum
GQKVLDIWFPYIVQSLLQAFKRENSD

SEQ ID NO: 2314128 - protein, 31 aa, Cryptosporidium parvum; identical to SEQ ID NO: 2190407

SEQ ID NO: 2314129 - protein, 20 aa, Cryptosporidium parvum
GQLEVFPLRSFAKDNNINIE

SEQ ID NO: 2314130 - protein, 17 aa, Cryptosporidium parvum
GQLLGLEKQLRNDTRQK

SEQ ID NO: 2314131 - protein, 26 aa, Cryptosporidium parvum
GQLLNCWLPHYKPINKIKLVQGNSIL

SEQ ID NO: 2314132 - protein, 18 aa, Cryptosporidium parvum
GQLLVKYQHGIDKEIAKW

SEQ ID NO: 2314133 - protein, 23 aa, Cryptosporidium parvum
GQMMRFDMRESFPLLTTKKVAIR

SEQ ID NO: 2314134 - protein, 17 aa, Cryptosporidium parvum
GQNIESQEFRFGEGTFT

SEQ ID NO: 2314135 - protein, 24 aa, Cryptosporidium parvum
GQNKKPILNYYSGGIYPQSMQIPT

SEQ ID NO: 2314136 - protein, 25 aa, Cryptosporidium parvum
GQNSYLQKYDIDNDNIFGNAGLNNG

SEQ ID NO: 2314137 - protein, 22 aa, Cryptosporidium parvum
GQNVMFSNYMWVSKRKILGCVV

SEQ ID NO: 2314138 - protein, 17 aa, Cryptosporidium parvum
GQQDKLLDPAYVTSLYK

SEQ ID NO: 2314139 - protein, 24 aa, Cryptosporidium parvum
GQRCDHIFLPPTHLSKKLAQYEPY

SEQ ID NO: 2314140 - protein, 22 aa, Cryptosporidium parvum
GQSRIHLFTWAADKLWEDSDVM

SEQ ID NO: 2314141 - protein, 23 aa, Cryptosporidium parvum
GQSTDRFLVALIFPNEQALRKWS

SEQ ID NO: 2314142 - protein, 25 aa, Cryptosporidium parvum
GQVSALHELLRPHLLRRVKEDVMKE

SEQ ID NO: 2314143 - protein, 18 aa, Cryptosporidium parvum
GRAALVVFPFVSLVSEKR

SEQ ID NO: 2314144 - protein, 26 aa, Cryptosporidium parvum
GRCNCGYPIFIINGEVIAGSSGFGCN

SEQ ID NO: 2314145 - protein, 17 aa, Cryptosporidium parvum
GRDGLYVKEIAIKVVER

SEQ ID NO: 2314146 - protein, 19 aa, Cryptosporidium parvum
GRDLLNRLLQLMSAMERLD

SEQ ID NO: 2314147 - protein, 24 aa, Cryptosporidium parvum
GREIGSCICCHLIYEDEMNVYRAD

SEQ ID NO: 2314148 - protein, 31 aa, Cryptosporidium parvum
GRFTSVISKILLLRGLSLRSLLNYNTREFLA

SEQ ID NO: 2314149 - protein, 25 aa, Cryptosporidium parvum
GRHLRLMRAGFGIMAYLLSENLCIE

SEQ ID NO: 2314150 - protein, 19 aa, Cryptosporidium parvum
GRHRFKHPPTKSPPGYWDL

SEQ ID NO: 2314151 - protein, 18 aa, Cryptosporidium parvum
GRIAWMDHIPVSIGWTLE

SEQ ID NO: 2314152 - protein, 24 aa, Cryptosporidium parvum
GRIFDLRIIRFIKINDIHALTGSI

SEQ ID NO: 2314153 - protein, 25 aa, Cryptosporidium parvum
GRIPSVFRIVYILPEYAKALLKSYK

SEQ ID NO: 2314154 - protein, 25 aa, Cryptosporidium parvum
GRIRDILILLDLPTASPVSWKRFIP

SEQ ID NO: 2314155 - protein, 19 aa, Cryptosporidium parvum
GRIVGYAGFYIIPHLGRKN

SEQ ID NO: 2314156 - protein, 34 aa, Cryptosporidium parvum; identical to SEQ ID NO: 2190432

SEQ ID NO: 2314157 - protein, 29 aa, Cryptosporidium parvum
GRKAISVLYKLLFLLCKLNFINFSIDDSK

SEQ ID NO: 2314158 - protein, 24 aa, Cryptosporidium parvum
GRKEKLFVFGNDWPTRDGTGVRDY

SEQ ID NO: 2314159 - protein, 26 aa, Cryptosporidium parvum
GRKSFILRINFLLPTGISLEQLPSTL

SEQ ID NO: 2314160 - protein, 29 aa, Cryptosporidium parvum
GRKSWVRLYIEIIGIMYIMFNECHLIHGD

SEQ ID NO: 2314161 - protein, 24 aa, Cryptosporidium parvum
GRLISIVCQLNKGVFKVLHVSDSI

SEQ ID NO: 2314162 - protein, 21 aa, Cryptosporidium parvum
GRLRAPLLRNRVVKAAEAANP

SEQ ID NO: 2314163 - protein, 24 aa, Cryptosporidium parvum
GRMILRDYWSGKLLYCHTPPSNTK

SEQ ID NO: 2314164 - protein, 21 aa, Cryptosporidium parvum
GRNQMLFKSIIYKLANKNGNN

SEQ ID NO: 2314165 - protein, 17 aa, Cryptosporidium parvum
GRNYYIDFVIDDVIFRC

SEQ ID NO: 2314166 - protein, 25 aa, Cryptosporidium parvum
GRPLKDIIIIDNSPISYILQPENAI

SEQ ID NO: 2314167 - protein, 51 aa, Cryptosporidium parvum
GRPSHALLICKRICHFDSRLSKLYRSMYIQNYRVGLKILKKRAALNNEEKI

SEQ ID NO: 2314168 - protein, 21 aa, Cryptosporidium parvum
GRQFPVQLNYLPEPELDYLEA

SEQ ID NO: 2314169 - protein, 25 aa, Cryptosporidium parvum
GRQMARFPLDPPLSKVLLTANKLDC

SEQ ID NO: 2314170 - protein, 30 aa, Cryptosporidium parvum; identical to SEQ ID NO: 2190440

SEQ ID NO: 2314171 - protein, 20 aa, Cryptosporidium parvum
GRRHTLILIKPGSIKRYGIP

SEQ ID NO: 2314172 - protein, 33 aa, Cryptosporidium parvum
GRRINNILMVVFFSLTNIIPLDLAIKLVKEAIK

SEQ ID NO: 2314173 - protein, 20 aa, Cryptosporidium parvum
GRSALMKLLDDMRVPVEKGD

SEQ ID NO: 2314174 - protein, 23 aa, Cryptosporidium parvum
GRSRGFGFVTFKDPKTVEIVQNI

SEQ ID NO: 2314175 - protein, 30 aa, Cryptosporidium parvum; identical to SEQ ID NO: 2190444

SEQ ID NO: 2314176 - protein, 25 aa, Cryptosporidium parvum
GRTGYAITFFTLRDIPKIKSIAKVI

SEQ ID NO: 2314177 - protein, 23 aa, Cryptosporidium parvum
GRTRQWLESLSTLFDGVYTQRST

SEQ ID NO: 2314178 - protein, 26 aa, Cryptosporidium parvum
GRVRIGKFILDTWYFSPLPDEYQNVD

SEQ ID NO: 2314179 - protein, 24 aa, Cryptosporidium parvum
GSAGLLFCVLGDGVAYLLSIPLLN

SEQ ID NO: 2314180 - protein, 17 aa, Cryptosporidium parvum
GSATFPFFGIEPAILDP

SEQ ID NO: 2314181 - protein, 21 aa, Cryptosporidium parvum
GSAYFSIGNTKVLCGIYGPNL

SEQ ID NO: 2314182 - protein, 28 aa, Cryptosporidium parvum
GSDFEDYFLKRELLMGIYEKGFERPSPI

SEQ ID NO: 2314183 - protein, 23 aa, Cryptosporidium parvum
GSEKLIFLLSTRAGGIGINLATA

SEQ ID NO: 2314184 - protein, 25 aa, Cryptosporidium parvum
GSEPDIYIYMLLNGKPFSCIRDPIS

SEQ ID NO: 2314185 - protein, 25 aa, Cryptosporidium parvum
GSFILPVNYYRKFGMSSNIIAITQA

SEQ ID NO: 2314186 - protein, 23 aa, Cryptosporidium parvum
GSFSTFIVFKYIEASVHLGQIQE

SEQ ID NO: 2314187 - protein, 30 aa, Cryptosporidium parvum; identical to SEQ ID NO: 2190463

SEQ ID NO: 2314188 - protein, 25 aa, Cryptosporidium parvum
GSGDTFFFRQLQCELCKSPLPSSAS

SEQ ID NO: 2314189 - protein, 32 aa, Cryptosporidium parvum; identical to SEQ ID NO: 2190465

SEQ ID NO: 2314190 - protein, 25 aa, Cryptosporidium parvum
GSGKSLLIMHLIAISILPEEIGGHD

SEQ ID NO: 2314191 - protein, 29 aa, Cryptosporidium parvum
GSGKTAAFLFPIVMKMLNDGPPPTPQQSS

SEQ ID NO: 2314192 - protein, 30 aa, Cryptosporidium parvum; identical to SEQ ID NO: 2190468

SEQ ID NO: 2314193 - protein, 29 aa, Cryptosporidium parvum
GSGKTIVFVLPMIMFSLEAELSLPFKGME

SEQ ID NO: 2314194 - protein, 24 aa, Cryptosporidium parvum
GSGKTLCYILPILGRLKNDKVYCA

SEQ ID NO: 2314195 - protein, 32 aa, Cryptosporidium parvum; identical to SEQ ID NO: 2190472

SEQ ID NO: 2314196 - protein, 23 aa, Cryptosporidium parvum
GSGTAHIGFPKPSLGGGTNQGGL

SEQ ID NO: 2314197 - protein, 25 aa, Cryptosporidium parvum
GSGWHYYHQILNQYKPCQSMIQFKY

SEQ ID NO: 2314198 - protein, 25 aa, Cryptosporidium parvum
GSHECPICRSLLKEELWLSKSDQLV

SEQ ID NO: 2314199 - protein, 19 aa, Cryptosporidium parvum
GSIAIPLIENIIQSKDEKL

SEQ ID NO: 2314200 - protein, 41 aa, Cryptosporidium parvum; identical to SEQ ID NO: 2190474

SEQ ID NO: 2314201 - protein, 25 aa, Cryptosporidium parvum
GSKEGLFFYILLENNAKKSSECMGR

SEQ ID NO: 2314202 - protein, 36 aa, Cryptosporidium parvum
GSKGLINFTIKRNDFRNIPMLVSNLFGTTNLKKQML

SEQ ID NO: 2314203 - protein, 24 aa, Cryptosporidium parvum
GSKSKANWWPFHGSTAGLVCGGAA

SEQ ID NO: 2314204 - protein, 19 aa, Cryptosporidium parvum
GSLAFFENSLNSGGCIFPN

SEQ ID NO: 2314205 - protein, 18 aa, Cryptosporidium parvum
GSLAMRRSGNLTPTVIKC

SEQ ID NO: 2314206 - protein, 25 aa, Cryptosporidium parvum
GSLKLYSKILKLLPGTFKIALCVGL

SEQ ID NO: 2314207 - protein, 23 aa, Cryptosporidium parvum
GSLSFWKVIYDLNSKSKIKSIEC

SEQ ID NO: 2314208 - protein, 24 aa, Cryptosporidium parvum
GSMERVCLFLNLANDPTIERILTP

SEQ ID NO: 2314209 - protein, 27 aa, Cryptosporidium parvum
GSMSQLFILCKFDFDLFSKIIASIKII

SEQ ID NO: 2314210 - protein, 21 aa, Cryptosporidium parvum
GSNFIGINSIKMGGGSNLGGD

SEQ ID NO: 2314211 - protein, 23 aa, Cryptosporidium parvum
GSNKIWVWTVHDFSEEQKLEQFA

SEQ ID NO: 2314212 - protein, 23 aa, Cryptosporidium parvum
GSNLQLFFFDSNVSPGSCFWLPA

SEQ ID NO: 2314213 - protein, 19 aa, Cryptosporidium parvum
GSNNLYFPKLISASKDFTL

SEQ ID NO: 2314214 - protein, 27 aa, Cryptosporidium parvum
GSNSDFGLILLQNGMLWNWDRRQAQTE

SEQ ID NO: 2314215 - protein, 17 aa, Cryptosporidium parvum
GSPFNIASYAILTMMLA

SEQ ID NO: 2314216 - protein, 22 aa, Cryptosporidium parvum
GSPYSFVSQFPYLKVSKFDENS

SEQ ID NO: 2314217 - protein, 21 aa, Cryptosporidium parvum
GSQFFITTVPCPWLDGKHVVF

SEQ ID NO: 2314218 - protein, 20 aa, Cryptosporidium parvum
GSQNPPLMGALSGAPHEFQA

SEQ ID NO: 2314219 - protein, 26 aa, Cryptosporidium parvum
GSRIKYRNDLFNLLCDAIGLSHDERS

SEQ ID NO: 2314220 - protein, 25 aa, Cryptosporidium parvum
GSRNIYVIDFGLAKRFRDPKTLQHI

SEQ ID NO: 2314221 - protein, 25 aa, Cryptosporidium parvum
GSRQSIFKMLYLKINKNLIEKERMR

SEQ ID NO: 2314222 - protein, 21 aa, Cryptosporidium parvum
GSSCPFVKSVLGRIFVNPTGN

SEQ ID NO: 2314223 - protein, 24 aa, Cryptosporidium parvum
GSSFTRFLTLRYSRLFPIPERTLS

SEQ ID NO: 2314224 - protein, 29 aa, Cryptosporidium parvum
GSSGKRAPPPKAPPPLKPPPKRGTTSQGF

SEQ ID NO: 2314225 - protein, 28 aa, Cryptosporidium parvum
GSSIKFFMKRYWLDIKLFGKMLYENKRE

SEQ ID NO: 2314226 - protein, 25 aa, Cryptosporidium parvum
GSSITYTIFLFVNPTSGGNKASVFT

SEQ ID NO: 2314227 - protein, 24 aa, Cryptosporidium parvum
GSTDDVLIPRLLEGPLEDIQITKV

SEQ ID NO: 2314228 - protein, 17 aa, Cryptosporidium parvum
GSTLTPWRNGKRSLSTN

SEQ ID NO: 2314229 - protein, 18 aa, Cryptosporidium parvum
GSTNEVYRLDLESGMFLA

SEQ ID NO: 2314230 - protein, 22 aa, Cryptosporidium parvum
GSTTCLLCFLDGNQLWVSNVGD

SEQ ID NO: 2314231 - protein, 24 aa, Cryptosporidium parvum
GSVPLMLQRIVLATQLQSLNALKK

SEQ ID NO: 2314232 - protein, 19 aa, Cryptosporidium parvum
GSVRFQIDWIPTTHFEMKK

SEQ ID NO: 2314233 - protein, 26 aa, Cryptosporidium parvum
GSYLHLERELFRIIAWRANSATVNEL

SEQ ID NO: 2314234 - protein, 17 aa, Cryptosporidium parvum
GSYLLVLTVFEQGKNEN

SEQ ID NO: 2314235 - protein, 59 aa, Cryptosporidium parvum
GSYYNIYSSPRYLIHVGPYDIPIPISSYLLLKPYYKLNLVNSLWNDILKRLIYSKKRDG

SEQ ID NO: 2314236 - protein, 17 aa, Cryptosporidium parvum
GTAVFNFRRNEVRSFLL

SEQ ID NO: 2314237 - protein, 22 aa, Cryptosporidium parvum
GTCLQDRLAWFLNGKLNVCDNC

SEQ ID NO: 2314238 - protein, 23 aa, Cryptosporidium parvum
GTCYMPYWMMQNLELQEGDITSI

SEQ ID NO: 2314239 - protein, 18 aa, Cryptosporidium parvum
GTDLLMDHSLLNAALKIT

SEQ ID NO: 2314240 - protein, 24 aa, Cryptosporidium parvum
GTDSGLHFLWSPTGNYLAHCSDKG

SEQ ID NO: 2314241 - protein, 22 aa, Cryptosporidium parvum
GTDSSYFNRMLNMLLNAGAEID

SEQ ID NO: 2314242 - protein, 21 aa, Cryptosporidium parvum
GTELFHVPKFALAARSKYFQN

SEQ ID NO: 2314243 - protein, 25 aa, Cryptosporidium parvum
GTEMGIGIPPILSTLNAPLSNLPPN

SEQ ID NO: 2314244 - protein, 34 aa, Cryptosporidium parvum
GTGKALLFLLPEEIAFLQYLKKMNIPLNEYVFGK

SEQ ID NO: 2314245 - protein, 24 aa, Cryptosporidium parvum
GTGKTAAFVIPLLEKINTKKNIIQ

SEQ ID NO: 2314246 - protein, 29 aa, Cryptosporidium parvum
GTGKTLAFVLPVIERLLKKGKFDPNKHGR

SEQ ID NO: 2314247 - protein, 23 aa, Cryptosporidium parvum
GTGNLTMRLLPLARKVVAFDIDP

SEQ ID NO: 2314248 - protein, 23 aa, Cryptosporidium parvum
GTIDFPEFLSLMARKMKDTDTED

SEQ ID NO: 2314249 - protein, 26 aa, Cryptosporidium parvum
GTKREEMVPILRPPSKKLTQEEIKEW

SEQ ID NO: 2314250 - protein, 27 aa, Cryptosporidium parvum
GTLAFCRRWLDQLGFNKHALALKSLVD

SEQ ID NO: 2314251 - protein, 17 aa, Cryptosporidium parvum
GTLIKLVYTLSLENDEL

SEQ ID NO: 2314252 - protein, 24 aa, Cryptosporidium parvum
GTLKELFEEQPLWLRPVIESKISP

SEQ ID NO: 2314253 - protein, 29 aa, Cryptosporidium parvum
GTLSPLDLYPKLLGFIPVVSQSLTMTLDR

SEQ ID NO: 2314254 - protein, 24 aa, Cryptosporidium parvum
GTPNGPFLYPLSVRGRKPFSLLTD

SEQ ID NO: 2314255 - protein, 42 aa, Cryptosporidium parvum
GTPRTLLCTLKTTPRPYLVWLLHDFNFLLYDTANNMILKSID

SEQ ID NO: 2314256 - protein, 26 aa, Cryptosporidium parvum
GTQNELIVIVYPKANLHELGIKCFIT

SEQ ID NO: 2314257 - protein, 20 aa, Cryptosporidium parvum
GTRIFLFFNNNTITFDEALE

SEQ ID NO: 2314258 - protein, 26 aa, Cryptosporidium parvum
GTSYFNIPLLHLWCADHIRFRKGNQA

SEQ ID NO: 2314259 - protein, 24 aa, Cryptosporidium parvum
GTTQTSQWRFLNLGELYSSNKDEH

SEQ ID NO: 2314260 - protein, 24 aa, Cryptosporidium parvum
GTYKIAYLPFNKKGLIMLDGLAKA

SEQ ID NO: 2314261 - protein, 20 aa, Cryptosporidium parvum
GTYLWSLFHLKGVESSPISI

SEQ ID NO: 2314262 - protein, 18 aa, Cryptosporidium parvum
GVAYLLSIPLLNNMILNR

SEQ ID NO: 2314263 - protein, 20 aa, Cryptosporidium parvum
GVCASKLACACLMLAHKIEG

SEQ ID NO: 2314264 - protein, 25 aa, Cryptosporidium parvum
GVDGYIPSTFVMKCLDKRNLNISSI

SEQ ID NO: 2314265 - protein, 27 aa, Cryptosporidium parvum
GVDKNKPLLRIVSRGKLYTLADFVNTH

SEQ ID NO: 2314266 - protein, 18 aa, Cryptosporidium parvum
GVFKSINLKENLNFNNCV

SEQ ID NO: 2314267 - protein, 18 aa, Cryptosporidium parvum
GVGGGQFNPFSGSIGKPL

SEQ ID NO: 2314268 - protein, 22 aa, Cryptosporidium parvum
GVGKSCLLLRFAQDDSFTDSYI

SEQ ID NO: 2314269 - protein, 30 aa, Cryptosporidium parvum
GVHGAPMQFGVPPQMYFIPGNPNVAATAMP

SEQ ID NO: 2314270 - protein, 27 aa, Cryptosporidium parvum
GVHISFIRSITMDSWTPKQMKAMELGG

SEQ ID NO: 2314271 - protein, 24 aa, Cryptosporidium parvum
GVISTIHLSPFDGQLFITSGWDGN

SEQ ID NO: 2314272 - protein, 24 aa, Cryptosporidium parvum
GVKKNLFFIGATNRPEILDEALLR

SEQ ID NO: 2314273 - protein, 35 aa, Cryptosporidium parvum
GVKVYLNGSLIPIKDFKSYTLLYLKSRMNNTNNIE

SEQ ID NO: 2314274 - protein, 19 aa, Cryptosporidium parvum
GVLCGRTLCYYRDVVRLLR

SEQ ID NO: 2314275 - protein, 34 aa, Cryptosporidium parvum
GVLDSTTLLELYYFDYDRFVISRPILDGKEDAWI

SEQ ID NO: 2314276 - protein, 31 aa, Cryptosporidium parvum
GVNFSDELCRCLIIVSLPFPQKTEMLFSKER

SEQ ID NO: 2314277 - protein, 25 aa, Cryptosporidium parvum
GVNGLFFVSYFLFGDNRLILSETSH

SEQ ID NO: 2314278 - protein, 35 aa, Cryptosporidium parvum; identical to SEQ ID NO: 2190558

SEQ ID NO: 2314279 - protein, 23 aa, Cryptosporidium parvum
GVNILQQSSPFIYNMSLSPKQAE

SEQ ID NO: 2314280 - protein, 23 aa, Cryptosporidium parvum
GVNKAQIRRKLGLQSQMNSKSYF

SEQ ID NO: 2314281 - protein, 19 aa, Cryptosporidium parvum
GVNLLLRQLGPLSGGSFQE

SEQ ID NO: 2314282 - protein, 28 aa, Cryptosporidium parvum
GVNNKQYIPLKNFADQSILVLPNLQNSS

SEQ ID NO: 2314283 - protein, 18 aa, Cryptosporidium parvum
GVPCELISKILTECKIRH

SEQ ID NO: 2314284 - protein, 21 aa, Cryptosporidium parvum
GVPRRRLYDITNVLEAVGLFT

SEQ ID NO: 2314285 - protein, 26 aa, Cryptosporidium parvum
GVRPSRIFFRWKIYYCHSKEDAYRFF

SEQ ID NO: 2314286 - protein, 17 aa, Cryptosporidium parvum
GVSDYQNLFKNYDKLHP

SEQ ID NO: 2314287 - protein, 22 aa, Cryptosporidium parvum
GVSFNFKSFCFMKFVTSIVGDS

SEQ ID NO: 2314288 - protein, 27 aa, Cryptosporidium parvum
GVSGLLKLILVLKNRIAPKILHFQKLN

SEQ ID NO: 2314289 - protein, 25 aa, Cryptosporidium parvum
GVSKKYLEGFARTFDPMRSLFRENR

SEQ ID NO: 2314290 - protein, 46 aa, Cryptosporidium parvum; identical to SEQ ID NO: 2190564

SEQ ID NO: 2314291 - protein, 30 aa, Cryptosporidium parvum
GVSWNSRMEAWLAFFVENGVRKSKTFSSRK

SEQ ID NO: 2314292 - protein, 27 aa, Cryptosporidium parvum
GVTGFVGRILLVKLIEEFKNMQIVCLV

SEQ ID NO: 2314293 - protein, 23 aa, Cryptosporidium parvum
GVTYRIINQIKPKPYLKRKSKSI

SEQ ID NO: 2314294 - protein, 26 aa, Cryptosporidium parvum
GVVWEEVLILLDPKVQLVLLSATIPN

SEQ ID NO: 2314295 - protein, 17 aa, Cryptosporidium parvum
GVVYQLVGGLRSCMGYL

SEQ ID NO: 2314296 - protein, 35 aa, Cryptosporidium parvum
GVWNRISQVLPRDSYFSLLNFVRQYHLGLMNEEEL

SEQ ID NO: 2314297 - protein, 20 aa, Cryptosporidium parvum
GVWYFEITVLEPRVISKFLG

SEQ ID NO: 2314298 - protein, 24 aa, Cryptosporidium parvum
GWFSNDLFNIKGLVFNKYGKPIYK

SEQ ID NO: 2314299 - protein, 25 aa, Cryptosporidium parvum
GWKISNWYGNFYFSGVDLLLAPNCH

SEQ ID NO: 2314300 - protein, 26 aa, Cryptosporidium parvum
GYAWTICVIYFFQKIGILPVIDANEF

SEQ ID NO: 2314301 - protein, 20 aa, Cryptosporidium parvum
GYDFNGVILEIQFANTHSRT

SEQ ID NO: 2314302 - protein, 24 aa, Cryptosporidium parvum
GYDITVLQLFVECLDLWGKPNRKF

SEQ ID NO: 2314303 - protein, 17 aa, Cryptosporidium parvum
GYDNFMNLVLENTTEVL

SEQ ID NO: 2314304 - protein, 22 aa, Cryptosporidium parvum
GYFIISFFYILKNTKCEPIPLM

SEQ ID NO: 2314305 - protein, 17 aa, Cryptosporidium parvum
GYGIRYTYGIFEQKIVQ

SEQ ID NO: 2314306 - protein, 26 aa, Cryptosporidium parvum
GYHSIECICLIMALKIRYKDKVTILR

SEQ ID NO: 2314307 - protein, 17 aa, Cryptosporidium parvum
GYIELEHSKKLLFEMLK

SEQ ID NO: 2314308 - protein, 25 aa, Cryptosporidium parvum
GYIRELPIIGFYKGIMLRGIIDSLQ

SEQ ID NO: 2314309 - protein, 20 aa, Cryptosporidium parvum
GYIRYSLKNCYFFNVPLTRM

SEQ ID NO: 2314310 - protein, 22 aa, Cryptosporidium parvum
GYISREHCIFYYSSIRNREYEG

SEQ ID NO: 2314311 - protein, 18 aa, Cryptosporidium parvum
GYQVGMPGRPLLFQGAEI

SEQ ID NO: 2314312 - protein, 27 aa, Cryptosporidium parvum
GYRKKKLLNIRMLYPFTIRCNGCEVYH

SEQ ID NO: 2314313 - protein, 24 aa, Cryptosporidium parvum
GYRKMNKFLKFSPLTFAPIQKEMI

SEQ ID NO: 2314314 - protein, 17 aa, Cryptosporidium parvum
GYRLVEWLIHSVNLGRN

SEQ ID NO: 2314315 - protein, 18 aa, Cryptosporidium parvum
GYSDLITRLTCEAITSIM

SEQ ID NO: 2314316 - protein, 20 aa, Cryptosporidium parvum
GYSMLLRKGIGIGYISLFSF

SEQ ID NO: 2314317 - protein, 26 aa, Cryptosporidium parvum
GYSSNFIWDLVRSIPIESLNRLYVSW

SEQ ID NO: 2314318 - protein, 20 aa, Cryptosporidium parvum
GYTSLLYFDSPDIISDWYFK

SEQ ID NO: 2314319 - protein, 31 aa, Cryptosporidium parvum; identical to SEQ ID NO: 2190592

SEQ ID NO: 2314320 - protein, 18 aa, Cryptosporidium parvum
GYVVCVIKIILKQPGRVQ

SEQ ID NO: 2314321 - protein, 20 aa, Cryptosporidium parvum
GYWNNVYGFNYQYVKPCIME

SEQ ID NO: 2314322 - protein, 27 aa, Cryptosporidium parvum
HAESCLENIYISVDKLEKFSELCKVEN

SEQ ID NO: 2314323 - protein, 23 aa, Cryptosporidium parvum
HAEVDPFFFNPLLNNCKDIIFPN

SEQ ID NO: 2314324 - protein, 22 aa, Cryptosporidium parvum
HAGSKFMPLDLRKKLTRAKRRA

SEQ ID NO: 2314325 - protein, 25 aa, Cryptosporidium parvum
HAHFQPFVEPILPICGPYLTEEQQI

SEQ ID NO: 2314326 - protein, 34 aa, Cryptosporidium parvum; identical to SEQ ID NO: 2190600

SEQ ID NO: 2314327 - protein, 22 aa, Cryptosporidium parvum
HAKFTWRDISFALNKVKPRIPH

SEQ ID NO: 2314328 - protein, 32 aa, Cryptosporidium parvum; identical to SEQ ID NO: 2190603

SEQ ID NO: 2314329 - protein, 39 aa, Cryptosporidium parvum
HAMKVRPTYLRWVALYYDILSKMFLLTENYSFHALAHLK

SEQ ID NO: 2314330 - protein, 23 aa, Cryptosporidium parvum
HAPPPFMDPWNMQGHPYPAYAPD

SEQ ID NO: 2314331 - protein, 35 aa, Cryptosporidium parvum; identical to SEQ ID NO: 2190605

SEQ ID NO: 2314332 - protein, 26 aa, Cryptosporidium parvum
HASKTFIDPYTLLPEQPWDVMKEDGD

SEQ ID NO: 2314333 - protein, 26 aa, Cryptosporidium parvum
HATCSWSSNPFLCRKCCKKSSIQPSI

SEQ ID NO: 2314334 - protein, 17 aa, Cryptosporidium parvum
HAYIHQTSNAMIGGLER

SEQ ID NO: 2314335 - protein, 19 aa, Cryptosporidium parvum
HCFYIHPSEACKSWPLCPY

SEQ ID NO: 2314336 - protein, 18 aa, Cryptosporidium parvum
HCLANYSFKYRRGGIVVA

SEQ ID NO: 2314337 - protein, 36 aa, Cryptosporidium parvum; identical to SEQ ID NO: 2190611

SEQ ID NO: 2314338 - protein, 19 aa, Cryptosporidium parvum
HCLNSILQGPYFDEAFLSK

SEQ ID NO: 2314339 - protein, 17 aa, Cryptosporidium parvum
HCMDIAKVLRVLYEDPN

SEQ ID NO: 2314340 - protein, 17 aa, Cryptosporidium parvum
HCNSAFQWATKEGILCE

SEQ ID NO: 2314341 - protein, 35 aa, Cryptosporidium parvum
HCPFCQIELDWNRVKPFIVLFKPKSEAIIEEDTNK

SEQ ID NO: 2314342 - protein, 22 aa, Cryptosporidium parvum
HCPGLPPLHRFVQSSGIIRSSR

SEQ ID NO: 2314343 - protein, 26 aa, Cryptosporidium parvum
HCTEFPGNFIFFLAAAVSDFYIPENL

SEQ ID NO: 2314344 - protein, 28 aa, Cryptosporidium parvum
HDACDGKLYRLVRSSFPFNLSSGPPNWG

SEQ ID NO: 2314345 - protein, 18 aa, Cryptosporidium parvum
HDAPISNIFWCDEQKFVV

SEQ ID NO: 2314346 - protein, 36 aa, Cryptosporidium parvum
HDATSFFQSCIIQNGLLGLVQALPHIFIEGPHTIID

SEQ ID NO: 2314347 - protein, 34 aa, Cryptosporidium parvum
HDDVSLQSLYIYNLYNPQLVLLDCNVQLNPFGCY

SEQ ID NO: 2314348 - protein, 23 aa, Cryptosporidium parvum
HDESLYYWCYKNNIPVFCPGITD

SEQ ID NO: 2314349 - protein, 19 aa, Cryptosporidium parvum
HDHVISFNFLDGKIWFRHY

SEQ ID NO: 2314350 - protein, 18 aa, Cryptosporidium parvum
HDITSPISIFSTTSGSPA

SEQ ID NO: 2314351 - protein, 19 aa, Cryptosporidium parvum
HDKLVSPHLFLIEQMKLKN

SEQ ID NO: 2314352 - protein, 28 aa, Cryptosporidium parvum
HDLKEAQSLLRFPPEWRSLNNEEVLGHS

SEQ ID NO: 2314353 - protein, 24 aa, Cryptosporidium parvum
HDLNQGMGFADLFYNFLNSEVEES

SEQ ID NO: 2314354 - protein, 23 aa, Cryptosporidium parvum
HDNIIIEYIIILFRSNRHNQALN

SEQ ID NO: 2314355 - protein, 22 aa, Cryptosporidium parvum
HDPRYMYTGYASGYSSNIYATG

SEQ ID NO: 2314356 - protein, 24 aa, Cryptosporidium parvum
HDQNIPICSAFGSPFDSSLIISSS

SEQ ID NO: 2314357 - protein, 33 aa, Cryptosporidium parvum; identical to SEQ ID NO: 2190631

SEQ ID NO: 2314358 - protein, 18 aa, Cryptosporidium parvum
HDYYNKDNFLPSLINSNF

SEQ ID NO: 2314359 - protein, 22 aa, Cryptosporidium parvum
HEDHFLGIFNLLKLKNSINIQQ

SEQ ID NO: 2314360 - protein, 18 aa, Cryptosporidium parvum
HEDTLFPATFLFNECINN

SEQ ID NO: 2314361 - protein, 18 aa, Cryptosporidium parvum
HEFGYSKRGIIGCTQPRR

SEQ ID NO: 2314362 - protein, 17 aa, Cryptosporidium parvum
HEFIMYILEIIHDGTIK

SEQ ID NO: 2314363 - protein, 37 aa, Cryptosporidium parvum
HEFYKSITLDYLNKNLRNLMLKVFRKDMFSDYCQKCK

SEQ ID NO: 2314364 - protein, 34 aa, Cryptosporidium parvum
HEGFCIFCNLHWNFLYMLSVHMRPVLHPSLIGGH

SEQ ID NO: 2314365 - protein, 27 aa, Cryptosporidium parvum
HEGIKFLNNYLLLAFNFNLLENIDEIY

SEQ ID NO: 2314366 - protein, 18 aa, Cryptosporidium parvum
HEILIRNIKQNFIWESIE

SEQ ID NO: 2314367 - protein, 24 aa, Cryptosporidium parvum
HEINKCIINPLKFSKIYSSFGIKP

SEQ ID NO: 2314368 - protein, 24 aa, Cryptosporidium parvum
HEKFTYVFIPYHDSDKIEVREFSG

SEQ ID NO: 2314369 - protein, 17 aa, Cryptosporidium parvum
HEKIEIEKGFMKKEEEY

SEQ ID NO: 2314370 - protein, 23 aa, Cryptosporidium parvum
HEKLLTWSLSGFSVLIYGFGSKR

SEQ ID NO: 2314371 - protein, 25 aa, Cryptosporidium parvum
HELEGWALSWNKIKESYLASGSDDN

SEQ ID NO: 2314372 - protein, 17 aa, Cryptosporidium parvum
HELLAKFNFVQPVNLTG

SEQ ID NO: 2314373 - protein, 23 aa, Cryptosporidium parvum
HELNLLVNSLLRQLKRNTSKPLT

SEQ ID NO: 2314374 - protein, 24 aa, Cryptosporidium parvum
HELTDMFDYLPLGALVEHHMFCDH

SEQ ID NO: 2314375 - protein, 25 aa, Cryptosporidium parvum
HENDVFYWICNLPELSLNMLKGFVQ

SEQ ID NO: 2314376 - protein, 27 aa, Cryptosporidium parvum
HENILQLYAWFEDKSRIWLVIEIAPGG

SEQ ID NO: 2314377 - protein, 18 aa, Cryptosporidium parvum
HEQINQLGLFNKNNLIQK

SEQ ID NO: 2314378 - protein, 34 aa, Cryptosporidium parvum; identical to SEQ ID NO: 2190649

SEQ ID NO: 2314379 - protein, 26 aa, Cryptosporidium parvum
HERNIICLTFRGQPKRWVFCPCRSCL

SEQ ID NO: 2314380 - protein, 29 aa, Cryptosporidium parvum
HESSKMKKIIFSIFKIVITDLDKKALIDG

SEQ ID NO: 2314381 - protein, 22 aa, Cryptosporidium parvum
HEVFVWSGHNFALTPNLITLEN

SEQ ID NO: 2314382 - protein, 20 aa, Cryptosporidium parvum
HEYLFRKGYLEPIVMKKGYC

SEQ ID NO: 2314383 - protein, 25 aa, Cryptosporidium parvum
HFANLALKAILRLGDNMNLDYIQII

SEQ ID NO: 2314384 - protein, 37 aa, Cryptosporidium parvum; identical to SEQ ID NO: 2190656

SEQ ID NO: 2314385 - protein, 28 aa, Cryptosporidium parvum
HFELDITQLLILLIRNNSKLSIKEISSI

SEQ ID NO: 2314386 - protein, 17 aa, Cryptosporidium parvum
HFFNPDVPALLVLSNYL

SEQ ID NO: 2314387 - protein, 29 aa, Cryptosporidium parvum
HFLAAHIPLYLYPFLNTVTKSRPFEYLRL

SEQ ID NO: 2314388 - protein, 17 aa, Cryptosporidium parvum
HFNLFLKSINRLFHFNN

SEQ ID NO: 2314389 - protein, 17 aa, Cryptosporidium parvum
HFPIYNQIKLLIELIIL

SEQ ID NO: 2314390 - protein, 19 aa, Cryptosporidium parvum
HFQDLILKGFSNAASLLSQ

SEQ ID NO: 2314391 - protein, 20 aa, Cryptosporidium parvum
HFVQGVGTLLPTYASLSSEQ

SEQ ID NO: 2314392 - protein, 18 aa, Cryptosporidium parvum
HFWDWKTTKNFRSFNAHE

SEQ ID NO: 2314393 - protein, 19 aa, Cryptosporidium parvum
HFYNTTFGIGPSLMDFRIN

SEQ ID NO: 2314394 - protein, 18 aa, Cryptosporidium parvum
HFYYHPFGGHVRILQAKL

SEQ ID NO: 2314395 - protein, 19 aa, Cryptosporidium parvum
HGALTLADVNRPIEVRFAS

SEQ ID NO: 2314396 - protein, 27 aa, Cryptosporidium parvum
HGCNVFINRQLIYNYPDQLFKEAGIVA

SEQ ID NO: 2314397 - protein, 17 aa, Cryptosporidium parvum
HGFLGYFKCDLYNEVGF

SEQ ID NO: 2314398 - protein, 18 aa, Cryptosporidium parvum
HGIIKTGMKSRRVAETAM

SEQ ID NO: 2314399 - protein, 19 aa, Cryptosporidium parvum
HGITWCYRSARFKVRYRRS

SEQ ID NO: 2314400 - protein, 18 aa, Cryptosporidium parvum
HGIYVKDLSEYFVTSPEE

SEQ ID NO: 2314401 - protein, 34 aa, Cryptosporidium parvum; identical to SEQ ID NO: 2190674

SEQ ID NO: 2314402 - protein, 22 aa, Cryptosporidium parvum
HGNPQFHYHHQIDIGAPGAAVQ

SEQ ID NO: 2314403 - protein, 24 aa, Cryptosporidium parvum
HGPNMRGYYGNPYKSYRGGGGGVG

SEQ ID NO: 2314404 - protein, 17 aa, Cryptosporidium parvum
HGQKGILSMLWPQENMP

SEQ ID NO: 2314405 - protein, 28 aa, Cryptosporidium parvum
HGRDYCLRPILTIRLSKVNKHFPLERFI

SEQ ID NO: 2314406 - protein, 17 aa, Cryptosporidium parvum
HGRVDTPIFMPVATHGS

SEQ ID NO: 2314407 - protein, 34 aa, Cryptosporidium parvum
HGWSVHREFLLNLFKYYGFDSKWNWSNKQLLTLF

SEQ ID NO: 2314408 - protein, 22 aa, Cryptosporidium parvum
HGWTDYQLRCNLAVAIGVSKDL

SEQ ID NO: 2314409 - protein, 25 aa, Cryptosporidium parvum
HGYISKTAFLQKADWKLHEKELEIK

SEQ ID NO: 2314410 - protein, 26 aa, Cryptosporidium parvum
HGYNIKNGFKFMSWNDLSASAKINQD

SEQ ID NO: 2314411 - protein, 31 aa, Cryptosporidium parvum
HHASILRYSEFLKEFILIINSFENCLRIKNF

SEQ ID NO: 2314412 - protein, 21 aa, Cryptosporidium parvum
HHHPTPVFNQYSQGPNPSQHG

SEQ ID NO: 2314413 - protein, 20 aa, Cryptosporidium parvum
HHILTNFLYNPNGPISLLSF

SEQ ID NO: 2314414 - protein, 24 aa, Cryptosporidium parvum
HHIRSKIKRRLIVEWAKELCLGGY

SEQ ID NO: 2314415 - protein, 17 aa, Cryptosporidium parvum
HHKIIIKSIKKYSYMLN

SEQ ID NO: 2314416 - protein, 29 aa, Cryptosporidium parvum
HHPWDIRNLCYLHYSLYVDLFNLVRTSAD

SEQ ID NO: 2314417 - protein, 48 aa, Cryptosporidium parvum; identical to SEQ ID NO: 2190689

SEQ ID NO: 2314418 - protein, 17 aa, Cryptosporidium parvum
HIADVYYYMLRHKELLS

SEQ ID NO: 2314419 - protein, 22 aa, Cryptosporidium parvum
HIDYMVSYFRKYDLRGNGKISR

SEQ ID NO: 2314420 - protein, 19 aa, Cryptosporidium parvum
HIFSFDWFIKTRSSNDIYR

SEQ ID NO: 2314421 - protein, 23 aa, Cryptosporidium parvum
HIGKVIIKIPYLAGIGDNSIPEE

SEQ ID NO: 2314422 - protein, 18 aa, Cryptosporidium parvum
HIIDGPIIGLEWKCTGTN

SEQ ID NO: 2314423 - protein, 29 aa, Cryptosporidium parvum
HIIRGLLIEADFYLLESLCSILSNKLLEQ

SEQ ID NO: 2314424 - protein, 17 aa, Cryptosporidium parvum
HIISMFKNILSCYKLAC

SEQ ID NO: 2314425 - protein, 19 aa, Cryptosporidium parvum
HIKNGYRFTNYNMNTQLSN

SEQ ID NO: 2314426 - protein, 27 aa, Cryptosporidium parvum
HIKSRFPLLHWIVQIVRGSFGDNRRHV

SEQ ID NO: 2314427 - protein, 22 aa, Cryptosporidium parvum
HIKYNYILPIRSVGVQGDFRTY

SEQ ID NO: 2314428 - protein, 20 aa, Cryptosporidium parvum
HILDRYINQVKIRNSAKSKP

SEQ ID NO: 2314429 - protein, 17 aa, Cryptosporidium parvum
HILGYFTNKNTIFNSIF

SEQ ID NO: 2314430 - protein, 20 aa, Cryptosporidium parvum
HILVREYQTCLSGYPDTRQH

SEQ ID NO: 2314431 - protein, 17 aa, Cryptosporidium parvum
HINLIDPSMSALNNFQV

SEQ ID NO: 2314432 - protein, 32 aa, Cryptosporidium parvum
HIPLDHTYRHLFLFLPKSLLEWSYKSIDDVFS

SEQ ID NO: 2314433 - protein, 22 aa, Cryptosporidium parvum
HIPLLKSTILLSFTKLYCNSDH

SEQ ID NO: 2314434 - protein, 25 aa, Cryptosporidium parvum
HIQMNDLFVLLKGKDKRIASTCSND

SEQ ID NO: 2314435 - protein, 20 aa, Cryptosporidium parvum
HIRHYLNLDFNWENESKMAE

SEQ ID NO: 2314436 - protein, 22 aa, Cryptosporidium parvum
HIRSFNLKIFLFKKNFGLCIFS

SEQ ID NO: 2314437 - protein, 24 aa, Cryptosporidium parvum
HISDNVFRIFIYSNIKTFSNQMDY

SEQ ID NO: 2314438 - protein, 29 aa, Cryptosporidium parvum
HIYDGLALTKFLYYLYKAGRDKTLFNGKV

SEQ ID NO: 2314439 - protein, 31 aa, Cryptosporidium parvum
HIYEVYEDRLNLYFILEFCAGGNLFHSLQDA

SEQ ID NO: 2314440 - protein, 19 aa, Cryptosporidium parvum
HIYLYANKLVNLIFEIMSG

SEQ ID NO: 2314441 - protein, 17 aa, Cryptosporidium parvum
HKAQVTCLKFLPNLGII

SEQ ID NO: 2314442 - protein, 18 aa, Cryptosporidium parvum
HKCSNVLFRFKPMHHYNI

SEQ ID NO: 2314443 - protein, 17 aa, Cryptosporidium parvum
HKDLLPIEKEYLEYKSI

SEQ ID NO: 2314444 - protein, 26 aa, Cryptosporidium parvum
HKDQNWSLIVNGRILELFRKIKATNL

SEQ ID NO: 2314445 - protein, 25 aa, Cryptosporidium parvum
HKETKKIRFLLRQEKTLKIVANHYV

SEQ ID NO: 2314446 - protein, 17 aa, Cryptosporidium parvum
HKEYPWILSCSDDQTMR

SEQ ID NO: 2314447 - protein, 32 aa, Cryptosporidium parvum; identical to SEQ ID NO: 2190720

SEQ ID NO: 2314448 - protein, 28 aa, Cryptosporidium parvum
HKIGDLVYSLWKGQLWKAIILDTSLKIH

SEQ ID NO: 2314449 - protein, 36 aa, Cryptosporidium parvum
HKINPIQVYLYKSWLVHWSLFPLFTQYFRESCFSTN

SEQ ID NO: 2314450 - protein, 19 aa, Cryptosporidium parvum
HKIPNLVRKILSFSSNDFN

SEQ ID NO: 2314451 - protein, 23 aa, Cryptosporidium parvum
HKLIWHIFYQIVQGLSYLHGKRV

SEQ ID NO: 2314452 - protein, 25 aa, Cryptosporidium parvum
HKLNSTWIKLIKYLRQSELCVPSDS

SEQ ID NO: 2314453 - protein, 24 aa, Cryptosporidium parvum
HKNLTIFVRDIYSFGFLHSILFNN

SEQ ID NO: 2314454 - protein, 23 aa, Cryptosporidium parvum
HKPNHKYIPVGRYTFNLLTENWT

SEQ ID NO: 2314455 - protein, 21 aa, Cryptosporidium parvum
HKRATMVPISINKCLITSKID

SEQ ID NO: 2314456 - protein, 21 aa, Cryptosporidium parvum
HKSEPLFEKLKFISVFTNDGN

SEQ ID NO: 2314457 - protein, 18 aa, Cryptosporidium parvum
HKSGILSMKIVEFGFQGT

SEQ ID NO: 2314458 - protein, 18 aa, Cryptosporidium parvum
HKVPGVPLIYLNNQVPIL

SEQ ID NO: 2314459 - protein, 27 aa, Cryptosporidium parvum
HLEGSRPLYKLFPAPLDEAWLSMDTNN

SEQ ID NO: 2314460 - protein, 21 aa, Cryptosporidium parvum
HLENCWRKDLLSHFLLKLCFM

SEQ ID NO: 2314461 - protein, 25 aa, Cryptosporidium parvum
HLHKNPDFYAFLKGCLELDPLKRLT

SEQ ID NO: 2314462 - protein, 22 aa, Cryptosporidium parvum
HLKIPLKFIYIGYNISQILSDR

SEQ ID NO: 2314463 - protein, 19 aa, Cryptosporidium parvum
HLLEFLFRSEDELRNNEKI

SEQ ID NO: 2314464 - protein, 19 aa, Cryptosporidium parvum
HLNCDLITIQRKLSGLFKH

SEQ ID NO: 2314465 - protein, 23 aa, Cryptosporidium parvum
HLNNEIVQLVKWLELTNSEHMLR

SEQ ID NO: 2314466 - protein, 35 aa, Cryptosporidium parvum
HLNVDIKIRFFPLRTLTLYLLYKKSLEVDTKFVTK

SEQ ID NO: 2314467 - protein, 26 aa, Cryptosporidium parvum
HLPDLKHPFSLLYSYKRLNELNIEVS

SEQ ID NO: 2314468 - protein, 17 aa, Cryptosporidium parvum
HLQIVHPLQNEYPEFFQ

SEQ ID NO: 2314469 - protein, 18 aa, Cryptosporidium parvum
HLQSPLKFVSGLGPRKAK

SEQ ID NO: 2314470 - protein, 27 aa, Cryptosporidium parvum
HLRFLERVKKIFGGVLIIGIYDDSTAQ

SEQ ID NO: 2314471 - protein, 18 aa, Cryptosporidium parvum
HLRRHMMLVHSSIEEKAS

SEQ ID NO: 2314472 - protein, 21 aa, Cryptosporidium parvum
HLRTDILPFLHDIIGKLLDDS

SEQ ID NO: 2314473 - protein, 25 aa, Cryptosporidium parvum
HLSPSPDYWLMFKRSIYNDIHNTSE

SEQ ID NO: 2314474 - protein, 18 aa, Cryptosporidium parvum
HLTLLYAFESFREVLYKD

SEQ ID NO: 2314475 - protein, 22 aa, Cryptosporidium parvum
HLYKYQGYIGAHLIVAGSDSTG

SEQ ID NO: 2314476 - protein, 21 aa, Cryptosporidium parvum
HMENELCRSRTTRWADVEAEE

SEQ ID NO: 2314477 - protein, 25 aa, Cryptosporidium parvum
HMFEMADRLVGIYKTFDITKSVSII

SEQ ID NO: 2314478 - protein, 17 aa, Cryptosporidium parvum
HMKKIKMDLLKQEQKIK

SEQ ID NO: 2314479 - protein, 47 aa, Cryptosporidium parvum
HMNPNRLFSIIRAYVLTLYIRHSSLIIPGWYLNKFPSAKNSLSFVYV

SEQ ID NO: 2314480 - protein, 30 aa, Cryptosporidium parvum
HMSNKILELKGLRFAFFKDDLDILDTCIIM

SEQ ID NO: 2314481 - protein, 19 aa, Cryptosporidium parvum
HNAKRVFNVVRPNKKIEQP

SEQ ID NO: 2314482 - protein, 18 aa, Cryptosporidium parvum
HNCETQMLFLSETDPNYV

SEQ ID NO: 2314483 - protein, 17 aa, Cryptosporidium parvum
HNFMRWNRNILTDSGGF

SEQ ID NO: 2314484 - protein, 43 aa, Cryptosporidium parvum
HNGNYYDKYGRFCGFFNNGIFHSFYYYYQQYLNSNNFLNEINE

SEQ ID NO: 2314485 - protein, 22 aa, Cryptosporidium parvum
HNGPNWNNNIPYNGFEYGSGLG

SEQ ID NO: 2314486 - protein, 20 aa, Cryptosporidium parvum
HNHDLTLIKDFVFNSYCLIH

SEQ ID NO: 2314487 - protein, 29 aa, Cryptosporidium parvum
HNHTKKKPLKYWRQILDGIIVRHRRITRS

SEQ ID NO: 2314488 - protein, 17 aa, Cryptosporidium parvum
HNIAMGNVIKWLKKQIC

SEQ ID NO: 2314489 - protein, 18 aa, Cryptosporidium parvum
HNIFMDEVPIFKEFTFFL

SEQ ID NO: 2314490 - protein, 27 aa, Cryptosporidium parvum
HNIRNFRLPVYFVPSSSDYFYVSESNT

SEQ ID NO: 2314491 - protein, 20 aa, Cryptosporidium parvum
HNLVLYLQDEILRINLELEQ

SEQ ID NO: 2314492 - protein, 26 aa, Cryptosporidium parvum
HNNPIIWRFYCHKFGFVQNKKGKKWC

SEQ ID NO: 2314493 - protein, 26 aa, Cryptosporidium parvum
HNQNICNISQLMKKYLGYGKKVRRHK

SEQ ID NO: 2314494 - protein, 22 aa, Cryptosporidium parvum
HNQYWKTKLCLMFSKGACKNGD

SEQ ID NO: 2314495 - protein, 21 aa, Cryptosporidium parvum
HNRFLILQGEVELIAQMKPKS

SEQ ID NO: 2314496 - protein, 17 aa, Cryptosporidium parvum
HNSEHIFYCIQYANRFG

SEQ ID NO: 2314497 - protein, 19 aa, Cryptosporidium parvum
HNSIKIRDFILKQNSIDIN

SEQ ID NO: 2314498 - protein, 25 aa, Cryptosporidium parvum
HNSNQIGILLTPDRSFSRSENIISP

SEQ ID NO: 2314499 - protein, 36 aa, Cryptosporidium parvum; identical to SEQ ID NO: 2190766

SEQ ID NO: 2314500 - protein, 30 aa, Cryptosporidium parvum
HNSSGTPCIPPFWNTNPALLASAASLIGSG

SEQ ID NO: 2314501 - protein, 20 aa, Cryptosporidium parvum
HNYYMIYFNELHIPQDFSKF

SEQ ID NO: 2314502 - protein, 28 aa, Cryptosporidium parvum
HPEHIEALGPFVPLLVKILNTISMAGYL

SEQ ID NO: 2314503 - protein, 23 aa, Cryptosporidium parvum
HPELSLFGVFDGHGGSVISEWVS

SEQ ID NO: 2314504 - protein, 18 aa, Cryptosporidium parvum
HPFEFITFLNYCRALRFE

SEQ ID NO: 2314505 - protein, 19 aa, Cryptosporidium parvum
HPHIFIHGNPQFHYHHQID

SEQ ID NO: 2314506 - protein, 17 aa, Cryptosporidium parvum
HPHNKWSIPSRYQVRHL

SEQ ID NO: 2314507 - protein, 20 aa, Cryptosporidium parvum
HPHQYDGVRWMWNRFRRSEG

SEQ ID NO: 2314508 - protein, 26 aa, Cryptosporidium parvum
HPILTPVIICLEQWAHRWSQVGKSLL

SEQ ID NO: 2314509 - protein, 21 aa, Cryptosporidium parvum
HPIQKNIIFIGSLDASVQILR

SEQ ID NO: 2314510 - protein, 18 aa, Cryptosporidium parvum
HPITPVSLLLDKKPNIYY

SEQ ID NO: 2314511 - protein, 22 aa, Cryptosporidium parvum
HPKLPWVLVSLHNGVIQFWDYR

SEQ ID NO: 2314512 - protein, 22 aa, Cryptosporidium parvum
HPLFQTELTFILDYIDHEKKPN

SEQ ID NO: 2314513 - protein, 18 aa, Cryptosporidium parvum
HPLSCFYPQEFESSLTTE

SEQ ID NO: 2314514 - protein, 30 aa, Cryptosporidium parvum
HPLSDRFLRHSPILFVDFPGKSSLNQIYSV

SEQ ID NO: 2314515 - protein, 38 aa, Cryptosporidium parvum
HPNIKIVSLIMKPTLYIFSPNFLFKKMDNILKAYCEVH

SEQ ID NO: 2314516 - protein, 24 aa, Cryptosporidium parvum
HPNIMKLFEILEDSSSFYIVGELY

SEQ ID NO: 2314517 - protein, 19 aa, Cryptosporidium parvum
HPNSVDFELLYNVLLSLKN

SEQ ID NO: 2314518 - protein, 17 aa, Cryptosporidium parvum
HPPPFYTSQQNKNVNKN

SEQ ID NO: 2314519 - protein, 23 aa, Cryptosporidium parvum
HPSCIPIFLELHLVFVKEFNNGK

SEQ ID NO: 2314520 - protein, 23 aa, Cryptosporidium parvum
HPTFPEYFIVAYGTKFSQNSSFE

SEQ ID NO: 2314521 - protein, 21 aa, Cryptosporidium parvum
HPYKVRYNNSVLFWVRNNNIR

SEQ ID NO: 2314522 - protein, 21 aa, Cryptosporidium parvum
HPYVIFGTGIFKKSLIETDIL

SEQ ID NO: 2314523 - protein, 25 aa, Cryptosporidium parvum
HQERKCIPIALLIEQITKKKLHVTK

SEQ ID NO: 2314524 - protein, 17 aa, Cryptosporidium parvum
HQFYRSLAHSGEMVGTI

SEQ ID NO: 2314525 - protein, 25 aa, Cryptosporidium parvum
HQKEGVLWMWGLYCNNHGGILADEM

SEQ ID NO: 2314526 - protein, 23 aa, Cryptosporidium parvum
HQKKMIQELIYEKISLNSEVNSL

SEQ ID NO: 2314527 - protein, 18 aa, Cryptosporidium parvum
HQLFLDLQFVGSQIYFNL

SEQ ID NO: 2314528 - protein, 27 aa, Cryptosporidium parvum
HQLWREDIILIIRKFAEIVYEIVTGNF

SEQ ID NO: 2314529 - protein, 25 aa, Cryptosporidium parvum
HQQLLTLNIHLFYKSLRNPNFNHLY

SEQ ID NO: 2314530 - protein, 23 aa, Cryptosporidium parvum
HQYSPFISRCIVFIGYMLENGIY

SEQ ID NO: 2314531 - protein, 35 aa, Cryptosporidium parvum
HRCEILEFIIEELNLWLFYSRFSISISRTTFLLNS

SEQ ID NO: 2314532 - protein, 27 aa, Cryptosporidium parvum
HRDLKPENFLFLTDSPDSPLKLIDFGL

SEQ ID NO: 2314533 - protein, 31 aa, Cryptosporidium parvum
HRDVSSLWIRYMSYYLDLEDLDKARMVAERS

SEQ ID NO: 2314534 - protein, 17 aa, Cryptosporidium parvum
HRFIRIMGPEICNYIVP

SEQ ID NO: 2314535 - protein, 18 aa, Cryptosporidium parvum
HRGIFDHLAPKLAEHSRN

SEQ ID NO: 2314536 - protein, 18 aa, Cryptosporidium parvum
HRGILHRDLKPSNILLHI

SEQ ID NO: 2314537 - protein, 22 aa, Cryptosporidium parvum
HRGYGFIEFGTADQAKLAIETM

SEQ ID NO: 2314538 - protein, 25 aa, Cryptosporidium parvum
HRIGRTARYISKGKSLLFVMSNEGY

SEQ ID NO: 2314539 - protein, 25 aa, Cryptosporidium parvum
HRITARLAMVYLNSSQFVKGLDYIE

SEQ ID NO: 2314540 - protein, 20 aa, Cryptosporidium parvum
HRLQPYFHKTDKSAFEKTLA

SEQ ID NO: 2314541 - protein, 26 aa, Cryptosporidium parvum
HRMGPQKWEYSLIPSLKSLIQNNNNL

SEQ ID NO: 2314542 - protein, 28 aa, Cryptosporidium parvum
HRMVVWRHYFVVFGGFHDTIRETRYFND

SEQ ID NO: 2314543 - protein, 34 aa, Cryptosporidium parvum; identical to SEQ ID NO: 2190804

SEQ ID NO: 2314544 - protein, 24 aa, Cryptosporidium parvum
HRSRFIEEYLLYGTSETFKFGQNT

SEQ ID NO: 2314545 - protein, 38 aa, Cryptosporidium parvum; identical to SEQ ID NO: 2190806

SEQ ID NO: 2314546 - protein, 26 aa, Cryptosporidium parvum
HRVLIFTQGVRTLKLLSALLEKDLGL

SEQ ID NO: 2314547 - protein, 23 aa, Cryptosporidium parvum
HSEFISGFKIIASQLKEIYQMIT

SEQ ID NO: 2314548 - protein, 23 aa, Cryptosporidium parvum
HSERLKRQLFTTQLDIMNKENPI

SEQ ID NO: 2314549 - protein, 23 aa, Cryptosporidium parvum
HSGGNFFGGYIHANRIKVPSENG

SEQ ID NO: 2314550 - protein, 21 aa, Cryptosporidium parvum
HSGVYNFLHNFDGILNGMVYL

SEQ ID NO: 2314551 - protein, 17 aa, Cryptosporidium parvum
HSHPGFGCWFSGTDVST

SEQ ID NO: 2314552 - protein, 18 aa, Cryptosporidium parvum
HSHPLNIWFKPDSTFNSP

SEQ ID NO: 2314553 - protein, 32 aa, Cryptosporidium parvum
HSHSSIRVVFPDKYILQLQFRPNHTTYDLIQS

SEQ ID NO: 2314554 - protein, 17 aa, Cryptosporidium parvum
HSIAWSKYLFDIVFGVR

SEQ ID NO: 2314555 - protein, 26 aa, Cryptosporidium parvum
HSIFDTLQFLEYIGNSMKFPIYPQRN

SEQ ID NO: 2314556 - protein, 28 aa, Cryptosporidium parvum
HSLETICLLFALKIRYPRQIHLIRGNHE

SEQ ID NO: 2314557 - protein, 21 aa, Cryptosporidium parvum
HSLMPLRSCFSSRNGLWVASA

SEQ ID NO: 2314558 - protein, 25 aa, Cryptosporidium parvum
HSLSAIYIAIDGTLDWVFCPSTDKD

SEQ ID NO: 2314559 - protein, 24 aa, Cryptosporidium parvum
HSMKKYLQLLNTDPITLKNKSLAT

SEQ ID NO: 2314560 - protein, 24 aa, Cryptosporidium parvum
HSNDEILLLNNQEPFEIHGCGHKL

SEQ ID NO: 2314561 - protein, 25 aa, Cryptosporidium parvum
HSNKYGHLILFVGLTTGVILSCKVD

SEQ ID NO: 2314562 - protein, 35 aa, Cryptosporidium parvum
HSPIVKSFTYYRLKFLLQSYQLYSLFNGKFENELS

SEQ ID NO: 2314563 - protein, 17 aa, Cryptosporidium parvum
HSPKKPVIIFVASRRQT

SEQ ID NO: 2314564 - protein, 23 aa, Cryptosporidium parvum
HSQNRIYIGSVPYSFTTDDLRHI

SEQ ID NO: 2314565 - protein, 26 aa, Cryptosporidium parvum
HSRQNKFQVLLFSATVPPWVKNILTE

SEQ ID NO: 2314566 - protein, 31 aa, Cryptosporidium parvum; identical to SEQ ID NO: 2190828

SEQ ID NO: 2314567 - protein, 27 aa, Cryptosporidium parvum
HSVAQHFKFNLMRILKRIKQTEEVQVY

SEQ ID NO: 2314568 - protein, 19 aa, Cryptosporidium parvum
HSVEDFQVWFSKPFSDLPS

SEQ ID NO: 2314569 - protein, 25 aa, Cryptosporidium parvum
HSVKNLHPYILIIICMLRERYQKAV

SEQ ID NO: 2314570 - protein, 20 aa, Cryptosporidium parvum
HSYPYMFSSSWYSPEDQEKK

SEQ ID NO: 2314571 - protein, 26 aa, Cryptosporidium parvum
HSYTVKKLYLSLLSRNDQILLIQVTL

SEQ ID NO: 2314572 - protein, 18 aa, Cryptosporidium parvum
HSYWVVSQWHILAEREFE

SEQ ID NO: 2314573 - protein, 29 aa, Cryptosporidium parvum
HTAILLVTGKLYMFGGGAFGKLGFGSTDD

SEQ ID NO: 2314574 - protein, 17 aa, Cryptosporidium parvum
HTDILFGLVKDVSRFRN

SEQ ID NO: 2314575 - protein, 20 aa, Cryptosporidium parvum
HTFDIPMDYLRLLQSQIKTQ

SEQ ID NO: 2314576 - protein, 24 aa, Cryptosporidium parvum
HTGGKLPFWLSPRQAIVLSISEKT

SEQ ID NO: 2314577 - protein, 38 aa, Cryptosporidium parvum
HTGGKLRLFTEFPFEKIYRDIYQTLYSIFFVQNVAYDC

SEQ ID NO: 2314578 - protein, 22 aa, Cryptosporidium parvum
HTIDLFPCLVHKPKNSKVASNY

SEQ ID NO: 2314579 - protein, 25 aa, Cryptosporidium parvum
HTLRLLSFPSLLEKGLSKLFSIKQN

SEQ ID NO: 2314580 - protein, 24 aa, Cryptosporidium parvum
HTNIFNRPYFNIDNISFEPKKEET

SEQ ID NO: 2314581 - protein, 21 aa, Cryptosporidium parvum
HTNWIEIVLNQLESIPAFAPY

SEQ ID NO: 2314582 - protein, 25 aa, Cryptosporidium parvum
HTQIKYPEYFIKPNNKYVNELGRSN

SEQ ID NO: 2314583 - protein, 22 aa, Cryptosporidium parvum
HTVLLRREDIVLVGATIGSGQA

SEQ ID NO: 2314584 - protein, 22 aa, Cryptosporidium parvum
HVCCFMRYYQIIYERLKKAKST

SEQ ID NO: 2314585 - protein, 22 aa, Cryptosporidium parvum
HVEAPVFKYGGYKNSSLIINNN

SEQ ID NO: 2314586 - protein, 21 aa, Cryptosporidium parvum
HVKLIIQDRIYDWKTPDSRKI

SEQ ID NO: 2314587 - protein, 17 aa, Cryptosporidium parvum
HVKMLESRFYLNKSGKS

SEQ ID NO: 2314588 - protein, 24 aa, Cryptosporidium parvum
HVKNRKVYILASLEPSKELSGGTF

SEQ ID NO: 2314589 - protein, 25 aa, Cryptosporidium parvum
HVQRYIQAINDYFAREGLLGVCESR

SEQ ID NO: 2314590 - protein, 20 aa, Cryptosporidium parvum
HVRPEFGFILSPTAPKTQKQ

SEQ ID NO: 2314591 - protein, 23 aa, Cryptosporidium parvum
HWGDPLYVIYKNSSGFILNFETW

SEQ ID NO: 2314592 - protein, 25 aa, Cryptosporidium parvum
HWNELIEVLKYIKIPANLQIILFEH

SEQ ID NO: 2314593 - protein, 24 aa, Cryptosporidium parvum
HYDENILNSMKVIELKDVCSKLQL

SEQ ID NO: 2314594 - protein, 19 aa, Cryptosporidium parvum
HYFESLPYVTDLEGVIDYD

SEQ ID NO: 2314595 - protein, 36 aa, Cryptosporidium parvum
HYFKLNVESVKLIRSFFYYFQNLSELFVKEKKNNKK

SEQ ID NO: 2314596 - protein, 19 aa, Cryptosporidium parvum
HYHIPSLCNFLGIEMIRPL

SEQ ID NO: 2314597 - protein, 23 aa, Cryptosporidium parvum
HYKEIVHLSLPFEMANEAFFRDY

SEQ ID NO: 2314598 - protein, 32 aa, Cryptosporidium parvum
HYKLILKRRIFLFWRELLRIILLKDKNFKQEN

SEQ ID NO: 2314599 - protein, 17 aa, Cryptosporidium parvum
HYLANNGWVMGWNAKED

SEQ ID NO: 2314600 - protein, 19 aa, Cryptosporidium parvum
HYLQLIYNILELPCSNNII

SEQ ID NO: 2314601 - protein, 24 aa, Cryptosporidium parvum
HYNETQLRLFRQEQLLLLAENERL

SEQ ID NO: 2314602 - protein, 33 aa, Cryptosporidium parvum; identical to SEQ ID NO: 2190862

SEQ ID NO: 2314603 - protein, 20 aa, Cryptosporidium parvum
HYSHVFWNRVSERIAPNYYN

SEQ ID NO: 2314604 - protein, 20 aa, Cryptosporidium parvum
IAAFRLLRRCMSDPSNALDF

SEQ ID NO: 2314605 - protein, 23 aa, Cryptosporidium parvum
IAAKKFLQSFLKLPEEALREDFD

SEQ ID NO: 2314606 - protein, 19 aa, Cryptosporidium parvum
IAAKLSLVPVRRGYWGNKI

SEQ ID NO: 2314607 - protein, 25 aa, Cryptosporidium parvum
IADHLNLPPIKLHCSLLAEDAIKHA

SEQ ID NO: 2314608 - protein, 23 aa, Cryptosporidium parvum
IADNLIMEYLGPIDSIRAANDPI

SEQ ID NO: 2314609 - protein, 19 aa, Cryptosporidium parvum
IAEIITILHPYLRSDFREI

SEQ ID NO: 2314610 - protein, 20 aa, Cryptosporidium parvum
IAEVCYIRRKALLLNSKVNT

SEQ ID NO: 2314611 - protein, 17 aa, Cryptosporidium parvum
IAFITKRPDLFGTIEEA

SEQ ID NO: 2314612 - protein, 25 aa, Cryptosporidium parvum
IAKDHITLLYRLFAQLDRLEDIMDF

SEQ ID NO: 2314613 - protein, 17 aa, Cryptosporidium parvum
IAKLDPSLGTKLAFEQH

SEQ ID NO: 2314614 - protein, 27 aa, Cryptosporidium parvum
IALEYLDYCILYPPPNVGIIRTHLYRI

SEQ ID NO: 2314615 - protein, 17 aa, Cryptosporidium parvum
IALISIKFKETASNCFQ

SEQ ID NO: 2314616 - protein, 20 aa, Cryptosporidium parvum
IALRVMLLENEYFLGLEPIL

SEQ ID NO: 2314617 - protein, 25 aa, Cryptosporidium parvum
IAMGGGSHPSFPFMYGNFPNNGSQQ

SEQ ID NO: 2314618 - protein, 24 aa, Cryptosporidium parvum
IAMGPFVVDTWYYSPYPKEVQNVD

SEQ ID NO: 2314619 - protein, 24 aa, Cryptosporidium parvum
IAMYMHNFTLYGSVRPFGCSILLG

SEQ ID NO: 2314620 - protein, 25 aa, Cryptosporidium parvum
IANAILLPHIISYNASNRPTKQSIL

SEQ ID NO: 2314621 - protein, 24 aa, Cryptosporidium parvum
IAPEIFGMLDVKKGLLLQLIGGVT

SEQ ID NO: 2314622 - protein, 22 aa, Cryptosporidium parvum
IAPKLDGVLPVKIESVPKKSDI

SEQ ID NO: 2314623 - protein, 19 aa, Cryptosporidium parvum
IAPLYYRSKKQKMVKGFFL

SEQ ID NO: 2314624 - protein, 28 aa, Cryptosporidium parvum
IAQANQRFLLLYTFLKKNRDKKVMVFFS

SEQ ID NO: 2314625 - protein, 25 aa, Cryptosporidium parvum
IAQGKKLVLILSKIDLVPGDVVKEW

SEQ ID NO: 2314626 - protein, 18 aa, Cryptosporidium parvum
IAQLPSLPEIKAILKWTD

SEQ ID NO: 2314627 - protein, 20 aa, Cryptosporidium parvum
IAQQQNSLSNTLKIIEESFS

SEQ ID NO: 2314628 - protein, 18 aa, Cryptosporidium parvum
IARAIGFDLTPGIRRKTG

SEQ ID NO: 2314629 - protein, 25 aa, Cryptosporidium parvum
IARSIWPIFVYHPIPNPKYILENLH

SEQ ID NO: 2314630 - protein, 24 aa, Cryptosporidium parvum
IARVKSLIGPNILLKVVLEIGEIN

SEQ ID NO: 2314631 - protein, 23 aa, Cryptosporidium parvum
IARVLEDWPYWNKSILSELKNNK

SEQ ID NO: 2314632 - protein, 23 aa, Cryptosporidium parvum
IASFLTCEIPWKLEERHLPKSST

SEQ ID NO: 2314633 - protein, 24 aa, Cryptosporidium parvum
IASHQQFFYWEKCIEIFGLDVCIN

SEQ ID NO: 2314634 - protein, 18 aa, Cryptosporidium parvum
IASILEGMFPIGSSTAPL

SEQ ID NO: 2314635 - protein, 33 aa, Cryptosporidium parvum
IASKVDSWCLGWSTFYLLFGTELFESVHNIDND

SEQ ID NO: 2314636 - protein, 18 aa, Cryptosporidium parvum
IATFIPCYDVIPPKFINA

SEQ ID NO: 2314637 - protein, 27 aa, Cryptosporidium parvum
IATHQLPPHPGIHAPPPFMDPWNMQGH

SEQ ID NO: 2314638 - protein, 18 aa, Cryptosporidium parvum
IATILLHVLSRTFSGGAC

SEQ ID NO: 2314639 - protein, 29 aa, Cryptosporidium parvum
IATIVTLRQFFIQWLTTPVGNLETAFIAY

SEQ ID NO: 2314640 - protein, 32 aa, Cryptosporidium parvum
IATYSTPWFVYYRPFLKFFLQNASKLGSICVF

SEQ ID NO: 2314641 - protein, 18 aa, Cryptosporidium parvum
IAVHGIHTKQLLLKYIKN

SEQ ID NO: 2314642 - protein, 19 aa, Cryptosporidium parvum
IAVIPTFAPFTCIKDFKYC

SEQ ID NO: 2314643 - protein, 24 aa, Cryptosporidium parvum
IAVPALNNRWFGGNQVFCSLYNTE

SEQ ID NO: 2314644 - protein, 17 aa, Cryptosporidium parvum
IAYWPPKEVLKIPITIE

SEQ ID NO: 2314645 - protein, 20 aa, Cryptosporidium parvum
ICEIVALSSLLYSGGNILAI

SEQ ID NO: 2314646 - protein, 28 aa, Cryptosporidium parvum
ICESRSHRRLYIKNLPFSANTESVIEVF

SEQ ID NO: 2314647 - protein, 29 aa, Cryptosporidium parvum
ICESYFTTLYSVSLFNLIAILKQNIPIES

SEQ ID NO: 2314648 - protein, 18 aa, Cryptosporidium parvum
ICEVPEKILEDGDCCWIH

SEQ ID NO: 2314649 - protein, 25 aa, Cryptosporidium parvum
ICFDLNMTLFLAWSPKEAGHILETL

SEQ ID NO: 2314650 - protein, 18 aa, Cryptosporidium parvum
ICGVNIGKYKFKCCLRKF

SEQ ID NO: 2314651 - protein, 17 aa, Cryptosporidium parvum
ICILLATNVPGTLDSAV

SEQ ID NO: 2314652 - protein, 20 aa, Cryptosporidium parvum
ICIRLISGLKFLEFDDIETG

SEQ ID NO: 2314653 - protein, 26 aa, Cryptosporidium parvum
ICKCMARIYLILLKKGIIHVHQERVN

SEQ ID NO: 2314654 - protein, 17 aa, Cryptosporidium parvum
ICKVGCIMDLIFENRYS

SEQ ID NO: 2314655 - protein, 17 aa, Cryptosporidium parvum
ICLIFNVECNDVYFGVP

SEQ ID NO: 2314656 - protein, 17 aa, Cryptosporidium parvum
ICLLLFERRVRSKSDGI

SEQ ID NO: 2314657 - protein, 22 aa, Cryptosporidium parvum
ICLQLPLENVFFKQGSFVSRPM

SEQ ID NO: 2314658 - protein, 32 aa, Cryptosporidium parvum; identical to SEQ ID NO: 2190910

SEQ ID NO: 2314659 - protein, 17 aa, Cryptosporidium parvum
ICMVISNIFWGLWGICK

SEQ ID NO: 2314660 - protein, 29 aa, Cryptosporidium parvum
ICNESFSCNIILLDRPRPSFKLDNEDVAK

SEQ ID NO: 2314661 - protein, 30 aa, Cryptosporidium parvum
ICNSAYKKLIFLFKQVIYSISPIKVNKLCF

SEQ ID NO: 2314662 - protein, 55 aa, Cryptosporidium parvum
ICNSPEIFKITYKIPFYWASLIANIYVFEKLRNYDIMLIIIEYISEVNPELIFEF

SEQ ID NO: 2314663 - protein, 18 aa, Cryptosporidium parvum
ICQLLPNGSIRIVDRRKN

SEQ ID NO: 2314664 - protein, 18 aa, Cryptosporidium parvum
ICRSWENYIHPRAKDFWK

SEQ ID NO: 2314665 - protein, 28 aa, Cryptosporidium parvum
ICSIPVFEIRLVWKDKILSNNALLSSYG

SEQ ID NO: 2314666 - protein, 24 aa, Cryptosporidium parvum
ICVGQNGIIWFSASNIKEMLLIMS

SEQ ID NO: 2314667 - protein, 28 aa, Cryptosporidium parvum
ICYKETLLKRNLLSNIFLDILGKLNAIL

SEQ ID NO: 2314668 - protein, 17 aa, Cryptosporidium parvum
ICYKMQFEPEFNLPFNT

SEQ ID NO: 2314669 - protein, 25 aa, Cryptosporidium parvum
IDCPSELFSTLLLNPDLESLSVQKI

SEQ ID NO: 2314670 - protein, 18 aa, Cryptosporidium parvum
IDCSYRCPYPDCGRFYSS

SEQ ID NO: 2314671 - protein, 25 aa, Cryptosporidium parvum
IDCTDNSWNLFHPSLLGSSTRDGDF

SEQ ID NO: 2314672 - protein, 29 aa, Cryptosporidium parvum
IDEETVISIFIQLLDALNYCHTRSNRVLH

SEQ ID NO: 2314673 - protein, 19 aa, Cryptosporidium parvum
IDEFSTWLDKYVCCDSIEI

SEQ ID NO: 2314674 - protein, 23 aa, Cryptosporidium parvum
IDELYSLIKHVYFLLDTVQEEAK

SEQ ID NO: 2314675 - protein, 30 aa, Cryptosporidium parvum; identical to SEQ ID NO: 2190927

SEQ ID NO: 2314676 - protein, 26 aa, Cryptosporidium parvum
IDFKAFSLTLLEKLSKIPGSRWFLQP

SEQ ID NO: 2314677 - protein, 23 aa, Cryptosporidium parvum
IDFKTWWNNTFLNRLGISDSKEH

SEQ ID NO: 2314678 - protein, 19 aa, Cryptosporidium parvum
IDFSSIFVPYMSTAKRVGQ

SEQ ID NO: 2314679 - protein, 24 aa, Cryptosporidium parvum
IDFWKSQFLYLVKKLLINYKKTKK

SEQ ID NO: 2314680 - protein, 18 aa, Cryptosporidium parvum
IDGEFFRGWSSPCSTYDS

SEQ ID NO: 2314681 - protein, 20 aa, Cryptosporidium parvum
IDGEWLILGSQDGSIRQWKF

SEQ ID NO: 2314682 - protein, 27 aa, Cryptosporidium parvum
IDGSKRVVIKLSKYVLDCEFRLKKTLL

SEQ ID NO: 2314683 - protein, 23 aa, Cryptosporidium parvum
IDGTPIVEIFPYSLNYSISRNVI

SEQ ID NO: 2314684 - protein, 41 aa, Cryptosporidium parvum; identical to SEQ ID NO: 2190935

SEQ ID NO: 2314685 - protein, 19 aa, Cryptosporidium parvum
IDIDGAFFGTSFPHIFLQV

SEQ ID NO: 2314686 - protein, 28 aa, Cryptosporidium parvum
IDIEWYKTQQLLPPLSRLCAPIPGLEIS

SEQ ID NO: 2314687 - protein, 18 aa, Cryptosporidium parvum
IDILDDALLRPGRIDRKI

SEQ ID NO: 2314688 - protein, 22 aa, Cryptosporidium parvum
IDIRKLCRCAICYDPGKARFNE

SEQ ID NO: 2314689 - protein, 27 aa, Cryptosporidium parvum
IDISKSFIPPPLFSCMDQKPYIPDSHV

SEQ ID NO: 2314690 - protein, 24 aa, Cryptosporidium parvum
IDKSIKIWDIRKANNPLKTIKNLP

SEQ ID NO: 2314691 - protein, 26 aa, Cryptosporidium parvum
IDKSYLDLMVWWQKNYMEFFSSIRNI

SEQ ID NO: 2314692 - protein, 24 aa, Cryptosporidium parvum
IDLEERLLLWSTPLQQSQDWESQG

SEQ ID NO: 2314693 - protein, 24 aa, Cryptosporidium parvum
IDLGLLQYLTILEYEKWLDPEIYE

SEQ ID NO: 2314694 - protein, 23 aa, Cryptosporidium parvum
IDLIQSFLRLNPLERISASQALE

SEQ ID NO: 2314695 - protein, 17 aa, Cryptosporidium parvum
IDLLPPDSPNFEDIYIV

SEQ ID NO: 2314696 - protein, 23 aa, Cryptosporidium parvum
IDLWSIGCVFGELILGKPLFSGE

SEQ ID NO: 2314697 - protein, 29 aa, Cryptosporidium parvum
IDMLATDWFLTLFSYSIPLNIIGKFWDDF

SEQ ID NO: 2314698 - protein, 21 aa, Cryptosporidium parvum
IDMWSVGCIFAELLNMLKENV

SEQ ID NO: 2314699 - protein, 27 aa, Cryptosporidium parvum
IDNELYIQNDCIYGDEDVKLYNNNNND

SEQ ID NO: 2314700 - protein, 25 aa, Cryptosporidium parvum
IDNHCLNFYPLLEKVKLDSKNYKCK

SEQ ID NO: 2314701 - protein, 25 aa, Cryptosporidium parvum
IDNIRSYFLYHIDTPRFKQIEETSI

SEQ ID NO: 2314702 - protein, 25 aa, Cryptosporidium parvum
IDNKDQVLLTLKLPERLKVVNKTNV

SEQ ID NO: 2314703 - protein, 25 aa, Cryptosporidium parvum
IDNKTLFDTFSLFGNIMSCKIATDV

SEQ ID NO: 2314704 - protein, 29 aa, Cryptosporidium parvum
IDNYAVGMNLLLFLTGRFICRQKGLDVTE

SEQ ID NO: 2314705 - protein, 18 aa, Cryptosporidium parvum
IDPKVFKLRIPYISKAVE

SEQ ID NO: 2314706 - protein, 17 aa, Cryptosporidium parvum
IDPVYIPFLKPQNIQEL

SEQ ID NO: 2314707 - protein, 26 aa, Cryptosporidium parvum
IDQDEELILNLFLLKMAQVDQKITSL

SEQ ID NO: 2314708 - protein, 21 aa, Cryptosporidium parvum
IDQLFGIFRLVGTPLGTSLDY

SEQ ID NO: 2314709 - protein, 24 aa, Cryptosporidium parvum
IDQYICNFGQWTISPELFNELLIL

SEQ ID NO: 2314710 - protein, 24 aa, Cryptosporidium parvum
IDRFKMYQFFKKLRDFETGGFKIQ

SEQ ID NO: 2314711 - protein, 22 aa, Cryptosporidium parvum
IDRGVLFKGILRMISRNRGEIE

SEQ ID NO: 2314712 - protein, 31 aa, Cryptosporidium parvum; identical to SEQ ID NO: 2190967

SEQ ID NO: 2314713 - protein, 39 aa, Cryptosporidium parvum
IDSGILFYEFRLPIIYHIIYLLEILRICIRIPTEGNWLF

SEQ ID NO: 2314714 - protein, 18 aa, Cryptosporidium parvum
IDSMPFDRFVCVFKTLDE

SEQ ID NO: 2314715 - protein, 27 aa, Cryptosporidium parvum
IDSNRLCNTIFPLKPWEKRDYIEVLHP

SEQ ID NO: 2314716 - protein, 29 aa, Cryptosporidium parvum
IDSSPWNLRLWKELLSYLKKVLAFLSLTC

SEQ ID NO: 2314717 - protein, 23 aa, Cryptosporidium parvum
IDTIIPFHNLYYLKSKISKNSET

SEQ ID NO: 2314718 - protein, 28 aa, Cryptosporidium parvum
IDVCFYIGFVPFYSKVILRLLHQQLASL

SEQ ID NO: 2314719 - protein, 17 aa, Cryptosporidium parvum
IDVKRSTQYLIDYQQEY

SEQ ID NO: 2314720 - protein, 23 aa, Cryptosporidium parvum
IDVQNAMITFFHQTVYDPIEGNM

SEQ ID NO: 2314721 - protein, 19 aa, Cryptosporidium parvum
IDWKIFPSEYIEGLSSSLC

SEQ ID NO: 2314722 - protein, 34 aa, Cryptosporidium parvum
IDYIVQNIVSFFLPNILNFLRIVTSPNNKQFFRL

SEQ ID NO: 2314723 - protein, 29 aa, Cryptosporidium parvum
IDYKSHGIGVFLPEGRTIDPNANDGLLFG

SEQ ID NO: 2314724 - protein, 28 aa, Cryptosporidium parvum
IDYQKLRTPFWIWLSVNDEWNYSLEWHP

SEQ ID NO: 2314725 - protein, 24 aa, Cryptosporidium parvum
IDYSLNACQVLLLAPTRELAQQIQ

SEQ ID NO: 2314726 - protein, 17 aa, Cryptosporidium parvum
IEALAYYELSEEDLLFF

SEQ ID NO: 2314727 - protein, 17 aa, Cryptosporidium parvum
IECLAYAPKKALLSVKG

SEQ ID NO: 2314728 - protein, 26 aa, Cryptosporidium parvum
IEDDKSLSLELILDSEKRKNEISDNW

SEQ ID NO: 2314729 - protein, 25 aa, Cryptosporidium parvum
IEDEIRELFSPYGQINEIFIMREPH

SEQ ID NO: 2314730 - protein, 28 aa, Cryptosporidium parvum
IEDGEKYFNYWMLAKKFEFEKIVTRWTS

SEQ ID NO: 2314731 - protein, 24 aa, Cryptosporidium parvum
IEEAKLLLSLKLKYVKMLLSSSIN

SEQ ID NO: 2314732 - protein, 24 aa, Cryptosporidium parvum
IEECLILDFQLPRGDEILLAETPS

SEQ ID NO: 2314733 - protein, 17 aa, Cryptosporidium parvum
IEEDLLKFLLNGNKKEL

SEQ ID NO: 2314734 - protein, 26 aa, Cryptosporidium parvum
IEEDNIILILNMPGWITGVGLEISSI

SEQ ID NO: 2314735 - protein, 24 aa, Cryptosporidium parvum
IEEFYLMMRFRWDGMDHYRMDKFT

SEQ ID NO: 2314736 - protein, 19 aa, Cryptosporidium parvum
IEELIEFLPKERQILLYSA

SEQ ID NO: 2314737 - protein, 24 aa, Cryptosporidium parvum
IEEMDPPLPQLKFVTARDARKNKA

SEQ ID NO: 2314738 - protein, 25 aa, Cryptosporidium parvum
IEEMLRAPIILLKEGSDTSQGKGQI

SEQ ID NO: 2314739 - protein, 17 aa, Cryptosporidium parvum
IEENLIAFITKRPDLFG

SEQ ID NO: 2314740 - protein, 23 aa, Cryptosporidium parvum
IEEYRWKFYQSDPGNWNNLHLET

SEQ ID NO: 2314741 - protein, 26 aa, Cryptosporidium parvum
IEFIKITFQQLLKESLDLIRISAPLF

SEQ ID NO: 2314742 - protein, 17 aa, Cryptosporidium parvum
IEFISLISKLKAHFGLK

SEQ ID NO: 2314743 - protein, 17 aa, Cryptosporidium parvum
IEFKPYNYITVFPDILL

SEQ ID NO: 2314744 - protein, 19 aa, Cryptosporidium parvum
IEFKYIPKTAIIIIRKLKN

SEQ ID NO: 2314745 - protein, 18 aa, Cryptosporidium parvum
IEFLESENTLRAFNRMST

SEQ ID NO: 2314746 - protein, 21 aa, Cryptosporidium parvum
IEFLKKKLYTLKNQQLIVSSE

SEQ ID NO: 2314747 - protein, 21 aa, Cryptosporidium parvum
IEFLPKERQILLYSATFPVTV

SEQ ID NO: 2314748 - protein, 23 aa, Cryptosporidium parvum
IEFLSEYIFLTKGRFHILDIYPL

SEQ ID NO: 2314749 - protein, 24 aa, Cryptosporidium parvum
IEFQPSIPALIFFKNNEYSFSFNF

SEQ ID NO: 2314750 - protein, 26 aa, Cryptosporidium parvum
IEFRRRYLEEFLRRVFNRGYLISSNL

SEQ ID NO: 2314751 - protein, 21 aa, Cryptosporidium parvum
IEFVLWPRHYKDWESISFLVL

SEQ ID NO: 2314752 - protein, 18 aa, Cryptosporidium parvum
IEFYKDVLQHPDFNEIGS

SEQ ID NO: 2314753 - protein, 33 aa, Cryptosporidium parvum
IEGEKYKLGSQKLPFFSDLKPPKLSVERLLTFD

SEQ ID NO: 2314754 - protein, 39 aa, Cryptosporidium parvum
IEGFHQFFPGLNMGGEYIGGLLPGALAAAGLNIGGGINS

SEQ ID NO: 2314755 - protein, 18 aa, Cryptosporidium parvum
IEGPFYYDAKPHSEIKFV

SEQ ID NO: 2314756 - protein, 20 aa, Cryptosporidium parvum
IEGVLKYWPITNSSKQILFL

SEQ ID NO: 2314757 - protein, 25 aa, Cryptosporidium parvum
IEHLHSLVFDAFHLLSTGKSQLNDG

SEQ ID NO: 2314758 - protein, 18 aa, Cryptosporidium parvum
IEHLLLVYRQWKDIDEET

SEQ ID NO: 2314759 - protein, 38 aa, Cryptosporidium parvum
IEIFKKWKDFIPKSYYWILIIVWYRIMHDYSRMIDCYN

SEQ ID NO: 2314760 - protein, 19 aa, Cryptosporidium parvum
IEIGKHKLIFDKQSAVPRY

SEQ ID NO: 2314761 - protein, 26 aa, Cryptosporidium parvum
IEIGNILTHHYLFYPKNIQVMDLKEN

SEQ ID NO: 2314762 - protein, 27 aa, Cryptosporidium parvum
IEIIGGCSRIPWVQRAIGAAFNDKELC

SEQ ID NO: 2314763 - protein, 31 aa, Cryptosporidium parvum; identical to SEQ ID NO: 2191008

SEQ ID NO: 2314764 - protein, 24 aa, Cryptosporidium parvum
IEILKYSPLSQAVSALFIAKECLG

SEQ ID NO: 2314765 - protein, 18 aa, Cryptosporidium parvum
IEILLDNGHLLNKVVKGK

SEQ ID NO: 2314766 - protein, 17 aa, Cryptosporidium parvum
IEINGKILHYNYSERYY

SEQ ID NO: 2314767 - protein, 20 aa, Cryptosporidium parvum
IEIRRKYYVKVTPINTKYIA

SEQ ID NO: 2314768 - protein, 25 aa, Cryptosporidium parvum
IEITSKPILSQLLKALIPVNSSHIS

SEQ ID NO: 2314769 - protein, 25 aa, Cryptosporidium parvum
IEKAELQHKILGYEKIRAFKCISTP

SEQ ID NO: 2314770 - protein, 25 aa, Cryptosporidium parvum
IEKETVFPGINRYDPGNLRSSFSPS

SEQ ID NO: 2314771 - protein, 29 aa, Cryptosporidium parvum
IEKFQTTQVPLFLLSTKAAGQGLNLTVAS

SEQ ID NO: 2314772 - protein, 22 aa, Cryptosporidium parvum
IEKIKVDILRKLNFNPSTGVQT

SEQ ID NO: 2314773 - protein, 19 aa, Cryptosporidium parvum
IEKILKAAAFMQQLKGIIR

SEQ ID NO: 2314774 - protein, 28 aa, Cryptosporidium parvum
IEKISRHLIMNFGYTDLLLRFTTPNGTL

SEQ ID NO: 2314775 - protein, 18 aa, Cryptosporidium parvum
IEKLFGRSSIFNIPGIGI

SEQ ID NO: 2314776 - protein, 20 aa, Cryptosporidium parvum
IEKLNLLYRMASIDTANNLL

SEQ ID NO: 2314777 - protein, 23 aa, Cryptosporidium parvum
IEKQIFLQFHRNTLLPKRWPIGE

SEQ ID NO: 2314778 - protein, 33 aa, Cryptosporidium parvum; identical to SEQ ID NO: 2191025

SEQ ID NO: 2314779 - protein, 17 aa, Cryptosporidium parvum
IEKRMLTILSLVGYSYI

SEQ ID NO: 2314780 - protein, 19 aa, Cryptosporidium parvum
IEKSNIISFMYIILEKNIS

SEQ ID NO: 2314781 - protein, 20 aa, Cryptosporidium parvum
IEKWLICRKMKFPRPVCSKN

SEQ ID NO: 2314782 - protein, 22 aa, Cryptosporidium parvum
IELDCNTPLPAPPSPRYTTIKV

SEQ ID NO: 2314783 - protein, 21 aa, Cryptosporidium parvum
IELERRPNWWRGSESENILDP

SEQ ID NO: 2314784 - protein, 27 aa, Cryptosporidium parvum
IELGKPMFHIGFITTVLKLLRCVCYAC

SEQ ID NO: 2314785 - protein, 20 aa, Cryptosporidium parvum
IELLFSYVNPVDLHYALFSM

SEQ ID NO: 2314786 - protein, 21 aa, Cryptosporidium parvum
IELLQQVCILVSYLSIGNLRD

SEQ ID NO: 2314787 - protein, 25 aa, Cryptosporidium parvum
IELSDDFFIKIPRNVFIGLNSIDFA

SEQ ID NO: 2314788 - protein, 32 aa, Cryptosporidium parvum
IEMAPLHNIITRYYPCNLLLRESTHEKTPLKD

SEQ ID NO: 2314789 - protein, 29 aa, Cryptosporidium parvum
IEMPSIELSLFLINFGKKFVKFELKEFSN

SEQ ID NO: 2314790 - protein, 25 aa, Cryptosporidium parvum
IEMTKPNDFSFLLNSDINDGNDFLH

SEQ ID NO: 2314791 - protein, 29 aa, Cryptosporidium parvum
IENDFPVRKLQYSPLGSYLLVLTVFEQGK

SEQ ID NO: 2314792 - protein, 33 aa, Cryptosporidium parvum
IENDVFYLDDGAGYITFNSSILDFSEMEKRPKP

SEQ ID NO: 2314793 - protein, 19 aa, Cryptosporidium parvum
IENEKIPLHILAKVSKSHS

SEQ ID NO: 2314794 - protein, 22 aa, Cryptosporidium parvum
IENIQYLIPIIVKLIECNPEKV

SEQ ID NO: 2314795 - protein, 17 aa, Cryptosporidium parvum
IENLFCIGALDSTTAAS

SEQ ID NO: 2314796 - protein, 26 aa, Cryptosporidium parvum
IENNIKYIFDGPLSFDTIMALKRKKS

SEQ ID NO: 2314797 - protein, 30 aa, Cryptosporidium parvum
IENRQIIRTLIQRWVRLISKDRPSSLETID

SEQ ID NO: 2314798 - protein, 24 aa, Cryptosporidium parvum
IENRSRGFINFYIVSDVYNKKIVE

SEQ ID NO: 2314799 - protein, 18 aa, Cryptosporidium parvum
IENSKIIHVIKTLKTDLS

SEQ ID NO: 2314800 - protein, 28 aa, Cryptosporidium parvum
IENVLKKRFLFWIINNYENQRIPNLNSF

SEQ ID NO: 2314801 - protein, 23 aa, Cryptosporidium parvum
IEPKLEISNLPQYLGKVSNENFE

SEQ ID NO: 2314802 - protein, 26 aa, Cryptosporidium parvum
IEPKRIQDLPLMLRGLELLSRSDPCI

SEQ ID NO: 2314803 - protein, 22 aa, Cryptosporidium parvum
IEQFYWERLPRFVGFEELPWRE

SEQ ID NO: 2314804 - protein, 43 aa, Cryptosporidium parvum; identical to SEQ ID NO: 2191044

SEQ ID NO: 2314805 - protein, 26 aa, Cryptosporidium parvum
IEQHRQLLLPYPEGIQWDLETLSWRY

SEQ ID NO: 2314806 - protein, 30 aa, Cryptosporidium parvum; identical to SEQ ID NO: 2191045

SEQ ID NO: 2314807 - protein, 25 aa, Cryptosporidium parvum
IEQTIENLWMIYGIKMYLQDMICEI

SEQ ID NO: 2314808 - protein, 19 aa, Cryptosporidium parvum
IERALGEGAVFNPFFNINS

SEQ ID NO: 2314809 - protein, 25 aa, Cryptosporidium parvum
IERDRIIELLKSLQYKSVGKWFSHT

SEQ ID NO: 2314810 - protein, 20 aa, Cryptosporidium parvum
IEREDIVAFLLFNADEILVD

SEQ ID NO: 2314811 - protein, 17 aa, Cryptosporidium parvum
IEREGLIPALINKKGDS

SEQ ID NO: 2314812 - protein, 20 aa, Cryptosporidium parvum
IERLNRIALVKPDKVLQIED

SEQ ID NO: 2314813 - protein, 18 aa, Cryptosporidium parvum
IERNNCVFVFNFSEKYYN

SEQ ID NO: 2314814 - protein, 26 aa, Cryptosporidium parvum
IERQKLHFFELRLARYLSYCVDGGLL

SEQ ID NO: 2314815 - protein, 18 aa, Cryptosporidium parvum
IERVKFLRKKFTPEELLN

SEQ ID NO: 2314816 - protein, 20 aa, Cryptosporidium parvum
IESARRLGVLSKIKIGRNAH

SEQ ID NO: 2314817 - protein, 27 aa, Cryptosporidium parvum
IESDVIKFFIVSYFNIVRKNVADSVPK

SEQ ID NO: 2314818 - protein, 25 aa, Cryptosporidium parvum
IESKDFQHRFVFFPSSTIHTKSLNQ

SEQ ID NO: 2314819 - protein, 20 aa, Cryptosporidium parvum
IESKLLIENKYWAQHIIHSV

SEQ ID NO: 2314820 - protein, 24 aa, Cryptosporidium parvum
IESRVGLMPYNTFLSINHESAEES

SEQ ID NO: 2314821 - protein, 28 aa, Cryptosporidium parvum
IESVCNVVLLPYNYLLDSITRQNLKIDL

SEQ ID NO: 2314822 - protein, 19 aa, Cryptosporidium parvum
IETPWEWERDFAIDEMDPL

SEQ ID NO: 2314823 - protein, 27 aa, Cryptosporidium parvum
IEVGKKVIISPLKLELLDNGSNYSKTQ

SEQ ID NO: 2314824 - protein, 17 aa, Cryptosporidium parvum
IEVLVSEKKVWEAAFHA

SEQ ID NO: 2314825 - protein, 21 aa, Cryptosporidium parvum
IEWKKYILSDFLKFENFDLSI

SEQ ID NO: 2314826 - protein, 25 aa, Cryptosporidium parvum
IEYCTRIIQLLKKNFPIKMGQVLIF

SEQ ID NO: 2314827 - protein, 25 aa, Cryptosporidium parvum
IFCEYEWVLWIKAETPQQMTLWATI

SEQ ID NO: 2314828 - protein, 30 aa, Cryptosporidium parvum
IFCMGIKEYSLFFQPYKDFERDQFLLGLNR

SEQ ID NO: 2314829 - protein, 26 aa, Cryptosporidium parvum
IFDDTDIFYNRLKIQKKRKTLENTKN

SEQ ID NO: 2314830 - protein, 21 aa, Cryptosporidium parvum
IFDIRKTCGPLFKLNTSKTNL

SEQ ID NO: 2314831 - protein, 31 aa, Cryptosporidium parvum; identical to SEQ ID NO: 2191068

SEQ ID NO: 2314832 - protein, 21 aa, Cryptosporidium parvum
IFDLDYVTMFPIILRELLKDL

SEQ ID NO: 2314833 - protein, 17 aa, Cryptosporidium parvum
IFEDLKYPALRNPDEFT

SEQ ID NO: 2314834 - protein, 23 aa, Cryptosporidium parvum
IFEDPIFSCKLNISFSKLRQMVW

SEQ ID NO: 2314835 - protein, 24 aa, Cryptosporidium parvum
IFEIIDLHWSVIHPIIIDVYTSTA

SEQ ID NO: 2314836 - protein, 24 aa, Cryptosporidium parvum
IFEKDILVLFPSFSDTHMILEIQK

SEQ ID NO: 2314837 - protein, 19 aa, Cryptosporidium parvum
IFEKLIEHLLLVYRQWKDI

SEQ ID NO: 2314838 - protein, 17 aa, Cryptosporidium parvum
IFEQNGFRFIFNSNSEI

SEQ ID NO: 2314839 - protein, 27 aa, Cryptosporidium parvum
IFESLDLAWELLRTFPEDMLKKIKHDL

SEQ ID NO: 2314840 - protein, 18 aa, Cryptosporidium parvum
IFETLKLPTSARLNPTVG

SEQ ID NO: 2314841 - protein, 19 aa, Cryptosporidium parvum
IFFIEKSIHNKYVSLKSKI

SEQ ID NO: 2314842 - protein, 17 aa, Cryptosporidium parvum
IFFPPSEVDIELLQKAC

SEQ ID NO: 2314843 - protein, 26 aa, Cryptosporidium parvum
IFGGLESIIIPPVLDLSANKAHYSSE

SEQ ID NO: 2314844 - protein, 17 aa, Cryptosporidium parvum
IFGKPDKCEVAKNKLSN

SEQ ID NO: 2314845 - protein, 18 aa, Cryptosporidium parvum
IFGNAIKIIWLVQGSYNL

SEQ ID NO: 2314846 - protein, 29 aa, Cryptosporidium parvum
IFGSFIMTNFRIILAPLFQKNINNKALTI

SEQ ID NO: 2314847 - protein, 39 aa, Cryptosporidium parvum
IFHALQVVQVCYIILRNFGIMLVLNDLNKFILLFAALCH

SEQ ID NO: 2314848 - protein, 26 aa, Cryptosporidium parvum
IFHDNTVTWLAYYRDSINNQFKYIFL

SEQ ID NO: 2314849 - protein, 17 aa, Cryptosporidium parvum
IFHKLILCQTFCAGQQI

SEQ ID NO: 2314850 - protein, 27 aa, Cryptosporidium parvum
IFIDPQQLLPMSRFLPKPSTQKTTKKT

SEQ ID NO: 2314851 - protein, 19 aa, Cryptosporidium parvum
IFIQWLDCVYQCYNQFPTE

SEQ ID NO: 2314852 - protein, 24 aa, Cryptosporidium parvum
IFLGPLEFLNFYQINTFNLNKIIN

SEQ ID NO: 2314853 - protein, 17 aa, Cryptosporidium parvum
IFLLNRNGEIVYSISNI

SEQ ID NO: 2314854 - protein, 17 aa, Cryptosporidium parvum
IFLQFSFNSEEKANFWY

SEQ ID NO: 2314855 - protein, 23 aa, Cryptosporidium parvum
IFLRNSILQIFRNFTDLIGSNSG

SEQ ID NO: 2314856 - protein, 19 aa, Cryptosporidium parvum
IFNGIEWMNNLPKIKQTQI

SEQ ID NO: 2314857 - protein, 24 aa, Cryptosporidium parvum
IFNKQIINLVKLLIIRSIISSNSD

SEQ ID NO: 2314858 - protein, 21 aa, Cryptosporidium parvum
IFPIYNEFVFLMSNLLRKTNF

SEQ ID NO: 2314859 - protein, 26 aa, Cryptosporidium parvum
IFPMNNFIYCILSMKLGEISEFRIYP

SEQ ID NO: 2314860 - protein, 33 aa, Cryptosporidium parvum; identical to SEQ ID NO: 2191085

SEQ ID NO: 2314861 - protein, 38 aa, Cryptosporidium parvum
IFPSRRKIENYLKLCLQLIFMSYQELLSEWTRLRGITF

SEQ ID NO: 2314862 - protein, 26 aa, Cryptosporidium parvum
IFQENLELFLRNCELNREVGWREVEN

SEQ ID NO: 2314863 - protein, 19 aa, Cryptosporidium parvum
IFQFIHKIAIILVTCAPEL

SEQ ID NO: 2314864 - protein, 18 aa, Cryptosporidium parvum
IFSDIMLTSMRVIENLRK

SEQ ID NO: 2314865 - protein, 17 aa, Cryptosporidium parvum
IFSHYISHYFKAVASEH

SEQ ID NO: 2314866 - protein, 24 aa, Cryptosporidium parvum
IFSKKLVPLFEWVCEQSPMSDILV

SEQ ID NO: 2314867 - protein, 19 aa, Cryptosporidium parvum
IFSQWGEPIDINLIRDKKL

SEQ ID NO: 2314868 - protein, 27 aa, Cryptosporidium parvum
IFSSHGGELIFVIRPAPSMGGEGGNHG

SEQ ID NO: 2314869 - protein, 25 aa, Cryptosporidium parvum
IFTERNLIENLFSFSKRKKFDIQIN

SEQ ID NO: 2314870 - protein, 20 aa, Cryptosporidium parvum
IFTHDMLLLKSVLNNNIEML

SEQ ID NO: 2314871 - protein, 18 aa, Cryptosporidium parvum
IFTPKLIESLAGLPIKEI

SEQ ID NO: 2314872 - protein, 25 aa, Cryptosporidium parvum
IGAFYIRSKPRRRIKPLIFGGGQER

SEQ ID NO: 2314873 - protein, 20 aa, Cryptosporidium parvum
IGAKALFALPICAIVKYMGY

SEQ ID NO: 2314874 - protein, 31 aa, Cryptosporidium parvum
IGALYRSEIATFIFLILPTSLISQWKEELDK

SEQ ID NO: 2314875 - protein, 18 aa, Cryptosporidium parvum
IGAYFTLVLDSDSQLFVW

SEQ ID NO: 2314876 - protein, 17 aa, Cryptosporidium parvum
IGAYLARLGHRVIQKAH

SEQ ID NO: 2314877 - protein, 24 aa, Cryptosporidium parvum
IGCCNTDWHFLQAKFGFENFTSYT

SEQ ID NO: 2314878 - protein, 19 aa, Cryptosporidium parvum
IGCQWHPVFPSRIASCGWD

SEQ ID NO: 2314879 - protein, 17 aa, Cryptosporidium parvum
IGDEYFCFLTESKTPKA

SEQ ID NO: 2314880 - protein, 19 aa, Cryptosporidium parvum
IGDHSYPIPVPVPVITPRT

SEQ ID NO: 2314881 - protein, 18 aa, Cryptosporidium parvum
IGDLLKTTFGPKGMDKIL

SEQ ID NO: 2314882 - protein, 17 aa, Cryptosporidium parvum
IGEGIPSYILDLPNEVM

SEQ ID NO: 2314883 - protein, 24 aa, Cryptosporidium parvum
IGELNFNELFIKFSLNILTEVYKK

SEQ ID NO: 2314884 - protein, 24 aa, Cryptosporidium parvum
IGESWPFDQYQATGLLPVDYAYWL

SEQ ID NO: 2314885 - protein, 19 aa, Cryptosporidium parvum
IGEVIIEIMLYFGKYYQND

SEQ ID NO: 2314886 - protein, 31 aa, Cryptosporidium parvum
IGFNLYPSLAKFPLFIQDTLKVLTLPCSSTF

SEQ ID NO: 2314887 - protein, 24 aa, Cryptosporidium parvum
IGGGTVWYQPPEILLRPGDSLDNP

SEQ ID NO: 2314888 - protein, 17 aa, Cryptosporidium parvum
IGGMNILGNPILESGLS

SEQ ID NO: 2314889 - protein, 25 aa, Cryptosporidium parvum
IGGPGRYIYIFEVKKRRLVRKIFTS

SEQ ID NO: 2314890 - protein, 34 aa, Cryptosporidium parvum; identical to SEQ ID NO: 2191109

SEQ ID NO: 2314891 - protein, 18 aa, Cryptosporidium parvum
IGHAKAALLNYYYANKYE

SEQ ID NO: 2314892 - protein, 40 aa, Cryptosporidium parvum
IGHDYIDINLLNKDVKLIPKLFWDKDFILKLNAGATQKED

SEQ ID NO: 2314893 - protein, 25 aa, Cryptosporidium parvum
IGHLGNVRQFLLNLEKQLSVDKKHT

SEQ ID NO: 2314894 - protein, 25 aa, Cryptosporidium parvum
IGIDKYMVILKNWLEFNLDSIKIQS

SEQ ID NO: 2314895 - protein, 23 aa, Cryptosporidium parvum
IGIKSFEKLIPFIDDPEASNDYL

SEQ ID NO: 2314896 - protein, 22 aa, Cryptosporidium parvum
IGISSIIPYSVLPIKSICSTDH

SEQ ID NO: 2314897 - protein, 20 aa, Cryptosporidium parvum
IGIVLQSIYDIFAAIRCYTN

SEQ ID NO: 2314898 - protein, 23 aa, Cryptosporidium parvum
IGKCALLMRNVAFQVVFDIMCIL

SEQ ID NO: 2314899 - protein, 34 aa, Cryptosporidium parvum
IGKFIDFMHLNLIKLFKFCNILFQPQFQNSNYVR

SEQ ID NO: 2314900 - protein, 18 aa, Cryptosporidium parvum
IGKKYRKLSLLIHPDKTS

SEQ ID NO: 2314901 - protein, 24 aa, Cryptosporidium parvum
IGKSPKDLPGLKKLPGTNLVKISS

SEQ ID NO: 2314902 - protein, 17 aa, Cryptosporidium parvum
IGKYTFLENIRSSSFIL

SEQ ID NO: 2314903 - protein, 25 aa, Cryptosporidium parvum
IGLDFSLIKILPYINGVNTSFEISR

SEQ ID NO: 2314904 - protein, 28 aa, Cryptosporidium parvum
IGLHKIFQVLRRIIVFYSSFNEVFEILL

SEQ ID NO: 2314905 - protein, 23 aa, Cryptosporidium parvum
IGLKTIWVGGVCDPGAFFTASKQ

SEQ ID NO: 2314906 - protein, 18 aa, Cryptosporidium parvum
IGLLSRIVIFRREEYIRK

SEQ ID NO: 2314907 - protein, 19 aa, Cryptosporidium parvum
IGMGGGHCMDIAKVLRVLY

SEQ ID NO: 2314908 - protein, 25 aa, Cryptosporidium parvum
IGMGMGNRIIPGISPGVIHPKSTVS

SEQ ID NO: 2314909 - protein, 21 aa, Cryptosporidium parvum
IGNFFILKTDHNFINKLTIYR

SEQ ID NO: 2314910 - protein, 24 aa, Cryptosporidium parvum
IGNLQLVRQLIASPKFNANATNEK

SEQ ID NO: 2314911 - protein, 19 aa, Cryptosporidium parvum
IGPLFLNFEIPMFNLSNIQ

SEQ ID NO: 2314912 - protein, 31 aa, Cryptosporidium parvum; identical to SEQ ID NO: 2191135

SEQ ID NO: 2314913 - protein, 23 aa, Cryptosporidium parvum
IGQSPQAFFYLDKTIFNEKSKHL

SEQ ID NO: 2314914 - protein, 28 aa, Cryptosporidium parvum
IGQVLEIIFNFLVLFKATPVIPELVDEF

SEQ ID NO: 2314915 - protein, 25 aa, Cryptosporidium parvum
IGRALRLCSLSRISLKRKYVLEVLD

SEQ ID NO: 2314916 - protein, 20 aa, Cryptosporidium parvum
IGSDPFRYYLAREGRFGNDI

SEQ ID NO: 2314917 - protein, 41 aa, Cryptosporidium parvum
IGSEVPALLAIACELFVRDLTSFSWNFTRRAKRRTVQVQDI

SEQ ID NO: 2314918 - protein, 23 aa, Cryptosporidium parvum
IGSFVDLLLTLRKLQETAISSLL

SEQ ID NO: 2314919 - protein, 25 aa, Cryptosporidium parvum
IGSKLSFLRCYVRHYFSLCDDYDFS

SEQ ID NO: 2314920 - protein, 25 aa, Cryptosporidium parvum
IGSMLPWFVNLSLKLNAHVLAYDYR

SEQ ID NO: 2314921 - protein, 26 aa, Cryptosporidium parvum
IGSSRWKYPIVDMSELLVIGWEALKK

SEQ ID NO: 2314922 - protein, 28 aa, Cryptosporidium parvum
IGSTENYLKLWLYGFLQRKESCRNALRQ

SEQ ID NO: 2314923 - protein, 27 aa, Cryptosporidium parvum
IGTGRLRYYVFNWKIPQISPSNVGIIL

SEQ ID NO: 2314924 - protein, 18 aa, Cryptosporidium parvum
IGTPGRIIALIRQKKLVT

SEQ ID NO: 2314925 - protein, 20 aa, Cryptosporidium parvum
IGVFIDFVPAHFCKDAWGLV

SEQ ID NO: 2314926 - protein, 19 aa, Cryptosporidium parvum
IGYDPRFAERIIKVVERPK

SEQ ID NO: 2314927 - protein, 27 aa, Cryptosporidium parvum
IHASGFRDFFLKPELIRAIGDAGFEHP

SEQ ID NO: 2314928 - protein, 32 aa, Cryptosporidium parvum; identical to SEQ ID NO: 2191148

SEQ ID NO: 2314929 - protein, 24 aa, Cryptosporidium parvum
IHDAPIMNFELLYNNNLNGNINGN

SEQ ID NO: 2314930 - protein, 21 aa, Cryptosporidium parvum
IHEDKIHGIYVKDLSEYFVTS

SEQ ID NO: 2314931 - protein, 26 aa, Cryptosporidium parvum
IHEFRQFMINLILNSSIFESSKNGVE

SEQ ID NO: 2314932 - protein, 26 aa, Cryptosporidium parvum
IHEGIIDLYILRYGIKDRLIPDLSPI

SEQ ID NO: 2314933 - protein, 25 aa, Cryptosporidium parvum
IHELFRKYCPDPLYLIADVTADDFE

SEQ ID NO: 2314934 - protein, 18 aa, Cryptosporidium parvum
IHENIARDIIFMTSLYFN

SEQ ID NO: 2314935 - protein, 31 aa, Cryptosporidium parvum; identical to SEQ ID NO: 2191151

SEQ ID NO: 2314936 - protein, 19 aa, Cryptosporidium parvum
IHFRRKYAPQFISPRNISS

SEQ ID NO: 2314937 - protein, 21 aa, Cryptosporidium parvum
IHGIYWVLCCSDLIQFNICDQ

SEQ ID NO: 2314938 - protein, 26 aa, Cryptosporidium parvum
IHGQFFDLLNIFDINGLPSVNNGYLF

SEQ ID NO: 2314939 - protein, 18 aa, Cryptosporidium parvum
IHHFIKNLKLMNKMIRNI

SEQ ID NO: 2314940 - protein, 17 aa, Cryptosporidium parvum
IHICISSYSFPSVLEEH

SEQ ID NO: 2314941 - protein, 26 aa, Cryptosporidium parvum
IHINKNCLYNLYKTVTYLPMDLRQGN

SEQ ID NO: 2314942 - protein, 17 aa, Cryptosporidium parvum
IHKDLINEFKHALVWGT

SEQ ID NO: 2314943 - protein, 21 aa, Cryptosporidium parvum
IHKELVLFSRYDTTRSIPNLL

SEQ ID NO: 2314944 - protein, 31 aa, Cryptosporidium parvum
IHKESNIVKFFPRYLIYYPQITSQALNFPIP

SEQ ID NO: 2314945 - protein, 18 aa, Cryptosporidium parvum
IHLGSLKNCFIRGSVVRY

SEQ ID NO: 2314946 - protein, 20 aa, Cryptosporidium parvum
IHLNYRLMYLRDVVMPRHLD

SEQ ID NO: 2314947 - protein, 17 aa, Cryptosporidium parvum
IHMISFTIAPYSDQNKP

SEQ ID NO: 2314948 - protein, 23 aa, Cryptosporidium parvum
IHPKTRFYSLSSGKLLLVQNFRI

SEQ ID NO: 2314949 - protein, 22 aa, Cryptosporidium parvum
IHQQQLMLLNAIQQQHIKQQQQ

SEQ ID NO: 2314950 - protein, 32 aa, Cryptosporidium parvum; identical to SEQ ID NO: 2191165

SEQ ID NO: 2314951 - protein, 27 aa, Cryptosporidium parvum
IHSIIRSIYIRIFNWVVSHINRFTSCK

SEQ ID NO: 2314952 - protein, 30 aa, Cryptosporidium parvum; identical to SEQ ID NO: 2191171

SEQ ID NO: 2314953 - protein, 38 aa, Cryptosporidium parvum
IHTRNKFLWCIEILHQFYYLNLDLLRMEKKRIEKSVKN

SEQ ID NO: 2314954 - protein, 26 aa, Cryptosporidium parvum
IHVMKMYWKPLMEWDLKCFVKILKQC

SEQ ID NO: 2314955 - protein, 28 aa, Cryptosporidium parvum
IHYKKKRLVILLRIYSIKQAKAIKIQRV

SEQ ID NO: 2314956 - protein, 17 aa, Cryptosporidium parvum
IIALTTMTKAFRFIEIS

SEQ ID NO: 2314957 - protein, 20 aa, Cryptosporidium parvum
IICMEWSKWSPNILMTGGVD

SEQ ID NO: 2314958 - protein, 26 aa, Cryptosporidium parvum
IICRRDLYLLLYYTNKLYLYIQSIIY

SEQ ID NO: 2314959 - protein, 33 aa, Cryptosporidium parvum
IIDPAMMRPGRLDRIIYVPLPNEMGRLDILMKV

SEQ ID NO: 2314960 - protein, 18 aa, Cryptosporidium parvum
IIDPLSRKEFYDLRAPST

SEQ ID NO: 2314961 - protein, 24 aa, Cryptosporidium parvum
IIDPMALFSWITYNLKKKIDKYLR

SEQ ID NO: 2314962 - protein, 24 aa, Cryptosporidium parvum
IIDSKLILSYCLSFHNVKYYLNEN

SEQ ID NO: 2314963 - protein, 23 aa, Cryptosporidium parvum
IIDSTMFLFCIDIKNGEILLNNI

SEQ ID NO: 2314964 - protein, 30 aa, Cryptosporidium parvum
IIDTSYTCQIFLEMWLRIKYKAFEYDKFCE

SEQ ID NO: 2314965 - protein, 28 aa, Cryptosporidium parvum
IIEENWLKIYYPFERIKTKILPAFNLGN

SEQ ID NO: 2314966 - protein, 23 aa, Cryptosporidium parvum
IIEFIFSCLKTIYPLNSKLLEAI

SEQ ID NO: 2314967 - protein, 39 aa, Cryptosporidium parvum
IIEGWLHKWTNMVNTWKPRYFRLYPGILCYIKGSKIRKI

SEQ ID NO: 2314968 - protein, 19 aa, Cryptosporidium parvum
IIEIRKLDAYWLQRELYSL

SEQ ID NO: 2314969 - protein, 27 aa, Cryptosporidium parvum
IIEISFVTQIKLIYKKIGWLVNSKSSK

SEQ ID NO: 2314970 - protein, 18 aa, Cryptosporidium parvum
IIEYGAGNAILSYWFIKE

SEQ ID NO: 2314971 - protein, 17 aa, Cryptosporidium parvum
IIFDSTYLFQLTKIKYL

SEQ ID NO: 2314972 - protein, 32 aa, Cryptosporidium parvum; identical to SEQ ID NO: 2191186

SEQ ID NO: 2314973 - protein, 24 aa, Cryptosporidium parvum
IIFNIKYKYIVLESNLIPLSFKAV

SEQ ID NO: 2314974 - protein, 17 aa, Cryptosporidium parvum
IIFTSCLHGWCLDITGG

SEQ ID NO: 2314975 - protein, 18 aa, Cryptosporidium parvum
IIGFVPSHWSPTAIKLFP

SEQ ID NO: 2314976 - protein, 18 aa, Cryptosporidium parvum
IIGHFEKVIRPYTRKKNQ

SEQ ID NO: 2314977 - protein, 19 aa, Cryptosporidium parvum
IIGPCLGSIYQNNLVSGTE

SEQ ID NO: 2314978 - protein, 27 aa, Cryptosporidium parvum
IIGPNWGEYFAIQIFNQLIVCSVGEEL

SEQ ID NO: 2314979 - protein, 17 aa, Cryptosporidium parvum
IIGVLDSAIWSVASHPK

SEQ ID NO: 2314980 - protein, 18 aa, Cryptosporidium parvum
IIGYANKRYKILGETLDI

SEQ ID NO: 2314981 - protein, 20 aa, Cryptosporidium parvum
IIHIPEKKMFLGLILRNIEI

SEQ ID NO: 2314982 - protein, 19 aa, Cryptosporidium parvum
IIHQLVHISCMIEEYGEKN

SEQ ID NO: 2314983 - protein, 18 aa, Cryptosporidium parvum
IIHQYRFQMIIDGIPTER

SEQ ID NO: 2314984 - protein, 17 aa, Cryptosporidium parvum
IIHVIKTLKTDLSQKNK

SEQ ID NO: 2314985 - protein, 26 aa, Cryptosporidium parvum
IIHVVYYWFEFVITNMLAWNRVEQWR

SEQ ID NO: 2314986 - protein, 26 aa, Cryptosporidium parvum
IIIKRHIRYPFIIDPSGYATSFLLEM

SEQ ID NO: 2314987 - protein, 17 aa, Cryptosporidium parvum
IIILFRSNRHNQALNYI

SEQ ID NO: 2314988 - protein, 17 aa, Cryptosporidium parvum
IIINNPVTFLTQMDAKY

SEQ ID NO: 2314989 - protein, 19 aa, Cryptosporidium parvum
IIIYLKKMSINKKDAKIEK

SEQ ID NO: 2314990 - protein, 18 aa, Cryptosporidium parvum
IIKETLCYIAKDPAAENE

SEQ ID NO: 2314991 - protein, 19 aa, Cryptosporidium parvum
IIKFPKLRVLLDPEGIPCN

SEQ ID NO: 2314992 - protein, 21 aa, Cryptosporidium parvum
IIKLINSFISFIAPRKKLKLS

SEQ ID NO: 2314993 - protein, 18 aa, Cryptosporidium parvum
IIKLTRLQRMGTIWCNSI

SEQ ID NO: 2314994 - protein, 19 aa, Cryptosporidium parvum
IIKMVYHGMEMDLLFACLN

SEQ ID NO: 2314995 - protein, 22 aa, Cryptosporidium parvum
IIKRRRLDLFTQKSIFKKIYDN

SEQ ID NO: 2314996 - protein, 17 aa, Cryptosporidium parvum
IIKSIKKYSYMLNDKVN

SEQ ID NO: 2314997 - protein, 22 aa, Cryptosporidium parvum
IIKVAIWFINHLSKSNINIRFY

SEQ ID NO: 2314998 - protein, 31 aa, Cryptosporidium parvum
IILKSKSEFRYWFKIYIKFSLDSLDLECIKE

SEQ ID NO: 2314999 - protein, 20 aa, Cryptosporidium parvum
IILNGIFQNGPNFGKKLRIY

SEQ ID NO: 2315000 - protein, 30 aa, Cryptosporidium parvum
IILNVKRSYNSFLIKGIIEIGKHKLIFDKQ

SEQ ID NO: 2315001 - protein, 19 aa, Cryptosporidium parvum
IILQSILRNSIVNNNILSA

SEQ ID NO: 2315002 - protein, 18 aa, Cryptosporidium parvum
IILRDLELPEGCRSIRSL

SEQ ID NO: 2315003 - protein, 19 aa, Cryptosporidium parvum
IILTVKWPYQEPEIIFYHP

SEQ ID NO: 2315004 - protein, 17 aa, Cryptosporidium parvum
IIMVPIATSLNGLSSIS

SEQ ID NO: 2315005 - protein, 34 aa, Cryptosporidium parvum
IINDHLYYQPINFNDTIVRYIGDKEPLVVSSNTI

SEQ ID NO: 2315006 - protein, 28 aa, Cryptosporidium parvum
IINEGLGASFYRFIFNSVFFSKSNLNEK

SEQ ID NO: 2315007 - protein, 28 aa, Cryptosporidium parvum
IINHHDFFILHLRKCIIGILDSWIKNRK

SEQ ID NO: 2315008 - protein, 18 aa, Cryptosporidium parvum
IINKYHILGYFTNKNTIF

SEQ ID NO: 2315009 - protein, 24 aa, Cryptosporidium parvum
IINLCNIIFNRLPELILEQMERST

SEQ ID NO: 2315010 - protein, 18 aa, Cryptosporidium parvum
IINLRMKLKSKYGNLIHQ

SEQ ID NO: 2315011 - protein, 21 aa, Cryptosporidium parvum
IINVLLCYCGNSEWIKHSSFT

SEQ ID NO: 2315012 - protein, 30 aa, Cryptosporidium parvum
IINYKVITPNFWITHPYINFSFLNNLNCKL

SEQ ID NO: 2315013 - protein, 18 aa, Cryptosporidium parvum
IIPICNPNKSSNSDKICF

SEQ ID NO: 2315014 - protein, 25 aa, Cryptosporidium parvum
IIQDDEFFIFIKSDFQLENETIFLQ

SEQ ID NO: 2315015 - protein, 25 aa, Cryptosporidium parvum
IIQNHKIPCNLLFGASIKICSKSVN

SEQ ID NO: 2315016 - protein, 24 aa, Cryptosporidium parvum
IIQNSSLLLSGYLSGTPAQSNSRK

SEQ ID NO: 2315017 - protein, 17 aa, Cryptosporidium parvum
IIQRHVPRTFNVPIPVY

SEQ ID NO: 2315018 - protein, 33 aa, Cryptosporidium parvum
IIRDIEEFVIRPLKLPDIYRAVGVNSPCGVLLQ

SEQ ID NO: 2315019 - protein, 23 aa, Cryptosporidium parvum
IIRIEVVGILIYAILAVPMSSKY

SEQ ID NO: 2315020 - protein, 25 aa, Cryptosporidium parvum
IIRNEFSLNYGWRPICNVPTPIQES

SEQ ID NO: 2315021 - protein, 29 aa, Cryptosporidium parvum
IISEWMGYCLLYESMLYTILDARNRYLKI

SEQ ID NO: 2315022 - protein, 17 aa, Cryptosporidium parvum
IISFMYIILEKNISNNN

SEQ ID NO: 2315023 - protein, 26 aa, Cryptosporidium parvum
IISHTVDWVCYYLSAGIALRFISNIK

SEQ ID NO: 2315024 - protein, 31 aa, Cryptosporidium parvum
IISLDGDILKRWELPWIAQKLFMGSNQQQII

SEQ ID NO: 2315025 - protein, 31 aa, Cryptosporidium parvum
IISPRVPLLFIQKNLFRLGWFEPNLSLINIP

SEQ ID NO: 2315026 - protein, 21 aa, Cryptosporidium parvum
IISRVLGFLQDQFPRVRYACC

SEQ ID NO: 2315027 - protein, 18 aa, Cryptosporidium parvum
IISVLQDIFNLLPDLREP

SEQ ID NO: 2315028 - protein, 19 aa, Cryptosporidium parvum
IITCDSPTSFYLYSQPNIS

SEQ ID NO: 2315029 - protein, 23 aa, Cryptosporidium parvum
IITCKNEFFKELAKVTRYPLFIN

SEQ ID NO: 2315030 - protein, 17 aa, Cryptosporidium parvum
IITCNPSFPLDIKTPMD

SEQ ID NO: 2315031 - protein, 27 aa, Cryptosporidium parvum
IITDLIGFCFLFLEYSFYNSEMYNVDV

SEQ ID NO: 2315032 - protein, 17 aa, Cryptosporidium parvum
IITGFSAVFLLSTSIDP

SEQ ID NO: 2315033 - protein, 36 aa, Cryptosporidium parvum
IITYIRTITNLLPPNGVWINLGPLLYHYSGLNNVIS

SEQ ID NO: 2315034 - protein, 26 aa, Cryptosporidium parvum
IIVDILCEFADFFVDLASNVAARTGK

SEQ ID NO: 2315035 - protein, 23 aa, Cryptosporidium parvum
IIVENLVFFFIITKDHENAKLIY

SEQ ID NO: 2315036 - protein, 23 aa, Cryptosporidium parvum
IIVKSIKFIPNSTKVWMVAANRE

SEQ ID NO: 2315037 - protein, 18 aa, Cryptosporidium parvum
IIVQQKRLLDSRKNSICI

SEQ ID NO: 2315038 - protein, 23 aa, Cryptosporidium parvum
IIVSEWMGFYLLHEGMLDSVIFA

SEQ ID NO: 2315039 - protein, 24 aa, Cryptosporidium parvum
IIVSPQYPILPPSVKFVTPIFHPN

SEQ ID NO: 2315040 - protein, 18 aa, Cryptosporidium parvum
IIYNYKKCTLWDLEFSHQ

SEQ ID NO: 2315041 - protein, 28 aa, Cryptosporidium parvum
IKAETTPLLLRVDGLVGLLARIRRDEIE

SEQ ID NO: 2315042 - protein, 24 aa, Cryptosporidium parvum
IKAPRGWICRPMVPNKWLVVFCDE

SEQ ID NO: 2315043 - protein, 18 aa, Cryptosporidium parvum
IKCDDQIYLYLGNSQSKH

SEQ ID NO: 2315044 - protein, 19 aa, Cryptosporidium parvum
IKCILDTLMKMMVYEMSYV

SEQ ID NO: 2315045 - protein, 26 aa, Cryptosporidium parvum
IKDDRKVFPSYWFNLSWVYIEDRKAN

SEQ ID NO: 2315046 - protein, 25 aa, Cryptosporidium parvum
IKDPFPICRKAAIQALLSTIHFYSP

SEQ ID NO: 2315047 - protein, 23 aa, Cryptosporidium parvum
IKDQSILLYLSRYVEYKTNNNPK

SEQ ID NO: 2315048 - protein, 17 aa, Cryptosporidium parvum
IKECCEILNLKISNLNN

SEQ ID NO: 2315049 - protein, 19 aa, Cryptosporidium parvum
IKEDSGVFDINNITKSSSM

SEQ ID NO: 2315050 - protein, 19 aa, Cryptosporidium parvum
IKELFLIRKELNKMIQNYQ

SEQ ID NO: 2315051 - protein, 25 aa, Cryptosporidium parvum
IKELKSSLSLFFKSGFNLTDESENR

SEQ ID NO: 2315052 - protein, 24 aa, Cryptosporidium parvum
IKEMKILLIELPSLSLSSKEIDLT

SEQ ID NO: 2315053 - protein, 22 aa, Cryptosporidium parvum
IKEPFLEPQRREYIGRKTLVLD

SEQ ID NO: 2315054 - protein, 25 aa, Cryptosporidium parvum
IKERNGIIYVLYDDGALMSTSIESN

SEQ ID NO: 2315055 - protein, 23 aa, Cryptosporidium parvum
IKESRLFPVGFKKEFCTFLEKPQ

SEQ ID NO: 2315056 - protein, 29 aa, Cryptosporidium parvum
IKETSKLPRHSPIPLLKKACSIRKIKIYF

SEQ ID NO: 2315057 - protein, 19 aa, Cryptosporidium parvum
IKEVKVAMRALGFDPKKEE

SEQ ID NO: 2315058 - protein, 25 aa, Cryptosporidium parvum
IKEVNPYYYTILQDKQELLPLSEFD

SEQ ID NO: 2315059 - protein, 29 aa, Cryptosporidium parvum
IKEYNLLYKFLLIILPVIDLNTLAKIFNY

SEQ ID NO: 2315060 - protein, 17 aa, Cryptosporidium parvum
IKFFGKPLKIQLKAGED

SEQ ID NO: 2315061 - protein, 27 aa, Cryptosporidium parvum
IKFICKDLWNFIFLKQADRLKTNRRGG

SEQ ID NO: 2315062 - protein, 18 aa, Cryptosporidium parvum
IKFSIISILLDPANYKPA

SEQ ID NO: 2315063 - protein, 20 aa, Cryptosporidium parvum
IKGIPRIPRRRSRSPSLEEG

SEQ ID NO: 2315064 - protein, 24 aa, Cryptosporidium parvum
IKGPSWLVISKPYQIVPVGGGRKS

SEQ ID NO: 2315065 - protein, 22 aa, Cryptosporidium parvum
IKIHCDAMVGGDTPLRDINLLQ

SEQ ID NO: 2315066 - protein, 20 aa, Cryptosporidium parvum
IKILMNVYYSIVSVSQKNQV

SEQ ID NO: 2315067 - protein, 17 aa, Cryptosporidium parvum
IKILSFKEIMKYSNHTG

SEQ ID NO: 2315068 - protein, 25 aa, Cryptosporidium parvum
IKKAYHKLAIKWHPDKNMGNDRQMC

SEQ ID NO: 2315069 - protein, 25 aa, Cryptosporidium parvum
IKKDILTNRWFSNSMFNDFVGEEKD

SEQ ID NO: 2315070 - protein, 21 aa, Cryptosporidium parvum
IKKEYRLRALALHPDKNQNDE

SEQ ID NO: 2315071 - protein, 26 aa, Cryptosporidium parvum
IKKFIDSLLKLSFGYGWNLLHIFSYL

SEQ ID NO: 2315072 - protein, 17 aa, Cryptosporidium parvum
IKKGLIIEPLRELYKDE

SEQ ID NO: 2315073 - protein, 23 aa, Cryptosporidium parvum
IKKKGLLSLINNKLSKSAPELGS

SEQ ID NO: 2315074 - protein, 31 aa, Cryptosporidium parvum
IKKLKKLPDLHEILKQFYRFNEKKTNLKKSD

SEQ ID NO: 2315075 - protein, 18 aa, Cryptosporidium parvum
IKKLLLKTKDQKLYSIGR

SEQ ID NO: 2315076 - protein, 27 aa, Cryptosporidium parvum
IKKMLILTPIIYYNMDSFRDIISDLLD

SEQ ID NO: 2315077 - protein, 20 aa, Cryptosporidium parvum
IKKSYRKLALKWHPDKNPDN

SEQ ID NO: 2315078 - protein, 22 aa, Cryptosporidium parvum
IKKYLCCFLFHYIAEFQGVWIC

SEQ ID NO: 2315079 - protein, 31 aa, Cryptosporidium parvum; identical to SEQ ID NO: 2191271

SEQ ID NO: 2315080 - protein, 18 aa, Cryptosporidium parvum
IKLFLIPGIDENTPLEPK

SEQ ID NO: 2315081 - protein, 23 aa, Cryptosporidium parvum
IKLSLRELFLEDFLINFPKIKCK

SEQ ID NO: 2315082 - protein, 19 aa, Cryptosporidium parvum
IKMGQVLIFKPNRLIKLSI

SEQ ID NO: 2315083 - protein, 25 aa, Cryptosporidium parvum
IKMHEEFLLILHRTIGISAMRGISW

SEQ ID NO: 2315084 - protein, 17 aa, Cryptosporidium parvum
IKMMKFDSSIRSPIEAR

SEQ ID NO: 2315085 - protein, 23 aa, Cryptosporidium parvum
IKNDSNIIFLPISAYHGVNILND

SEQ ID NO: 2315086 - protein, 25 aa, Cryptosporidium parvum
IKNEIIWGFPIVPNITFIKGESNNF

SEQ ID NO: 2315087 - protein, 20 aa, Cryptosporidium parvum
IKNELILFRLRFNSGNNQGS

SEQ ID NO: 2315088 - protein, 19 aa, Cryptosporidium parvum
IKNGLPWCVSLTWSNDGKT

SEQ ID NO: 2315089 - protein, 18 aa, Cryptosporidium parvum
IKNLILFLGIIPEYLFST

SEQ ID NO: 2315090 - protein, 17 aa, Cryptosporidium parvum
IKNLYSHLKPNKNIYEY

SEQ ID NO: 2315091 - protein, 37 aa, Cryptosporidium parvum
IKNNKNYHLLPFKSLFRLGINENILQLLKYYEISNKK

SEQ ID NO: 2315092 - protein, 25 aa, Cryptosporidium parvum
IKNNSQGILKNPYLLLSSIVETGNK

SEQ ID NO: 2315093 - protein, 43 aa, Cryptosporidium parvum; identical to SEQ ID NO: 2191285

SEQ ID NO: 2315094 - protein, 24 aa, Cryptosporidium parvum
IKPGTVIRLSWMKVIKNSTIRSLG

SEQ ID NO: 2315095 - protein, 21 aa, Cryptosporidium parvum
IKPKDILLLSYLKCINKKSEF

SEQ ID NO: 2315096 - protein, 28 aa, Cryptosporidium parvum
IKPSIHFEMFFIPPFPADVVIPAPPSTK

SEQ ID NO: 2315097 - protein, 19 aa, Cryptosporidium parvum
IKQFIKMKFILGTESEDFI

SEQ ID NO: 2315098 - protein, 27 aa, Cryptosporidium parvum
IKQFNKLYRINNKLNKKFREINNKISI

SEQ ID NO: 2315099 - protein, 18 aa, Cryptosporidium parvum
IKQIKRFLFTEPRSLESH

SEQ ID NO: 2315100 - protein, 17 aa, Cryptosporidium parvum
IKQLNLKSPIFKKTSSG

SEQ ID NO: 2315101 - protein, 25 aa, Cryptosporidium parvum
IKQNPIGDLLIFNTLSGNLIGTVEG

SEQ ID NO: 2315102 - protein, 17 aa, Cryptosporidium parvum
IKRGINGMIKDWNIIEG

SEQ ID NO: 2315103 - protein, 29 aa, Cryptosporidium parvum
IKRLKKRGWILFKTYLLTTLISGGSEKTI

SEQ ID NO: 2315104 - protein, 24 aa, Cryptosporidium parvum
IKRMIRIWNIKKDYLKWTKDCLEI

SEQ ID NO: 2315105 - protein, 19 aa, Cryptosporidium parvum
IKRREKIKMWSSLELSRPL

SEQ ID NO: 2315106 - protein, 31 aa, Cryptosporidium parvum
IKRRFQPNKFLKFSNLVLVPGKPRKWKRVQR

SEQ ID NO: 2315107 - protein, 18 aa, Cryptosporidium parvum
IKRYLELYCRTWGHERKC

SEQ ID NO: 2315108 - protein, 19 aa, Cryptosporidium parvum
IKSFQYSILKFEKLDSQNE

SEQ ID NO: 2315109 - protein, 18 aa, Cryptosporidium parvum
IKSFYNKYLDYYNEKLFN

SEQ ID NO: 2315110 - protein, 22 aa, Cryptosporidium parvum
IKSHLDPYDWYYSSSNNENGDN

SEQ ID NO: 2315111 - protein, 32 aa, Cryptosporidium parvum; identical to SEQ ID NO: 2191292

SEQ ID NO: 2315112 - protein, 24 aa, Cryptosporidium parvum
IKSKTEPYPILFSSNKDINQNNKI

SEQ ID NO: 2315113 - protein, 18 aa, Cryptosporidium parvum
IKSLFLWVDSQISDTRIF

SEQ ID NO: 2315114 - protein, 24 aa, Cryptosporidium parvum
IKSLKLIIVHLNHILLNVIKQKIV

SEQ ID NO: 2315115 - protein, 25 aa, Cryptosporidium parvum
IKSQKFLFYIINTRKFNSKPSFFQL

SEQ ID NO: 2315116 - protein, 27 aa, Cryptosporidium parvum
IKSSELIARYAILSKLILDSGIEESEE

SEQ ID NO: 2315117 - protein, 29 aa, Cryptosporidium parvum
IKSVSSKDFRLKRLLYASKSQLKNISYEN

SEQ ID NO: 2315118 - protein, 25 aa, Cryptosporidium parvum
IKSWFEYFEFLTTSELRTLLINQKK

SEQ ID NO: 2315119 - protein, 22 aa, Cryptosporidium parvum
IKTIPQLLLDNLRKKGLKSFQE

SEQ ID NO: 2315120 - protein, 25 aa, Cryptosporidium parvum
IKTLPLHQQYVIMGIILAIIDEQIQ

SEQ ID NO: 2315121 - protein, 21 aa, Cryptosporidium parvum
IKTVLPFLDPNYSLFYYICDT

SEQ ID NO: 2315122 - protein, 22 aa, Cryptosporidium parvum
IKVCLAFLQRTKVLLECQIAGF

SEQ ID NO: 2315123 - protein, 21 aa, Cryptosporidium parvum
IKVETDFYYGFPLIENHPDNT

SEQ ID NO: 2315124 - protein, 17 aa, Cryptosporidium parvum
IKVIKKNLRKETNFELA

SEQ ID NO: 2315125 - protein, 27 aa, Cryptosporidium parvum
IKVKWPNFIEYLLDKILTVFQIVVLEH

SEQ ID NO: 2315126 - protein, 25 aa, Cryptosporidium parvum
IKVMQWEKLLLLPHPCRKISPEALD

SEQ ID NO: 2315127 - protein, 19 aa, Cryptosporidium parvum
IKVNLVVSSLQCLCHYLKW

SEQ ID NO: 2315128 - protein, 18 aa, Cryptosporidium parvum
IKYKILQNQLPRKLLRIA

SEQ ID NO: 2315129 - protein, 24 aa, Cryptosporidium parvum
IKYNELFEYIFTNYKKEQFNNIIS

SEQ ID NO: 2315130 - protein, 17 aa, Cryptosporidium parvum
IKYWDYLKQFISKDLLE

SEQ ID NO: 2315131 - protein, 17 aa, Cryptosporidium parvum
ILAIYVSILFTSQDFKL

SEQ ID NO: 2315132 - protein, 17 aa, Cryptosporidium parvum
ILALERLKEVYSVKSRL

SEQ ID NO: 2315133 - protein, 31 aa, Cryptosporidium parvum
ILALEVFDKFLYVSILLPFYSKLNNCEQSKN

SEQ ID NO: 2315134 - protein, 26 aa, Cryptosporidium parvum
ILALNDHPFIIKLVRTFKDSENIYLL

SEQ ID NO: 2315135 - protein, 18 aa, Cryptosporidium parvum
ILASGIKIVYQKSDSQPS

SEQ ID NO: 2315136 - protein, 23 aa, Cryptosporidium parvum
ILCFTYMDILKKSLTKFTLFELS

SEQ ID NO: 2315137 - protein, 30 aa, Cryptosporidium parvum
ILCGEEFWAWIMIWMRFNSLGVLDWQRNYN

SEQ ID NO: 2315138 - protein, 20 aa, Cryptosporidium parvum
ILCMSILDKVSLYRENLRKS

SEQ ID NO: 2315139 - protein, 35 aa, Cryptosporidium parvum; identical to SEQ ID NO: 2191309

SEQ ID NO: 2315140 - protein, 27 aa, Cryptosporidium parvum
ILDFHSVNFIKRKWFDIVFCLNSETHV

SEQ ID NO: 2315141 - protein, 21 aa, Cryptosporidium parvum
ILDFYSPLLINTIIIHKSKSL

SEQ ID NO: 2315142 - protein, 17 aa, Cryptosporidium parvum
ILDLKNLLELERRVYEV

SEQ ID NO: 2315143 - protein, 27 aa, Cryptosporidium parvum
ILDLMELFHEFVFLQIQSVSWLFCNSL

SEQ ID NO: 2315144 - protein, 32 aa, Cryptosporidium parvum
ILDNPLSFLPEMLSLLLMLHVKIPGVLVNMWC

SEQ ID NO: 2315145 - protein, 25 aa, Cryptosporidium parvum
ILDQSKIHPAILRLGMRMKDRKIVG

SEQ ID NO: 2315146 - protein, 17 aa, Cryptosporidium parvum
ILDRRIIQSLTNSNYLV

SEQ ID NO: 2315147 - protein, 17 aa, Cryptosporidium parvum
ILEALYLSIAQKAEHFE

SEQ ID NO: 2315148 - protein, 19 aa, Cryptosporidium parvum
ILEEKLLLEFFERLEVIQS

SEQ ID NO: 2315149 - protein, 19 aa, Cryptosporidium parvum
ILEELIIGEPYSPTDSRWY

SEQ ID NO: 2315150 - protein, 25 aa, Cryptosporidium parvum
ILEHNPDLWGAKRYTLKPPQVVRVG

SEQ ID NO: 2315151 - protein, 18 aa, Cryptosporidium parvum
ILEKEKHELIKKIANMNR

SEQ ID NO: 2315152 - protein, 20 aa, Cryptosporidium parvum
ILEKSCWFTTSLWLRDGNFN

SEQ ID NO: 2315153 - protein, 18 aa, Cryptosporidium parvum
ILEKVVEYILYIINDFKG

SEQ ID NO: 2315154 - protein, 21 aa, Cryptosporidium parvum
ILELFQKFLLDTKLIEKIEKV

SEQ ID NO: 2315155 - protein, 19 aa, Cryptosporidium parvum
ILEMMNLFCKTYPLGLKYN

SEQ ID NO: 2315156 - protein, 26 aa, Cryptosporidium parvum
ILENGIGFFPLKSSYIWVITTKKTVS

SEQ ID NO: 2315157 - protein, 18 aa, Cryptosporidium parvum
ILENHPNALVRFLCNLII

SEQ ID NO: 2315158 - protein, 17 aa, Cryptosporidium parvum
ILEPIKSISWHNSDVND

SEQ ID NO: 2315159 - protein, 25 aa, Cryptosporidium parvum
ILESDLDWLVLLKSPSPTPEDIKTF

SEQ ID NO: 2315160 - protein, 17 aa, Cryptosporidium parvum
ILESIKKFNLSNSDPSL

SEQ ID NO: 2315161 - protein, 17 aa, Cryptosporidium parvum
ILETFKLPEDTTESSLI

SEQ ID NO: 2315162 - protein, 18 aa, Cryptosporidium parvum
ILFEKNAPRRLILHVISQ

SEQ ID NO: 2315163 - protein, 17 aa, Cryptosporidium parvum
ILFEVDIADLLRLCENS

SEQ ID NO: 2315164 - protein, 17 aa, Cryptosporidium parvum
ILFKHANPEDLYENVLV

SEQ ID NO: 2315165 - protein, 18 aa, Cryptosporidium parvum
ILFRDTSLPVIFQIAIKT

SEQ ID NO: 2315166 - protein, 27 aa, Cryptosporidium parvum
ILGAEKALFRALKTKKSTPKYGLIYHA

SEQ ID NO: 2315167 - protein, 25 aa, Cryptosporidium parvum
ILGKELPGLYPVGVGTINALPNTNS

SEQ ID NO: 2315168 - protein, 30 aa, Cryptosporidium parvum
ILGRGTISWLNLKPKIPYFNVRKALILLQD

SEQ ID NO: 2315169 - protein, 22 aa, Cryptosporidium parvum
ILGRVRRFFEKPAYDNIVRAIS

SEQ ID NO: 2315170 - protein, 24 aa, Cryptosporidium parvum
ILGTAFCPLPKRNDKWNISIPIYS

SEQ ID NO: 2315171 - protein, 24 aa, Cryptosporidium parvum
ILGVLIKYLFDQINFFSDLNIDEP

SEQ ID NO: 2315172 - protein, 25 aa, Cryptosporidium parvum
ILHCEQLSSIIPPLRSRCLCIRVPL

SEQ ID NO: 2315173 - protein, 22 aa, Cryptosporidium parvum
ILHEYCILNILLGRCHKAIEMY

SEQ ID NO: 2315174 - protein, 17 aa, Cryptosporidium parvum
ILHNKLMNYVKVYKINT

SEQ ID NO: 2315175 - protein, 17 aa, Cryptosporidium parvum
ILHRYIPAIYLASKELT

SEQ ID NO: 2315176 - protein, 18 aa, Cryptosporidium parvum
ILIFTEHPIKKIPWGLYI

SEQ ID NO: 2315177 - protein, 17 aa, Cryptosporidium parvum
ILIHLTGFHWEKNIRIK

SEQ ID NO: 2315178 - protein, 17 aa, Cryptosporidium parvum
ILIPNNVPTRIWLLWSN

SEQ ID NO: 2315179 - protein, 19 aa, Cryptosporidium parvum
ILIYDIFSHNLKLNGNSPL

SEQ ID NO: 2315180 - protein, 17 aa, Cryptosporidium parvum
ILKDILLDTNKLLSQNI

SEQ ID NO: 2315181 - protein, 24 aa, Cryptosporidium parvum
ILKGLSELGFLNPTPIQAACLVPA

SEQ ID NO: 2315182 - protein, 19 aa, Cryptosporidium parvum
ILKIDEIIMAKPAGGPKPR

SEQ ID NO: 2315183 - protein, 17 aa, Cryptosporidium parvum
ILKIRIARITKLLGDNI

SEQ ID NO: 2315184 - protein, 20 aa, Cryptosporidium parvum
ILKIYLSYLLDSGGIRIHEL

SEQ ID NO: 2315185 - protein, 29 aa, Cryptosporidium parvum
ILKKITHLFKLLFGENLLLRFFNVIKKEE

SEQ ID NO: 2315186 - protein, 17 aa, Cryptosporidium parvum
ILKLLHSGRNIETASVV

SEQ ID NO: 2315187 - protein, 30 aa, Cryptosporidium parvum; identical to SEQ ID NO: 2191339

SEQ ID NO: 2315188 - protein, 17 aa, Cryptosporidium parvum
ILKPDIQNNLLLEFGLK

SEQ ID NO: 2315189 - protein, 28 aa, Cryptosporidium parvum
ILKQKHKRWRKFFPCLKKNINYDVNTIN

SEQ ID NO: 2315190 - protein, 18 aa, Cryptosporidium parvum
ILKRLFGEKKKSLNDNSK

SEQ ID NO: 2315191 - protein, 23 aa, Cryptosporidium parvum
ILKSMLISKNILGLSLPVCQQLY

SEQ ID NO: 2315192 - protein, 19 aa, Cryptosporidium parvum
ILKTILPYLNNWKDKRLEI

SEQ ID NO: 2315193 - protein, 19 aa, Cryptosporidium parvum
ILKVMISYKLRSCFISSIA

SEQ ID NO: 2315194 - protein, 18 aa, Cryptosporidium parvum
ILKWLSYVPECVGGRLPI

SEQ ID NO: 2315195 - protein, 20 aa, Cryptosporidium parvum
ILLAQQVFPILQKSGSRPLK

SEQ ID NO: 2315196 - protein, 27 aa, Cryptosporidium parvum
ILLKKTPVLQYLYYLKQIGIAVSPVSN

SEQ ID NO: 2315197 - protein, 20 aa, Cryptosporidium parvum
ILLKQISLMNGFKYSFTGAL

SEQ ID NO: 2315198 - protein, 18 aa, Cryptosporidium parvum
ILLMSQYSRIKGIQFHEF

SEQ ID NO: 2315199 - protein, 17 aa, Cryptosporidium parvum
ILLNEFGIVFVKVKFET

SEQ ID NO: 2315200 - protein, 28 aa, Cryptosporidium parvum
ILMADLIGFHFFPYAKQFLSSCKRLLGL

SEQ ID NO: 2315201 - protein, 20 aa, Cryptosporidium parvum
ILMPFGFTMMHHYLGYEGRC

SEQ ID NO: 2315202 - protein, 17 aa, Cryptosporidium parvum
ILMSLRRNINSPKKCKL

SEQ ID NO: 2315203 - protein, 18 aa, Cryptosporidium parvum
ILMTEFYPQRGILETISQ

SEQ ID NO: 2315204 - protein, 26 aa, Cryptosporidium parvum
ILNEMKRKLLSFKPRVTFKKGTCFKP

SEQ ID NO: 2315205 - protein, 19 aa, Cryptosporidium parvum
ILNFETWKYAKSRSKSIGI

SEQ ID NO: 2315206 - protein, 18 aa, Cryptosporidium parvum
ILNGFKWNYNALFSEKIP

SEQ ID NO: 2315207 - protein, 21 aa, Cryptosporidium parvum
ILNGVLYKYILNPYKLNIEEI

SEQ ID NO: 2315208 - protein, 23 aa, Cryptosporidium parvum
ILNIELEHFFGYSKNLKVLVLSN

SEQ ID NO: 2315209 - protein, 17 aa, Cryptosporidium parvum
ILNLKIYNSIVLQMGKL

SEQ ID NO: 2315210 - protein, 22 aa, Cryptosporidium parvum
ILNLNIPILGLCYGHYIVNIGY

SEQ ID NO: 2315211 - protein, 22 aa, Cryptosporidium parvum
ILNLNYTMENYFGILEFDEIEN

SEQ ID NO: 2315212 - protein, 25 aa, Cryptosporidium parvum
ILNPGRLILFNSFSLTGKSLPMFAN

SEQ ID NO: 2315213 - protein, 18 aa, Cryptosporidium parvum
ILNQMKWIYKLFHNKEED

SEQ ID NO: 2315214 - protein, 19 aa, Cryptosporidium parvum
ILNQWIGKTKGFIIDENKD

SEQ ID NO: 2315215 - protein, 24 aa, Cryptosporidium parvum
ILNSFYGYVMRKGSRWFSMEMAAI

SEQ ID NO: 2315216 - protein, 20 aa, Cryptosporidium parvum
ILNTGYLCLEIPESFKLSKV

SEQ ID NO: 2315217 - protein, 24 aa, Cryptosporidium parvum
ILPTGEYDLILAFDSPICKSSETT

SEQ ID NO: 2315218 - protein, 24 aa, Cryptosporidium parvum
ILPTRESIIFPRENDLLLKNINNS

SEQ ID NO: 2315219 - protein, 24 aa, Cryptosporidium parvum
ILQEELFPAFLKGNSKKEAYDHVA

SEQ ID NO: 2315220 - protein, 18 aa, Cryptosporidium parvum
ILQLISLYDYKGVPIDIV

SEQ ID NO: 2315221 - protein, 26 aa, Cryptosporidium parvum
ILQLKMFCGLIIKPGQKVKLDSTQGE

SEQ ID NO: 2315222 - protein, 24 aa, Cryptosporidium parvum
ILQLLKTFEYILNKLKQIQSPESR

SEQ ID NO: 2315223 - protein, 26 aa, Cryptosporidium parvum
ILQMMENMQWWSKIGLVSDLTSYSNR

SEQ ID NO: 2315224 - protein, 18 aa, Cryptosporidium parvum
ILQNKIMNLFRAATKHVY

SEQ ID NO: 2315225 - protein, 29 aa, Cryptosporidium parvum
ILQNNLIIPFILLLHRTWYRIQDSTEILR

SEQ ID NO: 2315226 - protein, 31 aa, Cryptosporidium parvum; identical to SEQ ID NO: 2191369

SEQ ID NO: 2315227 - protein, 17 aa, Cryptosporidium parvum
ILQTLDLSYYQFKYIER

SEQ ID NO: 2315228 - protein, 19 aa, Cryptosporidium parvum
ILQWLKEYLNNFSQTSICS

SEQ ID NO: 2315229 - protein, 17 aa, Cryptosporidium parvum
ILQYIYPTESKDLVNIS

SEQ ID NO: 2315230 - protein, 17 aa, Cryptosporidium parvum
ILRFMKFYTNLNSDLNE

SEQ ID NO: 2315231 - protein, 20 aa, Cryptosporidium parvum
ILRLEYFKDALKRLFLDDEF

SEQ ID NO: 2315232 - protein, 27 aa, Cryptosporidium parvum
ILRSRTPLDIFTLACKYYLKDLYDKGG

SEQ ID NO: 2315233 - protein, 19 aa, Cryptosporidium parvum
ILSETLKLTFLFVREDEKL

SEQ ID NO: 2315234 - protein, 17 aa, Cryptosporidium parvum
ILSFVKDILCFKKREDI

SEQ ID NO: 2315235 - protein, 34 aa, Cryptosporidium parvum
ILSITLIYNLQNALRIFLRRALYKDGAAIRDNKT

SEQ ID NO: 2315236 - protein, 17 aa, Cryptosporidium parvum
ILSNFDYRLINNSLFIN

SEQ ID NO: 2315237 - protein, 21 aa, Cryptosporidium parvum
ILSVYERVILEYLIMRKLNHS

SEQ ID NO: 2315238 - protein, 19 aa, Cryptosporidium parvum
ILTAINWLTRDAEAGDILV

SEQ ID NO: 2315239 - protein, 35 aa, Cryptosporidium parvum
ILTDDSILLEMFMFAPFTLPLIYGKEYFEEYKNKI

SEQ ID NO: 2315240 - protein, 36 aa, Cryptosporidium parvum
ILTEILNFYIKLLENFPLILLNIYLNQSLLFENKFG

SEQ ID NO: 2315241 - protein, 23 aa, Cryptosporidium parvum
ILTGDWYIQWYLNNYKDDIKDNE

SEQ ID NO: 2315242 - protein, 19 aa, Cryptosporidium parvum
ILTNDLFYGKYILDPKETF

SEQ ID NO: 2315243 - protein, 17 aa, Cryptosporidium parvum
ILTWIRNGFFDGKGDLL

SEQ ID NO: 2315244 - protein, 21 aa, Cryptosporidium parvum
ILVCTNYYIILLNIIKNTNGN

SEQ ID NO: 2315245 - protein, 19 aa, Cryptosporidium parvum
ILVDSSNLYMEPILVHKYS

SEQ ID NO: 2315246 - protein, 17 aa, Cryptosporidium parvum
ILVIEKGGLWGLGRSTF

SEQ ID NO: 2315247 - protein, 18 aa, Cryptosporidium parvum
ILVNLPKESLNVGSGLIS

SEQ ID NO: 2315248 - protein, 18 aa, Cryptosporidium parvum
ILVVILPPSIINYGGNSK

SEQ ID NO: 2315249 - protein, 17 aa, Cryptosporidium parvum
ILVYELIDEIIDYGYPQ

SEQ ID NO: 2315250 - protein, 17 aa, Cryptosporidium parvum
ILWVHDFLLYASDAIDN

SEQ ID NO: 2315251 - protein, 17 aa, Cryptosporidium parvum
ILYIVEPTSNTLLYCNK

SEQ ID NO: 2315252 - protein, 24 aa, Cryptosporidium parvum
IMDASYWISIIKKFKTSYINQNLF

SEQ ID NO: 2315253 - protein, 26 aa, Cryptosporidium parvum
IMDFKTKYIFPFSFESVLDAILYKAY

SEQ ID NO: 2315254 - protein, 35 aa, Cryptosporidium parvum
IMDIETALLEIDPHPAISKLPLSDTRLLGIDTDDF

SEQ ID NO: 2315255 - protein, 25 aa, Cryptosporidium parvum
IMDINSLLDLQLSVAYKLHGIYIAF

SEQ ID NO: 2315256 - protein, 19 aa, Cryptosporidium parvum
IMDVGYNQKLFYYQGQYQQ

SEQ ID NO: 2315257 - protein, 25 aa, Cryptosporidium parvum
IMDYPKIKILGSQFLNPTKLLVSII

SEQ ID NO: 2315258 - protein, 26 aa, Cryptosporidium parvum
IMEDSSNLPLYSLGSFQDANYYPNVT

SEQ ID NO: 2315259 - protein, 18 aa, Cryptosporidium parvum
IMEKSFYDLIGLKYTYYT

SEQ ID NO: 2315260 - protein, 26 aa, Cryptosporidium parvum
IMGHRVKILPYSTFRLNLSVTSPYNA

SEQ ID NO: 2315261 - protein, 17 aa, Cryptosporidium parvum
IMGICTNATREYADVIR

SEQ ID NO: 2315262 - protein, 20 aa, Cryptosporidium parvum
IMIFNRYWIIDSNNEKLMNL

SEQ ID NO: 2315263 - protein, 18 aa, Cryptosporidium parvum
IMISLSLGLGLLSERSPE

SEQ ID NO: 2315264 - protein, 25 aa, Cryptosporidium parvum
IMKSAKQCKSRWYEWLDPRVKKTEW

SEQ ID NO: 2315265 - protein, 23 aa, Cryptosporidium parvum
IMKSISIIIYTLKNSPWLTMNEI

SEQ ID NO: 2315266 - protein, 19 aa, Cryptosporidium parvum
IMNILKYQKPTAIQSQVIP

SEQ ID NO: 2315267 - protein, 17 aa, Cryptosporidium parvum
IMNLFRAATKHVYEELI

SEQ ID NO: 2315268 - protein, 18 aa, Cryptosporidium parvum
IMNLTGGSLMGNVLMMSG

SEQ ID NO: 2315269 - protein, 23 aa, Cryptosporidium parvum
IMNPKTFLLDNDGFDSNFVLKVV

SEQ ID NO: 2315270 - protein, 17 aa, Cryptosporidium parvum
IMSIWNTKNDNFIEIEY

SEQ ID NO: 2315271 - protein, 24 aa, Cryptosporidium parvum
IMVSDFIAKELLTYALKAANNVPS

SEQ ID NO: 2315272 - protein, 17 aa, Cryptosporidium parvum
IMVSTNMRKGTYISILN

SEQ ID NO: 2315273 - protein, 19 aa, Cryptosporidium parvum
IMVVELIIIAKCCGLTGEL

SEQ ID NO: 2315274 - protein, 17 aa, Cryptosporidium parvum
IMWYGQVSAIDGCPVIR

SEQ ID NO: 2315275 - protein, 24 aa, Cryptosporidium parvum
INADSWLVSWNLLGIADGVSSVES

SEQ ID NO: 2315276 - protein, 34 aa, Cryptosporidium parvum
INAIAQLLSCILYSKRFFPYYSFCLLSGLDEQGK

SEQ ID NO: 2315277 - protein, 26 aa, Cryptosporidium parvum
INAVKLPVPPSYKGLGARKNPIGGVG

SEQ ID NO: 2315278 - protein, 18 aa, Cryptosporidium parvum
INCLPDQYKDLFSRFIRV

SEQ ID NO: 2315279 - protein, 25 aa, Cryptosporidium parvum
INDKMLSFIQWKFPTRVLNNSNQII

SEQ ID NO: 2315280 - protein, 18 aa, Cryptosporidium parvum
INDQLPLVRSIDKSLKIG

SEQ ID NO: 2315281 - protein, 28 aa, Cryptosporidium parvum
INDRLLWCNEWLPETPLEKFDGNAIAKI

SEQ ID NO: 2315282 - protein, 27 aa, Cryptosporidium parvum
INDTLYKKYIGYLSSILYIKSNKGNTE

SEQ ID NO: 2315283 - protein, 20 aa, Cryptosporidium parvum
INECNYLKEKLRSLSQALNT

SEQ ID NO: 2315284 - protein, 19 aa, Cryptosporidium parvum
INEHQIILAIVYQNAYSAV

SEQ ID NO: 2315285 - protein, 18 aa, Cryptosporidium parvum
INEKLSFEDLYIGRVLTG

SEQ ID NO: 2315286 - protein, 29 aa, Cryptosporidium parvum
INELDVTVLKEIYSEIIDFANKLAESNRI

SEQ ID NO: 2315287 - protein, 18 aa, Cryptosporidium parvum
INELKYIESILDKEIEEL

SEQ ID NO: 2315288 - protein, 20 aa, Cryptosporidium parvum
INELNILLESKREKLRQMDA

SEQ ID NO: 2315289 - protein, 26 aa, Cryptosporidium parvum
INEQIEQVWKLLWSLTTFGSQNKASE

SEQ ID NO: 2315290 - protein, 24 aa, Cryptosporidium parvum
INERYLVFRLFKCDNLAAADGVTG

SEQ ID NO: 2315291 - protein, 24 aa, Cryptosporidium parvum
INFEKLRILICKLKKSLYSDTLSK

SEQ ID NO: 2315292 - protein, 20 aa, Cryptosporidium parvum
INFPTFPMSTFTGFPIHFST

SEQ ID NO: 2315293 - protein, 28 aa, Cryptosporidium parvum
INFQDLSLLNDKLASLLFNKVSSSNNYC

SEQ ID NO: 2315294 - protein, 25 aa, Cryptosporidium parvum
INHEKGIIYDGITNPNIFVKQLGEV

SEQ ID NO: 2315295 - protein, 18 aa, Cryptosporidium parvum
INHHDIPKFGMITARFLK

SEQ ID NO: 2315296 - protein, 17 aa, Cryptosporidium parvum
INHVVTHMIRIKDVLLI

SEQ ID NO: 2315297 - protein, 20 aa, Cryptosporidium parvum
INIDHVSLILKNSFSFKFYE

SEQ ID NO: 2315298 - protein, 19 aa, Cryptosporidium parvum
INILELEELIFKKLEKLYL

SEQ ID NO: 2315299 - protein, 18 aa, Cryptosporidium parvum
INILKMASIDEISIVFKV

SEQ ID NO: 2315300 - protein, 23 aa, Cryptosporidium parvum
INIPKVIWNVIFDHLQPINTLNS

SEQ ID NO: 2315301 - protein, 19 aa, Cryptosporidium parvum
INIPNFWIITTNSQNLINY

SEQ ID NO: 2315302 - protein, 35 aa, Cryptosporidium parvum
INIPTQCQILITLPFMLELLLMSTTYQQWVSKIKF

SEQ ID NO: 2315303 - protein, 19 aa, Cryptosporidium parvum
INISIINSFPKLKKTELKK

SEQ ID NO: 2315304 - protein, 26 aa, Cryptosporidium parvum
INISLSRRILICLSYFIITESYREIN

SEQ ID NO: 2315305 - protein, 22 aa, Cryptosporidium parvum
INKDRFISKLFVRGDSVILILK

SEQ ID NO: 2315306 - protein, 20 aa, Cryptosporidium parvum
INKEWGISFVLYSISPHSTN

SEQ ID NO: 2315307 - protein, 32 aa, Cryptosporidium parvum; identical to SEQ ID NO: 2191435

SEQ ID NO: 2315308 - protein, 21 aa, Cryptosporidium parvum
INKIRSHIRKCSRVRDIAYEL

SEQ ID NO: 2315309 - protein, 23 aa, Cryptosporidium parvum
INKIVFSLFNYDDAEFLMFLIDI

SEQ ID NO: 2315310 - protein, 23 aa, Cryptosporidium parvum
INKKYWIIFDGDVDPEWAENLNS

SEQ ID NO: 2315311 - protein, 25 aa, Cryptosporidium parvum
INKRFSMDLIYSYAGRLLVAVNPFK

SEQ ID NO: 2315312 - protein, 22 aa, Cryptosporidium parvum
INLCIYFSFASFLDILGISKLK

SEQ ID NO: 2315313 - protein, 18 aa, Cryptosporidium parvum
INLCLLYRNVSSPLIHFE

SEQ ID NO: 2315314 - protein, 18 aa, Cryptosporidium parvum
INLLPKPTPGVKASPQTT

SEQ ID NO: 2315315 - protein, 19 aa, Cryptosporidium parvum
INLLQKMGWTEGKGLGKEE

SEQ ID NO: 2315316 - protein, 30 aa, Cryptosporidium parvum
INLNNNIVFLLLIVKVKFPIPGKLQIDMEF

SEQ ID NO: 2315317 - protein, 17 aa, Cryptosporidium parvum
INLSDELHWCCIQTIEL

SEQ ID NO: 2315318 - protein, 28 aa, Cryptosporidium parvum
INLSYTPRKLLTLPSPQLFTGLETLMSS

SEQ ID NO: 2315319 - protein, 18 aa, Cryptosporidium parvum
INLYTGHVYSNWPTARTP

SEQ ID NO: 2315320 - protein, 23 aa, Cryptosporidium parvum
INMGAPSFIPEYPTAYYSNPEVM

SEQ ID NO: 2315321 - protein, 17 aa, Cryptosporidium parvum
INMRLRACNLFLHKIED

SEQ ID NO: 2315322 - protein, 17 aa, Cryptosporidium parvum
INMSRLNEGLWSPYWEA

SEQ ID NO: 2315323 - protein, 23 aa, Cryptosporidium parvum
INNINLVINYDFPKSIDTYTHRI

SEQ ID NO: 2315324 - protein, 50 aa, Cryptosporidium parvum; identical to SEQ ID NO: 2191444

SEQ ID NO: 2315325 - protein, 33 aa, Cryptosporidium parvum
INNLGYSRRLISAWFRLYFEIIGNKTSNNCSGV

SEQ ID NO: 2315326 - protein, 17 aa, Cryptosporidium parvum
INNLQKSYLAFDDFHGL

SEQ ID NO: 2315327 - protein, 26 aa, Cryptosporidium parvum
INNNNPLSFVEWKDEDDFWSESEINS

SEQ ID NO: 2315328 - protein, 27 aa, Cryptosporidium parvum
INNPVLIWEKLIPLLNTTVRSISPTLV

SEQ ID NO: 2315329 - protein, 22 aa, Cryptosporidium parvum
INNQFKYIFLSASSGFKGMSDY

SEQ ID NO: 2315330 - protein, 26 aa, Cryptosporidium parvum
INNTPLITVFANPLGALLSLGYTHRY

SEQ ID NO: 2315331 - protein, 35 aa, Cryptosporidium parvum
INPELFTPNLLKVIYRIFLFNNLLNNTNLGITKIF

SEQ ID NO: 2315332 - protein, 21 aa, Cryptosporidium parvum
INPFVRWEAGGRRWICNMCGY

SEQ ID NO: 2315333 - protein, 20 aa, Cryptosporidium parvum
INPKLLQKLALSGELPHIII

SEQ ID NO: 2315334 - protein, 18 aa, Cryptosporidium parvum
INPSISLSNCDVPWPLTG

SEQ ID NO: 2315335 - protein, 26 aa, Cryptosporidium parvum
INQELTPPVLLFSYAIHTGKINYISV

SEQ ID NO: 2315336 - protein, 20 aa, Cryptosporidium parvum
INQIFHLFTSKQRVQIWLYD

SEQ ID NO: 2315337 - protein, 26 aa, Cryptosporidium parvum
INQKQQLYNYLPPQYFNMIDPGDFER

SEQ ID NO: 2315338 - protein, 23 aa, Cryptosporidium parvum
INQSILSIILRDPGTKTISINRK

SEQ ID NO: 2315339 - protein, 26 aa, Cryptosporidium parvum
INRENIVNGLYKLYKDYGPLYYCTVS

SEQ ID NO: 2315340 - protein, 25 aa, Cryptosporidium parvum
INRFLSHIKFFTAKISSIFSRFLSS

SEQ ID NO: 2315341 - protein, 17 aa, Cryptosporidium parvum
INSFIDLKWILDSSISV

SEQ ID NO: 2315342 - protein, 30 aa, Cryptosporidium parvum
INSLKYNIMLIINYLLNIGFIKPKDILLLS

SEQ ID NO: 2315343 - protein, 36 aa, Cryptosporidium parvum
INSPCILTFIRRPVFDPLTCLVGCPYGEVGTSYFSC

SEQ ID NO: 2315344 - protein, 22 aa, Cryptosporidium parvum
INSRTYLFKFGGEEKKFLLVES

SEQ ID NO: 2315345 - protein, 17 aa, Cryptosporidium parvum
INTLPIRQNPKPCLVMW

SEQ ID NO: 2315346 - protein, 19 aa, Cryptosporidium parvum
INVINIILKIYCDMKQFEK

SEQ ID NO: 2315347 - protein, 17 aa, Cryptosporidium parvum
INVLTLLPSVSLKQSFE

SEQ ID NO: 2315348 - protein, 29 aa, Cryptosporidium parvum
INYCARKLKWWLDAFQPIVSPIFPNMDTK

SEQ ID NO: 2315349 - protein, 22 aa, Cryptosporidium parvum
INYCREFIHPRLSLDAAAILEN

SEQ ID NO: 2315350 - protein, 24 aa, Cryptosporidium parvum
INYMQIVYEILESLLKPCIEHHNM

SEQ ID NO: 2315351 - protein, 26 aa, Cryptosporidium parvum
IPAQPQNMPPIVPPTPQGVAQQLSQM

SEQ ID NO: 2315352 - protein, 23 aa, Cryptosporidium parvum
IPDCSICREYLTRNLTVITVCGH

SEQ ID NO: 2315353 - protein, 23 aa, Cryptosporidium parvum
IPDIKGVPVEELIILSSSGILPN

SEQ ID NO: 2315354 - protein, 25 aa, Cryptosporidium parvum
IPDNDPLCWIWIDLDGTINNMNSLE

SEQ ID NO: 2315355 - protein, 18 aa, Cryptosporidium parvum
IPDPLLFSIIESIQKIYN

SEQ ID NO: 2315356 - protein, 22 aa, Cryptosporidium parvum
IPEDLYFLIKRAVSIRKHLEKF

SEQ ID NO: 2315357 - protein, 17 aa, Cryptosporidium parvum
IPEFETLIKELNLILLK

SEQ ID NO: 2315358 - protein, 28 aa, Cryptosporidium parvum
IPEKYMNELFQLLPMIDYIIGNQEEFVS

SEQ ID NO: 2315359 - protein, 21 aa, Cryptosporidium parvum
IPENWPKLLPISKTLKSIEIE

SEQ ID NO: 2315360 - protein, 18 aa, Cryptosporidium parvum
IPEYELYRRILHHVRIRL

SEQ ID NO: 2315361 - protein, 26 aa, Cryptosporidium parvum
IPFVINDLVIALFWDETEDIQMSKFM

SEQ ID NO: 2315362 - protein, 20 aa, Cryptosporidium parvum
IPIILPKIDAIYKFNKVSPF

SEQ ID NO: 2315363 - protein, 17 aa, Cryptosporidium parvum
IPISMVYSRNLLGGAGL

SEQ ID NO: 2315364 - protein, 19 aa, Cryptosporidium parvum
IPKFGMITARFLKTSGIPK

SEQ ID NO: 2315365 - protein, 24 aa, Cryptosporidium parvum
IPKIYEFIEKIYSWNKIKLNKFQE

SEQ ID NO: 2315366 - protein, 17 aa, Cryptosporidium parvum
IPKKPTFNPYLNKYGLV

SEQ ID NO: 2315367 - protein, 24 aa, Cryptosporidium parvum
IPKYQVLIIALKIQCLIKYNKLEE

SEQ ID NO: 2315368 - protein, 18 aa, Cryptosporidium parvum
IPLLIDILVNLKRQCINI

SEQ ID NO: 2315369 - protein, 36 aa, Cryptosporidium parvum
IPLYCPLAIGYFWIDKFMWQMYRFPGSNLQTISPIS

SEQ ID NO: 2315370 - protein, 25 aa, Cryptosporidium parvum
IPNEKLFEWFVKKESINSKKVTMIN

SEQ ID NO: 2315371 - protein, 25 aa, Cryptosporidium parvum
IPNNFLDICFWKQLLEIVLSAPILD

SEQ ID NO: 2315372 - protein, 18 aa, Cryptosporidium parvum
IPPLDKGKIAYSVCCKNE

SEQ ID NO: 2315373 - protein, 17 aa, Cryptosporidium parvum
IPPRKFIPNSKAVIGYD

SEQ ID NO: 2315374 - protein, 29 aa, Cryptosporidium parvum
IPQEYFDGVYKSIFIRIAEYKVKQRSALF

SEQ ID NO: 2315375 - protein, 30 aa, Cryptosporidium parvum
IPQIYGEKWSIIVIIAILQILKPCKDIDLE

SEQ ID NO: 2315376 - protein, 18 aa, Cryptosporidium parvum
IPREISLNCFLKVANELR

SEQ ID NO: 2315377 - protein, 25 aa, Cryptosporidium parvum
IPSCKLLSRIFYFNSVLGTFQIRVY

SEQ ID NO: 2315378 - protein, 17 aa, Cryptosporidium parvum
IPSNFRCRYPEAFLNKL

SEQ ID NO: 2315379 - protein, 31 aa, Cryptosporidium parvum
IPSNQYFGPFEAPPLHIIGYNPVISGCDQNN

SEQ ID NO: 2315380 - protein, 26 aa, Cryptosporidium parvum
IPSNSLQLFSFILNDIISSLVENALR

SEQ ID NO: 2315381 - protein, 31 aa, Cryptosporidium parvum
IPSSILIYYGKLKNSLLLVLFDKEQERSLVR

SEQ ID NO: 2315382 - protein, 22 aa, Cryptosporidium parvum
IPSYILDLPNEVMRTPFGSMIL

SEQ ID NO: 2315383 - protein, 27 aa, Cryptosporidium parvum
IPTPSTVASLLPSLASPLSTSQHQNLQ

SEQ ID NO: 2315384 - protein, 26 aa, Cryptosporidium parvum
IPTSCLYLLSIWDKIESIPSTRKTAW

SEQ ID NO: 2315385 - protein, 17 aa, Cryptosporidium parvum
IPVIISNSTRLAPQEIK

SEQ ID NO: 2315386 - protein, 17 aa, Cryptosporidium parvum
IPVIPKNISSFNDKEQY

SEQ ID NO: 2315387 - protein, 19 aa, Cryptosporidium parvum
IPVLPSPSYNFSSSLPAFN

SEQ ID NO: 2315388 - protein, 32 aa, Cryptosporidium parvum
IPVVENPHYFTLIRFLGLISNTSMAIDWTFED

SEQ ID NO: 2315389 - protein, 25 aa, Cryptosporidium parvum
IQAEFDWMILVFLSEEQLPSQDQEL

SEQ ID NO: 2315390 - protein, 19 aa, Cryptosporidium parvum
IQAKTLPPILRYIDQEGEG

SEQ ID NO: 2315391 - protein, 25 aa, Cryptosporidium parvum
IQALILALHKEKFAMALELNPNWFA

SEQ ID NO: 2315392 - protein, 25 aa, Cryptosporidium parvum
IQAQTKFFETILLTIDNLMELENWR

SEQ ID NO: 2315393 - protein, 33 aa, Cryptosporidium parvum; identical to SEQ ID NO: 2191506

SEQ ID NO: 2315394 - protein, 28 aa, Cryptosporidium parvum
IQCEIVKTFKNLTLSPCLCKSQESPNNP

SEQ ID NO: 2315395 - protein, 21 aa, Cryptosporidium parvum
IQCGKLRIKISFLGRISCELE

SEQ ID NO: 2315396 - protein, 18 aa, Cryptosporidium parvum
IQCLALSYYFIEWLHEYM

SEQ ID NO: 2315397 - protein, 21 aa, Cryptosporidium parvum
IQDALLRDIIGPKFARHLNQY

SEQ ID NO: 2315398 - protein, 26 aa, Cryptosporidium parvum
IQDNTHLRKVCNWPAIEFSKQTSPPT

SEQ ID NO: 2315399 - protein, 25 aa, Cryptosporidium parvum
IQEENWSAMFYLGGLMDNLSSKQVM

SEQ ID NO: 2315400 - protein, 25 aa, Cryptosporidium parvum
IQEFPKEPIVLLIQSMVRLEELKTH

SEQ ID NO: 2315401 - protein, 26 aa, Cryptosporidium parvum
IQGDIPYCDTILYLDNPKPKKYDTTF

SEQ ID NO: 2315402 - protein, 23 aa, Cryptosporidium parvum
IQGKTLLNFISSIVGEIFTTEEI

SEQ ID NO: 2315403 - protein, 26 aa, Cryptosporidium parvum
IQGRNRLDILLSQWVSYFSGRQSIDI

SEQ ID NO: 2315404 - protein, 37 aa, Cryptosporidium parvum; identical to SEQ ID NO: 2191519

SEQ ID NO: 2315405 - protein, 18 aa, Cryptosporidium parvum
IQGYKFKIKYPLLGKAEN

SEQ ID NO: 2315406 - protein, 25 aa, Cryptosporidium parvum
IQHSHFFEKIRIKLWKSEYVMKIQC

SEQ ID NO: 2315407 - protein, 25 aa, Cryptosporidium parvum
IQICLMLFDCMGFNGESLLKKSLFE

SEQ ID NO: 2315408 - protein, 26 aa, Cryptosporidium parvum
IQIDNIFCVTFTSSLFSLICLKLDGL

SEQ ID NO: 2315409 - protein, 17 aa, Cryptosporidium parvum
IQILIKKQYNLVKSNDI

SEQ ID NO: 2315410 - protein, 19 aa, Cryptosporidium parvum
IQILYRLGQFEECERLYSI

SEQ ID NO: 2315411 - protein, 29 aa, Cryptosporidium parvum
IQISNDVFLFFEMWPSKLLPNAGNTTESY

SEQ ID NO: 2315412 - protein, 17 aa, Cryptosporidium parvum
IQKDMPALILKDKQWKT

SEQ ID NO: 2315413 - protein, 28 aa, Cryptosporidium parvum
IQKLIQQFINLFSFFIGERLECKQTGSV

SEQ ID NO: 2315414 - protein, 25 aa, Cryptosporidium parvum
IQLKAGEDALLPLTLRPIVEGSTRN

SEQ ID NO: 2315415 - protein, 17 aa, Cryptosporidium parvum
IQLLPWKEQHDIELLLK

SEQ ID NO: 2315416 - protein, 20 aa, Cryptosporidium parvum
IQLRDFKKFFKTICSTLSLD

SEQ ID NO: 2315417 - protein, 25 aa, Cryptosporidium parvum
IQLSTNIHPLIFRNVIENLLEYKGF

SEQ ID NO: 2315418 - protein, 20 aa, Cryptosporidium parvum
IQLTALTNLVNKFEKNKMIK

SEQ ID NO: 2315419 - protein, 33 aa, Cryptosporidium parvum
IQLTQLPVILGIPLKQIDFLDLLSQINKYKVRV

SEQ ID NO: 2315420 - protein, 29 aa, Cryptosporidium parvum
IQNKSNLLPPYQYPWPGLFSDCQIVAMAD

SEQ ID NO: 2315421 - protein, 19 aa, Cryptosporidium parvum
IQNLYAFYLSLATGEAPLS

SEQ ID NO: 2315422 - protein, 17 aa, Cryptosporidium parvum
IQPFLVLKVHRDSIVND

SEQ ID NO: 2315423 - protein, 17 aa, Cryptosporidium parvum
IQPSITYDIEYSASLIN

SEQ ID NO: 2315424 - protein, 25 aa, Cryptosporidium parvum
IQQHIHKWRILQQRSYIAIGKFKQT

SEQ ID NO: 2315425 - protein, 19 aa, Cryptosporidium parvum
IQQLFAKSIVRELNLKPLF

SEQ ID NO: 2315426 - protein, 21 aa, Cryptosporidium parvum
IQQRLEDVFSGKLDQLSIACK

SEQ ID NO: 2315427 - protein, 19 aa, Cryptosporidium parvum
IQREILRYILIGANSLSSD

SEQ ID NO: 2315428 - protein, 21 aa, Cryptosporidium parvum
IQRITLVYQVIPFNGIKNILK

SEQ ID NO: 2315429 - protein, 24 aa, Cryptosporidium parvum
IQRLFVNDIIPYSFFITILKEIKM

SEQ ID NO: 2315430 - protein, 18 aa, Cryptosporidium parvum
IQRMINLYKAGELKQYNF

SEQ ID NO: 2315431 - protein, 19 aa, Cryptosporidium parvum
IQRPFILTRSFYIGSHCYG

SEQ ID NO: 2315432 - protein, 27 aa, Cryptosporidium parvum
IQRSMNHLISMFKWRVSTYPLSDMESN

SEQ ID NO: 2315433 - protein, 19 aa, Cryptosporidium parvum
IQSINCEIIIFSSNNFLIN

SEQ ID NO: 2315434 - protein, 35 aa, Cryptosporidium parvum; identical to SEQ ID NO: 2191538

SEQ ID NO: 2315435 - protein, 20 aa, Cryptosporidium parvum
IQTLTLLEELVEHHGWGYER

SEQ ID NO: 2315436 - protein, 20 aa, Cryptosporidium parvum
IQVCVFIGALYRSEIATFIF

SEQ ID NO: 2315437 - protein, 28 aa, Cryptosporidium parvum
IQVISLFGKYTWSWISPRLLHGVSSTPT

SEQ ID NO: 2315438 - protein, 24 aa, Cryptosporidium parvum
IQVMEYKFLELLSIDFQQTPEEII

SEQ ID NO: 2315439 - protein, 18 aa, Cryptosporidium parvum
IRAVRIIERPKDGRSLGI

SEQ ID NO: 2315440 - protein, 20 aa, Cryptosporidium parvum
IRCLLPEKYIYGLSDRMIVE

SEQ ID NO: 2315441 - protein, 19 aa, Cryptosporidium parvum
IRDVINWMKERQGEAIQWL

SEQ ID NO: 2315442 - protein, 20 aa, Cryptosporidium parvum
IREIPVPSIVDLIGIVRHFS

SEQ ID NO: 2315443 - protein, 30 aa, Cryptosporidium parvum; identical to SEQ ID NO: 2191548

SEQ ID NO: 2315444 - protein, 36 aa, Cryptosporidium parvum; identical to SEQ ID NO: 2191549

SEQ ID NO: 2315445 - protein, 17 aa, Cryptosporidium parvum
IREMIELPLRHPGLFKA

SEQ ID NO: 2315446 - protein, 18 aa, Cryptosporidium parvum
IRENQIGVFPILLTHFYT

SEQ ID NO: 2315447 - protein, 24 aa, Cryptosporidium parvum
IRESQLLQWNYMLVIGENEARDKK

SEQ ID NO: 2315448 - protein, 31 aa, Cryptosporidium parvum
IRFISTVFHHYLIPYLRVNSKIIIENMNKYL

SEQ ID NO: 2315449 - protein, 32 aa, Cryptosporidium parvum; identical to SEQ ID NO: 2191558

SEQ ID NO: 2315450 - protein, 30 aa, Cryptosporidium parvum; identical to SEQ ID NO: 2191559

SEQ ID NO: 2315451 - protein, 34 aa, Cryptosporidium parvum
IRIEEVDHFFTFMEQLLYNEIVGSAGLFDKVLES

SEQ ID NO: 2315452 - protein, 24 aa, Cryptosporidium parvum
IRIKDLLNHFPPQGDILGISKDEI

SEQ ID NO: 2315453 - protein, 27 aa, Cryptosporidium parvum
IRITNEYLMLYSFPFGGFSSCFQFNFD

SEQ ID NO: 2315454 - protein, 22 aa, Cryptosporidium parvum
IRKRIVKLPPSGGKIQRFICIP

SEQ ID NO: 2315455 - protein, 18 aa, Cryptosporidium parvum
IRKTPFLFWHDDGQNKAP

SEQ ID NO: 2315456 - protein, 24 aa, Cryptosporidium parvum
IRLNDLIIALRRAFDNGTVTFSRH

SEQ ID NO: 2315457 - protein, 18 aa, Cryptosporidium parvum
IRMQLEQFQKLHLINENV

SEQ ID NO: 2315458 - protein, 25 aa, Cryptosporidium parvum
IRNKLPLCFLVLFKLETEYEILFKK

SEQ ID NO: 2315459 - protein, 25 aa, Cryptosporidium parvum
IRNTFVHDILLFLRNIKSIVVDVEP

SEQ ID NO: 2315460 - protein, 18 aa, Cryptosporidium parvum
IRPDRQTLLWSATWPKEV

SEQ ID NO: 2315461 - protein, 19 aa, Cryptosporidium parvum
IRPLWRHYYSNTDGLIFVI

SEQ ID NO: 2315462 - protein, 19 aa, Cryptosporidium parvum
IRPLWRHYYTNTDGIIFVV

SEQ ID NO: 2315463 - protein, 20 aa, Cryptosporidium parvum
IRQISAFGLSFMRLDIRQEA

SEQ ID NO: 2315464 - protein, 23 aa, Cryptosporidium parvum
IRRRFERRIYIPLPDEESRVLLI

SEQ ID NO: 2315465 - protein, 33 aa, Cryptosporidium parvum
IRRTHFFWDQKSNEILIICLELIYGIKKSFIVS

SEQ ID NO: 2315466 - protein, 28 aa, Cryptosporidium parvum
IRSEKDYQLLIFQKLLIALHDAYFKEFD

SEQ ID NO: 2315467 - protein, 19 aa, Cryptosporidium parvum
IRSKYWIEALRAYVNQSKG

SEQ ID NO: 2315468 - protein, 18 aa, Cryptosporidium parvum
IRTFLPDIRREINARIRT

SEQ ID NO: 2315469 - protein, 20 aa, Cryptosporidium parvum
IRTGDICQLLPNGSIRIVDR

SEQ ID NO: 2315470 - protein, 22 aa, Cryptosporidium parvum
IRTVTKIRGEWLLEISPKYYNL

SEQ ID NO: 2315471 - protein, 27 aa, Cryptosporidium parvum
IRVMNTLQFIGLLYLPQKNTKFEQDVF

SEQ ID NO: 2315472 - protein, 18 aa, Cryptosporidium parvum
IRVYVIKDKDDLTMKDNI

SEQ ID NO: 2315473 - protein, 19 aa, Cryptosporidium parvum
IRYDLLDIGLAICSPQLLK

SEQ ID NO: 2315474 - protein, 25 aa, Cryptosporidium parvum
IRYESGIKGKFWRCSTEAHNRMYEV

SEQ ID NO: 2315475 - protein, 19 aa, Cryptosporidium parvum
IRYWKRASTHIFGLRFDLI

SEQ ID NO: 2315476 - protein, 23 aa, Cryptosporidium parvum
ISACFSWPIINLVTDTTSNKPGK

SEQ ID NO: 2315477 - protein, 24 aa, Cryptosporidium parvum
ISAINHLWLNDYCSRWFISTETNS

SEQ ID NO: 2315478 - protein, 26 aa, Cryptosporidium parvum
ISAPTPIKIVPKIIPKPAITKEQPTN

SEQ ID NO: 2315479 - protein, 22 aa, Cryptosporidium parvum
ISARAMLKFVKGLTPTQLGINW

SEQ ID NO: 2315480 - protein, 18 aa, Cryptosporidium parvum
ISCEFPESLLPINGVPII

SEQ ID NO: 2315481 - protein, 18 aa, Cryptosporidium parvum
ISCFIFYSETDDQYVLFS

SEQ ID NO: 2315482 - protein, 28 aa, Cryptosporidium parvum
ISCISDLKLRILWIKETIHCFEPFTDTL

SEQ ID NO: 2315483 - protein, 24 aa, Cryptosporidium parvum
ISCKIPVICTEPIFRFGNNILCDI

SEQ ID NO: 2315484 - protein, 24 aa, Cryptosporidium parvum
ISCKNALLHPWFDDIDRSKYVMWD

SEQ ID NO: 2315485 - protein, 30 aa, Cryptosporidium parvum
ISCPFYFSNNYFGDLFWKLSKNQFNKNIFK

SEQ ID NO: 2315486 - protein, 24 aa, Cryptosporidium parvum
ISCPPPPPLLSPSLNLHDCRSIPD

SEQ ID NO: 2315487 - protein, 23 aa, Cryptosporidium parvum
ISDEMYFTSFLFNKIKMGNNTIN

SEQ ID NO: 2315488 - protein, 25 aa, Cryptosporidium parvum
ISDESYSFQLTFKSSAFKFTGAVVS

SEQ ID NO: 2315489 - protein, 18 aa, Cryptosporidium parvum
ISDFLLKQDPLYIHLQLA

SEQ ID NO: 2315490 - protein, 36 aa, Cryptosporidium parvum; identical to SEQ ID NO: 2191595

SEQ ID NO: 2315491 - protein, 23 aa, Cryptosporidium parvum
ISDYVILVLVFSDQIKILKDLSE

SEQ ID NO: 2315492 - protein, 23 aa, Cryptosporidium parvum
ISEIALLISFDRYGREDNNPYRY

SEQ ID NO: 2315493 - protein, 23 aa, Cryptosporidium parvum
ISEKVVVPKLFNSTPDLYHADKN

SEQ ID NO: 2315494 - protein, 35 aa, Cryptosporidium parvum
ISELQGKIMLAEKARELLLTRYKSDEIQFMLQNEK

SEQ ID NO: 2315495 - protein, 24 aa, Cryptosporidium parvum
ISELSNMLIFLMPEVFNSDLLEDA

SEQ ID NO: 2315496 - protein, 25 aa, Cryptosporidium parvum
ISEMTFAFKVLKSFRGKLRLGVCCT

SEQ ID NO: 2315497 - protein, 31 aa, Cryptosporidium parvum; identical to SEQ ID NO: 2191601

SEQ ID NO: 2315498 - protein, 17 aa, Cryptosporidium parvum
ISFCRQCERFQKPPWVS

SEQ ID NO: 2315499 - protein, 35 aa, Cryptosporidium parvum; identical to SEQ ID NO: 2191607

SEQ ID NO: 2315500 - protein, 23 aa, Cryptosporidium parvum
ISFWDTYRFEGNSQWIPIKNNNK

SEQ ID NO: 2315501 - protein, 28 aa, Cryptosporidium parvum
ISFWFSQILHGIIIETIFIIKNNNFIII

SEQ ID NO: 2315502 - protein, 21 aa, Cryptosporidium parvum
ISGFFYSIINKIITLDPNDSH

SEQ ID NO: 2315503 - protein, 29 aa, Cryptosporidium parvum
ISGKERVRLFWIILKSLMLKTGAKMKHLI

SEQ ID NO: 2315504 - protein, 25 aa, Cryptosporidium parvum
ISGNNFISYLPRFIRNYFFGQSQSC

SEQ ID NO: 2315505 - protein, 19 aa, Cryptosporidium parvum
ISGPSSIFEMRLSPSTNEL

SEQ ID NO: 2315506 - protein, 24 aa, Cryptosporidium parvum
ISGRIKDMIIIRGRNFYPQDIEEV

SEQ ID NO: 2315507 - protein, 31 aa, Cryptosporidium parvum; identical to SEQ ID NO: 2191609

SEQ ID NO: 2315508 - protein, 24 aa, Cryptosporidium parvum
ISHPFKLHIHDLIKDVWHSSILCK

SEQ ID NO: 2315509 - protein, 30 aa, Cryptosporidium parvum
ISIEDFWFDYRIWCFLFKVRLEKIQSINQF

SEQ ID NO: 2315510 - protein, 31 aa, Cryptosporidium parvum
ISINQIKNRMLGKHCFSLVSVDWDSDEEKKV

SEQ ID NO: 2315511 - protein, 32 aa, Cryptosporidium parvum
ISIPSHGSHLPLLPPSRFPFQSEARRTINRLS

SEQ ID NO: 2315512 - protein, 25 aa, Cryptosporidium parvum
ISIQGFNLLPFITSSNKLIEIALEN

SEQ ID NO: 2315513 - protein, 22 aa, Cryptosporidium parvum
ISIQIIYPKNQLSIQKLGSLGI

SEQ ID NO: 2315514 - protein, 20 aa, Cryptosporidium parvum
ISIQLSYFYSETLNFKGMIE

SEQ ID NO: 2315515 - protein, 25 aa, Cryptosporidium parvum
ISISILKDNLLMTELFLTCGSDVQA

SEQ ID NO: 2315516 - protein, 25 aa, Cryptosporidium parvum
ISISSFPLPPRYAKILLLTTAYIRK

SEQ ID NO: 2315517 - protein, 23 aa, Cryptosporidium parvum
ISKDFIGCISSQAGVICTSNKRR

SEQ ID NO: 2315518 - protein, 24 aa, Cryptosporidium parvum
ISKEEFSPYLKIIESIGLKINEKM

SEQ ID NO: 2315519 - protein, 22 aa, Cryptosporidium parvum
ISKGFGILTYKLFKHIFELSNQ

SEQ ID NO: 2315520 - protein, 20 aa, Cryptosporidium parvum
ISKKLKVLPLKTPNIISNES

SEQ ID NO: 2315521 - protein, 19 aa, Cryptosporidium parvum
ISKKLTWLLRHGDPAKTGL

SEQ ID NO: 2315522 - protein, 17 aa, Cryptosporidium parvum
ISKLCSWEFSIAETSIS

SEQ ID NO: 2315523 - protein, 26 aa, Cryptosporidium parvum
ISKNSYPSPLNYWEFPKSCCTSVNEI

SEQ ID NO: 2315524 - protein, 29 aa, Cryptosporidium parvum
ISKSRILFRNLFVLLTWASDYIGKSEFSK

SEQ ID NO: 2315525 - protein, 17 aa, Cryptosporidium parvum
ISLDTITWEWKFEVTHF

SEQ ID NO: 2315526 - protein, 40 aa, Cryptosporidium parvum
ISLEELYIVQSIIPISIFSLLLTRFPVPAASTFSFSLICN

SEQ ID NO: 2315527 - protein, 18 aa, Cryptosporidium parvum
ISLELILKSLRRSPLTLE

SEQ ID NO: 2315528 - protein, 34 aa, Cryptosporidium parvum
ISLNKLLMNIPVYSKKMVFLKDKIFSLANLSNNN

SEQ ID NO: 2315529 - protein, 19 aa, Cryptosporidium parvum
ISMILKSLESSPSVFKMFE

SEQ ID NO: 2315530 - protein, 28 aa, Cryptosporidium parvum
ISNEGSLLHWINNFMYITLESQIKPPGK

SEQ ID NO: 2315531 - protein, 26 aa, Cryptosporidium parvum
ISNFDSILLAWDFFKDIKEEVFGVER

SEQ ID NO: 2315532 - protein, 31 aa, Cryptosporidium parvum
ISNFPEIQKLILEFLFSFKTSQKLSLVNKEG

SEQ ID NO: 2315533 - protein, 32 aa, Cryptosporidium parvum; identical to SEQ ID NO: 2191632

SEQ ID NO: 2315534 - protein, 24 aa, Cryptosporidium parvum
ISNFRRFQGLSRLKKIALTLIAQN

SEQ ID NO: 2315535 - protein, 25 aa, Cryptosporidium parvum
ISNHYYDIFVSFPPIFEASSHLHIF

SEQ ID NO: 2315536 - protein, 17 aa, Cryptosporidium parvum
ISNIFWCDEQKFVVTGS

SEQ ID NO: 2315537 - protein, 25 aa, Cryptosporidium parvum
ISNKIFEFPYHIAKKKIPYLKYLND

SEQ ID NO: 2315538 - protein, 18 aa, Cryptosporidium parvum
ISNKIFETLKLPTSARLN

SEQ ID NO: 2315539 - protein, 18 aa, Cryptosporidium parvum
ISNNLLLKDKHINRKCDF

SEQ ID NO: 2315540 - protein, 31 aa, Cryptosporidium parvum
ISNPRVDILRFVHDKYVIPILMVIQECFTRR

SEQ ID NO: 2315541 - protein, 25 aa, Cryptosporidium parvum
ISNRNILWDSILLEKLKSLVNQEIN

SEQ ID NO: 2315542 - protein, 18 aa, Cryptosporidium parvum
ISNRVSYVFGMRGPSMTV

SEQ ID NO: 2315543 - protein, 20 aa, Cryptosporidium parvum
ISPEYLVPGTPGFFPNKFYL

SEQ ID NO: 2315544 - protein, 21 aa, Cryptosporidium parvum
ISPKVYLEIWTKPDISCMYNI

SEQ ID NO: 2315545 - protein, 24 aa, Cryptosporidium parvum
ISPNKYFCFTPLLTQIVSNRLPRE

SEQ ID NO: 2315546 - protein, 20 aa, Cryptosporidium parvum
ISPNNTIRRKFIVGITETAE

SEQ ID NO: 2315547 - protein, 18 aa, Cryptosporidium parvum
ISPSKTPRTGVNPPPIVS

SEQ ID NO: 2315548 - protein, 18 aa, Cryptosporidium parvum
ISPTSVLSAIFEFQRRYQ

SEQ ID NO: 2315549 - protein, 21 aa, Cryptosporidium parvum
ISQLIWYQHIQPLSTEIVRIL

SEQ ID NO: 2315550 - protein, 37 aa, Cryptosporidium parvum
ISQQVEIILVPPYSSFIKFCVKRLGFSITYNKRRAWF

SEQ ID NO: 2315551 - protein, 26 aa, Cryptosporidium parvum
ISQTMALLNVNPLGLQPFVQAQTPQQ

SEQ ID NO: 2315552 - protein, 29 aa, Cryptosporidium parvum
ISRDRNEFDYFFYPKKLPDNSRVIYIKLD

SEQ ID NO: 2315553 - protein, 20 aa, Cryptosporidium parvum
ISREYIVQPYLLENFDKGQQ

SEQ ID NO: 2315554 - protein, 17 aa, Cryptosporidium parvum
ISRYFSAKRYGVEKSYE

SEQ ID NO: 2315555 - protein, 22 aa, Cryptosporidium parvum
ISRYHATIRYRNDNFMLEDHDS

SEQ ID NO: 2315556 - protein, 27 aa, Cryptosporidium parvum
ISSAPRLPFIIKRPQINLAISRGIFFE

SEQ ID NO: 2315557 - protein, 25 aa, Cryptosporidium parvum
ISSATKLFILELMAKINKQLNDSGS

SEQ ID NO: 2315558 - protein, 26 aa, Cryptosporidium parvum
ISSFGYPSYPLPPIHNIAPSCNKCLL

SEQ ID NO: 2315559 - protein, 17 aa, Cryptosporidium parvum
ISSFTHSIILLKKLGIT

SEQ ID NO: 2315560 - protein, 20 aa, Cryptosporidium parvum
ISSLALLKMLKHGRAGVPME

SEQ ID NO: 2315561 - protein, 25 aa, Cryptosporidium parvum
ISSLEIPIFLQLLNFCVYSVMDSID

SEQ ID NO: 2315562 - protein, 34 aa, Cryptosporidium parvum
ISSNKLDFKGFLSNLLVPLFSSSHYSYLDQLFDL

SEQ ID NO: 2315563 - protein, 36 aa, Cryptosporidium parvum
ISSNLLAEVVWSLPLLYAEKLLILVESVLKLMYDHS

SEQ ID NO: 2315564 - protein, 23 aa, Cryptosporidium parvum
ISSNYFFKLPILKTNTNINIEFP

SEQ ID NO: 2315565 - protein, 17 aa, Cryptosporidium parvum
ISSRVFSAIPYFSKRTL

SEQ ID NO: 2315566 - protein, 26 aa, Cryptosporidium parvum
ISSSIRRKLSILLENLRKDPNFELFI

SEQ ID NO: 2315567 - protein, 24 aa, Cryptosporidium parvum
ISTAVCQSLYPLFVRETTAVAAAS

SEQ ID NO: 2315568 - protein, 20 aa, Cryptosporidium parvum
ISTCFVYVTSQMRLQIWMNG

SEQ ID NO: 2315569 - protein, 23 aa, Cryptosporidium parvum
ISTHGLFRATFEDKILLSDIVFC

SEQ ID NO: 2315570 - protein, 19 aa, Cryptosporidium parvum
ISTIFDRIASNCSNLAIVE

SEQ ID NO: 2315571 - protein, 42 aa, Cryptosporidium parvum
ISTKFEIKFELGLINGSWLGGDIFILDRKHALEAVSYSIACV

SEQ ID NO: 2315572 - protein, 24 aa, Cryptosporidium parvum
ISTLNVINYLIPNKEFRLKVSSVV

SEQ ID NO: 2315573 - protein, 30 aa, Cryptosporidium parvum; identical to SEQ ID NO: 2191662

SEQ ID NO: 2315574 - protein, 24 aa, Cryptosporidium parvum
ISTSYSFGNNCPLLLEGFYNDDNT

SEQ ID NO: 2315575 - protein, 20 aa, Cryptosporidium parvum
ISTTLPFFNNITLELTITVS

SEQ ID NO: 2315576 - protein, 18 aa, Cryptosporidium parvum
ISVFDRNTLCWADVEYTA

SEQ ID NO: 2315577 - protein, 32 aa, Cryptosporidium parvum
ISVHDKRVIEWLYNLLECCGKLAKLRSYIIWN

SEQ ID NO: 2315578 - protein, 17 aa, Cryptosporidium parvum
ISVLLEGIARQVVAFKG

SEQ ID NO: 2315579 - protein, 40 aa, Cryptosporidium parvum
ISVPIGLTCFYVELNPLLKIEFLIRFLLNMKRELESGKQI

SEQ ID NO: 2315580 - protein, 17 aa, Cryptosporidium parvum
ISYGKLWEKTINQHIFI

SEQ ID NO: 2315581 - protein, 25 aa, Cryptosporidium parvum
ISYKSGIPGVYWKTRDQEWVAEWYD

SEQ ID NO: 2315582 - protein, 20 aa, Cryptosporidium parvum
ISYSILIKFLKLHNGEKHTL

SEQ ID NO: 2315583 - protein, 17 aa, Cryptosporidium parvum
ITACHIWRRNEIRQLKS

SEQ ID NO: 2315584 - protein, 26 aa, Cryptosporidium parvum
ITADDIYVVLSSFLFSSTSINPGQSN

SEQ ID NO: 2315585 - protein, 24 aa, Cryptosporidium parvum
ITALLQEIISIYPLLSPPNLSNQA

SEQ ID NO: 2315586 - protein, 25 aa, Cryptosporidium parvum
ITCARFSSFLRNNSGRLHWLRVMYH

SEQ ID NO: 2315587 - protein, 18 aa, Cryptosporidium parvum
ITDKKGFKDILDLPFFVL

SEQ ID NO: 2315588 - protein, 33 aa, Cryptosporidium parvum
ITDNDLENFLDITNILVSSLYMNEMEDLTIEEN

SEQ ID NO: 2315589 - protein, 18 aa, Cryptosporidium parvum
ITDSHWMFSPNNDSWTVV

SEQ ID NO: 2315590 - protein, 20 aa, Cryptosporidium parvum
ITELLNIPPIPIKSLKYPEI

SEQ ID NO: 2315591 - protein, 25 aa, Cryptosporidium parvum
ITESLYNFISAFHFNQADFPDSNEF

SEQ ID NO: 2315592 - protein, 27 aa, Cryptosporidium parvum
ITETYISRTLYLCKLPYDMTEDSVREL

SEQ ID NO: 2315593 - protein, 35 aa, Cryptosporidium parvum
ITFSKFDTFPIKQPIIEFTWFYNKIASFDVDRKHI

SEQ ID NO: 2315594 - protein, 24 aa, Cryptosporidium parvum
ITGFEGILLKRIKKRDIMFVQTIK

SEQ ID NO: 2315595 - protein, 27 aa, Cryptosporidium parvum
ITGIIQWVCNLTIEIGFLILDLGSFIM

SEQ ID NO: 2315596 - protein, 22 aa, Cryptosporidium parvum
ITGPHLIVVPLSTVGNWAREAR

SEQ ID NO: 2315597 - protein, 17 aa, Cryptosporidium parvum
ITHLKIQILYRLGQFEE

SEQ ID NO: 2315598 - protein, 21 aa, Cryptosporidium parvum
ITIDIALWQFETPKYHYTVID

SEQ ID NO: 2315599 - protein, 24 aa, Cryptosporidium parvum
ITIFDTITFHSWLKILSIEQYSLR

SEQ ID NO: 2315600 - protein, 36 aa, Cryptosporidium parvum; identical to SEQ ID NO: 2191683

SEQ ID NO: 2315601 - protein, 18 aa, Cryptosporidium parvum
ITIQCHTPLLVTTKLSKA

SEQ ID NO: 2315602 - protein, 27 aa, Cryptosporidium parvum
ITKKSFLPPLFISRPLNLYSYSGINIP

SEQ ID NO: 2315603 - protein, 29 aa, Cryptosporidium parvum
ITLQDPATVIFKAPNWYKIIKSTNEISPS

SEQ ID NO: 2315604 - protein, 25 aa, Cryptosporidium parvum
ITLTVKLLLIIRRISTVKPSFYNML

SEQ ID NO: 2315605 - protein, 19 aa, Cryptosporidium parvum
ITMPNLLFHLEELNLFERI

SEQ ID NO: 2315606 - protein, 20 aa, Cryptosporidium parvum
ITMVYTMVTDLIFSWLELRD

SEQ ID NO: 2315607 - protein, 18 aa, Cryptosporidium parvum
ITNAPWGKKLAFDESLVS

SEQ ID NO: 2315608 - protein, 25 aa, Cryptosporidium parvum
ITNLRRIIIYHSLFLTKPSNSRPPS

SEQ ID NO: 2315609 - protein, 40 aa, Cryptosporidium parvum
ITNMNKLDAYYKFLVLSYSKMFLAFISLKNDCELEDVHFH

SEQ ID NO: 2315610 - protein, 17 aa, Cryptosporidium parvum
ITPFHSLATPKISIGDY

SEQ ID NO: 2315611 - protein, 18 aa, Cryptosporidium parvum
ITPLRQPFETFVTGNDGT

SEQ ID NO: 2315612 - protein, 25 aa, Cryptosporidium parvum
ITPTNYIEPILIPIFERLASCIQSP

SEQ ID NO: 2315613 - protein, 23 aa, Cryptosporidium parvum
ITQKFMEPRLLIVTDPRVDSQAV

SEQ ID NO: 2315614 - protein, 27 aa, Cryptosporidium parvum
ITQNKFLSMLIFFPNIESQISIFLASV

SEQ ID NO: 2315615 - protein, 25 aa, Cryptosporidium parvum
ITRDTQFLQIIQHKMPKRSNKTLGS

SEQ ID NO: 2315616 - protein, 24 aa, Cryptosporidium parvum
ITRGALKFIFKAPSPDFTKIPPED

SEQ ID NO: 2315617 - protein, 21 aa, Cryptosporidium parvum
ITRYLIMFGYIIRTQKKYENS

SEQ ID NO: 2315618 - protein, 26 aa, Cryptosporidium parvum
ITSALYILQKFFVKDILRVLLCSNCY

SEQ ID NO: 2315619 - protein, 25 aa, Cryptosporidium parvum
ITSVYGWDLCYEVILLDFHDLMIEG

SEQ ID NO: 2315620 - protein, 25 aa, Cryptosporidium parvum
ITTEIQSFVPVILGENQKLDTSEME

SEQ ID NO: 2315621 - protein, 27 aa, Cryptosporidium parvum
ITTTCSYPILLTPRLYIVCVSLLSELS

SEQ ID NO: 2315622 - protein, 44 aa, Cryptosporidium parvum
ITTTSAMTLQPLHSPPLLPPPPPPPPPPPPPHTLPHLSQSQNSI

SEQ ID NO: 2315623 - protein, 31 aa, Cryptosporidium parvum
ITVLINIHCFFPYLYCEVPKSTPPNPEKIKT

SEQ ID NO: 2315624 - protein, 19 aa, Cryptosporidium parvum
ITVYSTPWLNKSTTRIREH

SEQ ID NO: 2315625 - protein, 28 aa, Cryptosporidium parvum
ITYGGYNFRILLTPYKLDSLNSQDQVPF

SEQ ID NO: 2315626 - protein, 18 aa, Cryptosporidium parvum
IVASYWIANLVRNENIFA

SEQ ID NO: 2315627 - protein, 19 aa, Cryptosporidium parvum
IVDQLFKGINGTVLAYGQT

SEQ ID NO: 2315628 - protein, 26 aa, Cryptosporidium parvum
IVDRLHKVLRPFLLRREKIQVANEVP

SEQ ID NO: 2315629 - protein, 19 aa, Cryptosporidium parvum
IVEEFNGFRLKLGSSSSIE

SEQ ID NO: 2315630 - protein, 19 aa, Cryptosporidium parvum
IVEILSLPFQSMPLSIMVE

SEQ ID NO: 2315631 - protein, 24 aa, Cryptosporidium parvum
IVEISLYHALSFYNAIYSEDFGYI

SEQ ID NO: 2315632 - protein, 33 aa, Cryptosporidium parvum; identical to SEQ ID NO: 2191710

SEQ ID NO: 2315633 - protein, 24 aa, Cryptosporidium parvum
IVENVLMWAQLKQSMELKKKMKSN

SEQ ID NO: 2315634 - protein, 20 aa, Cryptosporidium parvum
IVERLLLRGYKVRATTRSKN

SEQ ID NO: 2315635 - protein, 17 aa, Cryptosporidium parvum
IVEVEMWKRKLKTQEVQ

SEQ ID NO: 2315636 - protein, 29 aa, Cryptosporidium parvum
IVFELLTSVLFYLDIPYITAIEFLENCSI

SEQ ID NO: 2315637 - protein, 20 aa, Cryptosporidium parvum
IVFIHDICILSDFFKKPTSE

SEQ ID NO: 2315638 - protein, 17 aa, Cryptosporidium parvum
IVFLISMASRKYTLGSC

SEQ ID NO: 2315639 - protein, 27 aa, Cryptosporidium parvum
IVGAIIDTFGPISSPFYVLSKQSNVNN

SEQ ID NO: 2315640 - protein, 17 aa, Cryptosporidium parvum
IVGEYFVHIWKAAGMDM

SEQ ID NO: 2315641 - protein, 20 aa, Cryptosporidium parvum
IVGIAEYVCRTAEQYINKSH

SEQ ID NO: 2315642 - protein, 25 aa, Cryptosporidium parvum
IVIAPLKLFGLTNFLHRISNWYNYR

SEQ ID NO: 2315643 - protein, 23 aa, Cryptosporidium parvum
IVIRNLELISYFSCCKLQPLHTS

SEQ ID NO: 2315644 - protein, 19 aa, Cryptosporidium parvum
IVISLKDRLFSQADTLIGV

SEQ ID NO: 2315645 - protein, 26 aa, Cryptosporidium parvum
IVKHETPFWLACWIGNEQIVQYLLNF

SEQ ID NO: 2315646 - protein, 27 aa, Cryptosporidium parvum
IVKNRDLINYLYQDIKFLKETNNLLSN

SEQ ID NO: 2315647 - protein, 18 aa, Cryptosporidium parvum
IVKQPYSIGSTKIKCIEA

SEQ ID NO: 2315648 - protein, 26 aa, Cryptosporidium parvum
IVKSDPSTIMLDLGSVLCLEDKTIVG

SEQ ID NO: 2315649 - protein, 34 aa, Cryptosporidium parvum; identical to SEQ ID NO: 2191725

SEQ ID NO: 2315650 - protein, 29 aa, Cryptosporidium parvum
IVLVHEYLPFQLMYWNRYGKFYSVINNSR

SEQ ID NO: 2315651 - protein, 31 aa, Cryptosporidium parvum
IVNDLLPRAIGITIALLLLRSFSKSISNSAS

SEQ ID NO: 2315652 - protein, 20 aa, Cryptosporidium parvum
IVNLGDDLFFLASKLSDSLL

SEQ ID NO: 2315653 - protein, 18 aa, Cryptosporidium parvum
IVNLWISLLPIKYDTDEA

SEQ ID NO: 2315654 - protein, 24 aa, Cryptosporidium parvum
IVNSAIGFGFYKPPLKNKFEVDNV

SEQ ID NO: 2315655 - protein, 18 aa, Cryptosporidium parvum
IVPGIFDSATLNSVGAGA

SEQ ID NO: 2315656 - protein, 23 aa, Cryptosporidium parvum
IVQIKGCFYSLTPGGIIMQNIVM

SEQ ID NO: 2315657 - protein, 18 aa, Cryptosporidium parvum
IVQQFLPSIVQLRKYELE

SEQ ID NO: 2315658 - protein, 28 aa, Cryptosporidium parvum
IVQSYNESFKFKPLSRIESKRSISVPVQ

SEQ ID NO: 2315659 - protein, 37 aa, Cryptosporidium parvum; identical to SEQ ID NO: 2191738

SEQ ID NO: 2315660 - protein, 20 aa, Cryptosporidium parvum
IVSFDKWNLMEFVKGIICQH

SEQ ID NO: 2315661 - protein, 22 aa, Cryptosporidium parvum
IVSICCLILRIISCTWSNNFSS

SEQ ID NO: 2315662 - protein, 28 aa, Cryptosporidium parvum
IVSKLGWGHFSTVWLAIDTLSTPTTYFA

SEQ ID NO: 2315663 - protein, 36 aa, Cryptosporidium parvum
IVSLELWNLYKEMGPNIWPSFLRYENPPKHVKMLES

SEQ ID NO: 2315664 - protein, 28 aa, Cryptosporidium parvum
IVSLKKDIDIYFISLSKDANMYREIEYI

SEQ ID NO: 2315665 - protein, 24 aa, Cryptosporidium parvum
IVSNIYRRGLIEIPPANDAFYGRR

SEQ ID NO: 2315666 - protein, 24 aa, Cryptosporidium parvum
IVTEKWTSPLIPYIIKDFSCPNCF

SEQ ID NO: 2315667 - protein, 26 aa, Cryptosporidium parvum
IVTNFIQNWTPLLYNHDFWSKCYVLF

SEQ ID NO: 2315668 - protein, 26 aa, Cryptosporidium parvum
IVTNGNFLFYSLFEALKVNLNVDQNQ

SEQ ID NO: 2315669 - protein, 25 aa, Cryptosporidium parvum
IVTQTFLYLDIPTAWSFLRNGIRKS

SEQ ID NO: 2315670 - protein, 19 aa, Cryptosporidium parvum
IVTRRPLILQLQQIKQENR

SEQ ID NO: 2315671 - protein, 17 aa, Cryptosporidium parvum
IVVMLVGNKLDLVEKDP

SEQ ID NO: 2315672 - protein, 18 aa, Cryptosporidium parvum
IVVNQVMFPIDLPSGNDQ

SEQ ID NO: 2315673 - protein, 18 aa, Cryptosporidium parvum
IVYNCYKLRNIVGNKFPR

SEQ ID NO: 2315674 - protein, 20 aa, Cryptosporidium parvum
IWAAIFRYINKLVYIAKPRK

SEQ ID NO: 2315675 - protein, 19 aa, Cryptosporidium parvum
IWECKGCRKVLAGGAWQLS

SEQ ID NO: 2315676 - protein, 18 aa, Cryptosporidium parvum
IWEGIYYVVGSNLTQYLS

SEQ ID NO: 2315677 - protein, 24 aa, Cryptosporidium parvum
IWIDNNLFIILSSSSVYLLALENE

SEQ ID NO: 2315678 - protein, 19 aa, Cryptosporidium parvum
IWKHKKYMKSLQSISNREK

SEQ ID NO: 2315679 - protein, 28 aa, Cryptosporidium parvum
IWKSNNVFMFPIPIWKSPTQKKNLNGRN

SEQ ID NO: 2315680 - protein, 19 aa, Cryptosporidium parvum
IWRLAYISVMGYEIDFGWL

SEQ ID NO: 2315681 - protein, 17 aa, Cryptosporidium parvum
IWRLAYTTLNPSSRSRS

SEQ ID NO: 2315682 - protein, 23 aa, Cryptosporidium parvum
IWSLGCVLAGLIFKRDPFFCGVD

SEQ ID NO: 2315683 - protein, 25 aa, Cryptosporidium parvum
IWSVGCIFIELLIGRPIFSGDSEVS

SEQ ID NO: 2315684 - protein, 23 aa, Cryptosporidium parvum
IWTMNKYILLKQGAFQVLRTINA

SEQ ID NO: 2315685 - protein, 18 aa, Cryptosporidium parvum
IYDILTLDEFLKFSVSGF

SEQ ID NO: 2315686 - protein, 19 aa, Cryptosporidium parvum
IYDKVKLIHKFIIQECKMN

SEQ ID NO: 2315687 - protein, 27 aa, Cryptosporidium parvum
IYDNDLTLLFVRTLRFFLSSCHEKKFG

SEQ ID NO: 2315688 - protein, 27 aa, Cryptosporidium parvum
IYDSGFKQKLLDILSIRPNQYGERITS

SEQ ID NO: 2315689 - protein, 17 aa, Cryptosporidium parvum
IYEGMWYKDQAIGLYIL

SEQ ID NO: 2315690 - protein, 21 aa, Cryptosporidium parvum
IYEKAFHIIVSYFPYEYEDDH

SEQ ID NO: 2315691 - protein, 22 aa, Cryptosporidium parvum
IYEKMFFGRYRDGGHFGPHTDC

SEQ ID NO: 2315692 - protein, 23 aa, Cryptosporidium parvum
IYEKMLEFISYLDSALHAYFPKW

SEQ ID NO: 2315693 - protein, 29 aa, Cryptosporidium parvum
IYETSISILIKYLIPLALCDISEQVRISA

SEQ ID NO: 2315694 - protein, 27 aa, Cryptosporidium parvum
IYFEEQIYIYLRQSSLFFVLTSYYDVS

SEQ ID NO: 2315695 - protein, 18 aa, Cryptosporidium parvum
IYGPGQFIGLRLCSKNYL

SEQ ID NO: 2315696 - protein, 20 aa, Cryptosporidium parvum
IYIDIRSYLIRLNRPSEQVP

SEQ ID NO: 2315697 - protein, 19 aa, Cryptosporidium parvum
IYKLHVWASNYYFVHQNFS

SEQ ID NO: 2315698 - protein, 20 aa, Cryptosporidium parvum
IYKRCILNSAFLHSTIPSLP

SEQ ID NO: 2315699 - protein, 22 aa, Cryptosporidium parvum
IYNALVFPIYAERDNWSCIPTP

SEQ ID NO: 2315700 - protein, 18 aa, Cryptosporidium parvum
IYNKILTHSPKKPVIIFV

SEQ ID NO: 2315701 - protein, 20 aa, Cryptosporidium parvum
IYNKLPYNNSIQNLNYIQQP

SEQ ID NO: 2315702 - protein, 26 aa, Cryptosporidium parvum
IYNNYNYGYPIYFLKGLYKENVLDFN

SEQ ID NO: 2315703 - protein, 20 aa, Cryptosporidium parvum
IYPLYFNIKCLNHHISENIN

SEQ ID NO: 2315704 - protein, 20 aa, Cryptosporidium parvum
IYQGCMIFRGDNLMLCGLID

SEQ ID NO: 2315705 - protein, 19 aa, Cryptosporidium parvum
IYRIGNIHPNLRGLSSIII

SEQ ID NO: 2315706 - protein, 28 aa, Cryptosporidium parvum
IYRLPDERYISLKFLAKFVLNKNIQTEV

SEQ ID NO: 2315707 - protein, 17 aa, Cryptosporidium parvum
IYRRAPVGVPQNLGYRL

SEQ ID NO: 2315708 - protein, 24 aa, Cryptosporidium parvum
IYSLHRRIAGFFIICSRLGAAINS

SEQ ID NO: 2315709 - protein, 30 aa, Cryptosporidium parvum
IYSPKYPTFGSISWPILRKPIHVDINDIII

SEQ ID NO: 2315710 - protein, 19 aa, Cryptosporidium parvum
IYVYDLLDPIRPIRRFSRH

SEQ ID NO: 2315711 - protein, 18 aa, Cryptosporidium parvum
IYWKKWFEYINSIRIYKS

SEQ ID NO: 2315712 - protein, 18 aa, Cryptosporidium parvum
IYYELDILEIRKLRFKDF

SEQ ID NO: 2315713 - protein, 26 aa, Cryptosporidium parvum
IYYGYFSMQYPIIWEDFKNHLNSNNS

SEQ ID NO: 2315714 - protein, 25 aa, Cryptosporidium parvum
KAAAQLKAAILARASSKKNISADNS

SEQ ID NO: 2315715 - protein, 21 aa, Cryptosporidium parvum
KAAEFVIKFLDRMQSKKYAMN

SEQ ID NO: 2315716 - protein, 19 aa, Cryptosporidium parvum
KAELKFWDKYNPVLDNTFE

SEQ ID NO: 2315717 - protein, 21 aa, Cryptosporidium parvum
KAEYNPLIKFLQEKNIRIKNL

SEQ ID NO: 2315718 - protein, 22 aa, Cryptosporidium parvum
KAFERNLLFSGFIKVKKLKGDG

SEQ ID NO: 2315719 - protein, 20 aa, Cryptosporidium parvum
KAFTPIRVLIYPLTIGTRNN

SEQ ID NO: 2315720 - protein, 23 aa, Cryptosporidium parvum
KAHIPVGLVFQPLASPPPGYPEV

SEQ ID NO: 2315721 - protein, 20 aa, Cryptosporidium parvum
KAICKLVWQDYARVNKFSAG

SEQ ID NO: 2315722 - protein, 23 aa, Cryptosporidium parvum
KAIIEKIPKFWADTISRHPVFQD

SEQ ID NO: 2315723 - protein, 21 aa, Cryptosporidium parvum
KAILVGVLAACGIEKIVSAKE

SEQ ID NO: 2315724 - protein, 33 aa, Cryptosporidium parvum
KAISEGTHFFLPWFQVPFIYDVRVKPKVINTTT

SEQ ID NO: 2315725 - protein, 28 aa, Cryptosporidium parvum
KAIVSLLPVLYLCKILRSMFENKERLIP

SEQ ID NO: 2315726 - protein, 24 aa, Cryptosporidium parvum
KAIYFDVLIPLFETENAFFRIFEL

SEQ ID NO: 2315727 - protein, 31 aa, Cryptosporidium parvum
KAIYPEAVRMLLLFIYGHTTSLRGANPYLIL

SEQ ID NO: 2315728 - protein, 25 aa, Cryptosporidium parvum
KAKAPLGVINFKIAEWSLQISDSDE

SEQ ID NO: 2315729 - protein, 36 aa, Cryptosporidium parvum
KAKEEPPPAPPAEESSWFSGWFGAAAPAEPEPEPNK

SEQ ID NO: 2315730 - protein, 36 aa, Cryptosporidium parvum
KAKEEPPPAPPAEESSWFSGWFGASAPEEPPKEEEK

SEQ ID NO: 2315731 - protein, 29 aa, Cryptosporidium parvum
KAKFGLDIFADALLAIPKTLAENAGLDQQ

SEQ ID NO: 2315732 - protein, 17 aa, Cryptosporidium parvum
KAKLDLFKMRFLGRNMK

SEQ ID NO: 2315733 - protein, 26 aa, Cryptosporidium parvum
KAKMVFHGRFFAGRKLNVSFIKDEEF

SEQ ID NO: 2315734 - protein, 30 aa, Cryptosporidium parvum; identical to SEQ ID NO: 2209764

SEQ ID NO: 2315735 - protein, 24 aa, Cryptosporidium parvum
KALDILISLIYYTTDYRDYFSNWK

SEQ ID NO: 2315736 - protein, 24 aa, Cryptosporidium parvum
KALDLNHCMALIGSPAKIFGENNY

SEQ ID NO: 2315737 - protein, 26 aa, Cryptosporidium parvum
KALENIYYIFERLVKYLKDFYDENSV

SEQ ID NO: 2315738 - protein, 27 aa, Cryptosporidium parvum
KALRKLWSNILNIYPLIPSITKNLALI

SEQ ID NO: 2315739 - protein, 25 aa, Cryptosporidium parvum
KALSNFHFHHNFSMFGEVIQDNGQR

SEQ ID NO: 2315740 - protein, 21 aa, Cryptosporidium parvum
KALSNSRYWSLDSITSRCPQS

SEQ ID NO: 2315741 - protein, 24 aa, Cryptosporidium parvum
KALVPPVVITSRQLDLFSGGMDEN

SEQ ID NO: 2315742 - protein, 20 aa, Cryptosporidium parvum
KALYNKAFYVWHENFLKNSD

SEQ ID NO: 2315743 - protein, 17 aa, Cryptosporidium parvum
KAMKHIFLRVIIDGEPY

SEQ ID NO: 2315744 - protein, 17 aa, Cryptosporidium parvum
KAMWSAFVSVRHTLAKY

SEQ ID NO: 2315745 - protein, 23 aa, Cryptosporidium parvum
KANELLDYILMSIVKDNGHTGNV

SEQ ID NO: 2315746 - protein, 17 aa, Cryptosporidium parvum
KANLIAQALQPYPTGIK

SEQ ID NO: 2315747 - protein, 19 aa, Cryptosporidium parvum
KANLNIVVNSEKSVFEVVP

SEQ ID NO: 2315748 - protein, 25 aa, Cryptosporidium parvum
KANNRLELVLFQLYCNENMGGKYFD

SEQ ID NO: 2315749 - protein, 32 aa, Cryptosporidium parvum; identical to SEQ ID NO: 2191801

SEQ ID NO: 2315750 - protein, 29 aa, Cryptosporidium parvum
KAPDVCYSWWIFSLLYFLGRANYIDKNLL

SEQ ID NO: 2315751 - protein, 23 aa, Cryptosporidium parvum
KAPKSYKLLELVPGAIEAPKRER

SEQ ID NO: 2315752 - protein, 21 aa, Cryptosporidium parvum
KAPNHLTVNDLLRPVFSCDYS

SEQ ID NO: 2315753 - protein, 27 aa, Cryptosporidium parvum
KAPPVYKIDIFPLSPKAFDICLNPIAN

SEQ ID NO: 2315754 - protein, 31 aa, Cryptosporidium parvum; identical to SEQ ID NO: 2191806

SEQ ID NO: 2315755 - protein, 28 aa, Cryptosporidium parvum
KAQDKYIELAIGNAPWPMGVTMVGIHER

SEQ ID NO: 2315756 - protein, 18 aa, Cryptosporidium parvum
KAQFFKEPACSLVVAVHS

SEQ ID NO: 2315757 - protein, 26 aa, Cryptosporidium parvum
KARGRCKVAYLDRKAFKRVLGPIEDI

SEQ ID NO: 2315758 - protein, 22 aa, Cryptosporidium parvum
KARILHAVAQWRERFKTIDDFH

SEQ ID NO: 2315759 - protein, 25 aa, Cryptosporidium parvum
KARIRNQYTISWLKMGIFALNDIKK

SEQ ID NO: 2315760 - protein, 21 aa, Cryptosporidium parvum
KARKKILNIYLKSKNYIQIDD

SEQ ID NO: 2315761 - protein, 23 aa, Cryptosporidium parvum
KARLRKGITILGGTPGRILDHID

SEQ ID NO: 2315762 - protein, 20 aa, Cryptosporidium parvum
KASIKFQLKKVLCLGVAIGN

SEQ ID NO: 2315763 - protein, 23 aa, Cryptosporidium parvum
KASRSFNAGVLLLSLKKLRENNF

SEQ ID NO: 2315764 - protein, 33 aa, Cryptosporidium parvum
KATHRLFICTKKHLFFLNNKYFKMAPSLRKKPI

SEQ ID NO: 2315765 - protein, 24 aa, Cryptosporidium parvum
KAVDIHWILTNLEHKYRDTTIEFT

SEQ ID NO: 2315766 - protein, 32 aa, Cryptosporidium parvum
KAVFIGHGLPVHYIWLLSPRTILKTSSGKIRR

SEQ ID NO: 2315767 - protein, 18 aa, Cryptosporidium parvum
KAVYISSEWLKVFKINHF

SEQ ID NO: 2315768 - protein, 21 aa, Cryptosporidium parvum
KAYVYCLLGFYDSAMSVCLKE

SEQ ID NO: 2315769 - protein, 22 aa, Cryptosporidium parvum
KCCAFWKKWCCCCLSDKGPTKS

SEQ ID NO: 2315770 - protein, 17 aa, Cryptosporidium parvum
KCCSKCIFEGEKETLQC

SEQ ID NO: 2315771 - protein, 18 aa, Cryptosporidium parvum
KCDFKLISFYKAVKGNIV

SEQ ID NO: 2315772 - protein, 20 aa, Cryptosporidium parvum
KCEDYLFKIGSLESELLIIR

SEQ ID NO: 2315773 - protein, 27 aa, Cryptosporidium parvum
KCFNMHMLIRFLAKNLSLYKYIKSSYA

SEQ ID NO: 2315774 - protein, 25 aa, Cryptosporidium parvum
KCFNNTQWFKATRFIFEISGNDDDT

SEQ ID NO: 2315775 - protein, 20 aa, Cryptosporidium parvum
KCFNPGDIIFAESPLLVVTP

SEQ ID NO: 2315776 - protein, 21 aa, Cryptosporidium parvum
KCGQYLIFLGGIKSSKRENGI

SEQ ID NO: 2315777 - protein, 18 aa, Cryptosporidium parvum
KCHPFVSPFYQIPQTKNV

SEQ ID NO: 2315778 - protein, 20 aa, Cryptosporidium parvum
KCKFITPQNRFSIESGYRWD

SEQ ID NO: 2315779 - protein, 26 aa, Cryptosporidium parvum
KCKHLTPQWYIDTYIKLFCLAGNIIK

SEQ ID NO: 2315780 - protein, 23 aa, Cryptosporidium parvum
KCKKLFIKSIKMDTFIVSVREYG

SEQ ID NO: 2315781 - protein, 17 aa, Cryptosporidium parvum
KCKLVFKRLINKVNIVR

SEQ ID NO: 2315782 - protein, 26 aa, Cryptosporidium parvum
KCKMHKILIFTQFQLILDELENYCLW

SEQ ID NO: 2315783 - protein, 29 aa, Cryptosporidium parvum
KCLDACVHYISYTLKYLLDNPEENALNIS

SEQ ID NO: 2315784 - protein, 34 aa, Cryptosporidium parvum
KCMYKVLKMELLKNPFRWRGMLKDLYGVSEETTT

SEQ ID NO: 2315785 - protein, 24 aa, Cryptosporidium parvum
KCNELLYPILGRSLISTIYCEKTM

SEQ ID NO: 2315786 - protein, 27 aa, Cryptosporidium parvum
KCNSLDLVFFELIKSLFRVLNLNNKHS

SEQ ID NO: 2315787 - protein, 53 aa, Cryptosporidium parvum
KCQEFQSLLLAYRIDYLFYWDQVIQSFLLPKLKEFVQLWINQFISIGGVDHEV

SEQ ID NO: 2315788 - protein, 27 aa, Cryptosporidium parvum
KCQINYMQKILYSLKYKKHALLESPTG

SEQ ID NO: 2315789 - protein, 17 aa, Cryptosporidium parvum
KCSGAVNHMIGSEVPAL

SEQ ID NO: 2315790 - protein, 27 aa, Cryptosporidium parvum
KCTEKLIILNSYLAFLVFKISKKNQTT

SEQ ID NO: 2315791 - protein, 17 aa, Cryptosporidium parvum
KCTLWRSSQPKSAFKRC

SEQ ID NO: 2315792 - protein, 30 aa, Cryptosporidium parvum; identical to SEQ ID NO: 2191839

SEQ ID NO: 2315793 - protein, 28 aa, Cryptosporidium parvum
KCVIKTLHQILRPFMLRRLKADVERDLP

SEQ ID NO: 2315794 - protein, 22 aa, Cryptosporidium parvum
KCYRYRIFSLPPRAGASSSENA

SEQ ID NO: 2315795 - protein, 27 aa, Cryptosporidium parvum
KDAFHLHDMFYLCFPLRLKHSCTHEDK

SEQ ID NO: 2315796 - protein, 20 aa, Cryptosporidium parvum
KDCAIIKWDLETGKKIIFPG

SEQ ID NO: 2315797 - protein, 24 aa, Cryptosporidium parvum
KDDDLLIEWLIYNFHMNSRNLQGS

SEQ ID NO: 2315798 - protein, 27 aa, Cryptosporidium parvum
KDDDSQNKLPPWKRKPISLDNDILKRA

SEQ ID NO: 2315799 - protein, 24 aa, Cryptosporidium parvum
KDEHCYNIFILKGIGWRKLSDYEN

SEQ ID NO: 2315800 - protein, 24 aa, Cryptosporidium parvum
KDEHFMCNWIQWDPTGRYVTTAFQ

SEQ ID NO: 2315801 - protein, 26 aa, Cryptosporidium parvum
KDFDKPGALPHLFRSFRATKFCKRCG

SEQ ID NO: 2315802 - protein, 18 aa, Cryptosporidium parvum
KDFERDQFLLGLNREGTN

SEQ ID NO: 2315803 - protein, 20 aa, Cryptosporidium parvum
KDFKNLLIIGPRKVEKLYNL

SEQ ID NO: 2315804 - protein, 34 aa, Cryptosporidium parvum
KDFKPLMLEVFIRKAPWQILVKNLNYLIGNVKSG

SEQ ID NO: 2315805 - protein, 31 aa, Cryptosporidium parvum; identical to SEQ ID NO: 2191853

SEQ ID NO: 2315806 - protein, 27 aa, Cryptosporidium parvum
KDFVFNSYCLIHLKDCINLLTNEINSQ

SEQ ID NO: 2315807 - protein, 21 aa, Cryptosporidium parvum
KDFVILRKKIYLCIMNSLNYE

SEQ ID NO: 2315808 - protein, 22 aa, Cryptosporidium parvum
KDGIVLFTTLNRTVLCYIYSII

SEQ ID NO: 2315809 - protein, 23 aa, Cryptosporidium parvum
KDGKGILRFAMGHSIQGVWKDGV

SEQ ID NO: 2315810 - protein, 26 aa, Cryptosporidium parvum
KDGKVSFVEFIIGLARLAVGSNPEEK

SEQ ID NO: 2315811 - protein, 25 aa, Cryptosporidium parvum
KDGQYLPQYIPKVSSAKWPSSALLG

SEQ ID NO: 2315812 - protein, 26 aa, Cryptosporidium parvum
KDGSERYYLCIPSKGDFLVTTPTDQE

SEQ ID NO: 2315813 - protein, 23 aa, Cryptosporidium parvum
KDGTIIVTVSFYHQIRGMKISEF

SEQ ID NO: 2315814 - protein, 25 aa, Cryptosporidium parvum
KDHFKAGLLFYKKKYHEVVTPSLLK

SEQ ID NO: 2315815 - protein, 33 aa, Cryptosporidium parvum; identical to SEQ ID NO: 2191857

SEQ ID NO: 2315816 - protein, 19 aa, Cryptosporidium parvum
KDICVVYYHYLLESNGSFA

SEQ ID NO: 2315817 - protein, 21 aa, Cryptosporidium parvum
KDIHPDLLFNITLGGSSISIR

SEQ ID NO: 2315818 - protein, 19 aa, Cryptosporidium parvum
KDIIPFYKHIILKVVDQND

SEQ ID NO: 2315819 - protein, 18 aa, Cryptosporidium parvum
KDILLSLSFMVMNQLVSF

SEQ ID NO: 2315820 - protein, 37 aa, Cryptosporidium parvum
KDINPVYGCLVPCLKCCIYPCRAFFLTGRCISQKRRM

SEQ ID NO: 2315821 - protein, 26 aa, Cryptosporidium parvum
KDITDLSYVFIRLGDILQLAEKYYEA

SEQ ID NO: 2315822 - protein, 17 aa, Cryptosporidium parvum
KDIVSCGFVKDLYFDPE

SEQ ID NO: 2315823 - protein, 27 aa, Cryptosporidium parvum
KDKKSPLDFALWKKAKPEEPCWDSPWG

SEQ ID NO: 2315824 - protein, 29 aa, Cryptosporidium parvum
KDLALIGYDPYYLTKAMKILIQKGDLIER

SEQ ID NO: 2315825 - protein, 18 aa, Cryptosporidium parvum
KDLCGPVYKLPRFKKIDA

SEQ ID NO: 2315826 - protein, 27 aa, Cryptosporidium parvum
KDLFSLNLMKYYEYMDKIPDKRPFGNT

SEQ ID NO: 2315827 - protein, 20 aa, Cryptosporidium parvum
KDLIAKWKKQGYEYLCCINC

SEQ ID NO: 2315828 - protein, 25 aa, Cryptosporidium parvum
KDLPQGYIRFKTSISSPLSQDDFFS

SEQ ID NO: 2315829 - protein, 27 aa, Cryptosporidium parvum
KDNADFPIIILYFDDGKVFSYSFNISS

SEQ ID NO: 2315830 - protein, 21 aa, Cryptosporidium parvum
KDNAFYLGQETALQLLFTLED

SEQ ID NO: 2315831 - protein, 26 aa, Cryptosporidium parvum
KDNNEEFLVIPPEKIPDTFVCSQAIK

SEQ ID NO: 2315832 - protein, 25 aa, Cryptosporidium parvum
KDNNQNFQLIPRITLKSLIEEISRN

SEQ ID NO: 2315833 - protein, 30 aa, Cryptosporidium parvum; identical to SEQ ID NO: 2191877

SEQ ID NO: 2315834 - protein, 24 aa, Cryptosporidium parvum
KDPIKWYSIFQNNFKFWSSFLTAK

SEQ ID NO: 2315835 - protein, 25 aa, Cryptosporidium parvum
KDPNLPELIILPIYSSLPSEQQAKI

SEQ ID NO: 2315836 - protein, 25 aa, Cryptosporidium parvum
KDPSTLYELYHDSGYLTWVGNRSEV

SEQ ID NO: 2315837 - protein, 17 aa, Cryptosporidium parvum
KDQNIFTPQPNLKDRVL

SEQ ID NO: 2315838 - protein, 30 aa, Cryptosporidium parvum
KDQSIIPNIPFSLCISYLRQERSQICNKLH

SEQ ID NO: 2315839 - protein, 29 aa, Cryptosporidium parvum
KDRLVQSLHLLALLWRCYKICEERGYYDL

SEQ ID NO: 2315840 - protein, 26 aa, Cryptosporidium parvum
KDSEIVVCFIMQLPYYIKVQAGETVD

SEQ ID NO: 2315841 - protein, 21 aa, Cryptosporidium parvum
KDSFFKIFCQKIQSLIRLVSK

SEQ ID NO: 2315842 - protein, 22 aa, Cryptosporidium parvum
KDSILSTLKFLYRLEALNKSGN

SEQ ID NO: 2315843 - protein, 22 aa, Cryptosporidium parvum
KDSIWTKIDILNKKKLCYDCQK

SEQ ID NO: 2315844 - protein, 25 aa, Cryptosporidium parvum
KDSKNLCYALNNIILRDLELPEGCR

SEQ ID NO: 2315845 - protein, 22 aa, Cryptosporidium parvum
KDSKYLFERALNLVRNHFEGKN

SEQ ID NO: 2315846 - protein, 21 aa, Cryptosporidium parvum
KDSLKFYSKILYPTIRTNISQ

SEQ ID NO: 2315847 - protein, 27 aa, Cryptosporidium parvum
KDSLTMLHILLFLQRVAPVKFEVSAAT

SEQ ID NO: 2315848 - protein, 19 aa, Cryptosporidium parvum
KDTIINEFLPLSVNDPVWS

SEQ ID NO: 2315849 - protein, 23 aa, Cryptosporidium parvum
KDVDLLLRVILSPFLDQSISVIK

SEQ ID NO: 2315850 - protein, 20 aa, Cryptosporidium parvum
KDVFFYLSDDSHYVPRALLF

SEQ ID NO: 2315851 - protein, 29 aa, Cryptosporidium parvum
KDVIKDVLLPWYHCYRFFVQEAIRYENTN

SEQ ID NO: 2315852 - protein, 23 aa, Cryptosporidium parvum
KDVILGLHKLVNVHKGAALLSTF

SEQ ID NO: 2315853 - protein, 17 aa, Cryptosporidium parvum
KDVLQHPDFNEIGSIKS

SEQ ID NO: 2315854 - protein, 20 aa, Cryptosporidium parvum
KDWFNPITCLKLHRLQDSVD

SEQ ID NO: 2315855 - protein, 35 aa, Cryptosporidium parvum; identical to SEQ ID NO: 2191893

SEQ ID NO: 2315856 - protein, 24 aa, Cryptosporidium parvum
KDWRRRWFVLTRNYLASFKDQRSL

SEQ ID NO: 2315857 - protein, 19 aa, Cryptosporidium parvum
KDWWRLIPTESTNSDFSKG

SEQ ID NO: 2315858 - protein, 20 aa, Cryptosporidium parvum
KDYILIIKLEEIESEIILHL

SEQ ID NO: 2315859 - protein, 31 aa, Cryptosporidium parvum
KEAPPPAEESSWFSGWFGTSAPEEPPKEEEK

SEQ ID NO: 2315860 - protein, 40 aa, Cryptosporidium parvum; identical to SEQ ID NO: 2191900

SEQ ID NO: 2315861 - protein, 21 aa, Cryptosporidium parvum
KECIIFLFDLALLQNNKLLSD

SEQ ID NO: 2315862 - protein, 40 aa, Cryptosporidium parvum
KECILLNPNWSKGWYRAGKALYYLNIFDKAVIVFKAALKR

SEQ ID NO: 2315863 - protein, 29 aa, Cryptosporidium parvum
KECQDYIIYYKFIKSIQLPIKKRVFIIFK

SEQ ID NO: 2315864 - protein, 34 aa, Cryptosporidium parvum
KEDAEYEGIFWHPINKVWIGVWLDSITHETCTQS

SEQ ID NO: 2315865 - protein, 24 aa, Cryptosporidium parvum
KEDAKRYIRIFSKRTGIDLQTRFP

SEQ ID NO: 2315866 - protein, 31 aa, Cryptosporidium parvum
KEDAPPAEESSWFGGWFGASTPEEPPKEDPA

SEQ ID NO: 2315867 - protein, 32 aa, Cryptosporidium parvum
KEDHHWLDQGLTPFLIFHLLPSIQAREEIFIS

SEQ ID NO: 2315868 - protein, 26 aa, Cryptosporidium parvum
KEDICRAYMRLALEWYPDGNRSDTEL

SEQ ID NO: 2315869 - protein, 17 aa, Cryptosporidium parvum
KEDIVYIHSGLSCISHF

SEQ ID NO: 2315870 - protein, 22 aa, Cryptosporidium parvum
KEEACMADLIYLIKANLDGVIC

SEQ ID NO: 2315871 - protein, 30 aa, Cryptosporidium parvum
KEEDWKHVSFLAIDLIRKLLTYNPSERITA

SEQ ID NO: 2315872 - protein, 46 aa, Cryptosporidium parvum
KEEISRLNTLLKNNELLLSKYKLNSLALNAQLPFLKSRSFMEEDKE

SEQ ID NO: 2315873 - protein, 25 aa, Cryptosporidium parvum
KEEKKTLIIFVLDYEFCLSLANELS

SEQ ID NO: 2315874 - protein, 23 aa, Cryptosporidium parvum
KEELDKWCPKIPKFIYHGNLNMR

SEQ ID NO: 2315875 - protein, 27 aa, Cryptosporidium parvum
KEEMERWNIWIAYINMEIVYGKNELLT

SEQ ID NO: 2315876 - protein, 25 aa, Cryptosporidium parvum
KEEMLIGPLMQLTTMDQFVLTFALN

SEQ ID NO: 2315877 - protein, 22 aa, Cryptosporidium parvum
KEFEFKFKNIRPGKLSQRLKDA

SEQ ID NO: 2315878 - protein, 27 aa, Cryptosporidium parvum
KEFETPSLVFFKKSLKWYLESFHSVHL

SEQ ID NO: 2315879 - protein, 18 aa, Cryptosporidium parvum
KEFFDNYKGEESFDFVPI

SEQ ID NO: 2315880 - protein, 23 aa, Cryptosporidium parvum
KEFPVLLSNCNFFIISGPNDIGP

SEQ ID NO: 2315881 - protein, 30 aa, Cryptosporidium parvum
KEGGYFPEKPFFEDLFQYGLVSFPDMEVME

SEQ ID NO: 2315882 - protein, 24 aa, Cryptosporidium parvum
KEGLSIFYSYDLCSSSCSVPTVVT

SEQ ID NO: 2315883 - protein, 24 aa, Cryptosporidium parvum
KEGNIFLYNRIALDSPRVLFSSLL

SEQ ID NO: 2315884 - protein, 19 aa, Cryptosporidium parvum
KEHGLVLNAFEKVDPERRC

SEQ ID NO: 2315885 - protein, 17 aa, Cryptosporidium parvum
KEHLLINGVTPIDHFRG

SEQ ID NO: 2315886 - protein, 26 aa, Cryptosporidium parvum
KEIAEMNNILFQAKERYQLTLNENNE

SEQ ID NO: 2315887 - protein, 25 aa, Cryptosporidium parvum
KEIAKGLHFLMDSINDYMDGRFCDE

SEQ ID NO: 2315888 - protein, 34 aa, Cryptosporidium parvum
KEIDRLPNCVFPKSFYLWLLNENNNKYFSVQDLM

SEQ ID NO: 2315889 - protein, 31 aa, Cryptosporidium parvum; identical to SEQ ID NO: 2191922

SEQ ID NO: 2315890 - protein, 27 aa, Cryptosporidium parvum
KEINISNFIYSWLNVTRFYCVFDHSKL

SEQ ID NO: 2315891 - protein, 32 aa, Cryptosporidium parvum
KEIQIEIDYLYDLRYIPVVSIVLVLKSGKESK

SEQ ID NO: 2315892 - protein, 28 aa, Cryptosporidium parvum
KEIQKLDIPIVIKLLHNKLIDLSDTDTN

SEQ ID NO: 2315893 - protein, 19 aa, Cryptosporidium parvum
KEIQRIRGIELAEKEERAK

SEQ ID NO: 2315894 - protein, 21 aa, Cryptosporidium parvum
KEIQRVLDRLPPPTHIVPSQL

SEQ ID NO: 2315895 - protein, 24 aa, Cryptosporidium parvum
KEISEIRWFSFTSLPNWHANQSLR

SEQ ID NO: 2315896 - protein, 20 aa, Cryptosporidium parvum
KEITDLFSFFIIESTVINNE

SEQ ID NO: 2315897 - protein, 18 aa, Cryptosporidium parvum
KEIVLYAHYLNLKYFSTE

SEQ ID NO: 2315898 - protein, 23 aa, Cryptosporidium parvum
KEKGFKSWLEYHKKFWLENFHAF

SEQ ID NO: 2315899 - protein, 27 aa, Cryptosporidium parvum
KEKHNYKKFKKWLKKNKLKLKNKKIIS

SEQ ID NO: 2315900 - protein, 21 aa, Cryptosporidium parvum
KEKILSIVCNICKQTFMCTAN

SEQ ID NO: 2315901 - protein, 22 aa, Cryptosporidium parvum
KEKKEELLIGGLSVCKHIFCFV

SEQ ID NO: 2315902 - protein, 25 aa, Cryptosporidium parvum
KEKLGLIFQLNEFSRMVKGSYWMVL

SEQ ID NO: 2315903 - protein, 18 aa, Cryptosporidium parvum
KEKMNIGMDDPDLMWNEA

SEQ ID NO: 2315904 - protein, 25 aa, Cryptosporidium parvum
KEKPCKEFYFLENLSKIKLQDSWNT

SEQ ID NO: 2315905 - protein, 25 aa, Cryptosporidium parvum
KEKRKKFHTLIKKFVPFITSRTVEN

SEQ ID NO: 2315906 - protein, 26 aa, Cryptosporidium parvum
KEKSTWSRIFSPLSFGFDKRELSYSG

SEQ ID NO: 2315907 - protein, 26 aa, Cryptosporidium parvum
KEKVSLLHYNLACILTLPCYQRKGYG

SEQ ID NO: 2315908 - protein, 19 aa, Cryptosporidium parvum
KEKYYQYSSPCNGGFYIHS

SEQ ID NO: 2315909 - protein, 20 aa, Cryptosporidium parvum
KELDYYRHTVKPEFKEIDSN

SEQ ID NO: 2315910 - protein, 19 aa, Cryptosporidium parvum
KELELLFQKIKKFMREKYG

SEQ ID NO: 2315911 - protein, 20 aa, Cryptosporidium parvum
KELFKEDLNLILIGRNREKL

SEQ ID NO: 2315912 - protein, 19 aa, Cryptosporidium parvum
KELHWLIDIKVVCLSYDGN

SEQ ID NO: 2315913 - protein, 21 aa, Cryptosporidium parvum
KELLCRYLRLKKELNEYISIL

SEQ ID NO: 2315914 - protein, 23 aa, Cryptosporidium parvum
KELQIISFKFIRSLSKMWGYSIM

SEQ ID NO: 2315915 - protein, 26 aa, Cryptosporidium parvum
KELTHPSFHWTLHKLKPVLQGLVLPS

SEQ ID NO: 2315916 - protein, 21 aa, Cryptosporidium parvum
KELVLCQKFIVRSHFQIGNIY

SEQ ID NO: 2315917 - protein, 21 aa, Cryptosporidium parvum
KEMEQLLALDDFKKVIGLLER

SEQ ID NO: 2315918 - protein, 27 aa, Cryptosporidium parvum
KEMSEKPFFVNFLNDKVKIDNIRFGLD

SEQ ID NO: 2315919 - protein, 30 aa, Cryptosporidium parvum
KEMYGKFMKSVLLPLKTFEKTCRRPTFPFV

SEQ ID NO: 2315920 - protein, 24 aa, Cryptosporidium parvum
KENEFIPCFALDFTKNSIPSSLIL

SEQ ID NO: 2315921 - protein, 22 aa, Cryptosporidium parvum
KENFVACLYTCYEFLRPDTVME

SEQ ID NO: 2315922 - protein, 27 aa, Cryptosporidium parvum
KENKLKQMNFLVGKIFKSLQDSSSEYD

SEQ ID NO: 2315923 - protein, 24 aa, Cryptosporidium parvum
KENKMKFRRLVKSNLNGFEHPNTS

SEQ ID NO: 2315924 - protein, 19 aa, Cryptosporidium parvum
KENKTCLDKKIRENCILQS

SEQ ID NO: 2315925 - protein, 21 aa, Cryptosporidium parvum
KENQELLKEIKLKSQALNDGE

SEQ ID NO: 2315926 - protein, 17 aa, Cryptosporidium parvum
KENVLQPLLVNLSSVKL

SEQ ID NO: 2315927 - protein, 19 aa, Cryptosporidium parvum
KENWIPITNFGLLESSTSS

SEQ ID NO: 2315928 - protein, 22 aa, Cryptosporidium parvum
KEPCFSSWWTTYGGVTSKQYVP

SEQ ID NO: 2315929 - protein, 20 aa, Cryptosporidium parvum
KEQCFKLFKSRSFPIKDFRG

SEQ ID NO: 2315930 - protein, 22 aa, Cryptosporidium parvum
KEQFEVFIFHIEKRIEKSSNEI

SEQ ID NO: 2315931 - protein, 26 aa, Cryptosporidium parvum
KEQFKIHKEFIIPISWSSDGLRLSKI

SEQ ID NO: 2315932 - protein, 34 aa, Cryptosporidium parvum
KEQKFLNNWKNCRKLLLKRKKLWITQKEKTELEI

SEQ ID NO: 2315933 - protein, 20 aa, Cryptosporidium parvum
KEQSFPWHLEIPFPSEEEDL

SEQ ID NO: 2315934 - protein, 26 aa, Cryptosporidium parvum
KERIGKLLKNAFFPKFNKLEEFDSLS

SEQ ID NO: 2315935 - protein, 22 aa, Cryptosporidium parvum
KERMFYFNKLRAIEILYEELNE

SEQ ID NO: 2315936 - protein, 17 aa, Cryptosporidium parvum
KERMQVLLNLVKTKEGS

SEQ ID NO: 2315937 - protein, 21 aa, Cryptosporidium parvum
KERQLLVIWLMDSSSCLKRLD

SEQ ID NO: 2315938 - protein, 26 aa, Cryptosporidium parvum
KERSSVRTFIRFCPSKKTIIEDSKEC

SEQ ID NO: 2315939 - protein, 31 aa, Cryptosporidium parvum; identical to SEQ ID NO: 2191952

SEQ ID NO: 2315940 - protein, 17 aa, Cryptosporidium parvum
KERYHNGNYYDKYGRFC

SEQ ID NO: 2315941 - protein, 25 aa, Cryptosporidium parvum
KESEEFFIPLISMLLHPKFDKSRID

SEQ ID NO: 2315942 - protein, 22 aa, Cryptosporidium parvum
KESLDLIRISAPLFLEKESGLN

SEQ ID NO: 2315943 - protein, 24 aa, Cryptosporidium parvum
KESLVDYWIELTLTQAKSMNNNLE

SEQ ID NO: 2315944 - protein, 24 aa, Cryptosporidium parvum
KESQMISYEEYMKKMAPKRLEVPK

SEQ ID NO: 2315945 - protein, 18 aa, Cryptosporidium parvum
KETDLVIQSSPLFDSDEN

SEQ ID NO: 2315946 - protein, 20 aa, Cryptosporidium parvum
KETILITGINKKFVLEDIKE

SEQ ID NO: 2315947 - protein, 29 aa, Cryptosporidium parvum
KETIRIYQVILPPKLLFKLPKHHVLKSLP

SEQ ID NO: 2315948 - protein, 29 aa, Cryptosporidium parvum
KEVEMDILLLINDLFNNIKLVFSEKSDLH

SEQ ID NO: 2315949 - protein, 26 aa, Cryptosporidium parvum
KEVKVLLLSLLKVDPLLRPSIFDIEQ

SEQ ID NO: 2315950 - protein, 24 aa, Cryptosporidium parvum
KEVPIRIRFLINDVIDSRKNNWKS

SEQ ID NO: 2315951 - protein, 24 aa, Cryptosporidium parvum
KEVSIWAPRIRAVKYHGSQKERRQ

SEQ ID NO: 2315952 - protein, 19 aa, Cryptosporidium parvum
KEVYDDIPVVKYVPKFDVE

SEQ ID NO: 2315953 - protein, 18 aa, Cryptosporidium parvum
KEYFSQFGKILRIKLSRS

SEQ ID NO: 2315954 - protein, 31 aa, Cryptosporidium parvum
KEYNLGKNEDIVELIRILRIQEESRKSLEEE

SEQ ID NO: 2315955 - protein, 31 aa, Cryptosporidium parvum
KEYPSSPNLWLLYGFIYRKAFPDRINEALKI

SEQ ID NO: 2315956 - protein, 18 aa, Cryptosporidium parvum
KEYQHPAAWRQSCGARIW

SEQ ID NO: 2315957 - protein, 22 aa, Cryptosporidium parvum
KEYSLELFYNNPVMLQSFIKKM

SEQ ID NO: 2315958 - protein, 22 aa, Cryptosporidium parvum
KFDAHWLIVRINESAPIQPKPF

SEQ ID NO: 2315959 - protein, 18 aa, Cryptosporidium parvum
KFDGAMFRGRQIKVSTKR

SEQ ID NO: 2315960 - protein, 24 aa, Cryptosporidium parvum
KFEEPNRIFVKKRKLDLPKPQLSL

SEQ ID NO: 2315961 - protein, 18 aa, Cryptosporidium parvum
KFEFSEFGLTLSHITLTE

SEQ ID NO: 2315962 - protein, 19 aa, Cryptosporidium parvum
KFEIMTDSLLLLQRLEESR

SEQ ID NO: 2315963 - protein, 22 aa, Cryptosporidium parvum
KFEIPLFTHNPLSLAISNLLKS

SEQ ID NO: 2315964 - protein, 20 aa, Cryptosporidium parvum
KFENKLKNKLYLPLYSKFVD

SEQ ID NO: 2315965 - protein, 19 aa, Cryptosporidium parvum
KFEPHIFSLARRALVSWAE

SEQ ID NO: 2315966 - protein, 25 aa, Cryptosporidium parvum
KFERGRIFFSLLSLCLQLEDEEREE

SEQ ID NO: 2315967 - protein, 20 aa, Cryptosporidium parvum
KFFALLISSRPIANNEAFFP

SEQ ID NO: 2315968 - protein, 26 aa, Cryptosporidium parvum
KFFQTPRIWLFGYNKEGYPLSTEEMV

SEQ ID NO: 2315969 - protein, 25 aa, Cryptosporidium parvum
KFGETLYVKIVFSKLTQLPKGVAFV

SEQ ID NO: 2315970 - protein, 23 aa, Cryptosporidium parvum
KFGLGKWRIILATSKLTNRDEVG

SEQ ID NO: 2315971 - protein, 19 aa, Cryptosporidium parvum
KFGWIAYHEYLFTKERLHK

SEQ ID NO: 2315972 - protein, 21 aa, Cryptosporidium parvum
KFHESLLKSVLRKKGLNKLPP

SEQ ID NO: 2315973 - protein, 19 aa, Cryptosporidium parvum
KFHFNIPTLLVSTPGRFIQ

SEQ ID NO: 2315974 - protein, 17 aa, Cryptosporidium parvum
KFHLYILNPRNTLEGLR

SEQ ID NO: 2315975 - protein, 25 aa, Cryptosporidium parvum
KFHNKRWLLFSTCVEGFIIIYDLTT

SEQ ID NO: 2315976 - protein, 25 aa, Cryptosporidium parvum
KFHTSNYILKYLNLYLSIAGKEEME

SEQ ID NO: 2315977 - protein, 19 aa, Cryptosporidium parvum
KFIPDLFRGTLSYTIECVS

SEQ ID NO: 2315978 - protein, 18 aa, Cryptosporidium parvum
KFIVKNLQILTGKEIKFI

SEQ ID NO: 2315979 - protein, 31 aa, Cryptosporidium parvum
KFKHLEFFNTLLIRLEKFLSWIAKNNIQDYG

SEQ ID NO: 2315980 - protein, 17 aa, Cryptosporidium parvum
KFKRTKIKVIKKNLRKE

SEQ ID NO: 2315981 - protein, 19 aa, Cryptosporidium parvum
KFLFKPDHYALFSKLKSLL

SEQ ID NO: 2315982 - protein, 18 aa, Cryptosporidium parvum
KFLIFPEDSNSIAQINRN

SEQ ID NO: 2315983 - protein, 22 aa, Cryptosporidium parvum
KFLKILEISFRRDPMNFRPRIN

SEQ ID NO: 2315984 - protein, 19 aa, Cryptosporidium parvum
KFLLKLIAPPQLSTFSFIY

SEQ ID NO: 2315985 - protein, 18 aa, Cryptosporidium parvum
KFLLVESGIRFHTTQWKR

SEQ ID NO: 2315986 - protein, 20 aa, Cryptosporidium parvum
KFLNLLKRYYKEIYDDFSES

SEQ ID NO: 2315987 - protein, 21 aa, Cryptosporidium parvum
KFNFPEKIEIKRLLELNIIEN

SEQ ID NO: 2315988 - protein, 25 aa, Cryptosporidium parvum
KFNILETRILLPCIGFGIVHHINYQ

SEQ ID NO: 2315989 - protein, 17 aa, Cryptosporidium parvum
KFNIMADLIRLLSKPRL

SEQ ID NO: 2315990 - protein, 22 aa, Cryptosporidium parvum
KFNKIDTWWVSETGIMDFILMV

SEQ ID NO: 2315991 - protein, 18 aa, Cryptosporidium parvum
KFNRAIGKADYLLEQLSN

SEQ ID NO: 2315992 - protein, 17 aa, Cryptosporidium parvum
KFNRLPICIWRTISDFE

SEQ ID NO: 2315993 - protein, 20 aa, Cryptosporidium parvum
KFNTDFGPLIFNVWDTAGQE

SEQ ID NO: 2315994 - protein, 20 aa, Cryptosporidium parvum
KFPRQIIRYCFGGTPLYSES

SEQ ID NO: 2315995 - protein, 25 aa, Cryptosporidium parvum
KFQIGELVWVNYKCTFWPAQIMEFS

SEQ ID NO: 2315996 - protein, 27 aa, Cryptosporidium parvum
KFQYNNSMLSLLPYNIISILDETGKIP

SEQ ID NO: 2315997 - protein, 20 aa, Cryptosporidium parvum
KFRAFSTLRKQFIEAKNFGK

SEQ ID NO: 2315998 - protein, 18 aa, Cryptosporidium parvum
KFRTAFECFRFGSIYPNS

SEQ ID NO: 2315999 - protein, 21 aa, Cryptosporidium parvum
KFSFNQFIDEIYKNTFKMYFK

SEQ ID NO: 2316000 - protein, 17 aa, Cryptosporidium parvum
KFSIHNGIGFLYKNQSF

SEQ ID NO: 2316001 - protein, 19 aa, Cryptosporidium parvum
KFSILRYFNPVGCHPSSLI

SEQ ID NO: 2316002 - protein, 17 aa, Cryptosporidium parvum
KFSILYYNRFRQNDLVD

SEQ ID NO: 2316003 - protein, 27 aa, Cryptosporidium parvum
KFSKPNKLILYLFEFLTCILEPIKQDG

SEQ ID NO: 2316004 - protein, 31 aa, Cryptosporidium parvum; identical to SEQ ID NO: 2192013

SEQ ID NO: 2316005 - protein, 28 aa, Cryptosporidium parvum
KFSQSHTLFYRFLKFIETHLWTTVIDIS

SEQ ID NO: 2316006 - protein, 26 aa, Cryptosporidium parvum
KFTPYKNLFVIWDYMIKRSYQELGMD

SEQ ID NO: 2316007 - protein, 24 aa, Cryptosporidium parvum
KFVNKDLPICIWLNGEKTVGWNLD

SEQ ID NO: 2316008 - protein, 24 aa, Cryptosporidium parvum
KFVPPLAHNLLKLKKNRIYTNSSD

SEQ ID NO: 2316009 - protein, 17 aa, Cryptosporidium parvum
KFVRKKERRLARKSQLT

SEQ ID NO: 2316010 - protein, 17 aa, Cryptosporidium parvum
KFWADTISRHPVFQDNM

SEQ ID NO: 2316011 - protein, 17 aa, Cryptosporidium parvum
KFYFDRILCDVPCSSDG

SEQ ID NO: 2316012 - protein, 23 aa, Cryptosporidium parvum
KFYLCGLCPHELFENTKLYMGPC

SEQ ID NO: 2316013 - protein, 17 aa, Cryptosporidium parvum
KFYLDPIMDFDINLYNQ

SEQ ID NO: 2316014 - protein, 19 aa, Cryptosporidium parvum
KGAIAIYLEPWHVDVVEFI

SEQ ID NO: 2316015 - protein, 25 aa, Cryptosporidium parvum
KGATKVIFCGPPIYPSIYLDCIQSI

SEQ ID NO: 2316016 - protein, 23 aa, Cryptosporidium parvum
KGDPETCPAFLFVTPEKLKHSKT

SEQ ID NO: 2316017 - protein, 28 aa, Cryptosporidium parvum
KGDPTHWLWDRIIFSNTRQILGGKLKAI

SEQ ID NO: 2316018 - protein, 27 aa, Cryptosporidium parvum
KGDSQVEVFFWTKIKDPRLQAPEGSFM

SEQ ID NO: 2316019 - protein, 23 aa, Cryptosporidium parvum
KGDSYNFYLEKLWNWCILVISDI

SEQ ID NO: 2316020 - protein, 22 aa, Cryptosporidium parvum
KGEFRIVSIYLSSGSILGEIFT

SEQ ID NO: 2316021 - protein, 24 aa, Cryptosporidium parvum
KGEILIFSFQLLDLGEKLEFNLKK

SEQ ID NO: 2316022 - protein, 30 aa, Cryptosporidium parvum; identical to SEQ ID NO: 2192027

SEQ ID NO: 2316023 - protein, 25 aa, Cryptosporidium parvum
KGERNFHIFYQLCSAAKHIISQGSS

SEQ ID NO: 2316024 - protein, 25 aa, Cryptosporidium parvum
KGEVLFASIIGDNILFLPKLSERVV

SEQ ID NO: 2316025 - protein, 21 aa, Cryptosporidium parvum
KGFKDILDLPFFVLTSFLIKK

SEQ ID NO: 2316026 - protein, 25 aa, Cryptosporidium parvum
KGFKRGIFIFTGNDLEFKYLNDMLN

SEQ ID NO: 2316027 - protein, 17 aa, Cryptosporidium parvum
KGFSWLESNPCQFDINQ

SEQ ID NO: 2316028 - protein, 23 aa, Cryptosporidium parvum
KGGACLELLMNPQKLMECLVVIK

SEQ ID NO: 2316029 - protein, 28 aa, Cryptosporidium parvum
KGGIYSIKSIPFTDLFFTGSDDQEIKAW

SEQ ID NO: 2316030 - protein, 24 aa, Cryptosporidium parvum
KGGKYYITLNYSTILAFKVGEEFD

SEQ ID NO: 2316031 - protein, 27 aa, Cryptosporidium parvum
KGGVLRQILKLILKIGNFLNHGTNRGK

SEQ ID NO: 2316032 - protein, 19 aa, Cryptosporidium parvum
KGHFFKLFEDSESPPICTI

SEQ ID NO: 2316033 - protein, 29 aa, Cryptosporidium parvum
KGHIPNQYFIFTSPSLLYASFGLYSAPFK

SEQ ID NO: 2316034 - protein, 29 aa, Cryptosporidium parvum
KGIIFAKDLRDGYWDYGRSKIIFTRRNKS

SEQ ID NO: 2316035 - protein, 31 aa, Cryptosporidium parvum
KGIINKLIYIEKQLPYILLASCKASAIPVKD

SEQ ID NO: 2316036 - protein, 18 aa, Cryptosporidium parvum
KGIIQIWSIPFQNPENEA

SEQ ID NO: 2316037 - protein, 20 aa, Cryptosporidium parvum
KGILQFDMWGVTPDSGLCDW

SEQ ID NO: 2316038 - protein, 17 aa, Cryptosporidium parvum
KGILRMISRNRGEIEVT

SEQ ID NO: 2316039 - protein, 20 aa, Cryptosporidium parvum
KGILSMLWPQENMPFSESGM

SEQ ID NO: 2316040 - protein, 26 aa, Cryptosporidium parvum
KGISKKLMMWLLEQLRNKGSTLVKVK

SEQ ID NO: 2316041 - protein, 18 aa, Cryptosporidium parvum
KGKIPPRKFIPNSKAVIG

SEQ ID NO: 2316042 - protein, 37 aa, Cryptosporidium parvum
KGKKTALLSIPKRDFKRILLLIGDYAIHRFQDYGLQL

SEQ ID NO: 2316043 - protein, 24 aa, Cryptosporidium parvum
KGKNFKPERFIWSSVSDSTALWGF

SEQ ID NO: 2316044 - protein, 34 aa, Cryptosporidium parvum
KGKNKIWLTLEFWGILILLFKHKSLDIYLSIMRI

SEQ ID NO: 2316045 - protein, 23 aa, Cryptosporidium parvum
KGKNLISLPYVVKGMDLSFSGIL

SEQ ID NO: 2316046 - protein, 20 aa, Cryptosporidium parvum
KGKRVVMLKALPSGLVVVTG

SEQ ID NO: 2316047 - protein, 25 aa, Cryptosporidium parvum
KGLEWKVVFIPKFVDKVFPLYRESE

SEQ ID NO: 2316048 - protein, 29 aa, Cryptosporidium parvum
KGLKGNDLTLFLLRKEQLSLFAENENLMS

SEQ ID NO: 2316049 - protein, 28 aa, Cryptosporidium parvum
KGLKLSGYLDLIYFKATAPLLDSKMDTK

SEQ ID NO: 2316050 - protein, 25 aa, Cryptosporidium parvum
KGLQNWIYRLFSTYRSNGTSKEDIE

SEQ ID NO: 2316051 - protein, 20 aa, Cryptosporidium parvum
KGLQSEYPMYVSLAVSVGRL

SEQ ID NO: 2316052 - protein, 26 aa, Cryptosporidium parvum
KGLYDKLFDYIILNLNENIKPPSGFK

SEQ ID NO: 2316053 - protein, 19 aa, Cryptosporidium parvum
KGMCGTSIQWGPWIEQGMA

SEQ ID NO: 2316054 - protein, 17 aa, Cryptosporidium parvum
KGMLGYTRQSLIGGIDA

SEQ ID NO: 2316055 - protein, 21 aa, Cryptosporidium parvum
KGNIHYFLKEYHKALHAYQEG

SEQ ID NO: 2316056 - protein, 23 aa, Cryptosporidium parvum
KGNIYLPAWARIYNDRTKLEPAE

SEQ ID NO: 2316057 - protein, 22 aa, Cryptosporidium parvum
KGNLNDLFYFEPSLYQYRCVPN

SEQ ID NO: 2316058 - protein, 23 aa, Cryptosporidium parvum
KGPFHHRAPSKILFRAVRGMIPH

SEQ ID NO: 2316059 - protein, 25 aa, Cryptosporidium parvum
KGQTKLGRLKFPKNKKKSKKHNIEV

SEQ ID NO: 2316060 - protein, 25 aa, Cryptosporidium parvum
KGRDIHSLSYWYIPNSVKHQYYMNY

SEQ ID NO: 2316061 - protein, 18 aa, Cryptosporidium parvum
KGRFYAFGRVFSGTVATG

SEQ ID NO: 2316062 - protein, 21 aa, Cryptosporidium parvum
KGRIPILSWTNPDLKCTLWRS

SEQ ID NO: 2316063 - protein, 23 aa, Cryptosporidium parvum
KGRKRRLLFPSTVTKKQIRRSFP

SEQ ID NO: 2316064 - protein, 25 aa, Cryptosporidium parvum
KGRNPDLFPCVILNSIYTLNMLRTV

SEQ ID NO: 2316065 - protein, 20 aa, Cryptosporidium parvum
KGSFKYAWVLDKLKAERERG

SEQ ID NO: 2316066 - protein, 18 aa, Cryptosporidium parvum
KGSFLRRVEDETGTFIFI

SEQ ID NO: 2316067 - protein, 25 aa, Cryptosporidium parvum
KGSKGKLLLWFVSGEINMISDDPLL

SEQ ID NO: 2316068 - protein, 22 aa, Cryptosporidium parvum
KGSVFELIDYLDSKYSIALEMI

SEQ ID NO: 2316069 - protein, 18 aa, Cryptosporidium parvum
KGVCYVEFYSVESVLKAL

SEQ ID NO: 2316070 - protein, 18 aa, Cryptosporidium parvum
KGVNIVFEFFPYDLKRYL

SEQ ID NO: 2316071 - protein, 21 aa, Cryptosporidium parvum
KGVQLISYSYLLNTKSDSNSS

SEQ ID NO: 2316072 - protein, 31 aa, Cryptosporidium parvum; identical to SEQ ID NO: 2192073

SEQ ID NO: 2316073 - protein, 20 aa, Cryptosporidium parvum
KGWQLILKRKHIIHNSKVNS

SEQ ID NO: 2316074 - protein, 25 aa, Cryptosporidium parvum
KGYGKLLVDLSYKLSLKEGKWGHPE

SEQ ID NO: 2316075 - protein, 17 aa, Cryptosporidium parvum
KHAIAAIGQPLLMRVYE

SEQ ID NO: 2316076 - protein, 21 aa, Cryptosporidium parvum
KHAYMRNELVFCNKPILEIDH

SEQ ID NO: 2316077 - protein, 18 aa, Cryptosporidium parvum
KHCILQFFGILDLNNSLN

SEQ ID NO: 2316078 - protein, 24 aa, Cryptosporidium parvum
KHDEKPIWSFFIGSQDISIELNEK

SEQ ID NO: 2316079 - protein, 17 aa, Cryptosporidium parvum
KHFLPNTTNMMPSSCIA

SEQ ID NO: 2316080 - protein, 22 aa, Cryptosporidium parvum
KHIEVLLRKYIMEYVACSMCKS

SEQ ID NO: 2316081 - protein, 19 aa, Cryptosporidium parvum
KHIIDLCNKSEYRFLQEWT

SEQ ID NO: 2316082 - protein, 18 aa, Cryptosporidium parvum
KHIILPLRRQVEYRMPYI

SEQ ID NO: 2316083 - protein, 17 aa, Cryptosporidium parvum
KHIPFDINLNRFDTFET

SEQ ID NO: 2316084 - protein, 24 aa, Cryptosporidium parvum
KHISQIVLNLLPVTLRNGYKIPKS

SEQ ID NO: 2316085 - protein, 19 aa, Cryptosporidium parvum
KHLFSWIEYEMALLGNSIH

SEQ ID NO: 2316086 - protein, 25 aa, Cryptosporidium parvum
KHLILYFNLIIFSIKSGKSLSNNNN

SEQ ID NO: 2316087 - protein, 17 aa, Cryptosporidium parvum
KHLIMGLKGLTIRGEIR

SEQ ID NO: 2316088 - protein, 34 aa, Cryptosporidium parvum; identical to SEQ ID NO: 2192092

SEQ ID NO: 2316089 - protein, 19 aa, Cryptosporidium parvum
KHMEREKMYIPPNEKLFLK

SEQ ID NO: 2316090 - protein, 27 aa, Cryptosporidium parvum
KHNCLDATMPFFIQSLRDMTNRIDVLE

SEQ ID NO: 2316091 - protein, 32 aa, Cryptosporidium parvum; identical to SEQ ID NO: 2192095

SEQ ID NO: 2316092 - protein, 22 aa, Cryptosporidium parvum
KHPNCEFIQPQWVFDSMNESIR

SEQ ID NO: 2316093 - protein, 18 aa, Cryptosporidium parvum
KHVVLSQVFLLNQNLMRS

SEQ ID NO: 2316094 - protein, 24 aa, Cryptosporidium parvum
KHWSRLQLWLFLKGCGMKLEEQLS

SEQ ID NO: 2316095 - protein, 22 aa, Cryptosporidium parvum
KHYEDFNTLFLQFEEFSTNKEV

SEQ ID NO: 2316096 - protein, 19 aa, Cryptosporidium parvum
KHYHYSGLKSSKLEKKHRK

SEQ ID NO: 2316097 - protein, 22 aa, Cryptosporidium parvum
KHYLLGLWSHMVIPLLYQGDRA

SEQ ID NO: 2316098 - protein, 24 aa, Cryptosporidium parvum
KIACIDFPLKQYRMQMGIRVELED

SEQ ID NO: 2316099 - protein, 24 aa, Cryptosporidium parvum
KIADFFVTEFYSRLKKDPSTLYEL

SEQ ID NO: 2316100 - protein, 17 aa, Cryptosporidium parvum
KIAELYCNQKRPPPPPP

SEQ ID NO: 2316101 - protein, 18 aa, Cryptosporidium parvum
KIAKIPHYDENILNSMKV

SEQ ID NO: 2316102 - protein, 35 aa, Cryptosporidium parvum
KIALKQSLICRLGYIPLLKLNPPVSLGELSLFGTE

SEQ ID NO: 2316103 - protein, 20 aa, Cryptosporidium parvum
KIALLTCPFEPPKPKTKHKI

SEQ ID NO: 2316104 - protein, 25 aa, Cryptosporidium parvum
KIANNLFNQAFIMSIWNTKNDNFIE

SEQ ID NO: 2316105 - protein, 27 aa, Cryptosporidium parvum
KICTKMLKYLPFGKLPFEPMTSPHQKV

SEQ ID NO: 2316106 - protein, 27 aa, Cryptosporidium parvum
KIDIEETLLIMRPFEPTLLMKPQDVSE

SEQ ID NO: 2316107 - protein, 17 aa, Cryptosporidium parvum
KIDLPCPIPPIMKSKKS

SEQ ID NO: 2316108 - protein, 22 aa, Cryptosporidium parvum
KIDSREELIPSLDFDDLSMIER

SEQ ID NO: 2316109 - protein, 21 aa, Cryptosporidium parvum
KIDTLFNFLRTHSNKKIIVFV

SEQ ID NO: 2316110 - protein, 45 aa, Cryptosporidium parvum
KIEAQIGFLEFIIIPQWKLLSRIIPKSIILLKQAEKNRELWLNQN

SEQ ID NO: 2316111 - protein, 23 aa, Cryptosporidium parvum
KIECINSLYKHWLRKKCNNYLVM

SEQ ID NO: 2316112 - protein, 26 aa, Cryptosporidium parvum
KIEGELKIPPLPDSLYNLITMCLRPN

SEQ ID NO: 2316113 - protein, 21 aa, Cryptosporidium parvum
KIEHIEWVLSIRTEPKNFISE

SEQ ID NO: 2316114 - protein, 17 aa, Cryptosporidium parvum
KIEIQRLTFERKSLREE

SEQ ID NO: 2316115 - protein, 19 aa, Cryptosporidium parvum
KIEKITPSIFFKLIAEQVD

SEQ ID NO: 2316116 - protein, 26 aa, Cryptosporidium parvum
KIESGKKPFFLKQKDINLSIQHDKYK

SEQ ID NO: 2316117 - protein, 21 aa, Cryptosporidium parvum
KIESNIILIYISAPNQDEATS

SEQ ID NO: 2316118 - protein, 23 aa, Cryptosporidium parvum
KIEYRVWNPFRSKLGATIIGGVA

SEQ ID NO: 2316119 - protein, 30 aa, Cryptosporidium parvum
KIFDDHNFVLWKLPILYPTEFLLDKKINTV

SEQ ID NO: 2316120 - protein, 30 aa, Cryptosporidium parvum
KIFELPNNKGNLLDVLFGSSAKMAKNLEKK

SEQ ID NO: 2316121 - protein, 19 aa, Cryptosporidium parvum
KIFKKLSSDADYLLKRTAD

SEQ ID NO: 2316122 - protein, 20 aa, Cryptosporidium parvum
KIFMDYLQDLRTQLIQKIET

SEQ ID NO: 2316123 - protein, 24 aa, Cryptosporidium parvum
KIFNKYGLVVECNIIRDSNGPKGC

SEQ ID NO: 2316124 - protein, 20 aa, Cryptosporidium parvum
KIFVTHFISFLNKNNVLLDE

SEQ ID NO: 2316125 - protein, 22 aa, Cryptosporidium parvum
KIGARLLLPNENEYILSADKTC

SEQ ID NO: 2316126 - protein, 18 aa, Cryptosporidium parvum
KIGLWDFCQCDVARCSGR

SEQ ID NO: 2316127 - protein, 23 aa, Cryptosporidium parvum
KIGNNCIISLKSSLPPNLEICND

SEQ ID NO: 2316128 - protein, 25 aa, Cryptosporidium parvum
KIGSLESELLIIRQQLAFQKQLNSK

SEQ ID NO: 2316129 - protein, 23 aa, Cryptosporidium parvum
KIHVAQMKIGNSFFPFSITVLEE

SEQ ID NO: 2316130 - protein, 18 aa, Cryptosporidium parvum
KIIEFKGIKIQRAINSAN

SEQ ID NO: 2316131 - protein, 18 aa, Cryptosporidium parvum
KIIFTRRNKSGQTTIIEN

SEQ ID NO: 2316132 - protein, 21 aa, Cryptosporidium parvum
KIIGNVYFHDELNDINFELKN

SEQ ID NO: 2316133 - protein, 25 aa, Cryptosporidium parvum
KIIHSAPILIDLYDHLFWYSANNHI

SEQ ID NO: 2316134 - protein, 20 aa, Cryptosporidium parvum
KIIKRFILHSQKTAFVVEHD

SEQ ID NO: 2316135 - protein, 18 aa, Cryptosporidium parvum
KIILNIFCNLTPIQNYLY

SEQ ID NO: 2316136 - protein, 25 aa, Cryptosporidium parvum
KIINQKRIEILTKIFTMLKNQKNIS

SEQ ID NO: 2316137 - protein, 24 aa, Cryptosporidium parvum
KIIRDYFICFNGDFSDLLIKNMEN

SEQ ID NO: 2316138 - protein, 29 aa, Cryptosporidium parvum
KIITQWNNYSIIWRQFILNKSNNNNNNNE

SEQ ID NO: 2316139 - protein, 25 aa, Cryptosporidium parvum
KIIVIFVINIEYFPREDKKLGLVIN

SEQ ID NO: 2316140 - protein, 24 aa, Cryptosporidium parvum
KIIYCKLPDDIASRNVFILDPILG

SEQ ID NO: 2316141 - protein, 25 aa, Cryptosporidium parvum
KIKIGALNLYVWCSIPLSELNYIPE

SEQ ID NO: 2316142 - protein, 31 aa, Cryptosporidium parvum
KIKIRRYIGLMYQITILKIHLSRLLGKVRNK

SEQ ID NO: 2316143 - protein, 29 aa, Cryptosporidium parvum
KIKLKLEDIQVLDLWKLSILIGGGISQIG

SEQ ID NO: 2316144 - protein, 21 aa, Cryptosporidium parvum
KIKNELFERISGYFFGEGRNI

SEQ ID NO: 2316145 - protein, 22 aa, Cryptosporidium parvum
KIKNIIIKFGRDFPIKFRKFEE

SEQ ID NO: 2316146 - protein, 23 aa, Cryptosporidium parvum
KIKPGIIVLVNNCDWEILGGENY

SEQ ID NO: 2316147 - protein, 24 aa, Cryptosporidium parvum
KIKWHPTIPMVLLSCSYDNTIIAW

SEQ ID NO: 2316148 - protein, 25 aa, Cryptosporidium parvum
KIKYNIPDFYLRLDGTTPILERQNM

SEQ ID NO: 2316149 - protein, 18 aa, Cryptosporidium parvum
KILDLPRQISSNISVECR

SEQ ID NO: 2316150 - protein, 20 aa, Cryptosporidium parvum
KILFRAVRGMIPHKTPRGAA

SEQ ID NO: 2316151 - protein, 36 aa, Cryptosporidium parvum
KILGFDPVKCNPSWFINTVIPIPPPAVRPYVQFGSD

SEQ ID NO: 2316152 - protein, 19 aa, Cryptosporidium parvum
KILHHHLLFLCKEGGFKCD

SEQ ID NO: 2316153 - protein, 19 aa, Cryptosporidium parvum
KILILFRHDSFGVVELCWT

SEQ ID NO: 2316154 - protein, 17 aa, Cryptosporidium parvum
KILKAWMDGCECFSRAA

SEQ ID NO: 2316155 - protein, 26 aa, Cryptosporidium parvum
KILNIYKRTCLLLKKILGFGVKNNTT

SEQ ID NO: 2316156 - protein, 19 aa, Cryptosporidium parvum
KILNLRIVKDFQGESRGYA

SEQ ID NO: 2316157 - protein, 37 aa, Cryptosporidium parvum
KILQNQLPRKLLRIATRPFHKIFSISVIKFLRTCLGT

SEQ ID NO: 2316158 - protein, 29 aa, Cryptosporidium parvum
KILSIPIHTPIAEFLYISPREMLTRLKNC

SEQ ID NO: 2316159 - protein, 22 aa, Cryptosporidium parvum
KILTTIIYSIPLLIDILVNLKR

SEQ ID NO: 2316160 - protein, 22 aa, Cryptosporidium parvum
KIMIFSQLIKDCIFGRIFDLRI

SEQ ID NO: 2316161 - protein, 17 aa, Cryptosporidium parvum
KIMRFKKIKELKSSLSL

SEQ ID NO: 2316162 - protein, 24 aa, Cryptosporidium parvum
KINGKIYELFNNSNFIALLEKYDI

SEQ ID NO: 2316163 - protein, 33 aa, Cryptosporidium parvum
KINNLKNLLLPLFQSYPQIFYLISELLELDPNK

SEQ ID NO: 2316164 - protein, 32 aa, Cryptosporidium parvum
KINSIEDKLNELILLFNTKMKSLSNGNNVSFQ

SEQ ID NO: 2316165 - protein, 21 aa, Cryptosporidium parvum
KINSLLDEYYSLHFEDVLDNG

SEQ ID NO: 2316166 - protein, 20 aa, Cryptosporidium parvum
KINSYHYLNGKKNTIANILS

SEQ ID NO: 2316167 - protein, 29 aa, Cryptosporidium parvum
KINTDLIIEKLYTLYSKLTGQIIRGQQNS

SEQ ID NO: 2316168 - protein, 24 aa, Cryptosporidium parvum
KIPELTPPNLFLLSKKGSIGDHVL

SEQ ID NO: 2316169 - protein, 17 aa, Cryptosporidium parvum
KIPLLWVPGTSAGIFKA

SEQ ID NO: 2316170 - protein, 26 aa, Cryptosporidium parvum
KIPNYKTILIGMLPNLIYLDFQKINK

SEQ ID NO: 2316171 - protein, 42 aa, Cryptosporidium parvum; identical to SEQ ID NO: 2192163

SEQ ID NO: 2316172 - protein, 37 aa, Cryptosporidium parvum
KIPSSIYQHLLRCANLFLAKNILFTRVKIAKKVEAGT

SEQ ID NO: 2316173 - protein, 23 aa, Cryptosporidium parvum
KIQAIFCCKLIEGFGMSECIGTL

SEQ ID NO: 2316174 - protein, 36 aa, Cryptosporidium parvum; identical to SEQ ID NO: 2192167

SEQ ID NO: 2316175 - protein, 19 aa, Cryptosporidium parvum
KIQIEQILLYINTGAKYNS

SEQ ID NO: 2316176 - protein, 24 aa, Cryptosporidium parvum
KIQKIIILDLLHEAYLRVAQGLLH

SEQ ID NO: 2316177 - protein, 21 aa, Cryptosporidium parvum
KIQLLFRDCFRVGLQLLDLSG

SEQ ID NO: 2316178 - protein, 25 aa, Cryptosporidium parvum
KIQVQNSILLLNNNNVKYLGGNVES

SEQ ID NO: 2316179 - protein, 25 aa, Cryptosporidium parvum
KIQYEVTALLYDIFQKLKIYIRVCQ

SEQ ID NO: 2316180 - protein, 20 aa, Cryptosporidium parvum
KIRFSIQFIVDIYYGYFSMQ

SEQ ID NO: 2316181 - protein, 17 aa, Cryptosporidium parvum
KIRGFLSGFVEAIDYAL

SEQ ID NO: 2316182 - protein, 23 aa, Cryptosporidium parvum
KIRKSRLILNRHPLVLTINGCIG

SEQ ID NO: 2316183 - protein, 44 aa, Cryptosporidium parvum; identical to SEQ ID NO: 2192177

SEQ ID NO: 2316184 - protein, 19 aa, Cryptosporidium parvum
KIRYVPIPKLENFMASSPS

SEQ ID NO: 2316185 - protein, 34 aa, Cryptosporidium parvum
KISIDILEYVMKICKLYLKILKQAKPTKQEQKIN

SEQ ID NO: 2316186 - protein, 33 aa, Cryptosporidium parvum
KISKFILEHLSNKDWFISSKAIYFDVLIPLFET

SEQ ID NO: 2316187 - protein, 25 aa, Cryptosporidium parvum
KISKHYLLPLILLYSDLKESEAERF

SEQ ID NO: 2316188 - protein, 24 aa, Cryptosporidium parvum
KISKLLIEGKIKEAISSSYGNDEL

SEQ ID NO: 2316189 - protein, 23 aa, Cryptosporidium parvum
KISKLQYWDLKSVLIHKYCINKF

SEQ ID NO: 2316190 - protein, 27 aa, Cryptosporidium parvum
KISLESKLLVLDYWKFMNLKERNQQKI

SEQ ID NO: 2316191 - protein, 26 aa, Cryptosporidium parvum
KISQYCPTIFWNIVRIFHGEIDLGII

SEQ ID NO: 2316192 - protein, 24 aa, Cryptosporidium parvum
KISTQLLDIMPKLKKQLSEEGVMG

SEQ ID NO: 2316193 - protein, 21 aa, Cryptosporidium parvum
KISVKPHLILKRLFGTQANAC

SEQ ID NO: 2316194 - protein, 27 aa, Cryptosporidium parvum
KITCFKLWRFFIYYRKTRNSRFEKITN

SEQ ID NO: 2316195 - protein, 24 aa, Cryptosporidium parvum
KITERIYKQILILLKEGNKDLTDL

SEQ ID NO: 2316196 - protein, 20 aa, Cryptosporidium parvum
KITFNRQVLFITPHSEIVPH

SEQ ID NO: 2316197 - protein, 24 aa, Cryptosporidium parvum
KITYTLLNCLAYHLRYATKVIIGS

SEQ ID NO: 2316198 - protein, 30 aa, Cryptosporidium parvum
KIVAEYAKHVYLHHLKAYRSFNNGNTGGNS

SEQ ID NO: 2316199 - protein, 25 aa, Cryptosporidium parvum
KIVMIDVILLLMNLYMNDFKSALSI

SEQ ID NO: 2316200 - protein, 22 aa, Cryptosporidium parvum
KIWSSDSKCIYIYHGHKNAVRD

SEQ ID NO: 2316201 - protein, 26 aa, Cryptosporidium parvum
KIYDLGALRSPLPWDLGRHSKSTIQV

SEQ ID NO: 2316202 - protein, 20 aa, Cryptosporidium parvum
KIYDLLISNIWDKFLKLGNQ

SEQ ID NO: 2316203 - protein, 25 aa, Cryptosporidium parvum
KIYGNPIPIRVLAERIAMYMHNFTL

SEQ ID NO: 2316204 - protein, 21 aa, Cryptosporidium parvum
KIYTRFPLNQANIVRECNFKE

SEQ ID NO: 2316205 - protein, 24 aa, Cryptosporidium parvum
KKAALLLGSLFIPTREILKSMLIS

SEQ ID NO: 2316206 - protein, 28 aa, Cryptosporidium parvum
KKACEKGFFSVLGLLLRDIDISIGESAS

SEQ ID NO: 2316207 - protein, 24 aa, Cryptosporidium parvum
KKAKPNLLDLLERAQYTPLTKTIH

SEQ ID NO: 2316208 - protein, 20 aa, Cryptosporidium parvum
KKCWWDSCFLGESKLDLSQV

SEQ ID NO: 2316209 - protein, 24 aa, Cryptosporidium parvum
KKDECYCCFWKKNPYKYRMTLPFL

SEQ ID NO: 2316210 - protein, 17 aa, Cryptosporidium parvum
KKDILLNVFYKNQLIHL

SEQ ID NO: 2316211 - protein, 32 aa, Cryptosporidium parvum
KKDLDKFVLDCDLREYFIGESIKFRDGKIVTD

SEQ ID NO: 2316212 - protein, 24 aa, Cryptosporidium parvum
KKDYLRMMIIIYKMNKIYYQINFG

SEQ ID NO: 2316213 - protein, 25 aa, Cryptosporidium parvum
KKEELETNLRYYQDREMYLQHELEL

SEQ ID NO: 2316214 - protein, 25 aa, Cryptosporidium parvum
KKEELLIVRIQLVEKIAVSRQLFVG

SEQ ID NO: 2316215 - protein, 25 aa, Cryptosporidium parvum
KKEFKVIIRFLYTSYLDETDLQTLC

SEQ ID NO: 2316216 - protein, 24 aa, Cryptosporidium parvum
KKEGKFLFKPFAEVARAVGIPAHS

SEQ ID NO: 2316217 - protein, 34 aa, Cryptosporidium parvum
KKERFDCPWFFSTLLTIILFKDKYKNLLKTNEII

SEQ ID NO: 2316218 - protein, 22 aa, Cryptosporidium parvum
KKERKHWRYNLLDTRILGKKHV

SEQ ID NO: 2316219 - protein, 20 aa, Cryptosporidium parvum
KKEVIVYRLITRDTIEEKIF

SEQ ID NO: 2316220 - protein, 22 aa, Cryptosporidium parvum
KKEYMTYIKAYLARIKEAMEKS

SEQ ID NO: 2316221 - protein, 22 aa, Cryptosporidium parvum
KKFDDIINYFKQFTKKISEKDI

SEQ ID NO: 2316222 - protein, 24 aa, Cryptosporidium parvum
KKFDEALGFYLKALGILELEQSLK

SEQ ID NO: 2316223 - protein, 21 aa, Cryptosporidium parvum
KKFDELFGSTRYSKALELITK

SEQ ID NO: 2316224 - protein, 27 aa, Cryptosporidium parvum
KKFNEKYQFPFSRLPPIIDFSFAESRH

SEQ ID NO: 2316225 - protein, 33 aa, Cryptosporidium parvum; identical to SEQ ID NO: 2192217

SEQ ID NO: 2316226 - protein, 24 aa, Cryptosporidium parvum
KKGKKQWILGLDKFQDNNTNKLLI

SEQ ID NO: 2316227 - protein, 17 aa, Cryptosporidium parvum
KKGKLIRVYVIKDKDDL

SEQ ID NO: 2316228 - protein, 29 aa, Cryptosporidium parvum
KKHSKYLGCSIIRKSLYKVRKQIKKNNRY

SEQ ID NO: 2316229 - protein, 20 aa, Cryptosporidium parvum
KKIDLFNYDIVLLPINVNNV

SEQ ID NO: 2316230 - protein, 18 aa, Cryptosporidium parvum
KKIISQENGILVPRSDTN

SEQ ID NO: 2316231 - protein, 23 aa, Cryptosporidium parvum
KKIKFFNKCLQIAPLYPEKCNKR

SEQ ID NO: 2316232 - protein, 31 aa, Cryptosporidium parvum
KKILNIHIIQYLFYRWIRSIKCHSGSIAAST

SEQ ID NO: 2316233 - protein, 20 aa, Cryptosporidium parvum
KKIPGILHSVIYQIFQNINH

SEQ ID NO: 2316234 - protein, 26 aa, Cryptosporidium parvum
KKIRCVSFWVKEWGILFVGSTAFSQM

SEQ ID NO: 2316235 - protein, 25 aa, Cryptosporidium parvum
KKISKLESYLSLCEDLYLGGISKTQ

SEQ ID NO: 2316236 - protein, 19 aa, Cryptosporidium parvum
KKKAPILRRIFGKKGSSNT

SEQ ID NO: 2316237 - protein, 26 aa, Cryptosporidium parvum
KKKFDEAIVKLYWAMTNRMNLLNITE

SEQ ID NO: 2316238 - protein, 25 aa, Cryptosporidium parvum
KKKFLVPMNMLVGEFKYIIHKHITQ

SEQ ID NO: 2316239 - protein, 28 aa, Cryptosporidium parvum
KKKIQKSIDFIYWLLKKKTDFHCSESET

SEQ ID NO: 2316240 - protein, 25 aa, Cryptosporidium parvum
KKKNEYLWPIYRINHLRSRFIYTKY

SEQ ID NO: 2316241 - protein, 30 aa, Cryptosporidium parvum
KKKRKLIILNLILYSPFRIPESFDLRSNEA

SEQ ID NO: 2316242 - protein, 23 aa, Cryptosporidium parvum
KKKSIYLFIQMEYCSGYSLQNAI

SEQ ID NO: 2316243 - protein, 32 aa, Cryptosporidium parvum
KKKTINKIMLPLLPIASYLFPNLQIGSRINNP

SEQ ID NO: 2316244 - protein, 29 aa, Cryptosporidium parvum
KKKYNSQIAAYYRGMLKDLCEGNTPGPKP

SEQ ID NO: 2316245 - protein, 30 aa, Cryptosporidium parvum
KKLEASLLDIYSFISWYIYDYNNEITQKTE

SEQ ID NO: 2316246 - protein, 26 aa, Cryptosporidium parvum
KKLEDELLIHLFSTKLDIVDLIEIAA

SEQ ID NO: 2316247 - protein, 27 aa, Cryptosporidium parvum
KKLERYILNCFLSAIKMLWKEGREQSF

SEQ ID NO: 2316248 - protein, 22 aa, Cryptosporidium parvum
KKLGKGAYGIVWKSIDRRTGEV

SEQ ID NO: 2316249 - protein, 23 aa, Cryptosporidium parvum
KKLGLVINSLLHLTLKNNIGSNS

SEQ ID NO: 2316250 - protein, 23 aa, Cryptosporidium parvum
KKLIHPSLLDLGNFPFICNDLNL

SEQ ID NO: 2316251 - protein, 28 aa, Cryptosporidium parvum
KKLTVGGYNKVSGFFDSISCETLDPERS

SEQ ID NO: 2316252 - protein, 21 aa, Cryptosporidium parvum
KKMFLGLILRNIEILNQFLIN

SEQ ID NO: 2316253 - protein, 23 aa, Cryptosporidium parvum
KKMKDIFRNPLLFVKNLNGQPES

SEQ ID NO: 2316254 - protein, 25 aa, Cryptosporidium parvum
KKMLNEICELLRSPRFCRSTSIIYC

SEQ ID NO: 2316255 - protein, 30 aa, Cryptosporidium parvum
KKMTKHQILAIQYFVPYVIKHSYKLEDDEI

SEQ ID NO: 2316256 - protein, 18 aa, Cryptosporidium parvum
KKMVLHRPIFVDIKPEIK

SEQ ID NO: 2316257 - protein, 24 aa, Cryptosporidium parvum
KKNELLFNSAFFDDDVISEFWTDE

SEQ ID NO: 2316258 - protein, 21 aa, Cryptosporidium parvum
KKNGYFIGRSIQPFAEVFVVK

SEQ ID NO: 2316259 - protein, 22 aa, Cryptosporidium parvum
KKNIIGLKSFLDDFVSHISGSI

SEQ ID NO: 2316260 - protein, 22 aa, Cryptosporidium parvum
KKNIIISIENLYLLLDIDDDEI

SEQ ID NO: 2316261 - protein, 17 aa, Cryptosporidium parvum
KKNILLIKHGRGGVLNI

SEQ ID NO: 2316262 - protein, 23 aa, Cryptosporidium parvum
KKNKIIPMIKFEKKKNMISLTKK

SEQ ID NO: 2316263 - protein, 21 aa, Cryptosporidium parvum
KKNLTNFLYDIIYSRELHSMG

SEQ ID NO: 2316264 - protein, 18 aa, Cryptosporidium parvum
KKNLVTLLRFTCSFDEDT

SEQ ID NO: 2316265 - protein, 32 aa, Cryptosporidium parvum; identical to SEQ ID NO: 2192252

SEQ ID NO: 2316266 - protein, 17 aa, Cryptosporidium parvum
KKNPIKMMKFDSSIRSP

SEQ ID NO: 2316267 - protein, 23 aa, Cryptosporidium parvum
KKNQKGKWRVKLRNGIAQIANQE

SEQ ID NO: 2316268 - protein, 29 aa, Cryptosporidium parvum
KKNTDIFLIAPYLNLPKYFISLLKNRERS

SEQ ID NO: 2316269 - protein, 52 aa, Cryptosporidium parvum
KKNVKIMSGLINLLLLFEKNQRFKKMTFITSLKFNSFFKEMKKKEFNLEQIT

SEQ ID NO: 2316270 - protein, 25 aa, Cryptosporidium parvum
KKPKIPSWFHPSISNLLSKCFERKP

SEQ ID NO: 2316271 - protein, 17 aa, Cryptosporidium parvum
KKPMKTIFYYWNNKTIQ

SEQ ID NO: 2316272 - protein, 22 aa, Cryptosporidium parvum
KKPPKFIPFANKESERKQLNEQ

SEQ ID NO: 2316273 - protein, 27 aa, Cryptosporidium parvum
KKQAQQQALLAALFKGTENIKKVSAED

SEQ ID NO: 2316274 - protein, 34 aa, Cryptosporidium parvum
KKQLYNISFLVYIQNIKLFQEILVSSHGLLSGLK

SEQ ID NO: 2316275 - protein, 24 aa, Cryptosporidium parvum
KKRDYYIQMVPLLVEIFSGNELDG

SEQ ID NO: 2316276 - protein, 24 aa, Cryptosporidium parvum
KKRGKLILIYSIINQTNYPTNCIS

SEQ ID NO: 2316277 - protein, 17 aa, Cryptosporidium parvum
KKRLDLAGPLVAASFGQ

SEQ ID NO: 2316278 - protein, 24 aa, Cryptosporidium parvum
KKRPFYIPVIVGLIGKDSCKEIRQ

SEQ ID NO: 2316279 - protein, 20 aa, Cryptosporidium parvum
KKSAWFLNGMPTNLFNTCFS

SEQ ID NO: 2316280 - protein, 25 aa, Cryptosporidium parvum
KKSENVVCHFFRPSTLRCEIFDRHL

SEQ ID NO: 2316281 - protein, 23 aa, Cryptosporidium parvum
KKSIDLVPKKWQGKGYLGCNIAF

SEQ ID NO: 2316282 - protein, 19 aa, Cryptosporidium parvum
KKSLFQKSKKLKDPYNCLV

SEQ ID NO: 2316283 - protein, 21 aa, Cryptosporidium parvum
KKSPIVGFIRPLSYLERLEKE

SEQ ID NO: 2316284 - protein, 24 aa, Cryptosporidium parvum
KKSRDEYLLLKNNDILLFDKCKEA

SEQ ID NO: 2316285 - protein, 18 aa, Cryptosporidium parvum
KKSWRPIHNLSGGEKTLS

SEQ ID NO: 2316286 - protein, 24 aa, Cryptosporidium parvum
KKTKLTLFGIKLFNSFQLIYHHHK

SEQ ID NO: 2316287 - protein, 18 aa, Cryptosporidium parvum
KKVDILSYYSSLNSKGQT

SEQ ID NO: 2316288 - protein, 23 aa, Cryptosporidium parvum
KKYDLEAWFPGYNSYRELVSCSN

SEQ ID NO: 2316289 - protein, 32 aa, Cryptosporidium parvum; identical to SEQ ID NO: 2192279

SEQ ID NO: 2316290 - protein, 26 aa, Cryptosporidium parvum
KKYKLRSYISILRYITMMIENCASIE

SEQ ID NO: 2316291 - protein, 27 aa, Cryptosporidium parvum
KKYKPQTLLCLIYQLLLNKKQRKSLSK

SEQ ID NO: 2316292 - protein, 24 aa, Cryptosporidium parvum
KKYLVKYIILHFIEKVSLGSDDQL

SEQ ID NO: 2316293 - protein, 21 aa, Cryptosporidium parvum
KKYMVKFPIINYKKIINLSRL

SEQ ID NO: 2316294 - protein, 38 aa, Cryptosporidium parvum
KLANTSFFDKLALDTLFFIFYFQQGTFQQFLSIQELKR

SEQ ID NO: 2316295 - protein, 22 aa, Cryptosporidium parvum
KLAYNTPLMDFLKNLNQQNSTE

SEQ ID NO: 2316296 - protein, 18 aa, Cryptosporidium parvum
KLCGQIIIKFPKLRVLLD

SEQ ID NO: 2316297 - protein, 25 aa, Cryptosporidium parvum
KLCKSQLYSYSWYCYNHLITTLDQF

SEQ ID NO: 2316298 - protein, 21 aa, Cryptosporidium parvum
KLCLKLLNLPYHPNVMKIYQV

SEQ ID NO: 2316299 - protein, 22 aa, Cryptosporidium parvum
KLCNQCLNLLRQNKISSKNAFD

SEQ ID NO: 2316300 - protein, 19 aa, Cryptosporidium parvum
KLCNQLPPTGLISSLNEDS

SEQ ID NO: 2316301 - protein, 20 aa, Cryptosporidium parvum
KLCNRMYKNELDSFSGIGIV

SEQ ID NO: 2316302 - protein, 30 aa, Cryptosporidium parvum; identical to SEQ ID NO: 2192288

SEQ ID NO: 2316303 - protein, 25 aa, Cryptosporidium parvum
KLDDEFIHLLFQFSEIIILDNSSSK

SEQ ID NO: 2316304 - protein, 23 aa, Cryptosporidium parvum
KLDDLINFKLDIPFNLKKVFLNE

SEQ ID NO: 2316305 - protein, 21 aa, Cryptosporidium parvum
KLDEALTYRIESAITAEREIN

SEQ ID NO: 2316306 - protein, 29 aa, Cryptosporidium parvum
KLDKAVSMIQPLLDPFHPLHEEYKRDGLQ

SEQ ID NO: 2316307 - protein, 26 aa, Cryptosporidium parvum
KLDPNELLNVFQWKKLKDPETGRIIR

SEQ ID NO: 2316308 - protein, 24 aa, Cryptosporidium parvum
KLDSIGALLFDWIRRIPKSQVLEL

SEQ ID NO: 2316309 - protein, 21 aa, Cryptosporidium parvum
KLDYVLGLTISKFLERRLQTR

SEQ ID NO: 2316310 - protein, 22 aa, Cryptosporidium parvum
KLEAAPPKITLPELHILNKRIE

SEQ ID NO: 2316311 - protein, 25 aa, Cryptosporidium parvum
KLEAFFSSLFEFFLKHLLFCQQKKS

SEQ ID NO: 2316312 - protein, 24 aa, Cryptosporidium parvum
KLECSVHWMYRSERGWMPFSERNN

SEQ ID NO: 2316313 - protein, 23 aa, Cryptosporidium parvum
KLEEKKREFMLASEKFEEYEREN

SEQ ID NO: 2316314 - protein, 20 aa, Cryptosporidium parvum
KLEEQLSLWKSLWTDANSFD

SEQ ID NO: 2316315 - protein, 27 aa, Cryptosporidium parvum
KLEFEKVYCPFLLMNKKRYAGVLFKNP

SEQ ID NO: 2316316 - protein, 25 aa, Cryptosporidium parvum
KLEGSKMLIYEILRDVFVEDENLVG

SEQ ID NO: 2316317 - protein, 23 aa, Cryptosporidium parvum
KLEGWSVFQLPKYMPESKKNYCE

SEQ ID NO: 2316318 - protein, 18 aa, Cryptosporidium parvum
KLELLDNGSNYSKTQSFN

SEQ ID NO: 2316319 - protein, 26 aa, Cryptosporidium parvum
KLELLFLGIRTGFFWNDLNLISKYIK

SEQ ID NO: 2316320 - protein, 24 aa, Cryptosporidium parvum
KLETFIFDSFAFTNIPVHCINVSR

SEQ ID NO: 2316321 - protein, 21 aa, Cryptosporidium parvum
KLEVASLFTSRRPVLSCFACG

SEQ ID NO: 2316322 - protein, 32 aa, Cryptosporidium parvum
KLEYSECLVIILGYDFLFEKSPILFYQNEELI

SEQ ID NO: 2316323 - protein, 26 aa, Cryptosporidium parvum
KLEYSQNLLFPMFLNRDFVDQASKLI

SEQ ID NO: 2316324 - protein, 27 aa, Cryptosporidium parvum
KLFCTFPLNHRIYLPFHVNIQDLILTA

SEQ ID NO: 2316325 - protein, 34 aa, Cryptosporidium parvum
KLFEEVFVNLFSWKFLTFIRIWSLSISNISQLYP

SEQ ID NO: 2316326 - protein, 17 aa, Cryptosporidium parvum
KLFKSRSFPIKDFRGTA

SEQ ID NO: 2316327 - protein, 25 aa, Cryptosporidium parvum
KLFQLNDFFFFTRLAKTKITSKDTR

SEQ ID NO: 2316328 - protein, 26 aa, Cryptosporidium parvum
KLGKLSNNFLEKIKLIYPSLEIVKVS

SEQ ID NO: 2316329 - protein, 17 aa, Cryptosporidium parvum
KLGLILPKPNQFVSTDF

SEQ ID NO: 2316330 - protein, 17 aa, Cryptosporidium parvum
KLGNNFLYTLYSLILKD

SEQ ID NO: 2316331 - protein, 26 aa, Cryptosporidium parvum
KLGYYCWFGGKCSCGYWQTPSFQIHK

SEQ ID NO: 2316332 - protein, 25 aa, Cryptosporidium parvum
KLHGIYIAFRHNSAICRVIQQHIHK

SEQ ID NO: 2316333 - protein, 19 aa, Cryptosporidium parvum
KLIDFGLAARFKPGKMMRT

SEQ ID NO: 2316334 - protein, 20 aa, Cryptosporidium parvum
KLIDHLSINIGKISFEGLKN

SEQ ID NO: 2316335 - protein, 23 aa, Cryptosporidium parvum
KLIEYHILRLFEKVIDFNSFSRC

SEQ ID NO: 2316336 - protein, 18 aa, Cryptosporidium parvum
KLILNWLEDGVFDALEKQ

SEQ ID NO: 2316337 - protein, 21 aa, Cryptosporidium parvum
KLIMEYRGNFPKRLLNQGVFT

SEQ ID NO: 2316338 - protein, 26 aa, Cryptosporidium parvum
KLINEGWSVELIFKGLAEFIIMCDKI

SEQ ID NO: 2316339 - protein, 34 aa, Cryptosporidium parvum; identical to SEQ ID NO: 2192315

SEQ ID NO: 2316340 - protein, 23 aa, Cryptosporidium parvum
KLISVFYYRKIFADIMHPELWTS

SEQ ID NO: 2316341 - protein, 34 aa, Cryptosporidium parvum
KLIVQTIGIWSYLPVNLIPTTTLPPKFIVVPMNP

SEQ ID NO: 2316342 - protein, 26 aa, Cryptosporidium parvum
KLIYDRHYNINYLKLEFGPEIKEIIS

SEQ ID NO: 2316343 - protein, 17 aa, Cryptosporidium parvum
KLKCPVVMIGQRSILPR

SEQ ID NO: 2316344 - protein, 24 aa, Cryptosporidium parvum
KLKGKISRILAAKLSLCIRVDALN

SEQ ID NO: 2316345 - protein, 17 aa, Cryptosporidium parvum
KLKIEYLKTLGKPSIKI

SEQ ID NO: 2316346 - protein, 23 aa, Cryptosporidium parvum
KLKKYLGEYFIKKQEELASNHAT

SEQ ID NO: 2316347 - protein, 17 aa, Cryptosporidium parvum
KLKLHIVELNDTFQKRW

SEQ ID NO: 2316348 - protein, 27 aa, Cryptosporidium parvum
KLKNNNILNIPILLISAGSNISGRLND

SEQ ID NO: 2316349 - protein, 32 aa, Cryptosporidium parvum
KLKNRFWTEIYNGAKLFYLSGIHNGFYNKTEI

SEQ ID NO: 2316350 - protein, 17 aa, Cryptosporidium parvum
KLKPCYLCYSSSTISNQ

SEQ ID NO: 2316351 - protein, 17 aa, Cryptosporidium parvum
KLKPRHVPDFVLISPED

SEQ ID NO: 2316352 - protein, 19 aa, Cryptosporidium parvum
KLKQFWSEYPEKLNKKIEF

SEQ ID NO: 2316353 - protein, 19 aa, Cryptosporidium parvum
KLKQKECLDYSSKIQQIEL

SEQ ID NO: 2316354 - protein, 27 aa, Cryptosporidium parvum
KLKQQLQLHTLLISELRKYHTEIEDLK

SEQ ID NO: 2316355 - protein, 29 aa, Cryptosporidium parvum
KLKRNILECLIPVKFRLGFIPNISLLKKY

SEQ ID NO: 2316356 - protein, 25 aa, Cryptosporidium parvum
KLKSRITALKSLIGYLIKLDSKKKF

SEQ ID NO: 2316357 - protein, 20 aa, Cryptosporidium parvum
KLKTFLLNPQQTMTGLNKVP

SEQ ID NO: 2316358 - protein, 17 aa, Cryptosporidium parvum
KLLAFKEVNLDFIPYDS

SEQ ID NO: 2316359 - protein, 25 aa, Cryptosporidium parvum
KLLDSETRMFLVLKDYFGHSKKVFR

SEQ ID NO: 2316360 - protein, 17 aa, Cryptosporidium parvum
KLLGCDFCTYSYHPKCI

SEQ ID NO: 2316361 - protein, 20 aa, Cryptosporidium parvum
KLLHSTLSSLKIVSKILGDL

SEQ ID NO: 2316362 - protein, 24 aa, Cryptosporidium parvum
KLLKDKFHFIFSIETTGCIPPVEL

SEQ ID NO: 2316363 - protein, 18 aa, Cryptosporidium parvum
KLLLKRIRETRSSRENEI

SEQ ID NO: 2316364 - protein, 22 aa, Cryptosporidium parvum
KLLLLKRRCINYFSFGEESRVG

SEQ ID NO: 2316365 - protein, 20 aa, Cryptosporidium parvum
KLLPSDFTPKLVGGIDTLKR

SEQ ID NO: 2316366 - protein, 20 aa, Cryptosporidium parvum
KLLRESFLEIWRNSIKLSTD

SEQ ID NO: 2316367 - protein, 17 aa, Cryptosporidium parvum
KLLSGLWVSNLIAMHSR

SEQ ID NO: 2316368 - protein, 24 aa, Cryptosporidium parvum
KLLSSLLVELLFQTSVKVINLIGP

SEQ ID NO: 2316369 - protein, 19 aa, Cryptosporidium parvum
KLLVSRLISKLAPNYKILV

SEQ ID NO: 2316370 - protein, 18 aa, Cryptosporidium parvum
KLMSFSGIPFSTLQAILF

SEQ ID NO: 2316371 - protein, 29 aa, Cryptosporidium parvum
KLNDPYRPLFSNYLFMEYINGVPLDNLLY

SEQ ID NO: 2316372 - protein, 18 aa, Cryptosporidium parvum
KLNFAFKGGDKSLEDHSQ

SEQ ID NO: 2316373 - protein, 21 aa, Cryptosporidium parvum
KLNFCCFTGYYYCDYCYGSNT

SEQ ID NO: 2316374 - protein, 23 aa, Cryptosporidium parvum
KLNKQIFEVIYYAALDASCELAE

SEQ ID NO: 2316375 - protein, 25 aa, Cryptosporidium parvum
KLNLVVSFLLSCDYADIISNKLIRS

SEQ ID NO: 2316376 - protein, 27 aa, Cryptosporidium parvum
KLNMDLESLFYYFSNNSVYLKCKQFAS

SEQ ID NO: 2316377 - protein, 17 aa, Cryptosporidium parvum
KLNYHYYQALKKAMFKP

SEQ ID NO: 2316378 - protein, 21 aa, Cryptosporidium parvum
KLPFDFSDPWKMKLINKRGRK

SEQ ID NO: 2316379 - protein, 17 aa, Cryptosporidium parvum
KLPFEPMTSPHQKVFIL

SEQ ID NO: 2316380 - protein, 17 aa, Cryptosporidium parvum
KLPFNQFKWMESHLYHS

SEQ ID NO: 2316381 - protein, 21 aa, Cryptosporidium parvum
KLPIIYQCYGDFYYYHYNHDN

SEQ ID NO: 2316382 - protein, 17 aa, Cryptosporidium parvum
KLPQFYSDPYLLPHVIV

SEQ ID NO: 2316383 - protein, 17 aa, Cryptosporidium parvum
KLPWKHITSLLGEESSI

SEQ ID NO: 2316384 - protein, 30 aa, Cryptosporidium parvum
KLQNIIINSLGMLSHWCVCEPEYLDPKCTK

SEQ ID NO: 2316385 - protein, 31 aa, Cryptosporidium parvum
KLQREKLLMRLYMKLVIKQLVEPAFDVVRMF

SEQ ID NO: 2316386 - protein, 21 aa, Cryptosporidium parvum
KLQSAWIHYKKKRLVILLRIY

SEQ ID NO: 2316387 - protein, 20 aa, Cryptosporidium parvum
KLQWKYLDETISKMKNTLAT

SEQ ID NO: 2316388 - protein, 23 aa, Cryptosporidium parvum
KLQYKTYLILENLLKPCFNHEEL

SEQ ID NO: 2316389 - protein, 23 aa, Cryptosporidium parvum
KLREQLFMMGFELQNQNIEKDQK

SEQ ID NO: 2316390 - protein, 21 aa, Cryptosporidium parvum
KLREYMIRAIYIEMLGHDASF

SEQ ID NO: 2316391 - protein, 18 aa, Cryptosporidium parvum
KLRKLRDYRLNDIDIKRS

SEQ ID NO: 2316392 - protein, 28 aa, Cryptosporidium parvum
KLRNEEIKTYWSIRVAYDTLTQERDSLL

SEQ ID NO: 2316393 - protein, 20 aa, Cryptosporidium parvum
KLSKIPGSRWFLQPVDPELD

SEQ ID NO: 2316394 - protein, 18 aa, Cryptosporidium parvum
KLSLGVDGRKLLLKRIRE

SEQ ID NO: 2316395 - protein, 22 aa, Cryptosporidium parvum
KLSLREKPVYRILACYNSIVFG

SEQ ID NO: 2316396 - protein, 19 aa, Cryptosporidium parvum
KLSMSIDGEWLILGSQDGS

SEQ ID NO: 2316397 - protein, 26 aa, Cryptosporidium parvum
KLSNNSIFWHLFDLGIGSDECCNICN

SEQ ID NO: 2316398 - protein, 40 aa, Cryptosporidium parvum
KLSQLELILEGFYQLFKVKFIHQFYFLLGTENLKICISDE

SEQ ID NO: 2316399 - protein, 25 aa, Cryptosporidium parvum
KLSRDSLFLHFMEKPNLSSNFGTKY

SEQ ID NO: 2316400 - protein, 29 aa, Cryptosporidium parvum
KLSSLFLELPSYFPAMYVPRAYVNNVKVI

SEQ ID NO: 2316401 - protein, 21 aa, Cryptosporidium parvum
KLSVERLLTFDDPDYDYLRLL

SEQ ID NO: 2316402 - protein, 19 aa, Cryptosporidium parvum
KLSVRYFLNLIIVDEEDRR

SEQ ID NO: 2316403 - protein, 23 aa, Cryptosporidium parvum
KLTEINWPETHGWWLYCCHNGWL

SEQ ID NO: 2316404 - protein, 24 aa, Cryptosporidium parvum
KLTELQDLFKSCGSINRITIMNDK

SEQ ID NO: 2316405 - protein, 33 aa, Cryptosporidium parvum
KLTINNNIILRMDILWIGDLNGKLPEFLKRTVL

SEQ ID NO: 2316406 - protein, 35 aa, Cryptosporidium parvum
KLTQSLYLCLDLLFESSFFLCKINHTILNNLLIYE

SEQ ID NO: 2316407 - protein, 18 aa, Cryptosporidium parvum
KLVLIGDSGVGKSCLLLR

SEQ ID NO: 2316408 - protein, 28 aa, Cryptosporidium parvum
KLVNKFCRLFSGMPFELPPLPYDKKALE

SEQ ID NO: 2316409 - protein, 23 aa, Cryptosporidium parvum
KLVNKIIPCFIDGRHFVSINKIR

SEQ ID NO: 2316410 - protein, 26 aa, Cryptosporidium parvum
KLVPTTSMLYFILNPSLIGVMVLHDI

SEQ ID NO: 2316411 - protein, 20 aa, Cryptosporidium parvum
KLVREWIYEASLEHSMNEEE

SEQ ID NO: 2316412 - protein, 19 aa, Cryptosporidium parvum
KLVRGKPLYVGLHERKEQR

SEQ ID NO: 2316413 - protein, 28 aa, Cryptosporidium parvum
KLVVTRYELLSFWYTISSLYSFQGKPML

SEQ ID NO: 2316414 - protein, 20 aa, Cryptosporidium parvum
KLVYYEALFNKLENDVVLRC

SEQ ID NO: 2316415 - protein, 17 aa, Cryptosporidium parvum
KLWDYLYGTEIDSINLE

SEQ ID NO: 2316416 - protein, 19 aa, Cryptosporidium parvum
KLYIQIFSSLRRHSKEEQG

SEQ ID NO: 2316417 - protein, 49 aa, Cryptosporidium parvum
KLYIRRVCLIQSTFRMYLQRRYFIRLSGSVLKAQILWRGKLARRQFQKL

SEQ ID NO: 2316418 - protein, 18 aa, Cryptosporidium parvum
KLYQIEYTFRAVKNSNIT

SEQ ID NO: 2316419 - protein, 18 aa, Cryptosporidium parvum
KLYTLKNQQLIVSSENYE

SEQ ID NO: 2316420 - protein, 25 aa, Cryptosporidium parvum
KLYVASCYYFGDISTFLPIGAKSIQ

SEQ ID NO: 2316421 - protein, 24 aa, Cryptosporidium parvum
KMAIKNLVFGMIREVYRAHGAVEI

SEQ ID NO: 2316422 - protein, 22 aa, Cryptosporidium parvum
KMCLIHSIRLLDPIRRLKVVNI

SEQ ID NO: 2316423 - protein, 18 aa, Cryptosporidium parvum
KMCTLSNKLVEMLCKCVI

SEQ ID NO: 2316424 - protein, 17 aa, Cryptosporidium parvum
KMDCIYFVTNEKRNLER

SEQ ID NO: 2316425 - protein, 17 aa, Cryptosporidium parvum
KMDLLKQEQKIKAVELK

SEQ ID NO: 2316426 - protein, 17 aa, Cryptosporidium parvum
KMFNKTQGEKALEMNRE

SEQ ID NO: 2316427 - protein, 24 aa, Cryptosporidium parvum
KMKMWPSFDHIFKAARRDNKWYLR

SEQ ID NO: 2316428 - protein, 17 aa, Cryptosporidium parvum
KMKYYQWISNNSSAKHI

SEQ ID NO: 2316429 - protein, 30 aa, Cryptosporidium parvum
KMLAKYIFKEYPRFLTQYFKIRKEWKEYNR

SEQ ID NO: 2316430 - protein, 19 aa, Cryptosporidium parvum
KMLFESVAVLPLIDQWVKG

SEQ ID NO: 2316431 - protein, 18 aa, Cryptosporidium parvum
KMLMNKFSLILNNYKLQE

SEQ ID NO: 2316432 - protein, 18 aa, Cryptosporidium parvum
KMLVQRHANQIRVCQSYK

SEQ ID NO: 2316433 - protein, 21 aa, Cryptosporidium parvum
KMMQRLWGDNFFNPETKKFTK

SEQ ID NO: 2316434 - protein, 21 aa, Cryptosporidium parvum
KMNALIMKIQKHEFDLSGKFQ

SEQ ID NO: 2316435 - protein, 24 aa, Cryptosporidium parvum
KMNKILCEQLILNQLLQQVEWSEG

SEQ ID NO: 2316436 - protein, 23 aa, Cryptosporidium parvum
KMNYRALLRIKKIVELRKLDQAQ

SEQ ID NO: 2316437 - protein, 23 aa, Cryptosporidium parvum
KMRNWEARILSYLSPHPNIVQCL

SEQ ID NO: 2316438 - protein, 20 aa, Cryptosporidium parvum
KMRQRFWELQNSKIGALISS

SEQ ID NO: 2316439 - protein, 30 aa, Cryptosporidium parvum; identical to SEQ ID NO: 2192397

SEQ ID NO: 2316440 - protein, 33 aa, Cryptosporidium parvum
KMSKNYFDKLNSGGLHSAIPFSSNIGINLLQKM

SEQ ID NO: 2316441 - protein, 25 aa, Cryptosporidium parvum
KMSLPYWVLECLFSLNQKSLIMLRR

SEQ ID NO: 2316442 - protein, 24 aa, Cryptosporidium parvum
KMSQDWNQVVWKKGGSRPKGISKE

SEQ ID NO: 2316443 - protein, 27 aa, Cryptosporidium parvum
KMSQYSALETMRKLYYATQEYMEKWPS

SEQ ID NO: 2316444 - protein, 17 aa, Cryptosporidium parvum
KMVLELCKGGDLYQYVL

SEQ ID NO: 2316445 - protein, 19 aa, Cryptosporidium parvum
KMWQVSESVSKFLFSAKSK

SEQ ID NO: 2316446 - protein, 17 aa, Cryptosporidium parvum
KMYLTLGRIQRIINQLL

SEQ ID NO: 2316447 - protein, 20 aa, Cryptosporidium parvum
KNAFDILLIDHLNDIVNVQD

SEQ ID NO: 2316448 - protein, 24 aa, Cryptosporidium parvum
KNAPFHRLVACISPIPPPSVLSSS

SEQ ID NO: 2316449 - protein, 19 aa, Cryptosporidium parvum
KNAQIFIAVNRNGQIRIFM

SEQ ID NO: 2316450 - protein, 23 aa, Cryptosporidium parvum
KNCAMTILPTMNGGVIGEIPNGD

SEQ ID NO: 2316451 - protein, 19 aa, Cryptosporidium parvum
KNDFAFEYIHLDDTPIVIN

SEQ ID NO: 2316452 - protein, 17 aa, Cryptosporidium parvum
KNDHIFSFDWFIKTRSS

SEQ ID NO: 2316453 - protein, 23 aa, Cryptosporidium parvum
KNDSIIWSPFFFEGNELSVLDSI

SEQ ID NO: 2316454 - protein, 24 aa, Cryptosporidium parvum
KNDSRNMYLLIHGSGKEAESAVLS

SEQ ID NO: 2316455 - protein, 23 aa, Cryptosporidium parvum
KNDVRIYLDFEWLTILRSVKANI

SEQ ID NO: 2316456 - protein, 24 aa, Cryptosporidium parvum
KNEENLTLDLLLFEETQSYEERYL

SEQ ID NO: 2316457 - protein, 39 aa, Cryptosporidium parvum
KNEIWTVQQLSFVFLRTKKLIPATQLPLLAKRLTTCARN

SEQ ID NO: 2316458 - protein, 26 aa, Cryptosporidium parvum
KNEKSQFLIKFQSLAIRSMKKSKRIS

SEQ ID NO: 2316459 - protein, 20 aa, Cryptosporidium parvum
KNEPKNLPPIPFIENPIERK

SEQ ID NO: 2316460 - protein, 20 aa, Cryptosporidium parvum
KNFFSKYFGIKKHSYNSILK

SEQ ID NO: 2316461 - protein, 21 aa, Cryptosporidium parvum
KNFLRLMCLLDRSTPHTTTSP

SEQ ID NO: 2316462 - protein, 20 aa, Cryptosporidium parvum
KNGILIKPLISQGESFISGN

SEQ ID NO: 2316463 - protein, 17 aa, Cryptosporidium parvum
KNGLFEILSRCDPENST

SEQ ID NO: 2316464 - protein, 27 aa, Cryptosporidium parvum
KNHFPNSQFIIVSLKEGMFNKADVLFK

SEQ ID NO: 2316465 - protein, 27 aa, Cryptosporidium parvum
KNHPPHLSIVILLKFITTVIPSIELDN

SEQ ID NO: 2316466 - protein, 28 aa, Cryptosporidium parvum
KNIESISAIFFLRNLKRLSLVNNPITKI

SEQ ID NO: 2316467 - protein, 30 aa, Cryptosporidium parvum
KNIFPDSFFILRLLIPPLFGKKSFDQFSES

SEQ ID NO: 2316468 - protein, 20 aa, Cryptosporidium parvum
KNIICMALLSSKLAIERVFS

SEQ ID NO: 2316469 - protein, 36 aa, Cryptosporidium parvum
KNIIDSLAKDYVRLLKYADSPYKCKMLKRAALGRMC

SEQ ID NO: 2316470 - protein, 23 aa, Cryptosporidium parvum
KNIIIHPIVLLSIVDHYNRIAKG

SEQ ID NO: 2316471 - protein, 23 aa, Cryptosporidium parvum
KNIIKPFPIQMQSIPILMSGYDM

SEQ ID NO: 2316472 - protein, 17 aa, Cryptosporidium parvum
KNILLLSEKFAPSYNWY

SEQ ID NO: 2316473 - protein, 20 aa, Cryptosporidium parvum
KNILLNDEIWELNRIIKSNN

SEQ ID NO: 2316474 - protein, 20 aa, Cryptosporidium parvum
KNILSCYKLACIVQHNHISA

SEQ ID NO: 2316475 - protein, 19 aa, Cryptosporidium parvum
KNIQNPLIAPKSSLKLDPT

SEQ ID NO: 2316476 - protein, 18 aa, Cryptosporidium parvum
KNIYLLEISAHSLFSKWF

SEQ ID NO: 2316477 - protein, 26 aa, Cryptosporidium parvum
KNKDFNNKLYIDLPTIFVEGETDINR

SEQ ID NO: 2316478 - protein, 30 aa, Cryptosporidium parvum
KNKFESHNFIYHIIKLLGYGYYGTVFLAKM

SEQ ID NO: 2316479 - protein, 21 aa, Cryptosporidium parvum
KNKKLIKGALLPYYTTEEQED

SEQ ID NO: 2316480 - protein, 29 aa, Cryptosporidium parvum
KNKKNYLDQLKSINKKRKIAFCLDNDLDT

SEQ ID NO: 2316481 - protein, 19 aa, Cryptosporidium parvum
KNKLYLPLYSKFVDENSFI

SEQ ID NO: 2316482 - protein, 17 aa, Cryptosporidium parvum
KNKNSLRKAIYIHSLYD

SEQ ID NO: 2316483 - protein, 37 aa, Cryptosporidium parvum
KNKTGTILIPMQLDSLLLEILCYLDAIWNKGKILYPI

SEQ ID NO: 2316484 - protein, 20 aa, Cryptosporidium parvum
KNLDLLKKGLILPGMKEAEG

SEQ ID NO: 2316485 - protein, 23 aa, Cryptosporidium parvum
KNLDLYSLPPDMLKTERFSNISN

SEQ ID NO: 2316486 - protein, 27 aa, Cryptosporidium parvum
KNLFSYTFRENFESLPLFSSINGIFEF

SEQ ID NO: 2316487 - protein, 20 aa, Cryptosporidium parvum
KNLIQKIGKLKLENANLSMR

SEQ ID NO: 2316488 - protein, 31 aa, Cryptosporidium parvum
KNLKMPNYFSSKLFIRNLPKVSINNLSSKPI

SEQ ID NO: 2316489 - protein, 21 aa, Cryptosporidium parvum
KNLKNYFMYYGQTGIYSSCFE

SEQ ID NO: 2316490 - protein, 28 aa, Cryptosporidium parvum
KNLLEQKMLLNLHKPTWSEPLRCDKEEN

SEQ ID NO: 2316491 - protein, 23 aa, Cryptosporidium parvum
KNLLRLSRNHAYLYVKKNNKGKD

SEQ ID NO: 2316492 - protein, 33 aa, Cryptosporidium parvum
KNLNLKTPIILTPFEYQVFLGITEWSTRYLNTP

SEQ ID NO: 2316493 - protein, 20 aa, Cryptosporidium parvum
KNLNVWKSTKIFPKFKCLIN

SEQ ID NO: 2316494 - protein, 19 aa, Cryptosporidium parvum
KNLPIYPMRDSLVDAIRNN

SEQ ID NO: 2316495 - protein, 30 aa, Cryptosporidium parvum
KNLPSIYLKCEILFIITAYIRELSTFEKVI

SEQ ID NO: 2316496 - protein, 20 aa, Cryptosporidium parvum
KNLREVDLLYVLCGKGSSRE

SEQ ID NO: 2316497 - protein, 23 aa, Cryptosporidium parvum
KNLRQRIVCFVGSPLEDDLTEKQ

SEQ ID NO: 2316498 - protein, 23 aa, Cryptosporidium parvum
KNLSIVWTIWKPIKYCAVENIIP

SEQ ID NO: 2316499 - protein, 27 aa, Cryptosporidium parvum
KNLTTNMILMLLERILQLLKTFEYILN

SEQ ID NO: 2316500 - protein, 26 aa, Cryptosporidium parvum
KNLVSKLTKVLFKHIRTFLPDIRREI

SEQ ID NO: 2316501 - protein, 21 aa, Cryptosporidium parvum
KNMKALILSSFNNAFCSESEF

SEQ ID NO: 2316502 - protein, 23 aa, Cryptosporidium parvum
KNMKNLLKNILHYEIQSRRSAQN

SEQ ID NO: 2316503 - protein, 26 aa, Cryptosporidium parvum
KNNCLDIFQFLLKHLQDISLQNYKFN

SEQ ID NO: 2316504 - protein, 25 aa, Cryptosporidium parvum
KNNIKTVLLFLIDFVKRLYNQHIGE

SEQ ID NO: 2316505 - protein, 30 aa, Cryptosporidium parvum
KNNKKIHIIVDRTYPKFLKSWELNTIKSQL

SEQ ID NO: 2316506 - protein, 27 aa, Cryptosporidium parvum
KNNNSLVSCLWFYEVEERKSIEASLKQ

SEQ ID NO: 2316507 - protein, 17 aa, Cryptosporidium parvum
KNNQACKYPIYNILYKL

SEQ ID NO: 2316508 - protein, 23 aa, Cryptosporidium parvum
KNNRLYIDEIDYFNSVFSECDGN

SEQ ID NO: 2316509 - protein, 24 aa, Cryptosporidium parvum
KNNRVKLPGYLDLPARLSKNLDKG

SEQ ID NO: 2316510 - protein, 22 aa, Cryptosporidium parvum
KNNRYLRLLKINNGNHLLTNSK

SEQ ID NO: 2316511 - protein, 27 aa, Cryptosporidium parvum
KNNTFKTTPIPLLSPRVFIHDNIVLDK

SEQ ID NO: 2316512 - protein, 17 aa, Cryptosporidium parvum
KNNTRLTFFRYIQILDK

SEQ ID NO: 2316513 - protein, 23 aa, Cryptosporidium parvum
KNNVKVIWFNPISQIFKDTFLFR

SEQ ID NO: 2316514 - protein, 26 aa, Cryptosporidium parvum
KNPIKNIMVYLWIGSKTTYFNQAKQI

SEQ ID NO: 2316515 - protein, 21 aa, Cryptosporidium parvum
KNPLDAYSLLNSHEFYKSITL

SEQ ID NO: 2316516 - protein, 34 aa, Cryptosporidium parvum
KNPSLDFCLGFGALLPNFINKSIFKASMHDKFFL

SEQ ID NO: 2316517 - protein, 28 aa, Cryptosporidium parvum
KNPYKYRMTLPFLQQKPRFNLWASIKES

SEQ ID NO: 2316518 - protein, 42 aa, Cryptosporidium parvum
KNQFKLRLQSLFWYVDIMKQFLSGRILLLNKFNDISRFTIPM

SEQ ID NO: 2316519 - protein, 25 aa, Cryptosporidium parvum
KNQIAQEFSFILGDELYNTGLYSHN

SEQ ID NO: 2316520 - protein, 24 aa, Cryptosporidium parvum
KNQSSSWFSSWFGNNSSANEIQED

SEQ ID NO: 2316521 - protein, 21 aa, Cryptosporidium parvum
KNRCRSFFSFVANWSDDDVSK

SEQ ID NO: 2316522 - protein, 22 aa, Cryptosporidium parvum
KNRIFAIIKGFSFIMRYSKGRQ

SEQ ID NO: 2316523 - protein, 23 aa, Cryptosporidium parvum
KNRLLNYLVGVSLIMNLPNAMRN

SEQ ID NO: 2316524 - protein, 19 aa, Cryptosporidium parvum
KNRQWIEYYYSLDDEIQRL

SEQ ID NO: 2316525 - protein, 23 aa, Cryptosporidium parvum
KNRRWKEKWFRRGRKLFVRKFVQ

SEQ ID NO: 2316526 - protein, 26 aa, Cryptosporidium parvum
KNRTRRNYFKLLKNYTNIFNSENYNS

SEQ ID NO: 2316527 - protein, 21 aa, Cryptosporidium parvum
KNRYVILPKDFEKGWKIHVKK

SEQ ID NO: 2316528 - protein, 18 aa, Cryptosporidium parvum
KNSDFIKILSFKEIMKYS

SEQ ID NO: 2316529 - protein, 28 aa, Cryptosporidium parvum
KNSKNVKALYRRGLARLGFGMYEESKED

SEQ ID NO: 2316530 - protein, 41 aa, Cryptosporidium parvum
KNSLEILYQVLMLTVKLLSPFIPFTCELLYSNLKNALIDEL

SEQ ID NO: 2316531 - protein, 19 aa, Cryptosporidium parvum
KNSLFILETFKLPEDTTES

SEQ ID NO: 2316532 - protein, 26 aa, Cryptosporidium parvum
KNSLRKAIYIHSLYDGSNLGTIFCDD

SEQ ID NO: 2316533 - protein, 31 aa, Cryptosporidium parvum; identical to SEQ ID NO: 2192459

SEQ ID NO: 2316534 - protein, 32 aa, Cryptosporidium parvum; identical to SEQ ID NO: 2192460

SEQ ID NO: 2316535 - protein, 28 aa, Cryptosporidium parvum
KNTDPPIWKYWSLPNIEFHGLWDVLHYE

SEQ ID NO: 2316536 - protein, 19 aa, Cryptosporidium parvum
KNTLDLYKIMTKSKELGTW

SEQ ID NO: 2316537 - protein, 34 aa, Cryptosporidium parvum
KNTLPIKIYLYITYQIILFLYNNNQNKIYDLLIS

SEQ ID NO: 2316538 - protein, 27 aa, Cryptosporidium parvum
KNTQSMEHVLIQSLRMIQKIDQFRVGS

SEQ ID NO: 2316539 - protein, 20 aa, Cryptosporidium parvum
KNTRFVIICNYISKIIEPLA

SEQ ID NO: 2316540 - protein, 21 aa, Cryptosporidium parvum
KNVIFRIEPISGFYYETSGLH

SEQ ID NO: 2316541 - protein, 17 aa, Cryptosporidium parvum
KNVKCTIWLSFTSNMIS

SEQ ID NO: 2316542 - protein, 31 aa, Cryptosporidium parvum; identical to SEQ ID NO: 2192466

SEQ ID NO: 2316543 - protein, 29 aa, Cryptosporidium parvum
KNVLNDMMIWYFITYSPGEWSLKPFVVHK

SEQ ID NO: 2316544 - protein, 23 aa, Cryptosporidium parvum
KNVNPLIFFNEYMGYYLSKKHIP

SEQ ID NO: 2316545 - protein, 39 aa, Cryptosporidium parvum
KNVRVITQELWIPLLRELAYINALVRFDVLRQSTLGSNA

SEQ ID NO: 2316546 - protein, 27 aa, Cryptosporidium parvum
KNVSNKLLIKNLPFQATKSDIMSLFNS

SEQ ID NO: 2316547 - protein, 27 aa, Cryptosporidium parvum
KNVSQINMPYFTKLLLVSAYVASKVSK

SEQ ID NO: 2316548 - protein, 20 aa, Cryptosporidium parvum
KNVSSIFLLDLSLSLSTFSR

SEQ ID NO: 2316549 - protein, 30 aa, Cryptosporidium parvum; identical to SEQ ID NO: 2192470

SEQ ID NO: 2316550 - protein, 24 aa, Cryptosporidium parvum
KNWGPHLIVVPTSVMLNWEMEFKR

SEQ ID NO: 2316551 - protein, 19 aa, Cryptosporidium parvum
KNYDTFLELMYYQSLNKHS

SEQ ID NO: 2316552 - protein, 25 aa, Cryptosporidium parvum
KNYKRWIKTWYNQPGRKQSRRIARQ

SEQ ID NO: 2316553 - protein, 37 aa, Cryptosporidium parvum
KNYSLVYKRLYDCLGPVMFPIAPLKGIKHPRGELKLW

SEQ ID NO: 2316554 - protein, 22 aa, Cryptosporidium parvum
KPAIRRLARRGGVKRISALIYE

SEQ ID NO: 2316555 - protein, 20 aa, Cryptosporidium parvum
KPANLSGELVLPLVYQTYVT

SEQ ID NO: 2316556 - protein, 17 aa, Cryptosporidium parvum
KPCYLCYSSSTISNQMI

SEQ ID NO: 2316557 - protein, 25 aa, Cryptosporidium parvum
KPDDCLWSIIDGKTIQIVLEKQENI

SEQ ID NO: 2316558 - protein, 19 aa, Cryptosporidium parvum
KPEEPIILIKIPDGKSKAS

SEQ ID NO: 2316559 - protein, 18 aa, Cryptosporidium parvum
KPEFINRRLSLFKTLYEK

SEQ ID NO: 2316560 - protein, 20 aa, Cryptosporidium parvum
KPEIEWKPANLSGELVLPLV

SEQ ID NO: 2316561 - protein, 25 aa, Cryptosporidium parvum
KPEISPLAALLRAKAPPLPLHMKSG

SEQ ID NO: 2316562 - protein, 19 aa, Cryptosporidium parvum
KPFFQPIAEWIVRNIYRFH

SEQ ID NO: 2316563 - protein, 24 aa, Cryptosporidium parvum
KPFINAPESLPIFPPNPIEIDENT

SEQ ID NO: 2316564 - protein, 17 aa, Cryptosporidium parvum
KPHKYFENILSPNKSIK

SEQ ID NO: 2316565 - protein, 18 aa, Cryptosporidium parvum
KPIFIKVPIIISNYFLQE

SEQ ID NO: 2316566 - protein, 23 aa, Cryptosporidium parvum
KPIFVHISLLPFTEQISLSVNNK

SEQ ID NO: 2316567 - protein, 18 aa, Cryptosporidium parvum
KPIKIRHRLALKGDWIDN

SEQ ID NO: 2316568 - protein, 19 aa, Cryptosporidium parvum
KPIKLQPLELILNAEIRQQ

SEQ ID NO: 2316569 - protein, 26 aa, Cryptosporidium parvum
KPINEQLITGIKFIDSLIPIGLGQRE

SEQ ID NO: 2316570 - protein, 22 aa, Cryptosporidium parvum
KPISNKKLFNICQLLLCKNLKE

SEQ ID NO: 2316571 - protein, 24 aa, Cryptosporidium parvum
KPISNWEWVKFRNSARNDSLKLYH

SEQ ID NO: 2316572 - protein, 21 aa, Cryptosporidium parvum
KPIVHTFLHLLSIAKTYKDDV

SEQ ID NO: 2316573 - protein, 27 aa, Cryptosporidium parvum
KPIVKGKPPGPPPPLKSKSALSLKSSG

SEQ ID NO: 2316574 - protein, 19 aa, Cryptosporidium parvum
KPKIFKGTSNFQFPYLRSL

SEQ ID NO: 2316575 - protein, 26 aa, Cryptosporidium parvum
KPKKPKRMFSGKYKDPSLFLKSAQKE

SEQ ID NO: 2316576 - protein, 25 aa, Cryptosporidium parvum
KPKPLQMLFHFALKQKERSNSPFHF

SEQ ID NO: 2316577 - protein, 25 aa, Cryptosporidium parvum
KPLKRLSCPAIFFDCTHDNETPCEI

SEQ ID NO: 2316578 - protein, 20 aa, Cryptosporidium parvum
KPLNPIWKIDDEMVIISCIY

SEQ ID NO: 2316579 - protein, 20 aa, Cryptosporidium parvum
KPNFVQFYAVPHPPVPAMKY

SEQ ID NO: 2316580 - protein, 27 aa, Cryptosporidium parvum
KPNRLIKLSIKLALLTKKKIKRKIQII

SEQ ID NO: 2316581 - protein, 26 aa, Cryptosporidium parvum
KPNWSFHFKGIYFFRNISKSNPCGSN

SEQ ID NO: 2316582 - protein, 18 aa, Cryptosporidium parvum
KPPPPVYNPLHWEMKSRS

SEQ ID NO: 2316583 - protein, 17 aa, Cryptosporidium parvum
KPRFNLWASIKESITKD

SEQ ID NO: 2316584 - protein, 20 aa, Cryptosporidium parvum
KPRHVPDFVLISPEDVDRLL

SEQ ID NO: 2316585 - protein, 23 aa, Cryptosporidium parvum
KPRIKAFQFLIDSYNKFINESSI

SEQ ID NO: 2316586 - protein, 17 aa, Cryptosporidium parvum
KPRKFSQDGGFREKKQS

SEQ ID NO: 2316587 - protein, 23 aa, Cryptosporidium parvum
KPRPINWWFNHSVRHITVKFNCE

SEQ ID NO: 2316588 - protein, 24 aa, Cryptosporidium parvum
KPSKGILLYGPPGTGKTLIARSIA

SEQ ID NO: 2316589 - protein, 25 aa, Cryptosporidium parvum
KPSNILLHITFDKFLEQPICQALLS

SEQ ID NO: 2316590 - protein, 19 aa, Cryptosporidium parvum
KPYFEDVIAPSIMSGKSVL

SEQ ID NO: 2316591 - protein, 19 aa, Cryptosporidium parvum
KPYLWMQCMDKYNCSVSGA

SEQ ID NO: 2316592 - protein, 27 aa, Cryptosporidium parvum
KPYQLEGLNWLINLYEGGLNGILADEM

SEQ ID NO: 2316593 - protein, 26 aa, Cryptosporidium parvum
KQAYRKLKFFTEFKLWKIFKDEYSNI

SEQ ID NO: 2316594 - protein, 26 aa, Cryptosporidium parvum
KQEALRTYLFTYGHLYSSYSVNNLIE

SEQ ID NO: 2316595 - protein, 25 aa, Cryptosporidium parvum
KQECPAFIYYWNGSTCYIYDDNIAF

SEQ ID NO: 2316596 - protein, 29 aa, Cryptosporidium parvum
KQEFDNIILSKIFPKLLSYFKIDLQVEQN

SEQ ID NO: 2316597 - protein, 24 aa, Cryptosporidium parvum
KQEGAWIFDKPVDEKAWNCSDYYK

SEQ ID NO: 2316598 - protein, 25 aa, Cryptosporidium parvum
KQEIIEVVFSYWDGSGHRRSVHVPR

SEQ ID NO: 2316599 - protein, 27 aa, Cryptosporidium parvum
KQELIYDLLFGNNKRKLPKGGIWNFED

SEQ ID NO: 2316600 - protein, 25 aa, Cryptosporidium parvum
KQETRNISVPLTIDELEEKIMQENL

SEQ ID NO: 2316601 - protein, 23 aa, Cryptosporidium parvum
KQEYVIHPLISNLGMEKNQIAQE

SEQ ID NO: 2316602 - protein, 20 aa, Cryptosporidium parvum
KQFPPLKILQFSVGQRHTLV

SEQ ID NO: 2316603 - protein, 34 aa, Cryptosporidium parvum; identical to SEQ ID NO: 2192523

SEQ ID NO: 2316604 - protein, 17 aa, Cryptosporidium parvum
KQFYSARMRTNAFNSRH

SEQ ID NO: 2316605 - protein, 17 aa, Cryptosporidium parvum
KQGWTKFLNLAKKEFES

SEQ ID NO: 2316606 - protein, 23 aa, Cryptosporidium parvum
KQHKERLVLLEFQGSLSISKLNT

SEQ ID NO: 2316607 - protein, 27 aa, Cryptosporidium parvum
KQHLLKRHDIIPKFIRFVLIIEVGKKS

SEQ ID NO: 2316608 - protein, 20 aa, Cryptosporidium parvum
KQHSYSEDLFPDCFAGIPSC

SEQ ID NO: 2316609 - protein, 26 aa, Cryptosporidium parvum
KQIKSKGLQKLRWYCQLCEKQCRDEN

SEQ ID NO: 2316610 - protein, 17 aa, Cryptosporidium parvum
KQILLLNVEKVQLEAEL

SEQ ID NO: 2316611 - protein, 27 aa, Cryptosporidium parvum
KQKAIYFLSIIILTRYLRDNALPACIS

SEQ ID NO: 2316612 - protein, 24 aa, Cryptosporidium parvum
KQKHTVWCLTQSQKNLNQIIKEYC

SEQ ID NO: 2316613 - protein, 17 aa, Cryptosporidium parvum
KQKIDFLKGIINKKNQC

SEQ ID NO: 2316614 - protein, 18 aa, Cryptosporidium parvum
KQKMAFMSMPIVVGGQTF

SEQ ID NO: 2316615 - protein, 25 aa, Cryptosporidium parvum
KQKRFYYSYFLPNNHMMSVPQIALL

SEQ ID NO: 2316616 - protein, 17 aa, Cryptosporidium parvum
KQLPMLSQFNMILERKV

SEQ ID NO: 2316617 - protein, 20 aa, Cryptosporidium parvum
KQMPVPLALSLTMSYKNLIS

SEQ ID NO: 2316618 - protein, 20 aa, Cryptosporidium parvum
KQMRLLFEPQRLTIHDVYSD

SEQ ID NO: 2316619 - protein, 23 aa, Cryptosporidium parvum
KQNPSNLLGVRDANIEGGSIGAR

SEQ ID NO: 2316620 - protein, 20 aa, Cryptosporidium parvum
KQPIRKYKIGSPGAIHVYDE

SEQ ID NO: 2316621 - protein, 21 aa, Cryptosporidium parvum
KQRLLKIKNILKNISKKRYEE

SEQ ID NO: 2316622 - protein, 22 aa, Cryptosporidium parvum
KQRSHLIDYLNNRLYNVAPNLQ

SEQ ID NO: 2316623 - protein, 22 aa, Cryptosporidium parvum
KQRYSVPWCYENFLQSRALKGA

SEQ ID NO: 2316624 - protein, 20 aa, Cryptosporidium parvum
KQRYVLPCRYGIDPYYSMRN

SEQ ID NO: 2316625 - protein, 33 aa, Cryptosporidium parvum
KQTIEYIYSKISDVKLILENPKYVKSQLEKHKV

SEQ ID NO: 2316626 - protein, 18 aa, Cryptosporidium parvum
KQTKCQETMRGAGYETSI

SEQ ID NO: 2316627 - protein, 30 aa, Cryptosporidium parvum
KQTLQSSLLQWFLFYIHQNGLFDFSNLRKD

SEQ ID NO: 2316628 - protein, 26 aa, Cryptosporidium parvum
KQVKEEICIPPAFYGNTYLSLSSVER

SEQ ID NO: 2316629 - protein, 19 aa, Cryptosporidium parvum
KQWKVRRLIATLEAARGNG

SEQ ID NO: 2316630 - protein, 22 aa, Cryptosporidium parvum
KQYTPPLAENFPKGLPSIVQDP

SEQ ID NO: 2316631 - protein, 20 aa, Cryptosporidium parvum
KRAKFIVFIDEIDLARSNRN

SEQ ID NO: 2316632 - protein, 32 aa, Cryptosporidium parvum
KRDALDWIKKTFLYIRIIRNPSLYGLDIDEII

SEQ ID NO: 2316633 - protein, 23 aa, Cryptosporidium parvum
KRDKNLWTRGLYMLQNTDRSELE

SEQ ID NO: 2316634 - protein, 23 aa, Cryptosporidium parvum
KRDNIIQRFRTGKIWILICTDLM

SEQ ID NO: 2316635 - protein, 26 aa, Cryptosporidium parvum
KREFSVFFKHILFSTSIEHLNLSRNK

SEQ ID NO: 2316636 - protein, 17 aa, Cryptosporidium parvum
KREILIMKRLDHPNIIK

SEQ ID NO: 2316637 - protein, 18 aa, Cryptosporidium parvum
KREIVQDITLYDLDLANA

SEQ ID NO: 2316638 - protein, 29 aa, Cryptosporidium parvum
KREKIVGQWKILYLPPKGGNLMVPRCVYE

SEQ ID NO: 2316639 - protein, 28 aa, Cryptosporidium parvum
KREYSTSPCYYYLPRGYERIGNCFNEIR

SEQ ID NO: 2316640 - protein, 34 aa, Cryptosporidium parvum
KRFKELHEFGTMYRLLLSGTPLHNNLEELWSLLH

SEQ ID NO: 2316641 - protein, 18 aa, Cryptosporidium parvum
KRFPLNFLSYLEDVSVEP

SEQ ID NO: 2316642 - protein, 25 aa, Cryptosporidium parvum
KRGDYFGELALLRNAPRAATVKARG

SEQ ID NO: 2316643 - protein, 30 aa, Cryptosporidium parvum
KRGYELNNVLQDHLMLLKAQLEISTEEKTN

SEQ ID NO: 2316644 - protein, 21 aa, Cryptosporidium parvum
KRIESLQKNYKVRILLCLVDI

SEQ ID NO: 2316645 - protein, 28 aa, Cryptosporidium parvum
KRIFEGLTFFISREVPLLPLAFVIKSFG

SEQ ID NO: 2316646 - protein, 20 aa, Cryptosporidium parvum
KRKEIMDSLFACQVGDNGNN

SEQ ID NO: 2316647 - protein, 17 aa, Cryptosporidium parvum
KRKKEIIELIESRFKQL

SEQ ID NO: 2316648 - protein, 17 aa, Cryptosporidium parvum
KRKLTWIVNNGLVEGWD

SEQ ID NO: 2316649 - protein, 25 aa, Cryptosporidium parvum
KRKMHYREFITAKSKLPKANDSDSS

SEQ ID NO: 2316650 - protein, 21 aa, Cryptosporidium parvum
KRKQKGPPQYARLPAVVPNAK

SEQ ID NO: 2316651 - protein, 17 aa, Cryptosporidium parvum
KRLALTDFKAKIPRGAR

SEQ ID NO: 2316652 - protein, 24 aa, Cryptosporidium parvum
KRLAQLGRFLTFGYTQGLYGVRVD

SEQ ID NO: 2316653 - protein, 21 aa, Cryptosporidium parvum
KRLRYMIYRYVVDVSSSTPQF

SEQ ID NO: 2316654 - protein, 26 aa, Cryptosporidium parvum
KRLSTPPFLKLHLKPMPSDPTHSSYY

SEQ ID NO: 2316655 - protein, 17 aa, Cryptosporidium parvum
KRMEHILNMRILEEEKN

SEQ ID NO: 2316656 - protein, 24 aa, Cryptosporidium parvum
KRMIGEILKWYFGMSHVSLNDITP

SEQ ID NO: 2316657 - protein, 29 aa, Cryptosporidium parvum
KRNLLQKGFKLWTRREFNLLLRCLETNGV

SEQ ID NO: 2316658 - protein, 24 aa, Cryptosporidium parvum
KRPRHFFCFSCNQFKPRSTKARFK

SEQ ID NO: 2316659 - protein, 25 aa, Cryptosporidium parvum
KRPTDKPLRLPLQDVYKIGGVGTVP

SEQ ID NO: 2316660 - protein, 20 aa, Cryptosporidium parvum
KRQDYILDFTKKLELSGMNL

SEQ ID NO: 2316661 - protein, 25 aa, Cryptosporidium parvum
KRQIEEHILLSFKYPDVLDKIVNGT

SEQ ID NO: 2316662 - protein, 21 aa, Cryptosporidium parvum
KRRDSVVKWIGRLSMNSSSEE

SEQ ID NO: 2316663 - protein, 23 aa, Cryptosporidium parvum
KRRDTICIVLVDPDLEEGKIRMN

SEQ ID NO: 2316664 - protein, 23 aa, Cryptosporidium parvum
KRREKLWYLMESYLPTDIESIQR

SEQ ID NO: 2316665 - protein, 17 aa, Cryptosporidium parvum
KRSFSKENSTILLESNE

SEQ ID NO: 2316666 - protein, 25 aa, Cryptosporidium parvum
KRSGLLVCKFADSEDLNLTWPGGQT

SEQ ID NO: 2316667 - protein, 21 aa, Cryptosporidium parvum
KRSQLLQMLQKNWKKSPENPM

SEQ ID NO: 2316668 - protein, 25 aa, Cryptosporidium parvum
KRSWSSLIRMLYTDYLMSNPKDYPV

SEQ ID NO: 2316669 - protein, 20 aa, Cryptosporidium parvum
KRTFLRHRITARLAMVYLNS

SEQ ID NO: 2316670 - protein, 18 aa, Cryptosporidium parvum
KRTIQFVDWCPTGFKCGI

SEQ ID NO: 2316671 - protein, 27 aa, Cryptosporidium parvum
KRTKTKFYTFPFKVLQKIPVCISFDVH

SEQ ID NO: 2316672 - protein, 33 aa, Cryptosporidium parvum
KRTPSYFNTGFIPNQLVLNASLLNELRQEPCGN

SEQ ID NO: 2316673 - protein, 17 aa, Cryptosporidium parvum
KRWVFCPCRSCLFKGKA

SEQ ID NO: 2316674 - protein, 21 aa, Cryptosporidium parvum
KRYFLNILRSNNEKFKIVNKF

SEQ ID NO: 2316675 - protein, 20 aa, Cryptosporidium parvum
KRYLTYISNILPQRLYCSFC

SEQ ID NO: 2316676 - protein, 20 aa, Cryptosporidium parvum
KSALSELGDFNKKLLEENTR

SEQ ID NO: 2316677 - protein, 17 aa, Cryptosporidium parvum
KSASFQTHFGLKLIAEE

SEQ ID NO: 2316678 - protein, 25 aa, Cryptosporidium parvum
KSATIMCLPIKWKTYINTIYSGENI

SEQ ID NO: 2316679 - protein, 26 aa, Cryptosporidium parvum
KSCEDDISLFLEGKPFVLSNINYNEL

SEQ ID NO: 2316680 - protein, 19 aa, Cryptosporidium parvum
KSCEPFVDWLLDGSNDESD

SEQ ID NO: 2316681 - protein, 33 aa, Cryptosporidium parvum; identical to SEQ ID NO: 2192596

SEQ ID NO: 2316682 - protein, 33 aa, Cryptosporidium parvum; identical to SEQ ID NO: 2192597

SEQ ID NO: 2316683 - protein, 32 aa, Cryptosporidium parvum
KSCPVWIPPWWTAFRIGGWNWQYSLEVELSWF

SEQ ID NO: 2316684 - protein, 24 aa, Cryptosporidium parvum
KSDENFTFWLSLTSDKDQSCQKYN

SEQ ID NO: 2316685 - protein, 27 aa, Cryptosporidium parvum
KSDKGVFNYFELVEKYTSRNSYNRRGN

SEQ ID NO: 2316686 - protein, 22 aa, Cryptosporidium parvum
KSDLPMIISHCPGWICYSEKSL

SEQ ID NO: 2316687 - protein, 42 aa, Cryptosporidium parvum; identical to SEQ ID NO: 2192604

SEQ ID NO: 2316688 - protein, 17 aa, Cryptosporidium parvum
KSEKFLKALNSNLLRII

SEQ ID NO: 2316689 - protein, 20 aa, Cryptosporidium parvum
KSEKLLPLKIVQNKYNKHKK

SEQ ID NO: 2316690 - protein, 25 aa, Cryptosporidium parvum
KSELDYIFGILSRESFSSGFSALQN

SEQ ID NO: 2316691 - protein, 27 aa, Cryptosporidium parvum
KSENTLRKLLNWWKTEGFFKRSKHLED

SEQ ID NO: 2316692 - protein, 26 aa, Cryptosporidium parvum
KSENYTIPFIPKVYKTKYLNLYCTGD

SEQ ID NO: 2316693 - protein, 32 aa, Cryptosporidium parvum
KSEQRLLVDFQEFPVMLVDLLNRSKGNGFSES

SEQ ID NO: 2316694 - protein, 31 aa, Cryptosporidium parvum
KSESNINIPLKWPYLLNITISKDISRSNILE

SEQ ID NO: 2316695 - protein, 18 aa, Cryptosporidium parvum
KSFDSFLSERNFVTDDLP

SEQ ID NO: 2316696 - protein, 23 aa, Cryptosporidium parvum
KSFLFNCMVLVGRLIKKVSAFKV

SEQ ID NO: 2316697 - protein, 33 aa, Cryptosporidium parvum; identical to SEQ ID NO: 2192616

SEQ ID NO: 2316698 - protein, 30 aa, Cryptosporidium parvum
KSFPENIHIIFDYSLPLTFSDDLINNLYSS

SEQ ID NO: 2316699 - protein, 24 aa, Cryptosporidium parvum
KSFQNIFLGNKWLSPPELFSRMFN

SEQ ID NO: 2316700 - protein, 29 aa, Cryptosporidium parvum
KSFSNCLFDYIPKLVLLLRSHETLSLILK

SEQ ID NO: 2316701 - protein, 28 aa, Cryptosporidium parvum
KSFSNLRRDQLKALVLRYAKENGKDTFN

SEQ ID NO: 2316702 - protein, 24 aa, Cryptosporidium parvum
KSGKKFIRIVKLTDSGFFEISSVT

SEQ ID NO: 2316703 - protein, 25 aa, Cryptosporidium parvum
KSGKKHVLAIVYLACREEGVSRTVK

SEQ ID NO: 2316704 - protein, 22 aa, Cryptosporidium parvum
KSGMLKRRIFPEDVTLNIAEDA

SEQ ID NO: 2316705 - protein, 25 aa, Cryptosporidium parvum
KSGSAYPFWDLKIINVISSSERKRR

SEQ ID NO: 2316706 - protein, 45 aa, Cryptosporidium parvum
KSGTRIRVIGLFLPYISRRTQFLRNIRLQLKSLIVLIEEYAICYP

SEQ ID NO: 2316707 - protein, 25 aa, Cryptosporidium parvum
KSGTRWAIRTFLRFGRSSFISRSMM

SEQ ID NO: 2316708 - protein, 37 aa, Cryptosporidium parvum; identical to SEQ ID NO: 2192622

SEQ ID NO: 2316709 - protein, 23 aa, Cryptosporidium parvum
KSHCYLYIENKKDFFLKLQTKYD

SEQ ID NO: 2316710 - protein, 30 aa, Cryptosporidium parvum
KSHDPYKRLLVFFKWLFNSLNRGSRAVFQF

SEQ ID NO: 2316711 - protein, 17 aa, Cryptosporidium parvum
KSHKLYLEKLHKLTLAP

SEQ ID NO: 2316712 - protein, 21 aa, Cryptosporidium parvum
KSHLHKNFSLAFNQLKYDETI

SEQ ID NO: 2316713 - protein, 25 aa, Cryptosporidium parvum
KSHLTLLKEIVFAYSYPRLDINVSK

SEQ ID NO: 2316714 - protein, 48 aa, Cryptosporidium parvum
KSHYFNRVSYSFRNCLLYFSYHPEVWYEYFIFVWNSHPVQLTGMEIAT

SEQ ID NO: 2316715 - protein, 25 aa, Cryptosporidium parvum
KSIAKLLDLILDNSDEFLAEDTAGR

SEQ ID NO: 2316716 - protein, 24 aa, Cryptosporidium parvum
KSIDRWRSKYYSSNDDYLSPTFLD

SEQ ID NO: 2316717 - protein, 24 aa, Cryptosporidium parvum
KSIELPFFVPSCVSLPFGTLNKLL

SEQ ID NO: 2316718 - protein, 20 aa, Cryptosporidium parvum
KSIFKASMHDKFFLGGNCGA

SEQ ID NO: 2316719 - protein, 20 aa, Cryptosporidium parvum
KSIFSIFRLCSPFKTDASLG

SEQ ID NO: 2316720 - protein, 31 aa, Cryptosporidium parvum
KSIIDVWNLLVLDPIFLLKNTVEYISNLINK

SEQ ID NO: 2316721 - protein, 27 aa, Cryptosporidium parvum
KSIKFYKNLLLNRIKWDQPIETTTSCS

SEQ ID NO: 2316722 - protein, 30 aa, Cryptosporidium parvum
KSILEYLDLFPCFVLAIFKSLVLLDQGELD

SEQ ID NO: 2316723 - protein, 24 aa, Cryptosporidium parvum
KSILQDRFPVPKFVLCHAGGSQAR

SEQ ID NO: 2316724 - protein, 25 aa, Cryptosporidium parvum
KSINARIELYKQYLAQWLKNAENNG

SEQ ID NO: 2316725 - protein, 29 aa, Cryptosporidium parvum
KSINFRDFHVRLIAILRSSQLVEILENML

SEQ ID NO: 2316726 - protein, 32 aa, Cryptosporidium parvum
KSINFVLGHLLINLIYETWITWGSEIWHISSL

SEQ ID NO: 2316727 - protein, 34 aa, Cryptosporidium parvum
KSINISKTILCRYIWRLRIPTWNRIFITSSKESK

SEQ ID NO: 2316728 - protein, 18 aa, Cryptosporidium parvum
KSIRTMFFDTFSGPIVRG

SEQ ID NO: 2316729 - protein, 26 aa, Cryptosporidium parvum
KSISCLYSDILWSTRFSVCKNSIIQD

SEQ ID NO: 2316730 - protein, 24 aa, Cryptosporidium parvum
KSIVRELNLKPLFNKNNENRIDRH

SEQ ID NO: 2316731 - protein, 24 aa, Cryptosporidium parvum
KSKDFFLNLLQDKNLIYFKTELTK

SEQ ID NO: 2316732 - protein, 21 aa, Cryptosporidium parvum
KSKEYFWIKWANFEEKYGNFE

SEQ ID NO: 2316733 - protein, 23 aa, Cryptosporidium parvum
KSKIHIRLRSVGYIKYTFTAEPY

SEQ ID NO: 2316734 - protein, 20 aa, Cryptosporidium parvum
KSKKAFCDILIQIGAKALFA

SEQ ID NO: 2316735 - protein, 23 aa, Cryptosporidium parvum
KSKKNRLFYISKICSKKIEKVIP

SEQ ID NO: 2316736 - protein, 18 aa, Cryptosporidium parvum
KSKRGYFNLTKSISKIGT

SEQ ID NO: 2316737 - protein, 19 aa, Cryptosporidium parvum
KSKRRKTSLLKYTANERRL

SEQ ID NO: 2316738 - protein, 23 aa, Cryptosporidium parvum
KSKYNYIGPWRKDQKEKVITENI

SEQ ID NO: 2316739 - protein, 23 aa, Cryptosporidium parvum
KSLDIYLSIMRILEEKKTFDSEQ

SEQ ID NO: 2316740 - protein, 21 aa, Cryptosporidium parvum
KSLEKLMIPSILKVGKEPVIQ

SEQ ID NO: 2316741 - protein, 17 aa, Cryptosporidium parvum
KSLFERRQYLRKCINEG

SEQ ID NO: 2316742 - protein, 17 aa, Cryptosporidium parvum
KSLFPTFNDNDIRFYIY

SEQ ID NO: 2316743 - protein, 18 aa, Cryptosporidium parvum
KSLGITEPILTQVDLVCK

SEQ ID NO: 2316744 - protein, 22 aa, Cryptosporidium parvum
KSLISILRGLLDTRNKFFNGKA

SEQ ID NO: 2316745 - protein, 25 aa, Cryptosporidium parvum
KSLKLFRIDSDFCSYKLLNSVRSEN

SEQ ID NO: 2316746 - protein, 23 aa, Cryptosporidium parvum
KSLKNLHFLPLDSYKSYYKEICT

SEQ ID NO: 2316747 - protein, 37 aa, Cryptosporidium parvum
KSLLYKEFPTNIRWTYYSFYPLILSSYLQAYNNLKTE

SEQ ID NO: 2316748 - protein, 25 aa, Cryptosporidium parvum
KSLNDFLQDLLNFIGYHIESESILE

SEQ ID NO: 2316749 - protein, 20 aa, Cryptosporidium parvum
KSLWVWIHPIASHQQFFYWE

SEQ ID NO: 2316750 - protein, 24 aa, Cryptosporidium parvum
KSNEFLLCKGIIPPELTLNSGIDG

SEQ ID NO: 2316751 - protein, 21 aa, Cryptosporidium parvum
KSNFEIIKLSQKVDLLQKDLI

SEQ ID NO: 2316752 - protein, 31 aa, Cryptosporidium parvum
KSNGMQIIDTWPYAFPRYKYDIDDQLEISIY

SEQ ID NO: 2316753 - protein, 22 aa, Cryptosporidium parvum
KSNKFILNALKYDGKKSKILVD

SEQ ID NO: 2316754 - protein, 19 aa, Cryptosporidium parvum
KSNKPMLTLRKLLHRMNDQ

SEQ ID NO: 2316755 - protein, 39 aa, Cryptosporidium parvum
KSNLFTFNLRLPIHVKITYLRQFILGKLRKERPSSKLEV

SEQ ID NO: 2316756 - protein, 39 aa, Cryptosporidium parvum
KSNLNIRQIISKNIYPIEVLLKLYKPLNVPRSIFKLETA

SEQ ID NO: 2316757 - protein, 30 aa, Cryptosporidium parvum; identical to SEQ ID NO: 2192657

SEQ ID NO: 2316758 - protein, 27 aa, Cryptosporidium parvum
KSNYYATAFLRYLPGINAKNIKVLTSN

SEQ ID NO: 2316759 - protein, 28 aa, Cryptosporidium parvum
KSPCRIITLPYIFRYLSNELAAMNIVIR

SEQ ID NO: 2316760 - protein, 17 aa, Cryptosporidium parvum
KSPDWMICLRDGISKGI

SEQ ID NO: 2316761 - protein, 24 aa, Cryptosporidium parvum
KSPIYYYCLSRMRLYSSILGVMTP

SEQ ID NO: 2316762 - protein, 19 aa, Cryptosporidium parvum
KSQCCINTPGGFECKDSKD

SEQ ID NO: 2316763 - protein, 20 aa, Cryptosporidium parvum
KSQHIHFELQKQFMSDSLNN

SEQ ID NO: 2316764 - protein, 26 aa, Cryptosporidium parvum
KSQLPLIRWVMLEILPILHKLNSIPN

SEQ ID NO: 2316765 - protein, 26 aa, Cryptosporidium parvum
KSQSGLITRLSLFKNIHPLYESSDPS

SEQ ID NO: 2316766 - protein, 17 aa, Cryptosporidium parvum
KSQSKINFLTRISDKWI

SEQ ID NO: 2316767 - protein, 21 aa, Cryptosporidium parvum
KSRDEFTWRASQDLYKLEWKV

SEQ ID NO: 2316768 - protein, 32 aa, Cryptosporidium parvum; identical to SEQ ID NO: 2192667

SEQ ID NO: 2316769 - protein, 21 aa, Cryptosporidium parvum
KSRTLVVFKNGKLYLRHNSFS

SEQ ID NO: 2316770 - protein, 28 aa, Cryptosporidium parvum
KSRVAIAIMAYLNPHLLILDEPTNHLDL

SEQ ID NO: 2316771 - protein, 23 aa, Cryptosporidium parvum
KSSEFMDFFSRASRLIERALGEG

SEQ ID NO: 2316772 - protein, 18 aa, Cryptosporidium parvum
KSSFELLLNMNIRRTFSL

SEQ ID NO: 2316773 - protein, 31 aa, Cryptosporidium parvum
KSSHKDYHLPSSSYLYLLATAATEIFEKQEV

SEQ ID NO: 2316774 - protein, 39 aa, Cryptosporidium parvum
KSSIDQVFMINKRLLFTLVRLKLWIVEEILYDEEILDGS

SEQ ID NO: 2316775 - protein, 26 aa, Cryptosporidium parvum
KSSIIDIDSLLYWIVQRQSGIEGGFQ

SEQ ID NO: 2316776 - protein, 24 aa, Cryptosporidium parvum
KSSQGTWYRLSIKFHLNILNEIYR

SEQ ID NO: 2316777 - protein, 35 aa, Cryptosporidium parvum; identical to SEQ ID NO: 2192674

SEQ ID NO: 2316778 - protein, 23 aa, Cryptosporidium parvum
KSTYLIDEFMYLVSELGFLTKSF

SEQ ID NO: 2316779 - protein, 24 aa, Cryptosporidium parvum
KSVCAINCWGLFASNLISFQNLMN

SEQ ID NO: 2316780 - protein, 22 aa, Cryptosporidium parvum
KSVFENIIDFAVKKVSIYKNYS

SEQ ID NO: 2316781 - protein, 22 aa, Cryptosporidium parvum
KSVGIYVCRRCFFQGKDDEYSK

SEQ ID NO: 2316782 - protein, 25 aa, Cryptosporidium parvum
KSVIVIKFWKRNGFERFIVMKECHY

SEQ ID NO: 2316783 - protein, 28 aa, Cryptosporidium parvum
KSVMDKLTTLKIWYTKNGLKWCRNNETC

SEQ ID NO: 2316784 - protein, 18 aa, Cryptosporidium parvum
KSVVFNHLDDRCFVAWNK

SEQ ID NO: 2316785 - protein, 17 aa, Cryptosporidium parvum
KSYFFGTPEFPLKPHTI

SEQ ID NO: 2316786 - protein, 29 aa, Cryptosporidium parvum
KSYLSELNLFRLILELIQTDLVRDLRGLE

SEQ ID NO: 2316787 - protein, 26 aa, Cryptosporidium parvum
KSYNLWSNRAWLLEFIVNLKDADKIL

SEQ ID NO: 2316788 - protein, 22 aa, Cryptosporidium parvum
KSYTFTHETLFTMTSKHVWGPI

SEQ ID NO: 2316789 - protein, 24 aa, Cryptosporidium parvum
KSYTMPLLKAMLLSHYNRTAWNNA

SEQ ID NO: 2316790 - protein, 28 aa, Cryptosporidium parvum
KSYYKQMVRIYSVFAPLGLEIIGLPSRE

SEQ ID NO: 2316791 - protein, 17 aa, Cryptosporidium parvum
KSYYRLKYTREFSEKIL

SEQ ID NO: 2316792 - protein, 33 aa, Cryptosporidium parvum
KTATKCTAAVFFYHLLVLATYNEIKLTQSTPGG

SEQ ID NO: 2316793 - protein, 22 aa, Cryptosporidium parvum
KTAVFFRSILSKYFNHIKSNQN

SEQ ID NO: 2316794 - protein, 24 aa, Cryptosporidium parvum
KTCDPWIDKFLILNGPKKIEKEPN

SEQ ID NO: 2316795 - protein, 17 aa, Cryptosporidium parvum
KTCKEWYRRIQSHFLNG

SEQ ID NO: 2316796 - protein, 18 aa, Cryptosporidium parvum
KTCPGIVSLKKDIDIYFI

SEQ ID NO: 2316797 - protein, 24 aa, Cryptosporidium parvum
KTCSDIVFFIAKFIQHYPRLDEGL

SEQ ID NO: 2316798 - protein, 23 aa, Cryptosporidium parvum
KTDAIKRCLIDRLPPYLHVCLQR

SEQ ID NO: 2316799 - protein, 35 aa, Cryptosporidium parvum; identical to SEQ ID NO: 2192688

SEQ ID NO: 2316800 - protein, 25 aa, Cryptosporidium parvum
KTEATKIILCYLANIQKSTSSFDFT

SEQ ID NO: 2316801 - protein, 19 aa, Cryptosporidium parvum
KTEDFMDLTWIRLSAIPGS

SEQ ID NO: 2316802 - protein, 35 aa, Cryptosporidium parvum
KTEHAINSLKNPLLFWFKGLFRQNEPTHIRPAFAN

SEQ ID NO: 2316803 - protein, 28 aa, Cryptosporidium parvum
KTFSLDNLLRIVWISPQLISIRWCEANK

SEQ ID NO: 2316804 - protein, 19 aa, Cryptosporidium parvum
KTGIKRPTVFIPNLAINIK

SEQ ID NO: 2316805 - protein, 17 aa, Cryptosporidium parvum
KTGIYYLRTQSATRPIQ

SEQ ID NO: 2316806 - protein, 22 aa, Cryptosporidium parvum
KTGLDSLIRRKILQGIKDKLKA

SEQ ID NO: 2316807 - protein, 23 aa, Cryptosporidium parvum
KTGQLIIWEWQSESYILKQQGHS

SEQ ID NO: 2316808 - protein, 25 aa, Cryptosporidium parvum
KTGSFIIPILQRLLDDQVPMYAVIL

SEQ ID NO: 2316809 - protein, 25 aa, Cryptosporidium parvum
KTIGGVFCYLLKQLVAEDQITIQEW

SEQ ID NO: 2316810 - protein, 20 aa, Cryptosporidium parvum
KTILPILNSTTLETMWDCLG

SEQ ID NO: 2316811 - protein, 18 aa, Cryptosporidium parvum
KTIRPIIGGLPKARVAKI

SEQ ID NO: 2316812 - protein, 36 aa, Cryptosporidium parvum
KTISERFYQIIRIMRICTYFIIRGREDFVFPAAHQN

SEQ ID NO: 2316813 - protein, 17 aa, Cryptosporidium parvum
KTIYKYFSPKERSIKGI

SEQ ID NO: 2316814 - protein, 24 aa, Cryptosporidium parvum
KTKDFLRRVFDPVFGFPNIVRFSW

SEQ ID NO: 2316815 - protein, 21 aa, Cryptosporidium parvum
KTKFNILTRNISKKYFGDWRQ

SEQ ID NO: 2316816 - protein, 21 aa, Cryptosporidium parvum
KTKFWLPYKEDIIFEDLKLND

SEQ ID NO: 2316817 - protein, 26 aa, Cryptosporidium parvum
KTKIGRELYLLYSSLFNIVVNRMKCN

SEQ ID NO: 2316818 - protein, 28 aa, Cryptosporidium parvum
KTKSDFMPFLFFTNGHVWKMAFSPPSHS

SEQ ID NO: 2316819 - protein, 29 aa, Cryptosporidium parvum
KTKSEMTEFLPPNKLYKLERKTQYDLTQK

SEQ ID NO: 2316820 - protein, 19 aa, Cryptosporidium parvum
KTLFCGWSSPLWSQADSGK

SEQ ID NO: 2316821 - protein, 23 aa, Cryptosporidium parvum
KTLHVACFVLFHTGEPSPGCVRS

SEQ ID NO: 2316822 - protein, 19 aa, Cryptosporidium parvum
KTLIDPIRSLPINILNFII

SEQ ID NO: 2316823 - protein, 17 aa, Cryptosporidium parvum
KTLLKNGADPRYKNKQG

SEQ ID NO: 2316824 - protein, 25 aa, Cryptosporidium parvum
KTLLQYITEIIWRDKPELLSLAEPL

SEQ ID NO: 2316825 - protein, 19 aa, Cryptosporidium parvum
KTLLVFERRIKEEFIFVAI

SEQ ID NO: 2316826 - protein, 23 aa, Cryptosporidium parvum
KTLSNALAFDQFDAGLQSREFLD

SEQ ID NO: 2316827 - protein, 30 aa, Cryptosporidium parvum; identical to SEQ ID NO: 2192709

SEQ ID NO: 2316828 - protein, 17 aa, Cryptosporidium parvum
KTLWYEYNSFNFFVLDN

SEQ ID NO: 2316829 - protein, 24 aa, Cryptosporidium parvum
KTLYNSVHLFLFYVLTECDDKGYH

SEQ ID NO: 2316830 - protein, 19 aa, Cryptosporidium parvum
KTMRFVELVKVKRKINQLQ

SEQ ID NO: 2316831 - protein, 17 aa, Cryptosporidium parvum
KTMYHILGYVKEIHRIM

SEQ ID NO: 2316832 - protein, 19 aa, Cryptosporidium parvum
KTMYISSGTYFYSNTETSR

SEQ ID NO: 2316833 - protein, 22 aa, Cryptosporidium parvum
KTNIAMLCILNIISQFIEPQNN

SEQ ID NO: 2316834 - protein, 23 aa, Cryptosporidium parvum
KTNLKPPLLFDIAYEFEKLKLSK

SEQ ID NO: 2316835 - protein, 28 aa, Cryptosporidium parvum
KTNNNILMRFVLFAYDLGLLYFDESIIE

SEQ ID NO: 2316836 - protein, 23 aa, Cryptosporidium parvum
KTNYYFDHVFDDKSTNYLIYDKL

SEQ ID NO: 2316837 - protein, 33 aa, Cryptosporidium parvum
KTPAEVRAICRDWWIFSLKYYRNIKYKDNKQNS

SEQ ID NO: 2316838 - protein, 23 aa, Cryptosporidium parvum
KTPDYRMNMLNAPDYRTPNYIQQ

SEQ ID NO: 2316839 - protein, 22 aa, Cryptosporidium parvum
KTPFRRSIPFMGSSQDSVGYPA

SEQ ID NO: 2316840 - protein, 24 aa, Cryptosporidium parvum
KTPKGVLLYGPPGTGKTLLARAMA

SEQ ID NO: 2316841 - protein, 24 aa, Cryptosporidium parvum
KTPRKIQNYLFSATLTLPNHLHPR

SEQ ID NO: 2316842 - protein, 25 aa, Cryptosporidium parvum
KTQDLVKTLLPAPKALNVDEDDPSI

SEQ ID NO: 2316843 - protein, 19 aa, Cryptosporidium parvum
KTQIKITETYQTDGTYTSK

SEQ ID NO: 2316844 - protein, 26 aa, Cryptosporidium parvum
KTQVYDIYKYLPPRIQTVLVSATLPD

SEQ ID NO: 2316845 - protein, 22 aa, Cryptosporidium parvum
KTQYYLYISFKNCIIAKLNINS

SEQ ID NO: 2316846 - protein, 22 aa, Cryptosporidium parvum
KTRWEKFAELKGIKKRKRSRMV

SEQ ID NO: 2316847 - protein, 28 aa, Cryptosporidium parvum
KTSDGYVLRLFCIAFTRRMADQVKSTCY

SEQ ID NO: 2316848 - protein, 33 aa, Cryptosporidium parvum
KTSKLQISYLGDSGIIILRRTPETFRMGIVYRS

SEQ ID NO: 2316849 - protein, 22 aa, Cryptosporidium parvum
KTSLLEYIIGRHFLPRGQGIVT

SEQ ID NO: 2316850 - protein, 25 aa, Cryptosporidium parvum
KTSRNRSQYYRNENYYDQGYDNDYA

SEQ ID NO: 2316851 - protein, 42 aa, Cryptosporidium parvum
KTSSKNWFCFQCLSLTLRILPSLIYRIPNLTPGLINSIQNLY

SEQ ID NO: 2316852 - protein, 30 aa, Cryptosporidium parvum
KTTKEIVDFYYCIWKRTSRYKAWKSNRQLS

SEQ ID NO: 2316853 - protein, 33 aa, Cryptosporidium parvum
KTTKTEPSFLRKYWWLIAIGFITYSVLTTDQSL

SEQ ID NO: 2316854 - protein, 27 aa, Cryptosporidium parvum
KTVDLIQKIMLLFSSIDSDFFNQLEEY

SEQ ID NO: 2316855 - protein, 29 aa, Cryptosporidium parvum
KTVLRFPISISMYSLLLFASDSLQLNPLS

SEQ ID NO: 2316856 - protein, 21 aa, Cryptosporidium parvum
KTVRYLIRQIDYTRRIRWVGC

SEQ ID NO: 2316857 - protein, 23 aa, Cryptosporidium parvum
KTVSGTIYLWPPDSRIVVSDVDG

SEQ ID NO: 2316858 - protein, 24 aa, Cryptosporidium parvum
KTYNGVSHFLYYSALHLTNTIMME

SEQ ID NO: 2316859 - protein, 28 aa, Cryptosporidium parvum
KVADKIQLIKNLLLKVDRMIIGGGMAFT

SEQ ID NO: 2316860 - protein, 25 aa, Cryptosporidium parvum
KVCKHVSCYHCLRKALHVEYWAAKN

SEQ ID NO: 2316861 - protein, 25 aa, Cryptosporidium parvum
KVECNYAFTPTKSSLRVRCIYCKKI

SEQ ID NO: 2316862 - protein, 32 aa, Cryptosporidium parvum
KVEDLYKILLCFIYTDFLIWDPFSDSPNTDLL

SEQ ID NO: 2316863 - protein, 24 aa, Cryptosporidium parvum
KVETIQLSSLPPAKLFQLRDQTQD

SEQ ID NO: 2316864 - protein, 25 aa, Cryptosporidium parvum
KVFDFRPGILIKQLNLKSPIFKKTS

SEQ ID NO: 2316865 - protein, 20 aa, Cryptosporidium parvum
KVFEFQIISSIIYEWENLFG

SEQ ID NO: 2316866 - protein, 19 aa, Cryptosporidium parvum
KVFPKVWIFSSNDVDSLCT

SEQ ID NO: 2316867 - protein, 25 aa, Cryptosporidium parvum
KVFSSKLIFHWLTHHILTNFLYNPN

SEQ ID NO: 2316868 - protein, 17 aa, Cryptosporidium parvum
KVFVVAATNRPDIIDPA

SEQ ID NO: 2316869 - protein, 28 aa, Cryptosporidium parvum
KVFYNESLLYIPLMKSTLYNWVPIDYNN

SEQ ID NO: 2316870 - protein, 19 aa, Cryptosporidium parvum
KVIDLLTFEGLTKSLERIS

SEQ ID NO: 2316871 - protein, 23 aa, Cryptosporidium parvum
KVIHKLWVELPESIPTCIATIVS

SEQ ID NO: 2316872 - protein, 18 aa, Cryptosporidium parvum
KVIIRQLLSSLEYCHLNN

SEQ ID NO: 2316873 - protein, 45 aa, Cryptosporidium parvum; identical to SEQ ID NO: 2192747

SEQ ID NO: 2316874 - protein, 19 aa, Cryptosporidium parvum
KVINRIFKEVWNDSMNIVF

SEQ ID NO: 2316875 - protein, 19 aa, Cryptosporidium parvum
KVISRIFDLDLLPDPLISE

SEQ ID NO: 2316876 - protein, 25 aa, Cryptosporidium parvum
KVIVLFISQGFIKSSRRPKKWRFIM

SEQ ID NO: 2316877 - protein, 25 aa, Cryptosporidium parvum
KVKFKALRLIKHLCENGNPTFKMLV

SEQ ID NO: 2316878 - protein, 17 aa, Cryptosporidium parvum
KVKKDMIVITLKKANNS

SEQ ID NO: 2316879 - protein, 18 aa, Cryptosporidium parvum
KVKKEKMYKDAKTGYLVV

SEQ ID NO: 2316880 - protein, 24 aa, Cryptosporidium parvum
KVKNYYCFYPKIWQSQDLYSSIGL

SEQ ID NO: 2316881 - protein, 17 aa, Cryptosporidium parvum
KVKVLSKPSFDVSRLME

SEQ ID NO: 2316882 - protein, 26 aa, Cryptosporidium parvum
KVLGEELFFKIQLAKILVVGAGGIGC

SEQ ID NO: 2316883 - protein, 17 aa, Cryptosporidium parvum
KVLHDLLVKLKVELNPT

SEQ ID NO: 2316884 - protein, 26 aa, Cryptosporidium parvum
KVLHRIELIMNTLESILCRCEKVEAK

SEQ ID NO: 2316885 - protein, 23 aa, Cryptosporidium parvum
KVLMIENTPRLFFVSKRDIICGE

SEQ ID NO: 2316886 - protein, 18 aa, Cryptosporidium parvum
KVLPLKTPNIISNESETS

SEQ ID NO: 2316887 - protein, 17 aa, Cryptosporidium parvum
KVLPPKIILNIFCNLTP

SEQ ID NO: 2316888 - protein, 38 aa, Cryptosporidium parvum
KVLQHAFKERLKIILVLNKMDRLILELGFDVKEAYIHI

SEQ ID NO: 2316889 - protein, 22 aa, Cryptosporidium parvum
KVLQIEDYILRTARNHGYSPYR

SEQ ID NO: 2316890 - protein, 17 aa, Cryptosporidium parvum
KVLRYEYSDNSWNPLLL

SEQ ID NO: 2316891 - protein, 25 aa, Cryptosporidium parvum
KVLYTKRLFSLKYNLPKLLERIIGS

SEQ ID NO: 2316892 - protein, 21 aa, Cryptosporidium parvum
KVNEFFLHSKELRNPLSFFFG

SEQ ID NO: 2316893 - protein, 22 aa, Cryptosporidium parvum
KVPLGTVWVWGSGECDQLGIKE

SEQ ID NO: 2316894 - protein, 17 aa, Cryptosporidium parvum
KVPQAKPPFIVLENIYG

SEQ ID NO: 2316895 - protein, 19 aa, Cryptosporidium parvum
KVQFVPGVLMFITSGKDNA

SEQ ID NO: 2316896 - protein, 28 aa, Cryptosporidium parvum
KVQHLSHEKLLLQRGIEFLKKKLYTLKN

SEQ ID NO: 2316897 - protein, 31 aa, Cryptosporidium parvum
KVQSESYLGIPIWRFYGRCTQCGNEIVFKTD

SEQ ID NO: 2316898 - protein, 23 aa, Cryptosporidium parvum
KVSFNFQIPDLRKFRKGLPEMYF

SEQ ID NO: 2316899 - protein, 20 aa, Cryptosporidium parvum
KVSFVEILLLILDYTEDKVL

SEQ ID NO: 2316900 - protein, 26 aa, Cryptosporidium parvum
KVSGKTVILIPLRLLEEFMSLEEQRS

SEQ ID NO: 2316901 - protein, 17 aa, Cryptosporidium parvum
KVSIDYWTRFEALWFVE

SEQ ID NO: 2316902 - protein, 17 aa, Cryptosporidium parvum
KVSLNFCAKYSYYILLK

SEQ ID NO: 2316903 - protein, 26 aa, Cryptosporidium parvum
KVSNSINPYWFLKDTKRIISNFPVKD

SEQ ID NO: 2316904 - protein, 20 aa, Cryptosporidium parvum
KVSTKRKNIPGYNRGRGMGP

SEQ ID NO: 2316905 - protein, 22 aa, Cryptosporidium parvum
KVTRYPLFINLVNNKGYNNSLA

SEQ ID NO: 2316906 - protein, 17 aa, Cryptosporidium parvum
KVVLQRLVLIREFIDIC

SEQ ID NO: 2316907 - protein, 17 aa, Cryptosporidium parvum
KVVSDLLICPICEGFFR

SEQ ID NO: 2316908 - protein, 23 aa, Cryptosporidium parvum
KVVSSFSFFPPKLSGLVLRDRDG

SEQ ID NO: 2316909 - protein, 24 aa, Cryptosporidium parvum
KVVWSPIMFTIMQPSLNMQNLDFD

SEQ ID NO: 2316910 - protein, 20 aa, Cryptosporidium parvum
KVWIHPFFERFSSINLFEFF

SEQ ID NO: 2316911 - protein, 18 aa, Cryptosporidium parvum
KVWLLKDKITGKKYAGKL

SEQ ID NO: 2316912 - protein, 17 aa, Cryptosporidium parvum
KVYEQIPRYLRVNTTIE

SEQ ID NO: 2316913 - protein, 19 aa, Cryptosporidium parvum
KWCMIFIYSKGVEITLTYL

SEQ ID NO: 2316914 - protein, 18 aa, Cryptosporidium parvum
KWCSKVSSIKFLSQNLIE

SEQ ID NO: 2316915 - protein, 21 aa, Cryptosporidium parvum
KWDVMVDVFFWRDPEEYENSA

SEQ ID NO: 2316916 - protein, 22 aa, Cryptosporidium parvum
KWIIFTDIIQTKKTYIRIISAI

SEQ ID NO: 2316917 - protein, 19 aa, Cryptosporidium parvum
KWISFLYNKEILNVEYEFL

SEQ ID NO: 2316918 - protein, 19 aa, Cryptosporidium parvum
KWMQPLNCLFLSNGSTIEK

SEQ ID NO: 2316919 - protein, 19 aa, Cryptosporidium parvum
KWNHSRFHWADLTSVHPLL

SEQ ID NO: 2316920 - protein, 19 aa, Cryptosporidium parvum
KWPPSLPNYTQKNLLRTFF

SEQ ID NO: 2316921 - protein, 18 aa, Cryptosporidium parvum
KWVIYPMYDFAHGQSDSI

SEQ ID NO: 2316922 - protein, 30 aa, Cryptosporidium parvum; identical to SEQ ID NO: 2192783

SEQ ID NO: 2316923 - protein, 26 aa, Cryptosporidium parvum
KYCAHIILNTLFLDNQPYRLKMQQKI

SEQ ID NO: 2316924 - protein, 34 aa, Cryptosporidium parvum
KYCMKKVGLLGKFSPRWFIFKGTNLAVFHSAHEE

SEQ ID NO: 2316925 - protein, 26 aa, Cryptosporidium parvum
KYDIDDQLEISIYYKLKNSSNKTNSD

SEQ ID NO: 2316926 - protein, 24 aa, Cryptosporidium parvum
KYDQRWYITEQNKMGPFGWFDGKY

SEQ ID NO: 2316927 - protein, 17 aa, Cryptosporidium parvum
KYEFISRYKAKSDLPMI

SEQ ID NO: 2316928 - protein, 26 aa, Cryptosporidium parvum
KYEKAKYIQIWLHNLIPIGISRVKLL

SEQ ID NO: 2316929 - protein, 19 aa, Cryptosporidium parvum
KYEKLCLLLGNLTDKLIEF

SEQ ID NO: 2316930 - protein, 27 aa, Cryptosporidium parvum
KYETELIEWLPDYLQLINAPEPKHDEK

SEQ ID NO: 2316931 - protein, 18 aa, Cryptosporidium parvum
KYEWATYKSFFCCQETLN

SEQ ID NO: 2316932 - protein, 19 aa, Cryptosporidium parvum
KYFALLNILREACNHPELL

SEQ ID NO: 2316933 - protein, 25 aa, Cryptosporidium parvum
KYFLKEFHDIILFTYRNEFKNIIIT

SEQ ID NO: 2316934 - protein, 18 aa, Cryptosporidium parvum
KYFLLIHGTKDDIVPVQV

SEQ ID NO: 2316935 - protein, 21 aa, Cryptosporidium parvum
KYFNSVYFARIIKQTLQSSLL

SEQ ID NO: 2316936 - protein, 29 aa, Cryptosporidium parvum
KYFRFTLGNLYAHKLFWGNNIPISCMITN

SEQ ID NO: 2316937 - protein, 18 aa, Cryptosporidium parvum
KYFRSKLTEYKYLHNFGI

SEQ ID NO: 2316938 - protein, 18 aa, Cryptosporidium parvum
KYGLFNYINKFISNSSKL

SEQ ID NO: 2316939 - protein, 20 aa, Cryptosporidium parvum
KYGLTLLSQDLLNFLISDIN

SEQ ID NO: 2316940 - protein, 24 aa, Cryptosporidium parvum
KYGQCRRSYLLGYFGEKFNREKSS

SEQ ID NO: 2316941 - protein, 17 aa, Cryptosporidium parvum
KYGSVPHSGFGLGFERL

SEQ ID NO: 2316942 - protein, 21 aa, Cryptosporidium parvum
KYHKIPQFINYKLPSAEIKVD

SEQ ID NO: 2316943 - protein, 25 aa, Cryptosporidium parvum
KYIDNTFILKLIDLFQSFDPRERDY

SEQ ID NO: 2316944 - protein, 43 aa, Cryptosporidium parvum
KYINPLQCDITANGFMLIMVLLYQMGWIDTAILCQMYYVPKTL

SEQ ID NO: 2316945 - protein, 27 aa, Cryptosporidium parvum
KYKIASKFMSLIFYRRSRKGFSKIHSR

SEQ ID NO: 2316946 - protein, 17 aa, Cryptosporidium parvum
KYKLRGMDWYKYLNVSN

SEQ ID NO: 2316947 - protein, 23 aa, Cryptosporidium parvum
KYKNHYIFVSIDRLDQLSGLQLK

SEQ ID NO: 2316948 - protein, 17 aa, Cryptosporidium parvum
KYKRNLIFSGENNTIVS

SEQ ID NO: 2316949 - protein, 27 aa, Cryptosporidium parvum
KYLEKLSYLKIWVPSAHRPPKHQTAII

SEQ ID NO: 2316950 - protein, 18 aa, Cryptosporidium parvum
KYLSRYKSFYGRLHSPSN

SEQ ID NO: 2316951 - protein, 19 aa, Cryptosporidium parvum
KYLTAILSLLDGFDENNRV

SEQ ID NO: 2316952 - protein, 18 aa, Cryptosporidium parvum
KYNILPHYNISKLSKSEC

SEQ ID NO: 2316953 - protein, 17 aa, Cryptosporidium parvum
KYNLWIVGNSRYLLGNP

SEQ ID NO: 2316954 - protein, 30 aa, Cryptosporidium parvum; identical to SEQ ID NO: 2192805

SEQ ID NO: 2316955 - protein, 18 aa, Cryptosporidium parvum
KYPSIQRILRRICKRAII

SEQ ID NO: 2316956 - protein, 20 aa, Cryptosporidium parvum
KYREFLNRFREYPAHSSFTQ

SEQ ID NO: 2316957 - protein, 27 aa, Cryptosporidium parvum
KYRELGLLVFSWLQNIFNKPRLVSPIT

SEQ ID NO: 2316958 - protein, 38 aa, Cryptosporidium parvum
KYRMKYAILTFPCNVPKWIAQQVWFKCSFLSNETDKRS

SEQ ID NO: 2316959 - protein, 34 aa, Cryptosporidium parvum; identical to SEQ ID NO: 2192812

SEQ ID NO: 2316960 - protein, 24 aa, Cryptosporidium parvum
KYSNIIRLKYLNILLSSNMSKRQL

SEQ ID NO: 2316961 - protein, 20 aa, Cryptosporidium parvum
KYSPILHGPILNIKWIMLYD

SEQ ID NO: 2316962 - protein, 25 aa, Cryptosporidium parvum
KYSSPELYLPLSNTPLTFIKEPGDL

SEQ ID NO: 2316963 - protein, 28 aa, Cryptosporidium parvum
KYTIKIPLSIIFLFPPSELQVKSKSIIQ

SEQ ID NO: 2316964 - protein, 20 aa, Cryptosporidium parvum
KYVKFCISFCIYGQGIIDWN

SEQ ID NO: 2316965 - protein, 21 aa, Cryptosporidium parvum
KYVLDCEFRLKKTLLHECCHV

SEQ ID NO: 2316966 - protein, 24 aa, Cryptosporidium parvum
KYVNYSLYNRILGALGNLISSMEV

SEQ ID NO: 2316967 - protein, 25 aa, Cryptosporidium parvum
KYVSPITPILGDYLYRAVASEKQKL

SEQ ID NO: 2316968 - protein, 30 aa, Cryptosporidium parvum; identical to SEQ ID NO: 2192820

SEQ ID NO: 2316969 - protein, 17 aa, Cryptosporidium parvum
KYYFYSIRLKKTIPKEY

SEQ ID NO: 2316970 - protein, 20 aa, Cryptosporidium parvum
KYYINVLKNLDSLTNIIFCI

SEQ ID NO: 2316971 - protein, 26 aa, Cryptosporidium parvum
LAAAIYSRYFFDSQPAKLFLTDVSRL

SEQ ID NO: 2316972 - protein, 31 aa, Cryptosporidium parvum; identical to SEQ ID NO: 2192822

SEQ ID NO: 2316973 - protein, 21 aa, Cryptosporidium parvum
LAAYKTAFWNGIDWTASSFAE

SEQ ID NO: 2316974 - protein, 23 aa, Cryptosporidium parvum
LACEILRPNGIFVTKVFRSTDYN

SEQ ID NO: 2316975 - protein, 28 aa, Cryptosporidium parvum
LACGVEEYLFILVLKLPSICFAEDSEAS

SEQ ID NO: 2316976 - protein, 27 aa, Cryptosporidium parvum
LACYNSIVFGVLRPNAKWRPGRGNSSK

SEQ ID NO: 2316977 - protein, 17 aa, Cryptosporidium parvum
LADVNRPIEVRFASKNH

SEQ ID NO: 2316978 - protein, 24 aa, Cryptosporidium parvum
LAEEWRLRYLYSNPNGPNGQQNGA

SEQ ID NO: 2316979 - protein, 18 aa, Cryptosporidium parvum
LAEFHNSRSSLIRWSKVS

SEQ ID NO: 2316980 - protein, 18 aa, Cryptosporidium parvum
LAEIIIKGNLNEPSESRY

SEQ ID NO: 2316981 - protein, 25 aa, Cryptosporidium parvum
LAELFVIGLPRCSFYMQKQGLIGDP

SEQ ID NO: 2316982 - protein, 18 aa, Cryptosporidium parvum
LAELQCVLCFIFHVERIS

SEQ ID NO: 2316983 - protein, 17 aa, Cryptosporidium parvum
LAEMWKNLPELERSPWE

SEQ ID NO: 2316984 - protein, 18 aa, Cryptosporidium parvum
LAFPLPTNQLAVATQFYD

SEQ ID NO: 2316985 - protein, 22 aa, Cryptosporidium parvum
LAGGRMQIKPFLDAMKVKKKNK

SEQ ID NO: 2316986 - protein, 20 aa, Cryptosporidium parvum
LAHVEYFVEPPIGICLHSLL

SEQ ID NO: 2316987 - protein, 19 aa, Cryptosporidium parvum
LAICGPRLGFKPAYSPDFL

SEQ ID NO: 2316988 - protein, 20 aa, Cryptosporidium parvum
LAIDLLEQILRYEPDLRINP

SEQ ID NO: 2316989 - protein, 19 aa, Cryptosporidium parvum
LAILDIIDENKLILNIPIL

SEQ ID NO: 2316990 - protein, 22 aa, Cryptosporidium parvum
LAIQGTFYYVHRHDRLCASKFK

SEQ ID NO: 2316991 - protein, 31 aa, Cryptosporidium parvum; identical to SEQ ID NO: 2192835

SEQ ID NO: 2316992 - protein, 25 aa, Cryptosporidium parvum
LAKDFLHNYIFLTVGRVGATSGSIV

SEQ ID NO: 2316993 - protein, 19 aa, Cryptosporidium parvum
LAKFNFVQPVNLTGVSFKL

SEQ ID NO: 2316994 - protein, 26 aa, Cryptosporidium parvum
LAKIFLKTMLAIDKKILVNLPKESLN

SEQ ID NO: 2316995 - protein, 18 aa, Cryptosporidium parvum
LAKLRKETSLLYKNEYVK

SEQ ID NO: 2316996 - protein, 22 aa, Cryptosporidium parvum
LAKVCYLLKNKGNLNVLIVACD

SEQ ID NO: 2316997 - protein, 18 aa, Cryptosporidium parvum
LALYEFYKDLKFVGVSSF

SEQ ID NO: 2316998 - protein, 21 aa, Cryptosporidium parvum
LAMSFPMLSKENFELIKQAQQ

SEQ ID NO: 2316999 - protein, 27 aa, Cryptosporidium parvum
LANDPTIERILTPKLALTTAEYLAYEK

SEQ ID NO: 2317000 - protein, 21 aa, Cryptosporidium parvum
LANIITLVRNQISTPTQVCST

SEQ ID NO: 2317001 - protein, 23 aa, Cryptosporidium parvum
LANMPYYNVPLYFNNQPSNQYHP

SEQ ID NO: 2317002 - protein, 33 aa, Cryptosporidium parvum; identical to SEQ ID NO: 2192845

SEQ ID NO: 2317003 - protein, 25 aa, Cryptosporidium parvum
LAPLKVGMILRSYSNFVTLSRFQLF

SEQ ID NO: 2317004 - protein, 19 aa, Cryptosporidium parvum
LAQILAPYLVKYLKSSTIS

SEQ ID NO: 2317005 - protein, 23 aa, Cryptosporidium parvum
LARAMIIIPTRELALQVYKQTTQ

SEQ ID NO: 2317006 - protein, 18 aa, Cryptosporidium parvum
LARDHGIKWAPRFKLNKV

SEQ ID NO: 2317007 - protein, 17 aa, Cryptosporidium parvum
LARLEYWQYINSYLHEI

SEQ ID NO: 2317008 - protein, 34 aa, Cryptosporidium parvum; identical to SEQ ID NO: 2192852

SEQ ID NO: 2317009 - protein, 17 aa, Cryptosporidium parvum
LARSFGWGIQVSHRSGE

SEQ ID NO: 2317010 - protein, 19 aa, Cryptosporidium parvum
LASIHYRWSRGPSRAVCTF

SEQ ID NO: 2317011 - protein, 29 aa, Cryptosporidium parvum
LASQIPVLSLFLKLRLFLEGRDGVVINGV

SEQ ID NO: 2317012 - protein, 17 aa, Cryptosporidium parvum
LASSNFIYGIPNIFHGS

SEQ ID NO: 2317013 - protein, 28 aa, Cryptosporidium parvum
LASTRDLLLDFLFLPASICNVPPTGVES

SEQ ID NO: 2317014 - protein, 17 aa, Cryptosporidium parvum
LASVPRFANLNTPANAV

SEQ ID NO: 2317015 - protein, 20 aa, Cryptosporidium parvum
LATEFGAIRAVRIIERPKDG

SEQ ID NO: 2317016 - protein, 26 aa, Cryptosporidium parvum
LATRQSHLGQFLRALQKIADTFGVAV

SEQ ID NO: 2317017 - protein, 19 aa, Cryptosporidium parvum
LATVDFPRLLFSDGAANGK

SEQ ID NO: 2317018 - protein, 23 aa, Cryptosporidium parvum
LAVIYSRLYDYFTDEDFEIIFGY

SEQ ID NO: 2317019 - protein, 42 aa, Cryptosporidium parvum
LAVRLLDNYPISNSFPPPYYIIVPIYVPPKPFFQPIAEWIVR

SEQ ID NO: 2317020 - protein, 21 aa, Cryptosporidium parvum
LAYAIPICHNLLNISNRLANK

SEQ ID NO: 2317021 - protein, 18 aa, Cryptosporidium parvum
LCDRCDRGYHTYCLDPPL

SEQ ID NO: 2317022 - protein, 18 aa, Cryptosporidium parvum
LCEHLLMKEAFTKNILFP

SEQ ID NO: 2317023 - protein, 20 aa, Cryptosporidium parvum
LCEICRVCGFVIVFAVESEY

SEQ ID NO: 2317024 - protein, 19 aa, Cryptosporidium parvum
LCEYPIGGDFLDDQIARHL

SEQ ID NO: 2317025 - protein, 20 aa, Cryptosporidium parvum
LCFQLPGLLKYNNPASVTVV

SEQ ID NO: 2317026 - protein, 28 aa, Cryptosporidium parvum
LCIEKVKFILYRNLMRRIRNWCRKNLKG

SEQ ID NO: 2317027 - protein, 18 aa, Cryptosporidium parvum
LCKGGDLYQYVLANGAME

SEQ ID NO: 2317028 - protein, 17 aa, Cryptosporidium parvum
LCKISSLAPLFSSLNIC

SEQ ID NO: 2317029 - protein, 19 aa, Cryptosporidium parvum
LCLAYLFDHFNLKDEAEYW

SEQ ID NO: 2317030 - protein, 23 aa, Cryptosporidium parvum
LCNAKIEIIGLFSATNIIAVNSN

SEQ ID NO: 2317031 - protein, 30 aa, Cryptosporidium parvum
LCNCPSYSELFLFSIIYDDSILIKENSKFL

SEQ ID NO: 2317032 - protein, 24 aa, Cryptosporidium parvum
LCNDWNLIRPVKSIHVKNRKVYIL

SEQ ID NO: 2317033 - protein, 19 aa, Cryptosporidium parvum
LCNVIDLISPFHGITTRNL

SEQ ID NO: 2317034 - protein, 36 aa, Cryptosporidium parvum
LCPSFIRSSIVNRLTWNFLFSLLTNGVHIPTKLAID

SEQ ID NO: 2317035 - protein, 25 aa, Cryptosporidium parvum
LCQILCNYAARRGYTPLFIDLDPRG

SEQ ID NO: 2317036 - protein, 25 aa, Cryptosporidium parvum
LCRERGIPLIMVPDSKELGEMAGLC

SEQ ID NO: 2317037 - protein, 19 aa, Cryptosporidium parvum
LCRNTISIQIIYPKNQLSI

SEQ ID NO: 2317038 - protein, 22 aa, Cryptosporidium parvum
LCSSFLFEFDLNLPVLGMIRSS

SEQ ID NO: 2317039 - protein, 17 aa, Cryptosporidium parvum
LCSVYSLFSKILITGYH

SEQ ID NO: 2317040 - protein, 26 aa, Cryptosporidium parvum
LCTDGELWQKILPIGIKPLRQAVYYL

SEQ ID NO: 2317041 - protein, 23 aa, Cryptosporidium parvum
LCYDPIKRILYSISWDQILNSNR

SEQ ID NO: 2317042 - protein, 20 aa, Cryptosporidium parvum
LCYIYSIIFGEKIFEMIPKV

SEQ ID NO: 2317043 - protein, 17 aa, Cryptosporidium parvum
LDAMYEQVYDFKTKYIL

SEQ ID NO: 2317044 - protein, 26 aa, Cryptosporidium parvum
LDATTLTIMRRLPREVDPMVYNMLHE

SEQ ID NO: 2317045 - protein, 19 aa, Cryptosporidium parvum
LDCDLLMESWDRIFRDVVF

SEQ ID NO: 2317046 - protein, 21 aa, Cryptosporidium parvum
LDCFRWVERDSYLPCGSRGLK

SEQ ID NO: 2317047 - protein, 23 aa, Cryptosporidium parvum
LDCFSHLELWFNKDLVGKSLVSQ

SEQ ID NO: 2317048 - protein, 26 aa, Cryptosporidium parvum
LDCIESIIKKIFSLGPLENWLSTYET

SEQ ID NO: 2317049 - protein, 19 aa, Cryptosporidium parvum
LDCKASFTVFSSSPLLLNR

SEQ ID NO: 2317050 - protein, 23 aa, Cryptosporidium parvum
LDDDLLHPSIASSSPLGKVFQST

SEQ ID NO: 2317051 - protein, 29 aa, Cryptosporidium parvum
LDDDSWRFKLLKRRQISWSDISHPIIAPL

SEQ ID NO: 2317052 - protein, 25 aa, Cryptosporidium parvum
LDDESLSSALPWFTSRRKSQQLVKK

SEQ ID NO: 2317053 - protein, 36 aa, Cryptosporidium parvum
LDDNRILIDFTSHLKLWIKLLFGYSIDKKDIIYLCS

SEQ ID NO: 2317054 - protein, 45 aa, Cryptosporidium parvum
LDDQFRITPLGELLSRWPVDLSIGILFIYGLIFDCIDPIVTIASF

SEQ ID NO: 2317055 - protein, 25 aa, Cryptosporidium parvum
LDDQGKPIWGLLPPIEDDDSNNSKN

SEQ ID NO: 2317056 - protein, 22 aa, Cryptosporidium parvum
LDEFISFWCKYTEHIEKNGDSN

SEQ ID NO: 2317057 - protein, 24 aa, Cryptosporidium parvum
LDEHIQFFPIPAYNILIKEMNMSP

SEQ ID NO: 2317058 - protein, 27 aa, Cryptosporidium parvum
LDELSDLLLTDFPSRNWHLAKSDILKT

SEQ ID NO: 2317059 - protein, 19 aa, Cryptosporidium parvum
LDEMILFPPVKAVEIRDNI

SEQ ID NO: 2317060 - protein, 24 aa, Cryptosporidium parvum
LDENRLRIRKLYEKKLHDRKLRIY

SEQ ID NO: 2317061 - protein, 26 aa, Cryptosporidium parvum
LDEPQKLSLILKYGPILINKIQKQTT

SEQ ID NO: 2317062 - protein, 19 aa, Cryptosporidium parvum
LDERLLRIEQLEMNYQNVN

SEQ ID NO: 2317063 - protein, 26 aa, Cryptosporidium parvum
LDETDLQTLCNVLLIADSYNLSALSD

SEQ ID NO: 2317064 - protein, 20 aa, Cryptosporidium parvum
LDFAGFVSLVNSGNEIKKFT

SEQ ID NO: 2317065 - protein, 20 aa, Cryptosporidium parvum
LDFLRGYLERLKRSDFLNLS

SEQ ID NO: 2317066 - protein, 40 aa, Cryptosporidium parvum; identical to SEQ ID NO: 2192898

SEQ ID NO: 2317067 - protein, 17 aa, Cryptosporidium parvum
LDGFPRTIPQAEGLAKI

SEQ ID NO: 2317068 - protein, 29 aa, Cryptosporidium parvum
LDGLIEKIWQYLDLIRIYTKPKGQIPDYA

SEQ ID NO: 2317069 - protein, 33 aa, Cryptosporidium parvum
LDHDNLKYWCKLFKVNLLFPPCKSDNIRRVGNN

SEQ ID NO: 2317070 - protein, 29 aa, Cryptosporidium parvum
LDHIYGSDHCPILLILKTGEFESLYNNEK

SEQ ID NO: 2317071 - protein, 20 aa, Cryptosporidium parvum
LDIIAFFNPICRISSYDIAI

SEQ ID NO: 2317072 - protein, 24 aa, Cryptosporidium parvum
LDIIRFPFRNIASSSIKSLKPAFL

SEQ ID NO: 2317073 - protein, 30 aa, Cryptosporidium parvum
LDIKDYFGHIVIDLLFFQAKKFASIVGTRC

SEQ ID NO: 2317074 - protein, 17 aa, Cryptosporidium parvum
LDIPIKGYFTISPESKE

SEQ ID NO: 2317075 - protein, 17 aa, Cryptosporidium parvum
LDITHSMVMFGSTSKVI

SEQ ID NO: 2317076 - protein, 24 aa, Cryptosporidium parvum
LDKIRLYMMSLSRYGKSPFIYPVY

SEQ ID NO: 2317077 - protein, 27 aa, Cryptosporidium parvum
LDKLEPFLAQWLIWIDKNSSSISTLVL

SEQ ID NO: 2317078 - protein, 26 aa, Cryptosporidium parvum
LDKNIDMNDILWGGGKLNSSLKDDIQ

SEQ ID NO: 2317079 - protein, 20 aa, Cryptosporidium parvum
LDKRIKLWDYLYGTEIDSIN

SEQ ID NO: 2317080 - protein, 28 aa, Cryptosporidium parvum
LDKSYMLQRRWKVVIWDLSIENLCDEEA

SEQ ID NO: 2317081 - protein, 17 aa, Cryptosporidium parvum
LDKYFRFTLGNLYAHKL

SEQ ID NO: 2317082 - protein, 27 aa, Cryptosporidium parvum
LDLDGVLQRLLLLKKKKYACIQIVDFH

SEQ ID NO: 2317083 - protein, 20 aa, Cryptosporidium parvum
LDLDPKFTKAWSRKGNIHYF

SEQ ID NO: 2317084 - protein, 19 aa, Cryptosporidium parvum
LDLFAFNILEIFILTNNKA

SEQ ID NO: 2317085 - protein, 18 aa, Cryptosporidium parvum
LDLGWDMSSDMWGFGCIL

SEQ ID NO: 2317086 - protein, 22 aa, Cryptosporidium parvum
LDLPFFVLTSFLIKKGFFELSD

SEQ ID NO: 2317087 - protein, 17 aa, Cryptosporidium parvum
LDLQFVGSQIYFNLQLE

SEQ ID NO: 2317088 - protein, 17 aa, Cryptosporidium parvum
LDLVPGIVNDDFRNALE

SEQ ID NO: 2317089 - protein, 21 aa, Cryptosporidium parvum
LDMERIYRLISYFLSCCQNRD

SEQ ID NO: 2317090 - protein, 21 aa, Cryptosporidium parvum
LDMFNMFYNGNKNHILSNCIG

SEQ ID NO: 2317091 - protein, 26 aa, Cryptosporidium parvum
LDNIHHYIIISFIDRSLVLTIGEHVE

SEQ ID NO: 2317092 - protein, 28 aa, Cryptosporidium parvum
LDNIQKKFSLLMVLGRPSRELDTGIYRN

SEQ ID NO: 2317093 - protein, 28 aa, Cryptosporidium parvum
LDNISKAALLLPFAIQKELKLFNSCSTS

SEQ ID NO: 2317094 - protein, 30 aa, Cryptosporidium parvum
LDNTILPFDWFPNLCRIPYRIYYSSGISVF

SEQ ID NO: 2317095 - protein, 23 aa, Cryptosporidium parvum
LDNYYLSTWSVKPIKYLNTKIIL

SEQ ID NO: 2317096 - protein, 26 aa, Cryptosporidium parvum
LDPNYSLFYYICDTGRYKLASFEPEK

SEQ ID NO: 2317097 - protein, 31 aa, Cryptosporidium parvum
LDPRSVPCGSFIWWDRRVWEYNFVYMARRLS

SEQ ID NO: 2317098 - protein, 27 aa, Cryptosporidium parvum
LDPTEFDFFYFRISQILKLKGFDLTET

SEQ ID NO: 2317099 - protein, 26 aa, Cryptosporidium parvum
LDPVKTLRILAIRLWDKRIMLKGDLG

SEQ ID NO: 2317100 - protein, 19 aa, Cryptosporidium parvum
LDQNIFNDKFLNTPIMECS

SEQ ID NO: 2317101 - protein, 33 aa, Cryptosporidium parvum
LDRFNIKGLAEALSYLIKFRKQQKNFQLIIITH

SEQ ID NO: 2317102 - protein, 33 aa, Cryptosporidium parvum
LDRHNSDFFIPIGRVLFLLEWIELIISEDQQNQ

SEQ ID NO: 2317103 - protein, 30 aa, Cryptosporidium parvum
LDSDFVTRKAILLRFSWLAPCHLVQIECIN

SEQ ID NO: 2317104 - protein, 28 aa, Cryptosporidium parvum
LDSEFSCKTLLNNGLYLGGMEISIEKWK

SEQ ID NO: 2317105 - protein, 31 aa, Cryptosporidium parvum
LDSGRMKVLLFRFPDYFGSESLRFFDSEDLL

SEQ ID NO: 2317106 - protein, 27 aa, Cryptosporidium parvum
LDSNLKLIPNIRIQLGKYFPLSKDSLL

SEQ ID NO: 2317107 - protein, 25 aa, Cryptosporidium parvum
LDSRLARRHVLIKELPPISANDDEL

SEQ ID NO: 2317108 - protein, 17 aa, Cryptosporidium parvum
LDSSLLNNQLISSDNNS

SEQ ID NO: 2317109 - protein, 32 aa, Cryptosporidium parvum; identical to SEQ ID NO: 2192936

SEQ ID NO: 2317110 - protein, 22 aa, Cryptosporidium parvum
LDSVLLYMHSLGIPDIVDFPFP

SEQ ID NO: 2317111 - protein, 24 aa, Cryptosporidium parvum
LDTFKNFVVCWLDRLIEAQDKDVE

SEQ ID NO: 2317112 - protein, 24 aa, Cryptosporidium parvum
LDTRSFSIKWWPLNEKFYKHEKLG

SEQ ID NO: 2317113 - protein, 21 aa, Cryptosporidium parvum
LDTSLALDLLISNLDMMKNPN

SEQ ID NO: 2317114 - protein, 20 aa, Cryptosporidium parvum
LDTVLFCRDKWLKEDGLIFP

SEQ ID NO: 2317115 - protein, 26 aa, Cryptosporidium parvum
LDTVMEFYRFWSNFSSTRTFSWKDLW

SEQ ID NO: 2317116 - protein, 28 aa, Cryptosporidium parvum
LDVAQFDWVWFDWPHSKIPFSRSELRVI

SEQ ID NO: 2317117 - protein, 29 aa, Cryptosporidium parvum
LDVLEPVYLRRLIRLMSNKLYELEMNRWN

SEQ ID NO: 2317118 - protein, 17 aa, Cryptosporidium parvum
LDVLVISSSLEKAFLMD

SEQ ID NO: 2317119 - protein, 45 aa, Cryptosporidium parvum; identical to SEQ ID NO: 2192948

SEQ ID NO: 2317120 - protein, 23 aa, Cryptosporidium parvum
LDVTPSLILKPNSPIILQAFGEN

SEQ ID NO: 2317121 - protein, 17 aa, Cryptosporidium parvum
LDVYRRCLFVENIDNEN

SEQ ID NO: 2317122 - protein, 19 aa, Cryptosporidium parvum
LDYKKIHRKSTNSVTWDES

SEQ ID NO: 2317123 - protein, 21 aa, Cryptosporidium parvum
LDYKYLIDYSCLLEFSPDGLY

SEQ ID NO: 2317124 - protein, 23 aa, Cryptosporidium parvum
LDYRDFIILIENTEFHSFERSTN

SEQ ID NO: 2317125 - protein, 24 aa, Cryptosporidium parvum
LEAIGYVLMYFCRNGTLPWQGIRA

SEQ ID NO: 2317126 - protein, 27 aa, Cryptosporidium parvum
LEAKKPFYKRFLYDSLPLESCFGVSPL

SEQ ID NO: 2317127 - protein, 19 aa, Cryptosporidium parvum
LEAVMITILTIHFSKPKGG

SEQ ID NO: 2317128 - protein, 17 aa, Cryptosporidium parvum
LECLGGQLKFSCLTLPP

SEQ ID NO: 2317129 - protein, 20 aa, Cryptosporidium parvum
LECTLNYMLDRCWCLSVSEN

SEQ ID NO: 2317130 - protein, 19 aa, Cryptosporidium parvum
LEDFYRFCQTLNPTSAEVM

SEQ ID NO: 2317131 - protein, 27 aa, Cryptosporidium parvum
LEDGESMYLWLGRAIPTTFIQQVFGVA

SEQ ID NO: 2317132 - protein, 20 aa, Cryptosporidium parvum
LEDIKYRYNSLKQDLFSLES

SEQ ID NO: 2317133 - protein, 27 aa, Cryptosporidium parvum
LEDKLPPLKLIIMSATLRVTDFSENPK

SEQ ID NO: 2317134 - protein, 19 aa, Cryptosporidium parvum
LEDLFNLCHRRFTMKTILM

SEQ ID NO: 2317135 - protein, 33 aa, Cryptosporidium parvum; identical to SEQ ID NO: 2192956

SEQ ID NO: 2317136 - protein, 24 aa, Cryptosporidium parvum
LEDMGPTKLYRYLDSLPYDKRLNI

SEQ ID NO: 2317137 - protein, 33 aa, Cryptosporidium parvum
LEDMRIIQRNLVYVVGLSYSIAKREILSCENSF

SEQ ID NO: 2317138 - protein, 26 aa, Cryptosporidium parvum
LEDNSWILRYLVLRLEKEHLKMKNIL

SEQ ID NO: 2317139 - protein, 19 aa, Cryptosporidium parvum
LEEAMILHKLRHPNIVSLV

SEQ ID NO: 2317140 - protein, 25 aa, Cryptosporidium parvum
LEEEVTRLRYLVDSQTKRISALEMR

SEQ ID NO: 2317141 - protein, 25 aa, Cryptosporidium parvum
LEEHSHTILIFIFNLNKIKNSQKKN

SEQ ID NO: 2317142 - protein, 19 aa, Cryptosporidium parvum
LEEIFAKYGKIESIKMFNS

SEQ ID NO: 2317143 - protein, 22 aa, Cryptosporidium parvum
LEEIHGFLDQLLSKLGLVAEYS

SEQ ID NO: 2317144 - protein, 25 aa, Cryptosporidium parvum
LEEKPVMDYIYKLGMFRFSKILRNE

SEQ ID NO: 2317145 - protein, 21 aa, Cryptosporidium parvum
LEELIIIEGRLKNSILDLNKL

SEQ ID NO: 2317146 - protein, 23 aa, Cryptosporidium parvum
LEEQFQIISKCKQFIIALEEIIS

SEQ ID NO: 2317147 - protein, 19 aa, Cryptosporidium parvum
LEESRAILWEISQPSPFNP

SEQ ID NO: 2317148 - protein, 20 aa, Cryptosporidium parvum
LEFEPLKISLYELIMRQLMD

SEQ ID NO: 2317149 - protein, 18 aa, Cryptosporidium parvum
LEFLLSNNKKENFVACLY

SEQ ID NO: 2317150 - protein, 27 aa, Cryptosporidium parvum
LEFNLKKIVTFGLPFVPFSIRAENDSG

SEQ ID NO: 2317151 - protein, 38 aa, Cryptosporidium parvum
LEFQEKYRIFDLSLFIKMILILRFEVKLIRICNNKGGV

SEQ ID NO: 2317152 - protein, 17 aa, Cryptosporidium parvum
LEGDLAPILVQLVIRDS

SEQ ID NO: 2317153 - protein, 24 aa, Cryptosporidium parvum
LEGEVQVSLPSNWLSRRASSLTSM

SEQ ID NO: 2317154 - protein, 22 aa, Cryptosporidium parvum
LEGIGILKKMGRNAFMCSASVP

SEQ ID NO: 2317155 - protein, 38 aa, Cryptosporidium parvum
LEGLQWVSYYYFRGVPSWRWYYPYRYAPFACDIAIILS

SEQ ID NO: 2317156 - protein, 20 aa, Cryptosporidium parvum
LEGLTKLKPCYLCYSSSTIS

SEQ ID NO: 2317157 - protein, 21 aa, Cryptosporidium parvum
LEGMTKSKMMNSLLLGNGVNN

SEQ ID NO: 2317158 - protein, 19 aa, Cryptosporidium parvum
LEHIETLQLLLEHFSFEEQ

SEQ ID NO: 2317159 - protein, 25 aa, Cryptosporidium parvum
LEHKLPVAEFAPPAPIKNGLPWCVS

SEQ ID NO: 2317160 - protein, 25 aa, Cryptosporidium parvum
LEHRESILLSALEDSSYRMTDIDKA

SEQ ID NO: 2317161 - protein, 19 aa, Cryptosporidium parvum
LEHSVYFSSPLTKKVTMQY

SEQ ID NO: 2317162 - protein, 27 aa, Cryptosporidium parvum
LEIESSNIFLPLIKGKCSRAARRQQKL

SEQ ID NO: 2317163 - protein, 24 aa, Cryptosporidium parvum
LEIGYLYDHIFSPVGGVHWMPRNE

SEQ ID NO: 2317164 - protein, 19 aa, Cryptosporidium parvum
LEIIKMLMDVYFDDFISWN

SEQ ID NO: 2317165 - protein, 24 aa, Cryptosporidium parvum
LEIITLILMNPRKEYYYYLNLNNK

SEQ ID NO: 2317166 - protein, 17 aa, Cryptosporidium parvum
LEIKLMKESLERLILNK

SEQ ID NO: 2317167 - protein, 19 aa, Cryptosporidium parvum
LEIMSFSGLIDFSSIFVPY

SEQ ID NO: 2317168 - protein, 17 aa, Cryptosporidium parvum
LEISREGDLLKLIQEEI

SEQ ID NO: 2317169 - protein, 24 aa, Cryptosporidium parvum
LEIVIKRAIKGGLDKILITAGSYQ

SEQ ID NO: 2317170 - protein, 26 aa, Cryptosporidium parvum
LEIVQDILLLSIIRGPLSSDFLSCTY

SEQ ID NO: 2317171 - protein, 22 aa, Cryptosporidium parvum
LEKAFLMDIYSRTFVASDSSLF

SEQ ID NO: 2317172 - protein, 36 aa, Cryptosporidium parvum
LEKDDYNLLIYNSDKYWSSRLYDLYRRMKGESSQRD

SEQ ID NO: 2317173 - protein, 24 aa, Cryptosporidium parvum
LEKHIQLPSIVSFRDLCMEAFGEE

SEQ ID NO: 2317174 - protein, 31 aa, Cryptosporidium parvum
LEKKELNTSIRLWWKRIFKGSIETDISKFNR

SEQ ID NO: 2317175 - protein, 25 aa, Cryptosporidium parvum
LEKKKFKWSFLHTEKFWLENVMNFE

SEQ ID NO: 2317176 - protein, 34 aa, Cryptosporidium parvum
LEKLMNYICEIVKLYWTPFYFKETEKFVKSIRNV

SEQ ID NO: 2317177 - protein, 25 aa, Cryptosporidium parvum
LEKNNYLIWPRILLSENKNLKMFAV

SEQ ID NO: 2317178 - protein, 32 aa, Cryptosporidium parvum; identical to SEQ ID NO: 2192992

SEQ ID NO: 2317179 - protein, 22 aa, Cryptosporidium parvum
LEKRPCIIYNYPKDIKSFYMKL

SEQ ID NO: 2317180 - protein, 18 aa, Cryptosporidium parvum
LEKSELIGEINYLRKMLN

SEQ ID NO: 2317181 - protein, 17 aa, Cryptosporidium parvum
LEKSYERLLDSLTTKRM

SEQ ID NO: 2317182 - protein, 23 aa, Cryptosporidium parvum
LELDKFIESFSVTLVFIASTLIN

SEQ ID NO: 2317183 - protein, 18 aa, Cryptosporidium parvum
LELEMAFIGPGSDFQFSI

SEQ ID NO: 2317184 - protein, 17 aa, Cryptosporidium parvum
LELFPFHQESLKLESLL

SEQ ID NO: 2317185 - protein, 19 aa, Cryptosporidium parvum
LELKPSHFIPLLKSYIEDT

SEQ ID NO: 2317186 - protein, 33 aa, Cryptosporidium parvum
LELKVGSELILYKRSWDWLARTRLDEACKKKIG

SEQ ID NO: 2317187 - protein, 18 aa, Cryptosporidium parvum
LELLKKRGNISSSNKKDP

SEQ ID NO: 2317188 - protein, 20 aa, Cryptosporidium parvum
LELLNHYKYHFDSSLQLSGA

SEQ ID NO: 2317189 - protein, 18 aa, Cryptosporidium parvum
LELPYMGELLKFGDSGLK

SEQ ID NO: 2317190 - protein, 27 aa, Cryptosporidium parvum
LELQQMRILQKFDEYLLTLSDSEKSLE

SEQ ID NO: 2317191 - protein, 19 aa, Cryptosporidium parvum
LELRLEPIMNLWPDTFFYD

SEQ ID NO: 2317192 - protein, 24 aa, Cryptosporidium parvum
LELSELRVPSYLNNSPLIDKHNNN

SEQ ID NO: 2317193 - protein, 19 aa, Cryptosporidium parvum
LEMGMGSLGSLFTTVEGMI

SEQ ID NO: 2317194 - protein, 25 aa, Cryptosporidium parvum
LEMNSYTELFLKLNINPILSNSGST

SEQ ID NO: 2317195 - protein, 22 aa, Cryptosporidium parvum
LENDFLLLDGILNYGIAIHNSK

SEQ ID NO: 2317196 - protein, 17 aa, Cryptosporidium parvum
LENETIFLQFSFNSEEK

SEQ ID NO: 2317197 - protein, 25 aa, Cryptosporidium parvum
LENIGKLHRKIIGSELFQSSQNTQL

SEQ ID NO: 2317198 - protein, 21 aa, Cryptosporidium parvum
LENILFTDNNYIWVNAPRHPG

SEQ ID NO: 2317199 - protein, 26 aa, Cryptosporidium parvum
LENIYKIFEYKMNIEIPKFNDSMDLG

SEQ ID NO: 2317200 - protein, 21 aa, Cryptosporidium parvum
LENLENCYLVISPNISNMLSS

SEQ ID NO: 2317201 - protein, 34 aa, Cryptosporidium parvum
LENLTKQWIPIRPKSRFLYYYKKKGNYSNAIMKS

SEQ ID NO: 2317202 - protein, 24 aa, Cryptosporidium parvum
LENNVLGLPSWFIEDENKHNKPEL

SEQ ID NO: 2317203 - protein, 29 aa, Cryptosporidium parvum
LENTFDFNGILLKASFLGKTDIIKSCLDN

SEQ ID NO: 2317204 - protein, 29 aa, Cryptosporidium parvum
LEPITGLYDSFILLLDFNSLYPSIIQEFN

SEQ ID NO: 2317205 - protein, 27 aa, Cryptosporidium parvum
LEPLTEFSPLLLPLEPMNIVKFSASHH

SEQ ID NO: 2317206 - protein, 26 aa, Cryptosporidium parvum
LEPMMAITYLLNYILHRDDYGTNLYL

SEQ ID NO: 2317207 - protein, 36 aa, Cryptosporidium parvum; identical to SEQ ID NO: 2193012

SEQ ID NO: 2317208 - protein, 20 aa, Cryptosporidium parvum
LEPSLIYIRSSFNQKYELSA

SEQ ID NO: 2317209 - protein, 27 aa, Cryptosporidium parvum
LEPSLKSLFSLKTLKWIFVGGKGGVGK

SEQ ID NO: 2317210 - protein, 22 aa, Cryptosporidium parvum
LEPTHPIRLGLALNFSVFHYEI

SEQ ID NO: 2317211 - protein, 23 aa, Cryptosporidium parvum
LEQAKKMYPNTHLIVGVASDEET

SEQ ID NO: 2317212 - protein, 24 aa, Cryptosporidium parvum
LEQDRTLVYWAKKPSFRDEQPRGS

SEQ ID NO: 2317213 - protein, 18 aa, Cryptosporidium parvum
LEQFQHTHLYGRHLIIEV

SEQ ID NO: 2317214 - protein, 20 aa, Cryptosporidium parvum
LEQLKMILEMDLEIGVNGCS

SEQ ID NO: 2317215 - protein, 28 aa, Cryptosporidium parvum
LEQNKSIPPYFRPFDKPNNYIHERNCSS

SEQ ID NO: 2317216 - protein, 24 aa, Cryptosporidium parvum
LERCKSAFFCKLLHEFYQVDKHPD

SEQ ID NO: 2317217 - protein, 25 aa, Cryptosporidium parvum
LERDPREEILKAFKLFDDDNTGKIS

SEQ ID NO: 2317218 - protein, 24 aa, Cryptosporidium parvum
LEREVYAYRLLRHPNICSYIGVCL

SEQ ID NO: 2317219 - protein, 17 aa, Cryptosporidium parvum
LERFDDLEFYLGPSLDC

SEQ ID NO: 2317220 - protein, 30 aa, Cryptosporidium parvum
LERFSIGYFTLSLSCLKWLLLSDPDNNISI

SEQ ID NO: 2317221 - protein, 26 aa, Cryptosporidium parvum
LERLRTYPGPIPWNYGAFPQTWEDPN

SEQ ID NO: 2317222 - protein, 18 aa, Cryptosporidium parvum
LERLSLHLINSASKHFID

SEQ ID NO: 2317223 - protein, 25 aa, Cryptosporidium parvum
LERQKWVPTLPYSLSSNCIKIKEIE

SEQ ID NO: 2317224 - protein, 25 aa, Cryptosporidium parvum
LERRGLIELIVHPLCIDDPAPWRGS

SEQ ID NO: 2317225 - protein, 21 aa, Cryptosporidium parvum
LERSLINAKTKYTKLLMQCNS

SEQ ID NO: 2317226 - protein, 18 aa, Cryptosporidium parvum
LERYTFKNNFTKTLGIFN

SEQ ID NO: 2317227 - protein, 25 aa, Cryptosporidium parvum
LESHSFISLLYMKIGNYFKSYEHIM

SEQ ID NO: 2317228 - protein, 22 aa, Cryptosporidium parvum
LESINFPVFGAIKLTMSSRGAI

SEQ ID NO: 2317229 - protein, 22 aa, Cryptosporidium parvum
LESQFGLPITPFMDLKDDITKI

SEQ ID NO: 2317230 - protein, 21 aa, Cryptosporidium parvum
LESRELLALCLKKIKGLNTVR

SEQ ID NO: 2317231 - protein, 27 aa, Cryptosporidium parvum
LESRRFIHIPFPPLNYKHDTKLLILAL

SEQ ID NO: 2317232 - protein, 35 aa, Cryptosporidium parvum
LESSTLKIIIPLMKYMEPVYLRWRKWNKKYKRLMD

SEQ ID NO: 2317233 - protein, 19 aa, Cryptosporidium parvum
LETGFWSEMPSKMKIESLK

SEQ ID NO: 2317234 - protein, 22 aa, Cryptosporidium parvum
LETILFNIISNPGDLRYRSIKS

SEQ ID NO: 2317235 - protein, 17 aa, Cryptosporidium parvum
LETPMIPMISGTSGYFV

SEQ ID NO: 2317236 - protein, 23 aa, Cryptosporidium parvum
LETSINIFGFENFGFESSEISKR

SEQ ID NO: 2317237 - protein, 18 aa, Cryptosporidium parvum
LETSLLNHLLIKKPDDHE

SEQ ID NO: 2317238 - protein, 41 aa, Cryptosporidium parvum
LETVDYIIKSVIWIAKHGWKFLPLYIFEESLGTWRHRSEWK

SEQ ID NO: 2317239 - protein, 18 aa, Cryptosporidium parvum
LEVFFPYDNVYPEQLEYM

SEQ ID NO: 2317240 - protein, 25 aa, Cryptosporidium parvum
LEVSDPFCYPTPIALSSASNHIEKN

SEQ ID NO: 2317241 - protein, 17 aa, Cryptosporidium parvum
LEVYGKILNLRIVKDFQ

SEQ ID NO: 2317242 - protein, 17 aa, Cryptosporidium parvum
LEVYKQFLDLIPNNFHE

SEQ ID NO: 2317243 - protein, 26 aa, Cryptosporidium parvum
LEVYLGQFTFFRFQLRDYPAITKVVC

SEQ ID NO: 2317244 - protein, 25 aa, Cryptosporidium parvum
LEYINNPRFKYLTALGIVYLRLTES

SEQ ID NO: 2317245 - protein, 20 aa, Cryptosporidium parvum
LFDAQGFFFPPKTLENINSI

SEQ ID NO: 2317246 - protein, 19 aa, Cryptosporidium parvum
LFDDLENIIFHRLKIFFST

SEQ ID NO: 2317247 - protein, 17 aa, Cryptosporidium parvum
LFDFCKTIEKFTFHTET

SEQ ID NO: 2317248 - protein, 27 aa, Cryptosporidium parvum
LFDKLTNHRFVNIPNIFILYNEIHMSK

SEQ ID NO: 2317249 - protein, 18 aa, Cryptosporidium parvum
LFDSLLTYNPELANQLDF

SEQ ID NO: 2317250 - protein, 18 aa, Cryptosporidium parvum
LFEDISVVFFYEVKNKGD

SEQ ID NO: 2317251 - protein, 18 aa, Cryptosporidium parvum
LFEEAIKSLWNKCPKYFV

SEQ ID NO: 2317252 - protein, 17 aa, Cryptosporidium parvum
LFEFIRVVSCQIIDFDT

SEQ ID NO: 2317253 - protein, 18 aa, Cryptosporidium parvum
LFEFLQNPSYIQDKNIVC

SEQ ID NO: 2317254 - protein, 24 aa, Cryptosporidium parvum
LFEFMVTLQERFYSWLSSSNSLLY

SEQ ID NO: 2317255 - protein, 28 aa, Cryptosporidium parvum
LFEHVYNPYYYKVLKGLTVLPAVISKKI

SEQ ID NO: 2317256 - protein, 17 aa, Cryptosporidium parvum
LFEIDIIDWRMLFSPIH

SEQ ID NO: 2317257 - protein, 24 aa, Cryptosporidium parvum
LFEIGFNVYPIGMPPLIHSNSQVC

SEQ ID NO: 2317258 - protein, 23 aa, Cryptosporidium parvum
LFESFEDYNSIYLIMELCTGGEL

SEQ ID NO: 2317259 - protein, 17 aa, Cryptosporidium parvum
LFGKWSYDDVNVSDLSL

SEQ ID NO: 2317260 - protein, 17 aa, Cryptosporidium parvum
LFGMMDDLIVRRGFDLF

SEQ ID NO: 2317261 - protein, 24 aa, Cryptosporidium parvum
LFGNNLLHLLTPYSESRLSFQEKQ

SEQ ID NO: 2317262 - protein, 24 aa, Cryptosporidium parvum
LFGPGSLVWIPCPKEVWRPGVVSR

SEQ ID NO: 2317263 - protein, 18 aa, Cryptosporidium parvum
LFHKCVSVWLQDLNLILR

SEQ ID NO: 2317264 - protein, 28 aa, Cryptosporidium parvum
LFHSIKTLFRNKPVFIILNKIDSRSVDD

SEQ ID NO: 2317265 - protein, 17 aa, Cryptosporidium parvum
LFIDILEKYMYYLEQGN

SEQ ID NO: 2317266 - protein, 29 aa, Cryptosporidium parvum
LFIEIENVLLFWLNLIFSSSDIDYKPPFF

SEQ ID NO: 2317267 - protein, 22 aa, Cryptosporidium parvum
LFIFFILKMIERRKIAVIGSGQ

SEQ ID NO: 2317268 - protein, 20 aa, Cryptosporidium parvum
LFIHGSLYHLALMKRREFPE

SEQ ID NO: 2317269 - protein, 17 aa, Cryptosporidium parvum
LFITFKRNQEAFLDDEA

SEQ ID NO: 2317270 - protein, 19 aa, Cryptosporidium parvum
LFIVVDLVLHHGASKLNSL

SEQ ID NO: 2317271 - protein, 20 aa, Cryptosporidium parvum
LFKILFERCFQEYLLLCCDP

SEQ ID NO: 2317272 - protein, 18 aa, Cryptosporidium parvum
LFKLIIKSVIKNDPEPLI

SEQ ID NO: 2317273 - protein, 20 aa, Cryptosporidium parvum
LFKNFKITGYYILISSLRNN

SEQ ID NO: 2317274 - protein, 18 aa, Cryptosporidium parvum
LFKSHRIMLPPNVQGRVV

SEQ ID NO: 2317275 - protein, 20 aa, Cryptosporidium parvum
LFKYSLYSVTGFLPDIGLVQ

SEQ ID NO: 2317276 - protein, 19 aa, Cryptosporidium parvum
LFLQLLKEKVNILPEILYN

SEQ ID NO: 2317277 - protein, 19 aa, Cryptosporidium parvum
LFLSNNYFDDYRFDFINDN

SEQ ID NO: 2317278 - protein, 21 aa, Cryptosporidium parvum
LFLTYTQMVVNTWLLEHGFTV

SEQ ID NO: 2317279 - protein, 28 aa, Cryptosporidium parvum
LFNAENSPYFVFLLSTKAGGFGINLQSA

SEQ ID NO: 2317280 - protein, 23 aa, Cryptosporidium parvum
LFNDNIRSTFGDRLYFSNYDDEL

SEQ ID NO: 2317281 - protein, 18 aa, Cryptosporidium parvum
LFNLVIINRNPIIPLPIS

SEQ ID NO: 2317282 - protein, 18 aa, Cryptosporidium parvum
LFNNPISRNVLLNCTKQI

SEQ ID NO: 2317283 - protein, 17 aa, Cryptosporidium parvum
LFPDCFAGIPSCTSDDW

SEQ ID NO: 2317284 - protein, 18 aa, Cryptosporidium parvum
LFPIVYDKQFYEGIASGI

SEQ ID NO: 2317285 - protein, 17 aa, Cryptosporidium parvum
LFPKFQGIEGNEIELGG

SEQ ID NO: 2317286 - protein, 24 aa, Cryptosporidium parvum
LFPKTKLGAEFLPLNKKENIPGKK

SEQ ID NO: 2317287 - protein, 18 aa, Cryptosporidium parvum
LFPTFNDNDIRFYIYQIL

SEQ ID NO: 2317288 - protein, 26 aa, Cryptosporidium parvum
LFQEPGIFTFIVPPLPQFIHSRQMHT

SEQ ID NO: 2317289 - protein, 25 aa, Cryptosporidium parvum
LFQFVNSYCRIFPKGLFINELLAEL

SEQ ID NO: 2317290 - protein, 25 aa, Cryptosporidium parvum
LFQGHYISYVFKKEFNGWFKFDDDI

SEQ ID NO: 2317291 - protein, 17 aa, Cryptosporidium parvum
LFQLYNFNCSNGGKIQV

SEQ ID NO: 2317292 - protein, 21 aa, Cryptosporidium parvum
LFRHEVLYVLGQMGLKSPLTR

SEQ ID NO: 2317293 - protein, 18 aa, Cryptosporidium parvum
LFRHMEMIMELIQNENNT

SEQ ID NO: 2317294 - protein, 35 aa, Cryptosporidium parvum
LFRLNNFGSIKFSSFNWLIARALTFYHNSICNSNE

SEQ ID NO: 2317295 - protein, 17 aa, Cryptosporidium parvum
LFSAPIKYRNTDMLEGF

SEQ ID NO: 2317296 - protein, 17 aa, Cryptosporidium parvum
LFSEMVQYSLSCLKPGI

SEQ ID NO: 2317297 - protein, 18 aa, Cryptosporidium parvum
LFSGFIKVKKLKGDGLNS

SEQ ID NO: 2317298 - protein, 17 aa, Cryptosporidium parvum
LFSKFLPDLISALPGID

SEQ ID NO: 2317299 - protein, 26 aa, Cryptosporidium parvum
LFSMRCREWYSWHFPELAKIITDTEK

SEQ ID NO: 2317300 - protein, 25 aa, Cryptosporidium parvum
LFSQGLIRVLITTATLAWGVNLPAR

SEQ ID NO: 2317301 - protein, 31 aa, Cryptosporidium parvum
LFSWSRSRLEWVQTPILYLFDAFIRNEEQFK

SEQ ID NO: 2317302 - protein, 18 aa, Cryptosporidium parvum
LFTQFGIPMFPFDFIETL

SEQ ID NO: 2317303 - protein, 33 aa, Cryptosporidium parvum
LFTSSFIFFWDSFFPGKKLLYPPTFDGRIIMYP

SEQ ID NO: 2317304 - protein, 18 aa, Cryptosporidium parvum
LFVGTSMLDILLSIWEAY

SEQ ID NO: 2317305 - protein, 21 aa, Cryptosporidium parvum
LFVTPFEKNLEFWRQLWRTIE

SEQ ID NO: 2317306 - protein, 20 aa, Cryptosporidium parvum
LFYGKYILDPKETFELEISK

SEQ ID NO: 2317307 - protein, 27 aa, Cryptosporidium parvum
LGAVKVEELLLWYSYHMEYRSILLDKL

SEQ ID NO: 2317308 - protein, 23 aa, Cryptosporidium parvum
LGCCIYEILAGRPPFYARSYDEL

SEQ ID NO: 2317309 - protein, 20 aa, Cryptosporidium parvum
LGCDFCTYSYHPKCIETEVF

SEQ ID NO: 2317310 - protein, 19 aa, Cryptosporidium parvum
LGCKHALYYSIRSTLTIFS

SEQ ID NO: 2317311 - protein, 18 aa, Cryptosporidium parvum
LGDFVYCGIYSCIHAFDT

SEQ ID NO: 2317312 - protein, 23 aa, Cryptosporidium parvum
LGDLFKLLVHIIGKPIVEPQTMS

SEQ ID NO: 2317313 - protein, 17 aa, Cryptosporidium parvum
LGDTRIIFKKYKKIFMI

SEQ ID NO: 2317314 - protein, 17 aa, Cryptosporidium parvum
LGDYCEGALLHNVRTRY

SEQ ID NO: 2317315 - protein, 21 aa, Cryptosporidium parvum
LGEENKFYYNKELKSWVVRGE

SEQ ID NO: 2317316 - protein, 26 aa, Cryptosporidium parvum
LGEQQIYRVVLFELLKRINFTDKSEF

SEQ ID NO: 2317317 - protein, 19 aa, Cryptosporidium parvum
LGFNDSHSWIRHLNSQSHN

SEQ ID NO: 2317318 - protein, 17 aa, Cryptosporidium parvum
LGFPEYWKRITVMRCMA

SEQ ID NO: 2317319 - protein, 24 aa, Cryptosporidium parvum
LGFSITYNKRRAWFSVRSRGVLEA

SEQ ID NO: 2317320 - protein, 25 aa, Cryptosporidium parvum
LGFSYITFYLFLTKEGVFNIREIIL

SEQ ID NO: 2317321 - protein, 26 aa, Cryptosporidium parvum
LGGGADPPYSPYCLRCIMVCTISPSV

SEQ ID NO: 2317322 - protein, 23 aa, Cryptosporidium parvum
LGGIHTKYIWRLAYTTLNPSSRS

SEQ ID NO: 2317323 - protein, 27 aa, Cryptosporidium parvum
LGGYTASFYGLRWIESLRTLRCEKLGK

SEQ ID NO: 2317324 - protein, 19 aa, Cryptosporidium parvum
LGHHYWYINPPNDEVIFKL

SEQ ID NO: 2317325 - protein, 25 aa, Cryptosporidium parvum
LGHPLPTHYAIIQELLHKLQYIFRE

SEQ ID NO: 2317326 - protein, 17 aa, Cryptosporidium parvum
LGIGPFQTLNIAEKLYL

SEQ ID NO: 2317327 - protein, 30 aa, Cryptosporidium parvum
LGIKLTMLPVPPFLGKLIYHSIEFGCTSEA

SEQ ID NO: 2317328 - protein, 20 aa, Cryptosporidium parvum
LGILTWYARMDPRVVHVVVL

SEQ ID NO: 2317329 - protein, 31 aa, Cryptosporidium parvum
LGINKDHIIKILRPYYEPSTILSTISDLESK

SEQ ID NO: 2317330 - protein, 19 aa, Cryptosporidium parvum
LGISPSSGKLFIWNITSME

SEQ ID NO: 2317331 - protein, 27 aa, Cryptosporidium parvum
LGKCEGFLDILLSPPRFTRGILNRHCY

SEQ ID NO: 2317332 - protein, 22 aa, Cryptosporidium parvum
LGKGWKIFLSRSVDLGRWTIIQ

SEQ ID NO: 2317333 - protein, 18 aa, Cryptosporidium parvum
LGKKLVPRNWGILLKDIE

SEQ ID NO: 2317334 - protein, 17 aa, Cryptosporidium parvum
LGKMGGIEYGVVRNFLL

SEQ ID NO: 2317335 - protein, 29 aa, Cryptosporidium parvum
LGKRVAIDASMWIYQFLAAIREGSQWGNL

SEQ ID NO: 2317336 - protein, 41 aa, Cryptosporidium parvum; identical to SEQ ID NO: 2193097

SEQ ID NO: 2317337 - protein, 26 aa, Cryptosporidium parvum
LGKVDDMCFLSFLLMNKVFTGFLESI

SEQ ID NO: 2317338 - protein, 19 aa, Cryptosporidium parvum
LGKVFIRCNNVLYISRAEE

SEQ ID NO: 2317339 - protein, 28 aa, Cryptosporidium parvum
LGLTQYSHPYNFPKASFLPPNTEPSSNI

SEQ ID NO: 2317340 - protein, 27 aa, Cryptosporidium parvum
LGNDIIPFEYHWEKPLFHSKLFEIDHE

SEQ ID NO: 2317341 - protein, 24 aa, Cryptosporidium parvum
LGNGFGVFSAIKYLLSKGVLQRKI

SEQ ID NO: 2317342 - protein, 17 aa, Cryptosporidium parvum
LGNHFCGYINSAINCLL

SEQ ID NO: 2317343 - protein, 18 aa, Cryptosporidium parvum
LGNYWRTFHPKYKNLQLA

SEQ ID NO: 2317344 - protein, 29 aa, Cryptosporidium parvum
LGPDGRPMPYWLYKLNGLGIEFKCEICGN

SEQ ID NO: 2317345 - protein, 22 aa, Cryptosporidium parvum
LGPTAFEWILGEIEHQFYRSLA

SEQ ID NO: 2317346 - protein, 32 aa, Cryptosporidium parvum
LGQIKSRLMVEKSLPNIFKIVNNDLLDDKTSE

SEQ ID NO: 2317347 - protein, 19 aa, Cryptosporidium parvum
LGRLKKLIPVCYISNILKT

SEQ ID NO: 2317348 - protein, 21 aa, Cryptosporidium parvum
LGRSAGLGLFSDRHFRKNDII

SEQ ID NO: 2317349 - protein, 22 aa, Cryptosporidium parvum
LGRSNYHVNYYCGKSGGSEEVK

SEQ ID NO: 2317350 - protein, 27 aa, Cryptosporidium parvum
LGSFSSILGYIPYNILLASENIQNEKE

SEQ ID NO: 2317351 - protein, 17 aa, Cryptosporidium parvum
LGSGLYLNKSHKGRIYE

SEQ ID NO: 2317352 - protein, 19 aa, Cryptosporidium parvum
LGSIFRLELKIGFTKEMLK

SEQ ID NO: 2317353 - protein, 23 aa, Cryptosporidium parvum
LGSLRVEDILSIDGKFIQKTTLS

SEQ ID NO: 2317354 - protein, 23 aa, Cryptosporidium parvum
LGSSKLHWEWKANSLNPYFEGNN

SEQ ID NO: 2317355 - protein, 23 aa, Cryptosporidium parvum
LGTIPIYIWDDVNWIPYGNLMER

SEQ ID NO: 2317356 - protein, 19 aa, Cryptosporidium parvum
LGTIVYLRKAFPNLEHLCL

SEQ ID NO: 2317357 - protein, 39 aa, Cryptosporidium parvum
LGVIGAMPDWIQLKGIFFRNPFIMSSAKQYKYLNTQFDS

SEQ ID NO: 2317358 - protein, 18 aa, Cryptosporidium parvum
LGVQVKIMLPYDPEGKTG

SEQ ID NO: 2317359 - protein, 31 aa, Cryptosporidium parvum
LHDHTLFAIAQKKYIYIYDREGIEIHCIRDH

SEQ ID NO: 2317360 - protein, 22 aa, Cryptosporidium parvum
LHDLFQAVMSYPLITQWYKEME

SEQ ID NO: 2317361 - protein, 19 aa, Cryptosporidium parvum
LHECCHVAQFLLDSCIRPP

SEQ ID NO: 2317362 - protein, 17 aa, Cryptosporidium parvum
LHEGMLDSVIFARDKWL

SEQ ID NO: 2317363 - protein, 23 aa, Cryptosporidium parvum
LHFPCASILNFKFFNSIFELYEQ

SEQ ID NO: 2317364 - protein, 27 aa, Cryptosporidium parvum
LHGNISPLTIYLNFEGSWKLGGFENAI

SEQ ID NO: 2317365 - protein, 28 aa, Cryptosporidium parvum
LHGSDYDIIWLQRDFSVYIVNMFDTGQA

SEQ ID NO: 2317366 - protein, 17 aa, Cryptosporidium parvum
LHHHMMVFDGFDKSVFA

SEQ ID NO: 2317367 - protein, 19 aa, Cryptosporidium parvum
LHHTTISIIALLCYCFQNV

SEQ ID NO: 2317368 - protein, 18 aa, Cryptosporidium parvum
LHIKPGVDINVISTPTGP

SEQ ID NO: 2317369 - protein, 24 aa, Cryptosporidium parvum
LHINDIYFFLLSLGPSHGQGFVTY

SEQ ID NO: 2317370 - protein, 23 aa, Cryptosporidium parvum
LHKDHPHLYQQVSIQEIDDSLFM

SEQ ID NO: 2317371 - protein, 18 aa, Cryptosporidium parvum
LHKSYMWGNNNRIMTCNQ

SEQ ID NO: 2317372 - protein, 18 aa, Cryptosporidium parvum
LHLIPLYKQVYGNEDFTT

SEQ ID NO: 2317373 - protein, 18 aa, Cryptosporidium parvum
LHLLPPTFIPNKSSLYNK

SEQ ID NO: 2317374 - protein, 23 aa, Cryptosporidium parvum
LHNDLKYKLSFSLVYLNLNKRGE

SEQ ID NO: 2317375 - protein, 21 aa, Cryptosporidium parvum
LHNFDGILNGMVYLRDRIIDE

SEQ ID NO: 2317376 - protein, 26 aa, Cryptosporidium parvum
LHNGLLVLSKYPILNARFTCFSDVTL

SEQ ID NO: 2317377 - protein, 23 aa, Cryptosporidium parvum
LHNHPHLQQLHALQNLAPIQGMH

SEQ ID NO: 2317378 - protein, 21 aa, Cryptosporidium parvum
LHNLVIVITIRMALDYSLSVQ

SEQ ID NO: 2317379 - protein, 33 aa, Cryptosporidium parvum
LHNNLEELWSLLHFLNPLRFQNYQEFRLRYPDI

SEQ ID NO: 2317380 - protein, 20 aa, Cryptosporidium parvum
LHNQIKTYRFIKDSSKTGNH

SEQ ID NO: 2317381 - protein, 25 aa, Cryptosporidium parvum
LHNSLKLCTLIKSNYDFILSFTCII

SEQ ID NO: 2317382 - protein, 17 aa, Cryptosporidium parvum
LHQLYNGRIPAAPMSAR

SEQ ID NO: 2317383 - protein, 20 aa, Cryptosporidium parvum
LHRLDAPWIHLLKVQVQRDK

SEQ ID NO: 2317384 - protein, 26 aa, Cryptosporidium parvum
LHRPVPLKHYLYIYEKCFQIMDENNK

SEQ ID NO: 2317385 - protein, 19 aa, Cryptosporidium parvum
LHSGGLLHRDMKPSNILLN

SEQ ID NO: 2317386 - protein, 22 aa, Cryptosporidium parvum
LHSTHHHSLIGDELRAVLGLSA

SEQ ID NO: 2317387 - protein, 18 aa, Cryptosporidium parvum
LHTIIWQGDKKQLCGTGK

SEQ ID NO: 2317388 - protein, 19 aa, Cryptosporidium parvum
LIAEFNNFLPEELRLQIPQ

SEQ ID NO: 2317389 - protein, 36 aa, Cryptosporidium parvum
LIAMELFPCGKWPDLLPFLFRLISNLQNYTGATTAP

SEQ ID NO: 2317390 - protein, 19 aa, Cryptosporidium parvum
LICNGPYLNPPMISLLIRA

SEQ ID NO: 2317391 - protein, 17 aa, Cryptosporidium parvum
LICPCDCKGSMQFVHLQ

SEQ ID NO: 2317392 - protein, 17 aa, Cryptosporidium parvum
LICPICEGFFRGATTIR

SEQ ID NO: 2317393 - protein, 25 aa, Cryptosporidium parvum
LIDEMNSFIWILFGHDPCNKELEAI

SEQ ID NO: 2317394 - protein, 18 aa, Cryptosporidium parvum
LIDLIPNKNKQTLSKIDS

SEQ ID NO: 2317395 - protein, 28 aa, Cryptosporidium parvum
LIDLITDNYLYLNAPILPLESLLNNEFE

SEQ ID NO: 2317396 - protein, 20 aa, Cryptosporidium parvum
LIDLLRIMLKFRRHLICPNH

SEQ ID NO: 2317397 - protein, 26 aa, Cryptosporidium parvum
LIDNFKLKFYSLNPFDFVRPSILSIL

SEQ ID NO: 2317398 - protein, 19 aa, Cryptosporidium parvum
LIDNRVYHGIFHSISKKEG

SEQ ID NO: 2317399 - protein, 19 aa, Cryptosporidium parvum
LIDQPYVAIAYFGGLVAIH

SEQ ID NO: 2317400 - protein, 35 aa, Cryptosporidium parvum; identical to SEQ ID NO: 2193155

SEQ ID NO: 2317401 - protein, 25 aa, Cryptosporidium parvum
LIEEYYIRMIILYRKRIQIKEKYEY

SEQ ID NO: 2317402 - protein, 26 aa, Cryptosporidium parvum
LIEHLRPTFWFSGHHHCFFDASIEFE

SEQ ID NO: 2317403 - protein, 20 aa, Cryptosporidium parvum
LIEIVRICILHGILIGINYL

SEQ ID NO: 2317404 - protein, 19 aa, Cryptosporidium parvum
LIEKSFILHGLEYQLRVRK

SEQ ID NO: 2317405 - protein, 17 aa, Cryptosporidium parvum
LIELFTHDVLSKQFLND

SEQ ID NO: 2317406 - protein, 17 aa, Cryptosporidium parvum
LIEYTWLSKLSEGYKSI

SEQ ID NO: 2317407 - protein, 18 aa, Cryptosporidium parvum
LIFINIPSFASGNDIWRY

SEQ ID NO: 2317408 - protein, 19 aa, Cryptosporidium parvum
LIGEKVFFSSALQNSLSSK

SEQ ID NO: 2317409 - protein, 19 aa, Cryptosporidium parvum
LIGFDASWRYKLCNKFKIV

SEQ ID NO: 2317410 - protein, 24 aa, Cryptosporidium parvum
LIGTPLMPPNAYYSKIYTLPMFSI

SEQ ID NO: 2317411 - protein, 28 aa, Cryptosporidium parvum
LIGVVVNSGVWPFGRIGLLNQSQDSSNS

SEQ ID NO: 2317412 - protein, 17 aa, Cryptosporidium parvum
LIHANSYAFKNIYNLDD

SEQ ID NO: 2317413 - protein, 26 aa, Cryptosporidium parvum
LIHASSLHTWIMLARVQALMNGEEKL

SEQ ID NO: 2317414 - protein, 19 aa, Cryptosporidium parvum
LIIEKTFSKTPYIAYNLEP

SEQ ID NO: 2317415 - protein, 17 aa, Cryptosporidium parvum
LIKCCIDKSAWRCLHTL

SEQ ID NO: 2317416 - protein, 19 aa, Cryptosporidium parvum
LIKCPKLLSLYTVKMPVIS

SEQ ID NO: 2317417 - protein, 31 aa, Cryptosporidium parvum
LIKGNFIQSLLLCDIAWIFQSMKNISSNLKT

SEQ ID NO: 2317418 - protein, 25 aa, Cryptosporidium parvum
LIKILKKFCVLVSGNWVYKSELMYN

SEQ ID NO: 2317419 - protein, 33 aa, Cryptosporidium parvum
LIKPGSIKRYGIPALMNYSYRYTNKALSSDTEQ

SEQ ID NO: 2317420 - protein, 20 aa, Cryptosporidium parvum
LIKRRILLNIKNSSGQLANV

SEQ ID NO: 2317421 - protein, 22 aa, Cryptosporidium parvum
LIKSIVILLTNQLVQKGILHSQ

SEQ ID NO: 2317422 - protein, 25 aa, Cryptosporidium parvum
LILDELENYCLWRGWQYMRLDGSTN

SEQ ID NO: 2317423 - protein, 20 aa, Cryptosporidium parvum
LILEEHWSRTPSIQNVPIIY

SEQ ID NO: 2317424 - protein, 17 aa, Cryptosporidium parvum
LILENLFMYLEDHSKIL

SEQ ID NO: 2317425 - protein, 18 aa, Cryptosporidium parvum
LILFDVLNCIYNSLSIII

SEQ ID NO: 2317426 - protein, 26 aa, Cryptosporidium parvum
LILIEELEILGLWEWAVFIIMHTNMN

SEQ ID NO: 2317427 - protein, 19 aa, Cryptosporidium parvum
LILKAYSFGYLGIAFNNTL

SEQ ID NO: 2317428 - protein, 24 aa, Cryptosporidium parvum
LILNNLVRNYLTLGLMISYNTENN

SEQ ID NO: 2317429 - protein, 18 aa, Cryptosporidium parvum
LILPLNIVSLVEIPSEKL

SEQ ID NO: 2317430 - protein, 32 aa, Cryptosporidium parvum; identical to SEQ ID NO: 2193187

SEQ ID NO: 2317431 - protein, 17 aa, Cryptosporidium parvum
LILSQVIIDQFFESILR

SEQ ID NO: 2317432 - protein, 19 aa, Cryptosporidium parvum
LILTFGRFLLKRLESQMIR

SEQ ID NO: 2317433 - protein, 18 aa, Cryptosporidium parvum
LILTVLHEARRFKVQLLE

SEQ ID NO: 2317434 - protein, 18 aa, Cryptosporidium parvum
LIMECSWLSLYNSMVCYG

SEQ ID NO: 2317435 - protein, 18 aa, Cryptosporidium parvum
LIMGLKGLTIRGEIRTNV

SEQ ID NO: 2317436 - protein, 17 aa, Cryptosporidium parvum
LIMLCGLGSSGKTSIIK

SEQ ID NO: 2317437 - protein, 20 aa, Cryptosporidium parvum
LIMNYNLELDLRSVGIRAFE

SEQ ID NO: 2317438 - protein, 21 aa, Cryptosporidium parvum
LIMRHPFPGPGLSINVICYDG

SEQ ID NO: 2317439 - protein, 26 aa, Cryptosporidium parvum
LINCFSVILGFRYANFMLLIDSVDER

SEQ ID NO: 2317440 - protein, 17 aa, Cryptosporidium parvum
LINDKYDGPFKLEMKNN

SEQ ID NO: 2317441 - protein, 18 aa, Cryptosporidium parvum
LINFLLEVVPSALDCSRQ

SEQ ID NO: 2317442 - protein, 22 aa, Cryptosporidium parvum
LINKPYLYSQISNTPFISCYKF

SEQ ID NO: 2317443 - protein, 31 aa, Cryptosporidium parvum
LINLEMFPSKLLFVKPNFRKQLPMLSQFNMI

SEQ ID NO: 2317444 - protein, 29 aa, Cryptosporidium parvum
LINMFDHDKWPLNKWAPSPFRVQHASPYK

SEQ ID NO: 2317445 - protein, 20 aa, Cryptosporidium parvum
LINNNPLTIATTASSGIITA

SEQ ID NO: 2317446 - protein, 20 aa, Cryptosporidium parvum
LINNRLFQLCTFKLTSESDQ

SEQ ID NO: 2317447 - protein, 24 aa, Cryptosporidium parvum
LINPENPLQLIKKLGGELGYSIKG

SEQ ID NO: 2317448 - protein, 17 aa, Cryptosporidium parvum
LINPSIGGLPIPPPGVP

SEQ ID NO: 2317449 - protein, 25 aa, Cryptosporidium parvum
LINSDLLSLLILKMSQKYKIFNNEQ

SEQ ID NO: 2317450 - protein, 27 aa, Cryptosporidium parvum
LINSGKLVFLFQFNGPNGFISNLNRAN

SEQ ID NO: 2317451 - protein, 17 aa, Cryptosporidium parvum
LINSTHLSKLIKLHTVH

SEQ ID NO: 2317452 - protein, 20 aa, Cryptosporidium parvum
LINYFNYQHFYVLYSRFVEL

SEQ ID NO: 2317453 - protein, 21 aa, Cryptosporidium parvum
LIPGQPVRRIVEAKEPLYGVY

SEQ ID NO: 2317454 - protein, 19 aa, Cryptosporidium parvum
LIQFLPFECFKCRKKFCIE

SEQ ID NO: 2317455 - protein, 31 aa, Cryptosporidium parvum
LIQNENNTWLFRKMLFISESLIIDDIELFAN

SEQ ID NO: 2317456 - protein, 23 aa, Cryptosporidium parvum
LIQTYLNIFLKIHSTTILENESE

SEQ ID NO: 2317457 - protein, 22 aa, Cryptosporidium parvum
LIRLYIEFINAMDSKKIKKLNK

SEQ ID NO: 2317458 - protein, 26 aa, Cryptosporidium parvum
LIRNNKLIMIDYLDNFKPPDLLIHVA

SEQ ID NO: 2317459 - protein, 26 aa, Cryptosporidium parvum
LIRQIVQFHGFIGILSFCEEPIIQFT

SEQ ID NO: 2317460 - protein, 19 aa, Cryptosporidium parvum
LIRRGLSFGIKLSLEKAKK

SEQ ID NO: 2317461 - protein, 20 aa, Cryptosporidium parvum
LIRSISCWCISRFTPWLALQ

SEQ ID NO: 2317462 - protein, 22 aa, Cryptosporidium parvum
LIRVSPKFRVPRSFKVFSKVFS

SEQ ID NO: 2317463 - protein, 17 aa, Cryptosporidium parvum
LIRVVDSLSLEEFNFSN

SEQ ID NO: 2317464 - protein, 25 aa, Cryptosporidium parvum
LISDVISVLLFRFGALKNTNILNQI

SEQ ID NO: 2317465 - protein, 25 aa, Cryptosporidium parvum
LISELGILLLKCIESILLESTKLSE

SEQ ID NO: 2317466 - protein, 19 aa, Cryptosporidium parvum
LISFDRLIFYTIVSSIISI

SEQ ID NO: 2317467 - protein, 20 aa, Cryptosporidium parvum
LISFLDTLCNWYVRLNRDRM

SEQ ID NO: 2317468 - protein, 34 aa, Cryptosporidium parvum; identical to SEQ ID NO: 2193214

SEQ ID NO: 2317469 - protein, 21 aa, Cryptosporidium parvum
LISKPLIVNRIKPFTKHRGIL

SEQ ID NO: 2317470 - protein, 18 aa, Cryptosporidium parvum
LISRYSMAKLIDIKTRKL

SEQ ID NO: 2317471 - protein, 29 aa, Cryptosporidium parvum
LISSNEMVNYWKDQYEICNESLKIVNEEF

SEQ ID NO: 2317472 - protein, 18 aa, Cryptosporidium parvum
LITILKSYSSRVIACSNN

SEQ ID NO: 2317473 - protein, 20 aa, Cryptosporidium parvum
LITVMQRFLEYARTNGTHNF

SEQ ID NO: 2317474 - protein, 34 aa, Cryptosporidium parvum; identical to SEQ ID NO: 2193220

SEQ ID NO: 2317475 - protein, 27 aa, Cryptosporidium parvum
LIVKIGMPSIVFSLGLLISNIFGGKDL

SEQ ID NO: 2317476 - protein, 18 aa, Cryptosporidium parvum
LIVLIEEYAICYPMIRFL

SEQ ID NO: 2317477 - protein, 19 aa, Cryptosporidium parvum
LIVPDLNKFGRSEQLFFSI

SEQ ID NO: 2317478 - protein, 26 aa, Cryptosporidium parvum
LIYIHDPEDFRFWKQKPESFMKQLSE

SEQ ID NO: 2317479 - protein, 30 aa, Cryptosporidium parvum
LIYSSRIKIIDFFLYIFNKKEYYSELIRLG

SEQ ID NO: 2317480 - protein, 25 aa, Cryptosporidium parvum
LKCIKRKSLQYLFMKSKQKAQQAYE

SEQ ID NO: 2317481 - protein, 26 aa, Cryptosporidium parvum
LKCYHPICMRFFHTQCLLYYQNNIIW

SEQ ID NO: 2317482 - protein, 18 aa, Cryptosporidium parvum
LKDNVAVVILLEYRQNDL

SEQ ID NO: 2317483 - protein, 23 aa, Cryptosporidium parvum
LKDQYLCTNGIAYLSHEPCISCS

SEQ ID NO: 2317484 - protein, 35 aa, Cryptosporidium parvum; identical to SEQ ID NO: 2193242

SEQ ID NO: 2317485 - protein, 27 aa, Cryptosporidium parvum
LKDSFEYFQYFMTIKLNQFVDLNQIKE

SEQ ID NO: 2317486 - protein, 24 aa, Cryptosporidium parvum
LKDTGNCIPLKFNSKKGKEDFLNF

SEQ ID NO: 2317487 - protein, 17 aa, Cryptosporidium parvum
LKECVEWPLIHSELFEY

SEQ ID NO: 2317488 - protein, 18 aa, Cryptosporidium parvum
LKEEASSVSIPPAPAPAP

SEQ ID NO: 2317489 - protein, 26 aa, Cryptosporidium parvum
LKEERQQLIQLLTALSSNNNFYIDNN

SEQ ID NO: 2317490 - protein, 23 aa, Cryptosporidium parvum
LKEEWLNYLVKLDNYEKEILIGQ

SEQ ID NO: 2317491 - protein, 19 aa, Cryptosporidium parvum
LKEIEGFTGFFPIQQKVIP

SEQ ID NO: 2317492 - protein, 27 aa, Cryptosporidium parvum
LKEILLRRNFESKNPLRLVVMSATLES

SEQ ID NO: 2317493 - protein, 30 aa, Cryptosporidium parvum
LKEKVNILPEILYNLGIWVIGEYGSCVEND

SEQ ID NO: 2317494 - protein, 23 aa, Cryptosporidium parvum
LKELNPYYVLQGDSFSSSKICNI

SEQ ID NO: 2317495 - protein, 26 aa, Cryptosporidium parvum
LKELWSLIDFVYPGKLGTLPVFEQQF

SEQ ID NO: 2317496 - protein, 25 aa, Cryptosporidium parvum
LKEMETIKILYEEKLSLVRRTNKNE

SEQ ID NO: 2317497 - protein, 29 aa, Cryptosporidium parvum
LKEMNIHDELKLLFIAKSKVNEQNKHPRT

SEQ ID NO: 2317498 - protein, 32 aa, Cryptosporidium parvum
LKERIFLDHELVSRLRYFWPTNELQEQLLFSI

SEQ ID NO: 2317499 - protein, 37 aa, Cryptosporidium parvum; identical to SEQ ID NO: 2193251

SEQ ID NO: 2317500 - protein, 24 aa, Cryptosporidium parvum
LKESGNCIPLFFNNSQDKERFVAT

SEQ ID NO: 2317501 - protein, 18 aa, Cryptosporidium parvum
LKEWMMRLDPELLSLQEK

SEQ ID NO: 2317502 - protein, 22 aa, Cryptosporidium parvum
LKEYQIVGVSWLLALHQNSYNG

SEQ ID NO: 2317503 - protein, 18 aa, Cryptosporidium parvum
LKFDNLSIDIKPAYTLSM

SEQ ID NO: 2317504 - protein, 17 aa, Cryptosporidium parvum
LKFLLNGNKKELLDLIL

SEQ ID NO: 2317505 - protein, 28 aa, Cryptosporidium parvum
LKFQKKFLCYIYILKLISKRIKLSLREL

SEQ ID NO: 2317506 - protein, 25 aa, Cryptosporidium parvum
LKFVDIACPYLPTKNSRRLILEQLK

SEQ ID NO: 2317507 - protein, 23 aa, Cryptosporidium parvum
LKFVNFKLYQLNNLTYPPTINTP

SEQ ID NO: 2317508 - protein, 32 aa, Cryptosporidium parvum
LKGFGTIIPLGRMRMLFNYQKIEYLICGESKI

SEQ ID NO: 2317509 - protein, 24 aa, Cryptosporidium parvum
LKGKYKVFSMNNAKHRIFSRKKAG

SEQ ID NO: 2317510 - protein, 27 aa, Cryptosporidium parvum
LKGVAMPWLYQNFDANGYSFYYMKYNK

SEQ ID NO: 2317511 - protein, 29 aa, Cryptosporidium parvum
LKGVSKERLKILLDLYPTPDEIQLLNSIK

SEQ ID NO: 2317512 - protein, 25 aa, Cryptosporidium parvum
LKHPRILFRIYGKHVGKFYDSKVEL

SEQ ID NO: 2317513 - protein, 28 aa, Cryptosporidium parvum
LKHSLSVFKLKFLYFAENISLFESLFRL

SEQ ID NO: 2317514 - protein, 19 aa, Cryptosporidium parvum
LKIDELEHLNLNLKLNEDV

SEQ ID NO: 2317515 - protein, 25 aa, Cryptosporidium parvum
LKIDIKKFQFSIGKETIRFDKIIEF

SEQ ID NO: 2317516 - protein, 29 aa, Cryptosporidium parvum
LKIENEELKILLKKKEGIIMDLQNELGQI

SEQ ID NO: 2317517 - protein, 18 aa, Cryptosporidium parvum
LKIFVISKHLCGNGFDLG

SEQ ID NO: 2317518 - protein, 22 aa, Cryptosporidium parvum
LKIIQVFVFCIMNRYDLAQSLF

SEQ ID NO: 2317519 - protein, 41 aa, Cryptosporidium parvum
LKIKSKILVYKRYEDYIRLLPFFKERKYIPLFSNTELDSEM

SEQ ID NO: 2317520 - protein, 28 aa, Cryptosporidium parvum
LKITKAQKKIPLWARSMNWIPKMKEQRN

SEQ ID NO: 2317521 - protein, 30 aa, Cryptosporidium parvum; identical to SEQ ID NO: 2193263

SEQ ID NO: 2317522 - protein, 38 aa, Cryptosporidium parvum; identical to SEQ ID NO: 2193265

SEQ ID NO: 2317523 - protein, 24 aa, Cryptosporidium parvum
LKKIALTVIARYCPDKWIENLRNV

SEQ ID NO: 2317524 - protein, 17 aa, Cryptosporidium parvum
LKKIKSKTWRKNRRKQM

SEQ ID NO: 2317525 - protein, 26 aa, Cryptosporidium parvum
LKKIQSYLVLSKFWNSHIFLNFETNM

SEQ ID NO: 2317526 - protein, 34 aa, Cryptosporidium parvum
LKKKFDNLYFKFYSNLPFINFYSSVYFINIAELY

SEQ ID NO: 2317527 - protein, 17 aa, Cryptosporidium parvum
LKKLLAFKEVNLDFIPY

SEQ ID NO: 2317528 - protein, 28 aa, Cryptosporidium parvum
LKKNSKPLSIYWIQDSKLILDDLINDLN

SEQ ID NO: 2317529 - protein, 27 aa, Cryptosporidium parvum
LKKSQFIYLYTKIIQILIKKQYNLVKS

SEQ ID NO: 2317530 - protein, 18 aa, Cryptosporidium parvum
LKKTLLHECCHVAQFLLD

SEQ ID NO: 2317531 - protein, 18 aa, Cryptosporidium parvum
LKLIDKLPGMVTKNSPSS

SEQ ID NO: 2317532 - protein, 28 aa, Cryptosporidium parvum
LKLINDPHFKLLISPLYKEYHSNLETKS

SEQ ID NO: 2317533 - protein, 17 aa, Cryptosporidium parvum
LKLKFDYERNHKVPRIL

SEQ ID NO: 2317534 - protein, 17 aa, Cryptosporidium parvum
LKLLEESLNRIQLATSS

SEQ ID NO: 2317535 - protein, 23 aa, Cryptosporidium parvum
LKLNSIPFLPFTLQNLEILTEIS

SEQ ID NO: 2317536 - protein, 24 aa, Cryptosporidium parvum
LKLRRRGRRRRPGKLNISKQLTKD

SEQ ID NO: 2317537 - protein, 17 aa, Cryptosporidium parvum
LKLYHWSKVQSSNKQEV

SEQ ID NO: 2317538 - protein, 18 aa, Cryptosporidium parvum
LKMLKNRMPIDVTKLAFL

SEQ ID NO: 2317539 - protein, 17 aa, Cryptosporidium parvum
LKMYGVNYPIWNLDQIK

SEQ ID NO: 2317540 - protein, 38 aa, Cryptosporidium parvum
LKNCYFFNVPLTRMTMDFWFAAIRFFFLEAGRNLPLNR

SEQ ID NO: 2317541 - protein, 41 aa, Cryptosporidium parvum
LKNELNEILILYPNGILLSLLKRFYNRYWGKKLSPTTFGYT

SEQ ID NO: 2317542 - protein, 18 aa, Cryptosporidium parvum
LKNFHNKYYSSNNMFLTL

SEQ ID NO: 2317543 - protein, 19 aa, Cryptosporidium parvum
LKNFKKGVLKCLLLKIIRP

SEQ ID NO: 2317544 - protein, 23 aa, Cryptosporidium parvum
LKNKPRDEIFTSLKLIERDFKLI

SEQ ID NO: 2317545 - protein, 34 aa, Cryptosporidium parvum
LKNNLIPINNLLDLLLPWWFPNYNVEVNRNNNED

SEQ ID NO: 2317546 - protein, 24 aa, Cryptosporidium parvum
LKNQLFLEKFGRIFIHWINNKIEN

SEQ ID NO: 2317547 - protein, 25 aa, Cryptosporidium parvum
LKNRDEIMFVKRKVNLISQIYPINI

SEQ ID NO: 2317548 - protein, 24 aa, Cryptosporidium parvum
LKNSLKQFFSIRLDKIFPVDEVFI

SEQ ID NO: 2317549 - protein, 23 aa, Cryptosporidium parvum
LKNYSHIYNTNYTNPFLSVSTND

SEQ ID NO: 2317550 - protein, 19 aa, Cryptosporidium parvum
LKPAPLITKNAMIGKSPKD

SEQ ID NO: 2317551 - protein, 21 aa, Cryptosporidium parvum
LKPQRKYTTLGTLSSLVGYNK

SEQ ID NO: 2317552 - protein, 24 aa, Cryptosporidium parvum
LKPTCIILCTRAHLPVISFNPKDP

SEQ ID NO: 2317553 - protein, 31 aa, Cryptosporidium parvum
LKQEYLQYDPLLHFQINLFESLLEQFTLHIK

SEQ ID NO: 2317554 - protein, 20 aa, Cryptosporidium parvum
LKQKIFEYEFKDNKLDVEAL

SEQ ID NO: 2317555 - protein, 26 aa, Cryptosporidium parvum
LKQPCLELLTFILIDIIMDNEIHFNI

SEQ ID NO: 2317556 - protein, 22 aa, Cryptosporidium parvum
LKQQYFFVCATIQDILRRFKKS

SEQ ID NO: 2317557 - protein, 27 aa, Cryptosporidium parvum
LKQSQYFMWEIFIGFTDPNPNTRWSIK

SEQ ID NO: 2317558 - protein, 22 aa, Cryptosporidium parvum
LKQSYKSFFISKGVMNKIPPSV

SEQ ID NO: 2317559 - protein, 20 aa, Cryptosporidium parvum
LKRDCVNVTLFFNKVLQSRK

SEQ ID NO: 2317560 - protein, 41 aa, Cryptosporidium parvum
LKRIDEVDKFLLSFGLRKVGMHIIFLFEIDPKVHYKIKISL

SEQ ID NO: 2317561 - protein, 30 aa, Cryptosporidium parvum
LKSESNFKVIYKILCLILSMLETNQNTKKS

SEQ ID NO: 2317562 - protein, 24 aa, Cryptosporidium parvum
LKSGFSVIFFHRKGSHIPFTIDCP

SEQ ID NO: 2317563 - protein, 18 aa, Cryptosporidium parvum
LKSILFINWRRYSKKQKI

SEQ ID NO: 2317564 - protein, 27 aa, Cryptosporidium parvum
LKSILPILEFCISSRSPLLIIAEEIEG

SEQ ID NO: 2317565 - protein, 18 aa, Cryptosporidium parvum
LKSLGSEDVFSFPFIDPP

SEQ ID NO: 2317566 - protein, 23 aa, Cryptosporidium parvum
LKSPIPRQFLSEVNKRFPTLPFS

SEQ ID NO: 2317567 - protein, 24 aa, Cryptosporidium parvum
LKSRTPLNSFIFPQASNVQVFNIM

SEQ ID NO: 2317568 - protein, 18 aa, Cryptosporidium parvum
LKTKHLFKLIIKSVIKND

SEQ ID NO: 2317569 - protein, 20 aa, Cryptosporidium parvum
LKTMLGLKEFGFELKLAIST

SEQ ID NO: 2317570 - protein, 22 aa, Cryptosporidium parvum
LKTNYIPNDILLNGGSSPAPCS

SEQ ID NO: 2317571 - protein, 22 aa, Cryptosporidium parvum
LKTPPKRPFLRKGEGKSLVISN

SEQ ID NO: 2317572 - protein, 23 aa, Cryptosporidium parvum
LKTPQMHLHVLKRLTLLPPESKS

SEQ ID NO: 2317573 - protein, 19 aa, Cryptosporidium parvum
LKTVKNTKYFLLIHGTKDD

SEQ ID NO: 2317574 - protein, 26 aa, Cryptosporidium parvum
LKVHSVLLYPTDFYQLFLISSDSFAK

SEQ ID NO: 2317575 - protein, 37 aa, Cryptosporidium parvum; identical to SEQ ID NO: 2193298

SEQ ID NO: 2317576 - protein, 23 aa, Cryptosporidium parvum
LKVKAFEPILLLGKQIFSGVDIR

SEQ ID NO: 2317577 - protein, 34 aa, Cryptosporidium parvum
LKVLGKKELMQLLKWRFLVLKDIKANSIGKKDSL

SEQ ID NO: 2317578 - protein, 33 aa, Cryptosporidium parvum
LKYKDIIDWKGCNPLILISSFFCNGKKLCDVRS

SEQ ID NO: 2317579 - protein, 17 aa, Cryptosporidium parvum
LKYLQKTQKILSYELSS

SEQ ID NO: 2317580 - protein, 17 aa, Cryptosporidium parvum
LKYPLQFFDWSPEEDNL

SEQ ID NO: 2317581 - protein, 27 aa, Cryptosporidium parvum
LKYQDFIKFPTQIFWISCKSIKCFMQP

SEQ ID NO: 2317582 - protein, 24 aa, Cryptosporidium parvum
LLASQLRNLRRKGFIGQFVSIFCN

SEQ ID NO: 2317583 - protein, 17 aa, Cryptosporidium parvum
LLATRFNKEVPNFQSNN

SEQ ID NO: 2317584 - protein, 27 aa, Cryptosporidium parvum
LLDENITHLFYKTLVYISAISGINSNG

SEQ ID NO: 2317585 - protein, 19 aa, Cryptosporidium parvum
LLDLLNNLGKVFVGNLPPG

SEQ ID NO: 2317586 - protein, 29 aa, Cryptosporidium parvum
LLDSALLRPGRLDRIIYIGLPDSKARKKI

SEQ ID NO: 2317587 - protein, 24 aa, Cryptosporidium parvum
LLDSYFQKIIYPISNNYSFIEING

SEQ ID NO: 2317588 - protein, 27 aa, Cryptosporidium parvum
LLDTNKIQWVILALISVHTIDSYNPHV

SEQ ID NO: 2317589 - protein, 46 aa, Cryptosporidium parvum; identical to SEQ ID NO: 2193309

SEQ ID NO: 2317590 - protein, 18 aa, Cryptosporidium parvum
LLEEGFGASYKKIYQFVI

SEQ ID NO: 2317591 - protein, 17 aa, Cryptosporidium parvum
LLEFPLQKKYFGGGGSM

SEQ ID NO: 2317592 - protein, 17 aa, Cryptosporidium parvum
LLEIVLSAPILDLSVLT

SEQ ID NO: 2317593 - protein, 17 aa, Cryptosporidium parvum
LLELGWVNSVNIFVEKK

SEQ ID NO: 2317594 - protein, 19 aa, Cryptosporidium parvum
LLELIKYLDKSYMLQRRWK

SEQ ID NO: 2317595 - protein, 18 aa, Cryptosporidium parvum
LLELISSKASVLDGNYRY

SEQ ID NO: 2317596 - protein, 30 aa, Cryptosporidium parvum; identical to SEQ ID NO: 2193313

SEQ ID NO: 2317597 - protein, 31 aa, Cryptosporidium parvum
LLEPSWPHLLVIYEFFLRFVISPQFSTKVAK

SEQ ID NO: 2317598 - protein, 21 aa, Cryptosporidium parvum
LLERRQKPFFYPTFIKEQVEN

SEQ ID NO: 2317599 - protein, 21 aa, Cryptosporidium parvum
LLESTKIKVFKIFRVTKNFDA

SEQ ID NO: 2317600 - protein, 26 aa, Cryptosporidium parvum
LLETAPFWFSKLLSILFIICKEESIK

SEQ ID NO: 2317601 - protein, 30 aa, Cryptosporidium parvum; identical to SEQ ID NO: 2193316

SEQ ID NO: 2317602 - protein, 25 aa, Cryptosporidium parvum
LLEVTNYHFLIWISSREISIYYVNR

SEQ ID NO: 2317603 - protein, 40 aa, Cryptosporidium parvum
LLEWKAMIKEFYSNDPDYILSLPRILQKKARDLNNFQYGD

SEQ ID NO: 2317604 - protein, 19 aa, Cryptosporidium parvum
LLEYRICGVKLYQNPPYTS

SEQ ID NO: 2317605 - protein, 17 aa, Cryptosporidium parvum
LLFFIHEKVMKDPSYLG

SEQ ID NO: 2317606 - protein, 20 aa, Cryptosporidium parvum
LLFLVERGSLLLFSWSRSRL

SEQ ID NO: 2317607 - protein, 28 aa, Cryptosporidium parvum
LLFPCSHSFHFGCMLLKYTSLMNHDEIN

SEQ ID NO: 2317608 - protein, 18 aa, Cryptosporidium parvum
LLFRWDKKSLPPDLHRLD

SEQ ID NO: 2317609 - protein, 25 aa, Cryptosporidium parvum
LLGFGDNCFYIVNNGPFSQSNHTSK

SEQ ID NO: 2317610 - protein, 18 aa, Cryptosporidium parvum
LLGVHRKPELLASQLRNL

SEQ ID NO: 2317611 - protein, 20 aa, Cryptosporidium parvum
LLGYTYLGRNSLLDNSNNNN

SEQ ID NO: 2317612 - protein, 25 aa, Cryptosporidium parvum
LLHASPLLFNLFELKLNLLTEEGTE

SEQ ID NO: 2317613 - protein, 19 aa, Cryptosporidium parvum
LLHIFSYLEHIETLQLLLE

SEQ ID NO: 2317614 - protein, 20 aa, Cryptosporidium parvum
LLHILNNVPEFIWRKIIHEF

SEQ ID NO: 2317615 - protein, 17 aa, Cryptosporidium parvum
LLHYRYNINWDIPDKFL

SEQ ID NO: 2317616 - protein, 18 aa, Cryptosporidium parvum
LLIHLTREKLNELESYVF

SEQ ID NO: 2317617 - protein, 17 aa, Cryptosporidium parvum
LLILLAHVYLTKPMTRN

SEQ ID NO: 2317618 - protein, 35 aa, Cryptosporidium parvum
LLIQYSPILAFLDPKRFLSLLKRPSFTSIDLNLIL

SEQ ID NO: 2317619 - protein, 17 aa, Cryptosporidium parvum
LLISQPLYNHSSLSTSS

SEQ ID NO: 2317620 - protein, 19 aa, Cryptosporidium parvum
LLKDDVLFNLYLELIKEAN

SEQ ID NO: 2317621 - protein, 25 aa, Cryptosporidium parvum
LLKDENFIIFQNYIKLIPITNKIIY

SEQ ID NO: 2317622 - protein, 19 aa, Cryptosporidium parvum
LLKIFRLVDEKALAQESLE

SEQ ID NO: 2317623 - protein, 20 aa, Cryptosporidium parvum
LLKIPQLLDFSLRLLNERLN

SEQ ID NO: 2317624 - protein, 18 aa, Cryptosporidium parvum
LLKKEQLIKYKLPNKFST

SEQ ID NO: 2317625 - protein, 17 aa, Cryptosporidium parvum
LLKRVNFDTLYSAYWSP

SEQ ID NO: 2317626 - protein, 27 aa, Cryptosporidium parvum
LLKYIHIRTFEVLYKPWGIVRGSSKKF

SEQ ID NO: 2317627 - protein, 17 aa, Cryptosporidium parvum
LLLCVPPETQLNVILDC

SEQ ID NO: 2317628 - protein, 23 aa, Cryptosporidium parvum
LLLEQKKNLLLFQKSRGGDQQLD

SEQ ID NO: 2317629 - protein, 17 aa, Cryptosporidium parvum
LLLGDYYNEVFGHISYF

SEQ ID NO: 2317630 - protein, 17 aa, Cryptosporidium parvum
LLLGIYGLKFETVRLLL

SEQ ID NO: 2317631 - protein, 19 aa, Cryptosporidium parvum
LLLHTFIEDPLRLETKRLK

SEQ ID NO: 2317632 - protein, 18 aa, Cryptosporidium parvum
LLLIPEWQDILDGLEILL

SEQ ID NO: 2317633 - protein, 24 aa, Cryptosporidium parvum
LLLKQLRVRVLLIKARIFELNNMF

SEQ ID NO: 2317634 - protein, 20 aa, Cryptosporidium parvum
LLLLTKKEAYQFSKNNIKFG

SEQ ID NO: 2317635 - protein, 20 aa, Cryptosporidium parvum
LLLMFTEEVNLLKKLRGCPH

SEQ ID NO: 2317636 - protein, 19 aa, Cryptosporidium parvum
LLLPFFERRIGSELDCSFL

SEQ ID NO: 2317637 - protein, 19 aa, Cryptosporidium parvum
LLLQVFNLEIWSYLDSFKI

SEQ ID NO: 2317638 - protein, 17 aa, Cryptosporidium parvum
LLLSFSENEFFLLREYW

SEQ ID NO: 2317639 - protein, 25 aa, Cryptosporidium parvum
LLLSTKFKMELLTFNLKDGYLEAMV

SEQ ID NO: 2317640 - protein, 21 aa, Cryptosporidium parvum
LLLVNYKEFVSIFLDIPNWGR

SEQ ID NO: 2317641 - protein, 21 aa, Cryptosporidium parvum
LLMQYSSFLVPSTITYWEIPS

SEQ ID NO: 2317642 - protein, 19 aa, Cryptosporidium parvum
LLMSMTKKMKKTASQIVHP

SEQ ID NO: 2317643 - protein, 18 aa, Cryptosporidium parvum
LLNALNGFFPAFEDVRSA

SEQ ID NO: 2317644 - protein, 17 aa, Cryptosporidium parvum
LLNDEVVLKYYLDYVRS

SEQ ID NO: 2317645 - protein, 19 aa, Cryptosporidium parvum
LLNDLQERKEYSEKCLLAN

SEQ ID NO: 2317646 - protein, 26 aa, Cryptosporidium parvum
LLNEHYPRKLIKTFSVFPMLNNESSD

SEQ ID NO: 2317647 - protein, 18 aa, Cryptosporidium parvum
LLNKWRKVAEYPELYISE

SEQ ID NO: 2317648 - protein, 22 aa, Cryptosporidium parvum
LLNLESIPVPLAYQQIKKLEWD

SEQ ID NO: 2317649 - protein, 18 aa, Cryptosporidium parvum
LLNNLFGYIKSQLKVYDT

SEQ ID NO: 2317650 - protein, 25 aa, Cryptosporidium parvum
LLNPSILGWGLFSYSSLFNHSCDPN

SEQ ID NO: 2317651 - protein, 23 aa, Cryptosporidium parvum
LLNSFQSIFKRYGSLSKSPGSFE

SEQ ID NO: 2317652 - protein, 17 aa, Cryptosporidium parvum
LLNSKSITFRQFICKMR

SEQ ID NO: 2317653 - protein, 30 aa, Cryptosporidium parvum
LLNYKNLLVEGLKRQFYYYLKFISTEYNLK

SEQ ID NO: 2317654 - protein, 19 aa, Cryptosporidium parvum
LLPCCLVIANSKDSNISCI

SEQ ID NO: 2317655 - protein, 25 aa, Cryptosporidium parvum
LLPEIPKIMLNPDSYFNLANMPYYN

SEQ ID NO: 2317656 - protein, 18 aa, Cryptosporidium parvum
LLPKPPLSNYYASYLSKV

SEQ ID NO: 2317657 - protein, 18 aa, Cryptosporidium parvum
LLPSKFFIQVAFCTFDAI

SEQ ID NO: 2317658 - protein, 18 aa, Cryptosporidium parvum
LLPSWKIVILDEAEMMTA

SEQ ID NO: 2317659 - protein, 28 aa, Cryptosporidium parvum
LLQAQELNIPTIFALNRHRIGRAMGKHM

SEQ ID NO: 2317660 - protein, 21 aa, Cryptosporidium parvum
LLQASIRMISNPRVDILRFVH

SEQ ID NO: 2317661 - protein, 19 aa, Cryptosporidium parvum
LLQEYLGGGADPPYSPYCL

SEQ ID NO: 2317662 - protein, 26 aa, Cryptosporidium parvum
LLRLEMIFMYYDKGNKGYWNMYDWEL

SEQ ID NO: 2317663 - protein, 18 aa, Cryptosporidium parvum
LLRLLVLLNRIQLLNDVR

SEQ ID NO: 2317664 - protein, 17 aa, Cryptosporidium parvum
LLRNISFSNSGGLKGAI

SEQ ID NO: 2317665 - protein, 40 aa, Cryptosporidium parvum; identical to SEQ ID NO: 2193368

SEQ ID NO: 2317666 - protein, 21 aa, Cryptosporidium parvum
LLSAVWPHIESFNTFLSVGLK

SEQ ID NO: 2317667 - protein, 18 aa, Cryptosporidium parvum
LLSIDFIRRNIGELKLQI

SEQ ID NO: 2317668 - protein, 19 aa, Cryptosporidium parvum
LLSILTFITSFFPKYYPNL

SEQ ID NO: 2317669 - protein, 18 aa, Cryptosporidium parvum
LLSIQKLMLNKWNRANIG

SEQ ID NO: 2317670 - protein, 19 aa, Cryptosporidium parvum
LLSLAWKISFQEIEPLPSC

SEQ ID NO: 2317671 - protein, 25 aa, Cryptosporidium parvum
LLSQQDVFQLLIRQMELVQAKLQYQ

SEQ ID NO: 2317672 - protein, 23 aa, Cryptosporidium parvum
LLSSLYPIQISTKLKVKCLKFLN

SEQ ID NO: 2317673 - protein, 17 aa, Cryptosporidium parvum
LLSYELILTQNLELNGI

SEQ ID NO: 2317674 - protein, 27 aa, Cryptosporidium parvum
LLTEDCNVLWKWILRQGFVNRDNHSNY

SEQ ID NO: 2317675 - protein, 20 aa, Cryptosporidium parvum
LLTNNIFNGIEWMNNLPKIK

SEQ ID NO: 2317676 - protein, 41 aa, Cryptosporidium parvum
LLTNQYSFRLYRMFILHDSLFIQTVWSLMKQFLTDLQQHKI

SEQ ID NO: 2317677 - protein, 18 aa, Cryptosporidium parvum
LLVAINPFKDVGLVGNDV

SEQ ID NO: 2317678 - protein, 30 aa, Cryptosporidium parvum
LLVDHEYAPIWLLSLKYLIQISQQSNLLLL

SEQ ID NO: 2317679 - protein, 17 aa, Cryptosporidium parvum
LLVLFDKEQERSLVRAL

SEQ ID NO: 2317680 - protein, 20 aa, Cryptosporidium parvum
LLVNLLKQWSSLYGYNNTEG

SEQ ID NO: 2317681 - protein, 28 aa, Cryptosporidium parvum
LLVSIPTYHFGFLGICINPPLALENPLS

SEQ ID NO: 2317682 - protein, 17 aa, Cryptosporidium parvum
LLYLDKNIENGLVERLK

SEQ ID NO: 2317683 - protein, 18 aa, Cryptosporidium parvum
LLYRLSQDLPEDTKFWIL

SEQ ID NO: 2317684 - protein, 20 aa, Cryptosporidium parvum
LMCCSPPQINSMPINQAPPS

SEQ ID NO: 2317685 - protein, 17 aa, Cryptosporidium parvum
LMEFMNGFSPKSQWKFI

SEQ ID NO: 2317686 - protein, 18 aa, Cryptosporidium parvum
LMEKLENLELLVSRKESL

SEQ ID NO: 2317687 - protein, 20 aa, Cryptosporidium parvum
LMFEEILDEKLFETKEPEED

SEQ ID NO: 2317688 - protein, 17 aa, Cryptosporidium parvum
LMGDSSIKTLIVGGSLQ

SEQ ID NO: 2317689 - protein, 41 aa, Cryptosporidium parvum; identical to SEQ ID NO: 2193394

SEQ ID NO: 2317690 - protein, 30 aa, Cryptosporidium parvum
LMKKLIQFFKGFMLYKNKMELFWNSDKEKI

SEQ ID NO: 2317691 - protein, 19 aa, Cryptosporidium parvum
LMLLDSPLCKSGCLSDILI

SEQ ID NO: 2317692 - protein, 26 aa, Cryptosporidium parvum
LMLSRMDLFKVWVFLGNLEMISKGDP

SEQ ID NO: 2317693 - protein, 25 aa, Cryptosporidium parvum
LMNEEELFLVLKKLNYLPFEDQIKL

SEQ ID NO: 2317694 - protein, 29 aa, Cryptosporidium parvum
LMNKDFVLEFIKPKKFIYKSYPGVVHTIT

SEQ ID NO: 2317695 - protein, 23 aa, Cryptosporidium parvum
LMPEVDYLLIGHGLDLERVKRRE

SEQ ID NO: 2317696 - protein, 18 aa, Cryptosporidium parvum
LMSKDFNCISYSLDLNYI

SEQ ID NO: 2317697 - protein, 21 aa, Cryptosporidium parvum
LMYEILLKLKVNVKLKIFTGE

SEQ ID NO: 2317698 - protein, 25 aa, Cryptosporidium parvum
LNCNKELFMRLVSSLYQHPSITCQS

SEQ ID NO: 2317699 - protein, 26 aa, Cryptosporidium parvum
LNDDSNLIIPAQKKLLNTTSPEATKE

SEQ ID NO: 2317700 - protein, 34 aa, Cryptosporidium parvum
LNDEKWKFLVDKLGIPLNWLLEAIIYKLESSGNI

SEQ ID NO: 2317701 - protein, 17 aa, Cryptosporidium parvum
LNDNIILFTNKLKRIKL

SEQ ID NO: 2317702 - protein, 26 aa, Cryptosporidium parvum
LNDPNICGFIFIIAKPIHIEEPGKTL

SEQ ID NO: 2317703 - protein, 20 aa, Cryptosporidium parvum
LNDSILLKKISNLNFDEMSL

SEQ ID NO: 2317704 - protein, 21 aa, Cryptosporidium parvum
LNDYYDYFAPDFKLHIPPLNL

SEQ ID NO: 2317705 - protein, 25 aa, Cryptosporidium parvum
LNEDNFQYRYILGKILLDKNPGIKT

SEQ ID NO: 2317706 - protein, 21 aa, Cryptosporidium parvum
LNEEKIMIQSQYYKEKSKFDC

SEQ ID NO: 2317707 - protein, 28 aa, Cryptosporidium parvum
LNEFLEQIRPQIPLIEAASPGAAPVLLS

SEQ ID NO: 2317708 - protein, 22 aa, Cryptosporidium parvum
LNEGLWSPYWEAFKVNNAYSHI

SEQ ID NO: 2317709 - protein, 22 aa, Cryptosporidium parvum
LNEHVRIQLLLSTSYNISSSCR

SEQ ID NO: 2317710 - protein, 26 aa, Cryptosporidium parvum
LNEIGPRFILKLYKIELGTLEMKNLS

SEQ ID NO: 2317711 - protein, 28 aa, Cryptosporidium parvum
LNEILSSYPWIPISLYNDNYFSYYMSQI

SEQ ID NO: 2317712 - protein, 24 aa, Cryptosporidium parvum
LNEKNQEIHFLKKTVKDLETRIIS

SEQ ID NO: 2317713 - protein, 23 aa, Cryptosporidium parvum
LNELLQSEIFSRKSMEQRLIEII

SEQ ID NO: 2317714 - protein, 24 aa, Cryptosporidium parvum
LNEQVIRRFFEFTDPSFENDSLES

SEQ ID NO: 2317715 - protein, 17 aa, Cryptosporidium parvum
LNEWRLYNNLDGAYQIF

SEQ ID NO: 2317716 - protein, 19 aa, Cryptosporidium parvum
LNFILNLQCMWRHYNLKIQ

SEQ ID NO: 2317717 - protein, 24 aa, Cryptosporidium parvum
LNFYSVFQWARIPKQLYEMIENEG

SEQ ID NO: 2317718 - protein, 25 aa, Cryptosporidium parvum
LNGISINFILPHQLSLIQQIQDYYD

SEQ ID NO: 2317719 - protein, 17 aa, Cryptosporidium parvum
LNGLLNLRYRDGSLLSS

SEQ ID NO: 2317720 - protein, 28 aa, Cryptosporidium parvum
LNIEQILNFLYEIPLFQLKSTIVSVQAN

SEQ ID NO: 2317721 - protein, 19 aa, Cryptosporidium parvum
LNIEYDFCKMVSKKSKLDD

SEQ ID NO: 2317722 - protein, 35 aa, Cryptosporidium parvum; identical to SEQ ID NO: 2193425

SEQ ID NO: 2317723 - protein, 39 aa, Cryptosporidium parvum; identical to SEQ ID NO: 2193426

SEQ ID NO: 2317724 - protein, 18 aa, Cryptosporidium parvum
LNIILRQNDFLTKLGSGK

SEQ ID NO: 2317725 - protein, 25 aa, Cryptosporidium parvum
LNINNNYSFFLSKDLRIIKSPNGNG

SEQ ID NO: 2317726 - protein, 17 aa, Cryptosporidium parvum
LNIPFKFTTLIEASGNS

SEQ ID NO: 2317727 - protein, 26 aa, Cryptosporidium parvum
LNIQDKLHFDFILSASNLYSNMVRLP

SEQ ID NO: 2317728 - protein, 31 aa, Cryptosporidium parvum
LNISLVEIFLDTFFLIKFPKNCNLIELINSK

SEQ ID NO: 2317729 - protein, 20 aa, Cryptosporidium parvum
LNKAIILSFVKDILCFKKRE

SEQ ID NO: 2317730 - protein, 22 aa, Cryptosporidium parvum
LNKDYYIPLKSLLDKLNTIKNT

SEQ ID NO: 2317731 - protein, 25 aa, Cryptosporidium parvum
LNKFRTTQVLTPSSPIKITASPLQQ

SEQ ID NO: 2317732 - protein, 19 aa, Cryptosporidium parvum
LNKKKILPLIREYVSFKIS

SEQ ID NO: 2317733 - protein, 20 aa, Cryptosporidium parvum
LNKLFNNWIILLQYSMNKRY

SEQ ID NO: 2317734 - protein, 20 aa, Cryptosporidium parvum
LNKSILNIILRQNDFLTKLG

SEQ ID NO: 2317735 - protein, 18 aa, Cryptosporidium parvum
LNKYPFCLTILSSGKLIN

SEQ ID NO: 2317736 - protein, 26 aa, Cryptosporidium parvum
LNLANDFVVELWQNLYAHRKRDDKRL

SEQ ID NO: 2317737 - protein, 17 aa, Cryptosporidium parvum
LNLEEFYYKNIESIPRC

SEQ ID NO: 2317738 - protein, 24 aa, Cryptosporidium parvum
LNLEGDLLRGIFAYGFEKPSAIQQ

SEQ ID NO: 2317739 - protein, 18 aa, Cryptosporidium parvum
LNLMLISNLTRYSKGREK

SEQ ID NO: 2317740 - protein, 23 aa, Cryptosporidium parvum
LNLNSVTELYWLDGSYDSKFMDY

SEQ ID NO: 2317741 - protein, 25 aa, Cryptosporidium parvum
LNLQFGINIFFQIINSIQFLHNLGI

SEQ ID NO: 2317742 - protein, 18 aa, Cryptosporidium parvum
LNLQLKFKETMRTKQLPT

SEQ ID NO: 2317743 - protein, 18 aa, Cryptosporidium parvum
LNLRYRDGSLLSSLPDIG

SEQ ID NO: 2317744 - protein, 25 aa, Cryptosporidium parvum
LNLSPDLLKGIYNKGFNRPSKIQAA

SEQ ID NO: 2317745 - protein, 36 aa, Cryptosporidium parvum
LNLTQIFHYRLFRCIQILQILILNGLHFSIKKDFKI

SEQ ID NO: 2317746 - protein, 21 aa, Cryptosporidium parvum
LNLVALCISTPPPFTGLPQNN

SEQ ID NO: 2317747 - protein, 18 aa, Cryptosporidium parvum
LNMSLGKCDFKLISFYKA

SEQ ID NO: 2317748 - protein, 24 aa, Cryptosporidium parvum
LNNERYISSSLILTNGTSQGKFAL

SEQ ID NO: 2317749 - protein, 37 aa, Cryptosporidium parvum
LNNESEWEFFWQELLIYLFFKPILNKNSIELRDLPAM

SEQ ID NO: 2317750 - protein, 26 aa, Cryptosporidium parvum
LNNGNVRFFIFPLLDLIKNYIESCNE

SEQ ID NO: 2317751 - protein, 18 aa, Cryptosporidium parvum
LNNIGLGPTLIIDCDYDD

SEQ ID NO: 2317752 - protein, 20 aa, Cryptosporidium parvum
LNNINLCLNFILNPPEKSTL

SEQ ID NO: 2317753 - protein, 25 aa, Cryptosporidium parvum
LNNKIQKLLWGCLNFTPCQRLTLAQ

SEQ ID NO: 2317754 - protein, 17 aa, Cryptosporidium parvum
LNNNGILANYFISDNSI

SEQ ID NO: 2317755 - protein, 17 aa, Cryptosporidium parvum
LNPDDGLFLCRFCNEKL

SEQ ID NO: 2317756 - protein, 24 aa, Cryptosporidium parvum
LNPFQMICIALNKPCIEFYDLRSG

SEQ ID NO: 2317757 - protein, 23 aa, Cryptosporidium parvum
LNPINPEYIFYSTTLGNLGILYI

SEQ ID NO: 2317758 - protein, 27 aa, Cryptosporidium parvum
LNPLSQPPFRVNLSANLFFPNFRIVSI

SEQ ID NO: 2317759 - protein, 27 aa, Cryptosporidium parvum
LNPNPSKCYTLPIKGFGELVQREQQQR

SEQ ID NO: 2317760 - protein, 23 aa, Cryptosporidium parvum
LNPTFYDRLIKPLSKQIELILDL

SEQ ID NO: 2317761 - protein, 20 aa, Cryptosporidium parvum
LNQAIKMAYSVGLTYEAGLG

SEQ ID NO: 2317762 - protein, 25 aa, Cryptosporidium parvum
LNQASPISLTPLAPLGVLNPIPQFG

SEQ ID NO: 2317763 - protein, 22 aa, Cryptosporidium parvum
LNQIEELYKPLEYPKLCNRMYK

SEQ ID NO: 2317764 - protein, 26 aa, Cryptosporidium parvum
LNQIPNRRFTLWWSPTINRANVYIGF

SEQ ID NO: 2317765 - protein, 26 aa, Cryptosporidium parvum
LNQKRIIISILKIFEGIQGYLEREGS

SEQ ID NO: 2317766 - protein, 30 aa, Cryptosporidium parvum
LNQLARRNITWPMLFQISNPAKNKFTHSGV

SEQ ID NO: 2317767 - protein, 24 aa, Cryptosporidium parvum
LNQQNLWGNRWADIARHLPGRTTH

SEQ ID NO: 2317768 - protein, 24 aa, Cryptosporidium parvum
LNREELYFELIPEKKQFYTRKQNA

SEQ ID NO: 2317769 - protein, 18 aa, Cryptosporidium parvum
LNREFILGILNKYKERQF

SEQ ID NO: 2317770 - protein, 22 aa, Cryptosporidium parvum
LNRHFFICCEQPKVLFWSYNSG

SEQ ID NO: 2317771 - protein, 24 aa, Cryptosporidium parvum
LNRINSMILNNSYIKRLKKRGWIL

SEQ ID NO: 2317772 - protein, 26 aa, Cryptosporidium parvum
LNRNRGLFEIIIFNPPYVPSSNKELN

SEQ ID NO: 2317773 - protein, 27 aa, Cryptosporidium parvum
LNRRYGLFTLIKFNISGTYYAVLSQRE

SEQ ID NO: 2317774 - protein, 17 aa, Cryptosporidium parvum
LNRSIFCMGIKEYSLFF

SEQ ID NO: 2317775 - protein, 25 aa, Cryptosporidium parvum
LNRVTAFRHFCELHLIPLYKQVYGN

SEQ ID NO: 2317776 - protein, 18 aa, Cryptosporidium parvum
LNRYKTICEIGEGAFGVV

SEQ ID NO: 2317777 - protein, 22 aa, Cryptosporidium parvum
LNSIILILSRITEFRDLCLSYQ

SEQ ID NO: 2317778 - protein, 17 aa, Cryptosporidium parvum
LNSIPSLNPFYTQTINL

SEQ ID NO: 2317779 - protein, 24 aa, Cryptosporidium parvum
LNSKGILDLFPYNFQNQAFSSLEQ

SEQ ID NO: 2317780 - protein, 24 aa, Cryptosporidium parvum
LNSLITIERFSLKLASRISQVSIF

SEQ ID NO: 2317781 - protein, 22 aa, Cryptosporidium parvum
LNSLKIVLNLNISEGGIEQSYL

SEQ ID NO: 2317782 - protein, 47 aa, Cryptosporidium parvum
LNSRDKLFGNFLSSLYRISRIKLISFTWRKIVLNAKLSSFKTLPTVP

SEQ ID NO: 2317783 - protein, 32 aa, Cryptosporidium parvum; identical to SEQ ID NO: 2193478

SEQ ID NO: 2317784 - protein, 25 aa, Cryptosporidium parvum
LNTAVNQFIIPKLLLKLNSNQQLDL

SEQ ID NO: 2317785 - protein, 19 aa, Cryptosporidium parvum
LNTYDIMNLCSQFGNIIDI

SEQ ID NO: 2317786 - protein, 25 aa, Cryptosporidium parvum
LNTYLPVQSKFRLTYQMILQLSCRH

SEQ ID NO: 2317787 - protein, 21 aa, Cryptosporidium parvum
LNVKECLALFPIKKFKRFLRL

SEQ ID NO: 2317788 - protein, 26 aa, Cryptosporidium parvum
LNVKNFKPELLGYKSVEDWVSSQPKT

SEQ ID NO: 2317789 - protein, 24 aa, Cryptosporidium parvum
LNVPKLIAFQRPEHYIRFPVHKEF

SEQ ID NO: 2317790 - protein, 29 aa, Cryptosporidium parvum
LNVQKPTLQPIQFPNMQAGVPNLCGIQGQ

SEQ ID NO: 2317791 - protein, 25 aa, Cryptosporidium parvum
LNYGDIIHWLFLSICTFEERKCFSL

SEQ ID NO: 2317792 - protein, 29 aa, Cryptosporidium parvum
LPAIIIKKLVVNGPLPMDRLYHLVIKDKE

SEQ ID NO: 2317793 - protein, 18 aa, Cryptosporidium parvum
LPCPIRIREILIGGRIGN

SEQ ID NO: 2317794 - protein, 19 aa, Cryptosporidium parvum
LPDCALNFEKLGIVQPLLS

SEQ ID NO: 2317795 - protein, 21 aa, Cryptosporidium parvum
LPDGPVFLSPDRLFPSFKREV

SEQ ID NO: 2317796 - protein, 27 aa, Cryptosporidium parvum
LPEESLIHKFPRLKMLFESVAVLPLID

SEQ ID NO: 2317797 - protein, 23 aa, Cryptosporidium parvum
LPEEWVCTMNTWDKLYSSCDAAE

SEQ ID NO: 2317798 - protein, 20 aa, Cryptosporidium parvum
LPEFLKRTVLSSSLSTIKVL

SEQ ID NO: 2317799 - protein, 18 aa, Cryptosporidium parvum
LPEHALLNSIIESGLRSM

SEQ ID NO: 2317800 - protein, 25 aa, Cryptosporidium parvum
LPEIREVQDLILETKKLIGEETQDY

SEQ ID NO: 2317801 - protein, 29 aa, Cryptosporidium parvum
LPEKTGSYAIFMCYKLYSLFDPEDKGYIS

SEQ ID NO: 2317802 - protein, 19 aa, Cryptosporidium parvum
LPFVLKVVLSESLDMILLV

SEQ ID NO: 2317803 - protein, 24 aa, Cryptosporidium parvum
LPGLPTSIKWSYDGSLLAVSCMDK

SEQ ID NO: 2317804 - protein, 21 aa, Cryptosporidium parvum
LPHLSLLPQHHLAGTGAGAGG

SEQ ID NO: 2317805 - protein, 18 aa, Cryptosporidium parvum
LPHLSLPPPPPPQYSSYK

SEQ ID NO: 2317806 - protein, 19 aa, Cryptosporidium parvum
LPIIQSRLGILTWYARMDP

SEQ ID NO: 2317807 - protein, 28 aa, Cryptosporidium parvum
LPIRQNPKPCLVMWEPIIDCPSDLSSGL

SEQ ID NO: 2317808 - protein, 40 aa, Cryptosporidium parvum
LPKDSRLVIYGKFKDNPLVSLIGEVPLELSSFANSYRLAG

SEQ ID NO: 2317809 - protein, 25 aa, Cryptosporidium parvum
LPKGIVDFVALLPPSNIPTSSIRNI

SEQ ID NO: 2317810 - protein, 24 aa, Cryptosporidium parvum
LPKKEFFKPYYTTTTTTTTTTTTT

SEQ ID NO: 2317811 - protein, 19 aa, Cryptosporidium parvum
LPKLECLMLNGNRLKEISF

SEQ ID NO: 2317812 - protein, 28 aa, Cryptosporidium parvum
LPKNCTEDQLLLLFKQFGHVDEVHIIRD

SEQ ID NO: 2317813 - protein, 18 aa, Cryptosporidium parvum
LPLILSTIWSRYSGFITD

SEQ ID NO: 2317814 - protein, 17 aa, Cryptosporidium parvum
LPLIREYVSFKISTDKF

SEQ ID NO: 2317815 - protein, 18 aa, Cryptosporidium parvum
LPLLNSQSSTFSFGQGID

SEQ ID NO: 2317816 - protein, 23 aa, Cryptosporidium parvum
LPLPIHHYLKKKNIIKPFPIQMQ

SEQ ID NO: 2317817 - protein, 18 aa, Cryptosporidium parvum
LPNIFPSISHRPLPVNVC

SEQ ID NO: 2317818 - protein, 32 aa, Cryptosporidium parvum
LPNWQKEFEIWSPELKILCFKGSRYERRSLIY

SEQ ID NO: 2317819 - protein, 33 aa, Cryptosporidium parvum; identical to SEQ ID NO: 2193509

SEQ ID NO: 2317820 - protein, 26 aa, Cryptosporidium parvum
LPPIGGFSLPPFKYWEYFQADPSQNE

SEQ ID NO: 2317821 - protein, 30 aa, Cryptosporidium parvum; identical to SEQ ID NO: 2193512

SEQ ID NO: 2317822 - protein, 27 aa, Cryptosporidium parvum
LPPSLMSRFDLIYLMLDKQSEESDKRL

SEQ ID NO: 2317823 - protein, 23 aa, Cryptosporidium parvum
LPQLRALPPDKLDDFRKLYAMWN

SEQ ID NO: 2317824 - protein, 19 aa, Cryptosporidium parvum
LPRFVGFEELPWREYWCYP

SEQ ID NO: 2317825 - protein, 20 aa, Cryptosporidium parvum
LPSDLQAKIFKPSPYRKVIV

SEQ ID NO: 2317826 - protein, 28 aa, Cryptosporidium parvum
LPSIQILELLKVYYLTKGTPEKLFSAIY

SEQ ID NO: 2317827 - protein, 17 aa, Cryptosporidium parvum
LPTLRTAGLPKIYTAYQ

SEQ ID NO: 2317828 - protein, 26 aa, Cryptosporidium parvum
LPTSRDPKLWLVKVDRAGLEKDICIA

SEQ ID NO: 2317829 - protein, 19 aa, Cryptosporidium parvum
LPVESIVELAFEILQEKLN

SEQ ID NO: 2317830 - protein, 25 aa, Cryptosporidium parvum
LPVFEQQFVLPIKQAELRNAAKVQT

SEQ ID NO: 2317831 - protein, 25 aa, Cryptosporidium parvum
LPVREELLRSILMADLIGFHFFPYA

SEQ ID NO: 2317832 - protein, 17 aa, Cryptosporidium parvum
LPYMGILGNSSNKGTLK

SEQ ID NO: 2317833 - protein, 24 aa, Cryptosporidium parvum
LQDDFYLNLVDWSSTNLLAVGLSS

SEQ ID NO: 2317834 - protein, 25 aa, Cryptosporidium parvum
LQDIRGNIRVFCRVRPPTISEQDFC

SEQ ID NO: 2317835 - protein, 26 aa, Cryptosporidium parvum
LQELFDAWMLYINFEKDRMLSIDYSS

SEQ ID NO: 2317836 - protein, 22 aa, Cryptosporidium parvum
LQELRAKQFAILEQEGMLSHIK

SEQ ID NO: 2317837 - protein, 25 aa, Cryptosporidium parvum
LQESLVFTLPGSKFHRLKHLTIFIE

SEQ ID NO: 2317838 - protein, 31 aa, Cryptosporidium parvum
LQESMDMFFFSAYIFELFYVVFYSDEDELID

SEQ ID NO: 2317839 - protein, 25 aa, Cryptosporidium parvum
LQETIFTFINVLEAYIDTPWTSVLK

SEQ ID NO: 2317840 - protein, 42 aa, Cryptosporidium parvum; identical to SEQ ID NO: 2193536

SEQ ID NO: 2317841 - protein, 21 aa, Cryptosporidium parvum
LQGFHAIIIHLIRENIKQINE

SEQ ID NO: 2317842 - protein, 28 aa, Cryptosporidium parvum
LQGNVAYWLYMPAISHIIDCHGKLIFGN

SEQ ID NO: 2317843 - protein, 27 aa, Cryptosporidium parvum
LQGNVTNLILYCLKHIFTQLAQSSPES

SEQ ID NO: 2317844 - protein, 17 aa, Cryptosporidium parvum
LQGPYFDEAFLSKIAYE

SEQ ID NO: 2317845 - protein, 25 aa, Cryptosporidium parvum
LQHYLLNVGVLLMSLRRLETLIFCI

SEQ ID NO: 2317846 - protein, 24 aa, Cryptosporidium parvum
LQIGDIFGFLKERGLYKPNSVPMT

SEQ ID NO: 2317847 - protein, 19 aa, Cryptosporidium parvum
LQIIAFKMEFHKLSGSKLA

SEQ ID NO: 2317848 - protein, 17 aa, Cryptosporidium parvum
LQILELIGVVVNSGVWP

SEQ ID NO: 2317849 - protein, 18 aa, Cryptosporidium parvum
LQITGWMNSFGLPAISST

SEQ ID NO: 2317850 - protein, 21 aa, Cryptosporidium parvum
LQITMPIITLIASETKYCGNG

SEQ ID NO: 2317851 - protein, 18 aa, Cryptosporidium parvum
LQKVFSIQFQIRRRIKGL

SEQ ID NO: 2317852 - protein, 18 aa, Cryptosporidium parvum
LQKVMILHTYILDDPFED

SEQ ID NO: 2317853 - protein, 25 aa, Cryptosporidium parvum
LQLGEIPVIRYLANSPLCRNIAFAV

SEQ ID NO: 2317854 - protein, 23 aa, Cryptosporidium parvum
LQLKLKAFDNFLQNYPYIKEEQP

SEQ ID NO: 2317855 - protein, 22 aa, Cryptosporidium parvum
LQLKVLRPFNQESKLILNWLED

SEQ ID NO: 2317856 - protein, 24 aa, Cryptosporidium parvum
LQLRQHAERLLGFTGNPVLRTRFD

SEQ ID NO: 2317857 - protein, 19 aa, Cryptosporidium parvum
LQLTSSIFNVFRTYAGKQD

SEQ ID NO: 2317858 - protein, 23 aa, Cryptosporidium parvum
LQNDQVLIYIYNHGFPDYSIDYN

SEQ ID NO: 2317859 - protein, 20 aa, Cryptosporidium parvum
LQNFGLLMGTGLGMPSLGAT

SEQ ID NO: 2317860 - protein, 29 aa, Cryptosporidium parvum
LQNNLMELWSLLHFLMPHIFTSHHDFKTW

SEQ ID NO: 2317861 - protein, 17 aa, Cryptosporidium parvum
LQNSLGGNSLTALIVTC

SEQ ID NO: 2317862 - protein, 25 aa, Cryptosporidium parvum
LQNTKQFLFKNLLNLVIDEADRILE

SEQ ID NO: 2317863 - protein, 24 aa, Cryptosporidium parvum
LQNYKLKYFEAMRKLQRLETEMVI

SEQ ID NO: 2317864 - protein, 25 aa, Cryptosporidium parvum
LQNYKNLRCLLLGGNKIKDFSELIV

SEQ ID NO: 2317865 - protein, 17 aa, Cryptosporidium parvum
LQPVNQISKPFLQNTNT

SEQ ID NO: 2317866 - protein, 21 aa, Cryptosporidium parvum
LQPYSGAYKRTKGKRWSTEQT

SEQ ID NO: 2317867 - protein, 25 aa, Cryptosporidium parvum
LQQDVAEWLGTYFTCVWIQISKQRD

SEQ ID NO: 2317868 - protein, 27 aa, Cryptosporidium parvum
LQQEALWISRKFLQTYPELFKEELLRR

SEQ ID NO: 2317869 - protein, 20 aa, Cryptosporidium parvum
LQQHWSPVLDVCSILTCIQS

SEQ ID NO: 2317870 - protein, 21 aa, Cryptosporidium parvum
LQQPHFYSILKGETFLVRMDS

SEQ ID NO: 2317871 - protein, 19 aa, Cryptosporidium parvum
LQQPHHLIDGRLVFVHQAI

SEQ ID NO: 2317872 - protein, 23 aa, Cryptosporidium parvum
LQQPVFHVGYFKHLYGVLCCICK

SEQ ID NO: 2317873 - protein, 20 aa, Cryptosporidium parvum
LQQQFLANTIPFNFQSRQQL

SEQ ID NO: 2317874 - protein, 19 aa, Cryptosporidium parvum
LQQQKPVLGILPAIDEECF

SEQ ID NO: 2317875 - protein, 19 aa, Cryptosporidium parvum
LQQVLWENAQWEPIEFSKL

SEQ ID NO: 2317876 - protein, 20 aa, Cryptosporidium parvum
LQSDLLEESLKLLIKHVIAQ

SEQ ID NO: 2317877 - protein, 19 aa, Cryptosporidium parvum
LQSELIFEMSLFDTHVKEI

SEQ ID NO: 2317878 - protein, 24 aa, Cryptosporidium parvum
LQSGSLNIYISWSSYRLMESEKNN

SEQ ID NO: 2317879 - protein, 22 aa, Cryptosporidium parvum
LQSIYLIADPPWNSGWIDIWFS

SEQ ID NO: 2317880 - protein, 22 aa, Cryptosporidium parvum
LQSREFLDLNLDYSFESNSASM

SEQ ID NO: 2317881 - protein, 39 aa, Cryptosporidium parvum
LQSSNSEYYLFLTWNNCILGYIPINTNKINKISLEAGEN

SEQ ID NO: 2317882 - protein, 28 aa, Cryptosporidium parvum
LQTMINKAILPWFRLGSRPILSDESDEY

SEQ ID NO: 2317883 - protein, 34 aa, Cryptosporidium parvum; identical to SEQ ID NO: 2193570

SEQ ID NO: 2317884 - protein, 30 aa, Cryptosporidium parvum
LQTQPQAFPNFFQLQHLFQQQLLQQQQQQQ

SEQ ID NO: 2317885 - protein, 20 aa, Cryptosporidium parvum
LQVIPLIFEKDILVLFPSFS

SEQ ID NO: 2317886 - protein, 17 aa, Cryptosporidium parvum
LQVLLNSAQRKLAERNN

SEQ ID NO: 2317887 - protein, 19 aa, Cryptosporidium parvum
LRALLYLLEGMTPEQILEV

SEQ ID NO: 2317888 - protein, 18 aa, Cryptosporidium parvum
LRDEIFSSLLFPGSKVSA

SEQ ID NO: 2317889 - protein, 18 aa, Cryptosporidium parvum
LRDLYRQRDDLRLALEQE

SEQ ID NO: 2317890 - protein, 25 aa, Cryptosporidium parvum
LRECIPLAILLRNRLKFALTYTEAK

SEQ ID NO: 2317891 - protein, 21 aa, Cryptosporidium parvum
LRELELKGFRVTYLKVNNKGL

SEQ ID NO: 2317892 - protein, 17 aa, Cryptosporidium parvum
LRELGEPICYFGEDQYR

SEQ ID NO: 2317893 - protein, 18 aa, Cryptosporidium parvum
LRFFSSNAHPIILRRFML

SEQ ID NO: 2317894 - protein, 20 aa, Cryptosporidium parvum
LRFGPKPIKSAYLLQRCDYV

SEQ ID NO: 2317895 - protein, 17 aa, Cryptosporidium parvum
LRHPIIQDKLRSSEMIN

SEQ ID NO: 2317896 - protein, 24 aa, Cryptosporidium parvum
LRIHANFLEQFTSNLFKYIESSKH

SEQ ID NO: 2317897 - protein, 33 aa, Cryptosporidium parvum
LRIKEEFAGFTWDLFTINKFQTIIILNNNCHNR

SEQ ID NO: 2317898 - protein, 24 aa, Cryptosporidium parvum
LRIKRMAYPVALVLSPTRELAIQT

SEQ ID NO: 2317899 - protein, 27 aa, Cryptosporidium parvum
LRIRIPVLYLYNQGCNPEFLQRQLLAH

SEQ ID NO: 2317900 - protein, 17 aa, Cryptosporidium parvum
LRISPKLILDEYKFYSF

SEQ ID NO: 2317901 - protein, 17 aa, Cryptosporidium parvum
LRKGLVPYLELVKAVRS

SEQ ID NO: 2317902 - protein, 24 aa, Cryptosporidium parvum
LRKKDIFDIFSKIPGNPLFKKNEE

SEQ ID NO: 2317903 - protein, 18 aa, Cryptosporidium parvum
LRKLLKSENYRELQKKKD

SEQ ID NO: 2317904 - protein, 17 aa, Cryptosporidium parvum
LRKMDCIYFVTNEKRNL

SEQ ID NO: 2317905 - protein, 27 aa, Cryptosporidium parvum
LRKNPDIWTIWKPEKALSLHKKQVSLL

SEQ ID NO: 2317906 - protein, 29 aa, Cryptosporidium parvum
LRKNPNLFAKWSISFSLGLHRLQRNILLR

SEQ ID NO: 2317907 - protein, 22 aa, Cryptosporidium parvum
LRKNSNVVCLCCRKKGHQMSDC

SEQ ID NO: 2317908 - protein, 18 aa, Cryptosporidium parvum
LRKVANVCELTLYTSEMN

SEQ ID NO: 2317909 - protein, 23 aa, Cryptosporidium parvum
LRLESFEFWPLYLRNEKGINILR

SEQ ID NO: 2317910 - protein, 27 aa, Cryptosporidium parvum
LRLLCNLRFIKLIQPLIESILENLQHR

SEQ ID NO: 2317911 - protein, 18 aa, Cryptosporidium parvum
LRMMFSNGRARSGIIVLP

SEQ ID NO: 2317912 - protein, 25 aa, Cryptosporidium parvum
LRMVNTRAAIFKDPTLIIALHLKDT

SEQ ID NO: 2317913 - protein, 26 aa, Cryptosporidium parvum
LRNIKINLILIIKYSKVLLSISSDKR

SEQ ID NO: 2317914 - protein, 18 aa, Cryptosporidium parvum
LRNKPRNLLRHQTQNIWL

SEQ ID NO: 2317915 - protein, 23 aa, Cryptosporidium parvum
LRNNWKFVVSLKGPLHYGTLEVV

SEQ ID NO: 2317916 - protein, 23 aa, Cryptosporidium parvum
LRPSWSLYYLLKKIICKEMSGYY

SEQ ID NO: 2317917 - protein, 18 aa, Cryptosporidium parvum
LRQEKLNRLKIAEKELNT

SEQ ID NO: 2317918 - protein, 18 aa, Cryptosporidium parvum
LRQERFGMISEADKIKNR

SEQ ID NO: 2317919 - protein, 24 aa, Cryptosporidium parvum
LRQERSQICNKLHSVWKGYKTRSI

SEQ ID NO: 2317920 - protein, 30 aa, Cryptosporidium parvum
LRQNIGKDVHLIILLHYNSSLGIESNPLIF

SEQ ID NO: 2317921 - protein, 20 aa, Cryptosporidium parvum
LRRLDRTLLLIEENFEQVSK

SEQ ID NO: 2317922 - protein, 20 aa, Cryptosporidium parvum
LRRQKFGACGPSTEAEKRLA

SEQ ID NO: 2317923 - protein, 17 aa, Cryptosporidium parvum
LRRVIMDMLIIDSSQRP

SEQ ID NO: 2317924 - protein, 26 aa, Cryptosporidium parvum
LRSAAIRFGMRYISSGKELSFGGKAR

SEQ ID NO: 2317925 - protein, 27 aa, Cryptosporidium parvum
LRSFGGKWPFIFFKSRIEFLETVTQSL

SEQ ID NO: 2317926 - protein, 19 aa, Cryptosporidium parvum
LRVTRAGQIWFPDSAYKTA

SEQ ID NO: 2317927 - protein, 33 aa, Cryptosporidium parvum
LSAEIHSWRLTSYCPLLVQFLGAFIKPNKSVVC

SEQ ID NO: 2317928 - protein, 18 aa, Cryptosporidium parvum
LSAIFEFQRRYQDVLVSK

SEQ ID NO: 2317929 - protein, 17 aa, Cryptosporidium parvum
LSALLEKDLGLIPNKDV

SEQ ID NO: 2317930 - protein, 26 aa, Cryptosporidium parvum
LSALSFLIPIDFFCQLKLNRIQVLKV

SEQ ID NO: 2317931 - protein, 19 aa, Cryptosporidium parvum
LSAPKNLTKRNVANSGGGS

SEQ ID NO: 2317932 - protein, 29 aa, Cryptosporidium parvum
LSCLMKRFGIPEVPIITLFAKVCSQNGLE

SEQ ID NO: 2317933 - protein, 18 aa, Cryptosporidium parvum
LSCTCNCNIGINSFDQKV

SEQ ID NO: 2317934 - protein, 17 aa, Cryptosporidium parvum
LSDFLKFENFDLSIKEI

SEQ ID NO: 2317935 - protein, 29 aa, Cryptosporidium parvum
LSDFLKYEFISLIKDILFFSKYLGIDDEH

SEQ ID NO: 2317936 - protein, 26 aa, Cryptosporidium parvum
LSDIQLVLNLVFILRNYVSVDDYIIK

SEQ ID NO: 2317937 - protein, 23 aa, Cryptosporidium parvum
LSDKFNVFFIKSIINTACICPNF

SEQ ID NO: 2317938 - protein, 17 aa, Cryptosporidium parvum
LSDLYACMSIGQSIIFV

SEQ ID NO: 2317939 - protein, 34 aa, Cryptosporidium parvum
LSDSNMPFPYKHEFFSGLIKLPFLSSEPEYINFP

SEQ ID NO: 2317940 - protein, 31 aa, Cryptosporidium parvum; identical to SEQ ID NO: 2193628

SEQ ID NO: 2317941 - protein, 17 aa, Cryptosporidium parvum
LSEILNKGQIFPIDGIN

SEQ ID NO: 2317942 - protein, 25 aa, Cryptosporidium parvum
LSEKIQRFNLLLEKINKMEQMNISF

SEQ ID NO: 2317943 - protein, 34 aa, Cryptosporidium parvum; identical to SEQ ID NO: 2193632

SEQ ID NO: 2317944 - protein, 24 aa, Cryptosporidium parvum
LSELILTPSILFANAFFADYFLEE

SEQ ID NO: 2317945 - protein, 26 aa, Cryptosporidium parvum
LSELNVKLWIFFELTFEEILKIFNIK

SEQ ID NO: 2317946 - protein, 25 aa, Cryptosporidium parvum
LSELNYIPEWFRIGLRILTVSNALE

SEQ ID NO: 2317947 - protein, 26 aa, Cryptosporidium parvum
LSELRYGISMWSGCTAAVCVRIFNEA

SEQ ID NO: 2317948 - protein, 28 aa, Cryptosporidium parvum
LSERKRAKEYLAWLIAQRTSTVSVDTRA

SEQ ID NO: 2317949 - protein, 18 aa, Cryptosporidium parvum
LSESLPEGFDYLDSKYGT

SEQ ID NO: 2317950 - protein, 17 aa, Cryptosporidium parvum
LSETLLELIYVLNNYKT

SEQ ID NO: 2317951 - protein, 26 aa, Cryptosporidium parvum
LSEVNKRFPTLPFSLNMISDEKVARL

SEQ ID NO: 2317952 - protein, 24 aa, Cryptosporidium parvum
LSEWTRLRGITFVKNPFLMLDQIG

SEQ ID NO: 2317953 - protein, 20 aa, Cryptosporidium parvum
LSFAYHPSSIIYYKILEKLH

SEQ ID NO: 2317954 - protein, 28 aa, Cryptosporidium parvum
LSFEFYLRSYLFIPYNIAKIGSCLYSKA

SEQ ID NO: 2317955 - protein, 26 aa, Cryptosporidium parvum
LSGETNYLFYKFPNKNNNSLVSCLWF

SEQ ID NO: 2317956 - protein, 23 aa, Cryptosporidium parvum
LSGGSVFEFKLTSGIPSTVPTQI

SEQ ID NO: 2317957 - protein, 25 aa, Cryptosporidium parvum
LSGGWRMRVALARAIYANPDILLLD

SEQ ID NO: 2317958 - protein, 24 aa, Cryptosporidium parvum
LSGTVYIWVITTGQLLNCWLPHYK

SEQ ID NO: 2317959 - protein, 24 aa, Cryptosporidium parvum
LSGTWDGKLIIWLTLERSKKNSNN

SEQ ID NO: 2317960 - protein, 27 aa, Cryptosporidium parvum
LSHPIRLYCRFVDKLYIIIKLSKQEIK

SEQ ID NO: 2317961 - protein, 18 aa, Cryptosporidium parvum
LSIDIWKYLDKKGFKSEI

SEQ ID NO: 2317962 - protein, 20 aa, Cryptosporidium parvum
LSIHFLSMISSFIGLTSTGV

SEQ ID NO: 2317963 - protein, 26 aa, Cryptosporidium parvum
LSIIAKLSHVFTLFSTAMRCIDDVIL

SEQ ID NO: 2317964 - protein, 25 aa, Cryptosporidium parvum
LSILENLFERLILENIKLGRSMVEY

SEQ ID NO: 2317965 - protein, 19 aa, Cryptosporidium parvum
LSILGVVSGLIPYPNHNQS

SEQ ID NO: 2317966 - protein, 35 aa, Cryptosporidium parvum; identical to SEQ ID NO: 2193653

SEQ ID NO: 2317967 - protein, 19 aa, Cryptosporidium parvum
LSIRYIPSLKRMRFEYDCI

SEQ ID NO: 2317968 - protein, 28 aa, Cryptosporidium parvum
LSISINDILSFFLLLGVPLNPERKHLIA

SEQ ID NO: 2317969 - protein, 17 aa, Cryptosporidium parvum
LSIWQRIHLLYDPDRNQ

SEQ ID NO: 2317970 - protein, 17 aa, Cryptosporidium parvum
LSIYRKAMGITRNGFKR

SEQ ID NO: 2317971 - protein, 28 aa, Cryptosporidium parvum
LSKDLNALYLRRSGKKLILPLNIVSLVE

SEQ ID NO: 2317972 - protein, 30 aa, Cryptosporidium parvum
LSKDSIPESFLPDFLDLIIWGHEHECIVNP

SEQ ID NO: 2317973 - protein, 25 aa, Cryptosporidium parvum
LSKDSKEYTFWKNANRFGDSKTNLD

SEQ ID NO: 2317974 - protein, 29 aa, Cryptosporidium parvum
LSKESPNFHLIIILKIEAIISNSSISSNI

SEQ ID NO: 2317975 - protein, 33 aa, Cryptosporidium parvum
LSKMPLEIQKPYFLLFKLPRTLSLVALEPKSPL

SEQ ID NO: 2317976 - protein, 21 aa, Cryptosporidium parvum
LSKPSIISCRVNPLVILSILD

SEQ ID NO: 2317977 - protein, 17 aa, Cryptosporidium parvum
LSKVPKVIFAFPESMDY

SEQ ID NO: 2317978 - protein, 17 aa, Cryptosporidium parvum
LSKWKFDEIRLICSLGN

SEQ ID NO: 2317979 - protein, 26 aa, Cryptosporidium parvum
LSLFCSTNCYYLYLDLSISLSETHPH

SEQ ID NO: 2317980 - protein, 35 aa, Cryptosporidium parvum
LSLFKEAIRIGFIDCFRLFTNGNIDWILVSGNCSY

SEQ ID NO: 2317981 - protein, 28 aa, Cryptosporidium parvum
LSLFKLKKLPQFPRLTSLNLNISLEKHS

SEQ ID NO: 2317982 - protein, 23 aa, Cryptosporidium parvum
LSLGSFTHVLGLCKPCVFVNKTN

SEQ ID NO: 2317983 - protein, 32 aa, Cryptosporidium parvum
LSLIHQTPVALFEYLEQYPLLLNNLGMAARIH

SEQ ID NO: 2317984 - protein, 23 aa, Cryptosporidium parvum
LSLNPFVCKYSLEPAVKYPGYKL

SEQ ID NO: 2317985 - protein, 26 aa, Cryptosporidium parvum
LSLNRYYLPGYFKTAPFNYVRDAKVF

SEQ ID NO: 2317986 - protein, 20 aa, Cryptosporidium parvum
LSLPKTIFAHGFVTAPDGKK

SEQ ID NO: 2317987 - protein, 22 aa, Cryptosporidium parvum
LSLSLFNYIEISPLVSYYGENL

SEQ ID NO: 2317988 - protein, 31 aa, Cryptosporidium parvum; identical to SEQ ID NO: 2193673

SEQ ID NO: 2317989 - protein, 22 aa, Cryptosporidium parvum
LSLYCVIYLLSMNVAMDEYGNP

SEQ ID NO: 2317990 - protein, 25 aa, Cryptosporidium parvum
LSMANTLRRIILAEIPTLAIDLVTM

SEQ ID NO: 2317991 - protein, 23 aa, Cryptosporidium parvum
LSMKNEVLINLSNRLKCFSTKVE

SEQ ID NO: 2317992 - protein, 17 aa, Cryptosporidium parvum
LSNFYFCCLYFHRLDSM

SEQ ID NO: 2317993 - protein, 34 aa, Cryptosporidium parvum
LSNFYLRFNGNCKLLLEYIPFSEPEDINYYVSMI

SEQ ID NO: 2317994 - protein, 25 aa, Cryptosporidium parvum
LSNGRLFTQLQWISKHYSTPVILIE

SEQ ID NO: 2317995 - protein, 28 aa, Cryptosporidium parvum
LSNHCNFIDLIFLYLEKLIENLENILGD

SEQ ID NO: 2317996 - protein, 24 aa, Cryptosporidium parvum
LSNIEKPEWLLETYFSLFKSHSEY

SEQ ID NO: 2317997 - protein, 18 aa, Cryptosporidium parvum
LSNIFSSHGGELIFVIRP

SEQ ID NO: 2317998 - protein, 23 aa, Cryptosporidium parvum
LSNITNHFILRRANTLLAKVLPP

SEQ ID NO: 2317999 - protein, 57 aa, Cryptosporidium parvum; identical to SEQ ID NO: 2193679

SEQ ID NO: 2318000 - protein, 33 aa, Cryptosporidium parvum
LSNNKGLQFILRLLFRYNILSASQYMSAIPSNS

SEQ ID NO: 2318001 - protein, 27 aa, Cryptosporidium parvum
LSNNLQIFILGLLAYNGSHFKVNWNNY

SEQ ID NO: 2318002 - protein, 22 aa, Cryptosporidium parvum
LSNNPNYFRSILLLIGNDISSI

SEQ ID NO: 2318003 - protein, 20 aa, Cryptosporidium parvum
LSNNWYQRLNWVWRDGYSIV

SEQ ID NO: 2318004 - protein, 24 aa, Cryptosporidium parvum
LSNSLFVYILENLGIYWIKMDKIE

SEQ ID NO: 2318005 - protein, 24 aa, Cryptosporidium parvum
LSNSRIFLDKFIKLLISSPMVNEL

SEQ ID NO: 2318006 - protein, 22 aa, Cryptosporidium parvum
LSNTKRYVQLIYIAADNCLPVP

SEQ ID NO: 2318007 - protein, 24 aa, Cryptosporidium parvum
LSPDIRYNNYMGNSLLVDDQRDQC

SEQ ID NO: 2318008 - protein, 17 aa, Cryptosporidium parvum
LSPPELFSRMFNSLNSE

SEQ ID NO: 2318009 - protein, 17 aa, Cryptosporidium parvum
LSPYEYLRRHNLISNFT

SEQ ID NO: 2318010 - protein, 26 aa, Cryptosporidium parvum
LSQQIKQWETMAYRYTHNLKVLNRES

SEQ ID NO: 2318011 - protein, 27 aa, Cryptosporidium parvum
LSQSDGEILFTSPSYRISPNNTIRRKF

SEQ ID NO: 2318012 - protein, 17 aa, Cryptosporidium parvum
LSRFRTRICERKALHGV

SEQ ID NO: 2318013 - protein, 32 aa, Cryptosporidium parvum
LSRILLSHPKLFEKNLLLIIQLINENLNNSCT

SEQ ID NO: 2318014 - protein, 22 aa, Cryptosporidium parvum
LSRILVYDSPFQPEFWSYRILT

SEQ ID NO: 2318015 - protein, 20 aa, Cryptosporidium parvum
LSRIVIFRREEYIRKTKQGL

SEQ ID NO: 2318016 - protein, 19 aa, Cryptosporidium parvum
LSRLTFTSALSYLRRLNTP

SEQ ID NO: 2318017 - protein, 22 aa, Cryptosporidium parvum
LSSAFMLETLLRRLDKDNIKVG

SEQ ID NO: 2318018 - protein, 23 aa, Cryptosporidium parvum
LSSAIQRFLPKDEILKLVLAEVY

SEQ ID NO: 2318019 - protein, 24 aa, Cryptosporidium parvum
LSSCFAFHFSLMKTRKIFYDLLQT

SEQ ID NO: 2318020 - protein, 26 aa, Cryptosporidium parvum
LSSDSWGSFLPYSKITDYCFENSPDN

SEQ ID NO: 2318021 - protein, 24 aa, Cryptosporidium parvum
LSSFFGNAPIFNIPGRTFPVEIEY

SEQ ID NO: 2318022 - protein, 24 aa, Cryptosporidium parvum
LSSGFSINWVLDADWSFLNNHKLV

SEQ ID NO: 2318023 - protein, 24 aa, Cryptosporidium parvum
LSSGITPALWFGFSKIISDYKPTI

SEQ ID NO: 2318024 - protein, 27 aa, Cryptosporidium parvum
LSSGKLYLIFDFFPIGPTMAPDTGARR

SEQ ID NO: 2318025 - protein, 19 aa, Cryptosporidium parvum
LSSLRHRSWFIQSTCATAG

SEQ ID NO: 2318026 - protein, 23 aa, Cryptosporidium parvum
LSSNFIEWIISQSNLHMDKFLLF

SEQ ID NO: 2318027 - protein, 25 aa, Cryptosporidium parvum
LSSRLGRCIPANPIALVGLLSNFGQ

SEQ ID NO: 2318028 - protein, 18 aa, Cryptosporidium parvum
LSSTAALLATRFNKEVPN

SEQ ID NO: 2318029 - protein, 20 aa, Cryptosporidium parvum
LSTEVILSKFKFISVRDLQQ

SEQ ID NO: 2318030 - protein, 24 aa, Cryptosporidium parvum
LSTFKNYLVLVSSPLNISSEYYSN

SEQ ID NO: 2318031 - protein, 17 aa, Cryptosporidium parvum
LSTLRELELKGFRVTYL

SEQ ID NO: 2318032 - protein, 19 aa, Cryptosporidium parvum
LSTQYLNWQYYRENVIMRD

SEQ ID NO: 2318033 - protein, 19 aa, Cryptosporidium parvum
LSWVPRGYAKEVPIKNAHY

SEQ ID NO: 2318034 - protein, 24 aa, Cryptosporidium parvum
LSYDRVLYYGLPGDFYLPPNDGLD

SEQ ID NO: 2318035 - protein, 17 aa, Cryptosporidium parvum
LSYFLLSSNAKMRVNSI

SEQ ID NO: 2318036 - protein, 28 aa, Cryptosporidium parvum
LSYVDFIELVIFYFKKFNLKGVFVGNIH

SEQ ID NO: 2318037 - protein, 25 aa, Cryptosporidium parvum
LTALAMLCMDPYYRTIQGFLSLIEK

SEQ ID NO: 2318038 - protein, 19 aa, Cryptosporidium parvum
LTAYKLSNIFSSHGGELIF

SEQ ID NO: 2318039 - protein, 17 aa, Cryptosporidium parvum
LTCWNKSVKFYDPQIPY

SEQ ID NO: 2318040 - protein, 18 aa, Cryptosporidium parvum
LTDALMASPIVLGEGTSS

SEQ ID NO: 2318041 - protein, 47 aa, Cryptosporidium parvum; identical to SEQ ID NO: 2193713

SEQ ID NO: 2318042 - protein, 28 aa, Cryptosporidium parvum
LTDSASATKYWYFMKMIGDKTSNVALEV

SEQ ID NO: 2318043 - protein, 22 aa, Cryptosporidium parvum
LTDYVVTRWYRAPEIILCVNRY

SEQ ID NO: 2318044 - protein, 17 aa, Cryptosporidium parvum
LTENIFTPGFKCSCFAY

SEQ ID NO: 2318045 - protein, 20 aa, Cryptosporidium parvum
LTENIYSQLILKFVDFDSLL

SEQ ID NO: 2318046 - protein, 20 aa, Cryptosporidium parvum
LTEWSIEPLSSWISVAEIPL

SEQ ID NO: 2318047 - protein, 27 aa, Cryptosporidium parvum
LTEYCNLHFILKKLLSEGLEYWKTLFN

SEQ ID NO: 2318048 - protein, 20 aa, Cryptosporidium parvum
LTEYEKWERSMSIAGFINSD

SEQ ID NO: 2318049 - protein, 17 aa, Cryptosporidium parvum
LTFYAIEICFKKIDSKL

SEQ ID NO: 2318050 - protein, 25 aa, Cryptosporidium parvum
LTIMSEFLVVMNRWKKLAKYTIEND

SEQ ID NO: 2318051 - protein, 17 aa, Cryptosporidium parvum
LTISARAMLKFVKGLTP

SEQ ID NO: 2318052 - protein, 24 aa, Cryptosporidium parvum
LTIVPSIIIVIARSIWPIFVYHPI

SEQ ID NO: 2318053 - protein, 26 aa, Cryptosporidium parvum
LTIVTERKILLFDLLNIDRKSEWMSI

SEQ ID NO: 2318054 - protein, 25 aa, Cryptosporidium parvum
LTKELILKPISLLKSCYPKVIVMTQ

SEQ ID NO: 2318055 - protein, 20 aa, Cryptosporidium parvum
LTLAINFLVSLLKKNWHNIK

SEQ ID NO: 2318056 - protein, 20 aa, Cryptosporidium parvum
LTLISKWLEMPQYRYQIRLI

SEQ ID NO: 2318057 - protein, 22 aa, Cryptosporidium parvum
LTMEYIKGFNILNKMLLKENRV

SEQ ID NO: 2318058 - protein, 19 aa, Cryptosporidium parvum
LTMWYRAPEILLGIDKYSP

SEQ ID NO: 2318059 - protein, 17 aa, Cryptosporidium parvum
LTNKNQGSFYFYPPGQA

SEQ ID NO: 2318060 - protein, 31 aa, Cryptosporidium parvum; identical to SEQ ID NO: 2193736

SEQ ID NO: 2318061 - protein, 25 aa, Cryptosporidium parvum
LTNWNKFTFPLLEEFSMIQDQIQLV

SEQ ID NO: 2318062 - protein, 21 aa, Cryptosporidium parvum
LTPVPLRELIASIILCSRGTL

SEQ ID NO: 2318063 - protein, 24 aa, Cryptosporidium parvum
LTQKKSYKFAVLSPFNISHRLYNL

SEQ ID NO: 2318064 - protein, 20 aa, Cryptosporidium parvum
LTRALLLGEVELFNSSLWSL

SEQ ID NO: 2318065 - protein, 25 aa, Cryptosporidium parvum
LTRFFDINLIPREISQLIWYQHIQP

SEQ ID NO: 2318066 - protein, 18 aa, Cryptosporidium parvum
LTRFTAGIIIVLSSVFDK

SEQ ID NO: 2318067 - protein, 24 aa, Cryptosporidium parvum
LTRGQRKRRLVLERVKRKQDLTSY

SEQ ID NO: 2318068 - protein, 31 aa, Cryptosporidium parvum; identical to SEQ ID NO: 2193746

SEQ ID NO: 2318069 - protein, 26 aa, Cryptosporidium parvum
LTRNLTVITVCGHVFHKQCIDAWLSK

SEQ ID NO: 2318070 - protein, 17 aa, Cryptosporidium parvum
LTSKGMHLLFEKYQTQK

SEQ ID NO: 2318071 - protein, 25 aa, Cryptosporidium parvum
LTSNRVRLLFRKGMKCYRPRRTGEM

SEQ ID NO: 2318072 - protein, 24 aa, Cryptosporidium parvum
LTSRIVRFLLSGYSPILALTFTKK

SEQ ID NO: 2318073 - protein, 24 aa, Cryptosporidium parvum
LTSRKIQILLNSYIKRHKFILSRP

SEQ ID NO: 2318074 - protein, 31 aa, Cryptosporidium parvum
LTSTILAPPAFSKKIIKFFKMNQRNSLNYPS

SEQ ID NO: 2318075 - protein, 23 aa, Cryptosporidium parvum
LTSYKKISLPKIDLSKIGVQELI

SEQ ID NO: 2318076 - protein, 17 aa, Cryptosporidium parvum
LTTLFYSLQFHIGVQFN

SEQ ID NO: 2318077 - protein, 30 aa, Cryptosporidium parvum
LTVLNSNQRIWLISLLERKQVKKGSKFINQ

SEQ ID NO: 2318078 - protein, 18 aa, Cryptosporidium parvum
LTVLQHHSYWVVSQWHIL

SEQ ID NO: 2318079 - protein, 19 aa, Cryptosporidium parvum
LTVNLLKIPQLLDFSLRLL

SEQ ID NO: 2318080 - protein, 20 aa, Cryptosporidium parvum
LTVSRILEYFQGKKADLVLC

SEQ ID NO: 2318081 - protein, 28 aa, Cryptosporidium parvum
LTVVETLLALEFFFPMDSGDLPYEVKRM

SEQ ID NO: 2318082 - protein, 28 aa, Cryptosporidium parvum
LTYDEGNQLIFPPGYKIPASSKSKKEDP

SEQ ID NO: 2318083 - protein, 23 aa, Cryptosporidium parvum
LTYLDRWQLYDNIRFWAEVIDKL

SEQ ID NO: 2318084 - protein, 23 aa, Cryptosporidium parvum
LTYNSVLPILATSALPVVTADPY

SEQ ID NO: 2318085 - protein, 25 aa, Cryptosporidium parvum
LVAGDGRFFLPEAIQIISEIAAAHK

SEQ ID NO: 2318086 - protein, 21 aa, Cryptosporidium parvum
LVASVRYFQPAFLISPAEEAQ

SEQ ID NO: 2318087 - protein, 20 aa, Cryptosporidium parvum
LVCTFFTILGSYSKGFIVIV

SEQ ID NO: 2318088 - protein, 30 aa, Cryptosporidium parvum; identical to SEQ ID NO: 2193764

SEQ ID NO: 2318089 - protein, 22 aa, Cryptosporidium parvum
LVDLNGPLFKLLKQVRDIWKFQ

SEQ ID NO: 2318090 - protein, 17 aa, Cryptosporidium parvum
LVDLRRAARRALLEVIR

SEQ ID NO: 2318091 - protein, 20 aa, Cryptosporidium parvum
LVEEFFFLFNRHFIHFGDGD

SEQ ID NO: 2318092 - protein, 24 aa, Cryptosporidium parvum
LVEEGIIESLPLKVFDMRGSDENG

SEQ ID NO: 2318093 - protein, 24 aa, Cryptosporidium parvum
LVEEGIIESLPLKVYDMRGSDENG

SEQ ID NO: 2318094 - protein, 25 aa, Cryptosporidium parvum
LVEQKQNLPPPPPKRPTTTDSGTRT

SEQ ID NO: 2318095 - protein, 28 aa, Cryptosporidium parvum
LVERAVQQRIYLLEPKLDDSIKHLQENI

SEQ ID NO: 2318096 - protein, 26 aa, Cryptosporidium parvum
LVEYERLQYLYLSLKTIIENNASTKA

SEQ ID NO: 2318097 - protein, 26 aa, Cryptosporidium parvum
LVFIDKYLQVPKILTPIVLCIEKIDK

SEQ ID NO: 2318098 - protein, 26 aa, Cryptosporidium parvum
LVFSESLLMLDLIELTILIPNKIDWE

SEQ ID NO: 2318099 - protein, 19 aa, Cryptosporidium parvum
LVGDFSLDMRLYCLVRRSE

SEQ ID NO: 2318100 - protein, 18 aa, Cryptosporidium parvum
LVGIINFCTTIKLKHLHF

SEQ ID NO: 2318101 - protein, 18 aa, Cryptosporidium parvum
LVGKWISFLYNKEILNVE

SEQ ID NO: 2318102 - protein, 24 aa, Cryptosporidium parvum
LVKLQLCFSLLYFVNGNFQECYTN

SEQ ID NO: 2318103 - protein, 31 aa, Cryptosporidium parvum
LVKNILNCEILKKYPLPLIYQRNLICEIVKI

SEQ ID NO: 2318104 - protein, 36 aa, Cryptosporidium parvum
LVKNYLFGGFLAIPNDWWMCYVHGDDLEKILCHNSG

SEQ ID NO: 2318105 - protein, 18 aa, Cryptosporidium parvum
LVKPWNGNRFMFPRGKMD

SEQ ID NO: 2318106 - protein, 19 aa, Cryptosporidium parvum
LVKTLLDTSVPKSGIRLRL

SEQ ID NO: 2318107 - protein, 17 aa, Cryptosporidium parvum
LVLEACAIRIQTAFRKY

SEQ ID NO: 2318108 - protein, 25 aa, Cryptosporidium parvum
LVLLSNNDLYFVKLPEYSEFKETID

SEQ ID NO: 2318109 - protein, 18 aa, Cryptosporidium parvum
LVLYVGFNSPGNLTILVF

SEQ ID NO: 2318110 - protein, 24 aa, Cryptosporidium parvum
LVMDLRYLMSPWSAIKLQENKHNK

SEQ ID NO: 2318111 - protein, 17 aa, Cryptosporidium parvum
LVNILTPSRTPYVPQRD

SEQ ID NO: 2318112 - protein, 32 aa, Cryptosporidium parvum; identical to SEQ ID NO: 2193787

SEQ ID NO: 2318113 - protein, 22 aa, Cryptosporidium parvum
LVNNILKYFLGFGENSNFLGYH

SEQ ID NO: 2318114 - protein, 31 aa, Cryptosporidium parvum
LVNSRRFDVPFRNMLLWGKPGTGKTMFARKL

SEQ ID NO: 2318115 - protein, 25 aa, Cryptosporidium parvum
LVNVEFKALVFKPKIGELLICRISH

SEQ ID NO: 2318116 - protein, 34 aa, Cryptosporidium parvum; identical to SEQ ID NO: 2193791

SEQ ID NO: 2318117 - protein, 29 aa, Cryptosporidium parvum
LVPELQHLSVPYWNLFPDVIDDVLNDTNK

SEQ ID NO: 2318118 - protein, 17 aa, Cryptosporidium parvum
LVPIEKEEKTYFLRGLL

SEQ ID NO: 2318119 - protein, 27 aa, Cryptosporidium parvum
LVPYTSIPCVLDFLKQRYLVNQIYTTA

SEQ ID NO: 2318120 - protein, 22 aa, Cryptosporidium parvum
LVQSLRPDLGLQSNLFTLCIHA

SEQ ID NO: 2318121 - protein, 17 aa, Cryptosporidium parvum
LVRAYISVDLFMCTSQP

SEQ ID NO: 2318122 - protein, 38 aa, Cryptosporidium parvum
LVRGALLSNLVIFLEFCGLQLRPLLPQIQTILVKFLLD

SEQ ID NO: 2318123 - protein, 24 aa, Cryptosporidium parvum
LVRPEHILKKSLDFVYNNYIKYSS

SEQ ID NO: 2318124 - protein, 25 aa, Cryptosporidium parvum
LVSCKCCGLTVHWSCYGLGEKMESI

SEQ ID NO: 2318125 - protein, 26 aa, Cryptosporidium parvum
LVSEDLYFFTHFYSAITFLEKLDGRQ

SEQ ID NO: 2318126 - protein, 26 aa, Cryptosporidium parvum
LVSEFLKKILIVVENWSNYINCYISK

SEQ ID NO: 2318127 - protein, 19 aa, Cryptosporidium parvum
LVSKCTLLYFSMPSNQLNE

SEQ ID NO: 2318128 - protein, 26 aa, Cryptosporidium parvum
LVSKIRRVLIYRSEWKRPPMYLLITH

SEQ ID NO: 2318129 - protein, 19 aa, Cryptosporidium parvum
LVSLLKLNPSLPINIKSKD

SEQ ID NO: 2318130 - protein, 18 aa, Cryptosporidium parvum
LVSLLSCLQKTAPRVLIF

SEQ ID NO: 2318131 - protein, 29 aa, Cryptosporidium parvum
LVSNDFLSQLLSFFNMRAIAIVGNSEAAT

SEQ ID NO: 2318132 - protein, 29 aa, Cryptosporidium parvum
LVSNIYPNIFKKLGKINFKLSRKGTKSEA

SEQ ID NO: 2318133 - protein, 30 aa, Cryptosporidium parvum
LVSNRLCNSFLTFLSFIYGFFEITSSDEDL

SEQ ID NO: 2318134 - protein, 45 aa, Cryptosporidium parvum; identical to SEQ ID NO: 2193809

SEQ ID NO: 2318135 - protein, 20 aa, Cryptosporidium parvum
LVTVYNRQDLKNQFFLASLC

SEQ ID NO: 2318136 - protein, 24 aa, Cryptosporidium parvum
LVYEPFFQDFGPLNLRCIYKYCKK

SEQ ID NO: 2318137 - protein, 19 aa, Cryptosporidium parvum
LVYRYHPDNSPTKAVLLLF

SEQ ID NO: 2318138 - protein, 30 aa, Cryptosporidium parvum
LWEVSDPIILNTFEKELFAFLTGETPKENS

SEQ ID NO: 2318139 - protein, 20 aa, Cryptosporidium parvum
LWKGIYYDNRNKGWKLCLDG

SEQ ID NO: 2318140 - protein, 17 aa, Cryptosporidium parvum
LWLSYDPSNERQSEINK

SEQ ID NO: 2318141 - protein, 24 aa, Cryptosporidium parvum
LWVCNPNKLRVCEFLIHWHEQRGD

SEQ ID NO: 2318142 - protein, 19 aa, Cryptosporidium parvum
LWVEVFEPKFNKWISVDIH

SEQ ID NO: 2318143 - protein, 18 aa, Cryptosporidium parvum
LYCLNILFRIYKLEFTEN

SEQ ID NO: 2318144 - protein, 21 aa, Cryptosporidium parvum
LYCLRFIEFKNTSFRWGEIHN

SEQ ID NO: 2318145 - protein, 18 aa, Cryptosporidium parvum
LYDIIYSRELHSMGLLSW

SEQ ID NO: 2318146 - protein, 17 aa, Cryptosporidium parvum
LYEDEVGLIWKYRFYLF

SEQ ID NO: 2318147 - protein, 21 aa, Cryptosporidium parvum
LYEHYGIKYVFKIWQHRSDGL

SEQ ID NO: 2318148 - protein, 20 aa, Cryptosporidium parvum
LYELLNASWRIVTIASILVP

SEQ ID NO: 2318149 - protein, 21 aa, Cryptosporidium parvum
LYELVKLFPEKMDISNDLTFR

SEQ ID NO: 2318150 - protein, 43 aa, Cryptosporidium parvum
LYETSMLHFAYIINTKIRLQMVDAFWRIQTRPSKRNLVETEEV

SEQ ID NO: 2318151 - protein, 27 aa, Cryptosporidium parvum
LYEYNKLQWCTLALTRIAQYSALGIRH

SEQ ID NO: 2318152 - protein, 25 aa, Cryptosporidium parvum
LYFEEQERYFIAALSTLESWLSFDQ

SEQ ID NO: 2318153 - protein, 20 aa, Cryptosporidium parvum
LYFQEIYDFQLSLDRFEIKE

SEQ ID NO: 2318154 - protein, 38 aa, Cryptosporidium parvum; identical to SEQ ID NO: 2193836

SEQ ID NO: 2318155 - protein, 18 aa, Cryptosporidium parvum
LYIPRKCSATKRLIPSKE

SEQ ID NO: 2318156 - protein, 22 aa, Cryptosporidium parvum
LYIQSGWIPENMKLLLAIKSPF

SEQ ID NO: 2318157 - protein, 32 aa, Cryptosporidium parvum
LYISSLFKHPSFPEFLFGIIPNLKKLQKHNSR

SEQ ID NO: 2318158 - protein, 33 aa, Cryptosporidium parvum; identical to SEQ ID NO: 2193839

SEQ ID NO: 2318159 - protein, 19 aa, Cryptosporidium parvum
LYKIRNYFDAYLLNTNENL

SEQ ID NO: 2318160 - protein, 28 aa, Cryptosporidium parvum
LYKMSISFYLITQVLYRVSTRQLIYSSR

SEQ ID NO: 2318161 - protein, 18 aa, Cryptosporidium parvum
LYKYPRSCIGSRRFSRYN

SEQ ID NO: 2318162 - protein, 20 aa, Cryptosporidium parvum
LYLKYFNFHSIGKPKGINTA

SEQ ID NO: 2318163 - protein, 36 aa, Cryptosporidium parvum
LYNADLTKFSQGYLKNLFLLSLDKNKDKINFEDGLT

SEQ ID NO: 2318164 - protein, 19 aa, Cryptosporidium parvum
LYNSMVCYGPKSPIYYYCL

SEQ ID NO: 2318165 - protein, 30 aa, Cryptosporidium parvum; identical to SEQ ID NO: 2193845

SEQ ID NO: 2318166 - protein, 17 aa, Cryptosporidium parvum
LYPNGSCVHTHCLSNEY

SEQ ID NO: 2318167 - protein, 22 aa, Cryptosporidium parvum
LYPNWKWSQRWHGIREKFYLWV

SEQ ID NO: 2318168 - protein, 21 aa, Cryptosporidium parvum
LYQPTFKRKSIINSPKVFACM

SEQ ID NO: 2318169 - protein, 26 aa, Cryptosporidium parvum
LYQTQKQFQIILGKRNVEFSNVKDEL

SEQ ID NO: 2318170 - protein, 20 aa, Cryptosporidium parvum
LYRCVLTPHHRTGTKYKVYP

SEQ ID NO: 2318171 - protein, 38 aa, Cryptosporidium parvum
LYREDVWGTYRSYDPIYWWVDFVLPSVNPYISTYSDQK

SEQ ID NO: 2318172 - protein, 24 aa, Cryptosporidium parvum
LYRMGYLCIIISTRTLALGVNMPC

SEQ ID NO: 2318173 - protein, 32 aa, Cryptosporidium parvum
LYSFQGKPMLKPLNWLLFEFKNHDLIGKNESI

SEQ ID NO: 2318174 - protein, 28 aa, Cryptosporidium parvum
LYSGKSIMVRLIGLDYIDQLRDLRVEWL

SEQ ID NO: 2318175 - protein, 26 aa, Cryptosporidium parvum
LYSISNFDMISIIRIPIYPNRCVFLS

SEQ ID NO: 2318176 - protein, 19 aa, Cryptosporidium parvum
LYTKDYVCIGFSNGSVRLY

SEQ ID NO: 2318177 - protein, 17 aa, Cryptosporidium parvum
LYVFDQLKIGLSELPLT

SEQ ID NO: 2318178 - protein, 17 aa, Cryptosporidium parvum
LYVIGVMNYGSSWSNKN

SEQ ID NO: 2318179 - protein, 22 aa, Cryptosporidium parvum
LYVLGQMGLKSPLTRLYEILAD

SEQ ID NO: 2318180 - protein, 17 aa, Cryptosporidium parvum
LYYNKRPIDKMIEYLTT

SEQ ID NO: 2318181 - protein, 34 aa, Cryptosporidium parvum
MAAMAAAYSGWYSPYGYTMPFMGSYTPIMPSIIP

SEQ ID NO: 2318182 - protein, 18 aa, Cryptosporidium parvum
MAAWFFEIQGIPAATISG

SEQ ID NO: 2318183 - protein, 27 aa, Cryptosporidium parvum
MAENAIMFLDKKYIFDNSKRPIEVRLA

SEQ ID NO: 2318184 - protein, 24 aa, Cryptosporidium parvum
MAEVFFEVYRVPALFISTQAVLSL

SEQ ID NO: 2318185 - protein, 17 aa, Cryptosporidium parvum
MAGDKRKRVQETEVDSE

SEQ ID NO: 2318186 - protein, 23 aa, Cryptosporidium parvum
MAGFDILSNHEGLLKKLLAFKEV

SEQ ID NO: 2318187 - protein, 28 aa, Cryptosporidium parvum
MAKIGWSRFDSFFRKIPMGAKKDIILKT

SEQ ID NO: 2318188 - protein, 22 aa, Cryptosporidium parvum
MAKLFEGIVIWLSVNDSKILTT

SEQ ID NO: 2318189 - protein, 28 aa, Cryptosporidium parvum
MAKSRNWTKFPILLKYDDLLIMEKSIFD

SEQ ID NO: 2318190 - protein, 17 aa, Cryptosporidium parvum
MALDLLGKNSKEFLVEE

SEQ ID NO: 2318191 - protein, 24 aa, Cryptosporidium parvum
MALLELEIKTLAYILSRELKTSSQ

SEQ ID NO: 2318192 - protein, 36 aa, Cryptosporidium parvum; identical to SEQ ID NO: 2193863

SEQ ID NO: 2318193 - protein, 18 aa, Cryptosporidium parvum
MALTLMSHFDFNASDIIF

SEQ ID NO: 2318194 - protein, 20 aa, Cryptosporidium parvum
MAMLWNVDTLRRARPTPLDE

SEQ ID NO: 2318195 - protein, 23 aa, Cryptosporidium parvum
MANYYLQQQVAYATAANLAISSN

SEQ ID NO: 2318196 - protein, 18 aa, Cryptosporidium parvum
MAPEIHRGEPYSLCVDLW

SEQ ID NO: 2318197 - protein, 25 aa, Cryptosporidium parvum
MATRCKIILGCRDLMFPPLNLQDRE

SEQ ID NO: 2318198 - protein, 39 aa, Cryptosporidium parvum
MCDRFIRDIPRGFFYAYFLNPLILLASDPIRNVRSTWLR

SEQ ID NO: 2318199 - protein, 25 aa, Cryptosporidium parvum
MCEISVGYRPYAIRTFLDEWGMDSI

SEQ ID NO: 2318200 - protein, 24 aa, Cryptosporidium parvum
MCKQIKYLRFPLCGRIIKSHKYVK

SEQ ID NO: 2318201 - protein, 37 aa, Cryptosporidium parvum
MDAMYNRDINYIRDLLCILSRDIWSLLLSCHQNFGQM

SEQ ID NO: 2318202 - protein, 26 aa, Cryptosporidium parvum
MDAYRLYNVTPRLISFLDTLCNWYVR

SEQ ID NO: 2318203 - protein, 17 aa, Cryptosporidium parvum
MDFLKNLNQQNSTEAEI

SEQ ID NO: 2318204 - protein, 29 aa, Cryptosporidium parvum
MDGIRLNGKIDLLRGIQIAQLALKHRLNK

SEQ ID NO: 2318205 - protein, 17 aa, Cryptosporidium parvum
MDIAIIKLIINEFNCKY

SEQ ID NO: 2318206 - protein, 25 aa, Cryptosporidium parvum
MDIHRTLHNFPTPIPGRHLTLHIGV

SEQ ID NO: 2318207 - protein, 28 aa, Cryptosporidium parvum
MDILNQQFPQILSLILFVLTSYLENPQN

SEQ ID NO: 2318208 - protein, 27 aa, Cryptosporidium parvum
MDISNDLTFRYLLDILQESYHNFKFIS

SEQ ID NO: 2318209 - protein, 24 aa, Cryptosporidium parvum
MDKVLCHPWFNLAKNTPIINHHIY

SEQ ID NO: 2318210 - protein, 29 aa, Cryptosporidium parvum
MDLEDVFQRPWYISTIARDNRIKSWQNDR

SEQ ID NO: 2318211 - protein, 18 aa, Cryptosporidium parvum
MDLSNICHVLLSLDFDRK

SEQ ID NO: 2318212 - protein, 27 aa, Cryptosporidium parvum
MDNPPIILKIELLLDNIILIDDSSSSI

SEQ ID NO: 2318213 - protein, 27 aa, Cryptosporidium parvum
MDQDYIIILDVLLPNCPIPENCRKFDS

SEQ ID NO: 2318214 - protein, 27 aa, Cryptosporidium parvum
MDRQKWLQTSGLYIPLLNEVIEQILHE

SEQ ID NO: 2318215 - protein, 25 aa, Cryptosporidium parvum
MDSEHLGYAGIWPSNGKDAKVVPMG

SEQ ID NO: 2318216 - protein, 23 aa, Cryptosporidium parvum
MDSLITMLRLACIHPQLGIMGIH

SEQ ID NO: 2318217 - protein, 18 aa, Cryptosporidium parvum
MDTFSLVRSISNLRLIGS

SEQ ID NO: 2318218 - protein, 23 aa, Cryptosporidium parvum
MDTHFIPLWLRNCPKFGIVHILA

SEQ ID NO: 2318219 - protein, 17 aa, Cryptosporidium parvum
MDVLLVNTIFGAAATEF

SEQ ID NO: 2318220 - protein, 25 aa, Cryptosporidium parvum
MDYYSRLRYVFPNNEYYLNSHFNTE

SEQ ID NO: 2318221 - protein, 25 aa, Cryptosporidium parvum
MEASRLKLIFAGRILNDSQTVQDVG

SEQ ID NO: 2318222 - protein, 17 aa, Cryptosporidium parvum
MEDAICTVDLWVKSPID

SEQ ID NO: 2318223 - protein, 26 aa, Cryptosporidium parvum
MEDISLLPGWILRNLSLMREIDKKSN

SEQ ID NO: 2318224 - protein, 32 aa, Cryptosporidium parvum
MEEKAKRSFKISKIYLIFYSCNKTVLNIEEQL

SEQ ID NO: 2318225 - protein, 17 aa, Cryptosporidium parvum
MEEPYCRILFSDNIEEI

SEQ ID NO: 2318226 - protein, 24 aa, Cryptosporidium parvum
MEEQLTLDFIGYYANKFEEDSNWA

SEQ ID NO: 2318227 - protein, 27 aa, Cryptosporidium parvum
MEHIDQVLTHLLPLSLTATRIYFTLQH

SEQ ID NO: 2318228 - protein, 18 aa, Cryptosporidium parvum
MEHLINFPTLKMLIGNLE

SEQ ID NO: 2318229 - protein, 34 aa, Cryptosporidium parvum; identical to SEQ ID NO: 2193886

SEQ ID NO: 2318230 - protein, 31 aa, Cryptosporidium parvum
MEIPDVILKEYLYLMALVDDSKFIDVDKAEE

SEQ ID NO: 2318231 - protein, 22 aa, Cryptosporidium parvum
MEISYFTFMNLSIAREIQIFDI

SEQ ID NO: 2318232 - protein, 23 aa, Cryptosporidium parvum
MEKIDLTLLNRLLRLITDHNIAD

SEQ ID NO: 2318233 - protein, 17 aa, Cryptosporidium parvum
MEKISINLPKFQKHQFE

SEQ ID NO: 2318234 - protein, 22 aa, Cryptosporidium parvum
MEKSEYYNSRILSLCKRSRDSL

SEQ ID NO: 2318235 - protein, 18 aa, Cryptosporidium parvum
MERAFKMFDKDGSGKIST

SEQ ID NO: 2318236 - protein, 27 aa, Cryptosporidium parvum
MERLNEIISMRLSYNQDLISLQSTLDI

SEQ ID NO: 2318237 - protein, 21 aa, Cryptosporidium parvum
METDFKLSIPILIELIKKDNL

SEQ ID NO: 2318238 - protein, 21 aa, Cryptosporidium parvum
MEVRKTLMGSILLSGGTSLTT

SEQ ID NO: 2318239 - protein, 28 aa, Cryptosporidium parvum
MEYSLTVIVPILEELLGKSVIFAKDCVG

SEQ ID NO: 2318240 - protein, 25 aa, Cryptosporidium parvum
MFEDPKLLYTLLIGSLDVFSQGILH

SEQ ID NO: 2318241 - protein, 17 aa, Cryptosporidium parvum
MFEKFDVPAVYTAKKAI

SEQ ID NO: 2318242 - protein, 18 aa, Cryptosporidium parvum
MFHACVYKTKIISAAPPS

SEQ ID NO: 2318243 - protein, 18 aa, Cryptosporidium parvum
MFLHIRGDQDCYSKFVRI

SEQ ID NO: 2318244 - protein, 17 aa, Cryptosporidium parvum
MFLWDPLGENGRKPIHR

SEQ ID NO: 2318245 - protein, 17 aa, Cryptosporidium parvum
MFMKNYYQLLSLERQNT

SEQ ID NO: 2318246 - protein, 17 aa, Cryptosporidium parvum
MFNFRQTPSLTLGCGSW

SEQ ID NO: 2318247 - protein, 23 aa, Cryptosporidium parvum
MFNYEHFNWIKKVLKNRWSIYFC

SEQ ID NO: 2318248 - protein, 17 aa, Cryptosporidium parvum
MFPDLFSSKYNQKSSRS

SEQ ID NO: 2318249 - protein, 25 aa, Cryptosporidium parvum
MFSLFENAYLGLVLVLVLELVFKLK

SEQ ID NO: 2318250 - protein, 19 aa, Cryptosporidium parvum
MFSYETFVLGCILTGCDYV

SEQ ID NO: 2318251 - protein, 17 aa, Cryptosporidium parvum
MGAKQPAFLSSKQLFDE

SEQ ID NO: 2318252 - protein, 21 aa, Cryptosporidium parvum
MGCDFGITRCQYSHNIYWPRR

SEQ ID NO: 2318253 - protein, 26 aa, Cryptosporidium parvum
MGDDGFHAIFPLLTQVKSLGKLDLGM

SEQ ID NO: 2318254 - protein, 17 aa, Cryptosporidium parvum
MGDFYYNSIKLNNKFMS

SEQ ID NO: 2318255 - protein, 20 aa, Cryptosporidium parvum
MGELLRFRPGVFDGAISISV

SEQ ID NO: 2318256 - protein, 17 aa, Cryptosporidium parvum
MGFLHISTDYRNVFTSN

SEQ ID NO: 2318257 - protein, 20 aa, Cryptosporidium parvum
MGGIEYGVVRNFLLEKSRVI

SEQ ID NO: 2318258 - protein, 25 aa, Cryptosporidium parvum
MGIMGLLLCDKIYDKSYLDQLVMIE

SEQ ID NO: 2318259 - protein, 17 aa, Cryptosporidium parvum
MGKGSFKYAWVLDKLKA

SEQ ID NO: 2318260 - protein, 23 aa, Cryptosporidium parvum
MGKMYGIILIPEGLIEFIPEMKI

SEQ ID NO: 2318261 - protein, 18 aa, Cryptosporidium parvum
MGNVIKWLKKQICKINPS

SEQ ID NO: 2318262 - protein, 25 aa, Cryptosporidium parvum
MGQNYQYYYPVNNQGYYNYGQYYYD

SEQ ID NO: 2318263 - protein, 19 aa, Cryptosporidium parvum
MGRNKVLVKLNPEGKFLVD

SEQ ID NO: 2318264 - protein, 18 aa, Cryptosporidium parvum
MGYSRDISSLRRPDERRK

SEQ ID NO: 2318265 - protein, 26 aa, Cryptosporidium parvum
MHAKEDILLQMLKHARSKSVASFIGI

SEQ ID NO: 2318266 - protein, 17 aa, Cryptosporidium parvum
MHDWQFYDKKRIMELHK

SEQ ID NO: 2318267 - protein, 17 aa, Cryptosporidium parvum
MHLKLVRGKPLYVGLHE

SEQ ID NO: 2318268 - protein, 21 aa, Cryptosporidium parvum
MHLNLYQIASFLCREDLEIPS

SEQ ID NO: 2318269 - protein, 26 aa, Cryptosporidium parvum
MHQNHLCIVFEWLHGSLKNCIHHFSK

SEQ ID NO: 2318270 - protein, 24 aa, Cryptosporidium parvum
MHSCREFMYYSDIYDLQNFIKVFY

SEQ ID NO: 2318271 - protein, 30 aa, Cryptosporidium parvum
MHTFTDYNYGINLPSLRKPISLISRSPRNS

SEQ ID NO: 2318272 - protein, 19 aa, Cryptosporidium parvum
MIAKIQLLYNNSSTYFKNI

SEQ ID NO: 2318273 - protein, 18 aa, Cryptosporidium parvum
MICEIIYLILRDCCEYDP

SEQ ID NO: 2318274 - protein, 26 aa, Cryptosporidium parvum
MIDNQAQILPYNKPLKNLVNTIAGIC

SEQ ID NO: 2318275 - protein, 19 aa, Cryptosporidium parvum
MIDVKLAEFHNSRSSLIRW

SEQ ID NO: 2318276 - protein, 20 aa, Cryptosporidium parvum
MIEKMTPFYTPGILSYLAAC

SEQ ID NO: 2318277 - protein, 31 aa, Cryptosporidium parvum
MIEKYRLISIYRFYYACFLKDLCNPMITFEL

SEQ ID NO: 2318278 - protein, 18 aa, Cryptosporidium parvum
MIESWVIKLLQRHPSHYG

SEQ ID NO: 2318279 - protein, 26 aa, Cryptosporidium parvum
MIGRGALLKPWIFTEIKENRNWDISA

SEQ ID NO: 2318280 - protein, 27 aa, Cryptosporidium parvum
MIHRRRHSLSYKPDIKKGVRKTDKSRI

SEQ ID NO: 2318281 - protein, 17 aa, Cryptosporidium parvum
MILMSELSKRRIRSVNK

SEQ ID NO: 2318282 - protein, 20 aa, Cryptosporidium parvum
MINFKRFRDICDKVKAYLMV

SEQ ID NO: 2318283 - protein, 23 aa, Cryptosporidium parvum
MINKIVVWPWHQQRMRVTKSRAS

SEQ ID NO: 2318284 - protein, 17 aa, Cryptosporidium parvum
MINLYKAGELKQYNFSG

SEQ ID NO: 2318285 - protein, 19 aa, Cryptosporidium parvum
MINQSLLTLGRVINALVEH

SEQ ID NO: 2318286 - protein, 18 aa, Cryptosporidium parvum
MINSNWDSNDWGFDEDFE

SEQ ID NO: 2318287 - protein, 18 aa, Cryptosporidium parvum
MIPEKPIVKGKPPGPPPP

SEQ ID NO: 2318288 - protein, 25 aa, Cryptosporidium parvum
MIQNPSKVFYLYEPFSKKITRETYS

SEQ ID NO: 2318289 - protein, 28 aa, Cryptosporidium parvum
MIRGADINKLYLDLIQKSQQNVQAIKTC

SEQ ID NO: 2318290 - protein, 38 aa, Cryptosporidium parvum
MISETYTYIRHTFSWMNNQFGMKLIAPQAPAYITPNSG

SEQ ID NO: 2318291 - protein, 17 aa, Cryptosporidium parvum
MISLVPKIDQLNSLIFS

SEQ ID NO: 2318292 - protein, 18 aa, Cryptosporidium parvum
MISNNFLQQLHTPGIDIL

SEQ ID NO: 2318293 - protein, 23 aa, Cryptosporidium parvum
MISNYLNSYYGNMLKHQFFGDNS

SEQ ID NO: 2318294 - protein, 21 aa, Cryptosporidium parvum
MITNIFFHYRAYDLSAGIMIA

SEQ ID NO: 2318295 - protein, 18 aa, Cryptosporidium parvum
MITTQRKLWSILVNTKIS

SEQ ID NO: 2318296 - protein, 19 aa, Cryptosporidium parvum
MKDDLLKVSLIIDEEQAYQ

SEQ ID NO: 2318297 - protein, 38 aa, Cryptosporidium parvum; identical to SEQ ID NO: 2193953

SEQ ID NO: 2318298 - protein, 23 aa, Cryptosporidium parvum
MKFIQYYSYWVPFHTISENRDSS

SEQ ID NO: 2318299 - protein, 17 aa, Cryptosporidium parvum
MKGLLGENVEGGSGSNN

SEQ ID NO: 2318300 - protein, 27 aa, Cryptosporidium parvum
MKKFEYKMRLVYSHFPINSNILNNGSL

SEQ ID NO: 2318301 - protein, 18 aa, Cryptosporidium parvum
MKLDCGIVFSLVSPTMFR

SEQ ID NO: 2318302 - protein, 26 aa, Cryptosporidium parvum
MKNHKRWIMSLPISGKIFLDKGAIKS

SEQ ID NO: 2318303 - protein, 20 aa, Cryptosporidium parvum
MKPIIDKFSGIVLAGNILRL

SEQ ID NO: 2318304 - protein, 19 aa, Cryptosporidium parvum
MKPPENVLFVCKLNPVTQD

SEQ ID NO: 2318305 - protein, 24 aa, Cryptosporidium parvum
MKQDFVPYLPHLLPGIFNILETRE

SEQ ID NO: 2318306 - protein, 22 aa, Cryptosporidium parvum
MKYFVSAGCIAVRRVEKVDLRR

SEQ ID NO: 2318307 - protein, 29 aa, Cryptosporidium parvum
MKYVLSLDMDAILKEALRPQLRVLKISLK

SEQ ID NO: 2318308 - protein, 30 aa, Cryptosporidium parvum
MLAQIFSSLHYLLTHLGIDGFRFTVPDLSE

SEQ ID NO: 2318309 - protein, 30 aa, Cryptosporidium parvum
MLDFQCKLLLEKLESFPLDMENRQIELKSS

SEQ ID NO: 2318310 - protein, 18 aa, Cryptosporidium parvum
MLDRGLLQSIFGSDSASA

SEQ ID NO: 2318311 - protein, 22 aa, Cryptosporidium parvum
MLDSILPKLRAAGHRVLIFSQM

SEQ ID NO: 2318312 - protein, 17 aa, Cryptosporidium parvum
MLELLNQLDGFESTQNI

SEQ ID NO: 2318313 - protein, 18 aa, Cryptosporidium parvum
MLEMLKRVGRSELVVGWY

SEQ ID NO: 2318314 - protein, 17 aa, Cryptosporidium parvum
MLGYTRQSLIGGIDAFL

SEQ ID NO: 2318315 - protein, 17 aa, Cryptosporidium parvum
MLHLSKLYHKSKPIDIL

SEQ ID NO: 2318316 - protein, 21 aa, Cryptosporidium parvum
MLISSPLLCYGSMKMNSDISR

SEQ ID NO: 2318317 - protein, 17 aa, Cryptosporidium parvum
MLKNIWNLSQEKANINP

SEQ ID NO: 2318318 - protein, 18 aa, Cryptosporidium parvum
MLKRCILALKRKSLIRLG

SEQ ID NO: 2318319 - protein, 30 aa, Cryptosporidium parvum
MLLELGIHYPIPLPKPWDELLLEDVCLTRQ

SEQ ID NO: 2318320 - protein, 17 aa, Cryptosporidium parvum
MLLFIDEAEAFLSKGRE

SEQ ID NO: 2318321 - protein, 31 aa, Cryptosporidium parvum; identical to SEQ ID NO: 2193976

SEQ ID NO: 2318322 - protein, 19 aa, Cryptosporidium parvum
MLMDVYFDDFISWNNLNSQ

SEQ ID NO: 2318323 - protein, 25 aa, Cryptosporidium parvum
MLNDKVNVFFHYLDGFFGAIGAYLS

SEQ ID NO: 2318324 - protein, 28 aa, Cryptosporidium parvum
MLNRNRVHFFTLRMNDLLQRHIEDVDTL

SEQ ID NO: 2318325 - protein, 30 aa, Cryptosporidium parvum
MLNWEMEFKRWLPCFKVITYFGTPKERQKK

SEQ ID NO: 2318326 - protein, 21 aa, Cryptosporidium parvum
MLQIGRNFSLPSWVQLRNIRD

SEQ ID NO: 2318327 - protein, 19 aa, Cryptosporidium parvum
MLQPINQIFHLFTSKQRVQ

SEQ ID NO: 2318328 - protein, 29 aa, Cryptosporidium parvum
MLQQLLMDFEYIIPIFVIYRIFEVHSENC

SEQ ID NO: 2318329 - protein, 17 aa, Cryptosporidium parvum
MLRASLLSEFSAGEGKM

SEQ ID NO: 2318330 - protein, 21 aa, Cryptosporidium parvum
MLSIYERHQIFINLKVNNILC

SEQ ID NO: 2318331 - protein, 17 aa, Cryptosporidium parvum
MLSLRYHPFENICGFTN

SEQ ID NO: 2318332 - protein, 19 aa, Cryptosporidium parvum
MLYLMVRDRWEALVYNRNS

SEQ ID NO: 2318333 - protein, 32 aa, Cryptosporidium parvum; identical to SEQ ID NO: 2193983

SEQ ID NO: 2318334 - protein, 17 aa, Cryptosporidium parvum
MMMIEIINGIQICNNNN

SEQ ID NO: 2318335 - protein, 17 aa, Cryptosporidium parvum
MMNLPLQQRQELERIEK

SEQ ID NO: 2318336 - protein, 19 aa, Cryptosporidium parvum
MMRMKLDLDKIRKDEFDRI

SEQ ID NO: 2318337 - protein, 19 aa, Cryptosporidium parvum
MMSIHLYELITQFSLLVIS

SEQ ID NO: 2318338 - protein, 20 aa, Cryptosporidium parvum
MNEIARFCPSIKAVKFLGNG

SEQ ID NO: 2318339 - protein, 25 aa, Cryptosporidium parvum
MNELRVYNFWILGQLINELYRNSRE

SEQ ID NO: 2318340 - protein, 33 aa, Cryptosporidium parvum
MNGACGGFVPCFPGPYLNMHYDPHFGNFSGNNY

SEQ ID NO: 2318341 - protein, 42 aa, Cryptosporidium parvum
MNINRFFELLQRRYRTMLLARGFWRIWSSCYSPLFKRKTNCG

SEQ ID NO: 2318342 - protein, 19 aa, Cryptosporidium parvum
MNIPLRLVDMIRKRIFSQV

SEQ ID NO: 2318343 - protein, 25 aa, Cryptosporidium parvum
MNISFKEAFLSEKWNLNSNLNSETR

SEQ ID NO: 2318344 - protein, 40 aa, Cryptosporidium parvum; identical to SEQ ID NO: 2193994

SEQ ID NO: 2318345 - protein, 17 aa, Cryptosporidium parvum
MNKVLHDLLVKLKVELN

SEQ ID NO: 2318346 - protein, 18 aa, Cryptosporidium parvum
MNLLLRKEKILDGKVINL

SEQ ID NO: 2318347 - protein, 24 aa, Cryptosporidium parvum
MNNYELGTIVLRRLCISESSEIKA

SEQ ID NO: 2318348 - protein, 29 aa, Cryptosporidium parvum
MNPGLFQTPLFINPFYNSTSCPSCYFSWL

SEQ ID NO: 2318349 - protein, 19 aa, Cryptosporidium parvum
MNPQLFIAETSIPGQWFKA

SEQ ID NO: 2318350 - protein, 21 aa, Cryptosporidium parvum
MNQYLQQQLVFQQTLQEQMRN

SEQ ID NO: 2318351 - protein, 23 aa, Cryptosporidium parvum
MNSEYWDLLMISRSQFEDLVSSI

SEQ ID NO: 2318352 - protein, 19 aa, Cryptosporidium parvum
MNSTLKHKTNLDPKSLLFN

SEQ ID NO: 2318353 - protein, 30 aa, Cryptosporidium parvum; identical to SEQ ID NO: 2194003

SEQ ID NO: 2318354 - protein, 55 aa, Cryptosporidium parvum
MNVCKSNVVLIPYYGGLTKGNYLRFGFNVPRTDLLPISISFFDSNDAKSLFVLNP

SEQ ID NO: 2318355 - protein, 27 aa, Cryptosporidium parvum
MNWSNMQIVFQSYLRQLQTITLLEEYS

SEQ ID NO: 2318356 - protein, 18 aa, Cryptosporidium parvum
MNYLVGIFLYALDFNVEQ

SEQ ID NO: 2318357 - protein, 33 aa, Cryptosporidium parvum
MNYSSKYCLLKNKYLFLGIEFLHETLGKIISSR

SEQ ID NO: 2318358 - protein, 23 aa, Cryptosporidium parvum
MPAPMPMQMPIPAHLPTPMPMPV

SEQ ID NO: 2318359 - protein, 27 aa, Cryptosporidium parvum
MPDNQAENLLFWIQQLQNQWKVDEAVA

SEQ ID NO: 2318360 - protein, 36 aa, Cryptosporidium parvum
MPESKFLGPLMPWEYYEPWDPILRPTLDLGGVMTIY

SEQ ID NO: 2318361 - protein, 19 aa, Cryptosporidium parvum
MPIQVPMYIIGGGISTILL

SEQ ID NO: 2318362 - protein, 19 aa, Cryptosporidium parvum
MPIWYYRKKKNMSLYAFGG

SEQ ID NO: 2318363 - protein, 20 aa, Cryptosporidium parvum
MPKILPFTMSNWNVIKLLAY

SEQ ID NO: 2318364 - protein, 20 aa, Cryptosporidium parvum
MPKLLGSYFIKANKMPIAIK

SEQ ID NO: 2318365 - protein, 23 aa, Cryptosporidium parvum
MPLLAHLKVYTRQSDLRHILIHM

SEQ ID NO: 2318366 - protein, 24 aa, Cryptosporidium parvum
MPLNSFIEIFGFYIESIESLKLFT

SEQ ID NO: 2318367 - protein, 25 aa, Cryptosporidium parvum
MPLSGVCKWFDSTKGFGFITPDDGS

SEQ ID NO: 2318368 - protein, 20 aa, Cryptosporidium parvum
MQDFLKKRSFPTEFMKLMVI

SEQ ID NO: 2318369 - protein, 19 aa, Cryptosporidium parvum
MQQDPAISSSIDCAMFSGF

SEQ ID NO: 2318370 - protein, 18 aa, Cryptosporidium parvum
MQQQFPSCQCGTNYFNTQ

SEQ ID NO: 2318371 - protein, 24 aa, Cryptosporidium parvum
MQTDTIHPAFIQLLKLKTNSESKD

SEQ ID NO: 2318372 - protein, 25 aa, Cryptosporidium parvum
MRAGISLLEYLLSQGFLDEDTIMEG

SEQ ID NO: 2318373 - protein, 19 aa, Cryptosporidium parvum
MRCLRHKKLKALIVAPDIE

SEQ ID NO: 2318374 - protein, 19 aa, Cryptosporidium parvum
MRDRFYQQMRLLVASIKIS

SEQ ID NO: 2318375 - protein, 31 aa, Cryptosporidium parvum
MRGKKIFGMCNPILDIVLKASPDRIKDLGLK

SEQ ID NO: 2318376 - protein, 23 aa, Cryptosporidium parvum
MRLKEWYGWHFPELGKIISDRDV

SEQ ID NO: 2318377 - protein, 26 aa, Cryptosporidium parvum
MRLRDPKCTGLLFRSGRLMITGARLE

SEQ ID NO: 2318378 - protein, 26 aa, Cryptosporidium parvum
MRNNYAWLHDLLTKNWEKLSKPRNSE

SEQ ID NO: 2318379 - protein, 23 aa, Cryptosporidium parvum
MRYPLLSMQGLFQPLAKIVESNT

SEQ ID NO: 2318380 - protein, 24 aa, Cryptosporidium parvum
MSCSNLNIYYPIQTTQRKSNEIDS

SEQ ID NO: 2318381 - protein, 27 aa, Cryptosporidium parvum
MSELQLQLVGIMDMFMATSPASFTVHG

SEQ ID NO: 2318382 - protein, 17 aa, Cryptosporidium parvum
MSFGPNSLSILPQGTVH

SEQ ID NO: 2318383 - protein, 26 aa, Cryptosporidium parvum
MSFRKKILALSIKKSYYRLKYTREFS

SEQ ID NO: 2318384 - protein, 20 aa, Cryptosporidium parvum
MSILLIKVKNRQVESFYYMF

SEQ ID NO: 2318385 - protein, 17 aa, Cryptosporidium parvum
MSLIKNYSRYNKNSKKS

SEQ ID NO: 2318386 - protein, 18 aa, Cryptosporidium parvum
MSLQNIQTPILFTNSNRA

SEQ ID NO: 2318387 - protein, 18 aa, Cryptosporidium parvum
MSLRLLLNTIITTAAKYQ

SEQ ID NO: 2318388 - protein, 25 aa, Cryptosporidium parvum
MSLRRLETLIFCIQVLALQKTQSIL

SEQ ID NO: 2318389 - protein, 21 aa, Cryptosporidium parvum
MSNEGYFLKSLYEKGINTIKK

SEQ ID NO: 2318390 - protein, 33 aa, Cryptosporidium parvum; identical to SEQ ID NO: 2194040

SEQ ID NO: 2318391 - protein, 18 aa, Cryptosporidium parvum
MSPLDFEDILMNCPKSWV

SEQ ID NO: 2318392 - protein, 39 aa, Cryptosporidium parvum
MSQLNNLHERIYPSPLNEIVKILNMHQLTLQSIESEAQR

SEQ ID NO: 2318393 - protein, 24 aa, Cryptosporidium parvum
MSQPNGIIQLPKGLKISMIKCESD

SEQ ID NO: 2318394 - protein, 19 aa, Cryptosporidium parvum
MSQYISTIGYKTSNIDLGV

SEQ ID NO: 2318395 - protein, 18 aa, Cryptosporidium parvum
MSRPFGVAMLIAGADSDG

SEQ ID NO: 2318396 - protein, 35 aa, Cryptosporidium parvum; identical to SEQ ID NO: 2194044

SEQ ID NO: 2318397 - protein, 28 aa, Cryptosporidium parvum
MSSDMWGFGCILMELYTGVLLFKTHEHM

SEQ ID NO: 2318398 - protein, 25 aa, Cryptosporidium parvum
MSSFPGSYSIWKKLCLKLLNLPYHP

SEQ ID NO: 2318399 - protein, 19 aa, Cryptosporidium parvum
MTAITALAHIHSCILYFVD

SEQ ID NO: 2318400 - protein, 22 aa, Cryptosporidium parvum
MTAPCIPILAAKKLTIEGLNWP

SEQ ID NO: 2318401 - protein, 18 aa, Cryptosporidium parvum
MTDGILLREFLSEPDLKN

SEQ ID NO: 2318402 - protein, 19 aa, Cryptosporidium parvum
MTGKFWDIVTRILKSLTGH

SEQ ID NO: 2318403 - protein, 28 aa, Cryptosporidium parvum
MTGTAMMLRLYRYYKQTKLLEKQVIQLS

SEQ ID NO: 2318404 - protein, 17 aa, Cryptosporidium parvum
MTIDGIFDSLLTRDVHA

SEQ ID NO: 2318405 - protein, 27 aa, Cryptosporidium parvum
MTKDNHLLGKFHLDGIPPAPRGVPQIE

SEQ ID NO: 2318406 - protein, 18 aa, Cryptosporidium parvum
MTLSYLYQEIAKYSFRFN

SEQ ID NO: 2318407 - protein, 27 aa, Cryptosporidium parvum
MTPREFYNPVIDLPTWRRMRTQAELRR

SEQ ID NO: 2318408 - protein, 17 aa, Cryptosporidium parvum
MTQKILERDPREEILKA

SEQ ID NO: 2318409 - protein, 26 aa, Cryptosporidium parvum
MTRMDRLLNFLSFVQDLFKNYCSPEI

SEQ ID NO: 2318410 - protein, 22 aa, Cryptosporidium parvum
MTSFYSFPVFDLNLVKNIKNEE

SEQ ID NO: 2318411 - protein, 29 aa, Cryptosporidium parvum
MTSKHVWGPINLFYPDVKSTFTYIPDLEV

SEQ ID NO: 2318412 - protein, 25 aa, Cryptosporidium parvum
MTSPHQKVFILLQANIFSIPVTVVD

SEQ ID NO: 2318413 - protein, 20 aa, Cryptosporidium parvum
MTVGKLLELISSKASVLDGN

SEQ ID NO: 2318414 - protein, 24 aa, Cryptosporidium parvum
MTVNQNFIISLNKALLLYNESGFK

SEQ ID NO: 2318415 - protein, 17 aa, Cryptosporidium parvum
MTVRRFLTATGHAISLF

SEQ ID NO: 2318416 - protein, 26 aa, Cryptosporidium parvum
MVAKEKLSFWMDLPCNMDRKKAKTGI

SEQ ID NO: 2318417 - protein, 20 aa, Cryptosporidium parvum
MVCYGPKSPIYYYCLSRMRL

SEQ ID NO: 2318418 - protein, 33 aa, Cryptosporidium parvum; identical to SEQ ID NO: 2194064

SEQ ID NO: 2318419 - protein, 17 aa, Cryptosporidium parvum
MVDKVVTPLLIAVGGKD

SEQ ID NO: 2318420 - protein, 28 aa, Cryptosporidium parvum
MVEMNHFPNLLYFLNKQAGKKVALSLIN

SEQ ID NO: 2318421 - protein, 19 aa, Cryptosporidium parvum
MVHFTPLQIFGQSGSCYSL

SEQ ID NO: 2318422 - protein, 19 aa, Cryptosporidium parvum
MVNSKLKPDIRYIEKRLYF

SEQ ID NO: 2318423 - protein, 22 aa, Cryptosporidium parvum
MVRRRLTLYRYNEFREFSIQVI

SEQ ID NO: 2318424 - protein, 40 aa, Cryptosporidium parvum; identical to SEQ ID NO: 2194071

SEQ ID NO: 2318425 - protein, 19 aa, Cryptosporidium parvum
MVSPFMFQQGINQSFNNGM

SEQ ID NO: 2318426 - protein, 25 aa, Cryptosporidium parvum
MVTSVFTPRKLFGIVITGLGFNMST

SEQ ID NO: 2318427 - protein, 24 aa, Cryptosporidium parvum
MYLKQRIMKISEFPDFSIANSRTN

SEQ ID NO: 2318428 - protein, 36 aa, Cryptosporidium parvum
MYTERLLSRSSLRRMLNRPSTLFRLPIIERREMNNN

SEQ ID NO: 2318429 - protein, 32 aa, Cryptosporidium parvum
NAAPSQIINRFFYIYKTWQWKNPVILCEIKEV

SEQ ID NO: 2318430 - protein, 19 aa, Cryptosporidium parvum
NAAVRLHLEFIGEIPMTAS

SEQ ID NO: 2318431 - protein, 33 aa, Cryptosporidium parvum
NACNNLAPHNLRILRWTIFKSNRLPIGKYVCAI

SEQ ID NO: 2318432 - protein, 25 aa, Cryptosporidium parvum
NACRGVIIAGLPFPSIADARVCLKK

SEQ ID NO: 2318433 - protein, 20 aa, Cryptosporidium parvum
NADGLYFDNHSHYHVPTNYS

SEQ ID NO: 2318434 - protein, 18 aa, Cryptosporidium parvum
NAEKFRFDLRVENLHIFL

SEQ ID NO: 2318435 - protein, 18 aa, Cryptosporidium parvum
NAFHLCREVLRLTKLVVD

SEQ ID NO: 2318436 - protein, 30 aa, Cryptosporidium parvum
NAIKNYGIPKFFISVLVELEAFLDEKFRDK

SEQ ID NO: 2318437 - protein, 24 aa, Cryptosporidium parvum
NAIKRTLKYPYIKKISTTKKYLTN

SEQ ID NO: 2318438 - protein, 24 aa, Cryptosporidium parvum
NAIRIFRYNGDLLKRVNFDTLYSA

SEQ ID NO: 2318439 - protein, 30 aa, Cryptosporidium parvum
NALILQREWVQLVFWVISWMGNDINKNILS

SEQ ID NO: 2318440 - protein, 23 aa, Cryptosporidium parvum
NALIRIMQLMFNLITTGDLSTWT

SEQ ID NO: 2318441 - protein, 17 aa, Cryptosporidium parvum
NALLERIYYISDSYYKS

SEQ ID NO: 2318442 - protein, 24 aa, Cryptosporidium parvum
NALNPLDASLLTLFSLIQAQRHDE

SEQ ID NO: 2318443 - protein, 23 aa, Cryptosporidium parvum
NANPLQVVVLTKSNLYITSAEIF

SEQ ID NO: 2318444 - protein, 24 aa, Cryptosporidium parvum
NANQNFLKLMLSPDLYYDQIELNN

SEQ ID NO: 2318445 - protein, 24 aa, Cryptosporidium parvum
NANRYQPPFLRTTSSSAFERGSNL

SEQ ID NO: 2318446 - protein, 25 aa, Cryptosporidium parvum
NARDGLINLYLITNGIKKSTSSGRC

SEQ ID NO: 2318447 - protein, 24 aa, Cryptosporidium parvum
NARVHNRLKYKKALKRLKGTQRSM

SEQ ID NO: 2318448 - protein, 20 aa, Cryptosporidium parvum
NASLSFLNLVKTGGVPGSTN

SEQ ID NO: 2318449 - protein, 43 aa, Cryptosporidium parvum; identical to SEQ ID NO: 2194109

SEQ ID NO: 2318450 - protein, 20 aa, Cryptosporidium parvum
NATLWSIVIKTAYRKRRSKR

SEQ ID NO: 2318451 - protein, 20 aa, Cryptosporidium parvum
NAYPWYQFGVCPINTAEIIE

SEQ ID NO: 2318452 - protein, 19 aa, Cryptosporidium parvum
NCCNNFTISWLNSCSNEES

SEQ ID NO: 2318453 - protein, 24 aa, Cryptosporidium parvum
NCDYMIFIKVYNFYLEHFKSNSKY

SEQ ID NO: 2318454 - protein, 24 aa, Cryptosporidium parvum
NCEAHYRIITPKLVSLRGEAAIIG

SEQ ID NO: 2318455 - protein, 24 aa, Cryptosporidium parvum
NCIDGKWDLVIKDLVIFGKSLGRV

SEQ ID NO: 2318456 - protein, 22 aa, Cryptosporidium parvum
NCINYLSFDLSLARGLDYYTGV

SEQ ID NO: 2318457 - protein, 20 aa, Cryptosporidium parvum
NCIQLFHPICAWLNGVQIEV

SEQ ID NO: 2318458 - protein, 26 aa, Cryptosporidium parvum
NCKGGWPIRILGLILQVYQIEERKRG

SEQ ID NO: 2318459 - protein, 39 aa, Cryptosporidium parvum; identical to SEQ ID NO: 2194122

SEQ ID NO: 2318460 - protein, 24 aa, Cryptosporidium parvum
NCMENELISVYWLKTTYKRRRYNY

SEQ ID NO: 2318461 - protein, 21 aa, Cryptosporidium parvum
NCMMDWHIKKSVFENIFPIQV

SEQ ID NO: 2318462 - protein, 35 aa, Cryptosporidium parvum
NCMNNEDNMVLYPGTKLLLNLQQGGLSKIQVQNSI

SEQ ID NO: 2318463 - protein, 17 aa, Cryptosporidium parvum
NCPDKQILWLKAAQNQS

SEQ ID NO: 2318464 - protein, 26 aa, Cryptosporidium parvum
NCPKFGIVHILAFGLAPWLAAEVPFL

SEQ ID NO: 2318465 - protein, 24 aa, Cryptosporidium parvum
NCRDSIAPNLPGAFLSVVMQNLSS

SEQ ID NO: 2318466 - protein, 32 aa, Cryptosporidium parvum
NCRTSSMLDVWNLLLKPLGLSLQVVNMGSDCT

SEQ ID NO: 2318467 - protein, 19 aa, Cryptosporidium parvum
NCSDYYKIITKPMDFSLIR

SEQ ID NO: 2318468 - protein, 22 aa, Cryptosporidium parvum
NCVKHEKFISDFKMLSKIANNL

SEQ ID NO: 2318469 - protein, 23 aa, Cryptosporidium parvum
NCWFSLGCVALRLERWEIAQQAF

SEQ ID NO: 2318470 - protein, 23 aa, Cryptosporidium parvum
NDACRIFESLFFSDNIAHPFFSE

SEQ ID NO: 2318471 - protein, 18 aa, Cryptosporidium parvum
NDAGRLLMSIIGAGQQNN

SEQ ID NO: 2318472 - protein, 25 aa, Cryptosporidium parvum
NDAQEIMLVFLQLLGSGLKGDDPLK

SEQ ID NO: 2318473 - protein, 26 aa, Cryptosporidium parvum
NDCNKMSLLFSWYTYVPNSELDTSAL

SEQ ID NO: 2318474 - protein, 24 aa, Cryptosporidium parvum
NDCSLCLRQIGISNNIPGVVLQCC

SEQ ID NO: 2318475 - protein, 24 aa, Cryptosporidium parvum
NDDDYYFMDLPTSNNNKLSMFKKS

SEQ ID NO: 2318476 - protein, 22 aa, Cryptosporidium parvum
NDDFILDMTGLKNKCELDKNID

SEQ ID NO: 2318477 - protein, 28 aa, Cryptosporidium parvum
NDDFKKSDILLLLRLKRKKLAMLESQLK

SEQ ID NO: 2318478 - protein, 23 aa, Cryptosporidium parvum
NDDMGYMRNLIPIGGSNSSPLHS

SEQ ID NO: 2318479 - protein, 21 aa, Cryptosporidium parvum
NDECMQMIKKYLLLDNNDKDE

SEQ ID NO: 2318480 - protein, 23 aa, Cryptosporidium parvum
NDEIPRSILYYETPQYCYSLLRC

SEQ ID NO: 2318481 - protein, 25 aa, Cryptosporidium parvum
NDEKDGFYTVYKKLFEDIIEEEMKY

SEQ ID NO: 2318482 - protein, 29 aa, Cryptosporidium parvum
NDELWFDSSLRIVILYFMIVSKKSNDEIS

SEQ ID NO: 2318483 - protein, 39 aa, Cryptosporidium parvum
NDESLRERIQILEKIRANLLRIISMKSEAYYRLLNKADN

SEQ ID NO: 2318484 - protein, 26 aa, Cryptosporidium parvum
NDFYLHYNFVCSLLNDLFGIQSRGGC

SEQ ID NO: 2318485 - protein, 18 aa, Cryptosporidium parvum
NDFYPVFKSHFFGKANLT

SEQ ID NO: 2318486 - protein, 23 aa, Cryptosporidium parvum
NDGIYDKVFGFNIPVRPDVKELL

SEQ ID NO: 2318487 - protein, 25 aa, Cryptosporidium parvum
NDGLLKEVFLLKERLLTCNKYIGLL

SEQ ID NO: 2318488 - protein, 19 aa, Cryptosporidium parvum
NDHLGFESGLLLYGEGALG

SEQ ID NO: 2318489 - protein, 25 aa, Cryptosporidium parvum
NDHRANMVNLLPLSSQYPSPVVVSF

SEQ ID NO: 2318490 - protein, 18 aa, Cryptosporidium parvum
NDIDFQEELKFKVQEREN

SEQ ID NO: 2318491 - protein, 25 aa, Cryptosporidium parvum
NDIEINLWFCIKYLEYYGSGRKHER

SEQ ID NO: 2318492 - protein, 20 aa, Cryptosporidium parvum
NDIFERSLFTSIGHGNEYLE

SEQ ID NO: 2318493 - protein, 21 aa, Cryptosporidium parvum
NDILIVLHILAPAGQLQLLND

SEQ ID NO: 2318494 - protein, 23 aa, Cryptosporidium parvum
NDIRFYIYQILKALDFCHSQGIM

SEQ ID NO: 2318495 - protein, 31 aa, Cryptosporidium parvum
NDKATWHDVWSPFLFFEKHKHFIQVKMLSNN

SEQ ID NO: 2318496 - protein, 18 aa, Cryptosporidium parvum
NDKFLNTPIMECSDFFQV

SEQ ID NO: 2318497 - protein, 32 aa, Cryptosporidium parvum
NDKHNGKIIIPFINNFLLFMNTSMDTGNEAIF

SEQ ID NO: 2318498 - protein, 29 aa, Cryptosporidium parvum
NDKKDGDGKFTWPDGRAYIGQWKNGKQHG

SEQ ID NO: 2318499 - protein, 24 aa, Cryptosporidium parvum
NDKMHTLLKFLIKSLVELKNDGKK

SEQ ID NO: 2318500 - protein, 32 aa, Cryptosporidium parvum
NDKNMLECTFKPEILWPIGKFINKNNKSWLKN

SEQ ID NO: 2318501 - protein, 40 aa, Cryptosporidium parvum
NDKNNILFKAKLLLRDERLFVSLLLEYMGYKDKIDYQLGL

SEQ ID NO: 2318502 - protein, 17 aa, Cryptosporidium parvum
NDKRYEGVLHSIDVDKS

SEQ ID NO: 2318503 - protein, 19 aa, Cryptosporidium parvum
NDLCKIYHIYQVNLVKRSQ

SEQ ID NO: 2318504 - protein, 21 aa, Cryptosporidium parvum
NDLCRFRTKPCRRSKQMGCDF

SEQ ID NO: 2318505 - protein, 33 aa, Cryptosporidium parvum
NDLDNMLFIVHILNRIFYIFNKSNHFSIQSFTE

SEQ ID NO: 2318506 - protein, 17 aa, Cryptosporidium parvum
NDLDTRLFVLLDKLLAI

SEQ ID NO: 2318507 - protein, 19 aa, Cryptosporidium parvum
NDLIPRWLHDWLSELLTCM

SEQ ID NO: 2318508 - protein, 27 aa, Cryptosporidium parvum
NDLRVHPDFRLLYQSSAPFQETNNLGE

SEQ ID NO: 2318509 - protein, 20 aa, Cryptosporidium parvum
NDLVKKLVTYISKNLNPKPE

SEQ ID NO: 2318510 - protein, 29 aa, Cryptosporidium parvum
NDNGGGEVLLLLRYFDISNPRINEFSLKY

SEQ ID NO: 2318511 - protein, 28 aa, Cryptosporidium parvum
NDPDRMSLFKRPLIQNPIILAPKTHHMI

SEQ ID NO: 2318512 - protein, 26 aa, Cryptosporidium parvum
NDPDSARFMILIRNAMEDLQHQVETE

SEQ ID NO: 2318513 - protein, 24 aa, Cryptosporidium parvum
NDPEGLHILVRYNEPRELEIVEAI

SEQ ID NO: 2318514 - protein, 35 aa, Cryptosporidium parvum; identical to SEQ ID NO: 2194163

SEQ ID NO: 2318515 - protein, 25 aa, Cryptosporidium parvum
NDQAQFLLLMLLYNQQLSFQENIIN

SEQ ID NO: 2318516 - protein, 20 aa, Cryptosporidium parvum
NDQIILPNRNINITLNSASV

SEQ ID NO: 2318517 - protein, 23 aa, Cryptosporidium parvum
NDQILLIQVTLWAIGEYSQHLFT

SEQ ID NO: 2318518 - protein, 25 aa, Cryptosporidium parvum
NDQLYNIIKIIKAVMFLGNITFIEN

SEQ ID NO: 2318519 - protein, 35 aa, Cryptosporidium parvum
NDSELRATFFDVLEIFLLTIYKFREKLSSSPDVFS

SEQ ID NO: 2318520 - protein, 17 aa, Cryptosporidium parvum
NDSFLFNPIPFVEDLRN

SEQ ID NO: 2318521 - protein, 26 aa, Cryptosporidium parvum
NDSIFYFIVPIINLLSRDPSLITDFS

SEQ ID NO: 2318522 - protein, 27 aa, Cryptosporidium parvum
NDSIRRLILLRNPWGKISWKGKFSKYD

SEQ ID NO: 2318523 - protein, 23 aa, Cryptosporidium parvum
NDSKLWYSFFPKKTDQFNHIKMN

SEQ ID NO: 2318524 - protein, 25 aa, Cryptosporidium parvum
NDSLQKLLHFQDILGKGSKLESNYN

SEQ ID NO: 2318525 - protein, 23 aa, Cryptosporidium parvum
NDSVVIGIFFSTLGRQGSFAIVE

SEQ ID NO: 2318526 - protein, 34 aa, Cryptosporidium parvum
NDTFLSVIMWVRRLYYLYTPTLFMNSIYLYDPDS

SEQ ID NO: 2318527 - protein, 22 aa, Cryptosporidium parvum
NDTLSFIPDERLNHLIMPMNKS

SEQ ID NO: 2318528 - protein, 23 aa, Cryptosporidium parvum
NDTLSRLEKNKFVFGRKGDCSIR

SEQ ID NO: 2318529 - protein, 25 aa, Cryptosporidium parvum
NDTYKYIDIYLYKNADITNLTNFDN

SEQ ID NO: 2318530 - protein, 20 aa, Cryptosporidium parvum
NDVKILITILKSYSSRVIAC

SEQ ID NO: 2318531 - protein, 17 aa, Cryptosporidium parvum
NDVLTFLDILKKATEEK

SEQ ID NO: 2318532 - protein, 24 aa, Cryptosporidium parvum
NDVRAVLGDGPWISKMSIYEEGWD

SEQ ID NO: 2318533 - protein, 19 aa, Cryptosporidium parvum
NDWKFLFSNTLGLNVVLIT

SEQ ID NO: 2318534 - protein, 24 aa, Cryptosporidium parvum
NDYLPIKFKALINSGKLVFLFQFN

SEQ ID NO: 2318535 - protein, 20 aa, Cryptosporidium parvum
NEARWLFSQIFNAVINLHNK

SEQ ID NO: 2318536 - protein, 31 aa, Cryptosporidium parvum
NEDGKINRSKIVPYITREMSIAQLQDKKYHS

SEQ ID NO: 2318537 - protein, 26 aa, Cryptosporidium parvum
NEDPNHIFWLRIGTCIDIMTPITSVK

SEQ ID NO: 2318538 - protein, 33 aa, Cryptosporidium parvum
NEDSAFNGFIPLKPIGWRKRSFSKENSTILLES

SEQ ID NO: 2318539 - protein, 23 aa, Cryptosporidium parvum
NEEDPIVFIPKKVNIADFDTECS

SEQ ID NO: 2318540 - protein, 26 aa, Cryptosporidium parvum
NEEDSFEWQLKYKNKMKGNMIFMASL

SEQ ID NO: 2318541 - protein, 20 aa, Cryptosporidium parvum
NEEFNLLSIFKDDNANIKNN

SEQ ID NO: 2318542 - protein, 25 aa, Cryptosporidium parvum
NEEITKVLLPYYIDVNFDGISQFES

SEQ ID NO: 2318543 - protein, 23 aa, Cryptosporidium parvum
NEELLDLYGFYKQATVGDAPEKS

SEQ ID NO: 2318544 - protein, 21 aa, Cryptosporidium parvum
NEELSFIEIFRSSWPEGLIQL

SEQ ID NO: 2318545 - protein, 17 aa, Cryptosporidium parvum
NEETSPFAIRYRAFRDL

SEQ ID NO: 2318546 - protein, 24 aa, Cryptosporidium parvum
NEFEKVFKIIKLMKIKKFLNKSEC

SEQ ID NO: 2318547 - protein, 27 aa, Cryptosporidium parvum
NEFKSFASSFGFISFLADLRNENERIF

SEQ ID NO: 2318548 - protein, 17 aa, Cryptosporidium parvum
NEFLLGKKLVPRNWGIL

SEQ ID NO: 2318549 - protein, 24 aa, Cryptosporidium parvum
NEGFLIPDLPGTSRTRNFRSSHRN

SEQ ID NO: 2318550 - protein, 25 aa, Cryptosporidium parvum
NEHFKEVFPISFRSNIPLICESFVD

SEQ ID NO: 2318551 - protein, 27 aa, Cryptosporidium parvum
NEHIQYFMYQILRGLSYLHKVNIIHRD

SEQ ID NO: 2318552 - protein, 17 aa, Cryptosporidium parvum
NEHIRHYLNLDFNWENE

SEQ ID NO: 2318553 - protein, 24 aa, Cryptosporidium parvum
NEICDGNYLLSEYILLCICSRQKL

SEQ ID NO: 2318554 - protein, 33 aa, Cryptosporidium parvum
NEIKYIQYLLNKMGIYLIHFFQSLNDISNDKVS

SEQ ID NO: 2318555 - protein, 28 aa, Cryptosporidium parvum
NEILSYYSPKYSILAIISRGRCFAFYSQ

SEQ ID NO: 2318556 - protein, 25 aa, Cryptosporidium parvum
NEKCQHFYFLIKKNVPLIESVNIKN

SEQ ID NO: 2318557 - protein, 17 aa, Cryptosporidium parvum
NEKLFNVNYLNNAYNCT

SEQ ID NO: 2318558 - protein, 21 aa, Cryptosporidium parvum
NEKLLVIKIEPFFGPTQILNW

SEQ ID NO: 2318559 - protein, 32 aa, Cryptosporidium parvum
NEKLMLKFPRIIHTKIFPNFLSKILKIEDYQS

SEQ ID NO: 2318560 - protein, 28 aa, Cryptosporidium parvum
NEKRDTLQIPICKFSLIKKIIVALDNSQ

SEQ ID NO: 2318561 - protein, 24 aa, Cryptosporidium parvum
NEKRYFFNIEYLTISYGLATDNYS

SEQ ID NO: 2318562 - protein, 25 aa, Cryptosporidium parvum
NEKTLFPLLYVLGTGSAIPSPYRNV

SEQ ID NO: 2318563 - protein, 36 aa, Cryptosporidium parvum
NELDDVLCLYKCKLLINGIWRNIFVDSLIPIDSGNN

SEQ ID NO: 2318564 - protein, 25 aa, Cryptosporidium parvum
NELHNWFIIHRDLAPANIFINSKGI

SEQ ID NO: 2318565 - protein, 20 aa, Cryptosporidium parvum
NELIKCADIDGFLVGGASLK

SEQ ID NO: 2318566 - protein, 21 aa, Cryptosporidium parvum
NELLHQYYSYIQDLQHRFEEM

SEQ ID NO: 2318567 - protein, 46 aa, Cryptosporidium parvum; identical to SEQ ID NO: 2194207

SEQ ID NO: 2318568 - protein, 18 aa, Cryptosporidium parvum
NELSDWQFISYHPSWRDD

SEQ ID NO: 2318569 - protein, 23 aa, Cryptosporidium parvum
NELVWWRMTRKQRYLPGRTVTLE

SEQ ID NO: 2318570 - protein, 21 aa, Cryptosporidium parvum
NELYLNHKYMLIGHENTFVGR

SEQ ID NO: 2318571 - protein, 37 aa, Cryptosporidium parvum
NEMVSRRDFLIKKILPWEIELEVVPWSLLFGDSLSNK

SEQ ID NO: 2318572 - protein, 19 aa, Cryptosporidium parvum
NENFSGYHNLGNSQYFYLD

SEQ ID NO: 2318573 - protein, 26 aa, Cryptosporidium parvum
NENHKAYLLFYYRSDFNKYDLLKDSG

SEQ ID NO: 2318574 - protein, 17 aa, Cryptosporidium parvum
NENIKQWRLASTSLILW

SEQ ID NO: 2318575 - protein, 26 aa, Cryptosporidium parvum
NENKLWLLPIDTIYESVRIVEFLGGT

SEQ ID NO: 2318576 - protein, 19 aa, Cryptosporidium parvum
NENLWDMPCSEMTSMTLGD

SEQ ID NO: 2318577 - protein, 25 aa, Cryptosporidium parvum
NENMIFLRMGLKLLGKWEMSDPYTR

SEQ ID NO: 2318578 - protein, 26 aa, Cryptosporidium parvum
NENMNRIQRMCLPVNISMILKSLESS

SEQ ID NO: 2318579 - protein, 21 aa, Cryptosporidium parvum
NENPYSIIALKYCVENGILMG

SEQ ID NO: 2318580 - protein, 30 aa, Cryptosporidium parvum
NENQNILKEYLFSLLNLPENLQKENPFFAH

SEQ ID NO: 2318581 - protein, 24 aa, Cryptosporidium parvum
NENYKLINNLKLNKLSRSKNYYST

SEQ ID NO: 2318582 - protein, 25 aa, Cryptosporidium parvum
NEQDLLYFNMITGELSFNILPSGGG

SEQ ID NO: 2318583 - protein, 26 aa, Cryptosporidium parvum
NEQESSFWGWFGYSTTPENPKAKIKT

SEQ ID NO: 2318584 - protein, 17 aa, Cryptosporidium parvum
NEQPPPPPPTPAPVEES

SEQ ID NO: 2318585 - protein, 25 aa, Cryptosporidium parvum
NEQQTKCYNPFWTLGINPKKFKIEQ

SEQ ID NO: 2318586 - protein, 35 aa, Cryptosporidium parvum; identical to SEQ ID NO: 2194219

SEQ ID NO: 2318587 - protein, 24 aa, Cryptosporidium parvum
NERLIVKATLIIAPGSIVDQWYDE

SEQ ID NO: 2318588 - protein, 28 aa, Cryptosporidium parvum
NESFGKMYIIVIYLEKFLAPKISVITRY

SEQ ID NO: 2318589 - protein, 21 aa, Cryptosporidium parvum
NESIGWWIISVNEYGYLRETT

SEQ ID NO: 2318590 - protein, 22 aa, Cryptosporidium parvum
NESKILPCFGIIDLPGTGQIQD

SEQ ID NO: 2318591 - protein, 24 aa, Cryptosporidium parvum
NESKKPLDWLASKVLIQLHSLSIL

SEQ ID NO: 2318592 - protein, 23 aa, Cryptosporidium parvum
NESKSIGLTSLLQKNIKLNDSSS

SEQ ID NO: 2318593 - protein, 22 aa, Cryptosporidium parvum
NETIPLYNNEYYLIGKDARVVN

SEQ ID NO: 2318594 - protein, 17 aa, Cryptosporidium parvum
NETTISTTLPFFNNITL

SEQ ID NO: 2318595 - protein, 30 aa, Cryptosporidium parvum
NETVEKLLSLEQWGTLIQTMNQMNPELQNS

SEQ ID NO: 2318596 - protein, 27 aa, Cryptosporidium parvum
NEVCSFNLLQPLSLNISYSGSNDKSQG

SEQ ID NO: 2318597 - protein, 33 aa, Cryptosporidium parvum
NEVFKPMVYETIVFPPGYFEYKKQLEELRKKYL

SEQ ID NO: 2318598 - protein, 23 aa, Cryptosporidium parvum
NEVKNIMPYLIDNTINRLELKLR

SEQ ID NO: 2318599 - protein, 17 aa, Cryptosporidium parvum
NEWIFMEEKYIQNPLVY

SEQ ID NO: 2318600 - protein, 28 aa, Cryptosporidium parvum
NEYGNIYGIIFLFKFTEKFKGNHFSQPI

SEQ ID NO: 2318601 - protein, 17 aa, Cryptosporidium parvum
NEYIKLIEKKNPQWEET

SEQ ID NO: 2318602 - protein, 30 aa, Cryptosporidium parvum
NEYTLLPLPHILSFFNRYLSFISISNHLML

SEQ ID NO: 2318603 - protein, 31 aa, Cryptosporidium parvum
NEYTRPLKVTILTKLFLLISRVYSSICIDQF

SEQ ID NO: 2318604 - protein, 30 aa, Cryptosporidium parvum
NFCNQLTIHPNIDVLPWIGSVGVGGVVTWN

SEQ ID NO: 2318605 - protein, 18 aa, Cryptosporidium parvum
NFDALFQPQKHPARDSHD

SEQ ID NO: 2318606 - protein, 35 aa, Cryptosporidium parvum
NFDDLPFVIPSKRIIIEWPLHLLKNLKALDFENND

SEQ ID NO: 2318607 - protein, 20 aa, Cryptosporidium parvum
NFDIPVFLPSSEPSPIEFSD

SEQ ID NO: 2318608 - protein, 23 aa, Cryptosporidium parvum
NFDLQKLKRLPLFLTEEGRYIEP

SEQ ID NO: 2318609 - protein, 19 aa, Cryptosporidium parvum
NFDMIFVTKDYSKPVKRVD

SEQ ID NO: 2318610 - protein, 25 aa, Cryptosporidium parvum
NFEDIKNLKLQLPTNYFGIDNKDQV

SEQ ID NO: 2318611 - protein, 27 aa, Cryptosporidium parvum
NFEICKDILKLFVKYISEEKKDFEGVE

SEQ ID NO: 2318612 - protein, 26 aa, Cryptosporidium parvum
NFERLKYFEQTFGLVGGIMELIIKNL

SEQ ID NO: 2318613 - protein, 23 aa, Cryptosporidium parvum
NFETSVMFAPPLAMPEIKVKSPK

SEQ ID NO: 2318614 - protein, 24 aa, Cryptosporidium parvum
NFEVMRWRYYFVKMAINIDKFFPE

SEQ ID NO: 2318615 - protein, 27 aa, Cryptosporidium parvum
NFFQEVPYISWPIKTSFAKLENLIFCE

SEQ ID NO: 2318616 - protein, 19 aa, Cryptosporidium parvum
NFFSAILSKIKNGVKLTSD

SEQ ID NO: 2318617 - protein, 38 aa, Cryptosporidium parvum
NFGDLTRKCYISKSVLLYYFFEKWMNEKFVGEYKYLRI

SEQ ID NO: 2318618 - protein, 28 aa, Cryptosporidium parvum
NFHIPNNWMTYFAKLSLRWNNFGNDQTT

SEQ ID NO: 2318619 - protein, 29 aa, Cryptosporidium parvum
NFHSKDPIATYIYTLYRDLYNKSEINSRR

SEQ ID NO: 2318620 - protein, 25 aa, Cryptosporidium parvum
NFIDIDLLWLDIHLLSILKGDSYNF

SEQ ID NO: 2318621 - protein, 19 aa, Cryptosporidium parvum
NFIIIELPRHFTSNSLFFK

SEQ ID NO: 2318622 - protein, 33 aa, Cryptosporidium parvum
NFILRNMDQFIFFGLPFFFPPVLGIKPNENITN

SEQ ID NO: 2318623 - protein, 21 aa, Cryptosporidium parvum
NFITEIDPLLSLTKLKSLNIS

SEQ ID NO: 2318624 - protein, 24 aa, Cryptosporidium parvum
NFKESFSFLPSFFVDEIFGGQLLG

SEQ ID NO: 2318625 - protein, 19 aa, Cryptosporidium parvum
NFKIYWTPCSQPSNIDHYD

SEQ ID NO: 2318626 - protein, 29 aa, Cryptosporidium parvum
NFKKLDLNGIYYSLAKMIILPTRESIIFP

SEQ ID NO: 2318627 - protein, 20 aa, Cryptosporidium parvum
NFKNDLFLIISDKDKKQMIN

SEQ ID NO: 2318628 - protein, 22 aa, Cryptosporidium parvum
NFKPILVLGTTNIPWEIDSGIR

SEQ ID NO: 2318629 - protein, 28 aa, Cryptosporidium parvum
NFKPRSMKMIFTRWLSFEKEFGSLQSQK

SEQ ID NO: 2318630 - protein, 25 aa, Cryptosporidium parvum
NFKQNYLNIYQWLNKYPSKFDITNS

SEQ ID NO: 2318631 - protein, 20 aa, Cryptosporidium parvum
NFLFYWCSLFKLLAVCPKCS

SEQ ID NO: 2318632 - protein, 23 aa, Cryptosporidium parvum
NFMNNFILLWDNLCSEISIVSSN

SEQ ID NO: 2318633 - protein, 17 aa, Cryptosporidium parvum
NFNHPDTFIGYILLSIQ

SEQ ID NO: 2318634 - protein, 18 aa, Cryptosporidium parvum
NFNIIPLEKMNYQEILNN

SEQ ID NO: 2318635 - protein, 20 aa, Cryptosporidium parvum
NFNNFFEIIPTNPKLDEKLH

SEQ ID NO: 2318636 - protein, 34 aa, Cryptosporidium parvum
NFNSESAFFLNNKYKFIYLYVVYDHFKDENIKMK

SEQ ID NO: 2318637 - protein, 26 aa, Cryptosporidium parvum
NFQADIKTLPPKLRKLRDYRLNDIDI

SEQ ID NO: 2318638 - protein, 17 aa, Cryptosporidium parvum
NFRIKLLNLNFVDVLRP

SEQ ID NO: 2318639 - protein, 23 aa, Cryptosporidium parvum
NFRLNIEDAPPVDYIARFTAQQQ

SEQ ID NO: 2318640 - protein, 26 aa, Cryptosporidium parvum
NFSGDFLLNLLIKFGILRSDASDLHS

SEQ ID NO: 2318641 - protein, 35 aa, Cryptosporidium parvum; identical to SEQ ID NO: 2194273

SEQ ID NO: 2318642 - protein, 17 aa, Cryptosporidium parvum
NFSNNIYDLVFVYSGPV

SEQ ID NO: 2318643 - protein, 35 aa, Cryptosporidium parvum; identical to SEQ ID NO: 2194275

SEQ ID NO: 2318644 - protein, 26 aa, Cryptosporidium parvum
NFSVTLPDLHLFPRSFLKCISSELIN

SEQ ID NO: 2318645 - protein, 42 aa, Cryptosporidium parvum
NFTITLLNVHRIIVTALILATKFFDDIYYSNAFYAKISGVGT

SEQ ID NO: 2318646 - protein, 20 aa, Cryptosporidium parvum
NFVYLFQKNQPSKYTWIAEI

SEQ ID NO: 2318647 - protein, 22 aa, Cryptosporidium parvum
NFYQFYILKRLIERVFKQWRIK

SEQ ID NO: 2318648 - protein, 20 aa, Cryptosporidium parvum
NGAKYIIPMLDLNFTEKRNS

SEQ ID NO: 2318649 - protein, 28 aa, Cryptosporidium parvum
NGAVLELIIYLLKVCKHPLLLLKPEFQS

SEQ ID NO: 2318650 - protein, 34 aa, Cryptosporidium parvum; identical to SEQ ID NO: 2194284

SEQ ID NO: 2318651 - protein, 25 aa, Cryptosporidium parvum
NGDNSHNFFLTYMALELNEISDDYN

SEQ ID NO: 2318652 - protein, 22 aa, Cryptosporidium parvum
NGDYLSFDFKSNNRICKSYFQL

SEQ ID NO: 2318653 - protein, 25 aa, Cryptosporidium parvum
NGEEYLGEYLLPSLSSLLLSKINTT

SEQ ID NO: 2318654 - protein, 27 aa, Cryptosporidium parvum
NGEFEYMNILKLFGAINRLERDSNIIF

SEQ ID NO: 2318655 - protein, 25 aa, Cryptosporidium parvum
NGEPTCPLCRVPCSVFTLCDLVNIT

SEQ ID NO: 2318656 - protein, 18 aa, Cryptosporidium parvum
NGEPWFYKLVDSVSNIMG

SEQ ID NO: 2318657 - protein, 25 aa, Cryptosporidium parvum
NGEVNLWNLDFIDSIDPILTLHSDL

SEQ ID NO: 2318658 - protein, 28 aa, Cryptosporidium parvum
NGFDDFQIIDLTFLFQNISFCDISKYHA

SEQ ID NO: 2318659 - protein, 26 aa, Cryptosporidium parvum
NGFDLKYNGFYILYAKSNKPDSQWKQ

SEQ ID NO: 2318660 - protein, 34 aa, Cryptosporidium parvum; identical to SEQ ID NO: 2194293

SEQ ID NO: 2318661 - protein, 18 aa, Cryptosporidium parvum
NGFNSLFVILNRLREYTA

SEQ ID NO: 2318662 - protein, 17 aa, Cryptosporidium parvum
NGFTGPLRPYPISIKRK

SEQ ID NO: 2318663 - protein, 22 aa, Cryptosporidium parvum
NGFTPFELLNSTWNDFLKLRNE

SEQ ID NO: 2318664 - protein, 29 aa, Cryptosporidium parvum
NGGGSQRSFIVGELKPRINQALKAELDTE

SEQ ID NO: 2318665 - protein, 21 aa, Cryptosporidium parvum
NGGNPVILPSPLTTASTAPTA

SEQ ID NO: 2318666 - protein, 25 aa, Cryptosporidium parvum
NGGRQFLRNFTPPGTPSYSIQKVPG

SEQ ID NO: 2318667 - protein, 19 aa, Cryptosporidium parvum
NGHINHRFSNRPRFVSMQD

SEQ ID NO: 2318668 - protein, 28 aa, Cryptosporidium parvum
NGHLEYIRPQLFFLTKKNWIISIGICAR

SEQ ID NO: 2318669 - protein, 32 aa, Cryptosporidium parvum
NGHLIKRLFKIPFWPDGFRFIKNRKYFIKDGI

SEQ ID NO: 2318670 - protein, 24 aa, Cryptosporidium parvum
NGIAHFLEHLIFKGTYNRSRKEIE

SEQ ID NO: 2318671 - protein, 29 aa, Cryptosporidium parvum
NGIENFLDVIFGFLLRKTDFFTAMNQGEE

SEQ ID NO: 2318672 - protein, 25 aa, Cryptosporidium parvum
NGIHPIKLILVGGIVFERQLSEIEI

SEQ ID NO: 2318673 - protein, 22 aa, Cryptosporidium parvum
NGIILDVHFPLAVYKKLLGYKV

SEQ ID NO: 2318674 - protein, 19 aa, Cryptosporidium parvum
NGKKLHWNPTVHGLSFVVN

SEQ ID NO: 2318675 - protein, 38 aa, Cryptosporidium parvum
NGKLPPMDSLTEFFSRWLIWSLIWGFSSSMNLSDRISY

SEQ ID NO: 2318676 - protein, 39 aa, Cryptosporidium parvum
NGKRKFRFSSLCPKLLNCLFPWIRSEQYFEDHDQPIFYI

SEQ ID NO: 2318677 - protein, 25 aa, Cryptosporidium parvum
NGLAHFLEHMLFLGSARHPNPSDFD

SEQ ID NO: 2318678 - protein, 18 aa, Cryptosporidium parvum
NGLELFDIQLSEAAKKFA

SEQ ID NO: 2318679 - protein, 34 aa, Cryptosporidium parvum
NGLIGSNKLQFGLTSLAKSLLGYTYLGRNSLLDN

SEQ ID NO: 2318680 - protein, 19 aa, Cryptosporidium parvum
NGLIVPLVNLLNTAEFDVK

SEQ ID NO: 2318681 - protein, 24 aa, Cryptosporidium parvum
NGLNVKMILLSLKYWCGIDNKDKE

SEQ ID NO: 2318682 - protein, 24 aa, Cryptosporidium parvum
NGLPSLKQLIVFKSLSDFSEGKAL

SEQ ID NO: 2318683 - protein, 26 aa, Cryptosporidium parvum
NGLSRPFINPYTPKDFKLVDFIWECT

SEQ ID NO: 2318684 - protein, 19 aa, Cryptosporidium parvum
NGLTPSSIAALWAKAMSKT

SEQ ID NO: 2318685 - protein, 22 aa, Cryptosporidium parvum
NGMQIIKLSLILSELDINMDQF

SEQ ID NO: 2318686 - protein, 29 aa, Cryptosporidium parvum
NGMTMEEPILLFLTYQFAETLLAFNEMKI

SEQ ID NO: 2318687 - protein, 22 aa, Cryptosporidium parvum
NGMYRQKLHPCEICAAFLSETD

SEQ ID NO: 2318688 - protein, 28 aa, Cryptosporidium parvum
NGNHELLGIYYLYTKKMVTHKPYLVDYT

SEQ ID NO: 2318689 - protein, 22 aa, Cryptosporidium parvum
NGNLFHVIIRDLEILDTNIQKE

SEQ ID NO: 2318690 - protein, 22 aa, Cryptosporidium parvum
NGNLIYPLHRNLVMSDWLLCEL

SEQ ID NO: 2318691 - protein, 20 aa, Cryptosporidium parvum
NGNLLLIPKGRDNEIYVYDT

SEQ ID NO: 2318692 - protein, 29 aa, Cryptosporidium parvum
NGNPQYINKLILFIDSFTQELKRIAGICS

SEQ ID NO: 2318693 - protein, 24 aa, Cryptosporidium parvum
NGNTSFMFFSSLSNIVNPGIEISV

SEQ ID NO: 2318694 - protein, 17 aa, Cryptosporidium parvum
NGNYYVGGFKNGLTDGP

SEQ ID NO: 2318695 - protein, 32 aa, Cryptosporidium parvum; identical to SEQ ID NO: 2194324

SEQ ID NO: 2318696 - protein, 17 aa, Cryptosporidium parvum
NGPIYISSATFNCNIHP

SEQ ID NO: 2318697 - protein, 25 aa, Cryptosporidium parvum
NGQTPKLIFLMFTPENAKVKDRMVF

SEQ ID NO: 2318698 - protein, 17 aa, Cryptosporidium parvum
NGQYLTSLPIISFLIKP

SEQ ID NO: 2318699 - protein, 23 aa, Cryptosporidium parvum
NGSGFFQIIPATSNLPELSIPVT

SEQ ID NO: 2318700 - protein, 22 aa, Cryptosporidium parvum
NGSQFFITTASCPWLDGVHTIF

SEQ ID NO: 2318701 - protein, 17 aa, Cryptosporidium parvum
NGTFLNGKRLNKSVPTQ

SEQ ID NO: 2318702 - protein, 23 aa, Cryptosporidium parvum
NGTLLHHTLFDYSKTLKMFEQVT

SEQ ID NO: 2318703 - protein, 25 aa, Cryptosporidium parvum
NGTSQGKFALSPLNGTEVAPLFSKF

SEQ ID NO: 2318704 - protein, 24 aa, Cryptosporidium parvum
NGTYRKILVVPDYINYVGLNISEK

SEQ ID NO: 2318705 - protein, 30 aa, Cryptosporidium parvum
NGVCVFFTSHLFLDVFFKFLVSDKSSKDFY

SEQ ID NO: 2318706 - protein, 27 aa, Cryptosporidium parvum
NGYPNHVLCCRIFILVIQKVSERERKK

SEQ ID NO: 2318707 - protein, 30 aa, Cryptosporidium parvum
NGYQILSLRKVGINLPPYVPFSLGSVVIPE

SEQ ID NO: 2318708 - protein, 26 aa, Cryptosporidium parvum
NGYRYVPIKMLDIAGLIPGAHLGNGL

SEQ ID NO: 2318709 - protein, 19 aa, Cryptosporidium parvum
NGYSFYYMKYNKLPDELDV

SEQ ID NO: 2318710 - protein, 27 aa, Cryptosporidium parvum
NHECANMPWFVLFKSNPQLLEAKYDFN

SEQ ID NO: 2318711 - protein, 25 aa, Cryptosporidium parvum
NHEEQIIFVFFKPTVTSCSQASLIG

SEQ ID NO: 2318712 - protein, 17 aa, Cryptosporidium parvum
NHEIVYYSFQTIHKYLS

SEQ ID NO: 2318713 - protein, 18 aa, Cryptosporidium parvum
NHELFNIYLLNKLENVKN

SEQ ID NO: 2318714 - protein, 20 aa, Cryptosporidium parvum
NHFCGYINSAINCLLSIDQF

SEQ ID NO: 2318715 - protein, 24 aa, Cryptosporidium parvum
NHFKDYSLVLWKKLIKKCKNDNKL

SEQ ID NO: 2318716 - protein, 30 aa, Cryptosporidium parvum; identical to SEQ ID NO: 2194342

SEQ ID NO: 2318717 - protein, 19 aa, Cryptosporidium parvum
NHGYSPYRKIQESELINMI

SEQ ID NO: 2318718 - protein, 17 aa, Cryptosporidium parvum
NHKERLGHLSCRVCGVE

SEQ ID NO: 2318719 - protein, 43 aa, Cryptosporidium parvum; identical to SEQ ID NO: 2194345

SEQ ID NO: 2318720 - protein, 20 aa, Cryptosporidium parvum
NHLILLFENYLSNGSCELLN

SEQ ID NO: 2318721 - protein, 18 aa, Cryptosporidium parvum
NHLKNQIPILLASVGIST

SEQ ID NO: 2318722 - protein, 17 aa, Cryptosporidium parvum
NHMIGSEVPALLAIACE

SEQ ID NO: 2318723 - protein, 18 aa, Cryptosporidium parvum
NHPNDIYILVKRSIDDPA

SEQ ID NO: 2318724 - protein, 18 aa, Cryptosporidium parvum
NHPNYIIGYFKLEKMEKN

SEQ ID NO: 2318725 - protein, 23 aa, Cryptosporidium parvum
NHQSQYMYNILQNLMGSNKSVPT

SEQ ID NO: 2318726 - protein, 27 aa, Cryptosporidium parvum
NHSEDLLWEDYYILYRLMVCINCVKES

SEQ ID NO: 2318727 - protein, 27 aa, Cryptosporidium parvum
NHSFLSLYLLFLIYNKIHVSNQLILTD

SEQ ID NO: 2318728 - protein, 29 aa, Cryptosporidium parvum
NHSLPNFIAKIILPLFASKNEKDFLKTSL

SEQ ID NO: 2318729 - protein, 21 aa, Cryptosporidium parvum
NHTKRLLFEFIRVVSCQIIDF

SEQ ID NO: 2318730 - protein, 28 aa, Cryptosporidium parvum
NHVSNVFRCYLLELYSLKLEKYLDKNAT

SEQ ID NO: 2318731 - protein, 25 aa, Cryptosporidium parvum
NIAAILFCEGVVLDALDWSIEFPKP

SEQ ID NO: 2318732 - protein, 26 aa, Cryptosporidium parvum
NIAKLLFIHMLGYPSQFGQVECLKLI

SEQ ID NO: 2318733 - protein, 19 aa, Cryptosporidium parvum
NIAQGRLNYLLSDNGEPTC

SEQ ID NO: 2318734 - protein, 20 aa, Cryptosporidium parvum
NIARNLLYSLGSEKFIRVHN

SEQ ID NO: 2318735 - protein, 37 aa, Cryptosporidium parvum; identical to SEQ ID NO: 2194357

SEQ ID NO: 2318736 - protein, 29 aa, Cryptosporidium parvum
NIDDETLDTIPWFCSYNKLQVLSNSEYEV

SEQ ID NO: 2318737 - protein, 24 aa, Cryptosporidium parvum
NIDEYWTEFWNLIALDLGNRCERT

SEQ ID NO: 2318738 - protein, 25 aa, Cryptosporidium parvum
NIDIYNYRFIPTINKDYYSHSFAAV

SEQ ID NO: 2318739 - protein, 30 aa, Cryptosporidium parvum; identical to SEQ ID NO: 2194362

SEQ ID NO: 2318740 - protein, 37 aa, Cryptosporidium parvum
NIDNDIRWQWYSMGYRDYLYTYLGIKEKLSIDARSFI

SEQ ID NO: 2318741 - protein, 26 aa, Cryptosporidium parvum
NIEENINLLILYDFLLILNDKNETMN

SEQ ID NO: 2318742 - protein, 35 aa, Cryptosporidium parvum
NIEEPLLQQIIGPKFYLFENIFPNSILSIPFIQNS

SEQ ID NO: 2318743 - protein, 25 aa, Cryptosporidium parvum
NIEIFTIICILSLQKLADKNYQQYL

SEQ ID NO: 2318744 - protein, 17 aa, Cryptosporidium parvum
NIEIIKPIPSLLENETT

SEQ ID NO: 2318745 - protein, 23 aa, Cryptosporidium parvum
NIEKKPYFPIFLLTGFVGFDGKF

SEQ ID NO: 2318746 - protein, 23 aa, Cryptosporidium parvum
NIEKPHVLILLGPFIDVRNESIK

SEQ ID NO: 2318747 - protein, 27 aa, Cryptosporidium parvum
NIENKLCQRFPWLEVLIRSMDMSILNP

SEQ ID NO: 2318748 - protein, 22 aa, Cryptosporidium parvum
NIERRDLKLGTLLFGVIDHVSE

SEQ ID NO: 2318749 - protein, 23 aa, Cryptosporidium parvum
NIERSWEVILFSKIIGMIKTLFL

SEQ ID NO: 2318750 - protein, 17 aa, Cryptosporidium parvum
NIFAYFCENPFAAASIG

SEQ ID NO: 2318751 - protein, 27 aa, Cryptosporidium parvum
NIFGSDIWISLLIDALTLKNFLVKNIP

SEQ ID NO: 2318752 - protein, 25 aa, Cryptosporidium parvum
NIFIKSHILSLYLYYNQEYDTQKSI

SEQ ID NO: 2318753 - protein, 20 aa, Cryptosporidium parvum
NIFKRAFVSILKKHDKFHNG

SEQ ID NO: 2318754 - protein, 31 aa, Cryptosporidium parvum
NIFLKKAIIDWKEKVIFPLKNSIINKFEEMI

SEQ ID NO: 2318755 - protein, 19 aa, Cryptosporidium parvum
NIFLNNQIYIILDTKSSGS

SEQ ID NO: 2318756 - protein, 20 aa, Cryptosporidium parvum
NIFQQTAISDLKYFSDLILE

SEQ ID NO: 2318757 - protein, 17 aa, Cryptosporidium parvum
NIFTPFGAVRPFTYCKN

SEQ ID NO: 2318758 - protein, 17 aa, Cryptosporidium parvum
NIGLLEIPPLNGTYSFP

SEQ ID NO: 2318759 - protein, 21 aa, Cryptosporidium parvum
NIGMGFIPRGGIVAPIQIEWP

SEQ ID NO: 2318760 - protein, 26 aa, Cryptosporidium parvum
NIGQQNIFLHGFDPNFSLYSVSDDHT

SEQ ID NO: 2318761 - protein, 27 aa, Cryptosporidium parvum
NIGSNERFKIIYWLSLHSNRLKFQSCT

SEQ ID NO: 2318762 - protein, 23 aa, Cryptosporidium parvum
NIGTLFQTSLFSYLQTIYNTDRN

SEQ ID NO: 2318763 - protein, 17 aa, Cryptosporidium parvum
NIHFWEFELLKTYYHPL

SEQ ID NO: 2318764 - protein, 17 aa, Cryptosporidium parvum
NIIADFTNFPDFTLLAC

SEQ ID NO: 2318765 - protein, 23 aa, Cryptosporidium parvum
NIIDDLPLYCQIPANIHILSLFE

SEQ ID NO: 2318766 - protein, 19 aa, Cryptosporidium parvum
NIIEDKLYLFGGWNGFQAL

SEQ ID NO: 2318767 - protein, 17 aa, Cryptosporidium parvum
NIIFGINKKFDYPFSGT

SEQ ID NO: 2318768 - protein, 18 aa, Cryptosporidium parvum
NIIKFFSKLTIVPSIIIV

SEQ ID NO: 2318769 - protein, 19 aa, Cryptosporidium parvum
NIILGGPGFFKDDFFKYLF

SEQ ID NO: 2318770 - protein, 20 aa, Cryptosporidium parvum
NIILKWFSETVVYISNDSLS

SEQ ID NO: 2318771 - protein, 26 aa, Cryptosporidium parvum
NIIPNSIIQFFKYLRDLEYEIIIQES

SEQ ID NO: 2318772 - protein, 25 aa, Cryptosporidium parvum
NIIPTSLDTYSLYLASCIWVCYENF

SEQ ID NO: 2318773 - protein, 23 aa, Cryptosporidium parvum
NIIQGFIGDCSFIVVLSLLLEHE

SEQ ID NO: 2318774 - protein, 26 aa, Cryptosporidium parvum
NIITKKQLIELLIQDGITNENSIKLF

SEQ ID NO: 2318775 - protein, 17 aa, Cryptosporidium parvum
NIIVDFPSKFKSVGENN

SEQ ID NO: 2318776 - protein, 20 aa, Cryptosporidium parvum
NIIVITHEKLLEPLKEDLKN

SEQ ID NO: 2318777 - protein, 20 aa, Cryptosporidium parvum
NIKFGNMKIINLIKRISSDL

SEQ ID NO: 2318778 - protein, 19 aa, Cryptosporidium parvum
NIKFIWSCNSSFSSLVILR

SEQ ID NO: 2318779 - protein, 19 aa, Cryptosporidium parvum
NIKIIPKAVKFLGSPSFEA

SEQ ID NO: 2318780 - protein, 30 aa, Cryptosporidium parvum; identical to SEQ ID NO: 2194397

SEQ ID NO: 2318781 - protein, 41 aa, Cryptosporidium parvum; identical to SEQ ID NO: 2194398

SEQ ID NO: 2318782 - protein, 23 aa, Cryptosporidium parvum
NIKNNPLGYPKKVYYFIYGFFHR

SEQ ID NO: 2318783 - protein, 24 aa, Cryptosporidium parvum
NIKRFVNFCLRYIADLDIPIKRGT

SEQ ID NO: 2318784 - protein, 25 aa, Cryptosporidium parvum
NIKRSLHFIYHRYKRYVAYNEMLNS

SEQ ID NO: 2318785 - protein, 36 aa, Cryptosporidium parvum; identical to SEQ ID NO: 2194402

SEQ ID NO: 2318786 - protein, 36 aa, Cryptosporidium parvum
NILDGKVFHIVATPYSIYLFDTLCNLVSFQKITNKE

SEQ ID NO: 2318787 - protein, 43 aa, Cryptosporidium parvum
NILDPYFKKPIYSGKSKFNFFPKFLKDNMKWFKNRIPSNNTND

SEQ ID NO: 2318788 - protein, 20 aa, Cryptosporidium parvum
NILFRIYKLEFTENWDLILF

SEQ ID NO: 2318789 - protein, 20 aa, Cryptosporidium parvum
NILGIIDLLPPDSPNFEDIY

SEQ ID NO: 2318790 - protein, 17 aa, Cryptosporidium parvum
NILGILGVLMKYYPNVY

SEQ ID NO: 2318791 - protein, 22 aa, Cryptosporidium parvum
NILGNPILESGLSPDIRYNNYM

SEQ ID NO: 2318792 - protein, 49 aa, Cryptosporidium parvum
NILIELIRGIFQSCIVLLWRLESIVFEILNIIKVFNLAILDIIDENKLI

SEQ ID NO: 2318793 - protein, 19 aa, Cryptosporidium parvum
NILIIFGPNGAGKTTILRC

SEQ ID NO: 2318794 - protein, 26 aa, Cryptosporidium parvum
NILKKDEWVCVLPLSVKSQEWVDSDS

SEQ ID NO: 2318795 - protein, 50 aa, Cryptosporidium parvum
NILNILSDRYYRLLYSQLLYRPIYISKNKKLLVFLIWQIVNNPEIHYKVS

SEQ ID NO: 2318796 - protein, 28 aa, Cryptosporidium parvum
NILNSPCQSPIFLILKPEIPKESEEINQ

SEQ ID NO: 2318797 - protein, 24 aa, Cryptosporidium parvum
NILNYLIDGVWRQQQYRLDMIEKH

SEQ ID NO: 2318798 - protein, 21 aa, Cryptosporidium parvum
NILRRCATYVYKILSILGLCG

SEQ ID NO: 2318799 - protein, 21 aa, Cryptosporidium parvum
NILSYKMEGDWLIVPEFKEVV

SEQ ID NO: 2318800 - protein, 19 aa, Cryptosporidium parvum
NILVKARNFLVFQGDVEDV

SEQ ID NO: 2318801 - protein, 20 aa, Cryptosporidium parvum
NIMRQIFSALHYLHNQGICH

SEQ ID NO: 2318802 - protein, 28 aa, Cryptosporidium parvum
NINERVDIFRFILIEFTMIQQEMHLRQI

SEQ ID NO: 2318803 - protein, 25 aa, Cryptosporidium parvum
NINHSSLFNWKLSADVLIQKSTNIH

SEQ ID NO: 2318804 - protein, 26 aa, Cryptosporidium parvum
NINILNHNIYSLLGINKLECLTETDF

SEQ ID NO: 2318805 - protein, 25 aa, Cryptosporidium parvum
NINKEAMLFKPVPMNLISKFTETTT

SEQ ID NO: 2318806 - protein, 18 aa, Cryptosporidium parvum
NINLIYLSTNFRSTKSII

SEQ ID NO: 2318807 - protein, 17 aa, Cryptosporidium parvum
NINLPPSLMSRFDLIYL

SEQ ID NO: 2318808 - protein, 22 aa, Cryptosporidium parvum
NINLSFFDIFEDNFIRYSSNKG

SEQ ID NO: 2318809 - protein, 27 aa, Cryptosporidium parvum
NINNDSAFIQNFSWDDDKWSSNDEINI

SEQ ID NO: 2318810 - protein, 21 aa, Cryptosporidium parvum
NINNEYINRKLLVITEEEFSS

SEQ ID NO: 2318811 - protein, 26 aa, Cryptosporidium parvum
NINNRLILTIGSKGIFRLWKVIIKHD

SEQ ID NO: 2318812 - protein, 33 aa, Cryptosporidium parvum
NINNYYIFQNVPLELFMFIFDFNASATNNQTNL

SEQ ID NO: 2318813 - protein, 28 aa, Cryptosporidium parvum
NINPGSIFFDLWNGSLFISCTNTPLVHN

SEQ ID NO: 2318814 - protein, 27 aa, Cryptosporidium parvum
NINPHYKLLFENLLFHFQTIFSLERYE

SEQ ID NO: 2318815 - protein, 25 aa, Cryptosporidium parvum
NINQEPAKCLLIGSPFKLPCSKGCH

SEQ ID NO: 2318816 - protein, 27 aa, Cryptosporidium parvum
NINQFVSQLQNLLPPIVPGHNSGNIQN

SEQ ID NO: 2318817 - protein, 32 aa, Cryptosporidium parvum; identical to SEQ ID NO: 2194426

SEQ ID NO: 2318818 - protein, 20 aa, Cryptosporidium parvum
NIPLCGIGMINKIVVWPWHQ

SEQ ID NO: 2318819 - protein, 21 aa, Cryptosporidium parvum
NIPQGLTWIKVVNDRIFAGDI

SEQ ID NO: 2318820 - protein, 18 aa, Cryptosporidium parvum
NIPSVNFTGGVSSSSISV

SEQ ID NO: 2318821 - protein, 33 aa, Cryptosporidium parvum; identical to SEQ ID NO: 2194433

SEQ ID NO: 2318822 - protein, 25 aa, Cryptosporidium parvum
NIQEDWLLDLVPIIDTPELGTLAGE

SEQ ID NO: 2318823 - protein, 20 aa, Cryptosporidium parvum
NIQIFVFNLWYILAQESYRE

SEQ ID NO: 2318824 - protein, 25 aa, Cryptosporidium parvum
NIQSRRFFLGYNFDSIFDTEIMFSV

SEQ ID NO: 2318825 - protein, 19 aa, Cryptosporidium parvum
NIQTPILFTNSNRALVFGD

SEQ ID NO: 2318826 - protein, 24 aa, Cryptosporidium parvum
NIRDWPINVLEKFACCLRIEIFMD

SEQ ID NO: 2318827 - protein, 24 aa, Cryptosporidium parvum
NIRKSIVMLAFIIKLFGLKNMQIT

SEQ ID NO: 2318828 - protein, 25 aa, Cryptosporidium parvum
NIRNIPFLTNLLYELIKTRNLILDE

SEQ ID NO: 2318829 - protein, 25 aa, Cryptosporidium parvum
NIRQYFKMLCSNSIIFNMFATSINL

SEQ ID NO: 2318830 - protein, 19 aa, Cryptosporidium parvum
NIRRAHCLANYSFKYRRGG

SEQ ID NO: 2318831 - protein, 17 aa, Cryptosporidium parvum
NIRRHSELAFKPLVLSA

SEQ ID NO: 2318832 - protein, 26 aa, Cryptosporidium parvum
NIRSSSFILFHSLLDKYFKDLTPLVY

SEQ ID NO: 2318833 - protein, 20 aa, Cryptosporidium parvum
NISCMIGVICLLEISSIGYA

SEQ ID NO: 2318834 - protein, 26 aa, Cryptosporidium parvum
NISEQFLLALSFLRKMKLTHTDLKLE

SEQ ID NO: 2318835 - protein, 20 aa, Cryptosporidium parvum
NISFPPIEFIKNEKFAFLQA

SEQ ID NO: 2318836 - protein, 21 aa, Cryptosporidium parvum
NISKEMLWYKPISINHVVTHM

SEQ ID NO: 2318837 - protein, 25 aa, Cryptosporidium parvum
NISKIKSLIKYKVLYEYIGHRVGQL

SEQ ID NO: 2318838 - protein, 23 aa, Cryptosporidium parvum
NISKYERFLLKEIFQSCIESILV

SEQ ID NO: 2318839 - protein, 18 aa, Cryptosporidium parvum
NISLKFLENAQIQWMNEK

SEQ ID NO: 2318840 - protein, 24 aa, Cryptosporidium parvum
NISLRLLEKAPIPHLARDFLLKTR

SEQ ID NO: 2318841 - protein, 27 aa, Cryptosporidium parvum
NISMDLPKYIWENFQSIKKLNVFNNKT

SEQ ID NO: 2318842 - protein, 25 aa, Cryptosporidium parvum
NISNRFLLIKVLHRGNFGQVYVGLD

SEQ ID NO: 2318843 - protein, 37 aa, Cryptosporidium parvum; identical to SEQ ID NO: 2194448

SEQ ID NO: 2318844 - protein, 24 aa, Cryptosporidium parvum
NISSSVKDLIKWMMTKDPESRCTA

SEQ ID NO: 2318845 - protein, 27 aa, Cryptosporidium parvum
NITIINFNRFPPGSLVILHTIRHKGFS

SEQ ID NO: 2318846 - protein, 18 aa, Cryptosporidium parvum
NITKCKIEFPRQPTLSNE

SEQ ID NO: 2318847 - protein, 26 aa, Cryptosporidium parvum
NITKNMSIILLPGEKLLLFSKECGIS

SEQ ID NO: 2318848 - protein, 19 aa, Cryptosporidium parvum
NITLDDCWCFNILKKDEWV

SEQ ID NO: 2318849 - protein, 25 aa, Cryptosporidium parvum
NITQTIPNSIYYYPTPNINQEKEEK

SEQ ID NO: 2318850 - protein, 21 aa, Cryptosporidium parvum
NIVFEFFPYDLKRYLSMFPDK

SEQ ID NO: 2318851 - protein, 17 aa, Cryptosporidium parvum
NIVKFLIGEGIPSYILD

SEQ ID NO: 2318852 - protein, 19 aa, Cryptosporidium parvum
NIVLLTPSLAPIASFRQFL

SEQ ID NO: 2318853 - protein, 36 aa, Cryptosporidium parvum
NIVLNLMRILLSKFHKKYLIASLYPDLLTSSEDNEY

SEQ ID NO: 2318854 - protein, 29 aa, Cryptosporidium parvum
NIVNAFYEYYMAELLWRIGTVLGHSSFVN

SEQ ID NO: 2318855 - protein, 28 aa, Cryptosporidium parvum
NIVSSFPPPPPYFRLFDHEDKVAKIKPP

SEQ ID NO: 2318856 - protein, 18 aa, Cryptosporidium parvum
NIVVNSEKSVFEVVPSEQ

SEQ ID NO: 2318857 - protein, 18 aa, Cryptosporidium parvum
NIYLKKFLQLEDLKWDIN

SEQ ID NO: 2318858 - protein, 17 aa, Cryptosporidium parvum
NIYNSLSTRIRTIILNP

SEQ ID NO: 2318859 - protein, 17 aa, Cryptosporidium parvum
NIYQNIFINFNEEKIRK

SEQ ID NO: 2318860 - protein, 30 aa, Cryptosporidium parvum
NIYRCNLMSDFYYDYLKLILDSIVEHNILF

SEQ ID NO: 2318861 - protein, 18 aa, Cryptosporidium parvum
NIYYSRSLIPWRVPKSQS

SEQ ID NO: 2318862 - protein, 22 aa, Cryptosporidium parvum
NKADVIIFGLINEQKKLTQEME

SEQ ID NO: 2318863 - protein, 23 aa, Cryptosporidium parvum
NKAKFLGLVLFKNKDIQGNEIPE

SEQ ID NO: 2318864 - protein, 26 aa, Cryptosporidium parvum
NKAQDLLLSLIYIKLPMISNQSSDYF

SEQ ID NO: 2318865 - protein, 23 aa, Cryptosporidium parvum
NKASLSLPPIYMKSCSLDAIVDL

SEQ ID NO: 2318866 - protein, 25 aa, Cryptosporidium parvum
NKAVDLLGLIPIYPVKNIKTFTNNL

SEQ ID NO: 2318867 - protein, 25 aa, Cryptosporidium parvum
NKCHFGYLRNKFAKLFIHERKNKNE

SEQ ID NO: 2318868 - protein, 17 aa, Cryptosporidium parvum
NKCKLNESFYLLIENEN

SEQ ID NO: 2318869 - protein, 23 aa, Cryptosporidium parvum
NKDELIKYLACLSPGFVGSEIRN

SEQ ID NO: 2318870 - protein, 28 aa, Cryptosporidium parvum
NKDGIWVHLVCAIWHLPLVTCEDWKNLS

SEQ ID NO: 2318871 - protein, 17 aa, Cryptosporidium parvum
NKDLINVDFPLLETNSA

SEQ ID NO: 2318872 - protein, 21 aa, Cryptosporidium parvum
NKDLVVIDPLLNLLSLNTSGV

SEQ ID NO: 2318873 - protein, 25 aa, Cryptosporidium parvum
NKEEWKFWMVGLLVSHALAQREKLV

SEQ ID NO: 2318874 - protein, 21 aa, Cryptosporidium parvum
NKFILLFAALCHDIDHPGVNN

SEQ ID NO: 2318875 - protein, 19 aa, Cryptosporidium parvum
NKFMSFGVASLRSMNSNAL

SEQ ID NO: 2318876 - protein, 28 aa, Cryptosporidium parvum
NKFRLGITSLQYIARLTPNKVWVKPGGE

SEQ ID NO: 2318877 - protein, 20 aa, Cryptosporidium parvum
NKGIIRFSGVYNPSKTFFVE

SEQ ID NO: 2318878 - protein, 27 aa, Cryptosporidium parvum
NKGIVDDPIILTIYGTQCPDLTLIDLP

SEQ ID NO: 2318879 - protein, 26 aa, Cryptosporidium parvum
NKGKEIALIMPFSIKINKIKADLQET

SEQ ID NO: 2318880 - protein, 30 aa, Cryptosporidium parvum; identical to SEQ ID NO: 2194490

SEQ ID NO: 2318881 - protein, 26 aa, Cryptosporidium parvum
NKGNLTCFLDCNYSYMFLSDYTKGEE

SEQ ID NO: 2318882 - protein, 27 aa, Cryptosporidium parvum
NKGTALVFQFKYCEPYFGAWQAKELSN

SEQ ID NO: 2318883 - protein, 21 aa, Cryptosporidium parvum
NKGVLNVKLDKVDESEDTGNN

SEQ ID NO: 2318884 - protein, 27 aa, Cryptosporidium parvum
NKGYWNMYDWELLMRDIQYPAKNGEKL

SEQ ID NO: 2318885 - protein, 26 aa, Cryptosporidium parvum
NKHGRRPLVLVLLPTRELAQQVSNEF

SEQ ID NO: 2318886 - protein, 22 aa, Cryptosporidium parvum
NKHYPIMNYSNIGFWIDMNEPS

SEQ ID NO: 2318887 - protein, 23 aa, Cryptosporidium parvum
NKIEFPLDMKYCQVKSIISGDCY

SEQ ID NO: 2318888 - protein, 24 aa, Cryptosporidium parvum
NKIGRLVIELFQDIVPKTSENFRQ

SEQ ID NO: 2318889 - protein, 31 aa, Cryptosporidium parvum
NKIGTMVYRMGLILEETWDKSLEGSRARYEQ

SEQ ID NO: 2318890 - protein, 18 aa, Cryptosporidium parvum
NKIKRPEGVSKKLGSFIA

SEQ ID NO: 2318891 - protein, 20 aa, Cryptosporidium parvum
NKIYLLRQSLLEEADSIRRE

SEQ ID NO: 2318892 - protein, 42 aa, Cryptosporidium parvum
NKKAIERLFIIIRNLRKYLPKLNCLFNFALNLGRKPDLIYSH

SEQ ID NO: 2318893 - protein, 30 aa, Cryptosporidium parvum
NKKDLKILLFELFIQFGLIDKITIRGGSPY

SEQ ID NO: 2318894 - protein, 24 aa, Cryptosporidium parvum
NKKFSFIQLRMYGSIKLRIIYKEN

SEQ ID NO: 2318895 - protein, 32 aa, Cryptosporidium parvum; identical to SEQ ID NO: 2194502

SEQ ID NO: 2318896 - protein, 26 aa, Cryptosporidium parvum
NKKIQKSLLFRLFKSEIHIYEKKMIS

SEQ ID NO: 2318897 - protein, 28 aa, Cryptosporidium parvum
NKKVGIYGFNCRCGFNFCSTHRYADAHD

SEQ ID NO: 2318898 - protein, 26 aa, Cryptosporidium parvum
NKLESVSFLKYCWNLTDINLSNNNLT

SEQ ID NO: 2318899 - protein, 22 aa, Cryptosporidium parvum
NKLFLLLNRPEKKLTSFGSWAI

SEQ ID NO: 2318900 - protein, 22 aa, Cryptosporidium parvum
NKLKSIKRLLKVWCMEMCPEEY

SEQ ID NO: 2318901 - protein, 21 aa, Cryptosporidium parvum
NKLLFNPGYTFYKNRWEIVLS

SEQ ID NO: 2318902 - protein, 31 aa, Cryptosporidium parvum; identical to SEQ ID NO: 2194507

SEQ ID NO: 2318903 - protein, 19 aa, Cryptosporidium parvum
NKLVAILDLDNTLLHAYNS

SEQ ID NO: 2318904 - protein, 28 aa, Cryptosporidium parvum
NKLVDSCYSFWFTGLLFCIEEILRIRTS

SEQ ID NO: 2318905 - protein, 17 aa, Cryptosporidium parvum
NKMCLLQLESDLLEHQL

SEQ ID NO: 2318906 - protein, 25 aa, Cryptosporidium parvum
NKMNTITLIWKIALILCMHPYISVC

SEQ ID NO: 2318907 - protein, 23 aa, Cryptosporidium parvum
NKNDDSFYYYIDGALEERDNINQ

SEQ ID NO: 2318908 - protein, 23 aa, Cryptosporidium parvum
NKNFGRWYLSNNTKARSFPNMHF

SEQ ID NO: 2318909 - protein, 17 aa, Cryptosporidium parvum
NKNIIWKGISSINHILC

SEQ ID NO: 2318910 - protein, 23 aa, Cryptosporidium parvum
NKNKDCLPLFFSSNTPIRKGYEV

SEQ ID NO: 2318911 - protein, 17 aa, Cryptosporidium parvum
NKNLCYDIKWNYFGNIL

SEQ ID NO: 2318912 - protein, 20 aa, Cryptosporidium parvum
NKNLNIFIDYLYLINGQIDF

SEQ ID NO: 2318913 - protein, 23 aa, Cryptosporidium parvum
NKNLQNLLLLTSIKIDVRRLDDY

SEQ ID NO: 2318914 - protein, 26 aa, Cryptosporidium parvum
NKNNGSCPFCFFKGNNKGQKLSISIN

SEQ ID NO: 2318915 - protein, 33 aa, Cryptosporidium parvum
NKNNQILFPVSYIFLRDEYSFPAAVLPSPDGTT

SEQ ID NO: 2318916 - protein, 28 aa, Cryptosporidium parvum
NKNSLKLMLGLMLKGPLFMRSCKDTINE

SEQ ID NO: 2318917 - protein, 23 aa, Cryptosporidium parvum
NKNTVIPCILLQMLDKSNLKAKG

SEQ ID NO: 2318918 - protein, 26 aa, Cryptosporidium parvum
NKNVVNRRLIMERNLADRFNSDTDVP

SEQ ID NO: 2318919 - protein, 23 aa, Cryptosporidium parvum
NKNYPYLIFAYTGQGCQYINMCK

SEQ ID NO: 2318920 - protein, 20 aa, Cryptosporidium parvum
NKPLLRIQRFIKYCETIQES

SEQ ID NO: 2318921 - protein, 25 aa, Cryptosporidium parvum
NKPSIGFNTFNPYSLFVGPESSSNN

SEQ ID NO: 2318922 - protein, 31 aa, Cryptosporidium parvum
NKPSLSLELIKLFIYIWGLDKSFSIDESKQK

SEQ ID NO: 2318923 - protein, 30 aa, Cryptosporidium parvum
NKQDCESFEFFFPFIYGLIVHSDKVKIPVS

SEQ ID NO: 2318924 - protein, 21 aa, Cryptosporidium parvum
NKQIFIIGGIIDRNKYKNISK

SEQ ID NO: 2318925 - protein, 33 aa, Cryptosporidium parvum
NKQKPSLGLIWSNSINWRIFLSKSISPSFEKDL

SEQ ID NO: 2318926 - protein, 31 aa, Cryptosporidium parvum; identical to SEQ ID NO: 2194525

SEQ ID NO: 2318927 - protein, 21 aa, Cryptosporidium parvum
NKQRELAEKKAQLAKAVKNPA

SEQ ID NO: 2318928 - protein, 27 aa, Cryptosporidium parvum
NKQSKCSAFVTFPRKFMAENAIMFLDK

SEQ ID NO: 2318929 - protein, 19 aa, Cryptosporidium parvum
NKRLLSELMAIITVGRKGN

SEQ ID NO: 2318930 - protein, 17 aa, Cryptosporidium parvum
NKSIPLLKGELAINTKK

SEQ ID NO: 2318931 - protein, 23 aa, Cryptosporidium parvum
NKSIVANIRHLTQKPILISSCTS

SEQ ID NO: 2318932 - protein, 26 aa, Cryptosporidium parvum
NKSKVLYIDFFINKLFGYFHKRLINS

SEQ ID NO: 2318933 - protein, 32 aa, Cryptosporidium parvum
NKSLDINYGYIKPIRYLNDGLPVYRLEDINLG

SEQ ID NO: 2318934 - protein, 33 aa, Cryptosporidium parvum
NKSNGPIISLRAYYPERFASSKPKYIPGNDSFK

SEQ ID NO: 2318935 - protein, 22 aa, Cryptosporidium parvum
NKSSFMLLPHRETSLLVSIPTY

SEQ ID NO: 2318936 - protein, 26 aa, Cryptosporidium parvum
NKTCNSLYKLIFDPTSPKNYSKNNLG

SEQ ID NO: 2318937 - protein, 24 aa, Cryptosporidium parvum
NKTLRVYSLGKKRLLRKSEYRNIP

SEQ ID NO: 2318938 - protein, 25 aa, Cryptosporidium parvum
NKTNIYFPFHFLHIQIVSGLRNLII

SEQ ID NO: 2318939 - protein, 24 aa, Cryptosporidium parvum
NKVGAQLIFQWIKNPNIGDQEIYG

SEQ ID NO: 2318940 - protein, 26 aa, Cryptosporidium parvum
NKVLEYFISCYLLEICLYDIEILKYS

SEQ ID NO: 2318941 - protein, 21 aa, Cryptosporidium parvum
NKYIKQLVYLKSYLSSLLIMN

SEQ ID NO: 2318942 - protein, 31 aa, Cryptosporidium parvum
NKYINRIWINQSLYNLYYLNLSSIQDSLPKS

SEQ ID NO: 2318943 - protein, 17 aa, Cryptosporidium parvum
NKYLDYYNEKLFNVIKE

SEQ ID NO: 2318944 - protein, 20 aa, Cryptosporidium parvum
NKYLYSCNLQFNKDGDILVL

SEQ ID NO: 2318945 - protein, 24 aa, Cryptosporidium parvum
NLAKLHGLQLFKPIESLINLASEI

SEQ ID NO: 2318946 - protein, 18 aa, Cryptosporidium parvum
NLAQIKYPSIQRILRRIC

SEQ ID NO: 2318947 - protein, 20 aa, Cryptosporidium parvum
NLAVVSYINNANRRLSVAEN

SEQ ID NO: 2318948 - protein, 30 aa, Cryptosporidium parvum
NLCEIYISIPCGYILDYFYLGVSSGDLLQE

SEQ ID NO: 2318949 - protein, 18 aa, Cryptosporidium parvum
NLCYSRELILNGIGNLFP

SEQ ID NO: 2318950 - protein, 37 aa, Cryptosporidium parvum
NLDELELENLCLIRQLFKDFVRIITQGRIETLEKGIG

SEQ ID NO: 2318951 - protein, 23 aa, Cryptosporidium parvum
NLDFGVNLNFGLGLSLETDINRG

SEQ ID NO: 2318952 - protein, 35 aa, Cryptosporidium parvum
NLDGAYQIFYFGMYYRHLFLDVSFMSCFVSFLLDT

SEQ ID NO: 2318953 - protein, 23 aa, Cryptosporidium parvum
NLDILKIFLELKPLKFLESISDE

SEQ ID NO: 2318954 - protein, 26 aa, Cryptosporidium parvum
NLDNNEYIFPLKIYSSNMIKSNHNIM

SEQ ID NO: 2318955 - protein, 17 aa, Cryptosporidium parvum
NLDPLSPEYQRLIEEQV

SEQ ID NO: 2318956 - protein, 26 aa, Cryptosporidium parvum
NLDSLMDFIFFIWAADDEFWDKNKLC

SEQ ID NO: 2318957 - protein, 17 aa, Cryptosporidium parvum
NLEIKWNAYRKRTQRLE

SEQ ID NO: 2318958 - protein, 28 aa, Cryptosporidium parvum
NLEKLKIDRFEPFNSLIKQLATQPCIRT

SEQ ID NO: 2318959 - protein, 25 aa, Cryptosporidium parvum
NLEKNLLNKRLFLDKIKSFGNKQTE

SEQ ID NO: 2318960 - protein, 17 aa, Cryptosporidium parvum
NLELIYRAESPFGLEIP

SEQ ID NO: 2318961 - protein, 24 aa, Cryptosporidium parvum
NLELTEHAGIIPRAVQLIFERLES

SEQ ID NO: 2318962 - protein, 21 aa, Cryptosporidium parvum
NLERFLPIYNEIIDSIANLRL

SEQ ID NO: 2318963 - protein, 31 aa, Cryptosporidium parvum
NLERKNLFKVFLRYFIYPAYLDLYSYGNIIL

SEQ ID NO: 2318964 - protein, 23 aa, Cryptosporidium parvum
NLERYERFIGSTKLLEEVSIHDA

SEQ ID NO: 2318965 - protein, 27 aa, Cryptosporidium parvum
NLFLPELINMMGPLLSGTLFPYNNNTE

SEQ ID NO: 2318966 - protein, 35 aa, Cryptosporidium parvum
NLFPEVKFILNTMLQDGIFLVNLYNGPQYYYQDRY

SEQ ID NO: 2318967 - protein, 22 aa, Cryptosporidium parvum
NLGDILHLPLSIVSGQIGHVSI

SEQ ID NO: 2318968 - protein, 25 aa, Cryptosporidium parvum
NLGITKIFFDPILFSNNNFFESGFF

SEQ ID NO: 2318969 - protein, 27 aa, Cryptosporidium parvum
NLGNLAFPYKLFLRKSKTIPPTLLSEA

SEQ ID NO: 2318970 - protein, 18 aa, Cryptosporidium parvum
NLGSYYYIYQRTEFIDDS

SEQ ID NO: 2318971 - protein, 24 aa, Cryptosporidium parvum
NLHKNFNQHFSGCSTNIIGEIRDS

SEQ ID NO: 2318972 - protein, 25 aa, Cryptosporidium parvum
NLHSRIAFSLLLRSNAIKAMEYPQN

SEQ ID NO: 2318973 - protein, 33 aa, Cryptosporidium parvum
NLIDKYLKKNFIYMLLPMIIKKAFLAYNSLKEI

SEQ ID NO: 2318974 - protein, 30 aa, Cryptosporidium parvum
NLIENKVLCYFMILNRPLIKPKNSQNTKNL

SEQ ID NO: 2318975 - protein, 29 aa, Cryptosporidium parvum
NLIENWKHIFSIDFPYMQTLGGGLGRLLV

SEQ ID NO: 2318976 - protein, 25 aa, Cryptosporidium parvum
NLIEVRRAISWLFSESLLNANEMPN

SEQ ID NO: 2318977 - protein, 20 aa, Cryptosporidium parvum
NLIFSPKVFLPCNPDKGYKL

SEQ ID NO: 2318978 - protein, 18 aa, Cryptosporidium parvum
NLILQYKRFYSLTEWISK

SEQ ID NO: 2318979 - protein, 24 aa, Cryptosporidium parvum
NLISEVLFSYFPLQFQSSSSQLPR

SEQ ID NO: 2318980 - protein, 20 aa, Cryptosporidium parvum
NLIVNKLGVSRLDKLDIVDG

SEQ ID NO: 2318981 - protein, 23 aa, Cryptosporidium parvum
NLKDFLLAAKQFNLLRPDYAICG

SEQ ID NO: 2318982 - protein, 20 aa, Cryptosporidium parvum
NLKDLIYRPEQEGGPVDISQ

SEQ ID NO: 2318983 - protein, 35 aa, Cryptosporidium parvum; identical to SEQ ID NO: 2194572

SEQ ID NO: 2318984 - protein, 24 aa, Cryptosporidium parvum
NLKSELELLYLDFIKKQFQETHIP

SEQ ID NO: 2318985 - protein, 22 aa, Cryptosporidium parvum
NLKSLLELLLVIMKVESLNSNQ

SEQ ID NO: 2318986 - protein, 23 aa, Cryptosporidium parvum
NLKVGSIIFVRIKKYSFSDNGDF

SEQ ID NO: 2318987 - protein, 17 aa, Cryptosporidium parvum
NLKYLETPQYLRKTLFK

SEQ ID NO: 2318988 - protein, 27 aa, Cryptosporidium parvum
NLLAEKYGWDKLAVKSLWAFGPDPSIG

SEQ ID NO: 2318989 - protein, 18 aa, Cryptosporidium parvum
NLLFFSWDNFGDCTDRML

SEQ ID NO: 2318990 - protein, 20 aa, Cryptosporidium parvum
NLLFSLAGFSVRILPTCRIG

SEQ ID NO: 2318991 - protein, 22 aa, Cryptosporidium parvum
NLLKENDILFKFPRVSPIINDE

SEQ ID NO: 2318992 - protein, 30 aa, Cryptosporidium parvum
NLLKKSPYIGKAHPFNLIYLDYLEKMKKNT

SEQ ID NO: 2318993 - protein, 19 aa, Cryptosporidium parvum
NLLSDLWIRYHVISSIARN

SEQ ID NO: 2318994 - protein, 29 aa, Cryptosporidium parvum
NLLSRLHSVLRPFLLRRLKKDVEKEMPSK

SEQ ID NO: 2318995 - protein, 21 aa, Cryptosporidium parvum
NLLTEMPILYLIVSNTGVSQI

SEQ ID NO: 2318996 - protein, 24 aa, Cryptosporidium parvum
NLLTKWMGCPPLPFKLDDKETGNL

SEQ ID NO: 2318997 - protein, 27 aa, Cryptosporidium parvum
NLLTTVDSIIKFLKSYSTHIAVVGPSD

SEQ ID NO: 2318998 - protein, 21 aa, Cryptosporidium parvum
NLMLSPHLFVAFCRARMLSPD

SEQ ID NO: 2318999 - protein, 40 aa, Cryptosporidium parvum
NLMNNLFRKKLQVIQHRLDSLYKFLLPREEFSQEFKNKSI

SEQ ID NO: 2319000 - protein, 22 aa, Cryptosporidium parvum
NLNEELFSFNLHSKKPIICMEW

SEQ ID NO: 2319001 - protein, 22 aa, Cryptosporidium parvum
NLNIIFVNDLLDLLCILKQMIN

SEQ ID NO: 2319002 - protein, 31 aa, Cryptosporidium parvum; identical to SEQ ID NO: 2194594

SEQ ID NO: 2319003 - protein, 23 aa, Cryptosporidium parvum
NLNIKPIIILIPSSECLAPGQLG

SEQ ID NO: 2319004 - protein, 20 aa, Cryptosporidium parvum
NLNILFYNQKDFHANKYSLR

SEQ ID NO: 2319005 - protein, 21 aa, Cryptosporidium parvum
NLNINILPTIALIKNSKLIHK

SEQ ID NO: 2319006 - protein, 33 aa, Cryptosporidium parvum
NLNLKLLNEPLQDDFLLTFPGGIPKGSTKNAKS

SEQ ID NO: 2319007 - protein, 20 aa, Cryptosporidium parvum
NLNMDYCISNGYGPNMNTNN

SEQ ID NO: 2319008 - protein, 18 aa, Cryptosporidium parvum
NLNNKSCIITWDPVKTKL

SEQ ID NO: 2319009 - protein, 28 aa, Cryptosporidium parvum
NLNNYSNLPFPPFQVKITQIFRRNRNNS

SEQ ID NO: 2319010 - protein, 23 aa, Cryptosporidium parvum
NLNQMLYIYDANCLPKWFITSQG

SEQ ID NO: 2319011 - protein, 20 aa, Cryptosporidium parvum
NLNSRLLLKVQLPESINQLY

SEQ ID NO: 2319012 - protein, 24 aa, Cryptosporidium parvum
NLNTNKYKYLIFKERYHNGNYYDK

SEQ ID NO: 2319013 - protein, 21 aa, Cryptosporidium parvum
NLPFDYRSPVIMACMGTGIAP

SEQ ID NO: 2319014 - protein, 18 aa, Cryptosporidium parvum
NLPICYIYKYRRESILKE

SEQ ID NO: 2319015 - protein, 37 aa, Cryptosporidium parvum
NLPIEVVLSQFLYQRTLYPCFPVQHPINPKLLQKLAL

SEQ ID NO: 2319016 - protein, 33 aa, Cryptosporidium parvum
NLPNPKFSQWLNPPYFRIGPQFEPVPMSYNWGP

SEQ ID NO: 2319017 - protein, 31 aa, Cryptosporidium parvum
NLPNSFLERIFLRYNQLFEIFLCQVNDSDSS

SEQ ID NO: 2319018 - protein, 18 aa, Cryptosporidium parvum
NLPPPPPITGFPSNMIYF

SEQ ID NO: 2319019 - protein, 22 aa, Cryptosporidium parvum
NLQEKISNHLIGLSIAKSNNSF

SEQ ID NO: 2319020 - protein, 17 aa, Cryptosporidium parvum
NLQIILFEHIALELLEL

SEQ ID NO: 2319021 - protein, 17 aa, Cryptosporidium parvum
NLQLMLNSIWSDLSKEN

SEQ ID NO: 2319022 - protein, 29 aa, Cryptosporidium parvum
NLQQLLRVAHQCGLWNAAVRLHLEFIGEI

SEQ ID NO: 2319023 - protein, 37 aa, Cryptosporidium parvum; identical to SEQ ID NO: 2194615

SEQ ID NO: 2319024 - protein, 24 aa, Cryptosporidium parvum
NLRAPIVASLPLRKKDETPEDRRN

SEQ ID NO: 2319025 - protein, 24 aa, Cryptosporidium parvum
NLRDPILYRILKQSHPHTGDKWVI

SEQ ID NO: 2319026 - protein, 27 aa, Cryptosporidium parvum
NLRKDPNFELFIYPIDPVRDGCLDYFE

SEQ ID NO: 2319027 - protein, 21 aa, Cryptosporidium parvum
NLRRIFKNAINSRPCILVFDD

SEQ ID NO: 2319028 - protein, 20 aa, Cryptosporidium parvum
NLSAISFLRLYEKWSNTRSN

SEQ ID NO: 2319029 - protein, 24 aa, Cryptosporidium parvum
NLSDPIQMIKLLKLTLEYGGIKGI

SEQ ID NO: 2319030 - protein, 23 aa, Cryptosporidium parvum
NLSHLFSLLRLHNIMEYYPKSIN

SEQ ID NO: 2319031 - protein, 21 aa, Cryptosporidium parvum
NLSIYKHLFKQSNKANFDRLK

SEQ ID NO: 2319032 - protein, 20 aa, Cryptosporidium parvum
NLSKRLECMILRSSFEQLYL

SEQ ID NO: 2319033 - protein, 39 aa, Cryptosporidium parvum
NLSLNGIHYPIDDRLYLWNGLYWIRILDQSKSGALKTYF

SEQ ID NO: 2319034 - protein, 21 aa, Cryptosporidium parvum
NLSLSTILDICDVRIVDELPP

SEQ ID NO: 2319035 - protein, 31 aa, Cryptosporidium parvum; identical to SEQ ID NO: 2194630

SEQ ID NO: 2319036 - protein, 17 aa, Cryptosporidium parvum
NLTEIEMALRKCVKNDY

SEQ ID NO: 2319037 - protein, 25 aa, Cryptosporidium parvum
NLTILKPCYLLLWNYNIRNCNNTIK

SEQ ID NO: 2319038 - protein, 21 aa, Cryptosporidium parvum
NLTISYILDLYQPTFKRKSII

SEQ ID NO: 2319039 - protein, 23 aa, Cryptosporidium parvum
NLTKRACLNPAYTSLRKSARLAQ

SEQ ID NO: 2319040 - protein, 23 aa, Cryptosporidium parvum
NLTSPIPITPFRRPEFQLNSTPK

SEQ ID NO: 2319041 - protein, 22 aa, Cryptosporidium parvum
NLTTRNLSISTTTIRVVSVDSD

SEQ ID NO: 2319042 - protein, 25 aa, Cryptosporidium parvum
NLVEKKVLRKVPVSGVYELSGSRIP

SEQ ID NO: 2319043 - protein, 27 aa, Cryptosporidium parvum
NLVETLPLSYKVFLASLILELEFKHKM

SEQ ID NO: 2319044 - protein, 18 aa, Cryptosporidium parvum
NLVFNIFSIVLQIDKRIQ

SEQ ID NO: 2319045 - protein, 26 aa, Cryptosporidium parvum
NLVGFDQLTNIVLQNCFEKIYNKDLN

SEQ ID NO: 2319046 - protein, 33 aa, Cryptosporidium parvum; identical to SEQ ID NO: 2194639

SEQ ID NO: 2319047 - protein, 30 aa, Cryptosporidium parvum
NLVMSDWLLCELIWEQVLLELGVKTKIEKF

SEQ ID NO: 2319048 - protein, 24 aa, Cryptosporidium parvum
NLVPLLITKWKSFPIDHPCLVASM

SEQ ID NO: 2319049 - protein, 18 aa, Cryptosporidium parvum
NLVTLLRCDLNRNIQSLA

SEQ ID NO: 2319050 - protein, 26 aa, Cryptosporidium parvum
NLVYGIPLLCLRGSMPIWYYRKKKNM

SEQ ID NO: 2319051 - protein, 29 aa, Cryptosporidium parvum
NLYIFQCSIIIKPQYWNDLLNFDILIKYH

SEQ ID NO: 2319052 - protein, 17 aa, Cryptosporidium parvum
NLYPLNPLSSLSYDRVL

SEQ ID NO: 2319053 - protein, 33 aa, Cryptosporidium parvum
NMAIEFFTLEREIYIAKLLLHLEEQRDAIKHLN

SEQ ID NO: 2319054 - protein, 18 aa, Cryptosporidium parvum
NMARDAFKFINNNNKLPF

SEQ ID NO: 2319055 - protein, 28 aa, Cryptosporidium parvum
NMASNPLNFYFENIYEKSLKTLSNALAF

SEQ ID NO: 2319056 - protein, 17 aa, Cryptosporidium parvum
NMCNSFVYYMQRWEDGL

SEQ ID NO: 2319057 - protein, 18 aa, Cryptosporidium parvum
NMCVNCGYIYHLTCQSQA

SEQ ID NO: 2319058 - protein, 24 aa, Cryptosporidium parvum
NMDDRICMHCWISKSTLYCSTCMC

SEQ ID NO: 2319059 - protein, 21 aa, Cryptosporidium parvum
NMDEFTRWNIALQFGGFINGV

SEQ ID NO: 2319060 - protein, 19 aa, Cryptosporidium parvum
NMDLQLSELRYGISMWSGC

SEQ ID NO: 2319061 - protein, 21 aa, Cryptosporidium parvum
NMDPDSILRLIDDYDYEFEED

SEQ ID NO: 2319062 - protein, 17 aa, Cryptosporidium parvum
NMECNLIQFLPFECFKC

SEQ ID NO: 2319063 - protein, 27 aa, Cryptosporidium parvum
NMEDNNHILLMKWSRMHKTKRDRDEND

SEQ ID NO: 2319064 - protein, 20 aa, Cryptosporidium parvum
NMFGRYYGMTLPQGQTNHSP

SEQ ID NO: 2319065 - protein, 29 aa, Cryptosporidium parvum
NMGIRLCYSSLWRKLPQQIPVRELAMSRY

SEQ ID NO: 2319066 - protein, 26 aa, Cryptosporidium parvum
NMKSPNEILLLIKKKLIACCITFNFT

SEQ ID NO: 2319067 - protein, 17 aa, Cryptosporidium parvum
NMLIMPHKYSPTEIKIQ

SEQ ID NO: 2319068 - protein, 24 aa, Cryptosporidium parvum
NMLPIDGVRFHKSDFRMGIFESFS

SEQ ID NO: 2319069 - protein, 19 aa, Cryptosporidium parvum
NMLRDYFQLSTSSSNTNYT

SEQ ID NO: 2319070 - protein, 19 aa, Cryptosporidium parvum
NMLTKIFNKSLKKRLIYPS

SEQ ID NO: 2319071 - protein, 18 aa, Cryptosporidium parvum
NMNGGSIAIPLIENIIQS

SEQ ID NO: 2319072 - protein, 33 aa, Cryptosporidium parvum; identical to SEQ ID NO: 2194661

SEQ ID NO: 2319073 - protein, 18 aa, Cryptosporidium parvum
NMNMNPPHLPPPPNMQMQ

SEQ ID NO: 2319074 - protein, 24 aa, Cryptosporidium parvum
NMNNLNQFPLIKPPYHHHLYEVYH

SEQ ID NO: 2319075 - protein, 24 aa, Cryptosporidium parvum
NMNYRVFPTTIWDETLFAAWSEIV

SEQ ID NO: 2319076 - protein, 18 aa, Cryptosporidium parvum
NMSFLLEILQELIKLKGL

SEQ ID NO: 2319077 - protein, 27 aa, Cryptosporidium parvum
NMTERFAYEVLLFWQNSAGSSDFKSAT

SEQ ID NO: 2319078 - protein, 21 aa, Cryptosporidium parvum
NMTIGIPLKLLYEGLGHIVTI

SEQ ID NO: 2319079 - protein, 29 aa, Cryptosporidium parvum
NMTMQFFNFRIVKRRHYSSSSNLLKSFNR

SEQ ID NO: 2319080 - protein, 18 aa, Cryptosporidium parvum
NMYVWNHRTWFIRKYNSV

SEQ ID NO: 2319081 - protein, 22 aa, Cryptosporidium parvum
NNAATQILGSKLPGVHPTTAAL

SEQ ID NO: 2319082 - protein, 23 aa, Cryptosporidium parvum
NNAFIQLFNQGYIFRKTRLVSWC

SEQ ID NO: 2319083 - protein, 19 aa, Cryptosporidium parvum
NNAKWDLVNKYYINVLKNL

SEQ ID NO: 2319084 - protein, 17 aa, Cryptosporidium parvum
NNAYSHIKYISKPILLG

SEQ ID NO: 2319085 - protein, 21 aa, Cryptosporidium parvum
NNCRSLFLSHCFGQKGKFQEA

SEQ ID NO: 2319086 - protein, 22 aa, Cryptosporidium parvum
NNDIKLMMQNNPLLEEYNESDR

SEQ ID NO: 2319087 - protein, 26 aa, Cryptosporidium parvum
NNDLDWDTIIHIIDTDVIEGMVIIED

SEQ ID NO: 2319088 - protein, 24 aa, Cryptosporidium parvum
NNEDLKLISLFYTAETNVPLSPSQ

SEQ ID NO: 2319089 - protein, 25 aa, Cryptosporidium parvum
NNEEEMIGLLKLVFDKATTQHHFIP

SEQ ID NO: 2319090 - protein, 26 aa, Cryptosporidium parvum
NNEIQIEWIDLNNEPKVFKDSKGNIY

SEQ ID NO: 2319091 - protein, 28 aa, Cryptosporidium parvum
NNENDQFLRLLQLLGEWAEFGLIVIFCN

SEQ ID NO: 2319092 - protein, 29 aa, Cryptosporidium parvum
NNEVFMDFYILFWYLDLSDISLPYQHYSE

SEQ ID NO: 2319093 - protein, 24 aa, Cryptosporidium parvum
NNFHFPLTFRIYSSKWIQFLISNY

SEQ ID NO: 2319094 - protein, 17 aa, Cryptosporidium parvum
NNFNFRINVQWHSVYVD

SEQ ID NO: 2319095 - protein, 22 aa, Cryptosporidium parvum
NNFQPQIIILPEQEFMLTCQDN

SEQ ID NO: 2319096 - protein, 23 aa, Cryptosporidium parvum
NNFSEWLLPFLRSKKIQIEGFGQ

SEQ ID NO: 2319097 - protein, 21 aa, Cryptosporidium parvum
NNGILANYFISDNSIPGLSQL

SEQ ID NO: 2319098 - protein, 28 aa, Cryptosporidium parvum
NNGLYCKHVRWIIQIPRLYNIFHKDGCV

SEQ ID NO: 2319099 - protein, 25 aa, Cryptosporidium parvum
NNGSYMQMFNFVEAALIIQNSTSLY

SEQ ID NO: 2319100 - protein, 25 aa, Cryptosporidium parvum
NNHDDILNPLWLSNGVSSTPIISAS

SEQ ID NO: 2319101 - protein, 17 aa, Cryptosporidium parvum
NNHKLIWHIFYQIVQGL

SEQ ID NO: 2319102 - protein, 22 aa, Cryptosporidium parvum
NNHKYIIYALIFHKGKTTNSGH

SEQ ID NO: 2319103 - protein, 23 aa, Cryptosporidium parvum
NNHLKVLFCTSLHMMDSEIKADR

SEQ ID NO: 2319104 - protein, 22 aa, Cryptosporidium parvum
NNHPLFCRRGVEVTVISQGEFF

SEQ ID NO: 2319105 - protein, 31 aa, Cryptosporidium parvum; identical to SEQ ID NO: 2132606

SEQ ID NO: 2319106 - protein, 21 aa, Cryptosporidium parvum
NNIALFLPRNTNITEFSALLS

SEQ ID NO: 2319107 - protein, 23 aa, Cryptosporidium parvum
NNIFAKVFIYFSNHQLRIGDLNK

SEQ ID NO: 2319108 - protein, 25 aa, Cryptosporidium parvum
NNIKILINILIHRKEYRRAIKILRD

SEQ ID NO: 2319109 - protein, 19 aa, Cryptosporidium parvum
NNIKIPFGSSIKFIELIES

SEQ ID NO: 2319110 - protein, 23 aa, Cryptosporidium parvum
NNIMDKWIYSEAQSLLKFVKTEM

SEQ ID NO: 2319111 - protein, 22 aa, Cryptosporidium parvum
NNINFFLDRHWIDKEFKELISN

SEQ ID NO: 2319112 - protein, 24 aa, Cryptosporidium parvum
NNINSIFCYSVDLVYSLFSSLQNE

SEQ ID NO: 2319113 - protein, 32 aa, Cryptosporidium parvum
NNKDNFLIFNNIFYVFPIPFDMKSIRSLQTFS

SEQ ID NO: 2319114 - protein, 25 aa, Cryptosporidium parvum
NNKIILRHIIISLITIYRCGFASSI

SEQ ID NO: 2319115 - protein, 35 aa, Cryptosporidium parvum
NNKKIFFLNPVQSQLFHILFYSDENIFLGAPTGSG

SEQ ID NO: 2319116 - protein, 22 aa, Cryptosporidium parvum
NNKPFLRGGDFTRRRARGETPM

SEQ ID NO: 2319117 - protein, 26 aa, Cryptosporidium parvum
NNKRMIINNISPSRLKIWSKKNKKNC

SEQ ID NO: 2319118 - protein, 26 aa, Cryptosporidium parvum
NNKSTSLEIIPLLKPLLTGYMDDQIP

SEQ ID NO: 2319119 - protein, 24 aa, Cryptosporidium parvum
NNLGPPFHILLDTNFINFSIQHKL

SEQ ID NO: 2319120 - protein, 23 aa, Cryptosporidium parvum
NNLIEMFQLPREKIHSLLSKMML

SEQ ID NO: 2319121 - protein, 18 aa, Cryptosporidium parvum
NNLNISRILAPIAATAFA

SEQ ID NO: 2319122 - protein, 25 aa, Cryptosporidium parvum
NNLNNNILYEEPLDFGISSTLELLK

SEQ ID NO: 2319123 - protein, 25 aa, Cryptosporidium parvum
NNLREGFIPLIYKGVQLISYSYLLN

SEQ ID NO: 2319124 - protein, 26 aa, Cryptosporidium parvum
NNLRELWSLLNFLMPNLFSSSEDFES

SEQ ID NO: 2319125 - protein, 29 aa, Cryptosporidium parvum
NNLYDPDYLSFLGLYSNLLFPASNFQMFG

SEQ ID NO: 2319126 - protein, 23 aa, Cryptosporidium parvum
NNMFMWYSYFRGNIYLENTSRII

SEQ ID NO: 2319127 - protein, 25 aa, Cryptosporidium parvum
NNNDKLRLILLYISHYTGINNDDLN

SEQ ID NO: 2319128 - protein, 22 aa, Cryptosporidium parvum
NNNIFGMLSCRPYSSSISTITS

SEQ ID NO: 2319129 - protein, 25 aa, Cryptosporidium parvum
NNNILLQCIFLLNLKDEFISKVKNY

SEQ ID NO: 2319130 - protein, 28 aa, Cryptosporidium parvum
NNNLDFSYLNIRWRRKMGEKLIDIQGKD

SEQ ID NO: 2319131 - protein, 21 aa, Cryptosporidium parvum
NNNLQLYSWLDMKLSQYESKQ

SEQ ID NO: 2319132 - protein, 25 aa, Cryptosporidium parvum
NNNNIALSYFYLDTTYILNKYVMEN

SEQ ID NO: 2319133 - protein, 24 aa, Cryptosporidium parvum
NNNNINLIFIHGFLGSAFKSWNID

SEQ ID NO: 2319134 - protein, 31 aa, Cryptosporidium parvum; identical to SEQ ID NO: 2194724

SEQ ID NO: 2319135 - protein, 36 aa, Cryptosporidium parvum
NNNNNNMLLLLKLVDNILIRIILLTIENIVDINNED

SEQ ID NO: 2319136 - protein, 25 aa, Cryptosporidium parvum
NNNNNNYYYYYYKNKIKIGGNNYNE

SEQ ID NO: 2319137 - protein, 21 aa, Cryptosporidium parvum
NNNQLDRKISDIYTNHMDNNS

SEQ ID NO: 2319138 - protein, 25 aa, Cryptosporidium parvum
NNNSCRLLTYFLNLFNPVIGDAISD

SEQ ID NO: 2319139 - protein, 23 aa, Cryptosporidium parvum
NNNTGLGLFGSTSSNIGNTNNNL

SEQ ID NO: 2319140 - protein, 17 aa, Cryptosporidium parvum
NNNYRYYQMFGNSNDRI

SEQ ID NO: 2319141 - protein, 20 aa, Cryptosporidium parvum
NNPEFYTKLIFLNDERWANI

SEQ ID NO: 2319142 - protein, 27 aa, Cryptosporidium parvum
NNPEIMFLTLLRNLYKYAFLDGQNDLP

SEQ ID NO: 2319143 - protein, 29 aa, Cryptosporidium parvum
NNPFNNIIDPFLWLKTPDLFNIISSKLIN

SEQ ID NO: 2319144 - protein, 26 aa, Cryptosporidium parvum
NNPGKDLFFSYLYFSPTSISDVVSYY

SEQ ID NO: 2319145 - protein, 28 aa, Cryptosporidium parvum
NNPLSVVEFFKYPIPFFSKKNISKNGFS

SEQ ID NO: 2319146 - protein, 24 aa, Cryptosporidium parvum
NNQEIVFSRRILSSGASRYLIDKN

SEQ ID NO: 2319147 - protein, 22 aa, Cryptosporidium parvum
NNQIILFELFKQVYEDILCLIS

SEQ ID NO: 2319148 - protein, 24 aa, Cryptosporidium parvum
NNQKLNEQFISLSSPNNANSNNSN

SEQ ID NO: 2319149 - protein, 20 aa, Cryptosporidium parvum
NNQYWLSCMVGSVPYNGTLE

SEQ ID NO: 2319150 - protein, 25 aa, Cryptosporidium parvum
NNRELLLFDLAINMYQKYTHLSRIL

SEQ ID NO: 2319151 - protein, 24 aa, Cryptosporidium parvum
NNRICKSYFQLCQRLKEYLRNMSP

SEQ ID NO: 2319152 - protein, 27 aa, Cryptosporidium parvum
NNRINIVHDLLLLRTLTSIIQNSKDRS

SEQ ID NO: 2319153 - protein, 30 aa, Cryptosporidium parvum
NNRQGLSSIFYPIFPLVCFPDFVRSGANME

SEQ ID NO: 2319154 - protein, 23 aa, Cryptosporidium parvum
NNRSITFVMKLLGTFAQTITFEQ

SEQ ID NO: 2319155 - protein, 24 aa, Cryptosporidium parvum
NNSIDLLFNFNRLNRWLLKRIIAS

SEQ ID NO: 2319156 - protein, 32 aa, Cryptosporidium parvum
NNSIYRTKYDPGQYFNITPITFVETKVSNLLN

SEQ ID NO: 2319157 - protein, 21 aa, Cryptosporidium parvum
NNSKNTKGFAFITYSKREEAQ

SEQ ID NO: 2319158 - protein, 26 aa, Cryptosporidium parvum
NNSNWLIIGAVKHELFFYLAKENVTS

SEQ ID NO: 2319159 - protein, 28 aa, Cryptosporidium parvum
NNSPQTLPYIYLFERFMNYLIEAGTKRI

SEQ ID NO: 2319160 - protein, 31 aa, Cryptosporidium parvum; identical to SEQ ID NO: 2194751

SEQ ID NO: 2319161 - protein, 26 aa, Cryptosporidium parvum
NNSTNPQLWCKISFIDLAGSERASAT

SEQ ID NO: 2319162 - protein, 19 aa, Cryptosporidium parvum
NNSVLLSAVLQVIASIQKL

SEQ ID NO: 2319163 - protein, 27 aa, Cryptosporidium parvum
NNSVNCWLIFVYINELLIQILSSNLKN

SEQ ID NO: 2319164 - protein, 23 aa, Cryptosporidium parvum
NNTAGQIFLKHGSELQLIPRDRV

SEQ ID NO: 2319165 - protein, 21 aa, Cryptosporidium parvum
NNTQFIQWICHSANIIEQRIS

SEQ ID NO: 2319166 - protein, 24 aa, Cryptosporidium parvum
NNTTLLDRLIFVREDREDESSRYG

SEQ ID NO: 2319167 - protein, 18 aa, Cryptosporidium parvum
NNVFALANLPPLKELLTF

SEQ ID NO: 2319168 - protein, 24 aa, Cryptosporidium parvum
NNVFQYDTPIKGIGYWYEQGMNNT

SEQ ID NO: 2319169 - protein, 21 aa, Cryptosporidium parvum
NNVIGLFALSPNNVSHLPPTE

SEQ ID NO: 2319170 - protein, 27 aa, Cryptosporidium parvum
NNVPEFIWRKIIHEFAFPINETATVWK

SEQ ID NO: 2319171 - protein, 22 aa, Cryptosporidium parvum
NNVSILHLKANYLNLEGGSEFE

SEQ ID NO: 2319172 - protein, 25 aa, Cryptosporidium parvum
NNVSPPVFIFVIDTCLIEAELTELR

SEQ ID NO: 2319173 - protein, 32 aa, Cryptosporidium parvum
NNWSCCNSCLRFIWTLIQYKSLRYNDIDEKNI

SEQ ID NO: 2319174 - protein, 28 aa, Cryptosporidium parvum
NNYEINYWLDWLFNNITLNGKYGLELYF

SEQ ID NO: 2319175 - protein, 26 aa, Cryptosporidium parvum
NNYSKSLLCNLWFRSIKIIQEIQNYN

SEQ ID NO: 2319176 - protein, 24 aa, Cryptosporidium parvum
NPCLVHILPSILKRTISKGNPEFS

SEQ ID NO: 2319177 - protein, 30 aa, Cryptosporidium parvum; identical to SEQ ID NO: 2194761

SEQ ID NO: 2319178 - protein, 23 aa, Cryptosporidium parvum
NPEKVINNLLIDKGLHLSRLLCE

SEQ ID NO: 2319179 - protein, 33 aa, Cryptosporidium parvum; identical to SEQ ID NO: 2194765

SEQ ID NO: 2319180 - protein, 26 aa, Cryptosporidium parvum
NPFGWQLDMRLVFYNALKYHKEGNTV

SEQ ID NO: 2319181 - protein, 21 aa, Cryptosporidium parvum
NPGATTFMVGLSGEFREFPLG

SEQ ID NO: 2319182 - protein, 27 aa, Cryptosporidium parvum
NPGIFVKLISKFQYLRFIISVTRSGNL

SEQ ID NO: 2319183 - protein, 25 aa, Cryptosporidium parvum
NPHEFERLVKLIFSNCMIFNPNSGE

SEQ ID NO: 2319184 - protein, 20 aa, Cryptosporidium parvum
NPHFDGVFHYYDFVNNQNII

SEQ ID NO: 2319185 - protein, 34 aa, Cryptosporidium parvum
NPIFRITLQIIFQEIYDFQLSLSQFTLRNISNDN

SEQ ID NO: 2319186 - protein, 19 aa, Cryptosporidium parvum
NPIPSVAIPSNVSSAIGVA

SEQ ID NO: 2319187 - protein, 21 aa, Cryptosporidium parvum
NPIQRPDLHVGLHSAPRGILL

SEQ ID NO: 2319188 - protein, 27 aa, Cryptosporidium parvum
NPIYDPKYIYVPYKKEFMPLKDLSEPH

SEQ ID NO: 2319189 - protein, 28 aa, Cryptosporidium parvum
NPKDFLLGSKLFMEFLKSNSITGHLCND

SEQ ID NO: 2319190 - protein, 26 aa, Cryptosporidium parvum
NPKDNPLIFILLTNIVGWDTVDDESQ

SEQ ID NO: 2319191 - protein, 26 aa, Cryptosporidium parvum
NPKSLDLWNLGCLIYWSYQVSSNLNP

SEQ ID NO: 2319192 - protein, 25 aa, Cryptosporidium parvum
NPKYEELMEWLIKEQNFNEARVNSY

SEQ ID NO: 2319193 - protein, 27 aa, Cryptosporidium parvum
NPLCKICDPFFIGYSDLLNLQVSTKTI

SEQ ID NO: 2319194 - protein, 24 aa, Cryptosporidium parvum
NPLHSLVICHPDLHLIEQRFFEIY

SEQ ID NO: 2319195 - protein, 18 aa, Cryptosporidium parvum
NPLLDRLDPMNKCPYRLF

SEQ ID NO: 2319196 - protein, 21 aa, Cryptosporidium parvum
NPLLEELKIIRKENNSLIKSL

SEQ ID NO: 2319197 - protein, 23 aa, Cryptosporidium parvum
NPLNKYQYLLLKHLEIPSVKFEI

SEQ ID NO: 2319198 - protein, 26 aa, Cryptosporidium parvum
NPNENPILCVWFAQKKGNYGFVEFRT

SEQ ID NO: 2319199 - protein, 23 aa, Cryptosporidium parvum
NPNGLFCFDFKLRINPNSSESDR

SEQ ID NO: 2319200 - protein, 28 aa, Cryptosporidium parvum
NPNKAPLGKLIPSPLMITIGIGNTELTE

SEQ ID NO: 2319201 - protein, 27 aa, Cryptosporidium parvum
NPNVKIVHTLWLWACDGQWQRVSEDLF

SEQ ID NO: 2319202 - protein, 18 aa, Cryptosporidium parvum
NPPIIHRDIKSLNIFLSL

SEQ ID NO: 2319203 - protein, 25 aa, Cryptosporidium parvum
NPPYTSHRLLQIPSALRGINADIIA

SEQ ID NO: 2319204 - protein, 27 aa, Cryptosporidium parvum
NPQDFDILFDYIIFITQYLELDSVLQE

SEQ ID NO: 2319205 - protein, 28 aa, Cryptosporidium parvum
NPQLSNILNYLLFIKFNKYPTCESDTDL

SEQ ID NO: 2319206 - protein, 18 aa, Cryptosporidium parvum
NPSAWRWYHSVVGEERCS

SEQ ID NO: 2319207 - protein, 17 aa, Cryptosporidium parvum
NPSFCEEGWNNDTNLFT

SEQ ID NO: 2319208 - protein, 27 aa, Cryptosporidium parvum
NPSTLATYPYLIQQLYDADILSEKVIL

SEQ ID NO: 2319209 - protein, 19 aa, Cryptosporidium parvum
NPTRLFYYSQLYSSSTTFS

SEQ ID NO: 2319210 - protein, 22 aa, Cryptosporidium parvum
NPTSSINFYNSMTGGVGGGHGI

SEQ ID NO: 2319211 - protein, 24 aa, Cryptosporidium parvum
NPVAPVHALLVPKKRSGLTRLSKA

SEQ ID NO: 2319212 - protein, 28 aa, Cryptosporidium parvum
NPVLKNMIFFLYDSFLSEIFQLDGLTEN

SEQ ID NO: 2319213 - protein, 27 aa, Cryptosporidium parvum
NPVQMLIRLSRLFYFAGKYRESQNTLD

SEQ ID NO: 2319214 - protein, 23 aa, Cryptosporidium parvum
NPVVTLCNHYFCEKCAFSHYTNT

SEQ ID NO: 2319215 - protein, 21 aa, Cryptosporidium parvum
NPYLNGVWIKNGLSFVVSQKY

SEQ ID NO: 2319216 - protein, 17 aa, Cryptosporidium parvum
NQCGLFGYNNYCHYCKS

SEQ ID NO: 2319217 - protein, 25 aa, Cryptosporidium parvum
NQEGRPFIFYLDNYAFPTPKIESTV

SEQ ID NO: 2319218 - protein, 25 aa, Cryptosporidium parvum
NQEIHQLLIIDNILVSACWGGKIVF

SEQ ID NO: 2319219 - protein, 28 aa, Cryptosporidium parvum
NQEIPVYPIKNITSYLHRWRIVGRVVSK

SEQ ID NO: 2319220 - protein, 27 aa, Cryptosporidium parvum
NQEYYNILLILIFHTKRESLLQYVLQY

SEQ ID NO: 2319221 - protein, 21 aa, Cryptosporidium parvum
NQFFFKRITPQGGEDSWIFSK

SEQ ID NO: 2319222 - protein, 30 aa, Cryptosporidium parvum
NQFPTEFQFHPNLLIIIADHLNNSLFGNFH

SEQ ID NO: 2319223 - protein, 24 aa, Cryptosporidium parvum
NQFQFFEPEFLTCLIYTINNNNNN

SEQ ID NO: 2319224 - protein, 24 aa, Cryptosporidium parvum
NQIDSCEYLFFGSDPGNKSNSTFG

SEQ ID NO: 2319225 - protein, 28 aa, Cryptosporidium parvum
NQIGFENFLLTVLQLRITIWATKNSTIE

SEQ ID NO: 2319226 - protein, 24 aa, Cryptosporidium parvum
NQIYSVFNRAILKPFPTLSNHADA

SEQ ID NO: 2319227 - protein, 29 aa, Cryptosporidium parvum
NQKCHSLVLALLYYRYLQLEVILENGKKL

SEQ ID NO: 2319228 - protein, 26 aa, Cryptosporidium parvum
NQKLEEFFLFFAQFLEKIVHISEKNK

SEQ ID NO: 2319229 - protein, 27 aa, Cryptosporidium parvum
NQKNDEYIFILCPAPSDLEEEYIDQEG

SEQ ID NO: 2319230 - protein, 21 aa, Cryptosporidium parvum
NQLITTFEWSHEINQIFVALN

SEQ ID NO: 2319231 - protein, 29 aa, Cryptosporidium parvum
NQLKISYILVRVLAQLRMIESILGRCVAF

SEQ ID NO: 2319232 - protein, 25 aa, Cryptosporidium parvum
NQLLTHPFIDTCIVSRYVMQQIPKS

SEQ ID NO: 2319233 - protein, 19 aa, Cryptosporidium parvum
NQLNLKHVFAILSGAEPIR

SEQ ID NO: 2319234 - protein, 24 aa, Cryptosporidium parvum
NQLRRSITVTPLVEDLQRVLNGEA

SEQ ID NO: 2319235 - protein, 25 aa, Cryptosporidium parvum
NQLSKGYSGLISLPLKLRFHCENLE

SEQ ID NO: 2319236 - protein, 20 aa, Cryptosporidium parvum
NQMAMAMYSPILAGGYGIAG

SEQ ID NO: 2319237 - protein, 26 aa, Cryptosporidium parvum
NQMLKLKLELFHKEMIKFSGISLQGR

SEQ ID NO: 2319238 - protein, 20 aa, Cryptosporidium parvum
NQNIMLLDPSFSYLSSKNNS

SEQ ID NO: 2319239 - protein, 17 aa, Cryptosporidium parvum
NQNINAYPQIYSNINHL

SEQ ID NO: 2319240 - protein, 27 aa, Cryptosporidium parvum
NQNNKIPFLLKILSISKPLSLQVHPDK

SEQ ID NO: 2319241 - protein, 50 aa, Cryptosporidium parvum; identical to SEQ ID NO: 2194820

SEQ ID NO: 2319242 - protein, 26 aa, Cryptosporidium parvum
NQNTLPYLNHTILSKPNVTTQLSMLN

SEQ ID NO: 2319243 - protein, 30 aa, Cryptosporidium parvum
NQNYSTIKIPFNIPILGLPSITQWMNIIEN

SEQ ID NO: 2319244 - protein, 26 aa, Cryptosporidium parvum
NQPNVLLNFPLPFKLPPKRYSNSDHP

SEQ ID NO: 2319245 - protein, 24 aa, Cryptosporidium parvum
NQQEELVLSGIKWLTSVVNEIDEL

SEQ ID NO: 2319246 - protein, 27 aa, Cryptosporidium parvum
NQQEPDKVKFIPLSSLKKLQSLKSPNI

SEQ ID NO: 2319247 - protein, 26 aa, Cryptosporidium parvum
NQRDFIFFRHYRYIFRKKRTTSTQNA

SEQ ID NO: 2319248 - protein, 24 aa, Cryptosporidium parvum
NQRLSMQNVFKRFYSPGNPNSNTN

SEQ ID NO: 2319249 - protein, 22 aa, Cryptosporidium parvum
NQRSILSAYKQYNNLRLKILAN

SEQ ID NO: 2319250 - protein, 21 aa, Cryptosporidium parvum
NQSCYKIPVIGELISEHELKE

SEQ ID NO: 2319251 - protein, 21 aa, Cryptosporidium parvum
NQSIPPIPPQSQPPFMMGGPG

SEQ ID NO: 2319252 - protein, 24 aa, Cryptosporidium parvum
NQSLYNFMYPLGVDAQLWSASQDS

SEQ ID NO: 2319253 - protein, 23 aa, Cryptosporidium parvum
NQSSGIISSFKSWTHSLIAHSSR

SEQ ID NO: 2319254 - protein, 20 aa, Cryptosporidium parvum
NQSYSRELIMDHSEGIDWIS

SEQ ID NO: 2319255 - protein, 32 aa, Cryptosporidium parvum
NQTMDPYGFLLDTLYLYYPRNESKNPVHMLDP

SEQ ID NO: 2319256 - protein, 18 aa, Cryptosporidium parvum
NQTTNFITYPPLTSMQSI

SEQ ID NO: 2319257 - protein, 36 aa, Cryptosporidium parvum
NQVFKDINGIPWIGIWRWDLYEKKRGKLILIYSIIN

SEQ ID NO: 2319258 - protein, 20 aa, Cryptosporidium parvum
NQYHYLISPEIIRELSHSLI

SEQ ID NO: 2319259 - protein, 25 aa, Cryptosporidium parvum
NQYSLVLAIINKSSFMLLPHRETSL

SEQ ID NO: 2319260 - protein, 27 aa, Cryptosporidium parvum
NRCIQQLKILFWRHPGDPLLGKELARC

SEQ ID NO: 2319261 - protein, 21 aa, Cryptosporidium parvum
NRDDPGALILKLLHSGRNIET

SEQ ID NO: 2319262 - protein, 25 aa, Cryptosporidium parvum
NRDSSPDFTIVRRMNPTKSDESNPK

SEQ ID NO: 2319263 - protein, 26 aa, Cryptosporidium parvum
NREAFRPITIQDFNLSLKLVKPSYSS

SEQ ID NO: 2319264 - protein, 20 aa, Cryptosporidium parvum
NREEWYLTEHACNAFGICLA

SEQ ID NO: 2319265 - protein, 18 aa, Cryptosporidium parvum
NREILKQTKIGVVMTAVK

SEQ ID NO: 2319266 - protein, 30 aa, Cryptosporidium parvum
NREINFGELKHELLIKLVNCQKLVLEEKYS

SEQ ID NO: 2319267 - protein, 20 aa, Cryptosporidium parvum
NRENLYFNSLKKCVIFDTDW

SEQ ID NO: 2319268 - protein, 17 aa, Cryptosporidium parvum
NRESWFLAFIMDTNEEE

SEQ ID NO: 2319269 - protein, 22 aa, Cryptosporidium parvum
NREVRMLLEKLPASTITLYPDL

SEQ ID NO: 2319270 - protein, 21 aa, Cryptosporidium parvum
NRGIIYISRIPPKMQPHHIRE

SEQ ID NO: 2319271 - protein, 27 aa, Cryptosporidium parvum
NRGSIWMVFEYLPYDLSGYIEGLKLEG

SEQ ID NO: 2319272 - protein, 23 aa, Cryptosporidium parvum
NRGTTTLGFIYQGGVILAVDSRA

SEQ ID NO: 2319273 - protein, 17 aa, Cryptosporidium parvum
NRHNDLSVWFQFMESIE

SEQ ID NO: 2319274 - protein, 20 aa, Cryptosporidium parvum
NRIFFKSITYSSDPYKVLGV

SEQ ID NO: 2319275 - protein, 19 aa, Cryptosporidium parvum
NRIKSYYLINNDSGQIIPI

SEQ ID NO: 2319276 - protein, 25 aa, Cryptosporidium parvum
NRKIRIYADGVYDLLHLGHMRQLEQ

SEQ ID NO: 2319277 - protein, 25 aa, Cryptosporidium parvum
NRKKYENYLLKRTDKISLLELEILT

SEQ ID NO: 2319278 - protein, 25 aa, Cryptosporidium parvum
NRKLDYLRWKEREYKRLKGEYFDYM

SEQ ID NO: 2319279 - protein, 17 aa, Cryptosporidium parvum
NRKLLFENWKDELLELF

SEQ ID NO: 2319280 - protein, 28 aa, Cryptosporidium parvum
NRKVSRLYEILRLPSNGLERAIIHRNMM

SEQ ID NO: 2319281 - protein, 18 aa, Cryptosporidium parvum
NRKYLDVFIFESADIRDK

SEQ ID NO: 2319282 - protein, 17 aa, Cryptosporidium parvum
NRLLAKFHKKRPSSSET

SEQ ID NO: 2319283 - protein, 18 aa, Cryptosporidium parvum
NRLQGSLKCFYYMENIES

SEQ ID NO: 2319284 - protein, 26 aa, Cryptosporidium parvum
NRMDHKFDLMYSKRAFVHWYVGEGME

SEQ ID NO: 2319285 - protein, 18 aa, Cryptosporidium parvum
NRMPIDVTKLAFLQENPE

SEQ ID NO: 2319286 - protein, 28 aa, Cryptosporidium parvum
NRNCPESLKIIDFGLAASLGSPAMKMRC

SEQ ID NO: 2319287 - protein, 24 aa, Cryptosporidium parvum
NRNKGWKLCLDGYAEKFFGSMEFG

SEQ ID NO: 2319288 - protein, 28 aa, Cryptosporidium parvum
NRNQLTKLDFPLFRAGTTSIECGMSLME

SEQ ID NO: 2319289 - protein, 19 aa, Cryptosporidium parvum
NRNRLKLLLSWLEERVQEG

SEQ ID NO: 2319290 - protein, 34 aa, Cryptosporidium parvum
NRNTIWTYSEIRMFIEKYLMYPKDFRRIASFMEY

SEQ ID NO: 2319291 - protein, 27 aa, Cryptosporidium parvum
NRPKLLIHNIIFGKLWIEIVGISTIIN

SEQ ID NO: 2319292 - protein, 23 aa, Cryptosporidium parvum
NRQVIAPVWYSLSMLESIDVDPV

SEQ ID NO: 2319293 - protein, 27 aa, Cryptosporidium parvum
NRRAKRYALEICQWLDGILKDESVDES

SEQ ID NO: 2319294 - protein, 27 aa, Cryptosporidium parvum
NRRPVVHRYICRICIPRVNRMPALQNR

SEQ ID NO: 2319295 - protein, 19 aa, Cryptosporidium parvum
NRRREIFWNSYFLTRLCRN

SEQ ID NO: 2319296 - protein, 21 aa, Cryptosporidium parvum
NRSFPIICLLLFERRVRSKSD

SEQ ID NO: 2319297 - protein, 23 aa, Cryptosporidium parvum
NRSKWISFIVRNVPFRDSTKKSL

SEQ ID NO: 2319298 - protein, 28 aa, Cryptosporidium parvum
NRVGELYSLVRFIGFHPYAYNFCNKVDC

SEQ ID NO: 2319299 - protein, 18 aa, Cryptosporidium parvum
NRVQYILNRVHKLTNLEI

SEQ ID NO: 2319300 - protein, 41 aa, Cryptosporidium parvum
NRWEIVLSNIQYLSLFSPRIPSFLFNLMTYILESPCLNEKI

SEQ ID NO: 2319301 - protein, 21 aa, Cryptosporidium parvum
NRYEGYWENDRRHGKGIFYCA

SEQ ID NO: 2319302 - protein, 20 aa, Cryptosporidium parvum
NRYFPPDFDPKKLEESKKLL

SEQ ID NO: 2319303 - protein, 23 aa, Cryptosporidium parvum
NRYYFGYYLCDHTTFLSNICVEC

SEQ ID NO: 2319304 - protein, 25 aa, Cryptosporidium parvum
NSAFKLIPIDFLKMDFNNHPINLIN

SEQ ID NO: 2319305 - protein, 23 aa, Cryptosporidium parvum
NSAIFGLCWCNNDSFLLSGCLDR

SEQ ID NO: 2319306 - protein, 27 aa, Cryptosporidium parvum
NSANGTNLLWRIIKKIVANVQLEIQDI

SEQ ID NO: 2319307 - protein, 23 aa, Cryptosporidium parvum
NSCGTRMRFLLQVYAPQDDREDL

SEQ ID NO: 2319308 - protein, 18 aa, Cryptosporidium parvum
NSCMSLSNSTSRPLLESN

SEQ ID NO: 2319309 - protein, 23 aa, Cryptosporidium parvum
NSDDFCFLLSTKAGGLGINLTTA

SEQ ID NO: 2319310 - protein, 32 aa, Cryptosporidium parvum
NSDEIHLHSVIYFPCILLDEIDKKGKKQWILG

SEQ ID NO: 2319311 - protein, 25 aa, Cryptosporidium parvum
NSDEVELVLSFPLIGSSRSIDTLKN

SEQ ID NO: 2319312 - protein, 41 aa, Cryptosporidium parvum
NSDGFIYSFGKIYLGYNIHKILLSIIDLYDLILDEESKVFQ

SEQ ID NO: 2319313 - protein, 25 aa, Cryptosporidium parvum
NSDLNYLKYIGIKSLSKIALIDPSY

SEQ ID NO: 2319314 - protein, 23 aa, Cryptosporidium parvum
NSDSRFKIILEDTPHILITSSKD

SEQ ID NO: 2319315 - protein, 19 aa, Cryptosporidium parvum
NSDWIKRCMKIGNYISNKY

SEQ ID NO: 2319316 - protein, 30 aa, Cryptosporidium parvum; identical to SEQ ID NO: 2194873

SEQ ID NO: 2319317 - protein, 29 aa, Cryptosporidium parvum
NSEGEIYYYPGYFFQRIICSLSQFFTSSF

SEQ ID NO: 2319318 - protein, 24 aa, Cryptosporidium parvum
NSEIHLRCLLLSNMFTEQSIKESM

SEQ ID NO: 2319319 - protein, 29 aa, Cryptosporidium parvum
NSEKLKFVTLIESKLLKDIKDFLANQKSC

SEQ ID NO: 2319320 - protein, 21 aa, Cryptosporidium parvum
NSELEFLIDASKFYSLICPSL

SEQ ID NO: 2319321 - protein, 26 aa, Cryptosporidium parvum
NSELFIFDIISSNLLDWVKFKSPAIC

SEQ ID NO: 2319322 - protein, 27 aa, Cryptosporidium parvum
NSFGKYGKILNMRILPNNNDTCSAFIT

SEQ ID NO: 2319323 - protein, 26 aa, Cryptosporidium parvum
NSFGTYLMDAIWWFETEQPIVALTID

SEQ ID NO: 2319324 - protein, 22 aa, Cryptosporidium parvum
NSFISGILWLNPSDTFMDIKRK

SEQ ID NO: 2319325 - protein, 22 aa, Cryptosporidium parvum
NSFKLHRLPVPRPGQVLGLVGT

SEQ ID NO: 2319326 - protein, 18 aa, Cryptosporidium parvum
NSFLPPDIQIDTGIGNTN

SEQ ID NO: 2319327 - protein, 17 aa, Cryptosporidium parvum
NSFLSLEDSFRSVSEYN

SEQ ID NO: 2319328 - protein, 18 aa, Cryptosporidium parvum
NSFPIQIPVFFSQNIQHI

SEQ ID NO: 2319329 - protein, 28 aa, Cryptosporidium parvum
NSFPPALERSFLHFLRTFKNEEGIPKYV

SEQ ID NO: 2319330 - protein, 24 aa, Cryptosporidium parvum
NSFSFSLIRIMFKKRNVSKEQIRK

SEQ ID NO: 2319331 - protein, 23 aa, Cryptosporidium parvum
NSFTPINLIFRLNINTLKSELSK

SEQ ID NO: 2319332 - protein, 36 aa, Cryptosporidium parvum
NSGEILGFSLLFMHNYWQYQGLLLSIRRSIIDGILE

SEQ ID NO: 2319333 - protein, 26 aa, Cryptosporidium parvum
NSGFKKSIILSYLVSSGYLDLNEGVE

SEQ ID NO: 2319334 - protein, 28 aa, Cryptosporidium parvum
NSGLPNGISLFVHLLDLMKFQTRIIEEF

SEQ ID NO: 2319335 - protein, 30 aa, Cryptosporidium parvum
NSGRLHWLRVMYHYLDTVDARKIREVNKGD

SEQ ID NO: 2319336 - protein, 23 aa, Cryptosporidium parvum
NSHFRMLCRIISKKTELWTEMVV

SEQ ID NO: 2319337 - protein, 23 aa, Cryptosporidium parvum
NSHKKWKLYVFKYNYPHDVGKND

SEQ ID NO: 2319338 - protein, 17 aa, Cryptosporidium parvum
NSIADELALLLKKFIDV

SEQ ID NO: 2319339 - protein, 24 aa, Cryptosporidium parvum
NSIAFPIIISLIRLIKISEKWCMI

SEQ ID NO: 2319340 - protein, 25 aa, Cryptosporidium parvum
NSIDYIEIMPILEPLKNIISSLNYM

SEQ ID NO: 2319341 - protein, 17 aa, Cryptosporidium parvum
NSIEYWFNRCCLYLSNN

SEQ ID NO: 2319342 - protein, 25 aa, Cryptosporidium parvum
NSIFIENCVGCIFLVNGVISSIEIV

SEQ ID NO: 2319343 - protein, 30 aa, Cryptosporidium parvum
NSILKDDLHLLYFYPQYKLSIDTKLINKLK

SEQ ID NO: 2319344 - protein, 21 aa, Cryptosporidium parvum
NSIPLESFIITKTLTKLPQFY

SEQ ID NO: 2319345 - protein, 19 aa, Cryptosporidium parvum
NSIPLFRNRFFESFEKSRS

SEQ ID NO: 2319346 - protein, 31 aa, Cryptosporidium parvum; identical to SEQ ID NO: 2194892

SEQ ID NO: 2319347 - protein, 28 aa, Cryptosporidium parvum
NSITELWSLLNFLLPQVFHSVEDFQVWF

SEQ ID NO: 2319348 - protein, 22 aa, Cryptosporidium parvum
NSITIMYGLETILFEKFEYEVK

SEQ ID NO: 2319349 - protein, 19 aa, Cryptosporidium parvum
NSIVIYPYVLSLSNRPKKE

SEQ ID NO: 2319350 - protein, 20 aa, Cryptosporidium parvum
NSKELMWKCLVCNQVFESRN

SEQ ID NO: 2319351 - protein, 22 aa, Cryptosporidium parvum
NSKGFILLGVTNQGLLFSQGLK

SEQ ID NO: 2319352 - protein, 22 aa, Cryptosporidium parvum
NSKISICNLSFDKLPNITEKNG

SEQ ID NO: 2319353 - protein, 23 aa, Cryptosporidium parvum
NSKKLVRRISRKKIANRNIHNVL

SEQ ID NO: 2319354 - protein, 29 aa, Cryptosporidium parvum
NSKLQYEILIQLRDAWINALRSNAVDTKD

SEQ ID NO: 2319355 - protein, 31 aa, Cryptosporidium parvum; identical to SEQ ID NO: 2194898

SEQ ID NO: 2319356 - protein, 22 aa, Cryptosporidium parvum
NSKSGPRIPRTTRHDPELIEHE

SEQ ID NO: 2319357 - protein, 18 aa, Cryptosporidium parvum
NSKVFDWTGKFLASFEFF

SEQ ID NO: 2319358 - protein, 23 aa, Cryptosporidium parvum
NSKVNSLDWSRCDRFLLTASNDM

SEQ ID NO: 2319359 - protein, 24 aa, Cryptosporidium parvum
NSKVQITSLFYLLGSDLIPVNQVK

SEQ ID NO: 2319360 - protein, 25 aa, Cryptosporidium parvum
NSKYSLTYFFPLISCLDINEAKKQK

SEQ ID NO: 2319361 - protein, 24 aa, Cryptosporidium parvum
NSKYYILVGTPGRIFHLFENLKDG

SEQ ID NO: 2319362 - protein, 18 aa, Cryptosporidium parvum
NSLCLLDYDTGIRPFMPY

SEQ ID NO: 2319363 - protein, 20 aa, Cryptosporidium parvum
NSLCPIIKPLINKPYLYSQI

SEQ ID NO: 2319364 - protein, 28 aa, Cryptosporidium parvum
NSLELVKNMHIPVFPPYQSKNDINFNKT

SEQ ID NO: 2319365 - protein, 28 aa, Cryptosporidium parvum
NSLITRIYGLHALRFKKPLLQPFNTIRE

SEQ ID NO: 2319366 - protein, 22 aa, Cryptosporidium parvum
NSLKNFRMQTITILSSMYEVIN

SEQ ID NO: 2319367 - protein, 26 aa, Cryptosporidium parvum
NSLLEWFGVIIIPKTFSLSLLISRDD

SEQ ID NO: 2319368 - protein, 21 aa, Cryptosporidium parvum
NSLLKVYPYNFFPSNSIPNDS

SEQ ID NO: 2319369 - protein, 34 aa, Cryptosporidium parvum
NSLPTSLFRIPITAPFRKLIRYFRDVAAIHEGII

SEQ ID NO: 2319370 - protein, 19 aa, Cryptosporidium parvum
NSLYICEEFLLFGSSGQEV

SEQ ID NO: 2319371 - protein, 24 aa, Cryptosporidium parvum
NSMRCKMNFLYLKVSTFEEYDVEL

SEQ ID NO: 2319372 - protein, 32 aa, Cryptosporidium parvum; identical to SEQ ID NO: 2194912

SEQ ID NO: 2319373 - protein, 23 aa, Cryptosporidium parvum
NSNDVCVGILNFVDLAGSESIKR

SEQ ID NO: 2319374 - protein, 25 aa, Cryptosporidium parvum
NSNENFFMCLKWPESLSVTPEAEDV

SEQ ID NO: 2319375 - protein, 23 aa, Cryptosporidium parvum
NSNFLGYHMIDDYFPRYSIIPNK

SEQ ID NO: 2319376 - protein, 23 aa, Cryptosporidium parvum
NSNIPVLIGVLYSSKESGSILKK

SEQ ID NO: 2319377 - protein, 28 aa, Cryptosporidium parvum
NSNKVSIPYFFFSKLGSPFDLIDVNKII

SEQ ID NO: 2319378 - protein, 31 aa, Cryptosporidium parvum
NSNNIPSFTGFVSNIKSFFNDERSNPVVDWN

SEQ ID NO: 2319379 - protein, 28 aa, Cryptosporidium parvum
NSNNTVQDYRFLPKPTFRIEDNNLYSNL

SEQ ID NO: 2319380 - protein, 25 aa, Cryptosporidium parvum
NSNRYLPPPSLPYSSTSRDGERSQN

SEQ ID NO: 2319381 - protein, 23 aa, Cryptosporidium parvum
NSNSQLLDINPVNFFSSSRNKLD

SEQ ID NO: 2319382 - protein, 24 aa, Cryptosporidium parvum
NSNTPFPIMLSVGKVMEQMELLHQ

SEQ ID NO: 2319383 - protein, 26 aa, Cryptosporidium parvum
NSNYADYYRNPYLPVHAGGVPSQQIY

SEQ ID NO: 2319384 - protein, 28 aa, Cryptosporidium parvum
NSNYNSFFYNINMLTLPYNNLSEEPSEV

SEQ ID NO: 2319385 - protein, 22 aa, Cryptosporidium parvum
NSPFQVCVFAPNLLLGCVMTYP

SEQ ID NO: 2319386 - protein, 24 aa, Cryptosporidium parvum
NSPGNLTILVFWDIQKKVDAKVHK

SEQ ID NO: 2319387 - protein, 17 aa, Cryptosporidium parvum
NSPLNRNLADYLSYGII

SEQ ID NO: 2319388 - protein, 28 aa, Cryptosporidium parvum
NSPRHIRMLFLLHKWDAPMNYSPETSLQ

SEQ ID NO: 2319389 - protein, 29 aa, Cryptosporidium parvum
NSPYKLNQLDLVRPIYFISSVTGESNIPS

SEQ ID NO: 2319390 - protein, 19 aa, Cryptosporidium parvum
NSQFITLIISLSNTPEFVK

SEQ ID NO: 2319391 - protein, 31 aa, Cryptosporidium parvum
NSQIPLLRVSLPNKLFCIFSAPMDMDVLRLK

SEQ ID NO: 2319392 - protein, 23 aa, Cryptosporidium parvum
NSQLHGHNAFPVSFPTPVNRSIS

SEQ ID NO: 2319393 - protein, 18 aa, Cryptosporidium parvum
NSQMIRDVINWMKERQGE

SEQ ID NO: 2319394 - protein, 25 aa, Cryptosporidium parvum
NSQPPKISIPFYRDNKHSKKSSNIP

SEQ ID NO: 2319395 - protein, 24 aa, Cryptosporidium parvum
NSQSQYILAIFGVARNRRAAELRV

SEQ ID NO: 2319396 - protein, 26 aa, Cryptosporidium parvum
NSQTQQIWSIYSLCNHNSKFENFEIC

SEQ ID NO: 2319397 - protein, 22 aa, Cryptosporidium parvum
NSQVFPSLDLSIEEYRWKFYQS

SEQ ID NO: 2319398 - protein, 20 aa, Cryptosporidium parvum
NSQWAIWRVVPQRKIPINED

SEQ ID NO: 2319399 - protein, 25 aa, Cryptosporidium parvum
NSRRLILEQLKIATSILPLKRFEAV

SEQ ID NO: 2319400 - protein, 19 aa, Cryptosporidium parvum
NSRSITYTVPSLRVKLRRD

SEQ ID NO: 2319401 - protein, 24 aa, Cryptosporidium parvum
NSRSNQFCFVPNGLEIVGFNSTEL

SEQ ID NO: 2319402 - protein, 24 aa, Cryptosporidium parvum
NSSDFQYFQQLIIKGFLASRKHVD

SEQ ID NO: 2319403 - protein, 27 aa, Cryptosporidium parvum
NSSDVIWLIDSLNTFGLAITLFEDISV

SEQ ID NO: 2319404 - protein, 18 aa, Cryptosporidium parvum
NSSKWPRLSYKDSPLKKT

SEQ ID NO: 2319405 - protein, 23 aa, Cryptosporidium parvum
NSSLEAFIVCRYFKFDDQDSTNV

SEQ ID NO: 2319406 - protein, 27 aa, Cryptosporidium parvum
NSSLKLEQLFHLLINCYPDMSNMFKIA

SEQ ID NO: 2319407 - protein, 20 aa, Cryptosporidium parvum
NSSLNWIWRYNGVVIDTRNI

SEQ ID NO: 2319408 - protein, 22 aa, Cryptosporidium parvum
NSSLTINRYLSIFFKVLNNNET

SEQ ID NO: 2319409 - protein, 26 aa, Cryptosporidium parvum
NSSLWNSFELILRPELKKLNFNIENI

SEQ ID NO: 2319410 - protein, 25 aa, Cryptosporidium parvum
NSSNLNGWRFKYYKGLGTSTDLEFK

SEQ ID NO: 2319411 - protein, 24 aa, Cryptosporidium parvum
NSSNWKEWNSYSKLLPLAVVELDV

SEQ ID NO: 2319412 - protein, 33 aa, Cryptosporidium parvum
NSSPLITHPLLFRLQLLIWSLKLKQFLNHDGLY

SEQ ID NO: 2319413 - protein, 33 aa, Cryptosporidium parvum; identical to SEQ ID NO: 2194943

SEQ ID NO: 2319414 - protein, 20 aa, Cryptosporidium parvum
NSTFHLPYNFKEVPEPKIRS

SEQ ID NO: 2319415 - protein, 21 aa, Cryptosporidium parvum
NSTFYNDLYVFEVNNKRWYEI

SEQ ID NO: 2319416 - protein, 26 aa, Cryptosporidium parvum
NSTSCPSCYFSWLRLINSKNGDDNNS

SEQ ID NO: 2319417 - protein, 24 aa, Cryptosporidium parvum
NSTSSILFSVWNQLFRGNSRIESD

SEQ ID NO: 2319418 - protein, 23 aa, Cryptosporidium parvum
NSTYIKFWEVTTGQIYILKNRFI

SEQ ID NO: 2319419 - protein, 33 aa, Cryptosporidium parvum; identical to SEQ ID NO: 2194948

SEQ ID NO: 2319420 - protein, 25 aa, Cryptosporidium parvum
NSVHTNFWLRLKGKEKRIISRNAMK

SEQ ID NO: 2319421 - protein, 20 aa, Cryptosporidium parvum
NSVLSFFDFFSENISDDIDI

SEQ ID NO: 2319422 - protein, 20 aa, Cryptosporidium parvum
NSVLYLIDKISSYNPKLCIP

SEQ ID NO: 2319423 - protein, 18 aa, Cryptosporidium parvum
NSVNSNGRRNFKGSPGKI

SEQ ID NO: 2319424 - protein, 28 aa, Cryptosporidium parvum
NSVSVPVAIPAPGCIPIVGGCGTVGVGA

SEQ ID NO: 2319425 - protein, 20 aa, Cryptosporidium parvum
NSWVGLLRPNGIFSRFDCCN

SEQ ID NO: 2319426 - protein, 20 aa, Cryptosporidium parvum
NSYDALYEKMVWLHPSNQSI

SEQ ID NO: 2319427 - protein, 24 aa, Cryptosporidium parvum
NSYFIKPYYVIKQLEGIEEGGGSN

SEQ ID NO: 2319428 - protein, 29 aa, Cryptosporidium parvum
NSYFKSNPIFLKLFFYINQGVIFIKDPEI

SEQ ID NO: 2319429 - protein, 22 aa, Cryptosporidium parvum
NSYIEPFLIVSTLLESSVSIKQ

SEQ ID NO: 2319430 - protein, 32 aa, Cryptosporidium parvum
NSYQGVQPPVCPVSLLPPIPHPPPGRHTMFWD

SEQ ID NO: 2319431 - protein, 18 aa, Cryptosporidium parvum
NTAFIPIFNKNDNINILI

SEQ ID NO: 2319432 - protein, 28 aa, Cryptosporidium parvum
NTCIKNILLYPSFSLLNLSPAIMDIKFK

SEQ ID NO: 2319433 - protein, 17 aa, Cryptosporidium parvum
NTDIYLRERDRGVLANK

SEQ ID NO: 2319434 - protein, 45 aa, Cryptosporidium parvum
NTEIPLIEDLILRLHYHFPLDIGIISPILLNYYKLNTGDAVFIGA

SEQ ID NO: 2319435 - protein, 34 aa, Cryptosporidium parvum
NTENKLLSCKIPLHYILTLYIRSRIRRIREKLGN

SEQ ID NO: 2319436 - protein, 18 aa, Cryptosporidium parvum
NTEPGFIVALSSFLTQIA

SEQ ID NO: 2319437 - protein, 27 aa, Cryptosporidium parvum
NTEYSIPFDIRFSKLRKGFSSQNGRAT

SEQ ID NO: 2319438 - protein, 21 aa, Cryptosporidium parvum
NTFITFEDLFRRNIYNSIESF

SEQ ID NO: 2319439 - protein, 17 aa, Cryptosporidium parvum
NTFNIRDEMLEKKVQTL

SEQ ID NO: 2319440 - protein, 18 aa, Cryptosporidium parvum
NTFQTKFCIATKKKIIFY

SEQ ID NO: 2319441 - protein, 24 aa, Cryptosporidium parvum
NTGILKRVLIPQKFDLFQTSESKF

SEQ ID NO: 2319442 - protein, 21 aa, Cryptosporidium parvum
NTGISFFSFNNLGGAYKIATL

SEQ ID NO: 2319443 - protein, 26 aa, Cryptosporidium parvum
NTGKISSTLPLILLGGERGKIELWDL

SEQ ID NO: 2319444 - protein, 17 aa, Cryptosporidium parvum
NTGMIIGKEENIVFGRL

SEQ ID NO: 2319445 - protein, 20 aa, Cryptosporidium parvum
NTIDYKIWLAKCIDLSQMDE

SEQ ID NO: 2319446 - protein, 25 aa, Cryptosporidium parvum
NTIKIKCYLIWSIKFEIIKKKKRLK

SEQ ID NO: 2319447 - protein, 24 aa, Cryptosporidium parvum
NTIRGHCKLFGKLKIVLLEGRYFV

SEQ ID NO: 2319448 - protein, 22 aa, Cryptosporidium parvum
NTIYPLLRRRLTLNDLISVPDI

SEQ ID NO: 2319449 - protein, 29 aa, Cryptosporidium parvum
NTKNFLIQPQLENKPLLGKGFNINKSNLR

SEQ ID NO: 2319450 - protein, 17 aa, Cryptosporidium parvum
NTKVFWTWGVLDGEISF

SEQ ID NO: 2319451 - protein, 18 aa, Cryptosporidium parvum
NTLFGRSIDRINSTAFLM

SEQ ID NO: 2319452 - protein, 26 aa, Cryptosporidium parvum
NTLNREICLFYLPLNLPCMYSVPFIE

SEQ ID NO: 2319453 - protein, 18 aa, Cryptosporidium parvum
NTLTTTFLLTNENMVSEA

SEQ ID NO: 2319454 - protein, 24 aa, Cryptosporidium parvum
NTLYTLPYNTLVLNMNMLLQSKGF

SEQ ID NO: 2319455 - protein, 26 aa, Cryptosporidium parvum
NTMDDRWFISKLSSGSFFGILDGYNG

SEQ ID NO: 2319456 - protein, 29 aa, Cryptosporidium parvum
NTNLSISYLSLSIPIFKPLQRNISKYSNV

SEQ ID NO: 2319457 - protein, 29 aa, Cryptosporidium parvum
NTNNKIIIPKPFPGLISKVSVPWKRVKTS

SEQ ID NO: 2319458 - protein, 24 aa, Cryptosporidium parvum
NTNSSFFILLRELLKRNADFSSSE

SEQ ID NO: 2319459 - protein, 29 aa, Cryptosporidium parvum
NTNTQLFNSSAFPPLTSALIKQIPSSKDS

SEQ ID NO: 2319460 - protein, 32 aa, Cryptosporidium parvum
NTNYRKISVIFWRKVWINIYKIVHGKLELSQI

SEQ ID NO: 2319461 - protein, 17 aa, Cryptosporidium parvum
NTPFINKINCDYVSNNR

SEQ ID NO: 2319462 - protein, 25 aa, Cryptosporidium parvum
NTPKVIEIPFPLLVSKFSYEEEQYS

SEQ ID NO: 2319463 - protein, 27 aa, Cryptosporidium parvum
NTPNINLLPWEILSRALPLDLGIDFNS

SEQ ID NO: 2319464 - protein, 26 aa, Cryptosporidium parvum
NTPSRFIRYIFNRLILESSAVRAASI

SEQ ID NO: 2319465 - protein, 25 aa, Cryptosporidium parvum
NTQEFFDGIFKFYKKQFSDEELELA

SEQ ID NO: 2319466 - protein, 28 aa, Cryptosporidium parvum
NTQKFRFYPKYILIGHEAIIWSIDTLWE

SEQ ID NO: 2319467 - protein, 36 aa, Cryptosporidium parvum
NTQLKKSAWEYFDSLHSKLINLAGFHNPDECSICKD

SEQ ID NO: 2319468 - protein, 24 aa, Cryptosporidium parvum
NTQYKVFNFRKSISTLKFLCDRNS

SEQ ID NO: 2319469 - protein, 24 aa, Cryptosporidium parvum
NTRCILGMMSMENTAILSVRTEYA

SEQ ID NO: 2319470 - protein, 26 aa, Cryptosporidium parvum
NTRKLLPGMYVTISGVFLPVVKEGFQ

SEQ ID NO: 2319471 - protein, 22 aa, Cryptosporidium parvum
NTRLTFFRYIQILDKGEWIYHP

SEQ ID NO: 2319472 - protein, 24 aa, Cryptosporidium parvum
NTSDHVFLGPKLDDGHAFFANSRG

SEQ ID NO: 2319473 - protein, 17 aa, Cryptosporidium parvum
NTSEFIKFSWLPPKLDN

SEQ ID NO: 2319474 - protein, 23 aa, Cryptosporidium parvum
NTSKARISFRMLESMIPASLKKR

SEQ ID NO: 2319475 - protein, 24 aa, Cryptosporidium parvum
NTSNFVVVFIRKSKDKAFLCVVNM

SEQ ID NO: 2319476 - protein, 25 aa, Cryptosporidium parvum
NTTVCSIWKIERLIGGGSFGDIYLA

SEQ ID NO: 2319477 - protein, 25 aa, Cryptosporidium parvum
NTVRLVDASFIWTEPHSRRLKVKCT

SEQ ID NO: 2319478 - protein, 21 aa, Cryptosporidium parvum
NTYMKFISNLLIIPNVNQLNF

SEQ ID NO: 2319479 - protein, 25 aa, Cryptosporidium parvum
NTYRSGNLPILYNENNMLRCESNML

SEQ ID NO: 2319480 - protein, 18 aa, Cryptosporidium parvum
NVCIKLLDLLINDLIDSL

SEQ ID NO: 2319481 - protein, 25 aa, Cryptosporidium parvum
NVCLTTFDFIIRESGALQSMQWKHI

SEQ ID NO: 2319482 - protein, 18 aa, Cryptosporidium parvum
NVDFLFSNDYFNTSYRGG

SEQ ID NO: 2319483 - protein, 21 aa, Cryptosporidium parvum
NVDILYICEFCLSFFAHSDEY

SEQ ID NO: 2319484 - protein, 27 aa, Cryptosporidium parvum
NVDINEYFRLLFEFNKNGVHFVNIIQG

SEQ ID NO: 2319485 - protein, 31 aa, Cryptosporidium parvum; identical to SEQ ID NO: 2195007

SEQ ID NO: 2319486 - protein, 23 aa, Cryptosporidium parvum
NVEFRLYGRLFTLPEPENQDKDW

SEQ ID NO: 2319487 - protein, 25 aa, Cryptosporidium parvum
NVERKLSIQLLRFPEVFDGILNDFF

SEQ ID NO: 2319488 - protein, 25 aa, Cryptosporidium parvum
NVGDSFLEYRFKIASLLWDNHISCE

SEQ ID NO: 2319489 - protein, 26 aa, Cryptosporidium parvum
NVGGIPFLLNLRHFYQFNFITQRHRR

SEQ ID NO: 2319490 - protein, 28 aa, Cryptosporidium parvum
NVGPDEFTLIPLPYPDFSMIAKTRGITK

SEQ ID NO: 2319491 - protein, 29 aa, Cryptosporidium parvum
NVHKGLYISWHPKTRRFVVALKSCESGKT

SEQ ID NO: 2319492 - protein, 32 aa, Cryptosporidium parvum; identical to SEQ ID NO: 2195016

SEQ ID NO: 2319493 - protein, 21 aa, Cryptosporidium parvum
NVHWTLGVVNFKLGYIQYIDS

SEQ ID NO: 2319494 - protein, 18 aa, Cryptosporidium parvum
NVHYHKNYKRWIKTWYNQ

SEQ ID NO: 2319495 - protein, 21 aa, Cryptosporidium parvum
NVIATCMKFLTNTVLIIGGFF

SEQ ID NO: 2319496 - protein, 17 aa, Cryptosporidium parvum
NVIHCLSPFLAMNQGNS

SEQ ID NO: 2319497 - protein, 24 aa, Cryptosporidium parvum
NVIIVPCNLLPYKSSLNNAYSECT

SEQ ID NO: 2319498 - protein, 19 aa, Cryptosporidium parvum
NVIKGKYVINPIISTEKET

SEQ ID NO: 2319499 - protein, 25 aa, Cryptosporidium parvum
NVILRLVPRLDVPALIRKSQNSQDV

SEQ ID NO: 2319500 - protein, 21 aa, Cryptosporidium parvum
NVKKWEGITIKYKGPLKEFRG

SEQ ID NO: 2319501 - protein, 49 aa, Cryptosporidium parvum
NVKRPKFVEFFFDSSIPIFFPSRQLIWPTSLHFLLAQFFSNYSEVRECK

SEQ ID NO: 2319502 - protein, 21 aa, Cryptosporidium parvum
NVLFRFKPMHHYNIYQLSSEM

SEQ ID NO: 2319503 - protein, 21 aa, Cryptosporidium parvum
NVMDLLFHQSFVCTVMSGVNP

SEQ ID NO: 2319504 - protein, 20 aa, Cryptosporidium parvum
NVMFDCGVLPYLVKCMSSEI

SEQ ID NO: 2319505 - protein, 22 aa, Cryptosporidium parvum
NVMHPLPSVCCYIPNTNNSCID

SEQ ID NO: 2319506 - protein, 22 aa, Cryptosporidium parvum
NVMKTLTLLKSHYLPSSATRGQ

SEQ ID NO: 2319507 - protein, 21 aa, Cryptosporidium parvum
NVMPEDFEYILKSTNILLNEL

SEQ ID NO: 2319508 - protein, 24 aa, Cryptosporidium parvum
NVNACMDISGYVSDLSLKNVTTGT

SEQ ID NO: 2319509 - protein, 17 aa, Cryptosporidium parvum
NVNFKYKSSLREKDTLI

SEQ ID NO: 2319510 - protein, 29 aa, Cryptosporidium parvum
NVNLQFKHYFSIFWSKTMRPHLKFDHDKS

SEQ ID NO: 2319511 - protein, 25 aa, Cryptosporidium parvum
NVNSNLLLPGFAGLGNFGNIPNFGN

SEQ ID NO: 2319512 - protein, 24 aa, Cryptosporidium parvum
NVPTKHLYLYLSELLKLNGLGEEI

SEQ ID NO: 2319513 - protein, 23 aa, Cryptosporidium parvum
NVPTRIWLLWSNEVVLQLFNEKE

SEQ ID NO: 2319514 - protein, 23 aa, Cryptosporidium parvum
NVQDKIYWTYKIKGLAMGKKFQE

SEQ ID NO: 2319515 - protein, 17 aa, Cryptosporidium parvum
NVQFIIPNFYPNVRSII

SEQ ID NO: 2319516 - protein, 26 aa, Cryptosporidium parvum
NVQNKAVFVPLRRDNPITYGTYFQYN

SEQ ID NO: 2319517 - protein, 27 aa, Cryptosporidium parvum
NVQSQMFPRQVPIPRVGVMGKPPGLGT

SEQ ID NO: 2319518 - protein, 20 aa, Cryptosporidium parvum
NVRKWTVSALVLKFIRLTLS

SEQ ID NO: 2319519 - protein, 28 aa, Cryptosporidium parvum
NVRMDTLGYVLYYPQKPLVTTRAMTYMR

SEQ ID NO: 2319520 - protein, 23 aa, Cryptosporidium parvum
NVRMQLHDIVPLKWEYLDDNNVI

SEQ ID NO: 2319521 - protein, 22 aa, Cryptosporidium parvum
NVRRVFAWHPLTKSYSPCLCLK

SEQ ID NO: 2319522 - protein, 27 aa, Cryptosporidium parvum
NVSEVPILLRIFSKKAINLTLVDLPGL

SEQ ID NO: 2319523 - protein, 23 aa, Cryptosporidium parvum
NVSIIIMLINSFLIDFYESQRFS

SEQ ID NO: 2319524 - protein, 36 aa, Cryptosporidium parvum
NVSTSSIFTPLSTKTRFLPILPTSPRKEMYENLKSN

SEQ ID NO: 2319525 - protein, 22 aa, Cryptosporidium parvum
NVSVLDFDVPFSLKFGAFDDLV

SEQ ID NO: 2319526 - protein, 17 aa, Cryptosporidium parvum
NVTFLKNVILRPSIDRW

SEQ ID NO: 2319527 - protein, 31 aa, Cryptosporidium parvum; identical to SEQ ID NO: 2195044

SEQ ID NO: 2319528 - protein, 18 aa, Cryptosporidium parvum
NVVITAPCWIPSSTLSKV

SEQ ID NO: 2319529 - protein, 17 aa, Cryptosporidium parvum
NVVLLLKSLGSEDVFSF

SEQ ID NO: 2319530 - protein, 19 aa, Cryptosporidium parvum
NVVLPKLEDGMNYILRELD

SEQ ID NO: 2319531 - protein, 17 aa, Cryptosporidium parvum
NVYKYLVYILTMGVVEE

SEQ ID NO: 2319532 - protein, 17 aa, Cryptosporidium parvum
NWCSNIEKKPYFPIFLL

SEQ ID NO: 2319533 - protein, 32 aa, Cryptosporidium parvum
NWDARAYCRLLYSLSCISFGIPMVFMGTENLQ

SEQ ID NO: 2319534 - protein, 24 aa, Cryptosporidium parvum
NWERTVLKYFIFGGAIRVKINIKS

SEQ ID NO: 2319535 - protein, 17 aa, Cryptosporidium parvum
NWFALLVSIVIGSNIHL

SEQ ID NO: 2319536 - protein, 19 aa, Cryptosporidium parvum
NWFDKYHPGYFGKVGMRYF

SEQ ID NO: 2319537 - protein, 17 aa, Cryptosporidium parvum
NWKEIIDLFRFSDKYGI

SEQ ID NO: 2319538 - protein, 22 aa, Cryptosporidium parvum
NWPKVDCLISFYSTGFPLNKAI

SEQ ID NO: 2319539 - protein, 19 aa, Cryptosporidium parvum
NWSFGSNEEFNLLSIFKDD

SEQ ID NO: 2319540 - protein, 19 aa, Cryptosporidium parvum
NWSFGYYKLRPGVINMLRT

SEQ ID NO: 2319541 - protein, 17 aa, Cryptosporidium parvum
NWTEIETPWEWERDFAI

SEQ ID NO: 2319542 - protein, 19 aa, Cryptosporidium parvum
NWVCFVIANTYFIMNIDDQ

SEQ ID NO: 2319543 - protein, 24 aa, Cryptosporidium parvum
NWVEDVIDLLRRLLEKSPSKRISA

SEQ ID NO: 2319544 - protein, 25 aa, Cryptosporidium parvum
NWVKSVCPWDLSLSSNTWKHIHRPT

SEQ ID NO: 2319545 - protein, 27 aa, Cryptosporidium parvum
NWYSINNEILLFLLSSLLQKGMSMNKS

SEQ ID NO: 2319546 - protein, 19 aa, Cryptosporidium parvum
NYAIWKGAQLFSALRDYQE

SEQ ID NO: 2319547 - protein, 26 aa, Cryptosporidium parvum
NYCKWVDHVKFLGLIYPALCQKCITN

SEQ ID NO: 2319548 - protein, 32 aa, Cryptosporidium parvum
NYDDAEFLMFLIDIYIQGVLLFLLEHVESTYS

SEQ ID NO: 2319549 - protein, 25 aa, Cryptosporidium parvum
NYDPSEINLWQYFSRDVFGDFNDEK

SEQ ID NO: 2319550 - protein, 23 aa, Cryptosporidium parvum
NYERLKFVLNWYNKNCINTIELP

SEQ ID NO: 2319551 - protein, 17 aa, Cryptosporidium parvum
NYGCLMAELKEKMVLFR

SEQ ID NO: 2319552 - protein, 20 aa, Cryptosporidium parvum
NYGTNAPIVRAYKATIQTIN

SEQ ID NO: 2319553 - protein, 35 aa, Cryptosporidium parvum
NYGVLFSFLEPFQRSELLLYFVRVLLDGKKYQQAY

SEQ ID NO: 2319554 - protein, 24 aa, Cryptosporidium parvum
NYHEQMYLMFKKINTKEKIIGWYS

SEQ ID NO: 2319555 - protein, 34 aa, Cryptosporidium parvum
NYHYYQALKKAMFKPAAWFKGILLPLAEDESCTI

SEQ ID NO: 2319556 - protein, 32 aa, Cryptosporidium parvum
NYIFGSNTFRIWPTRILLYPASKSQVPNDHKN

SEQ ID NO: 2319557 - protein, 20 aa, Cryptosporidium parvum
NYIIILLGRRHVKAGFSKKM

SEQ ID NO: 2319558 - protein, 20 aa, Cryptosporidium parvum
NYILGHVYMAPDSKSLQIMI

SEQ ID NO: 2319559 - protein, 21 aa, Cryptosporidium parvum
NYINISRIPFWIKQDVDTENK

SEQ ID NO: 2319560 - protein, 18 aa, Cryptosporidium parvum
NYINTGMIIGKEENIVFG

SEQ ID NO: 2319561 - protein, 28 aa, Cryptosporidium parvum
NYKHKRKFPFLYYYGRQPSINNDYGHIR

SEQ ID NO: 2319562 - protein, 18 aa, Cryptosporidium parvum
NYKIVIITLINGSTIQGT

SEQ ID NO: 2319563 - protein, 18 aa, Cryptosporidium parvum
NYLKPYYHKIFFTQNENS

SEQ ID NO: 2319564 - protein, 17 aa, Cryptosporidium parvum
NYLKSRFCGYTFQCSIS

SEQ ID NO: 2319565 - protein, 17 aa, Cryptosporidium parvum
NYLLERAKLFQLNDFFF

SEQ ID NO: 2319566 - protein, 32 aa, Cryptosporidium parvum
NYLSQLNVAVLQQERLRMWARDNAKYTSSISN

SEQ ID NO: 2319567 - protein, 29 aa, Cryptosporidium parvum
NYLVMIRCSIKFFSLYRHIKRKNACIQIC

SEQ ID NO: 2319568 - protein, 27 aa, Cryptosporidium parvum
NYNKIQVLMIINDMIQILLLNINHFNN

SEQ ID NO: 2319569 - protein, 17 aa, Cryptosporidium parvum
NYPKLIDQPYVAIAYFG

SEQ ID NO: 2319570 - protein, 27 aa, Cryptosporidium parvum
NYQIKYYYYHSMTWPQLLDIATDSNDP

SEQ ID NO: 2319571 - protein, 17 aa, Cryptosporidium parvum
NYQYLLNQCLSFVMSSL

SEQ ID NO: 2319572 - protein, 22 aa, Cryptosporidium parvum
NYRQIIFPRLEKIIGKCTNDLV

SEQ ID NO: 2319573 - protein, 34 aa, Cryptosporidium parvum
NYSFKKDILSIFWKFYLDGKFTMVSKKYIYFFFS

SEQ ID NO: 2319574 - protein, 31 aa, Cryptosporidium parvum
NYSFKNILISCKLCKFSFKKPYWEKKIKNTN

SEQ ID NO: 2319575 - protein, 21 aa, Cryptosporidium parvum
NYSIYNSIRRPINLAEYRANY

SEQ ID NO: 2319576 - protein, 28 aa, Cryptosporidium parvum
NYSKLQLCAVPYMLYQINLASVTNKDDA

SEQ ID NO: 2319577 - protein, 27 aa, Cryptosporidium parvum
NYYAVPPAQYILDTSIYSSATPYVAVP

SEQ ID NO: 2319578 - protein, 21 aa, Cryptosporidium parvum
NYYETLSTIDFARRAKKIQNK

SEQ ID NO: 2319579 - protein, 18 aa, Cryptosporidium parvum
NYYRRLESLVFDIFLVRS

SEQ ID NO: 2319580 - protein, 19 aa, Cryptosporidium parvum
PAAKTILVRTYKALRMGDA

SEQ ID NO: 2319581 - protein, 27 aa, Cryptosporidium parvum
PACYLVSRFYRAPEIILGCISYGQPID

SEQ ID NO: 2319582 - protein, 19 aa, Cryptosporidium parvum
PADIFVSIPKFQDLINKLK

SEQ ID NO: 2319583 - protein, 31 aa, Cryptosporidium parvum; identical to SEQ ID NO: 2195101

SEQ ID NO: 2319584 - protein, 20 aa, Cryptosporidium parvum
PAGYGLFRVTNSKLLSMDTD

SEQ ID NO: 2319585 - protein, 32 aa, Cryptosporidium parvum
PAHARGALGVMPLPMQLPPQPPASHSEDNSQI

SEQ ID NO: 2319586 - protein, 17 aa, Cryptosporidium parvum
PAIDLTKIRIRSCKRVV

SEQ ID NO: 2319587 - protein, 21 aa, Cryptosporidium parvum
PAIFSIEYSLTKLWESKGIVP

SEQ ID NO: 2319588 - protein, 24 aa, Cryptosporidium parvum
PAIYNDFLMLLSKYKDGEKSVNEV

SEQ ID NO: 2319589 - protein, 23 aa, Cryptosporidium parvum
PALERFCEFFKSPLFSEEYLQNE

SEQ ID NO: 2319590 - protein, 19 aa, Cryptosporidium parvum
PALIRPGRIDRKIELPNPD

SEQ ID NO: 2319591 - protein, 27 aa, Cryptosporidium parvum
PAMIHIRAQPLLRYGDGPICLVLAPTR

SEQ ID NO: 2319592 - protein, 19 aa, Cryptosporidium parvum
PAMMGVCASKLACACLMLA

SEQ ID NO: 2319593 - protein, 30 aa, Cryptosporidium parvum; identical to SEQ ID NO: 2195107

SEQ ID NO: 2319594 - protein, 23 aa, Cryptosporidium parvum
PAPARQGVIAPCNVVVPAGATGL

SEQ ID NO: 2319595 - protein, 26 aa, Cryptosporidium parvum
PAPVEESSWFSSWFGGTTEPAKVNDL

SEQ ID NO: 2319596 - protein, 27 aa, Cryptosporidium parvum
PAQEIACDMLFACIPKSLTNVGERLKR

SEQ ID NO: 2319597 - protein, 25 aa, Cryptosporidium parvum
PAQINDIIFLKSALELLHPFEYDNM

SEQ ID NO: 2319598 - protein, 30 aa, Cryptosporidium parvum; identical to SEQ ID NO: 2195110

SEQ ID NO: 2319599 - protein, 17 aa, Cryptosporidium parvum
PAVVRAIPRVNKRYAKP

SEQ ID NO: 2319600 - protein, 22 aa, Cryptosporidium parvum
PCGRAITLFDHNGMAVATTTST

SEQ ID NO: 2319601 - protein, 17 aa, Cryptosporidium parvum
PCHKSLINYMILRKNAE

SEQ ID NO: 2319602 - protein, 17 aa, Cryptosporidium parvum
PCMILRRKIQKTVKKIA

SEQ ID NO: 2319603 - protein, 18 aa, Cryptosporidium parvum
PCSYLLINSNFKTNRYLR

SEQ ID NO: 2319604 - protein, 20 aa, Cryptosporidium parvum
PCVTIEWYPGGRRLVVGTVG

SEQ ID NO: 2319605 - protein, 17 aa, Cryptosporidium parvum
PCYDVIPPKFINAIVTE

SEQ ID NO: 2319606 - protein, 20 aa, Cryptosporidium parvum
PDAPRHLLQSRTNHFPEEGL

SEQ ID NO: 2319607 - protein, 26 aa, Cryptosporidium parvum
PDEFKNPSSFLKIYGDPLCGKQPSNG

SEQ ID NO: 2319608 - protein, 28 aa, Cryptosporidium parvum
PDEKELIWGFIKLIQTLRPHIIASYNGD

SEQ ID NO: 2319609 - protein, 25 aa, Cryptosporidium parvum
PDFGSLLLRRLINQFRISYSKGDKY

SEQ ID NO: 2319610 - protein, 25 aa, Cryptosporidium parvum
PDFTHITCLCSDKSLKLFRIDSDFC

SEQ ID NO: 2319611 - protein, 30 aa, Cryptosporidium parvum; identical to SEQ ID NO: 2195124

SEQ ID NO: 2319612 - protein, 29 aa, Cryptosporidium parvum
PDIRYIEKRLYFWRRSNLSVFQSLCNQNM

SEQ ID NO: 2319613 - protein, 25 aa, Cryptosporidium parvum
PDISRAIRILNWKPTVDIKTGIKET

SEQ ID NO: 2319614 - protein, 35 aa, Cryptosporidium parvum
PDLFSIFDFITQEFIRVIPIHLRLYFSRKELRSFL

SEQ ID NO: 2319615 - protein, 17 aa, Cryptosporidium parvum
PDLIIRRGEKRGERFAT

SEQ ID NO: 2319616 - protein, 29 aa, Cryptosporidium parvum
PDLILVVFYRYILLMRRLQSIYLLEPAGS

SEQ ID NO: 2319617 - protein, 17 aa, Cryptosporidium parvum
PDLVIHPSILKGLSELG

SEQ ID NO: 2319618 - protein, 20 aa, Cryptosporidium parvum
PDNILLYPNPSFCEEGWNND

SEQ ID NO: 2319619 - protein, 26 aa, Cryptosporidium parvum
PDNSPTKAVLLLFVSGKVIVTGCKNY

SEQ ID NO: 2319620 - protein, 22 aa, Cryptosporidium parvum
PDSNLFDPVKQYEKLLKKTISL

SEQ ID NO: 2319621 - protein, 28 aa, Cryptosporidium parvum
PDSYKLLQHPFILSKKKSIKIFNNNFQN

SEQ ID NO: 2319622 - protein, 27 aa, Cryptosporidium parvum
PDTKDYLMCVFLPNYNVSNAQIIIPAS

SEQ ID NO: 2319623 - protein, 23 aa, Cryptosporidium parvum
PDTLWKSLIRGYSINPLSGKMFN

SEQ ID NO: 2319624 - protein, 25 aa, Cryptosporidium parvum
PDVLDPALLRPGRLDRKVEIPLPNE

SEQ ID NO: 2319625 - protein, 20 aa, Cryptosporidium parvum
PDVLLMITSNIFRPFNQCHA

SEQ ID NO: 2319626 - protein, 22 aa, Cryptosporidium parvum
PDYEIKLLINDKYDGPFKLEMK

SEQ ID NO: 2319627 - protein, 21 aa, Cryptosporidium parvum
PDYPVRCAFSLLNEYLKTYID

SEQ ID NO: 2319628 - protein, 20 aa, Cryptosporidium parvum
PEDCGWLEPIRLKVHAMEVQ

SEQ ID NO: 2319629 - protein, 27 aa, Cryptosporidium parvum
PEDFFCSHSPFPVIWFSNYDDIQSFDI

SEQ ID NO: 2319630 - protein, 17 aa, Cryptosporidium parvum
PEDIHGIIKTGMKSRRV

SEQ ID NO: 2319631 - protein, 17 aa, Cryptosporidium parvum
PEDLTFLRKVRSGLING

SEQ ID NO: 2319632 - protein, 23 aa, Cryptosporidium parvum
PEDQQMFVLGEKLRSLLFNSFNL

SEQ ID NO: 2319633 - protein, 24 aa, Cryptosporidium parvum
PEDTKFWILCDYDCFGLSIAATYI

SEQ ID NO: 2319634 - protein, 26 aa, Cryptosporidium parvum
PEEITRLYGLKPIRTLTLGTTKKSQK

SEQ ID NO: 2319635 - protein, 25 aa, Cryptosporidium parvum
PEEKILYWCAQLAAGLYYLHNECRI

SEQ ID NO: 2319636 - protein, 31 aa, Cryptosporidium parvum; identical to SEQ ID NO: 2195143

SEQ ID NO: 2319637 - protein, 36 aa, Cryptosporidium parvum
PEGMSYVIFVNSPKFFSIVWNSFKSLLAARTVEKIL

SEQ ID NO: 2319638 - protein, 40 aa, Cryptosporidium parvum; identical to SEQ ID NO: 2195144

SEQ ID NO: 2319639 - protein, 19 aa, Cryptosporidium parvum
PEIISYKLSVADCQILLFD

SEQ ID NO: 2319640 - protein, 21 aa, Cryptosporidium parvum
PEIKDLPPVKVTVGPDGRETN

SEQ ID NO: 2319641 - protein, 28 aa, Cryptosporidium parvum
PEIKRGVMLLLPGMLTFIMHKDAEQSVH

SEQ ID NO: 2319642 - protein, 30 aa, Cryptosporidium parvum
PEINVLKLRFKILIQCYRMLSRGLIPGEKL

SEQ ID NO: 2319643 - protein, 18 aa, Cryptosporidium parvum
PEIPTYWLDSTNFPTFDS

SEQ ID NO: 2319644 - protein, 26 aa, Cryptosporidium parvum
PEISWPPLEITFQNSFLYCAKRGYFP

SEQ ID NO: 2319645 - protein, 18 aa, Cryptosporidium parvum
PEIYDSINITLYRMRRLL

SEQ ID NO: 2319646 - protein, 19 aa, Cryptosporidium parvum
PEKALKLGLILPKPNQFVS

SEQ ID NO: 2319647 - protein, 26 aa, Cryptosporidium parvum
PEKRQKAAWLAYVDNNLPILKNENPT

SEQ ID NO: 2319648 - protein, 27 aa, Cryptosporidium parvum
PEKVDLTLPCEFVGEIYSIIDDGAIFG

SEQ ID NO: 2319649 - protein, 19 aa, Cryptosporidium parvum
PELEDMILFQNWSMNKFQD

SEQ ID NO: 2319650 - protein, 25 aa, Cryptosporidium parvum
PELELRPFLINLPLNKNENTRDGIK

SEQ ID NO: 2319651 - protein, 26 aa, Cryptosporidium parvum
PELFNELLILIHNILIEKFSNSAIDM

SEQ ID NO: 2319652 - protein, 33 aa, Cryptosporidium parvum; identical to SEQ ID NO: 2195156

SEQ ID NO: 2319653 - protein, 17 aa, Cryptosporidium parvum
PELPYLGISKKLVKIHL

SEQ ID NO: 2319654 - protein, 31 aa, Cryptosporidium parvum; identical to SEQ ID NO: 2195159

SEQ ID NO: 2319655 - protein, 23 aa, Cryptosporidium parvum
PENAIKVVLYKNGFIIDDEEFRD

SEQ ID NO: 2319656 - protein, 18 aa, Cryptosporidium parvum
PENDLIFDQFESLNPLEQ

SEQ ID NO: 2319657 - protein, 27 aa, Cryptosporidium parvum
PENKNRLIFAVLPFGTGNDWAKSFGWS

SEQ ID NO: 2319658 - protein, 18 aa, Cryptosporidium parvum
PENLLGFDLKDLAARGAL

SEQ ID NO: 2319659 - protein, 26 aa, Cryptosporidium parvum
PEPQVNVNPLILWISSEDGEKRVIEV

SEQ ID NO: 2319660 - protein, 17 aa, Cryptosporidium parvum
PERHEIVLFKSMEDANN

SEQ ID NO: 2319661 - protein, 31 aa, Cryptosporidium parvum
PERYEDCMNCLYLLLPFTLTHGTSQNVSWLD

SEQ ID NO: 2319662 - protein, 23 aa, Cryptosporidium parvum
PESLELAYLYFLEQFRKVCLGDY

SEQ ID NO: 2319663 - protein, 18 aa, Cryptosporidium parvum
PESLSLFPELPYLGISKK

SEQ ID NO: 2319664 - protein, 31 aa, Cryptosporidium parvum
PESPIFKFVPLMQYWRHYWFDNTERTQPFPV

SEQ ID NO: 2319665 - protein, 28 aa, Cryptosporidium parvum
PESRFQLLEDILFQYALSRSRYESCMNP

SEQ ID NO: 2319666 - protein, 25 aa, Cryptosporidium parvum
PESYNQLFNWLVNRPKQLGQSRIHL

SEQ ID NO: 2319667 - protein, 17 aa, Cryptosporidium parvum
PETARSILLDNPQFCYA

SEQ ID NO: 2319668 - protein, 22 aa, Cryptosporidium parvum
PETLIRALELLYSLGALDDKGE

SEQ ID NO: 2319669 - protein, 18 aa, Cryptosporidium parvum
PETLMRTISYIASIYEGK

SEQ ID NO: 2319670 - protein, 20 aa, Cryptosporidium parvum
PEVVTLWYRCPELLFGSTKY

SEQ ID NO: 2319671 - protein, 27 aa, Cryptosporidium parvum
PEWVWPMGHFLMAKYQLLKEKYEKTIS

SEQ ID NO: 2319672 - protein, 18 aa, Cryptosporidium parvum
PEYCFRRRNFKGEGELEN

SEQ ID NO: 2319673 - protein, 19 aa, Cryptosporidium parvum
PEYLAGHYMIQSASSLIPV

SEQ ID NO: 2319674 - protein, 17 aa, Cryptosporidium parvum
PEYNPFKTHNYFKPKKI

SEQ ID NO: 2319675 - protein, 28 aa, Cryptosporidium parvum
PFEYGNGYGYLYTRLKWILDNNETNGQF

SEQ ID NO: 2319676 - protein, 18 aa, Cryptosporidium parvum
PFEYLRLTSLGVIGALVK

SEQ ID NO: 2319677 - protein, 17 aa, Cryptosporidium parvum
PFFLSLVSEQPIHHHYA

SEQ ID NO: 2319678 - protein, 18 aa, Cryptosporidium parvum
PFGAVRPFTYCKNDFNLS

SEQ ID NO: 2319679 - protein, 33 aa, Cryptosporidium parvum; identical to SEQ ID NO: 2195175

SEQ ID NO: 2319680 - protein, 19 aa, Cryptosporidium parvum
PFGLFEPQLKEYFSQFGKI

SEQ ID NO: 2319681 - protein, 17 aa, Cryptosporidium parvum
PFIHYRNIGFNKDLKQD

SEQ ID NO: 2319682 - protein, 28 aa, Cryptosporidium parvum
PFLKEINHILRDWAVFVLQADPDSGSNL

SEQ ID NO: 2319683 - protein, 19 aa, Cryptosporidium parvum
PFLPGLIEKMTGPVLCMVF

SEQ ID NO: 2319684 - protein, 18 aa, Cryptosporidium parvum
PFNQFKWMESHLYHSKRF

SEQ ID NO: 2319685 - protein, 22 aa, Cryptosporidium parvum
PFQPEFWSYRILTSMSIKIKDA

SEQ ID NO: 2319686 - protein, 20 aa, Cryptosporidium parvum
PFSIFVMEYLPHSCMKWNSK

SEQ ID NO: 2319687 - protein, 17 aa, Cryptosporidium parvum
PFSITVLEESHVDFLFG

SEQ ID NO: 2319688 - protein, 20 aa, Cryptosporidium parvum
PFSYHALLDFLFGVQKTYVD

SEQ ID NO: 2319689 - protein, 24 aa, Cryptosporidium parvum
PGAILPMILLFISSKMNKSTQNNL

SEQ ID NO: 2319690 - protein, 18 aa, Cryptosporidium parvum
PGECFFGLSPPYVGDDQL

SEQ ID NO: 2319691 - protein, 17 aa, Cryptosporidium parvum
PGEFVLLALLDQFEERL

SEQ ID NO: 2319692 - protein, 21 aa, Cryptosporidium parvum
PGELLRIKGPSIQMPHSGQSI

SEQ ID NO: 2319693 - protein, 32 aa, Cryptosporidium parvum; identical to SEQ ID NO: 2195187

SEQ ID NO: 2319694 - protein, 25 aa, Cryptosporidium parvum
PGFYAIITEYLTNGNLFELLYENKV

SEQ ID NO: 2319695 - protein, 17 aa, Cryptosporidium parvum
PGGGSALLWASRNLGKL

SEQ ID NO: 2319696 - protein, 26 aa, Cryptosporidium parvum
PGGTRLLKRWITYPLVNTERINERLD

SEQ ID NO: 2319697 - protein, 25 aa, Cryptosporidium parvum
PGHALFGYFADLVEAYSLCLIPNKS

SEQ ID NO: 2319698 - protein, 26 aa, Cryptosporidium parvum
PGISPFPLITAWFKGVGKPSDSWCIH

SEQ ID NO: 2319699 - protein, 20 aa, Cryptosporidium parvum
PGIYYFRFKVRVGNTYAWMD

SEQ ID NO: 2319700 - protein, 23 aa, Cryptosporidium parvum
PGLPDYNLRNIKLGQISFENLSN

SEQ ID NO: 2319701 - protein, 22 aa, Cryptosporidium parvum
PGLSCVINLPDKKTLCLMFNDE

SEQ ID NO: 2319702 - protein, 22 aa, Cryptosporidium parvum
PGMELRIIWQRSSYTIQQYLRS

SEQ ID NO: 2319703 - protein, 27 aa, Cryptosporidium parvum
PGNWNNLHLETLRLLTQQYNSFIEQGK

SEQ ID NO: 2319704 - protein, 25 aa, Cryptosporidium parvum
PGPSPAFCRIAIPNYIQSIYKNGVD

SEQ ID NO: 2319705 - protein, 31 aa, Cryptosporidium parvum; identical to SEQ ID NO: 2195202

SEQ ID NO: 2319706 - protein, 24 aa, Cryptosporidium parvum
PGQRKVLFATFKKKLNNELKVAQL

SEQ ID NO: 2319707 - protein, 23 aa, Cryptosporidium parvum
PGRILDMLLNTLSIQLELLEIII

SEQ ID NO: 2319708 - protein, 18 aa, Cryptosporidium parvum
PGRRYGHIMVYSKPNLIV

SEQ ID NO: 2319709 - protein, 26 aa, Cryptosporidium parvum
PGSKRAFCQFIMEPICQLFSSIMNGD

SEQ ID NO: 2319710 - protein, 24 aa, Cryptosporidium parvum
PGSNISDLLRNLRFLVLDEADRLL

SEQ ID NO: 2319711 - protein, 42 aa, Cryptosporidium parvum
PGSQGGLVNPFLMMQRMSAANPMLLAFNPQLAAAAAATAATS

SEQ ID NO: 2319712 - protein, 27 aa, Cryptosporidium parvum
PGTIDRIRRWFGLYKAVENKDVAKVNM

SEQ ID NO: 2319713 - protein, 27 aa, Cryptosporidium parvum
PGTKDIIPFKIWRPPKVPLAAGQKYLP

SEQ ID NO: 2319714 - protein, 17 aa, Cryptosporidium parvum
PGVIPQMIPLANSYAAF

SEQ ID NO: 2319715 - protein, 17 aa, Cryptosporidium parvum
PGVREFLNTIAPYYIMG

SEQ ID NO: 2319716 - protein, 22 aa, Cryptosporidium parvum
PHFFNLEFKPKCVLPLLIGDFT

SEQ ID NO: 2319717 - protein, 29 aa, Cryptosporidium parvum
PHHMRISEWLPYRQGVIVPGPKLFKGTIS

SEQ ID NO: 2319718 - protein, 18 aa, Cryptosporidium parvum
PHHNLLLRTQFLMSLQCP

SEQ ID NO: 2319719 - protein, 17 aa, Cryptosporidium parvum
PHIEKSLMGKALIGKKG

SEQ ID NO: 2319720 - protein, 28 aa, Cryptosporidium parvum
PHKYSPTEIKIQPSIFSFDVSLDTKRSN

SEQ ID NO: 2319721 - protein, 17 aa, Cryptosporidium parvum
PHLILPSVSTPLHIPPP

SEQ ID NO: 2319722 - protein, 22 aa, Cryptosporidium parvum
PHLVVVPLSTLPNWQKEFEIWS

SEQ ID NO: 2319723 - protein, 24 aa, Cryptosporidium parvum
PHNFGAGYFTVPNAYPAPNVEIKL

SEQ ID NO: 2319724 - protein, 21 aa, Cryptosporidium parvum
PHPFAIAEWTYRRMLKDNRSQ

SEQ ID NO: 2319725 - protein, 24 aa, Cryptosporidium parvum
PHRVYEVSILLLIGKKVKEKNFVS

SEQ ID NO: 2319726 - protein, 21 aa, Cryptosporidium parvum
PHSWTILREEYIPIIFFDIYA

SEQ ID NO: 2319727 - protein, 19 aa, Cryptosporidium parvum
PHTITLRFPKKTKVSVIDL

SEQ ID NO: 2319728 - protein, 24 aa, Cryptosporidium parvum
PHTLSFRPVILPGSTELLIHVPES

SEQ ID NO: 2319729 - protein, 29 aa, Cryptosporidium parvum
PHVYGYSQLKKGILLLLVGGVEKRTKDNI

SEQ ID NO: 2319730 - protein, 17 aa, Cryptosporidium parvum
PIASYKLTPDMAIVDAN

SEQ ID NO: 2319731 - protein, 26 aa, Cryptosporidium parvum
PICTPKRSYLPLITHISSPLSNPSTA

SEQ ID NO: 2319732 - protein, 24 aa, Cryptosporidium parvum
PIDDFELLLFIDQKGKKSIFCPRC

SEQ ID NO: 2319733 - protein, 17 aa, Cryptosporidium parvum
PIDPLSLFLPSTSQENS

SEQ ID NO: 2319734 - protein, 22 aa, Cryptosporidium parvum
PIDVFLPIFVNHDHLLLEMAWD

SEQ ID NO: 2319735 - protein, 17 aa, Cryptosporidium parvum
PIEFIKNEKFAFLQAYS

SEQ ID NO: 2319736 - protein, 33 aa, Cryptosporidium parvum
PIEKEEKTYFLRGLLYRIWKYNRNGKVINNSNL

SEQ ID NO: 2319737 - protein, 38 aa, Cryptosporidium parvum
PIEYIISYIDMMFSSIYRNILYYVLNSDKSKVLLETSS

SEQ ID NO: 2319738 - protein, 19 aa, Cryptosporidium parvum
PIFVQTLLERVPYQDLDIL

SEQ ID NO: 2319739 - protein, 21 aa, Cryptosporidium parvum
PIGELFNLSLSSSEYPERRIS

SEQ ID NO: 2319740 - protein, 27 aa, Cryptosporidium parvum
PIGIPGNMFILNPYLEVGEIKTIIEIE

SEQ ID NO: 2319741 - protein, 20 aa, Cryptosporidium parvum
PIHHHYAYLWLRECPNLLKD

SEQ ID NO: 2319742 - protein, 19 aa, Cryptosporidium parvum
PIIALKYVNDIYHLCSPPD

SEQ ID NO: 2319743 - protein, 24 aa, Cryptosporidium parvum
PIIDPNLCEKIDPIKAIITSSNSY

SEQ ID NO: 2319744 - protein, 19 aa, Cryptosporidium parvum
PIITLQHIVKERYPCFVDA

SEQ ID NO: 2319745 - protein, 18 aa, Cryptosporidium parvum
PIKIIQVAEILFKIYSNN

SEQ ID NO: 2319746 - protein, 29 aa, Cryptosporidium parvum
PIKKIPWGLYICHLPIGPTSYFRIRSVKL

SEQ ID NO: 2319747 - protein, 25 aa, Cryptosporidium parvum
PIKNEYLIEGYSVPFPYDAYKCQIN

SEQ ID NO: 2319748 - protein, 25 aa, Cryptosporidium parvum
PIKVRIIMSILYISDSLRESCKQEF

SEQ ID NO: 2319749 - protein, 18 aa, Cryptosporidium parvum
PILIIATRQDIIGALAPG

SEQ ID NO: 2319750 - protein, 17 aa, Cryptosporidium parvum
PILLNILMDGIGAYNSM

SEQ ID NO: 2319751 - protein, 17 aa, Cryptosporidium parvum
PILNSYEAFVLLGNLSN

SEQ ID NO: 2319752 - protein, 30 aa, Cryptosporidium parvum
PILVQNNSYQLLLSQLMQYLYGGNNNNSNN

SEQ ID NO: 2319753 - protein, 18 aa, Cryptosporidium parvum
PIMDQLMCRVGASDAQIL

SEQ ID NO: 2319754 - protein, 25 aa, Cryptosporidium parvum
PIMKLRTLVLVKITSPRKINHKAHI

SEQ ID NO: 2319755 - protein, 26 aa, Cryptosporidium parvum
PINDNYFILDLLAQAGTYIKEFVNGD

SEQ ID NO: 2319756 - protein, 25 aa, Cryptosporidium parvum
PIPASPLVTILAFVPAIETFGFETD

SEQ ID NO: 2319757 - protein, 18 aa, Cryptosporidium parvum
PIPGRHLTLHIGVGYGRT

SEQ ID NO: 2319758 - protein, 26 aa, Cryptosporidium parvum
PIPLNLLQTMINGMFPAIDLTKIRIR

SEQ ID NO: 2319759 - protein, 18 aa, Cryptosporidium parvum
PIPSFPMFDEERGNREFL

SEQ ID NO: 2319760 - protein, 26 aa, Cryptosporidium parvum
PIQEKLRYPDLKLIPKVGIGKNLKIE

SEQ ID NO: 2319761 - protein, 19 aa, Cryptosporidium parvum
PIQHISKDTLYLYKTTKCT

SEQ ID NO: 2319762 - protein, 19 aa, Cryptosporidium parvum
PIRCAIFVSRKQWIITCGD

SEQ ID NO: 2319763 - protein, 27 aa, Cryptosporidium parvum
PIRNIPDLMTMLDLSDIPPHVQIPKYY

SEQ ID NO: 2319764 - protein, 18 aa, Cryptosporidium parvum
PISLNAICELLSSKDFKD

SEQ ID NO: 2319765 - protein, 26 aa, Cryptosporidium parvum
PISLPQPPFQPYIFKNSRNYQSFNSF

SEQ ID NO: 2319766 - protein, 20 aa, Cryptosporidium parvum
PISYFLYNDATEVYRKAHIE

SEQ ID NO: 2319767 - protein, 17 aa, Cryptosporidium parvum
PITINKTTIIAPGAPNT

SEQ ID NO: 2319768 - protein, 18 aa, Cryptosporidium parvum
PITIVYLSSLLHPYLNIW

SEQ ID NO: 2319769 - protein, 19 aa, Cryptosporidium parvum
PITLNNIIQFLRDKEFVDP

SEQ ID NO: 2319770 - protein, 33 aa, Cryptosporidium parvum
PIVEKKLMINYSFSSLIFFPNICITMSSNVPGL

SEQ ID NO: 2319771 - protein, 18 aa, Cryptosporidium parvum
PIVEYCGEWGYNPRLLLS

SEQ ID NO: 2319772 - protein, 18 aa, Cryptosporidium parvum
PIVLLNNAYWEPKVKEWV

SEQ ID NO: 2319773 - protein, 19 aa, Cryptosporidium parvum
PIVWKRYIEYLQSQKNTDE

SEQ ID NO: 2319774 - protein, 21 aa, Cryptosporidium parvum
PIYQLIVLNQKNPENLILGIT

SEQ ID NO: 2319775 - protein, 19 aa, Cryptosporidium parvum
PIYSRVVIQRIPWRELKEI

SEQ ID NO: 2319776 - protein, 18 aa, Cryptosporidium parvum
PKAKAAAPSYSGLPAPVL

SEQ ID NO: 2319777 - protein, 19 aa, Cryptosporidium parvum
PKAMLPGCPVKPLGGGEFS

SEQ ID NO: 2319778 - protein, 24 aa, Cryptosporidium parvum
PKDDIVRLLTCRKIQLREGEIMKH

SEQ ID NO: 2319779 - protein, 33 aa, Cryptosporidium parvum
PKEIAYLPGNIPLSILRYLSSIVPSIQLTNFRD

SEQ ID NO: 2319780 - protein, 25 aa, Cryptosporidium parvum
PKEIIMGICYFLEPKDTISLSLTCN

SEQ ID NO: 2319781 - protein, 22 aa, Cryptosporidium parvum
PKELSSWYQGPSLFEILSSINQ

SEQ ID NO: 2319782 - protein, 25 aa, Cryptosporidium parvum
PKEYDYYFISAPWTQINILRTLSKV

SEQ ID NO: 2319783 - protein, 39 aa, Cryptosporidium parvum
PKFHEQTWFYWLENIQDWCISRQLWWGHRIPAYKIISSK

SEQ ID NO: 2319784 - protein, 21 aa, Cryptosporidium parvum
PKFKQIKRIKNPRLRLKKILE

SEQ ID NO: 2319785 - protein, 20 aa, Cryptosporidium parvum
PKFPSYLDFAQRYSDTRINK

SEQ ID NO: 2319786 - protein, 17 aa, Cryptosporidium parvum
PKFQFSFSKGDNFNSQL

SEQ ID NO: 2319787 - protein, 22 aa, Cryptosporidium parvum
PKFVKASIVIFFYTVFDCFNIP

SEQ ID NO: 2319788 - protein, 21 aa, Cryptosporidium parvum
PKGIRLLNIDPIEALFVGVIT

SEQ ID NO: 2319789 - protein, 33 aa, Cryptosporidium parvum
PKGNTAVYLLYAYARICAIFRKVEFIQSDNSMV

SEQ ID NO: 2319790 - protein, 21 aa, Cryptosporidium parvum
PKGVLLYGPPGTGKTLLARAV

SEQ ID NO: 2319791 - protein, 25 aa, Cryptosporidium parvum
PKHFVNPRILLLNLELELKAEKDNA

SEQ ID NO: 2319792 - protein, 26 aa, Cryptosporidium parvum
PKIDYSFILCIIWISLLKSGYQVTSF

SEQ ID NO: 2319793 - protein, 30 aa, Cryptosporidium parvum; identical to SEQ ID NO: 2195278

SEQ ID NO: 2319794 - protein, 19 aa, Cryptosporidium parvum
PKIFYYDFMERCFGSAFQT

SEQ ID NO: 2319795 - protein, 44 aa, Cryptosporidium parvum; identical to SEQ ID NO: 2301421

SEQ ID NO: 2319796 - protein, 20 aa, Cryptosporidium parvum
PKIQTRIGAVIKPLVYSKHL

SEQ ID NO: 2319797 - protein, 28 aa, Cryptosporidium parvum
PKIRDYFTCMLFITLKFQDIFTKKNSEI

SEQ ID NO: 2319798 - protein, 19 aa, Cryptosporidium parvum
PKIRLMSVKAIFSENFLSI

SEQ ID NO: 2319799 - protein, 30 aa, Cryptosporidium parvum; identical to SEQ ID NO: 2195281

SEQ ID NO: 2319800 - protein, 25 aa, Cryptosporidium parvum
PKKVYYFIYGFFHRIYEKIYHYRHP

SEQ ID NO: 2319801 - protein, 21 aa, Cryptosporidium parvum
PKLLEEFQNRLLFKAKQRQNE

SEQ ID NO: 2319802 - protein, 28 aa, Cryptosporidium parvum
PKLLESYFILNFILCKSYYLLNIVGNYH

SEQ ID NO: 2319803 - protein, 18 aa, Cryptosporidium parvum
PKLLKLCNNFGFVEFLKL

SEQ ID NO: 2319804 - protein, 19 aa, Cryptosporidium parvum
PKMPREYIVRLIFDRNHYS

SEQ ID NO: 2319805 - protein, 29 aa, Cryptosporidium parvum
PKNEDSVLFLKSKFDYLLCNGCNRAFHWY

SEQ ID NO: 2319806 - protein, 23 aa, Cryptosporidium parvum
PKNISPKWFIWSKDDIAYQRLVD

SEQ ID NO: 2319807 - protein, 33 aa, Cryptosporidium parvum
PKQFKDWRAHDIGIGFLLYGESVCFVLARMIEL

SEQ ID NO: 2319808 - protein, 23 aa, Cryptosporidium parvum
PKQIFDFMINVENKPLYDSTCAE

SEQ ID NO: 2319809 - protein, 25 aa, Cryptosporidium parvum
PKRVEILLAEPSFNNLLTRLVNTVN

SEQ ID NO: 2319810 - protein, 21 aa, Cryptosporidium parvum
PKSFTLEPKWDPLLEQQSQQS

SEQ ID NO: 2319811 - protein, 18 aa, Cryptosporidium parvum
PKSLSFPGYIETLSMCIA

SEQ ID NO: 2319812 - protein, 25 aa, Cryptosporidium parvum
PKSVFLNKIILDKIQLVLDSLKIKN

SEQ ID NO: 2319813 - protein, 24 aa, Cryptosporidium parvum
PKTLHLKLVLLGDASVGKSCLVVR

SEQ ID NO: 2319814 - protein, 27 aa, Cryptosporidium parvum
PKVDSYLSDKLLFFLSGLISHSNDGAY

SEQ ID NO: 2319815 - protein, 23 aa, Cryptosporidium parvum
PKVKFITRIWHPNISSQTGAICL

SEQ ID NO: 2319816 - protein, 23 aa, Cryptosporidium parvum
PLAKPEYYYFPPELLTDARDFLE

SEQ ID NO: 2319817 - protein, 18 aa, Cryptosporidium parvum
PLCFSQHPAFSTSFVMIN

SEQ ID NO: 2319818 - protein, 18 aa, Cryptosporidium parvum
PLCKSGCLSDILILNLDG

SEQ ID NO: 2319819 - protein, 20 aa, Cryptosporidium parvum
PLCWDNLRKAFCSGYFHNSA

SEQ ID NO: 2319820 - protein, 26 aa, Cryptosporidium parvum
PLCYTGSFFHRIIPQFMIQGGDFTRG

SEQ ID NO: 2319821 - protein, 19 aa, Cryptosporidium parvum
PLDNLWLNQNFQITKKHNL

SEQ ID NO: 2319822 - protein, 26 aa, Cryptosporidium parvum
PLDPNSFISKVPIPSSFFNNIGQNKI

SEQ ID NO: 2319823 - protein, 22 aa, Cryptosporidium parvum
PLDWLQFVEMIVSARTIELNNE

SEQ ID NO: 2319824 - protein, 23 aa, Cryptosporidium parvum
PLEFLKMIKAMVNKDVFEVCDTI

SEQ ID NO: 2319825 - protein, 19 aa, Cryptosporidium parvum
PLEILLHLPLVCEDKNTPY

SEQ ID NO: 2319826 - protein, 26 aa, Cryptosporidium parvum
PLEKEENWWVILIKIAVPNSSKENKD

SEQ ID NO: 2319827 - protein, 18 aa, Cryptosporidium parvum
PLELSSFANSYRLAGYET

SEQ ID NO: 2319828 - protein, 19 aa, Cryptosporidium parvum
PLETRVSWLSKWLRISKSG

SEQ ID NO: 2319829 - protein, 25 aa, Cryptosporidium parvum
PLETRYRVLLLLESWSKSDLLTCNY

SEQ ID NO: 2319830 - protein, 20 aa, Cryptosporidium parvum
PLEYGGMGFDYIWNTSICSS

SEQ ID NO: 2319831 - protein, 21 aa, Cryptosporidium parvum
PLEYQNLNSIPLFRNRFFESF

SEQ ID NO: 2319832 - protein, 27 aa, Cryptosporidium parvum
PLFETENAFFRIFELSELWDMINLESF

SEQ ID NO: 2319833 - protein, 18 aa, Cryptosporidium parvum
PLFTDDRVFIFDSIVFTV

SEQ ID NO: 2319834 - protein, 18 aa, Cryptosporidium parvum
PLFVLEKCLLSPTQELAL

SEQ ID NO: 2319835 - protein, 19 aa, Cryptosporidium parvum
PLGALLSLGYTHRYFIPEF

SEQ ID NO: 2319836 - protein, 23 aa, Cryptosporidium parvum
PLGVLNPIPQFGVGLSPLNGFSG

SEQ ID NO: 2319837 - protein, 24 aa, Cryptosporidium parvum
PLIDQRSFFLGKILGRMISSILSG

SEQ ID NO: 2319838 - protein, 25 aa, Cryptosporidium parvum
PLILEKFHPIWIRKIIDERRNLVLK

SEQ ID NO: 2319839 - protein, 18 aa, Cryptosporidium parvum
PLITKRVIPQTNKIVYQP

SEQ ID NO: 2319840 - protein, 24 aa, Cryptosporidium parvum
PLKSFRSEMVRTVNGNLIHVGSSK

SEQ ID NO: 2319841 - protein, 38 aa, Cryptosporidium parvum
PLKSKMPFVIDVFVLYCIERYTGKFLPFKGISWKTIIE

SEQ ID NO: 2319842 - protein, 20 aa, Cryptosporidium parvum
PLLEQLSIISLKRNIEPTEC

SEQ ID NO: 2319843 - protein, 19 aa, Cryptosporidium parvum
PLLFPKLGTLLDGSYCFCS

SEQ ID NO: 2319844 - protein, 19 aa, Cryptosporidium parvum
PLLSILDKFIETFTLLHGE

SEQ ID NO: 2319845 - protein, 18 aa, Cryptosporidium parvum
PLLTQWTYHAMIHELLEI

SEQ ID NO: 2319846 - protein, 23 aa, Cryptosporidium parvum
PLMMSYLKTRFTLTSGMFPHKLK

SEQ ID NO: 2319847 - protein, 26 aa, Cryptosporidium parvum
PLMSLQKVHFLALPPFNAALSPLAQK

SEQ ID NO: 2319848 - protein, 17 aa, Cryptosporidium parvum
PLMWHSFGCITALLQEI

SEQ ID NO: 2319849 - protein, 20 aa, Cryptosporidium parvum
PLNIWFKPDSTFNSPHSLIN

SEQ ID NO: 2319850 - protein, 17 aa, Cryptosporidium parvum
PLNKISVVILGQDPYHQ

SEQ ID NO: 2319851 - protein, 26 aa, Cryptosporidium parvum
PLPDPDPFLRPIKNNGKQRFYLTASE

SEQ ID NO: 2319852 - protein, 24 aa, Cryptosporidium parvum
PLPGRPRCIWTLKNGIDPSLSGSQ

SEQ ID NO: 2319853 - protein, 17 aa, Cryptosporidium parvum
PLPLLFTKKNMEHYYNL

SEQ ID NO: 2319854 - protein, 18 aa, Cryptosporidium parvum
PLPTLVRNVFSLAALANG

SEQ ID NO: 2319855 - protein, 30 aa, Cryptosporidium parvum; identical to SEQ ID NO: 2195326

SEQ ID NO: 2319856 - protein, 27 aa, Cryptosporidium parvum
PLRAVFAGLRILDSIRFMGLSSSIGIG

SEQ ID NO: 2319857 - protein, 29 aa, Cryptosporidium parvum
PLRSSEFFMISILGLNRFKIRAQCVLAMK

SEQ ID NO: 2319858 - protein, 18 aa, Cryptosporidium parvum
PLSFNELNNGYTGVLINT

SEQ ID NO: 2319859 - protein, 20 aa, Cryptosporidium parvum
PLSLDALKTLPGWGARQKLE

SEQ ID NO: 2319860 - protein, 29 aa, Cryptosporidium parvum
PLTKQKEYLIKWKVPGQPVQPTWEPEENL

SEQ ID NO: 2319861 - protein, 22 aa, Cryptosporidium parvum
PLTLDAAITPITTPVKRSAKNK

SEQ ID NO: 2319862 - protein, 19 aa, Cryptosporidium parvum
PLTSYVSTRWYRAPELLVK

SEQ ID NO: 2319863 - protein, 24 aa, Cryptosporidium parvum
PLVCPELYQQIGIDPPTGVLLYGP

SEQ ID NO: 2319864 - protein, 17 aa, Cryptosporidium parvum
PLYDLLCSCIPADLILV

SEQ ID NO: 2319865 - protein, 23 aa, Cryptosporidium parvum
PLYSERVFHISLFYIKKSDLYLG

SEQ ID NO: 2319866 - protein, 19 aa, Cryptosporidium parvum
PMCGRIIPHKFFSNSFKQS

SEQ ID NO: 2319867 - protein, 18 aa, Cryptosporidium parvum
PMHCNQTSHWWLIVICHP

SEQ ID NO: 2319868 - protein, 26 aa, Cryptosporidium parvum
PMKYVDYYIETLPRPNIDFNQTHKML

SEQ ID NO: 2319869 - protein, 21 aa, Cryptosporidium parvum
PMLYDKLSRSIAPSIWENDDV

SEQ ID NO: 2319870 - protein, 17 aa, Cryptosporidium parvum
PMNSLRVGLFMTLKIST

SEQ ID NO: 2319871 - protein, 17 aa, Cryptosporidium parvum
PMSTFTGFPIHFSTADP

SEQ ID NO: 2319872 - protein, 25 aa, Cryptosporidium parvum
PMWYYNIVIYYDIEIIITALDTLKP

SEQ ID NO: 2319873 - protein, 26 aa, Cryptosporidium parvum
PNAKCRLRLLKYERIKDYLMMEQEFI

SEQ ID NO: 2319874 - protein, 28 aa, Cryptosporidium parvum
PNALVRFLCNLIISQIFKFPTVFRTNIK

SEQ ID NO: 2319875 - protein, 20 aa, Cryptosporidium parvum
PNDHYYSPKLCPEICFVKSN

SEQ ID NO: 2319876 - protein, 23 aa, Cryptosporidium parvum
PNDVRSFIVGSKRFRIFIELPQD

SEQ ID NO: 2319877 - protein, 17 aa, Cryptosporidium parvum
PNDVSFQGFPQFLAQFC

SEQ ID NO: 2319878 - protein, 23 aa, Cryptosporidium parvum
PNEFLYLNIPIYDTPFEDISKYF

SEQ ID NO: 2319879 - protein, 25 aa, Cryptosporidium parvum
PNFGKKLRIYSWWSDIEIVDLSMLR

SEQ ID NO: 2319880 - protein, 32 aa, Cryptosporidium parvum
PNFPIKLNSCKIFYLNLPKLRSIKLKCKSILD

SEQ ID NO: 2319881 - protein, 25 aa, Cryptosporidium parvum
PNGEFKVFRIPLGGTLIEGSYAISG

SEQ ID NO: 2319882 - protein, 24 aa, Cryptosporidium parvum
PNGNFIAKLFIRFGMKPEQTQIHD

SEQ ID NO: 2319883 - protein, 28 aa, Cryptosporidium parvum
PNGNFKYNILKGFQIYIIGYSKTIGGFN

SEQ ID NO: 2319884 - protein, 29 aa, Cryptosporidium parvum
PNGNKQRWKWVALLPFIDQKVLLETVIPL

SEQ ID NO: 2319885 - protein, 26 aa, Cryptosporidium parvum
PNGRSWDIFVNVPKKFANVTTLGFEN

SEQ ID NO: 2319886 - protein, 26 aa, Cryptosporidium parvum
PNHTTPLNIYGPIPGAPNGGIIAPII

SEQ ID NO: 2319887 - protein, 24 aa, Cryptosporidium parvum
PNIIKLFEVFEDTNYLYFVMEICT

SEQ ID NO: 2319888 - protein, 23 aa, Cryptosporidium parvum
PNIPKKLLFLHMGQEHIAEAKWH

SEQ ID NO: 2319889 - protein, 20 aa, Cryptosporidium parvum
PNIQDINAFKLTKIIGKLDE

SEQ ID NO: 2319890 - protein, 31 aa, Cryptosporidium parvum; identical to SEQ ID NO: 2195364

SEQ ID NO: 2319891 - protein, 29 aa, Cryptosporidium parvum
PNKPGKIIKTRLLLKAPLSPYELDWCTDA

SEQ ID NO: 2319892 - protein, 24 aa, Cryptosporidium parvum
PNKSNFRWVWPAHVFVTHTGTIIF

SEQ ID NO: 2319893 - protein, 21 aa, Cryptosporidium parvum
PNKVRFFIMDGTDPIAFLSYY

SEQ ID NO: 2319894 - protein, 23 aa, Cryptosporidium parvum
PNKVVMDILRSWAILNPSKNKKN

SEQ ID NO: 2319895 - protein, 18 aa, Cryptosporidium parvum
PNLDIGFASLSRNSSNEA

SEQ ID NO: 2319896 - protein, 19 aa, Cryptosporidium parvum
PNLKVYFFSALNEINKREH

SEQ ID NO: 2319897 - protein, 20 aa, Cryptosporidium parvum
PNNFHHHSMGIYSSITNMDY

SEQ ID NO: 2319898 - protein, 27 aa, Cryptosporidium parvum
PNNHHFLNIFAPNRNHINLIDPSMSAL

SEQ ID NO: 2319899 - protein, 21 aa, Cryptosporidium parvum
PNNIIIIFSGRERHLLDEWFG

SEQ ID NO: 2319900 - protein, 24 aa, Cryptosporidium parvum
PNNKTEYPTVPYPFSIDSDDGHLR

SEQ ID NO: 2319901 - protein, 24 aa, Cryptosporidium parvum
PNNQLTLDLLKLSSVPIAAPSANR

SEQ ID NO: 2319902 - protein, 23 aa, Cryptosporidium parvum
PNNSLKLEISWSDRFALSGFCGE

SEQ ID NO: 2319903 - protein, 24 aa, Cryptosporidium parvum
PNPKYQYLFVGAEPYNTIGIRIPN

SEQ ID NO: 2319904 - protein, 22 aa, Cryptosporidium parvum
PNPLTYLTSKSSPYTLLLCLSG

SEQ ID NO: 2319905 - protein, 18 aa, Cryptosporidium parvum
PNPSPFNLSLISPGSSSI

SEQ ID NO: 2319906 - protein, 31 aa, Cryptosporidium parvum; identical to SEQ ID NO: 2195380

SEQ ID NO: 2319907 - protein, 28 aa, Cryptosporidium parvum
PNQQIAALEILAGRKLINAIQLNIEIDE

SEQ ID NO: 2319908 - protein, 19 aa, Cryptosporidium parvum
PNRTLSRVPRIYSLAEGDF

SEQ ID NO: 2319909 - protein, 18 aa, Cryptosporidium parvum
PNRYVSQPPIYYYEQQPS

SEQ ID NO: 2319910 - protein, 18 aa, Cryptosporidium parvum
PNSDRIFIYGGYSKIKDN

SEQ ID NO: 2319911 - protein, 25 aa, Cryptosporidium parvum
PNSEKLVFLLSTRAGGLGINLATAD

SEQ ID NO: 2319912 - protein, 19 aa, Cryptosporidium parvum
PNSGWGGKGLLGCDIAAGP

SEQ ID NO: 2319913 - protein, 17 aa, Cryptosporidium parvum
PNSIIAYWPPKEVLKIP

SEQ ID NO: 2319914 - protein, 20 aa, Cryptosporidium parvum
PNSLAAGAIYFVCNLCNIQI

SEQ ID NO: 2319915 - protein, 26 aa, Cryptosporidium parvum
PNSNIIIPKCFILDIIYGIFTANSQK

SEQ ID NO: 2319916 - protein, 19 aa, Cryptosporidium parvum
PNSQLFLSNNYFDDYRFDF

SEQ ID NO: 2319917 - protein, 29 aa, Cryptosporidium parvum
PNSTINEDYYRRINVQPAIVDTPMSPRTA

SEQ ID NO: 2319918 - protein, 23 aa, Cryptosporidium parvum
PNTHEVVTLWYRAPELLLGQRCY

SEQ ID NO: 2319919 - protein, 23 aa, Cryptosporidium parvum
PNTKNVMLCTPLHFSASNGFDEI

SEQ ID NO: 2319920 - protein, 22 aa, Cryptosporidium parvum
PNTRWSIKKALFHPDCIQQLLF

SEQ ID NO: 2319921 - protein, 30 aa, Cryptosporidium parvum
PNTWPQHIAAMTWLCELLDYEQAVFPHLNY

SEQ ID NO: 2319922 - protein, 30 aa, Cryptosporidium parvum
PNTYEPWITYTSNVLAYLFGKIPGCDSPSS

SEQ ID NO: 2319923 - protein, 21 aa, Cryptosporidium parvum
PNTYPDIGLVPYTSIPCVLDF

SEQ ID NO: 2319924 - protein, 18 aa, Cryptosporidium parvum
PNVQDLYMKIIKDNLHIL

SEQ ID NO: 2319925 - protein, 21 aa, Cryptosporidium parvum
PNWDEYFMKIAKLASQRSNCV

SEQ ID NO: 2319926 - protein, 34 aa, Cryptosporidium parvum
PNYSIEYDWWSFGVLIYEMVFGINFSIPPYGYHP

SEQ ID NO: 2319927 - protein, 17 aa, Cryptosporidium parvum
PPAVFSKVTHPVNIKWI

SEQ ID NO: 2319928 - protein, 21 aa, Cryptosporidium parvum
PPCCDPSLLEPVKLPFGENDE

SEQ ID NO: 2319929 - protein, 18 aa, Cryptosporidium parvum
PPDLLIHVAKCDFLSLTP

SEQ ID NO: 2319930 - protein, 28 aa, Cryptosporidium parvum
PPEIDEPFLEFFKPKPKLRIKQKSRGKS

SEQ ID NO: 2319931 - protein, 22 aa, Cryptosporidium parvum
PPESLLIDDLFFSNVPISDSED

SEQ ID NO: 2319932 - protein, 18 aa, Cryptosporidium parvum
PPILNRLIERMLSLKIIT

SEQ ID NO: 2319933 - protein, 19 aa, Cryptosporidium parvum
PPKGVILYGPPGTGKTLLA

SEQ ID NO: 2319934 - protein, 26 aa, Cryptosporidium parvum
PPKKEILLYVPLTNMQRRLYKDLLSK

SEQ ID NO: 2319935 - protein, 25 aa, Cryptosporidium parvum
PPKRELYVYIGLSKLQKKIYSELLT

SEQ ID NO: 2319936 - protein, 21 aa, Cryptosporidium parvum
PPKVKIQLFKDLNISYLVENQ

SEQ ID NO: 2319937 - protein, 41 aa, Cryptosporidium parvum
PPLDCPINLFRQILVLTSERFALFQYSPLKLLQAAPIVDFE

SEQ ID NO: 2319938 - protein, 18 aa, Cryptosporidium parvum
PPLPLHMKSGMKSKSCPF

SEQ ID NO: 2319939 - protein, 21 aa, Cryptosporidium parvum
PPNHFFSFKNLSNESAKISFV

SEQ ID NO: 2319940 - protein, 23 aa, Cryptosporidium parvum
PPNILSFRVLGIGRFGITVAPSN

SEQ ID NO: 2319941 - protein, 27 aa, Cryptosporidium parvum
PPPAEESSWFSGWFGASETTPAPPPTP

SEQ ID NO: 2319942 - protein, 19 aa, Cryptosporidium parvum
PPPKIGILEPVETSEGLVS

SEQ ID NO: 2319943 - protein, 18 aa, Cryptosporidium parvum
PPPPAKPLGGKPATKIPP

SEQ ID NO: 2319944 - protein, 33 aa, Cryptosporidium parvum
PPPPITGFPSNMIYFPPPPPPHLNPPIPGHPNI

SEQ ID NO: 2319945 - protein, 25 aa, Cryptosporidium parvum
PPPPKPQQGLFPQAPRPSSSYMSGG

SEQ ID NO: 2319946 - protein, 17 aa, Cryptosporidium parvum
PPPPPPGVSRHYPVSPI

SEQ ID NO: 2319947 - protein, 23 aa, Cryptosporidium parvum
PPPPPPPPPPPPPPPPVLRHSVT

SEQ ID NO: 2319948 - protein, 17 aa, Cryptosporidium parvum
PPPPSSGELPPPLPPSF

SEQ ID NO: 2319949 - protein, 17 aa, Cryptosporidium parvum
PPPSEELPPPPPPSEEL

SEQ ID NO: 2319950 - protein, 19 aa, Cryptosporidium parvum
PPPYQKPPSYPPSKPQIPP

SEQ ID NO: 2319951 - protein, 27 aa, Cryptosporidium parvum
PPQNSDWLYIRAASILRHLYVRPNVGV

SEQ ID NO: 2319952 - protein, 24 aa, Cryptosporidium parvum
PPSNKPLLMYLSGAKGQLINIAQM

SEQ ID NO: 2319953 - protein, 24 aa, Cryptosporidium parvum
PPSNTIYLWLGANTILEYPLEEAI

SEQ ID NO: 2319954 - protein, 25 aa, Cryptosporidium parvum
PPTLYNTLYISCYLCTFNPLKADEV

SEQ ID NO: 2319955 - protein, 17 aa, Cryptosporidium parvum
PPVGALDPNVLASLGLN

SEQ ID NO: 2319956 - protein, 19 aa, Cryptosporidium parvum
PPVTLKKFSELDFLKPFIS

SEQ ID NO: 2319957 - protein, 23 aa, Cryptosporidium parvum
PQAGAIIRFKSKETIYCSCEFLD

SEQ ID NO: 2319958 - protein, 35 aa, Cryptosporidium parvum
PQANPMLNSFLSNPFMNPFGLQVPPILGQNANLIA

SEQ ID NO: 2319959 - protein, 27 aa, Cryptosporidium parvum
PQDLTRTGFIIFWGGRELDSFNIGNNI

SEQ ID NO: 2319960 - protein, 21 aa, Cryptosporidium parvum
PQETALIYRPLKLSDIFKINK

SEQ ID NO: 2319961 - protein, 31 aa, Cryptosporidium parvum
PQHAQINPMIFQNPILMNALQSGGTNPMGVP

SEQ ID NO: 2319962 - protein, 17 aa, Cryptosporidium parvum
PQHSIAWSKYLFDIVFG

SEQ ID NO: 2319963 - protein, 18 aa, Cryptosporidium parvum
PQINPLNILIVILHYVIF

SEQ ID NO: 2319964 - protein, 36 aa, Cryptosporidium parvum
PQKAEELWKLCYTFGDPWVVHPKNKSWRRIQILGNS

SEQ ID NO: 2319965 - protein, 25 aa, Cryptosporidium parvum
PQKIINEPYLYVSPFEEVIKDLVDL

SEQ ID NO: 2319966 - protein, 21 aa, Cryptosporidium parvum
PQNILIIKRPKSPNSTILAVE

SEQ ID NO: 2319967 - protein, 21 aa, Cryptosporidium parvum
PQQMTLWATIIRNTVRERAFR

SEQ ID NO: 2319968 - protein, 18 aa, Cryptosporidium parvum
PQSFSRLAAVKGSLQRLG

SEQ ID NO: 2319969 - protein, 24 aa, Cryptosporidium parvum
PQSLKRRFYMQIQFVKYMEKHIGA

SEQ ID NO: 2319970 - protein, 18 aa, Cryptosporidium parvum
PQSMLTWEDTQFQGQANI

SEQ ID NO: 2319971 - protein, 17 aa, Cryptosporidium parvum
PQVKYTMRLLDESIYSE

SEQ ID NO: 2319972 - protein, 26 aa, Cryptosporidium parvum
PQVRTSFLEVINWLREWACSRSYGLG

SEQ ID NO: 2319973 - protein, 23 aa, Cryptosporidium parvum
PQYYVPRIYGFAVYRNKRDLLAE

SEQ ID NO: 2319974 - protein, 23 aa, Cryptosporidium parvum
PRAPIEWHWTFHTPEDLTFLRKV

SEQ ID NO: 2319975 - protein, 17 aa, Cryptosporidium parvum
PRDKMLFIKSIPTKWNH

SEQ ID NO: 2319976 - protein, 17 aa, Cryptosporidium parvum
PREDLLVKDYSFDLYRI

SEQ ID NO: 2319977 - protein, 18 aa, Cryptosporidium parvum
PRGKIPYEYLVKYHHQSY

SEQ ID NO: 2319978 - protein, 25 aa, Cryptosporidium parvum
PRIISYNYHLFKLISPKLAEKWYVN

SEQ ID NO: 2319979 - protein, 19 aa, Cryptosporidium parvum
PRILHAFIQLNKLGNYLSP

SEQ ID NO: 2319980 - protein, 24 aa, Cryptosporidium parvum
PRISFGLFPSPKGMIGGRIKLIYK

SEQ ID NO: 2319981 - protein, 30 aa, Cryptosporidium parvum
PRKDWAFDEAILYPLHPRTGLPKSPKIKTR

SEQ ID NO: 2319982 - protein, 26 aa, Cryptosporidium parvum
PRKDWPFDEAILYPPHPRIGSPVTKV

SEQ ID NO: 2319983 - protein, 17 aa, Cryptosporidium parvum
PRKFIPNSKAVIGYDGY

SEQ ID NO: 2319984 - protein, 34 aa, Cryptosporidium parvum
PRKLSKATRSRLLLKERIFSMNPFEVNINGQIET

SEQ ID NO: 2319985 - protein, 17 aa, Cryptosporidium parvum
PRKTQNVILDYINLCNF

SEQ ID NO: 2319986 - protein, 26 aa, Cryptosporidium parvum
PRLHSALTRLYWKNMLKSIKCIQSWW

SEQ ID NO: 2319987 - protein, 18 aa, Cryptosporidium parvum
PRPAIPPPHMYAPNMARP

SEQ ID NO: 2319988 - protein, 22 aa, Cryptosporidium parvum
PRRDFRDGFFNSEISRGVTNIQ

SEQ ID NO: 2319989 - protein, 29 aa, Cryptosporidium parvum
PRRSKDLPLSYDEARFIREIWQDTRAQYE

SEQ ID NO: 2319990 - protein, 22 aa, Cryptosporidium parvum
PRSDEELAFLFAFDTDEYNRFD

SEQ ID NO: 2319991 - protein, 18 aa, Cryptosporidium parvum
PRSESVFDASYSLNNEYR

SEQ ID NO: 2319992 - protein, 26 aa, Cryptosporidium parvum
PRSGIRWLCFILGEYGKLISSKVSII

SEQ ID NO: 2319993 - protein, 23 aa, Cryptosporidium parvum
PRSLYIRIVNLTDFDLTLQLPAA

SEQ ID NO: 2319994 - protein, 23 aa, Cryptosporidium parvum
PRSSWIDISSFPQSGTEIGPENI

SEQ ID NO: 2319995 - protein, 29 aa, Cryptosporidium parvum
PRTFRSRKLPGIWHRILADGFRPGERVTR

SEQ ID NO: 2319996 - protein, 25 aa, Cryptosporidium parvum
PRTPQFRATYILPTSPHFSDSDEFY

SEQ ID NO: 2319997 - protein, 20 aa, Cryptosporidium parvum
PRVLPIPVKPIMFDIASDFV

SEQ ID NO: 2319998 - protein, 23 aa, Cryptosporidium parvum
PSAPIQMAFFIISACELSDKKTA

SEQ ID NO: 2319999 - protein, 32 aa, Cryptosporidium parvum
PSCDIISFLDIFLLSLFRSKIPQLIRHLGWDE

SEQ ID NO: 2320000 - protein, 17 aa, Cryptosporidium parvum
PSCLAGLSLLFQLNIRI

SEQ ID NO: 2320001 - protein, 19 aa, Cryptosporidium parvum
PSCRSLRTSIRINRSSTLS

SEQ ID NO: 2320002 - protein, 19 aa, Cryptosporidium parvum
PSCTLYVCRLSLKTKEDDL

SEQ ID NO: 2320003 - protein, 18 aa, Cryptosporidium parvum
PSDILCVHVFQKEYFSTI

SEQ ID NO: 2320004 - protein, 23 aa, Cryptosporidium parvum
PSDQLIMPIRISPEIFNIGLNLS

SEQ ID NO: 2320005 - protein, 44 aa, Cryptosporidium parvum; identical to SEQ ID NO: 2195464

SEQ ID NO: 2320006 - protein, 24 aa, Cryptosporidium parvum
PSENCKIDVSYNSKLDLKGQEKSV

SEQ ID NO: 2320007 - protein, 29 aa, Cryptosporidium parvum
PSEYICKLCGFPLLNPVLIKCAGSCGASA

SEQ ID NO: 2320008 - protein, 33 aa, Cryptosporidium parvum
PSEYIPYARSLDTHWLKYLLDSGLTMISDDSNN

SEQ ID NO: 2320009 - protein, 23 aa, Cryptosporidium parvum
PSFTALHYIIANLSLTNPNLNLN

SEQ ID NO: 2320010 - protein, 22 aa, Cryptosporidium parvum
PSGDFMMCKVCGFKSAVLGKTG

SEQ ID NO: 2320011 - protein, 28 aa, Cryptosporidium parvum
PSHSALYVTLKFPLPNIVQQFLPSIVQL

SEQ ID NO: 2320012 - protein, 18 aa, Cryptosporidium parvum
PSHYQNVRKKWWSSWGSN

SEQ ID NO: 2320013 - protein, 30 aa, Cryptosporidium parvum
PSIASTFLYFCPQFILVKLISEIFKNREIL

SEQ ID NO: 2320014 - protein, 25 aa, Cryptosporidium parvum
PSIIHPNIMPRISPIIGPCLGSIYQ

SEQ ID NO: 2320015 - protein, 24 aa, Cryptosporidium parvum
PSIRQKTMMQANANKRLLLSKAKN

SEQ ID NO: 2320016 - protein, 19 aa, Cryptosporidium parvum
PSKIQAAALPLILNSPMNL

SEQ ID NO: 2320017 - protein, 18 aa, Cryptosporidium parvum
PSKLGYGARGCPPVIPKN

SEQ ID NO: 2320018 - protein, 21 aa, Cryptosporidium parvum
PSKRWYERIAVISPYNEQVKI

SEQ ID NO: 2320019 - protein, 21 aa, Cryptosporidium parvum
PSKYVILALHNYFWDQKSNKG

SEQ ID NO: 2320020 - protein, 34 aa, Cryptosporidium parvum
PSLERIRTLVLPKLYTYINYLFINQLRTQGNGII

SEQ ID NO: 2320021 - protein, 28 aa, Cryptosporidium parvum
PSLIELPVPYMVPKPFVVPVHVPVLEFR

SEQ ID NO: 2320022 - protein, 37 aa, Cryptosporidium parvum; identical to SEQ ID NO: 2195484

SEQ ID NO: 2320023 - protein, 19 aa, Cryptosporidium parvum
PSMIMPISRAYRAQLERHN

SEQ ID NO: 2320024 - protein, 21 aa, Cryptosporidium parvum
PSMPPIKRVVVTSTQAMNCLK

SEQ ID NO: 2320025 - protein, 31 aa, Cryptosporidium parvum; identical to SEQ ID NO: 2195486

SEQ ID NO: 2320026 - protein, 29 aa, Cryptosporidium parvum
PSNIGYSYYLIFLLCSYHPLIYSGPKTMN

SEQ ID NO: 2320027 - protein, 23 aa, Cryptosporidium parvum
PSNILVNLSCDLKICDFGLARGN

SEQ ID NO: 2320028 - protein, 17 aa, Cryptosporidium parvum
PSNLAVVSYINNANRRL

SEQ ID NO: 2320029 - protein, 29 aa, Cryptosporidium parvum
PSNVTSYLKGIDIFLRIPEYIRPKKDGAV

SEQ ID NO: 2320030 - protein, 25 aa, Cryptosporidium parvum
PSNYRDFFNLISQLKFQLVNLIISK

SEQ ID NO: 2320031 - protein, 21 aa, Cryptosporidium parvum
PSPFGGVLNDGFWNHSHNSVA

SEQ ID NO: 2320032 - protein, 19 aa, Cryptosporidium parvum
PSQGILSLGFGFEYLPLKC

SEQ ID NO: 2320033 - protein, 24 aa, Cryptosporidium parvum
PSQNWPSNWVWLNTRYSVTLINQK

SEQ ID NO: 2320034 - protein, 23 aa, Cryptosporidium parvum
PSQTIFPDYYQIISKPVCLQHIR

SEQ ID NO: 2320035 - protein, 20 aa, Cryptosporidium parvum
PSRFACESIPLFPILTHFCV

SEQ ID NO: 2320036 - protein, 18 aa, Cryptosporidium parvum
PSRKNSFFGINRTAERIK

SEQ ID NO: 2320037 - protein, 23 aa, Cryptosporidium parvum
PSRNPFIMQLHSVIFLSSYSFNF

SEQ ID NO: 2320038 - protein, 27 aa, Cryptosporidium parvum
PSRSLSYYIEFLLMFAQFGRDPLCIKL

SEQ ID NO: 2320039 - protein, 35 aa, Cryptosporidium parvum; identical to SEQ ID NO: 2195496

SEQ ID NO: 2320040 - protein, 36 aa, Cryptosporidium parvum
PSSGELPPPLPPSFGELPLPPPPPPLEEPLSSPSDE

SEQ ID NO: 2320041 - protein, 26 aa, Cryptosporidium parvum
PSSHHSLFLPFIEYSKRYSQGFKALH

SEQ ID NO: 2320042 - protein, 17 aa, Cryptosporidium parvum
PSYFEKGGQLKKSAWFL

SEQ ID NO: 2320043 - protein, 20 aa, Cryptosporidium parvum
PSYQNYWKVVKIPMDIMTVT

SEQ ID NO: 2320044 - protein, 19 aa, Cryptosporidium parvum
PTCPDVIPTYPFFDRDPFA

SEQ ID NO: 2320045 - protein, 27 aa, Cryptosporidium parvum
PTCSNYDYLFRLIWVETSTLYDSSIVG

SEQ ID NO: 2320046 - protein, 34 aa, Cryptosporidium parvum; identical to SEQ ID NO: 2195504

SEQ ID NO: 2320047 - protein, 30 aa, Cryptosporidium parvum; identical to SEQ ID NO: 2195506

SEQ ID NO: 2320048 - protein, 23 aa, Cryptosporidium parvum
PTHPYGIFGPGNPVSAAAAAAAA

SEQ ID NO: 2320049 - protein, 17 aa, Cryptosporidium parvum
PTILFINAGMNQFKSIF

SEQ ID NO: 2320050 - protein, 21 aa, Cryptosporidium parvum
PTIRNWLGSGLYLNKSHKGRI

SEQ ID NO: 2320051 - protein, 20 aa, Cryptosporidium parvum
PTKGLRYQLPMRGHTGYLSF

SEQ ID NO: 2320052 - protein, 30 aa, Cryptosporidium parvum; identical to SEQ ID NO: 2210310

SEQ ID NO: 2320053 - protein, 32 aa, Cryptosporidium parvum
PTKVDVFCLGWMLLFTLTKYQPFETCRLITDN

SEQ ID NO: 2320054 - protein, 18 aa, Cryptosporidium parvum
PTLGFNIKTLLHGKYRLN

SEQ ID NO: 2320055 - protein, 21 aa, Cryptosporidium parvum
PTLILIDHSLETLKKYTFLLK

SEQ ID NO: 2320056 - protein, 22 aa, Cryptosporidium parvum
PTLSAVRRKGYPPQSLWDFCDK

SEQ ID NO: 2320057 - protein, 27 aa, Cryptosporidium parvum
PTMMEQFILDPIWNIYQNIFINFNEEK

SEQ ID NO: 2320058 - protein, 25 aa, Cryptosporidium parvum
PTNHLDILAVTWLENFLKEWDKICV

SEQ ID NO: 2320059 - protein, 24 aa, Cryptosporidium parvum
PTNKRKITPLYTKEQLMSKLSNTK

SEQ ID NO: 2320060 - protein, 24 aa, Cryptosporidium parvum
PTNNFQNGMFPQLGVGFNGIPDMF

SEQ ID NO: 2320061 - protein, 19 aa, Cryptosporidium parvum
PTNTYGLPLSMIDDDYKPD

SEQ ID NO: 2320062 - protein, 22 aa, Cryptosporidium parvum
PTQGDYLLSIKTTSDGKFVAFP

SEQ ID NO: 2320063 - protein, 20 aa, Cryptosporidium parvum
PTRISNYNSFPINEPSIKNL

SEQ ID NO: 2320064 - protein, 20 aa, Cryptosporidium parvum
PTVIKCFFHSYRDGISRLQC

SEQ ID NO: 2320065 - protein, 18 aa, Cryptosporidium parvum
PTVKYLRDNFSIKAFPQM

SEQ ID NO: 2320066 - protein, 26 aa, Cryptosporidium parvum
PTVYEPLLVDLLTQAMLKLLEPTVIV

SEQ ID NO: 2320067 - protein, 32 aa, Cryptosporidium parvum; identical to SEQ ID NO: 2195526

SEQ ID NO: 2320068 - protein, 23 aa, Cryptosporidium parvum
PTYKQVIWCCFGLLSGELELSLF

SEQ ID NO: 2320069 - protein, 22 aa, Cryptosporidium parvum
PTYPNSNFPLILNTLISASQFR

SEQ ID NO: 2320070 - protein, 32 aa, Cryptosporidium parvum; identical to SEQ ID NO: 2195528

SEQ ID NO: 2320071 - protein, 24 aa, Cryptosporidium parvum
PVDFCVMVILIRRAVEKSKGRLSV

SEQ ID NO: 2320072 - protein, 25 aa, Cryptosporidium parvum
PVDHVFGFWDWVGGRFSVCSAVGLV

SEQ ID NO: 2320073 - protein, 24 aa, Cryptosporidium parvum
PVDLHMIEILPMKHGLTSETRLVR

SEQ ID NO: 2320074 - protein, 22 aa, Cryptosporidium parvum
PVEIEYLRYFPDDYIDAAVRQC

SEQ ID NO: 2320075 - protein, 28 aa, Cryptosporidium parvum
PVEWKPDVSFLRYGFISPISSNYPISFS

SEQ ID NO: 2320076 - protein, 25 aa, Cryptosporidium parvum
PVFDEELLRWIAEAEYLGVSRETAI

SEQ ID NO: 2320077 - protein, 20 aa, Cryptosporidium parvum
PVGRIQRMLKHRIPGDCRVG

SEQ ID NO: 2320078 - protein, 31 aa, Cryptosporidium parvum; identical to SEQ ID NO: 2195538

SEQ ID NO: 2320079 - protein, 17 aa, Cryptosporidium parvum
PVIISCPASLLDNWTKE

SEQ ID NO: 2320080 - protein, 26 aa, Cryptosporidium parvum
PVIMFSPSIINFRRFTFSRMELEPER

SEQ ID NO: 2320081 - protein, 23 aa, Cryptosporidium parvum
PVKKGDAFLVRGGFRPIEFKVVG

SEQ ID NO: 2320082 - protein, 23 aa, Cryptosporidium parvum
PVKYKQPECFTSALRHSKPALTW

SEQ ID NO: 2320083 - protein, 23 aa, Cryptosporidium parvum
PVLNQICVVCKNKMYFYKESDKE

SEQ ID NO: 2320084 - protein, 20 aa, Cryptosporidium parvum
PVLQFVYRKCVELRFTVNNE

SEQ ID NO: 2320085 - protein, 21 aa, Cryptosporidium parvum
PVMQQIFIIWSIIQKTEIIED

SEQ ID NO: 2320086 - protein, 18 aa, Cryptosporidium parvum
PVPNRISFYGFVARIGPN

SEQ ID NO: 2320087 - protein, 32 aa, Cryptosporidium parvum
PVPYLGCVGKKFRPPEIFAGKPYIASKVDSWC

SEQ ID NO: 2320088 - protein, 28 aa, Cryptosporidium parvum
PVRNQDILMMLPFVDNLVKLGVPGNLLL

SEQ ID NO: 2320089 - protein, 29 aa, Cryptosporidium parvum
PVSNNALFLELMKNPFPKFFNVGLNVSLS

SEQ ID NO: 2320090 - protein, 18 aa, Cryptosporidium parvum
PVTYKYPKSLSFPGYIET

SEQ ID NO: 2320091 - protein, 25 aa, Cryptosporidium parvum
PVVKNTLLALSFIDNLVPNSSYLFL

SEQ ID NO: 2320092 - protein, 27 aa, Cryptosporidium parvum
PVVRLRGLPWKAAVLDIIAFFNPICRI

SEQ ID NO: 2320093 - protein, 18 aa, Cryptosporidium parvum
PVYMISWSVDSRLIASAS

SEQ ID NO: 2320094 - protein, 19 aa, Cryptosporidium parvum
PWCYDPDYVPWYDSEMKNL

SEQ ID NO: 2320095 - protein, 17 aa, Cryptosporidium parvum
PWVNKRPKDGLPSRAPT

SEQ ID NO: 2320096 - protein, 25 aa, Cryptosporidium parvum
PYCDRSFLKRTLKIHLRYFCGPNSM

SEQ ID NO: 2320097 - protein, 24 aa, Cryptosporidium parvum
PYCPIKLISFVLALSSDILWVHDF

SEQ ID NO: 2320098 - protein, 25 aa, Cryptosporidium parvum
PYFNNIPLVLKKKETILITGINKKF

SEQ ID NO: 2320099 - protein, 18 aa, Cryptosporidium parvum
PYHLSLNLMLISNLTRYS

SEQ ID NO: 2320100 - protein, 19 aa, Cryptosporidium parvum
PYIVLSLEAKQFPLMSLCD

SEQ ID NO: 2320101 - protein, 20 aa, Cryptosporidium parvum
PYNRPIYSDFMKRTGVLLRK

SEQ ID NO: 2320102 - protein, 31 aa, Cryptosporidium parvum; identical to SEQ ID NO: 2195557

SEQ ID NO: 2320103 - protein, 20 aa, Cryptosporidium parvum
PYQYTLSKILQSRLSFLKEN

SEQ ID NO: 2320104 - protein, 20 aa, Cryptosporidium parvum
PYVMTSLGPIPLPDNVRNQI

SEQ ID NO: 2320105 - protein, 21 aa, Cryptosporidium parvum
PYYFPYFFPNYSENNELIVQL

SEQ ID NO: 2320106 - protein, 20 aa, Cryptosporidium parvum
QAAALPLILNSPMNLIAQAH

SEQ ID NO: 2320107 - protein, 19 aa, Cryptosporidium parvum
QACILLQFNDFISLSLLEL

SEQ ID NO: 2320108 - protein, 25 aa, Cryptosporidium parvum
QACKYPIYNILYKLGNDIKSQEGDP

SEQ ID NO: 2320109 - protein, 24 aa, Cryptosporidium parvum
QADFYYSYIVLFKYLNHCYKKYNN

SEQ ID NO: 2320110 - protein, 25 aa, Cryptosporidium parvum
QAEKKLAQAALLYMASKLTTLDETK

SEQ ID NO: 2320111 - protein, 20 aa, Cryptosporidium parvum
QAESLIRRLLTKSPKQRITS

SEQ ID NO: 2320112 - protein, 32 aa, Cryptosporidium parvum
QAHIDPRVLIILFWKDLIPIEWDLKYSNGSLS

SEQ ID NO: 2320113 - protein, 21 aa, Cryptosporidium parvum
QAKDFLLQLLNKNPSERISAF

SEQ ID NO: 2320114 - protein, 18 aa, Cryptosporidium parvum
QAKIFKPSPYRKVIVATN

SEQ ID NO: 2320115 - protein, 17 aa, Cryptosporidium parvum
QAKILRHLCQVKVRGPN

SEQ ID NO: 2320116 - protein, 26 aa, Cryptosporidium parvum
QAKMTIEQWLLSSLKQSERYILYAEA

SEQ ID NO: 2320117 - protein, 23 aa, Cryptosporidium parvum
QALRRLMEVYSESTRFALACNQS

SEQ ID NO: 2320118 - protein, 27 aa, Cryptosporidium parvum
QALSDLYRIPIYIFEKVRNSKLNASLL

SEQ ID NO: 2320119 - protein, 24 aa, Cryptosporidium parvum
QANQLLCSLLERDPCRLNSSGLYS

SEQ ID NO: 2320120 - protein, 35 aa, Cryptosporidium parvum
QANRLKPLPKRIIWVPSRRVFIVSYKRLGAINQMN

SEQ ID NO: 2320121 - protein, 27 aa, Cryptosporidium parvum
QAQIQTLNCAIPFFSLPRKRLNPSSQI

SEQ ID NO: 2320122 - protein, 32 aa, Cryptosporidium parvum
QATENLVDTVLKLAKLSILRIESEGGGTGAGG

SEQ ID NO: 2320123 - protein, 31 aa, Cryptosporidium parvum; identical to SEQ ID NO: 2195580

SEQ ID NO: 2320124 - protein, 26 aa, Cryptosporidium parvum
QAWDAILTCFFLDTAKNIITYIRTIT

SEQ ID NO: 2320125 - protein, 27 aa, Cryptosporidium parvum
QAYEANIPFILRYLIDRDLSTGSWVSI

SEQ ID NO: 2320126 - protein, 17 aa, Cryptosporidium parvum
QAYFNGFFDLIKDDFGT

SEQ ID NO: 2320127 - protein, 19 aa, Cryptosporidium parvum
QCATTLRCFCGVGCYKQGF

SEQ ID NO: 2320128 - protein, 27 aa, Cryptosporidium parvum
QCCWIWSTYVFLKIIKSFTFCLENINN

SEQ ID NO: 2320129 - protein, 26 aa, Cryptosporidium parvum
QCFKNAPLKYIPICEGVLKEVYLELV

SEQ ID NO: 2320130 - protein, 25 aa, Cryptosporidium parvum
QCLCHYLKWIPLNYILECDLRPQLP

SEQ ID NO: 2320131 - protein, 19 aa, Cryptosporidium parvum
QCLNRFIQQLIKSCNIMRD

SEQ ID NO: 2320132 - protein, 17 aa, Cryptosporidium parvum
QCMWRHYNLKIQLKAEE

SEQ ID NO: 2320133 - protein, 25 aa, Cryptosporidium parvum
QCRNLRYFDFIHKELVLFSRYDTTR

SEQ ID NO: 2320134 - protein, 26 aa, Cryptosporidium parvum
QCTPSVFPLVLTLMEPFKDVTTCPKF

SEQ ID NO: 2320135 - protein, 17 aa, Cryptosporidium parvum
QCWYVCRADPMLCSAAF

SEQ ID NO: 2320136 - protein, 25 aa, Cryptosporidium parvum
QCYNSLVYPILGTKIIFEDDVFKHI

SEQ ID NO: 2320137 - protein, 21 aa, Cryptosporidium parvum
QDCIIAFLRKYKEWYNDVVVV

SEQ ID NO: 2320138 - protein, 34 aa, Cryptosporidium parvum; identical to SEQ ID NO: 2195597

SEQ ID NO: 2320139 - protein, 30 aa, Cryptosporidium parvum
QDEIPKLNYIHYILAIIQRINEIDFKLLEY

SEQ ID NO: 2320140 - protein, 22 aa, Cryptosporidium parvum
QDEVKYIVRFLQGRLRIGIQQT

SEQ ID NO: 2320141 - protein, 25 aa, Cryptosporidium parvum
QDEVLAHRLGLIPMLIDPNTIEFRN

SEQ ID NO: 2320142 - protein, 26 aa, Cryptosporidium parvum
QDEVPSLDLTPLKELVTKYTQHPLST

SEQ ID NO: 2320143 - protein, 26 aa, Cryptosporidium parvum
QDFRKSIWFPIVDIPLRYEKVSSIIQ

SEQ ID NO: 2320144 - protein, 22 aa, Cryptosporidium parvum
QDFVLIGIFVKKGSITILTSNE

SEQ ID NO: 2320145 - protein, 18 aa, Cryptosporidium parvum
QDGGFREKKQSWNGSERN

SEQ ID NO: 2320146 - protein, 25 aa, Cryptosporidium parvum
QDGTIHIWSQFKKKPLFTSNDLHKG

SEQ ID NO: 2320147 - protein, 18 aa, Cryptosporidium parvum
QDINLIWSRSRVFELQVA

SEQ ID NO: 2320148 - protein, 20 aa, Cryptosporidium parvum
QDISWIYSKMDTSRFYLSIT

SEQ ID NO: 2320149 - protein, 32 aa, Cryptosporidium parvum; identical to SEQ ID NO: 2195604

SEQ ID NO: 2320150 - protein, 25 aa, Cryptosporidium parvum
QDKKLKSMIWSNGIYMIGPLEVNLL

SEQ ID NO: 2320151 - protein, 23 aa, Cryptosporidium parvum
QDKLLDPAYVTSLYKVRKHIGAV

SEQ ID NO: 2320152 - protein, 30 aa, Cryptosporidium parvum
QDLLSFLSCLLLPFLIFTKSKMIKNQIFDH

SEQ ID NO: 2320153 - protein, 19 aa, Cryptosporidium parvum
QDMILNEDILNWPKVDCLI

SEQ ID NO: 2320154 - protein, 34 aa, Cryptosporidium parvum
QDNGIFWIEWNDILKWFSHIYLAWDPEKVSKHLK

SEQ ID NO: 2320155 - protein, 24 aa, Cryptosporidium parvum
QDNILALGCIFHQAGNFRYALELY

SEQ ID NO: 2320156 - protein, 24 aa, Cryptosporidium parvum
QDPLLDVSIPYNSLAPYALTCYQL

SEQ ID NO: 2320157 - protein, 20 aa, Cryptosporidium parvum
QDQLNSCFLPPTPQYNGAIL

SEQ ID NO: 2320158 - protein, 23 aa, Cryptosporidium parvum
QDRFYFQGIIYCSILTGTVSLVE

SEQ ID NO: 2320159 - protein, 30 aa, Cryptosporidium parvum
QDRILLHETIFWKRRHGLRISSGLLKDIFG

SEQ ID NO: 2320160 - protein, 24 aa, Cryptosporidium parvum
QDTSKWKIIYPSYLNSNNTKSSGR

SEQ ID NO: 2320161 - protein, 22 aa, Cryptosporidium parvum
QDVLSLLSYLVPNSGGDVNCSS

SEQ ID NO: 2320162 - protein, 25 aa, Cryptosporidium parvum
QDYDSFLYFFNQLGINSLRFSDCFM

SEQ ID NO: 2320163 - protein, 24 aa, Cryptosporidium parvum
QDYRKYIFDGYYFFAKQGFENKAT

SEQ ID NO: 2320164 - protein, 25 aa, Cryptosporidium parvum
QDYRYSIIFYQAIPNYSRLTSCYIQ

SEQ ID NO: 2320165 - protein, 24 aa, Cryptosporidium parvum
QEAISFPVIIRINPEYITGNKPHE

SEQ ID NO: 2320166 - protein, 25 aa, Cryptosporidium parvum
QECVAYFIQLPIEEPFMRNINPSKN

SEQ ID NO: 2320167 - protein, 25 aa, Cryptosporidium parvum
QEDGTPTALLFIVDNKYMSLFLPEN

SEQ ID NO: 2320168 - protein, 18 aa, Cryptosporidium parvum
QEEFIARSILINGGSIFL

SEQ ID NO: 2320169 - protein, 28 aa, Cryptosporidium parvum
QEEFKFWPIEVLSLPNIFKGLIKRKKLV

SEQ ID NO: 2320170 - protein, 22 aa, Cryptosporidium parvum
QEESCIKPIFSSKMITYCWIKY

SEQ ID NO: 2320171 - protein, 30 aa, Cryptosporidium parvum
QEGGHNQLIWKRPLEKFAPRLLNAVQISKL

SEQ ID NO: 2320172 - protein, 20 aa, Cryptosporidium parvum
QEGILALRRVKRRNMERLTL

SEQ ID NO: 2320173 - protein, 33 aa, Cryptosporidium parvum
QEGKNPSSLYSISLLLIIGLALKKNGENETLGS

SEQ ID NO: 2320174 - protein, 26 aa, Cryptosporidium parvum
QEHPELLNSLLMLTLKPKKSSEMIPK

SEQ ID NO: 2320175 - protein, 30 aa, Cryptosporidium parvum
QEIDDSLFMSISSDKFLFENTMLISEKQVK

SEQ ID NO: 2320176 - protein, 27 aa, Cryptosporidium parvum
QEIKGDLYFRCLLALEYSKSKDLSVDC

SEQ ID NO: 2320177 - protein, 24 aa, Cryptosporidium parvum
QEITMYLQKLLSDKGYIATTRDDL

SEQ ID NO: 2320178 - protein, 29 aa, Cryptosporidium parvum
QEKVELLNSFPSCSLAIIKSLTRGDEIDE

SEQ ID NO: 2320179 - protein, 21 aa, Cryptosporidium parvum
QELNWPIENIILWGCSIGTGP

SEQ ID NO: 2320180 - protein, 26 aa, Cryptosporidium parvum
QELSTLFTFMLEWITISKTVWISNSL

SEQ ID NO: 2320181 - protein, 19 aa, Cryptosporidium parvum
QEMNKICLPALENLLFNSK

SEQ ID NO: 2320182 - protein, 26 aa, Cryptosporidium parvum
QENKFPLFSLIVPKLSLLVFQDLCYT

SEQ ID NO: 2320183 - protein, 25 aa, Cryptosporidium parvum
QENKWIPFYKCLTKSFWQNVAKLDP

SEQ ID NO: 2320184 - protein, 24 aa, Cryptosporidium parvum
QENLILLKYIIYKYFKEKNYIVKD

SEQ ID NO: 2320185 - protein, 27 aa, Cryptosporidium parvum
QEQKHLKLPLKLIKDLFIQVFGTPRYH

SEQ ID NO: 2320186 - protein, 19 aa, Cryptosporidium parvum
QERALKLSDQAFRSLVGEY

SEQ ID NO: 2320187 - protein, 25 aa, Cryptosporidium parvum
QEREHALRLFRSGQRPILVATDVAA

SEQ ID NO: 2320188 - protein, 31 aa, Cryptosporidium parvum
QERPNIQQIFQSNIYFLNFINSFLNTCNHKH

SEQ ID NO: 2320189 - protein, 22 aa, Cryptosporidium parvum
QERYRAITSAYYRGAVGALLVY

SEQ ID NO: 2320190 - protein, 24 aa, Cryptosporidium parvum
QESWLELLGYFSYLEYDKKCIQIL

SEQ ID NO: 2320191 - protein, 22 aa, Cryptosporidium parvum
QESYHNFKFISSSNKKTFDMIS

SEQ ID NO: 2320192 - protein, 38 aa, Cryptosporidium parvum
QEVERYLFKDLNVYFGWETPLVIPIITEPDCCYQSSYS

SEQ ID NO: 2320193 - protein, 31 aa, Cryptosporidium parvum
QEVFFSVLDLILKDLPSFLKYQTISSLEQEL

SEQ ID NO: 2320194 - protein, 33 aa, Cryptosporidium parvum; identical to SEQ ID NO: 2195638

SEQ ID NO: 2320195 - protein, 24 aa, Cryptosporidium parvum
QEVKALKEQWKKALASCNKKGSKK

SEQ ID NO: 2320196 - protein, 24 aa, Cryptosporidium parvum
QEVLKNWFIKLPLEYLEQAVSTLQ

SEQ ID NO: 2320197 - protein, 18 aa, Cryptosporidium parvum
QEWKDFLASIEPKDKRYK

SEQ ID NO: 2320198 - protein, 20 aa, Cryptosporidium parvum
QEYLSPVAFSLLLDPVSEVR

SEQ ID NO: 2320199 - protein, 17 aa, Cryptosporidium parvum
QFCRFLEWIPQSEKPEK

SEQ ID NO: 2320200 - protein, 23 aa, Cryptosporidium parvum
QFDYQRSILLKYWLSLEEKLASK

SEQ ID NO: 2320201 - protein, 24 aa, Cryptosporidium parvum
QFEERLLFYISVYGFEELGFKCIY

SEQ ID NO: 2320202 - protein, 20 aa, Cryptosporidium parvum
QFEIWVTWMEKLSLINDILV

SEQ ID NO: 2320203 - protein, 17 aa, Cryptosporidium parvum
QFESTEFCRLLLSPNST

SEQ ID NO: 2320204 - protein, 37 aa, Cryptosporidium parvum
QFETQLRQYRAILNKLTIEKFDKLYEQILSVGINNEE

SEQ ID NO: 2320205 - protein, 26 aa, Cryptosporidium parvum
QFFNSKLKFPAIRKLPMAPKALRSTF

SEQ ID NO: 2320206 - protein, 17 aa, Cryptosporidium parvum
QFFTCVIIDNPTLSVEE

SEQ ID NO: 2320207 - protein, 30 aa, Cryptosporidium parvum; identical to SEQ ID NO: 2195649

SEQ ID NO: 2320208 - protein, 28 aa, Cryptosporidium parvum
QFGILSINPILIDKFWNLFSTSYCAISS

SEQ ID NO: 2320209 - protein, 20 aa, Cryptosporidium parvum
QFGLNLKFKDKSHLKQNLLL

SEQ ID NO: 2320210 - protein, 18 aa, Cryptosporidium parvum
QFGTWVFQLVESSKNDYS

SEQ ID NO: 2320211 - protein, 30 aa, Cryptosporidium parvum
QFHYDCYKALYFLLIAKRLIGESIERILFL

SEQ ID NO: 2320212 - protein, 17 aa, Cryptosporidium parvum
QFIIPKKDSNLLKFLND

SEQ ID NO: 2320213 - protein, 18 aa, Cryptosporidium parvum
QFIIRVPKEYPFKPPKVK

SEQ ID NO: 2320214 - protein, 20 aa, Cryptosporidium parvum
QFISQLMANPLFQSQAIASQ

SEQ ID NO: 2320215 - protein, 26 aa, Cryptosporidium parvum
QFLMSLQCPIAKLRKPLNPFPNIPEA

SEQ ID NO: 2320216 - protein, 19 aa, Cryptosporidium parvum
QFLPNIRTPVVITRCGHHF

SEQ ID NO: 2320217 - protein, 19 aa, Cryptosporidium parvum
QFMDKFLVKLANLALRDTE

SEQ ID NO: 2320218 - protein, 23 aa, Cryptosporidium parvum
QFNGRRIFARLALNRTEIANIES

SEQ ID NO: 2320219 - protein, 17 aa, Cryptosporidium parvum
QFNPFSGSIGKPLGDMN

SEQ ID NO: 2320220 - protein, 20 aa, Cryptosporidium parvum
QFNQTYFDFWSCGKLLYLML

SEQ ID NO: 2320221 - protein, 19 aa, Cryptosporidium parvum
QFRFNYSKEFLRWALCVPG

SEQ ID NO: 2320222 - protein, 34 aa, Cryptosporidium parvum; identical to SEQ ID NO: 2195661

SEQ ID NO: 2320223 - protein, 18 aa, Cryptosporidium parvum
QFRVPLMALARDLRGICM

SEQ ID NO: 2320224 - protein, 31 aa, Cryptosporidium parvum; identical to SEQ ID NO: 2195663

SEQ ID NO: 2320225 - protein, 32 aa, Cryptosporidium parvum
QFVLEIDSLIWSKLQFLQLLSSFNLLVYDSQN

SEQ ID NO: 2320226 - protein, 18 aa, Cryptosporidium parvum
QGAFITDIDLFDNTFFGL

SEQ ID NO: 2320227 - protein, 29 aa, Cryptosporidium parvum
QGATTMIHGITPFYYGISGLSEVQPVNLQ

SEQ ID NO: 2320228 - protein, 21 aa, Cryptosporidium parvum
QGAVWGVAWHPLGHLVVSSGQ

SEQ ID NO: 2320229 - protein, 27 aa, Cryptosporidium parvum
QGDKNSALLVLRRKKLVTQEREKLLSS

SEQ ID NO: 2320230 - protein, 17 aa, Cryptosporidium parvum
QGFAQLRRFYEVRGMSP

SEQ ID NO: 2320231 - protein, 22 aa, Cryptosporidium parvum
QGGIYLLFSIKDDPKFFSQLVL

SEQ ID NO: 2320232 - protein, 17 aa, Cryptosporidium parvum
QGGYFIINGMEKVLVGQ

SEQ ID NO: 2320233 - protein, 20 aa, Cryptosporidium parvum
QGHPFVKCRLCFLVKKDHCI

SEQ ID NO: 2320234 - protein, 19 aa, Cryptosporidium parvum
QGIKKKSFGVFDKLVSLAQ

SEQ ID NO: 2320235 - protein, 21 aa, Cryptosporidium parvum
QGISNLLTSFEPLISGNSSFS

SEQ ID NO: 2320236 - protein, 26 aa, Cryptosporidium parvum
QGKNMETVGTCLFFADTEPTNKDSSD

SEQ ID NO: 2320237 - protein, 18 aa, Cryptosporidium parvum
QGLIGRYNSMCMDDQILK

SEQ ID NO: 2320238 - protein, 18 aa, Cryptosporidium parvum
QGLQRLIDKLKEVKLGSS

SEQ ID NO: 2320239 - protein, 26 aa, Cryptosporidium parvum
QGMNFLVGCILWHSSSEEQAFELLVS

SEQ ID NO: 2320240 - protein, 29 aa, Cryptosporidium parvum
QGMTFKSPFFFRPYFYLEAQKAVDIHWIL

SEQ ID NO: 2320241 - protein, 24 aa, Cryptosporidium parvum
QGNTPLLTGQRILDALFPSVQGGT

SEQ ID NO: 2320242 - protein, 23 aa, Cryptosporidium parvum
QGPWYINYVIQRLKEYKGTGFNG

SEQ ID NO: 2320243 - protein, 24 aa, Cryptosporidium parvum
QGQEHFVQHLLKNNLPQGGCSQTG

SEQ ID NO: 2320244 - protein, 22 aa, Cryptosporidium parvum
QGTSWRTVWPNSNLMSNGGIGD

SEQ ID NO: 2320245 - protein, 19 aa, Cryptosporidium parvum
QGVFRACCPSGASTGIYEA

SEQ ID NO: 2320246 - protein, 21 aa, Cryptosporidium parvum
QGVSFRKYTFLKANELNVFGW

SEQ ID NO: 2320247 - protein, 25 aa, Cryptosporidium parvum
QGYKYIDIYNFLRDRLRAVWQDLTV

SEQ ID NO: 2320248 - protein, 31 aa, Cryptosporidium parvum; identical to SEQ ID NO: 2195692

SEQ ID NO: 2320249 - protein, 18 aa, Cryptosporidium parvum
QHDSKILIFGKPDKCEVA

SEQ ID NO: 2320250 - protein, 42 aa, Cryptosporidium parvum; identical to SEQ ID NO: 2195694

SEQ ID NO: 2320251 - protein, 28 aa, Cryptosporidium parvum
QHFSTNPKLWMFYLSAKAESIKDITSHF

SEQ ID NO: 2320252 - protein, 20 aa, Cryptosporidium parvum
QHHFIPMYVELCDKLRDHLK

SEQ ID NO: 2320253 - protein, 30 aa, Cryptosporidium parvum
QHIKPQIPTMFPAGYYHNVHYIGDESLGAI

SEQ ID NO: 2320254 - protein, 17 aa, Cryptosporidium parvum
QHIMLDVQIRMMITLRR

SEQ ID NO: 2320255 - protein, 20 aa, Cryptosporidium parvum
QHIMVALDMLMRIYNNREFP

SEQ ID NO: 2320256 - protein, 21 aa, Cryptosporidium parvum
QHIQDLNLKCFKFETARNYLE

SEQ ID NO: 2320257 - protein, 21 aa, Cryptosporidium parvum
QHNGTWFLTIFPAGVNCDGDM

SEQ ID NO: 2320258 - protein, 26 aa, Cryptosporidium parvum
QHPETWVPFFVPQKKLGNSTPIWVHK

SEQ ID NO: 2320259 - protein, 19 aa, Cryptosporidium parvum
QHSEFICDLLLSKLGHDKE

SEQ ID NO: 2320260 - protein, 18 aa, Cryptosporidium parvum
QHSLFEIIFEQFGFNKAI

SEQ ID NO: 2320261 - protein, 18 aa, Cryptosporidium parvum
QIAIFSATFPNIIEQFTN

SEQ ID NO: 2320262 - protein, 25 aa, Cryptosporidium parvum
QIALNRLSCIFQPRKFQCNFESDII

SEQ ID NO: 2320263 - protein, 20 aa, Cryptosporidium parvum
QICPVCHGFVKYIADFEYGE

SEQ ID NO: 2320264 - protein, 25 aa, Cryptosporidium parvum
QIEDRYLINYTYQYGYGSWDQILSA

SEQ ID NO: 2320265 - protein, 24 aa, Cryptosporidium parvum
QIEHRIQHNFGIPIPFCLDNKATT

SEQ ID NO: 2320266 - protein, 29 aa, Cryptosporidium parvum
QIESFTRVLIGFIRLHKLVFPIGTNATAI

SEQ ID NO: 2320267 - protein, 23 aa, Cryptosporidium parvum
QIETILREYGVIDRVPRQDMSSN

SEQ ID NO: 2320268 - protein, 30 aa, Cryptosporidium parvum
QIGHVSITIPWTSLGYKPLVIKLKELHVVV

SEQ ID NO: 2320269 - protein, 18 aa, Cryptosporidium parvum
QIGKKELLAWGSSLLGEE

SEQ ID NO: 2320270 - protein, 23 aa, Cryptosporidium parvum
QIGKSIEFDLIISKSIQSNIRFQ

SEQ ID NO: 2320271 - protein, 24 aa, Cryptosporidium parvum
QIGTFYCPGINKVRYWAMCFIGSE

SEQ ID NO: 2320272 - protein, 24 aa, Cryptosporidium parvum
QIGVFPILLTHFYTKIFNNMKNGI

SEQ ID NO: 2320273 - protein, 19 aa, Cryptosporidium parvum
QIGYRVRYHNSYVGWVALS

SEQ ID NO: 2320274 - protein, 19 aa, Cryptosporidium parvum
QIIFIDFGLSYSDSLTIED

SEQ ID NO: 2320275 - protein, 20 aa, Cryptosporidium parvum
QIIGSLRGYDNFMNLVLENT

SEQ ID NO: 2320276 - protein, 19 aa, Cryptosporidium parvum
QIIIFDLNIVLSNPDGLAY

SEQ ID NO: 2320277 - protein, 17 aa, Cryptosporidium parvum
QIIKFRPFKENCSSIGS

SEQ ID NO: 2320278 - protein, 18 aa, Cryptosporidium parvum
QIILFEHIALELLELKEP

SEQ ID NO: 2320279 - protein, 23 aa, Cryptosporidium parvum
QIITQIYWSFKKITLKVLISYMK

SEQ ID NO: 2320280 - protein, 31 aa, Cryptosporidium parvum
QIKKFKHWFTYLGITNYILKVIKRLPPDIIL

SEQ ID NO: 2320281 - protein, 21 aa, Cryptosporidium parvum
QILEKLLDVLVISSSLEKAFL

SEQ ID NO: 2320282 - protein, 20 aa, Cryptosporidium parvum
QILELTLVNNYDLLFSIQKD

SEQ ID NO: 2320283 - protein, 28 aa, Cryptosporidium parvum
QILLDTKFKKILNYYKTWSFSIDEDYIK

SEQ ID NO: 2320284 - protein, 19 aa, Cryptosporidium parvum
QILNMIIPQLLKPNENKIL

SEQ ID NO: 2320285 - protein, 25 aa, Cryptosporidium parvum
QILPVSIHQFFKEKSLLICTPIYDQ

SEQ ID NO: 2320286 - protein, 17 aa, Cryptosporidium parvum
QILRFFSSNAHPIILRR

SEQ ID NO: 2320287 - protein, 18 aa, Cryptosporidium parvum
QILSNSLELVKNMHIPVF

SEQ ID NO: 2320288 - protein, 21 aa, Cryptosporidium parvum
QIMSLNKYPFYKSTLIGHTST

SEQ ID NO: 2320289 - protein, 24 aa, Cryptosporidium parvum
QINDILINLIKKKNKFESHNFIYH

SEQ ID NO: 2320290 - protein, 18 aa, Cryptosporidium parvum
QINNDQIILPNRNINITL

SEQ ID NO: 2320291 - protein, 26 aa, Cryptosporidium parvum
QINPQAQYLPLNPTIGQLTNYIQSWK

SEQ ID NO: 2320292 - protein, 25 aa, Cryptosporidium parvum
QINRIFFEEFPIYRKEYQYPSDCKQ

SEQ ID NO: 2320293 - protein, 23 aa, Cryptosporidium parvum
QIPALSHLWRASLNILLLLARCS

SEQ ID NO: 2320294 - protein, 20 aa, Cryptosporidium parvum
QIQILNLDLQYLKEENSRLK

SEQ ID NO: 2320295 - protein, 20 aa, Cryptosporidium parvum
QIQKILIFGIPTVIKELICS

SEQ ID NO: 2320296 - protein, 27 aa, Cryptosporidium parvum
QIQMQGLPIILMGRDLIGLAFTGSGKT

SEQ ID NO: 2320297 - protein, 25 aa, Cryptosporidium parvum
QIREKALRIFMLNNECIYLSNNKEH

SEQ ID NO: 2320298 - protein, 17 aa, Cryptosporidium parvum
QIRGILLFICDKEIQSS

SEQ ID NO: 2320299 - protein, 26 aa, Cryptosporidium parvum
QIRKIVLSYIRRPSCLILAITAANTD

SEQ ID NO: 2320300 - protein, 24 aa, Cryptosporidium parvum
QIRKRLFEIIKMENIPYVDSGIDT

SEQ ID NO: 2320301 - protein, 30 aa, Cryptosporidium parvum; identical to SEQ ID NO: 2195741

SEQ ID NO: 2320302 - protein, 33 aa, Cryptosporidium parvum
QIRRITFSIRNLLIRLLVFTFTLGTYKDIFNDQ

SEQ ID NO: 2320303 - protein, 32 aa, Cryptosporidium parvum
QISIKKIYISPFLIYNFWTDPTLWTIQTNENY

SEQ ID NO: 2320304 - protein, 31 aa, Cryptosporidium parvum; identical to SEQ ID NO: 2195743

SEQ ID NO: 2320305 - protein, 17 aa, Cryptosporidium parvum
QIVEVFSPVIDDLKIKY

SEQ ID NO: 2320306 - protein, 21 aa, Cryptosporidium parvum
QIWNHTFYWSCLRSPSETNKP

SEQ ID NO: 2320307 - protein, 24 aa, Cryptosporidium parvum
QIYRRLMVFSYNRYPMNYQWVSVK

SEQ ID NO: 2320308 - protein, 31 aa, Cryptosporidium parvum
QKCRKMLFICDNHPWYLGLGDQGYWTAEKIN

SEQ ID NO: 2320309 - protein, 28 aa, Cryptosporidium parvum
QKDTILWDLLTLLIYLDSMNPQIWDRRA

SEQ ID NO: 2320310 - protein, 22 aa, Cryptosporidium parvum
QKDVIDLYRKVINGIITGFEIA

SEQ ID NO: 2320311 - protein, 26 aa, Cryptosporidium parvum
QKEDILDFIDIYSLSSYFMGLTKIEG

SEQ ID NO: 2320312 - protein, 23 aa, Cryptosporidium parvum
QKENPFFAHDLLSNSLNMNKRRL

SEQ ID NO: 2320313 - protein, 23 aa, Cryptosporidium parvum
QKENYIFNFKNIHYFHSNKQGEF

SEQ ID NO: 2320314 - protein, 18 aa, Cryptosporidium parvum
QKGFGGFGGILRYKVDFQ

SEQ ID NO: 2320315 - protein, 17 aa, Cryptosporidium parvum
QKHPSCIPIFLELHLVF

SEQ ID NO: 2320316 - protein, 26 aa, Cryptosporidium parvum
QKIAQFEILCLSILLLNIYMQSNWTG

SEQ ID NO: 2320317 - protein, 19 aa, Cryptosporidium parvum
QKICIYQSLLQRIINKLND

SEQ ID NO: 2320318 - protein, 20 aa, Cryptosporidium parvum
QKIFELINWISEKDPTHEDC

SEQ ID NO: 2320319 - protein, 24 aa, Cryptosporidium parvum
QKIHPQVIIAGYRMALEEARKALS

SEQ ID NO: 2320320 - protein, 26 aa, Cryptosporidium parvum
QKIIKGIQSIFLGGPFKFEENSQISD

SEQ ID NO: 2320321 - protein, 20 aa, Cryptosporidium parvum
QKIIPRIVPNIFYLSKNTSE

SEQ ID NO: 2320322 - protein, 23 aa, Cryptosporidium parvum
QKIIVKRNVARVRPFILCAILRD

SEQ ID NO: 2320323 - protein, 35 aa, Cryptosporidium parvum; identical to SEQ ID NO: 2195761

SEQ ID NO: 2320324 - protein, 25 aa, Cryptosporidium parvum
QKLSSNILIILRDLSSQYKPRINPK

SEQ ID NO: 2320325 - protein, 39 aa, Cryptosporidium parvum
QKNESILLDNPFRWVLFPIKYSRLWSLYKKYEVSFWTAE

SEQ ID NO: 2320326 - protein, 28 aa, Cryptosporidium parvum
QKNKTFPFYPFIFPSGPFSDPKLHPNNG

SEQ ID NO: 2320327 - protein, 24 aa, Cryptosporidium parvum
QKNTPFFELSWTPGLAEDKTGQVK

SEQ ID NO: 2320328 - protein, 20 aa, Cryptosporidium parvum
QKQITPWQAYLEKRKQKRKE

SEQ ID NO: 2320329 - protein, 22 aa, Cryptosporidium parvum
QKQYSCPLCMTSTYYKNDIKMY

SEQ ID NO: 2320330 - protein, 29 aa, Cryptosporidium parvum
QKRLPDWAKRFHRILKVISQQEAFSPFVS

SEQ ID NO: 2320331 - protein, 31 aa, Cryptosporidium parvum; identical to SEQ ID NO: 2195773

SEQ ID NO: 2320332 - protein, 22 aa, Cryptosporidium parvum
QKRYSSLPRHNIRTIPPPFFPR

SEQ ID NO: 2320333 - protein, 18 aa, Cryptosporidium parvum
QKSFSVNKYGFYEAKRLA

SEQ ID NO: 2320334 - protein, 31 aa, Cryptosporidium parvum; identical to SEQ ID NO: 2195776

SEQ ID NO: 2320335 - protein, 32 aa, Cryptosporidium parvum
QKSPYFDRFSLRLPIIMLFESLLKVDLHRERL

SEQ ID NO: 2320336 - protein, 27 aa, Cryptosporidium parvum
QKTLKCCFEWFKTFKIMESDGVVCNDV

SEQ ID NO: 2320337 - protein, 23 aa, Cryptosporidium parvum
QKVFKFSIITMYTTKNNMNSGYA

SEQ ID NO: 2320338 - protein, 17 aa, Cryptosporidium parvum
QKVISNFCILPLVEDSC

SEQ ID NO: 2320339 - protein, 18 aa, Cryptosporidium parvum
QKVYLVDQSDCKELNKDE

SEQ ID NO: 2320340 - protein, 22 aa, Cryptosporidium parvum
QKVYRQVPYYKDVEVPFVVPRY

SEQ ID NO: 2320341 - protein, 23 aa, Cryptosporidium parvum
QKYIKLCDYLIHIPLYGNGTASL

SEQ ID NO: 2320342 - protein, 17 aa, Cryptosporidium parvum
QKYLVDMAAYRTTSGSP

SEQ ID NO: 2320343 - protein, 23 aa, Cryptosporidium parvum
QKYRLMRSIGVENVIYLLEDLNS

SEQ ID NO: 2320344 - protein, 21 aa, Cryptosporidium parvum
QKYTHLSRILTNTFYGRYISD

SEQ ID NO: 2320345 - protein, 19 aa, Cryptosporidium parvum
QLALYNQMAMAMYSPILAG

SEQ ID NO: 2320346 - protein, 17 aa, Cryptosporidium parvum
QLAPFCPIIDDENAFFS

SEQ ID NO: 2320347 - protein, 23 aa, Cryptosporidium parvum
QLCDSCTFIFLYDKNTKQSIEKC

SEQ ID NO: 2320348 - protein, 32 aa, Cryptosporidium parvum; identical to SEQ ID NO: 2195786

SEQ ID NO: 2320349 - protein, 19 aa, Cryptosporidium parvum
QLDSNLSIAYLKLQDYPNA

SEQ ID NO: 2320350 - protein, 25 aa, Cryptosporidium parvum
QLEENVNILLKLPSIFDLLPQPIED

SEQ ID NO: 2320351 - protein, 19 aa, Cryptosporidium parvum
QLEFNQVIIFVKSVSRAQA

SEQ ID NO: 2320352 - protein, 26 aa, Cryptosporidium parvum
QLEKQYKQELLRRSDLEELKRTIKDQ

SEQ ID NO: 2320353 - protein, 25 aa, Cryptosporidium parvum
QLEKRYAALFALRNILTGIIDSNQR

SEQ ID NO: 2320354 - protein, 30 aa, Cryptosporidium parvum; identical to SEQ ID NO: 2195793

SEQ ID NO: 2320355 - protein, 18 aa, Cryptosporidium parvum
QLFGFLGGLDGLFKSTYK

SEQ ID NO: 2320356 - protein, 20 aa, Cryptosporidium parvum
QLFGKLLMELYEIESFIKRS

SEQ ID NO: 2320357 - protein, 20 aa, Cryptosporidium parvum
QLFKPTIFITVPRVLNRIHD

SEQ ID NO: 2320358 - protein, 20 aa, Cryptosporidium parvum
QLGKWRECRDYVFSLSIWDY

SEQ ID NO: 2320359 - protein, 17 aa, Cryptosporidium parvum
QLGLFNKNNLIQKKSNE

SEQ ID NO: 2320360 - protein, 29 aa, Cryptosporidium parvum
QLGPAYRLTVIKIVPWITQLDAIPINRSG

SEQ ID NO: 2320361 - protein, 25 aa, Cryptosporidium parvum
QLGTLYRLSMQILPILLENNSYYLF

SEQ ID NO: 2320362 - protein, 18 aa, Cryptosporidium parvum
QLIIEKILKKNGSMNWKK

SEQ ID NO: 2320363 - protein, 58 aa, Cryptosporidium parvum
QLIKHAMSKSQLKALFSIFKISNYTQTFRSIAYLNRIQAIMSDYFRRSRYQNRMVILN

SEQ ID NO: 2320364 - protein, 19 aa, Cryptosporidium parvum
QLIKYKLPNKFSTSLPRSV

SEQ ID NO: 2320365 - protein, 31 aa, Cryptosporidium parvum; identical to SEQ ID NO: 2195801

SEQ ID NO: 2320366 - protein, 31 aa, Cryptosporidium parvum
QLKDFINSQAYLYFDILKVLGIDFDSSNNSF

SEQ ID NO: 2320367 - protein, 27 aa, Cryptosporidium parvum
QLKDFRNQLLLLRRNLAAEFGISNTNS

SEQ ID NO: 2320368 - protein, 17 aa, Cryptosporidium parvum
QLKEYFSQFGKILRIKL

SEQ ID NO: 2320369 - protein, 24 aa, Cryptosporidium parvum
QLKMRSPAIFSLSFDRPNLKYEVR

SEQ ID NO: 2320370 - protein, 19 aa, Cryptosporidium parvum
QLKPLVRIQAQLRRVLDIE

SEQ ID NO: 2320371 - protein, 27 aa, Cryptosporidium parvum
QLLEAVYLRYKLRREFRKNQLKPLVRI

SEQ ID NO: 2320372 - protein, 24 aa, Cryptosporidium parvum
QLLEDEYFIVYEKNKQIGQELEEE

SEQ ID NO: 2320373 - protein, 19 aa, Cryptosporidium parvum
QLLLTLVYGNDWVPMAIIE

SEQ ID NO: 2320374 - protein, 21 aa, Cryptosporidium parvum
QLLQYSRFILSKKISLCIKSL

SEQ ID NO: 2320375 - protein, 18 aa, Cryptosporidium parvum
QLLTKLILLVQRCQNYVK

SEQ ID NO: 2320376 - protein, 24 aa, Cryptosporidium parvum
QLMPSIPGVYFDRRQIGYRVRYHN

SEQ ID NO: 2320377 - protein, 18 aa, Cryptosporidium parvum
QLMQAYPQNRFVSKKKCR

SEQ ID NO: 2320378 - protein, 20 aa, Cryptosporidium parvum
QLMSNHRLMALLKSIAIVGT

SEQ ID NO: 2320379 - protein, 25 aa, Cryptosporidium parvum
QLNEKVINTTFFNSNPTLIGNSVEN

SEQ ID NO: 2320380 - protein, 17 aa, Cryptosporidium parvum
QLNPLLEELKIIRKENN

SEQ ID NO: 2320381 - protein, 24 aa, Cryptosporidium parvum
QLNSIFSEVFPRDLELQKASVIKP

SEQ ID NO: 2320382 - protein, 23 aa, Cryptosporidium parvum
QLNVNNSHFLIMQGRITKVINMK

SEQ ID NO: 2320383 - protein, 19 aa, Cryptosporidium parvum
QLNYFRVTNIYIPGTELNS

SEQ ID NO: 2320384 - protein, 18 aa, Cryptosporidium parvum
QLPTFYSLKIRINNTNPN

SEQ ID NO: 2320385 - protein, 25 aa, Cryptosporidium parvum
QLQDKKYHSFVQNTLADYQASAFDA

SEQ ID NO: 2320386 - protein, 21 aa, Cryptosporidium parvum
QLQFVPQRYLRRGIFSSVDLS

SEQ ID NO: 2320387 - protein, 20 aa, Cryptosporidium parvum
QLRDEFFIMYANSGICKSRM

SEQ ID NO: 2320388 - protein, 17 aa, Cryptosporidium parvum
QLRDRLIKQFTLESQIG

SEQ ID NO: 2320389 - protein, 21 aa, Cryptosporidium parvum
QLRKIVNHPYLFVEEYLIEDD

SEQ ID NO: 2320390 - protein, 17 aa, Cryptosporidium parvum
QLSELRRRHSNELQRFE

SEQ ID NO: 2320391 - protein, 24 aa, Cryptosporidium parvum
QLSFSNFKIFLKLPNRLQVQDVLS

SEQ ID NO: 2320392 - protein, 25 aa, Cryptosporidium parvum
QLSKLNLMDDWIRSISFTETNKRFI

SEQ ID NO: 2320393 - protein, 17 aa, Cryptosporidium parvum
QLSLELSKALRLPVLYL

SEQ ID NO: 2320394 - protein, 25 aa, Cryptosporidium parvum
QLSLSSSLSVPFPKPSRSSKANSVD

SEQ ID NO: 2320395 - protein, 18 aa, Cryptosporidium parvum
QLSNILLNLRYKAFSELS

SEQ ID NO: 2320396 - protein, 17 aa, Cryptosporidium parvum
QLSRLLIVLFSVYHNFE

SEQ ID NO: 2320397 - protein, 17 aa, Cryptosporidium parvum
QLSRYFFDSFSSFISDI

SEQ ID NO: 2320398 - protein, 24 aa, Cryptosporidium parvum
QLTALINVPHWLKPASNKQEFLLE

SEQ ID NO: 2320399 - protein, 23 aa, Cryptosporidium parvum
QLTPQLAAFLGNPNLIPTKDVGS

SEQ ID NO: 2320400 - protein, 29 aa, Cryptosporidium parvum
QLTPYEVLNQYLQFAFTPLLDALGNAKTT

SEQ ID NO: 2320401 - protein, 31 aa, Cryptosporidium parvum; identical to SEQ ID NO: 2195830

SEQ ID NO: 2320402 - protein, 19 aa, Cryptosporidium parvum
QLVYLEPFYVKVLQTEFGS

SEQ ID NO: 2320403 - protein, 17 aa, Cryptosporidium parvum
QLWDKLVTRIDLNSELN

SEQ ID NO: 2320404 - protein, 18 aa, Cryptosporidium parvum
QLYHPLMYKTKECSLYPN

SEQ ID NO: 2320405 - protein, 21 aa, Cryptosporidium parvum
QLYSIITKYLLPDIHFAGKTI

SEQ ID NO: 2320406 - protein, 30 aa, Cryptosporidium parvum
QLYVDSKYILNIFEILLLYHKNPELDNSNT

SEQ ID NO: 2320407 - protein, 25 aa, Cryptosporidium parvum
QMAADIYFYWQELGMKDENLYHAYK

SEQ ID NO: 2320408 - protein, 26 aa, Cryptosporidium parvum
QMDSKKLFLFDLDGTLTLPRKPIMED

SEQ ID NO: 2320409 - protein, 24 aa, Cryptosporidium parvum
QMDSNFFLIGITSLDIFPTNDHEY

SEQ ID NO: 2320410 - protein, 23 aa, Cryptosporidium parvum
QMDYFLEEILTPNFIPKIINELD

SEQ ID NO: 2320411 - protein, 23 aa, Cryptosporidium parvum
QMEWYLCHSFLKNIESIPNKISE

SEQ ID NO: 2320412 - protein, 24 aa, Cryptosporidium parvum
QMGIHNIFYGCKNYRFGGCGSVLD

SEQ ID NO: 2320413 - protein, 33 aa, Cryptosporidium parvum; identical to SEQ ID NO: 2195839

SEQ ID NO: 2320414 - protein, 27 aa, Cryptosporidium parvum
QMIKLCSSFRRMLKLYVASCYYFGDIS

SEQ ID NO: 2320415 - protein, 19 aa, Cryptosporidium parvum
QMLICGIPSYLILQFFDKN

SEQ ID NO: 2320416 - protein, 18 aa, Cryptosporidium parvum
QMLMIVPSEFSFGSNYCN

SEQ ID NO: 2320417 - protein, 40 aa, Cryptosporidium parvum; identical to SEQ ID NO: 2195843

SEQ ID NO: 2320418 - protein, 18 aa, Cryptosporidium parvum
QMNMLWSSVITPIVSPEH

SEQ ID NO: 2320419 - protein, 37 aa, Cryptosporidium parvum
QMPNYEWLANWMKIILSAICMPLITLFPQKVNCDVND

SEQ ID NO: 2320420 - protein, 19 aa, Cryptosporidium parvum
QMQRAGGLHPGFQPVLHHL

SEQ ID NO: 2320421 - protein, 23 aa, Cryptosporidium parvum
QMSGRDLFVYDPSLFVDDEDAAG

SEQ ID NO: 2320422 - protein, 20 aa, Cryptosporidium parvum
QMVVNTWLLEHGFTVGCQDI

SEQ ID NO: 2320423 - protein, 38 aa, Cryptosporidium parvum
QNAKSLFQIISKEELKYIYCIILKFIYQSKTKYCQEKA

SEQ ID NO: 2320424 - protein, 24 aa, Cryptosporidium parvum
QNCDILPYYIEYYRFQNVAFQRVV

SEQ ID NO: 2320425 - protein, 28 aa, Cryptosporidium parvum
QNDIVNLRRQLESYIKKYEIAKTDYQNL

SEQ ID NO: 2320426 - protein, 28 aa, Cryptosporidium parvum
QNDKLLINQLQFRLHKLTKNPKFICRTY

SEQ ID NO: 2320427 - protein, 24 aa, Cryptosporidium parvum
QNDSGIFLIKLFSSIISLQFRISS

SEQ ID NO: 2320428 - protein, 26 aa, Cryptosporidium parvum
QNEETIKRLRLLGEPITLFGEDDNER

SEQ ID NO: 2320429 - protein, 24 aa, Cryptosporidium parvum
QNEFGDFNTPYSSWFEGLGSCYSE

SEQ ID NO: 2320430 - protein, 21 aa, Cryptosporidium parvum
QNFIQAKYLNWFDQESFRSLD

SEQ ID NO: 2320431 - protein, 25 aa, Cryptosporidium parvum
QNFLKDSIKLFPLNGFDPLDIPNVG

SEQ ID NO: 2320432 - protein, 25 aa, Cryptosporidium parvum
QNGDMRLRFKDWSDLHNYLLVSMKQ

SEQ ID NO: 2320433 - protein, 21 aa, Cryptosporidium parvum
QNGLRFPPDFPKDAKLLVESL

SEQ ID NO: 2320434 - protein, 20 aa, Cryptosporidium parvum
QNHLHFENRLKDLVLRISSD

SEQ ID NO: 2320435 - protein, 35 aa, Cryptosporidium parvum; identical to SEQ ID NO: 2195857

SEQ ID NO: 2320436 - protein, 24 aa, Cryptosporidium parvum
QNINTLIHDIPINDLLVATSIDEI

SEQ ID NO: 2320437 - protein, 26 aa, Cryptosporidium parvum
QNKCRSMQLLIYKYHLMVAESCLDSL

SEQ ID NO: 2320438 - protein, 25 aa, Cryptosporidium parvum
QNKESFFWIRDRCLRYTPVNVEKYS

SEQ ID NO: 2320439 - protein, 23 aa, Cryptosporidium parvum
QNKLKKLFLTNNKIKIIQGLNNN

SEQ ID NO: 2320440 - protein, 28 aa, Cryptosporidium parvum
QNLKSSEWIFFFFKHLLSENPCTFRDLY

SEQ ID NO: 2320441 - protein, 26 aa, Cryptosporidium parvum
QNLLKDLYKIFPKAYTKIVRGITKGE

SEQ ID NO: 2320442 - protein, 24 aa, Cryptosporidium parvum
QNLNSIILNMFELLCNLITERNDC

SEQ ID NO: 2320443 - protein, 33 aa, Cryptosporidium parvum
QNLSEKMIWIVRTLFVMTILQNDVLVMSHLISK

SEQ ID NO: 2320444 - protein, 28 aa, Cryptosporidium parvum
QNMEEEVPLFSIKPWKCNIEIYENSKQF

SEQ ID NO: 2320445 - protein, 17 aa, Cryptosporidium parvum
QNMVFDETSRFLIYTCM

SEQ ID NO: 2320446 - protein, 20 aa, Cryptosporidium parvum
QNNCYWLVGFKEERWKKLIP

SEQ ID NO: 2320447 - protein, 29 aa, Cryptosporidium parvum
QNNDLIIDFPLFIKLVEYRIIKGTSQILR

SEQ ID NO: 2320448 - protein, 29 aa, Cryptosporidium parvum
QNNIPIFNNYKFVISPNIKVPSISEISWL

SEQ ID NO: 2320449 - protein, 27 aa, Cryptosporidium parvum
QNNQIELPFSFSYWPLDAGNGYTNVTI

SEQ ID NO: 2320450 - protein, 29 aa, Cryptosporidium parvum
QNNTEELWPLLNYIEPIKFASIEAFTQEF

SEQ ID NO: 2320451 - protein, 30 aa, Cryptosporidium parvum
QNPEHLTAPLPVMYPYHRGIGRAIGVPNHT

SEQ ID NO: 2320452 - protein, 20 aa, Cryptosporidium parvum
QNQHIFKKYTTTTTTPANVI

SEQ ID NO: 2320453 - protein, 26 aa, Cryptosporidium parvum
QNQPSNFWFHLPSILIFISRTLLRKE

SEQ ID NO: 2320454 - protein, 24 aa, Cryptosporidium parvum
QNQQKFNFIIPNINKMDSILLNNQ

SEQ ID NO: 2320455 - protein, 25 aa, Cryptosporidium parvum
QNQRRINRDFLLNSHATINNYNLEH

SEQ ID NO: 2320456 - protein, 28 aa, Cryptosporidium parvum
QNRKRHSRHFYVKKYGFNEAKKLAIQCR

SEQ ID NO: 2320457 - protein, 25 aa, Cryptosporidium parvum
QNRRGFIRLWKPLEKIIGYMEKNLP

SEQ ID NO: 2320458 - protein, 24 aa, Cryptosporidium parvum
QNSIRFYALFWDTVKHVVYRVNDI

SEQ ID NO: 2320459 - protein, 27 aa, Cryptosporidium parvum
QNSLRELWSLLNFLYPEIFSSSEEFEA

SEQ ID NO: 2320460 - protein, 23 aa, Cryptosporidium parvum
QNTDLNIRFVALGLLENMKEFPN

SEQ ID NO: 2320461 - protein, 20 aa, Cryptosporidium parvum
QNTRELLRNISFSNSGGLKG

SEQ ID NO: 2320462 - protein, 18 aa, Cryptosporidium parvum
QNTSLILYGLGGNNSKCH

SEQ ID NO: 2320463 - protein, 19 aa, Cryptosporidium parvum
QNVFKIAPLYYRSKKQKMV

SEQ ID NO: 2320464 - protein, 27 aa, Cryptosporidium parvum
QNVLRNQLTMRYSFNNDQLYSYSGGGN

SEQ ID NO: 2320465 - protein, 21 aa, Cryptosporidium parvum
QNYQEFRLRYPDIENPNVIGP

SEQ ID NO: 2320466 - protein, 17 aa, Cryptosporidium parvum
QNYYSILRRYAIECLIE

SEQ ID NO: 2320467 - protein, 47 aa, Cryptosporidium parvum; identical to SEQ ID NO: 2195883

SEQ ID NO: 2320468 - protein, 31 aa, Cryptosporidium parvum
QPDIPFNHGYIWGPLPITCFIDVINPNGGNL

SEQ ID NO: 2320469 - protein, 23 aa, Cryptosporidium parvum
QPEIETLLLALQPCCVNLSKVFL

SEQ ID NO: 2320470 - protein, 22 aa, Cryptosporidium parvum
QPEKFSHFNLSNKKSNLSLNQK

SEQ ID NO: 2320471 - protein, 24 aa, Cryptosporidium parvum
QPEKQIYRPKWASSGFAERMRAAR

SEQ ID NO: 2320472 - protein, 20 aa, Cryptosporidium parvum
QPHDIEKIYLSWKGINPPEN

SEQ ID NO: 2320473 - protein, 17 aa, Cryptosporidium parvum
QPHSIFDTLQFLEYIGN

SEQ ID NO: 2320474 - protein, 36 aa, Cryptosporidium parvum
QPHSPHPMGLQPFPMHSILLPTLLQAQIQAQMRQTS

SEQ ID NO: 2320475 - protein, 28 aa, Cryptosporidium parvum
QPIDTSNWPLLLKNYSKLNVRTGHYTPL

SEQ ID NO: 2320476 - protein, 22 aa, Cryptosporidium parvum
QPKGFFHELFKRQTKSEAEEDK

SEQ ID NO: 2320477 - protein, 18 aa, Cryptosporidium parvum
QPKRWMIMFSRAQSSSSR

SEQ ID NO: 2320478 - protein, 17 aa, Cryptosporidium parvum
QPKRWVFCPCRSCLFKG

SEQ ID NO: 2320479 - protein, 25 aa, Cryptosporidium parvum
QPKVLSLTRRLWQKGIRSEYRLTPV

SEQ ID NO: 2320480 - protein, 22 aa, Cryptosporidium parvum
QPLCIRLWEFLFKEGNIIKFFS

SEQ ID NO: 2320481 - protein, 21 aa, Cryptosporidium parvum
QPLMSNGVLFEQVPTVSRSRK

SEQ ID NO: 2320482 - protein, 18 aa, Cryptosporidium parvum
QPLSNYLSLIKSDVSRIF

SEQ ID NO: 2320483 - protein, 17 aa, Cryptosporidium parvum
QPPPPPPTPAPVEESSW

SEQ ID NO: 2320484 - protein, 33 aa, Cryptosporidium parvum
QPSILDDILIDVPQFKEIVLTEFITDAISKYDS

SEQ ID NO: 2320485 - protein, 27 aa, Cryptosporidium parvum
QPTVEESSWFSGWFGASETTPAPPPTP

SEQ ID NO: 2320486 - protein, 17 aa, Cryptosporidium parvum
QPWGGIPSPMAGGMPTR

SEQ ID NO: 2320487 - protein, 30 aa, Cryptosporidium parvum
QQADQDFNGAQVYYGAVQTPSQTTYGKCGV

SEQ ID NO: 2320488 - protein, 27 aa, Cryptosporidium parvum
QQALKHPWLVDSFKYNPIGPIYKQILC

SEQ ID NO: 2320489 - protein, 25 aa, Cryptosporidium parvum
QQDTLEYFTFLQEKLSDDLKKYYNH

SEQ ID NO: 2320490 - protein, 30 aa, Cryptosporidium parvum; identical to SEQ ID NO: 2179830

SEQ ID NO: 2320491 - protein, 20 aa, Cryptosporidium parvum
QQFFKSIKEKDPLNNKCIDC

SEQ ID NO: 2320492 - protein, 34 aa, Cryptosporidium parvum; identical to SEQ ID NO: 2195902

SEQ ID NO: 2320493 - protein, 24 aa, Cryptosporidium parvum
QQFSDELVFYNFLEQSRKLSCDIK

SEQ ID NO: 2320494 - protein, 29 aa, Cryptosporidium parvum
QQFSFALSCLYNRLNFVRNVLPDCTYTLA

SEQ ID NO: 2320495 - protein, 25 aa, Cryptosporidium parvum
QQGLDLLLQLLQYSPESRLTARQAL

SEQ ID NO: 2320496 - protein, 22 aa, Cryptosporidium parvum
QQIQSLLDMSISTAQNLESEME

SEQ ID NO: 2320497 - protein, 30 aa, Cryptosporidium parvum
QQITEDFLALIDPYILFLGGIDHQDNMNSQ

SEQ ID NO: 2320498 - protein, 20 aa, Cryptosporidium parvum
QQIYIIMEYCDEGDLGNILK

SEQ ID NO: 2320499 - protein, 17 aa, Cryptosporidium parvum
QQKLVFDIVLYYIEHIN

SEQ ID NO: 2320500 - protein, 26 aa, Cryptosporidium parvum
QQLLFTQQQYEYSLQLQYQYQLQQQL

SEQ ID NO: 2320501 - protein, 29 aa, Cryptosporidium parvum
QQLVRKLETLPLKFPWVNKSCTYIFPSGY

SEQ ID NO: 2320502 - protein, 19 aa, Cryptosporidium parvum
QQMYQHLQMLAFAQQQQML

SEQ ID NO: 2320503 - protein, 25 aa, Cryptosporidium parvum
QQNITSIIRLYLRFKNLISDRYGNI

SEQ ID NO: 2320504 - protein, 30 aa, Cryptosporidium parvum
QQNMSHMSILSIILERLFNSPFEELQKLHS

SEQ ID NO: 2320505 - protein, 19 aa, Cryptosporidium parvum
QQPLYKEWLAAKEVLLNSL

SEQ ID NO: 2320506 - protein, 22 aa, Cryptosporidium parvum
QQPQVYFQTKNIPMFSEAMSSG

SEQ ID NO: 2320507 - protein, 26 aa, Cryptosporidium parvum
QQQNNKLVITPKLKFGFGGTNLISGS

SEQ ID NO: 2320508 - protein, 31 aa, Cryptosporidium parvum
QQQQMLQRQLQMKEWALAAAYLTQQQQQQQQ

SEQ ID NO: 2320509 - protein, 24 aa, Cryptosporidium parvum
QQSLIRHLALIVDNFRGRFLYNNI

SEQ ID NO: 2320510 - protein, 20 aa, Cryptosporidium parvum
QQTFNKTFKPFLNSAGKSRG

SEQ ID NO: 2320511 - protein, 18 aa, Cryptosporidium parvum
QQTPLLSEPIHIVVDPSF

SEQ ID NO: 2320512 - protein, 21 aa, Cryptosporidium parvum
QRCCIMFYPPGNELIRQDGLS

SEQ ID NO: 2320513 - protein, 25 aa, Cryptosporidium parvum
QRDNHLIWSLFRQILEILSYCHKNE

SEQ ID NO: 2320514 - protein, 22 aa, Cryptosporidium parvum
QRELKALLKEKIAISDQSVHYI

SEQ ID NO: 2320515 - protein, 39 aa, Cryptosporidium parvum; identical to SEQ ID NO: 2195923

SEQ ID NO: 2320516 - protein, 28 aa, Cryptosporidium parvum
QRFAPIDQKLLCKYIRYARKYCKPQIRS

SEQ ID NO: 2320517 - protein, 23 aa, Cryptosporidium parvum
QRFSQFWIVNNIINSLFSTNNAY

SEQ ID NO: 2320518 - protein, 20 aa, Cryptosporidium parvum
QRGFFFIMNHEIIEFIFLEN

SEQ ID NO: 2320519 - protein, 20 aa, Cryptosporidium parvum
QRHVPRTFNVPIPVYSDALI

SEQ ID NO: 2320520 - protein, 25 aa, Cryptosporidium parvum
QRIEFRIPDSSACPHLAFSAILCAG

SEQ ID NO: 2320521 - protein, 27 aa, Cryptosporidium parvum
QRIETPLKVILDLETKMYYLGCNSNRI

SEQ ID NO: 2320522 - protein, 27 aa, Cryptosporidium parvum
QRKQSSNFQILWPSLQDWIYSSDKNIL

SEQ ID NO: 2320523 - protein, 25 aa, Cryptosporidium parvum
QRKRFISESIYIRPDIYHINQGNKK

SEQ ID NO: 2320524 - protein, 22 aa, Cryptosporidium parvum
QRLMDKFIQMYVLCPNCELPEI

SEQ ID NO: 2320525 - protein, 20 aa, Cryptosporidium parvum
QRNFYIENVLIALRHEMASN

SEQ ID NO: 2320526 - protein, 26 aa, Cryptosporidium parvum
QRNRLLQQQLEAMFKLVNDLSIKLDE

SEQ ID NO: 2320527 - protein, 30 aa, Cryptosporidium parvum
QRNSGIGTKLLNSFIPWMGTCGAQPSVGQN

SEQ ID NO: 2320528 - protein, 20 aa, Cryptosporidium parvum
QRQRIRPLSQRSAASNGISG

SEQ ID NO: 2320529 - protein, 24 aa, Cryptosporidium parvum
QRQYELIIRDLRRRIMFLERDIES

SEQ ID NO: 2320530 - protein, 22 aa, Cryptosporidium parvum
QRRVAMLLKLPAFKLAVEQSIK

SEQ ID NO: 2320531 - protein, 23 aa, Cryptosporidium parvum
QRTRELIRLVSLLETNKLNSLEE

SEQ ID NO: 2320532 - protein, 19 aa, Cryptosporidium parvum
QRVFLRNSFEKLKEVDYPT

SEQ ID NO: 2320533 - protein, 26 aa, Cryptosporidium parvum
QRVFSTVFMRYFIEKAQTYTPLVPKE

SEQ ID NO: 2320534 - protein, 27 aa, Cryptosporidium parvum
QRYNRTFMYRYYFNNIIFSLKAVTNNK

SEQ ID NO: 2320535 - protein, 18 aa, Cryptosporidium parvum
QSALFGLYKEFYGELEDI

SEQ ID NO: 2320536 - protein, 30 aa, Cryptosporidium parvum
QSCPRQIFAISWFMEFILYGFSNEESVLKS

SEQ ID NO: 2320537 - protein, 23 aa, Cryptosporidium parvum
QSDIFDQRLASKILKIVDVSYGG

SEQ ID NO: 2320538 - protein, 26 aa, Cryptosporidium parvum
QSDLRHILIHMLSHQLALDTTQINMA

SEQ ID NO: 2320539 - protein, 25 aa, Cryptosporidium parvum
QSEKSDFIIIRFYGEAYGSMSYKEY

SEQ ID NO: 2320540 - protein, 22 aa, Cryptosporidium parvum
QSEVCRLLREFLIEREFIEIHT

SEQ ID NO: 2320541 - protein, 17 aa, Cryptosporidium parvum
QSFMIWICKDFIAPRVI

SEQ ID NO: 2320542 - protein, 35 aa, Cryptosporidium parvum; identical to SEQ ID NO: 2195947

SEQ ID NO: 2320543 - protein, 19 aa, Cryptosporidium parvum
QSIGVYDMALGSDVNIQIL

SEQ ID NO: 2320544 - protein, 19 aa, Cryptosporidium parvum
QSIMKCDLDIRKDLYANIV

SEQ ID NO: 2320545 - protein, 23 aa, Cryptosporidium parvum
QSISISFVILLKLGRRLNILTYK

SEQ ID NO: 2320546 - protein, 28 aa, Cryptosporidium parvum
QSISSFPWNYIFKCSRDFSLSQFHSELE

SEQ ID NO: 2320547 - protein, 22 aa, Cryptosporidium parvum
QSKINFLTRISDKWISLSTNQF

SEQ ID NO: 2320548 - protein, 31 aa, Cryptosporidium parvum
QSKTDSLFQLLPYLLKLTKFQIIRNEFSLNY

SEQ ID NO: 2320549 - protein, 20 aa, Cryptosporidium parvum
QSKYSWHILVTNVDGKLIFD

SEQ ID NO: 2320550 - protein, 29 aa, Cryptosporidium parvum
QSLETICLLFAYKIKYPENFFLLRGNHEC

SEQ ID NO: 2320551 - protein, 48 aa, Cryptosporidium parvum; identical to SEQ ID NO: 2179892

SEQ ID NO: 2320552 - protein, 26 aa, Cryptosporidium parvum
QSLLSDPQFRLVLEQLKQNPATLTQV

SEQ ID NO: 2320553 - protein, 26 aa, Cryptosporidium parvum
QSLQLNLAMIYVKIQEWSKAIQVTGQ

SEQ ID NO: 2320554 - protein, 25 aa, Cryptosporidium parvum
QSLSLCLSPIMKFYRDLTTFIVNTI

SEQ ID NO: 2320555 - protein, 23 aa, Cryptosporidium parvum
QSLSPALFNRCVVNWMGQLNNQA

SEQ ID NO: 2320556 - protein, 33 aa, Cryptosporidium parvum; identical to SEQ ID NO: 2195963

SEQ ID NO: 2320557 - protein, 18 aa, Cryptosporidium parvum
QSNPLKLREIISSVLDQA

SEQ ID NO: 2320558 - protein, 26 aa, Cryptosporidium parvum
QSNSSKIFTYWYPYELDIPIKGYFTI

SEQ ID NO: 2320559 - protein, 32 aa, Cryptosporidium parvum
QSPIKRDLLLAIRKYLYSIPIFTEACISKSSL

SEQ ID NO: 2320560 - protein, 19 aa, Cryptosporidium parvum
QSPKHLQLSLSSRNIKQNQ

SEQ ID NO: 2320561 - protein, 22 aa, Cryptosporidium parvum
QSPYDLIRRRYLGELKKTLVND

SEQ ID NO: 2320562 - protein, 24 aa, Cryptosporidium parvum
QSQESFFYRLILETNQDKGFLTFF

SEQ ID NO: 2320563 - protein, 31 aa, Cryptosporidium parvum
QSQILSFLSISYISEKLFPFMSGQLANNTSS

SEQ ID NO: 2320564 - protein, 18 aa, Cryptosporidium parvum
QSRESIFPSMFPPEDPKI

SEQ ID NO: 2320565 - protein, 25 aa, Cryptosporidium parvum
QSSINNMILIFRQIEKRNLYNSLYK

SEQ ID NO: 2320566 - protein, 29 aa, Cryptosporidium parvum
QSSRNVSAEIFLVCLGYKAPKKIDSRFFD

SEQ ID NO: 2320567 - protein, 23 aa, Cryptosporidium parvum
QSTAIPPPPLSPPPPPPSSTIKS

SEQ ID NO: 2320568 - protein, 25 aa, Cryptosporidium parvum
QSTGIRKNLYTSTPGLNIMKNSKEQ

SEQ ID NO: 2320569 - protein, 23 aa, Cryptosporidium parvum
QSTYFSRYYIRKLLQEFNVNVLY

SEQ ID NO: 2320570 - protein, 18 aa, Cryptosporidium parvum
QSVDPIRKFYWKWRADNL

SEQ ID NO: 2320571 - protein, 21 aa, Cryptosporidium parvum
QSVHYIRYDGEILKKHYEQLR

SEQ ID NO: 2320572 - protein, 32 aa, Cryptosporidium parvum
QSVSFPDIYLSSLLHYIIKLQSSILEQLMYCT

SEQ ID NO: 2320573 - protein, 17 aa, Cryptosporidium parvum
QTAFKLLGLEVGASTKE

SEQ ID NO: 2320574 - protein, 25 aa, Cryptosporidium parvum
QTCVWLQYLFDSGKLVKPVIISCPA

SEQ ID NO: 2320575 - protein, 26 aa, Cryptosporidium parvum
QTELFDILLEIYNIIPTWGSFKENFY

SEQ ID NO: 2320576 - protein, 25 aa, Cryptosporidium parvum
QTELPMPRFGHSMAWISEKTFLIYG

SEQ ID NO: 2320577 - protein, 40 aa, Cryptosporidium parvum
QTFGVGIDWLDGMYRFIWLNDGRFIVPSLPPLPFEISKLY

SEQ ID NO: 2320578 - protein, 32 aa, Cryptosporidium parvum; identical to SEQ ID NO: 2195983

SEQ ID NO: 2320579 - protein, 23 aa, Cryptosporidium parvum
QTGFQFRLQVPMGSILASLRSQD

SEQ ID NO: 2320580 - protein, 18 aa, Cryptosporidium parvum
QTITQLKTRIRRLAMINS

SEQ ID NO: 2320581 - protein, 17 aa, Cryptosporidium parvum
QTKFCIATKKKIIFYNT

SEQ ID NO: 2320582 - protein, 23 aa, Cryptosporidium parvum
QTKKHLIFWEVDLGLNYVSRKSS

SEQ ID NO: 2320583 - protein, 28 aa, Cryptosporidium parvum
QTKVHSNFYFLFNNYLNFLENQPLKNDL

SEQ ID NO: 2320584 - protein, 20 aa, Cryptosporidium parvum
QTLHLRFSDIEQGKLDILSI

SEQ ID NO: 2320585 - protein, 24 aa, Cryptosporidium parvum
QTLIRRLSNLIEKCLIIDPKKRIS

SEQ ID NO: 2320586 - protein, 22 aa, Cryptosporidium parvum
QTLSRYWTHISLIGECFNILKK

SEQ ID NO: 2320587 - protein, 26 aa, Cryptosporidium parvum
QTMDQLISKVLYFYSRIHEICGEFTN

SEQ ID NO: 2320588 - protein, 20 aa, Cryptosporidium parvum
QTMRIPLPKNFVMDLNKLEK

SEQ ID NO: 2320589 - protein, 24 aa, Cryptosporidium parvum
QTNSIIRYMRRWNYLSLVMLPPNN

SEQ ID NO: 2320590 - protein, 21 aa, Cryptosporidium parvum
QTPAAFLNLLERQQQFFDAVQ

SEQ ID NO: 2320591 - protein, 23 aa, Cryptosporidium parvum
QTPHGFSQFFFFSSSKVTCELLV

SEQ ID NO: 2320592 - protein, 38 aa, Cryptosporidium parvum
QTPMFIKDKVMLEKYIYSLFELLTMIEPKRSNCNGVLE

SEQ ID NO: 2320593 - protein, 33 aa, Cryptosporidium parvum
QTPNPFPYQPHHQLPMPPLPPQNMQMPAPMPMQ

SEQ ID NO: 2320594 - protein, 25 aa, Cryptosporidium parvum
QTPSQTTYGKCGVKYETTQSGKTQI

SEQ ID NO: 2320595 - protein, 24 aa, Cryptosporidium parvum
QTQICRRAYIPNYSKDEVKDLIGC

SEQ ID NO: 2320596 - protein, 25 aa, Cryptosporidium parvum
QTSHWWLIVICHPRKIFNLMNSSSP

SEQ ID NO: 2320597 - protein, 29 aa, Cryptosporidium parvum
QTSNLKHQFILDPKLFRPLYESNNPDKCD

SEQ ID NO: 2320598 - protein, 19 aa, Cryptosporidium parvum
QTSRKLWVTYLTCLYESDN

SEQ ID NO: 2320599 - protein, 25 aa, Cryptosporidium parvum
QTTLYPVYMSFPYNQGRNINVPYTV

SEQ ID NO: 2320600 - protein, 24 aa, Cryptosporidium parvum
QTVLDYYQHWLKVSPPHEITVLYS

SEQ ID NO: 2320601 - protein, 25 aa, Cryptosporidium parvum
QTYVNRILAFLYADDESFLELQKKP

SEQ ID NO: 2320602 - protein, 25 aa, Cryptosporidium parvum
QVAWELFYIGRGDALRWIMMDRIRE

SEQ ID NO: 2320603 - protein, 24 aa, Cryptosporidium parvum
QVDGDAAIIYPDGGKYTGEVVNGI

SEQ ID NO: 2320604 - protein, 30 aa, Cryptosporidium parvum; identical to SEQ ID NO: 2196015

SEQ ID NO: 2320605 - protein, 25 aa, Cryptosporidium parvum
QVESFYYMFPSLEEFNRSWSRLREG

SEQ ID NO: 2320606 - protein, 26 aa, Cryptosporidium parvum
QVEYKDTKLLLLNQDYEILKRDFALL

SEQ ID NO: 2320607 - protein, 25 aa, Cryptosporidium parvum
QVFKSIACRHILLLSGTPVQNNTEE

SEQ ID NO: 2320608 - protein, 18 aa, Cryptosporidium parvum
QVFLLNQNLMRSCLEILI

SEQ ID NO: 2320609 - protein, 18 aa, Cryptosporidium parvum
QVILTVCPHLIRYLACFG

SEQ ID NO: 2320610 - protein, 28 aa, Cryptosporidium parvum
QVIPKEWPLLKMINFLKNSLVSSIHNQT

SEQ ID NO: 2320611 - protein, 22 aa, Cryptosporidium parvum
QVIQSAWRTLKAQALLVEKLAF

SEQ ID NO: 2320612 - protein, 25 aa, Cryptosporidium parvum
QVKNEWFPGIFPMVPGHEIIGIVEE

SEQ ID NO: 2320613 - protein, 17 aa, Cryptosporidium parvum
QVLETHVKLIIQDRIYD

SEQ ID NO: 2320614 - protein, 30 aa, Cryptosporidium parvum; identical to SEQ ID NO: 2196030

SEQ ID NO: 2320615 - protein, 20 aa, Cryptosporidium parvum
QVLIFKPNRLIKLSIKLALL

SEQ ID NO: 2320616 - protein, 22 aa, Cryptosporidium parvum
QVLWLIKNYLCGLEANKAVKYI

SEQ ID NO: 2320617 - protein, 19 aa, Cryptosporidium parvum
QVMNLLPIIISVIKGRLTA

SEQ ID NO: 2320618 - protein, 17 aa, Cryptosporidium parvum
QVNNPNLVLFVGEALVG

SEQ ID NO: 2320619 - protein, 29 aa, Cryptosporidium parvum
QVNYQLIPSIIRILSYAKNMFLDVAIVTN

SEQ ID NO: 2320620 - protein, 17 aa, Cryptosporidium parvum
QVPILCLGLTFDGDRII

SEQ ID NO: 2320621 - protein, 17 aa, Cryptosporidium parvum
QVPLIYVSLENIVSKWY

SEQ ID NO: 2320622 - protein, 20 aa, Cryptosporidium parvum
QVQELICSYAALVLSDGGVP

SEQ ID NO: 2320623 - protein, 24 aa, Cryptosporidium parvum
QVQLPTILHPTGTSSPYLILNTNS

SEQ ID NO: 2320624 - protein, 17 aa, Cryptosporidium parvum
QVRFRIPNPHSLMPLRS

SEQ ID NO: 2320625 - protein, 17 aa, Cryptosporidium parvum
QVRKYMQSIIRPEMKLI

SEQ ID NO: 2320626 - protein, 17 aa, Cryptosporidium parvum
QVRREAPDVSDTRAFPV

SEQ ID NO: 2320627 - protein, 29 aa, Cryptosporidium parvum
QVSLKDLFSLYGKNPFFYTLKENARINGF

SEQ ID NO: 2320628 - protein, 21 aa, Cryptosporidium parvum
QVSYGIGIARPLSLYINTFGT

SEQ ID NO: 2320629 - protein, 25 aa, Cryptosporidium parvum
QVTGFSVGYPFKTDQWREQQQSISF

SEQ ID NO: 2320630 - protein, 23 aa, Cryptosporidium parvum
QVTRSFNHLPVDIKLCGNGKVVR

SEQ ID NO: 2320631 - protein, 27 aa, Cryptosporidium parvum
QVVQRRDHISWFKVPPSIYFNRGCLEE

SEQ ID NO: 2320632 - protein, 17 aa, Cryptosporidium parvum
QVYGRLKNDLKLIQIFE

SEQ ID NO: 2320633 - protein, 18 aa, Cryptosporidium parvum
QWAPSVVRGISKLAFFSS

SEQ ID NO: 2320634 - protein, 17 aa, Cryptosporidium parvum
QWHEILIRNIKQNFIWE

SEQ ID NO: 2320635 - protein, 17 aa, Cryptosporidium parvum
QWIEFPPEKIYANSIVE

SEQ ID NO: 2320636 - protein, 19 aa, Cryptosporidium parvum
QWYKRLLDVGNVHGDVSFR

SEQ ID NO: 2320637 - protein, 22 aa, Cryptosporidium parvum
QYCETVCALGILRKHGSFIIKC

SEQ ID NO: 2320638 - protein, 19 aa, Cryptosporidium parvum
QYDLEFFNRILYGVLERNK

SEQ ID NO: 2320639 - protein, 21 aa, Cryptosporidium parvum
QYDLFIWGSTGFTGNLICDLL

SEQ ID NO: 2320640 - protein, 23 aa, Cryptosporidium parvum
QYDPLIHIIRRNEKGRWMRLMYE

SEQ ID NO: 2320641 - protein, 30 aa, Cryptosporidium parvum
QYFSESLPIWGILETPEIIKLPRYNSFSVI

SEQ ID NO: 2320642 - protein, 31 aa, Cryptosporidium parvum; identical to SEQ ID NO: 2196051

SEQ ID NO: 2320643 - protein, 39 aa, Cryptosporidium parvum
QYGQVHIPLISPIPHQFWYNHLIPQCNFGHIVPPPPDYF

SEQ ID NO: 2320644 - protein, 19 aa, Cryptosporidium parvum
QYIGVKRGINKRAPPIITK

SEQ ID NO: 2320645 - protein, 19 aa, Cryptosporidium parvum
QYLLDIFLELFDDYLRKFG

SEQ ID NO: 2320646 - protein, 18 aa, Cryptosporidium parvum
QYLLNQCLSFVMSSLENI

SEQ ID NO: 2320647 - protein, 30 aa, Cryptosporidium parvum; identical to SEQ ID NO: 2196057

SEQ ID NO: 2320648 - protein, 24 aa, Cryptosporidium parvum
QYNELWKAIIRPPRDRYSIRDLGP

SEQ ID NO: 2320649 - protein, 26 aa, Cryptosporidium parvum
QYNMKDIFYFYQSFDGQLVYLEPFYV

SEQ ID NO: 2320650 - protein, 19 aa, Cryptosporidium parvum
QYRFYLSTLLAITVKLVQN

SEQ ID NO: 2320651 - protein, 31 aa, Cryptosporidium parvum; identical to SEQ ID NO: 2196060

SEQ ID NO: 2320652 - protein, 34 aa, Cryptosporidium parvum
QYSQKIWISLFLVGSVHFPYLPKLRFNASMSTPF

SEQ ID NO: 2320653 - protein, 17 aa, Cryptosporidium parvum
QYSVDMVTKVFASLMQC

SEQ ID NO: 2320654 - protein, 17 aa, Cryptosporidium parvum
QYYFNLKGGMMFGTSKK

SEQ ID NO: 2320655 - protein, 24 aa, Cryptosporidium parvum
RAACYMQLLEYPSALIDVQKALDL

SEQ ID NO: 2320656 - protein, 17 aa, Cryptosporidium parvum
RAAMVWLDKKRYKYFET

SEQ ID NO: 2320657 - protein, 28 aa, Cryptosporidium parvum
RACKDYAFQISPYPIILSLEMHASDKQR

SEQ ID NO: 2320658 - protein, 29 aa, Cryptosporidium parvum
RAEHFITIMKKLILYLQEYIRVYSTRIEG

SEQ ID NO: 2320659 - protein, 24 aa, Cryptosporidium parvum
RAEILDILSYCRLMIDETADDCFL

SEQ ID NO: 2320660 - protein, 27 aa, Cryptosporidium parvum
RAEKGSSNLPPLPRTEDYWPKINKDTT

SEQ ID NO: 2320661 - protein, 17 aa, Cryptosporidium parvum
RAFFADLRCSVLKVPFN

SEQ ID NO: 2320662 - protein, 33 aa, Cryptosporidium parvum
RAFLRLSKEDIILLYIILFINNKVNMKNKKLLS

SEQ ID NO: 2320663 - protein, 25 aa, Cryptosporidium parvum
RAHLKYIGFPIVRDILYSDKVLPGT

SEQ ID NO: 2320664 - protein, 17 aa, Cryptosporidium parvum
RAHWGIGYVWFKREEYY

SEQ ID NO: 2320665 - protein, 23 aa, Cryptosporidium parvum
RAIELLLLPQHPCLILDIGCGTG

SEQ ID NO: 2320666 - protein, 25 aa, Cryptosporidium parvum
RAIETGVEILRRTLNKRENEIRASL

SEQ ID NO: 2320667 - protein, 22 aa, Cryptosporidium parvum
RAISHLDSYREWLDGMFTGADC

SEQ ID NO: 2320668 - protein, 22 aa, Cryptosporidium parvum
RAKVHKIFTSKLKMIQHEKLKN

SEQ ID NO: 2320669 - protein, 18 aa, Cryptosporidium parvum
RALVLKNNLRVLLVQDEN

SEQ ID NO: 2320670 - protein, 17 aa, Cryptosporidium parvum
RAMAMLWNVDTLRRARP

SEQ ID NO: 2320671 - protein, 17 aa, Cryptosporidium parvum
RAPCVTIEWYPGGRRLV

SEQ ID NO: 2320672 - protein, 28 aa, Cryptosporidium parvum
RAPVVTWQDIPIFKPFTFFSVNSEEEQG

SEQ ID NO: 2320673 - protein, 17 aa, Cryptosporidium parvum
RAQRAKSMKFRDGYMIA

SEQ ID NO: 2320674 - protein, 23 aa, Cryptosporidium parvum
RAQRIIPGIFLGGSTVANDLKKL

SEQ ID NO: 2320675 - protein, 18 aa, Cryptosporidium parvum
RARLDQNMYMVEGMGVNG

SEQ ID NO: 2320676 - protein, 19 aa, Cryptosporidium parvum
RARNYFKQVLGVNFSPKTK

SEQ ID NO: 2320677 - protein, 17 aa, Cryptosporidium parvum
RASRLIERALGEGAVFN

SEQ ID NO: 2320678 - protein, 26 aa, Cryptosporidium parvum
RATQKHMLPLSYKWIGLSRSNHKLLN

SEQ ID NO: 2320679 - protein, 32 aa, Cryptosporidium parvum; identical to SEQ ID NO: 2196092

SEQ ID NO: 2320680 - protein, 30 aa, Cryptosporidium parvum; identical to SEQ ID NO: 2196093

SEQ ID NO: 2320681 - protein, 24 aa, Cryptosporidium parvum
RAYAQAFEIIPYTLAENAGLNPIE

SEQ ID NO: 2320682 - protein, 25 aa, Cryptosporidium parvum
RAYDNKILIFTYKFNHKAPEFNWRD

SEQ ID NO: 2320683 - protein, 41 aa, Cryptosporidium parvum
RAYTCLEVYRYFKAIKSITLLQQWWRVTFTLRKHIDSGNSL

SEQ ID NO: 2320684 - protein, 22 aa, Cryptosporidium parvum
RCDSFKIPLLIDLNGEVVKIGW

SEQ ID NO: 2320685 - protein, 26 aa, Cryptosporidium parvum
RCEFEKKFLGTQYLIAFNPGSISCVL

SEQ ID NO: 2320686 - protein, 18 aa, Cryptosporidium parvum
RCELMLSINTRKEPSIDQ

SEQ ID NO: 2320687 - protein, 23 aa, Cryptosporidium parvum
RCIDDVILLSKSLSPIFNHFITK

SEQ ID NO: 2320688 - protein, 19 aa, Cryptosporidium parvum
RCIMVCTISPSVTFFQQTY

SEQ ID NO: 2320689 - protein, 18 aa, Cryptosporidium parvum
RCINYFSFGEESRVGITF

SEQ ID NO: 2320690 - protein, 17 aa, Cryptosporidium parvum
RCIVEVEMWKRKLKTQE

SEQ ID NO: 2320691 - protein, 25 aa, Cryptosporidium parvum
RCKGSLGFVLLRQTFYRLQLVVDAN

SEQ ID NO: 2320692 - protein, 28 aa, Cryptosporidium parvum
RCQYSHNVYWPRRCPFYLSDRSALRYLP

SEQ ID NO: 2320693 - protein, 25 aa, Cryptosporidium parvum
RCREFPIKYILKLLQTIEKPTENTE

SEQ ID NO: 2320694 - protein, 17 aa, Cryptosporidium parvum
RCRLNIPPCSRVPEPDY

SEQ ID NO: 2320695 - protein, 17 aa, Cryptosporidium parvum
RCSRYLYTLVMKDLEKA

SEQ ID NO: 2320696 - protein, 22 aa, Cryptosporidium parvum
RCYYLSLEFLLGRAMQNALVNL

SEQ ID NO: 2320697 - protein, 25 aa, Cryptosporidium parvum
RDAEAGDILVFYFAGHGVQVDVLTS

SEQ ID NO: 2320698 - protein, 22 aa, Cryptosporidium parvum
RDANTLFLDDNISFIGSKETDS

SEQ ID NO: 2320699 - protein, 25 aa, Cryptosporidium parvum
RDDENLLNYCFLISKPFKSNSIGFT

SEQ ID NO: 2320700 - protein, 22 aa, Cryptosporidium parvum
RDDPKLCWRCHKRDATPHMRSC

SEQ ID NO: 2320701 - protein, 24 aa, Cryptosporidium parvum
RDDWVRKLSRLMIPYVQKGVLDLG

SEQ ID NO: 2320702 - protein, 19 aa, Cryptosporidium parvum
RDELIPSCDIISFLDIFLL

SEQ ID NO: 2320703 - protein, 23 aa, Cryptosporidium parvum
RDENLIFKIVLLLLDELEKSSTQ

SEQ ID NO: 2320704 - protein, 22 aa, Cryptosporidium parvum
RDERKMFRLESSAESWVVKQKE

SEQ ID NO: 2320705 - protein, 26 aa, Cryptosporidium parvum
RDFAIFNQFFMPYFLAKSREYHEKEF

SEQ ID NO: 2320706 - protein, 28 aa, Cryptosporidium parvum
RDFNMEELPLIILANWRGFSGGQKDMFD

SEQ ID NO: 2320707 - protein, 17 aa, Cryptosporidium parvum
RDFVGGGGISRGGGNRD

SEQ ID NO: 2320708 - protein, 18 aa, Cryptosporidium parvum
RDGILLVNLLKQWSSLYG

SEQ ID NO: 2320709 - protein, 19 aa, Cryptosporidium parvum
RDGSRLRWIKSSLENGELV

SEQ ID NO: 2320710 - protein, 32 aa, Cryptosporidium parvum
RDHVTSPYKLDFLPYHFLLCSIGEFGELRYQD

SEQ ID NO: 2320711 - protein, 19 aa, Cryptosporidium parvum
RDIEPIYQLIVLNQKNPEN

SEQ ID NO: 2320712 - protein, 21 aa, Cryptosporidium parvum
RDIKSLNIFLSLPIKSNADVP

SEQ ID NO: 2320713 - protein, 24 aa, Cryptosporidium parvum
RDIKTVLNLIDPYISVNSFNRPNI

SEQ ID NO: 2320714 - protein, 20 aa, Cryptosporidium parvum
RDILRSYPQLSSNVIPILME

SEQ ID NO: 2320715 - protein, 25 aa, Cryptosporidium parvum
RDLAYRLCFLACHIEVVNAIASADD

SEQ ID NO: 2320716 - protein, 20 aa, Cryptosporidium parvum
RDLFIKCKIKCFKESDTTTI

SEQ ID NO: 2320717 - protein, 43 aa, Cryptosporidium parvum
RDLGRNYLIGRKCEFLKTVILELKFDIIELKKVIMKFIGQPQN

SEQ ID NO: 2320718 - protein, 17 aa, Cryptosporidium parvum
RDLKPENFLFLHSKSNI

SEQ ID NO: 2320719 - protein, 18 aa, Cryptosporidium parvum
RDLMFVTLTILLYKSKDI

SEQ ID NO: 2320720 - protein, 28 aa, Cryptosporidium parvum
RDNKWYLRSQPLRGINKILFEEQKLINI

SEQ ID NO: 2320721 - protein, 23 aa, Cryptosporidium parvum
RDNVNIPPPPYNAIGLNFPCNEG

SEQ ID NO: 2320722 - protein, 17 aa, Cryptosporidium parvum
RDRLIKQFTLESQIGDL

SEQ ID NO: 2320723 - protein, 24 aa, Cryptosporidium parvum
RDRLPSILLELWNGEEYLGEYLLP

SEQ ID NO: 2320724 - protein, 26 aa, Cryptosporidium parvum
RDRMRFKVINLFKKWTSRLSNSNCKV

SEQ ID NO: 2320725 - protein, 30 aa, Cryptosporidium parvum
RDSISRYLYEWIFNLIVELINIALKQNIFE

SEQ ID NO: 2320726 - protein, 22 aa, Cryptosporidium parvum
RDSIYLLGWVVEAIQALILIAD

SEQ ID NO: 2320727 - protein, 32 aa, Cryptosporidium parvum
RDSMAKAIYSKLFDWLVFRINKSMTNGLMNNN

SEQ ID NO: 2320728 - protein, 24 aa, Cryptosporidium parvum
RDSQINILFFMPHCDRCVFGMIIN

SEQ ID NO: 2320729 - protein, 24 aa, Cryptosporidium parvum
RDSSMFGMLLSSIFTAGIKNNINV

SEQ ID NO: 2320730 - protein, 25 aa, Cryptosporidium parvum
RDVADYDFIMKEKFFIIPRTSRESN

SEQ ID NO: 2320731 - protein, 18 aa, Cryptosporidium parvum
RDVYLVFDYMETDLHAVI

SEQ ID NO: 2320732 - protein, 17 aa, Cryptosporidium parvum
RDYCLRALSPGDKDIWL

SEQ ID NO: 2320733 - protein, 24 aa, Cryptosporidium parvum
RDYNLQLKTIKWNLSDLKNPELNS

SEQ ID NO: 2320734 - protein, 17 aa, Cryptosporidium parvum
REAILSSIFSKVLETFN

SEQ ID NO: 2320735 - protein, 18 aa, Cryptosporidium parvum
REALIASCRARHAAKENR

SEQ ID NO: 2320736 - protein, 20 aa, Cryptosporidium parvum
RECRDYVFSLSIWDYNQEDL

SEQ ID NO: 2320737 - protein, 27 aa, Cryptosporidium parvum
RECSDDYICKLYLLLKNVGIKITESFL

SEQ ID NO: 2320738 - protein, 28 aa, Cryptosporidium parvum
REDDLIQDLQWLIGPKLYEANWMELQDR

SEQ ID NO: 2320739 - protein, 21 aa, Cryptosporidium parvum
REDFMVWENKLRTLKWQTNPS

SEQ ID NO: 2320740 - protein, 34 aa, Cryptosporidium parvum
REEKWWESIYNYYSQIYIPGYLFGMISTRLTVDD

SEQ ID NO: 2320741 - protein, 17 aa, Cryptosporidium parvum
REELLKANDLYENYRKL

SEQ ID NO: 2320742 - protein, 25 aa, Cryptosporidium parvum
REEQILKHLFTFYSKVLLLDLDELE

SEQ ID NO: 2320743 - protein, 19 aa, Cryptosporidium parvum
REFFYSFLADCNEFCFLQL

SEQ ID NO: 2320744 - protein, 20 aa, Cryptosporidium parvum
REGKFIERESKLVEKENKLI

SEQ ID NO: 2320745 - protein, 17 aa, Cryptosporidium parvum
REGVARGLWPNEARLRN

SEQ ID NO: 2320746 - protein, 34 aa, Cryptosporidium parvum
REHRENLFDTFFWKLLIYSYFKLNSTLSSMPSLI

SEQ ID NO: 2320747 - protein, 17 aa, Cryptosporidium parvum
REILASRMIFRVSDGTG

SEQ ID NO: 2320748 - protein, 20 aa, Cryptosporidium parvum
REILDVVRYIPKIPTIHIIA

SEQ ID NO: 2320749 - protein, 32 aa, Cryptosporidium parvum
REIVYREWFLKCCKIIDPFLKISLKSLVYPET

SEQ ID NO: 2320750 - protein, 29 aa, Cryptosporidium parvum
REKCKILKPKLLLVPSDVLTLFIDYRLLS

SEQ ID NO: 2320751 - protein, 24 aa, Cryptosporidium parvum
REKCSYLLFILTPSENDKDLTTLE

SEQ ID NO: 2320752 - protein, 20 aa, Cryptosporidium parvum
REKDALLKIFRLVDEKALAQ

SEQ ID NO: 2320753 - protein, 31 aa, Cryptosporidium parvum
REKFSQLSKIWPLSFLKPRFTPEVLSDQVQH

SEQ ID NO: 2320754 - protein, 20 aa, Cryptosporidium parvum
REKHYCHFLNGTLCAIQRTM

SEQ ID NO: 2320755 - protein, 24 aa, Cryptosporidium parvum
RELFSPYCSIVSLYLWEISNGDYK

SEQ ID NO: 2320756 - protein, 20 aa, Cryptosporidium parvum
RELKVYILELRANDIREINT

SEQ ID NO: 2320757 - protein, 28 aa, Cryptosporidium parvum
RELTKQQFITWFVINQQNGPSIADSEVT

SEQ ID NO: 2320758 - protein, 18 aa, Cryptosporidium parvum
REMYLQHELELKENELNK

SEQ ID NO: 2320759 - protein, 29 aa, Cryptosporidium parvum
RENYAKYGMFLFLKLLEGYKDHWVDSIRL

SEQ ID NO: 2320760 - protein, 17 aa, Cryptosporidium parvum
RENYYSLRPSEVASMFP

SEQ ID NO: 2320761 - protein, 18 aa, Cryptosporidium parvum
REPSPPPIYDKNGSRINT

SEQ ID NO: 2320762 - protein, 17 aa, Cryptosporidium parvum
REQKAKLSLYRPNGNSN

SEQ ID NO: 2320763 - protein, 24 aa, Cryptosporidium parvum
REQNPLPFQRWSPNGPDVPRPTYK

SEQ ID NO: 2320764 - protein, 24 aa, Cryptosporidium parvum
REQRKPPFMKLYTIRQGDPLENKF

SEQ ID NO: 2320765 - protein, 26 aa, Cryptosporidium parvum
REQSLIILGLITTYLFFSIPKSRIRI

SEQ ID NO: 2320766 - protein, 18 aa, Cryptosporidium parvum
RERGITIDIALWQFETPK

SEQ ID NO: 2320767 - protein, 26 aa, Cryptosporidium parvum
RESHCSLPNPIIYKWPSNSVCIEDYK

SEQ ID NO: 2320768 - protein, 20 aa, Cryptosporidium parvum
RESKLTRLLQEYLGGGADPP

SEQ ID NO: 2320769 - protein, 29 aa, Cryptosporidium parvum
RESWNRAMSMNLINLKWLLVRSSESIRNK

SEQ ID NO: 2320770 - protein, 23 aa, Cryptosporidium parvum
RESYNHLVNWLADARTLARVDIS

SEQ ID NO: 2320771 - protein, 18 aa, Cryptosporidium parvum
RETCYLAAHSLRLKREKR

SEQ ID NO: 2320772 - protein, 25 aa, Cryptosporidium parvum
RETDNLKLYYLYESFENKKGTQNEL

SEQ ID NO: 2320773 - protein, 22 aa, Cryptosporidium parvum
REVRLSIFPEKYPEKRKISEEI

SEQ ID NO: 2320774 - protein, 24 aa, Cryptosporidium parvum
REYNKLYQKYTALLSEYTASKKNE

SEQ ID NO: 2320775 - protein, 19 aa, Cryptosporidium parvum
RFAFYKGELPILITTERFL

SEQ ID NO: 2320776 - protein, 18 aa, Cryptosporidium parvum
RFDKPLLSSLLGHSKQIS

SEQ ID NO: 2320777 - protein, 19 aa, Cryptosporidium parvum
RFDLRVENLHIFLHEQCEI

SEQ ID NO: 2320778 - protein, 45 aa, Cryptosporidium parvum; identical to SEQ ID NO: 2196181

SEQ ID NO: 2320779 - protein, 18 aa, Cryptosporidium parvum
RFEKSSLWKYFLDKSSEN

SEQ ID NO: 2320780 - protein, 31 aa, Cryptosporidium parvum
RFESNLRELISWWMKIVINDIPVIRFGDDKQ

SEQ ID NO: 2320781 - protein, 18 aa, Cryptosporidium parvum
RFFGNMVLSLWDCGGQDI

SEQ ID NO: 2320782 - protein, 19 aa, Cryptosporidium parvum
RFHKRKWKMYIDSSKTKIF

SEQ ID NO: 2320783 - protein, 17 aa, Cryptosporidium parvum
RFHQITILQVMLTNLFN

SEQ ID NO: 2320784 - protein, 22 aa, Cryptosporidium parvum
RFHSDVLKSRLLTPAVVVNQLK

SEQ ID NO: 2320785 - protein, 17 aa, Cryptosporidium parvum
RFHVYNLIKLNKSTKYR

SEQ ID NO: 2320786 - protein, 18 aa, Cryptosporidium parvum
RFIRIGLDRLASVEFNSP

SEQ ID NO: 2320787 - protein, 19 aa, Cryptosporidium parvum
RFKIFQPDLEEIFKIADIP

SEQ ID NO: 2320788 - protein, 17 aa, Cryptosporidium parvum
RFKIRAQCVLAMKAFEE

SEQ ID NO: 2320789 - protein, 23 aa, Cryptosporidium parvum
RFKNVNLLVMHFPSSFTNDQSWI

SEQ ID NO: 2320790 - protein, 17 aa, Cryptosporidium parvum
RFLFEGERLRPEMTAED

SEQ ID NO: 2320791 - protein, 20 aa, Cryptosporidium parvum
RFLGKLLNINLPVSIRRRIY

SEQ ID NO: 2320792 - protein, 19 aa, Cryptosporidium parvum
RFLIKLPIVVQTYSPSFLK

SEQ ID NO: 2320793 - protein, 18 aa, Cryptosporidium parvum
RFNEALRIYLVVKYNQMS

SEQ ID NO: 2320794 - protein, 17 aa, Cryptosporidium parvum
RFNQILKLLKNSSQFII

SEQ ID NO: 2320795 - protein, 26 aa, Cryptosporidium parvum
RFNQNQSIFLFILTSRVGGVGLNITG

SEQ ID NO: 2320796 - protein, 18 aa, Cryptosporidium parvum
RFPAKYKGQKKDTPSSYS

SEQ ID NO: 2320797 - protein, 24 aa, Cryptosporidium parvum
RFPEKSCRFLLDLLQNAESNCDMK

SEQ ID NO: 2320798 - protein, 22 aa, Cryptosporidium parvum
RFPPILLVQKTLPHIYLRGEIL

SEQ ID NO: 2320799 - protein, 18 aa, Cryptosporidium parvum
RFPTRVNSPRYYNEKKEV

SEQ ID NO: 2320800 - protein, 18 aa, Cryptosporidium parvum
RFPVEIIKDEFESLINPE

SEQ ID NO: 2320801 - protein, 26 aa, Cryptosporidium parvum
RFQRSTELLIRKLPFQRLVREIAQDF

SEQ ID NO: 2320802 - protein, 36 aa, Cryptosporidium parvum; identical to SEQ ID NO: 2196200

SEQ ID NO: 2320803 - protein, 27 aa, Cryptosporidium parvum
RFRGLSKLFKLPKSRSKILIRTLQTCI

SEQ ID NO: 2320804 - protein, 34 aa, Cryptosporidium parvum
RFRLRNNNPPRILICNPLKYLILERDSQIIIFDL

SEQ ID NO: 2320805 - protein, 18 aa, Cryptosporidium parvum
RFRTITSAYYRGADGVVL

SEQ ID NO: 2320806 - protein, 17 aa, Cryptosporidium parvum
RFRTITSSYYRGAHGII

SEQ ID NO: 2320807 - protein, 18 aa, Cryptosporidium parvum
RFSELQYLSLNATGLQRL

SEQ ID NO: 2320808 - protein, 18 aa, Cryptosporidium parvum
RFSLIKQLEYYFSDENLK

SEQ ID NO: 2320809 - protein, 26 aa, Cryptosporidium parvum
RFSSINLFEFFLIGAKNDLQQLFRIL

SEQ ID NO: 2320810 - protein, 27 aa, Cryptosporidium parvum
RFTEPKILRFIRVGNQLRRSITVTPLV

SEQ ID NO: 2320811 - protein, 33 aa, Cryptosporidium parvum
RFTLDLWMETQRRWIYLQGIFLASTDIANLLPQ

SEQ ID NO: 2320812 - protein, 18 aa, Cryptosporidium parvum
RFTMKTILMIADQMLQRV

SEQ ID NO: 2320813 - protein, 26 aa, Cryptosporidium parvum
RFTWEAYKMILDIIRLTPKLERIYHE

SEQ ID NO: 2320814 - protein, 32 aa, Cryptosporidium parvum
RFVEALKSFRSLNPLLLFSGDVFNPSIMSVTT

SEQ ID NO: 2320815 - protein, 20 aa, Cryptosporidium parvum
RFVLILDRPILQNSEVLLSE

SEQ ID NO: 2320816 - protein, 25 aa, Cryptosporidium parvum
RFYRQTIHYLSYTPLNKIPYKEKPS

SEQ ID NO: 2320817 - protein, 25 aa, Cryptosporidium parvum
RGDGKSYWQHTSPYKFSSSQGVIDW

SEQ ID NO: 2320818 - protein, 22 aa, Cryptosporidium parvum
RGEAAIIGSCKLNLSSRGAINN

SEQ ID NO: 2320819 - protein, 28 aa, Cryptosporidium parvum
RGEAKRFTLLFHISKMYLAIKTCKEWYR

SEQ ID NO: 2320820 - protein, 32 aa, Cryptosporidium parvum; identical to SEQ ID NO: 2196214

SEQ ID NO: 2320821 - protein, 17 aa, Cryptosporidium parvum
RGELFNDSIFSRKKQDI

SEQ ID NO: 2320822 - protein, 25 aa, Cryptosporidium parvum
RGELYLTLDELRWVQLHVRPEFGFI

SEQ ID NO: 2320823 - protein, 19 aa, Cryptosporidium parvum
RGEWLLEISPKYYNLEDFP

SEQ ID NO: 2320824 - protein, 23 aa, Cryptosporidium parvum
RGFALQDFSLENCLLYSVIEDKD

SEQ ID NO: 2320825 - protein, 18 aa, Cryptosporidium parvum
RGFLSGFVEAIDYALDKG

SEQ ID NO: 2320826 - protein, 18 aa, Cryptosporidium parvum
RGFVTLCRRLCGAIFETA

SEQ ID NO: 2320827 - protein, 26 aa, Cryptosporidium parvum
RGGAYNIIHGVFTWSFCKAISDIATG

SEQ ID NO: 2320828 - protein, 18 aa, Cryptosporidium parvum
RGGILYIVEPTSNTLLYC

SEQ ID NO: 2320829 - protein, 28 aa, Cryptosporidium parvum
RGGIVAPIQIEWPKTPPASPVEFEWLLH

SEQ ID NO: 2320830 - protein, 26 aa, Cryptosporidium parvum
RGGRIWFDRHLLFQDNFEPYFTDPDK

SEQ ID NO: 2320831 - protein, 20 aa, Cryptosporidium parvum
RGHTGLNHLLFTSVGVLNDK

SEQ ID NO: 2320832 - protein, 18 aa, Cryptosporidium parvum
RGIFSIKVKGLSAFWDDE

SEQ ID NO: 2320833 - protein, 17 aa, Cryptosporidium parvum
RGIHLFNKLNIPILTVV

SEQ ID NO: 2320834 - protein, 18 aa, Cryptosporidium parvum
RGIKLFRTEWGIKYDFWL

SEQ ID NO: 2320835 - protein, 24 aa, Cryptosporidium parvum
RGINMKRIFKLTQSKLRLRGKGSG

SEQ ID NO: 2320836 - protein, 17 aa, Cryptosporidium parvum
RGIRFNLLDVTLHADAI

SEQ ID NO: 2320837 - protein, 34 aa, Cryptosporidium parvum; identical to SEQ ID NO: 2196225

SEQ ID NO: 2320838 - protein, 19 aa, Cryptosporidium parvum
RGKLFDNLFTFIIYETCIE

SEQ ID NO: 2320839 - protein, 24 aa, Cryptosporidium parvum
RGKRCLSIRFKKQKFFTKKMTIRC

SEQ ID NO: 2320840 - protein, 17 aa, Cryptosporidium parvum
RGLHVDNILLVINFGAP

SEQ ID NO: 2320841 - protein, 28 aa, Cryptosporidium parvum
RGLQQWEQLYRQGLLLHKVDELSYDSWS

SEQ ID NO: 2320842 - protein, 18 aa, Cryptosporidium parvum
RGLRPSGDLIPWTLCNHL

SEQ ID NO: 2320843 - protein, 18 aa, Cryptosporidium parvum
RGLWPNEARLRNLTYSSP

SEQ ID NO: 2320844 - protein, 31 aa, Cryptosporidium parvum
RGLYHFGPEFRPVPLLQTFIGIKAKKGFKKL

SEQ ID NO: 2320845 - protein, 18 aa, Cryptosporidium parvum
RGLYMSHEHWVLPLSHDE

SEQ ID NO: 2320846 - protein, 17 aa, Cryptosporidium parvum
RGNIHILLMGDPGVAKS

SEQ ID NO: 2320847 - protein, 28 aa, Cryptosporidium parvum
RGNRDPRRSLLIRSLRFDTPTSLVRREF

SEQ ID NO: 2320848 - protein, 26 aa, Cryptosporidium parvum
RGPSRCPITLWFDQYNMKVVLEDFDT

SEQ ID NO: 2320849 - protein, 24 aa, Cryptosporidium parvum
RGQQLRHKYFGQQKLYGFPSNMSN

SEQ ID NO: 2320850 - protein, 30 aa, Cryptosporidium parvum
RGRLVSIVELLFRYIFHFERNEIRIRLSLP

SEQ ID NO: 2320851 - protein, 20 aa, Cryptosporidium parvum
RGRPCRIMWCLRDPASRRNN

SEQ ID NO: 2320852 - protein, 17 aa, Cryptosporidium parvum
RGRQIKVSTKRKNIPGY

SEQ ID NO: 2320853 - protein, 17 aa, Cryptosporidium parvum
RGRRKMFNKTQGEKALE

SEQ ID NO: 2320854 - protein, 30 aa, Cryptosporidium parvum
RGSFSIEVLLLLYSLKLNYPDTVYLLRGNH

SEQ ID NO: 2320855 - protein, 28 aa, Cryptosporidium parvum
RGSNRYKLLYGKTIKWLGSNTPLHIAAF

SEQ ID NO: 2320856 - protein, 48 aa, Cryptosporidium parvum
RGTLKFTTNNYLKWDPSHLITDLRGIHIPLSLAGKYFGLLKNERTKGD

SEQ ID NO: 2320857 - protein, 17 aa, Cryptosporidium parvum
RGTLRFVVKLVPNQQNP

SEQ ID NO: 2320858 - protein, 23 aa, Cryptosporidium parvum
RGVELYCIHPSGSCYKYCAMAVG

SEQ ID NO: 2320859 - protein, 25 aa, Cryptosporidium parvum
RGVNSYLFAQPAWKNVSSAAQHFVQ

SEQ ID NO: 2320860 - protein, 24 aa, Cryptosporidium parvum
RGVPQDFRWKIWNSLLQISSLDDE

SEQ ID NO: 2320861 - protein, 22 aa, Cryptosporidium parvum
RGYAFVTFKTIESALLACKNPV

SEQ ID NO: 2320862 - protein, 32 aa, Cryptosporidium parvum
RGYHNKVLLKRRKIVYITAGFNGCTSVKTCPG

SEQ ID NO: 2320863 - protein, 18 aa, Cryptosporidium parvum
RGYHTYCLDPPLDSVPSG

SEQ ID NO: 2320864 - protein, 25 aa, Cryptosporidium parvum
RGYILEVMLTKVRLLSKLQGEGRTI

SEQ ID NO: 2320865 - protein, 19 aa, Cryptosporidium parvum
RGYVLRRILRRAIRYGSQY

SEQ ID NO: 2320866 - protein, 18 aa, Cryptosporidium parvum
RHEIASFGSLNSVIWGSD

SEQ ID NO: 2320867 - protein, 26 aa, Cryptosporidium parvum
RHEKSLGICINFILNKSNLTDEQFDE

SEQ ID NO: 2320868 - protein, 17 aa, Cryptosporidium parvum
RHEMCVVQKNAIKDLIN

SEQ ID NO: 2320869 - protein, 18 aa, Cryptosporidium parvum
RHFNKIFAGITFLKFQDL

SEQ ID NO: 2320870 - protein, 26 aa, Cryptosporidium parvum
RHFQVLHAWLHAHLPAILCGPPGSGK

SEQ ID NO: 2320871 - protein, 27 aa, Cryptosporidium parvum
RHIKPIRALAKHPIHYSFLSAGADCIK

SEQ ID NO: 2320872 - protein, 17 aa, Cryptosporidium parvum
RHISTLFPGFNCPEAID

SEQ ID NO: 2320873 - protein, 25 aa, Cryptosporidium parvum
RHIYRKWIDWKPDPSIYIQYSKFEE

SEQ ID NO: 2320874 - protein, 23 aa, Cryptosporidium parvum
RHLAEFWMIEPEMAFADLSDNMK

SEQ ID NO: 2320875 - protein, 28 aa, Cryptosporidium parvum
RHNAWRDDIWCIKYLSNFKWHNLTEHNR

SEQ ID NO: 2320876 - protein, 23 aa, Cryptosporidium parvum
RHPGALIRRPVRPEIRLIDFGAA

SEQ ID NO: 2320877 - protein, 25 aa, Cryptosporidium parvum
RHPNICSYIGVCLEPGFYAIITEYL

SEQ ID NO: 2320878 - protein, 22 aa, Cryptosporidium parvum
RHPQLIYETKVLKLLQGGVGIA

SEQ ID NO: 2320879 - protein, 32 aa, Cryptosporidium parvum; identical to SEQ ID NO: 2196261

SEQ ID NO: 2320880 - protein, 30 aa, Cryptosporidium parvum
RIAACVLINILISYDPILQFPSHQNILYNS

SEQ ID NO: 2320881 - protein, 18 aa, Cryptosporidium parvum
RIAFLACGTLLNRDPYSW

SEQ ID NO: 2320882 - protein, 18 aa, Cryptosporidium parvum
RIAKLRSEILWDVPSNLN

SEQ ID NO: 2320883 - protein, 18 aa, Cryptosporidium parvum
RIAMFSWESLYTHSVGGV

SEQ ID NO: 2320884 - protein, 25 aa, Cryptosporidium parvum
RICHRFSQFWSSKSPIIHQYRFQMI

SEQ ID NO: 2320885 - protein, 27 aa, Cryptosporidium parvum
RIDADYTDLLWSFLVSIRDENLIFKIV

SEQ ID NO: 2320886 - protein, 24 aa, Cryptosporidium parvum
RIDGNNRIDFFNKFLIDMDINESE

SEQ ID NO: 2320887 - protein, 17 aa, Cryptosporidium parvum
RIDILDPILGKISKVDF

SEQ ID NO: 2320888 - protein, 21 aa, Cryptosporidium parvum
RIDLFLISKGLISESIKCEIL

SEQ ID NO: 2320889 - protein, 28 aa, Cryptosporidium parvum
RIEDNPMKLLELSNWISVLLEGIARQVV

SEQ ID NO: 2320890 - protein, 27 aa, Cryptosporidium parvum
RIEGDIPYRVFIKGKMYPGLAMSRAIG

SEQ ID NO: 2320891 - protein, 26 aa, Cryptosporidium parvum
RIEKSSNEILPWSKGIISIDGLASKG

SEQ ID NO: 2320892 - protein, 31 aa, Cryptosporidium parvum
RIELAGQLISILFEDLFKRFSVLTKKQIDQT

SEQ ID NO: 2320893 - protein, 23 aa, Cryptosporidium parvum
RIELKNLPIGDIIWVARPKLEDN

SEQ ID NO: 2320894 - protein, 26 aa, Cryptosporidium parvum
RIENRGRAHERSEFKYLRSNVKNHSR

SEQ ID NO: 2320895 - protein, 25 aa, Cryptosporidium parvum
RIERQRLELPGPGTPVTFETFMEWK

SEQ ID NO: 2320896 - protein, 17 aa, Cryptosporidium parvum
RIFAIYEYGGISLLTFI

SEQ ID NO: 2320897 - protein, 18 aa, Cryptosporidium parvum
RIFKMTWYDNMSKKSEEN

SEQ ID NO: 2320898 - protein, 17 aa, Cryptosporidium parvum
RIFLELLGARRFQVNVT

SEQ ID NO: 2320899 - protein, 17 aa, Cryptosporidium parvum
RIFPLKPGVPFTDDFQL

SEQ ID NO: 2320900 - protein, 18 aa, Cryptosporidium parvum
RIFVVFESPSMAQIAVPA

SEQ ID NO: 2320901 - protein, 17 aa, Cryptosporidium parvum
RIGALTEVFFALSKTQK

SEQ ID NO: 2320902 - protein, 17 aa, Cryptosporidium parvum
RIGLDRLASVEFNSPLI

SEQ ID NO: 2320903 - protein, 31 aa, Cryptosporidium parvum; identical to SEQ ID NO: 2196279

SEQ ID NO: 2320904 - protein, 20 aa, Cryptosporidium parvum
RIGVCLDTCHLFAAGYDVRT

SEQ ID NO: 2320905 - protein, 19 aa, Cryptosporidium parvum
RIHFRQILGGTEPFRITHE

SEQ ID NO: 2320906 - protein, 19 aa, Cryptosporidium parvum
RIHSSLIGSLSWTVPTDKD

SEQ ID NO: 2320907 - protein, 18 aa, Cryptosporidium parvum
RIIALIRQKKLVTEGIAH

SEQ ID NO: 2320908 - protein, 37 aa, Cryptosporidium parvum
RIIDIMTLLHKKIVIFQFISFLVIDEGDRLFDMGFAP

SEQ ID NO: 2320909 - protein, 20 aa, Cryptosporidium parvum
RIIDQLLNTAFGKFYFSITI

SEQ ID NO: 2320910 - protein, 34 aa, Cryptosporidium parvum
RIIENFVDQYYLYADNWINLLNKLNAENVVFIGT

SEQ ID NO: 2320911 - protein, 23 aa, Cryptosporidium parvum
RIIENLLLLKPDILNLSILIIIL

SEQ ID NO: 2320912 - protein, 20 aa, Cryptosporidium parvum
RIIFKKYKKIFMITGVDFDE

SEQ ID NO: 2320913 - protein, 28 aa, Cryptosporidium parvum
RIIMGEIDIFLALKLYLVQRESSMGLLS

SEQ ID NO: 2320914 - protein, 18 aa, Cryptosporidium parvum
RIIRMPVSLEAAFQTRDS

SEQ ID NO: 2320915 - protein, 37 aa, Cryptosporidium parvum; identical to SEQ ID NO: 2196285

SEQ ID NO: 2320916 - protein, 18 aa, Cryptosporidium parvum
RIKDEIRKGLVDCSTDTE

SEQ ID NO: 2320917 - protein, 18 aa, Cryptosporidium parvum
RIKKKEFCFTISDFIKEY

SEQ ID NO: 2320918 - protein, 28 aa, Cryptosporidium parvum
RIKQSFRSRFLSRIYLNLFNTISHGVGI

SEQ ID NO: 2320919 - protein, 27 aa, Cryptosporidium parvum
RIKRANLYYNKLLSYVKYYAVDEASEF

SEQ ID NO: 2320920 - protein, 19 aa, Cryptosporidium parvum
RILATWEFGMITGNISFKN

SEQ ID NO: 2320921 - protein, 25 aa, Cryptosporidium parvum
RILDYILEILINQITLFLKNYCDWG

SEQ ID NO: 2320922 - protein, 19 aa, Cryptosporidium parvum
RILIDLKFTGKLIQDLSIC

SEQ ID NO: 2320923 - protein, 21 aa, Cryptosporidium parvum
RILINEWKKLRWSNKLNLVIN

SEQ ID NO: 2320924 - protein, 22 aa, Cryptosporidium parvum
RILNKWQPLIFSGDIIFQDKNN

SEQ ID NO: 2320925 - protein, 20 aa, Cryptosporidium parvum
RILQAKLLMDLIEKYLKRLR

SEQ ID NO: 2320926 - protein, 28 aa, Cryptosporidium parvum
RINAYLTLLEFKLSLDPLYDPGPPDNHT

SEQ ID NO: 2320927 - protein, 35 aa, Cryptosporidium parvum; identical to SEQ ID NO: 2196295

SEQ ID NO: 2320928 - protein, 25 aa, Cryptosporidium parvum
RINEYEIWLVTEYIRTGDLFKLIHG

SEQ ID NO: 2320929 - protein, 18 aa, Cryptosporidium parvum
RINFLDVNRFPNLIKLSW

SEQ ID NO: 2320930 - protein, 22 aa, Cryptosporidium parvum
RINHLRSRFIYTKYYLDKEISR

SEQ ID NO: 2320931 - protein, 24 aa, Cryptosporidium parvum
RINNCLIWFDFGIENESKFDRSAL

SEQ ID NO: 2320932 - protein, 25 aa, Cryptosporidium parvum
RIRDRNMVRFIQWGPAAIQVALSKY

SEQ ID NO: 2320933 - protein, 19 aa, Cryptosporidium parvum
RIRGACLLEYKFIISKETE

SEQ ID NO: 2320934 - protein, 25 aa, Cryptosporidium parvum
RIRGGAVPPVLRPGAIPPGPPGVHG

SEQ ID NO: 2320935 - protein, 20 aa, Cryptosporidium parvum
RIRKDDGCLILPISKRRVSL

SEQ ID NO: 2320936 - protein, 19 aa, Cryptosporidium parvum
RIRLIASRDYYLDALNFGH

SEQ ID NO: 2320937 - protein, 18 aa, Cryptosporidium parvum
RIRLLKDLLPTINELYVG

SEQ ID NO: 2320938 - protein, 33 aa, Cryptosporidium parvum
RIRPNTQLQWLFIDKWPHLVVLTIPGIEIKQGD

SEQ ID NO: 2320939 - protein, 20 aa, Cryptosporidium parvum
RIRSNKWITNTFVRSFTMPI

SEQ ID NO: 2320940 - protein, 24 aa, Cryptosporidium parvum
RISDDWRWLALKSEKRLNNMKKMN

SEQ ID NO: 2320941 - protein, 19 aa, Cryptosporidium parvum
RISEFLNKHLSFINKLSED

SEQ ID NO: 2320942 - protein, 18 aa, Cryptosporidium parvum
RISGYFFGEGRNIFLKKA

SEQ ID NO: 2320943 - protein, 18 aa, Cryptosporidium parvum
RISKRFSNLLGRRPSKTY

SEQ ID NO: 2320944 - protein, 22 aa, Cryptosporidium parvum
RISQFDKLRLALLYSLKYEKEE

SEQ ID NO: 2320945 - protein, 34 aa, Cryptosporidium parvum; identical to SEQ ID NO: 2196307

SEQ ID NO: 2320946 - protein, 18 aa, Cryptosporidium parvum
RITELEKLLKMAENEQLV

SEQ ID NO: 2320947 - protein, 19 aa, Cryptosporidium parvum
RITERPFLIVFRGEGSTDF

SEQ ID NO: 2320948 - protein, 23 aa, Cryptosporidium parvum
RITIYITLQVVFILENLKNHFSS

SEQ ID NO: 2320949 - protein, 24 aa, Cryptosporidium parvum
RITTLCVIPNYILLLFGRNIENEL

SEQ ID NO: 2320950 - protein, 17 aa, Cryptosporidium parvum
RIVELIPRKSIVFDLTC

SEQ ID NO: 2320951 - protein, 28 aa, Cryptosporidium parvum
RIVISGLRCPIPIYIKKHIFVMSYIGDG

SEQ ID NO: 2320952 - protein, 17 aa, Cryptosporidium parvum
RIVKLTFGFGDNTFYLI

SEQ ID NO: 2320953 - protein, 23 aa, Cryptosporidium parvum
RIYFVKTLWPQINPLNILIVILH

SEQ ID NO: 2320954 - protein, 17 aa, Cryptosporidium parvum
RIYLDDIAKYFGWDNSH

SEQ ID NO: 2320955 - protein, 32 aa, Cryptosporidium parvum; identical to SEQ ID NO: 2196318

SEQ ID NO: 2320956 - protein, 18 aa, Cryptosporidium parvum
RIYVPLSIETKDDNAFFL

SEQ ID NO: 2320957 - protein, 34 aa, Cryptosporidium parvum
RKASFSIQSRWRSFQIRKSFLAILGSRIQAARVI

SEQ ID NO: 2320958 - protein, 26 aa, Cryptosporidium parvum
RKATPFLCLLVKLLQIRPSTEIVLEY

SEQ ID NO: 2320959 - protein, 25 aa, Cryptosporidium parvum
RKATRLVDQLLIKTSNDFSNLEGVA

SEQ ID NO: 2320960 - protein, 27 aa, Cryptosporidium parvum
RKCPVDYLRLLLKNIIFIGGSSINSLL

SEQ ID NO: 2320961 - protein, 25 aa, Cryptosporidium parvum
RKEGPIWILLIRTSKGRYESKIQCV

SEQ ID NO: 2320962 - protein, 21 aa, Cryptosporidium parvum
RKEIYKLPDGFSWFDCNLWDI

SEQ ID NO: 2320963 - protein, 24 aa, Cryptosporidium parvum
RKEKSAKWQVPIPKIKALNEDEMF

SEQ ID NO: 2320964 - protein, 26 aa, Cryptosporidium parvum
RKELRSFLITLYSNKLPIIISSASSA

SEQ ID NO: 2320965 - protein, 24 aa, Cryptosporidium parvum
RKEPNLGFKSLISSGIKVNMAELM

SEQ ID NO: 2320966 - protein, 32 aa, Cryptosporidium parvum
RKESDIIVIKTLVVALYRNDLVKKLVTYISKN

SEQ ID NO: 2320967 - protein, 22 aa, Cryptosporidium parvum
RKETSLLYKNEYVKDFLENYHL

SEQ ID NO: 2320968 - protein, 19 aa, Cryptosporidium parvum
RKEYRRELLDNSLRKFEMD

SEQ ID NO: 2320969 - protein, 26 aa, Cryptosporidium parvum
RKGKCLLPVFAIGRAQELLLILEEHW

SEQ ID NO: 2320970 - protein, 36 aa, Cryptosporidium parvum
RKHFLKLIDIYYFFRIQIIFWKLAMYKTYHIPNASV

SEQ ID NO: 2320971 - protein, 22 aa, Cryptosporidium parvum
RKHSRICLFCKGFKRPIQHISK

SEQ ID NO: 2320972 - protein, 23 aa, Cryptosporidium parvum
RKIAPPETLKFLEKVRVIWKHDN

SEQ ID NO: 2320973 - protein, 28 aa, Cryptosporidium parvum
RKIELLGKYYIILRYLKNNLISISLGKV

SEQ ID NO: 2320974 - protein, 20 aa, Cryptosporidium parvum
RKIFQLFRLRQINNGVFLPL

SEQ ID NO: 2320975 - protein, 60 aa, Cryptosporidium parvum
RKILARVRELWLSNIVEGLPRKIAAFILQRHGNQIPYDRQFWSYAYKTGRLHPAEEQVQR

SEQ ID NO: 2320976 - protein, 23 aa, Cryptosporidium parvum
RKIYDLMISPINDNYFILDLLAQ

SEQ ID NO: 2320977 - protein, 24 aa, Cryptosporidium parvum
RKKIHNWLCFSTALWYRCYAEHHR

SEQ ID NO: 2320978 - protein, 25 aa, Cryptosporidium parvum
RKKLPIINIPKLTRGFPVMGEQSVT

SEQ ID NO: 2320979 - protein, 23 aa, Cryptosporidium parvum
RKKLPWIRRNLLLRAINRENFCG

SEQ ID NO: 2320980 - protein, 26 aa, Cryptosporidium parvum
RKKNFESNFIFDLWSFLNGGGGNGNT

SEQ ID NO: 2320981 - protein, 21 aa, Cryptosporidium parvum
RKKPKIIFQFDNLSELASNIE

SEQ ID NO: 2320982 - protein, 19 aa, Cryptosporidium parvum
RKKVNLRGTIYSIPKPRRG

SEQ ID NO: 2320983 - protein, 26 aa, Cryptosporidium parvum
RKKVWPAVIVRQRKAFRRPEGTFLYF

SEQ ID NO: 2320984 - protein, 27 aa, Cryptosporidium parvum
RKKWQFHKKCFAWFYKRSDSKITTEDA

SEQ ID NO: 2320985 - protein, 29 aa, Cryptosporidium parvum
RKLHVPNSYIEIPLRGLSKLQLLTLEQLS

SEQ ID NO: 2320986 - protein, 21 aa, Cryptosporidium parvum
RKLRPPIVTLLTTSPPEVQYV

SEQ ID NO: 2320987 - protein, 18 aa, Cryptosporidium parvum
RKLVILYGNLSFPSKMIG

SEQ ID NO: 2320988 - protein, 17 aa, Cryptosporidium parvum
RKMVALAIEIFRGTAPS

SEQ ID NO: 2320989 - protein, 29 aa, Cryptosporidium parvum
RKNEDSISLLFIPILLKADLKKTRVNPEK

SEQ ID NO: 2320990 - protein, 19 aa, Cryptosporidium parvum
RKNIPGYNRGRGMGPGGGF

SEQ ID NO: 2320991 - protein, 19 aa, Cryptosporidium parvum
RKNSGLLIKTKLDQHGNFL

SEQ ID NO: 2320992 - protein, 25 aa, Cryptosporidium parvum
RKPPKLERYIRPTGLRFKKAHVTHP

SEQ ID NO: 2320993 - protein, 22 aa, Cryptosporidium parvum
RKPYIFKIAALRDIRNLFPIYR

SEQ ID NO: 2320994 - protein, 32 aa, Cryptosporidium parvum
RKQFTDKQALEILIGIFGEEYILSESHSGIDS

SEQ ID NO: 2320995 - protein, 41 aa, Cryptosporidium parvum
RKQIKKNNRYLLKIARFEEAFITIIPTLKGYYRSCGNNVNI

SEQ ID NO: 2320996 - protein, 24 aa, Cryptosporidium parvum
RKQNPLPIINISPSGGIVSVNNAI

SEQ ID NO: 2320997 - protein, 26 aa, Cryptosporidium parvum
RKQSDILRFLMRVRSWEYRQLPAVMR

SEQ ID NO: 2320998 - protein, 21 aa, Cryptosporidium parvum
RKRFFIGPHIDGVSYNPTIHR

SEQ ID NO: 2320999 - protein, 18 aa, Cryptosporidium parvum
RKRLDELFQERDGLYMQI

SEQ ID NO: 2321000 - protein, 23 aa, Cryptosporidium parvum
RKRYRFDVVITTPSILNSQVDCD

SEQ ID NO: 2321001 - protein, 38 aa, Cryptosporidium parvum; identical to SEQ ID NO: 2196349

SEQ ID NO: 2321002 - protein, 25 aa, Cryptosporidium parvum
RKSDWIRIIHRLGVFGLTPSWSSIF

SEQ ID NO: 2321003 - protein, 18 aa, Cryptosporidium parvum
RKSIERGRSKERVKRNYE

SEQ ID NO: 2321004 - protein, 26 aa, Cryptosporidium parvum
RKSKIHKIFFIVMENIFHTPVEIHRR

SEQ ID NO: 2321005 - protein, 24 aa, Cryptosporidium parvum
RKSLDRTFYLFFEDSKIPLSKVLG

SEQ ID NO: 2321006 - protein, 22 aa, Cryptosporidium parvum
RKSLEEVVIFPNQNLWLQEEKT

SEQ ID NO: 2321007 - protein, 19 aa, Cryptosporidium parvum
RKSSFLNASKWLEDIKQNS

SEQ ID NO: 2321008 - protein, 19 aa, Cryptosporidium parvum
RKSSLSRSPERPSEPYFSN

SEQ ID NO: 2321009 - protein, 54 aa, Cryptosporidium parvum; identical to SEQ ID NO: 2196357

SEQ ID NO: 2321010 - protein, 27 aa, Cryptosporidium parvum
RKTHNLFGFKFLNIGIKNQINLARAAR

SEQ ID NO: 2321011 - protein, 26 aa, Cryptosporidium parvum
RKTQDLAFQIFQGLKIIHEKGLVHAD

SEQ ID NO: 2321012 - protein, 23 aa, Cryptosporidium parvum
RKVHHPHIVHFIASFEEEDHVCL

SEQ ID NO: 2321013 - protein, 19 aa, Cryptosporidium parvum
RKVLYHKDLLPIEKEYLEY

SEQ ID NO: 2321014 - protein, 18 aa, Cryptosporidium parvum
RKVVFIQTLYLNDVNHIL

SEQ ID NO: 2321015 - protein, 25 aa, Cryptosporidium parvum
RKWRTLWCWTHIYVHYKRAQIYTRN

SEQ ID NO: 2321016 - protein, 19 aa, Cryptosporidium parvum
RKYLIQRIKKYFSLQANVE

SEQ ID NO: 2321017 - protein, 19 aa, Cryptosporidium parvum
RKYQVEKSLYYFAVVECDC

SEQ ID NO: 2321018 - protein, 20 aa, Cryptosporidium parvum
RKYVKDGLVPDLPKFYSSEL

SEQ ID NO: 2321019 - protein, 19 aa, Cryptosporidium parvum
RKYYPGEEIPILSIMGDGN

SEQ ID NO: 2321020 - protein, 18 aa, Cryptosporidium parvum
RLAIKELLRRYASKDYSE

SEQ ID NO: 2321021 - protein, 20 aa, Cryptosporidium parvum
RLALLGLDWDNITADDIYVV

SEQ ID NO: 2321022 - protein, 27 aa, Cryptosporidium parvum
RLDDERLLLYPDLLKDISDFLSTQYLN

SEQ ID NO: 2321023 - protein, 18 aa, Cryptosporidium parvum
RLDLLDEALLRPGRFEVQ

SEQ ID NO: 2321024 - protein, 17 aa, Cryptosporidium parvum
RLDSYFSIVVRNIRDSV

SEQ ID NO: 2321025 - protein, 27 aa, Cryptosporidium parvum
RLENMKPPPLIILPVYSSQPSEIQSLI

SEQ ID NO: 2321026 - protein, 30 aa, Cryptosporidium parvum; identical to SEQ ID NO: 2196373

SEQ ID NO: 2321027 - protein, 21 aa, Cryptosporidium parvum
RLFDMGFAPQLLSIISIIRPD

SEQ ID NO: 2321028 - protein, 17 aa, Cryptosporidium parvum
RLFPSFKREVIDRKPYI

SEQ ID NO: 2321029 - protein, 18 aa, Cryptosporidium parvum
RLFQIAIGKGTRAYQNFL

SEQ ID NO: 2321030 - protein, 31 aa, Cryptosporidium parvum
RLHNRSSELRLIIAPLALALVPVGEVKKIIS

SEQ ID NO: 2321031 - protein, 20 aa, Cryptosporidium parvum
RLHSVLIRPFALGKSEVIPA

SEQ ID NO: 2321032 - protein, 18 aa, Cryptosporidium parvum
RLIINPKVLLLDCTLEYK

SEQ ID NO: 2321033 - protein, 26 aa, Cryptosporidium parvum
RLINVENMLLSIIPKSHSVADIFQTK

SEQ ID NO: 2321034 - protein, 26 aa, Cryptosporidium parvum
RLKAIEWRVKLINEKKLRDNVVEYVN

SEQ ID NO: 2321035 - protein, 20 aa, Cryptosporidium parvum
RLKDVPISLGRKSWVRLYIE

SEQ ID NO: 2321036 - protein, 24 aa, Cryptosporidium parvum
RLKEYLRNMSPFFKDNLEVDIGLD

SEQ ID NO: 2321037 - protein, 26 aa, Cryptosporidium parvum
RLKFDKFLISIFGISSLGLFSKMKYD

SEQ ID NO: 2321038 - protein, 17 aa, Cryptosporidium parvum
RLKLLINELELCNRLFE

SEQ ID NO: 2321039 - protein, 25 aa, Cryptosporidium parvum
RLKNDLKLIQIFERETKSMGTLEII

SEQ ID NO: 2321040 - protein, 20 aa, Cryptosporidium parvum
RLLEAGIKPVFVFDGAPPEM

SEQ ID NO: 2321041 - protein, 22 aa, Cryptosporidium parvum
RLLVSYLLNCSKIKNLGITKEE

SEQ ID NO: 2321042 - protein, 18 aa, Cryptosporidium parvum
RLNKVNRLQGSLKCFYYM

SEQ ID NO: 2321043 - protein, 31 aa, Cryptosporidium parvum; identical to SEQ ID NO: 2196392

SEQ ID NO: 2321044 - protein, 24 aa, Cryptosporidium parvum
RLNSFLLNHFPRLNWINADISTLN

SEQ ID NO: 2321045 - protein, 34 aa, Cryptosporidium parvum
RLNSHQYKLQIFKFLNIKIPIKCDDQIYLYLGNS

SEQ ID NO: 2321046 - protein, 36 aa, Cryptosporidium parvum
RLPDEILKHQSWWIYKKIVILLYKYLVCIENNNFQN

SEQ ID NO: 2321047 - protein, 17 aa, Cryptosporidium parvum
RLPIIERREMNNNMIGI

SEQ ID NO: 2321048 - protein, 23 aa, Cryptosporidium parvum
RLPSLLSVLGKHLLIANLASEAA

SEQ ID NO: 2321049 - protein, 31 aa, Cryptosporidium parvum; identical to SEQ ID NO: 2196397

SEQ ID NO: 2321050 - protein, 21 aa, Cryptosporidium parvum
RLQSIYLLEPAGSRGVWGLDD

SEQ ID NO: 2321051 - protein, 28 aa, Cryptosporidium parvum
RLQTVDDLILLFVFVLELIMIENPHDYA

SEQ ID NO: 2321052 - protein, 26 aa, Cryptosporidium parvum
RLQVSLADFRRLCILKGVYPREPKKK

SEQ ID NO: 2321053 - protein, 20 aa, Cryptosporidium parvum
RLREFASILKEWRLCTGIEL

SEQ ID NO: 2321054 - protein, 26 aa, Cryptosporidium parvum
RLRTDLIDYIWTIEDFPLLRTLAMQR

SEQ ID NO: 2321055 - protein, 36 aa, Cryptosporidium parvum
RLSNGTYLLTLDYFIPLIETLNEILPLIAQRIAFSN

SEQ ID NO: 2321056 - protein, 18 aa, Cryptosporidium parvum
RLSWQQILALGKSTEKIV

SEQ ID NO: 2321057 - protein, 19 aa, Cryptosporidium parvum
RLTEIFSEYGLNGCDIKKK

SEQ ID NO: 2321058 - protein, 27 aa, Cryptosporidium parvum
RLTHTIRAFTKPIPVAPGQVKLNSADE

SEQ ID NO: 2321059 - protein, 31 aa, Cryptosporidium parvum; identical to SEQ ID NO: 2196402

SEQ ID NO: 2321060 - protein, 18 aa, Cryptosporidium parvum
RLTMCLHAYIRRKFETDE

SEQ ID NO: 2321061 - protein, 26 aa, Cryptosporidium parvum
RLTNTILKIVIIPAINQGVPNPLPEL

SEQ ID NO: 2321062 - protein, 20 aa, Cryptosporidium parvum
RLTNYRFSFDRMLDPKGNTA

SEQ ID NO: 2321063 - protein, 22 aa, Cryptosporidium parvum
RLVEKSFFSKFFKLKVKSDISR

SEQ ID NO: 2321064 - protein, 19 aa, Cryptosporidium parvum
RLVVQLLEISYKLLNEWNA

SEQ ID NO: 2321065 - protein, 17 aa, Cryptosporidium parvum
RLYEELYNKFQTCKNDI

SEQ ID NO: 2321066 - protein, 19 aa, Cryptosporidium parvum
RLYSEVYCLPDGTFAVLKD

SEQ ID NO: 2321067 - protein, 25 aa, Cryptosporidium parvum
RMDKFTFLQRTMLAESLNLLSKKNF

SEQ ID NO: 2321068 - protein, 21 aa, Cryptosporidium parvum
RMDLWSQYFDILTKLCSKDNP

SEQ ID NO: 2321069 - protein, 18 aa, Cryptosporidium parvum
RMESSLKPLNYWVKSIDS

SEQ ID NO: 2321070 - protein, 25 aa, Cryptosporidium parvum
RMIHRDMILYISFQEEIMSQRNQSE

SEQ ID NO: 2321071 - protein, 20 aa, Cryptosporidium parvum
RMILQIFTQLKLSAFSLKKC

SEQ ID NO: 2321072 - protein, 19 aa, Cryptosporidium parvum
RMLDLFLKERYNAVIHFAG

SEQ ID NO: 2321073 - protein, 18 aa, Cryptosporidium parvum
RMLDMGFAPQIREIVEDS

SEQ ID NO: 2321074 - protein, 32 aa, Cryptosporidium parvum
RMLKGEMMVPMTPWYKSFKGKIFPIKQKSKKN

SEQ ID NO: 2321075 - protein, 18 aa, Cryptosporidium parvum
RMLKHRIPGDCRVGSTAS

SEQ ID NO: 2321076 - protein, 26 aa, Cryptosporidium parvum
RMLNFTRSPWLKQLFSIEIVSRTIKN

SEQ ID NO: 2321077 - protein, 32 aa, Cryptosporidium parvum
RMLPKLIRFRHKVLIFCQMTQLMDILGDFLDY

SEQ ID NO: 2321078 - protein, 20 aa, Cryptosporidium parvum
RMLSRGLIPGEKLLGELFGM

SEQ ID NO: 2321079 - protein, 30 aa, Cryptosporidium parvum
RMLTNRVVTLWYRPPELLLGAQFYDTPVDM

SEQ ID NO: 2321080 - protein, 17 aa, Cryptosporidium parvum
RMMLNPQMIQSVLNSNN

SEQ ID NO: 2321081 - protein, 25 aa, Cryptosporidium parvum
RMNEYYLYNKWLIWCKKAYDRIEWV

SEQ ID NO: 2321082 - protein, 20 aa, Cryptosporidium parvum
RMSRLSPELLALVVRHIYSQ

SEQ ID NO: 2321083 - protein, 23 aa, Cryptosporidium parvum
RMVRDVFRLARENSPAIVFIDEV

SEQ ID NO: 2321084 - protein, 29 aa, Cryptosporidium parvum
RMYHGNLFIVRNLLYLKYELINLSKQNNC

SEQ ID NO: 2321085 - protein, 17 aa, Cryptosporidium parvum
RMYKLRLMVYNTLISKN

SEQ ID NO: 2321086 - protein, 17 aa, Cryptosporidium parvum
RNARQRKIKGMRLTPSE

SEQ ID NO: 2321087 - protein, 17 aa, Cryptosporidium parvum
RNCISLSFLLEEERLII

SEQ ID NO: 2321088 - protein, 18 aa, Cryptosporidium parvum
RNDFRRFDILFDSNLFGY

SEQ ID NO: 2321089 - protein, 18 aa, Cryptosporidium parvum
RNDHFPSEKLYKPSINNS

SEQ ID NO: 2321090 - protein, 23 aa, Cryptosporidium parvum
RNDLCVIMTGIPYIDKKNFLRLM

SEQ ID NO: 2321091 - protein, 20 aa, Cryptosporidium parvum
RNDWFSKVHKSKPEKCTSSE

SEQ ID NO: 2321092 - protein, 22 aa, Cryptosporidium parvum
RNEIRIMNLLRHPNIVQYMGGN

SEQ ID NO: 2321093 - protein, 28 aa, Cryptosporidium parvum
RNEKGINILRPFLPRLLICLLENSIFTD

SEQ ID NO: 2321094 - protein, 29 aa, Cryptosporidium parvum
RNELVQVGLFDLLDQFFSDLWSTGMAYKI

SEQ ID NO: 2321095 - protein, 27 aa, Cryptosporidium parvum
RNEVRSFLLGAAYHWLRRYHIDGLRID

SEQ ID NO: 2321096 - protein, 17 aa, Cryptosporidium parvum
RNFIRTVTKIRGEWLLE

SEQ ID NO: 2321097 - protein, 18 aa, Cryptosporidium parvum
RNFLSSELYIQIPDDEHK

SEQ ID NO: 2321098 - protein, 23 aa, Cryptosporidium parvum
RNGFKRLIISLNLSPELIKSEKT

SEQ ID NO: 2321099 - protein, 26 aa, Cryptosporidium parvum
RNGPSLSYLTIPRTASLFLSIGNNKT

SEQ ID NO: 2321100 - protein, 42 aa, Cryptosporidium parvum
RNGTNIILRFLMIPNGDIKCILWPFSLLFIHKNELSDDVNSV

SEQ ID NO: 2321101 - protein, 19 aa, Cryptosporidium parvum
RNHDVILVKKVFRKNQNNL

SEQ ID NO: 2321102 - protein, 21 aa, Cryptosporidium parvum
RNHHYFPIRNDPPNPFIHHQI

SEQ ID NO: 2321103 - protein, 17 aa, Cryptosporidium parvum
RNHLQKVQEWCSLGIRT

SEQ ID NO: 2321104 - protein, 19 aa, Cryptosporidium parvum
RNHPPYYGYVRRSINRKPG

SEQ ID NO: 2321105 - protein, 26 aa, Cryptosporidium parvum
RNHSNYRHSWVFPPDFPCFDAIHAMK

SEQ ID NO: 2321106 - protein, 24 aa, Cryptosporidium parvum
RNHVFPYGELLLPNPQVSKLINAV

SEQ ID NO: 2321107 - protein, 20 aa, Cryptosporidium parvum
RNIILQLRKGGIQSLQISDD

SEQ ID NO: 2321108 - protein, 17 aa, Cryptosporidium parvum
RNIMISLSLGLGLLSER

SEQ ID NO: 2321109 - protein, 25 aa, Cryptosporidium parvum
RNIRKVPFPILILHGTNDQVIHISN

SEQ ID NO: 2321110 - protein, 30 aa, Cryptosporidium parvum
RNIVILSYPSLKLFTTFFGNTPDYIQLALF

SEQ ID NO: 2321111 - protein, 19 aa, Cryptosporidium parvum
RNKDFIIIENLIESAKALL

SEQ ID NO: 2321112 - protein, 24 aa, Cryptosporidium parvum
RNKEAFSLIRWIAIADCIALHITG

SEQ ID NO: 2321113 - protein, 18 aa, Cryptosporidium parvum
RNLADYLSYGIINLDKPA

SEQ ID NO: 2321114 - protein, 27 aa, Cryptosporidium parvum
RNLGFSYRRTFSEFIYQFKYCDMSAAN

SEQ ID NO: 2321115 - protein, 26 aa, Cryptosporidium parvum
RNLQTLRQISWFYVILDEGHKIRNPD

SEQ ID NO: 2321116 - protein, 22 aa, Cryptosporidium parvum
RNLRFEEYGLFWKTIPEKNGNY

SEQ ID NO: 2321117 - protein, 26 aa, Cryptosporidium parvum
RNLRGWIEVLKRIPLYNPSNPGGIIP

SEQ ID NO: 2321118 - protein, 23 aa, Cryptosporidium parvum
RNLVSSFIPIPLNTRGLRRETMN

SEQ ID NO: 2321119 - protein, 23 aa, Cryptosporidium parvum
RNNPSFKLLMNHIEKWEVDNTYA

SEQ ID NO: 2321120 - protein, 23 aa, Cryptosporidium parvum
RNNRNVISLALNWISLSGEHNKK

SEQ ID NO: 2321121 - protein, 19 aa, Cryptosporidium parvum
RNNSLPYMGILGNSSNKGT

SEQ ID NO: 2321122 - protein, 25 aa, Cryptosporidium parvum
RNSDYLYIWDVRKPNNILFKLDREN

SEQ ID NO: 2321123 - protein, 26 aa, Cryptosporidium parvum
RNSGGRRILIDLLTQLEDYQQSMDDL

SEQ ID NO: 2321124 - protein, 32 aa, Cryptosporidium parvum
RNSIRFCDQIIFFLKKNWGIFYKKVNKIILNI

SEQ ID NO: 2321125 - protein, 17 aa, Cryptosporidium parvum
RNSKLTMVLKNSLGGNS

SEQ ID NO: 2321126 - protein, 17 aa, Cryptosporidium parvum
RNTFDQNTLQKILMSCK

SEQ ID NO: 2321127 - protein, 27 aa, Cryptosporidium parvum
RNTHNFSWVSVYFQMLIGSTPILIRGC

SEQ ID NO: 2321128 - protein, 18 aa, Cryptosporidium parvum
RNTLHPRSDLVMMSTLTE

SEQ ID NO: 2321129 - protein, 19 aa, Cryptosporidium parvum
RNTTVPKTPKFATQMRSES

SEQ ID NO: 2321130 - protein, 20 aa, Cryptosporidium parvum
RNTWLSLCLSNKGSLYNFSL

SEQ ID NO: 2321131 - protein, 22 aa, Cryptosporidium parvum
RNVQSIAKFLKKASFQSIVISL

SEQ ID NO: 2321132 - protein, 23 aa, Cryptosporidium parvum
RNWHYSYRHQFALQDYVVFCDHL

SEQ ID NO: 2321133 - protein, 34 aa, Cryptosporidium parvum
RNWRRRIVSYSTVPLYWYLLQEGGLIYIVTDVYD

SEQ ID NO: 2321134 - protein, 51 aa, Cryptosporidium parvum; identical to SEQ ID NO: 2196475

SEQ ID NO: 2321135 - protein, 17 aa, Cryptosporidium parvum
RPCILVFDDIETLGAFT

SEQ ID NO: 2321136 - protein, 18 aa, Cryptosporidium parvum
RPDMLDDAALRRLSKRVL

SEQ ID NO: 2321137 - protein, 20 aa, Cryptosporidium parvum
RPEGFPVYTTQWPSAFHGGD

SEQ ID NO: 2321138 - protein, 24 aa, Cryptosporidium parvum
RPEKVLWMRRQRVLRRLLRKYRES

SEQ ID NO: 2321139 - protein, 28 aa, Cryptosporidium parvum
RPELIHEYQLTIFSLYAAVSLGITVDSI

SEQ ID NO: 2321140 - protein, 29 aa, Cryptosporidium parvum
RPETYVPLEIKTSIFAAYFAAEPVVIHFS

SEQ ID NO: 2321141 - protein, 17 aa, Cryptosporidium parvum
RPFLLDEAEFKNAPETM

SEQ ID NO: 2321142 - protein, 31 aa, Cryptosporidium parvum
RPGVDKFLNIVSAIFEVVIFTASLSKYANPL

SEQ ID NO: 2321143 - protein, 18 aa, Cryptosporidium parvum
RPIANNEAFFPLPNNFSL

SEQ ID NO: 2321144 - protein, 29 aa, Cryptosporidium parvum
RPLPVNVCYIKLTFNWPGARLVRDLWALD

SEQ ID NO: 2321145 - protein, 26 aa, Cryptosporidium parvum
RPNKGFRLFLATELPKKILNPSHKDS

SEQ ID NO: 2321146 - protein, 17 aa, Cryptosporidium parvum
RPNWICLGNYHISIHTN

SEQ ID NO: 2321147 - protein, 24 aa, Cryptosporidium parvum
RPPQPPVYFIVLDVSMPSVSSGLV

SEQ ID NO: 2321148 - protein, 24 aa, Cryptosporidium parvum
RPQMSSCFLLRIPEDSINGIFDTL

SEQ ID NO: 2321149 - protein, 30 aa, Cryptosporidium parvum; identical to SEQ ID NO: 2196482

SEQ ID NO: 2321150 - protein, 21 aa, Cryptosporidium parvum
RPVITITFNITNSLFMSVGTL

SEQ ID NO: 2321151 - protein, 24 aa, Cryptosporidium parvum
RQAVDHPYLIVYGKFNHKKDLEYK

SEQ ID NO: 2321152 - protein, 17 aa, Cryptosporidium parvum
RQCYRLQFKGSDGKWYF

SEQ ID NO: 2321153 - protein, 27 aa, Cryptosporidium parvum
RQEAVSMLPVLFLDVKPNHYVLDLCSA

SEQ ID NO: 2321154 - protein, 22 aa, Cryptosporidium parvum
RQEQIRLLKKAAEISRPLSLQA

SEQ ID NO: 2321155 - protein, 33 aa, Cryptosporidium parvum
RQEWPVLVICPSSIRFQWYQQALDWLSPEINKS

SEQ ID NO: 2321156 - protein, 29 aa, Cryptosporidium parvum
RQGEYVASFKCTLLLLPNGSKRISGLQFT

SEQ ID NO: 2321157 - protein, 29 aa, Cryptosporidium parvum
RQIARLLVLISFFRYLPNPLPKIESNIED

SEQ ID NO: 2321158 - protein, 21 aa, Cryptosporidium parvum
RQIMQTINPRDYPFGNPSRGN

SEQ ID NO: 2321159 - protein, 28 aa, Cryptosporidium parvum
RQIWYNRLMWVLKHEIIISLLSLSQIDN

SEQ ID NO: 2321160 - protein, 33 aa, Cryptosporidium parvum; identical to SEQ ID NO: 2196493

SEQ ID NO: 2321161 - protein, 24 aa, Cryptosporidium parvum
RQKILNLSLKLQNGFKLLLELVQY

SEQ ID NO: 2321162 - protein, 27 aa, Cryptosporidium parvum
RQKQLIIQRSLVKLSLREKPVYRILAC

SEQ ID NO: 2321163 - protein, 24 aa, Cryptosporidium parvum
RQKSYRCICYISTPIYIHEYHEIS

SEQ ID NO: 2321164 - protein, 27 aa, Cryptosporidium parvum
RQLGTATYLIDFLALRVGGEKDTDEEA

SEQ ID NO: 2321165 - protein, 21 aa, Cryptosporidium parvum
RQLIECKGFWRRESSQWSFVT

SEQ ID NO: 2321166 - protein, 28 aa, Cryptosporidium parvum
RQLNTRFRLLLTGTPLQNSLRELWSLLN

SEQ ID NO: 2321167 - protein, 19 aa, Cryptosporidium parvum
RQLQYLLNENLVNLNLGIL

SEQ ID NO: 2321168 - protein, 17 aa, Cryptosporidium parvum
RQLRYEVNNLRKKLLET

SEQ ID NO: 2321169 - protein, 25 aa, Cryptosporidium parvum
RQLTGHVVTRWYRAPELILLQENYT

SEQ ID NO: 2321170 - protein, 22 aa, Cryptosporidium parvum
RQRISSSLYYRDLNDGTGHGGG

SEQ ID NO: 2321171 - protein, 17 aa, Cryptosporidium parvum
RQRMLMTRRSLPVYKVR

SEQ ID NO: 2321172 - protein, 24 aa, Cryptosporidium parvum
RQRSILEYVVVLSLELLFCDPYEA

SEQ ID NO: 2321173 - protein, 27 aa, Cryptosporidium parvum
RQRSSIAKYWYQKFNKQVFHNRLPEEV

SEQ ID NO: 2321174 - protein, 23 aa, Cryptosporidium parvum
RQSIRRMCQIATYLDNSGYSDEI

SEQ ID NO: 2321175 - protein, 27 aa, Cryptosporidium parvum
RQSNKRDIFTKWKNLLLKINPKADCNE

SEQ ID NO: 2321176 - protein, 28 aa, Cryptosporidium parvum
RQSVPKLFWLSIYYLVNSMKFISREHQR

SEQ ID NO: 2321177 - protein, 20 aa, Cryptosporidium parvum
RQTLIMNGYSFYSVISSSKT

SEQ ID NO: 2321178 - protein, 19 aa, Cryptosporidium parvum
RQTMLFSATLSRSVTDLAL

SEQ ID NO: 2321179 - protein, 24 aa, Cryptosporidium parvum
RQTQSICMLFHTMKLIEYKKQRFA

SEQ ID NO: 2321180 - protein, 26 aa, Cryptosporidium parvum
RQVYILGWLIHLRILNRIVDNIFIKS

SEQ ID NO: 2321181 - protein, 43 aa, Cryptosporidium parvum
RQVYKDELSSLTIIICWIEECLQNFVYPIQRKQSEYKLEISRE

SEQ ID NO: 2321182 - protein, 18 aa, Cryptosporidium parvum
RRAELWVEVFEPKFNKWI

SEQ ID NO: 2321183 - protein, 22 aa, Cryptosporidium parvum
RRAYIAFVRSYMSYDREFSKIF

SEQ ID NO: 2321184 - protein, 29 aa, Cryptosporidium parvum
RRCENEVWLTLPLFFPSATLHNVTHQRRD

SEQ ID NO: 2321185 - protein, 26 aa, Cryptosporidium parvum
RREELELYLLVLRVVSKKADIVISFN

SEQ ID NO: 2321186 - protein, 22 aa, Cryptosporidium parvum
RREKSGPLIVLKVGTSTLTNSR

SEQ ID NO: 2321187 - protein, 25 aa, Cryptosporidium parvum
RREYKLIVSLFSKYFELFSKDTWKN

SEQ ID NO: 2321188 - protein, 32 aa, Cryptosporidium parvum
RRFEQDFQAIPKEIIFPLIEKGILINNSKNTL

SEQ ID NO: 2321189 - protein, 25 aa, Cryptosporidium parvum
RRHSELAFKPLVLSAVENRRATAPD

SEQ ID NO: 2321190 - protein, 19 aa, Cryptosporidium parvum
RRIHKQLLPQMKYALVWGQ

SEQ ID NO: 2321191 - protein, 20 aa, Cryptosporidium parvum
RRIKTILESIKKFNLSNSDP

SEQ ID NO: 2321192 - protein, 17 aa, Cryptosporidium parvum
RRKMFNKTQGEKALEMN

SEQ ID NO: 2321193 - protein, 22 aa, Cryptosporidium parvum
RRKMKLIRFLMKLVNNSVVIEL

SEQ ID NO: 2321194 - protein, 27 aa, Cryptosporidium parvum
RRKRTESFALYIYKVLKQVHPETGISK

SEQ ID NO: 2321195 - protein, 25 aa, Cryptosporidium parvum
RRLFRKPVNTLLPGTYLPLNDDSGL

SEQ ID NO: 2321196 - protein, 28 aa, Cryptosporidium parvum
RRLLYNPLIDLLRLIEVWSKYRLELQKS

SEQ ID NO: 2321197 - protein, 19 aa, Cryptosporidium parvum
RRLYRLKENLKRLKIDKNA

SEQ ID NO: 2321198 - protein, 29 aa, Cryptosporidium parvum
RRPCPLCLEDLFYSIKTVSILNCGHTIHE

SEQ ID NO: 2321199 - protein, 22 aa, Cryptosporidium parvum
RRQERIYTLPFTRGINLNKYPN

SEQ ID NO: 2321200 - protein, 18 aa, Cryptosporidium parvum
RRQLHDQSHFLPSNSLVN

SEQ ID NO: 2321201 - protein, 33 aa, Cryptosporidium parvum; identical to SEQ ID NO: 2196531

SEQ ID NO: 2321202 - protein, 19 aa, Cryptosporidium parvum
RRRVCAVGPLVVYAEDNGI

SEQ ID NO: 2321203 - protein, 24 aa, Cryptosporidium parvum
RRSNRKFEFIKCKLINISYAFPSD

SEQ ID NO: 2321204 - protein, 27 aa, Cryptosporidium parvum
RRSRYQNRMVILNLIKKKRTKSSSKTE

SEQ ID NO: 2321205 - protein, 19 aa, Cryptosporidium parvum
RRTIRPTLDQFMKLTHTIK

SEQ ID NO: 2321206 - protein, 19 aa, Cryptosporidium parvum
RRVWVGIKPSYFSELKGEE

SEQ ID NO: 2321207 - protein, 17 aa, Cryptosporidium parvum
RRWLGDSIGKFYFDKFD

SEQ ID NO: 2321208 - protein, 17 aa, Cryptosporidium parvum
RRYLQGKKGLERPPYKL

SEQ ID NO: 2321209 - protein, 28 aa, Cryptosporidium parvum
RRYTGRKALLISCNWKWNGILYMEHKYG

SEQ ID NO: 2321210 - protein, 36 aa, Cryptosporidium parvum
RSAFKLIQLAQKFNIFKNCQVLVDLCAAPGGWLQVA

SEQ ID NO: 2321211 - protein, 25 aa, Cryptosporidium parvum
RSALGMFYHVLDPIMPFIELQEACE

SEQ ID NO: 2321212 - protein, 19 aa, Cryptosporidium parvum
RSALKHFNLSNRFQDFNFG

SEQ ID NO: 2321213 - protein, 26 aa, Cryptosporidium parvum
RSCELEFISLPPPEYSYNILNFNDQG

SEQ ID NO: 2321214 - protein, 19 aa, Cryptosporidium parvum
RSCFSSRNGLWVASAAEDC

SEQ ID NO: 2321215 - protein, 29 aa, Cryptosporidium parvum
RSCHYSYFNKLIINPIKRYGFSGEGSEAL

SEQ ID NO: 2321216 - protein, 26 aa, Cryptosporidium parvum
RSDLQKAIPYFLKAVELYNKNGRFSQ

SEQ ID NO: 2321217 - protein, 18 aa, Cryptosporidium parvum
RSEDNYYLVSLFGVHKYN

SEQ ID NO: 2321218 - protein, 18 aa, Cryptosporidium parvum
RSEFYIDCISPYLSKGVG

SEQ ID NO: 2321219 - protein, 19 aa, Cryptosporidium parvum
RSENYGLETPKGLSSKRAS

SEQ ID NO: 2321220 - protein, 31 aa, Cryptosporidium parvum
RSESGFEPFGPWLVTPLFLGAKGGGGSQGHS

SEQ ID NO: 2321221 - protein, 27 aa, Cryptosporidium parvum
RSEWKRPPMYLLITHKGRHCKGNYPLA

SEQ ID NO: 2321222 - protein, 18 aa, Cryptosporidium parvum
RSGFLESIGPSRFSLHKS

SEQ ID NO: 2321223 - protein, 28 aa, Cryptosporidium parvum
RSIEYELLRLIFSKRLPRYIIQTNTNIL

SEQ ID NO: 2321224 - protein, 23 aa, Cryptosporidium parvum
RSIKANILALYPLLEQVIDDILP

SEQ ID NO: 2321225 - protein, 17 aa, Cryptosporidium parvum
RSIKTWKLPNNGEFFDV

SEQ ID NO: 2321226 - protein, 35 aa, Cryptosporidium parvum
RSILLDNPQFCYALLHSQFILGMVNEPFVPLNQEQ

SEQ ID NO: 2321227 - protein, 18 aa, Cryptosporidium parvum
RSILSWSGVIFSLLEGYS

SEQ ID NO: 2321228 - protein, 32 aa, Cryptosporidium parvum; identical to SEQ ID NO: 2196563

SEQ ID NO: 2321229 - protein, 27 aa, Cryptosporidium parvum
RSIRTDFLLGLLKMELLNGSKLKVVIM

SEQ ID NO: 2321230 - protein, 23 aa, Cryptosporidium parvum
RSISKSIFIPKSVIKPNAHSSTS

SEQ ID NO: 2321231 - protein, 21 aa, Cryptosporidium parvum
RSITFLYKFISGICPKSYGMN

SEQ ID NO: 2321232 - protein, 23 aa, Cryptosporidium parvum
RSKKITIPSYILKKMNLSNISEN

SEQ ID NO: 2321233 - protein, 17 aa, Cryptosporidium parvum
RSKTFNSKIYGFDVARS

SEQ ID NO: 2321234 - protein, 25 aa, Cryptosporidium parvum
RSKVWTCPFSLQRNPFPPHYAEHIS

SEQ ID NO: 2321235 - protein, 27 aa, Cryptosporidium parvum
RSLALTSFEPYLSTPFYMGIKVKDMLN

SEQ ID NO: 2321236 - protein, 23 aa, Cryptosporidium parvum
RSLEKKISFLERGEGINLFHNSV

SEQ ID NO: 2321237 - protein, 17 aa, Cryptosporidium parvum
RSLFCQCIICKFNTYYQ

SEQ ID NO: 2321238 - protein, 18 aa, Cryptosporidium parvum
RSLFHTTKLIGEGSFAKV

SEQ ID NO: 2321239 - protein, 17 aa, Cryptosporidium parvum
RSLLALANCINSLALSS

SEQ ID NO: 2321240 - protein, 21 aa, Cryptosporidium parvum
RSLLLAFVTSFSLLDPDIIVG

SEQ ID NO: 2321241 - protein, 18 aa, Cryptosporidium parvum
RSLNWLKIKKDYVDGLTD

SEQ ID NO: 2321242 - protein, 18 aa, Cryptosporidium parvum
RSLPINILNFIIKNGLAI

SEQ ID NO: 2321243 - protein, 26 aa, Cryptosporidium parvum
RSLSHKLRLISQKLFPGWLSSDMLNC

SEQ ID NO: 2321244 - protein, 23 aa, Cryptosporidium parvum
RSLSNWEIIYNPRNLPFQENNFD

SEQ ID NO: 2321245 - protein, 37 aa, Cryptosporidium parvum
RSLYEKYSFLRLNYESEYLFRLLWHFSHCCIYHGNLL

SEQ ID NO: 2321246 - protein, 21 aa, Cryptosporidium parvum
RSMRVSVRWLRLASSMHLNLY

SEQ ID NO: 2321247 - protein, 31 aa, Cryptosporidium parvum
RSNCNGVLEYLYIGHSFILSSRYAAETYTMI

SEQ ID NO: 2321248 - protein, 17 aa, Cryptosporidium parvum
RSNIFYWEYVTKSFETW

SEQ ID NO: 2321249 - protein, 18 aa, Cryptosporidium parvum
RSPVIMACMGTGIAPFRA

SEQ ID NO: 2321250 - protein, 19 aa, Cryptosporidium parvum
RSQPLLAPANILRKFPKTS

SEQ ID NO: 2321251 - protein, 23 aa, Cryptosporidium parvum
RSRLVCIVLLSPMLSLESIKKKT

SEQ ID NO: 2321252 - protein, 18 aa, Cryptosporidium parvum
RSRVIYCHVCCQYKPRST

SEQ ID NO: 2321253 - protein, 22 aa, Cryptosporidium parvum
RSSIDCYFYIIDDDGSAFSAAI

SEQ ID NO: 2321254 - protein, 23 aa, Cryptosporidium parvum
RSSLCFELKSLFIAPTREICIQI

SEQ ID NO: 2321255 - protein, 18 aa, Cryptosporidium parvum
RSSLCTFFDFCNCFGPRV

SEQ ID NO: 2321256 - protein, 25 aa, Cryptosporidium parvum
RSSLQPGVVCILLAGPYKGKRVVML

SEQ ID NO: 2321257 - protein, 24 aa, Cryptosporidium parvum
RSSRFQMMLKYLKDNIILQLINQP

SEQ ID NO: 2321258 - protein, 25 aa, Cryptosporidium parvum
RSSSKLILIHKYSKVYWQILNETIK

SEQ ID NO: 2321259 - protein, 17 aa, Cryptosporidium parvum
RSSVLRRQLHDQSHFLP

SEQ ID NO: 2321260 - protein, 37 aa, Cryptosporidium parvum
RSSWPEGLIQLRYIGIENFDFSFRGLLTPWNKTCNGN

SEQ ID NO: 2321261 - protein, 21 aa, Cryptosporidium parvum
RSTKGIWRKNILKDWFGLEGE

SEQ ID NO: 2321262 - protein, 25 aa, Cryptosporidium parvum
RSTRLMISHLFIWRQRNSMFRVSKD

SEQ ID NO: 2321263 - protein, 24 aa, Cryptosporidium parvum
RSVENLLKLLSYHGVMACVGAPPA

SEQ ID NO: 2321264 - protein, 17 aa, Cryptosporidium parvum
RSVLARWSRSGRVLEAV

SEQ ID NO: 2321265 - protein, 19 aa, Cryptosporidium parvum
RSVLRLRGLPWSTTEIEIV

SEQ ID NO: 2321266 - protein, 26 aa, Cryptosporidium parvum
RSVTDAMHYFFKLHPSIITNSPSSPR

SEQ ID NO: 2321267 - protein, 28 aa, Cryptosporidium parvum
RSVVQQDPRILPELLVRIGQSNPEILQL

SEQ ID NO: 2321268 - protein, 35 aa, Cryptosporidium parvum
RSYDFQVSYLIFIHGWKLAFLTVSPMSKLFEIPSN

SEQ ID NO: 2321269 - protein, 24 aa, Cryptosporidium parvum
RSYTHEVVTLWYRAPDVLMGSKKY

SEQ ID NO: 2321270 - protein, 30 aa, Cryptosporidium parvum
RSYTSGRVFPLKLLPHYQLMSLVADYRKQI

SEQ ID NO: 2321271 - protein, 22 aa, Cryptosporidium parvum
RTCFAAIPFGLLKKELKIEDSV

SEQ ID NO: 2321272 - protein, 18 aa, Cryptosporidium parvum
RTCLVANTSNMPVAAREA

SEQ ID NO: 2321273 - protein, 20 aa, Cryptosporidium parvum
RTEIREFIQLMKDAANKDEI

SEQ ID NO: 2321274 - protein, 25 aa, Cryptosporidium parvum
RTGKMWKPRILLQQKSKRSIRAPED

SEQ ID NO: 2321275 - protein, 23 aa, Cryptosporidium parvum
RTGSKLISLKHSLVSKESKPAFS

SEQ ID NO: 2321276 - protein, 20 aa, Cryptosporidium parvum
RTGVLLRKLKYANGRIEWRV

SEQ ID NO: 2321277 - protein, 18 aa, Cryptosporidium parvum
RTHDYIIDPFNLFNEIQM

SEQ ID NO: 2321278 - protein, 23 aa, Cryptosporidium parvum
RTHLRNMVILPEMVGSVAGVYNG

SEQ ID NO: 2321279 - protein, 17 aa, Cryptosporidium parvum
RTIEFISLISKLKAHFG

SEQ ID NO: 2321280 - protein, 21 aa, Cryptosporidium parvum
RTIKELWNITYKGHDIDYIAI

SEQ ID NO: 2321281 - protein, 20 aa, Cryptosporidium parvum
RTINTSWFPNIDLTICTLEK

SEQ ID NO: 2321282 - protein, 31 aa, Cryptosporidium parvum; identical to SEQ ID NO: 2196603

SEQ ID NO: 2321283 - protein, 33 aa, Cryptosporidium parvum
RTKVLLECQIAGFTLLSLLVKYSPESIEILRKS

SEQ ID NO: 2321284 - protein, 21 aa, Cryptosporidium parvum
RTLCYYRDVVRLLRGYRRKIL

SEQ ID NO: 2321285 - protein, 25 aa, Cryptosporidium parvum
RTLIWEFQILIPLISKNVSYYNKIQ

SEQ ID NO: 2321286 - protein, 21 aa, Cryptosporidium parvum
RTLKPRLFISKLRLMSVRIQS

SEQ ID NO: 2321287 - protein, 29 aa, Cryptosporidium parvum
RTLLKYYKNQVKSDYILSPAIEQIIKVEP

SEQ ID NO: 2321288 - protein, 24 aa, Cryptosporidium parvum
RTLNLRLIELYLDYKKKNKMNNNI

SEQ ID NO: 2321289 - protein, 22 aa, Cryptosporidium parvum
RTNLIKLIYQGIQDLFGSISIC

SEQ ID NO: 2321290 - protein, 20 aa, Cryptosporidium parvum
RTNVLNLLHANTRSFICIEP

SEQ ID NO: 2321291 - protein, 20 aa, Cryptosporidium parvum
RTPDLFLLSRQGTPFDHTLL

SEQ ID NO: 2321292 - protein, 19 aa, Cryptosporidium parvum
RTPFGSMILPMLQKAQKSQ

SEQ ID NO: 2321293 - protein, 24 aa, Cryptosporidium parvum
RTPRDFFDFLKHIIKIYKEKNETL

SEQ ID NO: 2321294 - protein, 27 aa, Cryptosporidium parvum
RTPTVDDWYVFDKQLSEIQYRNSVKRF

SEQ ID NO: 2321295 - protein, 23 aa, Cryptosporidium parvum
RTQAELRRELNIPLAIKADSEYV

SEQ ID NO: 2321296 - protein, 20 aa, Cryptosporidium parvum
RTQIAAGEYTAIAIGPGPSE

SEQ ID NO: 2321297 - protein, 19 aa, Cryptosporidium parvum
RTRALARITLISHSLWPGS

SEQ ID NO: 2321298 - protein, 18 aa, Cryptosporidium parvum
RTRLSNWIISFSCLDDDI

SEQ ID NO: 2321299 - protein, 20 aa, Cryptosporidium parvum
RTRSKFKLQYLFGQNIDSIS

SEQ ID NO: 2321300 - protein, 30 aa, Cryptosporidium parvum
RTRSTNPYRILLSKLYTFLGRRTDSSFNDT

SEQ ID NO: 2321301 - protein, 29 aa, Cryptosporidium parvum
RTSGSKFFHLWRYFFNRLSSKSVYTNETN

SEQ ID NO: 2321302 - protein, 17 aa, Cryptosporidium parvum
RTSPYLSGRKRNIEAAW

SEQ ID NO: 2321303 - protein, 18 aa, Cryptosporidium parvum
RTSRYKAWKSNRQLSEYI

SEQ ID NO: 2321304 - protein, 19 aa, Cryptosporidium parvum
RTSYLYVIGVMNYGSSWSN

SEQ ID NO: 2321305 - protein, 28 aa, Cryptosporidium parvum
RTTISIPQRYNYIRNRNSSLMKEISIKK

SEQ ID NO: 2321306 - protein, 18 aa, Cryptosporidium parvum
RTVEFHKEYPWILSCSDD

SEQ ID NO: 2321307 - protein, 17 aa, Cryptosporidium parvum
RTYINPFVRWEAGGRRW

SEQ ID NO: 2321308 - protein, 24 aa, Cryptosporidium parvum
RTYSKVCIKIILNNADWKCVTQFL

SEQ ID NO: 2321309 - protein, 28 aa, Cryptosporidium parvum
RVEHKRTFLYLEQLILKHGAHEKVSNIV

SEQ ID NO: 2321310 - protein, 19 aa, Cryptosporidium parvum
RVEIPLGCLFTPLKESSKL

SEQ ID NO: 2321311 - protein, 29 aa, Cryptosporidium parvum
RVEKIKNIYLVLLKTPNIRDWPINVLEKF

SEQ ID NO: 2321312 - protein, 29 aa, Cryptosporidium parvum
RVELPCKRWPELLPYLIRLVQNNSDNKMS

SEQ ID NO: 2321313 - protein, 35 aa, Cryptosporidium parvum; identical to SEQ ID NO: 2196628

SEQ ID NO: 2321314 - protein, 17 aa, Cryptosporidium parvum
RVFEYLPVGAIIEDRIL

SEQ ID NO: 2321315 - protein, 19 aa, Cryptosporidium parvum
RVFIIFKGNYIFNKYNYNC

SEQ ID NO: 2321316 - protein, 19 aa, Cryptosporidium parvum
RVFIPSKLGYGARGCPPVI

SEQ ID NO: 2321317 - protein, 20 aa, Cryptosporidium parvum
RVFNRGYLISSNLVRTWLNR

SEQ ID NO: 2321318 - protein, 19 aa, Cryptosporidium parvum
RVFNVVRPNKKIEQPEIKK

SEQ ID NO: 2321319 - protein, 19 aa, Cryptosporidium parvum
RVFSPLLEQLSIISLKRNI

SEQ ID NO: 2321320 - protein, 17 aa, Cryptosporidium parvum
RVFYKQSIITKVSPNHE

SEQ ID NO: 2321321 - protein, 23 aa, Cryptosporidium parvum
RVGPEYQAVVPDLIVPEKKTQDK

SEQ ID NO: 2321322 - protein, 30 aa, Cryptosporidium parvum; identical to SEQ ID NO: 2196631

SEQ ID NO: 2321323 - protein, 19 aa, Cryptosporidium parvum
RVGWDYCLWIDIPEFSCMY

SEQ ID NO: 2321324 - protein, 17 aa, Cryptosporidium parvum
RVHLERATPVNRLRFGI

SEQ ID NO: 2321325 - protein, 19 aa, Cryptosporidium parvum
RVIMFIRQLIECKGFWRRE

SEQ ID NO: 2321326 - protein, 20 aa, Cryptosporidium parvum
RVIQGLIRRSYGNSGAVCAK

SEQ ID NO: 2321327 - protein, 18 aa, Cryptosporidium parvum
RVIVFFQTKKEAHRCAIL

SEQ ID NO: 2321328 - protein, 19 aa, Cryptosporidium parvum
RVKLLNKRCSLQATPYRGA

SEQ ID NO: 2321329 - protein, 17 aa, Cryptosporidium parvum
RVKRGRSFKLEPVNYLN

SEQ ID NO: 2321330 - protein, 31 aa, Cryptosporidium parvum
RVLDIGCGNGLFLIDLIRNINFSSAVGIDYI

SEQ ID NO: 2321331 - protein, 30 aa, Cryptosporidium parvum; identical to SEQ ID NO: 2196644

SEQ ID NO: 2321332 - protein, 24 aa, Cryptosporidium parvum
RVLLRTEFIVPVAPLDYVEYSTDS

SEQ ID NO: 2321333 - protein, 17 aa, Cryptosporidium parvum
RVMCYIEQKINGHFTKD

SEQ ID NO: 2321334 - protein, 31 aa, Cryptosporidium parvum; identical to SEQ ID NO: 2196646

SEQ ID NO: 2321335 - protein, 20 aa, Cryptosporidium parvum
RVNFYFAALRILHQLKRKTP

SEQ ID NO: 2321336 - protein, 17 aa, Cryptosporidium parvum
RVNKMCLLQLESDLLEH

SEQ ID NO: 2321337 - protein, 26 aa, Cryptosporidium parvum
RVPKGPMVLFCYFLGKLYMQQDRFVL

SEQ ID NO: 2321338 - protein, 32 aa, Cryptosporidium parvum; identical to SEQ ID NO: 2196648

SEQ ID NO: 2321339 - protein, 17 aa, Cryptosporidium parvum
RVPRSFKVFSKVFSEFL

SEQ ID NO: 2321340 - protein, 26 aa, Cryptosporidium parvum
RVPTCEMLYYSKPFDKLFFSEGTYNS

SEQ ID NO: 2321341 - protein, 18 aa, Cryptosporidium parvum
RVPYILKGKGPPIFGKDT

SEQ ID NO: 2321342 - protein, 28 aa, Cryptosporidium parvum
RVQFDELPPELLLSRPFNPLSIDEASNQ

SEQ ID NO: 2321343 - protein, 24 aa, Cryptosporidium parvum
RVQGIFIDRKYAFQQYTKLQETRN

SEQ ID NO: 2321344 - protein, 19 aa, Cryptosporidium parvum
RVQIWLYDHKNLVLEGVIQ

SEQ ID NO: 2321345 - protein, 17 aa, Cryptosporidium parvum
RVQSSLINWLLSSNEFL

SEQ ID NO: 2321346 - protein, 18 aa, Cryptosporidium parvum
RVRIIKNLLSKPFETPYE

SEQ ID NO: 2321347 - protein, 19 aa, Cryptosporidium parvum
RVRQFLNNPLLARKQFVVD

SEQ ID NO: 2321348 - protein, 17 aa, Cryptosporidium parvum
RVRYHNSYVGWVALSRH

SEQ ID NO: 2321349 - protein, 19 aa, Cryptosporidium parvum
RVTKDEAMQWFQSKYDGII

SEQ ID NO: 2321350 - protein, 24 aa, Cryptosporidium parvum
RVVLIVHEMPHFFSEKINIFNETI

SEQ ID NO: 2321351 - protein, 30 aa, Cryptosporidium parvum
RVVTIRVACRLLIISVLLSSLENLVNKEHS

SEQ ID NO: 2321352 - protein, 17 aa, Cryptosporidium parvum
RVYAMDLKYPALVVAAA

SEQ ID NO: 2321353 - protein, 17 aa, Cryptosporidium parvum
RVYIIEYTIRRMNEYYL

SEQ ID NO: 2321354 - protein, 28 aa, Cryptosporidium parvum
RWENMREIIKEYLKFDDKILVVGNGTSR

SEQ ID NO: 2321355 - protein, 17 aa, Cryptosporidium parvum
RWFGYIKDYDGGTLMEC

SEQ ID NO: 2321356 - protein, 25 aa, Cryptosporidium parvum
RWKCPLCYQIIRPGMLKIDSFVKMI

SEQ ID NO: 2321357 - protein, 21 aa, Cryptosporidium parvum
RWLNNQLLINKGRAFQIHQYC

SEQ ID NO: 2321358 - protein, 22 aa, Cryptosporidium parvum
RWLPTVLIGLINRYYNRRRPIL

SEQ ID NO: 2321359 - protein, 25 aa, Cryptosporidium parvum
RWMRLMYELHEIILKYIEIEKLFEE

SEQ ID NO: 2321360 - protein, 22 aa, Cryptosporidium parvum
RYADIIVHRLLSASIGLEPLCE

SEQ ID NO: 2321361 - protein, 26 aa, Cryptosporidium parvum
RYERIFKTIWKLKLTIHKLNSTWIKL

SEQ ID NO: 2321362 - protein, 25 aa, Cryptosporidium parvum
RYFPRSISCPGILLRNGLIVTDRYI

SEQ ID NO: 2321363 - protein, 24 aa, Cryptosporidium parvum
RYGAILNFLIANSSAIPILVQNKN

SEQ ID NO: 2321364 - protein, 21 aa, Cryptosporidium parvum
RYGHIMVYSKPNLIVFGGNDG

SEQ ID NO: 2321365 - protein, 24 aa, Cryptosporidium parvum
RYGKSPFIYPVYGLGGLPEGFSRL

SEQ ID NO: 2321366 - protein, 24 aa, Cryptosporidium parvum
RYINKLVYIAKPRKLLYIAVDGVA

SEQ ID NO: 2321367 - protein, 29 aa, Cryptosporidium parvum
RYIWNLIDTYPIFRWFPNNCCDFFFEEER

SEQ ID NO: 2321368 - protein, 17 aa, Cryptosporidium parvum
RYKNIYLLEISAHSLFS

SEQ ID NO: 2321369 - protein, 27 aa, Cryptosporidium parvum
RYNARDATWFFLNAALDYCVNIPNGYQ

SEQ ID NO: 2321370 - protein, 20 aa, Cryptosporidium parvum
RYNPLFFRPRIRSAVEEYQS

SEQ ID NO: 2321371 - protein, 20 aa, Cryptosporidium parvum
RYQIRPNNNNWHYSGRKTRR

SEQ ID NO: 2321372 - protein, 27 aa, Cryptosporidium parvum
RYQRSTELLIRKLPFQRLVREIAQDFK

SEQ ID NO: 2321373 - protein, 21 aa, Cryptosporidium parvum
RYRLAMYFYEFLKSIKMLTEK

SEQ ID NO: 2321374 - protein, 18 aa, Cryptosporidium parvum
RYRVYKIDPFDKRLWIEE

SEQ ID NO: 2321375 - protein, 22 aa, Cryptosporidium parvum
RYSELIRLKNKLLEELSNVENE

SEQ ID NO: 2321376 - protein, 26 aa, Cryptosporidium parvum
RYSLHDPFILWVLRNGILANIGDLNI

SEQ ID NO: 2321377 - protein, 17 aa, Cryptosporidium parvum
RYSLHLLTVSQVLANRK

SEQ ID NO: 2321378 - protein, 21 aa, Cryptosporidium parvum
RYVPCLYVHNKIDNLKLSEID

SEQ ID NO: 2321379 - protein, 25 aa, Cryptosporidium parvum
RYYYDTWCYLSILTGPNHHFTVAAK

SEQ ID NO: 2321380 - protein, 20 aa, Cryptosporidium parvum
SAAGSNFFHSYRKIKQIEEE

SEQ ID NO: 2321381 - protein, 23 aa, Cryptosporidium parvum
SAAQHFVQWLLESDPKKRPTAEN

SEQ ID NO: 2321382 - protein, 26 aa, Cryptosporidium parvum
SACWGGKIVFWKFDQASGTFIISAQI

SEQ ID NO: 2321383 - protein, 24 aa, Cryptosporidium parvum
SADKPQPGSLSSGGYGPSVIVRNI

SEQ ID NO: 2321384 - protein, 51 aa, Cryptosporidium parvum
SAEEIFNLDFIKYKTIKLSPKLDLYFLMYEYQKILSYNRYLESLLKGDQIS

SEQ ID NO: 2321385 - protein, 20 aa, Cryptosporidium parvum
SAEFDLKRLLKAFKKNFSCN

SEQ ID NO: 2321386 - protein, 27 aa, Cryptosporidium parvum
SAEGLASPIGFSPLASPTYRKNVQQSR

SEQ ID NO: 2321387 - protein, 25 aa, Cryptosporidium parvum
SAEVRAQIRLIFREYQNKKKIQIVR

SEQ ID NO: 2321388 - protein, 18 aa, Cryptosporidium parvum
SAGGSTLTPWRNGKRSLS

SEQ ID NO: 2321389 - protein, 27 aa, Cryptosporidium parvum
SAGQRVLACIIIRLALAESFCVNCGIL

SEQ ID NO: 2321390 - protein, 18 aa, Cryptosporidium parvum
SAGQYYYSKSRALWKITP

SEQ ID NO: 2321391 - protein, 25 aa, Cryptosporidium parvum
SAGTVIFAELYWVPGTMLQAEDRCH

SEQ ID NO: 2321392 - protein, 27 aa, Cryptosporidium parvum
SAISRIRYIITPLNLKIRIFAYSKCIS

SEQ ID NO: 2321393 - protein, 24 aa, Cryptosporidium parvum
SAKAGLQFPVGRVARYLKKGRYAK

SEQ ID NO: 2321394 - protein, 30 aa, Cryptosporidium parvum
SAKIFSRDILKLRKQMERLSLARSQLMGAE

SEQ ID NO: 2321395 - protein, 20 aa, Cryptosporidium parvum
SALASPWMQSILNDPEIFRV

SEQ ID NO: 2321396 - protein, 24 aa, Cryptosporidium parvum
SALKDILHRIFGDHLIRTLELFQL

SEQ ID NO: 2321397 - protein, 41 aa, Cryptosporidium parvum
SALLDLELPHLILLTNFPKTFIGGLPILHKLLTEKGISCKI

SEQ ID NO: 2321398 - protein, 24 aa, Cryptosporidium parvum
SALLRAINTIRPLKVYPGINLWEN

SEQ ID NO: 2321399 - protein, 26 aa, Cryptosporidium parvum
SALLWASRNLGKLYSQSPPPGKTLTP

SEQ ID NO: 2321400 - protein, 17 aa, Cryptosporidium parvum
SALRRIIEVSSKNTRFV

SEQ ID NO: 2321401 - protein, 30 aa, Cryptosporidium parvum; identical to SEQ ID NO: 2196695

SEQ ID NO: 2321402 - protein, 24 aa, Cryptosporidium parvum
SANDTFLWSLTEIENDCSLCLRQI

SEQ ID NO: 2321403 - protein, 25 aa, Cryptosporidium parvum
SANKVYLVSFLLAVAYQISGEKNKA

SEQ ID NO: 2321404 - protein, 22 aa, Cryptosporidium parvum
SANYLISFLIQMGRVLSFLSDE

SEQ ID NO: 2321405 - protein, 20 aa, Cryptosporidium parvum
SAPILSRFDLFFVMIDDPED

SEQ ID NO: 2321406 - protein, 21 aa, Cryptosporidium parvum
SAPKVLIFCETKRGADILTKE

SEQ ID NO: 2321407 - protein, 19 aa, Cryptosporidium parvum
SAPLMFDSEYNVIGHLGNV

SEQ ID NO: 2321408 - protein, 22 aa, Cryptosporidium parvum
SAPTLFRHHFSFKDIGIGGLDD

SEQ ID NO: 2321409 - protein, 28 aa, Cryptosporidium parvum
SAQDLTGGLVRSFSKAQNDNNLFSANKG

SEQ ID NO: 2321410 - protein, 26 aa, Cryptosporidium parvum
SAQWDTQSYLPMSYYAGAYDPNGMAY

SEQ ID NO: 2321411 - protein, 23 aa, Cryptosporidium parvum
SARFHTVPMAFLEKNKVDQRNKT

SEQ ID NO: 2321412 - protein, 26 aa, Cryptosporidium parvum
SARKNIPSIDIIKRLAGRLKNKDSDT

SEQ ID NO: 2321413 - protein, 24 aa, Cryptosporidium parvum
SASDNYFPFKLYSRLDRSGHLELN

SEQ ID NO: 2321414 - protein, 35 aa, Cryptosporidium parvum
SASESKMLISFPFFLKYYLSVLTTIRQKHFSSVKI

SEQ ID NO: 2321415 - protein, 23 aa, Cryptosporidium parvum
SASKLPCFSLFTNKEYFIQDIRD

SEQ ID NO: 2321416 - protein, 23 aa, Cryptosporidium parvum
SASKSFYLFSISVPRKSIIQVCN

SEQ ID NO: 2321417 - protein, 22 aa, Cryptosporidium parvum
SASNIKEMLLIMSALKVIPNCT

SEQ ID NO: 2321418 - protein, 25 aa, Cryptosporidium parvum
SASSIKQVFACRPDLVELGMTNFEL

SEQ ID NO: 2321419 - protein, 20 aa, Cryptosporidium parvum
SATVYLPKSTPLLETDPLGA

SEQ ID NO: 2321420 - protein, 20 aa, Cryptosporidium parvum
SAVTLFFQQLRKIKGAASYP

SEQ ID NO: 2321421 - protein, 46 aa, Cryptosporidium parvum
SAYSDYINRILGLYDLFCKFNILLQYFQYKALRYLQIHDIPNMTNG

SEQ ID NO: 2321422 - protein, 19 aa, Cryptosporidium parvum
SAYSWFRTLEQFKACSKGD

SEQ ID NO: 2321423 - protein, 30 aa, Cryptosporidium parvum; identical to SEQ ID NO: 2196714

SEQ ID NO: 2321424 - protein, 17 aa, Cryptosporidium parvum
SCDSSVLCSLVLTVSDL

SEQ ID NO: 2321425 - protein, 17 aa, Cryptosporidium parvum
SCEFLDLESFYETERDQ

SEQ ID NO: 2321426 - protein, 23 aa, Cryptosporidium parvum
SCELQPIVILRDKMGKLWDDDDE

SEQ ID NO: 2321427 - protein, 17 aa, Cryptosporidium parvum
SCFLPPTPQYNGAILSN

SEQ ID NO: 2321428 - protein, 18 aa, Cryptosporidium parvum
SCFVSFLLDTGKLQQARN

SEQ ID NO: 2321429 - protein, 25 aa, Cryptosporidium parvum
SCGAAKYLLQLLSSPKKVIRKEACW

SEQ ID NO: 2321430 - protein, 24 aa, Cryptosporidium parvum
SCGKLLYLMLTGKYLEIDFFECFD

SEQ ID NO: 2321431 - protein, 25 aa, Cryptosporidium parvum
SCGKSCIYSYYILRAGVVCGVSVAV

SEQ ID NO: 2321432 - protein, 28 aa, Cryptosporidium parvum
SCGKSQLLRFVMSIAPLAISTTGRGCSG

SEQ ID NO: 2321433 - protein, 25 aa, Cryptosporidium parvum
SCGNSYDFLFLLDAFENEYTSSSHN

SEQ ID NO: 2321434 - protein, 22 aa, Cryptosporidium parvum
SCGVILYALLCGSLPFDDENVG

SEQ ID NO: 2321435 - protein, 20 aa, Cryptosporidium parvum
SCGYNIYHFLKSGSIKVFVN

SEQ ID NO: 2321436 - protein, 24 aa, Cryptosporidium parvum
SCIARTILFFNSKPLNPCSPDCQI

SEQ ID NO: 2321437 - protein, 24 aa, Cryptosporidium parvum
SCILKKLQFLVDAGVVFIGHALPS

SEQ ID NO: 2321438 - protein, 20 aa, Cryptosporidium parvum
SCIPYRESKLTRLLQEYLGG

SEQ ID NO: 2321439 - protein, 33 aa, Cryptosporidium parvum
SCISLSYTPILFDSILEIPLLMIQKCLLNQEET

SEQ ID NO: 2321440 - protein, 18 aa, Cryptosporidium parvum
SCLAGLSIVGRDYFGVFP

SEQ ID NO: 2321441 - protein, 25 aa, Cryptosporidium parvum
SCLKRNWRIEFWSNFMTNCINFCPI

SEQ ID NO: 2321442 - protein, 21 aa, Cryptosporidium parvum
SCLPLRILIKFERKTLKDKDR

SEQ ID NO: 2321443 - protein, 31 aa, Cryptosporidium parvum; identical to SEQ ID NO: 2196732

SEQ ID NO: 2321444 - protein, 21 aa, Cryptosporidium parvum
SCNVILPWQKVTLESNYENDQ

SEQ ID NO: 2321445 - protein, 26 aa, Cryptosporidium parvum
SCQFIGDLIILFTSNGYYDTFSSNLS

SEQ ID NO: 2321446 - protein, 23 aa, Cryptosporidium parvum
SCQICLNYYFPSKAIKQMESNSN

SEQ ID NO: 2321447 - protein, 28 aa, Cryptosporidium parvum
SCRFIYMRIHFWINILSIPLSKMLINSN

SEQ ID NO: 2321448 - protein, 37 aa, Cryptosporidium parvum
SCRSKLFTIPQSFVRVFSILIEPILGLFQEHNSKANL

SEQ ID NO: 2321449 - protein, 25 aa, Cryptosporidium parvum
SCSSPSLPLFLLFDESYTSHTFYEW

SEQ ID NO: 2321450 - protein, 26 aa, Cryptosporidium parvum
SCTFGQEFFLRIYGTGLLNEIQNHTT

SEQ ID NO: 2321451 - protein, 31 aa, Cryptosporidium parvum
SCYNPVSLMQFLDPFFFKYTAKFVDLPSQSI

SEQ ID NO: 2321452 - protein, 25 aa, Cryptosporidium parvum
SDAIRRKLFVRNLGFETNEDSLSEV

SEQ ID NO: 2321453 - protein, 26 aa, Cryptosporidium parvum
SDASHDFFLKRLKGIGRHQVKINIYN

SEQ ID NO: 2321454 - protein, 30 aa, Cryptosporidium parvum; identical to SEQ ID NO: 2196743

SEQ ID NO: 2321455 - protein, 24 aa, Cryptosporidium parvum
SDDDIQMLIFKIDQIRSALKHFNL

SEQ ID NO: 2321456 - protein, 49 aa, Cryptosporidium parvum
SDDESVKSFFNGCGVVKRVSIPRYSDTGKMRGFAMVEFENDEQIQNALK

SEQ ID NO: 2321457 - protein, 27 aa, Cryptosporidium parvum
SDDGSWVYWGTVWSTMSFGPNSLSILP

SEQ ID NO: 2321458 - protein, 25 aa, Cryptosporidium parvum
SDDGTIIMWIFSNLSIYNQTNLYTY

SEQ ID NO: 2321459 - protein, 25 aa, Cryptosporidium parvum
SDDKKMFVWDVGIPIVVKHIADPLM

SEQ ID NO: 2321460 - protein, 25 aa, Cryptosporidium parvum
SDEGVLGGLFSTRRPRDAMAGFSSG

SEQ ID NO: 2321461 - protein, 23 aa, Cryptosporidium parvum
SDEKLNLRIYDDIAGKRGLNVDR

SEQ ID NO: 2321462 - protein, 23 aa, Cryptosporidium parvum
SDEKNWRAVFRLGIQQIVSICNK

SEQ ID NO: 2321463 - protein, 17 aa, Cryptosporidium parvum
SDELEFIRWHPRGPCIF

SEQ ID NO: 2321464 - protein, 40 aa, Cryptosporidium parvum
SDELRNSIIRLVPKEQLNSVFFLVSSLISKSINFRDFHVR

SEQ ID NO: 2321465 - protein, 18 aa, Cryptosporidium parvum
SDGEIAIWDLERSLKIFS

SEQ ID NO: 2321466 - protein, 18 aa, Cryptosporidium parvum
SDGKYYFYSIRLKKTIPK

SEQ ID NO: 2321467 - protein, 29 aa, Cryptosporidium parvum
SDHDKRPIWVFPDGLIIIETFHQSSKAAC

SEQ ID NO: 2321468 - protein, 31 aa, Cryptosporidium parvum; identical to SEQ ID NO: 2196762

SEQ ID NO: 2321469 - protein, 24 aa, Cryptosporidium parvum
SDHLTLLNIFIQWKRHGSNVRWSE

SEQ ID NO: 2321470 - protein, 36 aa, Cryptosporidium parvum; identical to SEQ ID NO: 2196765

SEQ ID NO: 2321471 - protein, 24 aa, Cryptosporidium parvum
SDIGAGFFQIVIAKLKGVVAENVE

SEQ ID NO: 2321472 - protein, 20 aa, Cryptosporidium parvum
SDIPFLSYFLLSSNAKMRVN

SEQ ID NO: 2321473 - protein, 17 aa, Cryptosporidium parvum
SDIPPIQSGPARASRNS

SEQ ID NO: 2321474 - protein, 22 aa, Cryptosporidium parvum
SDIPRKYVLLCLVDSIVRKCRS

SEQ ID NO: 2321475 - protein, 20 aa, Cryptosporidium parvum
SDIVPNYPDKSLPTMIIYRN

SEQ ID NO: 2321476 - protein, 31 aa, Cryptosporidium parvum
SDIYVQGKLLKALFDKLYGEWALLSRQTQED

SEQ ID NO: 2321477 - protein, 23 aa, Cryptosporidium parvum
SDKENEFFLYSSKIHKVNVKDTI

SEQ ID NO: 2321478 - protein, 28 aa, Cryptosporidium parvum
SDKEPLKPLYLLYRHLKDSTYRTKNHPT

SEQ ID NO: 2321479 - protein, 25 aa, Cryptosporidium parvum
SDKIGSLNIFWALPSAAKFSKENRL

SEQ ID NO: 2321480 - protein, 38 aa, Cryptosporidium parvum; identical to SEQ ID NO: 2196772

SEQ ID NO: 2321481 - protein, 24 aa, Cryptosporidium parvum
SDKKDLLDLILIYGFLIGNKLENK

SEQ ID NO: 2321482 - protein, 30 aa, Cryptosporidium parvum
SDKKLICIIPRYSIIPKETLAFLKTIQLIN

SEQ ID NO: 2321483 - protein, 29 aa, Cryptosporidium parvum
SDKTVKDLIWLLYDTSLLTSGFSLEDPTQ

SEQ ID NO: 2321484 - protein, 17 aa, Cryptosporidium parvum
SDLCPVVKKFKAQLLLV

SEQ ID NO: 2321485 - protein, 34 aa, Cryptosporidium parvum; identical to SEQ ID NO: 2196777

SEQ ID NO: 2321486 - protein, 30 aa, Cryptosporidium parvum; identical to SEQ ID NO: 2196778

SEQ ID NO: 2321487 - protein, 22 aa, Cryptosporidium parvum
SDLIYFDICINGIILLDDEFNE

SEQ ID NO: 2321488 - protein, 25 aa, Cryptosporidium parvum
SDLQFVFAQIPLSVSKPLIAIREGL

SEQ ID NO: 2321489 - protein, 25 aa, Cryptosporidium parvum
SDLSLPINNIGRMMKLSIPGSAKIS

SEQ ID NO: 2321490 - protein, 19 aa, Cryptosporidium parvum
SDLSLYTLGIALSVCKILG

SEQ ID NO: 2321491 - protein, 25 aa, Cryptosporidium parvum
SDNYEFEFYLFKVSHISFPITLLNT

SEQ ID NO: 2321492 - protein, 24 aa, Cryptosporidium parvum
SDNYLALYLVLTDTGTIVPISERR

SEQ ID NO: 2321493 - protein, 24 aa, Cryptosporidium parvum
SDPLCRMWYDMTQFFGFLGEDIID

SEQ ID NO: 2321494 - protein, 20 aa, Cryptosporidium parvum
SDPNLFSIVSILGQKFIEEC

SEQ ID NO: 2321495 - protein, 20 aa, Cryptosporidium parvum
SDREEYILKKRWTEDTVFRN

SEQ ID NO: 2321496 - protein, 28 aa, Cryptosporidium parvum
SDRFECPIIPIPDFILDRFPDFKKYEIE

SEQ ID NO: 2321497 - protein, 24 aa, Cryptosporidium parvum
SDSFKLHRIFPNKVDPLVSLMKVE

SEQ ID NO: 2321498 - protein, 20 aa, Cryptosporidium parvum
SDSFLEKWNLTKKCNRAKAR

SEQ ID NO: 2321499 - protein, 34 aa, Cryptosporidium parvum
SDSIELWFSTIELLMLLQNWKKARTFLDLARSKN

SEQ ID NO: 2321500 - protein, 23 aa, Cryptosporidium parvum
SDSILLLFTIFQVFQGEKSKWNK

SEQ ID NO: 2321501 - protein, 24 aa, Cryptosporidium parvum
SDSLWLDICKNELYKLIRVKSPKD

SEQ ID NO: 2321502 - protein, 26 aa, Cryptosporidium parvum
SDSNSIYILFRVIPSDNDLIPKENQG

SEQ ID NO: 2321503 - protein, 19 aa, Cryptosporidium parvum
SDTFDPFWDITLALPEVSD

SEQ ID NO: 2321504 - protein, 25 aa, Cryptosporidium parvum
SDTSQVFYVIRVLVKVRDWCGSCLL

SEQ ID NO: 2321505 - protein, 29 aa, Cryptosporidium parvum
SDTTNNAFLPPITYLFHSLDYDFRKQPIL

SEQ ID NO: 2321506 - protein, 26 aa, Cryptosporidium parvum
SDVCSPPIKLPWSIIFHTLDPTEFDF

SEQ ID NO: 2321507 - protein, 19 aa, Cryptosporidium parvum
SDVDPSFFIEFLDARVGMP

SEQ ID NO: 2321508 - protein, 19 aa, Cryptosporidium parvum
SDVFQYNKLVSNSMNYTIS

SEQ ID NO: 2321509 - protein, 31 aa, Cryptosporidium parvum
SDVNIQILYNRSLVQLGLSAFRLGQISEAQQ

SEQ ID NO: 2321510 - protein, 25 aa, Cryptosporidium parvum
SDWDSPFIDLSNSLFISNCANYKLG

SEQ ID NO: 2321511 - protein, 24 aa, Cryptosporidium parvum
SDWNSLFCILSHLPKLECLMLNGN

SEQ ID NO: 2321512 - protein, 24 aa, Cryptosporidium parvum
SDYHIAVMLLYKKTVIKASEEEMA

SEQ ID NO: 2321513 - protein, 20 aa, Cryptosporidium parvum
SDYIIESLQPVYPYFARETK

SEQ ID NO: 2321514 - protein, 26 aa, Cryptosporidium parvum
SEADQRAYILWLKGKDLTYRGKMDEA

SEQ ID NO: 2321515 - protein, 24 aa, Cryptosporidium parvum
SEANFSFVLKLFISIVGSCVDMLE

SEQ ID NO: 2321516 - protein, 19 aa, Cryptosporidium parvum
SEAQRLKEKITIAEDCLVR

SEQ ID NO: 2321517 - protein, 24 aa, Cryptosporidium parvum
SECGILDWYCILNRIYIAGQTLGY

SEQ ID NO: 2321518 - protein, 26 aa, Cryptosporidium parvum
SECKSYINWLLTYDPANRPNIFEAFS

SEQ ID NO: 2321519 - protein, 18 aa, Cryptosporidium parvum
SECNPKFLEIHRGNTNHK

SEQ ID NO: 2321520 - protein, 17 aa, Cryptosporidium parvum
SECSCINIFAFGSSGTG

SEQ ID NO: 2321521 - protein, 28 aa, Cryptosporidium parvum
SEDKQMPNWMITTPYLNMKDILSDWRNS

SEQ ID NO: 2321522 - protein, 24 aa, Cryptosporidium parvum
SEDKTIKIWSFPDLKLQGTCKGHL

SEQ ID NO: 2321523 - protein, 36 aa, Cryptosporidium parvum; identical to SEQ ID NO: 2196811

SEQ ID NO: 2321524 - protein, 26 aa, Cryptosporidium parvum
SEDYIIKLYELFIELIEILVDYYLFG

SEQ ID NO: 2321525 - protein, 24 aa, Cryptosporidium parvum
SEEADNYWNLYKEALNRIDELESS

SEQ ID NO: 2321526 - protein, 24 aa, Cryptosporidium parvum
SEEKGLVLFIGKLIADTWLKSKVL

SEQ ID NO: 2321527 - protein, 25 aa, Cryptosporidium parvum
SEEKKVLEIILRETLDGDSLTRATS

SEQ ID NO: 2321528 - protein, 25 aa, Cryptosporidium parvum
SEELKTRFLLSQYSLFVKIVDSQGV

SEQ ID NO: 2321529 - protein, 31 aa, Cryptosporidium parvum
SEERQIEYNLFLKLLHRFSQFKFRSIGATED

SEQ ID NO: 2321530 - protein, 18 aa, Cryptosporidium parvum
SEFLGRFSELQYLSLNAT

SEQ ID NO: 2321531 - protein, 23 aa, Cryptosporidium parvum
SEGDMIFGYKNTRYFDTEIQSMK

SEQ ID NO: 2321532 - protein, 20 aa, Cryptosporidium parvum
SEGLEYWKTLFNKAFCLQKM

SEQ ID NO: 2321533 - protein, 18 aa, Cryptosporidium parvum
SEHFFIPYKNSEGEVSRS

SEQ ID NO: 2321534 - protein, 29 aa, Cryptosporidium parvum
SEIDSLPPYLLVQLVRFEWKKSSEIARTE

SEQ ID NO: 2321535 - protein, 20 aa, Cryptosporidium parvum
SEIFGFFETSEDKQMPNWMI

SEQ ID NO: 2321536 - protein, 27 aa, Cryptosporidium parvum
SEIKEIRQIAKMLVWLQENNPKTSASA

SEQ ID NO: 2321537 - protein, 19 aa, Cryptosporidium parvum
SEIQLFRLFSTCKEFKFLL

SEQ ID NO: 2321538 - protein, 29 aa, Cryptosporidium parvum
SEIQLKLCIMELYDFLYNRNDSIIKENQD

SEQ ID NO: 2321539 - protein, 23 aa, Cryptosporidium parvum
SEIRRRLHFSRQKSDIMIDGTRI

SEQ ID NO: 2321540 - protein, 17 aa, Cryptosporidium parvum
SEIRWLFDGYLSSDLSE

SEQ ID NO: 2321541 - protein, 23 aa, Cryptosporidium parvum
SEKDIIIQTLLKDTILNFMNINK

SEQ ID NO: 2321542 - protein, 32 aa, Cryptosporidium parvum
SEKEKINSWLEKQILIWNGIPINKLSGKNKVS

SEQ ID NO: 2321543 - protein, 19 aa, Cryptosporidium parvum
SEKFGLWSFELYKNSNACI

SEQ ID NO: 2321544 - protein, 22 aa, Cryptosporidium parvum
SEKFIRNKLVMALEGIDSRISQ

SEQ ID NO: 2321545 - protein, 25 aa, Cryptosporidium parvum
SEKGYKSWWALKSEIFNLIQMTKQS

SEQ ID NO: 2321546 - protein, 24 aa, Cryptosporidium parvum
SEKHRVELLYKLEKLRKIQDEYFR

SEQ ID NO: 2321547 - protein, 29 aa, Cryptosporidium parvum
SEKKNIFQFIINYLKLMSSHLLFMAETDP

SEQ ID NO: 2321548 - protein, 30 aa, Cryptosporidium parvum
SEKNESIKFIKIKVAFLINQGYPEKSPPEI

SEQ ID NO: 2321549 - protein, 31 aa, Cryptosporidium parvum
SEKNKNIIKLRPLCLFVITFLTFGVIQDHET

SEQ ID NO: 2321550 - protein, 18 aa, Cryptosporidium parvum
SEKNLTFEKSLFSMGLIS

SEQ ID NO: 2321551 - protein, 29 aa, Cryptosporidium parvum
SEKSFMKKLKFILFQQQRENKRLKKIKSK

SEQ ID NO: 2321552 - protein, 23 aa, Cryptosporidium parvum
SEKSLLGIIAFSISKSFKSLNSN

SEQ ID NO: 2321553 - protein, 35 aa, Cryptosporidium parvum; identical to SEQ ID NO: 2196837

SEQ ID NO: 2321554 - protein, 17 aa, Cryptosporidium parvum
SELDVLEPVYLRRLIRL

SEQ ID NO: 2321555 - protein, 20 aa, Cryptosporidium parvum
SELIFICVKPHILSQILSEI

SEQ ID NO: 2321556 - protein, 20 aa, Cryptosporidium parvum
SELKHMLQRRKSYNFNYRKQ

SEQ ID NO: 2321557 - protein, 27 aa, Cryptosporidium parvum
SELRKSNDLVIINSLNFSELSSEEKVQ

SEQ ID NO: 2321558 - protein, 25 aa, Cryptosporidium parvum
SELSFEYPFSLPFKSTYESNFDSST

SEQ ID NO: 2321559 - protein, 17 aa, Cryptosporidium parvum
SEMDFGPSPPLGFEPKR

SEQ ID NO: 2321560 - protein, 19 aa, Cryptosporidium parvum
SEMNLLFPGEEEGDWKELA

SEQ ID NO: 2321561 - protein, 23 aa, Cryptosporidium parvum
SEMSKIFHILTLDLNSEEFLKLS

SEQ ID NO: 2321562 - protein, 26 aa, Cryptosporidium parvum
SEMVSSFFEVYFAYHEYYFKQLVNLI

SEQ ID NO: 2321563 - protein, 29 aa, Cryptosporidium parvum
SEMYADLCQILKWRSPVLVNKDGKSTIAF

SEQ ID NO: 2321564 - protein, 24 aa, Cryptosporidium parvum
SEMYAPILRAKPWCYDPDYVPWYD

SEQ ID NO: 2321565 - protein, 30 aa, Cryptosporidium parvum
SENEFFLLREYWIKYDPIIRLVSSDSREEL

SEQ ID NO: 2321566 - protein, 25 aa, Cryptosporidium parvum
SENENIIKFLKIKNEFQNKIISNIC

SEQ ID NO: 2321567 - protein, 21 aa, Cryptosporidium parvum
SENFLIRNTLHPRSDLVMMST

SEQ ID NO: 2321568 - protein, 35 aa, Cryptosporidium parvum; identical to SEQ ID NO: 2196847

SEQ ID NO: 2321569 - protein, 25 aa, Cryptosporidium parvum
SENIYLLTELIPGGELYDALQRIGL

SEQ ID NO: 2321570 - protein, 24 aa, Cryptosporidium parvum
SENMSRRRFSISYVQNLPNKGIEN

SEQ ID NO: 2321571 - protein, 22 aa, Cryptosporidium parvum
SENPLRVILLDRSGNPLVLCNN

SEQ ID NO: 2321572 - protein, 31 aa, Cryptosporidium parvum; identical to SEQ ID NO: 2196851

SEQ ID NO: 2321573 - protein, 21 aa, Cryptosporidium parvum
SENSGFIFARALNEYDPKTVK

SEQ ID NO: 2321574 - protein, 27 aa, Cryptosporidium parvum
SENSQLFIWDKIWNALYPHQKEGVLWM

SEQ ID NO: 2321575 - protein, 23 aa, Cryptosporidium parvum
SENTRLLGIKKVELDEARSLLAS

SEQ ID NO: 2321576 - protein, 25 aa, Cryptosporidium parvum
SEPPKYAVSLVMDLSKVPNIDQMKE

SEQ ID NO: 2321577 - protein, 24 aa, Cryptosporidium parvum
SEQAKQLIRRLLTVDPSQRMTLSE

SEQ ID NO: 2321578 - protein, 30 aa, Cryptosporidium parvum
SEQTIELELDYLLGWWLGAREAEFVRISEA

SEQ ID NO: 2321579 - protein, 33 aa, Cryptosporidium parvum
SERLHICLDKRYRPFIIQFVIFNSKIGQSRLID

SEQ ID NO: 2321580 - protein, 22 aa, Cryptosporidium parvum
SESGLVLPIFKTNWDLLKLINK

SEQ ID NO: 2321581 - protein, 28 aa, Cryptosporidium parvum
SESNKSISILWPTLDKWASLSEKSFKLN

SEQ ID NO: 2321582 - protein, 24 aa, Cryptosporidium parvum
SESPGYLVLQWDNSWSLFSGKTVH

SEQ ID NO: 2321583 - protein, 26 aa, Cryptosporidium parvum
SESRKAYFIGYMVHKLCLGALGRVPE

SEQ ID NO: 2321584 - protein, 22 aa, Cryptosporidium parvum
SESVIFFHFISKDDKYSNLPNS

SEQ ID NO: 2321585 - protein, 36 aa, Cryptosporidium parvum
SESWINMVYGTRTLHPFGCKFYFNLSLDINKNLGHN

SEQ ID NO: 2321586 - protein, 22 aa, Cryptosporidium parvum
SESYTSFILARSLNPIKYTHEN

SEQ ID NO: 2321587 - protein, 17 aa, Cryptosporidium parvum
SETDALFTYFWIERFVL

SEQ ID NO: 2321588 - protein, 32 aa, Cryptosporidium parvum; identical to SEQ ID NO: 2196867

SEQ ID NO: 2321589 - protein, 28 aa, Cryptosporidium parvum
SETISSSSFLFWLVNNCLKFETRKIVVV

SEQ ID NO: 2321590 - protein, 29 aa, Cryptosporidium parvum
SETLRIEMYKKFLKNQALLALKLGKYNDS

SEQ ID NO: 2321591 - protein, 21 aa, Cryptosporidium parvum
SETMYIIRFRLKNISSQINEK

SEQ ID NO: 2321592 - protein, 19 aa, Cryptosporidium parvum
SETNFQGFDPTEWCNLGSG

SEQ ID NO: 2321593 - protein, 21 aa, Cryptosporidium parvum
SEVLSILRYLSNFDTFSTSLD

SEQ ID NO: 2321594 - protein, 25 aa, Cryptosporidium parvum
SEVQPVNLQYLGGGPHLGPHPHIFI

SEQ ID NO: 2321595 - protein, 26 aa, Cryptosporidium parvum
SEVTRKRLVILLQTFGDKMTEDEINR

SEQ ID NO: 2321596 - protein, 19 aa, Cryptosporidium parvum
SEWKLNDYYRNPGPIQFDG

SEQ ID NO: 2321597 - protein, 22 aa, Cryptosporidium parvum
SEWVRDVAWRPSVDLLAETIAS

SEQ ID NO: 2321598 - protein, 23 aa, Cryptosporidium parvum
SEYDSLLEMILNIGNITNKTFQE

SEQ ID NO: 2321599 - protein, 22 aa, Cryptosporidium parvum
SEYFLSHIIKNLNLKTPIILTP

SEQ ID NO: 2321600 - protein, 33 aa, Cryptosporidium parvum
SEYFNDYQWDFLSKFYRVYISDQYKFVSNIPVS

SEQ ID NO: 2321601 - protein, 20 aa, Cryptosporidium parvum
SEYIHHTGLLPPWLSNGEKV

SEQ ID NO: 2321602 - protein, 20 aa, Cryptosporidium parvum
SEYNVIGHLGNVRQFLLNLE

SEQ ID NO: 2321603 - protein, 24 aa, Cryptosporidium parvum
SEYTPLYIYKSFGSSVRSVSISGT

SEQ ID NO: 2321604 - protein, 20 aa, Cryptosporidium parvum
SFAFAPILKINVHSSVLATS

SEQ ID NO: 2321605 - protein, 18 aa, Cryptosporidium parvum
SFAPVRFGSMSISDTLAL

SEQ ID NO: 2321606 - protein, 34 aa, Cryptosporidium parvum; identical to SEQ ID NO: 2196876

SEQ ID NO: 2321607 - protein, 26 aa, Cryptosporidium parvum
SFDPNAIFIHYGHTAPITSISWNPNE

SEQ ID NO: 2321608 - protein, 25 aa, Cryptosporidium parvum
SFDRSRLLTRFVIKLILELNDKNKS

SEQ ID NO: 2321609 - protein, 18 aa, Cryptosporidium parvum
SFEDLYIGRVLTGVIINV

SEQ ID NO: 2321610 - protein, 18 aa, Cryptosporidium parvum
SFEFIPPPSKHIVEFLMG

SEQ ID NO: 2321611 - protein, 29 aa, Cryptosporidium parvum
SFEHALDLFSAFFICPLFDTKYVDREVNA

SEQ ID NO: 2321612 - protein, 26 aa, Cryptosporidium parvum
SFELEAPKFELSFSDLSIRGEASISV

SEQ ID NO: 2321613 - protein, 25 aa, Cryptosporidium parvum
SFENLSRPYTPLRDITGSIFGGLVR

SEQ ID NO: 2321614 - protein, 18 aa, Cryptosporidium parvum
SFFGINRTAERIKIPSDG

SEQ ID NO: 2321615 - protein, 24 aa, Cryptosporidium parvum
SFFLSYIGYFIYSENKDPFSECKK

SEQ ID NO: 2321616 - protein, 25 aa, Cryptosporidium parvum
SFGDRAYYIGILPKSQMDLEERLRK

SEQ ID NO: 2321617 - protein, 18 aa, Cryptosporidium parvum
SFGVFDKLVSLAQNRSIA

SEQ ID NO: 2321618 - protein, 23 aa, Cryptosporidium parvum
SFHALAHLKYFLHLKQFKKNVSQ

SEQ ID NO: 2321619 - protein, 30 aa, Cryptosporidium parvum
SFHVIKTSCPIMIKLLREWILNANRGEFDH

SEQ ID NO: 2321620 - protein, 20 aa, Cryptosporidium parvum
SFIAALFITFKRNQEAFLDD

SEQ ID NO: 2321621 - protein, 21 aa, Cryptosporidium parvum
SFICNDKVKAVPWSNIREIFT

SEQ ID NO: 2321622 - protein, 24 aa, Cryptosporidium parvum
SFIICKVPLSLIKCPKLLSLYTVK

SEQ ID NO: 2321623 - protein, 20 aa, Cryptosporidium parvum
SFIIEKLLKMYGVNYPIWNL

SEQ ID NO: 2321624 - protein, 20 aa, Cryptosporidium parvum
SFILHGLEYQLRVRKLIQSI

SEQ ID NO: 2321625 - protein, 18 aa, Cryptosporidium parvum
SFITVNSILHMGGPGGTQ

SEQ ID NO: 2321626 - protein, 19 aa, Cryptosporidium parvum
SFKENFYFHWKRIIGACNF

SEQ ID NO: 2321627 - protein, 19 aa, Cryptosporidium parvum
SFKFRDESKLLKDSSSSSS

SEQ ID NO: 2321628 - protein, 41 aa, Cryptosporidium parvum
SFKGDKIQKPLLSQKKRMLLRCHLTVPKLQYKIYSSAHQIN

SEQ ID NO: 2321629 - protein, 20 aa, Cryptosporidium parvum
SFKKKFFFFVDDLVNENNDT

SEQ ID NO: 2321630 - protein, 18 aa, Cryptosporidium parvum
SFKKPYWEKKIKNTNRHE

SEQ ID NO: 2321631 - protein, 21 aa, Cryptosporidium parvum
SFKLIQLIHSLQDFFTPPSLS

SEQ ID NO: 2321632 - protein, 24 aa, Cryptosporidium parvum
SFKPFAITFFNYKVKYSWIAVHGI

SEQ ID NO: 2321633 - protein, 25 aa, Cryptosporidium parvum
SFLDASRQLILPKLFQISQGEHLIL

SEQ ID NO: 2321634 - protein, 21 aa, Cryptosporidium parvum
SFLEIFKRANYKCILKMEQTF

SEQ ID NO: 2321635 - protein, 17 aa, Cryptosporidium parvum
SFLIKRMTRKMYTDITT

SEQ ID NO: 2321636 - protein, 24 aa, Cryptosporidium parvum
SFLKAYLHGYLMNSKLFNDLRDII

SEQ ID NO: 2321637 - protein, 28 aa, Cryptosporidium parvum
SFLSIRIIHYCILRLLKIRKSIDAIYQT

SEQ ID NO: 2321638 - protein, 19 aa, Cryptosporidium parvum
SFLVKGVAFKKTFSYAGFE

SEQ ID NO: 2321639 - protein, 18 aa, Cryptosporidium parvum
SFMIYYHCEASPAILLSV

SEQ ID NO: 2321640 - protein, 19 aa, Cryptosporidium parvum
SFMLLNTYKSDLPPLEVDI

SEQ ID NO: 2321641 - protein, 23 aa, Cryptosporidium parvum
SFNIIEFFKQKIIPRIVPNIFYL

SEQ ID NO: 2321642 - protein, 19 aa, Cryptosporidium parvum
SFNILFHFKNQSYNFFLIT

SEQ ID NO: 2321643 - protein, 27 aa, Cryptosporidium parvum
SFNNRKLYPAFVINIHLPQSLLDINVT

SEQ ID NO: 2321644 - protein, 18 aa, Cryptosporidium parvum
SFNTLNLPNQPNLSSKLA

SEQ ID NO: 2321645 - protein, 20 aa, Cryptosporidium parvum
SFPSCWPLEYQNLNSIPLFR

SEQ ID NO: 2321646 - protein, 27 aa, Cryptosporidium parvum
SFQGKIRNMLFKLLIHPVHELVNNLKT

SEQ ID NO: 2321647 - protein, 25 aa, Cryptosporidium parvum
SFQGLDPAMWQMVTTIAAICSTACQ

SEQ ID NO: 2321648 - protein, 27 aa, Cryptosporidium parvum
SFQNLLNYYHFIPNQLFLQILAKSENQ

SEQ ID NO: 2321649 - protein, 23 aa, Cryptosporidium parvum
SFRNTMNHFFFYCFSKDPNPKKD

SEQ ID NO: 2321650 - protein, 25 aa, Cryptosporidium parvum
SFSDVGLEPKPIFELDDLSYKQRRK

SEQ ID NO: 2321651 - protein, 18 aa, Cryptosporidium parvum
SFSKKLELYLLDGNYSKI

SEQ ID NO: 2321652 - protein, 26 aa, Cryptosporidium parvum
SFSSKTNLIYTYSSNWFASLVNSKSV

SEQ ID NO: 2321653 - protein, 19 aa, Cryptosporidium parvum
SFSYFSFQLNNSGYRIYPF

SEQ ID NO: 2321654 - protein, 30 aa, Cryptosporidium parvum
SFTKELFLKYTFLRFMPRSFSIKKISLSPC

SEQ ID NO: 2321655 - protein, 26 aa, Cryptosporidium parvum
SFTSIDLNLILPYLLDLNGIDIQYKD

SEQ ID NO: 2321656 - protein, 18 aa, Cryptosporidium parvum
SFTSKPLREVYVGNLPQG

SEQ ID NO: 2321657 - protein, 18 aa, Cryptosporidium parvum
SFVNKLIERYYSTSKSKL

SEQ ID NO: 2321658 - protein, 24 aa, Cryptosporidium parvum
SFYITQLSILTEQLNMQKQLLLSE

SEQ ID NO: 2321659 - protein, 23 aa, Cryptosporidium parvum
SFYQDFCFSLQETLFAMLIEVTE

SEQ ID NO: 2321660 - protein, 21 aa, Cryptosporidium parvum
SFYTNWIQGELFQKLKPKKRD

SEQ ID NO: 2321661 - protein, 21 aa, Cryptosporidium parvum
SGAPLPLFMLELFSLSREERA

SEQ ID NO: 2321662 - protein, 23 aa, Cryptosporidium parvum
SGAYGCVVSFYDKSRGSYIAVKK

SEQ ID NO: 2321663 - protein, 22 aa, Cryptosporidium parvum
SGCLLSSRYISRLVPLDIICSA

SEQ ID NO: 2321664 - protein, 24 aa, Cryptosporidium parvum
SGCTALHIALLNAYPEMLEILLSC

SEQ ID NO: 2321665 - protein, 18 aa, Cryptosporidium parvum
SGDFKLKGPGFKVENVYI

SEQ ID NO: 2321666 - protein, 18 aa, Cryptosporidium parvum
SGDLIPWTLCNHLARDDF

SEQ ID NO: 2321667 - protein, 25 aa, Cryptosporidium parvum
SGDTFYLVMDLVEGGELFYKIVEHG

SEQ ID NO: 2321668 - protein, 26 aa, Cryptosporidium parvum
SGECFVLNLAYKFDPCVWLDDPLPIS

SEQ ID NO: 2321669 - protein, 29 aa, Cryptosporidium parvum
SGFKLGFHLKPLLFRISKLLNSSEISIIS

SEQ ID NO: 2321670 - protein, 17 aa, Cryptosporidium parvum
SGFLAFCTEKRALKSGG

SEQ ID NO: 2321671 - protein, 23 aa, Cryptosporidium parvum
SGGAFRIWDIRTGRSILSQLAHS

SEQ ID NO: 2321672 - protein, 27 aa, Cryptosporidium parvum
SGGASGNRRWNFGASKEKGRYKQSGNE

SEQ ID NO: 2321673 - protein, 28 aa, Cryptosporidium parvum
SGGLEFWDPWTMTLPRRNIQDNELNPIK

SEQ ID NO: 2321674 - protein, 36 aa, Cryptosporidium parvum; identical to SEQ ID NO: 2196932

SEQ ID NO: 2321675 - protein, 24 aa, Cryptosporidium parvum
SGGTTVIRKALNLSIHRLNNSISN

SEQ ID NO: 2321676 - protein, 26 aa, Cryptosporidium parvum
SGIAARILKRSLPLVFSRYMSSKCEG

SEQ ID NO: 2321677 - protein, 18 aa, Cryptosporidium parvum
SGICSGINPSKWGGSVLP

SEQ ID NO: 2321678 - protein, 27 aa, Cryptosporidium parvum
SGIKNDIDKFVFLSNKLKNENSQIEKK

SEQ ID NO: 2321679 - protein, 22 aa, Cryptosporidium parvum
SGILFTPICPHTLSFRPVILPG

SEQ ID NO: 2321680 - protein, 17 aa, Cryptosporidium parvum
SGIPIASFPGIESILST

SEQ ID NO: 2321681 - protein, 28 aa, Cryptosporidium parvum
SGIRLRLEWDRRRYCFKFTVYQIEEVRD

SEQ ID NO: 2321682 - protein, 26 aa, Cryptosporidium parvum
SGIWHETLPIFIYTTQGHIKYAIPNI

SEQ ID NO: 2321683 - protein, 25 aa, Cryptosporidium parvum
SGKAIPNPILVQKMSRCLGVNLPKP

SEQ ID NO: 2321684 - protein, 22 aa, Cryptosporidium parvum
SGKILINPFQITYSKLNNICSN

SEQ ID NO: 2321685 - protein, 24 aa, Cryptosporidium parvum
SGKIVDYLRSMYLLFNADDGNILK

SEQ ID NO: 2321686 - protein, 23 aa, Cryptosporidium parvum
SGKKYLLSFFNSIGGSFISDYQI

SEQ ID NO: 2321687 - protein, 27 aa, Cryptosporidium parvum
SGKLLIYDDWLYFGPLSVQELYRMKLS

SEQ ID NO: 2321688 - protein, 31 aa, Cryptosporidium parvum; identical to SEQ ID NO: 2196939

SEQ ID NO: 2321689 - protein, 18 aa, Cryptosporidium parvum
SGKLVKPVIISCPASLLD

SEQ ID NO: 2321690 - protein, 22 aa, Cryptosporidium parvum
SGKPAGLYGGNLVPFGLSGGAL

SEQ ID NO: 2321691 - protein, 17 aa, Cryptosporidium parvum
SGKQECFDLLFQANADL

SEQ ID NO: 2321692 - protein, 23 aa, Cryptosporidium parvum
SGKSIVESILLPLSTTSCGTSAE

SEQ ID NO: 2321693 - protein, 33 aa, Cryptosporidium parvum
SGKSYVYFKIDFIKTIIIGYVPNLGLVLDSTIL

SEQ ID NO: 2321694 - protein, 23 aa, Cryptosporidium parvum
SGKTFICYYAMEQVLRFDNESVV

SEQ ID NO: 2321695 - protein, 23 aa, Cryptosporidium parvum
SGKTLAFLIPAANLLYNVEFLPR

SEQ ID NO: 2321696 - protein, 23 aa, Cryptosporidium parvum
SGKTLAYVIPILENIYRDNYCSI

SEQ ID NO: 2321697 - protein, 24 aa, Cryptosporidium parvum
SGKTLLCKILALNIQIPKSIGGPG

SEQ ID NO: 2321698 - protein, 17 aa, Cryptosporidium parvum
SGKWFAYGGFGNLAGDL

SEQ ID NO: 2321699 - protein, 29 aa, Cryptosporidium parvum
SGLALADYILFCNSKHQFVATFRRFSIGA

SEQ ID NO: 2321700 - protein, 23 aa, Cryptosporidium parvum
SGLAWPMYYKFDEKEIKEQNFEL

SEQ ID NO: 2321701 - protein, 27 aa, Cryptosporidium parvum
SGLDEKIRVIKYLWETKRDFNIHEVFD

SEQ ID NO: 2321702 - protein, 24 aa, Cryptosporidium parvum
SGLHGWAFTIEKFARIYAKKFGVE

SEQ ID NO: 2321703 - protein, 28 aa, Cryptosporidium parvum
SGLIKKRITIIPLDKIMDPSIPEKTLNS

SEQ ID NO: 2321704 - protein, 17 aa, Cryptosporidium parvum
SGLLFGGLGSNLGQHNV

SEQ ID NO: 2321705 - protein, 34 aa, Cryptosporidium parvum
SGLNDFLSKIPFPILLVYIGLNAGLFRGSEFGMD

SEQ ID NO: 2321706 - protein, 28 aa, Cryptosporidium parvum
SGLQDPRANLFWDPAVMAAASSVSPFYT

SEQ ID NO: 2321707 - protein, 25 aa, Cryptosporidium parvum
SGLREIFVYLAKNKLIDVIVTSAGG

SEQ ID NO: 2321708 - protein, 23 aa, Cryptosporidium parvum
SGLVKKFYLPNKLEVLLISSSDK

SEQ ID NO: 2321709 - protein, 28 aa, Cryptosporidium parvum
SGLYDLISEAFCFLPLAHVINDKVFVVH

SEQ ID NO: 2321710 - protein, 24 aa, Cryptosporidium parvum
SGMAEYLAITLLRDKYKPDMSFDE

SEQ ID NO: 2321711 - protein, 24 aa, Cryptosporidium parvum
SGMGTVHPQYYVVPSPLGVSGINN

SEQ ID NO: 2321712 - protein, 25 aa, Cryptosporidium parvum
SGMTQVLTRFSYIASLGIMTRVDSQ

SEQ ID NO: 2321713 - protein, 23 aa, Cryptosporidium parvum
SGNENVLGFIPFETAKKLAKNQF

SEQ ID NO: 2321714 - protein, 25 aa, Cryptosporidium parvum
SGNLFYISLITGQLLRWNPDEVTTN

SEQ ID NO: 2321715 - protein, 27 aa, Cryptosporidium parvum
SGNLKRIIKIVLFTLKSSNYEWIFISS

SEQ ID NO: 2321716 - protein, 26 aa, Cryptosporidium parvum
SGNSRAIQILKYLGLLDPSSENLEDL

SEQ ID NO: 2321717 - protein, 22 aa, Cryptosporidium parvum
SGNSSMFLPGRAQNTAGQAGQV

SEQ ID NO: 2321718 - protein, 22 aa, Cryptosporidium parvum
SGNTLLLNPFETSTIPIISEQI

SEQ ID NO: 2321719 - protein, 24 aa, Cryptosporidium parvum
SGNTTFTHAWYPEISKILYDVSKS

SEQ ID NO: 2321720 - protein, 33 aa, Cryptosporidium parvum
SGNVSSVKPIMITSLWSCIYKSLRYNMNRYNAC

SEQ ID NO: 2321721 - protein, 28 aa, Cryptosporidium parvum
SGQFDEEILLYLLFHTLELNRDVLNSRK

SEQ ID NO: 2321722 - protein, 17 aa, Cryptosporidium parvum
SGQFPNAIGISESSYGC

SEQ ID NO: 2321723 - protein, 18 aa, Cryptosporidium parvum
SGRKLLRFNYAKKLQFSS

SEQ ID NO: 2321724 - protein, 26 aa, Cryptosporidium parvum
SGRLKEWKLRLHLWGNLDDLEYSNLI

SEQ ID NO: 2321725 - protein, 29 aa, Cryptosporidium parvum
SGRVTRIIRLLTFINRSIEGSGILRILMS

SEQ ID NO: 2321726 - protein, 26 aa, Cryptosporidium parvum
SGRYDILAILLAYNSSYLRSLEILEN

SEQ ID NO: 2321727 - protein, 19 aa, Cryptosporidium parvum
SGSIISRFIPRFILSLSSC

SEQ ID NO: 2321728 - protein, 28 aa, Cryptosporidium parvum
SGSILDTLIFQICRLPLGLKSKSLIGFN

SEQ ID NO: 2321729 - protein, 26 aa, Cryptosporidium parvum
SGSILGEIFTFEFLKEFYGVLDFGSV

SEQ ID NO: 2321730 - protein, 23 aa, Cryptosporidium parvum
SGSWNDFLSFLYSKGHSVDWKIE

SEQ ID NO: 2321731 - protein, 17 aa, Cryptosporidium parvum
SGSYLYKYPRSCIGSRR

SEQ ID NO: 2321732 - protein, 25 aa, Cryptosporidium parvum
SGTTATVILHLPLENRIIAAHVGDS

SEQ ID NO: 2321733 - protein, 24 aa, Cryptosporidium parvum
SGVGKSCLLLRFADDTYTDSYIST

SEQ ID NO: 2321734 - protein, 18 aa, Cryptosporidium parvum
SGVILYEETLFQSTASGE

SEQ ID NO: 2321735 - protein, 30 aa, Cryptosporidium parvum
SGVSIESIIKLIFLLWSITKNEVEIYSHLS

SEQ ID NO: 2321736 - protein, 24 aa, Cryptosporidium parvum
SGVSRGFGFVSFLSPDEATKAITE

SEQ ID NO: 2321737 - protein, 24 aa, Cryptosporidium parvum
SGVTILDVFSRIMKSFHLSILEKL

SEQ ID NO: 2321738 - protein, 27 aa, Cryptosporidium parvum
SGYAGKVLFGWDFPAGFTPSLSCKGFH

SEQ ID NO: 2321739 - protein, 46 aa, Cryptosporidium parvum
SGYITSIEWIFHTKLLVFTIYRILDTFVFPFSIPNLKQPCLELLTF

SEQ ID NO: 2321740 - protein, 24 aa, Cryptosporidium parvum
SGYSIFGITRPFTSNLLKVTMEDG

SEQ ID NO: 2321741 - protein, 24 aa, Cryptosporidium parvum
SHANSFPLGLSYNVSNRRYDLNPR

SEQ ID NO: 2321742 - protein, 34 aa, Cryptosporidium parvum; identical to SEQ ID NO: 2196980

SEQ ID NO: 2321743 - protein, 26 aa, Cryptosporidium parvum
SHGVPMIHIPMLYDSFTSFRFEHDAT

SEQ ID NO: 2321744 - protein, 18 aa, Cryptosporidium parvum
SHIERFTRILLYSPKLNE

SEQ ID NO: 2321745 - protein, 25 aa, Cryptosporidium parvum
SHILEVWRIFMPFGCPMMDKKEVKD

SEQ ID NO: 2321746 - protein, 21 aa, Cryptosporidium parvum
SHIRGLGLNDALDARYSSDGM

SEQ ID NO: 2321747 - protein, 35 aa, Cryptosporidium parvum; identical to SEQ ID NO: 2196984

SEQ ID NO: 2321748 - protein, 33 aa, Cryptosporidium parvum
SHKKNPLLAVGFTNGLFSLIQPDTGKVLSLNNR

SEQ ID NO: 2321749 - protein, 17 aa, Cryptosporidium parvum
SHKLIEYHILRLFEKVI

SEQ ID NO: 2321750 - protein, 34 aa, Cryptosporidium parvum
SHKVDIWAIGCIFFEILHLRRPFGLRSNSIAEAF

SEQ ID NO: 2321751 - protein, 22 aa, Cryptosporidium parvum
SHLQDNALLIAMYKLGVQSYND

SEQ ID NO: 2321752 - protein, 17 aa, Cryptosporidium parvum
SHLRFFGNMVLSLWDCG

SEQ ID NO: 2321753 - protein, 44 aa, Cryptosporidium parvum
SHNGSLVSTPIRKSKRQIIYNFANSIWDYVKPVSLDELEERRKT

SEQ ID NO: 2321754 - protein, 24 aa, Cryptosporidium parvum
SHPAIPPYHMLPQPQPGVIPQMIP

SEQ ID NO: 2321755 - protein, 19 aa, Cryptosporidium parvum
SHQLGIYNSIRFVGKKSGD

SEQ ID NO: 2321756 - protein, 25 aa, Cryptosporidium parvum
SHRKLTWIYWYGECVLDYKLPTPNG

SEQ ID NO: 2321757 - protein, 18 aa, Cryptosporidium parvum
SHRQTLIAEGILPIIADS

SEQ ID NO: 2321758 - protein, 17 aa, Cryptosporidium parvum
SHSIVTESLLRGVTDNQ

SEQ ID NO: 2321759 - protein, 20 aa, Cryptosporidium parvum
SHSLGRFKLKFSPEKIDTMI

SEQ ID NO: 2321760 - protein, 18 aa, Cryptosporidium parvum
SHSSIPRYSLKNKLVIVF

SEQ ID NO: 2321761 - protein, 24 aa, Cryptosporidium parvum
SHVKALLLLCRGLDKFEIKTLKTV

SEQ ID NO: 2321762 - protein, 17 aa, Cryptosporidium parvum
SHVYYPRAYMYNNIKHN

SEQ ID NO: 2321763 - protein, 23 aa, Cryptosporidium parvum
SHYSYLDQLFDLFDMDSDSFISL

SEQ ID NO: 2321764 - protein, 30 aa, Cryptosporidium parvum; identical to SEQ ID NO: 2197000

SEQ ID NO: 2321765 - protein, 19 aa, Cryptosporidium parvum
SIAGIKFFGKPLKIQLKAG

SEQ ID NO: 2321766 - protein, 25 aa, Cryptosporidium parvum
SIAKYSYHILICIINIIEDKSFQLD

SEQ ID NO: 2321767 - protein, 24 aa, Cryptosporidium parvum
SIALQPCIAIKEKSFRLPIFELTY

SEQ ID NO: 2321768 - protein, 20 aa, Cryptosporidium parvum
SIARCFKKGLGGSILSSCMG

SEQ ID NO: 2321769 - protein, 24 aa, Cryptosporidium parvum
SIARPKFGGILKSQKGDMLCDYDD

SEQ ID NO: 2321770 - protein, 23 aa, Cryptosporidium parvum
SIAVELFEKLLNNLKFLCPEMNG

SEQ ID NO: 2321771 - protein, 20 aa, Cryptosporidium parvum
SICIRCLKIHPKEHCRKARC

SEQ ID NO: 2321772 - protein, 25 aa, Cryptosporidium parvum
SICQGTWLYYENPVAHFTKYKQNNS

SEQ ID NO: 2321773 - protein, 23 aa, Cryptosporidium parvum
SICRNIFLFYQSNKYYMHFTQLN

SEQ ID NO: 2321774 - protein, 19 aa, Cryptosporidium parvum
SIDIISFGEILVNRERLQA

SEQ ID NO: 2321775 - protein, 39 aa, Cryptosporidium parvum
SIDILPNLAIIILAMKVFQHSVLQQLLLSFSENEFFLLR

SEQ ID NO: 2321776 - protein, 20 aa, Cryptosporidium parvum
SIDLLKKMLVFNPNKRITVD

SEQ ID NO: 2321777 - protein, 20 aa, Cryptosporidium parvum
SIDLVNYIIMIFNRYWIIDS

SEQ ID NO: 2321778 - protein, 25 aa, Cryptosporidium parvum
SIDNYILIILGTWMNGSKLSCIYYN

SEQ ID NO: 2321779 - protein, 22 aa, Cryptosporidium parvum
SIDRGLFRSVFFRTYVSEEKQV

SEQ ID NO: 2321780 - protein, 18 aa, Cryptosporidium parvum
SIDRWREEWTKRLEASKD

SEQ ID NO: 2321781 - protein, 27 aa, Cryptosporidium parvum
SIDYWTRFEALWFVELSSVTGKLNNLL

SEQ ID NO: 2321782 - protein, 24 aa, Cryptosporidium parvum
SIEIPPRFDLTKLPWLSQIPNANF

SEQ ID NO: 2321783 - protein, 24 aa, Cryptosporidium parvum
SIEKDWEEFFKHKSPRMRKICQWK

SEQ ID NO: 2321784 - protein, 30 aa, Cryptosporidium parvum
SIENQKIFLSILFFTVYHLLSNGKYDNTKF

SEQ ID NO: 2321785 - protein, 20 aa, Cryptosporidium parvum
SIESGYRWDGVIRGNGFEEN

SEQ ID NO: 2321786 - protein, 27 aa, Cryptosporidium parvum
SIESINEFILLNWTPGEQKLLEEAICY

SEQ ID NO: 2321787 - protein, 19 aa, Cryptosporidium parvum
SIETLLKYSNDLDIIVAES

SEQ ID NO: 2321788 - protein, 21 aa, Cryptosporidium parvum
SIEYKLSYHKSIEFEFDRFFF

SEQ ID NO: 2321789 - protein, 27 aa, Cryptosporidium parvum
SIEYYEKNLPLICSFLSVLFELSYNEN

SEQ ID NO: 2321790 - protein, 17 aa, Cryptosporidium parvum
SIFEMRLSPSTNELNNE

SEQ ID NO: 2321791 - protein, 19 aa, Cryptosporidium parvum
SIFKINHVAIILDGNRRYA

SEQ ID NO: 2321792 - protein, 17 aa, Cryptosporidium parvum
SIFPTLLGQISSFFYIK

SEQ ID NO: 2321793 - protein, 20 aa, Cryptosporidium parvum
SIFTLIYEMEAKVGLDESRI

SEQ ID NO: 2321794 - protein, 17 aa, Cryptosporidium parvum
SIFVKLLEFINFNPNQL

SEQ ID NO: 2321795 - protein, 20 aa, Cryptosporidium parvum
SIGCLLLELCSLEKVFRKYS

SEQ ID NO: 2321796 - protein, 17 aa, Cryptosporidium parvum
SIGMWYDSVRWTHELLE

SEQ ID NO: 2321797 - protein, 19 aa, Cryptosporidium parvum
SIGPGLLLLVGIRTDDVDS

SEQ ID NO: 2321798 - protein, 27 aa, Cryptosporidium parvum
SIGQLRLQFIFLYYDTDRNGLLNLNEL

SEQ ID NO: 2321799 - protein, 21 aa, Cryptosporidium parvum
SIGVMAHILLCGVPPFAGNTD

SEQ ID NO: 2321800 - protein, 21 aa, Cryptosporidium parvum
SIHFQDLLEIYSKYFIQKTRP

SEQ ID NO: 2321801 - protein, 17 aa, Cryptosporidium parvum
SIHFRSITLQDPATVIF

SEQ ID NO: 2321802 - protein, 24 aa, Cryptosporidium parvum
SIIARFHRILRPFMLRRVKSEVEI

SEQ ID NO: 2321803 - protein, 17 aa, Cryptosporidium parvum
SIIAYWPPKEVLKIPIT

SEQ ID NO: 2321804 - protein, 20 aa, Cryptosporidium parvum
SIIEIWIDWKIFPSEYIEGL

SEQ ID NO: 2321805 - protein, 29 aa, Cryptosporidium parvum
SIIIVEGIFILFHPKIRHLINMSIFVDTD

SEQ ID NO: 2321806 - protein, 20 aa, Cryptosporidium parvum
SIIKTQFYNALPEKSRDLLC

SEQ ID NO: 2321807 - protein, 17 aa, Cryptosporidium parvum
SIILSFLNPIDSPVVVE

SEQ ID NO: 2321808 - protein, 30 aa, Cryptosporidium parvum
SIILSGHNLFLPYIFELHSGGLFPAPILIN

SEQ ID NO: 2321809 - protein, 40 aa, Cryptosporidium parvum
SIIMQESKLLREPIILLIDPKRMQIINLRNKISITDLDEI

SEQ ID NO: 2321810 - protein, 19 aa, Cryptosporidium parvum
SIINIDLYELLILSSSQRL

SEQ ID NO: 2321811 - protein, 20 aa, Cryptosporidium parvum
SIISILLDPANYKPAWILSL

SEQ ID NO: 2321812 - protein, 26 aa, Cryptosporidium parvum
SIKFQTLVEAFLQQFHYYFISEREDV

SEQ ID NO: 2321813 - protein, 17 aa, Cryptosporidium parvum
SIKKKYFGEIKALKFIL

SEQ ID NO: 2321814 - protein, 24 aa, Cryptosporidium parvum
SIKLKLLLENDLRLSLLKSIKSIE

SEQ ID NO: 2321815 - protein, 25 aa, Cryptosporidium parvum
SIKNEILFRILSTKLAQFYTTNGGD

SEQ ID NO: 2321816 - protein, 34 aa, Cryptosporidium parvum; identical to SEQ ID NO: 2197043

SEQ ID NO: 2321817 - protein, 23 aa, Cryptosporidium parvum
SIKSKIDFFKGKRVAIDTYGWLH

SEQ ID NO: 2321818 - protein, 17 aa, Cryptosporidium parvum
SIKTLVVNPKIEYPKCM

SEQ ID NO: 2321819 - protein, 17 aa, Cryptosporidium parvum
SIKWYSNRNLLYNPITF

SEQ ID NO: 2321820 - protein, 20 aa, Cryptosporidium parvum
SIKYLKHFLPNTTNMMPSSC

SEQ ID NO: 2321821 - protein, 19 aa, Cryptosporidium parvum
SILDLNKLIFELYNENCRI

SEQ ID NO: 2321822 - protein, 18 aa, Cryptosporidium parvum
SILENFLMDILEAFDCHT

SEQ ID NO: 2321823 - protein, 17 aa, Cryptosporidium parvum
SILGFGSTSLVYSAVWR

SEQ ID NO: 2321824 - protein, 17 aa, Cryptosporidium parvum
SILGFLKSTFKVEGPHI

SEQ ID NO: 2321825 - protein, 31 aa, Cryptosporidium parvum
SILIIDEYLLNIWISLLRKCIDTFIKFIPNT

SEQ ID NO: 2321826 - protein, 22 aa, Cryptosporidium parvum
SILIIDVQPLLHASPLLFNLFE

SEQ ID NO: 2321827 - protein, 28 aa, Cryptosporidium parvum
SILKCSQLDLLKFLKYSNDKLSKYNIGV

SEQ ID NO: 2321828 - protein, 25 aa, Cryptosporidium parvum
SILKGYLIHFTQDISWIYSKMDTSR

SEQ ID NO: 2321829 - protein, 26 aa, Cryptosporidium parvum
SILKRKKHIFIITKTSSVFQSSIDEI

SEQ ID NO: 2321830 - protein, 19 aa, Cryptosporidium parvum
SILLNPLCNRLFTAGSSGE

SEQ ID NO: 2321831 - protein, 28 aa, Cryptosporidium parvum
SILLPHFIQNFIYPYLYYRIRVGESYYH

SEQ ID NO: 2321832 - protein, 28 aa, Cryptosporidium parvum
SILSIWPIKSRLPVWKVWREMNNLLINK

SEQ ID NO: 2321833 - protein, 27 aa, Cryptosporidium parvum
SILTFVWLTYWHLKSLLNIAPSFWRFC

SEQ ID NO: 2321834 - protein, 30 aa, Cryptosporidium parvum
SIMHWQSVYKAIKYYLNSLRSKQRRLPQIK

SEQ ID NO: 2321835 - protein, 28 aa, Cryptosporidium parvum
SIMKYSIDNFWFSVYKYLIISVQNNAEN

SEQ ID NO: 2321836 - protein, 22 aa, Cryptosporidium parvum
SIMLAKFKIIRCKPVPILTRSY

SEQ ID NO: 2321837 - protein, 26 aa, Cryptosporidium parvum
SIMNSMDSFRFFYINKSNYAIRRSNR

SEQ ID NO: 2321838 - protein, 34 aa, Cryptosporidium parvum; identical to SEQ ID NO: 2197062

SEQ ID NO: 2321839 - protein, 24 aa, Cryptosporidium parvum
SINITLYRMRRLLGVRAHDGSKAQ

SEQ ID NO: 2321840 - protein, 19 aa, Cryptosporidium parvum
SINLILMISLIECTNFEKY

SEQ ID NO: 2321841 - protein, 28 aa, Cryptosporidium parvum
SINNNYNIYIYCFKPYNSHFPEINIENN

SEQ ID NO: 2321842 - protein, 28 aa, Cryptosporidium parvum
SINPECCGWLYVLNLKGNQYGRDISLEE

SEQ ID NO: 2321843 - protein, 22 aa, Cryptosporidium parvum
SIPGRMFPVELIYNIKPEKDYL

SEQ ID NO: 2321844 - protein, 22 aa, Cryptosporidium parvum
SIPIEYLDLIKRWLNEMEIVYY

SEQ ID NO: 2321845 - protein, 20 aa, Cryptosporidium parvum
SIPNLLDGLKPGQRKVLFAT

SEQ ID NO: 2321846 - protein, 20 aa, Cryptosporidium parvum
SIPNNWKFQATVARKQLRQF

SEQ ID NO: 2321847 - protein, 29 aa, Cryptosporidium parvum
SIQDKRVRILLLIFQWIKKQQCELVDPSV

SEQ ID NO: 2321848 - protein, 30 aa, Cryptosporidium parvum
SIQDVSKYSFLLQYIIDINIKIIQDDEFFI

SEQ ID NO: 2321849 - protein, 17 aa, Cryptosporidium parvum
SIQHYMQSPLSYTSNRI

SEQ ID NO: 2321850 - protein, 18 aa, Cryptosporidium parvum
SIQLELLEIIILDEADRL

SEQ ID NO: 2321851 - protein, 26 aa, Cryptosporidium parvum
SIQVTPKWVYDVVLDFTIIKPTSKRN

SEQ ID NO: 2321852 - protein, 26 aa, Cryptosporidium parvum
SIRDLFSLPAKYLKYKCKFEEILSSG

SEQ ID NO: 2321853 - protein, 20 aa, Cryptosporidium parvum
SIRIVILGVLYRISNILNIL

SEQ ID NO: 2321854 - protein, 19 aa, Cryptosporidium parvum
SIRIYNSGLGWSLLKSLCF

SEQ ID NO: 2321855 - protein, 19 aa, Cryptosporidium parvum
SIRLPIPISSLKKNKRRNI

SEQ ID NO: 2321856 - protein, 25 aa, Cryptosporidium parvum
SIRRRIYGFLINNYLYKDSSFSAYS

SEQ ID NO: 2321857 - protein, 20 aa, Cryptosporidium parvum
SIRVKKLDSLILDAALKKLT

SEQ ID NO: 2321858 - protein, 19 aa, Cryptosporidium parvum
SIRYTLLKNISKYERFLLK

SEQ ID NO: 2321859 - protein, 23 aa, Cryptosporidium parvum
SISCIDTWQNPLWYDSYSNGFCK

SEQ ID NO: 2321860 - protein, 36 aa, Cryptosporidium parvum
SISDKPMKLLKGGSLLPYQIIGVEWMLSLYNNKLHG

SEQ ID NO: 2321861 - protein, 19 aa, Cryptosporidium parvum
SISDLALACPLHCPELSIS

SEQ ID NO: 2321862 - protein, 17 aa, Cryptosporidium parvum
SISGRRITHGFSARVYG

SEQ ID NO: 2321863 - protein, 22 aa, Cryptosporidium parvum
SISKRLISFTEHILRKSKLDRG

SEQ ID NO: 2321864 - protein, 28 aa, Cryptosporidium parvum
SISKSPLRLAVPGGIFDAGFRGELRIPF

SEQ ID NO: 2321865 - protein, 23 aa, Cryptosporidium parvum
SISLSNCDVPWPLTGGDQFLHFN

SEQ ID NO: 2321866 - protein, 24 aa, Cryptosporidium parvum
SISLVRDYVLITVRLLEVYAPYYM

SEQ ID NO: 2321867 - protein, 25 aa, Cryptosporidium parvum
SISSKSAISSLPKPKAKSAVKSAPA

SEQ ID NO: 2321868 - protein, 24 aa, Cryptosporidium parvum
SISSLKFHPTLPYLISSCCDTFDQ

SEQ ID NO: 2321869 - protein, 28 aa, Cryptosporidium parvum
SISTIGYWSIIDGFSSSLIKHAPIKENG

SEQ ID NO: 2321870 - protein, 19 aa, Cryptosporidium parvum
SISTNVPIFVLQKDDPNKK

SEQ ID NO: 2321871 - protein, 26 aa, Cryptosporidium parvum
SISVLRSIWTEMVLALKNVHDLRIVH

SEQ ID NO: 2321872 - protein, 32 aa, Cryptosporidium parvum; identical to SEQ ID NO: 2197091

SEQ ID NO: 2321873 - protein, 18 aa, Cryptosporidium parvum
SISVWEFVSRDIGWACIC

SEQ ID NO: 2321874 - protein, 19 aa, Cryptosporidium parvum
SITDIYHGLGIPISMVYSR

SEQ ID NO: 2321875 - protein, 18 aa, Cryptosporidium parvum
SITLELYSTPKYARYIRN

SEQ ID NO: 2321876 - protein, 20 aa, Cryptosporidium parvum
SITMKQILLGIQDLLDNPNI

SEQ ID NO: 2321877 - protein, 18 aa, Cryptosporidium parvum
SIVDLFCLLNCNKELFMR

SEQ ID NO: 2321878 - protein, 30 aa, Cryptosporidium parvum; identical to SEQ ID NO: 2197096

SEQ ID NO: 2321879 - protein, 21 aa, Cryptosporidium parvum
SIVISLLTFCYGYFPDQVILF

SEQ ID NO: 2321880 - protein, 24 aa, Cryptosporidium parvum
SIVPQQQFPYYHHLTESSNLNNQF

SEQ ID NO: 2321881 - protein, 20 aa, Cryptosporidium parvum
SIWFSFLEYLCKNRISIRAF

SEQ ID NO: 2321882 - protein, 21 aa, Cryptosporidium parvum
SIWQSILFKDSFGSKCLSFAS

SEQ ID NO: 2321883 - protein, 17 aa, Cryptosporidium parvum
SIWSYVFKLCGIVKFEM

SEQ ID NO: 2321884 - protein, 17 aa, Cryptosporidium parvum
SIYHFIPSERSFHQTKL

SEQ ID NO: 2321885 - protein, 32 aa, Cryptosporidium parvum; identical to SEQ ID NO: 2197104

SEQ ID NO: 2321886 - protein, 45 aa, Cryptosporidium parvum
SKANLINFICPFCRFFVIDPYNKIIKPLFFTTFYSYTAIHNIHPK

SEQ ID NO: 2321887 - protein, 21 aa, Cryptosporidium parvum
SKAVRKLFSPPGKYSSDDSNA

SEQ ID NO: 2321888 - protein, 28 aa, Cryptosporidium parvum
SKAYYRRGIAYFNLLKYSLARKDFMMVL

SEQ ID NO: 2321889 - protein, 20 aa, Cryptosporidium parvum
SKCEFVILNDKFEKENIEYD

SEQ ID NO: 2321890 - protein, 23 aa, Cryptosporidium parvum
SKCLDLLYQSKLIRYNIINEEVS

SEQ ID NO: 2321891 - protein, 34 aa, Cryptosporidium parvum; identical to SEQ ID NO: 2197108

SEQ ID NO: 2321892 - protein, 30 aa, Cryptosporidium parvum; identical to SEQ ID NO: 2197109

SEQ ID NO: 2321893 - protein, 37 aa, Cryptosporidium parvum; identical to SEQ ID NO: 2197110

SEQ ID NO: 2321894 - protein, 24 aa, Cryptosporidium parvum
SKDKKMICSMLYDIPNFVKQLSNH

SEQ ID NO: 2321895 - protein, 27 aa, Cryptosporidium parvum
SKDLQGIMTCFNLLKTYINNVHSHPYE

SEQ ID NO: 2321896 - protein, 23 aa, Cryptosporidium parvum
SKDNKIELYWKFNQDRLKDTLKK

SEQ ID NO: 2321897 - protein, 23 aa, Cryptosporidium parvum
SKDNSIHRLYSSANSRISSVSSS

SEQ ID NO: 2321898 - protein, 26 aa, Cryptosporidium parvum
SKDSLYTLVQYIPVATFAGLQTEKVQ

SEQ ID NO: 2321899 - protein, 28 aa, Cryptosporidium parvum
SKEDLVTRLFIFTADQKSKLSKISQNDQ

SEQ ID NO: 2321900 - protein, 25 aa, Cryptosporidium parvum
SKEELMRHFSIGETLLLKVVKLDET

SEQ ID NO: 2321901 - protein, 24 aa, Cryptosporidium parvum
SKEELTYHARQLLQQLRDSLGVKK

SEQ ID NO: 2321902 - protein, 25 aa, Cryptosporidium parvum
SKEFLRWALCVPGQKKNWLVGVRVN

SEQ ID NO: 2321903 - protein, 17 aa, Cryptosporidium parvum
SKEKLGAFLFPESVVFW

SEQ ID NO: 2321904 - protein, 17 aa, Cryptosporidium parvum
SKEMLDRGLLQSIFGSD

SEQ ID NO: 2321905 - protein, 31 aa, Cryptosporidium parvum
SKFIYDEEIDLFKKVYYLSDLQELGSIDIDE

SEQ ID NO: 2321906 - protein, 17 aa, Cryptosporidium parvum
SKGEWIVLPFDHITGVE

SEQ ID NO: 2321907 - protein, 22 aa, Cryptosporidium parvum
SKGFAFMDFFESGDALAAHMLN

SEQ ID NO: 2321908 - protein, 21 aa, Cryptosporidium parvum
SKGIIVYNWNKQYSILLESDI

SEQ ID NO: 2321909 - protein, 22 aa, Cryptosporidium parvum
SKGLILNRMQFPGSVGFICYSH

SEQ ID NO: 2321910 - protein, 17 aa, Cryptosporidium parvum
SKGLPIISPSTLRNILN

SEQ ID NO: 2321911 - protein, 22 aa, Cryptosporidium parvum
SKGQLFFVGKNLLKNLGTRAIS

SEQ ID NO: 2321912 - protein, 27 aa, Cryptosporidium parvum
SKGQSLDLLGILLKAGPITTITVKSTG

SEQ ID NO: 2321913 - protein, 28 aa, Cryptosporidium parvum
SKGTYVKFMPLSMDFLDISNPKAVLETT

SEQ ID NO: 2321914 - protein, 24 aa, Cryptosporidium parvum
SKGVLQRKIIVLSLIVAHNAIHRI

SEQ ID NO: 2321915 - protein, 24 aa, Cryptosporidium parvum
SKGVPLRLQFPLNDKYEHGNMQFY

SEQ ID NO: 2321916 - protein, 22 aa, Cryptosporidium parvum
SKHAKLYHEKYKDLFMQMNQSL

SEQ ID NO: 2321917 - protein, 20 aa, Cryptosporidium parvum
SKHPHYCGVNMVRGMSSPKR

SEQ ID NO: 2321918 - protein, 18 aa, Cryptosporidium parvum
SKIASILQSLRPNSGSVT

SEQ ID NO: 2321919 - protein, 17 aa, Cryptosporidium parvum
SKIEFYSNWKNIINHQD

SEQ ID NO: 2321920 - protein, 18 aa, Cryptosporidium parvum
SKIFKKYSLKLNDIKGII

SEQ ID NO: 2321921 - protein, 19 aa, Cryptosporidium parvum
SKIINHHQLNYFRVTNIYI

SEQ ID NO: 2321922 - protein, 24 aa, Cryptosporidium parvum
SKIPLKMIICGVSQRLKQGLYKTL

SEQ ID NO: 2321923 - protein, 21 aa, Cryptosporidium parvum
SKIPLSFDERTVFESKPVANS

SEQ ID NO: 2321924 - protein, 22 aa, Cryptosporidium parvum
SKKCRFMIHILAINYKGKHKEQ

SEQ ID NO: 2321925 - protein, 26 aa, Cryptosporidium parvum
SKKDEFIYTILFIDEIDLICGSRDSF

SEQ ID NO: 2321926 - protein, 25 aa, Cryptosporidium parvum
SKKDKIFYYSFYKVKNFKGNEKQKT

SEQ ID NO: 2321927 - protein, 26 aa, Cryptosporidium parvum
SKKGHLLVPTLLPLPTTDLLKLEYSE

SEQ ID NO: 2321928 - protein, 26 aa, Cryptosporidium parvum
SKKHPFRLIFTRYYDSHILDMYEFNV

SEQ ID NO: 2321929 - protein, 24 aa, Cryptosporidium parvum
SKKILFTNNILLMLLTVTSYMKNY

SEQ ID NO: 2321930 - protein, 31 aa, Cryptosporidium parvum
SKKNYKSFLLSYPKLFRIFGKDDNHSIQWIG

SEQ ID NO: 2321931 - protein, 24 aa, Cryptosporidium parvum
SKKQKMVKGFFLFGDGIVEYRSIE

SEQ ID NO: 2321932 - protein, 30 aa, Cryptosporidium parvum
SKKWKFGTYWNLIYRNILNRRISIRNEVVE

SEQ ID NO: 2321933 - protein, 26 aa, Cryptosporidium parvum
SKLDETKLLPLLYRRQLSQIIEENYK

SEQ ID NO: 2321934 - protein, 20 aa, Cryptosporidium parvum
SKLFLKGFDHLILVTAYETD

SEQ ID NO: 2321935 - protein, 30 aa, Cryptosporidium parvum
SKLKNFRFGFLNLNSLLWFEKQYQSKYIEN

SEQ ID NO: 2321936 - protein, 17 aa, Cryptosporidium parvum
SKLLLIPTKNFVNITAS

SEQ ID NO: 2321937 - protein, 19 aa, Cryptosporidium parvum
SKLLLNNPVSFFVCMEQTF

SEQ ID NO: 2321938 - protein, 22 aa, Cryptosporidium parvum
SKLPLPFPIPIQQQPQLQMVNQ

SEQ ID NO: 2321939 - protein, 23 aa, Cryptosporidium parvum
SKLPPHVFAIAKRAFDNIMSVSR

SEQ ID NO: 2321940 - protein, 26 aa, Cryptosporidium parvum
SKLTEYKYLHNFGIPISLISTFNKMI

SEQ ID NO: 2321941 - protein, 22 aa, Cryptosporidium parvum
SKMSIIICLLKNSKIAIYDIIN

SEQ ID NO: 2321942 - protein, 33 aa, Cryptosporidium parvum
SKNFVMARRVLGTSLPLITRRSLFKSGGDIFGR

SEQ ID NO: 2321943 - protein, 26 aa, Cryptosporidium parvum
SKNIELLYHKFGFKNFIIKDYSNSFL

SEQ ID NO: 2321944 - protein, 23 aa, Cryptosporidium parvum
SKNKFFQMIIQNLVSHLNFDDLD

SEQ ID NO: 2321945 - protein, 18 aa, Cryptosporidium parvum
SKNKWLPIQTIPFNFDSS

SEQ ID NO: 2321946 - protein, 23 aa, Cryptosporidium parvum
SKNKYINYRDSKITRILSDSLGG

SEQ ID NO: 2321947 - protein, 17 aa, Cryptosporidium parvum
SKNLIVNKLGVSRLDKL

SEQ ID NO: 2321948 - protein, 24 aa, Cryptosporidium parvum
SKNLLMKSPLVKNALRRLNKSDIL

SEQ ID NO: 2321949 - protein, 28 aa, Cryptosporidium parvum
SKPIEDYCMFPLGSVYRLSTTNTNGIPT

SEQ ID NO: 2321950 - protein, 25 aa, Cryptosporidium parvum
SKPKNIYLSSMRWNIVTNGNFLFYS

SEQ ID NO: 2321951 - protein, 29 aa, Cryptosporidium parvum
SKPNLSGKLYLLSRLLFHIRSNTKDRVVL

SEQ ID NO: 2321952 - protein, 19 aa, Cryptosporidium parvum
SKPPPYPQPPRYPQPSQPP

SEQ ID NO: 2321953 - protein, 25 aa, Cryptosporidium parvum
SKPQDARVPTLLKSTYISTSDSSSN

SEQ ID NO: 2321954 - protein, 20 aa, Cryptosporidium parvum
SKQESKLILSEFRDDSMSFK

SEQ ID NO: 2321955 - protein, 21 aa, Cryptosporidium parvum
SKQIFLLNLFILEESKYMRTL

SEQ ID NO: 2321956 - protein, 29 aa, Cryptosporidium parvum
SKQQEIIKRLLRLSSYPFSKLGLLESIPE

SEQ ID NO: 2321957 - protein, 18 aa, Cryptosporidium parvum
SKQRVQIWLYDHKNLVLE

SEQ ID NO: 2321958 - protein, 28 aa, Cryptosporidium parvum
SKQSKSIMWYILVPYEYGIPIITETQRQ

SEQ ID NO: 2321959 - protein, 33 aa, Cryptosporidium parvum; identical to SEQ ID NO: 2197167

SEQ ID NO: 2321960 - protein, 34 aa, Cryptosporidium parvum
SKRDLCENFLFNNKLIYGLFYTNSTKWLSLLKKG

SEQ ID NO: 2321961 - protein, 24 aa, Cryptosporidium parvum
SKREKRIFALEYLQNLGISNIPTS

SEQ ID NO: 2321962 - protein, 37 aa, Cryptosporidium parvum
SKRHEGRPFLFVINETKLSRPWVFCPNIKCIKRAKSS

SEQ ID NO: 2321963 - protein, 24 aa, Cryptosporidium parvum
SKRIIIYEDFVSKHYKKWIDQLKM

SEQ ID NO: 2321964 - protein, 27 aa, Cryptosporidium parvum
SKRKVHRSLWIPPKSYEHAYVNDLNGT

SEQ ID NO: 2321965 - protein, 25 aa, Cryptosporidium parvum
SKRTIMLRRKLFPKFQGIEGNEIEL

SEQ ID NO: 2321966 - protein, 21 aa, Cryptosporidium parvum
SKRVTLLPRDIRLARQLRGRY

SEQ ID NO: 2321967 - protein, 22 aa, Cryptosporidium parvum
SKSFVIFGLPCIGSDKYERFLK

SEQ ID NO: 2321968 - protein, 25 aa, Cryptosporidium parvum
SKSISRISVFPWSGKNCFYIYTDNS

SEQ ID NO: 2321969 - protein, 21 aa, Cryptosporidium parvum
SKSITFRQFICKMRKSFKQLI

SEQ ID NO: 2321970 - protein, 24 aa, Cryptosporidium parvum
SKSKIPIGALFYALKHHTGVKFFL

SEQ ID NO: 2321971 - protein, 27 aa, Cryptosporidium parvum
SKSKKRRIIMRLSKLKKGLRGEVEIGG

SEQ ID NO: 2321972 - protein, 27 aa, Cryptosporidium parvum
SKSNSFIKYFLSILLFEINQCEPQYNN

SEQ ID NO: 2321973 - protein, 30 aa, Cryptosporidium parvum
SKSRRNLATIFYLKKLKKLGLSMNYFIKSK

SEQ ID NO: 2321974 - protein, 40 aa, Cryptosporidium parvum
SKSSLFNQIDLNNISFLPKKEFFKPYYTTSTTTTTTTTTT

SEQ ID NO: 2321975 - protein, 34 aa, Cryptosporidium parvum
SKSSPPRVKPPLKPKPKFLAPPKNPPKVSHISPK

SEQ ID NO: 2321976 - protein, 18 aa, Cryptosporidium parvum
SKSYLPYCSIVRDILKVS

SEQ ID NO: 2321977 - protein, 32 aa, Cryptosporidium parvum; identical to SEQ ID NO: 2197179

SEQ ID NO: 2321978 - protein, 31 aa, Cryptosporidium parvum; identical to SEQ ID NO: 2197180

SEQ ID NO: 2321979 - protein, 18 aa, Cryptosporidium parvum
SKTPQNILIIKRPKSPNS

SEQ ID NO: 2321980 - protein, 27 aa, Cryptosporidium parvum
SKTRRELLSNWLFYCQCERCNNPTDLS

SEQ ID NO: 2321981 - protein, 24 aa, Cryptosporidium parvum
SKTSSLYWIIYYSCSISSKWQINE

SEQ ID NO: 2321982 - protein, 21 aa, Cryptosporidium parvum
SKTVWISNSLMYIILSKIEAN

SEQ ID NO: 2321983 - protein, 24 aa, Cryptosporidium parvum
SKVHHFIHSFPYLPTTNNEIWRTP

SEQ ID NO: 2321984 - protein, 30 aa, Cryptosporidium parvum
SKVHQKRHLIRSRFLSWRSKDYTEKEKESQ

SEQ ID NO: 2321985 - protein, 23 aa, Cryptosporidium parvum
SKVIRPEQWHPWKSFSRLMDEAI

SEQ ID NO: 2321986 - protein, 24 aa, Cryptosporidium parvum
SKVKSIVLFLRANLGINVAKNFKE

SEQ ID NO: 2321987 - protein, 18 aa, Cryptosporidium parvum
SKVLLPDLPVPLSYNKSS

SEQ ID NO: 2321988 - protein, 20 aa, Cryptosporidium parvum
SKVNISLIDLLRIMLKFRRH

SEQ ID NO: 2321989 - protein, 34 aa, Cryptosporidium parvum
SKVNKHFPLERFIRLIVFCMEWGMRYLMCPGKVE

SEQ ID NO: 2321990 - protein, 17 aa, Cryptosporidium parvum
SKVTLLSGYLRSHKLSY

SEQ ID NO: 2321991 - protein, 28 aa, Cryptosporidium parvum
SKVYHGLIKYCFRFGILTLYNSLENKGE

SEQ ID NO: 2321992 - protein, 25 aa, Cryptosporidium parvum
SKWNWYYRMEQLYYDWQAINFPTFP

SEQ ID NO: 2321993 - protein, 19 aa, Cryptosporidium parvum
SKYFDIVENILICKRCLKN

SEQ ID NO: 2321994 - protein, 27 aa, Cryptosporidium parvum
SKYIKGEKYWAFVQLKSSDKDSAIVNV

SEQ ID NO: 2321995 - protein, 25 aa, Cryptosporidium parvum
SKYKDSICWATIKAVKEVYEPQVEY

SEQ ID NO: 2321996 - protein, 18 aa, Cryptosporidium parvum
SKYKFLNNVLIKYSDRLS

SEQ ID NO: 2321997 - protein, 22 aa, Cryptosporidium parvum
SKYKKFLAIKDPSKQIYGPKML

SEQ ID NO: 2321998 - protein, 33 aa, Cryptosporidium parvum
SKYSHIHVFLIKNLLIQLFKVGPRALPFDPLNL

SEQ ID NO: 2321999 - protein, 24 aa, Cryptosporidium parvum
SKYSIALEMIAGGRLYNLVVENHE

SEQ ID NO: 2322000 - protein, 25 aa, Cryptosporidium parvum
SLAALNHLAPFIKTLQPISEFGGIS

SEQ ID NO: 2322001 - protein, 22 aa, Cryptosporidium parvum
SLAKLERCLAKYGDVSCSNHEY

SEQ ID NO: 2322002 - protein, 23 aa, Cryptosporidium parvum
SLAVFAPEILQKVGLTFPTQQAI

SEQ ID NO: 2322003 - protein, 18 aa, Cryptosporidium parvum
SLCLNNCGFYGNPTTNNL

SEQ ID NO: 2322004 - protein, 33 aa, Cryptosporidium parvum
SLCNFLGIEMIRPLLFHSALRHLGYKSSHFHRD

SEQ ID NO: 2322005 - protein, 31 aa, Cryptosporidium parvum
SLDDSCLFSIRQFLHLVPRLFDGKSYDEIDN

SEQ ID NO: 2322006 - protein, 18 aa, Cryptosporidium parvum
SLDHHWNSGVLISSGVGG

SEQ ID NO: 2322007 - protein, 25 aa, Cryptosporidium parvum
SLDHMKWMRGIWNLISFKIFGNSSS

SEQ ID NO: 2322008 - protein, 17 aa, Cryptosporidium parvum
SLDPYLGYLGPAISLSY

SEQ ID NO: 2322009 - protein, 23 aa, Cryptosporidium parvum
SLDRTVKIWGLQPNICSLVNNTV

SEQ ID NO: 2322010 - protein, 26 aa, Cryptosporidium parvum
SLDVDLLLYFMKQLSYKRSDIKLVIM

SEQ ID NO: 2322011 - protein, 27 aa, Cryptosporidium parvum
SLEDKIPFPFIQFKDILSKYPTLQNIF

SEQ ID NO: 2322012 - protein, 22 aa, Cryptosporidium parvum
SLEEIVLNGVLYMQEYFKRIDN

SEQ ID NO: 2322013 - protein, 21 aa, Cryptosporidium parvum
SLEFSALIKEATHRTLPAEVK

SEQ ID NO: 2322014 - protein, 22 aa, Cryptosporidium parvum
SLEPFFMWQISILGNCHTPTLS

SEQ ID NO: 2322015 - protein, 24 aa, Cryptosporidium parvum
SLESLIRELELRSQILSIQGPALL

SEQ ID NO: 2322016 - protein, 31 aa, Cryptosporidium parvum; identical to SEQ ID NO: 2197210

SEQ ID NO: 2322017 - protein, 27 aa, Cryptosporidium parvum
SLEYMRFSTLFLKKLIIGPIQVKCNDS

SEQ ID NO: 2322018 - protein, 21 aa, Cryptosporidium parvum
SLFFVLTSYYDVSPTYIIELL

SEQ ID NO: 2322019 - protein, 19 aa, Cryptosporidium parvum
SLFLDLFQVILAMESLLMS

SEQ ID NO: 2322020 - protein, 25 aa, Cryptosporidium parvum
SLFSFDYFFYDTKSQKILFFACTTK

SEQ ID NO: 2322021 - protein, 26 aa, Cryptosporidium parvum
SLFSGTQNGIFFIKKNNGGNGVNSHH

SEQ ID NO: 2322022 - protein, 20 aa, Cryptosporidium parvum
SLFSLICLKLDGLIIDSQNI

SEQ ID NO: 2322023 - protein, 35 aa, Cryptosporidium parvum
SLFSNKYMGNIFSSFSPFIKGINKFTLRPKEKSPE

SEQ ID NO: 2322024 - protein, 27 aa, Cryptosporidium parvum
SLFYYNDQLIWFQKNKLFSLSLVDYQQ

SEQ ID NO: 2322025 - protein, 34 aa, Cryptosporidium parvum
SLGACSERQLIPKKVWLIVRDLPSKSYALQQNDM

SEQ ID NO: 2322026 - protein, 24 aa, Cryptosporidium parvum
SLGDNLFFHSYRNPGLKVDVVEDI

SEQ ID NO: 2322027 - protein, 19 aa, Cryptosporidium parvum
SLGIQMDLNFESKLDKSIQ

SEQ ID NO: 2322028 - protein, 18 aa, Cryptosporidium parvum
SLGKRILLSNGRLLSHLP

SEQ ID NO: 2322029 - protein, 33 aa, Cryptosporidium parvum; identical to SEQ ID NO: 2197221

SEQ ID NO: 2322030 - protein, 25 aa, Cryptosporidium parvum
SLGVQAIRFIPKTGHLLLSAGLDSQ

SEQ ID NO: 2322031 - protein, 25 aa, Cryptosporidium parvum
SLGYQKKRLIPIDQDELFVNVNASK

SEQ ID NO: 2322032 - protein, 25 aa, Cryptosporidium parvum
SLHKKQVSLLSRAFKLLKNGGKLVY

SEQ ID NO: 2322033 - protein, 23 aa, Cryptosporidium parvum
SLHQLEVFGFIDLALQDPSLQSD

SEQ ID NO: 2322034 - protein, 17 aa, Cryptosporidium parvum
SLICERLILKREKDLKA

SEQ ID NO: 2322035 - protein, 21 aa, Cryptosporidium parvum
SLIEFVRYILSSRSSSFPKLS

SEQ ID NO: 2322036 - protein, 31 aa, Cryptosporidium parvum
SLIGIFDDFSIKLICNFGYRPNCITWNEVNK

SEQ ID NO: 2322037 - protein, 20 aa, Cryptosporidium parvum
SLIGSLSWTVPTDKDDIILK

SEQ ID NO: 2322038 - protein, 20 aa, Cryptosporidium parvum
SLIHILWNEIGPEKTGLFLT

SEQ ID NO: 2322039 - protein, 23 aa, Cryptosporidium parvum
SLIKAKNFSLLILKTIALDQDHA

SEQ ID NO: 2322040 - protein, 28 aa, Cryptosporidium parvum
SLIKRICTRLRIKNLPNPSIEESLNHLC

SEQ ID NO: 2322041 - protein, 32 aa, Cryptosporidium parvum; identical to SEQ ID NO: 2197231

SEQ ID NO: 2322042 - protein, 17 aa, Cryptosporidium parvum
SLILLLAGSLRNRVTSI

SEQ ID NO: 2322043 - protein, 17 aa, Cryptosporidium parvum
SLILLSIGLLEEAMIFQ

SEQ ID NO: 2322044 - protein, 36 aa, Cryptosporidium parvum
SLINDLSPHKIWLYLDHWLFWLSLTNENNNSSNQKF

SEQ ID NO: 2322045 - protein, 18 aa, Cryptosporidium parvum
SLINWKFSDGCIVSITDF

SEQ ID NO: 2322046 - protein, 25 aa, Cryptosporidium parvum
SLISIIPCFILWAKLETYIIFNEFD

SEQ ID NO: 2322047 - protein, 18 aa, Cryptosporidium parvum
SLIVLINRLGVFKEKSKF

SEQ ID NO: 2322048 - protein, 27 aa, Cryptosporidium parvum
SLKAIKRLLPTVGKYIIKLTRLQRMGT

SEQ ID NO: 2322049 - protein, 30 aa, Cryptosporidium parvum
SLKDLTESLYPLIKFQALYAGRNLHQLPPG

SEQ ID NO: 2322050 - protein, 23 aa, Cryptosporidium parvum
SLKNKLVIVFVIGSITFPEIRCV

SEQ ID NO: 2322051 - protein, 18 aa, Cryptosporidium parvum
SLKNMNLINLKKLSSGIE

SEQ ID NO: 2322052 - protein, 18 aa, Cryptosporidium parvum
SLKPQLSIFGRPSPVDEE

SEQ ID NO: 2322053 - protein, 25 aa, Cryptosporidium parvum
SLKQDVWFEPKFVWEVKGADLSLSP

SEQ ID NO: 2322054 - protein, 24 aa, Cryptosporidium parvum
SLKQTVFLNMSPFSAYILAPSNLV

SEQ ID NO: 2322055 - protein, 22 aa, Cryptosporidium parvum
SLKSGATLLFRDYGRYDMAQLR

SEQ ID NO: 2322056 - protein, 25 aa, Cryptosporidium parvum
SLKTGYLYVYRFSNGMPIICKDTEY

SEQ ID NO: 2322057 - protein, 23 aa, Cryptosporidium parvum
SLLAFEICQSIIPRLAYEIAEEI

SEQ ID NO: 2322058 - protein, 24 aa, Cryptosporidium parvum
SLLARFRDFQRQSKLKKLALTCVA

SEQ ID NO: 2322059 - protein, 18 aa, Cryptosporidium parvum
SLLAYLREYRDIKGLHLV

SEQ ID NO: 2322060 - protein, 20 aa, Cryptosporidium parvum
SLLGSYYRLKSYKKLTSNKK

SEQ ID NO: 2322061 - protein, 18 aa, Cryptosporidium parvum
SLLLQRLLADEPRVCTNI

SEQ ID NO: 2322062 - protein, 20 aa, Cryptosporidium parvum
SLLLRRPPGRESYPGDIFYI

SEQ ID NO: 2322063 - protein, 24 aa, Cryptosporidium parvum
SLLMLLSHQTPAIRRKAYLALICA

SEQ ID NO: 2322064 - protein, 24 aa, Cryptosporidium parvum
SLLNIAPSFWRFCYNACNSLFTKL

SEQ ID NO: 2322065 - protein, 25 aa, Cryptosporidium parvum
SLLNSQLTFLKLLIKGEAPLVLVEK

SEQ ID NO: 2322066 - protein, 17 aa, Cryptosporidium parvum
SLLPINGVPIINYIIEM

SEQ ID NO: 2322067 - protein, 28 aa, Cryptosporidium parvum
SLLPTIQTSFYIITWSPGNSVLKIRMRQ

SEQ ID NO: 2322068 - protein, 20 aa, Cryptosporidium parvum
SLLSASLRKRGKVNNMVSGL

SEQ ID NO: 2322069 - protein, 31 aa, Cryptosporidium parvum
SLLYENIMTHILEWPSLSVQWMCESSISDVE

SEQ ID NO: 2322070 - protein, 19 aa, Cryptosporidium parvum
SLMELYNFLFDYSSMMYCD

SEQ ID NO: 2322071 - protein, 23 aa, Cryptosporidium parvum
SLMNNTNLHYPSISSSVMGGSVH

SEQ ID NO: 2322072 - protein, 26 aa, Cryptosporidium parvum
SLNESFLPFDFILLREYFSEEEFSVS

SEQ ID NO: 2322073 - protein, 27 aa, Cryptosporidium parvum
SLNFCAKYSYYILLKQSIVNQYIVQES

SEQ ID NO: 2322074 - protein, 31 aa, Cryptosporidium parvum; identical to SEQ ID NO: 2197262

SEQ ID NO: 2322075 - protein, 18 aa, Cryptosporidium parvum
SLNLDDLYLFITASKSKK

SEQ ID NO: 2322076 - protein, 21 aa, Cryptosporidium parvum
SLNNRFPGGFLLISQFKDIQQ

SEQ ID NO: 2322077 - protein, 26 aa, Cryptosporidium parvum
SLNPLEQRALLLKWITEILKTSEASS

SEQ ID NO: 2322078 - protein, 17 aa, Cryptosporidium parvum
SLNSGKLFTFDTKILFN

SEQ ID NO: 2322079 - protein, 21 aa, Cryptosporidium parvum
SLPEDLLFYVLSMLVTPVVYE

SEQ ID NO: 2322080 - protein, 30 aa, Cryptosporidium parvum
SLPESDIIKLCTMYPYLNPRYFLNKNAKKG

SEQ ID NO: 2322081 - protein, 18 aa, Cryptosporidium parvum
SLPHFLKYDYGPESRGFV

SEQ ID NO: 2322082 - protein, 17 aa, Cryptosporidium parvum
SLPIKMCTLSNKLVEML

SEQ ID NO: 2322083 - protein, 20 aa, Cryptosporidium parvum
SLPLPTFPNKGVSKIWLPTE

SEQ ID NO: 2322084 - protein, 31 aa, Cryptosporidium parvum; identical to SEQ ID NO: 2197275

SEQ ID NO: 2322085 - protein, 20 aa, Cryptosporidium parvum
SLPTPPKDYNLRKTGIDLNK

SEQ ID NO: 2322086 - protein, 37 aa, Cryptosporidium parvum
SLQLKDIQDFFKNNKIEDVKIKLPMRNGNNEGVAIVE

SEQ ID NO: 2322087 - protein, 19 aa, Cryptosporidium parvum
SLQLSDYFRLLIDRSIEIR

SEQ ID NO: 2322088 - protein, 17 aa, Cryptosporidium parvum
SLQYKSVGKWFSHTSLA

SEQ ID NO: 2322089 - protein, 23 aa, Cryptosporidium parvum
SLREKNIWLNSDKMKYLSNIREL

SEQ ID NO: 2322090 - protein, 24 aa, Cryptosporidium parvum
SLRHHVIHILLQAQELNIPTIFAL

SEQ ID NO: 2322091 - protein, 24 aa, Cryptosporidium parvum
SLRKYRPDFLVPQPSRIPIESVYN

SEQ ID NO: 2322092 - protein, 20 aa, Cryptosporidium parvum
SLRPFPDNLDWCDSTFSFVV

SEQ ID NO: 2322093 - protein, 27 aa, Cryptosporidium parvum
SLRQDFGFKHILWLYSGRRGVHCWVCD

SEQ ID NO: 2322094 - protein, 24 aa, Cryptosporidium parvum
SLRYDLTVPLARYIATSGLDHLKR

SEQ ID NO: 2322095 - protein, 18 aa, Cryptosporidium parvum
SLRYILSIQENVTYMGDV

SEQ ID NO: 2322096 - protein, 18 aa, Cryptosporidium parvum
SLSDLCVPPTLLYKENSL

SEQ ID NO: 2322097 - protein, 36 aa, Cryptosporidium parvum
SLSGILIQMQGLEIKLVTVIDICAFSIVFHSDIDEE

SEQ ID NO: 2322098 - protein, 17 aa, Cryptosporidium parvum
SLSIYLSHLAIHEPAMM

SEQ ID NO: 2322099 - protein, 18 aa, Cryptosporidium parvum
SLSKISISDLLMLKEKKC

SEQ ID NO: 2322100 - protein, 26 aa, Cryptosporidium parvum
SLSKSLKTGLIRFPVEIIKDEFESLI

SEQ ID NO: 2322101 - protein, 23 aa, Cryptosporidium parvum
SLSNPMVYPNTYSSNILSSHNKV

SEQ ID NO: 2322102 - protein, 18 aa, Cryptosporidium parvum
SLSRNRFAFYKGELPILI

SEQ ID NO: 2322103 - protein, 38 aa, Cryptosporidium parvum
SLTRDLIVSVGIFKLLFHLQVLPLTRELTNLAGFLWSK

SEQ ID NO: 2322104 - protein, 19 aa, Cryptosporidium parvum
SLTTSLIPYNRLFDSTNED

SEQ ID NO: 2322105 - protein, 25 aa, Cryptosporidium parvum
SLVKKNLIRPFKAPLVKVNMDICKS

SEQ ID NO: 2322106 - protein, 18 aa, Cryptosporidium parvum
SLVPVKFHYKPRLNPNRR

SEQ ID NO: 2322107 - protein, 20 aa, Cryptosporidium parvum
SLVVPLFKKSGDVKSYGSEL

SEQ ID NO: 2322108 - protein, 20 aa, Cryptosporidium parvum
SLVYIIYRDAPNISNIIKIM

SEQ ID NO: 2322109 - protein, 25 aa, Cryptosporidium parvum
SLYDFFQRAHLFDYSWKHLAEEQRR

SEQ ID NO: 2322110 - protein, 19 aa, Cryptosporidium parvum
SLYELIMRQLMDDGLIEVA

SEQ ID NO: 2322111 - protein, 17 aa, Cryptosporidium parvum
SLYHFVRIFPELNELGK

SEQ ID NO: 2322112 - protein, 29 aa, Cryptosporidium parvum
SLYNNYRHSIFGNFRWNNKRRRLGSYIAS

SEQ ID NO: 2322113 - protein, 27 aa, Cryptosporidium parvum
SLYSDDHWWYIFKKKFNMSTKGGISEE

SEQ ID NO: 2322114 - protein, 36 aa, Cryptosporidium parvum; identical to SEQ ID NO: 2197305

SEQ ID NO: 2322115 - protein, 27 aa, Cryptosporidium parvum
SMAVLETGLFKAPIYHHPRRQRNLQVG

SEQ ID NO: 2322116 - protein, 21 aa, Cryptosporidium parvum
SMCIIELFKELESKIFIIMAD

SEQ ID NO: 2322117 - protein, 19 aa, Cryptosporidium parvum
SMCLLIKYNCETLVDLELE

SEQ ID NO: 2322118 - protein, 22 aa, Cryptosporidium parvum
SMCMQLYRQALNFALHGLKYEP

SEQ ID NO: 2322119 - protein, 37 aa, Cryptosporidium parvum
SMDQLRQRLLQCGFDDVAIIPLPRWDRVALVRHFDTS

SEQ ID NO: 2322120 - protein, 24 aa, Cryptosporidium parvum
SMDSLPEVIISNKLQKLILSTDDQ

SEQ ID NO: 2322121 - protein, 21 aa, Cryptosporidium parvum
SMEIKGIPYQSALEKFWLVDS

SEQ ID NO: 2322122 - protein, 21 aa, Cryptosporidium parvum
SMESAYLLYLKTRTPSSKESL

SEQ ID NO: 2322123 - protein, 29 aa, Cryptosporidium parvum
SMESNLRLWMGAYYLPRNDKRARGGEDGW

SEQ ID NO: 2322124 - protein, 19 aa, Cryptosporidium parvum
SMFAQEGILALRRVKRRNM

SEQ ID NO: 2322125 - protein, 20 aa, Cryptosporidium parvum
SMFKDNINLIYLSTNFRSTK

SEQ ID NO: 2322126 - protein, 18 aa, Cryptosporidium parvum
SMHNQYYIPSNNSEVYNH

SEQ ID NO: 2322127 - protein, 25 aa, Cryptosporidium parvum
SMIKSIFELIFIKIQSQILSCIDTL

SEQ ID NO: 2322128 - protein, 17 aa, Cryptosporidium parvum
SMIPKRLQYFMATGNVK

SEQ ID NO: 2322129 - protein, 23 aa, Cryptosporidium parvum
SMKEMEIMKDRLGLWKESLQGLN

SEQ ID NO: 2322130 - protein, 21 aa, Cryptosporidium parvum
SMKFPIYPQRNCFKKPFVQSK

SEQ ID NO: 2322131 - protein, 21 aa, Cryptosporidium parvum
SMLKRSCSTPLLYSMNNAYPN

SEQ ID NO: 2322132 - protein, 28 aa, Cryptosporidium parvum
SMLWNKYLNQLGLLLYKNSLFYLENQSN

SEQ ID NO: 2322133 - protein, 25 aa, Cryptosporidium parvum
SMNKLLLVSMWKESRRFMFKKLEDE

SEQ ID NO: 2322134 - protein, 26 aa, Cryptosporidium parvum
SMNNLSNYFISEGVLDVLSQWLSPFK

SEQ ID NO: 2322135 - protein, 29 aa, Cryptosporidium parvum
SMPKLSFLKLPIFSLNKIYNLRLFSQINS

SEQ ID NO: 2322136 - protein, 33 aa, Cryptosporidium parvum
SMRFKKSYPILASLITNIDWWRIVLDEAQMTEG

SEQ ID NO: 2322137 - protein, 26 aa, Cryptosporidium parvum
SMRGRRRYRRTLLRNYEQPLGQNSHG

SEQ ID NO: 2322138 - protein, 23 aa, Cryptosporidium parvum
SMRRIIHSSYLKSPLILGVEPKN

SEQ ID NO: 2322139 - protein, 19 aa, Cryptosporidium parvum
SMRSIIFANYLPKDTSRLT

SEQ ID NO: 2322140 - protein, 36 aa, Cryptosporidium parvum; identical to SEQ ID NO: 2197327

SEQ ID NO: 2322141 - protein, 22 aa, Cryptosporidium parvum
SMSRRFEWLLDKNFTNKIDLEA

SEQ ID NO: 2322142 - protein, 18 aa, Cryptosporidium parvum
SMYPSKIHTLVRKGNFVT

SEQ ID NO: 2322143 - protein, 22 aa, Cryptosporidium parvum
SNAFAMVGGIDFHEFNNNLNGN

SEQ ID NO: 2322144 - protein, 25 aa, Cryptosporidium parvum
SNAHPIILRRFMLEGTSIIPVNVET

SEQ ID NO: 2322145 - protein, 27 aa, Cryptosporidium parvum
SNAINDIFFLKMLSLSLIFELSSVFGN

SEQ ID NO: 2322146 - protein, 24 aa, Cryptosporidium parvum
SNATLNLLLHLLKVSIADLNNLKS

SEQ ID NO: 2322147 - protein, 30 aa, Cryptosporidium parvum
SNCIKQFRLVFGPLFLPRQFIKYPTESEIT

SEQ ID NO: 2322148 - protein, 26 aa, Cryptosporidium parvum
SNDFINLLVPFYLPSFVNLEIMFRII

SEQ ID NO: 2322149 - protein, 47 aa, Cryptosporidium parvum
SNDLNPYLQQTLNKLPVALNPNLPYLQHSMIAFANRIPYQTTPEVQT

SEQ ID NO: 2322150 - protein, 25 aa, Cryptosporidium parvum
SNDLTFGFWLTYVLPASSSRNENSN

SEQ ID NO: 2322151 - protein, 19 aa, Cryptosporidium parvum
SNDNFFILLSSQAIEEEYK

SEQ ID NO: 2322152 - protein, 25 aa, Cryptosporidium parvum
SNDRNPLCTLTMKSIDLNPPCLSED

SEQ ID NO: 2322153 - protein, 30 aa, Cryptosporidium parvum; identical to SEQ ID NO: 2197341

SEQ ID NO: 2322154 - protein, 20 aa, Cryptosporidium parvum
SNEALIDRLIENTTLYPCFD

SEQ ID NO: 2322155 - protein, 18 aa, Cryptosporidium parvum
SNEDFPEYYHDLFPQFND

SEQ ID NO: 2322156 - protein, 21 aa, Cryptosporidium parvum
SNEEWLLYELITRHFLSSCSE

SEQ ID NO: 2322157 - protein, 20 aa, Cryptosporidium parvum
SNEHPYINPFIPIRSQETEN

SEQ ID NO: 2322158 - protein, 25 aa, Cryptosporidium parvum
SNEQFVCIRFCRRIHELYSNELSKP

SEQ ID NO: 2322159 - protein, 33 aa, Cryptosporidium parvum
SNERNNLWDLFSSNFLLFKFYPSGNEIEEELKS

SEQ ID NO: 2322160 - protein, 28 aa, Cryptosporidium parvum
SNESGLPVSFLLLALRCLIQTHLDSISL

SEQ ID NO: 2322161 - protein, 24 aa, Cryptosporidium parvum
SNEVEQAFIPCIPPVRYEYSEIKE

SEQ ID NO: 2322162 - protein, 27 aa, Cryptosporidium parvum
SNFDWRSSYLPHIYSATLGLKNGFIDP

SEQ ID NO: 2322163 - protein, 20 aa, Cryptosporidium parvum
SNFEIIYQLFLDSASNKNYS

SEQ ID NO: 2322164 - protein, 32 aa, Cryptosporidium parvum; identical to SEQ ID NO: 2197347

SEQ ID NO: 2322165 - protein, 32 aa, Cryptosporidium parvum
SNFGFDLVFPRGLNSSLILRYMHFYSAQIIGI

SEQ ID NO: 2322166 - protein, 17 aa, Cryptosporidium parvum
SNFIALLEKYDINNEKE

SEQ ID NO: 2322167 - protein, 20 aa, Cryptosporidium parvum
SNFIKSMPKYLIIHMQRFYL

SEQ ID NO: 2322168 - protein, 24 aa, Cryptosporidium parvum
SNFINTYLIIFQVLLHLCNSEITP

SEQ ID NO: 2322169 - protein, 18 aa, Cryptosporidium parvum
SNFPKFQFSFSKGDNFNS

SEQ ID NO: 2322170 - protein, 20 aa, Cryptosporidium parvum
SNFRIYCYTASPLQAKILRH

SEQ ID NO: 2322171 - protein, 32 aa, Cryptosporidium parvum; identical to SEQ ID NO: 2197350

SEQ ID NO: 2322172 - protein, 17 aa, Cryptosporidium parvum
SNGLERAIIHRNMMRMK

SEQ ID NO: 2322173 - protein, 29 aa, Cryptosporidium parvum
SNGLKLYRRTCPIGVILVIFEARPEVAIQ

SEQ ID NO: 2322174 - protein, 20 aa, Cryptosporidium parvum
SNGLLSLLLQRLLADEPRVC

SEQ ID NO: 2322175 - protein, 23 aa, Cryptosporidium parvum
SNGNIPHLLFYGPSGGGKKVRIS

SEQ ID NO: 2322176 - protein, 30 aa, Cryptosporidium parvum
SNGPKGCAFVRFSNIYEAQNAILCIHGKTV

SEQ ID NO: 2322177 - protein, 19 aa, Cryptosporidium parvum
SNGRRNFKGSPGKISRSRG

SEQ ID NO: 2322178 - protein, 25 aa, Cryptosporidium parvum
SNGSNKYPYFYSKRKKVFKDNSEII

SEQ ID NO: 2322179 - protein, 25 aa, Cryptosporidium parvum
SNGSSFIPLLSRSSLVDFYVLNVER

SEQ ID NO: 2322180 - protein, 31 aa, Cryptosporidium parvum; identical to SEQ ID NO: 2197356

SEQ ID NO: 2322181 - protein, 25 aa, Cryptosporidium parvum
SNHCPKLVPIACNNLFRATSFLEVK

SEQ ID NO: 2322182 - protein, 24 aa, Cryptosporidium parvum
SNHFDFLGFDFNINTVAFLQFTSG

SEQ ID NO: 2322183 - protein, 22 aa, Cryptosporidium parvum
SNHLTLFDILLDNDEYKIRYEN

SEQ ID NO: 2322184 - protein, 27 aa, Cryptosporidium parvum
SNHVKNHIWIFIKCLIVNPSFDSQTKE

SEQ ID NO: 2322185 - protein, 19 aa, Cryptosporidium parvum
SNIFLCHELKYPYKIKRSI

SEQ ID NO: 2322186 - protein, 21 aa, Cryptosporidium parvum
SNIFWGLWGICKSDIRSNNSS

SEQ ID NO: 2322187 - protein, 20 aa, Cryptosporidium parvum
SNIIFAVNKLDLCNWDEQVY

SEQ ID NO: 2322188 - protein, 37 aa, Cryptosporidium parvum; identical to SEQ ID NO: 2197364

SEQ ID NO: 2322189 - protein, 20 aa, Cryptosporidium parvum
SNILGWRIEIIYVEGGLTAY

SEQ ID NO: 2322190 - protein, 27 aa, Cryptosporidium parvum
SNINAPLPSPLYIVTQPPVIQGNVMNH

SEQ ID NO: 2322191 - protein, 19 aa, Cryptosporidium parvum
SNINIRFYILTENEEWIKK

SEQ ID NO: 2322192 - protein, 21 aa, Cryptosporidium parvum
SNIPSIISKLEGLQIEFDSLN

SEQ ID NO: 2322193 - protein, 24 aa, Cryptosporidium parvum
SNIRSFFNILINKVFLTDLSNIKN

SEQ ID NO: 2322194 - protein, 24 aa, Cryptosporidium parvum
SNISGCLFCQRLQHCCICDFSRRT

SEQ ID NO: 2322195 - protein, 25 aa, Cryptosporidium parvum
SNISKAFGIPPRFSESLIMNTNEGK

SEQ ID NO: 2322196 - protein, 26 aa, Cryptosporidium parvum
SNITLYIEYLYYIRGDVRKLPIYQKN

SEQ ID NO: 2322197 - protein, 24 aa, Cryptosporidium parvum
SNIYKAELGLNLHQLYNGRIPAAP

SEQ ID NO: 2322198 - protein, 21 aa, Cryptosporidium parvum
SNKDLLVCKKLPNITQFQSKY

SEQ ID NO: 2322199 - protein, 30 aa, Cryptosporidium parvum
SNKDQFNDPYFGRAFIFFYNVESAIKAKLD

SEQ ID NO: 2322200 - protein, 26 aa, Cryptosporidium parvum
SNKFNTLIASFWLFEGFLSLKNGGNL

SEQ ID NO: 2322201 - protein, 22 aa, Cryptosporidium parvum
SNKLKSLEEILIRNGEKSISEI

SEQ ID NO: 2322202 - protein, 22 aa, Cryptosporidium parvum
SNKLLSITFLNENTIIAGSSDG

SEQ ID NO: 2322203 - protein, 17 aa, Cryptosporidium parvum
SNKLREYMIRAIYIEML

SEQ ID NO: 2322204 - protein, 19 aa, Cryptosporidium parvum
SNKLRFPSIYTELISSKVE

SEQ ID NO: 2322205 - protein, 18 aa, Cryptosporidium parvum
SNKLSKLEYSECLVIILG

SEQ ID NO: 2322206 - protein, 17 aa, Cryptosporidium parvum
SNKVFEFQIISSIIYEW

SEQ ID NO: 2322207 - protein, 33 aa, Cryptosporidium parvum
SNLCKMVEFSLLWMALVITKFPNFIKASLGDDI

SEQ ID NO: 2322208 - protein, 30 aa, Cryptosporidium parvum; identical to SEQ ID NO: 2197380

SEQ ID NO: 2322209 - protein, 28 aa, Cryptosporidium parvum
SNLDQLIKYPLLDSFNPKPGFFQKLIHS

SEQ ID NO: 2322210 - protein, 26 aa, Cryptosporidium parvum
SNLGLLNFLPLFFTNFESLKKGILEG

SEQ ID NO: 2322211 - protein, 22 aa, Cryptosporidium parvum
SNLKIYIHHLLKNQMEIVSLNN

SEQ ID NO: 2322212 - protein, 21 aa, Cryptosporidium parvum
SNLLRVLPTRYARFNSTLSFK

SEQ ID NO: 2322213 - protein, 22 aa, Cryptosporidium parvum
SNLMDAISNILGWRIEIIYVEG

SEQ ID NO: 2322214 - protein, 17 aa, Cryptosporidium parvum
SNLQYYLFEGRATNVVI

SEQ ID NO: 2322215 - protein, 26 aa, Cryptosporidium parvum
SNLRLPPKVPGISSNNAFKFNISQPA

SEQ ID NO: 2322216 - protein, 29 aa, Cryptosporidium parvum
SNLSLTPYVLGLRVFKLINSNKKQVSNFQ

SEQ ID NO: 2322217 - protein, 20 aa, Cryptosporidium parvum
SNLTLFPLNSQIHSEMAVPF

SEQ ID NO: 2322218 - protein, 19 aa, Cryptosporidium parvum
SNMNNVVICLLIVNNLLPC

SEQ ID NO: 2322219 - protein, 23 aa, Cryptosporidium parvum
SNMNSILNIRIIPPKNLQTEKST

SEQ ID NO: 2322220 - protein, 27 aa, Cryptosporidium parvum
SNMSRYRQRWLEVQYMLILYEECLNWS

SEQ ID NO: 2322221 - protein, 23 aa, Cryptosporidium parvum
SNMWVPYISYSKCFYNFSRVSKL

SEQ ID NO: 2322222 - protein, 33 aa, Cryptosporidium parvum; identical to SEQ ID NO: 2197391

SEQ ID NO: 2322223 - protein, 24 aa, Cryptosporidium parvum
SNNDPLFVDLLNKLLCIDPDERLS

SEQ ID NO: 2322224 - protein, 23 aa, Cryptosporidium parvum
SNNDYEFVSTSSKLKFLALPTGV

SEQ ID NO: 2322225 - protein, 19 aa, Cryptosporidium parvum
SNNFLNPLLMTKCLNVNPP

SEQ ID NO: 2322226 - protein, 31 aa, Cryptosporidium parvum; identical to SEQ ID NO: 2197395

SEQ ID NO: 2322227 - protein, 26 aa, Cryptosporidium parvum
SNNKKYYEYYIAGKKVEDFITSKISD

SEQ ID NO: 2322228 - protein, 24 aa, Cryptosporidium parvum
SNNNKLSMFKKSGNNYPFILGDEQ

SEQ ID NO: 2322229 - protein, 27 aa, Cryptosporidium parvum
SNNPNPPLSSLQKFFALLISSRPIANN

SEQ ID NO: 2322230 - protein, 25 aa, Cryptosporidium parvum
SNNPTSFDPLLPNYNTRIHQEQHNS

SEQ ID NO: 2322231 - protein, 26 aa, Cryptosporidium parvum
SNNQDLRRLVYLAIKSLKVNESEAFV

SEQ ID NO: 2322232 - protein, 22 aa, Cryptosporidium parvum
SNNQEFVIFFPGVNLSINRFVL

SEQ ID NO: 2322233 - protein, 29 aa, Cryptosporidium parvum
SNNSLLYTLIDWPFQKNTKLIIIAIANTM

SEQ ID NO: 2322234 - protein, 27 aa, Cryptosporidium parvum
SNPEEPFLLISSVLPNIFPSISHRPLP

SEQ ID NO: 2322235 - protein, 23 aa, Cryptosporidium parvum
SNPIIVHFDFFKSYWKSQEIHIT

SEQ ID NO: 2322236 - protein, 19 aa, Cryptosporidium parvum
SNPLVQGSIYYLAPEIYSN

SEQ ID NO: 2322237 - protein, 29 aa, Cryptosporidium parvum
SNPMGIYRFGIFTLALGPILMVDSIDGVR

SEQ ID NO: 2322238 - protein, 18 aa, Cryptosporidium parvum
SNPYAPVYALRPIEYQLR

SEQ ID NO: 2322239 - protein, 20 aa, Cryptosporidium parvum
SNQALYFIGGILSHAKAIMA

SEQ ID NO: 2322240 - protein, 24 aa, Cryptosporidium parvum
SNQETLISLPILQGAKPLKRLSCP

SEQ ID NO: 2322241 - protein, 31 aa, Cryptosporidium parvum; identical to SEQ ID NO: 2197412

SEQ ID NO: 2322242 - protein, 24 aa, Cryptosporidium parvum
SNQKARNIIFPNFDIFNKYSDFIL

SEQ ID NO: 2322243 - protein, 28 aa, Cryptosporidium parvum
SNQKGGNIILPLALIDKCIGNRIYVVMK

SEQ ID NO: 2322244 - protein, 24 aa, Cryptosporidium parvum
SNQKYINIIKGLKFIGSIFKMRKK

SEQ ID NO: 2322245 - protein, 24 aa, Cryptosporidium parvum
SNQSTLLDSLKFGGGLEPPQVSQY

SEQ ID NO: 2322246 - protein, 18 aa, Cryptosporidium parvum
SNRDIAFKLLSRISSSEL

SEQ ID NO: 2322247 - protein, 26 aa, Cryptosporidium parvum
SNREEFLCYYIIYVTLQNMKADLIRV

SEQ ID NO: 2322248 - protein, 22 aa, Cryptosporidium parvum
SNRGCYMYYFKANDKNYCIDAT

SEQ ID NO: 2322249 - protein, 20 aa, Cryptosporidium parvum
SNRNLLYNPITFKAIKKAGT

SEQ ID NO: 2322250 - protein, 32 aa, Cryptosporidium parvum
SNRSEWMSKFIPWKRYILFEKSNPLGLDKSHY

SEQ ID NO: 2322251 - protein, 23 aa, Cryptosporidium parvum
SNRSKILNWFRDQKPIWDEEDYF

SEQ ID NO: 2322252 - protein, 25 aa, Cryptosporidium parvum
SNSCNIYPISYYYPNFFGDITTSIR

SEQ ID NO: 2322253 - protein, 45 aa, Cryptosporidium parvum
SNSITQKYVIPLIMSYPIAGIVFFNTNMGIKWFNAKNPIINDHLY

SEQ ID NO: 2322254 - protein, 24 aa, Cryptosporidium parvum
SNSITYLNKTFKKALLFGDKENIT

SEQ ID NO: 2322255 - protein, 24 aa, Cryptosporidium parvum
SNSLFDLKFIQRGIEYNNDLLDLE

SEQ ID NO: 2322256 - protein, 23 aa, Cryptosporidium parvum
SNSLFLLKDFIVALIRSDKEFDK

SEQ ID NO: 2322257 - protein, 20 aa, Cryptosporidium parvum
SNSRIVLSFGFDNLIYSGYM

SEQ ID NO: 2322258 - protein, 30 aa, Cryptosporidium parvum
SNSTKINLSLYWDESSSYLFDNTHSKIILF

SEQ ID NO: 2322259 - protein, 18 aa, Cryptosporidium parvum
SNSTKNFPGRVFTVGVRE

SEQ ID NO: 2322260 - protein, 31 aa, Cryptosporidium parvum
SNTIFEKRFLYLCLLDRLIIGNATYLQLAYQ

SEQ ID NO: 2322261 - protein, 25 aa, Cryptosporidium parvum
SNTLFQFCHAFYLSIIREIFCVLTD

SEQ ID NO: 2322262 - protein, 21 aa, Cryptosporidium parvum
SNTLLYCNKVCQDSVFLGSPS

SEQ ID NO: 2322263 - protein, 27 aa, Cryptosporidium parvum
SNTLSRHFFQFLWDVFSNNIKENTSIV

SEQ ID NO: 2322264 - protein, 23 aa, Cryptosporidium parvum
SNTPLNWDLKIYENFLNLSKDCI

SEQ ID NO: 2322265 - protein, 22 aa, Cryptosporidium parvum
SNTVLIFAGELLRNAAKLLNDN

SEQ ID NO: 2322266 - protein, 24 aa, Cryptosporidium parvum
SNVKPQLLEIKKLFHPSNNMTDSD

SEQ ID NO: 2322267 - protein, 30 aa, Cryptosporidium parvum; identical to SEQ ID NO: 2197432

SEQ ID NO: 2322268 - protein, 25 aa, Cryptosporidium parvum
SNVSPGSCFWLPAGARLYNKLMDFI

SEQ ID NO: 2322269 - protein, 26 aa, Cryptosporidium parvum
SNVSPSHFHSPLKSLPLSSSSSSSYI

SEQ ID NO: 2322270 - protein, 35 aa, Cryptosporidium parvum
SNVYLSDYEILKEGIYLNVVRLPKDLAKPLLEAAN

SEQ ID NO: 2322271 - protein, 27 aa, Cryptosporidium parvum
SNWCVLDYILYLFHNLEVYVGSNNDII

SEQ ID NO: 2322272 - protein, 22 aa, Cryptosporidium parvum
SNWKQTSLGLLKSPINGLSRSS

SEQ ID NO: 2322273 - protein, 26 aa, Cryptosporidium parvum
SNWNIYIREIIPNAIIYLISKLRETN

SEQ ID NO: 2322274 - protein, 35 aa, Cryptosporidium parvum; identical to SEQ ID NO: 2197437

SEQ ID NO: 2322275 - protein, 17 aa, Cryptosporidium parvum
SNYIYDYLLDIETPFPC

SEQ ID NO: 2322276 - protein, 19 aa, Cryptosporidium parvum
SNYRIPRETIVQRNNLDHN

SEQ ID NO: 2322277 - protein, 23 aa, Cryptosporidium parvum
SNYYYPCRSIFKKKLLDIHVSQL

SEQ ID NO: 2322278 - protein, 26 aa, Cryptosporidium parvum
SPDLKKSPLFLFLHGGPHSVTTTNYN

SEQ ID NO: 2322279 - protein, 25 aa, Cryptosporidium parvum
SPDSKVFYFKMKGDYHRYISEFSTG

SEQ ID NO: 2322280 - protein, 23 aa, Cryptosporidium parvum
SPEDYIFEEFINIALEETQILDD

SEQ ID NO: 2322281 - protein, 27 aa, Cryptosporidium parvum
SPEEAIFALKLSKLQWKYLDETISKMK

SEQ ID NO: 2322282 - protein, 24 aa, Cryptosporidium parvum
SPEGRLFQVEYAIAAIKLGSTAVG

SEQ ID NO: 2322283 - protein, 34 aa, Cryptosporidium parvum; identical to SEQ ID NO: 2197451

SEQ ID NO: 2322284 - protein, 29 aa, Cryptosporidium parvum
SPEIDEKFLFYLFSNFGKILSLKIVGNDQ

SEQ ID NO: 2322285 - protein, 26 aa, Cryptosporidium parvum
SPEIVLICIFLLTHLFFNDGVSERMV

SEQ ID NO: 2322286 - protein, 23 aa, Cryptosporidium parvum
SPEKYLIALQRYYHLFEEQEIVE

SEQ ID NO: 2322287 - protein, 29 aa, Cryptosporidium parvum
SPESNVTLILYSREILLFPYQNLNENSKP

SEQ ID NO: 2322288 - protein, 19 aa, Cryptosporidium parvum
SPFGRINRLCLSPSKTIAI

SEQ ID NO: 2322289 - protein, 29 aa, Cryptosporidium parvum
SPHGIPIDLLDRCLIIPTVPYSEEDVKKI

SEQ ID NO: 2322290 - protein, 21 aa, Cryptosporidium parvum
SPHIQSYDWILFSPDSNNNNE

SEQ ID NO: 2322291 - protein, 24 aa, Cryptosporidium parvum
SPHYSVRLPIAASMSLILATALSC

SEQ ID NO: 2322292 - protein, 20 aa, Cryptosporidium parvum
SPIVFKPKLETFFGGKNKVV

SEQ ID NO: 2322293 - protein, 29 aa, Cryptosporidium parvum
SPIYENIFPKFAPIDILSIPLDSVLLYMH

SEQ ID NO: 2322294 - protein, 17 aa, Cryptosporidium parvum
SPIYQYDLEFFNRILYG

SEQ ID NO: 2322295 - protein, 20 aa, Cryptosporidium parvum
SPKDLEIELLDFYVKSWKDD

SEQ ID NO: 2322296 - protein, 25 aa, Cryptosporidium parvum
SPLDDRLYIGTFYRNFEKISELSLK

SEQ ID NO: 2322297 - protein, 25 aa, Cryptosporidium parvum
SPLLSQFLDPNFVYCSDLQPINVDK

SEQ ID NO: 2322298 - protein, 23 aa, Cryptosporidium parvum
SPLPESRYMSMKLWYYEDRVPND

SEQ ID NO: 2322299 - protein, 19 aa, Cryptosporidium parvum
SPLPYLPPHSTRPKETIRI

SEQ ID NO: 2322300 - protein, 25 aa, Cryptosporidium parvum
SPLSPKFITYGKMVFIDLAGSERGA

SEQ ID NO: 2322301 - protein, 24 aa, Cryptosporidium parvum
SPNGFSHIIYLLSGEGKLIGMDLL

SEQ ID NO: 2322302 - protein, 29 aa, Cryptosporidium parvum
SPNLKAVIPLFGLLDLAFEIRKYCYTNEK

SEQ ID NO: 2322303 - protein, 26 aa, Cryptosporidium parvum
SPNNKQFFRLERHLIWVESIIRIHGN

SEQ ID NO: 2322304 - protein, 18 aa, Cryptosporidium parvum
SPPELFKRNFGSKELDRD

SEQ ID NO: 2322305 - protein, 19 aa, Cryptosporidium parvum
SPQFKQMPVPLALSLTMSY

SEQ ID NO: 2322306 - protein, 31 aa, Cryptosporidium parvum
SPRESNMYWCDIMQFYLFFCPKCIYLKQSNV

SEQ ID NO: 2322307 - protein, 24 aa, Cryptosporidium parvum
SPRLKINITWPTTLKNYTMYSNIQ

SEQ ID NO: 2322308 - protein, 23 aa, Cryptosporidium parvum
SPSSPLMDYTPTSPIYAASSPTY

SEQ ID NO: 2322309 - protein, 19 aa, Cryptosporidium parvum
SPTGKLFLCGQLYTNSKSN

SEQ ID NO: 2322310 - protein, 18 aa, Cryptosporidium parvum
SPTPPFVPSFVPSPSILS

SEQ ID NO: 2322311 - protein, 27 aa, Cryptosporidium parvum
SPTQIPLLVNNLPFTPQLYTNNLPQNY

SEQ ID NO: 2322312 - protein, 27 aa, Cryptosporidium parvum
SPTYQPLVYWRVYKGLSPSISFPSDEI

SEQ ID NO: 2322313 - protein, 28 aa, Cryptosporidium parvum
SPVLIKFGLLEKVIQFLLTFQDQSPVNN

SEQ ID NO: 2322314 - protein, 19 aa, Cryptosporidium parvum
SPYLRAPRMYSISDLALAC

SEQ ID NO: 2322315 - protein, 17 aa, Cryptosporidium parvum
SQALNFPIPMDTQFLIS

SEQ ID NO: 2322316 - protein, 24 aa, Cryptosporidium parvum
SQASGFILNAPFQPSNDLLKELIS

SEQ ID NO: 2322317 - protein, 24 aa, Cryptosporidium parvum
SQCFKLDLIMYSAIGWARHGEINQ

SEQ ID NO: 2322318 - protein, 27 aa, Cryptosporidium parvum
SQCLENYPFLNMLGQQPLNNVISGDRI

SEQ ID NO: 2322319 - protein, 31 aa, Cryptosporidium parvum
SQDFDEFMRFSVLLAVLFGLKDPIDPKVFKL

SEQ ID NO: 2322320 - protein, 25 aa, Cryptosporidium parvum
SQDLIMTTPLLLLQSSKLLGSWGSY

SEQ ID NO: 2322321 - protein, 26 aa, Cryptosporidium parvum
SQDNYIKIWDLRRFDKPLLSSLLGHS

SEQ ID NO: 2322322 - protein, 24 aa, Cryptosporidium parvum
SQDRKYQCILLSATLNKEVDSLKK

SEQ ID NO: 2322323 - protein, 27 aa, Cryptosporidium parvum
SQDVSIIRLPYACKLLFQELQAMNVCP

SEQ ID NO: 2322324 - protein, 27 aa, Cryptosporidium parvum
SQEAYDFLLETLLLKVISEYSSNKALL

SEQ ID NO: 2322325 - protein, 17 aa, Cryptosporidium parvum
SQEDPFFTIKKDLFINM

SEQ ID NO: 2322326 - protein, 21 aa, Cryptosporidium parvum
SQELKNWFFSQSNLHESVVSL

SEQ ID NO: 2322327 - protein, 29 aa, Cryptosporidium parvum
SQENNMYIKNLNPMQLKYLQKTQKILSYE

SEQ ID NO: 2322328 - protein, 27 aa, Cryptosporidium parvum
SQESQLIEFLFLDFLDYIHIDKGLIKD

SEQ ID NO: 2322329 - protein, 28 aa, Cryptosporidium parvum
SQEVRIPNQFLWRTYNKKIVDRTNYIEN

SEQ ID NO: 2322330 - protein, 18 aa, Cryptosporidium parvum
SQFIQMESIAVLNDCMSL

SEQ ID NO: 2322331 - protein, 18 aa, Cryptosporidium parvum
SQFIRLNNRLRANGFLSI

SEQ ID NO: 2322332 - protein, 36 aa, Cryptosporidium parvum
SQFYEIPLNIEILGWTNLLHFVEAFPDVWTVENVGP

SEQ ID NO: 2322333 - protein, 23 aa, Cryptosporidium parvum
SQFYPTSFVSYPPKQPINMFGAH

SEQ ID NO: 2322334 - protein, 24 aa, Cryptosporidium parvum
SQHSMALIWNGSYSNKFMLEEEEE

SEQ ID NO: 2322335 - protein, 20 aa, Cryptosporidium parvum
SQIFNSINYLMQIVGDGNMN

SEQ ID NO: 2322336 - protein, 27 aa, Cryptosporidium parvum
SQIMGIKPLFPVKPLLSISSPDFEQIW

SEQ ID NO: 2322337 - protein, 23 aa, Cryptosporidium parvum
SQIRRVKFQPTLSPIAQSPLSEN

SEQ ID NO: 2322338 - protein, 17 aa, Cryptosporidium parvum
SQKIVKHETPFWLACWI

SEQ ID NO: 2322339 - protein, 24 aa, Cryptosporidium parvum
SQKQNFFYFNYSSNICDYIIKSSF

SEQ ID NO: 2322340 - protein, 17 aa, Cryptosporidium parvum
SQLDRKLKVLSSKISEL

SEQ ID NO: 2322341 - protein, 25 aa, Cryptosporidium parvum
SQLLGLFFKEIFAYIKRFISKFRSG

SEQ ID NO: 2322342 - protein, 17 aa, Cryptosporidium parvum
SQLLRLMGKYKPETRAE

SEQ ID NO: 2322343 - protein, 26 aa, Cryptosporidium parvum
SQMTKNNPIILQFPMVRSSSQSPGGV

SEQ ID NO: 2322344 - protein, 32 aa, Cryptosporidium parvum; identical to SEQ ID NO: 2197515

SEQ ID NO: 2322345 - protein, 23 aa, Cryptosporidium parvum
SQNNIFEIIKLFDFKRKTKVFID

SEQ ID NO: 2322346 - protein, 27 aa, Cryptosporidium parvum
SQPDKDLIIKWPKYDKLFIGNWIDTDA

SEQ ID NO: 2322347 - protein, 23 aa, Cryptosporidium parvum
SQQIYGRYGRHDPRYMYTGYASG

SEQ ID NO: 2322348 - protein, 20 aa, Cryptosporidium parvum
SQQKFLCHLKLQQRSKKDWK

SEQ ID NO: 2322349 - protein, 22 aa, Cryptosporidium parvum
SQRDVFVMMPTGGGKSLCFQLP

SEQ ID NO: 2322350 - protein, 26 aa, Cryptosporidium parvum
SQRELFKQYVVPIVDEVLLGFNCTIF

SEQ ID NO: 2322351 - protein, 47 aa, Cryptosporidium parvum; identical to SEQ ID NO: 2197523

SEQ ID NO: 2322352 - protein, 23 aa, Cryptosporidium parvum
SQRLKQGLYKTLAESWLGVEILS

SEQ ID NO: 2322353 - protein, 25 aa, Cryptosporidium parvum
SQSDTRIYHWIRLSSLRLESQMILF

SEQ ID NO: 2322354 - protein, 26 aa, Cryptosporidium parvum
SQSGSKSLFFFTPHKYRKSVGIIVPR

SEQ ID NO: 2322355 - protein, 25 aa, Cryptosporidium parvum
SQSGTFPKFFGVNYPLEENESMAVL

SEQ ID NO: 2322356 - protein, 23 aa, Cryptosporidium parvum
SQSITNFKLNIPLTFVSTYNTNL

SEQ ID NO: 2322357 - protein, 17 aa, Cryptosporidium parvum
SQSLSIIAKLSHVFTLF

SEQ ID NO: 2322358 - protein, 22 aa, Cryptosporidium parvum
SQSNFLVRTVFHKALKQKESII

SEQ ID NO: 2322359 - protein, 25 aa, Cryptosporidium parvum
SQSQSHCQIPYSLSTYGNSCGVSST

SEQ ID NO: 2322360 - protein, 25 aa, Cryptosporidium parvum
SQSRKKNMLLPKGLEIGGGIASCKL

SEQ ID NO: 2322361 - protein, 25 aa, Cryptosporidium parvum
SQTDSWNMYAIPISSLMTLNIEGDK

SEQ ID NO: 2322362 - protein, 25 aa, Cryptosporidium parvum
SQTLTAPPPPPPPPPPSSQGITSNK

SEQ ID NO: 2322363 - protein, 27 aa, Cryptosporidium parvum
SQVDCDFLRQIDWYMMIVDEAHQLKNR

SEQ ID NO: 2322364 - protein, 32 aa, Cryptosporidium parvum; identical to SEQ ID NO: 2197532

SEQ ID NO: 2322365 - protein, 24 aa, Cryptosporidium parvum
SQVLDLYIHFIMNGPTSIHDMNKV

SEQ ID NO: 2322366 - protein, 26 aa, Cryptosporidium parvum
SQWNLRNIIRLLFQTKERMVYLFMNA

SEQ ID NO: 2322367 - protein, 19 aa, Cryptosporidium parvum
SRAALYRIVLKDSLACQLM

SEQ ID NO: 2322368 - protein, 26 aa, Cryptosporidium parvum
SRAPPEHLIPLVYILNDFAQKCKSQA

SEQ ID NO: 2322369 - protein, 32 aa, Cryptosporidium parvum
SRCTAAQAIYHPWFEKIQLSPGIMISYNNNNN

SEQ ID NO: 2322370 - protein, 21 aa, Cryptosporidium parvum
SRCTRFRFSPLPIEDIRNRIS

SEQ ID NO: 2322371 - protein, 35 aa, Cryptosporidium parvum; identical to SEQ ID NO: 2197538

SEQ ID NO: 2322372 - protein, 28 aa, Cryptosporidium parvum
SRDYLGGFRRSCLFELLSLSVGRGYIVS

SEQ ID NO: 2322373 - protein, 32 aa, Cryptosporidium parvum
SREQYNLQFFSLKFQLSLLTALLTMHMVKTKE

SEQ ID NO: 2322374 - protein, 23 aa, Cryptosporidium parvum
SRESFFSFFLAKLQQDINVTKVQ

SEQ ID NO: 2322375 - protein, 20 aa, Cryptosporidium parvum
SRESFPWNSFKHSILGEQKS

SEQ ID NO: 2322376 - protein, 27 aa, Cryptosporidium parvum
SRETAILIATKRRALNLNKSGGSLVVD

SEQ ID NO: 2322377 - protein, 34 aa, Cryptosporidium parvum; identical to SEQ ID NO: 2197543

SEQ ID NO: 2322378 - protein, 25 aa, Cryptosporidium parvum
SRFEKRGYRIAAMKLTIATPAILEE

SEQ ID NO: 2322379 - protein, 23 aa, Cryptosporidium parvum
SRFESKFQLGAQRTSLNSKVNSS

SEQ ID NO: 2322380 - protein, 25 aa, Cryptosporidium parvum
SRFGKFIEIYFDATGKLRGASISNY

SEQ ID NO: 2322381 - protein, 17 aa, Cryptosporidium parvum
SRFPKLSDQILDRSQEI

SEQ ID NO: 2322382 - protein, 18 aa, Cryptosporidium parvum
SRFYIKFEKNSLILLLTS

SEQ ID NO: 2322383 - protein, 22 aa, Cryptosporidium parvum
SRGIERLFPIQAQSFESIYGKK

SEQ ID NO: 2322384 - protein, 27 aa, Cryptosporidium parvum
SRGVRHLLPSFLQPLKPLTGVDNSSKV

SEQ ID NO: 2322385 - protein, 29 aa, Cryptosporidium parvum
SRHDVLLSPLFMNFLEFPNYENLPPIMKK

SEQ ID NO: 2322386 - protein, 23 aa, Cryptosporidium parvum
SRHPLCHYCRRSCKRLNYSRCPS

SEQ ID NO: 2322387 - protein, 25 aa, Cryptosporidium parvum
SRHPQLLYESKLYKILAGGIGVPTV

SEQ ID NO: 2322388 - protein, 28 aa, Cryptosporidium parvum
SRIDGLELIFIFSKLLQVVATCIPYCPI

SEQ ID NO: 2322389 - protein, 22 aa, Cryptosporidium parvum
SRIDQLEFMLNDLISEVESSSP

SEQ ID NO: 2322390 - protein, 26 aa, Cryptosporidium parvum
SRIFCYQMINWIILGKLVDPFEEFIV

SEQ ID NO: 2322391 - protein, 20 aa, Cryptosporidium parvum
SRIFSQYLSFFLCPKSGEGL

SEQ ID NO: 2322392 - protein, 20 aa, Cryptosporidium parvum
SRIHILFEICFFILDGISKE

SEQ ID NO: 2322393 - protein, 19 aa, Cryptosporidium parvum
SRIKYLERLPILEEVRKDP

SEQ ID NO: 2322394 - protein, 20 aa, Cryptosporidium parvum
SRILNYWRKIWKPHHYIKVS

SEQ ID NO: 2322395 - protein, 21 aa, Cryptosporidium parvum
SRINMLNILVATPGRLIQHMD

SEQ ID NO: 2322396 - protein, 23 aa, Cryptosporidium parvum
SRISMPICLNEPLSFIQRLSEDL

SEQ ID NO: 2322397 - protein, 17 aa, Cryptosporidium parvum
SRIWLVIEIAPGGELYE

SEQ ID NO: 2322398 - protein, 26 aa, Cryptosporidium parvum
SRKIVRSLLMVWKAKLDQVSAEAWIT

SEQ ID NO: 2322399 - protein, 27 aa, Cryptosporidium parvum
SRKMNLDNLWQLSIFKNQSIGLILSNH

SEQ ID NO: 2322400 - protein, 29 aa, Cryptosporidium parvum
SRKPPRSLWFDYAPFKFETALLQVFNIIK

SEQ ID NO: 2322401 - protein, 19 aa, Cryptosporidium parvum
SRKVIPPTLILIDHSLETL

SEQ ID NO: 2322402 - protein, 17 aa, Cryptosporidium parvum
SRLCLLINKITPAQYTL

SEQ ID NO: 2322403 - protein, 28 aa, Cryptosporidium parvum
SRLDILNKGFLLLYYTDPYTATMAAWFF

SEQ ID NO: 2322404 - protein, 22 aa, Cryptosporidium parvum
SRLFSVDSACRYVFIKRISKLE

SEQ ID NO: 2322405 - protein, 19 aa, Cryptosporidium parvum
SRLLKLELLDDFELEKIIH

SEQ ID NO: 2322406 - protein, 23 aa, Cryptosporidium parvum
SRLRFPLYMAHIEKLLGETCKYI

SEQ ID NO: 2322407 - protein, 26 aa, Cryptosporidium parvum
SRLSSLVRCAILGGADFIVTCTGKVK

SEQ ID NO: 2322408 - protein, 27 aa, Cryptosporidium parvum
SRLVNILVDALKWTISAREAILLLPRN

SEQ ID NO: 2322409 - protein, 20 aa, Cryptosporidium parvum
SRMISRLKQIAIGKSLPEYK

SEQ ID NO: 2322410 - protein, 29 aa, Cryptosporidium parvum
SRNEWQNLLIKWLTYVVKFSERNGISMYE

SEQ ID NO: 2322411 - protein, 18 aa, Cryptosporidium parvum
SRNLISDIPPIQSGPARA

SEQ ID NO: 2322412 - protein, 19 aa, Cryptosporidium parvum
SRNSIKIIALISIKFKETA

SEQ ID NO: 2322413 - protein, 28 aa, Cryptosporidium parvum
SRNSIQSILNLKAPRRPSLLVQQRNYSE

SEQ ID NO: 2322414 - protein, 22 aa, Cryptosporidium parvum
SRRACYTSMFLASPKILEPISL

SEQ ID NO: 2322415 - protein, 27 aa, Cryptosporidium parvum
SRREGLKTILTFLSKRGYPNQINPKTL

SEQ ID NO: 2322416 - protein, 20 aa, Cryptosporidium parvum
SRRLWDLEETLSFSNLDSIS

SEQ ID NO: 2322417 - protein, 23 aa, Cryptosporidium parvum
SRRQYEYLMPEFLLKHVNINNDD

SEQ ID NO: 2322418 - protein, 23 aa, Cryptosporidium parvum
SRRVDKHWRLIGFGDIISGDTVR

SEQ ID NO: 2322419 - protein, 20 aa, Cryptosporidium parvum
SRSIGTGLKRRKCWEMLVDE

SEQ ID NO: 2322420 - protein, 29 aa, Cryptosporidium parvum
SRSNDIVELFLIPQWWMNCKPFAEKACKA

SEQ ID NO: 2322421 - protein, 24 aa, Cryptosporidium parvum
SRSSGTLGFVIKGSGLGGSSSIEA

SEQ ID NO: 2322422 - protein, 45 aa, Cryptosporidium parvum
SRTLVRIITIALCSSLMVIRDISVLLKYPLLSIQGKLPVSIDLIC

SEQ ID NO: 2322423 - protein, 34 aa, Cryptosporidium parvum
SRTRKVMLPNPNPPFLFSFLKKSNRLYTFHTLNE

SEQ ID NO: 2322424 - protein, 32 aa, Cryptosporidium parvum
SRVFSAIPYFSKRTLFLSFKRFFHSDPELWTK

SEQ ID NO: 2322425 - protein, 18 aa, Cryptosporidium parvum
SRVIPPKLLKELGIQHVK

SEQ ID NO: 2322426 - protein, 20 aa, Cryptosporidium parvum
SRVLIFSQMVRMLNIISEFL

SEQ ID NO: 2322427 - protein, 20 aa, Cryptosporidium parvum
SRVYKPLISALFSLSRVASE

SEQ ID NO: 2322428 - protein, 19 aa, Cryptosporidium parvum
SRYFPSKFGGKPAWLNPQN

SEQ ID NO: 2322429 - protein, 28 aa, Cryptosporidium parvum
SSADPVHITMPPRLGLPSQTPLNMKDQY

SEQ ID NO: 2322430 - protein, 27 aa, Cryptosporidium parvum
SSAFNSFKFITLILSYILVISMNNTLN

SEQ ID NO: 2322431 - protein, 21 aa, Cryptosporidium parvum
SSAFYLEKYLSLVNEVYGSGD

SEQ ID NO: 2322432 - protein, 23 aa, Cryptosporidium parvum
SSAIIKFLWTVRATNFIQRFIEN

SEQ ID NO: 2322433 - protein, 22 aa, Cryptosporidium parvum
SSAKIWEYLPENIREQLLLDRE

SEQ ID NO: 2322434 - protein, 35 aa, Cryptosporidium parvum; identical to SEQ ID NO: 2197589

SEQ ID NO: 2322435 - protein, 32 aa, Cryptosporidium parvum
SSANQHKKFKRMLLFSLRSLSDLCVPPTLLYK

SEQ ID NO: 2322436 - protein, 28 aa, Cryptosporidium parvum
SSAPMSTPLPAIPQPPVPFQNNSSISGG

SEQ ID NO: 2322437 - protein, 27 aa, Cryptosporidium parvum
SSAVQDLLLLDVAPLSLGLETAGGVMT

SEQ ID NO: 2322438 - protein, 27 aa, Cryptosporidium parvum
SSCFPSLNTFYTYCTWKNPIGTAYFNK

SEQ ID NO: 2322439 - protein, 28 aa, Cryptosporidium parvum
SSCVACGRFFCHLCILYIRSSNPCSPIA

SEQ ID NO: 2322440 - protein, 25 aa, Cryptosporidium parvum
SSDDLSIGLSPKRSKCMLNDGLELE

SEQ ID NO: 2322441 - protein, 32 aa, Cryptosporidium parvum; identical to SEQ ID NO: 2197596

SEQ ID NO: 2322442 - protein, 26 aa, Cryptosporidium parvum
SSDKLIKFWDINSGILKLTLIGHIAA

SEQ ID NO: 2322443 - protein, 24 aa, Cryptosporidium parvum
SSDLIRMVTIPLIKKMIPQVGEIS

SEQ ID NO: 2322444 - protein, 25 aa, Cryptosporidium parvum
SSEEFKGMIDIRPHIFSMQSNQCPA

SEQ ID NO: 2322445 - protein, 24 aa, Cryptosporidium parvum
SSEFSIYPQFMYHLRRSHFLQTFN

SEQ ID NO: 2322446 - protein, 17 aa, Cryptosporidium parvum
SSEIIEFLESENTLRAF

SEQ ID NO: 2322447 - protein, 20 aa, Cryptosporidium parvum
SSEPVLMHSIMMNKSDLSNE

SEQ ID NO: 2322448 - protein, 30 aa, Cryptosporidium parvum
SSESDRMVILSLIFMPILEREVDRHIDNGD

SEQ ID NO: 2322449 - protein, 27 aa, Cryptosporidium parvum
SSFIKCAQKLIWKRFRIGMMHDAQEFL

SEQ ID NO: 2322450 - protein, 27 aa, Cryptosporidium parvum
SSFQDKILRLLLPLFDTGSRDKYDQEN

SEQ ID NO: 2322451 - protein, 26 aa, Cryptosporidium parvum
SSFTNNYKALFPYPKKRFYRVDVLEA
